United States Patent 7,655,785 (BIOINFORMATICALLY DETECTABLE GROUP OF NOVEL REGULATORY OLIGONUCLEOTIDES AND USES THEREOF) - sequence listing, part 12

SEQ ID NO: 449725 - RNA, 16 nt, Homo sapiens
ugaauguuaaugguca

SEQ ID NO: 449726 - RNA, 21 nt, Homo sapiens
ugaauuaagaacugacacaaa

SEQ ID NO: 449727 - RNA, 22 nt, Homo sapiens
ugaauuuaagcaugaguggccu

SEQ ID NO: 449728 - RNA, 16 nt, Homo sapiens
ugaauuuagucauuau

SEQ ID NO: 449729 - RNA, 18 nt, Homo sapiens
ugaauuucuuugauuuaa

SEQ ID NO: 449730 - RNA, 21 nt, Homo sapiens
ugaauuucuuugauuuaacug

SEQ ID NO: 449731 - RNA, 19 nt, Homo sapiens
ugaauuuguagacauacuu

SEQ ID NO: 449732 - RNA, 23 nt, Homo sapiens
ugaauuuuaaauuaaagcaaagu

SEQ ID NO: 449733 - RNA, 17 nt, Homo sapiens
ugaauuuuggcuguguc

SEQ ID NO: 449734 - RNA, 15 nt, Homo sapiens
ugacaaaggaugaag

SEQ ID NO: 449735 - RNA, 12 nt, Homo sapiens
ugacaaccucuu

SEQ ID NO: 449736 - RNA, 19 nt, Homo sapiens
ugacaaccuuuguguaaua

SEQ ID NO: 449737 - RNA, 15 nt, Homo sapiens
ugacaacuguuuaau

SEQ ID NO: 449738 - RNA, 19 nt, Homo sapiens
ugacaacuucuaauugcca

SEQ ID NO: 449739 - RNA, 14 nt, Homo sapiens
ugacaaucaacucu

SEQ ID NO: 449740 - RNA, 18 nt, Homo sapiens
ugacaaucaacucuaaua

SEQ ID NO: 449741 - RNA, 21 nt, Homo sapiens
ugacacagcugagcuggccua

SEQ ID NO: 449742 - RNA, 13 nt, Homo sapiens
ugacacagucuug

SEQ ID NO: 449743 - RNA, 14 nt, Homo sapiens
ugacacauaaaagu

SEQ ID NO: 449744 - RNA, 18 nt, Homo sapiens
ugacacauaaaaguaauu

SEQ ID NO: 449745 - RNA, 21 nt, Homo sapiens
ugacacuguuaauaguacuau

SEQ ID NO: 449746 - RNA, 12 nt, Homo sapiens
ugacagaacaag

SEQ ID NO: 449747 - RNA, 13 nt, Homo sapiens
ugacagaugucug

SEQ ID NO: 449748 - RNA, 14 nt, Homo sapiens
ugacaggacuuuca

SEQ ID NO: 449749 - RNA, 20 nt, Homo sapiens
ugacaguagcauacugauga

SEQ ID NO: 449750 - RNA, 17 nt, Homo sapiens
ugacauccaaaucuagc

SEQ ID NO: 449751 - RNA, 20 nt, Homo sapiens
ugacaugcacaguuugcaau

SEQ ID NO: 449752 - RNA, 12 nt, Homo sapiens
ugacaugugcaa

SEQ ID NO: 449753 - RNA, 13 nt, Homo sapiens
ugacauguuguca

SEQ ID NO: 449754 - RNA, 18 nt, Homo sapiens
ugacauucuucacugucu

SEQ ID NO: 449755 - RNA, 15 nt, Homo sapiens
ugacauuguauguau

SEQ ID NO: 449756 - RNA, 21 nt, Homo sapiens
ugaccaaaagugagaugggaa

SEQ ID NO: 449757 - RNA, 22 nt, Homo sapiens
ugaccaacauucaaaagcacaa

SEQ ID NO: 449758 - RNA, 15 nt, Homo sapiens
ugaccaagaacugca

SEQ ID NO: 449759 - RNA, 10 nt, Homo sapiens
ugaccacaga

SEQ ID NO: 449760 - RNA, 13 nt, Homo sapiens
ugaccccaggaag

SEQ ID NO: 449761 - RNA, 16 nt, Homo sapiens
ugacccggggcagcug

SEQ ID NO: 449762 - RNA, 18 nt, Homo sapiens
ugacccuauucaugucuc

SEQ ID NO: 449763 - RNA, 12 nt, Homo sapiens
ugacccugugau

SEQ ID NO: 449764 - RNA, 17 nt, Homo sapiens
ugaccgagaacuuuuaa

SEQ ID NO: 449765 - RNA, 24 nt, Homo sapiens
ugaccguacucucacauguggcaa

SEQ ID NO: 449766 - RNA, 12 nt, Homo sapiens
ugaccuacaggg

SEQ ID NO: 449767 - RNA, 14 nt, Homo sapiens
ugaccucagcugca

SEQ ID NO: 449768 - RNA, 14 nt, Homo sapiens
ugaccucaggugau

SEQ ID NO: 449769 - RNA, 22 nt, Homo sapiens
ugacgacaagugcugaacagug

SEQ ID NO: 449770 - RNA, 15 nt, Homo sapiens
ugacgacgacaacga

SEQ ID NO: 449771 - RNA, 15 nt, Homo sapiens
ugacgagcaugagcu

SEQ ID NO: 449772 - RNA, 21 nt, Homo sapiens
ugacggcccugcaauguaucc

SEQ ID NO: 449773 - RNA, 18 nt, Homo sapiens
ugacggcgcccccagugu

SEQ ID NO: 449774 - RNA, 13 nt, Homo sapiens
ugacguagcugca

SEQ ID NO: 449775 - RNA, 13 nt, Homo sapiens
ugacgugaccaau

SEQ ID NO: 449776 - RNA, 17 nt, Homo sapiens
ugacuauggcuaccaaa

SEQ ID NO: 449777 - RNA, 19 nt, Homo sapiens
ugacuauggcuaccaaaaa

SEQ ID NO: 449778 - RNA, 19 nt, Homo sapiens
ugacucacucauaaagguu

SEQ ID NO: 449779 - RNA, 15 nt, Homo sapiens
ugacucaggauuuaa

SEQ ID NO: 449780 - RNA, 19 nt, Homo sapiens
ugacucgucugacugugug

SEQ ID NO: 449781 - RNA, 15 nt, Homo sapiens
ugacucucacaagau

SEQ ID NO: 449782 - RNA, 19 nt, Homo sapiens
ugacugagcagacugguga

SEQ ID NO: 449783 - RNA, 17 nt, Homo sapiens
ugacugaugcugagauu

SEQ ID NO: 449784 - RNA, 14 nt, Homo sapiens
ugacugggccuccc

SEQ ID NO: 449785 - RNA, 16 nt, Homo sapiens
ugacugggggccucug

SEQ ID NO: 449786 - RNA, 12 nt, Homo sapiens
ugacugguggaa

SEQ ID NO: 449787 - RNA, 21 nt, Homo sapiens
ugacuguaggcgccccugggg

SEQ ID NO: 449788 - RNA, 19 nt, Homo sapiens
ugacuguccuacaauauca

SEQ ID NO: 449789 - RNA, 16 nt, Homo sapiens
ugacugugaccaccuu

SEQ ID NO: 449790 - RNA, 16 nt, Homo sapiens
ugacuuaagcacacuu

SEQ ID NO: 449791 - RNA, 14 nt, Homo sapiens
ugacuuaguucuuc

SEQ ID NO: 449792 - RNA, 14 nt, Homo sapiens
ugacuuaugugcag

SEQ ID NO: 449793 - RNA, 16 nt, Homo sapiens
ugacuucugagcaguu

SEQ ID NO: 449794 - RNA, 16 nt, Homo sapiens
ugacuugugucccaug

SEQ ID NO: 449795 - RNA, 14 nt, Homo sapiens
ugacuuuauacaga

SEQ ID NO: 449796 - RNA, 21 nt, Homo sapiens
ugacuuuccuaugacacucau

SEQ ID NO: 449797 - RNA, 19 nt, Homo sapiens
ugacuuugaacacaucucu

SEQ ID NO: 449798 - RNA, 21 nt, Homo sapiens
ugacuuugccacauccauuga

SEQ ID NO: 449799 - RNA, 15 nt, Homo sapiens
ugacuuuuaauguca

SEQ ID NO: 449800 - RNA, 15 nt, Homo sapiens
ugacuuuuacagcuu

SEQ ID NO: 449801 - RNA, 19 nt, Homo sapiens
ugacuuuugaagaacaaaa

SEQ ID NO: 449802 - RNA, 17 nt, Homo sapiens
ugagaaaaugagugacu

SEQ ID NO: 449803 - RNA, 23 nt, Homo sapiens
ugagaaaccuuauuguaccucuc

SEQ ID NO: 449804 - RNA, 16 nt, Homo sapiens
ugagaaacugauuuau

SEQ ID NO: 449805 - RNA, 23 nt, Homo sapiens
ugagaaauuuuuuuccagaauug

SEQ ID NO: 449806 - RNA, 12 nt, Homo sapiens
ugagaacaacca

SEQ ID NO: 449807 - RNA, 15 nt, Homo sapiens
ugagaacuugacaag

SEQ ID NO: 449808 - RNA, 18 nt, Homo sapiens
ugagaagaacacaucagg

SEQ ID NO: 449809 - RNA, 23 nt, Homo sapiens
ugagaagauaaaaacugcccauu

SEQ ID NO: 449810 - RNA, 13 nt, Homo sapiens
ugagaagaucuga

SEQ ID NO: 449811 - RNA, 12 nt, Homo sapiens
ugagaagauuca

SEQ ID NO: 449812 - RNA, 23 nt, Homo sapiens
ugagaagauucaauuuaaaauca

SEQ ID NO: 449813 - RNA, 16 nt, Homo sapiens
ugagaauaauugugua

SEQ ID NO: 449814 - RNA, 20 nt, Homo sapiens
ugagaaucgaccucacuguc

SEQ ID NO: 449815 - RNA, 17 nt, Homo sapiens
ugagaauucagcugccc

SEQ ID NO: 449816 - RNA, 22 nt, Homo sapiens
ugagaccuugucuccacaaaaa

SEQ ID NO: 449817 - RNA, 13 nt, Homo sapiens
ugagacuaggaua

SEQ ID NO: 449818 - RNA, 23 nt, Homo sapiens
ugagacucagacaggaaagggaa

SEQ ID NO: 449819 - RNA, 12 nt, Homo sapiens
ugagacuugaau

SEQ ID NO: 449820 - RNA, 14 nt, Homo sapiens
ugagacuugaauca

SEQ ID NO: 449821 - RNA, 14 nt, Homo sapiens
ugagagagacaaga

SEQ ID NO: 449822 - RNA, 21 nt, Homo sapiens
ugagagagagaaccuuuccac

SEQ ID NO: 449823 - RNA, 15 nt, Homo sapiens
ugagagcacagcagg

SEQ ID NO: 449824 - RNA, 18 nt, Homo sapiens
ugagaggguuugagucaa

SEQ ID NO: 449825 - RNA, 20 nt, Homo sapiens
ugagaggugggggaugcuga

SEQ ID NO: 449826 - RNA, 13 nt, Homo sapiens
ugagaucauguca

SEQ ID NO: 449827 - RNA, 21 nt, Homo sapiens
ugagaucggcccagcucugac

SEQ ID NO: 449828 - RNA, 17 nt, Homo sapiens
ugagaugcguuguuaca

SEQ ID NO: 449829 - RNA, 16 nt, Homo sapiens
ugagauuacaggcacc

SEQ ID NO: 449830 - RNA, 20 nt, Homo sapiens
ugagauucagugaacuaauu

SEQ ID NO: 449831 - RNA, 13 nt, Homo sapiens
ugagauucuucag

SEQ ID NO: 449832 - RNA, 22 nt, Homo sapiens
ugagauuuugaaaaucuaccaa

SEQ ID NO: 449833 - RNA, 17 nt, Homo sapiens
ugagcaaauggaacaau

SEQ ID NO: 449834 - RNA, 23 nt, Homo sapiens
ugagcaaggacauugccccaaga

SEQ ID NO: 449835 - RNA, 17 nt, Homo sapiens
ugagcaccgucauggcu

SEQ ID NO: 449836 - RNA, 12 nt, Homo sapiens
ugagcaccucca

SEQ ID NO: 449837 - RNA, 21 nt, Homo sapiens
ugagcagaacccagacccuga

SEQ ID NO: 449838 - RNA, 12 nt, Homo sapiens
ugagcagacaga

SEQ ID NO: 449839 - RNA, 19 nt, Homo sapiens
ugagcagugccagcuuucu

SEQ ID NO: 449840 - RNA, 19 nt, Homo sapiens
ugagcaguuguuauauuca

SEQ ID NO: 449841 - RNA, 16 nt, Homo sapiens
ugagcaucugucucaa

SEQ ID NO: 449842 - RNA, 15 nt, Homo sapiens
ugagcaugcuuucug

SEQ ID NO: 449843 - RNA, 14 nt, Homo sapiens
ugagccaaaaacaa

SEQ ID NO: 449844 - RNA, 12 nt, Homo sapiens
ugagccaaagag

SEQ ID NO: 449845 - RNA, 12 nt, Homo sapiens
ugagccagucau

SEQ ID NO: 449846 - RNA, 22 nt, Homo sapiens
ugagcccacaaagccuuaucaa

SEQ ID NO: 449847 - RNA, 18 nt, Homo sapiens
ugagcccccugugcccac

SEQ ID NO: 449848 - RNA, 16 nt, Homo sapiens
ugagccccuaccccac

SEQ ID NO: 449849 - RNA, 20 nt, Homo sapiens
ugagcccucccucuucccag

SEQ ID NO: 449850 - RNA, 22 nt, Homo sapiens
ugagccuuuuauuaacauauau

SEQ ID NO: 449851 - RNA, 15 nt, Homo sapiens
ugagcuaacgugcug

SEQ ID NO: 449852 - RNA, 17 nt, Homo sapiens
ugcaaauggaagacaaa

SEQ ID NO: 449853 - RNA, 13 nt, Homo sapiens
ugcaaauucucag

SEQ ID NO: 449854 - RNA, 13 nt, Homo sapiens
ugcaaccucugcc

SEQ ID NO: 449855 - RNA, 21 nt, Homo sapiens
ugcaacuuagcucacaccuga

SEQ ID NO: 449856 - RNA, 20 nt, Homo sapiens
ugcaagagugggcuuuccag

SEQ ID NO: 449857 - RNA, 19 nt, Homo sapiens
ugcaagcacaucugcauuu

SEQ ID NO: 449858 - RNA, 17 nt, Homo sapiens
ugcaagcuggaugccug

SEQ ID NO: 449859 - RNA, 18 nt, Homo sapiens
ugcaaggcccacaggagg

SEQ ID NO: 449860 - RNA, 22 nt, Homo sapiens
ugcaagggaugaauuguaaaag

SEQ ID NO: 449861 - RNA, 13 nt, Homo sapiens
ugcaagucccaug

SEQ ID NO: 449862 - RNA, 15 nt, Homo sapiens
ugcaagucccaugau

SEQ ID NO: 449863 - RNA, 18 nt, Homo sapiens
ugcaagugucugugugca

SEQ ID NO: 449864 - RNA, 23 nt, Homo sapiens
ugcaagugugugcacaugugugc

SEQ ID NO: 449865 - RNA, 18 nt, Homo sapiens
ugcaauaggugugcguca

SEQ ID NO: 449866 - RNA, 14 nt, Homo sapiens
ugcaauccuuccaa

SEQ ID NO: 449867 - RNA, 18 nt, Homo sapiens
ugcaauccuuccaaauga

SEQ ID NO: 449868 - RNA, 17 nt, Homo sapiens
ugcaaugcaagcccuuu

SEQ ID NO: 449869 - RNA, 19 nt, Homo sapiens
ugcaaugccuagacuuccc

SEQ ID NO: 449870 - RNA, 22 nt, Homo sapiens
ugcaaugucacaaccucucuga

SEQ ID NO: 449871 - RNA, 19 nt, Homo sapiens
ugcaauugcacaaauacaa

SEQ ID NO: 449872 - RNA, 15 nt, Homo sapiens
ugcugggaaguggcu

SEQ ID NO: 449873 - RNA, 20 nt, Homo sapiens
ugcugggccucauucuagca

SEQ ID NO: 449874 - RNA, 20 nt, Homo sapiens
ugcuggugcacaugacauuu

SEQ ID NO: 449875 - RNA, 15 nt, Homo sapiens
ugcugguuaagguga

SEQ ID NO: 449876 - RNA, 14 nt, Homo sapiens
ugcuguagagccau

SEQ ID NO: 449877 - RNA, 13 nt, Homo sapiens
ugcuguauacugu

SEQ ID NO: 449878 - RNA, 19 nt, Homo sapiens
ugcuguauacuguacugag

SEQ ID NO: 449879 - RNA, 19 nt, Homo sapiens
ugcuguccccuuccagggg

SEQ ID NO: 449880 - RNA, 20 nt, Homo sapiens
ugcugugccaggacugugac

SEQ ID NO: 449881 - RNA, 12 nt, Homo sapiens
ugcugugucaca

SEQ ID NO: 449882 - RNA, 22 nt, Homo sapiens
ugcuguuguaaacaacguguau

SEQ ID NO: 449883 - RNA, 15 nt, Homo sapiens
ugcuuaaucugagga

SEQ ID NO: 449884 - RNA, 18 nt, Homo sapiens
ugcuuaaugguagcaacu

SEQ ID NO: 449885 - RNA, 20 nt, Homo sapiens
ugcuuaauugugaacagcca

SEQ ID NO: 449886 - RNA, 22 nt, Homo sapiens
ugcuuaauugugaacagccaaa

SEQ ID NO: 449887 - RNA, 20 nt, Homo sapiens
ugcuuacaauucccugcugu

SEQ ID NO: 449888 - RNA, 12 nt, Homo sapiens
ugcuuacauuuu

SEQ ID NO: 449889 - RNA, 14 nt, Homo sapiens
ugcuuaguauuaga

SEQ ID NO: 449890 - RNA, 20 nt, Homo sapiens
ugcuuagugucccuuaccug

SEQ ID NO: 449891 - RNA, 19 nt, Homo sapiens
ugcuuauguaugccuauuc

SEQ ID NO: 449892 - RNA, 15 nt, Homo sapiens
ugcuuauucuugagc

SEQ ID NO: 449893 - RNA, 19 nt, Homo sapiens
ugcuucaaaaacauucuua

SEQ ID NO: 449894 - RNA, 18 nt, Homo sapiens
ugcuucaaccccaugaga

SEQ ID NO: 449895 - RNA, 17 nt, Homo sapiens
ugcuucaugaaaauccu

SEQ ID NO: 449896 - RNA, 17 nt, Homo sapiens
ugcuuccaagcccuucc

SEQ ID NO: 449897 - RNA, 23 nt, Homo sapiens
ugcuuccccuuuugccaaucuca

SEQ ID NO: 449898 - RNA, 22 nt, Homo sapiens
uggcagcaacaaaggauuugaa

SEQ ID NO: 449899 - RNA, 20 nt, Homo sapiens
uggcagcauacacagaugaa

SEQ ID NO: 449900 - RNA, 14 nt, Homo sapiens
uggcagcucuccag

SEQ ID NO: 449901 - RNA, 18 nt, Homo sapiens
uggcagcucuccagucag

SEQ ID NO: 449902 - RNA, 21 nt, Homo sapiens
uggcaggcagagaacugucuc

SEQ ID NO: 449903 - RNA, 14 nt, Homo sapiens
uggcaguacagagu

SEQ ID NO: 449904 - RNA, 16 nt, Homo sapiens
uggcaucccaguggcc

SEQ ID NO: 449905 - RNA, 18 nt, Homo sapiens
uggcauuguugaugcuca

SEQ ID NO: 449906 - RNA, 19 nt, Homo sapiens
uggccaaauaugcacuuuc

SEQ ID NO: 449907 - RNA, 14 nt, Homo sapiens
uggccaaucccugu

SEQ ID NO: 449908 - RNA, 12 nt, Homo sapiens
uggccaaugggg

SEQ ID NO: 449909 - RNA, 12 nt, Homo sapiens
uggccacgcagc

SEQ ID NO: 449910 - RNA, 22 nt, Homo sapiens
uggccacgugggcaaacaggca

SEQ ID NO: 449911 - RNA, 19 nt, Homo sapiens
uggccagaagggggccaug

SEQ ID NO: 449912 - RNA, 17 nt, Homo sapiens
uggccauccaugugaug

SEQ ID NO: 449913 - RNA, 15 nt, Homo sapiens
uggccauuaacaaug

SEQ ID NO: 449914 - RNA, 21 nt, Homo sapiens
uggccauuuaacuagcacuuu

SEQ ID NO: 449915 - RNA, 22 nt, Homo sapiens
uggccauuuuguaccagggcuc

SEQ ID NO: 449916 - RNA, 20 nt, Homo sapiens
uggcccaggaaaaaccugug

SEQ ID NO: 449917 - RNA, 23 nt, Homo sapiens
uggcccccgagcugggggccaug

SEQ ID NO: 449918 - RNA, 15 nt, Homo sapiens
uggccccuucacuuc

SEQ ID NO: 449919 - RNA, 18 nt, Homo sapiens
uggcccucgcucugccuc

SEQ ID NO: 449920 - RNA, 15 nt, Homo sapiens
uggcccucuuugaaa

SEQ ID NO: 449921 - RNA, 21 nt, Homo sapiens
uggccgaaaaggauaugcagu

SEQ ID NO: 449922 - RNA, 15 nt, Homo sapiens
uggccucugugccau

SEQ ID NO: 449923 - RNA, 15 nt, Homo sapiens
uggccugcugggaac

SEQ ID NO: 449924 - RNA, 12 nt, Homo sapiens
uggccugugcug

SEQ ID NO: 449925 - RNA, 23 nt, Homo sapiens
uggccuguguggugccacccugc

SEQ ID NO: 449926 - RNA, 18 nt, Homo sapiens
uggccuugaaaccaccuu

SEQ ID NO: 449927 - RNA, 14 nt, Homo sapiens
uggccuuuaggaag

SEQ ID NO: 449928 - RNA, 15 nt, Homo sapiens
uggcgcacccggcag

SEQ ID NO: 449929 - RNA, 18 nt, Homo sapiens
uggcuaaaggucccaagg

SEQ ID NO: 449930 - RNA, 21 nt, Homo sapiens
uggcuaccgauuucagcacau

SEQ ID NO: 449931 - RNA, 14 nt, Homo sapiens
uggcuagaggacau

SEQ ID NO: 449932 - RNA, 16 nt, Homo sapiens
uggcuagauguuuaca

SEQ ID NO: 449933 - RNA, 16 nt, Homo sapiens
uggcuaguacuguauu

SEQ ID NO: 449934 - RNA, 14 nt, Homo sapiens
uggcucagccucaa

SEQ ID NO: 449935 - RNA, 14 nt, Homo sapiens
uggcucagugccac

SEQ ID NO: 449936 - RNA, 14 nt, Homo sapiens
uggcucaucucuuu

SEQ ID NO: 449937 - RNA, 15 nt, Homo sapiens
uggcuccaacacugc

SEQ ID NO: 449938 - RNA, 17 nt, Homo sapiens
uggcuccccaaagggug

SEQ ID NO: 449939 - RNA, 16 nt, Homo sapiens
uggcucgggacuucaa

SEQ ID NO: 449940 - RNA, 15 nt, Homo sapiens
uggcucucuccagga

SEQ ID NO: 449941 - RNA, 13 nt, Homo sapiens
uggcugacugggg

SEQ ID NO: 449942 - RNA, 14 nt, Homo sapiens
uggcugacuggggc

SEQ ID NO: 449943 - RNA, 23 nt, Homo sapiens
uggcugggagggggcccuuccag

SEQ ID NO: 449944 - RNA, 15 nt, Homo sapiens
uggcugggcccagaa

SEQ ID NO: 449945 - RNA, 13 nt, Homo sapiens
uggcugugagcag

SEQ ID NO: 449946 - RNA, 15 nt, Homo sapiens
uggcuuaagccugug

SEQ ID NO: 449947 - RNA, 14 nt, Homo sapiens
uggcuucaagaaaa

SEQ ID NO: 449948 - RNA, 18 nt, Homo sapiens
uggcuucuaugaucagaa

SEQ ID NO: 449949 - RNA, 19 nt, Homo sapiens
uggcuucugcuugucaucc

SEQ ID NO: 449950 - RNA, 18 nt, Homo sapiens
uggcuucugggaccugug

SEQ ID NO: 449951 - RNA, 16 nt, Homo sapiens
uggcuugacaugugca

SEQ ID NO: 449952 - RNA, 21 nt, Homo sapiens
ugggaaaaaaguuuugaugaa

SEQ ID NO: 449953 - RNA, 14 nt, Homo sapiens
ugggaaaggugcuc

SEQ ID NO: 449954 - RNA, 17 nt, Homo sapiens
ugggaaaggugcucaaa

SEQ ID NO: 449955 - RNA, 22 nt, Homo sapiens
ugggaaaugucgauuuucaaua

SEQ ID NO: 449956 - RNA, 20 nt, Homo sapiens
ugggaaauucuugcacugua

SEQ ID NO: 449957 - RNA, 18 nt, Homo sapiens
ugggaacccgacugugaa

SEQ ID NO: 449958 - RNA, 15 nt, Homo sapiens
ugggaacugugccuu

SEQ ID NO: 449959 - RNA, 19 nt, Homo sapiens
ugggaaggagggagcugcu

SEQ ID NO: 449960 - RNA, 21 nt, Homo sapiens
ugggaagggaucccuuuguau

SEQ ID NO: 449961 - RNA, 20 nt, Homo sapiens
ugggaaugauuaagggagcu

SEQ ID NO: 449962 - RNA, 17 nt, Homo sapiens
ugggacacaaccacuaa

SEQ ID NO: 449963 - RNA, 18 nt, Homo sapiens
ugggacacccaacacuuu

SEQ ID NO: 449964 - RNA, 15 nt, Homo sapiens
ugggacugcugcuuc

SEQ ID NO: 449965 - RNA, 16 nt, Homo sapiens
ugggacuggagucaga

SEQ ID NO: 449966 - RNA, 16 nt, Homo sapiens
ugggacugucuugaga

SEQ ID NO: 449967 - RNA, 14 nt, Homo sapiens
ugggagacuuugaa

SEQ ID NO: 449968 - RNA, 18 nt, Homo sapiens
ugggagccagaauucacu

SEQ ID NO: 449969 - RNA, 16 nt, Homo sapiens
ugggaggccaaggugg

SEQ ID NO: 449970 - RNA, 15 nt, Homo sapiens
ugggaggggugcugc

SEQ ID NO: 449971 - RNA, 22 nt, Homo sapiens
ugggaguucaggaacuguguuu

SEQ ID NO: 449972 - RNA, 23 nt, Homo sapiens
ugggauacuuagugguaugucuc

SEQ ID NO: 449973 - RNA, 16 nt, Homo sapiens
ugggaucugugcccag

SEQ ID NO: 449974 - RNA, 18 nt, Homo sapiens
ugggaucugugcccagag

SEQ ID NO: 449975 - RNA, 22 nt, Homo sapiens
ugggaucuucaaugaacugugc

SEQ ID NO: 449976 - RNA, 15 nt, Homo sapiens
ugggauguaccuuuc

SEQ ID NO: 449977 - RNA, 15 nt, Homo sapiens
ugggauuaacauaaa

SEQ ID NO: 449978 - RNA, 17 nt, Homo sapiens
ugggauuacaaauagaa

SEQ ID NO: 449979 - RNA, 13 nt, Homo sapiens
ugggauuacaggc

SEQ ID NO: 449980 - RNA, 23 nt, Homo sapiens
ugggauuacaggcgugagccacc

SEQ ID NO: 449981 - RNA, 17 nt, Homo sapiens
ugggauuuggagucaga

SEQ ID NO: 449982 - RNA, 18 nt, Homo sapiens
ugggcaacagagcaagac

SEQ ID NO: 449983 - RNA, 21 nt, Homo sapiens
ugggcaacagagcaagacucu

SEQ ID NO: 449984 - RNA, 22 nt, Homo sapiens
ugggcaagucauuguccucuga

SEQ ID NO: 449985 - RNA, 12 nt, Homo sapiens
ugggcagaucaa

SEQ ID NO: 449986 - RNA, 17 nt, Homo sapiens
ugggcagcuaaaagcau

SEQ ID NO: 449987 - RNA, 22 nt, Homo sapiens
ugggcagggguuccagcuuccc

SEQ ID NO: 449988 - RNA, 14 nt, Homo sapiens
ugggcagguaguuu

SEQ ID NO: 449989 - RNA, 18 nt, Homo sapiens
ugggcauucuuguuucaa

SEQ ID NO: 449990 - RNA, 19 nt, Homo sapiens
ugggcauuuuucuuacuuu

SEQ ID NO: 449991 - RNA, 18 nt, Homo sapiens
ugggccaagccaggguuc

SEQ ID NO: 449992 - RNA, 22 nt, Homo sapiens
ugggccagggucucgucaggag

SEQ ID NO: 449993 - RNA, 14 nt, Homo sapiens
ugggcccagaucug

SEQ ID NO: 449994 - RNA, 13 nt, Homo sapiens
ugggcccuaggca

SEQ ID NO: 449995 - RNA, 17 nt, Homo sapiens
ugggcuacacagcagcu

SEQ ID NO: 449996 - RNA, 22 nt, Homo sapiens
ugggcucauucuucuuggcuca

SEQ ID NO: 449997 - RNA, 20 nt, Homo sapiens
ugggcuccuggggcaauggg

SEQ ID NO: 449998 - RNA, 13 nt, Homo sapiens
uuggccacugucu

SEQ ID NO: 449999 - RNA, 15 nt, Homo sapiens
uuggcccucucccau

SEQ ID NO: 450000 - RNA, 16 nt, Homo sapiens
uuggccucaaguucaa

SEQ ID NO: 450001 - RNA, 22 nt, Homo sapiens
uuggcugccccacaggccacac

SEQ ID NO: 450002 - RNA, 14 nt, Homo sapiens
uugggaaaauauca

SEQ ID NO: 450003 - RNA, 18 nt, Homo sapiens
uugggaaaauaucacuuu

SEQ ID NO: 450004 - RNA, 22 nt, Homo sapiens
uugggagauuucauuuucuaca

SEQ ID NO: 450005 - RNA, 12 nt, Homo sapiens
uugggagcaaaa

SEQ ID NO: 450006 - RNA, 22 nt, Homo sapiens
uugggaggaagcccaguagcca

SEQ ID NO: 450007 - RNA, 14 nt, Homo sapiens
uugggaggccaagg

SEQ ID NO: 450008 - RNA, 13 nt, Homo sapiens
uugggauuugccg

SEQ ID NO: 450009 - RNA, 15 nt, Homo sapiens
uugggccccagggaa

SEQ ID NO: 450010 - RNA, 17 nt, Homo sapiens
uugggcgggacauccuc

SEQ ID NO: 450011 - RNA, 16 nt, Homo sapiens
uugggcugcuccucau

SEQ ID NO: 450012 - RNA, 13 nt, Homo sapiens
uugggggauucaa

SEQ ID NO: 450013 - RNA, 14 nt, Homo sapiens
uuggguuccagaca

SEQ ID NO: 450014 - RNA, 15 nt, Homo sapiens
uuggguuccagacag

SEQ ID NO: 450015 - RNA, 14 nt, Homo sapiens
uugguaugugacau

SEQ ID NO: 450016 - RNA, 17 nt, Homo sapiens
uugguccaacaguuuga

SEQ ID NO: 450017 - RNA, 23 nt, Homo sapiens
uuggucuguuuugccuucaccca

SEQ ID NO: 450018 - RNA, 18 nt, Homo sapiens
uuggucuuagcuuuacau

SEQ ID NO: 450019 - RNA, 15 nt, Homo sapiens
uugguggccuaauuu

SEQ ID NO: 450020 - RNA, 15 nt, Homo sapiens
uuggugguuaugucc

SEQ ID NO: 450021 - RNA, 18 nt, Homo sapiens
uugguuaccuauugcugu

SEQ ID NO: 450022 - RNA, 14 nt, Homo sapiens
uugguuuaaaagac

SEQ ID NO: 450023 - RNA, 16 nt, Homo sapiens
uuguaaacuaguacua

SEQ ID NO: 450024 - RNA, 12 nt, Homo sapiens
uuguaacaagaa

SEQ ID NO: 450025 - RNA, 12 nt, Homo sapiens
uuguaacauauu

SEQ ID NO: 450026 - RNA, 14 nt, Homo sapiens
uuguaacugccuac

SEQ ID NO: 450027 - RNA, 21 nt, Homo sapiens
uuguaagaaaaugagacaaaa

SEQ ID NO: 450028 - RNA, 22 nt, Homo sapiens
uuguaagaaauaacacugugaa

SEQ ID NO: 450029 - RNA, 18 nt, Homo sapiens
uuguaagacacacagccu

SEQ ID NO: 450030 - RNA, 13 nt, Homo sapiens
uuguaauugcuua

SEQ ID NO: 450031 - RNA, 18 nt, Homo sapiens
uuguacagugucugugcc

SEQ ID NO: 450032 - RNA, 18 nt, Homo sapiens
uuguaccucuaaguacau

SEQ ID NO: 450033 - RNA, 19 nt, Homo sapiens
uuguaccuuauugaucuuu

SEQ ID NO: 450034 - RNA, 22 nt, Homo sapiens
uuguagagauggggucucacag

SEQ ID NO: 450035 - RNA, 14 nt, Homo sapiens
uuguaggguuucua

SEQ ID NO: 450036 - RNA, 14 nt, Homo sapiens
uuguauaggccauc

SEQ ID NO: 450037 - RNA, 13 nt, Homo sapiens
uugucaacaguau

SEQ ID NO: 450038 - RNA, 21 nt, Homo sapiens
uugucaauauuaaauacagac

SEQ ID NO: 450039 - RNA, 15 nt, Homo sapiens
uugucaccagcaaca

SEQ ID NO: 450040 - RNA, 12 nt, Homo sapiens
uugucagaauuu

SEQ ID NO: 450041 - RNA, 22 nt, Homo sapiens
uugucaguguagaucaacucau

SEQ ID NO: 450042 - RNA, 18 nt, Homo sapiens
uugucccugugccuaaca

SEQ ID NO: 450043 - RNA, 17 nt, Homo sapiens
uuguccugccagcugcc

SEQ ID NO: 450044 - RNA, 11 nt, Homo sapiens
uugucucaaga

SEQ ID NO: 450045 - RNA, 21 nt, Homo sapiens
uugucuguuaaaugaacuuga

SEQ ID NO: 450046 - RNA, 22 nt, Homo sapiens
uugucuguuaaaugaacuugau

SEQ ID NO: 450047 - RNA, 16 nt, Homo sapiens
uugucuuacuguugca

SEQ ID NO: 450048 - RNA, 23 nt, Homo sapiens
uugugaaguggaaauguucuaaa

SEQ ID NO: 450049 - RNA, 14 nt, Homo sapiens
uugugaguaugugu

SEQ ID NO: 450050 - RNA, 14 nt, Homo sapiens
uugugaucaugaga

SEQ ID NO: 450051 - RNA, 20 nt, Homo sapiens
uugugaugaugcugugacaa

SEQ ID NO: 450052 - RNA, 13 nt, Homo sapiens
uugugccuuucac

SEQ ID NO: 450053 - RNA, 13 nt, Homo sapiens
uugugcucuuucc

SEQ ID NO: 450054 - RNA, 16 nt, Homo sapiens
uugugcuuuugcaaaa

SEQ ID NO: 450055 - RNA, 14 nt, Homo sapiens
uuguguacugauaa

SEQ ID NO: 450056 - RNA, 15 nt, Homo sapiens
uuguguccugaugaa

SEQ ID NO: 450057 - RNA, 16 nt, Homo sapiens
uugugugaaaauguga

SEQ ID NO: 450058 - RNA, 15 nt, Homo sapiens
uugugugaguguacc

SEQ ID NO: 450059 - RNA, 13 nt, Homo sapiens
uugugugaugcgc

SEQ ID NO: 450060 - RNA, 21 nt, Homo sapiens
uuguuaauacuauauugcugu

SEQ ID NO: 450061 - RNA, 21 nt, Homo sapiens
uuguuaauacuguauugcugu

SEQ ID NO: 450062 - RNA, 20 nt, Homo sapiens
uuguuacagguguacuaugg

SEQ ID NO: 450063 - RNA, 15 nt, Homo sapiens
uuguuauuuguacag

SEQ ID NO: 450064 - RNA, 16 nt, Homo sapiens
uuguuccagcccuauu

SEQ ID NO: 450065 - RNA, 16 nt, Homo sapiens
uuguuccccacugaca

SEQ ID NO: 450066 - RNA, 22 nt, Homo sapiens
uuguuccugcuuucucuuucag

SEQ ID NO: 450067 - RNA, 21 nt, Homo sapiens
uuguugcaguuaauucuugcc

SEQ ID NO: 450068 - RNA, 20 nt, Homo sapiens
uuguugccuucaucuucacu

SEQ ID NO: 450069 - RNA, 20 nt, Homo sapiens
uuguuguggucugagccaaa

SEQ ID NO: 450070 - RNA, 17 nt, Homo sapiens
uuguuuaacauugcuga

SEQ ID NO: 450071 - RNA, 13 nt, Homo sapiens
uuguuucuuucug

SEQ ID NO: 450072 - RNA, 18 nt, Homo sapiens
uuguuugugugaaaggaa

SEQ ID NO: 450073 - RNA, 19 nt, Homo sapiens
uuuaaaaaaaaacauucaa

SEQ ID NO: 450074 - RNA, 15 nt, Homo sapiens
uuuaaaaaauaacau

SEQ ID NO: 450075 - RNA, 21 nt, Homo sapiens
uuuaaaaaauaacauauucuu

SEQ ID NO: 450076 - RNA, 20 nt, Homo sapiens
uuuaaaagcaaaacugcaaa

SEQ ID NO: 450077 - RNA, 21 nt, Homo sapiens
uuuaaacacggggcuugcaac

SEQ ID NO: 450078 - RNA, 21 nt, Homo sapiens
uuuaaacuacugauugaaugu

SEQ ID NO: 450079 - RNA, 23 nt, Homo sapiens
uuuaaagaaaaugugucugcaac

SEQ ID NO: 450080 - RNA, 12 nt, Homo sapiens
uuucuguucccu

SEQ ID NO: 450081 - RNA, 14 nt, Homo sapiens
uuucuuacauuagc

SEQ ID NO: 450082 - RNA, 22 nt, Homo sapiens
uuucuucagagagcuaaauuac

SEQ ID NO: 450083 - RNA, 15 nt, Homo sapiens
uuucuucaguggcaa

SEQ ID NO: 450084 - RNA, 16 nt, Homo sapiens
uuucuucaugcaauga

SEQ ID NO: 450085 - RNA, 21 nt, Homo sapiens
uuucuucuuccacacaugcaa

SEQ ID NO: 450086 - RNA, 15 nt, Homo sapiens
uuugaaacauuugcc

SEQ ID NO: 450087 - RNA, 22 nt, Homo sapiens
uuugaaacauuugccaaacuaa

SEQ ID NO: 450088 - RNA, 16 nt, Homo sapiens
uuugaaggucugcaag

SEQ ID NO: 450089 - RNA, 15 nt, Homo sapiens
uuugaaguccacuug

SEQ ID NO: 450090 - RNA, 13 nt, Homo sapiens
uuugaauggugca

SEQ ID NO: 450091 - RNA, 14 nt, Homo sapiens
uuugacaaccauga

SEQ ID NO: 450092 - RNA, 19 nt, Homo sapiens
uuugacaacgccaacugcc

SEQ ID NO: 450093 - RNA, 17 nt, Homo sapiens
uuugacagcugugcugu

SEQ ID NO: 450094 - RNA, 17 nt, Homo sapiens
uuugacauucuucacug

SEQ ID NO: 450095 - RNA, 22 nt, Homo sapiens
uuugacugaauguuuuauggaa

SEQ ID NO: 450096 - RNA, 23 nt, Homo sapiens
uuugacuuugguuguguuuaaau

SEQ ID NO: 450097 - RNA, 23 nt, Homo sapiens
uuugagcccacaaagccuuauca

SEQ ID NO: 450098 - RNA, 18 nt, Homo sapiens
uuugaggagcagcuucag

SEQ ID NO: 450099 - RNA, 16 nt, Homo sapiens
uuugaggcaaaggcca

SEQ ID NO: 450100 - RNA, 16 nt, Homo sapiens
uuugauacaguauuau

SEQ ID NO: 450101 - RNA, 21 nt, Homo sapiens
uuugauauacuauuuucauuc

SEQ ID NO: 450102 - RNA, 16 nt, Homo sapiens
uuugauaugauuguaa

SEQ ID NO: 450103 - RNA, 10 nt, Homo sapiens
uuugaucaug

SEQ ID NO: 450104 - RNA, 19 nt, Homo sapiens
uuugcagcagugagucucu

SEQ ID NO: 450105 - RNA, 17 nt, Homo sapiens
uuugcaugucugcauga

SEQ ID NO: 450106 - RNA, 15 nt, Homo sapiens
uuugcauugugugag

SEQ ID NO: 450107 - RNA, 12 nt, Homo sapiens
uuugccacugaa

SEQ ID NO: 450108 - RNA, 16 nt, Homo sapiens
uuugcccuucacuguu

SEQ ID NO: 450109 - RNA, 13 nt, Homo sapiens
uuugcucagaaca

SEQ ID NO: 450110 - RNA, 18 nt, Homo sapiens
uuugcuccaccccacuca

SEQ ID NO: 450111 - RNA, 19 nt, Homo sapiens
uuugcuucaaaaacauucu

SEQ ID NO: 450112 - RNA, 22 nt, Homo sapiens
uuugcuuguguacaaacccaga

SEQ ID NO: 450113 - RNA, 19 nt, Homo sapiens
uuugcuuguuuauuucuga

SEQ ID NO: 450114 - RNA, 20 nt, Homo sapiens
uuugcuuuagagacagggac

SEQ ID NO: 450115 - RNA, 14 nt, Homo sapiens
uuuggaaagccauu

SEQ ID NO: 450116 - RNA, 20 nt, Homo sapiens
uuuggaaucccacuuaucaa

SEQ ID NO: 450117 - RNA, 19 nt, Homo sapiens
uuuggagacacaacuauuu

SEQ ID NO: 450118 - RNA, 15 nt, Homo sapiens
uuuggauaucuguua

SEQ ID NO: 450119 - RNA, 19 nt, Homo sapiens
uuuggcaggcuuuuuucca

SEQ ID NO: 450120 - RNA, 20 nt, Homo sapiens
uuuggcaggcuuuuuuccag

SEQ ID NO: 450121 - RNA, 14 nt, Homo sapiens
uuuggcucacugca

SEQ ID NO: 450122 - RNA, 18 nt, Homo sapiens
uuuggcucgggacuucaa

SEQ ID NO: 450123 - RNA, 14 nt, Homo sapiens
uuugggagagacca

SEQ ID NO: 450124 - RNA, 16 nt, Homo sapiens
uuugggccccauucag

SEQ ID NO: 450125 - RNA, 15 nt, Homo sapiens
uuuggggagcagaga

SEQ ID NO: 450126 - RNA, 20 nt, Homo sapiens
uuugggguugaaaauucaaa

SEQ ID NO: 450127 - RNA, 20 nt, Homo sapiens
uuuggucuguuuugccuuca

SEQ ID NO: 450128 - RNA, 16 nt, Homo sapiens
uuugguuaaacccaug

SEQ ID NO: 450129 - RNA, 18 nt, Homo sapiens
uuugguuacugugccaug

SEQ ID NO: 450130 - RNA, 23 nt, Homo sapiens
uuuguaaaaagcuucauucucac

SEQ ID NO: 450131 - RNA, 14 nt, Homo sapiens
uuuguaacugccua

SEQ ID NO: 450132 - RNA, 20 nt, Homo sapiens
uucacaggcagugcauguga

SEQ ID NO: 450133 - RNA, 23 nt, Homo sapiens
uucacaguucucuccuucuuccc

SEQ ID NO: 450134 - RNA, 22 nt, Homo sapiens
uucacauaugucuuacuacuuu

SEQ ID NO: 450135 - RNA, 13 nt, Homo sapiens
uucacauuuugcc

SEQ ID NO: 450136 - RNA, 11 nt, Homo sapiens
uucaccagagc

SEQ ID NO: 450137 - RNA, 17 nt, Homo sapiens
uucaccucccaaaccca

SEQ ID NO: 450138 - RNA, 11 nt, Homo sapiens
uucaccuguaa

SEQ ID NO: 450139 - RNA, 20 nt, Homo sapiens
uucaccuuccagugucucgg

SEQ ID NO: 450140 - RNA, 22 nt, Homo sapiens
uucacgugcagcagcaacacaa

SEQ ID NO: 450141 - RNA, 18 nt, Homo sapiens
uucacucugacaguauua

SEQ ID NO: 450142 - RNA, 10 nt, Homo sapiens
uucacugaga

SEQ ID NO: 450143 - RNA, 14 nt, Homo sapiens
uucacugagauuau

SEQ ID NO: 450144 - RNA, 18 nt, Homo sapiens
uucacugcaaccucugcc

SEQ ID NO: 450145 - RNA, 12 nt, Homo sapiens
uucacuggagac

SEQ ID NO: 450146 - RNA, 14 nt, Homo sapiens
uucagaaguuugcu

SEQ ID NO: 450147 - RNA, 21 nt, Homo sapiens
uucagacaggagccacaggga

SEQ ID NO: 450148 - RNA, 12 nt, Homo sapiens
uucagagauuua

SEQ ID NO: 450149 - RNA, 17 nt, Homo sapiens
uucagagcaagcacugg

SEQ ID NO: 450150 - RNA, 15 nt, Homo sapiens
uucagagccagugaa

SEQ ID NO: 450151 - RNA, 19 nt, Homo sapiens
uucagaggagcaacccuau

SEQ ID NO: 450152 - RNA, 18 nt, Homo sapiens
uucagauggcaauuucac

SEQ ID NO: 450153 - RNA, 19 nt, Homo sapiens
uucagcacccccacccacc

SEQ ID NO: 450154 - RNA, 14 nt, Homo sapiens
uucagcaguaccua

SEQ ID NO: 450155 - RNA, 20 nt, Homo sapiens
uucagcauuauuccuccagg

SEQ ID NO: 450156 - RNA, 16 nt, Homo sapiens
uucagccaagaauucu

SEQ ID NO: 450157 - RNA, 16 nt, Homo sapiens
uucagcucuguuuuac

SEQ ID NO: 450158 - RNA, 15 nt, Homo sapiens
uucagcugaacacaa

SEQ ID NO: 450159 - RNA, 18 nt, Homo sapiens
uucagcugugaacaugga

SEQ ID NO: 450160 - RNA, 14 nt, Homo sapiens
uucaggcaggccaa

SEQ ID NO: 450161 - RNA, 18 nt, Homo sapiens
uucagguauguguguaua

SEQ ID NO: 450162 - RNA, 13 nt, Homo sapiens
uucaguauacugu

SEQ ID NO: 450163 - RNA, 13 nt, Homo sapiens
uucaguaugcaaa

SEQ ID NO: 450164 - RNA, 16 nt, Homo sapiens
uucagucaucaucuca

SEQ ID NO: 450165 - RNA, 21 nt, Homo sapiens
uucagucucugcaguguccau

SEQ ID NO: 450166 - RNA, 13 nt, Homo sapiens
uucaguguucuga

SEQ ID NO: 450167 - RNA, 22 nt, Homo sapiens
uucaguuccucuuugcauggaa

SEQ ID NO: 450168 - RNA, 22 nt, Homo sapiens
uucaguugacaaaauauauaau

SEQ ID NO: 450169 - RNA, 16 nt, Homo sapiens
uucaguuguacuucca

SEQ ID NO: 450170 - RNA, 16 nt, Homo sapiens
uucauacagcacuacu

SEQ ID NO: 450171 - RNA, 21 nt, Homo sapiens
uucauaccuguuguacacuug

SEQ ID NO: 450172 - RNA, 20 nt, Homo sapiens
uucauacuauuaagauucua

SEQ ID NO: 450173 - RNA, 17 nt, Homo sapiens
uucauauaccagcaaua

SEQ ID NO: 450174 - RNA, 18 nt, Homo sapiens
uucaucaccagacuuugg

SEQ ID NO: 450175 - RNA, 22 nt, Homo sapiens
uucaucgcaguggacugugucc

SEQ ID NO: 450176 - RNA, 11 nt, Homo sapiens
uucaucucuug

SEQ ID NO: 450177 - RNA, 18 nt, Homo sapiens
uucaucuucacugcaauu

SEQ ID NO: 450178 - RNA, 16 nt, Homo sapiens
uucaugacaagcauuu

SEQ ID NO: 450179 - RNA, 20 nt, Homo sapiens
uucaugacuuuuccauguau

SEQ ID NO: 450180 - RNA, 17 nt, Homo sapiens
uucaugcaauccuucca

SEQ ID NO: 450181 - RNA, 21 nt, Homo sapiens
uucaugccagcuauaaucucc

SEQ ID NO: 450182 - RNA, 19 nt, Homo sapiens
uucauguuagucuuaccga

SEQ ID NO: 450183 - RNA, 17 nt, Homo sapiens
uucauuagccaaauuga

SEQ ID NO: 450184 - RNA, 21 nt, Homo sapiens
uucauuccuaacacagcaugu

SEQ ID NO: 450185 - RNA, 13 nt, Homo sapiens
uucauuuugccaa

SEQ ID NO: 450186 - RNA, 18 nt, Homo sapiens
uuccaaagagaaggccug

SEQ ID NO: 450187 - RNA, 17 nt, Homo sapiens
uuccaaagagucaucau

SEQ ID NO: 450188 - RNA, 13 nt, Homo sapiens
uuccaaaguuuug

SEQ ID NO: 450189 - RNA, 23 nt, Homo sapiens
uuccaacaauggggugggcccau

SEQ ID NO: 450190 - RNA, 15 nt, Homo sapiens
uuccaacaccacaga

SEQ ID NO: 450191 - RNA, 23 nt, Homo sapiens
uuccaacuauguccagaugugca

SEQ ID NO: 450192 - RNA, 23 nt, Homo sapiens
uuccaagacaguuguaucacaaa

SEQ ID NO: 450193 - RNA, 16 nt, Homo sapiens
uuccaagccugggcca

SEQ ID NO: 450194 - RNA, 23 nt, Homo sapiens
uuccaaggguaugggaagccaua

SEQ ID NO: 450195 - RNA, 18 nt, Homo sapiens
uuccaaguauuuugccac

SEQ ID NO: 450196 - RNA, 17 nt, Homo sapiens
uuccaagucaacacucu

SEQ ID NO: 450197 - RNA, 18 nt, Homo sapiens
uuccaagugugugugcaa

SEQ ID NO: 450198 - RNA, 17 nt, Homo sapiens
uuccaauuuuguugcau

SEQ ID NO: 450199 - RNA, 21 nt, Homo sapiens
uuccacauccccaccuuccaa

SEQ ID NO: 450200 - RNA, 21 nt, Homo sapiens
uuccaccaagcguuucccagu

SEQ ID NO: 450201 - RNA, 21 nt, Homo sapiens
uuccaccuguaaaaacugcac

SEQ ID NO: 450202 - RNA, 13 nt, Homo sapiens
uuccacugacagg

SEQ ID NO: 450203 - RNA, 12 nt, Homo sapiens
uuccacugccuc

SEQ ID NO: 450204 - RNA, 19 nt, Homo sapiens
uuccacuucaggguucuaa

SEQ ID NO: 450205 - RNA, 17 nt, Homo sapiens
uuccacuuugauaccau

SEQ ID NO: 450206 - RNA, 22 nt, Homo sapiens
uuccagaaggccacaggccacu

SEQ ID NO: 450207 - RNA, 20 nt, Homo sapiens
uuccagacaggguggggcuu

SEQ ID NO: 450208 - RNA, 12 nt, Homo sapiens
uuccagauagca

SEQ ID NO: 450209 - RNA, 20 nt, Homo sapiens
uuccaggaccagaagcauuu

SEQ ID NO: 450210 - RNA, 15 nt, Homo sapiens
uuccaguauugaaaa

SEQ ID NO: 450211 - RNA, 23 nt, Homo sapiens
uuccagugucacuugacucuuga

SEQ ID NO: 450212 - RNA, 18 nt, Homo sapiens
uuccauggauuccccugg

SEQ ID NO: 450213 - RNA, 20 nt, Homo sapiens
uuccauucuuuuaaaugggu

SEQ ID NO: 450214 - RNA, 20 nt, Homo sapiens
uuccauugcucccagugcca

SEQ ID NO: 450215 - RNA, 18 nt, Homo sapiens
uuccauuuacuugaucau

SEQ ID NO: 450216 - RNA, 16 nt, Homo sapiens
uuccauuuccguucca

SEQ ID NO: 450217 - RNA, 17 nt, Homo sapiens
uuccauuuccguuccag

SEQ ID NO: 450218 - RNA, 19 nt, Homo sapiens
uuccauuugaagcagugau

SEQ ID NO: 450219 - RNA, 23 nt, Homo sapiens
uuccauuuuuauuucaaaauaua

SEQ ID NO: 450220 - RNA, 20 nt, Homo sapiens
uucccaacacuucagacugc

SEQ ID NO: 450221 - RNA, 20 nt, Homo sapiens
uucccaauaaaagugacucu

SEQ ID NO: 450222 - RNA, 17 nt, Homo sapiens
aaaaaaaucaguguuua

SEQ ID NO: 450223 - RNA, 13 nt, Homo sapiens
aaaaaaccaucca

SEQ ID NO: 450224 - RNA, 12 nt, Homo sapiens
aaaaaacuucca

SEQ ID NO: 450225 - RNA, 14 nt, Homo sapiens
aaaaaaugaagaca

SEQ ID NO: 450226 - RNA, 14 nt, Homo sapiens
aaaaaauuauuugc

SEQ ID NO: 450227 - RNA, 17 nt, Homo sapiens
aaaaaauuuauuauguc

SEQ ID NO: 450228 - RNA, 13 nt, Homo sapiens
aaaaacauggccu

SEQ ID NO: 450229 - RNA, 16 nt, Homo sapiens
aaaaacaugucaugua

SEQ ID NO: 450230 - RNA, 12 nt, Homo sapiens
aaaaacauuugu

SEQ ID NO: 450231 - RNA, 14 nt, Homo sapiens
aaaaaccccagugu

SEQ ID NO: 450232 - RNA, 18 nt, Homo sapiens
aaaaaccucuuagcuuuu

SEQ ID NO: 450233 - RNA, 12 nt, Homo sapiens
aaaaacuugggu

SEQ ID NO: 450234 - RNA, 14 nt, Homo sapiens
aaaaagaacuguau

SEQ ID NO: 450235 - RNA, 11 nt, Homo sapiens
aaaaagcacaa

SEQ ID NO: 450236 - RNA, 13 nt, Homo sapiens
aaaaaggacucug

SEQ ID NO: 450237 - RNA, 22 nt, Homo sapiens
aaaaaggccuuugggauuugcc

SEQ ID NO: 450238 - RNA, 11 nt, Homo sapiens
aaaaaggugcu

SEQ ID NO: 450239 - RNA, 15 nt, Homo sapiens
aaaaagucaaacuuu

SEQ ID NO: 450240 - RNA, 12 nt, Homo sapiens
aaaaaguguuua

SEQ ID NO: 450241 - RNA, 15 nt, Homo sapiens
aaaaaguugcacauu

SEQ ID NO: 450242 - RNA, 19 nt, Homo sapiens
aaaaaguuuaagauugcaa

SEQ ID NO: 450243 - RNA, 15 nt, Homo sapiens
aaaaauaacacugua

SEQ ID NO: 450244 - RNA, 13 nt, Homo sapiens
aaaaauaacugug

SEQ ID NO: 450245 - RNA, 17 nt, Homo sapiens
aaaaauaaguacauaua

SEQ ID NO: 450246 - RNA, 18 nt, Homo sapiens
aaaaauauucuccaugga

SEQ ID NO: 450247 - RNA, 15 nt, Homo sapiens
aaaaaucucucccca

SEQ ID NO: 450248 - RNA, 23 nt, Homo sapiens
aaaaauggauacuggugcaguca

SEQ ID NO: 450249 - RNA, 15 nt, Homo sapiens
aaaaauguccugccu

SEQ ID NO: 450250 - RNA, 12 nt, Homo sapiens
aaaaauguucuu

SEQ ID NO: 450251 - RNA, 14 nt, Homo sapiens
aaaacaaagccuua

SEQ ID NO: 450252 - RNA, 14 nt, Homo sapiens
aaaacaauacucaa

SEQ ID NO: 450253 - RNA, 16 nt, Homo sapiens
aaaacaauguuuuaaa

SEQ ID NO: 450254 - RNA, 16 nt, Homo sapiens
aaaaccaacaccauca

SEQ ID NO: 450255 - RNA, 11 nt, Homo sapiens
aaaaccaauga

SEQ ID NO: 450256 - RNA, 18 nt, Homo sapiens
aaaaccacagauacugaa

SEQ ID NO: 450257 - RNA, 16 nt, Homo sapiens
aaaaccagucuucucc

SEQ ID NO: 450258 - RNA, 18 nt, Homo sapiens
aaaacccaacuccucucc

SEQ ID NO: 450259 - RNA, 13 nt, Homo sapiens
aaaaccccagugu

SEQ ID NO: 450260 - RNA, 14 nt, Homo sapiens
aaaaccuuacuuaa

SEQ ID NO: 450261 - RNA, 18 nt, Homo sapiens
aaaaccuuucaaauuuca

SEQ ID NO: 450262 - RNA, 17 nt, Homo sapiens
aaaacguuuuauugugu

SEQ ID NO: 450263 - RNA, 13 nt, Homo sapiens
aaaacuaguucuu

SEQ ID NO: 450264 - RNA, 19 nt, Homo sapiens
aaaacugaaaaucuaauau

SEQ ID NO: 450265 - RNA, 19 nt, Homo sapiens
aaaacugacaguaaaucuc

SEQ ID NO: 450266 - RNA, 17 nt, Homo sapiens
aaaacugcccauuguaa

SEQ ID NO: 450267 - RNA, 17 nt, Homo sapiens
aaaacugucauuuagcu

SEQ ID NO: 450268 - RNA, 11 nt, Homo sapiens
aaaacugugac

SEQ ID NO: 450269 - RNA, 14 nt, Homo sapiens
aaaacuuaacauuc

SEQ ID NO: 450270 - RNA, 14 nt, Homo sapiens
aaaacuuaguuugu

SEQ ID NO: 450271 - RNA, 15 nt, Homo sapiens
aaaacuucaaagcug

SEQ ID NO: 450272 - RNA, 14 nt, Homo sapiens
aaaagaacuguauu

SEQ ID NO: 450273 - RNA, 12 nt, Homo sapiens
aaaagacugaau

SEQ ID NO: 450274 - RNA, 16 nt, Homo sapiens
aaaagaggcuauguga

SEQ ID NO: 450275 - RNA, 21 nt, Homo sapiens
aaaagauguugugucuugugu

SEQ ID NO: 450276 - RNA, 13 nt, Homo sapiens
aaaagauucaaag

SEQ ID NO: 450277 - RNA, 18 nt, Homo sapiens
aaaagauuuucagaaaau

SEQ ID NO: 450278 - RNA, 17 nt, Homo sapiens
aaaagcaaaacugcaaa

SEQ ID NO: 450279 - RNA, 14 nt, Homo sapiens
aaaagcaacaucag

SEQ ID NO: 450280 - RNA, 12 nt, Homo sapiens
aaaagcaacuuu

SEQ ID NO: 450281 - RNA, 20 nt, Homo sapiens
aaaagcacagcucucacugg

SEQ ID NO: 450282 - RNA, 18 nt, Homo sapiens
aaaagcagaaguucaugg

SEQ ID NO: 450283 - RNA, 14 nt, Homo sapiens
aaaagcagcuacca

SEQ ID NO: 450284 - RNA, 20 nt, Homo sapiens
aaaagcccaccugaaagccu

SEQ ID NO: 450285 - RNA, 14 nt, Homo sapiens
aaaagcuguuccca

SEQ ID NO: 450286 - RNA, 10 nt, Homo sapiens
aaaagcuuuu

SEQ ID NO: 450287 - RNA, 21 nt, Homo sapiens
aaaaggaaaccaaguggucag

SEQ ID NO: 450288 - RNA, 16 nt, Homo sapiens
aaaaggauaugcagua

SEQ ID NO: 450289 - RNA, 15 nt, Homo sapiens
aaaaggccuuuggga

SEQ ID NO: 450290 - RNA, 20 nt, Homo sapiens
aaaaggucauagcugagauu

SEQ ID NO: 450291 - RNA, 13 nt, Homo sapiens
aaaaggucauaua

SEQ ID NO: 450292 - RNA, 23 nt, Homo sapiens
aaaaggugcuacgguagugauga

SEQ ID NO: 450293 - RNA, 16 nt, Homo sapiens
aaaagguuaagccaua

SEQ ID NO: 450294 - RNA, 19 nt, Homo sapiens
aaaaguaagagagcacagu

SEQ ID NO: 450295 - RNA, 21 nt, Homo sapiens
aaaagugcuacuugagagugg

SEQ ID NO: 450296 - RNA, 20 nt, Homo sapiens
aaaagugcuuugcuggaguc

SEQ ID NO: 450297 - RNA, 22 nt, Homo sapiens
aaaaguuaacauucaguacuuu

SEQ ID NO: 450298 - RNA, 12 nt, Homo sapiens
aaaaguuuacaa

SEQ ID NO: 450299 - RNA, 21 nt, Homo sapiens
aaaaguuuuauguacuuugau

SEQ ID NO: 450300 - RNA, 14 nt, Homo sapiens
aaaauaaaguacgu

SEQ ID NO: 450301 - RNA, 15 nt, Homo sapiens
aaaauaguggccaga

SEQ ID NO: 450302 - RNA, 15 nt, Homo sapiens
aaaauauaguuugau

SEQ ID NO: 450303 - RNA, 12 nt, Homo sapiens
aaaauaugauau

SEQ ID NO: 450304 - RNA, 19 nt, Homo sapiens
aaaauaugauauauaugua

SEQ ID NO: 450305 - RNA, 19 nt, Homo sapiens
aaaauauuauguguuucca

SEQ ID NO: 450306 - RNA, 22 nt, Homo sapiens
aaaaucaacccaauaauucugu

SEQ ID NO: 450307 - RNA, 13 nt, Homo sapiens
aaaaucacucuca

SEQ ID NO: 450308 - RNA, 16 nt, Homo sapiens
aaaaucauaguacucu

SEQ ID NO: 450309 - RNA, 23 nt, Homo sapiens
aaaaucaugcuuauaagcaacau

SEQ ID NO: 450310 - RNA, 17 nt, Homo sapiens
aaaaucauucuacugaa

SEQ ID NO: 450311 - RNA, 17 nt, Homo sapiens
aaaauccaaaaugcaug

SEQ ID NO: 450312 - RNA, 22 nt, Homo sapiens
aaaauccaagcugcucauuuca

SEQ ID NO: 450313 - RNA, 21 nt, Homo sapiens
aaaaucccucuuccuccaaag

SEQ ID NO: 450314 - RNA, 18 nt, Homo sapiens
aaaaucuccaauccacac

SEQ ID NO: 450315 - RNA, 12 nt, Homo sapiens
aaaaucugucca

SEQ ID NO: 450316 - RNA, 17 nt, Homo sapiens
aaaaucuuuccaucuca

SEQ ID NO: 450317 - RNA, 20 nt, Homo sapiens
aaaaugaaaugacugucuaa

SEQ ID NO: 450318 - RNA, 13 nt, Homo sapiens
aaaaugaagauua

SEQ ID NO: 450319 - RNA, 17 nt, Homo sapiens
aaaaugacaaugaugau

SEQ ID NO: 450320 - RNA, 20 nt, Homo sapiens
aaaaugagaaucugugcagu

SEQ ID NO: 450321 - RNA, 22 nt, Homo sapiens
aaaaugagguucaacuguugau

SEQ ID NO: 450322 - RNA, 15 nt, Homo sapiens
aaaaugcacguagcu

SEQ ID NO: 450323 - RNA, 13 nt, Homo sapiens
aaaaugcaugaua

SEQ ID NO: 450324 - RNA, 21 nt, Homo sapiens
aaaauggacguguuaugacuc

SEQ ID NO: 450325 - RNA, 20 nt, Homo sapiens
aaaauggauccccagugaaa

SEQ ID NO: 450326 - RNA, 21 nt, Homo sapiens
aaaauggcaaagaauucaaac

SEQ ID NO: 450327 - RNA, 22 nt, Homo sapiens
aaaaugggagacagccucuuac

SEQ ID NO: 450328 - RNA, 20 nt, Homo sapiens
aaaaugguguuuucauguaa

SEQ ID NO: 450329 - RNA, 15 nt, Homo sapiens
aaaauguccugccuu

SEQ ID NO: 450330 - RNA, 16 nt, Homo sapiens
aaaauguccugccuuu

SEQ ID NO: 450331 - RNA, 14 nt, Homo sapiens
aaaaugugccuccc

SEQ ID NO: 450332 - RNA, 22 nt, Homo sapiens
aaaauguuagagcagaauucau

SEQ ID NO: 450333 - RNA, 22 nt, Homo sapiens
aaaauguucugacagcauuuca

SEQ ID NO: 450334 - RNA, 23 nt, Homo sapiens
aaaauguuuucuucaucugugac

SEQ ID NO: 450335 - RNA, 15 nt, Homo sapiens
aaaauuaauacugaa

SEQ ID NO: 450336 - RNA, 15 nt, Homo sapiens
aaaauuacugaugca

SEQ ID NO: 450337 - RNA, 18 nt, Homo sapiens
aaaauuauuauaagcauu

SEQ ID NO: 450338 - RNA, 20 nt, Homo sapiens
aaaauucacccccauccaca

SEQ ID NO: 450339 - RNA, 19 nt, Homo sapiens
aaaauuccauuuacuugau

SEQ ID NO: 450340 - RNA, 23 nt, Homo sapiens
aaaauugcagcaguugcuagcaa

SEQ ID NO: 450341 - RNA, 15 nt, Homo sapiens
aaaauuggcauuaaa

SEQ ID NO: 450342 - RNA, 13 nt, Homo sapiens
aaaauuuuacuuc

SEQ ID NO: 450343 - RNA, 21 nt, Homo sapiens
aaaauuuugcuccccagugaa

SEQ ID NO: 450344 - RNA, 20 nt, Homo sapiens
aaacaaaaauauuuugauca

SEQ ID NO: 450345 - RNA, 15 nt, Homo sapiens
aaacaaucacacuca

SEQ ID NO: 450346 - RNA, 14 nt, Homo sapiens
aaacaauucaaaga

SEQ ID NO: 450347 - RNA, 20 nt, Homo sapiens
aaacaauuggcaaacuuugu

SEQ ID NO: 450348 - RNA, 13 nt, Homo sapiens
aaacacacaucca

SEQ ID NO: 450349 - RNA, 13 nt, Homo sapiens
aaacacacuucca

SEQ ID NO: 450350 - RNA, 21 nt, Homo sapiens
aaacacacuuuugcacauaua

SEQ ID NO: 450351 - RNA, 18 nt, Homo sapiens
aaacacuagacuguauca

SEQ ID NO: 450352 - RNA, 16 nt, Homo sapiens
aaacacucagcuguuc

SEQ ID NO: 450353 - RNA, 20 nt, Homo sapiens
aaacacugcuguucuuuaaa

SEQ ID NO: 450354 - RNA, 12 nt, Homo sapiens
aaacacuguaau

SEQ ID NO: 450355 - RNA, 19 nt, Homo sapiens
aaacagaacggguucuccc

SEQ ID NO: 450356 - RNA, 22 nt, Homo sapiens
aaacaggcaguuggccagagag

SEQ ID NO: 450357 - RNA, 16 nt, Homo sapiens
aaacagggcaucucca

SEQ ID NO: 450358 - RNA, 12 nt, Homo sapiens
aaacaggugcua

SEQ ID NO: 450359 - RNA, 21 nt, Homo sapiens
aaacaguuaagacaacaggca

SEQ ID NO: 450360 - RNA, 12 nt, Homo sapiens
aaacaguucuug

SEQ ID NO: 450361 - RNA, 15 nt, Homo sapiens
aaacaguucuuggac

SEQ ID NO: 450362 - RNA, 17 nt, Homo sapiens
aaacauaauaaaaggag

SEQ ID NO: 450363 - RNA, 12 nt, Homo sapiens
aaacaucugcac

SEQ ID NO: 450364 - RNA, 20 nt, Homo sapiens
aaacaucuuuccaguccuug

SEQ ID NO: 450365 - RNA, 18 nt, Homo sapiens
aaacaugaaaacauugau

SEQ ID NO: 450366 - RNA, 18 nt, Homo sapiens
aaacauggccacauccaa

SEQ ID NO: 450367 - RNA, 19 nt, Homo sapiens
aaacauuaaucaccaaagu

SEQ ID NO: 450368 - RNA, 14 nt, Homo sapiens
aaacauuauucuca

SEQ ID NO: 450369 - RNA, 20 nt, Homo sapiens
aaacauuauucucaaccaga

SEQ ID NO: 450370 - RNA, 21 nt, Homo sapiens
aaacauugaaguaaugaauuu

SEQ ID NO: 450371 - RNA, 19 nt, Homo sapiens
aaacauuuuuuuguucucu

SEQ ID NO: 450372 - RNA, 13 nt, Homo sapiens
aaaccaaugauuc

SEQ ID NO: 450373 - RNA, 14 nt, Homo sapiens
aaaccaaugauuca

SEQ ID NO: 450374 - RNA, 14 nt, Homo sapiens
aaaccacaaaaaga

SEQ ID NO: 450375 - RNA, 16 nt, Homo sapiens
aaaccacccugagggu

SEQ ID NO: 450376 - RNA, 21 nt, Homo sapiens
aaaccacuaugcaaagaacuc

SEQ ID NO: 450377 - RNA, 23 nt, Homo sapiens
aaaccacugggcauaaugcuucc

SEQ ID NO: 450378 - RNA, 14 nt, Homo sapiens
aaaccaucuggccu

SEQ ID NO: 450379 - RNA, 11 nt, Homo sapiens
aaaccaugacu

SEQ ID NO: 450380 - RNA, 12 nt, Homo sapiens
aaaccaugacug

SEQ ID NO: 450381 - RNA, 19 nt, Homo sapiens
aaaccccagccacuuccug

SEQ ID NO: 450382 - RNA, 13 nt, Homo sapiens
aaaccccaucucu

SEQ ID NO: 450383 - RNA, 22 nt, Homo sapiens
aaacccgacaacauuucugcca

SEQ ID NO: 450384 - RNA, 16 nt, Homo sapiens
aaaccgagugcaauga

SEQ ID NO: 450385 - RNA, 17 nt, Homo sapiens
aaaccguaauuuuauua

SEQ ID NO: 450386 - RNA, 20 nt, Homo sapiens
aaaccucugggucaucucuc

SEQ ID NO: 450387 - RNA, 22 nt, Homo sapiens
aaaccugauguuaaaauuccau

SEQ ID NO: 450388 - RNA, 11 nt, Homo sapiens
aaaccuguggg

SEQ ID NO: 450389 - RNA, 12 nt, Homo sapiens
aaaccuuacuua

SEQ ID NO: 450390 - RNA, 17 nt, Homo sapiens
aaaccuuuccuguaaca

SEQ ID NO: 450391 - RNA, 21 nt, Homo sapiens
aaacgcaaaaccugcaguucc

SEQ ID NO: 450392 - RNA, 19 nt, Homo sapiens
aaacgccgcugacugccac

SEQ ID NO: 450393 - RNA, 20 nt, Homo sapiens
aaacgucacagcaguacuug

SEQ ID NO: 450394 - RNA, 18 nt, Homo sapiens
aaacuaaauacuguaaca

SEQ ID NO: 450395 - RNA, 17 nt, Homo sapiens
aaacuaaggaacccugg

SEQ ID NO: 450396 - RNA, 23 nt, Homo sapiens
aaacuaccauguggccauuaaca

SEQ ID NO: 450397 - RNA, 17 nt, Homo sapiens
ugccauccacauuuuaa

SEQ ID NO: 450398 - RNA, 16 nt, Homo sapiens
ugccaucgggugccaa

SEQ ID NO: 450399 - RNA, 23 nt, Homo sapiens
ugccauggaggcacacagcugca

SEQ ID NO: 450400 - RNA, 23 nt, Homo sapiens
ugccauggaggcaugccaaaugu

SEQ ID NO: 450401 - RNA, 16 nt, Homo sapiens
ugccaugugugcugaa

SEQ ID NO: 450402 - RNA, 18 nt, Homo sapiens
ugcccaaccaaugcacac

SEQ ID NO: 450403 - RNA, 21 nt, Homo sapiens
ugcccaaccugcucuccucuu

SEQ ID NO: 450404 - RNA, 17 nt, Homo sapiens
ugcccacccgucuucaa

SEQ ID NO: 450405 - RNA, 12 nt, Homo sapiens
ugcccagaguag

SEQ ID NO: 450406 - RNA, 23 nt, Homo sapiens
ugcccagcaaggaccagugagac

SEQ ID NO: 450407 - RNA, 22 nt, Homo sapiens
ugcccaggagcggcgaugcacu

SEQ ID NO: 450408 - RNA, 21 nt, Homo sapiens
ugcccaggcagucuuugcuca

SEQ ID NO: 450409 - RNA, 20 nt, Homo sapiens
ugcccaggcuggagugcaac

SEQ ID NO: 450410 - RNA, 20 nt, Homo sapiens
ugcccaggcuggaguggagu

SEQ ID NO: 450411 - RNA, 22 nt, Homo sapiens
ugcccaguguuguuuguaaaua

SEQ ID NO: 450412 - RNA, 15 nt, Homo sapiens
ugcccaguucauccc

SEQ ID NO: 450413 - RNA, 18 nt, Homo sapiens
ugcccauggaagucucaa

SEQ ID NO: 450414 - RNA, 19 nt, Homo sapiens
ugcccauggaagucucaaa

SEQ ID NO: 450415 - RNA, 24 nt, Homo sapiens
ugcccauuagcccacugccuggaa

SEQ ID NO: 450416 - RNA, 12 nt, Homo sapiens
ugcccauugcac

SEQ ID NO: 450417 - RNA, 19 nt, Homo sapiens
ugccccagauagguggugc

SEQ ID NO: 450418 - RNA, 14 nt, Homo sapiens
ugccccagcugggc

SEQ ID NO: 450419 - RNA, 11 nt, Homo sapiens
ugccccagugu

SEQ ID NO: 450420 - RNA, 14 nt, Homo sapiens
ugcccccaucuuuc

SEQ ID NO: 450421 - RNA, 18 nt, Homo sapiens
ugccccgccuccccgaaa

SEQ ID NO: 450422 - RNA, 15 nt, Homo sapiens
ugccccgucaccauc

SEQ ID NO: 450423 - RNA, 19 nt, Homo sapiens
ugccccgugcagacuggag

SEQ ID NO: 450424 - RNA, 16 nt, Homo sapiens
ugccccguuucuugcc

SEQ ID NO: 450425 - RNA, 13 nt, Homo sapiens
ugccccuccgucc

SEQ ID NO: 450426 - RNA, 16 nt, Homo sapiens
ugccccuggccuuuga

SEQ ID NO: 450427 - RNA, 18 nt, Homo sapiens
ugccccuuccacuuugag

SEQ ID NO: 450428 - RNA, 17 nt, Homo sapiens
ugcccgaccccaucuca

SEQ ID NO: 450429 - RNA, 15 nt, Homo sapiens
ugcccgcacagcagc

SEQ ID NO: 450430 - RNA, 14 nt, Homo sapiens
ugcccgcccgggga

SEQ ID NO: 450431 - RNA, 20 nt, Homo sapiens
ugcccggugguuugccaugu

SEQ ID NO: 450432 - RNA, 18 nt, Homo sapiens
ugcccguugccgggccug

SEQ ID NO: 450433 - RNA, 16 nt, Homo sapiens
ugcccucaggggacuu

SEQ ID NO: 450434 - RNA, 22 nt, Homo sapiens
ugcccucccauguugcaugccu

SEQ ID NO: 450435 - RNA, 18 nt, Homo sapiens
ugcccuccguccuggcag

SEQ ID NO: 450436 - RNA, 14 nt, Homo sapiens
ugcccucuccacac

SEQ ID NO: 450437 - RNA, 23 nt, Homo sapiens
ugcccugccaucgccuccaucag

SEQ ID NO: 450438 - RNA, 15 nt, Homo sapiens
ugcccugcucuucag

SEQ ID NO: 450439 - RNA, 13 nt, Homo sapiens
ugcccugggccag

SEQ ID NO: 450440 - RNA, 23 nt, Homo sapiens
ugcccuguuguguauagaugcaa

SEQ ID NO: 450441 - RNA, 16 nt, Homo sapiens
ugccggccgcccagac

SEQ ID NO: 450442 - RNA, 18 nt, Homo sapiens
ugccggucccccaugcca

SEQ ID NO: 450443 - RNA, 13 nt, Homo sapiens
ugccuaaguauuc

SEQ ID NO: 450444 - RNA, 23 nt, Homo sapiens
ugccuagcacucacaugcuggac

SEQ ID NO: 450445 - RNA, 22 nt, Homo sapiens
ugccucacaucagcccugugua

SEQ ID NO: 450446 - RNA, 16 nt, Homo sapiens
ugccucacuuccuaca

SEQ ID NO: 450447 - RNA, 16 nt, Homo sapiens
ugccuccccuguggaa

SEQ ID NO: 450448 - RNA, 19 nt, Homo sapiens
ugccuccugguaacagcua

SEQ ID NO: 450449 - RNA, 17 nt, Homo sapiens
ugccucucgguggccag

SEQ ID NO: 450450 - RNA, 22 nt, Homo sapiens
ugccugagaauuuaauuuuuaa

SEQ ID NO: 450451 - RNA, 15 nt, Homo sapiens
ugccugccucaaagg

SEQ ID NO: 450452 - RNA, 20 nt, Homo sapiens
ugccuggccaggcagaucug

SEQ ID NO: 450453 - RNA, 20 nt, Homo sapiens
ugccuggcgcuuccagcuga

SEQ ID NO: 450454 - RNA, 16 nt, Homo sapiens
ugccuguaacuugaga

SEQ ID NO: 450455 - RNA, 20 nt, Homo sapiens
ugccugugguuaacaucuca

SEQ ID NO: 450456 - RNA, 17 nt, Homo sapiens
ugccuuaggaagugacu

SEQ ID NO: 450457 - RNA, 14 nt, Homo sapiens
ugccuuaucuugca

SEQ ID NO: 450458 - RNA, 20 nt, Homo sapiens
ugccuucaucuucacugcaa

SEQ ID NO: 450459 - RNA, 22 nt, Homo sapiens
ugccuuccaggcagacacagcu

SEQ ID NO: 450460 - RNA, 20 nt, Homo sapiens
ugccuucuuauugcuuuuau

SEQ ID NO: 450461 - RNA, 18 nt, Homo sapiens
ugccuugcugcaccugag

SEQ ID NO: 450462 - RNA, 18 nt, Homo sapiens
ugccuuuaaaucugugau

SEQ ID NO: 450463 - RNA, 13 nt, Homo sapiens
ugccuuucuucca

SEQ ID NO: 450464 - RNA, 16 nt, Homo sapiens
ugccuuugauguggau

SEQ ID NO: 450465 - RNA, 18 nt, Homo sapiens
ugcgaaaguaaaaacacu

SEQ ID NO: 450466 - RNA, 13 nt, Homo sapiens
ugcgacugaugaa

SEQ ID NO: 450467 - RNA, 16 nt, Homo sapiens
ugaccuguuauuacca

SEQ ID NO: 450468 - RNA, 23 nt, Homo sapiens
ugaccuguuauuaccauuagcau

SEQ ID NO: 450469 - RNA, 21 nt, Homo sapiens
ugaccuugaugucuugagagc

SEQ ID NO: 450470 - RNA, 20 nt, Homo sapiens
ugaccuuggaggaaugacaa

SEQ ID NO: 450471 - RNA, 19 nt, Homo sapiens
ugaccuuggcugacugggg

SEQ ID NO: 450472 - RNA, 18 nt, Homo sapiens
ugaccuuggguauuugca

SEQ ID NO: 450473 - RNA, 12 nt, Homo sapiens
ugaccuuuccag

SEQ ID NO: 450474 - RNA, 15 nt, Homo sapiens
ugacgacaagugcug

SEQ ID NO: 450475 - RNA, 14 nt, Homo sapiens
ugacgcaaaaccac

SEQ ID NO: 450476 - RNA, 21 nt, Homo sapiens
ugacggcgcccccagugugca

SEQ ID NO: 450477 - RNA, 17 nt, Homo sapiens
ugacuaauucacaaaaa

SEQ ID NO: 450478 - RNA, 13 nt, Homo sapiens
ugacuaguacaaa

SEQ ID NO: 450479 - RNA, 15 nt, Homo sapiens
ugacuauucuugaug

SEQ ID NO: 450480 - RNA, 19 nt, Homo sapiens
ugacucaacauguuacuga

SEQ ID NO: 450481 - RNA, 19 nt, Homo sapiens
ugacucaacgagagcacuu

SEQ ID NO: 450482 - RNA, 17 nt, Homo sapiens
ugacucuaaaugcaguu

SEQ ID NO: 450483 - RNA, 21 nt, Homo sapiens
ugacugauccugaacaagaaa

SEQ ID NO: 450484 - RNA, 14 nt, Homo sapiens
ugacugccacccac

SEQ ID NO: 450485 - RNA, 12 nt, Homo sapiens
ugacugcugcuc

SEQ ID NO: 450486 - RNA, 10 nt, Homo sapiens
ugacugggaa

SEQ ID NO: 450487 - RNA, 22 nt, Homo sapiens
ugacuguugcuguaaaagugaa

SEQ ID NO: 450488 - RNA, 15 nt, Homo sapiens
ugacuuaagcacacu

SEQ ID NO: 450489 - RNA, 23 nt, Homo sapiens
ugacuuaagcacacuugacauca

SEQ ID NO: 450490 - RNA, 21 nt, Homo sapiens
ugacuucuuuugaguuagguu

SEQ ID NO: 450491 - RNA, 17 nt, Homo sapiens
ugacuugugucccauga

SEQ ID NO: 450492 - RNA, 23 nt, Homo sapiens
ugacuuugaacacaucucuuagu

SEQ ID NO: 450493 - RNA, 18 nt, Homo sapiens
ugacuuuuuaaaauauaa

SEQ ID NO: 450494 - RNA, 17 nt, Homo sapiens
ugacuuuuucagaguug

SEQ ID NO: 450495 - RNA, 14 nt, Homo sapiens
ugagaaaggauuaa

SEQ ID NO: 450496 - RNA, 15 nt, Homo sapiens
ugagaaaucucaucc

SEQ ID NO: 450497 - RNA, 12 nt, Homo sapiens
ugagaaaugggg

SEQ ID NO: 450498 - RNA, 21 nt, Homo sapiens
ugagaacaagucacagcugca

SEQ ID NO: 450499 - RNA, 21 nt, Homo sapiens
ugagaacugguucuugccuuc

SEQ ID NO: 450500 - RNA, 14 nt, Homo sapiens
ugagaagaacacau

SEQ ID NO: 450501 - RNA, 19 nt, Homo sapiens
ugagaagaacacaucaggc

SEQ ID NO: 450502 - RNA, 17 nt, Homo sapiens
ugagaagaggcugcugc

SEQ ID NO: 450503 - RNA, 19 nt, Homo sapiens
ugagaaggcuaaagaagac

SEQ ID NO: 450504 - RNA, 16 nt, Homo sapiens
ugagaauaaagcauuu

SEQ ID NO: 450505 - RNA, 21 nt, Homo sapiens
ugagaaucgaccucacuguca

SEQ ID NO: 450506 - RNA, 17 nt, Homo sapiens
ugagaaugucauuugcu

SEQ ID NO: 450507 - RNA, 20 nt, Homo sapiens
ugagacagccggaucuugga

SEQ ID NO: 450508 - RNA, 23 nt, Homo sapiens
ugagacaggagaccuggcacugg

SEQ ID NO: 450509 - RNA, 21 nt, Homo sapiens
ugagacagugggggugccugg

SEQ ID NO: 450510 - RNA, 19 nt, Homo sapiens
ugagacgaggcaggggcuc

SEQ ID NO: 450511 - RNA, 17 nt, Homo sapiens
ugagacggagucuugcu

SEQ ID NO: 450512 - RNA, 18 nt, Homo sapiens
ugagacuccugauugcuc

SEQ ID NO: 450513 - RNA, 15 nt, Homo sapiens
ugagagacaggacua

SEQ ID NO: 450514 - RNA, 19 nt, Homo sapiens
ugagagacaggacuagcug

SEQ ID NO: 450515 - RNA, 23 nt, Homo sapiens
ugagaggaugaauguaugugcac

SEQ ID NO: 450516 - RNA, 12 nt, Homo sapiens
ugagaguauuua

SEQ ID NO: 450517 - RNA, 23 nt, Homo sapiens
ugagauuucucauugaucacaga

SEQ ID NO: 450518 - RNA, 22 nt, Homo sapiens
ugagcaaaaugcugcuuucugc

SEQ ID NO: 450519 - RNA, 14 nt, Homo sapiens
ugagcaaaggugau

SEQ ID NO: 450520 - RNA, 13 nt, Homo sapiens
ugagcaaauggaa

SEQ ID NO: 450521 - RNA, 14 nt, Homo sapiens
ugagcaagucccau

SEQ ID NO: 450522 - RNA, 22 nt, Homo sapiens
ugagcaauccugcaagaacaag

SEQ ID NO: 450523 - RNA, 17 nt, Homo sapiens
ugagcaaugugcacuuc

SEQ ID NO: 450524 - RNA, 23 nt, Homo sapiens
ugagcacugagggucuggugcca

SEQ ID NO: 450525 - RNA, 22 nt, Homo sapiens
ugagcagaacccagacccugag

SEQ ID NO: 450526 - RNA, 16 nt, Homo sapiens
ugagcagcaacugugu

SEQ ID NO: 450527 - RNA, 19 nt, Homo sapiens
ugagcagccuccacugugu

SEQ ID NO: 450528 - RNA, 15 nt, Homo sapiens
ugcaaucuucuacuu

SEQ ID NO: 450529 - RNA, 18 nt, Homo sapiens
ugcaaugacacagucuug

SEQ ID NO: 450530 - RNA, 12 nt, Homo sapiens
ugcaaugucaca

SEQ ID NO: 450531 - RNA, 21 nt, Homo sapiens
ugcaauguuccguucaucuga

SEQ ID NO: 450532 - RNA, 22 nt, Homo sapiens
ugcaauuucucccgaauccuga

SEQ ID NO: 450533 - RNA, 21 nt, Homo sapiens
ugcacaaaagggacuuggaaa

SEQ ID NO: 450534 - RNA, 19 nt, Homo sapiens
ugcacaaaagucucaaugu

SEQ ID NO: 450535 - RNA, 14 nt, Homo sapiens
ugcacaaacuccau

SEQ ID NO: 450536 - RNA, 19 nt, Homo sapiens
ugcacaacucuccaaaaca

SEQ ID NO: 450537 - RNA, 17 nt, Homo sapiens
ugcacacauuaggcauu

SEQ ID NO: 450538 - RNA, 16 nt, Homo sapiens
ugcacacucacuugua

SEQ ID NO: 450539 - RNA, 17 nt, Homo sapiens
ugcacagcuaacaugga

SEQ ID NO: 450540 - RNA, 19 nt, Homo sapiens
ugcacaggaugggggcaau

SEQ ID NO: 450541 - RNA, 16 nt, Homo sapiens
ugcacaguagagcaaa

SEQ ID NO: 450542 - RNA, 15 nt, Homo sapiens
ugcacaguuugcaau

SEQ ID NO: 450543 - RNA, 22 nt, Homo sapiens
ugcacauauauuuuuuacaaac

SEQ ID NO: 450544 - RNA, 20 nt, Homo sapiens
ugcacauucucccuugauuc

SEQ ID NO: 450545 - RNA, 18 nt, Homo sapiens
ugcacauuugucacugaa

SEQ ID NO: 450546 - RNA, 23 nt, Homo sapiens
ugcaccauucuuucuuggugcau

SEQ ID NO: 450547 - RNA, 15 nt, Homo sapiens
ugcacccacccagga

SEQ ID NO: 450548 - RNA, 18 nt, Homo sapiens
ugcaccccaccagcaaua

SEQ ID NO: 450549 - RNA, 17 nt, Homo sapiens
ugcaccccagcauucca

SEQ ID NO: 450550 - RNA, 14 nt, Homo sapiens
ugcaccccaugugg

SEQ ID NO: 450551 - RNA, 20 nt, Homo sapiens
ugcaccuuaccaacuuucug

SEQ ID NO: 450552 - RNA, 17 nt, Homo sapiens
ugcacgucaccaaguaa

SEQ ID NO: 450553 - RNA, 14 nt, Homo sapiens
ugcacuaaaaguga

SEQ ID NO: 450554 - RNA, 15 nt, Homo sapiens
ugcacuauagccauu

SEQ ID NO: 450555 - RNA, 14 nt, Homo sapiens
ugcacuccaugagu

SEQ ID NO: 450556 - RNA, 11 nt, Homo sapiens
ugcacugcugu

SEQ ID NO: 450557 - RNA, 20 nt, Homo sapiens
ugcacuguaaaaugugggau

SEQ ID NO: 450558 - RNA, 15 nt, Homo sapiens
ugcacuguagccuua

SEQ ID NO: 450559 - RNA, 16 nt, Homo sapiens
ugcacugucacuuugc

SEQ ID NO: 450560 - RNA, 23 nt, Homo sapiens
ugcacuugcacgcccauguguga

SEQ ID NO: 450561 - RNA, 21 nt, Homo sapiens
ugcacuuugugaguauucuau

SEQ ID NO: 450562 - RNA, 17 nt, Homo sapiens
ugcagaaacaguucacc

SEQ ID NO: 450563 - RNA, 21 nt, Homo sapiens
ugcagaaagaccgugugugaa

SEQ ID NO: 450564 - RNA, 17 nt, Homo sapiens
ugcagaaauugaccuga

SEQ ID NO: 450565 - RNA, 21 nt, Homo sapiens
ugcagaauacaguaagcugcu

SEQ ID NO: 450566 - RNA, 23 nt, Homo sapiens
ugcagacaggccaugugagccac

SEQ ID NO: 450567 - RNA, 14 nt, Homo sapiens
ugcagagcaggaaa

SEQ ID NO: 450568 - RNA, 17 nt, Homo sapiens
ugcagagcaggaaauga

SEQ ID NO: 450569 - RNA, 14 nt, Homo sapiens
ugcagauaucacag

SEQ ID NO: 450570 - RNA, 17 nt, Homo sapiens
ugcagaucugugcucau

SEQ ID NO: 450571 - RNA, 14 nt, Homo sapiens
ugcagcacucuuau

SEQ ID NO: 450572 - RNA, 13 nt, Homo sapiens
ugcagcagagccu

SEQ ID NO: 450573 - RNA, 14 nt, Homo sapiens
ugcagcccaugccc

SEQ ID NO: 450574 - RNA, 16 nt, Homo sapiens
ugcagcuaagcucaaa

SEQ ID NO: 450575 - RNA, 17 nt, Homo sapiens
ugcagcuaugcuggaaa

SEQ ID NO: 450576 - RNA, 13 nt, Homo sapiens
ugcagcuauucac

SEQ ID NO: 450577 - RNA, 14 nt, Homo sapiens
ugcagcuauucaca

SEQ ID NO: 450578 - RNA, 17 nt, Homo sapiens
ugcagcugggauuugaa

SEQ ID NO: 450579 - RNA, 21 nt, Homo sapiens
ugcaggcccaccccagccacc

SEQ ID NO: 450580 - RNA, 21 nt, Homo sapiens
ugcaggcugcagucccuggaa

SEQ ID NO: 450581 - RNA, 14 nt, Homo sapiens
ugcagggacugcca

SEQ ID NO: 450582 - RNA, 14 nt, Homo sapiens
ugcaggguaggggg

SEQ ID NO: 450583 - RNA, 20 nt, Homo sapiens
ugcagguuguugucaucuga

SEQ ID NO: 450584 - RNA, 21 nt, Homo sapiens
ugcaguaaaguuccaugaaga

SEQ ID NO: 450585 - RNA, 19 nt, Homo sapiens
ugcaguacaagaaccucuc

SEQ ID NO: 450586 - RNA, 19 nt, Homo sapiens
ugcaguagagagcaaagau

SEQ ID NO: 450587 - RNA, 14 nt, Homo sapiens
ugcaguagugucac

SEQ ID NO: 450588 - RNA, 15 nt, Homo sapiens
ugcagucaucuacuu

SEQ ID NO: 450589 - RNA, 22 nt, Homo sapiens
ugcagucauuaugagaggcaau

SEQ ID NO: 450590 - RNA, 17 nt, Homo sapiens
ugcaguggcaccaucuc

SEQ ID NO: 450591 - RNA, 18 nt, Homo sapiens
ugcaguucagcaccaccc

SEQ ID NO: 450592 - RNA, 18 nt, Homo sapiens
ugcaguuccugaguaccu

SEQ ID NO: 450593 - RNA, 18 nt, Homo sapiens
ugcaguuuccucaucugu

SEQ ID NO: 450594 - RNA, 21 nt, Homo sapiens
ugcaguuuccucaucugucac

SEQ ID NO: 450595 - RNA, 21 nt, Homo sapiens
ugcauaaaagacaagcacuuu

SEQ ID NO: 450596 - RNA, 21 nt, Homo sapiens
ugcauaaacaauccaaaugca

SEQ ID NO: 450597 - RNA, 14 nt, Homo sapiens
ugcauaauaagcua

SEQ ID NO: 450598 - RNA, 17 nt, Homo sapiens
uauuaauuucuucacac

SEQ ID NO: 450599 - RNA, 19 nt, Homo sapiens
uauuacaaguugugcaugc

SEQ ID NO: 450600 - RNA, 13 nt, Homo sapiens
uauuacaucuuua

SEQ ID NO: 450601 - RNA, 13 nt, Homo sapiens
uauuaccuauuca

SEQ ID NO: 450602 - RNA, 14 nt, Homo sapiens
uauuacuaguacua

SEQ ID NO: 450603 - RNA, 18 nt, Homo sapiens
uauuacuaguacuauuac

SEQ ID NO: 450604 - RNA, 24 nt, Homo sapiens
uauuagcuguaaauacaugugugg

SEQ ID NO: 450605 - RNA, 14 nt, Homo sapiens
uauuauacaaauac

SEQ ID NO: 450606 - RNA, 12 nt, Homo sapiens
uauuauaguauu

SEQ ID NO: 450607 - RNA, 15 nt, Homo sapiens
uauuauaucauuaac

SEQ ID NO: 450608 - RNA, 15 nt, Homo sapiens
uauuauguagcugaa

SEQ ID NO: 450609 - RNA, 17 nt, Homo sapiens
uauuauucuucauaaca

SEQ ID NO: 450610 - RNA, 18 nt, Homo sapiens
uauuauucuucauaacaa

SEQ ID NO: 450611 - RNA, 19 nt, Homo sapiens
uauuauugaagauuuacca

SEQ ID NO: 450612 - RNA, 18 nt, Homo sapiens
uauuauuucuuacucaaa

SEQ ID NO: 450613 - RNA, 21 nt, Homo sapiens
uauucaacagcucaccaacua

SEQ ID NO: 450614 - RNA, 13 nt, Homo sapiens
uauucaaguauua

SEQ ID NO: 450615 - RNA, 20 nt, Homo sapiens
uauucagaacuuguaacuaa

SEQ ID NO: 450616 - RNA, 13 nt, Homo sapiens
uauucagcccacu

SEQ ID NO: 450617 - RNA, 20 nt, Homo sapiens
uauucaggaccccaucugcu

SEQ ID NO: 450618 - RNA, 17 nt, Homo sapiens
uauuccauuuuuacuaa

SEQ ID NO: 450619 - RNA, 14 nt, Homo sapiens
uauucccagccuug

SEQ ID NO: 450620 - RNA, 21 nt, Homo sapiens
uauucccaugguagacuguga

SEQ ID NO: 450621 - RNA, 14 nt, Homo sapiens
uauucccuguuaaa

SEQ ID NO: 450622 - RNA, 20 nt, Homo sapiens
uauuccuaggcaacuauuaa

SEQ ID NO: 450623 - RNA, 21 nt, Homo sapiens
uauuccuguuucugaaccauu

SEQ ID NO: 450624 - RNA, 16 nt, Homo sapiens
uauucucugcaauuug

SEQ ID NO: 450625 - RNA, 21 nt, Homo sapiens
uauucucuuaugauacuugag

SEQ ID NO: 450626 - RNA, 13 nt, Homo sapiens
uauucugauaaug

SEQ ID NO: 450627 - RNA, 21 nt, Homo sapiens
uauucuuccuugagcuaagca

SEQ ID NO: 450628 - RNA, 12 nt, Homo sapiens
uauucuugucaa

SEQ ID NO: 450629 - RNA, 14 nt, Homo sapiens
uauugaaucuuaau

SEQ ID NO: 450630 - RNA, 18 nt, Homo sapiens
uauugaaugaugugauac

SEQ ID NO: 450631 - RNA, 18 nt, Homo sapiens
uauugagacacugucaag

SEQ ID NO: 450632 - RNA, 16 nt, Homo sapiens
uauugaucuuugccca

SEQ ID NO: 450633 - RNA, 23 nt, Homo sapiens
uauugguuuuaaaaaagcauuau

SEQ ID NO: 450634 - RNA, 20 nt, Homo sapiens
uauuguaaaugagugccaca

SEQ ID NO: 450635 - RNA, 23 nt, Homo sapiens
uauuguacauugggcacauaucu

SEQ ID NO: 450636 - RNA, 15 nt, Homo sapiens
uauuguauaaacuau

SEQ ID NO: 450637 - RNA, 12 nt, Homo sapiens
uauuguaucugu

SEQ ID NO: 450638 - RNA, 17 nt, Homo sapiens
uauuguuccaagacauu

SEQ ID NO: 450639 - RNA, 13 nt, Homo sapiens
uauuuaaacaauu

SEQ ID NO: 450640 - RNA, 23 nt, Homo sapiens
uauuuaaaucauuuuaacuucua

SEQ ID NO: 450641 - RNA, 18 nt, Homo sapiens
uauuuagauauaacacua

SEQ ID NO: 450642 - RNA, 17 nt, Homo sapiens
uauuuaggcaugagcuc

SEQ ID NO: 450643 - RNA, 15 nt, Homo sapiens
uauuuagugaacuac

SEQ ID NO: 450644 - RNA, 12 nt, Homo sapiens
uauuuagugauu

SEQ ID NO: 450645 - RNA, 13 nt, Homo sapiens
uauuuauaacuca

SEQ ID NO: 450646 - RNA, 15 nt, Homo sapiens
uauuuaucacauagc

SEQ ID NO: 450647 - RNA, 14 nt, Homo sapiens
uauuuaugccucug

SEQ ID NO: 450648 - RNA, 17 nt, Homo sapiens
uauuuaugccucuguau

SEQ ID NO: 450649 - RNA, 20 nt, Homo sapiens
uauuucacuuaaacuuuguc

SEQ ID NO: 450650 - RNA, 19 nt, Homo sapiens
uauuuccaguuuuuugcca

SEQ ID NO: 450651 - RNA, 17 nt, Homo sapiens
uauuuccaucuaggacu

SEQ ID NO: 450652 - RNA, 16 nt, Homo sapiens
uauuuccccuuuccaa

SEQ ID NO: 450653 - RNA, 15 nt, Homo sapiens
uauuucuaaguauuu

SEQ ID NO: 450654 - RNA, 23 nt, Homo sapiens
uauuugacauucuucacugucug

SEQ ID NO: 450655 - RNA, 23 nt, Homo sapiens
uauuugagagagagaaccuuucc

SEQ ID NO: 450656 - RNA, 17 nt, Homo sapiens
uauuuggcaauucacaa

SEQ ID NO: 450657 - RNA, 14 nt, Homo sapiens
uauuuggguacaug

SEQ ID NO: 450658 - RNA, 16 nt, Homo sapiens
uauuuguaaauuuugg

SEQ ID NO: 450659 - RNA, 22 nt, Homo sapiens
uauuuuaaagcuuggugcuaaa

SEQ ID NO: 450660 - RNA, 14 nt, Homo sapiens
uauuuuacacagca

SEQ ID NO: 450661 - RNA, 14 nt, Homo sapiens
uauuuugacuguga

SEQ ID NO: 450662 - RNA, 22 nt, Homo sapiens
uauuuugcauaguaccaaucau

SEQ ID NO: 450663 - RNA, 11 nt, Homo sapiens
uauuuugccac

SEQ ID NO: 450664 - RNA, 22 nt, Homo sapiens
uauuuugcugcacacaaucuag

SEQ ID NO: 450665 - RNA, 13 nt, Homo sapiens
uauuuugguucuu

SEQ ID NO: 450666 - RNA, 16 nt, Homo sapiens
uauuuuuaagacuuuu

SEQ ID NO: 450667 - RNA, 12 nt, Homo sapiens
uauuuuuacuaa

SEQ ID NO: 450668 - RNA, 23 nt, Homo sapiens
uauuuuucaaagauguguugcua

SEQ ID NO: 450669 - RNA, 22 nt, Homo sapiens
uauuuuuguuucuuccaaagca

SEQ ID NO: 450670 - RNA, 18 nt, Homo sapiens
uauuuuuucccuccugac

SEQ ID NO: 450671 - RNA, 13 nt, Homo sapiens
agcugggauuuga

SEQ ID NO: 450672 - RNA, 15 nt, Homo sapiens
agcugggauuugaac

SEQ ID NO: 450673 - RNA, 18 nt, Homo sapiens
agcugggccccaccuacu

SEQ ID NO: 450674 - RNA, 20 nt, Homo sapiens
agcugggccccaugcucugc

SEQ ID NO: 450675 - RNA, 20 nt, Homo sapiens
agcugguggauggugacuuu

SEQ ID NO: 450676 - RNA, 15 nt, Homo sapiens
agcugguggcaauaa

SEQ ID NO: 450677 - RNA, 22 nt, Homo sapiens
agcugucuuagagugggaccaa

SEQ ID NO: 450678 - RNA, 14 nt, Homo sapiens
agcuguuuccauag

SEQ ID NO: 450679 - RNA, 23 nt, Homo sapiens
agcuguuuuggaugaaugcagua

SEQ ID NO: 450680 - RNA, 12 nt, Homo sapiens
agcuuacaggaa

SEQ ID NO: 450681 - RNA, 17 nt, Homo sapiens
agcuuauuacucugaua

SEQ ID NO: 450682 - RNA, 14 nt, Homo sapiens
agcuucaccagagc

SEQ ID NO: 450683 - RNA, 12 nt, Homo sapiens
agcuucagggcu

SEQ ID NO: 450684 - RNA, 14 nt, Homo sapiens
agcuuccauguuua

SEQ ID NO: 450685 - RNA, 23 nt, Homo sapiens
agcuuccauguuuaauguuaucc

SEQ ID NO: 450686 - RNA, 17 nt, Homo sapiens
agcuucccaagcagcug

SEQ ID NO: 450687 - RNA, 12 nt, Homo sapiens
agcuuccuccag

SEQ ID NO: 450688 - RNA, 22 nt, Homo sapiens
agcuucuuuacuacugcaaguu

SEQ ID NO: 450689 - RNA, 22 nt, Homo sapiens
agcuugagcuccccuggagcca

SEQ ID NO: 450690 - RNA, 13 nt, Homo sapiens
agcuugaugccuc

SEQ ID NO: 450691 - RNA, 14 nt, Homo sapiens
agcuugauugcuca

SEQ ID NO: 450692 - RNA, 22 nt, Homo sapiens
agcuuuauuuuuuaaguauuua

SEQ ID NO: 450693 - RNA, 12 nt, Homo sapiens
agcuuucugucc

SEQ ID NO: 450694 - RNA, 19 nt, Homo sapiens
agcuuucuucuacaaccag

SEQ ID NO: 450695 - RNA, 13 nt, Homo sapiens
aggaaaaaaccau

SEQ ID NO: 450696 - RNA, 20 nt, Homo sapiens
aggaaaaguaaggugcaguu

SEQ ID NO: 450697 - RNA, 20 nt, Homo sapiens
aggaaaauauugacaaguuu

SEQ ID NO: 450698 - RNA, 16 nt, Homo sapiens
aggaaaaugauacgca

SEQ ID NO: 450699 - RNA, 19 nt, Homo sapiens
aggaaaccacccugagggu

SEQ ID NO: 450700 - RNA, 16 nt, Homo sapiens
aggaaacugcacuguu

SEQ ID NO: 450701 - RNA, 13 nt, Homo sapiens
aggaaagcaauaa

SEQ ID NO: 450702 - RNA, 18 nt, Homo sapiens
aggaaaggggcgagcacc

SEQ ID NO: 450703 - RNA, 14 nt, Homo sapiens
aggaaauaucauaa

SEQ ID NO: 450704 - RNA, 13 nt, Homo sapiens
aggaacaaagaca

SEQ ID NO: 450705 - RNA, 16 nt, Homo sapiens
caggacucugccccuu

SEQ ID NO: 450706 - RNA, 13 nt, Homo sapiens
caggacugugcaa

SEQ ID NO: 450707 - RNA, 22 nt, Homo sapiens
caggacuuucauuguucuuggc

SEQ ID NO: 450708 - RNA, 19 nt, Homo sapiens
caggagaccuggcacugga

SEQ ID NO: 450709 - RNA, 14 nt, Homo sapiens
caggagaccuucca

SEQ ID NO: 450710 - RNA, 19 nt, Homo sapiens
caggagagacagugaggcu

SEQ ID NO: 450711 - RNA, 14 nt, Homo sapiens
caggagcaauggga

SEQ ID NO: 450712 - RNA, 17 nt, Homo sapiens
caggagcagcugugcug

SEQ ID NO: 450713 - RNA, 15 nt, Homo sapiens
caggaggcaagcaag

SEQ ID NO: 450714 - RNA, 20 nt, Homo sapiens
caggaggcccccaucuauga

SEQ ID NO: 450715 - RNA, 22 nt, Homo sapiens
caggaggcuuuaagcuccagcu

SEQ ID NO: 450716 - RNA, 18 nt, Homo sapiens
caggaggggcuguccaau

SEQ ID NO: 450717 - RNA, 17 nt, Homo sapiens
caggaggugcuaucgca

SEQ ID NO: 450718 - RNA, 17 nt, Homo sapiens
caggaguaccuggaccu

SEQ ID NO: 450719 - RNA, 20 nt, Homo sapiens
caggaguaucuuaccuguaa

SEQ ID NO: 450720 - RNA, 17 nt, Homo sapiens
caggagucucugccacc

SEQ ID NO: 450721 - RNA, 17 nt, Homo sapiens
caggaguggaaggugag

SEQ ID NO: 450722 - RNA, 17 nt, Homo sapiens
caggagugguggaaccu

SEQ ID NO: 450723 - RNA, 21 nt, Homo sapiens
caggauccccugcuacuccac

SEQ ID NO: 450724 - RNA, 18 nt, Homo sapiens
caggaugauuguacagaa

SEQ ID NO: 450725 - RNA, 18 nt, Homo sapiens
caggauguguggcucauu

SEQ ID NO: 450726 - RNA, 23 nt, Homo sapiens
caggauuccaguugcgugucugu

SEQ ID NO: 450727 - RNA, 20 nt, Homo sapiens
caggauugaggaugaacuca

SEQ ID NO: 450728 - RNA, 16 nt, Homo sapiens
caggcacuaagacuaa

SEQ ID NO: 450729 - RNA, 15 nt, Homo sapiens
caggcacugccugga

SEQ ID NO: 450730 - RNA, 15 nt, Homo sapiens
caggcacugcugccc

SEQ ID NO: 450731 - RNA, 16 nt, Homo sapiens
caggcagaucugugcc

SEQ ID NO: 450732 - RNA, 18 nt, Homo sapiens
caggcagcgauggucuca

SEQ ID NO: 450733 - RNA, 16 nt, Homo sapiens
caggcaggcaccuggg

SEQ ID NO: 450734 - RNA, 22 nt, Homo sapiens
caggcaucuguaagaaguagag

SEQ ID NO: 450735 - RNA, 21 nt, Homo sapiens
caggcaucuucccuucacuca

SEQ ID NO: 450736 - RNA, 15 nt, Homo sapiens
caggccacaaaugug

SEQ ID NO: 450737 - RNA, 13 nt, Homo sapiens
caggccacugacc

SEQ ID NO: 450738 - RNA, 18 nt, Homo sapiens
caggccacugaccuccca

SEQ ID NO: 450739 - RNA, 15 nt, Homo sapiens
caggccacuugcuca

SEQ ID NO: 450740 - RNA, 14 nt, Homo sapiens
caggccagcuccuu

SEQ ID NO: 450741 - RNA, 14 nt, Homo sapiens
caggccaggccuca

SEQ ID NO: 450742 - RNA, 15 nt, Homo sapiens
caggccauggaggca

SEQ ID NO: 450743 - RNA, 21 nt, Homo sapiens
caggcccuuccucuccacugc

SEQ ID NO: 450744 - RNA, 17 nt, Homo sapiens
caggccgggguggagca

SEQ ID NO: 450745 - RNA, 16 nt, Homo sapiens
caggcucacagagauu

SEQ ID NO: 450746 - RNA, 16 nt, Homo sapiens
caggcuccaggccuca

SEQ ID NO: 450747 - RNA, 13 nt, Homo sapiens
caggcucugcuga

SEQ ID NO: 450748 - RNA, 20 nt, Homo sapiens
caggcuggagggcaguggca

SEQ ID NO: 450749 - RNA, 20 nt, Homo sapiens
caggcuggagugcaaugaca

SEQ ID NO: 450750 - RNA, 16 nt, Homo sapiens
caggcuggagugcagu

SEQ ID NO: 450751 - RNA, 18 nt, Homo sapiens
caggcuggucucgaacuc

SEQ ID NO: 450752 - RNA, 22 nt, Homo sapiens
caggcuguaagcauucugagcu

SEQ ID NO: 450753 - RNA, 14 nt, Homo sapiens
caggcugugggccu

SEQ ID NO: 450754 - RNA, 14 nt, Homo sapiens
caggcuuaugaaua

SEQ ID NO: 450755 - RNA, 22 nt, Homo sapiens
caggcuucccaaaccaagugcc

SEQ ID NO: 450756 - RNA, 22 nt, Homo sapiens
cagggaagcaucugucuuguca

SEQ ID NO: 450757 - RNA, 20 nt, Homo sapiens
cagggaagccccacuugaag

SEQ ID NO: 450758 - RNA, 14 nt, Homo sapiens
cagggaagguaauu

SEQ ID NO: 450759 - RNA, 16 nt, Homo sapiens
cagggaauugauucaa

SEQ ID NO: 450760 - RNA, 17 nt, Homo sapiens
cagggaucauagcugac

SEQ ID NO: 450761 - RNA, 21 nt, Homo sapiens
cagggaucauagcugacucag

SEQ ID NO: 450762 - RNA, 13 nt, Homo sapiens
cagggaugccaac

SEQ ID NO: 450763 - RNA, 14 nt, Homo sapiens
cagggauggggcca

SEQ ID NO: 450764 - RNA, 18 nt, Homo sapiens
cagggauuaaccucugca

SEQ ID NO: 450765 - RNA, 21 nt, Homo sapiens
cagggauuaaccucugcacua

SEQ ID NO: 450766 - RNA, 23 nt, Homo sapiens
cagggccuggccugguccaggcu

SEQ ID NO: 450767 - RNA, 17 nt, Homo sapiens
caggggacacugaaccu

SEQ ID NO: 450768 - RNA, 20 nt, Homo sapiens
caggggcagcagcaucucag

SEQ ID NO: 450769 - RNA, 23 nt, Homo sapiens
caggggcaucucugggcugagcc

SEQ ID NO: 450770 - RNA, 13 nt, Homo sapiens
caggggcugcauc

SEQ ID NO: 450771 - RNA, 23 nt, Homo sapiens
cagggggguuggguuccagacag

SEQ ID NO: 450772 - RNA, 19 nt, Homo sapiens
caggguaucccagaccccu

SEQ ID NO: 450773 - RNA, 22 nt, Homo sapiens
cagggucaaacuacauugagcc

SEQ ID NO: 450774 - RNA, 15 nt, Homo sapiens
caggguccugugccu

SEQ ID NO: 450775 - RNA, 16 nt, Homo sapiens
cagggucugcucuuuc

SEQ ID NO: 450776 - RNA, 15 nt, Homo sapiens
cagggugcaguguga

SEQ ID NO: 450777 - RNA, 19 nt, Homo sapiens
caggguggucuugaucucc

SEQ ID NO: 450778 - RNA, 21 nt, Homo sapiens
cagguaauccgccugccuugg

SEQ ID NO: 450779 - RNA, 13 nt, Homo sapiens
cagguaaugugaa

SEQ ID NO: 450780 - RNA, 13 nt, Homo sapiens
cagguaguacugg

SEQ ID NO: 450781 - RNA, 15 nt, Homo sapiens
cagguaugcaaauau

SEQ ID NO: 450782 - RNA, 19 nt, Homo sapiens
caggucauuauuuuuuaca

SEQ ID NO: 450783 - RNA, 13 nt, Homo sapiens
caggucccagugc

SEQ ID NO: 450784 - RNA, 14 nt, Homo sapiens
caggucucacugcu

SEQ ID NO: 450785 - RNA, 20 nt, Homo sapiens
caggugaaaauccaucucau

SEQ ID NO: 450786 - RNA, 17 nt, Homo sapiens
caggugaucuaccugcc

SEQ ID NO: 450787 - RNA, 19 nt, Homo sapiens
caggugauguccuguaaac

SEQ ID NO: 450788 - RNA, 13 nt, Homo sapiens
caggugcacagac

SEQ ID NO: 450789 - RNA, 20 nt, Homo sapiens
caggugccagaauccucuca

SEQ ID NO: 450790 - RNA, 17 nt, Homo sapiens
caggugccucaagagaa

SEQ ID NO: 450791 - RNA, 18 nt, Homo sapiens
cagguguugggaccugcu

SEQ ID NO: 450792 - RNA, 23 nt, Homo sapiens
cagguuccauccaccaccuugcc

SEQ ID NO: 450793 - RNA, 17 nt, Homo sapiens
cagguuccaucccgaaa

SEQ ID NO: 450794 - RNA, 15 nt, Homo sapiens
cagguugcagcugcu

SEQ ID NO: 450795 - RNA, 18 nt, Homo sapiens
cagguuguugucaucuga

SEQ ID NO: 450796 - RNA, 16 nt, Homo sapiens
cagguuuagacaguau

SEQ ID NO: 450797 - RNA, 17 nt, Homo sapiens
cagguuuauccagauga

SEQ ID NO: 450798 - RNA, 14 nt, Homo sapiens
caguaaaaucuugc

SEQ ID NO: 450799 - RNA, 12 nt, Homo sapiens
caguaaauccaa

SEQ ID NO: 450800 - RNA, 16 nt, Homo sapiens
caguaaaucucacaaa

SEQ ID NO: 450801 - RNA, 19 nt, Homo sapiens
caguaaggcagcucugucg

SEQ ID NO: 450802 - RNA, 19 nt, Homo sapiens
caguaauaaaacaucuuuc

SEQ ID NO: 450803 - RNA, 19 nt, Homo sapiens
caguaaucaguuugcuaac

SEQ ID NO: 450804 - RNA, 13 nt, Homo sapiens
caguacaauguuu

SEQ ID NO: 450805 - RNA, 14 nt, Homo sapiens
caguacucuaguca

SEQ ID NO: 450806 - RNA, 19 nt, Homo sapiens
caguagagcaaaucuauga

SEQ ID NO: 450807 - RNA, 20 nt, Homo sapiens
caguagcuccaacacuuuga

SEQ ID NO: 450808 - RNA, 17 nt, Homo sapiens
caguagggaggucagug

SEQ ID NO: 450809 - RNA, 19 nt, Homo sapiens
caguagggcuuggugaaug

SEQ ID NO: 450810 - RNA, 16 nt, Homo sapiens
caguagguuggcagua

SEQ ID NO: 450811 - RNA, 17 nt, Homo sapiens
caguagucaccucuggg

SEQ ID NO: 450812 - RNA, 13 nt, Homo sapiens
caguauacugugu

SEQ ID NO: 450813 - RNA, 22 nt, Homo sapiens
caguaugagucaaugugcagug

SEQ ID NO: 450814 - RNA, 14 nt, Homo sapiens
caguaugugucuag

SEQ ID NO: 450815 - RNA, 22 nt, Homo sapiens
caguauucucagagcauguguc

SEQ ID NO: 450816 - RNA, 19 nt, Homo sapiens
cagucaaggaguggcuuac

SEQ ID NO: 450817 - RNA, 18 nt, Homo sapiens
cagucacagccauuucaa

SEQ ID NO: 450818 - RNA, 15 nt, Homo sapiens
cagucacugacucaa

SEQ ID NO: 450819 - RNA, 11 nt, Homo sapiens
cagucagggac

SEQ ID NO: 450820 - RNA, 21 nt, Homo sapiens
caguccaguccucacaugccc

SEQ ID NO: 450821 - RNA, 23 nt, Homo sapiens
cagucccuaaagaaaaaaaauca

SEQ ID NO: 450822 - RNA, 21 nt, Homo sapiens
cagucccucccuccuggcuca

SEQ ID NO: 450823 - RNA, 18 nt, Homo sapiens
cagucccuggagcugucc

SEQ ID NO: 450824 - RNA, 14 nt, Homo sapiens
caguccuccagacc

SEQ ID NO: 450825 - RNA, 11 nt, Homo sapiens
cagucugaguc

SEQ ID NO: 450826 - RNA, 13 nt, Homo sapiens
cagucugagucau

SEQ ID NO: 450827 - RNA, 15 nt, Homo sapiens
cagucuggugcccag

SEQ ID NO: 450828 - RNA, 20 nt, Homo sapiens
cagucuggugcccagacuca

SEQ ID NO: 450829 - RNA, 15 nt, Homo sapiens
cagucugucuacugu

SEQ ID NO: 450830 - RNA, 19 nt, Homo sapiens
cagucugucuacuguggug

SEQ ID NO: 450831 - RNA, 15 nt, Homo sapiens
cagugaaagcuuuca

SEQ ID NO: 450832 - RNA, 16 nt, Homo sapiens
cagugagcugagauca

SEQ ID NO: 450833 - RNA, 23 nt, Homo sapiens
cagugaugcugugcuaugaauuu

SEQ ID NO: 450834 - RNA, 17 nt, Homo sapiens
cagugcacccacucugc

SEQ ID NO: 450835 - RNA, 17 nt, Homo sapiens
cacugaagcacgugaga

SEQ ID NO: 450836 - RNA, 22 nt, Homo sapiens
cacugagaagucaaacauuuca

SEQ ID NO: 450837 - RNA, 23 nt, Homo sapiens
cacugagcccuugcacaggccac

SEQ ID NO: 450838 - RNA, 23 nt, Homo sapiens
cacugaguagucauuuugcccau

SEQ ID NO: 450839 - RNA, 18 nt, Homo sapiens
cacugaguuugaacacag

SEQ ID NO: 450840 - RNA, 18 nt, Homo sapiens
cacugauaauauguuuga

SEQ ID NO: 450841 - RNA, 21 nt, Homo sapiens
cacugcaccucuuugucacag

SEQ ID NO: 450842 - RNA, 23 nt, Homo sapiens
cacugcccucuuguggugcauug

SEQ ID NO: 450843 - RNA, 15 nt, Homo sapiens
cacugcgaccacaag

SEQ ID NO: 450844 - RNA, 20 nt, Homo sapiens
cacugcugcuccagugcagg

SEQ ID NO: 450845 - RNA, 23 nt, Homo sapiens
cacugcugggaaguggcuuaaua

SEQ ID NO: 450846 - RNA, 19 nt, Homo sapiens
cacugguuuguuucucaag

SEQ ID NO: 450847 - RNA, 13 nt, Homo sapiens
cacuguagccuua

SEQ ID NO: 450848 - RNA, 16 nt, Homo sapiens
cacuguccaguauucu

SEQ ID NO: 450849 - RNA, 13 nt, Homo sapiens
cacugucccuacc

SEQ ID NO: 450850 - RNA, 21 nt, Homo sapiens
cacugucccuaccacugagcc

SEQ ID NO: 450851 - RNA, 21 nt, Homo sapiens
cacugucuguuguuuaccuac

SEQ ID NO: 450852 - RNA, 12 nt, Homo sapiens
cacugugacuua

SEQ ID NO: 450853 - RNA, 21 nt, Homo sapiens
cacugugucccucucucugga

SEQ ID NO: 450854 - RNA, 12 nt, Homo sapiens
cacuguugcuua

SEQ ID NO: 450855 - RNA, 15 nt, Homo sapiens
cacuguuugccccag

SEQ ID NO: 450856 - RNA, 17 nt, Homo sapiens
cacuuaagacuguguau

SEQ ID NO: 450857 - RNA, 20 nt, Homo sapiens
cacuuaaucuucucucuuga

SEQ ID NO: 450858 - RNA, 17 nt, Homo sapiens
cacuuccuguccagaga

SEQ ID NO: 450859 - RNA, 19 nt, Homo sapiens
cacuucgagcacuguccag

SEQ ID NO: 450860 - RNA, 13 nt, Homo sapiens
cacuugacaucaa

SEQ ID NO: 450861 - RNA, 15 nt, Homo sapiens
cacuugacauuccuu

SEQ ID NO: 450862 - RNA, 18 nt, Homo sapiens
cacuugacuuugccacau

SEQ ID NO: 450863 - RNA, 21 nt, Homo sapiens
cacuugaugccguuucuuuca

SEQ ID NO: 450864 - RNA, 21 nt, Homo sapiens
cacuugccccuguuaccuaau

SEQ ID NO: 450865 - RNA, 19 nt, Homo sapiens
cacuugggauugucuuacu

SEQ ID NO: 450866 - RNA, 22 nt, Homo sapiens
cacuugguuuuuggcucuuuca

SEQ ID NO: 450867 - RNA, 21 nt, Homo sapiens
cacuuguuuuucuuuuuacag

SEQ ID NO: 450868 - RNA, 16 nt, Homo sapiens
cacuuuauaaauauca

SEQ ID NO: 450869 - RNA, 17 nt, Homo sapiens
cacuuucugaaauucac

SEQ ID NO: 450870 - RNA, 16 nt, Homo sapiens
cacuuugauaccauug

SEQ ID NO: 450871 - RNA, 14 nt, Homo sapiens
cacuuugcucuggg

SEQ ID NO: 450872 - RNA, 13 nt, Homo sapiens
cacuuuguuucau

SEQ ID NO: 450873 - RNA, 20 nt, Homo sapiens
cagaaaacaagaugagauug

SEQ ID NO: 450874 - RNA, 21 nt, Homo sapiens
cagaaaauaaucugguguucu

SEQ ID NO: 450875 - RNA, 17 nt, Homo sapiens
cagaaaauaugauauau

SEQ ID NO: 450876 - RNA, 22 nt, Homo sapiens
cagaaaauaugauauauaugua

SEQ ID NO: 450877 - RNA, 22 nt, Homo sapiens
cagaaacagugggagcccugac

SEQ ID NO: 450878 - RNA, 17 nt, Homo sapiens
cagaaacugaacuggcc

SEQ ID NO: 450879 - RNA, 20 nt, Homo sapiens
cagaaacuugugaaguggaa

SEQ ID NO: 450880 - RNA, 22 nt, Homo sapiens
cagaaagcaggagcagcugugc

SEQ ID NO: 450881 - RNA, 21 nt, Homo sapiens
cagaaauggggaauucucuaa

SEQ ID NO: 450882 - RNA, 23 nt, Homo sapiens
cagaaauugaccugauuuccauu

SEQ ID NO: 450883 - RNA, 22 nt, Homo sapiens
cagaaauuuuaagccaaaaaca

SEQ ID NO: 450884 - RNA, 23 nt, Homo sapiens
cagaacaaaagauaaaacuaauu

SEQ ID NO: 450885 - RNA, 19 nt, Homo sapiens
aggcaccugcuggaaacca

SEQ ID NO: 450886 - RNA, 23 nt, Homo sapiens
aggcagagacaauaaaacauucc

SEQ ID NO: 450887 - RNA, 20 nt, Homo sapiens
aggcagaggauguucuggac

SEQ ID NO: 450888 - RNA, 18 nt, Homo sapiens
aggcagauuaaaagcaca

SEQ ID NO: 450889 - RNA, 16 nt, Homo sapiens
aggcagcuagacacca

SEQ ID NO: 450890 - RNA, 17 nt, Homo sapiens
aggcaggagaugcugca

SEQ ID NO: 450891 - RNA, 20 nt, Homo sapiens
aggcagggagggaaacccgg

SEQ ID NO: 450892 - RNA, 19 nt, Homo sapiens
aggcauaagaaaacuaaga

SEQ ID NO: 450893 - RNA, 18 nt, Homo sapiens
aggcaucaaaaaaacaag

SEQ ID NO: 450894 - RNA, 15 nt, Homo sapiens
aggcauccacuucac

SEQ ID NO: 450895 - RNA, 18 nt, Homo sapiens
aggcauccaguaucuuga

SEQ ID NO: 450896 - RNA, 20 nt, Homo sapiens
aggcaucuucccuucacuca

SEQ ID NO: 450897 - RNA, 16 nt, Homo sapiens
aggcaugaaucuuccc

SEQ ID NO: 450898 - RNA, 14 nt, Homo sapiens
aggcaugagccacc

SEQ ID NO: 450899 - RNA, 18 nt, Homo sapiens
aggccaagggacaguggu

SEQ ID NO: 450900 - RNA, 18 nt, Homo sapiens
aggccaccaagcugcucu

SEQ ID NO: 450901 - RNA, 20 nt, Homo sapiens
aggccacuugaugaccccca

SEQ ID NO: 450902 - RNA, 17 nt, Homo sapiens
aggccagcuucgugcug

SEQ ID NO: 450903 - RNA, 19 nt, Homo sapiens
aggccaucugcuuaccaca

SEQ ID NO: 450904 - RNA, 12 nt, Homo sapiens
aggccauuccag

SEQ ID NO: 450905 - RNA, 17 nt, Homo sapiens
aggcccacaggaggcaa

SEQ ID NO: 450906 - RNA, 18 nt, Homo sapiens
aggcccaccccagccacc

SEQ ID NO: 450907 - RNA, 14 nt, Homo sapiens
aggcccacucuguu

SEQ ID NO: 450908 - RNA, 20 nt, Homo sapiens
aggcccaugcccuccguccu

SEQ ID NO: 450909 - RNA, 13 nt, Homo sapiens
aggccccagggcu

SEQ ID NO: 450910 - RNA, 15 nt, Homo sapiens
aggccccugguggca

SEQ ID NO: 450911 - RNA, 14 nt, Homo sapiens
aggccccuuaccug

SEQ ID NO: 450912 - RNA, 12 nt, Homo sapiens
aggcccuaggcg

SEQ ID NO: 450913 - RNA, 20 nt, Homo sapiens
aggcccugccuucagcccug

SEQ ID NO: 450914 - RNA, 21 nt, Homo sapiens
aggcccuguccuaagcacuuu

SEQ ID NO: 450915 - RNA, 23 nt, Homo sapiens
aggcccuuccucuccacugccuu

SEQ ID NO: 450916 - RNA, 18 nt, Homo sapiens
acugacaguaaaucucac

SEQ ID NO: 450917 - RNA, 20 nt, Homo sapiens
acugagcagacuggugagca

SEQ ID NO: 450918 - RNA, 13 nt, Homo sapiens
acugagccaaaaa

SEQ ID NO: 450919 - RNA, 18 nt, Homo sapiens
acugaggaaucagcucaa

SEQ ID NO: 450920 - RNA, 18 nt, Homo sapiens
acugaguccacucggagu

SEQ ID NO: 450921 - RNA, 15 nt, Homo sapiens
acugagucuguggac

SEQ ID NO: 450922 - RNA, 12 nt, Homo sapiens
acugaucauuaa

SEQ ID NO: 450923 - RNA, 22 nt, Homo sapiens
acugauccucgcaucucagccu

SEQ ID NO: 450924 - RNA, 20 nt, Homo sapiens
acugaucgugggguugacca

SEQ ID NO: 450925 - RNA, 15 nt, Homo sapiens
acugaucuuacucac

SEQ ID NO: 450926 - RNA, 12 nt, Homo sapiens
acugaugaaggc

SEQ ID NO: 450927 - RNA, 19 nt, Homo sapiens
acugauuucacaacagauc

SEQ ID NO: 450928 - RNA, 18 nt, Homo sapiens
acugcaaacccugcugcc

SEQ ID NO: 450929 - RNA, 17 nt, Homo sapiens
acugcaacuucuguccc

SEQ ID NO: 450930 - RNA, 20 nt, Homo sapiens
acugcacacacagcuccucu

SEQ ID NO: 450931 - RNA, 20 nt, Homo sapiens
acugcacacaugguuuccaa

SEQ ID NO: 450932 - RNA, 19 nt, Homo sapiens
acugcacagugcaucucag

SEQ ID NO: 450933 - RNA, 17 nt, Homo sapiens
acugcacccagcuccag

SEQ ID NO: 450934 - RNA, 20 nt, Homo sapiens
acugcacuccagccugggca

SEQ ID NO: 450935 - RNA, 18 nt, Homo sapiens
acugcagauuucucaccu

SEQ ID NO: 450936 - RNA, 20 nt, Homo sapiens
acugcagucaccccugucug

SEQ ID NO: 450937 - RNA, 21 nt, Homo sapiens
acugcauccuguaaggucugu

SEQ ID NO: 450938 - RNA, 16 nt, Homo sapiens
acugcaugcaagcuca

SEQ ID NO: 450939 - RNA, 17 nt, Homo sapiens
acugcaugcaagcucag

SEQ ID NO: 450940 - RNA, 17 nt, Homo sapiens
acugcauuuuacuguac

SEQ ID NO: 450941 - RNA, 13 nt, Homo sapiens
acugccaacuuuu

SEQ ID NO: 450942 - RNA, 13 nt, Homo sapiens
acugccacccaca

SEQ ID NO: 450943 - RNA, 23 nt, Homo sapiens
acugccaggauuuuguauugcca

SEQ ID NO: 450944 - RNA, 18 nt, Homo sapiens
acugccauggaggcacac

SEQ ID NO: 450945 - RNA, 22 nt, Homo sapiens
acugccauggaggcacacagcu

SEQ ID NO: 450946 - RNA, 14 nt, Homo sapiens
acugcccccgccac

SEQ ID NO: 450947 - RNA, 23 nt, Homo sapiens
acugcccgagcuggugcauuaca

SEQ ID NO: 450948 - RNA, 13 nt, Homo sapiens
acugccucuggaa

SEQ ID NO: 450949 - RNA, 20 nt, Homo sapiens
acugccucuuccucccucau

SEQ ID NO: 450950 - RNA, 13 nt, Homo sapiens
acugccuuugcag

SEQ ID NO: 450951 - RNA, 19 nt, Homo sapiens
acugcuaauaaaugaccag

SEQ ID NO: 450952 - RNA, 17 nt, Homo sapiens
acugcuacacuucugau

SEQ ID NO: 450953 - RNA, 22 nt, Homo sapiens
acugcuccauuuauaaccccag

SEQ ID NO: 450954 - RNA, 21 nt, Homo sapiens
acugcugcuucuuaaccccag

SEQ ID NO: 450955 - RNA, 16 nt, Homo sapiens
acugcuguacugcaau

SEQ ID NO: 450956 - RNA, 14 nt, Homo sapiens
acuggaacggugaa

SEQ ID NO: 450957 - RNA, 17 nt, Homo sapiens
acuggaacggugaaggu

SEQ ID NO: 450958 - RNA, 19 nt, Homo sapiens
acuggaauucagaugcaag

SEQ ID NO: 450959 - RNA, 16 nt, Homo sapiens
acuggcaacaguugga

SEQ ID NO: 450960 - RNA, 15 nt, Homo sapiens
acuggcagcuccucu

SEQ ID NO: 450961 - RNA, 17 nt, Homo sapiens
acuggcauuuuuagcuc

SEQ ID NO: 450962 - RNA, 16 nt, Homo sapiens
acuggcccaccccucu

SEQ ID NO: 450963 - RNA, 18 nt, Homo sapiens
acuggcugucugccugua

SEQ ID NO: 450964 - RNA, 19 nt, Homo sapiens
acuggcuucugcuugucau

SEQ ID NO: 450965 - RNA, 18 nt, Homo sapiens
acuggcuuugucccacag

SEQ ID NO: 450966 - RNA, 14 nt, Homo sapiens
acugggaagcauua

SEQ ID NO: 450967 - RNA, 14 nt, Homo sapiens
acugggcucaagag

SEQ ID NO: 450968 - RNA, 19 nt, Homo sapiens
acugguagaaaggcaguuc

SEQ ID NO: 450969 - RNA, 20 nt, Homo sapiens
acugguaggaagagguacca

SEQ ID NO: 450970 - RNA, 18 nt, Homo sapiens
acuggucacauugaaggu

SEQ ID NO: 450971 - RNA, 9 nt, Homo sapiens
acuggucca

SEQ ID NO: 450972 - RNA, 22 nt, Homo sapiens
acugguccaggccaggccucau

SEQ ID NO: 450973 - RNA, 14 nt, Homo sapiens
acuggugagcagac

SEQ ID NO: 450974 - RNA, 15 nt, Homo sapiens
acuggugcauuuaaa

SEQ ID NO: 450975 - RNA, 13 nt, Homo sapiens
acugguucuugcc

SEQ ID NO: 450976 - RNA, 15 nt, Homo sapiens
acugguuucaguuga

SEQ ID NO: 450977 - RNA, 17 nt, Homo sapiens
acuguaaaaugugggau

SEQ ID NO: 450978 - RNA, 19 nt, Homo sapiens
acuguaaacauucaucaag

SEQ ID NO: 450979 - RNA, 16 nt, Homo sapiens
acuguaacacuguaua

SEQ ID NO: 450980 - RNA, 14 nt, Homo sapiens
acuguacugagaca

SEQ ID NO: 450981 - RNA, 16 nt, Homo sapiens
acuguauuacauaaau

SEQ ID NO: 450982 - RNA, 16 nt, Homo sapiens
acuguauuuagugauu

SEQ ID NO: 450983 - RNA, 17 nt, Homo sapiens
acugucaaguacaagca

SEQ ID NO: 450984 - RNA, 17 nt, Homo sapiens
acugucacuuugcucug

SEQ ID NO: 450985 - RNA, 14 nt, Homo sapiens
acugucauguggcu

SEQ ID NO: 450986 - RNA, 17 nt, Homo sapiens
acuguccuacaauauca

SEQ ID NO: 450987 - RNA, 18 nt, Homo sapiens
acugucucguacuagaau

SEQ ID NO: 450988 - RNA, 18 nt, Homo sapiens
acugucuguuguuuaccu

SEQ ID NO: 450989 - RNA, 18 nt, Homo sapiens
acugucuucaacccugcc

SEQ ID NO: 450990 - RNA, 16 nt, Homo sapiens
acugucuucucccugc

SEQ ID NO: 450991 - RNA, 12 nt, Homo sapiens
acugucuuucag

SEQ ID NO: 450992 - RNA, 14 nt, Homo sapiens
acugugacacagcu

SEQ ID NO: 450993 - RNA, 14 nt, Homo sapiens
acugugucuacugu

SEQ ID NO: 450994 - RNA, 18 nt, Homo sapiens
acuguguuuuuccuccau

SEQ ID NO: 450995 - RNA, 21 nt, Homo sapiens
acuguuaaauaaggccucauc

SEQ ID NO: 450996 - RNA, 22 nt, Homo sapiens
acuguuaaauaaggccucaucc

SEQ ID NO: 450997 - RNA, 20 nt, Homo sapiens
acuguuaguauuaacuauua

SEQ ID NO: 450998 - RNA, 18 nt, Homo sapiens
acuguuagugacagagcc

SEQ ID NO: 450999 - RNA, 18 nt, Homo sapiens
acuguugacauccaagcu

SEQ ID NO: 451000 - RNA, 22 nt, Homo sapiens
acuguugauucgucugcgauuu

SEQ ID NO: 451001 - RNA, 13 nt, Homo sapiens
acuguugcucaaa

SEQ ID NO: 451002 - RNA, 22 nt, Homo sapiens
acuguugguauuauauaauuca

SEQ ID NO: 451003 - RNA, 20 nt, Homo sapiens
acuuaaaaaauguccaugau

SEQ ID NO: 451004 - RNA, 18 nt, Homo sapiens
acuuaaccgcaucagaag

SEQ ID NO: 451005 - RNA, 15 nt, Homo sapiens
acuuaaccugaagcu

SEQ ID NO: 451006 - RNA, 13 nt, Homo sapiens
acuuaagcacacu

SEQ ID NO: 451007 - RNA, 16 nt, Homo sapiens
acuuacaaguaaugaa

SEQ ID NO: 451008 - RNA, 14 nt, Homo sapiens
acuuacacaagacu

SEQ ID NO: 451009 - RNA, 19 nt, Homo sapiens
acuuacuaaaucuacucuu

SEQ ID NO: 451010 - RNA, 17 nt, Homo sapiens
acuuaguauuuuaccua

SEQ ID NO: 451011 - RNA, 21 nt, Homo sapiens
acuuauaaaucauauugauga

SEQ ID NO: 451012 - RNA, 14 nt, Homo sapiens
acuuauaccaaagg

SEQ ID NO: 451013 - RNA, 21 nt, Homo sapiens
acuuauauuaaauaaaugugc

SEQ ID NO: 451014 - RNA, 16 nt, Homo sapiens
acuuaugccgucucau

SEQ ID NO: 451015 - RNA, 13 nt, Homo sapiens
acuuaugcugcug

SEQ ID NO: 451016 - RNA, 16 nt, Homo sapiens
acuuauggacuccugu

SEQ ID NO: 451017 - RNA, 21 nt, Homo sapiens
acuuauuaugaggcuauuaaa

SEQ ID NO: 451018 - RNA, 21 nt, Homo sapiens
accagguuaccucacuuuuaa

SEQ ID NO: 451019 - RNA, 22 nt, Homo sapiens
accaguacucccccagcuuucc

SEQ ID NO: 451020 - RNA, 14 nt, Homo sapiens
accaguacugggaa

SEQ ID NO: 451021 - RNA, 13 nt, Homo sapiens
accaguacuugag

SEQ ID NO: 451022 - RNA, 22 nt, Homo sapiens
accaguaucgcucauagaucag

SEQ ID NO: 451023 - RNA, 19 nt, Homo sapiens
accagucugucuacugugg

SEQ ID NO: 451024 - RNA, 22 nt, Homo sapiens
ggcuauguugagcugagaucac

SEQ ID NO: 451025 - RNA, 17 nt, Homo sapiens
ggcucacgccuguaauc

SEQ ID NO: 451026 - RNA, 20 nt, Homo sapiens
ggcucagccucaaaugcagu

SEQ ID NO: 451027 - RNA, 18 nt, Homo sapiens
ggcucaggccauggcucc

SEQ ID NO: 451028 - RNA, 11 nt, Homo sapiens
ggcucaucucu

SEQ ID NO: 451029 - RNA, 17 nt, Homo sapiens
ggcucauucuucuuggc

SEQ ID NO: 451030 - RNA, 16 nt, Homo sapiens
ggcuccaacacugcug

SEQ ID NO: 451031 - RNA, 13 nt, Homo sapiens
ggcuccagcgugg

SEQ ID NO: 451032 - RNA, 14 nt, Homo sapiens
ggcucccaggacac

SEQ ID NO: 451033 - RNA, 13 nt, Homo sapiens
ggcucccaugacc

SEQ ID NO: 451034 - RNA, 16 nt, Homo sapiens
ggcuccuggggcaaug

SEQ ID NO: 451035 - RNA, 14 nt, Homo sapiens
ggcucuugcucaag

SEQ ID NO: 451036 - RNA, 14 nt, Homo sapiens
ggcucuuuccuugc

SEQ ID NO: 451037 - RNA, 21 nt, Homo sapiens
ggcugacaccuaccaugcugc

SEQ ID NO: 451038 - RNA, 21 nt, Homo sapiens
ggcugacccagauucccuucc

SEQ ID NO: 451039 - RNA, 14 nt, Homo sapiens
ggcugcaagcugca

SEQ ID NO: 451040 - RNA, 21 nt, Homo sapiens
ggcugcaggcucuaugggguu

SEQ ID NO: 451041 - RNA, 15 nt, Homo sapiens
ggcugcuggggcaug

SEQ ID NO: 451042 - RNA, 15 nt, Homo sapiens
ggcuggaacacugua

SEQ ID NO: 451043 - RNA, 16 nt, Homo sapiens
ggcuggcagcucucca

SEQ ID NO: 451044 - RNA, 15 nt, Homo sapiens
ggcugggagaaggug

SEQ ID NO: 451045 - RNA, 22 nt, Homo sapiens
ggcugguauucucucuaugcaa

SEQ ID NO: 451046 - RNA, 22 nt, Homo sapiens
ggcugguccagggcuagugacu

SEQ ID NO: 451047 - RNA, 22 nt, Homo sapiens
ggcuguaaauccuagacuugaa

SEQ ID NO: 451048 - RNA, 23 nt, Homo sapiens
ggcuguaaauccuagacuugaaa

SEQ ID NO: 451049 - RNA, 18 nt, Homo sapiens
ggcuguauuuaauggcau

SEQ ID NO: 451050 - RNA, 20 nt, Homo sapiens
ggcugucagucguguugcuu

SEQ ID NO: 451051 - RNA, 14 nt, Homo sapiens
ggcugugaaggcag

SEQ ID NO: 451052 - RNA, 16 nt, Homo sapiens
ggcuuagaauggggcu

SEQ ID NO: 451053 - RNA, 12 nt, Homo sapiens
ggcuuccagggg

SEQ ID NO: 451054 - RNA, 21 nt, Homo sapiens
ggcuuccauuugugugugugc

SEQ ID NO: 451055 - RNA, 19 nt, Homo sapiens
ggcuucuauguccaacaga

SEQ ID NO: 451056 - RNA, 14 nt, Homo sapiens
ggcuucucagcccu

SEQ ID NO: 451057 - RNA, 12 nt, Homo sapiens
ggcuucuucaac

SEQ ID NO: 451058 - RNA, 16 nt, Homo sapiens
ggcuugacaugugcaa

SEQ ID NO: 451059 - RNA, 14 nt, Homo sapiens
ggcuuggugaaugc

SEQ ID NO: 451060 - RNA, 23 nt, Homo sapiens
ggcuuguugcccucugcaguuga

SEQ ID NO: 451061 - RNA, 20 nt, Homo sapiens
ggcuuuccucagcaccuggg

SEQ ID NO: 451062 - RNA, 19 nt, Homo sapiens
ggcuuuuccaaaagcaaac

SEQ ID NO: 451063 - RNA, 13 nt, Homo sapiens
gggaaaaggagua

SEQ ID NO: 451064 - RNA, 13 nt, Homo sapiens
gggaaagccagug

SEQ ID NO: 451065 - RNA, 14 nt, Homo sapiens
gggaaagccaguga

SEQ ID NO: 451066 - RNA, 22 nt, Homo sapiens
gggaacaaggguggcaucccag

SEQ ID NO: 451067 - RNA, 21 nt, Homo sapiens
gggaagaguggucuugagggg

SEQ ID NO: 451068 - RNA, 14 nt, Homo sapiens
gggaagcucagggg

SEQ ID NO: 451069 - RNA, 21 nt, Homo sapiens
gggaaggagggagcugcucag

SEQ ID NO: 451070 - RNA, 22 nt, Homo sapiens
gggaaugaaugucagugugacu

SEQ ID NO: 451071 - RNA, 17 nt, Homo sapiens
gggaauugaggucugcu

SEQ ID NO: 451072 - RNA, 16 nt, Homo sapiens
gggacaacguccuucc

SEQ ID NO: 451073 - RNA, 15 nt, Homo sapiens
gggacgggggcugcu

SEQ ID NO: 451074 - RNA, 11 nt, Homo sapiens
gggacucuccu

SEQ ID NO: 451075 - RNA, 17 nt, Homo sapiens
gggacuuccuugcucuc

SEQ ID NO: 451076 - RNA, 13 nt, Homo sapiens
gggacuuggauag

SEQ ID NO: 451077 - RNA, 21 nt, Homo sapiens
gggagaaaaagaaacacaaga

SEQ ID NO: 451078 - RNA, 15 nt, Homo sapiens
gggagaagagcccug

SEQ ID NO: 451079 - RNA, 13 nt, Homo sapiens
gggagacugagcu

SEQ ID NO: 451080 - RNA, 23 nt, Homo sapiens
gggagagaaagcuuuauauuugu

SEQ ID NO: 451081 - RNA, 21 nt, Homo sapiens
gggagaucuuggggugcagca

SEQ ID NO: 451082 - RNA, 22 nt, Homo sapiens
gggaggagccuuggaguguaau

SEQ ID NO: 451083 - RNA, 13 nt, Homo sapiens
gggaggagggugg

SEQ ID NO: 451084 - RNA, 14 nt, Homo sapiens
gggagucagggagc

SEQ ID NO: 451085 - RNA, 22 nt, Homo sapiens
gggaucagagucuggccugcca

SEQ ID NO: 451086 - RNA, 21 nt, Homo sapiens
gggaucuaaaaggaggacagg

SEQ ID NO: 451087 - RNA, 15 nt, Homo sapiens
gggaugggauuucau

SEQ ID NO: 451088 - RNA, 14 nt, Homo sapiens
gggauuaucuguca

SEQ ID NO: 451089 - RNA, 17 nt, Homo sapiens
gggauugucuuacuguu

SEQ ID NO: 451090 - RNA, 16 nt, Homo sapiens
gggcaacccuggugac

SEQ ID NO: 451091 - RNA, 16 nt, Homo sapiens
gggcaagggaccugcu

SEQ ID NO: 451092 - RNA, 13 nt, Homo sapiens
gggcaaucuuugc

SEQ ID NO: 451093 - RNA, 13 nt, Homo sapiens
gggcagcacagag

SEQ ID NO: 451094 - RNA, 18 nt, Homo sapiens
gggcagccugugggagaa

SEQ ID NO: 451095 - RNA, 15 nt, Homo sapiens
gggcagcucauagag

SEQ ID NO: 451096 - RNA, 20 nt, Homo sapiens
gggcaggagggcccuaccug

SEQ ID NO: 451097 - RNA, 22 nt, Homo sapiens
gggcagggcuggcaccucucaa

SEQ ID NO: 451098 - RNA, 16 nt, Homo sapiens
gggcauccaacugaga

SEQ ID NO: 451099 - RNA, 17 nt, Homo sapiens
gggcaugccacccucac

SEQ ID NO: 451100 - RNA, 16 nt, Homo sapiens
gggcaugguagcucaa

SEQ ID NO: 451101 - RNA, 18 nt, Homo sapiens
gggccacauggguccacu

SEQ ID NO: 451102 - RNA, 18 nt, Homo sapiens
gggccagaugacacccua

SEQ ID NO: 451103 - RNA, 16 nt, Homo sapiens
gggccagcucuuggcu

SEQ ID NO: 451104 - RNA, 18 nt, Homo sapiens
gggccaggugcacagacg

SEQ ID NO: 451105 - RNA, 23 nt, Homo sapiens
gggccccccaaaucccagggaag

SEQ ID NO: 451106 - RNA, 14 nt, Homo sapiens
gggccuacacccgu

SEQ ID NO: 451107 - RNA, 19 nt, Homo sapiens
gggccucccauagugcugg

SEQ ID NO: 451108 - RNA, 19 nt, Homo sapiens
gggccuccuucccaugccu

SEQ ID NO: 451109 - RNA, 22 nt, Homo sapiens
gggccuccuuguccaggucuca

SEQ ID NO: 451110 - RNA, 12 nt, Homo sapiens
gggccucugaaa

SEQ ID NO: 451111 - RNA, 18 nt, Homo sapiens
gggccuggccaccucucu

SEQ ID NO: 451112 - RNA, 16 nt, Homo sapiens
gggccugucgugccag

SEQ ID NO: 451113 - RNA, 20 nt, Homo sapiens
gggcgaggcgggggagccug

SEQ ID NO: 451114 - RNA, 12 nt, Homo sapiens
gggcgcgguggc

SEQ ID NO: 451115 - RNA, 13 nt, Homo sapiens
gggcuacacagca

SEQ ID NO: 451116 - RNA, 13 nt, Homo sapiens
gggcuacauugua

SEQ ID NO: 451117 - RNA, 16 nt, Homo sapiens
gggcuggcacugacug

SEQ ID NO: 451118 - RNA, 17 nt, Homo sapiens
gggcuggguguguuuca

SEQ ID NO: 451119 - RNA, 18 nt, Homo sapiens
gggcuguguugacugcug

SEQ ID NO: 451120 - RNA, 19 nt, Homo sapiens
gggcuuaccuguacacuga

SEQ ID NO: 451121 - RNA, 23 nt, Homo sapiens
gggcuuguuuucuacuuugccac

SEQ ID NO: 451122 - RNA, 18 nt, Homo sapiens
ggggacagaguucaggga

SEQ ID NO: 451123 - RNA, 14 nt, Homo sapiens
ggggaggccaagug

SEQ ID NO: 451124 - RNA, 22 nt, Homo sapiens
ggggaggccaagugcaggcugg

SEQ ID NO: 451125 - RNA, 22 nt, Homo sapiens
ggggagguuuguuugugugaaa

SEQ ID NO: 451126 - RNA, 19 nt, Homo sapiens
ggggcacacuacagagcag

SEQ ID NO: 451127 - RNA, 13 nt, Homo sapiens
ggggcagcacaga

SEQ ID NO: 451128 - RNA, 19 nt, Homo sapiens
ggggccaggccauggccaa

SEQ ID NO: 451129 - RNA, 16 nt, Homo sapiens
ggggccaggugcacag

SEQ ID NO: 451130 - RNA, 20 nt, Homo sapiens
ggggcccugcaccugugcag

SEQ ID NO: 451131 - RNA, 13 nt, Homo sapiens
ggggggcaaggug

SEQ ID NO: 451132 - RNA, 20 nt, Homo sapiens
ggguccaaucuccgguguga

SEQ ID NO: 451133 - RNA, 13 nt, Homo sapiens
ggguccccaagga

SEQ ID NO: 451134 - RNA, 17 nt, Homo sapiens
gggucuauacauuccug

SEQ ID NO: 451135 - RNA, 20 nt, Homo sapiens
gggucucgcuuuguugccca

SEQ ID NO: 451136 - RNA, 21 nt, Homo sapiens
gggucucgcuuuguugcccag

SEQ ID NO: 451137 - RNA, 17 nt, Homo sapiens
gggucugagaucggccc

SEQ ID NO: 451138 - RNA, 11 nt, Homo sapiens
gggugcagcug

SEQ ID NO: 451139 - RNA, 18 nt, Homo sapiens
ggguggcaggugaccuuc

SEQ ID NO: 451140 - RNA, 18 nt, Homo sapiens
ggguggggggugacagug

SEQ ID NO: 451141 - RNA, 13 nt, Homo sapiens
ggguggggugccu

SEQ ID NO: 451142 - RNA, 18 nt, Homo sapiens
gggugguuuuugagccau

SEQ ID NO: 451143 - RNA, 21 nt, Homo sapiens
ggguuaguuuacaaucagcca

SEQ ID NO: 451144 - RNA, 22 nt, Homo sapiens
ggguucaagcaauugucugccu

SEQ ID NO: 451145 - RNA, 18 nt, Homo sapiens
ggaacaagaauugcuaaa

SEQ ID NO: 451146 - RNA, 13 nt, Homo sapiens
ggaacacaaccau

SEQ ID NO: 451147 - RNA, 15 nt, Homo sapiens
ggaacacaaccauag

SEQ ID NO: 451148 - RNA, 13 nt, Homo sapiens
ggaacagacucga

SEQ ID NO: 451149 - RNA, 14 nt, Homo sapiens
ggaacagaugcuaa

SEQ ID NO: 451150 - RNA, 12 nt, Homo sapiens
ggaacauaugca

SEQ ID NO: 451151 - RNA, 16 nt, Homo sapiens
ggaacuuuccagcagu

SEQ ID NO: 451152 - RNA, 14 nt, Homo sapiens
ggaagagggcagua

SEQ ID NO: 451153 - RNA, 17 nt, Homo sapiens
ggaagagugauguuuca

SEQ ID NO: 451154 - RNA, 15 nt, Homo sapiens
ggaagaucaggucau

SEQ ID NO: 451155 - RNA, 13 nt, Homo sapiens
ggaagaucuuaaa

SEQ ID NO: 451156 - RNA, 15 nt, Homo sapiens
ggaagcacaggccag

SEQ ID NO: 451157 - RNA, 18 nt, Homo sapiens
ggaagccagugggguccc

SEQ ID NO: 451158 - RNA, 14 nt, Homo sapiens
ggaaggaaccagaa

SEQ ID NO: 451159 - RNA, 14 nt, Homo sapiens
ggaaggacauaaaa

SEQ ID NO: 451160 - RNA, 19 nt, Homo sapiens
ggaaggccuugcugucaug

SEQ ID NO: 451161 - RNA, 21 nt, Homo sapiens
ggaagggccccacucagggau

SEQ ID NO: 451162 - RNA, 19 nt, Homo sapiens
ggaagggccuacagcccau

SEQ ID NO: 451163 - RNA, 19 nt, Homo sapiens
ggaagggggguugcagugg

SEQ ID NO: 451164 - RNA, 11 nt, Homo sapiens
ggaagggucaa

SEQ ID NO: 451165 - RNA, 13 nt, Homo sapiens
ggaagucaucuca

SEQ ID NO: 451166 - RNA, 12 nt, Homo sapiens
ggaaguugcuga

SEQ ID NO: 451167 - RNA, 16 nt, Homo sapiens
ggaauaauuauuuauu

SEQ ID NO: 451168 - RNA, 19 nt, Homo sapiens
ggaauauaauaugucuuca

SEQ ID NO: 451169 - RNA, 16 nt, Homo sapiens
ggaauauccagucaaa

SEQ ID NO: 451170 - RNA, 17 nt, Homo sapiens
ggaaucguacauuuugc

SEQ ID NO: 451171 - RNA, 20 nt, Homo sapiens
ggaaugaccagccuguccaa

SEQ ID NO: 451172 - RNA, 12 nt, Homo sapiens
ggaaugcucaau

SEQ ID NO: 451173 - RNA, 15 nt, Homo sapiens
ggaauggagcuguau

SEQ ID NO: 451174 - RNA, 14 nt, Homo sapiens
ggaauuacauaaca

SEQ ID NO: 451175 - RNA, 19 nt, Homo sapiens
ggaauuauuuugaauguca

SEQ ID NO: 451176 - RNA, 17 nt, Homo sapiens
ggaauucacccucucau

SEQ ID NO: 451177 - RNA, 21 nt, Homo sapiens
ggaauugugugauguuuaaca

SEQ ID NO: 451178 - RNA, 18 nt, Homo sapiens
ggacaaaggugauuuucc

SEQ ID NO: 451179 - RNA, 23 nt, Homo sapiens
ggacaaaggugauuuuccugugu

SEQ ID NO: 451180 - RNA, 19 nt, Homo sapiens
ggacaacagagaugccaug

SEQ ID NO: 451181 - RNA, 12 nt, Homo sapiens
ggacacaggcca

SEQ ID NO: 451182 - RNA, 20 nt, Homo sapiens
ggacacagucagauuuccag

SEQ ID NO: 451183 - RNA, 18 nt, Homo sapiens
ggacaccuuuuaacucac

SEQ ID NO: 451184 - RNA, 21 nt, Homo sapiens
ggacacugugcccagcccgga

SEQ ID NO: 451185 - RNA, 22 nt, Homo sapiens
ggacagagcacguuugcagaag

SEQ ID NO: 451186 - RNA, 20 nt, Homo sapiens
ggacagaugaaugccgugga

SEQ ID NO: 451187 - RNA, 18 nt, Homo sapiens
ggacagcggguaaaaaga

SEQ ID NO: 451188 - RNA, 18 nt, Homo sapiens
ggacagcuuuccugggug

SEQ ID NO: 451189 - RNA, 16 nt, Homo sapiens
ggacaggaagcacagc

SEQ ID NO: 451190 - RNA, 22 nt, Homo sapiens
ggacagggcuggagucaaaaca

SEQ ID NO: 451191 - RNA, 21 nt, Homo sapiens
ggacagugcugaccccaggaa

SEQ ID NO: 451192 - RNA, 13 nt, Homo sapiens
ggaccaaauggaa

SEQ ID NO: 451193 - RNA, 19 nt, Homo sapiens
ggaccaauuagcauuccau

SEQ ID NO: 451194 - RNA, 21 nt, Homo sapiens
ggaccaauuagcauuccauca

SEQ ID NO: 451195 - RNA, 19 nt, Homo sapiens
ggaccagaagcauuucacc

SEQ ID NO: 451196 - RNA, 19 nt, Homo sapiens
ggaccauugaccucagcug

SEQ ID NO: 451197 - RNA, 12 nt, Homo sapiens
ggaccucaggug

SEQ ID NO: 451198 - RNA, 14 nt, Homo sapiens
ggaccucaguuuua

SEQ ID NO: 451199 - RNA, 20 nt, Homo sapiens
ggaccugagccugguccugg

SEQ ID NO: 451200 - RNA, 20 nt, Homo sapiens
ggaccuucagagcaucccag

SEQ ID NO: 451201 - RNA, 20 nt, Homo sapiens
ggaccuuguuguuguuaaau

SEQ ID NO: 451202 - RNA, 20 nt, Homo sapiens
ggacgaggaguaauggcauu

SEQ ID NO: 451203 - RNA, 18 nt, Homo sapiens
ggacuaagaagauguuuu

SEQ ID NO: 451204 - RNA, 18 nt, Homo sapiens
ggacuagaaaaacuuggg

SEQ ID NO: 451205 - RNA, 13 nt, Homo sapiens
ggacuagcuggau

SEQ ID NO: 451206 - RNA, 17 nt, Homo sapiens
ggacuauuucuggcacu

SEQ ID NO: 451207 - RNA, 16 nt, Homo sapiens
ggacucucagggauuc

SEQ ID NO: 451208 - RNA, 20 nt, Homo sapiens
ggacucugcuucaguccacu

SEQ ID NO: 451209 - RNA, 23 nt, Homo sapiens
ggacugccucugccacacucuga

SEQ ID NO: 451210 - RNA, 19 nt, Homo sapiens
ggacuggaggugggcaugc

SEQ ID NO: 451211 - RNA, 22 nt, Homo sapiens
ggacuggaggugggcaugccac

SEQ ID NO: 451212 - RNA, 16 nt, Homo sapiens
ggacugggaagcauua

SEQ ID NO: 451213 - RNA, 16 nt, Homo sapiens
ggacugguccaggcau

SEQ ID NO: 451214 - RNA, 18 nt, Homo sapiens
ggacuguggccucaggag

SEQ ID NO: 451215 - RNA, 13 nt, Homo sapiens
ggacuuccuugcu

SEQ ID NO: 451216 - RNA, 16 nt, Homo sapiens
ggacuuccuugcucuc

SEQ ID NO: 451217 - RNA, 22 nt, Homo sapiens
ggacuucugcaucuuacaguca

SEQ ID NO: 451218 - RNA, 18 nt, Homo sapiens
ggacuucuggcagggaag

SEQ ID NO: 451219 - RNA, 16 nt, Homo sapiens
ggacuuuccugcaacu

SEQ ID NO: 451220 - RNA, 17 nt, Homo sapiens
ggacuuuugaaaagcuu

SEQ ID NO: 451221 - RNA, 22 nt, Homo sapiens
ggagaaauaugguacucauuaa

SEQ ID NO: 451222 - RNA, 20 nt, Homo sapiens
ggagaagacuucuuugcaac

SEQ ID NO: 451223 - RNA, 21 nt, Homo sapiens
ggagacaaucuaaaaaauauc

SEQ ID NO: 451224 - RNA, 14 nt, Homo sapiens
ggagacaauuacaa

SEQ ID NO: 451225 - RNA, 19 nt, Homo sapiens
ggagaccaggcuucccaaa

SEQ ID NO: 451226 - RNA, 16 nt, Homo sapiens
ggagacugucucaaga

SEQ ID NO: 451227 - RNA, 23 nt, Homo sapiens
ggagagagcaaucuugcugugaa

SEQ ID NO: 451228 - RNA, 23 nt, Homo sapiens
ggagagagguugaggaugcacug

SEQ ID NO: 451229 - RNA, 13 nt, Homo sapiens
ggagagcaucugc

SEQ ID NO: 451230 - RNA, 13 nt, Homo sapiens
ggagagcccuuca

SEQ ID NO: 451231 - RNA, 18 nt, Homo sapiens
ggagaggggaagggccag

SEQ ID NO: 451232 - RNA, 14 nt, Homo sapiens
ggagauaccagaga

SEQ ID NO: 451233 - RNA, 22 nt, Homo sapiens
ggagauggguguggcaguguau

SEQ ID NO: 451234 - RNA, 21 nt, Homo sapiens
ggagaugucugaauacugcag

SEQ ID NO: 451235 - RNA, 13 nt, Homo sapiens
ggagauugaacca

SEQ ID NO: 451236 - RNA, 23 nt, Homo sapiens
ggagcacguggagauagugccag

SEQ ID NO: 451237 - RNA, 21 nt, Homo sapiens
ggagccaccugucccaccuca

SEQ ID NO: 451238 - RNA, 23 nt, Homo sapiens
ggagccauaagggacaugucuuu

SEQ ID NO: 451239 - RNA, 20 nt, Homo sapiens
ggagccccacccagaccuga

SEQ ID NO: 451240 - RNA, 23 nt, Homo sapiens
ggagcccggggcagagcucagag

SEQ ID NO: 451241 - RNA, 22 nt, Homo sapiens
ggagccugaaaaggcuccacau

SEQ ID NO: 451242 - RNA, 21 nt, Homo sapiens
ggagcucuacgugcuccucag

SEQ ID NO: 451243 - RNA, 15 nt, Homo sapiens
ggagcugcggccacu

SEQ ID NO: 451244 - RNA, 14 nt, Homo sapiens
ggagcugcuuccag

SEQ ID NO: 451245 - RNA, 17 nt, Homo sapiens
ggagcuggggaaacuca

SEQ ID NO: 451246 - RNA, 17 nt, Homo sapiens
ggaggaaggagccuaug

SEQ ID NO: 451247 - RNA, 15 nt, Homo sapiens
ggaggaccagagcua

SEQ ID NO: 451248 - RNA, 23 nt, Homo sapiens
ggaggagaaaagugacagauccu

SEQ ID NO: 451249 - RNA, 21 nt, Homo sapiens
ggaggcagaggguugcaguga

SEQ ID NO: 451250 - RNA, 22 nt, Homo sapiens
ggaggcccaugggcagaagaua

SEQ ID NO: 451251 - RNA, 18 nt, Homo sapiens
ggaggccguucagcugug

SEQ ID NO: 451252 - RNA, 14 nt, Homo sapiens
ggagggaccaggug

SEQ ID NO: 451253 - RNA, 19 nt, Homo sapiens
ggagggaccaggugucuag

SEQ ID NO: 451254 - RNA, 23 nt, Homo sapiens
ggaggggucagcucuggccacaa

SEQ ID NO: 451255 - RNA, 14 nt, Homo sapiens
ggaggggucugccu

SEQ ID NO: 451256 - RNA, 15 nt, Homo sapiens
ggagguucucagagc

SEQ ID NO: 451257 - RNA, 18 nt, Homo sapiens
ggagguugagaaugcagu

SEQ ID NO: 451258 - RNA, 12 nt, Homo sapiens
ggaguccagacc

SEQ ID NO: 451259 - RNA, 21 nt, Homo sapiens
ggagucucugccacccacuca

SEQ ID NO: 451260 - RNA, 18 nt, Homo sapiens
ggagucugcuucauuucc

SEQ ID NO: 451261 - RNA, 13 nt, Homo sapiens
ggagugugccccu

SEQ ID NO: 451262 - RNA, 16 nt, Homo sapiens
ggaguucagauguuuu

SEQ ID NO: 451263 - RNA, 21 nt, Homo sapiens
ggaguuggaauguuguaguua

SEQ ID NO: 451264 - RNA, 21 nt, Homo sapiens
ggaguuuucuggagugagcac

SEQ ID NO: 451265 - RNA, 16 nt, Homo sapiens
ggauaacacauuugau

SEQ ID NO: 451266 - RNA, 19 nt, Homo sapiens
ggauacccuggagcaagac

SEQ ID NO: 451267 - RNA, 20 nt, Homo sapiens
ggauacugcccggggcagcu

SEQ ID NO: 451268 - RNA, 22 nt, Homo sapiens
ggauagcuucaucuugagccug

SEQ ID NO: 451269 - RNA, 17 nt, Homo sapiens
ggauaggagcuuccaga

SEQ ID NO: 451270 - RNA, 20 nt, Homo sapiens
ggauagucagcuguaccaag

SEQ ID NO: 451271 - RNA, 16 nt, Homo sapiens
ggauauaggucaguga

SEQ ID NO: 451272 - RNA, 22 nt, Homo sapiens
ggauauaggucagugaggccca

SEQ ID NO: 451273 - RNA, 14 nt, Homo sapiens
ggauccgcugccac

SEQ ID NO: 451274 - RNA, 19 nt, Homo sapiens
cagugccaaaaacaacaac

SEQ ID NO: 451275 - RNA, 13 nt, Homo sapiens
cagugccaccuau

SEQ ID NO: 451276 - RNA, 18 nt, Homo sapiens
cagugcccccuccgucca

SEQ ID NO: 451277 - RNA, 15 nt, Homo sapiens
cagugccuuccauaa

SEQ ID NO: 451278 - RNA, 20 nt, Homo sapiens
caguggagaggggacuugga

SEQ ID NO: 451279 - RNA, 22 nt, Homo sapiens
caguggccgaaccccccacucc

SEQ ID NO: 451280 - RNA, 18 nt, Homo sapiens
caguggggccccaaagcc

SEQ ID NO: 451281 - RNA, 15 nt, Homo sapiens
cagugggggugccug

SEQ ID NO: 451282 - RNA, 18 nt, Homo sapiens
caguggugagacuguauc

SEQ ID NO: 451283 - RNA, 16 nt, Homo sapiens
caguggugugaucucg

SEQ ID NO: 451284 - RNA, 22 nt, Homo sapiens
cagugguuggcaauuguuucaa

SEQ ID NO: 451285 - RNA, 17 nt, Homo sapiens
caguguagaucaacuca

SEQ ID NO: 451286 - RNA, 19 nt, Homo sapiens
caguguccucuugcucaaa

SEQ ID NO: 451287 - RNA, 15 nt, Homo sapiens
cagugucuuccauaa

SEQ ID NO: 451288 - RNA, 18 nt, Homo sapiens
cagugugacuuuaucuuc

SEQ ID NO: 451289 - RNA, 20 nt, Homo sapiens
cagugugcauaauuuugcca

SEQ ID NO: 451290 - RNA, 20 nt, Homo sapiens
caguguggugggaggggugu

SEQ ID NO: 451291 - RNA, 11 nt, Homo sapiens
caguguuuaca

SEQ ID NO: 451292 - RNA, 14 nt, Homo sapiens
caguuaacucuccc

SEQ ID NO: 451293 - RNA, 22 nt, Homo sapiens
caguuaagacaacaggcauuuu

SEQ ID NO: 451294 - RNA, 15 nt, Homo sapiens
caguuaauucuugcc

SEQ ID NO: 451295 - RNA, 19 nt, Homo sapiens
caguuacguugcauccaca

SEQ ID NO: 451296 - RNA, 19 nt, Homo sapiens
caguuacuuccuuccugcc

SEQ ID NO: 451297 - RNA, 22 nt, Homo sapiens
caguuagcccggccaaggacac

SEQ ID NO: 451298 - RNA, 23 nt, Homo sapiens
caguucacaaacaguaaaggcca

SEQ ID NO: 451299 - RNA, 14 nt, Homo sapiens
caguucaugccuga

SEQ ID NO: 451300 - RNA, 18 nt, Homo sapiens
caguucccccaaccucag

SEQ ID NO: 451301 - RNA, 13 nt, Homo sapiens
caguucugaugag

SEQ ID NO: 451302 - RNA, 23 nt, Homo sapiens
caguugagcuucauauaccagca

SEQ ID NO: 451303 - RNA, 19 nt, Homo sapiens
caguugcuagcaacaacuu

SEQ ID NO: 451304 - RNA, 13 nt, Homo sapiens
caguuggugcugc

SEQ ID NO: 451305 - RNA, 14 nt, Homo sapiens
caguuuaccugaaa

SEQ ID NO: 451306 - RNA, 12 nt, Homo sapiens
caguuucacugc

SEQ ID NO: 451307 - RNA, 17 nt, Homo sapiens
caguuucuugaagucca

SEQ ID NO: 451308 - RNA, 22 nt, Homo sapiens
caguuucuuuggccagaaggau

SEQ ID NO: 451309 - RNA, 17 nt, Homo sapiens
caguuuggaaguguuaa

SEQ ID NO: 451310 - RNA, 14 nt, Homo sapiens
caguuuuccaugaa

SEQ ID NO: 451311 - RNA, 18 nt, Homo sapiens
cauaaaacaaaaccaagc

SEQ ID NO: 451312 - RNA, 19 nt, Homo sapiens
cauaaaacuucugauuucu

SEQ ID NO: 451313 - RNA, 15 nt, Homo sapiens
cauaaaaguaauuaa

SEQ ID NO: 451314 - RNA, 17 nt, Homo sapiens
cauaaaaguuaacauua

SEQ ID NO: 451315 - RNA, 19 nt, Homo sapiens
cauaaaauauauaggauua

SEQ ID NO: 451316 - RNA, 17 nt, Homo sapiens
cauaaagaaacacuuuc

SEQ ID NO: 451317 - RNA, 19 nt, Homo sapiens
cauaaaggcauggcauuug

SEQ ID NO: 451318 - RNA, 14 nt, Homo sapiens
cauaaaucuuccaa

SEQ ID NO: 451319 - RNA, 22 nt, Homo sapiens
cauaacaggcauugcacuaaaa

SEQ ID NO: 451320 - RNA, 16 nt, Homo sapiens
cauaacaugcuuuaga

SEQ ID NO: 451321 - RNA, 18 nt, Homo sapiens
cauaaccacugcuuccau

SEQ ID NO: 451322 - RNA, 12 nt, Homo sapiens
cauaacuugaaa

SEQ ID NO: 451323 - RNA, 16 nt, Homo sapiens
cauaagaaaacuaaga

SEQ ID NO: 451324 - RNA, 20 nt, Homo sapiens
cauaagcuuuuucucugaac

SEQ ID NO: 451325 - RNA, 15 nt, Homo sapiens
cauaaggcauauaca

SEQ ID NO: 451326 - RNA, 16 nt, Homo sapiens
cauaagugaaaaucuu

SEQ ID NO: 451327 - RNA, 18 nt, Homo sapiens
cauaaguuaacuuccaau

SEQ ID NO: 451328 - RNA, 16 nt, Homo sapiens
cauaauaaaaggaguu

SEQ ID NO: 451329 - RNA, 17 nt, Homo sapiens
cauaauaagcuaaagag

SEQ ID NO: 451330 - RNA, 19 nt, Homo sapiens
cauaauagaauuuccuaau

SEQ ID NO: 451331 - RNA, 18 nt, Homo sapiens
cauaauguuacauuauua

SEQ ID NO: 451332 - RNA, 10 nt, Homo sapiens
cauacaggag

SEQ ID NO: 451333 - RNA, 11 nt, Homo sapiens
cauacagugau

SEQ ID NO: 451334 - RNA, 14 nt, Homo sapiens
cauacaguuugcac

SEQ ID NO: 451335 - RNA, 17 nt, Homo sapiens
cauacccacacacccag

SEQ ID NO: 451336 - RNA, 18 nt, Homo sapiens
cauacuaucuacucuccu

SEQ ID NO: 451337 - RNA, 13 nt, Homo sapiens
cauacugcaugua

SEQ ID NO: 451338 - RNA, 21 nt, Homo sapiens
cauagaacuccggaaugacca

SEQ ID NO: 451339 - RNA, 22 nt, Homo sapiens
cauagaagggcuagaauaggag

SEQ ID NO: 451340 - RNA, 14 nt, Homo sapiens
cauagacugcaaaa

SEQ ID NO: 451341 - RNA, 22 nt, Homo sapiens
cauagauucaccuguaaaacuu

SEQ ID NO: 451342 - RNA, 22 nt, Homo sapiens
cauagcgcugcucuuaugccau

SEQ ID NO: 451343 - RNA, 19 nt, Homo sapiens
cauagcuacuauaugcaua

SEQ ID NO: 451344 - RNA, 15 nt, Homo sapiens
cauagcuuccaugag

SEQ ID NO: 451345 - RNA, 16 nt, Homo sapiens
cauaggacauacugca

SEQ ID NO: 451346 - RNA, 21 nt, Homo sapiens
cauaggcugacaccaagaaga

SEQ ID NO: 451347 - RNA, 19 nt, Homo sapiens
cauauaaccaaaauccaga

SEQ ID NO: 451348 - RNA, 21 nt, Homo sapiens
cauauacuuuggggacuugua

SEQ ID NO: 451349 - RNA, 14 nt, Homo sapiens
cauauauuguuauu

SEQ ID NO: 451350 - RNA, 14 nt, Homo sapiens
cauaucaacuugag

SEQ ID NO: 451351 - RNA, 15 nt, Homo sapiens
cauaucaacuugagg

SEQ ID NO: 451352 - RNA, 18 nt, Homo sapiens
cauaucaguugagcuuca

SEQ ID NO: 451353 - RNA, 19 nt, Homo sapiens
cauaucaugugugagauaa

SEQ ID NO: 451354 - RNA, 22 nt, Homo sapiens
cauaucuuguuguucaguuugg

SEQ ID NO: 451355 - RNA, 23 nt, Homo sapiens
cauaugauaaauuugacuguuau

SEQ ID NO: 451356 - RNA, 17 nt, Homo sapiens
cauauguaccauguaca

SEQ ID NO: 451357 - RNA, 16 nt, Homo sapiens
cauaugugaagacaga

SEQ ID NO: 451358 - RNA, 11 nt, Homo sapiens
cauauguuaau

SEQ ID NO: 451359 - RNA, 18 nt, Homo sapiens
cauauguuguugcuugua

SEQ ID NO: 451360 - RNA, 22 nt, Homo sapiens
cauauuaagaauagucucuggg

SEQ ID NO: 451361 - RNA, 15 nt, Homo sapiens
cauauuagcaucaug

SEQ ID NO: 451362 - RNA, 23 nt, Homo sapiens
cauauucugggcuccuggaacca

SEQ ID NO: 451363 - RNA, 18 nt, Homo sapiens
cauauugugccaauaugu

SEQ ID NO: 451364 - RNA, 16 nt, Homo sapiens
cauauuuaaagucuug

SEQ ID NO: 451365 - RNA, 11 nt, Homo sapiens
cauauuugcuu

SEQ ID NO: 451366 - RNA, 13 nt, Homo sapiens
caucaagcuguac

SEQ ID NO: 451367 - RNA, 13 nt, Homo sapiens
caucaauucucua

SEQ ID NO: 451368 - RNA, 19 nt, Homo sapiens
caucacagcuuguuuugga

SEQ ID NO: 451369 - RNA, 15 nt, Homo sapiens
caucaccagacuuug

SEQ ID NO: 451370 - RNA, 18 nt, Homo sapiens
caucacuccucugucaua

SEQ ID NO: 451371 - RNA, 21 nt, Homo sapiens
caucacuggggaggacgugau

SEQ ID NO: 451372 - RNA, 22 nt, Homo sapiens
caucagagaugguaaucuacag

SEQ ID NO: 451373 - RNA, 13 nt, Homo sapiens
caucagcagugau

SEQ ID NO: 451374 - RNA, 13 nt, Homo sapiens
caucagcucucug

SEQ ID NO: 451375 - RNA, 18 nt, Homo sapiens
caucaguuacugguuuca

SEQ ID NO: 451376 - RNA, 20 nt, Homo sapiens
caucaugagccguugcuaau

SEQ ID NO: 451377 - RNA, 11 nt, Homo sapiens
caucaugccug

SEQ ID NO: 451378 - RNA, 21 nt, Homo sapiens
caucauggauucauuacagcu

SEQ ID NO: 451379 - RNA, 19 nt, Homo sapiens
caucaugggggauuuuuca

SEQ ID NO: 451380 - RNA, 14 nt, Homo sapiens
caucauuucugucu

SEQ ID NO: 451381 - RNA, 21 nt, Homo sapiens
caucauuugucuuugaacgua

SEQ ID NO: 451382 - RNA, 11 nt, Homo sapiens
cauccaaauaa

SEQ ID NO: 451383 - RNA, 14 nt, Homo sapiens
cauccaagcuuccu

SEQ ID NO: 451384 - RNA, 21 nt, Homo sapiens
cauccaauggauugugcaaau

SEQ ID NO: 451385 - RNA, 13 nt, Homo sapiens
cauccaauguaug

SEQ ID NO: 451386 - RNA, 17 nt, Homo sapiens
cauccacaggauuccag

SEQ ID NO: 451387 - RNA, 22 nt, Homo sapiens
cauccaccaccuugccaauggu

SEQ ID NO: 451388 - RNA, 17 nt, Homo sapiens
cauccacuucacaguuc

SEQ ID NO: 451389 - RNA, 16 nt, Homo sapiens
cauccaguaucuugaa

SEQ ID NO: 451390 - RNA, 20 nt, Homo sapiens
cauccauagacacaguauug

SEQ ID NO: 451391 - RNA, 17 nt, Homo sapiens
caucccaacagccaaga

SEQ ID NO: 451392 - RNA, 17 nt, Homo sapiens
caucccaugagcagucc

SEQ ID NO: 451393 - RNA, 12 nt, Homo sapiens
cauccccuguga

SEQ ID NO: 451394 - RNA, 20 nt, Homo sapiens
cauccccuuuggcuaccuga

SEQ ID NO: 451395 - RNA, 19 nt, Homo sapiens
cauccccuuuguguagaaa

SEQ ID NO: 451396 - RNA, 18 nt, Homo sapiens
caucccugaaacauugca

SEQ ID NO: 451397 - RNA, 19 nt, Homo sapiens
caucccugaaacauugcau

SEQ ID NO: 451398 - RNA, 19 nt, Homo sapiens
cauccuacccuaaugccag

SEQ ID NO: 451399 - RNA, 22 nt, Homo sapiens
cauccuauagagucaaccacca

SEQ ID NO: 451400 - RNA, 22 nt, Homo sapiens
cauccugagcagugccagcuuu

SEQ ID NO: 451401 - RNA, 14 nt, Homo sapiens
cauccuggggcuca

SEQ ID NO: 451402 - RNA, 23 nt, Homo sapiens
gagagccuuaauggaugcucauu

SEQ ID NO: 451403 - RNA, 15 nt, Homo sapiens
gagagccuugguuca

SEQ ID NO: 451404 - RNA, 23 nt, Homo sapiens
gagagcuaaauuacaauugucau

SEQ ID NO: 451405 - RNA, 19 nt, Homo sapiens
gagagcucaggauggcuca

SEQ ID NO: 451406 - RNA, 23 nt, Homo sapiens
gagagcuuucuguccuuuuggca

SEQ ID NO: 451407 - RNA, 20 nt, Homo sapiens
gagaggaguucaaugaucua

SEQ ID NO: 451408 - RNA, 21 nt, Homo sapiens
gagaggaugcacaguuugcua

SEQ ID NO: 451409 - RNA, 15 nt, Homo sapiens
gagaggcucugagaa

SEQ ID NO: 451410 - RNA, 15 nt, Homo sapiens
gagagggaugcagug

SEQ ID NO: 451411 - RNA, 22 nt, Homo sapiens
gagagucgcaucucagugcagg

SEQ ID NO: 451412 - RNA, 22 nt, Homo sapiens
gagagugaaaccaugacuguga

SEQ ID NO: 451413 - RNA, 20 nt, Homo sapiens
gagaguucuuuauauucaaa

SEQ ID NO: 451414 - RNA, 16 nt, Homo sapiens
gagauaaaccaauaaa

SEQ ID NO: 451415 - RNA, 20 nt, Homo sapiens
gagauagcaccauugcacuc

SEQ ID NO: 451416 - RNA, 13 nt, Homo sapiens
gagauauuuacau

SEQ ID NO: 451417 - RNA, 20 nt, Homo sapiens
gagaucaugucauugaugaa

SEQ ID NO: 451418 - RNA, 21 nt, Homo sapiens
gagaucgcaucauugcacucu

SEQ ID NO: 451419 - RNA, 23 nt, Homo sapiens
gagaucggcccagcucugacuga

SEQ ID NO: 451420 - RNA, 18 nt, Homo sapiens
gagaugagaaacaacaga

SEQ ID NO: 451421 - RNA, 14 nt, Homo sapiens
gagaugagacugau

SEQ ID NO: 451422 - RNA, 23 nt, Homo sapiens
gagaugagccccacguggagcuc

SEQ ID NO: 451423 - RNA, 14 nt, Homo sapiens
gagauggagaaaau

SEQ ID NO: 451424 - RNA, 17 nt, Homo sapiens
gagauggaggaaaguga

SEQ ID NO: 451425 - RNA, 14 nt, Homo sapiens
gagauggccaugua

SEQ ID NO: 451426 - RNA, 23 nt, Homo sapiens
gagaugggcuuguuuucuugcca

SEQ ID NO: 451427 - RNA, 17 nt, Homo sapiens
gagauguauuaugcaaa

SEQ ID NO: 451428 - RNA, 13 nt, Homo sapiens
gagauucugggaa

SEQ ID NO: 451429 - RNA, 16 nt, Homo sapiens
gagauuggcuuugccu

SEQ ID NO: 451430 - RNA, 18 nt, Homo sapiens
gagauuucuuguugcuca

SEQ ID NO: 451431 - RNA, 14 nt, Homo sapiens
gagcaaagggccag

SEQ ID NO: 451432 - RNA, 13 nt, Homo sapiens
gagcaaauggaac

SEQ ID NO: 451433 - RNA, 17 nt, Homo sapiens
gagcaaucguguauaag

SEQ ID NO: 451434 - RNA, 21 nt, Homo sapiens
gagcacaggcaacauuacaaa

SEQ ID NO: 451435 - RNA, 17 nt, Homo sapiens
gagcaccagguguuaaa

SEQ ID NO: 451436 - RNA, 11 nt, Homo sapiens
gagcaccucag

SEQ ID NO: 451437 - RNA, 21 nt, Homo sapiens
gagcacguuugcagaaggggg

SEQ ID NO: 451438 - RNA, 15 nt, Homo sapiens
gagcacuggccagag

SEQ ID NO: 451439 - RNA, 13 nt, Homo sapiens
gagcacuuccaaa

SEQ ID NO: 451440 - RNA, 14 nt, Homo sapiens
gagcagccucugcc

SEQ ID NO: 451441 - RNA, 12 nt, Homo sapiens
gagcagccugug

SEQ ID NO: 451442 - RNA, 13 nt, Homo sapiens
gagcaggcuucuu

SEQ ID NO: 451443 - RNA, 16 nt, Homo sapiens
gagcagugauucucuc

SEQ ID NO: 451444 - RNA, 22 nt, Homo sapiens
gagcagugauucucucuucucu

SEQ ID NO: 451445 - RNA, 22 nt, Homo sapiens
gagcaucccccaaaguucacaa

SEQ ID NO: 451446 - RNA, 17 nt, Homo sapiens
gagcauguuacugacag

SEQ ID NO: 451447 - RNA, 12 nt, Homo sapiens
gagccacaggga

SEQ ID NO: 451448 - RNA, 20 nt, Homo sapiens
gagccaccacguccagcugg

SEQ ID NO: 451449 - RNA, 18 nt, Homo sapiens
gagccaccucacccagcc

SEQ ID NO: 451450 - RNA, 21 nt, Homo sapiens
gagccagcagggcugugaugg

SEQ ID NO: 451451 - RNA, 13 nt, Homo sapiens
gagccagccaccc

SEQ ID NO: 451452 - RNA, 15 nt, Homo sapiens
gagccagucccucag

SEQ ID NO: 451453 - RNA, 16 nt, Homo sapiens
gagccagucccucagc

SEQ ID NO: 451454 - RNA, 13 nt, Homo sapiens
gagccaugcucuu

SEQ ID NO: 451455 - RNA, 15 nt, Homo sapiens
gagcccauccagucu

SEQ ID NO: 451456 - RNA, 15 nt, Homo sapiens
gagcccauucccacc

SEQ ID NO: 451457 - RNA, 15 nt, Homo sapiens
gagccccacccagac

SEQ ID NO: 451458 - RNA, 20 nt, Homo sapiens
gagcccccacccgggagcag

SEQ ID NO: 451459 - RNA, 21 nt, Homo sapiens
gagcccccaccugccugacca

SEQ ID NO: 451460 - RNA, 15 nt, Homo sapiens
gagccgagcucuccu

SEQ ID NO: 451461 - RNA, 14 nt, Homo sapiens
gagccucugcagac

SEQ ID NO: 451462 - RNA, 20 nt, Homo sapiens
gagccugcaggguggugcug

SEQ ID NO: 451463 - RNA, 18 nt, Homo sapiens
gagccuuauaaacagaua

SEQ ID NO: 451464 - RNA, 19 nt, Homo sapiens
gagcgagauuccgucucaa

SEQ ID NO: 451465 - RNA, 17 nt, Homo sapiens
gagcgcuaccucuccag

SEQ ID NO: 451466 - RNA, 18 nt, Homo sapiens
gagcuagaugugucuuac

SEQ ID NO: 451467 - RNA, 13 nt, Homo sapiens
gagcuccacagaa

SEQ ID NO: 451468 - RNA, 20 nt, Homo sapiens
gagcuccccaccaccccagc

SEQ ID NO: 451469 - RNA, 20 nt, Homo sapiens
agagcuuuuaaaaauguccu

SEQ ID NO: 451470 - RNA, 13 nt, Homo sapiens
agaggaaagaccu

SEQ ID NO: 451471 - RNA, 18 nt, Homo sapiens
agaggacauauucacagu

SEQ ID NO: 451472 - RNA, 14 nt, Homo sapiens
agaggacuuggcaa

SEQ ID NO: 451473 - RNA, 15 nt, Homo sapiens
agaggagucugggaa

SEQ ID NO: 451474 - RNA, 21 nt, Homo sapiens
agaggagugggaaauugauua

SEQ ID NO: 451475 - RNA, 19 nt, Homo sapiens
agaggaguucaaugaucua

SEQ ID NO: 451476 - RNA, 15 nt, Homo sapiens
acuacauuuucacaa

SEQ ID NO: 451477 - RNA, 19 nt, Homo sapiens
acuaccauguggccauuaa

SEQ ID NO: 451478 - RNA, 18 nt, Homo sapiens
acuaccauuguacccugc

SEQ ID NO: 451479 - RNA, 16 nt, Homo sapiens
acuacccgagcccagc

SEQ ID NO: 451480 - RNA, 14 nt, Homo sapiens
acuacgacuggcau

SEQ ID NO: 451481 - RNA, 16 nt, Homo sapiens
acuacgacuggcaucu

SEQ ID NO: 451482 - RNA, 15 nt, Homo sapiens
acuacgcuugcucau

SEQ ID NO: 451483 - RNA, 16 nt, Homo sapiens
acuacucugucuucac

SEQ ID NO: 451484 - RNA, 22 nt, Homo sapiens
acuacuuucuuaauaucacuuu

SEQ ID NO: 451485 - RNA, 13 nt, Homo sapiens
acuagacaugcca

SEQ ID NO: 451486 - RNA, 20 nt, Homo sapiens
acuagacuacucaauauuaa

SEQ ID NO: 451487 - RNA, 16 nt, Homo sapiens
acuagagucugaacag

SEQ ID NO: 451488 - RNA, 23 nt, Homo sapiens
acuagagucugaacagcuguaau

SEQ ID NO: 451489 - RNA, 16 nt, Homo sapiens
acuagaucucccuuaa

SEQ ID NO: 451490 - RNA, 14 nt, Homo sapiens
acuagaucuccuau

SEQ ID NO: 451491 - RNA, 16 nt, Homo sapiens
acuagcaggcaugccg

SEQ ID NO: 451492 - RNA, 13 nt, Homo sapiens
acuaggacacucc

SEQ ID NO: 451493 - RNA, 14 nt, Homo sapiens
acuaggagcacugu

SEQ ID NO: 451494 - RNA, 23 nt, Homo sapiens
acuaggcacuguggcucugcaug

SEQ ID NO: 451495 - RNA, 20 nt, Homo sapiens
acuaguucagacacuuugga

SEQ ID NO: 451496 - RNA, 17 nt, Homo sapiens
acuaguuuuuauuccuu

SEQ ID NO: 451497 - RNA, 15 nt, Homo sapiens
acuauaaacauuaaa

SEQ ID NO: 451498 - RNA, 21 nt, Homo sapiens
acuauaugcauaaacaacagu

SEQ ID NO: 451499 - RNA, 14 nt, Homo sapiens
acuaucuagguauu

SEQ ID NO: 451500 - RNA, 23 nt, Homo sapiens
acuaucucuagagugagaaucug

SEQ ID NO: 451501 - RNA, 19 nt, Homo sapiens
acuaugaagcuaccucaaa

SEQ ID NO: 451502 - RNA, 21 nt, Homo sapiens
acuauggguggggcacuccuu

SEQ ID NO: 451503 - RNA, 16 nt, Homo sapiens
acuauuaacucugcau

SEQ ID NO: 451504 - RNA, 14 nt, Homo sapiens
acuauuauggaauu

SEQ ID NO: 451505 - RNA, 21 nt, Homo sapiens
acuauucccacuuucauucaa

SEQ ID NO: 451506 - RNA, 23 nt, Homo sapiens
acuauucuauaaacauaugcaaa

SEQ ID NO: 451507 - RNA, 14 nt, Homo sapiens
acuauuuuuccaaa

SEQ ID NO: 451508 - RNA, 23 nt, Homo sapiens
acucaaaaggagaacugugcucu

SEQ ID NO: 451509 - RNA, 14 nt, Homo sapiens
acucaagugucuca

SEQ ID NO: 451510 - RNA, 17 nt, Homo sapiens
acucacaacucucuggu

SEQ ID NO: 451511 - RNA, 21 nt, Homo sapiens
acucacagccguccaacuuaa

SEQ ID NO: 451512 - RNA, 18 nt, Homo sapiens
acucaccuugcucugcca

SEQ ID NO: 451513 - RNA, 14 nt, Homo sapiens
acucacugcucaag

SEQ ID NO: 451514 - RNA, 13 nt, Homo sapiens
acucagaaggcaa

SEQ ID NO: 451515 - RNA, 22 nt, Homo sapiens
acucagccuuaagaaagcuaua

SEQ ID NO: 451516 - RNA, 12 nt, Homo sapiens
acucaggaucca

SEQ ID NO: 451517 - RNA, 16 nt, Homo sapiens
acucaggccugccaau

SEQ ID NO: 451518 - RNA, 16 nt, Homo sapiens
acucagggauuccuuc

SEQ ID NO: 451519 - RNA, 17 nt, Homo sapiens
acucagugcagcaauau

SEQ ID NO: 451520 - RNA, 13 nt, Homo sapiens
acucauaacucau

SEQ ID NO: 451521 - RNA, 15 nt, Homo sapiens
acucaucuguuaucc

SEQ ID NO: 451522 - RNA, 21 nt, Homo sapiens
acuccaauuacuccaccauca

SEQ ID NO: 451523 - RNA, 14 nt, Homo sapiens
acuccagauaugaa

SEQ ID NO: 451524 - RNA, 12 nt, Homo sapiens
acuccaugagaa

SEQ ID NO: 451525 - RNA, 15 nt, Homo sapiens
acucccuaaagcccu

SEQ ID NO: 451526 - RNA, 14 nt, Homo sapiens
acucccuccaugug

SEQ ID NO: 451527 - RNA, 16 nt, Homo sapiens
acucccucucuugccg

SEQ ID NO: 451528 - RNA, 14 nt, Homo sapiens
acuccugaccucag

SEQ ID NO: 451529 - RNA, 18 nt, Homo sapiens
acuccuuaauaugaucug

SEQ ID NO: 451530 - RNA, 23 nt, Homo sapiens
acuccuuaauaugaucuguggag

SEQ ID NO: 451531 - RNA, 13 nt, Homo sapiens
acuccuuccauca

SEQ ID NO: 451532 - RNA, 12 nt, Homo sapiens
acuccuugccau

SEQ ID NO: 451533 - RNA, 21 nt, Homo sapiens
acuccuuuugguuuaccuggg

SEQ ID NO: 451534 - RNA, 13 nt, Homo sapiens
acucgcagcaccc

SEQ ID NO: 451535 - RNA, 19 nt, Homo sapiens
acucgcccgcccacugucc

SEQ ID NO: 451536 - RNA, 23 nt, Homo sapiens
acucgcuucucugugacugaugu

SEQ ID NO: 451537 - RNA, 17 nt, Homo sapiens
acucgucugacugugug

SEQ ID NO: 451538 - RNA, 21 nt, Homo sapiens
acucgucuuggcacaaucuca

SEQ ID NO: 451539 - RNA, 15 nt, Homo sapiens
acucuaaguguaaaa

SEQ ID NO: 451540 - RNA, 13 nt, Homo sapiens
acucuacaaaaug

SEQ ID NO: 451541 - RNA, 18 nt, Homo sapiens
acucuacccccaacacca

SEQ ID NO: 451542 - RNA, 13 nt, Homo sapiens
acucuagccaaau

SEQ ID NO: 451543 - RNA, 23 nt, Homo sapiens
acucucacaagauggaaaucaca

SEQ ID NO: 451544 - RNA, 14 nt, Homo sapiens
acucucugaagaug

SEQ ID NO: 451545 - RNA, 23 nt, Homo sapiens
acucucugccagcuccacagggu

SEQ ID NO: 451546 - RNA, 15 nt, Homo sapiens
acucugaauccucau

SEQ ID NO: 451547 - RNA, 15 nt, Homo sapiens
acucugacaguauua

SEQ ID NO: 451548 - RNA, 19 nt, Homo sapiens
acucugaccuucacaggga

SEQ ID NO: 451549 - RNA, 22 nt, Homo sapiens
acucugcuuugacugagcagac

SEQ ID NO: 451550 - RNA, 14 nt, Homo sapiens
acucugcuuugcau

SEQ ID NO: 451551 - RNA, 19 nt, Homo sapiens
acucuggaccccaggccau

SEQ ID NO: 451552 - RNA, 23 nt, Homo sapiens
acucuggcuccuucuccauaaag

SEQ ID NO: 451553 - RNA, 18 nt, Homo sapiens
acucugguaaaugaucac

SEQ ID NO: 451554 - RNA, 12 nt, Homo sapiens
acucugguggca

SEQ ID NO: 451555 - RNA, 17 nt, Homo sapiens
acucuguccaggccacu

SEQ ID NO: 451556 - RNA, 18 nt, Homo sapiens
acucuuacuaaccaccau

SEQ ID NO: 451557 - RNA, 21 nt, Homo sapiens
acucuuaugaaaugggcuuua

SEQ ID NO: 451558 - RNA, 17 nt, Homo sapiens
acucuucaugagcacuu

SEQ ID NO: 451559 - RNA, 15 nt, Homo sapiens
acucuugaugugaag

SEQ ID NO: 451560 - RNA, 19 nt, Homo sapiens
acucuuucuggccugccuu

SEQ ID NO: 451561 - RNA, 14 nt, Homo sapiens
acugaaaacuguaa

SEQ ID NO: 451562 - RNA, 13 nt, Homo sapiens
acugaaacauuca

SEQ ID NO: 451563 - RNA, 15 nt, Homo sapiens
acugaaacauucaca

SEQ ID NO: 451564 - RNA, 14 nt, Homo sapiens
acugaaacauuuga

SEQ ID NO: 451565 - RNA, 15 nt, Homo sapiens
acugaaagaagacau

SEQ ID NO: 451566 - RNA, 18 nt, Homo sapiens
acugaacaaucaaagcac

SEQ ID NO: 451567 - RNA, 12 nt, Homo sapiens
acugaacauauu

SEQ ID NO: 451568 - RNA, 22 nt, Homo sapiens
acugaaccuuguugaugccagc

SEQ ID NO: 451569 - RNA, 20 nt, Homo sapiens
acugaagagcaggugagcaa

SEQ ID NO: 451570 - RNA, 19 nt, Homo sapiens
acugaaggacacagcagug

SEQ ID NO: 451571 - RNA, 14 nt, Homo sapiens
acugaaggggcaca

SEQ ID NO: 451572 - RNA, 13 nt, Homo sapiens
acugaauacuuga

SEQ ID NO: 451573 - RNA, 13 nt, Homo sapiens
acugaauuccauu

SEQ ID NO: 451574 - RNA, 21 nt, Homo sapiens
acugacacugcgaacucucag

SEQ ID NO: 451575 - RNA, 11 nt, Homo sapiens
acugaccagcc

SEQ ID NO: 451576 - RNA, 16 nt, Homo sapiens
acugaccagccuccau

SEQ ID NO: 451577 - RNA, 19 nt, Homo sapiens
acugaccagccuccaugcu

SEQ ID NO: 451578 - RNA, 19 nt, Homo sapiens
acugagaacagaucuccaa

SEQ ID NO: 451579 - RNA, 13 nt, Homo sapiens
acugagacuugaa

SEQ ID NO: 451580 - RNA, 21 nt, Homo sapiens
acuuuaucaauuaacugagua

SEQ ID NO: 451581 - RNA, 15 nt, Homo sapiens
acuuuauguauggag

SEQ ID NO: 451582 - RNA, 12 nt, Homo sapiens
acuuuauucuug

SEQ ID NO: 451583 - RNA, 16 nt, Homo sapiens
acuuucaaaauuaaau

SEQ ID NO: 451584 - RNA, 16 nt, Homo sapiens
acuuucacacuaagaa

SEQ ID NO: 451585 - RNA, 13 nt, Homo sapiens
acuuucagcugga

SEQ ID NO: 451586 - RNA, 14 nt, Homo sapiens
acuuuccagcagua

SEQ ID NO: 451587 - RNA, 21 nt, Homo sapiens
acuuucccuccaccagugugc

SEQ ID NO: 451588 - RNA, 22 nt, Homo sapiens
acuuuccuauuuucuuuuccau

SEQ ID NO: 451589 - RNA, 21 nt, Homo sapiens
acuuucugaaauaacauggcc

SEQ ID NO: 451590 - RNA, 23 nt, Homo sapiens
acuuucuuaauaucacuuugguc

SEQ ID NO: 451591 - RNA, 18 nt, Homo sapiens
acuuucuuaucacuuaua

SEQ ID NO: 451592 - RNA, 20 nt, Homo sapiens
acuuugacgagucaccuucc

SEQ ID NO: 451593 - RNA, 19 nt, Homo sapiens
acuuugacuaauacccaaa

SEQ ID NO: 451594 - RNA, 14 nt, Homo sapiens
acuuugaguaccaa

SEQ ID NO: 451595 - RNA, 12 nt, Homo sapiens
acuuugauacca

SEQ ID NO: 451596 - RNA, 23 nt, Homo sapiens
acuuuguauuuguucaguaugca

SEQ ID NO: 451597 - RNA, 16 nt, Homo sapiens
acuuugucacuucugc

SEQ ID NO: 451598 - RNA, 18 nt, Homo sapiens
agacagacuugagaacuu

SEQ ID NO: 451599 - RNA, 16 nt, Homo sapiens
agacagagcagaucag

SEQ ID NO: 451600 - RNA, 16 nt, Homo sapiens
agacagauacuccucc

SEQ ID NO: 451601 - RNA, 16 nt, Homo sapiens
agacagcagggacaag

SEQ ID NO: 451602 - RNA, 15 nt, Homo sapiens
agacaggguggggcu

SEQ ID NO: 451603 - RNA, 19 nt, Homo sapiens
agacaggguuucacugugu

SEQ ID NO: 451604 - RNA, 18 nt, Homo sapiens
agacaguaugagucaaug

SEQ ID NO: 451605 - RNA, 13 nt, Homo sapiens
agacagucucaag

SEQ ID NO: 451606 - RNA, 22 nt, Homo sapiens
agacauaccucucaacuuacau

SEQ ID NO: 451607 - RNA, 14 nt, Homo sapiens
agacauaucucuaa

SEQ ID NO: 451608 - RNA, 14 nt, Homo sapiens
agacaucaagauac

SEQ ID NO: 451609 - RNA, 15 nt, Homo sapiens
agacauccugagcag

SEQ ID NO: 451610 - RNA, 16 nt, Homo sapiens
agacaucuagucucag

SEQ ID NO: 451611 - RNA, 15 nt, Homo sapiens
agacaugaaauugag

SEQ ID NO: 451612 - RNA, 14 nt, Homo sapiens
agacaugaaccaag

SEQ ID NO: 451613 - RNA, 15 nt, Homo sapiens
agacaugaaccacca

SEQ ID NO: 451614 - RNA, 20 nt, Homo sapiens
agacaugagccuccgcgccu

SEQ ID NO: 451615 - RNA, 22 nt, Homo sapiens
agacaugccaacucgggagcau

SEQ ID NO: 451616 - RNA, 16 nt, Homo sapiens
agacauguaucacugu

SEQ ID NO: 451617 - RNA, 12 nt, Homo sapiens
agacauuccaag

SEQ ID NO: 451618 - RNA, 20 nt, Homo sapiens
agacauuucaaaucuguagc

SEQ ID NO: 451619 - RNA, 15 nt, Homo sapiens
agaccacuguuauca

SEQ ID NO: 451620 - RNA, 12 nt, Homo sapiens
agaccagcuuug

SEQ ID NO: 451621 - RNA, 19 nt, Homo sapiens
agaccagggugguugggac

SEQ ID NO: 451622 - RNA, 18 nt, Homo sapiens
agacccacaaacugccug

SEQ ID NO: 451623 - RNA, 15 nt, Homo sapiens
agaccccaagcauuc

SEQ ID NO: 451624 - RNA, 20 nt, Homo sapiens
agaccccuacccuuucccaa

SEQ ID NO: 451625 - RNA, 21 nt, Homo sapiens
agaccccuacccuuucccaaa

SEQ ID NO: 451626 - RNA, 21 nt, Homo sapiens
agacccucccccaccauucca

SEQ ID NO: 451627 - RNA, 17 nt, Homo sapiens
agacccugaguccuugg

SEQ ID NO: 451628 - RNA, 20 nt, Homo sapiens
agacccugccaacuuuccag

SEQ ID NO: 451629 - RNA, 22 nt, Homo sapiens
agaccuaacccaccauagucaa

SEQ ID NO: 451630 - RNA, 14 nt, Homo sapiens
agaccuccagcugu

SEQ ID NO: 451631 - RNA, 18 nt, Homo sapiens
agaccugaaaaaguuuug

SEQ ID NO: 451632 - RNA, 22 nt, Homo sapiens
agaccugaaaaaguuuugugga

SEQ ID NO: 451633 - RNA, 19 nt, Homo sapiens
agaccuguaaucauauaau

SEQ ID NO: 451634 - RNA, 14 nt, Homo sapiens
agaccugugcuagu

SEQ ID NO: 451635 - RNA, 14 nt, Homo sapiens
agaccuugccuccc

SEQ ID NO: 451636 - RNA, 12 nt, Homo sapiens
agaccuuggcau

SEQ ID NO: 451637 - RNA, 18 nt, Homo sapiens
agacgcaaggaucacuug

SEQ ID NO: 451638 - RNA, 21 nt, Homo sapiens
agacgcaaggaucacuugagc

SEQ ID NO: 451639 - RNA, 14 nt, Homo sapiens
agacgccuccccaa

SEQ ID NO: 451640 - RNA, 13 nt, Homo sapiens
agacgugaugaag

SEQ ID NO: 451641 - RNA, 11 nt, Homo sapiens
agacuacaggg

SEQ ID NO: 451642 - RNA, 22 nt, Homo sapiens
agacuauaagcagaagcacaua

SEQ ID NO: 451643 - RNA, 14 nt, Homo sapiens
agacuaucaaagac

SEQ ID NO: 451644 - RNA, 18 nt, Homo sapiens
agacucacuaaauccuuu

SEQ ID NO: 451645 - RNA, 17 nt, Homo sapiens
agacucaguuugucaga

SEQ ID NO: 451646 - RNA, 17 nt, Homo sapiens
agacucauacagaaggu

SEQ ID NO: 451647 - RNA, 16 nt, Homo sapiens
agacucauuguaauuc

SEQ ID NO: 451648 - RNA, 14 nt, Homo sapiens
agacucuauucuca

SEQ ID NO: 451649 - RNA, 13 nt, Homo sapiens
agacucugucuca

SEQ ID NO: 451650 - RNA, 20 nt, Homo sapiens
agacucuuuaguugauuuaa

SEQ ID NO: 451651 - RNA, 17 nt, Homo sapiens
agacugaacagccaaau

SEQ ID NO: 451652 - RNA, 12 nt, Homo sapiens
agacugagcucc

SEQ ID NO: 451653 - RNA, 18 nt, Homo sapiens
agacugcaggguccccaa

SEQ ID NO: 451654 - RNA, 21 nt, Homo sapiens
agacugggucucgcuuuguug

SEQ ID NO: 451655 - RNA, 19 nt, Homo sapiens
agacugucucaagagggca

SEQ ID NO: 451656 - RNA, 16 nt, Homo sapiens
agacuguggaacuauu

SEQ ID NO: 451657 - RNA, 17 nt, Homo sapiens
agacuuaaaucacagau

SEQ ID NO: 451658 - RNA, 16 nt, Homo sapiens
agacuuaaucauauca

SEQ ID NO: 451659 - RNA, 18 nt, Homo sapiens
agacuuagccccaugagu

SEQ ID NO: 451660 - RNA, 15 nt, Homo sapiens
agacuucuuugcaac

SEQ ID NO: 451661 - RNA, 19 nt, Homo sapiens
agacuuggggaaauugcuu

SEQ ID NO: 451662 - RNA, 14 nt, Homo sapiens
agagaaaacacuuu

SEQ ID NO: 451663 - RNA, 13 nt, Homo sapiens
agagaaaacuuau

SEQ ID NO: 451664 - RNA, 13 nt, Homo sapiens
agagaaaauaauu

SEQ ID NO: 451665 - RNA, 13 nt, Homo sapiens
agagaaaguguga

SEQ ID NO: 451666 - RNA, 16 nt, Homo sapiens
agagaaauacuuucag

SEQ ID NO: 451667 - RNA, 17 nt, Homo sapiens
agagaacaaagggccaa

SEQ ID NO: 451668 - RNA, 17 nt, Homo sapiens
agagaaccgagcaaaga

SEQ ID NO: 451669 - RNA, 17 nt, Homo sapiens
agagaagccuuuuccau

SEQ ID NO: 451670 - RNA, 13 nt, Homo sapiens
agagaaggccugg

SEQ ID NO: 451671 - RNA, 20 nt, Homo sapiens
agagaauucucuuauccaac

SEQ ID NO: 451672 - RNA, 18 nt, Homo sapiens
agagacaggacuagcugg

SEQ ID NO: 451673 - RNA, 19 nt, Homo sapiens
agagacccccgugccaaau

SEQ ID NO: 451674 - RNA, 17 nt, Homo sapiens
agagacgcaccuugcug

SEQ ID NO: 451675 - RNA, 22 nt, Homo sapiens
agagacuucuaggaggaugcug

SEQ ID NO: 451676 - RNA, 15 nt, Homo sapiens
agagagagagagaaa

SEQ ID NO: 451677 - RNA, 22 nt, Homo sapiens
agagagagugagagcacaaaga

SEQ ID NO: 451678 - RNA, 13 nt, Homo sapiens
agagagauggaau

SEQ ID NO: 451679 - RNA, 13 nt, Homo sapiens
agagagcaaagau

SEQ ID NO: 451680 - RNA, 15 nt, Homo sapiens
agagagccucagggc

SEQ ID NO: 451681 - RNA, 11 nt, Homo sapiens
agagagccugc

SEQ ID NO: 451682 - RNA, 15 nt, Homo sapiens
agagaggacuguuga

SEQ ID NO: 451683 - RNA, 14 nt, Homo sapiens
agagaggaguucaa

SEQ ID NO: 451684 - RNA, 15 nt, Homo sapiens
agagaggaucacuua

SEQ ID NO: 451685 - RNA, 23 nt, Homo sapiens
agagagucgcaucucagugcagg

SEQ ID NO: 451686 - RNA, 14 nt, Homo sapiens
agagagucuuccag

SEQ ID NO: 451687 - RNA, 13 nt, Homo sapiens
agagaugagcuuu

SEQ ID NO: 451688 - RNA, 12 nt, Homo sapiens
agagaugcugcu

SEQ ID NO: 451689 - RNA, 19 nt, Homo sapiens
agagauggaauaaagcccu

SEQ ID NO: 451690 - RNA, 16 nt, Homo sapiens
agagaugggacuagga

SEQ ID NO: 451691 - RNA, 17 nt, Homo sapiens
agagaugggacuaggac

SEQ ID NO: 451692 - RNA, 16 nt, Homo sapiens
agagaugggacuggga

SEQ ID NO: 451693 - RNA, 19 nt, Homo sapiens
agagauuacuuugcugccu

SEQ ID NO: 451694 - RNA, 16 nt, Homo sapiens
agagauucccaagcca

SEQ ID NO: 451695 - RNA, 13 nt, Homo sapiens
agagauuuucaag

SEQ ID NO: 451696 - RNA, 23 nt, Homo sapiens
agagcaaagacuuaaucauauca

SEQ ID NO: 451697 - RNA, 16 nt, Homo sapiens
agagcaaaggagacaa

SEQ ID NO: 451698 - RNA, 17 nt, Homo sapiens
agagcaaaucuaugaga

SEQ ID NO: 451699 - RNA, 19 nt, Homo sapiens
agagcaaucuugcugugaa

SEQ ID NO: 451700 - RNA, 23 nt, Homo sapiens
agagcaaucuugcugugaaacag

SEQ ID NO: 451701 - RNA, 10 nt, Homo sapiens
agagcacugg

SEQ ID NO: 451702 - RNA, 13 nt, Homo sapiens
agagcagaaccaa

SEQ ID NO: 451703 - RNA, 18 nt, Homo sapiens
agagcagauucuagcaca

SEQ ID NO: 451704 - RNA, 14 nt, Homo sapiens
agagcagcuggcuc

SEQ ID NO: 451705 - RNA, 13 nt, Homo sapiens
agagcaggaaaug

SEQ ID NO: 451706 - RNA, 13 nt, Homo sapiens
agagcagggauua

SEQ ID NO: 451707 - RNA, 12 nt, Homo sapiens
agagcagugugg

SEQ ID NO: 451708 - RNA, 16 nt, Homo sapiens
agagcaguguggaaaa

SEQ ID NO: 451709 - RNA, 21 nt, Homo sapiens
agagccaaccucggcuugugg

SEQ ID NO: 451710 - RNA, 14 nt, Homo sapiens
agagccacuaccuu

SEQ ID NO: 451711 - RNA, 13 nt, Homo sapiens
agagccagugaag

SEQ ID NO: 451712 - RNA, 20 nt, Homo sapiens
agagcccuucacugccauga

SEQ ID NO: 451713 - RNA, 12 nt, Homo sapiens
agagccuggaag

SEQ ID NO: 451714 - RNA, 16 nt, Homo sapiens
agagcuagucuuucac

SEQ ID NO: 451715 - RNA, 14 nt, Homo sapiens
agagcuauggugag

SEQ ID NO: 451716 - RNA, 14 nt, Homo sapiens
agagcucaggagaa

SEQ ID NO: 451717 - RNA, 10 nt, Homo sapiens
agagcucuau

SEQ ID NO: 451718 - RNA, 18 nt, Homo sapiens
agagcugggaguagcaug

SEQ ID NO: 451719 - RNA, 16 nt, Homo sapiens
agagcuucucccaaac

SEQ ID NO: 451720 - RNA, 22 nt, Homo sapiens
aacucucuccuguauaaucucu

SEQ ID NO: 451721 - RNA, 22 nt, Homo sapiens
aacucugggcacuuuugaacuc

SEQ ID NO: 451722 - RNA, 23 nt, Homo sapiens
aacucugggcacuuuugaacuca

SEQ ID NO: 451723 - RNA, 17 nt, Homo sapiens
aacucugggcugccaug

SEQ ID NO: 451724 - RNA, 18 nt, Homo sapiens
aacucugggcugccaugu

SEQ ID NO: 451725 - RNA, 22 nt, Homo sapiens
aacucuuccuggaaugcauuca

SEQ ID NO: 451726 - RNA, 12 nt, Homo sapiens
aacucuugcuca

SEQ ID NO: 451727 - RNA, 13 nt, Homo sapiens
aacugaacauauu

SEQ ID NO: 451728 - RNA, 14 nt, Homo sapiens
aacugaagcccaca

SEQ ID NO: 451729 - RNA, 21 nt, Homo sapiens
aacugaauucugaacuuuuca

SEQ ID NO: 451730 - RNA, 13 nt, Homo sapiens
aacugacaguaaa

SEQ ID NO: 451731 - RNA, 15 nt, Homo sapiens
aacugaccaguuguu

SEQ ID NO: 451732 - RNA, 18 nt, Homo sapiens
aacugacuuaaguggcau

SEQ ID NO: 451733 - RNA, 21 nt, Homo sapiens
aacugagauuacaggcaccca

SEQ ID NO: 451734 - RNA, 23 nt, Homo sapiens
aacugaggaaugcgguucagggc

SEQ ID NO: 451735 - RNA, 21 nt, Homo sapiens
aacugcagaauuuugcacagu

SEQ ID NO: 451736 - RNA, 22 nt, Homo sapiens
aacugcaucaagaugugacaug

SEQ ID NO: 451737 - RNA, 16 nt, Homo sapiens
aacugcuguguucuca

SEQ ID NO: 451738 - RNA, 19 nt, Homo sapiens
aacugggccuguugcccuu

SEQ ID NO: 451739 - RNA, 20 nt, Homo sapiens
aacuggucuuccauuuugcc

SEQ ID NO: 451740 - RNA, 14 nt, Homo sapiens
aacugguucuugcc

SEQ ID NO: 451741 - RNA, 18 nt, Homo sapiens
aacuguaaaauacuucuu

SEQ ID NO: 451742 - RNA, 19 nt, Homo sapiens
aacuguaacauauaugaaa

SEQ ID NO: 451743 - RNA, 23 nt, Homo sapiens
aacuguacaguuucuuccccaag

SEQ ID NO: 451744 - RNA, 12 nt, Homo sapiens
aacuguauuuau

SEQ ID NO: 451745 - RNA, 20 nt, Homo sapiens
aacugugaauacuugaacuc

SEQ ID NO: 451746 - RNA, 11 nt, Homo sapiens
aacugugcucu

SEQ ID NO: 451747 - RNA, 23 nt, Homo sapiens
aacugugcucucccaaagccaua

SEQ ID NO: 451748 - RNA, 22 nt, Homo sapiens
aacuguggaaggcacacugagc

SEQ ID NO: 451749 - RNA, 21 nt, Homo sapiens
aacuguuaguauuaacuauua

SEQ ID NO: 451750 - RNA, 20 nt, Homo sapiens
aacuguugauugcaggaaua

SEQ ID NO: 451751 - RNA, 18 nt, Homo sapiens
aacuguugccagagaugg

SEQ ID NO: 451752 - RNA, 13 nt, Homo sapiens
aacuuaacauuca

SEQ ID NO: 451753 - RNA, 13 nt, Homo sapiens
aacuuaacauugc

SEQ ID NO: 451754 - RNA, 12 nt, Homo sapiens
aacuuaauguuc

SEQ ID NO: 451755 - RNA, 15 nt, Homo sapiens
aacuuaauuaccuaa

SEQ ID NO: 451756 - RNA, 20 nt, Homo sapiens
aacuuagaucaucagucacc

SEQ ID NO: 451757 - RNA, 14 nt, Homo sapiens
aacuucaucugucu

SEQ ID NO: 451758 - RNA, 13 nt, Homo sapiens
aacuucauucuaa

SEQ ID NO: 451759 - RNA, 13 nt, Homo sapiens
aacuucauuugau

SEQ ID NO: 451760 - RNA, 15 nt, Homo sapiens
aacuuccaauuuaca

SEQ ID NO: 451761 - RNA, 14 nt, Homo sapiens
aacuuccacuaccu

SEQ ID NO: 451762 - RNA, 19 nt, Homo sapiens
aacuuccagguuccaucca

SEQ ID NO: 451763 - RNA, 16 nt, Homo sapiens
aacuuccauucuuucu

SEQ ID NO: 451764 - RNA, 16 nt, Homo sapiens
aacuucccagugaauu

SEQ ID NO: 451765 - RNA, 17 nt, Homo sapiens
aacuucuaguugcucuu

SEQ ID NO: 451766 - RNA, 22 nt, Homo sapiens
aacuugauuguugagacgccuu

SEQ ID NO: 451767 - RNA, 22 nt, Homo sapiens
aacuuggguuugcgcuaaaaag

SEQ ID NO: 451768 - RNA, 16 nt, Homo sapiens
aacuuggugccuaaug

SEQ ID NO: 451769 - RNA, 12 nt, Homo sapiens
aacuuguaaaua

SEQ ID NO: 451770 - RNA, 14 nt, Homo sapiens
aacuuucccuccac

SEQ ID NO: 451771 - RNA, 19 nt, Homo sapiens
aacuuuccucgccugacaa

SEQ ID NO: 451772 - RNA, 22 nt, Homo sapiens
aacuuuccucgccugacaacca

SEQ ID NO: 451773 - RNA, 23 nt, Homo sapiens
aacuuugacgagucaccuuccag

SEQ ID NO: 451774 - RNA, 19 nt, Homo sapiens
aacuuuguggaugucuucc

SEQ ID NO: 451775 - RNA, 22 nt, Homo sapiens
aacuuuguggaugucuuccuug

SEQ ID NO: 451776 - RNA, 15 nt, Homo sapiens
aacuuuguuucucau

SEQ ID NO: 451777 - RNA, 23 nt, Homo sapiens
aacuuuuaccuggcugcugccau

SEQ ID NO: 451778 - RNA, 16 nt, Homo sapiens
aagaaaaacaccgcuu

SEQ ID NO: 451779 - RNA, 21 nt, Homo sapiens
aagaaaaacaccgcuucugcc

SEQ ID NO: 451780 - RNA, 15 nt, Homo sapiens
aagaaaaauaaucuu

SEQ ID NO: 451781 - RNA, 15 nt, Homo sapiens
aagaaaacauuccag

SEQ ID NO: 451782 - RNA, 21 nt, Homo sapiens
aagaaaacuuguguucaaucu

SEQ ID NO: 451783 - RNA, 13 nt, Homo sapiens
aagaaaaugaagc

SEQ ID NO: 451784 - RNA, 20 nt, Homo sapiens
aagaaacaaagaaggacaga

SEQ ID NO: 451785 - RNA, 15 nt, Homo sapiens
aagaaacaccacuua

SEQ ID NO: 451786 - RNA, 15 nt, Homo sapiens
aagaaagacuccuuu

SEQ ID NO: 451787 - RNA, 21 nt, Homo sapiens
aagaaagacucuauucucaaa

SEQ ID NO: 451788 - RNA, 19 nt, Homo sapiens
aagaaagcuauauaugaau

SEQ ID NO: 451789 - RNA, 17 nt, Homo sapiens
aagaaauaacacuguga

SEQ ID NO: 451790 - RNA, 18 nt, Homo sapiens
aagaaauaauacccugcc

SEQ ID NO: 451791 - RNA, 18 nt, Homo sapiens
aagaaauauauacuugag

SEQ ID NO: 451792 - RNA, 15 nt, Homo sapiens
aagaaaugcauaaaa

SEQ ID NO: 451793 - RNA, 22 nt, Homo sapiens
aagaaauggaaucagcuuuuaa

SEQ ID NO: 451794 - RNA, 23 nt, Homo sapiens
aagaaauggcuuuccacaucccc

SEQ ID NO: 451795 - RNA, 12 nt, Homo sapiens
aagaacaucagu

SEQ ID NO: 451796 - RNA, 14 nt, Homo sapiens
aagaacaucaguuc

SEQ ID NO: 451797 - RNA, 17 nt, Homo sapiens
aagaacugcuuaguauu

SEQ ID NO: 451798 - RNA, 24 nt, Homo sapiens
aagaacuucucguagaugcugccu

SEQ ID NO: 451799 - RNA, 18 nt, Homo sapiens
aagaacuuugcacacuuc

SEQ ID NO: 451800 - RNA, 15 nt, Homo sapiens
aagaagaauauguau

SEQ ID NO: 451801 - RNA, 12 nt, Homo sapiens
aagaagacauga

SEQ ID NO: 451802 - RNA, 19 nt, Homo sapiens
aagaagacucgucuuggca

SEQ ID NO: 451803 - RNA, 15 nt, Homo sapiens
aagaagccacagacc

SEQ ID NO: 451804 - RNA, 17 nt, Homo sapiens
aagaagcccuccuugcc

SEQ ID NO: 451805 - RNA, 16 nt, Homo sapiens
aagaagucaaacuacu

SEQ ID NO: 451806 - RNA, 18 nt, Homo sapiens
aagaauaauaauggcuaa

SEQ ID NO: 451807 - RNA, 16 nt, Homo sapiens
aagaauacacugugac

SEQ ID NO: 451808 - RNA, 13 nt, Homo sapiens
aagaaucuaauag

SEQ ID NO: 451809 - RNA, 18 nt, Homo sapiens
aagaauucaaaccugacc

SEQ ID NO: 451810 - RNA, 22 nt, Homo sapiens
aagaauuggggauucucuauug

SEQ ID NO: 451811 - RNA, 22 nt, Homo sapiens
aagaauuuuuuuuaacauucca

SEQ ID NO: 451812 - RNA, 22 nt, Homo sapiens
aagacaaaugggccugccaaac

SEQ ID NO: 451813 - RNA, 21 nt, Homo sapiens
aagacaaauugaucagugcuu

SEQ ID NO: 451814 - RNA, 16 nt, Homo sapiens
aagacacguucuugcc

SEQ ID NO: 451815 - RNA, 21 nt, Homo sapiens
aagacacguucuugccagcuu

SEQ ID NO: 451816 - RNA, 16 nt, Homo sapiens
aagacagauacuccuc

SEQ ID NO: 451817 - RNA, 16 nt, Homo sapiens
aagacagaugccccag

SEQ ID NO: 451818 - RNA, 19 nt, Homo sapiens
aagacauaggaacauguag

SEQ ID NO: 451819 - RNA, 21 nt, Homo sapiens
aagacauccugagcagugcca

SEQ ID NO: 451820 - RNA, 13 nt, Homo sapiens
aagacaugaacca

SEQ ID NO: 451821 - RNA, 13 nt, Homo sapiens
aagacauucacca

SEQ ID NO: 451822 - RNA, 17 nt, Homo sapiens
aagacauucaccaacaa

SEQ ID NO: 451823 - RNA, 22 nt, Homo sapiens
aagacauucaccaacaacaguc

SEQ ID NO: 451824 - RNA, 14 nt, Homo sapiens
aagacauucuucca

SEQ ID NO: 451825 - RNA, 13 nt, Homo sapiens
aagaccaauguga

SEQ ID NO: 451826 - RNA, 21 nt, Homo sapiens
aagaccacacuugguguuacc

SEQ ID NO: 451827 - RNA, 19 nt, Homo sapiens
aagaccgauagcaggugaa

SEQ ID NO: 451828 - RNA, 20 nt, Homo sapiens
aagaccuucugaagaucuca

SEQ ID NO: 451829 - RNA, 18 nt, Homo sapiens
aagacuagaggcuugcau

SEQ ID NO: 451830 - RNA, 23 nt, Homo sapiens
aagacugaaucuaccugcccuaa

SEQ ID NO: 451831 - RNA, 18 nt, Homo sapiens
aagacugaccuugauguc

SEQ ID NO: 451832 - RNA, 23 nt, Homo sapiens
aagacuggaaaauaguccuccaa

SEQ ID NO: 451833 - RNA, 11 nt, Homo sapiens
aagacuuuucu

SEQ ID NO: 451834 - RNA, 15 nt, Homo sapiens
aagagaaaggggcaa

SEQ ID NO: 451835 - RNA, 15 nt, Homo sapiens
aagagaaaugagcuu

SEQ ID NO: 451836 - RNA, 14 nt, Homo sapiens
aagagaacugauga

SEQ ID NO: 451837 - RNA, 14 nt, Homo sapiens
aagagaaugccauu

SEQ ID NO: 451838 - RNA, 15 nt, Homo sapiens
aagagacuucugcuu

SEQ ID NO: 451839 - RNA, 17 nt, Homo sapiens
aagagaggaguucaaug

SEQ ID NO: 451840 - RNA, 23 nt, Homo sapiens
aagagagucgcaucucagugcag

SEQ ID NO: 451841 - RNA, 17 nt, Homo sapiens
aagagagugaacauauc

SEQ ID NO: 451842 - RNA, 17 nt, Homo sapiens
aagagcaggugagcaaa

SEQ ID NO: 451843 - RNA, 22 nt, Homo sapiens
aagagcuaaguucuaaguucau

SEQ ID NO: 451844 - RNA, 14 nt, Homo sapiens
aagagcuggaugca

SEQ ID NO: 451845 - RNA, 21 nt, Homo sapiens
aagagcuggaugcacaucagg

SEQ ID NO: 451846 - RNA, 14 nt, Homo sapiens
aagaggacuugaac

SEQ ID NO: 451847 - RNA, 14 nt, Homo sapiens
aagaggcauuccca

SEQ ID NO: 451848 - RNA, 17 nt, Homo sapiens
aagagggaacuuagcag

SEQ ID NO: 451849 - RNA, 13 nt, Homo sapiens
aagaguaguaaua

SEQ ID NO: 451850 - RNA, 22 nt, Homo sapiens
aaggcgguacuaguucagacac

SEQ ID NO: 451851 - RNA, 16 nt, Homo sapiens
aaggcuccuccuugcc

SEQ ID NO: 451852 - RNA, 22 nt, Homo sapiens
aaggcucugagcaaauguggcu

SEQ ID NO: 451853 - RNA, 16 nt, Homo sapiens
aaggcugcacagcuca

SEQ ID NO: 451854 - RNA, 16 nt, Homo sapiens
aaggcugccggcugca

SEQ ID NO: 451855 - RNA, 20 nt, Homo sapiens
aaggcugucaauuacaggaa

SEQ ID NO: 451856 - RNA, 12 nt, Homo sapiens
aaggcuguguca

SEQ ID NO: 451857 - RNA, 16 nt, Homo sapiens
aaggcuuccaaugugg

SEQ ID NO: 451858 - RNA, 21 nt, Homo sapiens
aaggcuucuccacaaccuccu

SEQ ID NO: 451859 - RNA, 20 nt, Homo sapiens
aaggcuucugggacuugaaa

SEQ ID NO: 451860 - RNA, 20 nt, Homo sapiens
aaggcuugaaguaaccuuau

SEQ ID NO: 451861 - RNA, 14 nt, Homo sapiens
aaggcuuucagggc

SEQ ID NO: 451862 - RNA, 18 nt, Homo sapiens
aaggcuuugccaugggcc

SEQ ID NO: 451863 - RNA, 18 nt, Homo sapiens
aagggaaaaaagcaacuu

SEQ ID NO: 451864 - RNA, 15 nt, Homo sapiens
aagggaaagucagcu

SEQ ID NO: 451865 - RNA, 17 nt, Homo sapiens
aagggaaauaacaguau

SEQ ID NO: 451866 - RNA, 18 nt, Homo sapiens
aagggaagaaaaggugaa

SEQ ID NO: 451867 - RNA, 14 nt, Homo sapiens
aagggaauugcuca

SEQ ID NO: 451868 - RNA, 15 nt, Homo sapiens
aagggacugguccag

SEQ ID NO: 451869 - RNA, 17 nt, Homo sapiens
aagggacugguccaggc

SEQ ID NO: 451870 - RNA, 14 nt, Homo sapiens
aagggagaguucuu

SEQ ID NO: 451871 - RNA, 15 nt, Homo sapiens
aagggaggaggugaa

SEQ ID NO: 451872 - RNA, 21 nt, Homo sapiens
aagggaggucuccucuagacu

SEQ ID NO: 451873 - RNA, 21 nt, Homo sapiens
aagggaucagaagauaucuuu

SEQ ID NO: 451874 - RNA, 18 nt, Homo sapiens
aaggggagaguaacccug

SEQ ID NO: 451875 - RNA, 17 nt, Homo sapiens
aagggggcuauucccug

SEQ ID NO: 451876 - RNA, 17 nt, Homo sapiens
aagggguaauugcauuc

SEQ ID NO: 451877 - RNA, 12 nt, Homo sapiens
aagggucuuccu

SEQ ID NO: 451878 - RNA, 18 nt, Homo sapiens
aagggugugggucaggga

SEQ ID NO: 451879 - RNA, 11 nt, Homo sapiens
aaggguucugu

SEQ ID NO: 451880 - RNA, 21 nt, Homo sapiens
aaggguugggagcugaugaaa

SEQ ID NO: 451881 - RNA, 15 nt, Homo sapiens
aagguaauacuauaa

SEQ ID NO: 451882 - RNA, 15 nt, Homo sapiens
aagguacuuaaagcu

SEQ ID NO: 451883 - RNA, 13 nt, Homo sapiens
aagguagaacuua

SEQ ID NO: 451884 - RNA, 21 nt, Homo sapiens
aaggucauaaaaauauuguua

SEQ ID NO: 451885 - RNA, 22 nt, Homo sapiens
aaggucccgaauggaguccaga

SEQ ID NO: 451886 - RNA, 21 nt, Homo sapiens
aaggugcacauuuuccacgga

SEQ ID NO: 451887 - RNA, 12 nt, Homo sapiens
aaggugcucaau

SEQ ID NO: 451888 - RNA, 14 nt, Homo sapiens
aagguggaaaaugg

SEQ ID NO: 451889 - RNA, 15 nt, Homo sapiens
aaggugggcacugga

SEQ ID NO: 451890 - RNA, 21 nt, Homo sapiens
aagguggggauugcccaucca

SEQ ID NO: 451891 - RNA, 13 nt, Homo sapiens
aagguuaaaccca

SEQ ID NO: 451892 - RNA, 14 nt, Homo sapiens
aagguuaacaguaa

SEQ ID NO: 451893 - RNA, 22 nt, Homo sapiens
aagguucucagguguugccaaa

SEQ ID NO: 451894 - RNA, 14 nt, Homo sapiens
aagguugauucuca

SEQ ID NO: 451895 - RNA, 18 nt, Homo sapiens
aagguuggcgacugucau

SEQ ID NO: 451896 - RNA, 20 nt, Homo sapiens
aagguuucacuguucaugaa

SEQ ID NO: 451897 - RNA, 13 nt, Homo sapiens
aagguuugugcug

SEQ ID NO: 451898 - RNA, 14 nt, Homo sapiens
aaguaaacugcccu

SEQ ID NO: 451899 - RNA, 15 nt, Homo sapiens
aaguaaagcuagaca

SEQ ID NO: 451900 - RNA, 16 nt, Homo sapiens
aaguaaaugagccuuu

SEQ ID NO: 451901 - RNA, 17 nt, Homo sapiens
aaguaaccucuacaggc

SEQ ID NO: 451902 - RNA, 22 nt, Homo sapiens
aaguaaccucuacaggcauuua

SEQ ID NO: 451903 - RNA, 15 nt, Homo sapiens
aaguaacuuuuacaa

SEQ ID NO: 451904 - RNA, 19 nt, Homo sapiens
aaguaacuuuuacaaaaca

SEQ ID NO: 451905 - RNA, 13 nt, Homo sapiens
aaguaauuuugca

SEQ ID NO: 451906 - RNA, 16 nt, Homo sapiens
aaguacagaacauauc

SEQ ID NO: 451907 - RNA, 14 nt, Homo sapiens
aaaugauucacuuu

SEQ ID NO: 451908 - RNA, 16 nt, Homo sapiens
aaaugauuuuaucugu

SEQ ID NO: 451909 - RNA, 12 nt, Homo sapiens
aaaugcaugaua

SEQ ID NO: 451910 - RNA, 15 nt, Homo sapiens
aaaugcuaccucuga

SEQ ID NO: 451911 - RNA, 19 nt, Homo sapiens
aaaugcuagguuaauucca

SEQ ID NO: 451912 - RNA, 21 nt, Homo sapiens
aaaugcuagguuaauuccaau

SEQ ID NO: 451913 - RNA, 14 nt, Homo sapiens
aaaugcuauauugc

SEQ ID NO: 451914 - RNA, 15 nt, Homo sapiens
aaaugcucacacucc

SEQ ID NO: 451915 - RNA, 13 nt, Homo sapiens
aaauggacuugcu

SEQ ID NO: 451916 - RNA, 16 nt, Homo sapiens
aaauggaugacaaaga

SEQ ID NO: 451917 - RNA, 13 nt, Homo sapiens
aaauggcaaagaa

SEQ ID NO: 451918 - RNA, 14 nt, Homo sapiens
aaauggcaugacaa

SEQ ID NO: 451919 - RNA, 21 nt, Homo sapiens
aaaugggacugaugucaucuu

SEQ ID NO: 451920 - RNA, 17 nt, Homo sapiens
aaaugggagacagccuc

SEQ ID NO: 451921 - RNA, 19 nt, Homo sapiens
aaaugggagacagccucuu

SEQ ID NO: 451922 - RNA, 16 nt, Homo sapiens
aaauguacauuaauua

SEQ ID NO: 451923 - RNA, 17 nt, Homo sapiens
aaauguacuacauuugc

SEQ ID NO: 451924 - RNA, 18 nt, Homo sapiens
aaauguacuacauuugca

SEQ ID NO: 451925 - RNA, 13 nt, Homo sapiens
aaauguccaugau

SEQ ID NO: 451926 - RNA, 19 nt, Homo sapiens
aaauguccauuuauaucau

SEQ ID NO: 451927 - RNA, 16 nt, Homo sapiens
aaaugugaagugaaug

SEQ ID NO: 451928 - RNA, 19 nt, Homo sapiens
aaaugugcagcucccauuu

SEQ ID NO: 451929 - RNA, 14 nt, Homo sapiens
aaaugugucugcaa

SEQ ID NO: 451930 - RNA, 22 nt, Homo sapiens
aaauguuagucccuaaccacuu

SEQ ID NO: 451931 - RNA, 17 nt, Homo sapiens
aaauguucuaacagauc

SEQ ID NO: 451932 - RNA, 21 nt, Homo sapiens
aaauguuggaacucugugcag

SEQ ID NO: 451933 - RNA, 14 nt, Homo sapiens
aaauguuggugcaa

SEQ ID NO: 451934 - RNA, 15 nt, Homo sapiens
aaauguuucaaagac

SEQ ID NO: 451935 - RNA, 21 nt, Homo sapiens
aaauguuuuuaaaaaggucau

SEQ ID NO: 451936 - RNA, 14 nt, Homo sapiens
aaauuaaaguauac

SEQ ID NO: 451937 - RNA, 17 nt, Homo sapiens
aaauuaacaguccuaac

SEQ ID NO: 451938 - RNA, 22 nt, Homo sapiens
aaauuaagaaguacaauaagca

SEQ ID NO: 451939 - RNA, 14 nt, Homo sapiens
aaauuaaucagaaa

SEQ ID NO: 451940 - RNA, 20 nt, Homo sapiens
aaauuacacaguuaaugcca

SEQ ID NO: 451941 - RNA, 22 nt, Homo sapiens
aaauuacacaguuaaugccaca

SEQ ID NO: 451942 - RNA, 20 nt, Homo sapiens
aaauuacacccaugcacaga

SEQ ID NO: 451943 - RNA, 19 nt, Homo sapiens
aaauuacagcuucacccug

SEQ ID NO: 451944 - RNA, 20 nt, Homo sapiens
aaauuagaaaguagccacgu

SEQ ID NO: 451945 - RNA, 23 nt, Homo sapiens
aaauuagcuugagcaaccuggcu

SEQ ID NO: 451946 - RNA, 21 nt, Homo sapiens
aaauuagggcucuaauuuccu

SEQ ID NO: 451947 - RNA, 17 nt, Homo sapiens
aaauuaguaauguacua

SEQ ID NO: 451948 - RNA, 15 nt, Homo sapiens
agugugugcacaugu

SEQ ID NO: 451949 - RNA, 13 nt, Homo sapiens
agugugugcaugu

SEQ ID NO: 451950 - RNA, 21 nt, Homo sapiens
aguguucauuuuagugacugu

SEQ ID NO: 451951 - RNA, 15 nt, Homo sapiens
aguguucccaaugcu

SEQ ID NO: 451952 - RNA, 12 nt, Homo sapiens
aguguugcccag

SEQ ID NO: 451953 - RNA, 15 nt, Homo sapiens
aguguuggcuuucau

SEQ ID NO: 451954 - RNA, 14 nt, Homo sapiens
aguguuuguauacc

SEQ ID NO: 451955 - RNA, 16 nt, Homo sapiens
aguguuuucaccucau

SEQ ID NO: 451956 - RNA, 15 nt, Homo sapiens
aguguuuugcaaggg

SEQ ID NO: 451957 - RNA, 20 nt, Homo sapiens
aguguuuuuuagauacagag

SEQ ID NO: 451958 - RNA, 14 nt, Homo sapiens
aguuaaaaagucaa

SEQ ID NO: 451959 - RNA, 16 nt, Homo sapiens
aguuaaauuggcuugu

SEQ ID NO: 451960 - RNA, 19 nt, Homo sapiens
aguuaacagacaacacguu

SEQ ID NO: 451961 - RNA, 19 nt, Homo sapiens
aguuaagacaacaggcauu

SEQ ID NO: 451962 - RNA, 12 nt, Homo sapiens
aguuaaggguua

SEQ ID NO: 451963 - RNA, 22 nt, Homo sapiens
aguuaaguugcuguaagcaccu

SEQ ID NO: 451964 - RNA, 13 nt, Homo sapiens
aguuaaucuugcu

SEQ ID NO: 451965 - RNA, 14 nt, Homo sapiens
aguuaaugaaggug

SEQ ID NO: 451966 - RNA, 14 nt, Homo sapiens
aguuacugaucaca

SEQ ID NO: 451967 - RNA, 18 nt, Homo sapiens
aguuacuuccuuccugcc

SEQ ID NO: 451968 - RNA, 23 nt, Homo sapiens
aguuagcccggccaaggacacug

SEQ ID NO: 451969 - RNA, 14 nt, Homo sapiens
aguuauucauucug

SEQ ID NO: 451970 - RNA, 16 nt, Homo sapiens
aguuauuuucagacau

SEQ ID NO: 451971 - RNA, 11 nt, Homo sapiens
aguucaaugau

SEQ ID NO: 451972 - RNA, 14 nt, Homo sapiens
aguucaaugaucua

SEQ ID NO: 451973 - RNA, 20 nt, Homo sapiens
aguucauauuucauuuccaa

SEQ ID NO: 451974 - RNA, 14 nt, Homo sapiens
aguucaucuugaau

SEQ ID NO: 451975 - RNA, 18 nt, Homo sapiens
aguucauggugaucagug

SEQ ID NO: 451976 - RNA, 16 nt, Homo sapiens
aguucauguugcucag

SEQ ID NO: 451977 - RNA, 17 nt, Homo sapiens
aguuccacgaaacacug

SEQ ID NO: 451978 - RNA, 15 nt, Homo sapiens
aguuccacuuaacac

SEQ ID NO: 451979 - RNA, 21 nt, Homo sapiens
aguuccacuuagagaacaaag

SEQ ID NO: 451980 - RNA, 15 nt, Homo sapiens
aguucccgugcaccu

SEQ ID NO: 451981 - RNA, 13 nt, Homo sapiens
aguucccuuggcc

SEQ ID NO: 451982 - RNA, 22 nt, Homo sapiens
aguucucagaacuguuggcugc

SEQ ID NO: 451983 - RNA, 15 nt, Homo sapiens
aguucugaacuggaa

SEQ ID NO: 451984 - RNA, 18 nt, Homo sapiens
aguucugaauaacuugaa

SEQ ID NO: 451985 - RNA, 18 nt, Homo sapiens
aguucugaucuguaccua

SEQ ID NO: 451986 - RNA, 16 nt, Homo sapiens
aguucuuaagcauuug

SEQ ID NO: 451987 - RNA, 15 nt, Homo sapiens
aguucuuuguuccug

SEQ ID NO: 451988 - RNA, 23 nt, Homo sapiens
aguucuuuuauaacuuuuaaaca

SEQ ID NO: 451989 - RNA, 14 nt, Homo sapiens
aguugaaagggaua

SEQ ID NO: 451990 - RNA, 21 nt, Homo sapiens
aguugaugaccaaucucugug

SEQ ID NO: 451991 - RNA, 16 nt, Homo sapiens
aguugcaaagcauuug

SEQ ID NO: 451992 - RNA, 12 nt, Homo sapiens
aguugcaaaggu

SEQ ID NO: 451993 - RNA, 13 nt, Homo sapiens
aguugcaccauuc

SEQ ID NO: 451994 - RNA, 23 nt, Homo sapiens
aguugcgacggagagaaaaaaga

SEQ ID NO: 451995 - RNA, 21 nt, Homo sapiens
aguugcuagcaacaacuuacu

SEQ ID NO: 451996 - RNA, 14 nt, Homo sapiens
aguuggaguacuau

SEQ ID NO: 451997 - RNA, 16 nt, Homo sapiens
aguugggagcacugga

SEQ ID NO: 451998 - RNA, 21 nt, Homo sapiens
aguugguuaccuauugcugua

SEQ ID NO: 451999 - RNA, 20 nt, Homo sapiens
aguugguucuuuuaccccac

SEQ ID NO: 452000 - RNA, 13 nt, Homo sapiens
aguuguaaugugu

SEQ ID NO: 452001 - RNA, 15 nt, Homo sapiens
aguuguuauauucau

SEQ ID NO: 452002 - RNA, 15 nt, Homo sapiens
aguuguuucuaagag

SEQ ID NO: 452003 - RNA, 20 nt, Homo sapiens
aguuuaggacccaagguggu

SEQ ID NO: 452004 - RNA, 20 nt, Homo sapiens
aguuuauaaaugugaacuua

SEQ ID NO: 452005 - RNA, 18 nt, Homo sapiens
aguuuaugcagugcugcu

SEQ ID NO: 452006 - RNA, 16 nt, Homo sapiens
aguuucaaaauguuaa

SEQ ID NO: 452007 - RNA, 18 nt, Homo sapiens
aguuucaaaugaguuuaa

SEQ ID NO: 452008 - RNA, 15 nt, Homo sapiens
aguuucaaugugauu

SEQ ID NO: 452009 - RNA, 12 nt, Homo sapiens
aguuucacauau

SEQ ID NO: 452010 - RNA, 15 nt, Homo sapiens
aguuucacaugagcu

SEQ ID NO: 452011 - RNA, 22 nt, Homo sapiens
aguuucagagaaauacuuucag

SEQ ID NO: 452012 - RNA, 15 nt, Homo sapiens
aguuucaucagucaa

SEQ ID NO: 452013 - RNA, 18 nt, Homo sapiens
aguuucauuuaugauaca

SEQ ID NO: 452014 - RNA, 19 nt, Homo sapiens
aguuuccaaguuuauugcc

SEQ ID NO: 452015 - RNA, 15 nt, Homo sapiens
aguuuccauauguua

SEQ ID NO: 452016 - RNA, 20 nt, Homo sapiens
uguguucacacuguaaacau

SEQ ID NO: 452017 - RNA, 16 nt, Homo sapiens
uguguugacugcugcu

SEQ ID NO: 452018 - RNA, 13 nt, Homo sapiens
uguguugcaugca

SEQ ID NO: 452019 - RNA, 20 nt, Homo sapiens
uguguugccaugugugcuga

SEQ ID NO: 452020 - RNA, 14 nt, Homo sapiens
uguguuuuuaauaa

SEQ ID NO: 452021 - RNA, 19 nt, Homo sapiens
uguuaacacuguaauaucu

SEQ ID NO: 452022 - RNA, 23 nt, Homo sapiens
uguuaauggucaaugcuagcaca

SEQ ID NO: 452023 - RNA, 18 nt, Homo sapiens
uguuaauucagcacugau

SEQ ID NO: 452024 - RNA, 14 nt, Homo sapiens
uguuacacauacac

SEQ ID NO: 452025 - RNA, 20 nt, Homo sapiens
uguuacacauacacacucau

SEQ ID NO: 452026 - RNA, 11 nt, Homo sapiens
uguuacacugu

SEQ ID NO: 452027 - RNA, 22 nt, Homo sapiens
uguuacaggaagucccuugcca

SEQ ID NO: 452028 - RNA, 22 nt, Homo sapiens
uguuacauagguauauauaugc

SEQ ID NO: 452029 - RNA, 16 nt, Homo sapiens
uguuacucugguucuu

SEQ ID NO: 452030 - RNA, 16 nt, Homo sapiens
uguuacuuaaacauca

SEQ ID NO: 452031 - RNA, 17 nt, Homo sapiens
uguuagauuccucuugc

SEQ ID NO: 452032 - RNA, 19 nt, Homo sapiens
uguuagauuccucuugccu

SEQ ID NO: 452033 - RNA, 18 nt, Homo sapiens
uguuaguauuaacuauua

SEQ ID NO: 452034 - RNA, 20 nt, Homo sapiens
uguuaucagucauaacuaaa

SEQ ID NO: 452035 - RNA, 18 nt, Homo sapiens
uguuaucuuccacuggaa

SEQ ID NO: 452036 - RNA, 23 nt, Homo sapiens
uguuaucuucuaucaaagcacau

SEQ ID NO: 452037 - RNA, 14 nt, Homo sapiens
uguuaugacuccuu

SEQ ID NO: 452038 - RNA, 18 nt, Homo sapiens
uguuauuuguacaguuca

SEQ ID NO: 452039 - RNA, 22 nt, Homo sapiens
uguuauuuguugagacuaucaa

SEQ ID NO: 452040 - RNA, 22 nt, Homo sapiens
uguucaaagucaaauaacuccu

SEQ ID NO: 452041 - RNA, 13 nt, Homo sapiens
uguucaagcuuuu

SEQ ID NO: 452042 - RNA, 18 nt, Homo sapiens
uguucagaauggauuuau

SEQ ID NO: 452043 - RNA, 18 nt, Homo sapiens
uguucagagaggccuuuu

SEQ ID NO: 452044 - RNA, 17 nt, Homo sapiens
uguucagugucccgggc

SEQ ID NO: 452045 - RNA, 16 nt, Homo sapiens
uguucaugcacacuug

SEQ ID NO: 452046 - RNA, 21 nt, Homo sapiens
uguucaugcacacuugcaccc

SEQ ID NO: 452047 - RNA, 14 nt, Homo sapiens
uguuccccacugac

SEQ ID NO: 452048 - RNA, 15 nt, Homo sapiens
uguuccccucaccca

SEQ ID NO: 452049 - RNA, 21 nt, Homo sapiens
uguucucauggagaagacuuc

SEQ ID NO: 452050 - RNA, 19 nt, Homo sapiens
uguucucuauuagacuuua

SEQ ID NO: 452051 - RNA, 20 nt, Homo sapiens
uguucugcagagacuucuag

SEQ ID NO: 452052 - RNA, 13 nt, Homo sapiens
uguucuggcuuua

SEQ ID NO: 452053 - RNA, 23 nt, Homo sapiens
uguucugguggccccagcuguga

SEQ ID NO: 452054 - RNA, 20 nt, Homo sapiens
uguugaaacuaaagcacuuc

SEQ ID NO: 452055 - RNA, 18 nt, Homo sapiens
uguugaaucccacuucag

SEQ ID NO: 452056 - RNA, 13 nt, Homo sapiens
uguugacauccaa

SEQ ID NO: 452057 - RNA, 21 nt, Homo sapiens
uguugagccaggccugggucu

SEQ ID NO: 452058 - RNA, 20 nt, Homo sapiens
uguugauugccaaauugaca

SEQ ID NO: 452059 - RNA, 12 nt, Homo sapiens
uguugcaccuca

SEQ ID NO: 452060 - RNA, 13 nt, Homo sapiens
uguugccagagau

SEQ ID NO: 452061 - RNA, 22 nt, Homo sapiens
uguugccuccucccauccagcg

SEQ ID NO: 452062 - RNA, 22 nt, Homo sapiens
uguugccuugguuuuaccugua

SEQ ID NO: 452063 - RNA, 14 nt, Homo sapiens
uguugcuuguauaa

SEQ ID NO: 452064 - RNA, 15 nt, Homo sapiens
uguuguguccaaucc

SEQ ID NO: 452065 - RNA, 19 nt, Homo sapiens
uguuuaaauaaaguaucau

SEQ ID NO: 452066 - RNA, 19 nt, Homo sapiens
uguuuacagcacuacucug

SEQ ID NO: 452067 - RNA, 12 nt, Homo sapiens
uguuuacaugag

SEQ ID NO: 452068 - RNA, 17 nt, Homo sapiens
uguuucaggaggcugga

SEQ ID NO: 452069 - RNA, 22 nt, Homo sapiens
uguuuccauagcuacuauaugc

SEQ ID NO: 452070 - RNA, 17 nt, Homo sapiens
uguuucccgcuccaaga

SEQ ID NO: 452071 - RNA, 22 nt, Homo sapiens
uguuucccuacuaacaucccaa

SEQ ID NO: 452072 - RNA, 19 nt, Homo sapiens
uguuucuaaaacuaugguu

SEQ ID NO: 452073 - RNA, 17 nt, Homo sapiens
uguuucuaaacaguuga

SEQ ID NO: 452074 - RNA, 12 nt, Homo sapiens
uguuucuauacu

SEQ ID NO: 452075 - RNA, 12 nt, Homo sapiens
uguuucucauau

SEQ ID NO: 452076 - RNA, 22 nt, Homo sapiens
uguuucugaaaaauaaaaguau

SEQ ID NO: 452077 - RNA, 21 nt, Homo sapiens
uguuucuugggaaaauaucac

SEQ ID NO: 452078 - RNA, 16 nt, Homo sapiens
uguuugauacaguauu

SEQ ID NO: 452079 - RNA, 22 nt, Homo sapiens
uguuugguggggguagagcuga

SEQ ID NO: 452080 - RNA, 15 nt, Homo sapiens
uguuugucaaaaagu

SEQ ID NO: 452081 - RNA, 16 nt, Homo sapiens
uguuuguggaacaaaa

SEQ ID NO: 452082 - RNA, 19 nt, Homo sapiens
uguuuguguggauacccag

SEQ ID NO: 452083 - RNA, 23 nt, Homo sapiens
uguuuuaauuccaauaugaugac

SEQ ID NO: 452084 - RNA, 20 nt, Homo sapiens
uguuuuacaucuuuugggaa

SEQ ID NO: 452085 - RNA, 12 nt, Homo sapiens
uguuuucaccuc

SEQ ID NO: 452086 - RNA, 21 nt, Homo sapiens
uguuuuccccaauuauccucc

SEQ ID NO: 452087 - RNA, 14 nt, Homo sapiens
uguuuuccuauaau

SEQ ID NO: 452088 - RNA, 17 nt, Homo sapiens
uguuuugcauggaguau

SEQ ID NO: 452089 - RNA, 16 nt, Homo sapiens
uguuuuuaaaaccacu

SEQ ID NO: 452090 - RNA, 15 nt, Homo sapiens
uguuuuuaacaacua

SEQ ID NO: 452091 - RNA, 19 nt, Homo sapiens
uguuuuuuuuuuccacuua

SEQ ID NO: 452092 - RNA, 14 nt, Homo sapiens
uuaaaaaauaacau

SEQ ID NO: 452093 - RNA, 15 nt, Homo sapiens
uuaaaaaauaacaua

SEQ ID NO: 452094 - RNA, 13 nt, Homo sapiens
uuaaaaaccauua

SEQ ID NO: 452095 - RNA, 20 nt, Homo sapiens
uuaaaaaggccuuugggauu

SEQ ID NO: 452096 - RNA, 12 nt, Homo sapiens
uuaaaaauaugu

SEQ ID NO: 452097 - RNA, 19 nt, Homo sapiens
uuaaaaauuaaauucucuc

SEQ ID NO: 452098 - RNA, 18 nt, Homo sapiens
uuaaaacuaggcauuugu

SEQ ID NO: 452099 - RNA, 20 nt, Homo sapiens
uuaaaacuuacuaugguaua

SEQ ID NO: 452100 - RNA, 17 nt, Homo sapiens
uuaaaagcaaaacugca

SEQ ID NO: 452101 - RNA, 20 nt, Homo sapiens
uuaaaagcaaaacugcaaau

SEQ ID NO: 452102 - RNA, 22 nt, Homo sapiens
uuaaaauaacuaagcaaguaua

SEQ ID NO: 452103 - RNA, 16 nt, Homo sapiens
uuaaaauuagugagau

SEQ ID NO: 452104 - RNA, 20 nt, Homo sapiens
uuaaaauucacccccaucca

SEQ ID NO: 452105 - RNA, 22 nt, Homo sapiens
uuaaaauucacccccauccaca

SEQ ID NO: 452106 - RNA, 18 nt, Homo sapiens
uuaaacauugaaguaaug

SEQ ID NO: 452107 - RNA, 14 nt, Homo sapiens
uuaaacccacagcc

SEQ ID NO: 452108 - RNA, 18 nt, Homo sapiens
uuaaacccacagccaaac

SEQ ID NO: 452109 - RNA, 11 nt, Homo sapiens
uuaaacgucau

SEQ ID NO: 452110 - RNA, 19 nt, Homo sapiens
uuaaacugugaauguucca

SEQ ID NO: 452111 - RNA, 20 nt, Homo sapiens
uuaaacuguguggacuguga

SEQ ID NO: 452112 - RNA, 11 nt, Homo sapiens
uuaaagcaaaa

SEQ ID NO: 452113 - RNA, 12 nt, Homo sapiens
uuaaagcaaaaa

SEQ ID NO: 452114 - RNA, 23 nt, Homo sapiens
uuaaagcagucacuucagacagg

SEQ ID NO: 452115 - RNA, 23 nt, Homo sapiens
uuaaagccugaguuugcuuucaa

SEQ ID NO: 452116 - RNA, 18 nt, Homo sapiens
uuaaaggcaucuacacaa

SEQ ID NO: 452117 - RNA, 18 nt, Homo sapiens
uuaaaguaccuguaguga

SEQ ID NO: 452118 - RNA, 23 nt, Homo sapiens
uuaaauaaaucauaaaacuugau

SEQ ID NO: 452119 - RNA, 18 nt, Homo sapiens
uuaaauaaaugugagaac

SEQ ID NO: 452120 - RNA, 18 nt, Homo sapiens
uuaaauaccaguacuuga

SEQ ID NO: 452121 - RNA, 16 nt, Homo sapiens
uuaaauagaacuugau

SEQ ID NO: 452122 - RNA, 13 nt, Homo sapiens
uuaaauaucagua

SEQ ID NO: 452123 - RNA, 22 nt, Homo sapiens
uuaaaucauuuuaacuucuaua

SEQ ID NO: 452124 - RNA, 19 nt, Homo sapiens
uuaaaucugugaugauccu

SEQ ID NO: 452125 - RNA, 20 nt, Homo sapiens
uuaaaugaacuugauagcua

SEQ ID NO: 452126 - RNA, 23 nt, Homo sapiens
uuaaaugaagugcccacuaagaa

SEQ ID NO: 452127 - RNA, 13 nt, Homo sapiens
uuaaauuauaucu

SEQ ID NO: 452128 - RNA, 19 nt, Homo sapiens
uuaacaacagcuucuugcu

SEQ ID NO: 452129 - RNA, 18 nt, Homo sapiens
uuaacaaccgacacuccu

SEQ ID NO: 452130 - RNA, 14 nt, Homo sapiens
uuaacacaguaaaa

SEQ ID NO: 452131 - RNA, 14 nt, Homo sapiens
uuaacacuguaaua

SEQ ID NO: 452132 - RNA, 21 nt, Homo sapiens
uuaacagcgugucaacuuuca

SEQ ID NO: 452133 - RNA, 14 nt, Homo sapiens
uuaacagugcugua

SEQ ID NO: 452134 - RNA, 15 nt, Homo sapiens
uuaacaucaaagacu

SEQ ID NO: 452135 - RNA, 21 nt, Homo sapiens
uuaacaugcuguguaagcugu

SEQ ID NO: 452136 - RNA, 18 nt, Homo sapiens
uuaacauugcaucaugaa

SEQ ID NO: 452137 - RNA, 17 nt, Homo sapiens
uuaacauuugaugucua

SEQ ID NO: 452138 - RNA, 15 nt, Homo sapiens
uuaacggcacugugg

SEQ ID NO: 452139 - RNA, 20 nt, Homo sapiens
uuaacugacuuaaguggcau

SEQ ID NO: 452140 - RNA, 17 nt, Homo sapiens
uuaagaaugucgauuaa

SEQ ID NO: 452141 - RNA, 18 nt, Homo sapiens
uuaagacaacaggcauuu

SEQ ID NO: 452142 - RNA, 12 nt, Homo sapiens
uuaagacuuuaa

SEQ ID NO: 452143 - RNA, 13 nt, Homo sapiens
uuaagacuuuaaa

SEQ ID NO: 452144 - RNA, 22 nt, Homo sapiens
uuaagagggaacuuagcagaga

SEQ ID NO: 452145 - RNA, 11 nt, Homo sapiens
uuaagauaucu

SEQ ID NO: 452146 - RNA, 13 nt, Homo sapiens
uuaagauauguga

SEQ ID NO: 452147 - RNA, 21 nt, Homo sapiens
uuaagauuuuacaaaagagga

SEQ ID NO: 452148 - RNA, 23 nt, Homo sapiens
uucucucuguguggcaaacauuu

SEQ ID NO: 452149 - RNA, 15 nt, Homo sapiens
uucucucuuguccaa

SEQ ID NO: 452150 - RNA, 12 nt, Homo sapiens
uucucugccuca

SEQ ID NO: 452151 - RNA, 17 nt, Homo sapiens
uucucugcuccaccaca

SEQ ID NO: 452152 - RNA, 20 nt, Homo sapiens
uucucuguauaacuugugau

SEQ ID NO: 452153 - RNA, 17 nt, Homo sapiens
uucucuucgcugugaug

SEQ ID NO: 452154 - RNA, 19 nt, Homo sapiens
uucugaaaaagaacuguau

SEQ ID NO: 452155 - RNA, 15 nt, Homo sapiens
uucugaaaaaguauc

SEQ ID NO: 452156 - RNA, 19 nt, Homo sapiens
uucugaaccauuacuguaa

SEQ ID NO: 452157 - RNA, 14 nt, Homo sapiens
uucugaagaucuca

SEQ ID NO: 452158 - RNA, 18 nt, Homo sapiens
uucugaaguuuccuauga

SEQ ID NO: 452159 - RNA, 16 nt, Homo sapiens
uucugacagcauuuca

SEQ ID NO: 452160 - RNA, 20 nt, Homo sapiens
uucugaccucaugaguguca

SEQ ID NO: 452161 - RNA, 15 nt, Homo sapiens
uucugaccuccccac

SEQ ID NO: 452162 - RNA, 17 nt, Homo sapiens
uucugacggcccugcaa

SEQ ID NO: 452163 - RNA, 21 nt, Homo sapiens
uucugccacuugcacugugcu

SEQ ID NO: 452164 - RNA, 21 nt, Homo sapiens
uucugcucuguccaauuccag

SEQ ID NO: 452165 - RNA, 17 nt, Homo sapiens
uucugcuguauacugua

SEQ ID NO: 452166 - RNA, 16 nt, Homo sapiens
uucugcuuugcacagg

SEQ ID NO: 452167 - RNA, 12 nt, Homo sapiens
uucuggcuuuac

SEQ ID NO: 452168 - RNA, 20 nt, Homo sapiens
uucugggaaaggugcucaaa

SEQ ID NO: 452169 - RNA, 22 nt, Homo sapiens
uucugggaagggagaguucuuu

SEQ ID NO: 452170 - RNA, 18 nt, Homo sapiens
uucugggucagcuugaau

SEQ ID NO: 452171 - RNA, 20 nt, Homo sapiens
uucuggugggguguguucca

SEQ ID NO: 452172 - RNA, 11 nt, Homo sapiens
uucuguaaaau

SEQ ID NO: 452173 - RNA, 14 nt, Homo sapiens
uucuguaaauggaa

SEQ ID NO: 452174 - RNA, 16 nt, Homo sapiens
uucuguacauguggaa

SEQ ID NO: 452175 - RNA, 16 nt, Homo sapiens
uucuguaccauagcgc

SEQ ID NO: 452176 - RNA, 14 nt, Homo sapiens
uucuguggauucua

SEQ ID NO: 452177 - RNA, 16 nt, Homo sapiens
uucuguugaaguuuac

SEQ ID NO: 452178 - RNA, 13 nt, Homo sapiens
uucuguuuccaua

SEQ ID NO: 452179 - RNA, 16 nt, Homo sapiens
uucuguuuuucucaaa

SEQ ID NO: 452180 - RNA, 13 nt, Homo sapiens
uucuuaagacaug

SEQ ID NO: 452181 - RNA, 14 nt, Homo sapiens
uucuuacaugcauu

SEQ ID NO: 452182 - RNA, 17 nt, Homo sapiens
uucuuacaugcauuuga

SEQ ID NO: 452183 - RNA, 19 nt, Homo sapiens
uucuuacccucucuuucaa

SEQ ID NO: 452184 - RNA, 17 nt, Homo sapiens
uucuuaccucauuugca

SEQ ID NO: 452185 - RNA, 12 nt, Homo sapiens
uucuuacuguau

SEQ ID NO: 452186 - RNA, 22 nt, Homo sapiens
uucuuagugaaaggucaucuca

SEQ ID NO: 452187 - RNA, 14 nt, Homo sapiens
uucuuagugucacu

SEQ ID NO: 452188 - RNA, 19 nt, Homo sapiens
uucuucaucugugacuccu

SEQ ID NO: 452189 - RNA, 17 nt, Homo sapiens
uucuucaugcaaugaca

SEQ ID NO: 452190 - RNA, 9 nt, Homo sapiens
uucuuccac

SEQ ID NO: 452191 - RNA, 16 nt, Homo sapiens
uucuucccaaggccag

SEQ ID NO: 452192 - RNA, 19 nt, Homo sapiens
uucuuccuauuuccuugua

SEQ ID NO: 452193 - RNA, 23 nt, Homo sapiens
uucuuccuccagucuguucucac

SEQ ID NO: 452194 - RNA, 13 nt, Homo sapiens
uucuugaaccaau

SEQ ID NO: 452195 - RNA, 13 nt, Homo sapiens
uucuugaagucca

SEQ ID NO: 452196 - RNA, 21 nt, Homo sapiens
uucuuggagggcccacuugua

SEQ ID NO: 452197 - RNA, 22 nt, Homo sapiens
uucuuggagggcccacuuguau

SEQ ID NO: 452198 - RNA, 16 nt, Homo sapiens
uucuuguaaaccugga

SEQ ID NO: 452199 - RNA, 15 nt, Homo sapiens
uucuuguugcugcau

SEQ ID NO: 452200 - RNA, 19 nt, Homo sapiens
uucuuguugcugcaucucc

SEQ ID NO: 452201 - RNA, 21 nt, Homo sapiens
uucuuguuuuaagagacagag

SEQ ID NO: 452202 - RNA, 15 nt, Homo sapiens
uucuuuaaaggcauc

SEQ ID NO: 452203 - RNA, 15 nt, Homo sapiens
uucuuuccaugcagu

SEQ ID NO: 452204 - RNA, 19 nt, Homo sapiens
uucuuucccuaaagaacau

SEQ ID NO: 452205 - RNA, 19 nt, Homo sapiens
uucuuucucccuaaccacu

SEQ ID NO: 452206 - RNA, 16 nt, Homo sapiens
uucuuucugcaugacu

SEQ ID NO: 452207 - RNA, 23 nt, Homo sapiens
uucuuuuauuaauggcauguaau

SEQ ID NO: 452208 - RNA, 15 nt, Homo sapiens
uugaaaaacauacau

SEQ ID NO: 452209 - RNA, 13 nt, Homo sapiens
uugaaaacacugc

SEQ ID NO: 452210 - RNA, 12 nt, Homo sapiens
uugaaaacacuu

SEQ ID NO: 452211 - RNA, 19 nt, Homo sapiens
uugaaaaccaacaccauca

SEQ ID NO: 452212 - RNA, 17 nt, Homo sapiens
uugaaaaccucuuucca

SEQ ID NO: 452213 - RNA, 20 nt, Homo sapiens
uugaaaagagguggauucau

SEQ ID NO: 452214 - RNA, 21 nt, Homo sapiens
uugaaaaugaaaugacugucu

SEQ ID NO: 452215 - RNA, 22 nt, Homo sapiens
uugaaacaacuuucucuuguaa

SEQ ID NO: 452216 - RNA, 22 nt, Homo sapiens
uugaaacagcagucccaguauu

SEQ ID NO: 452217 - RNA, 14 nt, Homo sapiens
uugaaaccuuugac

SEQ ID NO: 452218 - RNA, 14 nt, Homo sapiens
uugaaagaaccaga

SEQ ID NO: 452219 - RNA, 15 nt, Homo sapiens
uugaaagaaccagag

SEQ ID NO: 452220 - RNA, 16 nt, Homo sapiens
uugaaagcauccaugu

SEQ ID NO: 452221 - RNA, 15 nt, Homo sapiens
uugaaagcuguauaa

SEQ ID NO: 452222 - RNA, 23 nt, Homo sapiens
uugaaaggagaaaaaaaaagcca

SEQ ID NO: 452223 - RNA, 13 nt, Homo sapiens
uugaacaaacugg

SEQ ID NO: 452224 - RNA, 18 nt, Homo sapiens
uugaacaguuuaugcagu

SEQ ID NO: 452225 - RNA, 12 nt, Homo sapiens
uugaacauacuu

SEQ ID NO: 452226 - RNA, 13 nt, Homo sapiens
uugaaccaauaau

SEQ ID NO: 452227 - RNA, 15 nt, Homo sapiens
uugaacccaggagau

SEQ ID NO: 452228 - RNA, 15 nt, Homo sapiens
uugaacucuguaaaa

SEQ ID NO: 452229 - RNA, 22 nt, Homo sapiens
uugaagacuuuucuuucagcca

SEQ ID NO: 452230 - RNA, 23 nt, Homo sapiens
uugaagacuuuucuuucagccaa

SEQ ID NO: 452231 - RNA, 23 nt, Homo sapiens
uugaagcccuccaaaagcacuua

SEQ ID NO: 452232 - RNA, 23 nt, Homo sapiens
uugaaggccuuauucuacauuuc

SEQ ID NO: 452233 - RNA, 15 nt, Homo sapiens
uugaagucaucauaa

SEQ ID NO: 452234 - RNA, 19 nt, Homo sapiens
uugaaguccaguguuucca

SEQ ID NO: 452235 - RNA, 19 nt, Homo sapiens
uugaagugaucauuucaca

SEQ ID NO: 452236 - RNA, 14 nt, Homo sapiens
uugaauaauguagu

SEQ ID NO: 452237 - RNA, 22 nt, Homo sapiens
uugaaucuugucccagccucag

SEQ ID NO: 452238 - RNA, 13 nt, Homo sapiens
uugaaugaugcca

SEQ ID NO: 452239 - RNA, 17 nt, Homo sapiens
uugaauuuuuuuuaaca

SEQ ID NO: 452240 - RNA, 17 nt, Homo sapiens
uugacaaaauauauaau

SEQ ID NO: 452241 - RNA, 18 nt, Homo sapiens
uugacaccaagaaaccac

SEQ ID NO: 452242 - RNA, 19 nt, Homo sapiens
uugacaguucauauguacc

SEQ ID NO: 452243 - RNA, 12 nt, Homo sapiens
uugacucuugaa

SEQ ID NO: 452244 - RNA, 23 nt, Homo sapiens
uugagaagcaaauauguuugcau

SEQ ID NO: 452245 - RNA, 23 nt, Homo sapiens
uugagaauauuauaaaaauauca

SEQ ID NO: 452246 - RNA, 22 nt, Homo sapiens
uugagcaguggcugguccaggg

SEQ ID NO: 452247 - RNA, 11 nt, Homo sapiens
uugagccaugc

SEQ ID NO: 452248 - RNA, 20 nt, Homo sapiens
uugagggacgaggucaagga

SEQ ID NO: 452249 - RNA, 18 nt, Homo sapiens
uugaggggcugacuucaa

SEQ ID NO: 452250 - RNA, 15 nt, Homo sapiens
uugagggguggaccc

SEQ ID NO: 452251 - RNA, 21 nt, Homo sapiens
uugagguuuccuucagacaga

SEQ ID NO: 452252 - RNA, 18 nt, Homo sapiens
uugagucauauugaggca

SEQ ID NO: 452253 - RNA, 17 nt, Homo sapiens
uugaguucaaauuuugc

SEQ ID NO: 452254 - RNA, 14 nt, Homo sapiens
uugaucauucucag

SEQ ID NO: 452255 - RNA, 16 nt, Homo sapiens
uugaugaacugccaaa

SEQ ID NO: 452256 - RNA, 18 nt, Homo sapiens
uugaugagcacuccugau

SEQ ID NO: 452257 - RNA, 18 nt, Homo sapiens
uugaugauaaacacugag

SEQ ID NO: 452258 - RNA, 18 nt, Homo sapiens
uugaugcuguuucuacau

SEQ ID NO: 452259 - RNA, 17 nt, Homo sapiens
uugaugugaaacauuau

SEQ ID NO: 452260 - RNA, 14 nt, Homo sapiens
uugauuaaugaacu

SEQ ID NO: 452261 - RNA, 14 nt, Homo sapiens
uugauuacuuuuca

SEQ ID NO: 452262 - RNA, 19 nt, Homo sapiens
uugauuugcauggauuuug

SEQ ID NO: 452263 - RNA, 12 nt, Homo sapiens
uugcaaaguaau

SEQ ID NO: 452264 - RNA, 21 nt, Homo sapiens
uugcaaauuauucuagucaac

SEQ ID NO: 452265 - RNA, 14 nt, Homo sapiens
uugcaacacacaga

SEQ ID NO: 452266 - RNA, 15 nt, Homo sapiens
uugcaagaaucauua

SEQ ID NO: 452267 - RNA, 18 nt, Homo sapiens
uugcacaguuaccugcac

SEQ ID NO: 452268 - RNA, 19 nt, Homo sapiens
uugcacauaacaugcuuua

SEQ ID NO: 452269 - RNA, 17 nt, Homo sapiens
uugcacuaaaagugaug

SEQ ID NO: 452270 - RNA, 17 nt, Homo sapiens
uugcagauaacuuugac

SEQ ID NO: 452271 - RNA, 22 nt, Homo sapiens
uugcagguguccgggggucuag

SEQ ID NO: 452272 - RNA, 14 nt, Homo sapiens
uugcaguaaugaua

SEQ ID NO: 452273 - RNA, 17 nt, Homo sapiens
uugcaucuuuucuacuu

SEQ ID NO: 452274 - RNA, 20 nt, Homo sapiens
uugcaugaaagacagaacau

SEQ ID NO: 452275 - RNA, 21 nt, Homo sapiens
uugcaugugcugcagguguaa

SEQ ID NO: 452276 - RNA, 11 nt, Homo sapiens
uugccaaaaac

SEQ ID NO: 452277 - RNA, 23 nt, Homo sapiens
uugccaacaccacagaaaugggg

SEQ ID NO: 452278 - RNA, 18 nt, Homo sapiens
uugccaagaaaaugaagg

SEQ ID NO: 452279 - RNA, 16 nt, Homo sapiens
uugccaugugugcuga

SEQ ID NO: 452280 - RNA, 17 nt, Homo sapiens
uugccaugugugcugaa

SEQ ID NO: 452281 - RNA, 18 nt, Homo sapiens
ugaaagucuccuguauca

SEQ ID NO: 452282 - RNA, 19 nt, Homo sapiens
ugaaauaacauggccuugg

SEQ ID NO: 452283 - RNA, 14 nt, Homo sapiens
ugaaaucagugccu

SEQ ID NO: 452284 - RNA, 20 nt, Homo sapiens
ugaaaucucuagccucuuug

SEQ ID NO: 452285 - RNA, 18 nt, Homo sapiens
ugaaaugccacgugccau

SEQ ID NO: 452286 - RNA, 14 nt, Homo sapiens
ugaaaugggcuuua

SEQ ID NO: 452287 - RNA, 18 nt, Homo sapiens
ugaaaugugcaagaguau

SEQ ID NO: 452288 - RNA, 20 nt, Homo sapiens
ugaaauuauguauguuuaca

SEQ ID NO: 452289 - RNA, 16 nt, Homo sapiens
ugaaauucaaguguac

SEQ ID NO: 452290 - RNA, 20 nt, Homo sapiens
ugaaauuuguuauacuucaa

SEQ ID NO: 452291 - RNA, 21 nt, Homo sapiens
ugaaauuuguuauacuucaaa

SEQ ID NO: 452292 - RNA, 21 nt, Homo sapiens
ugaaauuuucuagacuuucug

SEQ ID NO: 452293 - RNA, 22 nt, Homo sapiens
ugaaauuuuuaaaucauuucau

SEQ ID NO: 452294 - RNA, 20 nt, Homo sapiens
ugaacaaaaaaaugcucaca

SEQ ID NO: 452295 - RNA, 18 nt, Homo sapiens
ugaacaagauuucccuaa

SEQ ID NO: 452296 - RNA, 15 nt, Homo sapiens
ugaacacucuuggua

SEQ ID NO: 452297 - RNA, 14 nt, Homo sapiens
ugaacaggcaugca

SEQ ID NO: 452298 - RNA, 21 nt, Homo sapiens
ugaacagguucuccaggugau

SEQ ID NO: 452299 - RNA, 21 nt, Homo sapiens
ugaacaguuuaugcagugcug

SEQ ID NO: 452300 - RNA, 22 nt, Homo sapiens
ugaaccacccuggaaauucugc

SEQ ID NO: 452301 - RNA, 19 nt, Homo sapiens
ugaaccaugugacuguauu

SEQ ID NO: 452302 - RNA, 22 nt, Homo sapiens
ugaacuaaguuuuuuacuucca

SEQ ID NO: 452303 - RNA, 19 nt, Homo sapiens
ugaacucgcuucucuguga

SEQ ID NO: 452304 - RNA, 22 nt, Homo sapiens
ugaacucuuucuggccugccuu

SEQ ID NO: 452305 - RNA, 14 nt, Homo sapiens
ugaacuguauuuau

SEQ ID NO: 452306 - RNA, 22 nt, Homo sapiens
ugaacuuaucaaaaaugcaaau

SEQ ID NO: 452307 - RNA, 18 nt, Homo sapiens
ugaacuuucacauagcac

SEQ ID NO: 452308 - RNA, 15 nt, Homo sapiens
ugaagaaaauccuaa

SEQ ID NO: 452309 - RNA, 14 nt, Homo sapiens
ugaagaaacaaaga

SEQ ID NO: 452310 - RNA, 20 nt, Homo sapiens
ugaagaaagauacuaauaga

SEQ ID NO: 452311 - RNA, 23 nt, Homo sapiens
ugaagaagagacucuuugcauau

SEQ ID NO: 452312 - RNA, 20 nt, Homo sapiens
ugaagaagcaaacaugacua

SEQ ID NO: 452313 - RNA, 15 nt, Homo sapiens
ugaagacacugucaa

SEQ ID NO: 452314 - RNA, 13 nt, Homo sapiens
ugaagacauucca

SEQ ID NO: 452315 - RNA, 23 nt, Homo sapiens
ugaagacccucaaugccaagaaa

SEQ ID NO: 452316 - RNA, 20 nt, Homo sapiens
ugaagagaaccgagcaaaga

SEQ ID NO: 452317 - RNA, 19 nt, Homo sapiens
ugaagagauuucaacaaga

SEQ ID NO: 452318 - RNA, 22 nt, Homo sapiens
ugaagagauuucaacaagaaua

SEQ ID NO: 452319 - RNA, 14 nt, Homo sapiens
ugaagagcuucauu

SEQ ID NO: 452320 - RNA, 18 nt, Homo sapiens
ugaagagggagaagcaug

SEQ ID NO: 452321 - RNA, 13 nt, Homo sapiens
ugaagaggggcca

SEQ ID NO: 452322 - RNA, 20 nt, Homo sapiens
ugaagagugacuaguacaaa

SEQ ID NO: 452323 - RNA, 23 nt, Homo sapiens
ugaagaugucccccaggggccca

SEQ ID NO: 452324 - RNA, 19 nt, Homo sapiens
ugaagauucuccugugcua

SEQ ID NO: 452325 - RNA, 13 nt, Homo sapiens
ugaagcagugauu

SEQ ID NO: 452326 - RNA, 20 nt, Homo sapiens
ugaagcaucaaccuacuuag

SEQ ID NO: 452327 - RNA, 22 nt, Homo sapiens
ugaagcccuccaaaagcacuua

SEQ ID NO: 452328 - RNA, 19 nt, Homo sapiens
ugaagccugucguguucuc

SEQ ID NO: 452329 - RNA, 18 nt, Homo sapiens
ugaagcgaacaucuucau

SEQ ID NO: 452330 - RNA, 16 nt, Homo sapiens
ugaaggaacauuccuu

SEQ ID NO: 452331 - RNA, 18 nt, Homo sapiens
ugaaggaacauuccuuag

SEQ ID NO: 452332 - RNA, 14 nt, Homo sapiens
ugaaggacuacagg

SEQ ID NO: 452333 - RNA, 14 nt, Homo sapiens
ugaaggauugugaa

SEQ ID NO: 452334 - RNA, 16 nt, Homo sapiens
ugaaggauugugaacu

SEQ ID NO: 452335 - RNA, 22 nt, Homo sapiens
ugaagguaauacuauaaauaua

SEQ ID NO: 452336 - RNA, 13 nt, Homo sapiens
ugaaguaagcaac

SEQ ID NO: 452337 - RNA, 21 nt, Homo sapiens
ugaagugaaugaaacacucag

SEQ ID NO: 452338 - RNA, 18 nt, Homo sapiens
ugaagugcccuucccuug

SEQ ID NO: 452339 - RNA, 11 nt, Homo sapiens
ugaaguggcac

SEQ ID NO: 452340 - RNA, 17 nt, Homo sapiens
ugaaguuuacauuguaa

SEQ ID NO: 452341 - RNA, 16 nt, Homo sapiens
ugaauaaaagugcaca

SEQ ID NO: 452342 - RNA, 14 nt, Homo sapiens
uugcccaaccaaug

SEQ ID NO: 452343 - RNA, 22 nt, Homo sapiens
uugcccacacuugggagcaaaa

SEQ ID NO: 452344 - RNA, 23 nt, Homo sapiens
uugcccaccacaacuaacaaugc

SEQ ID NO: 452345 - RNA, 23 nt, Homo sapiens
uugcccagcaaggaccagugaga

SEQ ID NO: 452346 - RNA, 21 nt, Homo sapiens
uugcccaggcuggagugcaau

SEQ ID NO: 452347 - RNA, 21 nt, Homo sapiens
uugcccaggcuggagugcagu

SEQ ID NO: 452348 - RNA, 23 nt, Homo sapiens
uugcccauggaagucucaaagau

SEQ ID NO: 452349 - RNA, 14 nt, Homo sapiens
uugcccauugcacu

SEQ ID NO: 452350 - RNA, 23 nt, Homo sapiens
uugcccauugcacuuacauacca

SEQ ID NO: 452351 - RNA, 18 nt, Homo sapiens
uugccccuuccacuuuga

SEQ ID NO: 452352 - RNA, 16 nt, Homo sapiens
uugccucucucaggag

SEQ ID NO: 452353 - RNA, 21 nt, Homo sapiens
uugccugaaguuggagugagu

SEQ ID NO: 452354 - RNA, 19 nt, Homo sapiens
uugccuuaauucuuaccuc

SEQ ID NO: 452355 - RNA, 16 nt, Homo sapiens
uugccuuugcucuuau

SEQ ID NO: 452356 - RNA, 14 nt, Homo sapiens
uugccuuuggcaau

SEQ ID NO: 452357 - RNA, 23 nt, Homo sapiens
uugcgcaaacuuuaacagguuuu

SEQ ID NO: 452358 - RNA, 23 nt, Homo sapiens
uugcuagagguagaguuugauca

SEQ ID NO: 452359 - RNA, 12 nt, Homo sapiens
uugcuccauuuu

SEQ ID NO: 452360 - RNA, 15 nt, Homo sapiens
uugcucugagugcua

SEQ ID NO: 452361 - RNA, 21 nt, Homo sapiens
uugcucuuggaaagcugauga

SEQ ID NO: 452362 - RNA, 16 nt, Homo sapiens
uugcucuuucaucucu

SEQ ID NO: 452363 - RNA, 16 nt, Homo sapiens
uugcugagaaaugggg

SEQ ID NO: 452364 - RNA, 18 nt, Homo sapiens
uugcugauggcuugacau

SEQ ID NO: 452365 - RNA, 13 nt, Homo sapiens
uugcugcauuuca

SEQ ID NO: 452366 - RNA, 15 nt, Homo sapiens
uugcugcccuaggcu

SEQ ID NO: 452367 - RNA, 19 nt, Homo sapiens
uugcuggagccugagucag

SEQ ID NO: 452368 - RNA, 16 nt, Homo sapiens
uugcuguaagcaccug

SEQ ID NO: 452369 - RNA, 20 nt, Homo sapiens
uugcuuaugacaugaucgcu

SEQ ID NO: 452370 - RNA, 20 nt, Homo sapiens
uugcuuccccuuuugccaau

SEQ ID NO: 452371 - RNA, 20 nt, Homo sapiens
uugcuucuguaguacuccuu

SEQ ID NO: 452372 - RNA, 21 nt, Homo sapiens
uugcuugccgagccuaaugaa

SEQ ID NO: 452373 - RNA, 15 nt, Homo sapiens
uugcuuggacuaccu

SEQ ID NO: 452374 - RNA, 20 nt, Homo sapiens
uugcuuuaaaguaccuguag

SEQ ID NO: 452375 - RNA, 22 nt, Homo sapiens
uugcuuuagcacaggacaacuu

SEQ ID NO: 452376 - RNA, 16 nt, Homo sapiens
uugcuuugcugaccaa

SEQ ID NO: 452377 - RNA, 16 nt, Homo sapiens
uugcuuuuuuuccaau

SEQ ID NO: 452378 - RNA, 19 nt, Homo sapiens
uuggaaaacauaaaaauca

SEQ ID NO: 452379 - RNA, 13 nt, Homo sapiens
uuggaaagauuua

SEQ ID NO: 452380 - RNA, 19 nt, Homo sapiens
uuggaagaggcugagacau

SEQ ID NO: 452381 - RNA, 19 nt, Homo sapiens
uuggaauuuguaaccucag

SEQ ID NO: 452382 - RNA, 16 nt, Homo sapiens
uuggacauuuucuuca

SEQ ID NO: 452383 - RNA, 16 nt, Homo sapiens
uuggacuugaggauuu

SEQ ID NO: 452384 - RNA, 16 nt, Homo sapiens
uuggaggcccuaggcg

SEQ ID NO: 452385 - RNA, 12 nt, Homo sapiens
uuggagggauaa

SEQ ID NO: 452386 - RNA, 14 nt, Homo sapiens
uuggauguggagcu

SEQ ID NO: 452387 - RNA, 18 nt, Homo sapiens
uuggauuauucauuuaaa

SEQ ID NO: 452388 - RNA, 20 nt, Homo sapiens
uuggcaacagaagcaguuga

SEQ ID NO: 452389 - RNA, 14 nt, Homo sapiens
uuggcaaugcacug

SEQ ID NO: 452390 - RNA, 23 nt, Homo sapiens
uuggcaauucuucuucucaagca

SEQ ID NO: 452391 - RNA, 23 nt, Homo sapiens
uuggcaccccuuucuaguucaau

SEQ ID NO: 452392 - RNA, 20 nt, Homo sapiens
uuggcaggcuuuuuuccaga

SEQ ID NO: 452393 - RNA, 17 nt, Homo sapiens
uuggcauaauagucaau

SEQ ID NO: 452394 - RNA, 23 nt, Homo sapiens
uuggccagaagggggccaugagg

SEQ ID NO: 452395 - RNA, 23 nt, Homo sapiens
uuggcccccgagcugggggccau

SEQ ID NO: 452396 - RNA, 19 nt, Homo sapiens
uuggccuagcccacccugc

SEQ ID NO: 452397 - RNA, 21 nt, Homo sapiens
uuggccuagucagauggaugu

SEQ ID NO: 452398 - RNA, 22 nt, Homo sapiens
uuggccucagaauucacaaaau

SEQ ID NO: 452399 - RNA, 19 nt, Homo sapiens
uuggccucccaaagugcua

SEQ ID NO: 452400 - RNA, 15 nt, Homo sapiens
uuggcuacacacaaa

SEQ ID NO: 452401 - RNA, 15 nt, Homo sapiens
uuggcucacuacaac

SEQ ID NO: 452402 - RNA, 22 nt, Homo sapiens
uuggcuccaugcuccucacugc

SEQ ID NO: 452403 - RNA, 14 nt, Homo sapiens
uuggcugcugccac

SEQ ID NO: 452404 - RNA, 18 nt, Homo sapiens
uugggaaaugcugauuua

SEQ ID NO: 452405 - RNA, 16 nt, Homo sapiens
uugggagauuucauuu

SEQ ID NO: 452406 - RNA, 16 nt, Homo sapiens
uugggaggccauuugu

SEQ ID NO: 452407 - RNA, 10 nt, Homo sapiens
uugggcucca

SEQ ID NO: 452408 - RNA, 13 nt, Homo sapiens
uugggcucugcgu

SEQ ID NO: 452409 - RNA, 13 nt, Homo sapiens
uuggggucaggaa

SEQ ID NO: 452410 - RNA, 13 nt, Homo sapiens
uugggucuuugaa

SEQ ID NO: 452411 - RNA, 13 nt, Homo sapiens
uuggguuccagac

SEQ ID NO: 452412 - RNA, 19 nt, Homo sapiens
uuggucucuuucuuuccaa

SEQ ID NO: 452413 - RNA, 20 nt, Homo sapiens
uuggucuuacuuugugcaaa

SEQ ID NO: 452414 - RNA, 18 nt, Homo sapiens
uuggugauguaaaacaga

SEQ ID NO: 452415 - RNA, 11 nt, Homo sapiens
uuggugccacu

SEQ ID NO: 452416 - RNA, 16 nt, Homo sapiens
uuggugcugcuuucuu

SEQ ID NO: 452417 - RNA, 23 nt, Homo sapiens
uugguggcagaguggauucuuga

SEQ ID NO: 452418 - RNA, 22 nt, Homo sapiens
uugguguuuuuuuuaagggcau

SEQ ID NO: 452419 - RNA, 19 nt, Homo sapiens
uuguaaaagcaacaucagc

SEQ ID NO: 452420 - RNA, 19 nt, Homo sapiens
uuguaaacguuucaguaau

SEQ ID NO: 452421 - RNA, 19 nt, Homo sapiens
uuguaaacuaguacuauua

SEQ ID NO: 452422 - RNA, 19 nt, Homo sapiens
uuguaaauacugcuugacc

SEQ ID NO: 452423 - RNA, 21 nt, Homo sapiens
uuguaaaugagugccacaaaa

SEQ ID NO: 452424 - RNA, 22 nt, Homo sapiens
uuguaagaaauauauuugauaa

SEQ ID NO: 452425 - RNA, 22 nt, Homo sapiens
uuguaagugagagagacaagaa

SEQ ID NO: 452426 - RNA, 23 nt, Homo sapiens
uuguaaguggucgcuuacuuuga

SEQ ID NO: 452427 - RNA, 15 nt, Homo sapiens
uuguacauauggaaa

SEQ ID NO: 452428 - RNA, 16 nt, Homo sapiens
uuguaccugacuucca

SEQ ID NO: 452429 - RNA, 18 nt, Homo sapiens
uuguacuacaguauacuu

SEQ ID NO: 452430 - RNA, 19 nt, Homo sapiens
uuguagagauggggucuca

SEQ ID NO: 452431 - RNA, 21 nt, Homo sapiens
uuguagaggggcaacugauga

SEQ ID NO: 452432 - RNA, 15 nt, Homo sapiens
uuguauaaugaacau

SEQ ID NO: 452433 - RNA, 22 nt, Homo sapiens
uuguaucuuuaaagacuugaug

SEQ ID NO: 452434 - RNA, 20 nt, Homo sapiens
uuguauuccucacauucaca

SEQ ID NO: 452435 - RNA, 22 nt, Homo sapiens
uuguauuuuaacucauaccuuu

SEQ ID NO: 452436 - RNA, 15 nt, Homo sapiens
uugucaaaaagucau

SEQ ID NO: 452437 - RNA, 16 nt, Homo sapiens
uugucaaaaagucauu

SEQ ID NO: 452438 - RNA, 20 nt, Homo sapiens
uugucacaaauaaacauaau

SEQ ID NO: 452439 - RNA, 17 nt, Homo sapiens
uugucacaacacugaac

SEQ ID NO: 452440 - RNA, 18 nt, Homo sapiens
uugucacuggaaccuccc

SEQ ID NO: 452441 - RNA, 14 nt, Homo sapiens
uugucaucuuuuag

SEQ ID NO: 452442 - RNA, 12 nt, Homo sapiens
uugucauucaag

SEQ ID NO: 452443 - RNA, 13 nt, Homo sapiens
uugucauuuauaa

SEQ ID NO: 452444 - RNA, 15 nt, Homo sapiens
uuguccaauggggcu

SEQ ID NO: 452445 - RNA, 13 nt, Homo sapiens
uuguccaugaugu

SEQ ID NO: 452446 - RNA, 21 nt, Homo sapiens
uugucccgccgaguacuaugu

SEQ ID NO: 452447 - RNA, 23 nt, Homo sapiens
uugucuaauuaaaacacuuucaa

SEQ ID NO: 452448 - RNA, 10 nt, Homo sapiens
uugucucaag

SEQ ID NO: 452449 - RNA, 18 nt, Homo sapiens
uugucucgaagucucuuu

SEQ ID NO: 452450 - RNA, 15 nt, Homo sapiens
uugucugagaacaaa

SEQ ID NO: 452451 - RNA, 21 nt, Homo sapiens
uugucuuuuuuuucauccuuu

SEQ ID NO: 452452 - RNA, 18 nt, Homo sapiens
uugugaaagcaccaucau

SEQ ID NO: 452453 - RNA, 19 nt, Homo sapiens
uugugagccuugcugccaa

SEQ ID NO: 452454 - RNA, 15 nt, Homo sapiens
uugugaugauagcac

SEQ ID NO: 452455 - RNA, 20 nt, Homo sapiens
uugugaugauagcacugguu

SEQ ID NO: 452456 - RNA, 19 nt, Homo sapiens
uugugaugaugcugugaca

SEQ ID NO: 452457 - RNA, 14 nt, Homo sapiens
uugugccaauaugu

SEQ ID NO: 452458 - RNA, 17 nt, Homo sapiens
uuguggucugagccaaa

SEQ ID NO: 452459 - RNA, 14 nt, Homo sapiens
uugugguuaaucug

SEQ ID NO: 452460 - RNA, 20 nt, Homo sapiens
uugugguuuauugaauguga

SEQ ID NO: 452461 - RNA, 14 nt, Homo sapiens
uuguguacaaagua

SEQ ID NO: 452462 - RNA, 17 nt, Homo sapiens
uuguguagaaagccaaa

SEQ ID NO: 452463 - RNA, 16 nt, Homo sapiens
uuguguccacugugac

SEQ ID NO: 452464 - RNA, 22 nt, Homo sapiens
uugugugcucauguaugugcga

SEQ ID NO: 452465 - RNA, 15 nt, Homo sapiens
uuguuaagcucagga

SEQ ID NO: 452466 - RNA, 22 nt, Homo sapiens
uuguuaauaacuaauaacugga

SEQ ID NO: 452467 - RNA, 18 nt, Homo sapiens
uuguuaccuuuaugguuu

SEQ ID NO: 452468 - RNA, 15 nt, Homo sapiens
uuguuauggcaaguu

SEQ ID NO: 452469 - RNA, 16 nt, Homo sapiens
uuguucacaccacagg

SEQ ID NO: 452470 - RNA, 20 nt, Homo sapiens
uuguucauuauuggagggua

SEQ ID NO: 452471 - RNA, 17 nt, Homo sapiens
uuguuccagauggggcc

SEQ ID NO: 452472 - RNA, 16 nt, Homo sapiens
uuguugacacggccau

SEQ ID NO: 452473 - RNA, 15 nt, Homo sapiens
uuuaaaauugcagca

SEQ ID NO: 452474 - RNA, 14 nt, Homo sapiens
uuuaaacacaucaa

SEQ ID NO: 452475 - RNA, 14 nt, Homo sapiens
uuuaaacuauucag

SEQ ID NO: 452476 - RNA, 22 nt, Homo sapiens
uuuaaaguaucauuuauuugaa

SEQ ID NO: 452477 - RNA, 12 nt, Homo sapiens
uuuaaagucaca

SEQ ID NO: 452478 - RNA, 20 nt, Homo sapiens
uuuaaauaaaguuacuugaa

SEQ ID NO: 452479 - RNA, 17 nt, Homo sapiens
uuuaaauagaacuugau

SEQ ID NO: 452480 - RNA, 17 nt, Homo sapiens
uuuaaauucucagucau

SEQ ID NO: 452481 - RNA, 17 nt, Homo sapiens
uuuaacaaaacaagaaa

SEQ ID NO: 452482 - RNA, 19 nt, Homo sapiens
uuuaacaaaucuaaucucu

SEQ ID NO: 452483 - RNA, 15 nt, Homo sapiens
uuuaaccuacuagac

SEQ ID NO: 452484 - RNA, 20 nt, Homo sapiens
uuuaacucagaucacuacug

SEQ ID NO: 452485 - RNA, 18 nt, Homo sapiens
uuuaacugugaaccugga

SEQ ID NO: 452486 - RNA, 16 nt, Homo sapiens
uuuaacuugaggguaa

SEQ ID NO: 452487 - RNA, 13 nt, Homo sapiens
uuuaagcuguaaa

SEQ ID NO: 452488 - RNA, 23 nt, Homo sapiens
uuuaaggcagcaacaagaaaaga

SEQ ID NO: 452489 - RNA, 16 nt, Homo sapiens
uuuaauagaauauaau

SEQ ID NO: 452490 - RNA, 22 nt, Homo sapiens
uuuaauagagaacuucuagugu

SEQ ID NO: 452491 - RNA, 13 nt, Homo sapiens
uuuaauagucauu

SEQ ID NO: 452492 - RNA, 13 nt, Homo sapiens
uuuaaucauuucc

SEQ ID NO: 452493 - RNA, 19 nt, Homo sapiens
uuuaaucauuuugccucuu

SEQ ID NO: 452494 - RNA, 20 nt, Homo sapiens
uuuaaucgaacgcgugugug

SEQ ID NO: 452495 - RNA, 17 nt, Homo sapiens
uuuaauguuuccuuuaa

SEQ ID NO: 452496 - RNA, 17 nt, Homo sapiens
uuuacaaguguauauca

SEQ ID NO: 452497 - RNA, 12 nt, Homo sapiens
uuuacacugacu

SEQ ID NO: 452498 - RNA, 20 nt, Homo sapiens
uuuacagacaauaaaaugga

SEQ ID NO: 452499 - RNA, 19 nt, Homo sapiens
uuuacagcacuacucugug

SEQ ID NO: 452500 - RNA, 18 nt, Homo sapiens
uuuacaugaguucaaaua

SEQ ID NO: 452501 - RNA, 14 nt, Homo sapiens
uuuacauucugcaa

SEQ ID NO: 452502 - RNA, 20 nt, Homo sapiens
uuuaccaaucaacagcaugu

SEQ ID NO: 452503 - RNA, 15 nt, Homo sapiens
uuuacgguacuuggu

SEQ ID NO: 452504 - RNA, 21 nt, Homo sapiens
uuuacguuuuaacacacagac

SEQ ID NO: 452505 - RNA, 23 nt, Homo sapiens
uuuacuaagcacuguguuuauau

SEQ ID NO: 452506 - RNA, 16 nt, Homo sapiens
uuuacuacuauucugu

SEQ ID NO: 452507 - RNA, 17 nt, Homo sapiens
uuuacucaucaggucau

SEQ ID NO: 452508 - RNA, 21 nt, Homo sapiens
uuuacuguugcccauugcacu

SEQ ID NO: 452509 - RNA, 16 nt, Homo sapiens
uuuacuuuguacuugu

SEQ ID NO: 452510 - RNA, 15 nt, Homo sapiens
uuuagaaacugaguc

SEQ ID NO: 452511 - RNA, 17 nt, Homo sapiens
uuuagacuaacuuccau

SEQ ID NO: 452512 - RNA, 22 nt, Homo sapiens
uuuagacuuuuaacuucaccuu

SEQ ID NO: 452513 - RNA, 15 nt, Homo sapiens
uuuagaguaugcaag

SEQ ID NO: 452514 - RNA, 22 nt, Homo sapiens
uuuagaguaugcaagaagaaua

SEQ ID NO: 452515 - RNA, 18 nt, Homo sapiens
uuuagcagaggagccaug

SEQ ID NO: 452516 - RNA, 19 nt, Homo sapiens
uuuagcuucucugccaagc

SEQ ID NO: 452517 - RNA, 13 nt, Homo sapiens
uuuagggugauca

SEQ ID NO: 452518 - RNA, 14 nt, Homo sapiens
uuuaggucauccaa

SEQ ID NO: 452519 - RNA, 14 nt, Homo sapiens
uuuaguauguguca

SEQ ID NO: 452520 - RNA, 14 nt, Homo sapiens
uuuagugucuugaa

SEQ ID NO: 452521 - RNA, 17 nt, Homo sapiens
uuuauaaauguguggug

SEQ ID NO: 452522 - RNA, 16 nt, Homo sapiens
uuuauaagagcuaaag

SEQ ID NO: 452523 - RNA, 12 nt, Homo sapiens
uuuauacaggaa

SEQ ID NO: 452524 - RNA, 20 nt, Homo sapiens
uuuaucaaacacacuuccag

SEQ ID NO: 452525 - RNA, 19 nt, Homo sapiens
uuuaucacacuucugugag

SEQ ID NO: 452526 - RNA, 17 nt, Homo sapiens
uuuaucauuucuacuga

SEQ ID NO: 452527 - RNA, 13 nt, Homo sapiens
uuuauccaugcca

SEQ ID NO: 452528 - RNA, 15 nt, Homo sapiens
uuuaugaaguuaaca

SEQ ID NO: 452529 - RNA, 20 nt, Homo sapiens
uuuaugagaaaugccagugu

SEQ ID NO: 452530 - RNA, 23 nt, Homo sapiens
uuuauggaccaauuagcauucca

SEQ ID NO: 452531 - RNA, 19 nt, Homo sapiens
uuuauguguugaugacuca

SEQ ID NO: 452532 - RNA, 20 nt, Homo sapiens
uuuauuauguccauuauuca

SEQ ID NO: 452533 - RNA, 17 nt, Homo sapiens
uuuauucacaguaucug

SEQ ID NO: 452534 - RNA, 15 nt, Homo sapiens
uuuauugcuuaaucc

SEQ ID NO: 452535 - RNA, 19 nt, Homo sapiens
uuuauuucauucauauccu

SEQ ID NO: 452536 - RNA, 20 nt, Homo sapiens
uuucaaaagaagaguuuuag

SEQ ID NO: 452537 - RNA, 19 nt, Homo sapiens
uuucaaaauauacauucaa

SEQ ID NO: 452538 - RNA, 15 nt, Homo sapiens
uuucaaaaugcaugu

SEQ ID NO: 452539 - RNA, 18 nt, Homo sapiens
uuucaaaaugcaugugau

SEQ ID NO: 452540 - RNA, 17 nt, Homo sapiens
uuucaaacagcaucaaa

SEQ ID NO: 452541 - RNA, 14 nt, Homo sapiens
uuucaaagucucac

SEQ ID NO: 452542 - RNA, 20 nt, Homo sapiens
uuucaaaguguugaugguaa

SEQ ID NO: 452543 - RNA, 14 nt, Homo sapiens
uuucaagugcuaaa

SEQ ID NO: 452544 - RNA, 23 nt, Homo sapiens
uuucaaguggaaaccuugcugcu

SEQ ID NO: 452545 - RNA, 15 nt, Homo sapiens
uuucaaugaccugua

SEQ ID NO: 452546 - RNA, 16 nt, Homo sapiens
uuucaaugcugacugg

SEQ ID NO: 452547 - RNA, 18 nt, Homo sapiens
uuucaaugguugggacaa

SEQ ID NO: 452548 - RNA, 20 nt, Homo sapiens
uuucacaccuuguggagaac

SEQ ID NO: 452549 - RNA, 16 nt, Homo sapiens
uuucaccugaaacacu

SEQ ID NO: 452550 - RNA, 14 nt, Homo sapiens
uuucacugcugcuc

SEQ ID NO: 452551 - RNA, 23 nt, Homo sapiens
uuucagaaacaaagcauuugacu

SEQ ID NO: 452552 - RNA, 17 nt, Homo sapiens
uuucagcuggcagaguu

SEQ ID NO: 452553 - RNA, 15 nt, Homo sapiens
uuucaggcacaucau

SEQ ID NO: 452554 - RNA, 20 nt, Homo sapiens
uuucagggaaaaauacuuua

SEQ ID NO: 452555 - RNA, 21 nt, Homo sapiens
uuucagggaguacacagguag

SEQ ID NO: 452556 - RNA, 13 nt, Homo sapiens
uuucaguaccaaa

SEQ ID NO: 452557 - RNA, 19 nt, Homo sapiens
uuucaguauuaaacucucc

SEQ ID NO: 452558 - RNA, 18 nt, Homo sapiens
uuucagugccauacaugu

SEQ ID NO: 452559 - RNA, 20 nt, Homo sapiens
uuucauaaacuucagggauc

SEQ ID NO: 452560 - RNA, 20 nt, Homo sapiens
uuucauccaggcucccaaaa

SEQ ID NO: 452561 - RNA, 21 nt, Homo sapiens
uuucaugauuagacaaugugg

SEQ ID NO: 452562 - RNA, 15 nt, Homo sapiens
uuucaugcgugugug

SEQ ID NO: 452563 - RNA, 20 nt, Homo sapiens
uuucaugcuauuucacucua

SEQ ID NO: 452564 - RNA, 15 nt, Homo sapiens
uuucaugugaucuau

SEQ ID NO: 452565 - RNA, 22 nt, Homo sapiens
uuucauuccuaacacagcaugu

SEQ ID NO: 452566 - RNA, 15 nt, Homo sapiens
uuucauuguucuugg

SEQ ID NO: 452567 - RNA, 19 nt, Homo sapiens
uuucauuuaucaagcagag

SEQ ID NO: 452568 - RNA, 13 nt, Homo sapiens
uuucauuuugcca

SEQ ID NO: 452569 - RNA, 21 nt, Homo sapiens
uuuccaaagcauuuuugauca

SEQ ID NO: 452570 - RNA, 17 nt, Homo sapiens
uuuccaagggucuuccu

SEQ ID NO: 452571 - RNA, 22 nt, Homo sapiens
uuuccaauccuuuauagcuuug

SEQ ID NO: 452572 - RNA, 13 nt, Homo sapiens
uuuccacacagcc

SEQ ID NO: 452573 - RNA, 21 nt, Homo sapiens
uuuccacucccacugccagga

SEQ ID NO: 452574 - RNA, 15 nt, Homo sapiens
uuuccagauauucaa

SEQ ID NO: 452575 - RNA, 22 nt, Homo sapiens
uuuccagcuccuaguagcuuuc

SEQ ID NO: 452576 - RNA, 15 nt, Homo sapiens
uuuccaggcuagucc

SEQ ID NO: 452577 - RNA, 18 nt, Homo sapiens
uuuccagugucacuugac

SEQ ID NO: 452578 - RNA, 14 nt, Homo sapiens
uuucccacacauau

SEQ ID NO: 452579 - RNA, 14 nt, Homo sapiens
uuucccacacccca

SEQ ID NO: 452580 - RNA, 18 nt, Homo sapiens
uuucccagcccuuuccag

SEQ ID NO: 452581 - RNA, 16 nt, Homo sapiens
uuucccaggacaggaa

SEQ ID NO: 452582 - RNA, 18 nt, Homo sapiens
uuuccccaccccagcuca

SEQ ID NO: 452583 - RNA, 22 nt, Homo sapiens
uuucccuacuaacaucccaaua

SEQ ID NO: 452584 - RNA, 21 nt, Homo sapiens
uuucccugcuggccaaaguca

SEQ ID NO: 452585 - RNA, 17 nt, Homo sapiens
uuuccgccagaccucaa

SEQ ID NO: 452586 - RNA, 13 nt, Homo sapiens
uuuccguuuccag

SEQ ID NO: 452587 - RNA, 22 nt, Homo sapiens
uuuccuaucuguaugucugccu

SEQ ID NO: 452588 - RNA, 20 nt, Homo sapiens
uuuuggguauugaauguggu

SEQ ID NO: 452589 - RNA, 15 nt, Homo sapiens
uuuuguaacugccua

SEQ ID NO: 452590 - RNA, 14 nt, Homo sapiens
uuuugugcauugga

SEQ ID NO: 452591 - RNA, 16 nt, Homo sapiens
uuuuguguuuugguua

SEQ ID NO: 452592 - RNA, 13 nt, Homo sapiens
uuuuguuaccuuu

SEQ ID NO: 452593 - RNA, 11 nt, Homo sapiens
uuuuguucuaa

SEQ ID NO: 452594 - RNA, 18 nt, Homo sapiens
uuuuucccuaucacugaa

SEQ ID NO: 452595 - RNA, 15 nt, Homo sapiens
uuuuuccuccuuguc

SEQ ID NO: 452596 - RNA, 20 nt, Homo sapiens
uuuuucucgaguccaaaauc

SEQ ID NO: 452597 - RNA, 11 nt, Homo sapiens
uuuuugcucuc

SEQ ID NO: 452598 - RNA, 17 nt, Homo sapiens
uuuuuggauggcuuaag

SEQ ID NO: 452599 - RNA, 15 nt, Homo sapiens
uuuuuguacuuugcu

SEQ ID NO: 452600 - RNA, 19 nt, Homo sapiens
uuuuuuaaauaaaagcagc

SEQ ID NO: 452601 - RNA, 13 nt, Homo sapiens
uuuuuuaacauuc

SEQ ID NO: 452602 - RNA, 12 nt, Homo sapiens
uuuuuuaagggc

SEQ ID NO: 452603 - RNA, 21 nt, Homo sapiens
uuuuuucauuuugccaaaaag

SEQ ID NO: 452604 - RNA, 12 nt, Homo sapiens
uuuuuugguguu

SEQ ID NO: 452605 - RNA, 15 nt, Homo sapiens
uaaguaacauauaaa

SEQ ID NO: 452606 - RNA, 12 nt, Homo sapiens
uaaguacaaaua

SEQ ID NO: 452607 - RNA, 13 nt, Homo sapiens
uaaguacauauag

SEQ ID NO: 452608 - RNA, 15 nt, Homo sapiens
uaaguaugauugaca

SEQ ID NO: 452609 - RNA, 16 nt, Homo sapiens
uaagucacaaagaguu

SEQ ID NO: 452610 - RNA, 16 nt, Homo sapiens
uaaguggcugugauua

SEQ ID NO: 452611 - RNA, 22 nt, Homo sapiens
uaaguggcuuuuuaacaugaaa

SEQ ID NO: 452612 - RNA, 12 nt, Homo sapiens
uaaguguacuuc

SEQ ID NO: 452613 - RNA, 20 nt, Homo sapiens
uaaguuaccuuucuagguca

SEQ ID NO: 452614 - RNA, 13 nt, Homo sapiens
uaaguuaggcagu

SEQ ID NO: 452615 - RNA, 14 nt, Homo sapiens
uaaguuauuuacuu

SEQ ID NO: 452616 - RNA, 15 nt, Homo sapiens
uaaguuuuacuugag

SEQ ID NO: 452617 - RNA, 20 nt, Homo sapiens
uaauaaaaaucaugcuuaua

SEQ ID NO: 452618 - RNA, 13 nt, Homo sapiens
uaauaaacucaca

SEQ ID NO: 452619 - RNA, 23 nt, Homo sapiens
uaauaaagaaauaauacccugcc

SEQ ID NO: 452620 - RNA, 15 nt, Homo sapiens
uaauaaagacagggu

SEQ ID NO: 452621 - RNA, 13 nt, Homo sapiens
uaauaaagugcac

SEQ ID NO: 452622 - RNA, 20 nt, Homo sapiens
uaauaacaacagaucugcag

SEQ ID NO: 452623 - RNA, 13 nt, Homo sapiens
uaauaacugugaa

SEQ ID NO: 452624 - RNA, 15 nt, Homo sapiens
uaauaagcuaaagag

SEQ ID NO: 452625 - RNA, 15 nt, Homo sapiens
uaauaaguaaucuaa

SEQ ID NO: 452626 - RNA, 17 nt, Homo sapiens
uaauaauaguacuauua

SEQ ID NO: 452627 - RNA, 17 nt, Homo sapiens
uaauaaucuucagguga

SEQ ID NO: 452628 - RNA, 17 nt, Homo sapiens
uaauaauguccuuuccc

SEQ ID NO: 452629 - RNA, 15 nt, Homo sapiens
uaauaauguuuaaua

SEQ ID NO: 452630 - RNA, 17 nt, Homo sapiens
uaauacuauauugcugu

SEQ ID NO: 452631 - RNA, 13 nt, Homo sapiens
uaauagaguacuu

SEQ ID NO: 452632 - RNA, 14 nt, Homo sapiens
uaauagaguacuua

SEQ ID NO: 452633 - RNA, 15 nt, Homo sapiens
uaauagcuauccuaa

SEQ ID NO: 452634 - RNA, 15 nt, Homo sapiens
uaauaguacuauuac

SEQ ID NO: 452635 - RNA, 18 nt, Homo sapiens
uaauauaaaugaaugaaa

SEQ ID NO: 452636 - RNA, 13 nt, Homo sapiens
uaauauacuuuaa

SEQ ID NO: 452637 - RNA, 16 nt, Homo sapiens
uaauaucuuucaguua

SEQ ID NO: 452638 - RNA, 15 nt, Homo sapiens
uaauaugucuucaua

SEQ ID NO: 452639 - RNA, 17 nt, Homo sapiens
uaaucaagauaagcacg

SEQ ID NO: 452640 - RNA, 15 nt, Homo sapiens
uaaucaccucucugu

SEQ ID NO: 452641 - RNA, 19 nt, Homo sapiens
uaaucaucuucucuuuuuc

SEQ ID NO: 452642 - RNA, 20 nt, Homo sapiens
uaaucaugugggugagccag

SEQ ID NO: 452643 - RNA, 23 nt, Homo sapiens
uaaucccuucaaggaagugauaa

SEQ ID NO: 452644 - RNA, 17 nt, Homo sapiens
uaaucuagagcuaugca

SEQ ID NO: 452645 - RNA, 17 nt, Homo sapiens
uaaucugaaacacaguc

SEQ ID NO: 452646 - RNA, 15 nt, Homo sapiens
uaaucugaggcaauc

SEQ ID NO: 452647 - RNA, 13 nt, Homo sapiens
uaaucuguagggc

SEQ ID NO: 452648 - RNA, 16 nt, Homo sapiens
ucuaacuaaacuaaaa

SEQ ID NO: 452649 - RNA, 20 nt, Homo sapiens
ucuaagaaauggcuuuccac

SEQ ID NO: 452650 - RNA, 14 nt, Homo sapiens
ucuaagacauucac

SEQ ID NO: 452651 - RNA, 17 nt, Homo sapiens
ucuaagauaguaacaau

SEQ ID NO: 452652 - RNA, 18 nt, Homo sapiens
ucuaagaugccagcauau

SEQ ID NO: 452653 - RNA, 15 nt, Homo sapiens
ucuaagccaacuuua

SEQ ID NO: 452654 - RNA, 16 nt, Homo sapiens
ucuaagccaguuuuca

SEQ ID NO: 452655 - RNA, 17 nt, Homo sapiens
ucuaagccuuuccauaa

SEQ ID NO: 452656 - RNA, 18 nt, Homo sapiens
ucuaagcuuauuucuaac

SEQ ID NO: 452657 - RNA, 14 nt, Homo sapiens
ucuaaggcaugcuc

SEQ ID NO: 452658 - RNA, 14 nt, Homo sapiens
ucuaagugggagaa

SEQ ID NO: 452659 - RNA, 16 nt, Homo sapiens
ucuaaguguacuucau

SEQ ID NO: 452660 - RNA, 15 nt, Homo sapiens
ucuaagugugcugca

SEQ ID NO: 452661 - RNA, 20 nt, Homo sapiens
ucuaaguuauuuacuuuuac

SEQ ID NO: 452662 - RNA, 13 nt, Homo sapiens
ucuaaucaaaagg

SEQ ID NO: 452663 - RNA, 21 nt, Homo sapiens
ucuaaucaaaagggaaaagaa

SEQ ID NO: 452664 - RNA, 14 nt, Homo sapiens
ucuaaucgaaagaa

SEQ ID NO: 452665 - RNA, 15 nt, Homo sapiens
ucuaauuugcugcug

SEQ ID NO: 452666 - RNA, 23 nt, Homo sapiens
ucuacacagcaguaugaaugaug

SEQ ID NO: 452667 - RNA, 20 nt, Homo sapiens
ucuacaccuggaccauuuga

SEQ ID NO: 452668 - RNA, 15 nt, Homo sapiens
ucuacaggcauuuaa

SEQ ID NO: 452669 - RNA, 21 nt, Homo sapiens
ucuacauaaguaauucaagaa

SEQ ID NO: 452670 - RNA, 23 nt, Homo sapiens
ucuacauguuuuagacagagaca

SEQ ID NO: 452671 - RNA, 15 nt, Homo sapiens
ucuaccagcauaaau

SEQ ID NO: 452672 - RNA, 19 nt, Homo sapiens
ucuacccugcugaccuccc

SEQ ID NO: 452673 - RNA, 21 nt, Homo sapiens
ucuaccuuuuuuucucuccua

SEQ ID NO: 452674 - RNA, 16 nt, Homo sapiens
ucuacuacaugugacu

SEQ ID NO: 452675 - RNA, 20 nt, Homo sapiens
ucuacuacaugugacuggca

SEQ ID NO: 452676 - RNA, 22 nt, Homo sapiens
ucuacuagaaccuucuaaucca

SEQ ID NO: 452677 - RNA, 16 nt, Homo sapiens
ucuacuuaaugagaua

SEQ ID NO: 452678 - RNA, 16 nt, Homo sapiens
ucuacuucuugugcuu

SEQ ID NO: 452679 - RNA, 14 nt, Homo sapiens
ucuagaacagccag

SEQ ID NO: 452680 - RNA, 16 nt, Homo sapiens
ucuagaacagccagac

SEQ ID NO: 452681 - RNA, 21 nt, Homo sapiens
ucuagaacauucagauuuacc

SEQ ID NO: 452682 - RNA, 20 nt, Homo sapiens
ucuagaauuauaagucacaa

SEQ ID NO: 452683 - RNA, 22 nt, Homo sapiens
ucuagacugacucacauugccu

SEQ ID NO: 452684 - RNA, 20 nt, Homo sapiens
ucuagaguaauuaucuguga

SEQ ID NO: 452685 - RNA, 18 nt, Homo sapiens
ucuagauagcugacucau

SEQ ID NO: 452686 - RNA, 18 nt, Homo sapiens
ucuagauccugcacccca

SEQ ID NO: 452687 - RNA, 13 nt, Homo sapiens
ucuagcacaucau

SEQ ID NO: 452688 - RNA, 15 nt, Homo sapiens
ucuagcaccaggacu

SEQ ID NO: 452689 - RNA, 22 nt, Homo sapiens
ucuagcaccaggacucagagga

SEQ ID NO: 452690 - RNA, 23 nt, Homo sapiens
ucuaggauaagcacuagaucucc

SEQ ID NO: 452691 - RNA, 15 nt, Homo sapiens
ucuaggcacaugugg

SEQ ID NO: 452692 - RNA, 14 nt, Homo sapiens
ucuaggguuuucca

SEQ ID NO: 452693 - RNA, 17 nt, Homo sapiens
ucuagugaaugaaucuc

SEQ ID NO: 452694 - RNA, 21 nt, Homo sapiens
ucuagugaaugaaucucaaga

SEQ ID NO: 452695 - RNA, 14 nt, Homo sapiens
ucuauaaaaugagg

SEQ ID NO: 452696 - RNA, 20 nt, Homo sapiens
ucuauaaauucaacacuuau

SEQ ID NO: 452697 - RNA, 12 nt, Homo sapiens
ucuauacauucc

SEQ ID NO: 452698 - RNA, 13 nt, Homo sapiens
ucuauagcacaua

SEQ ID NO: 452699 - RNA, 21 nt, Homo sapiens
ucuauauccauaaccucuaua

SEQ ID NO: 452700 - RNA, 12 nt, Homo sapiens
ucuaugacugug

SEQ ID NO: 452701 - RNA, 14 nt, Homo sapiens
ucuaugguugacau

SEQ ID NO: 452702 - RNA, 18 nt, Homo sapiens
ucuaugguugacauugua

SEQ ID NO: 452703 - RNA, 16 nt, Homo sapiens
ucuaugucucaugaug

SEQ ID NO: 452704 - RNA, 12 nt, Homo sapiens
ucuauguucccc

SEQ ID NO: 452705 - RNA, 20 nt, Homo sapiens
ucuauucccaucgcuggaaa

SEQ ID NO: 452706 - RNA, 18 nt, Homo sapiens
ucuauugaguguacauuu

SEQ ID NO: 452707 - RNA, 17 nt, Homo sapiens
ucuauuuggcaauucac

SEQ ID NO: 452708 - RNA, 16 nt, Homo sapiens
ucuauuuugugaugau

SEQ ID NO: 452709 - RNA, 22 nt, Homo sapiens
ucucaaaaaaaaaaaaaugcac

SEQ ID NO: 452710 - RNA, 19 nt, Homo sapiens
ucucaaacccccagccuca

SEQ ID NO: 452711 - RNA, 18 nt, Homo sapiens
ucucaaaugauacaguca

SEQ ID NO: 452712 - RNA, 16 nt, Homo sapiens
ucucaacuuacauaug

SEQ ID NO: 452713 - RNA, 17 nt, Homo sapiens
ucucaacuuacauaugu

SEQ ID NO: 452714 - RNA, 18 nt, Homo sapiens
ucucaaggacacauuugg

SEQ ID NO: 452715 - RNA, 23 nt, Homo sapiens
ucucaagggcuagcaucccugag

SEQ ID NO: 452716 - RNA, 22 nt, Homo sapiens
ucucaaggucacgggaccccua

SEQ ID NO: 452717 - RNA, 14 nt, Homo sapiens
ucucaauuugcagu

SEQ ID NO: 452718 - RNA, 19 nt, Homo sapiens
ucucacaaauaaguaauau

SEQ ID NO: 452719 - RNA, 12 nt, Homo sapiens
ucucacaaauga

SEQ ID NO: 452720 - RNA, 22 nt, Homo sapiens
ucucacaagauggaaaucacau

SEQ ID NO: 452721 - RNA, 15 nt, Homo sapiens
ucucacacauuccag

SEQ ID NO: 452722 - RNA, 18 nt, Homo sapiens
ucucacaguguugcccag

SEQ ID NO: 452723 - RNA, 14 nt, Homo sapiens
ucucacauguggca

SEQ ID NO: 452724 - RNA, 16 nt, Homo sapiens
ucucacccacuaggau

SEQ ID NO: 452725 - RNA, 16 nt, Homo sapiens
ucucaccuggacucca

SEQ ID NO: 452726 - RNA, 14 nt, Homo sapiens
ucucacuugucuca

SEQ ID NO: 452727 - RNA, 14 nt, Homo sapiens
ucucacuuuggacu

SEQ ID NO: 452728 - RNA, 23 nt, Homo sapiens
ucucagaacagucugaaauaccu

SEQ ID NO: 452729 - RNA, 20 nt, Homo sapiens
ucucagaacuccugugugug

SEQ ID NO: 452730 - RNA, 22 nt, Homo sapiens
ucucagacaucaagucaacuuu

SEQ ID NO: 452731 - RNA, 13 nt, Homo sapiens
ucucagagcaugu

SEQ ID NO: 452732 - RNA, 18 nt, Homo sapiens
ucucagagcuccacagaa

SEQ ID NO: 452733 - RNA, 14 nt, Homo sapiens
ucucagcaagagaa

SEQ ID NO: 452734 - RNA, 13 nt, Homo sapiens
ucucagcaagugu

SEQ ID NO: 452735 - RNA, 14 nt, Homo sapiens
ucucagcaagugua

SEQ ID NO: 452736 - RNA, 9 nt, Homo sapiens
ucucagcuc

SEQ ID NO: 452737 - RNA, 12 nt, Homo sapiens
ucucagugcagg

SEQ ID NO: 452738 - RNA, 14 nt, Homo sapiens
ucucagugcuucuu

SEQ ID NO: 452739 - RNA, 23 nt, Homo sapiens
ucucauagccucgaauaucuuaa

SEQ ID NO: 452740 - RNA, 18 nt, Homo sapiens
ucucauauuuuuacaaau

SEQ ID NO: 452741 - RNA, 13 nt, Homo sapiens
ucucauccacaga

SEQ ID NO: 452742 - RNA, 19 nt, Homo sapiens
ucucaucccacgcacucca

SEQ ID NO: 452743 - RNA, 14 nt, Homo sapiens
ucucauuacagauu

SEQ ID NO: 452744 - RNA, 20 nt, Homo sapiens
ucucauuccucuguccccga

SEQ ID NO: 452745 - RNA, 14 nt, Homo sapiens
ucucauucuugccc

SEQ ID NO: 452746 - RNA, 22 nt, Homo sapiens
ucucauuuguauuuucaguuug

SEQ ID NO: 452747 - RNA, 21 nt, Homo sapiens
ucucauuuuguauguaugugu

SEQ ID NO: 452748 - RNA, 16 nt, Homo sapiens
ucuccaaaaacaguga

SEQ ID NO: 452749 - RNA, 18 nt, Homo sapiens
ucuccaccuuguuacaca

SEQ ID NO: 452750 - RNA, 22 nt, Homo sapiens
ucuccagccagcaaugaugucc

SEQ ID NO: 452751 - RNA, 20 nt, Homo sapiens
ucuccauaaaaguccuguca

SEQ ID NO: 452752 - RNA, 20 nt, Homo sapiens
ucucccaaguccagugugac

SEQ ID NO: 452753 - RNA, 14 nt, Homo sapiens
ucuccccuccagag

SEQ ID NO: 452754 - RNA, 17 nt, Homo sapiens
ucuccccugcacuguaa

SEQ ID NO: 452755 - RNA, 15 nt, Homo sapiens
ucucccuaaccacua

SEQ ID NO: 452756 - RNA, 19 nt, Homo sapiens
ucucccuccccugccauuu

SEQ ID NO: 452757 - RNA, 14 nt, Homo sapiens
ucucccucucugca

SEQ ID NO: 452758 - RNA, 12 nt, Homo sapiens
ucucccuuccac

SEQ ID NO: 452759 - RNA, 19 nt, Homo sapiens
ucucccuuuugacacaguu

SEQ ID NO: 452760 - RNA, 17 nt, Homo sapiens
ucuccucuagacugacu

SEQ ID NO: 452761 - RNA, 16 nt, Homo sapiens
ucuccucugauuauca

SEQ ID NO: 452762 - RNA, 13 nt, Homo sapiens
ucuccugcaugca

SEQ ID NO: 452763 - RNA, 18 nt, Homo sapiens
ucuccuuccacaaugacu

SEQ ID NO: 452764 - RNA, 12 nt, Homo sapiens
ucuccuugcccu

SEQ ID NO: 452765 - RNA, 13 nt, Homo sapiens
ucuccuugcccug

SEQ ID NO: 452766 - RNA, 14 nt, Homo sapiens
ucuccuuugcugag

SEQ ID NO: 452767 - RNA, 19 nt, Homo sapiens
ucucuacuaccacaaggaa

SEQ ID NO: 452768 - RNA, 14 nt, Homo sapiens
ucucuagacaucua

SEQ ID NO: 452769 - RNA, 22 nt, Homo sapiens
ucucuaggagggagccuuguga

SEQ ID NO: 452770 - RNA, 18 nt, Homo sapiens
ucucuaggccuguugccu

SEQ ID NO: 452771 - RNA, 21 nt, Homo sapiens
ucucuauuuuuguuaaucauc

SEQ ID NO: 452772 - RNA, 22 nt, Homo sapiens
ucucucccaccccggccuccac

SEQ ID NO: 452773 - RNA, 18 nt, Homo sapiens
ucucuccccuugcacugg

SEQ ID NO: 452774 - RNA, 14 nt, Homo sapiens
ucucucucucaaaa

SEQ ID NO: 452775 - RNA, 15 nt, Homo sapiens
ucucugaugcacugu

SEQ ID NO: 452776 - RNA, 17 nt, Homo sapiens
ucucugccacccacuca

SEQ ID NO: 452777 - RNA, 15 nt, Homo sapiens
ucucugccagugaca

SEQ ID NO: 452778 - RNA, 20 nt, Homo sapiens
ucucuggguagguguugaaa

SEQ ID NO: 452779 - RNA, 15 nt, Homo sapiens
ucucuggguuuacaa

SEQ ID NO: 452780 - RNA, 16 nt, Homo sapiens
ucucugucuggcugua

SEQ ID NO: 452781 - RNA, 12 nt, Homo sapiens
ucucugugcucu

SEQ ID NO: 452782 - RNA, 16 nt, Homo sapiens
ucucuguuuacccucc

SEQ ID NO: 452783 - RNA, 21 nt, Homo sapiens
ucucuuaugauacuugaggua

SEQ ID NO: 452784 - RNA, 16 nt, Homo sapiens
ucucuucuguccauca

SEQ ID NO: 452785 - RNA, 12 nt, Homo sapiens
ucucuugauuca

SEQ ID NO: 452786 - RNA, 18 nt, Homo sapiens
ucucuugcacucaaagcu

SEQ ID NO: 452787 - RNA, 17 nt, Homo sapiens
ucucuugccagcauuuu

SEQ ID NO: 452788 - RNA, 20 nt, Homo sapiens
ucucuugcuaccugugagca

SEQ ID NO: 452789 - RNA, 16 nt, Homo sapiens
ucucuuguuauugcau

SEQ ID NO: 452790 - RNA, 17 nt, Homo sapiens
ucucuuucaauugcaga

SEQ ID NO: 452791 - RNA, 24 nt, Homo sapiens
ucugaaaauauuuuuuucuagcua

SEQ ID NO: 452792 - RNA, 23 nt, Homo sapiens
ucugaaacugcauaagugaaaau

SEQ ID NO: 452793 - RNA, 19 nt, Homo sapiens
ucugaacacauacuagaaa

SEQ ID NO: 452794 - RNA, 15 nt, Homo sapiens
ucugaagucacugca

SEQ ID NO: 452795 - RNA, 17 nt, Homo sapiens
ucugaagucacugcaca

SEQ ID NO: 452796 - RNA, 18 nt, Homo sapiens
ucugaagugucuaaugca

SEQ ID NO: 452797 - RNA, 23 nt, Homo sapiens
ucugaauguuaaacuacucuuga

SEQ ID NO: 452798 - RNA, 16 nt, Homo sapiens
ucugacacaugcucuc

SEQ ID NO: 452799 - RNA, 16 nt, Homo sapiens
ucugacgcaaaaccac

SEQ ID NO: 452800 - RNA, 22 nt, Homo sapiens
ucugacgcaaaaccacuuuccu

SEQ ID NO: 452801 - RNA, 22 nt, Homo sapiens
ucugacucccaaagagcugccu

SEQ ID NO: 452802 - RNA, 19 nt, Homo sapiens
ucugagaagaggagcccuc

SEQ ID NO: 452803 - RNA, 14 nt, Homo sapiens
ucugagacagcagu

SEQ ID NO: 452804 - RNA, 17 nt, Homo sapiens
ucugagaucagugccua

SEQ ID NO: 452805 - RNA, 17 nt, Homo sapiens
ucugagaucagugccuc

SEQ ID NO: 452806 - RNA, 13 nt, Homo sapiens
ucugagcaguugu

SEQ ID NO: 452807 - RNA, 23 nt, Homo sapiens
ucugagccaaagagaaugccauu

SEQ ID NO: 452808 - RNA, 20 nt, Homo sapiens
ucugaguaagaaacagaauc

SEQ ID NO: 452809 - RNA, 14 nt, Homo sapiens
ucugauacagccuu

SEQ ID NO: 452810 - RNA, 13 nt, Homo sapiens
ucugauaccucaa

SEQ ID NO: 452811 - RNA, 22 nt, Homo sapiens
ucugauaugcaguuuuccuuaa

SEQ ID NO: 452812 - RNA, 22 nt, Homo sapiens
ucugaucccugaucaagcuuca

SEQ ID NO: 452813 - RNA, 20 nt, Homo sapiens
ucugauugguccaacaguuu

SEQ ID NO: 452814 - RNA, 18 nt, Homo sapiens
ucugcaaauaguuucaaa

SEQ ID NO: 452815 - RNA, 12 nt, Homo sapiens
ucugcaccgacg

SEQ ID NO: 452816 - RNA, 13 nt, Homo sapiens
ucugcacuacucc

SEQ ID NO: 452817 - RNA, 18 nt, Homo sapiens
ucugcagagacuucuagg

SEQ ID NO: 452818 - RNA, 16 nt, Homo sapiens
ucugcagcuaacuuau

SEQ ID NO: 452819 - RNA, 16 nt, Homo sapiens
ucugcagguacuuccu

SEQ ID NO: 452820 - RNA, 16 nt, Homo sapiens
ucugcaguggagccug

SEQ ID NO: 452821 - RNA, 21 nt, Homo sapiens
ucugcauuaucugaggucaca

SEQ ID NO: 452822 - RNA, 13 nt, Homo sapiens
ucugccaagcccu

SEQ ID NO: 452823 - RNA, 13 nt, Homo sapiens
ucugccacccacu

SEQ ID NO: 452824 - RNA, 16 nt, Homo sapiens
ucugccaggccuguau

SEQ ID NO: 452825 - RNA, 20 nt, Homo sapiens
ucugcccagcuugggcccag

SEQ ID NO: 452826 - RNA, 23 nt, Homo sapiens
ucugcccuagcgcucucuuccag

SEQ ID NO: 452827 - RNA, 18 nt, Homo sapiens
ucugccggucccccaugc

SEQ ID NO: 452828 - RNA, 22 nt, Homo sapiens
ucugccgugagagcccaaucac

SEQ ID NO: 452829 - RNA, 14 nt, Homo sapiens
ucugccucacauca

SEQ ID NO: 452830 - RNA, 22 nt, Homo sapiens
ucugccuccaggagggcaucag

SEQ ID NO: 452831 - RNA, 21 nt, Homo sapiens
ucugccucccaggcucaagca

SEQ ID NO: 452832 - RNA, 22 nt, Homo sapiens
ucugccugcaccccugcaguuu

SEQ ID NO: 452833 - RNA, 22 nt, Homo sapiens
ucugccugccucaugcucucua

SEQ ID NO: 452834 - RNA, 12 nt, Homo sapiens
ucugccuuccag

SEQ ID NO: 452835 - RNA, 15 nt, Homo sapiens
ucugccuuuucacug

SEQ ID NO: 452836 - RNA, 21 nt, Homo sapiens
ucugcucaucugauauucaaa

SEQ ID NO: 452837 - RNA, 10 nt, Homo sapiens
ucugcuccac

SEQ ID NO: 452838 - RNA, 13 nt, Homo sapiens
ucugcuccaugca

SEQ ID NO: 452839 - RNA, 18 nt, Homo sapiens
ucugcucccaugcucaua

SEQ ID NO: 452840 - RNA, 18 nt, Homo sapiens
ucugcugcauagcucuau

SEQ ID NO: 452841 - RNA, 16 nt, Homo sapiens
ucugcuguauacugua

SEQ ID NO: 452842 - RNA, 19 nt, Homo sapiens
ucugcuuacaauucccugc

SEQ ID NO: 452843 - RNA, 21 nt, Homo sapiens
ucuggaaggccccucccagca

SEQ ID NO: 452844 - RNA, 21 nt, Homo sapiens
ucuggaagucaucucauucca

SEQ ID NO: 452845 - RNA, 14 nt, Homo sapiens
ucuggaauugcuca

SEQ ID NO: 452846 - RNA, 20 nt, Homo sapiens
ucuggaauuuaagcuauucu

SEQ ID NO: 452847 - RNA, 15 nt, Homo sapiens
ucuggacacugagag

SEQ ID NO: 452848 - RNA, 22 nt, Homo sapiens
ucuggagaaggugggcacugga

SEQ ID NO: 452849 - RNA, 16 nt, Homo sapiens
ucuggagaccaggacu

SEQ ID NO: 452850 - RNA, 23 nt, Homo sapiens
ucuggaggacguggacuggggua

SEQ ID NO: 452851 - RNA, 18 nt, Homo sapiens
ucuggagugugugggggu

SEQ ID NO: 452852 - RNA, 12 nt, Homo sapiens
ucuggccucaga

SEQ ID NO: 452853 - RNA, 20 nt, Homo sapiens
ucuggcuccuguguggaguu

SEQ ID NO: 452854 - RNA, 19 nt, Homo sapiens
ucuggcugccccaaccugc

SEQ ID NO: 452855 - RNA, 21 nt, Homo sapiens
ucuggcuggguuuucaggggc

SEQ ID NO: 452856 - RNA, 17 nt, Homo sapiens
ucugggaaaaagugcac

SEQ ID NO: 452857 - RNA, 19 nt, Homo sapiens
ucugggaaaaagugcacgu

SEQ ID NO: 452858 - RNA, 20 nt, Homo sapiens
ucugggaacucccaagaaca

SEQ ID NO: 452859 - RNA, 14 nt, Homo sapiens
ucugggaagggaga

SEQ ID NO: 452860 - RNA, 21 nt, Homo sapiens
ucuggggccuuuaucaaaaaa

SEQ ID NO: 452861 - RNA, 13 nt, Homo sapiens
ucugggugcagcu

SEQ ID NO: 452862 - RNA, 16 nt, Homo sapiens
ucuggugaucacuuua

SEQ ID NO: 452863 - RNA, 20 nt, Homo sapiens
ucugguuuuaacaauuuccu

SEQ ID NO: 452864 - RNA, 21 nt, Homo sapiens
ucuguaaaugaagggucauuu

SEQ ID NO: 452865 - RNA, 18 nt, Homo sapiens
ucuguaacccuugaauuu

SEQ ID NO: 452866 - RNA, 14 nt, Homo sapiens
ucuguaccuuucua

SEQ ID NO: 452867 - RNA, 16 nt, Homo sapiens
ucuguaucaagccccu

SEQ ID NO: 452868 - RNA, 15 nt, Homo sapiens
ucuguauguguucaa

SEQ ID NO: 452869 - RNA, 12 nt, Homo sapiens
ucugucauucaa

SEQ ID NO: 452870 - RNA, 12 nt, Homo sapiens
ucuguccaggcc

SEQ ID NO: 452871 - RNA, 23 nt, Homo sapiens
ucuguccaucugucuguccuacc

SEQ ID NO: 452872 - RNA, 20 nt, Homo sapiens
ucugucccaguuaacuguua

SEQ ID NO: 452873 - RNA, 21 nt, Homo sapiens
ucuguccccgagccgagcucu

SEQ ID NO: 452874 - RNA, 19 nt, Homo sapiens
ucuguccuaaauaucucaa

SEQ ID NO: 452875 - RNA, 17 nt, Homo sapiens
ucugugaagaaugaagu

SEQ ID NO: 452876 - RNA, 14 nt, Homo sapiens
ucugugauggaugg

SEQ ID NO: 452877 - RNA, 16 nt, Homo sapiens
ucugugcaggugcugc

SEQ ID NO: 452878 - RNA, 19 nt, Homo sapiens
ucugugcagucaucaacaa

SEQ ID NO: 452879 - RNA, 12 nt, Homo sapiens
ucugugcugcac

SEQ ID NO: 452880 - RNA, 18 nt, Homo sapiens
ucuguggagaauguacac

SEQ ID NO: 452881 - RNA, 22 nt, Homo sapiens
ucuguggaguuugacauuguau

SEQ ID NO: 452882 - RNA, 15 nt, Homo sapiens
ucuguguuuacuuaa

SEQ ID NO: 452883 - RNA, 16 nt, Homo sapiens
ucuguguuuacuuaag

SEQ ID NO: 452884 - RNA, 15 nt, Homo sapiens
ucuguuaaaugaacu

SEQ ID NO: 452885 - RNA, 17 nt, Homo sapiens
ucuguuccccauggcca

SEQ ID NO: 452886 - RNA, 20 nt, Homo sapiens
ucuguuuccccucagaacac

SEQ ID NO: 452887 - RNA, 17 nt, Homo sapiens
ucuguuuucugugcacu

SEQ ID NO: 452888 - RNA, 16 nt, Homo sapiens
ucuguuuugccuucac

SEQ ID NO: 452889 - RNA, 12 nt, Homo sapiens
ucuuaaacuaca

SEQ ID NO: 452890 - RNA, 22 nt, Homo sapiens
ucuuaaauuuugugauauggag

SEQ ID NO: 452891 - RNA, 13 nt, Homo sapiens
ucuuaacuauccu

SEQ ID NO: 452892 - RNA, 13 nt, Homo sapiens
ucuuaagcacuuu

SEQ ID NO: 452893 - RNA, 14 nt, Homo sapiens
ucuuaagccaagaa

SEQ ID NO: 452894 - RNA, 16 nt, Homo sapiens
ucuuaauaggcuuuau

SEQ ID NO: 452895 - RNA, 21 nt, Homo sapiens
ucuuacaaccaagaacauuau

SEQ ID NO: 452896 - RNA, 16 nt, Homo sapiens
ucuuacaauugcacug

SEQ ID NO: 452897 - RNA, 18 nt, Homo sapiens
ucuuacagccacaggcac

SEQ ID NO: 452898 - RNA, 17 nt, Homo sapiens
ucuuacaggaagccucu

SEQ ID NO: 452899 - RNA, 14 nt, Homo sapiens
ucuuacaugcauuu

SEQ ID NO: 452900 - RNA, 16 nt, Homo sapiens
ucuuacaugcauuuga

SEQ ID NO: 452901 - RNA, 22 nt, Homo sapiens
ucuuacccccaccacuaagaga

SEQ ID NO: 452902 - RNA, 15 nt, Homo sapiens
ucuuaccgaauaagg

SEQ ID NO: 452903 - RNA, 20 nt, Homo sapiens
ucuuacuaaccaccauuucc

SEQ ID NO: 452904 - RNA, 16 nt, Homo sapiens
ucuuacucuuuguaug

SEQ ID NO: 452905 - RNA, 18 nt, Homo sapiens
ucuuagaaauacuuguga

SEQ ID NO: 452906 - RNA, 13 nt, Homo sapiens
ucuuagacacugu

SEQ ID NO: 452907 - RNA, 11 nt, Homo sapiens
ucuuagacauu

SEQ ID NO: 452908 - RNA, 20 nt, Homo sapiens
ucuuagcugccaaguaaaua

SEQ ID NO: 452909 - RNA, 12 nt, Homo sapiens
ucuuagcuuucu

SEQ ID NO: 452910 - RNA, 16 nt, Homo sapiens
ucuuaguucucacugu

SEQ ID NO: 452911 - RNA, 16 nt, Homo sapiens
ucuuauaaaaucaaua

SEQ ID NO: 452912 - RNA, 19 nt, Homo sapiens
ucuuaugaaaugggcuuua

SEQ ID NO: 452913 - RNA, 17 nt, Homo sapiens
ucuuaugauuacuauca

SEQ ID NO: 452914 - RNA, 22 nt, Homo sapiens
ucuuaugauuacuaucauggca

SEQ ID NO: 452915 - RNA, 14 nt, Homo sapiens
ucuucaacaugguu

SEQ ID NO: 452916 - RNA, 17 nt, Homo sapiens
ucuucacaaaacacuuc

SEQ ID NO: 452917 - RNA, 19 nt, Homo sapiens
ucuucacucugaauccuca

SEQ ID NO: 452918 - RNA, 21 nt, Homo sapiens
ucuucagagagcuaaauuaca

SEQ ID NO: 452919 - RNA, 17 nt, Homo sapiens
ucuucagaggagaaaga

SEQ ID NO: 452920 - RNA, 18 nt, Homo sapiens
ucuucagaggagaaagaa

SEQ ID NO: 452921 - RNA, 18 nt, Homo sapiens
ucuucagccucauucacu

SEQ ID NO: 452922 - RNA, 19 nt, Homo sapiens
ucuucagccucauucacug

SEQ ID NO: 452923 - RNA, 22 nt, Homo sapiens
ucuucaggggucaccuccucca

SEQ ID NO: 452924 - RNA, 18 nt, Homo sapiens
ucuucaugaccuacuuca

SEQ ID NO: 452925 - RNA, 12 nt, Homo sapiens
ucuucaugcaau

SEQ ID NO: 452926 - RNA, 17 nt, Homo sapiens
ucuucauuucauuguau

SEQ ID NO: 452927 - RNA, 13 nt, Homo sapiens
ucuuccaaaaaga

SEQ ID NO: 452928 - RNA, 23 nt, Homo sapiens
ucuuccacuggaaaaguguaaua

SEQ ID NO: 452929 - RNA, 15 nt, Homo sapiens
ucuuccacuuugaua

SEQ ID NO: 452930 - RNA, 19 nt, Homo sapiens
ucuuccagaagaugcccuc

SEQ ID NO: 452931 - RNA, 16 nt, Homo sapiens
ucuuccauaugcucuu

SEQ ID NO: 452932 - RNA, 21 nt, Homo sapiens
ucuuccaucagcucucugcaa

SEQ ID NO: 452933 - RNA, 23 nt, Homo sapiens
ucuuccaucagcucucugcaaag

SEQ ID NO: 452934 - RNA, 16 nt, Homo sapiens
ucuucccacuuugcca

SEQ ID NO: 452935 - RNA, 15 nt, Homo sapiens
ucuucccccaugugc

SEQ ID NO: 452936 - RNA, 14 nt, Homo sapiens
ucuucccuaccuca

SEQ ID NO: 452937 - RNA, 15 nt, Homo sapiens
ucuucccuaccucag

SEQ ID NO: 452938 - RNA, 18 nt, Homo sapiens
ucuucccuaccucaggca

SEQ ID NO: 452939 - RNA, 21 nt, Homo sapiens
ucuuccucaagucuugacaau

SEQ ID NO: 452940 - RNA, 23 nt, Homo sapiens
ucuuccucugcaggacacagauc

SEQ ID NO: 452941 - RNA, 15 nt, Homo sapiens
ucuuccucuguuaca

SEQ ID NO: 452942 - RNA, 20 nt, Homo sapiens
ucuuccugaguggugccaaa

SEQ ID NO: 452943 - RNA, 18 nt, Homo sapiens
ucuucguagguugugaug

SEQ ID NO: 452944 - RNA, 14 nt, Homo sapiens
ucuucucuuucuca

SEQ ID NO: 452945 - RNA, 20 nt, Homo sapiens
ucuucugacacuugugguau

SEQ ID NO: 452946 - RNA, 13 nt, Homo sapiens
ucuucuuacucca

SEQ ID NO: 452947 - RNA, 21 nt, Homo sapiens
ucuucuuuuuuuaaacauuca

SEQ ID NO: 452948 - RNA, 19 nt, Homo sapiens
ucuucuuuuuuugugaugu

SEQ ID NO: 452949 - RNA, 20 nt, Homo sapiens
ucuugacauucaaggcauuu

SEQ ID NO: 452950 - RNA, 15 nt, Homo sapiens
ucuugagagcugcug

SEQ ID NO: 452951 - RNA, 17 nt, Homo sapiens
ucuugagagcugcugag

SEQ ID NO: 452952 - RNA, 17 nt, Homo sapiens
ucuugauucauaaugac

SEQ ID NO: 452953 - RNA, 13 nt, Homo sapiens
ucuugcaccccaa

SEQ ID NO: 452954 - RNA, 19 nt, Homo sapiens
ucuugcaucugggccagaa

SEQ ID NO: 452955 - RNA, 20 nt, Homo sapiens
ucuugccccagugugguuug

SEQ ID NO: 452956 - RNA, 23 nt, Homo sapiens
ucuugccccagugugguuugcau

SEQ ID NO: 452957 - RNA, 19 nt, Homo sapiens
ucuugccccccaccccagc

SEQ ID NO: 452958 - RNA, 13 nt, Homo sapiens
ucuugcucaaaaa

SEQ ID NO: 452959 - RNA, 17 nt, Homo sapiens
ucuugcugcaccugugc

SEQ ID NO: 452960 - RNA, 14 nt, Homo sapiens
ucuuggcacaaucu

SEQ ID NO: 452961 - RNA, 22 nt, Homo sapiens
ucuuggcacaaucucacacagc

SEQ ID NO: 452962 - RNA, 20 nt, Homo sapiens
ucuuggcucacuacaaccuc

SEQ ID NO: 452963 - RNA, 20 nt, Homo sapiens
ucuugggcuacuggcagcuc

SEQ ID NO: 452964 - RNA, 17 nt, Homo sapiens
ucuuggugaacacacau

SEQ ID NO: 452965 - RNA, 12 nt, Homo sapiens
ucuugguguugu

SEQ ID NO: 452966 - RNA, 17 nt, Homo sapiens
ucuuguccaauggggcu

SEQ ID NO: 452967 - RNA, 17 nt, Homo sapiens
ucuugucccuuucccua

SEQ ID NO: 452968 - RNA, 20 nt, Homo sapiens
ucuuguguuggcuguggcag

SEQ ID NO: 452969 - RNA, 19 nt, Homo sapiens
ucuuguguuuuugucuuau

SEQ ID NO: 452970 - RNA, 17 nt, Homo sapiens
ucuuguuccccacugac

SEQ ID NO: 452971 - RNA, 18 nt, Homo sapiens
ucuuguuguuauucagaa

SEQ ID NO: 452972 - RNA, 13 nt, Homo sapiens
ucuuuaaacuaua

SEQ ID NO: 452973 - RNA, 17 nt, Homo sapiens
ucuuuaaagacuugaug

SEQ ID NO: 452974 - RNA, 17 nt, Homo sapiens
ucuuuaaaguuacugau

SEQ ID NO: 452975 - RNA, 16 nt, Homo sapiens
ucuuuaacagcuuucu

SEQ ID NO: 452976 - RNA, 18 nt, Homo sapiens
ucuuuaacauacaucuaa

SEQ ID NO: 452977 - RNA, 16 nt, Homo sapiens
ucuuuaguugauuuaa

SEQ ID NO: 452978 - RNA, 19 nt, Homo sapiens
ucuuuaucagugauggucu

SEQ ID NO: 452979 - RNA, 15 nt, Homo sapiens
ucuuuauuaaccuca

SEQ ID NO: 452980 - RNA, 12 nt, Homo sapiens
ucuuucagagag

SEQ ID NO: 452981 - RNA, 21 nt, Homo sapiens
ucuuucagccaagaauucuua

SEQ ID NO: 452982 - RNA, 16 nt, Homo sapiens
ucuuucaucucugcuu

SEQ ID NO: 452983 - RNA, 19 nt, Homo sapiens
ucuuuccuccuuccaugga

SEQ ID NO: 452984 - RNA, 15 nt, Homo sapiens
ucuuucuacaugacu

SEQ ID NO: 452985 - RNA, 23 nt, Homo sapiens
ucuuucuauauaaaauguauuca

SEQ ID NO: 452986 - RNA, 14 nt, Homo sapiens
ucuuucucucugug

SEQ ID NO: 452987 - RNA, 17 nt, Homo sapiens
ucuuucucugccaguga

SEQ ID NO: 452988 - RNA, 22 nt, Homo sapiens
ucuuucucugccagugacagac

SEQ ID NO: 452989 - RNA, 15 nt, Homo sapiens
ucuuucugccaacuu

SEQ ID NO: 452990 - RNA, 15 nt, Homo sapiens
ucuuucuuugcugcu

SEQ ID NO: 452991 - RNA, 17 nt, Homo sapiens
ucuuugaagagauuuca

SEQ ID NO: 452992 - RNA, 21 nt, Homo sapiens
ucuuugacauuuggugguacu

SEQ ID NO: 452993 - RNA, 18 nt, Homo sapiens
ucuuugcaagaaagucag

SEQ ID NO: 452994 - RNA, 15 nt, Homo sapiens
ucuuugcugcaguca

SEQ ID NO: 452995 - RNA, 16 nt, Homo sapiens
ucuuuggacaaccaug

SEQ ID NO: 452996 - RNA, 21 nt, Homo sapiens
ucuuuggggguuagaccacuu

SEQ ID NO: 452997 - RNA, 21 nt, Homo sapiens
ucuuuggucaugggggccaag

SEQ ID NO: 452998 - RNA, 15 nt, Homo sapiens
ucuuuguacagacaa

SEQ ID NO: 452999 - RNA, 19 nt, Homo sapiens
ucuuuguuuacaugaguuc

SEQ ID NO: 453000 - RNA, 14 nt, Homo sapiens
ucuuuuccccucau

SEQ ID NO: 453001 - RNA, 17 nt, Homo sapiens
ucuuuucgccguggcug

SEQ ID NO: 453002 - RNA, 23 nt, Homo sapiens
ucuuuucugcaucaucuguagau

SEQ ID NO: 453003 - RNA, 21 nt, Homo sapiens
ucuuuucuggaauguaaucaa

SEQ ID NO: 453004 - RNA, 18 nt, Homo sapiens
ucuuuugaaagaacauca

SEQ ID NO: 453005 - RNA, 16 nt, Homo sapiens
ucuuuugagcauuuag

SEQ ID NO: 453006 - RNA, 13 nt, Homo sapiens
ucuuuugccauga

SEQ ID NO: 453007 - RNA, 23 nt, Homo sapiens
ucuuuugccaugacaacuucuaa

SEQ ID NO: 453008 - RNA, 17 nt, Homo sapiens
ucuuuuuuagcucucuu

SEQ ID NO: 453009 - RNA, 16 nt, Homo sapiens
ugaaaaaaaugaucua

SEQ ID NO: 453010 - RNA, 13 nt, Homo sapiens
ugaaaaaauaaca

SEQ ID NO: 453011 - RNA, 19 nt, Homo sapiens
ugaaaaaauaacacuguac

SEQ ID NO: 453012 - RNA, 12 nt, Homo sapiens
ugaaaaacauuc

SEQ ID NO: 453013 - RNA, 19 nt, Homo sapiens
ugaaaaacauuccaggaaa

SEQ ID NO: 453014 - RNA, 13 nt, Homo sapiens
ugaaaaagaacug

SEQ ID NO: 453015 - RNA, 14 nt, Homo sapiens
ugaaaaagaacugu

SEQ ID NO: 453016 - RNA, 22 nt, Homo sapiens
ugaaaaauaguguguccaugca

SEQ ID NO: 453017 - RNA, 15 nt, Homo sapiens
ugaaaacaacauugg

SEQ ID NO: 453018 - RNA, 17 nt, Homo sapiens
ugaaaacaucugcacaa

SEQ ID NO: 453019 - RNA, 17 nt, Homo sapiens
ugaaaaccaucuggccu

SEQ ID NO: 453020 - RNA, 23 nt, Homo sapiens
ugaaaacuuagagagguacaagu

SEQ ID NO: 453021 - RNA, 16 nt, Homo sapiens
ugaaaagacaaauggg

SEQ ID NO: 453022 - RNA, 17 nt, Homo sapiens
ugaaaagcuacccugaa

SEQ ID NO: 453023 - RNA, 17 nt, Homo sapiens
ugaaaaggaaguuaaua

SEQ ID NO: 453024 - RNA, 12 nt, Homo sapiens
ugaaaaggaauu

SEQ ID NO: 453025 - RNA, 18 nt, Homo sapiens
ugaaaaggguguugcuaa

SEQ ID NO: 453026 - RNA, 17 nt, Homo sapiens
ugaaaaucaacccaaua

SEQ ID NO: 453027 - RNA, 14 nt, Homo sapiens
ugaaaaugaaucuu

SEQ ID NO: 453028 - RNA, 19 nt, Homo sapiens
ugaaaaugagcaucagaga

SEQ ID NO: 453029 - RNA, 21 nt, Homo sapiens
ugaaaaugucagaaaccaguu

SEQ ID NO: 453030 - RNA, 17 nt, Homo sapiens
ugaaaauuacaacagau

SEQ ID NO: 453031 - RNA, 16 nt, Homo sapiens
ugaaacacacaggcca

SEQ ID NO: 453032 - RNA, 14 nt, Homo sapiens
ugaaacacaccagg

SEQ ID NO: 453033 - RNA, 15 nt, Homo sapiens
ugaaacacagucaug

SEQ ID NO: 453034 - RNA, 18 nt, Homo sapiens
ugaaacagaauacuguua

SEQ ID NO: 453035 - RNA, 17 nt, Homo sapiens
ugaaacagccaugucca

SEQ ID NO: 453036 - RNA, 18 nt, Homo sapiens
ugaaacaguguggaugua

SEQ ID NO: 453037 - RNA, 13 nt, Homo sapiens
ugaaacauuugcc

SEQ ID NO: 453038 - RNA, 20 nt, Homo sapiens
ugaaaccccaucucuacuaa

SEQ ID NO: 453039 - RNA, 15 nt, Homo sapiens
ugaaagaacaucagu

SEQ ID NO: 453040 - RNA, 14 nt, Homo sapiens
ugaaagacaaagaa

SEQ ID NO: 453041 - RNA, 16 nt, Homo sapiens
ugaaagagaguaccau

SEQ ID NO: 453042 - RNA, 17 nt, Homo sapiens
ugaaagaggcauuccca

SEQ ID NO: 453043 - RNA, 23 nt, Homo sapiens
ugaaaggaaagaggcucuggcua

SEQ ID NO: 453044 - RNA, 17 nt, Homo sapiens
ugaaagggaguauuaca

SEQ ID NO: 453045 - RNA, 19 nt, Homo sapiens
gccuccugguaacagcuau

SEQ ID NO: 453046 - RNA, 16 nt, Homo sapiens
gccuccuuauuuauca

SEQ ID NO: 453047 - RNA, 20 nt, Homo sapiens
gccucgggacaucaaaaaca

SEQ ID NO: 453048 - RNA, 19 nt, Homo sapiens
gccucuagaacagccagac

SEQ ID NO: 453049 - RNA, 19 nt, Homo sapiens
gccucucugguugccaaau

SEQ ID NO: 453050 - RNA, 21 nt, Homo sapiens
gccucugccccgucucaugag

SEQ ID NO: 453051 - RNA, 18 nt, Homo sapiens
gccucugugccauggaug

SEQ ID NO: 453052 - RNA, 22 nt, Homo sapiens
gccucuuccucccucccugcag

SEQ ID NO: 453053 - RNA, 17 nt, Homo sapiens
gccucuuguacaguuaa

SEQ ID NO: 453054 - RNA, 18 nt, Homo sapiens
gccugaaagcaacuacag

SEQ ID NO: 453055 - RNA, 13 nt, Homo sapiens
gccugacaaccac

SEQ ID NO: 453056 - RNA, 22 nt, Homo sapiens
gccugagacagcugucuuguga

SEQ ID NO: 453057 - RNA, 15 nt, Homo sapiens
gccugccaggcuccu

SEQ ID NO: 453058 - RNA, 23 nt, Homo sapiens
gccugccccaaacaaauaugcaa

SEQ ID NO: 453059 - RNA, 18 nt, Homo sapiens
gccugccccccucaucuc

SEQ ID NO: 453060 - RNA, 18 nt, Homo sapiens
gccugcccgcugcaaugc

SEQ ID NO: 453061 - RNA, 23 nt, Homo sapiens
gccugccggccgcccagacacca

SEQ ID NO: 453062 - RNA, 21 nt, Homo sapiens
gccuggaaagcccuucggaga

SEQ ID NO: 453063 - RNA, 15 nt, Homo sapiens
gccuggacuuuccug

SEQ ID NO: 453064 - RNA, 16 nt, Homo sapiens
gccuggacuuuccugc

SEQ ID NO: 453065 - RNA, 21 nt, Homo sapiens
gccuggcagaacugagcuccu

SEQ ID NO: 453066 - RNA, 20 nt, Homo sapiens
gccuggcagccgugccuuca

SEQ ID NO: 453067 - RNA, 15 nt, Homo sapiens
gccugggacccagcu

SEQ ID NO: 453068 - RNA, 15 nt, Homo sapiens
gccugggaucagugg

SEQ ID NO: 453069 - RNA, 21 nt, Homo sapiens
gccugggcucccuugugcgug

SEQ ID NO: 453070 - RNA, 20 nt, Homo sapiens
gccuggggauguaaccaagc

SEQ ID NO: 453071 - RNA, 20 nt, Homo sapiens
gccuggugacaggcagacac

SEQ ID NO: 453072 - RNA, 19 nt, Homo sapiens
gccuguaaucccagcacuu

SEQ ID NO: 453073 - RNA, 21 nt, Homo sapiens
gccuguaaucccagcacuuug

SEQ ID NO: 453074 - RNA, 14 nt, Homo sapiens
gccugucuggagcu

SEQ ID NO: 453075 - RNA, 19 nt, Homo sapiens
gccugugaucguguguugc

SEQ ID NO: 453076 - RNA, 19 nt, Homo sapiens
gccugugcguucccuucag

SEQ ID NO: 453077 - RNA, 15 nt, Homo sapiens
gccugugguuaacau

SEQ ID NO: 453078 - RNA, 20 nt, Homo sapiens
gccugugguuaacaucucag

SEQ ID NO: 453079 - RNA, 12 nt, Homo sapiens
gccuuaacaaac

SEQ ID NO: 453080 - RNA, 12 nt, Homo sapiens
gccuuaauacuu

SEQ ID NO: 453081 - RNA, 18 nt, Homo sapiens
gccuuaauucuuaccuca

SEQ ID NO: 453082 - RNA, 14 nt, Homo sapiens
gccuuccucugcag

SEQ ID NO: 453083 - RNA, 12 nt, Homo sapiens
gccuucucacca

SEQ ID NO: 453084 - RNA, 20 nt, Homo sapiens
gccuucuccccuccaaguga

SEQ ID NO: 453085 - RNA, 15 nt, Homo sapiens
gccuucugcccuccc

SEQ ID NO: 453086 - RNA, 18 nt, Homo sapiens
gccuugacaaguacauca

SEQ ID NO: 453087 - RNA, 12 nt, Homo sapiens
gccuugaccucc

SEQ ID NO: 453088 - RNA, 13 nt, Homo sapiens
gccuuggaccaaa

SEQ ID NO: 453089 - RNA, 22 nt, Homo sapiens
gccuugggagagaugccuucca

SEQ ID NO: 453090 - RNA, 13 nt, Homo sapiens
gccuugugaucac

SEQ ID NO: 453091 - RNA, 22 nt, Homo sapiens
gccuugugcgguuguguucuca

SEQ ID NO: 453092 - RNA, 23 nt, Homo sapiens
gccuuuaaauuguuccucuuugu

SEQ ID NO: 453093 - RNA, 21 nt, Homo sapiens
gccuuucuaguccuauucuau

SEQ ID NO: 453094 - RNA, 22 nt, Homo sapiens
gccuuucugccucacaucagcc

SEQ ID NO: 453095 - RNA, 20 nt, Homo sapiens
gccuuugaauaaaaaugcac

SEQ ID NO: 453096 - RNA, 16 nt, Homo sapiens
gccuuugauguggaug

SEQ ID NO: 453097 - RNA, 17 nt, Homo sapiens
gccuuugggauuugccg

SEQ ID NO: 453098 - RNA, 14 nt, Homo sapiens
gccuuuguugcuca

SEQ ID NO: 453099 - RNA, 15 nt, Homo sapiens
gccuuuguugcucag

SEQ ID NO: 453100 - RNA, 12 nt, Homo sapiens
gccuuuugcccg

SEQ ID NO: 453101 - RNA, 13 nt, Homo sapiens
gcgaacugugcag

SEQ ID NO: 453102 - RNA, 20 nt, Homo sapiens
gcgaaugauuuaaauagaac

SEQ ID NO: 453103 - RNA, 17 nt, Homo sapiens
gcgacuccaucucaaaa

SEQ ID NO: 453104 - RNA, 13 nt, Homo sapiens
gcgagacugagag

SEQ ID NO: 453105 - RNA, 23 nt, Homo sapiens
gcgagcugcucugcuauaugccu

SEQ ID NO: 453106 - RNA, 16 nt, Homo sapiens
gcgcagagcugacccc

SEQ ID NO: 453107 - RNA, 21 nt, Homo sapiens
gcgccugccaucaugccugac

SEQ ID NO: 453108 - RNA, 15 nt, Homo sapiens
gcgcuauccacagaa

SEQ ID NO: 453109 - RNA, 20 nt, Homo sapiens
gcgcugcucuuaugccauuu

SEQ ID NO: 453110 - RNA, 15 nt, Homo sapiens
gcggaaccauagcug

SEQ ID NO: 453111 - RNA, 19 nt, Homo sapiens
gcggaaggucccucagaca

SEQ ID NO: 453112 - RNA, 14 nt, Homo sapiens
gcggagcugcaugg

SEQ ID NO: 453113 - RNA, 15 nt, Homo sapiens
gcggccgccuguccu

SEQ ID NO: 453114 - RNA, 13 nt, Homo sapiens
gcggccugcugga

SEQ ID NO: 453115 - RNA, 22 nt, Homo sapiens
gcgguggcucacgccuguaauc

SEQ ID NO: 453116 - RNA, 18 nt, Homo sapiens
gcggugggcagccaugag

SEQ ID NO: 453117 - RNA, 13 nt, Homo sapiens
gcguagggccagg

SEQ ID NO: 453118 - RNA, 16 nt, Homo sapiens
gcguaguccgcuuucu

SEQ ID NO: 453119 - RNA, 18 nt, Homo sapiens
gcgucccagucucuggca

SEQ ID NO: 453120 - RNA, 19 nt, Homo sapiens
gcgucugccccacccucaa

SEQ ID NO: 453121 - RNA, 10 nt, Homo sapiens
gcgugcugcg

SEQ ID NO: 453122 - RNA, 20 nt, Homo sapiens
gcguguguccaugugugugc

SEQ ID NO: 453123 - RNA, 23 nt, Homo sapiens
gcguguguccaugugugugcaag

SEQ ID NO: 453124 - RNA, 13 nt, Homo sapiens
gcgugugugcaag

SEQ ID NO: 453125 - RNA, 20 nt, Homo sapiens
gcguuaaagucaggauuuau

SEQ ID NO: 453126 - RNA, 23 nt, Homo sapiens
gcguuacacccuuucuugacaaa

SEQ ID NO: 453127 - RNA, 15 nt, Homo sapiens
gcguuguuacaggaa

SEQ ID NO: 453128 - RNA, 13 nt, Homo sapiens
gcuaaaacugcuc

SEQ ID NO: 453129 - RNA, 19 nt, Homo sapiens
gcuaaaagcaucccuguga

SEQ ID NO: 453130 - RNA, 22 nt, Homo sapiens
gcuaaaaugaaaaauagugugu

SEQ ID NO: 453131 - RNA, 21 nt, Homo sapiens
gcuaaagaggaagugcacugg

SEQ ID NO: 453132 - RNA, 12 nt, Homo sapiens
gcuaaagggaaa

SEQ ID NO: 453133 - RNA, 20 nt, Homo sapiens
gcuaacuauauuugcuuuuu

SEQ ID NO: 453134 - RNA, 20 nt, Homo sapiens
gcuaacugagagaaguacua

SEQ ID NO: 453135 - RNA, 21 nt, Homo sapiens
gcuaagauagaggggcucugg

SEQ ID NO: 453136 - RNA, 15 nt, Homo sapiens
gcuaagccugaugau

SEQ ID NO: 453137 - RNA, 22 nt, Homo sapiens
gcuaaugaauuuuaaaagcaua

SEQ ID NO: 453138 - RNA, 20 nt, Homo sapiens
gcuaauuaggaagcuugauu

SEQ ID NO: 453139 - RNA, 13 nt, Homo sapiens
gcuaauucauacc

SEQ ID NO: 453140 - RNA, 21 nt, Homo sapiens
gcuaauugcuggcuggcugcc

SEQ ID NO: 453141 - RNA, 23 nt, Homo sapiens
gcuacacguuggaguauaccuau

SEQ ID NO: 453142 - RNA, 17 nt, Homo sapiens
gcuacauuccucagcug

SEQ ID NO: 453143 - RNA, 13 nt, Homo sapiens
gcuaccaucucau

SEQ ID NO: 453144 - RNA, 13 nt, Homo sapiens
gcuaccugugagc

SEQ ID NO: 453145 - RNA, 15 nt, Homo sapiens
gcuacucucuugcca

SEQ ID NO: 453146 - RNA, 21 nt, Homo sapiens
gcuacucucuugccagcauuu

SEQ ID NO: 453147 - RNA, 22 nt, Homo sapiens
gcuacucucuugccagcauuuu

SEQ ID NO: 453148 - RNA, 14 nt, Homo sapiens
gcuacuggcagcuc

SEQ ID NO: 453149 - RNA, 18 nt, Homo sapiens
gcuagaggacuucuggca

SEQ ID NO: 453150 - RNA, 18 nt, Homo sapiens
gcuagaugugucuuacca

SEQ ID NO: 453151 - RNA, 18 nt, Homo sapiens
gcuagccagcuguguuca

SEQ ID NO: 453152 - RNA, 22 nt, Homo sapiens
gcuaggcgcuggggagacugau

SEQ ID NO: 453153 - RNA, 13 nt, Homo sapiens
gcuaguacuguau

SEQ ID NO: 453154 - RNA, 21 nt, Homo sapiens
gcuaguccggacccaccucac

SEQ ID NO: 453155 - RNA, 18 nt, Homo sapiens
gcuagucugucagggccu

SEQ ID NO: 453156 - RNA, 13 nt, Homo sapiens
ugauugaaguauc

SEQ ID NO: 453157 - RNA, 16 nt, Homo sapiens
ugauugccauuucuuc

SEQ ID NO: 453158 - RNA, 19 nt, Homo sapiens
ugauuggacauuuucuuca

SEQ ID NO: 453159 - RNA, 15 nt, Homo sapiens
ugauuguaacauauu

SEQ ID NO: 453160 - RNA, 12 nt, Homo sapiens
ugauugugaaac

SEQ ID NO: 453161 - RNA, 16 nt, Homo sapiens
ugauuguucauaucaa

SEQ ID NO: 453162 - RNA, 21 nt, Homo sapiens
ugauuguuuaauuguagguca

SEQ ID NO: 453163 - RNA, 22 nt, Homo sapiens
ugauuuagggaagcagggacac

SEQ ID NO: 453164 - RNA, 17 nt, Homo sapiens
ugauuucuuccugcaga

SEQ ID NO: 453165 - RNA, 12 nt, Homo sapiens
ugauuucuugcu

SEQ ID NO: 453166 - RNA, 16 nt, Homo sapiens
ugauuuuaucugugaa

SEQ ID NO: 453167 - RNA, 21 nt, Homo sapiens
ugauuuucucuggcagcauaa

SEQ ID NO: 453168 - RNA, 18 nt, Homo sapiens
ugauuuugaccaaugccu

SEQ ID NO: 453169 - RNA, 23 nt, Homo sapiens
ugauuuuuugcugcagacucauc

SEQ ID NO: 453170 - RNA, 20 nt, Homo sapiens
ugcaaaaccggcaaccugua

SEQ ID NO: 453171 - RNA, 17 nt, Homo sapiens
ugcaaacaguucuugga

SEQ ID NO: 453172 - RNA, 20 nt, Homo sapiens
ugcaaagacugaguguucaa

SEQ ID NO: 453173 - RNA, 20 nt, Homo sapiens
ugcaaaguucccuacuuccu

SEQ ID NO: 453174 - RNA, 21 nt, Homo sapiens
guaacccgcucaucacuggau

SEQ ID NO: 453175 - RNA, 17 nt, Homo sapiens
guaaccugugguguauu

SEQ ID NO: 453176 - RNA, 23 nt, Homo sapiens
guaacugcacacaugguuuccaa

SEQ ID NO: 453177 - RNA, 15 nt, Homo sapiens
guaacugucaaguca

SEQ ID NO: 453178 - RNA, 11 nt, Homo sapiens
guaacuguccu

SEQ ID NO: 453179 - RNA, 12 nt, Homo sapiens
guaagaaaguga

SEQ ID NO: 453180 - RNA, 18 nt, Homo sapiens
guaagaaagugaagcaaa

SEQ ID NO: 453181 - RNA, 16 nt, Homo sapiens
guaagacuaaaucugu

SEQ ID NO: 453182 - RNA, 21 nt, Homo sapiens
guaagagaauguugaauacuu

SEQ ID NO: 453183 - RNA, 16 nt, Homo sapiens
guaagagucuguguua

SEQ ID NO: 453184 - RNA, 15 nt, Homo sapiens
guaagccaagucaug

SEQ ID NO: 453185 - RNA, 21 nt, Homo sapiens
guaagcucuuugaaacaacuu

SEQ ID NO: 453186 - RNA, 16 nt, Homo sapiens
guaaggaggagaaaau

SEQ ID NO: 453187 - RNA, 13 nt, Homo sapiens
guaaggugcaguu

SEQ ID NO: 453188 - RNA, 21 nt, Homo sapiens
guaaguggaggaaauguugga

SEQ ID NO: 453189 - RNA, 18 nt, Homo sapiens
guaauaaacgucuugcca

SEQ ID NO: 453190 - RNA, 21 nt, Homo sapiens
guaauaccuuaguuuuuucca

SEQ ID NO: 453191 - RNA, 19 nt, Homo sapiens
guaauaggaagaacaguac

SEQ ID NO: 453192 - RNA, 14 nt, Homo sapiens
guaauauuacuuua

SEQ ID NO: 453193 - RNA, 14 nt, Homo sapiens
ccuuuuuaauguca

SEQ ID NO: 453194 - RNA, 21 nt, Homo sapiens
cgaaaaaaaaauguucauucu

SEQ ID NO: 453195 - RNA, 16 nt, Homo sapiens
cgaagccuuaagccau

SEQ ID NO: 453196 - RNA, 15 nt, Homo sapiens
cgaagggaucagccc

SEQ ID NO: 453197 - RNA, 20 nt, Homo sapiens
cgacaagugcugaacagugg

SEQ ID NO: 453198 - RNA, 14 nt, Homo sapiens
cgacuggcugugag

SEQ ID NO: 453199 - RNA, 13 nt, Homo sapiens
cgacugggcucaa

SEQ ID NO: 453200 - RNA, 17 nt, Homo sapiens
cgagaccaaccuagcca

SEQ ID NO: 453201 - RNA, 22 nt, Homo sapiens
cgagagaggcgcgucugcccca

SEQ ID NO: 453202 - RNA, 15 nt, Homo sapiens
cgagagagucuucca

SEQ ID NO: 453203 - RNA, 18 nt, Homo sapiens
cgagagcucuuaguuuuu

SEQ ID NO: 453204 - RNA, 22 nt, Homo sapiens
cgagcauaagaaauaaaaucua

SEQ ID NO: 453205 - RNA, 13 nt, Homo sapiens
cgagcaugagcug

SEQ ID NO: 453206 - RNA, 18 nt, Homo sapiens
cgagcgcuaccucuccag

SEQ ID NO: 453207 - RNA, 22 nt, Homo sapiens
cgagcuaguuaaacagugccau

SEQ ID NO: 453208 - RNA, 21 nt, Homo sapiens
cgagcugugcaacgugggcaa

SEQ ID NO: 453209 - RNA, 23 nt, Homo sapiens
cgaggaaaagaacaaacaaaacu

SEQ ID NO: 453210 - RNA, 15 nt, Homo sapiens
cgaggcgaugccacg

SEQ ID NO: 453211 - RNA, 16 nt, Homo sapiens
cgagggauguggagca

SEQ ID NO: 453212 - RNA, 14 nt, Homo sapiens
cgagucaagugauu

SEQ ID NO: 453213 - RNA, 14 nt, Homo sapiens
cgagucucuucucc

SEQ ID NO: 453214 - RNA, 14 nt, Homo sapiens
cgagugugugcaug

SEQ ID NO: 453215 - RNA, 14 nt, Homo sapiens
cgauauacagauga

SEQ ID NO: 453216 - RNA, 14 nt, Homo sapiens
cgaucgacugccaa

SEQ ID NO: 453217 - RNA, 20 nt, Homo sapiens
cgaucucagcucacugcaag

SEQ ID NO: 453218 - RNA, 18 nt, Homo sapiens
cgaucuuagauugccacu

SEQ ID NO: 453219 - RNA, 23 nt, Homo sapiens
cgaugugcaaguguaugcacgug

SEQ ID NO: 453220 - RNA, 18 nt, Homo sapiens
cgauuaaaaucacucuca

SEQ ID NO: 453221 - RNA, 21 nt, Homo sapiens
cgcaaccaccaccaaccacug

SEQ ID NO: 453222 - RNA, 18 nt, Homo sapiens
cgcaaggccugugcugca

SEQ ID NO: 453223 - RNA, 17 nt, Homo sapiens
cgcacacccucacucug

SEQ ID NO: 453224 - RNA, 16 nt, Homo sapiens
cgcaccacuguguauu

SEQ ID NO: 453225 - RNA, 14 nt, Homo sapiens
cgcaccauugcacu

SEQ ID NO: 453226 - RNA, 15 nt, Homo sapiens
cgcagagcugacccc

SEQ ID NO: 453227 - RNA, 15 nt, Homo sapiens
cgcagcccgggagau

SEQ ID NO: 453228 - RNA, 15 nt, Homo sapiens
cgcaucucagugcag

SEQ ID NO: 453229 - RNA, 21 nt, Homo sapiens
cgccauccgucaccagaauua

SEQ ID NO: 453230 - RNA, 12 nt, Homo sapiens
cgccauccucau

SEQ ID NO: 453231 - RNA, 23 nt, Homo sapiens
cgccauuccaagucaacacucuu

SEQ ID NO: 453232 - RNA, 21 nt, Homo sapiens
cgcccacguggcagaccguga

SEQ ID NO: 453233 - RNA, 15 nt, Homo sapiens
cgccgcugacugcca

SEQ ID NO: 453234 - RNA, 13 nt, Homo sapiens
cgccucugagcca

SEQ ID NO: 453235 - RNA, 13 nt, Homo sapiens
cgccuucccucac

SEQ ID NO: 453236 - RNA, 20 nt, Homo sapiens
cgcgcaccuguaaucccagc

SEQ ID NO: 453237 - RNA, 12 nt, Homo sapiens
cgcuauuacaaa

SEQ ID NO: 453238 - RNA, 12 nt, Homo sapiens
cgcucaccugca

SEQ ID NO: 453239 - RNA, 19 nt, Homo sapiens
cgcucuucccccaugugcc

SEQ ID NO: 453240 - RNA, 22 nt, Homo sapiens
cgcucuuggcagguacucagcg

SEQ ID NO: 453241 - RNA, 13 nt, Homo sapiens
cgcugacucuggg

SEQ ID NO: 453242 - RNA, 17 nt, Homo sapiens
cgcugagggcaggguuc

SEQ ID NO: 453243 - RNA, 16 nt, Homo sapiens
cgcugccaggggcugc

SEQ ID NO: 453244 - RNA, 14 nt, Homo sapiens
cgcugcccacacca

SEQ ID NO: 453245 - RNA, 16 nt, Homo sapiens
cgcugccugcucugcg

SEQ ID NO: 453246 - RNA, 20 nt, Homo sapiens
cgcugcugugcucuggggau

SEQ ID NO: 453247 - RNA, 17 nt, Homo sapiens
cgcuggccucuuccucc

SEQ ID NO: 453248 - RNA, 18 nt, Homo sapiens
cgcuggcugggggccuca

SEQ ID NO: 453249 - RNA, 19 nt, Homo sapiens
cgcugggagaaaagccaga

SEQ ID NO: 453250 - RNA, 19 nt, Homo sapiens
cgcuucugccuuuucacug

SEQ ID NO: 453251 - RNA, 20 nt, Homo sapiens
cgcuucugccuuuucacugu

SEQ ID NO: 453252 - RNA, 13 nt, Homo sapiens
cgcuugcuuuagc

SEQ ID NO: 453253 - RNA, 22 nt, Homo sapiens
cgcuuggcuccaugcuccucac

SEQ ID NO: 453254 - RNA, 16 nt, Homo sapiens
cgcuuucuuucugcau

SEQ ID NO: 453255 - RNA, 17 nt, Homo sapiens
cggaacugcaugcugcu

SEQ ID NO: 453256 - RNA, 18 nt, Homo sapiens
cggaaggucccucagaca

SEQ ID NO: 453257 - RNA, 17 nt, Homo sapiens
cggaagugaccacagaa

SEQ ID NO: 453258 - RNA, 15 nt, Homo sapiens
cggaaguggccugag

SEQ ID NO: 453259 - RNA, 14 nt, Homo sapiens
cggacaaguuuuaa

SEQ ID NO: 453260 - RNA, 15 nt, Homo sapiens
cggaccugcuuugag

SEQ ID NO: 453261 - RNA, 15 nt, Homo sapiens
cggaggccacaugag

SEQ ID NO: 453262 - RNA, 14 nt, Homo sapiens
cggaggcugcagug

SEQ ID NO: 453263 - RNA, 15 nt, Homo sapiens
cggaucuagccaugg

SEQ ID NO: 453264 - RNA, 18 nt, Homo sapiens
cggcacccugauccucac

SEQ ID NO: 453265 - RNA, 17 nt, Homo sapiens
cggcaugugaauucugu

SEQ ID NO: 453266 - RNA, 13 nt, Homo sapiens
cggccgacugccu

SEQ ID NO: 453267 - RNA, 14 nt, Homo sapiens
cggccgacugccug

SEQ ID NO: 453268 - RNA, 20 nt, Homo sapiens
cggccggagaacaucugccu

SEQ ID NO: 453269 - RNA, 17 nt, Homo sapiens
cggccuugugacauuca

SEQ ID NO: 453270 - RNA, 18 nt, Homo sapiens
cggcugcggggggcacca

SEQ ID NO: 453271 - RNA, 14 nt, Homo sapiens
cggcugugcuccug

SEQ ID NO: 453272 - RNA, 23 nt, Homo sapiens
cggcuuggcuagucacauaucaa

SEQ ID NO: 453273 - RNA, 21 nt, Homo sapiens
cgggaagcaagaugugaaaga

SEQ ID NO: 453274 - RNA, 16 nt, Homo sapiens
cgggagaccugugcua

SEQ ID NO: 453275 - RNA, 13 nt, Homo sapiens
cgggagcacagcu

SEQ ID NO: 453276 - RNA, 15 nt, Homo sapiens
cgggagcagugucuu

SEQ ID NO: 453277 - RNA, 20 nt, Homo sapiens
cgggcuuggggcuggccaau

SEQ ID NO: 453278 - RNA, 15 nt, Homo sapiens
cggggcuccacugaa

SEQ ID NO: 453279 - RNA, 20 nt, Homo sapiens
cggggcuugcaacuuagcuc

SEQ ID NO: 453280 - RNA, 23 nt, Homo sapiens
cgggucacccugugacccucuca

SEQ ID NO: 453281 - RNA, 19 nt, Homo sapiens
cggucaauccuguggguga

SEQ ID NO: 453282 - RNA, 14 nt, Homo sapiens
cggucaugaugucu

SEQ ID NO: 453283 - RNA, 21 nt, Homo sapiens
cgguggugcaugccuguaauc

SEQ ID NO: 453284 - RNA, 20 nt, Homo sapiens
cguagaugcugccuaggguu

SEQ ID NO: 453285 - RNA, 14 nt, Homo sapiens
cguaguaacacaua

SEQ ID NO: 453286 - RNA, 19 nt, Homo sapiens
cguauaauuuagucccuua

SEQ ID NO: 453287 - RNA, 20 nt, Homo sapiens
cguaugguggcucaugucua

SEQ ID NO: 453288 - RNA, 16 nt, Homo sapiens
cgucagaccaguacug

SEQ ID NO: 453289 - RNA, 18 nt, Homo sapiens
cgucccacugagucucau

SEQ ID NO: 453290 - RNA, 13 nt, Homo sapiens
cgucccuaccucc

SEQ ID NO: 453291 - RNA, 14 nt, Homo sapiens
cguccuccaccggu

SEQ ID NO: 453292 - RNA, 16 nt, Homo sapiens
cguccugcagugugag

SEQ ID NO: 453293 - RNA, 19 nt, Homo sapiens
cguccuuagaauacuguau

SEQ ID NO: 453294 - RNA, 22 nt, Homo sapiens
cgucuuagcaagaaguaaaaug

SEQ ID NO: 453295 - RNA, 9 nt, Homo sapiens
cgucuuccc

SEQ ID NO: 453296 - RNA, 12 nt, Homo sapiens
cgugaaacacac

SEQ ID NO: 453297 - RNA, 13 nt, Homo sapiens
cgugacccagugg

SEQ ID NO: 453298 - RNA, 18 nt, Homo sapiens
cgugagagaaucugccug

SEQ ID NO: 453299 - RNA, 22 nt, Homo sapiens
cgugagccucagccaccccuca

SEQ ID NO: 453300 - RNA, 12 nt, Homo sapiens
cgugccauuguc

SEQ ID NO: 453301 - RNA, 16 nt, Homo sapiens
cguggauugcacgugg

SEQ ID NO: 453302 - RNA, 18 nt, Homo sapiens
cguggccccgugaacuca

SEQ ID NO: 453303 - RNA, 20 nt, Homo sapiens
cgugggaacucgaacuugaa

SEQ ID NO: 453304 - RNA, 18 nt, Homo sapiens
cgugggcaaacaggcagu

SEQ ID NO: 453305 - RNA, 21 nt, Homo sapiens
cguguagacccuaacccggag

SEQ ID NO: 453306 - RNA, 23 nt, Homo sapiens
cguguccaggagaccuuccacaa

SEQ ID NO: 453307 - RNA, 14 nt, Homo sapiens
cgugugcgugcaug

SEQ ID NO: 453308 - RNA, 19 nt, Homo sapiens
cgugugcgugcaugugcac

SEQ ID NO: 453309 - RNA, 13 nt, Homo sapiens
cgugugugcaagu

SEQ ID NO: 453310 - RNA, 17 nt, Homo sapiens
cgugugugcaagugucu

SEQ ID NO: 453311 - RNA, 11 nt, Homo sapiens
cguuaccagag

SEQ ID NO: 453312 - RNA, 12 nt, Homo sapiens
cguuaccagaga

SEQ ID NO: 453313 - RNA, 15 nt, Homo sapiens
cguucuugccagcuu

SEQ ID NO: 453314 - RNA, 15 nt, Homo sapiens
cguugacaugcacag

SEQ ID NO: 453315 - RNA, 13 nt, Homo sapiens
cguugaggaugag

SEQ ID NO: 453316 - RNA, 15 nt, Homo sapiens
cguuggcucaguccu

SEQ ID NO: 453317 - RNA, 16 nt, Homo sapiens
cguuuggccaaaaaga

SEQ ID NO: 453318 - RNA, 14 nt, Homo sapiens
cuaaaaaaauacaa

SEQ ID NO: 453319 - RNA, 17 nt, Homo sapiens
cuaaaaggaaaucucac

SEQ ID NO: 453320 - RNA, 16 nt, Homo sapiens
cuaaaagugaugugau

SEQ ID NO: 453321 - RNA, 18 nt, Homo sapiens
cuaaaauacucaccaaaa

SEQ ID NO: 453322 - RNA, 13 nt, Homo sapiens
cuaaaauauuauu

SEQ ID NO: 453323 - RNA, 22 nt, Homo sapiens
cuaaaaugauuuuaucugugaa

SEQ ID NO: 453324 - RNA, 15 nt, Homo sapiens
cuaaaauuagaugaa

SEQ ID NO: 453325 - RNA, 19 nt, Homo sapiens
cuaaaauuagaugaacuca

SEQ ID NO: 453326 - RNA, 13 nt, Homo sapiens
guaauauucucug

SEQ ID NO: 453327 - RNA, 20 nt, Homo sapiens
guaauguuuuauacuguuua

SEQ ID NO: 453328 - RNA, 17 nt, Homo sapiens
guaauuccucugauucu

SEQ ID NO: 453329 - RNA, 13 nt, Homo sapiens
guaauugucucaa

SEQ ID NO: 453330 - RNA, 14 nt, Homo sapiens
guaauuguuacaau

SEQ ID NO: 453331 - RNA, 13 nt, Homo sapiens
guacaaagacagg

SEQ ID NO: 453332 - RNA, 16 nt, Homo sapiens
guacaauuuucauccc

SEQ ID NO: 453333 - RNA, 18 nt, Homo sapiens
guacacacccuccagcac

SEQ ID NO: 453334 - RNA, 21 nt, Homo sapiens
guacagccuuuuauggaccaa

SEQ ID NO: 453335 - RNA, 17 nt, Homo sapiens
guacagugucugugcca

SEQ ID NO: 453336 - RNA, 22 nt, Homo sapiens
guacaguugaugucgaugcuca

SEQ ID NO: 453337 - RNA, 15 nt, Homo sapiens
guacaucugcaauau

SEQ ID NO: 453338 - RNA, 20 nt, Homo sapiens
guacauuccugauacugggu

SEQ ID NO: 453339 - RNA, 19 nt, Homo sapiens
guaccaagaucacaaauag

SEQ ID NO: 453340 - RNA, 22 nt, Homo sapiens
guacccaccugagcuuuggacg

SEQ ID NO: 453341 - RNA, 19 nt, Homo sapiens
guaccucucucugcuccuc

SEQ ID NO: 453342 - RNA, 18 nt, Homo sapiens
guaccugccauaacauaa

SEQ ID NO: 453343 - RNA, 20 nt, Homo sapiens
guacgaucuuucuggcaaau

SEQ ID NO: 453344 - RNA, 15 nt, Homo sapiens
guacuacauuugcau

SEQ ID NO: 453345 - RNA, 10 nt, Homo sapiens
guacuacucu

SEQ ID NO: 453346 - RNA, 17 nt, Homo sapiens
guacuacucuccagcuu

SEQ ID NO: 453347 - RNA, 13 nt, Homo sapiens
guacuagaauuca

SEQ ID NO: 453348 - RNA, 14 nt, Homo sapiens
guacuaguacuauu

SEQ ID NO: 453349 - RNA, 16 nt, Homo sapiens
guacuauuacuaguac

SEQ ID NO: 453350 - RNA, 14 nt, Homo sapiens
guacuauuacuauu

SEQ ID NO: 453351 - RNA, 16 nt, Homo sapiens
guacuauuacuauuac

SEQ ID NO: 453352 - RNA, 17 nt, Homo sapiens
guacucacuuuucacuu

SEQ ID NO: 453353 - RNA, 20 nt, Homo sapiens
guacuccagccugggugaca

SEQ ID NO: 453354 - RNA, 23 nt, Homo sapiens
guacugaguucucauccacagag

SEQ ID NO: 453355 - RNA, 19 nt, Homo sapiens
guacuggagaaaauggacg

SEQ ID NO: 453356 - RNA, 23 nt, Homo sapiens
guacuugcucaauaaaggucaua

SEQ ID NO: 453357 - RNA, 16 nt, Homo sapiens
guagaaacucuacaua

SEQ ID NO: 453358 - RNA, 19 nt, Homo sapiens
guagaagccugcagcggca

SEQ ID NO: 453359 - RNA, 13 nt, Homo sapiens
guagaaguggcau

SEQ ID NO: 453360 - RNA, 23 nt, Homo sapiens
guagacaugcacacccauucaca

SEQ ID NO: 453361 - RNA, 21 nt, Homo sapiens
guagaccuagggaggaccuua

SEQ ID NO: 453362 - RNA, 18 nt, Homo sapiens
guagagaggggacugggg

SEQ ID NO: 453363 - RNA, 22 nt, Homo sapiens
guagagcaaaggagacaaagca

SEQ ID NO: 453364 - RNA, 14 nt, Homo sapiens
guagaggcauuugu

SEQ ID NO: 453365 - RNA, 20 nt, Homo sapiens
guagaucaacucauguuaau

SEQ ID NO: 453366 - RNA, 22 nt, Homo sapiens
guagauguauuuucaauaaaga

SEQ ID NO: 453367 - RNA, 18 nt, Homo sapiens
guagcagagucauuguua

SEQ ID NO: 453368 - RNA, 16 nt, Homo sapiens
guagcagguuucacua

SEQ ID NO: 453369 - RNA, 18 nt, Homo sapiens
guagcauuucuugauguu

SEQ ID NO: 453370 - RNA, 13 nt, Homo sapiens
guagcugaugaaa

SEQ ID NO: 453371 - RNA, 15 nt, Homo sapiens
guagcuuuuacuuuu

SEQ ID NO: 453372 - RNA, 18 nt, Homo sapiens
guaggaaucugccuucca

SEQ ID NO: 453373 - RNA, 19 nt, Homo sapiens
guaggaaucugccuuccag

SEQ ID NO: 453374 - RNA, 13 nt, Homo sapiens
guaggacauacca

SEQ ID NO: 453375 - RNA, 15 nt, Homo sapiens
guaggagacacagau

SEQ ID NO: 453376 - RNA, 14 nt, Homo sapiens
guagggaguaccug

SEQ ID NO: 453377 - RNA, 15 nt, Homo sapiens
guagggugaggcgug

SEQ ID NO: 453378 - RNA, 21 nt, Homo sapiens
guagguagugauuaacuguga

SEQ ID NO: 453379 - RNA, 13 nt, Homo sapiens
guaguacuugaaa

SEQ ID NO: 453380 - RNA, 16 nt, Homo sapiens
guagucauuuugccca

SEQ ID NO: 453381 - RNA, 20 nt, Homo sapiens
guagucccagcuacuuggga

SEQ ID NO: 453382 - RNA, 12 nt, Homo sapiens
guagugaccuaa

SEQ ID NO: 453383 - RNA, 18 nt, Homo sapiens
guagugauuaacugugaa

SEQ ID NO: 453384 - RNA, 21 nt, Homo sapiens
guagugauuaacugugaauaa

SEQ ID NO: 453385 - RNA, 22 nt, Homo sapiens
guaguuaggaaauaaaaccuuu

SEQ ID NO: 453386 - RNA, 15 nt, Homo sapiens
guauaaaaccuaaaa

SEQ ID NO: 453387 - RNA, 23 nt, Homo sapiens
guauaaaaugguguuuucaugua

SEQ ID NO: 453388 - RNA, 22 nt, Homo sapiens
guauaacaagccaaacauucuu

SEQ ID NO: 453389 - RNA, 10 nt, Homo sapiens
guauaaucuc

SEQ ID NO: 453390 - RNA, 19 nt, Homo sapiens
guauacugugugggauacu

SEQ ID NO: 453391 - RNA, 16 nt, Homo sapiens
guauauaaaguuacac

SEQ ID NO: 453392 - RNA, 10 nt, Homo sapiens
guauaugcac

SEQ ID NO: 453393 - RNA, 23 nt, Homo sapiens
guaucaaguggcaugugcuguga

SEQ ID NO: 453394 - RNA, 15 nt, Homo sapiens
guauccaauuaugug

SEQ ID NO: 453395 - RNA, 18 nt, Homo sapiens
guauccaauuaugugaca

SEQ ID NO: 453396 - RNA, 12 nt, Homo sapiens
guauccaugcau

SEQ ID NO: 453397 - RNA, 20 nt, Homo sapiens
guaucccaccuccagcccac

SEQ ID NO: 453398 - RNA, 15 nt, Homo sapiens
guauccucgcuggug

SEQ ID NO: 453399 - RNA, 16 nt, Homo sapiens
guauccugcccagugu

SEQ ID NO: 453400 - RNA, 22 nt, Homo sapiens
guauccuuguugacacggccau

SEQ ID NO: 453401 - RNA, 20 nt, Homo sapiens
guaucuaccucacuauucaa

SEQ ID NO: 453402 - RNA, 21 nt, Homo sapiens
guaucucgaagucuuccauca

SEQ ID NO: 453403 - RNA, 22 nt, Homo sapiens
guaucugcauguaaaaucuuca

SEQ ID NO: 453404 - RNA, 12 nt, Homo sapiens
guaugauugaca

SEQ ID NO: 453405 - RNA, 18 nt, Homo sapiens
guauguagacaugcacac

SEQ ID NO: 453406 - RNA, 18 nt, Homo sapiens
guaugucuuuaucaaagg

SEQ ID NO: 453407 - RNA, 10 nt, Homo sapiens
guaugugcac

SEQ ID NO: 453408 - RNA, 18 nt, Homo sapiens
guaugugcgugugugcaa

SEQ ID NO: 453409 - RNA, 14 nt, Homo sapiens
guauguguguauau

SEQ ID NO: 453410 - RNA, 16 nt, Homo sapiens
guauguuaugaacaug

SEQ ID NO: 453411 - RNA, 13 nt, Homo sapiens
guauuaacuauua

SEQ ID NO: 453412 - RNA, 14 nt, Homo sapiens
guauuaacuauuag

SEQ ID NO: 453413 - RNA, 17 nt, Homo sapiens
guauuaagugugcuuau

SEQ ID NO: 453414 - RNA, 15 nt, Homo sapiens
guauuagccagucau

SEQ ID NO: 453415 - RNA, 21 nt, Homo sapiens
guauuauauuuuggccuuaca

SEQ ID NO: 453416 - RNA, 15 nt, Homo sapiens
guauucaagcaaaca

SEQ ID NO: 453417 - RNA, 18 nt, Homo sapiens
guauucccaagaguggug

SEQ ID NO: 453418 - RNA, 13 nt, Homo sapiens
guauucucagagc

SEQ ID NO: 453419 - RNA, 16 nt, Homo sapiens
guauucucucuaugca

SEQ ID NO: 453420 - RNA, 19 nt, Homo sapiens
guauucugcaacagccugu

SEQ ID NO: 453421 - RNA, 21 nt, Homo sapiens
guauucuuuacuaaagauauc

SEQ ID NO: 453422 - RNA, 22 nt, Homo sapiens
guauugaaggaauuagaaauga

SEQ ID NO: 453423 - RNA, 18 nt, Homo sapiens
guauugauaaacuuugaa

SEQ ID NO: 453424 - RNA, 13 nt, Homo sapiens
guauugauaucac

SEQ ID NO: 453425 - RNA, 17 nt, Homo sapiens
guauuuaggcagauuga

SEQ ID NO: 453426 - RNA, 19 nt, Homo sapiens
guauuuccagugcaauugu

SEQ ID NO: 453427 - RNA, 21 nt, Homo sapiens
guauuuuaggcagggauuuga

SEQ ID NO: 453428 - RNA, 18 nt, Homo sapiens
guauuuucaguuugcccu

SEQ ID NO: 453429 - RNA, 11 nt, Homo sapiens
guauuuugcca

SEQ ID NO: 453430 - RNA, 23 nt, Homo sapiens
gucaaaaaccagaauuaggucaa

SEQ ID NO: 453431 - RNA, 10 nt, Homo sapiens
gucaaaaagu

SEQ ID NO: 453432 - RNA, 11 nt, Homo sapiens
gucaaacugua

SEQ ID NO: 453433 - RNA, 13 nt, Homo sapiens
gucaaauaucuca

SEQ ID NO: 453434 - RNA, 22 nt, Homo sapiens
gucaaauaucucagaggcuaua

SEQ ID NO: 453435 - RNA, 13 nt, Homo sapiens
gucaaaugucauu

SEQ ID NO: 453436 - RNA, 14 nt, Homo sapiens
gucugcugcuccca

SEQ ID NO: 453437 - RNA, 14 nt, Homo sapiens
gucuguaguguuuu

SEQ ID NO: 453438 - RNA, 21 nt, Homo sapiens
gucugucaugaacauguuccu

SEQ ID NO: 453439 - RNA, 14 nt, Homo sapiens
gucugucccaaaga

SEQ ID NO: 453440 - RNA, 16 nt, Homo sapiens
gucuguccuuucccac

SEQ ID NO: 453441 - RNA, 15 nt, Homo sapiens
gucugucuacugugg

SEQ ID NO: 453442 - RNA, 12 nt, Homo sapiens
gucugucuucaa

SEQ ID NO: 453443 - RNA, 16 nt, Homo sapiens
gucugugugcaagugu

SEQ ID NO: 453444 - RNA, 21 nt, Homo sapiens
gucuguuucaaugaccuguau

SEQ ID NO: 453445 - RNA, 21 nt, Homo sapiens
gucuuaaucguccugcugcug

SEQ ID NO: 453446 - RNA, 23 nt, Homo sapiens
gucuuacaggaagccucucauag

SEQ ID NO: 453447 - RNA, 22 nt, Homo sapiens
gucuucacauuuagaauuugaa

SEQ ID NO: 453448 - RNA, 13 nt, Homo sapiens
gucuucacuugca

SEQ ID NO: 453449 - RNA, 20 nt, Homo sapiens
gucuucagggggccaggugc

SEQ ID NO: 453450 - RNA, 17 nt, Homo sapiens
gucuucauccuuagcaa

SEQ ID NO: 453451 - RNA, 23 nt, Homo sapiens
gucuuccacaaaaaauacuuuau

SEQ ID NO: 453452 - RNA, 19 nt, Homo sapiens
gucuucuaauuucaaaaau

SEQ ID NO: 453453 - RNA, 16 nt, Homo sapiens
gucuucuuuugauaua

SEQ ID NO: 453454 - RNA, 22 nt, Homo sapiens
gucuugaagugaucauuucaca

SEQ ID NO: 453455 - RNA, 21 nt, Homo sapiens
gucuugaccugaacucugcaa

SEQ ID NO: 453456 - RNA, 11 nt, Homo sapiens
gucuugaucuc

SEQ ID NO: 453457 - RNA, 22 nt, Homo sapiens
gucuuggcucacugcaacuucu

SEQ ID NO: 453458 - RNA, 16 nt, Homo sapiens
gucuugugacuagugc

SEQ ID NO: 453459 - RNA, 15 nt, Homo sapiens
gucuuuaacugucaa

SEQ ID NO: 453460 - RNA, 17 nt, Homo sapiens
gucuuucgcacauucuc

SEQ ID NO: 453461 - RNA, 14 nt, Homo sapiens
gucuuugaacccuu

SEQ ID NO: 453462 - RNA, 20 nt, Homo sapiens
gucuuugaacguacccaagg

SEQ ID NO: 453463 - RNA, 23 nt, Homo sapiens
cuaguugccguggcaacugugga

SEQ ID NO: 453464 - RNA, 21 nt, Homo sapiens
cuaguuuauuggaaguguuca

SEQ ID NO: 453465 - RNA, 14 nt, Homo sapiens
cuaguuucccugaa

SEQ ID NO: 453466 - RNA, 20 nt, Homo sapiens
cuaguuuugucaaacuguag

SEQ ID NO: 453467 - RNA, 21 nt, Homo sapiens
cuauaaaaugagggacuuccc

SEQ ID NO: 453468 - RNA, 23 nt, Homo sapiens
cuauaacaugucuuucagcauua

SEQ ID NO: 453469 - RNA, 21 nt, Homo sapiens
cuauaacuuuugguaucuacu

SEQ ID NO: 453470 - RNA, 17 nt, Homo sapiens
cuauaagcccacuguua

SEQ ID NO: 453471 - RNA, 19 nt, Homo sapiens
cuauaaucccagcacuuug

SEQ ID NO: 453472 - RNA, 21 nt, Homo sapiens
cuauaauucuauacuguugau

SEQ ID NO: 453473 - RNA, 11 nt, Homo sapiens
cuauacauucc

SEQ ID NO: 453474 - RNA, 12 nt, Homo sapiens
cuauacauuccu

SEQ ID NO: 453475 - RNA, 18 nt, Homo sapiens
cuauagaauaaagccucu

SEQ ID NO: 453476 - RNA, 19 nt, Homo sapiens
cuauagccauuugccccaa

SEQ ID NO: 453477 - RNA, 17 nt, Homo sapiens
cuauaggaacauaugaa

SEQ ID NO: 453478 - RNA, 18 nt, Homo sapiens
cuauauaaauaaagcaaa

SEQ ID NO: 453479 - RNA, 15 nt, Homo sapiens
cuauauguugcugaa

SEQ ID NO: 453480 - RNA, 14 nt, Homo sapiens
cuauauugcacugu

SEQ ID NO: 453481 - RNA, 12 nt, Homo sapiens
cuauauuugcuu

SEQ ID NO: 453482 - RNA, 22 nt, Homo sapiens
cuauauuuuacaaagcauguga

SEQ ID NO: 453483 - RNA, 14 nt, Homo sapiens
cuaucaaagcacau

SEQ ID NO: 453484 - RNA, 20 nt, Homo sapiens
cuaucaacaccacuaggaau

SEQ ID NO: 453485 - RNA, 21 nt, Homo sapiens
cuauccacagaaccuuuguca

SEQ ID NO: 453486 - RNA, 19 nt, Homo sapiens
cuauccagccgcaaaucca

SEQ ID NO: 453487 - RNA, 19 nt, Homo sapiens
cuauccugcaauuucuccc

SEQ ID NO: 453488 - RNA, 13 nt, Homo sapiens
cuaucuguuaaag

SEQ ID NO: 453489 - RNA, 15 nt, Homo sapiens
cuaucuuaggaguaa

SEQ ID NO: 453490 - RNA, 17 nt, Homo sapiens
cuaugaauuuucaagua

SEQ ID NO: 453491 - RNA, 23 nt, Homo sapiens
cuaugacaauaaauuuuaucuca

SEQ ID NO: 453492 - RNA, 19 nt, Homo sapiens
cuaugagauggccaugcuc

SEQ ID NO: 453493 - RNA, 18 nt, Homo sapiens
cuaugccuguauuuccaa

SEQ ID NO: 453494 - RNA, 22 nt, Homo sapiens
cuaugcugggguacacagugag

SEQ ID NO: 453495 - RNA, 16 nt, Homo sapiens
cuaugggacugcagug

SEQ ID NO: 453496 - RNA, 23 nt, Homo sapiens
cuauggucagguuauacuccucc

SEQ ID NO: 453497 - RNA, 23 nt, Homo sapiens
cuaugucgucguuuucaccagca

SEQ ID NO: 453498 - RNA, 14 nt, Homo sapiens
cuauguuuauuuac

SEQ ID NO: 453499 - RNA, 18 nt, Homo sapiens
cuauuaacucugcauaga

SEQ ID NO: 453500 - RNA, 23 nt, Homo sapiens
cuauuaacuuuaauucucuuuca

SEQ ID NO: 453501 - RNA, 18 nt, Homo sapiens
cuauuaagauacuuagau

SEQ ID NO: 453502 - RNA, 20 nt, Homo sapiens
cuauuaaucaccucucugua

SEQ ID NO: 453503 - RNA, 16 nt, Homo sapiens
cuauuacaccaaauaa

SEQ ID NO: 453504 - RNA, 19 nt, Homo sapiens
cuauuacugaugugugcaa

SEQ ID NO: 453505 - RNA, 18 nt, Homo sapiens
cuauuagagaaacaaaca

SEQ ID NO: 453506 - RNA, 19 nt, Homo sapiens
cuauucaaguauuaggggu

SEQ ID NO: 453507 - RNA, 15 nt, Homo sapiens
cuauucuacuuuaaa

SEQ ID NO: 453508 - RNA, 18 nt, Homo sapiens
cuauucucaaaguuuccu

SEQ ID NO: 453509 - RNA, 18 nt, Homo sapiens
cuauucuuaagcacuuug

SEQ ID NO: 453510 - RNA, 19 nt, Homo sapiens
cuauucuuaagcacuuuga

SEQ ID NO: 453511 - RNA, 20 nt, Homo sapiens
cuauucuuaagcacuuugaa

SEQ ID NO: 453512 - RNA, 21 nt, Homo sapiens
cuauucuuaagcacuuugaaa

SEQ ID NO: 453513 - RNA, 21 nt, Homo sapiens
cuauugcagauauuugaugua

SEQ ID NO: 453514 - RNA, 17 nt, Homo sapiens
cuauugccugagagcac

SEQ ID NO: 453515 - RNA, 15 nt, Homo sapiens
cuauugcuaguacua

SEQ ID NO: 453516 - RNA, 18 nt, Homo sapiens
cuauugcuaguacuagua

SEQ ID NO: 453517 - RNA, 15 nt, Homo sapiens
cuauuguuacucugg

SEQ ID NO: 453518 - RNA, 22 nt, Homo sapiens
cuauuguuucuccucugaagca

SEQ ID NO: 453519 - RNA, 15 nt, Homo sapiens
cuauuuaacuugagg

SEQ ID NO: 453520 - RNA, 17 nt, Homo sapiens
cuauuuaacuugagggu

SEQ ID NO: 453521 - RNA, 21 nt, Homo sapiens
cuauuuagaaauggauuuauc

SEQ ID NO: 453522 - RNA, 18 nt, Homo sapiens
cuauuuauucccuguuaa

SEQ ID NO: 453523 - RNA, 21 nt, Homo sapiens
cuauuucuggcacuugcaagu

SEQ ID NO: 453524 - RNA, 14 nt, Homo sapiens
cuauuuuacuuugu

SEQ ID NO: 453525 - RNA, 24 nt, Homo sapiens
cucaaaaaaaaaaaaaugcacaua

SEQ ID NO: 453526 - RNA, 17 nt, Homo sapiens
cucaaaaggagaacugu

SEQ ID NO: 453527 - RNA, 18 nt, Homo sapiens
cucaaaccgagagacuca

SEQ ID NO: 453528 - RNA, 19 nt, Homo sapiens
cucaaaccuccaaaagccc

SEQ ID NO: 453529 - RNA, 20 nt, Homo sapiens
cucaaacuccugaccucagg

SEQ ID NO: 453530 - RNA, 22 nt, Homo sapiens
cucaaacuucuggcuucaugca

SEQ ID NO: 453531 - RNA, 15 nt, Homo sapiens
cucaaagaucugaau

SEQ ID NO: 453532 - RNA, 14 nt, Homo sapiens
cucaaaucuauuca

SEQ ID NO: 453533 - RNA, 23 nt, Homo sapiens
cucaaaucuauucagacaagcaa

SEQ ID NO: 453534 - RNA, 14 nt, Homo sapiens
cucaaaugcaguau

SEQ ID NO: 453535 - RNA, 11 nt, Homo sapiens
cucaaccaaau

SEQ ID NO: 453536 - RNA, 19 nt, Homo sapiens
cucaacgagagcacuugaa

SEQ ID NO: 453537 - RNA, 16 nt, Homo sapiens
cucaacuuacauaugu

SEQ ID NO: 453538 - RNA, 23 nt, Homo sapiens
cucaagcagucuacccaccucag

SEQ ID NO: 453539 - RNA, 19 nt, Homo sapiens
cucaaggacuuugcagccg

SEQ ID NO: 453540 - RNA, 20 nt, Homo sapiens
cucaaggcugcagugagcca

SEQ ID NO: 453541 - RNA, 22 nt, Homo sapiens
cucaauaaaggucauauuggaa

SEQ ID NO: 453542 - RNA, 13 nt, Homo sapiens
cucaauacuugaa

SEQ ID NO: 453543 - RNA, 14 nt, Homo sapiens
cucaaucuagaaca

SEQ ID NO: 453544 - RNA, 18 nt, Homo sapiens
cucaaugaaaccuuccuc

SEQ ID NO: 453545 - RNA, 15 nt, Homo sapiens
cucaaugccaguaac

SEQ ID NO: 453546 - RNA, 18 nt, Homo sapiens
cucaaugcuuuucuagca

SEQ ID NO: 453547 - RNA, 19 nt, Homo sapiens
cucaauggagguuugcaaa

SEQ ID NO: 453548 - RNA, 18 nt, Homo sapiens
cucacaacucucugguuc

SEQ ID NO: 453549 - RNA, 19 nt, Homo sapiens
cucacacgggguauuuuag

SEQ ID NO: 453550 - RNA, 20 nt, Homo sapiens
cucacagagacccaccuuca

SEQ ID NO: 453551 - RNA, 14 nt, Homo sapiens
cucacagagugcau

SEQ ID NO: 453552 - RNA, 19 nt, Homo sapiens
cucacagagugcauuguga

SEQ ID NO: 453553 - RNA, 20 nt, Homo sapiens
cucacaguacaauguuucag

SEQ ID NO: 453554 - RNA, 17 nt, Homo sapiens
cucacaucucccuucca

SEQ ID NO: 453555 - RNA, 13 nt, Homo sapiens
cucacaugcacag

SEQ ID NO: 453556 - RNA, 13 nt, Homo sapiens
cucacauucccuc

SEQ ID NO: 453557 - RNA, 17 nt, Homo sapiens
cucaccaacuacagaaa

SEQ ID NO: 453558 - RNA, 22 nt, Homo sapiens
cucacccauugucucauugcca

SEQ ID NO: 453559 - RNA, 20 nt, Homo sapiens
cucaccuagaccuugccucc

SEQ ID NO: 453560 - RNA, 21 nt, Homo sapiens
cucaccuguaagaugaagaua

SEQ ID NO: 453561 - RNA, 17 nt, Homo sapiens
cucaccuugcucugcca

SEQ ID NO: 453562 - RNA, 19 nt, Homo sapiens
cucacgcccuaagcgcaca

SEQ ID NO: 453563 - RNA, 15 nt, Homo sapiens
cucacucuuaugaaa

SEQ ID NO: 453564 - RNA, 12 nt, Homo sapiens
cucacuggagau

SEQ ID NO: 453565 - RNA, 19 nt, Homo sapiens
cuguaucacagacuggcaa

SEQ ID NO: 453566 - RNA, 14 nt, Homo sapiens
cuguauggcacuua

SEQ ID NO: 453567 - RNA, 18 nt, Homo sapiens
cuguauuaacugaauucu

SEQ ID NO: 453568 - RNA, 15 nt, Homo sapiens
cugucaaagcuguca

SEQ ID NO: 453569 - RNA, 16 nt, Homo sapiens
cugucaauuacaggaa

SEQ ID NO: 453570 - RNA, 14 nt, Homo sapiens
cugucaccacaucu

SEQ ID NO: 453571 - RNA, 19 nt, Homo sapiens
cugucaccacaucuugucu

SEQ ID NO: 453572 - RNA, 18 nt, Homo sapiens
cugucaccggccuuguga

SEQ ID NO: 453573 - RNA, 21 nt, Homo sapiens
cugucaccggccuugugacau

SEQ ID NO: 453574 - RNA, 13 nt, Homo sapiens
cugucacuacugg

SEQ ID NO: 453575 - RNA, 17 nt, Homo sapiens
cugucacucagcugaga

SEQ ID NO: 453576 - RNA, 14 nt, Homo sapiens
cugucagaccuucu

SEQ ID NO: 453577 - RNA, 22 nt, Homo sapiens
cugucaguaggggcaugguaua

SEQ ID NO: 453578 - RNA, 17 nt, Homo sapiens
cugucagucguguugcu

SEQ ID NO: 453579 - RNA, 19 nt, Homo sapiens
cuguccaccugugcugcug

SEQ ID NO: 453580 - RNA, 12 nt, Homo sapiens
cugucccaaaga

SEQ ID NO: 453581 - RNA, 12 nt, Homo sapiens
cuguccuaagca

SEQ ID NO: 453582 - RNA, 14 nt, Homo sapiens
cuguccuaagcacu

SEQ ID NO: 453583 - RNA, 16 nt, Homo sapiens
cuguccucauucuucu

SEQ ID NO: 453584 - RNA, 14 nt, Homo sapiens
cuguccucuuucag

SEQ ID NO: 453585 - RNA, 21 nt, Homo sapiens
cuguccuggcuuuuauuuaaa

SEQ ID NO: 453586 - RNA, 22 nt, Homo sapiens
cugucgcaugagaacauuaaca

SEQ ID NO: 453587 - RNA, 20 nt, Homo sapiens
cugucgucccccuccagugc

SEQ ID NO: 453588 - RNA, 15 nt, Homo sapiens
cugucgucuuagcaa

SEQ ID NO: 453589 - RNA, 20 nt, Homo sapiens
cugucucaaaccuccaaaag

SEQ ID NO: 453590 - RNA, 14 nt, Homo sapiens
cugucucagccucc

SEQ ID NO: 453591 - RNA, 19 nt, Homo sapiens
cugucucuuuccacuuugu

SEQ ID NO: 453592 - RNA, 13 nt, Homo sapiens
cugucugguuguu

SEQ ID NO: 453593 - RNA, 23 nt, Homo sapiens
cugucuuagagugggaccaacuu

SEQ ID NO: 453594 - RNA, 19 nt, Homo sapiens
cugucuucauccuuagcaa

SEQ ID NO: 453595 - RNA, 23 nt, Homo sapiens
cugugaaaauuacacccaugcac

SEQ ID NO: 453596 - RNA, 22 nt, Homo sapiens
cugugaaaucauaaaguccuuu

SEQ ID NO: 453597 - RNA, 21 nt, Homo sapiens
cugugaaaugcuggcauuugc

SEQ ID NO: 453598 - RNA, 14 nt, Homo sapiens
cugugaacauuugu

SEQ ID NO: 453599 - RNA, 20 nt, Homo sapiens
cugugacccucucacuuugg

SEQ ID NO: 453600 - RNA, 13 nt, Homo sapiens
cugugacuccucc

SEQ ID NO: 453601 - RNA, 13 nt, Homo sapiens
cugugaguguaag

SEQ ID NO: 453602 - RNA, 13 nt, Homo sapiens
cugugcacauucu

SEQ ID NO: 453603 - RNA, 15 nt, Homo sapiens
cugugcacauucucc

SEQ ID NO: 453604 - RNA, 16 nt, Homo sapiens
cugugcacauucuccc

SEQ ID NO: 453605 - RNA, 13 nt, Homo sapiens
cugugcacuguag

SEQ ID NO: 453606 - RNA, 14 nt, Homo sapiens
cugugcagucauca

SEQ ID NO: 453607 - RNA, 17 nt, Homo sapiens
cugugccaggacuguga

SEQ ID NO: 453608 - RNA, 18 nt, Homo sapiens
cugugccuccccccagac

SEQ ID NO: 453609 - RNA, 15 nt, Homo sapiens
cugugcuaguuuuac

SEQ ID NO: 453610 - RNA, 17 nt, Homo sapiens
cugugcuccuguggaua

SEQ ID NO: 453611 - RNA, 23 nt, Homo sapiens
cugugcucugaaugggagccaga

SEQ ID NO: 453612 - RNA, 14 nt, Homo sapiens
cugugcugcaugcg

SEQ ID NO: 453613 - RNA, 15 nt, Homo sapiens
cugugcuugcuccua

SEQ ID NO: 453614 - RNA, 11 nt, Homo sapiens
uacaaacuauu

SEQ ID NO: 453615 - RNA, 13 nt, Homo sapiens
uacaaacugaaga

SEQ ID NO: 453616 - RNA, 14 nt, Homo sapiens
uacaaacugcaaua

SEQ ID NO: 453617 - RNA, 15 nt, Homo sapiens
uacaaagacagggaa

SEQ ID NO: 453618 - RNA, 15 nt, Homo sapiens
uacaaauacuaucuc

SEQ ID NO: 453619 - RNA, 20 nt, Homo sapiens
uacaacaaacacugugaugu

SEQ ID NO: 453620 - RNA, 17 nt, Homo sapiens
uacaacuucauugcuac

SEQ ID NO: 453621 - RNA, 19 nt, Homo sapiens
uacaaguuaagguaucugg

SEQ ID NO: 453622 - RNA, 17 nt, Homo sapiens
uacaaguugugcaugca

SEQ ID NO: 453623 - RNA, 14 nt, Homo sapiens
uacaauaaacaugu

SEQ ID NO: 453624 - RNA, 19 nt, Homo sapiens
uacaaucagccacauucua

SEQ ID NO: 453625 - RNA, 17 nt, Homo sapiens
uacaaucugcacuuuaa

SEQ ID NO: 453626 - RNA, 16 nt, Homo sapiens
uacaaugugcacugaa

SEQ ID NO: 453627 - RNA, 17 nt, Homo sapiens
uacaauucagagaauag

SEQ ID NO: 453628 - RNA, 16 nt, Homo sapiens
uacaauucagucuucu

SEQ ID NO: 453629 - RNA, 17 nt, Homo sapiens
uacaauugcacugcugu

SEQ ID NO: 453630 - RNA, 12 nt, Homo sapiens
uacaauugugag

SEQ ID NO: 453631 - RNA, 17 nt, Homo sapiens
uacacaaggaaggcauu

SEQ ID NO: 453632 - RNA, 21 nt, Homo sapiens
uacacacgugugauguauguu

SEQ ID NO: 453633 - RNA, 16 nt, Homo sapiens
uacacagaugaaggug

SEQ ID NO: 453634 - RNA, 23 nt, Homo sapiens
uacacccaauuuuaaaaaauaac

SEQ ID NO: 453635 - RNA, 19 nt, Homo sapiens
uacacccaguucugaauaa

SEQ ID NO: 453636 - RNA, 19 nt, Homo sapiens
uacaccuguugcaccucag

SEQ ID NO: 453637 - RNA, 19 nt, Homo sapiens
uacacuacaaauguuaaag

SEQ ID NO: 453638 - RNA, 21 nt, Homo sapiens
uacacuccagcgguugccuuu

SEQ ID NO: 453639 - RNA, 16 nt, Homo sapiens
uacacugaaucauuaa

SEQ ID NO: 453640 - RNA, 20 nt, Homo sapiens
uacagagauuacuuugcugc

SEQ ID NO: 453641 - RNA, 15 nt, Homo sapiens
uacagagcuaauugu

SEQ ID NO: 453642 - RNA, 21 nt, Homo sapiens
uacagaggauucugucuucca

SEQ ID NO: 453643 - RNA, 14 nt, Homo sapiens
uacagaggucucug

SEQ ID NO: 453644 - RNA, 19 nt, Homo sapiens
uacagaguuuaugauuuaa

SEQ ID NO: 453645 - RNA, 22 nt, Homo sapiens
uacagauccgcaugugucugua

SEQ ID NO: 453646 - RNA, 19 nt, Homo sapiens
uacagauuuuagacaagga

SEQ ID NO: 453647 - RNA, 17 nt, Homo sapiens
uacagcagugucaucag

SEQ ID NO: 453648 - RNA, 12 nt, Homo sapiens
uacagccuucac

SEQ ID NO: 453649 - RNA, 17 nt, Homo sapiens
uacaggaagcaccccau

SEQ ID NO: 453650 - RNA, 23 nt, Homo sapiens
uacaggggggucggaagccuguc

SEQ ID NO: 453651 - RNA, 21 nt, Homo sapiens
uacaguguaucucgaagucuu

SEQ ID NO: 453652 - RNA, 16 nt, Homo sapiens
uacaguuaacucuccc

SEQ ID NO: 453653 - RNA, 21 nt, Homo sapiens
uacaguuaauuaugugcauau

SEQ ID NO: 453654 - RNA, 15 nt, Homo sapiens
uacaguuacuuccuu

SEQ ID NO: 453655 - RNA, 15 nt, Homo sapiens
uacaguucugucaua

SEQ ID NO: 453656 - RNA, 22 nt, Homo sapiens
uacauaauuaaauuuuaaugua

SEQ ID NO: 453657 - RNA, 15 nt, Homo sapiens
uacauacagugauau

SEQ ID NO: 453658 - RNA, 16 nt, Homo sapiens
uacauauacacaaaga

SEQ ID NO: 453659 - RNA, 14 nt, Homo sapiens
uacauaugcuuuaa

SEQ ID NO: 453660 - RNA, 20 nt, Homo sapiens
uacauauggaaauccuguua

SEQ ID NO: 453661 - RNA, 18 nt, Homo sapiens
uacaucgaggcucuugcu

SEQ ID NO: 453662 - RNA, 22 nt, Homo sapiens
uacaucgaggcucuugcucaag

SEQ ID NO: 453663 - RNA, 15 nt, Homo sapiens
uacaucugcaauaug

SEQ ID NO: 453664 - RNA, 23 nt, Homo sapiens
uacaucugcaauaugaauucaag

SEQ ID NO: 453665 - RNA, 14 nt, Homo sapiens
uacaucugucaugg

SEQ ID NO: 453666 - RNA, 21 nt, Homo sapiens
uacaucuguguucuaugcaaa

SEQ ID NO: 453667 - RNA, 14 nt, Homo sapiens
uacaugcaauuuau

SEQ ID NO: 453668 - RNA, 18 nt, Homo sapiens
uacaugcagcccaugccc

SEQ ID NO: 453669 - RNA, 13 nt, Homo sapiens
uacaugcauuuga

SEQ ID NO: 453670 - RNA, 19 nt, Homo sapiens
uacaugcugugcucuuuga

SEQ ID NO: 453671 - RNA, 17 nt, Homo sapiens
uacaugguuuaaaguca

SEQ ID NO: 453672 - RNA, 11 nt, Homo sapiens
uacaugugauu

SEQ ID NO: 453673 - RNA, 21 nt, Homo sapiens
uacauguggaaaacucacaga

SEQ ID NO: 453674 - RNA, 16 nt, Homo sapiens
uacauguuaacugagg

SEQ ID NO: 453675 - RNA, 15 nt, Homo sapiens
uacauuaauuaccuu

SEQ ID NO: 453676 - RNA, 23 nt, Homo sapiens
uacauuccugagauucugggaaa

SEQ ID NO: 453677 - RNA, 22 nt, Homo sapiens
uacauucugcaagcacaucugc

SEQ ID NO: 453678 - RNA, 21 nt, Homo sapiens
uacauugggcacauaucuccu

SEQ ID NO: 453679 - RNA, 16 nt, Homo sapiens
uacauuguaaucugcu

SEQ ID NO: 453680 - RNA, 15 nt, Homo sapiens
uacauuucuguucau

SEQ ID NO: 453681 - RNA, 20 nt, Homo sapiens
uaccaaaugccuuucuagca

SEQ ID NO: 453682 - RNA, 23 nt, Homo sapiens
uaccaacugagccaaaaacaaua

SEQ ID NO: 453683 - RNA, 14 nt, Homo sapiens
uaccaagaucacaa

SEQ ID NO: 453684 - RNA, 21 nt, Homo sapiens
uaccacaaggaaaauaguuua

SEQ ID NO: 453685 - RNA, 15 nt, Homo sapiens
uaccacagacuguac

SEQ ID NO: 453686 - RNA, 18 nt, Homo sapiens
uaccacagugucuguauc

SEQ ID NO: 453687 - RNA, 16 nt, Homo sapiens
uaccacgaggaaaaga

SEQ ID NO: 453688 - RNA, 21 nt, Homo sapiens
uaccacugagcccuugcacag

SEQ ID NO: 453689 - RNA, 18 nt, Homo sapiens
uaccagagaccugaggca

SEQ ID NO: 453690 - RNA, 14 nt, Homo sapiens
uaccagagauuuac

SEQ ID NO: 453691 - RNA, 12 nt, Homo sapiens
uaccagauuuga

SEQ ID NO: 453692 - RNA, 17 nt, Homo sapiens
uaccaggaauaaugaua

SEQ ID NO: 453693 - RNA, 22 nt, Homo sapiens
uaccagucgcccucugugccua

SEQ ID NO: 453694 - RNA, 16 nt, Homo sapiens
uaccagugggcaugua

SEQ ID NO: 453695 - RNA, 20 nt, Homo sapiens
cuuuaaaguuacugaucaca

SEQ ID NO: 453696 - RNA, 12 nt, Homo sapiens
cuuuaaauauca

SEQ ID NO: 453697 - RNA, 18 nt, Homo sapiens
cuuuaauacucaccuccu

SEQ ID NO: 453698 - RNA, 19 nt, Homo sapiens
cuuuaaucuucaguuuuau

SEQ ID NO: 453699 - RNA, 12 nt, Homo sapiens
cuuuaauguugu

SEQ ID NO: 453700 - RNA, 22 nt, Homo sapiens
cuuuacaacuaaauaacacaga

SEQ ID NO: 453701 - RNA, 16 nt, Homo sapiens
cuuuacaggaucaugu

SEQ ID NO: 453702 - RNA, 20 nt, Homo sapiens
cuuuacauuuucaguaccaa

SEQ ID NO: 453703 - RNA, 14 nt, Homo sapiens
cuuuaccuguucaa

SEQ ID NO: 453704 - RNA, 16 nt, Homo sapiens
cuuuagaaacugaguc

SEQ ID NO: 453705 - RNA, 20 nt, Homo sapiens
cuuuaguguauuuucuguca

SEQ ID NO: 453706 - RNA, 15 nt, Homo sapiens
cuuuauaaaugcauu

SEQ ID NO: 453707 - RNA, 11 nt, Homo sapiens
cuuuauacuua

SEQ ID NO: 453708 - RNA, 19 nt, Homo sapiens
cuuuaucauuaaacaugaa

SEQ ID NO: 453709 - RNA, 18 nt, Homo sapiens
cuuuauccuaguuccauu

SEQ ID NO: 453710 - RNA, 17 nt, Homo sapiens
cuuuaucuugacauuca

SEQ ID NO: 453711 - RNA, 19 nt, Homo sapiens
cuuuauguauggagcucua

SEQ ID NO: 453712 - RNA, 16 nt, Homo sapiens
cuuuauuaaccucagc

SEQ ID NO: 453713 - RNA, 20 nt, Homo sapiens
cuuuauuuugaaacauuugc

SEQ ID NO: 453714 - RNA, 13 nt, Homo sapiens
cuuucaaugcuga

SEQ ID NO: 453715 - RNA, 14 nt, Homo sapiens
cuuucaaugcugac

SEQ ID NO: 453716 - RNA, 21 nt, Homo sapiens
cuuucaauuacaaagcaguua

SEQ ID NO: 453717 - RNA, 19 nt, Homo sapiens
cuuucaauugcagaugcca

SEQ ID NO: 453718 - RNA, 17 nt, Homo sapiens
cuuucacauagcacaga

SEQ ID NO: 453719 - RNA, 22 nt, Homo sapiens
cuuucagaacugcuaccaugaa

SEQ ID NO: 453720 - RNA, 14 nt, Homo sapiens
cuuucagcauuagg

SEQ ID NO: 453721 - RNA, 23 nt, Homo sapiens
cuuucagccugcuucuuccccag

SEQ ID NO: 453722 - RNA, 20 nt, Homo sapiens
cuuucagcuggcagaguuag

SEQ ID NO: 453723 - RNA, 13 nt, Homo sapiens
cuuucagcuguga

SEQ ID NO: 453724 - RNA, 15 nt, Homo sapiens
cuuucaggaccuuuu

SEQ ID NO: 453725 - RNA, 20 nt, Homo sapiens
cuuucauaaacuucagggau

SEQ ID NO: 453726 - RNA, 14 nt, Homo sapiens
cuuucauaguucug

SEQ ID NO: 453727 - RNA, 13 nt, Homo sapiens
cuuucauccucag

SEQ ID NO: 453728 - RNA, 15 nt, Homo sapiens
cuuuccaaauugaug

SEQ ID NO: 453729 - RNA, 14 nt, Homo sapiens
cuuuccaauccuuu

SEQ ID NO: 453730 - RNA, 12 nt, Homo sapiens
cuuuccaugcag

SEQ ID NO: 453731 - RNA, 13 nt, Homo sapiens
cuuucccaaauaa

SEQ ID NO: 453732 - RNA, 15 nt, Homo sapiens
cuuucccaucuuaaa

SEQ ID NO: 453733 - RNA, 15 nt, Homo sapiens
cuuuccccauucauu

SEQ ID NO: 453734 - RNA, 19 nt, Homo sapiens
cuuuccccggaguaccuau

SEQ ID NO: 453735 - RNA, 13 nt, Homo sapiens
cuuucccuuccag

SEQ ID NO: 453736 - RNA, 15 nt, Homo sapiens
cuuuccucccaaagg

SEQ ID NO: 453737 - RNA, 20 nt, Homo sapiens
cuuuccucgccugacaacca

SEQ ID NO: 453738 - RNA, 19 nt, Homo sapiens
cuuuccuguagucccauug

SEQ ID NO: 453739 - RNA, 22 nt, Homo sapiens
cuuuccuucucgucuuccucuc

SEQ ID NO: 453740 - RNA, 16 nt, Homo sapiens
cuuucucauucuugcc

SEQ ID NO: 453741 - RNA, 16 nt, Homo sapiens
cuuucuccugugccca

SEQ ID NO: 453742 - RNA, 15 nt, Homo sapiens
cuuucugaaauaaca

SEQ ID NO: 453743 - RNA, 20 nt, Homo sapiens
cuuucugaaauaacauggcc

SEQ ID NO: 453744 - RNA, 15 nt, Homo sapiens
cuuucugaaauucac

SEQ ID NO: 453745 - RNA, 15 nt, Homo sapiens
cuuucugauacuuau

SEQ ID NO: 453746 - RNA, 15 nt, Homo sapiens
cuuucugucugugaa

SEQ ID NO: 453747 - RNA, 21 nt, Homo sapiens
cuuucuguggagagugagaau

SEQ ID NO: 453748 - RNA, 14 nt, Homo sapiens
cuuucuuaauauca

SEQ ID NO: 453749 - RNA, 17 nt, Homo sapiens
cuuucuuccuccagucu

SEQ ID NO: 453750 - RNA, 15 nt, Homo sapiens
cuuucuuguugcugc

SEQ ID NO: 453751 - RNA, 17 nt, Homo sapiens
cuuucuuguugcugcau

SEQ ID NO: 453752 - RNA, 21 nt, Homo sapiens
cuuucuuguugcugcaucucc

SEQ ID NO: 453753 - RNA, 17 nt, Homo sapiens
cuuucuuuaccugagac

SEQ ID NO: 453754 - RNA, 18 nt, Homo sapiens
cuuucuuuugaaaugcca

SEQ ID NO: 453755 - RNA, 21 nt, Homo sapiens
cuuugaaaauauuucuaugua

SEQ ID NO: 453756 - RNA, 15 nt, Homo sapiens
cuuugaaagcuguau

SEQ ID NO: 453757 - RNA, 18 nt, Homo sapiens
uauccugacuucuaauau

SEQ ID NO: 453758 - RNA, 16 nt, Homo sapiens
uauccugcuagcugua

SEQ ID NO: 453759 - RNA, 20 nt, Homo sapiens
uauccugcuagcuguagaaa

SEQ ID NO: 453760 - RNA, 15 nt, Homo sapiens
uauccuuucuaacaa

SEQ ID NO: 453761 - RNA, 18 nt, Homo sapiens
uauccuuucuaacaaaaa

SEQ ID NO: 453762 - RNA, 22 nt, Homo sapiens
uauccuuuuaucucacaaauaa

SEQ ID NO: 453763 - RNA, 19 nt, Homo sapiens
uaucgagaguuucuaugga

SEQ ID NO: 453764 - RNA, 13 nt, Homo sapiens
uaucgaucucuua

SEQ ID NO: 453765 - RNA, 15 nt, Homo sapiens
uaucgggaacagugu

SEQ ID NO: 453766 - RNA, 21 nt, Homo sapiens
uaucgggagcagugucuucca

SEQ ID NO: 453767 - RNA, 21 nt, Homo sapiens
uaucuaacccucccauggcac

SEQ ID NO: 453768 - RNA, 18 nt, Homo sapiens
uaucuaccucacuauuca

SEQ ID NO: 453769 - RNA, 19 nt, Homo sapiens
uaucucggaccuuucagcu

SEQ ID NO: 453770 - RNA, 10 nt, Homo sapiens
uaucucucaa

SEQ ID NO: 453771 - RNA, 14 nt, Homo sapiens
uaucugaggucaca

SEQ ID NO: 453772 - RNA, 15 nt, Homo sapiens
uaucugggauucuac

SEQ ID NO: 453773 - RNA, 22 nt, Homo sapiens
uaucugugaaaugcuggcauuu

SEQ ID NO: 453774 - RNA, 16 nt, Homo sapiens
uaucuguuaaccaaau

SEQ ID NO: 453775 - RNA, 16 nt, Homo sapiens
uaucuguuugcuucua

SEQ ID NO: 453776 - RNA, 13 nt, Homo sapiens
uaucuuaugccac

SEQ ID NO: 453777 - RNA, 16 nt, Homo sapiens
uaucuugcaccccaaa

SEQ ID NO: 453778 - RNA, 19 nt, Homo sapiens
uaucuugcaccccaaagcu

SEQ ID NO: 453779 - RNA, 22 nt, Homo sapiens
uaucuuuaaauaaaugugagaa

SEQ ID NO: 453780 - RNA, 22 nt, Homo sapiens
uaucuuuuuucuuccuauuucc

SEQ ID NO: 453781 - RNA, 19 nt, Homo sapiens
uaugaaaauacaacuuaaa

SEQ ID NO: 453782 - RNA, 19 nt, Homo sapiens
uaugaagaaagauacuaau

SEQ ID NO: 453783 - RNA, 15 nt, Homo sapiens
uaugaagacacuguc

SEQ ID NO: 453784 - RNA, 20 nt, Homo sapiens
uaugaagugacucucacaag

SEQ ID NO: 453785 - RNA, 21 nt, Homo sapiens
uaugaagugacucucacaaga

SEQ ID NO: 453786 - RNA, 12 nt, Homo sapiens
uaugaaugcagu

SEQ ID NO: 453787 - RNA, 22 nt, Homo sapiens
uaugacaauaaauuuuaucuca

SEQ ID NO: 453788 - RNA, 22 nt, Homo sapiens
uaugacacuguuaauaguacua

SEQ ID NO: 453789 - RNA, 16 nt, Homo sapiens
uaugacuccagaauuu

SEQ ID NO: 453790 - RNA, 22 nt, Homo sapiens
uaugacuguuuuuguaguggua

SEQ ID NO: 453791 - RNA, 21 nt, Homo sapiens
uaugaguuuuugauagcuuua

SEQ ID NO: 453792 - RNA, 23 nt, Homo sapiens
uaugaguuuuugauagcuuuauu

SEQ ID NO: 453793 - RNA, 12 nt, Homo sapiens
uaugaucuuggc

SEQ ID NO: 453794 - RNA, 18 nt, Homo sapiens
uaugauucagauuguuau

SEQ ID NO: 453795 - RNA, 14 nt, Homo sapiens
uaugcaucuuugag

SEQ ID NO: 453796 - RNA, 15 nt, Homo sapiens
uaugccucuguauuu

SEQ ID NO: 453797 - RNA, 22 nt, Homo sapiens
uauggaaauccuguuacuuaaa

SEQ ID NO: 453798 - RNA, 21 nt, Homo sapiens
uauggaccaauuagcauucca

SEQ ID NO: 453799 - RNA, 20 nt, Homo sapiens
uauggacuccuguuguugaa

SEQ ID NO: 453800 - RNA, 17 nt, Homo sapiens
uauggagagaaaacaga

SEQ ID NO: 453801 - RNA, 17 nt, Homo sapiens
uauggauugaaggauug

SEQ ID NO: 453802 - RNA, 20 nt, Homo sapiens
uauggauugaaggauuguga

SEQ ID NO: 453803 - RNA, 19 nt, Homo sapiens
uaugggaacaaguguacag

SEQ ID NO: 453804 - RNA, 16 nt, Homo sapiens
uaugggcuacacagca

SEQ ID NO: 453805 - RNA, 13 nt, Homo sapiens
uaugggcuuucuc

SEQ ID NO: 453806 - RNA, 15 nt, Homo sapiens
uaugggggcacugag

SEQ ID NO: 453807 - RNA, 18 nt, Homo sapiens
uauggguugucaauagua

SEQ ID NO: 453808 - RNA, 18 nt, Homo sapiens
uauggugauucaaaugca

SEQ ID NO: 453809 - RNA, 15 nt, Homo sapiens
uaugguuuuguggau

SEQ ID NO: 453810 - RNA, 16 nt, Homo sapiens
uauguaagagcaccuu

SEQ ID NO: 453811 - RNA, 16 nt, Homo sapiens
uauguaugccuauuca

SEQ ID NO: 453812 - RNA, 19 nt, Homo sapiens
uauguaugcugauuuacua

SEQ ID NO: 453813 - RNA, 19 nt, Homo sapiens
uaugucauuucuacuuuga

SEQ ID NO: 453814 - RNA, 23 nt, Homo sapiens
uaugucugugugccccuccugcc

SEQ ID NO: 453815 - RNA, 19 nt, Homo sapiens
uaugugaauugagcacaua

SEQ ID NO: 453816 - RNA, 23 nt, Homo sapiens
uaugugagagaaagugugagcaa

SEQ ID NO: 453817 - RNA, 22 nt, Homo sapiens
uaugugagugaaaguacuucag

SEQ ID NO: 453818 - RNA, 19 nt, Homo sapiens
uaugugccuuucacuuuag

SEQ ID NO: 453819 - RNA, 17 nt, Homo sapiens
uaugugcggcuuuucag

SEQ ID NO: 453820 - RNA, 15 nt, Homo sapiens
uaugugcgugugugc

SEQ ID NO: 453821 - RNA, 20 nt, Homo sapiens
uauguggaguucaucuugaa

SEQ ID NO: 453822 - RNA, 12 nt, Homo sapiens
uauguguaaaau

SEQ ID NO: 453823 - RNA, 15 nt, Homo sapiens
uauguguaugugcca

SEQ ID NO: 453824 - RNA, 19 nt, Homo sapiens
uaugugucagccaugacca

SEQ ID NO: 453825 - RNA, 15 nt, Homo sapiens
ucagagaaaacacuu

SEQ ID NO: 453826 - RNA, 14 nt, Homo sapiens
ucagagagcucacu

SEQ ID NO: 453827 - RNA, 19 nt, Homo sapiens
ucagagcugggaguagcau

SEQ ID NO: 453828 - RNA, 20 nt, Homo sapiens
ucagaggagcggccagaaga

SEQ ID NO: 453829 - RNA, 18 nt, Homo sapiens
ucagagucuggccugcca

SEQ ID NO: 453830 - RNA, 17 nt, Homo sapiens
ucagaguggccaauccc

SEQ ID NO: 453831 - RNA, 21 nt, Homo sapiens
ucagauacaugguugugaccu

SEQ ID NO: 453832 - RNA, 16 nt, Homo sapiens
ucagaucugaacacag

SEQ ID NO: 453833 - RNA, 14 nt, Homo sapiens
ucagaugauucuau

SEQ ID NO: 453834 - RNA, 23 nt, Homo sapiens
ucagaugauucuaugucucauga

SEQ ID NO: 453835 - RNA, 15 nt, Homo sapiens
ucagauuccaccuag

SEQ ID NO: 453836 - RNA, 22 nt, Homo sapiens
ucagauuguuaucuaucaacua

SEQ ID NO: 453837 - RNA, 19 nt, Homo sapiens
ucagauuuuuaaaagcccu

SEQ ID NO: 453838 - RNA, 21 nt, Homo sapiens
ucagcaacccuacaguauaua

SEQ ID NO: 453839 - RNA, 18 nt, Homo sapiens
ucagcaaggggcucugcc

SEQ ID NO: 453840 - RNA, 15 nt, Homo sapiens
ucagcacagccucac

SEQ ID NO: 453841 - RNA, 20 nt, Homo sapiens
ucagcacaggccauggugca

SEQ ID NO: 453842 - RNA, 12 nt, Homo sapiens
ucagcacauguu

SEQ ID NO: 453843 - RNA, 19 nt, Homo sapiens
ucagcacugucccuugccu

SEQ ID NO: 453844 - RNA, 17 nt, Homo sapiens
ucagcagcgugcaauag

SEQ ID NO: 453845 - RNA, 15 nt, Homo sapiens
ucagccccucuugcc

SEQ ID NO: 453846 - RNA, 13 nt, Homo sapiens
ucagcccuggauu

SEQ ID NO: 453847 - RNA, 22 nt, Homo sapiens
ucagcccuguguauaaagccau

SEQ ID NO: 453848 - RNA, 17 nt, Homo sapiens
ucagccucauucacugu

SEQ ID NO: 453849 - RNA, 18 nt, Homo sapiens
ucagccucccgaguagcu

SEQ ID NO: 453850 - RNA, 12 nt, Homo sapiens
ucagccuuccaa

SEQ ID NO: 453851 - RNA, 22 nt, Homo sapiens
ucagcuaucaguguucuucuca

SEQ ID NO: 453852 - RNA, 19 nt, Homo sapiens
ucagcucucaguugcagcc

SEQ ID NO: 453853 - RNA, 17 nt, Homo sapiens
ucagcucucugggaccu

SEQ ID NO: 453854 - RNA, 16 nt, Homo sapiens
ucagcucuggccacaa

SEQ ID NO: 453855 - RNA, 12 nt, Homo sapiens
ucagcugccuca

SEQ ID NO: 453856 - RNA, 19 nt, Homo sapiens
ucagcugcuuuguuaccuu

SEQ ID NO: 453857 - RNA, 13 nt, Homo sapiens
ucagcuugguucc

SEQ ID NO: 453858 - RNA, 23 nt, Homo sapiens
ucagcuuuuguuguuuauauaca

SEQ ID NO: 453859 - RNA, 19 nt, Homo sapiens
ucaggaaaggaagauguaa

SEQ ID NO: 453860 - RNA, 17 nt, Homo sapiens
ucaggagaaugugcagu

SEQ ID NO: 453861 - RNA, 16 nt, Homo sapiens
ucaggagaccuagguu

SEQ ID NO: 453862 - RNA, 15 nt, Homo sapiens
ucaggagagugcaga

SEQ ID NO: 453863 - RNA, 14 nt, Homo sapiens
ucaggaggagacag

SEQ ID NO: 453864 - RNA, 17 nt, Homo sapiens
ucaggauaaaguuugcu

SEQ ID NO: 453865 - RNA, 16 nt, Homo sapiens
ucaggauggcucagac

SEQ ID NO: 453866 - RNA, 21 nt, Homo sapiens
ucaggauugaggaugaacuca

SEQ ID NO: 453867 - RNA, 17 nt, Homo sapiens
ucaggcgauucuccugc

SEQ ID NO: 453868 - RNA, 17 nt, Homo sapiens
ucaggcuacuaaaauau

SEQ ID NO: 453869 - RNA, 14 nt, Homo sapiens
ucagggaccaagga

SEQ ID NO: 453870 - RNA, 13 nt, Homo sapiens
ucagggaguacac

SEQ ID NO: 453871 - RNA, 18 nt, Homo sapiens
ucagggcagggcucugau

SEQ ID NO: 453872 - RNA, 14 nt, Homo sapiens
ucagggcuuccuua

SEQ ID NO: 453873 - RNA, 19 nt, Homo sapiens
ucagggggccaggugcaca

SEQ ID NO: 453874 - RNA, 23 nt, Homo sapiens
ucagggggccuuuaaagacuuaa

SEQ ID NO: 453875 - RNA, 16 nt, Homo sapiens
ucagguaguacuggga

SEQ ID NO: 453876 - RNA, 21 nt, Homo sapiens
ucaggugguguccuucuuccu

SEQ ID NO: 453877 - RNA, 14 nt, Homo sapiens
ucaguaagaucaag

SEQ ID NO: 453878 - RNA, 20 nt, Homo sapiens
ucaguaauaaaacaucuuuc

SEQ ID NO: 453879 - RNA, 15 nt, Homo sapiens
ucaguacacuuggug

SEQ ID NO: 453880 - RNA, 18 nt, Homo sapiens
ucaguagugccugugauc

SEQ ID NO: 453881 - RNA, 16 nt, Homo sapiens
ucaguaugaagacacu

SEQ ID NO: 453882 - RNA, 21 nt, Homo sapiens
ucaguauugagacacugucaa

SEQ ID NO: 453883 - RNA, 15 nt, Homo sapiens
ucagucaucaucuca

SEQ ID NO: 453884 - RNA, 16 nt, Homo sapiens
ucagucaugcacucac

SEQ ID NO: 453885 - RNA, 20 nt, Homo sapiens
ucaguccacuucugcucugg

SEQ ID NO: 453886 - RNA, 13 nt, Homo sapiens
ucagucuacaggc

SEQ ID NO: 453887 - RNA, 14 nt, Homo sapiens
ucagucuuggaguu

SEQ ID NO: 453888 - RNA, 12 nt, Homo sapiens
ucagugaaggac

SEQ ID NO: 453889 - RNA, 22 nt, Homo sapiens
ucagugacagaguucacuauaa

SEQ ID NO: 453890 - RNA, 21 nt, Homo sapiens
ucagugccacuugacauuccu

SEQ ID NO: 453891 - RNA, 12 nt, Homo sapiens
ucaguugcaaau

SEQ ID NO: 453892 - RNA, 16 nt, Homo sapiens
ucaguuggugcugcuu

SEQ ID NO: 453893 - RNA, 14 nt, Homo sapiens
ucaguuguuuuccc

SEQ ID NO: 453894 - RNA, 15 nt, Homo sapiens
ucaguuucacauauu

SEQ ID NO: 453895 - RNA, 22 nt, Homo sapiens
ucaguuuuaucuuuaaucuccu

SEQ ID NO: 453896 - RNA, 19 nt, Homo sapiens
ucaguuuuccuagucuuug

SEQ ID NO: 453897 - RNA, 17 nt, Homo sapiens
ucauaaacuucagggau

SEQ ID NO: 453898 - RNA, 22 nt, Homo sapiens
ucauaaauuggcuccuuuccca

SEQ ID NO: 453899 - RNA, 17 nt, Homo sapiens
gaagauagaacaaugcu

SEQ ID NO: 453900 - RNA, 13 nt, Homo sapiens
gaagaucuugaga

SEQ ID NO: 453901 - RNA, 12 nt, Homo sapiens
gaagcaaccucc

SEQ ID NO: 453902 - RNA, 14 nt, Homo sapiens
gaagcaaggccagc

SEQ ID NO: 453903 - RNA, 13 nt, Homo sapiens
gaagcacugccau

SEQ ID NO: 453904 - RNA, 10 nt, Homo sapiens
gaagcacuuu

SEQ ID NO: 453905 - RNA, 17 nt, Homo sapiens
gaagcagucuugcucug

SEQ ID NO: 453906 - RNA, 19 nt, Homo sapiens
gaagcaugcuuugcugcua

SEQ ID NO: 453907 - RNA, 19 nt, Homo sapiens
gaagccauauucacaccuc

SEQ ID NO: 453908 - RNA, 14 nt, Homo sapiens
gaagcccacccgcc

SEQ ID NO: 453909 - RNA, 21 nt, Homo sapiens
gaagcccuccaaaagcacuua

SEQ ID NO: 453910 - RNA, 15 nt, Homo sapiens
gaagccggcggccca

SEQ ID NO: 453911 - RNA, 20 nt, Homo sapiens
gaagccgucugacuccagag

SEQ ID NO: 453912 - RNA, 16 nt, Homo sapiens
gaagccugcugauuuc

SEQ ID NO: 453913 - RNA, 22 nt, Homo sapiens
gaagcuaauguaggacuguaua

SEQ ID NO: 453914 - RNA, 21 nt, Homo sapiens
gaagcuccugggggaugcucu

SEQ ID NO: 453915 - RNA, 22 nt, Homo sapiens
gaagcucucgagggaagcagug

SEQ ID NO: 453916 - RNA, 16 nt, Homo sapiens
gaagcugagacacaaa

SEQ ID NO: 453917 - RNA, 17 nt, Homo sapiens
gaagcuucuugcugcca

SEQ ID NO: 453918 - RNA, 14 nt, Homo sapiens
gaaggaaaaugaua

SEQ ID NO: 453919 - RNA, 13 nt, Homo sapiens
gaaggaaacauau

SEQ ID NO: 453920 - RNA, 12 nt, Homo sapiens
gaaggaaaccag

SEQ ID NO: 453921 - RNA, 16 nt, Homo sapiens
gaaggaaauaacauug

SEQ ID NO: 453922 - RNA, 18 nt, Homo sapiens
gaaggaauagccagagag

SEQ ID NO: 453923 - RNA, 23 nt, Homo sapiens
gaaggaccuccugagcgaugacu

SEQ ID NO: 453924 - RNA, 12 nt, Homo sapiens
gaaggacuauca

SEQ ID NO: 453925 - RNA, 23 nt, Homo sapiens
gaaggagccacgugaauggcccu

SEQ ID NO: 453926 - RNA, 18 nt, Homo sapiens
gaaggauuuucugaccuu

SEQ ID NO: 453927 - RNA, 17 nt, Homo sapiens
gaaggccuugcugucau

SEQ ID NO: 453928 - RNA, 14 nt, Homo sapiens
gaaggcucugggau

SEQ ID NO: 453929 - RNA, 19 nt, Homo sapiens
gaaggcucugggaucuccc

SEQ ID NO: 453930 - RNA, 15 nt, Homo sapiens
gaagggacuggucca

SEQ ID NO: 453931 - RNA, 20 nt, Homo sapiens
gaagggccccacucagggau

SEQ ID NO: 453932 - RNA, 21 nt, Homo sapiens
gaaggucccgaauggagucca

SEQ ID NO: 453933 - RNA, 16 nt, Homo sapiens
gaaggucccucagaca

SEQ ID NO: 453934 - RNA, 22 nt, Homo sapiens
gaagguucugguaaccuguggu

SEQ ID NO: 453935 - RNA, 23 nt, Homo sapiens
gaaguaacaaaagaagugacauc

SEQ ID NO: 453936 - RNA, 13 nt, Homo sapiens
gaaguagguguga

SEQ ID NO: 453937 - RNA, 20 nt, Homo sapiens
gaaguaggugugacuugaac

SEQ ID NO: 453938 - RNA, 16 nt, Homo sapiens
gaagucaucucauucc

SEQ ID NO: 453939 - RNA, 15 nt, Homo sapiens
gaaguccuucaguga

SEQ ID NO: 453940 - RNA, 18 nt, Homo sapiens
gaagucucuuuuucuucc

SEQ ID NO: 453941 - RNA, 22 nt, Homo sapiens
gaagucugcuuaccaaaacaua

SEQ ID NO: 453942 - RNA, 16 nt, Homo sapiens
gaagucuuuguacaga

SEQ ID NO: 453943 - RNA, 14 nt, Homo sapiens
gaagugacucucac

SEQ ID NO: 453944 - RNA, 20 nt, Homo sapiens
gaagugacuugaauguacaa

SEQ ID NO: 453945 - RNA, 13 nt, Homo sapiens
gaaguggauucug

SEQ ID NO: 453946 - RNA, 18 nt, Homo sapiens
gaagugucuaaugcauua

SEQ ID NO: 453947 - RNA, 20 nt, Homo sapiens
gaaguugcagugagcugaua

SEQ ID NO: 453948 - RNA, 17 nt, Homo sapiens
gaaguuuaaagaugccu

SEQ ID NO: 453949 - RNA, 18 nt, Homo sapiens
gaauaaaauuguaaaauu

SEQ ID NO: 453950 - RNA, 13 nt, Homo sapiens
gaauaaagccaca

SEQ ID NO: 453951 - RNA, 21 nt, Homo sapiens
gaauaaagcccuugaaccagc

SEQ ID NO: 453952 - RNA, 14 nt, Homo sapiens
gaauaaauuuggga

SEQ ID NO: 453953 - RNA, 15 nt, Homo sapiens
gaauaaccacuuaaa

SEQ ID NO: 453954 - RNA, 17 nt, Homo sapiens
gaauaagaaaacaauca

SEQ ID NO: 453955 - RNA, 19 nt, Homo sapiens
gaauaauaagcuacuugcc

SEQ ID NO: 453956 - RNA, 12 nt, Homo sapiens
ucccaaacccuu

SEQ ID NO: 453957 - RNA, 16 nt, Homo sapiens
ucccaaagagcugccu

SEQ ID NO: 453958 - RNA, 14 nt, Homo sapiens
ucccaacccauuca

SEQ ID NO: 453959 - RNA, 14 nt, Homo sapiens
ucccaacucuagcc

SEQ ID NO: 453960 - RNA, 20 nt, Homo sapiens
ucccaagguccucucaguuc

SEQ ID NO: 453961 - RNA, 22 nt, Homo sapiens
ucccaauaaaagugacucucag

SEQ ID NO: 453962 - RNA, 15 nt, Homo sapiens
ucccaauaaaguccu

SEQ ID NO: 453963 - RNA, 20 nt, Homo sapiens
ucccacauaauacauuccau

SEQ ID NO: 453964 - RNA, 12 nt, Homo sapiens
ucccaccacagc

SEQ ID NO: 453965 - RNA, 21 nt, Homo sapiens
ucccaccgguugcuucuggga

SEQ ID NO: 453966 - RNA, 21 nt, Homo sapiens
ucccacggccacugcagucac

SEQ ID NO: 453967 - RNA, 23 nt, Homo sapiens
ucccagaaauuagaaaccuuaau

SEQ ID NO: 453968 - RNA, 17 nt, Homo sapiens
ucccagacauucauugu

SEQ ID NO: 453969 - RNA, 23 nt, Homo sapiens
ucccagcacauuuccucucuauc

SEQ ID NO: 453970 - RNA, 14 nt, Homo sapiens
ucccagcaccugcc

SEQ ID NO: 453971 - RNA, 18 nt, Homo sapiens
ucccagcaccuggcacac

SEQ ID NO: 453972 - RNA, 22 nt, Homo sapiens
ucccagcacuuugggaggccaa

SEQ ID NO: 453973 - RNA, 23 nt, Homo sapiens
ucccagcagcccuaaggaucucu

SEQ ID NO: 453974 - RNA, 15 nt, Homo sapiens
ucccagcuacuuggg

SEQ ID NO: 453975 - RNA, 15 nt, Homo sapiens
ucccaggaaguccag

SEQ ID NO: 453976 - RNA, 20 nt, Homo sapiens
ucccaggacacgacuuguaa

SEQ ID NO: 453977 - RNA, 19 nt, Homo sapiens
ucccaggggacaugaguaa

SEQ ID NO: 453978 - RNA, 17 nt, Homo sapiens
ucccaguaaaaggcacu

SEQ ID NO: 453979 - RNA, 16 nt, Homo sapiens
ucccaguuaacuguua

SEQ ID NO: 453980 - RNA, 19 nt, Homo sapiens
ucccaguucauguugcuca

SEQ ID NO: 453981 - RNA, 17 nt, Homo sapiens
ucccauaacauaaaagu

SEQ ID NO: 453982 - RNA, 21 nt, Homo sapiens
ucccaucccugaaacauugca

SEQ ID NO: 453983 - RNA, 22 nt, Homo sapiens
ucccaucuaaaacucauacaau

SEQ ID NO: 453984 - RNA, 16 nt, Homo sapiens
ucccaucucauuucca

SEQ ID NO: 453985 - RNA, 19 nt, Homo sapiens
ucccaugcucauaccucuu

SEQ ID NO: 453986 - RNA, 16 nt, Homo sapiens
ucccaugcugaccugu

SEQ ID NO: 453987 - RNA, 17 nt, Homo sapiens
ucccaugguagacugug

SEQ ID NO: 453988 - RNA, 18 nt, Homo sapiens
ucccaugguagacuguga

SEQ ID NO: 453989 - RNA, 21 nt, Homo sapiens
ucccaugguagacugugacac

SEQ ID NO: 453990 - RNA, 18 nt, Homo sapiens
ucccauguugcaugccua

SEQ ID NO: 453991 - RNA, 16 nt, Homo sapiens
ucccauucuccacuca

SEQ ID NO: 453992 - RNA, 15 nt, Homo sapiens
ucccauucuugcaug

SEQ ID NO: 453993 - RNA, 16 nt, Homo sapiens
ucccauuuguguuuca

SEQ ID NO: 453994 - RNA, 19 nt, Homo sapiens
uccccaacuccuuccucuu

SEQ ID NO: 453995 - RNA, 16 nt, Homo sapiens
uccccaagcaguguga

SEQ ID NO: 453996 - RNA, 23 nt, Homo sapiens
uccccaagugguuuccacaugcu

SEQ ID NO: 453997 - RNA, 14 nt, Homo sapiens
uccccaauuauccu

SEQ ID NO: 453998 - RNA, 12 nt, Homo sapiens
uccccagggugc

SEQ ID NO: 453999 - RNA, 18 nt, Homo sapiens
uccccauccccaccagcu

SEQ ID NO: 454000 - RNA, 20 nt, Homo sapiens
uccccauuaguauccuguua

SEQ ID NO: 454001 - RNA, 22 nt, Homo sapiens
ucccccaaagcaaugugagucc

SEQ ID NO: 454002 - RNA, 14 nt, Homo sapiens
ucccccaaccucag

SEQ ID NO: 454003 - RNA, 17 nt, Homo sapiens
ucccccgacacugcugc

SEQ ID NO: 454004 - RNA, 22 nt, Homo sapiens
ucccccuggggcuucuccugac

SEQ ID NO: 454005 - RNA, 13 nt, Homo sapiens
ucccccuuucucc

SEQ ID NO: 454006 - RNA, 19 nt, Homo sapiens
uccccuacggccacagggg

SEQ ID NO: 454007 - RNA, 13 nt, Homo sapiens
uccccuccagacc

SEQ ID NO: 454008 - RNA, 23 nt, Homo sapiens
uccccucccugugacccguucca

SEQ ID NO: 454009 - RNA, 21 nt, Homo sapiens
uccccugaggucaugcauugu

SEQ ID NO: 454010 - RNA, 21 nt, Homo sapiens
uccccugcggagcugcaugga

SEQ ID NO: 454011 - RNA, 14 nt, Homo sapiens
uccccuggacauau

SEQ ID NO: 454012 - RNA, 15 nt, Homo sapiens
uccccugucccacca

SEQ ID NO: 454013 - RNA, 18 nt, Homo sapiens
uccccuuccccugcugac

SEQ ID NO: 454014 - RNA, 19 nt, Homo sapiens
uccccuuuugccaaucuca

SEQ ID NO: 454015 - RNA, 22 nt, Homo sapiens
ucccgaccuaccaccccacugg

SEQ ID NO: 454016 - RNA, 14 nt, Homo sapiens
ucccgagcuacucu

SEQ ID NO: 454017 - RNA, 16 nt, Homo sapiens
ucccgcccccuuggcu

SEQ ID NO: 454018 - RNA, 18 nt, Homo sapiens
ucccggagagggagucag

SEQ ID NO: 454019 - RNA, 20 nt, Homo sapiens
ucccggcgucccuaccuccu

SEQ ID NO: 454020 - RNA, 23 nt, Homo sapiens
ucccguaccucuucccaugacug

SEQ ID NO: 454021 - RNA, 16 nt, Homo sapiens
ucccuaagaauuccca

SEQ ID NO: 454022 - RNA, 12 nt, Homo sapiens
ucccuaccucag

SEQ ID NO: 454023 - RNA, 13 nt, Homo sapiens
ucccucauguucu

SEQ ID NO: 454024 - RNA, 15 nt, Homo sapiens
ucccucauguucuca

SEQ ID NO: 454025 - RNA, 11 nt, Homo sapiens
ucccuccacuc

SEQ ID NO: 454026 - RNA, 14 nt, Homo sapiens
ucccuccccagugu

SEQ ID NO: 454027 - RNA, 14 nt, Homo sapiens
ucccucccuaucua

SEQ ID NO: 454028 - RNA, 14 nt, Homo sapiens
ucccuccggccaua

SEQ ID NO: 454029 - RNA, 18 nt, Homo sapiens
ucccuccgggcaggggag

SEQ ID NO: 454030 - RNA, 14 nt, Homo sapiens
ucccucgcuguaug

SEQ ID NO: 454031 - RNA, 13 nt, Homo sapiens
ucccucuaugucg

SEQ ID NO: 454032 - RNA, 19 nt, Homo sapiens
ucccucuccuauguggcag

SEQ ID NO: 454033 - RNA, 23 nt, Homo sapiens
ucccugaaaauguuuuucugcca

SEQ ID NO: 454034 - RNA, 22 nt, Homo sapiens
ucccugcccaccuccuggagaa

SEQ ID NO: 454035 - RNA, 21 nt, Homo sapiens
ucccugccugugacuuucaag

SEQ ID NO: 454036 - RNA, 19 nt, Homo sapiens
ucccuggccauccauguga

SEQ ID NO: 454037 - RNA, 19 nt, Homo sapiens
gagaaaaaagaaguguccg

SEQ ID NO: 454038 - RNA, 19 nt, Homo sapiens
gagaaaacagauaaugaua

SEQ ID NO: 454039 - RNA, 23 nt, Homo sapiens
gagaaaccagggagccccuuuga

SEQ ID NO: 454040 - RNA, 11 nt, Homo sapiens
gagaaacugaa

SEQ ID NO: 454041 - RNA, 21 nt, Homo sapiens
gagaaacuuguaauggucucu

SEQ ID NO: 454042 - RNA, 20 nt, Homo sapiens
gagaaaggggauguauccau

SEQ ID NO: 454043 - RNA, 23 nt, Homo sapiens
gagaaaggggcaagaaauucauu

SEQ ID NO: 454044 - RNA, 12 nt, Homo sapiens
gagaacagggau

SEQ ID NO: 454045 - RNA, 13 nt, Homo sapiens
gagaacugugcuc

SEQ ID NO: 454046 - RNA, 15 nt, Homo sapiens
gagaagaaagaagca

SEQ ID NO: 454047 - RNA, 19 nt, Homo sapiens
gagaagaaagaagcacucu

SEQ ID NO: 454048 - RNA, 17 nt, Homo sapiens
gagaagaaguuugacca

SEQ ID NO: 454049 - RNA, 21 nt, Homo sapiens
gagaagaggcugcugcagaca

SEQ ID NO: 454050 - RNA, 21 nt, Homo sapiens
gagaagcaaauauguuugcau

SEQ ID NO: 454051 - RNA, 18 nt, Homo sapiens
gagaaggaaaagacugaa

SEQ ID NO: 454052 - RNA, 20 nt, Homo sapiens
gagaaggaaaaggcuggcaa

SEQ ID NO: 454053 - RNA, 20 nt, Homo sapiens
gagaaggcaaccuugacucu

SEQ ID NO: 454054 - RNA, 18 nt, Homo sapiens
gagaagucaaacauuuca

SEQ ID NO: 454055 - RNA, 21 nt, Homo sapiens
gagaauaaacuagacucugaa

SEQ ID NO: 454056 - RNA, 17 nt, Homo sapiens
gagaauaaagcauuuca

SEQ ID NO: 454057 - RNA, 21 nt, Homo sapiens
gagaauauuauaaaaauauca

SEQ ID NO: 454058 - RNA, 13 nt, Homo sapiens
gagaaucacugga

SEQ ID NO: 454059 - RNA, 20 nt, Homo sapiens
gagaaucgaccucacuguca

SEQ ID NO: 454060 - RNA, 15 nt, Homo sapiens
gagaaucugcugcau

SEQ ID NO: 454061 - RNA, 19 nt, Homo sapiens
gagaauggcuuuggucucu

SEQ ID NO: 454062 - RNA, 19 nt, Homo sapiens
gagacaagaaauccuagug

SEQ ID NO: 454063 - RNA, 23 nt, Homo sapiens
gagacaagaaauccuaguggccu

SEQ ID NO: 454064 - RNA, 21 nt, Homo sapiens
gagacacaacuauuuuuccaa

SEQ ID NO: 454065 - RNA, 14 nt, Homo sapiens
gagacagggagaaa

SEQ ID NO: 454066 - RNA, 16 nt, Homo sapiens
gagacaggguuucacc

SEQ ID NO: 454067 - RNA, 17 nt, Homo sapiens
gagacaggguuucacug

SEQ ID NO: 454068 - RNA, 22 nt, Homo sapiens
gagacaugggccucccacuccu

SEQ ID NO: 454069 - RNA, 19 nt, Homo sapiens
gagacauugggaggggcuu

SEQ ID NO: 454070 - RNA, 16 nt, Homo sapiens
gagaccagcaucccag

SEQ ID NO: 454071 - RNA, 21 nt, Homo sapiens
gagaccagcuucuagcagcua

SEQ ID NO: 454072 - RNA, 15 nt, Homo sapiens
gagaccauccuggcc

SEQ ID NO: 454073 - RNA, 14 nt, Homo sapiens
gagaccuuccacaa

SEQ ID NO: 454074 - RNA, 19 nt, Homo sapiens
gagacuaagauguauuaac

SEQ ID NO: 454075 - RNA, 13 nt, Homo sapiens
gagacuaggauag

SEQ ID NO: 454076 - RNA, 14 nt, Homo sapiens
gagacugggagcca

SEQ ID NO: 454077 - RNA, 21 nt, Homo sapiens
gagacugucucaagagggcac

SEQ ID NO: 454078 - RNA, 17 nt, Homo sapiens
gagagaaagaaugagaa

SEQ ID NO: 454079 - RNA, 22 nt, Homo sapiens
gagagagcuuccuguuucuaag

SEQ ID NO: 454080 - RNA, 23 nt, Homo sapiens
gagagcaaaaaggggaaauaugu

SEQ ID NO: 454081 - RNA, 20 nt, Homo sapiens
gagagcaaucuugcugugaa

SEQ ID NO: 454082 - RNA, 20 nt, Homo sapiens
gagagcccagaaaacuguca

SEQ ID NO: 454083 - RNA, 14 nt, Homo sapiens
gagagcccauuccc

SEQ ID NO: 454084 - RNA, 18 nt, Homo sapiens
gagagcccucugcugcuu

SEQ ID NO: 454085 - RNA, 15 nt, Homo sapiens
ugaaguacaguccca

SEQ ID NO: 454086 - RNA, 14 nt, Homo sapiens
ugaaguauugcuaa

SEQ ID NO: 454087 - RNA, 15 nt, Homo sapiens
ugaagucaaaccuua

SEQ ID NO: 454088 - RNA, 21 nt, Homo sapiens
ugaagucugcuuaccaaaaca

SEQ ID NO: 454089 - RNA, 21 nt, Homo sapiens
ugaaguucuggcaagauugaa

SEQ ID NO: 454090 - RNA, 17 nt, Homo sapiens
ugaauaauguagugcag

SEQ ID NO: 454091 - RNA, 15 nt, Homo sapiens
ugaauagaaauggga

SEQ ID NO: 454092 - RNA, 20 nt, Homo sapiens
ugaauauggaacauaugcac

SEQ ID NO: 454093 - RNA, 16 nt, Homo sapiens
ugaauauuauacuucu

SEQ ID NO: 454094 - RNA, 20 nt, Homo sapiens
ugaauauuuauauuucacua

SEQ ID NO: 454095 - RNA, 13 nt, Homo sapiens
ugaaucaaucugg

SEQ ID NO: 454096 - RNA, 18 nt, Homo sapiens
ugaauccucaugaggcuu

SEQ ID NO: 454097 - RNA, 21 nt, Homo sapiens
ugaaucgcaaggccugugcug

SEQ ID NO: 454098 - RNA, 23 nt, Homo sapiens
ugaaucgcaaggccugugcugca

SEQ ID NO: 454099 - RNA, 16 nt, Homo sapiens
ugaaugaaagucuugu

SEQ ID NO: 454100 - RNA, 21 nt, Homo sapiens
ugaaugaaauauaaacuguga

SEQ ID NO: 454101 - RNA, 14 nt, Homo sapiens
ugaaugaugugaua

SEQ ID NO: 454102 - RNA, 20 nt, Homo sapiens
ugaaugccguggauugcacg

SEQ ID NO: 454103 - RNA, 15 nt, Homo sapiens
ugaaugccuucuuaa

SEQ ID NO: 454104 - RNA, 13 nt, Homo sapiens
ugaaugucauuau

SEQ ID NO: 454105 - RNA, 16 nt, Homo sapiens
ugaauguuaaacuacu

SEQ ID NO: 454106 - RNA, 15 nt, Homo sapiens
ugaauuuccuaucug

SEQ ID NO: 454107 - RNA, 20 nt, Homo sapiens
ugaauuucuagacaguauug

SEQ ID NO: 454108 - RNA, 21 nt, Homo sapiens
ugaauuuucaaguaauuguga

SEQ ID NO: 454109 - RNA, 16 nt, Homo sapiens
ugaauuuuugcacauu

SEQ ID NO: 454110 - RNA, 11 nt, Homo sapiens
ugacaaaaagc

SEQ ID NO: 454111 - RNA, 13 nt, Homo sapiens
ugacaaauucugu

SEQ ID NO: 454112 - RNA, 20 nt, Homo sapiens
ugacaaggauuagaacacuc

SEQ ID NO: 454113 - RNA, 19 nt, Homo sapiens
ugacacaggggacacugaa

SEQ ID NO: 454114 - RNA, 14 nt, Homo sapiens
ugacacaugcucuc

SEQ ID NO: 454115 - RNA, 22 nt, Homo sapiens
ugacaccaagaaaccacugggc

SEQ ID NO: 454116 - RNA, 23 nt, Homo sapiens
ugacaccaagaaaccacugggca

SEQ ID NO: 454117 - RNA, 18 nt, Homo sapiens
ugacacgucugccuaccc

SEQ ID NO: 454118 - RNA, 13 nt, Homo sapiens
ugacacugagaac

SEQ ID NO: 454119 - RNA, 23 nt, Homo sapiens
ugacagagcgagauuccgucuca

SEQ ID NO: 454120 - RNA, 19 nt, Homo sapiens
ugacagaguucacuauaaa

SEQ ID NO: 454121 - RNA, 12 nt, Homo sapiens
ugacagcaauaa

SEQ ID NO: 454122 - RNA, 16 nt, Homo sapiens
ugacaggcuuucccag

SEQ ID NO: 454123 - RNA, 16 nt, Homo sapiens
ugacaguaaaucucac

SEQ ID NO: 454124 - RNA, 21 nt, Homo sapiens
ugacaguagcauacugaugag

SEQ ID NO: 454125 - RNA, 11 nt, Homo sapiens
ugacaguauua

SEQ ID NO: 454126 - RNA, 15 nt, Homo sapiens
ugacauacauggaau

SEQ ID NO: 454127 - RNA, 20 nt, Homo sapiens
ugacaugaaaauuacaacag

SEQ ID NO: 454128 - RNA, 20 nt, Homo sapiens
ugacaugugacaucuaccuc

SEQ ID NO: 454129 - RNA, 16 nt, Homo sapiens
ugacauucuucacugu

SEQ ID NO: 454130 - RNA, 16 nt, Homo sapiens
ugacauuguauguauc

SEQ ID NO: 454131 - RNA, 13 nt, Homo sapiens
ugaccacacugua

SEQ ID NO: 454132 - RNA, 18 nt, Homo sapiens
ugaccacauccaccuuua

SEQ ID NO: 454133 - RNA, 16 nt, Homo sapiens
ugaccacuuguagucc

SEQ ID NO: 454134 - RNA, 16 nt, Homo sapiens
ugaccagaaaauauga

SEQ ID NO: 454135 - RNA, 15 nt, Homo sapiens
ugaccagacugcaca

SEQ ID NO: 454136 - RNA, 17 nt, Homo sapiens
ugaccagagcaccucag

SEQ ID NO: 454137 - RNA, 16 nt, Homo sapiens
ugaccagcaacuuguc

SEQ ID NO: 454138 - RNA, 22 nt, Homo sapiens
ugaccauaaaggcauggcauuu

SEQ ID NO: 454139 - RNA, 12 nt, Homo sapiens
ugaccaugugau

SEQ ID NO: 454140 - RNA, 15 nt, Homo sapiens
ugacccacugaucuc

SEQ ID NO: 454141 - RNA, 20 nt, Homo sapiens
ugaccccacuuaugcugcug

SEQ ID NO: 454142 - RNA, 17 nt, Homo sapiens
ugacccccugcugccau

SEQ ID NO: 454143 - RNA, 16 nt, Homo sapiens
ugaccccugaccucac

SEQ ID NO: 454144 - RNA, 12 nt, Homo sapiens
ugacccucucac

SEQ ID NO: 454145 - RNA, 15 nt, Homo sapiens
ugaccggaucuacac

SEQ ID NO: 454146 - RNA, 15 nt, Homo sapiens
ugaccucccacuuug

SEQ ID NO: 454147 - RNA, 14 nt, Homo sapiens
ugaccucccaguga

SEQ ID NO: 454148 - RNA, 15 nt, Homo sapiens
ugaccucccagugac

SEQ ID NO: 454149 - RNA, 16 nt, Homo sapiens
ugaccuggcaucuugg

SEQ ID NO: 454150 - RNA, 14 nt, Homo sapiens
ugaccugugaccag

SEQ ID NO: 454151 - RNA, 17 nt, Homo sapiens
ugaccugugaccagcac

SEQ ID NO: 454152 - RNA, 14 nt, Homo sapiens
ugaccuugagcaaa

SEQ ID NO: 454153 - RNA, 18 nt, Homo sapiens
ugaccuugggguacaauu

SEQ ID NO: 454154 - RNA, 19 nt, Homo sapiens
ugaccuugggguacaauug

SEQ ID NO: 454155 - RNA, 18 nt, Homo sapiens
ugacgcggcucaaaagga

SEQ ID NO: 454156 - RNA, 15 nt, Homo sapiens
ugacggcaccaucug

SEQ ID NO: 454157 - RNA, 19 nt, Homo sapiens
ugacggcaccaucuggaag

SEQ ID NO: 454158 - RNA, 15 nt, Homo sapiens
ugacggcccugcaau

SEQ ID NO: 454159 - RNA, 17 nt, Homo sapiens
ugacgguguccaugccu

SEQ ID NO: 454160 - RNA, 20 nt, Homo sapiens
ugacgguguccaugccuucc

SEQ ID NO: 454161 - RNA, 23 nt, Homo sapiens
ugacgugaguggggaggagacuc

SEQ ID NO: 454162 - RNA, 11 nt, Homo sapiens
ugacuaaagag

SEQ ID NO: 454163 - RNA, 12 nt, Homo sapiens
ugacuaaccauu

SEQ ID NO: 454164 - RNA, 14 nt, Homo sapiens
ugacuagugcugaa

SEQ ID NO: 454165 - RNA, 13 nt, Homo sapiens
ugacuauggggaa

SEQ ID NO: 454166 - RNA, 16 nt, Homo sapiens
ugacuauuuauacaaa

SEQ ID NO: 454167 - RNA, 14 nt, Homo sapiens
ugacucagaauauu

SEQ ID NO: 454168 - RNA, 23 nt, Homo sapiens
ugacucaggauuuaaaaacugga

SEQ ID NO: 454169 - RNA, 21 nt, Homo sapiens
ugacucggucugagaagauuc

SEQ ID NO: 454170 - RNA, 21 nt, Homo sapiens
ugacucugaguccacugcucc

SEQ ID NO: 454171 - RNA, 15 nt, Homo sapiens
ugacugaaacauuca

SEQ ID NO: 454172 - RNA, 21 nt, Homo sapiens
ugacugaauuugggccucuug

SEQ ID NO: 454173 - RNA, 19 nt, Homo sapiens
ugacugauccugaacaaga

SEQ ID NO: 454174 - RNA, 17 nt, Homo sapiens
ugacugcacccagcucc

SEQ ID NO: 454175 - RNA, 21 nt, Homo sapiens
ugacugccucugccugucgca

SEQ ID NO: 454176 - RNA, 14 nt, Homo sapiens
ugacuggacugugu

SEQ ID NO: 454177 - RNA, 15 nt, Homo sapiens
ugacuggcaguauua

SEQ ID NO: 454178 - RNA, 16 nt, Homo sapiens
ugacuggggagucuga

SEQ ID NO: 454179 - RNA, 13 nt, Homo sapiens
ugacugggggccu

SEQ ID NO: 454180 - RNA, 20 nt, Homo sapiens
ugacuguguguggaggaguc

SEQ ID NO: 454181 - RNA, 17 nt, Homo sapiens
ugacuucuuuuuggcau

SEQ ID NO: 454182 - RNA, 14 nt, Homo sapiens
ugagaaaaaaacag

SEQ ID NO: 454183 - RNA, 17 nt, Homo sapiens
ugagaaauaaagcacau

SEQ ID NO: 454184 - RNA, 18 nt, Homo sapiens
ugagaacaaauacaauuc

SEQ ID NO: 454185 - RNA, 22 nt, Homo sapiens
ugagaacagaucuccaaagcuu

SEQ ID NO: 454186 - RNA, 17 nt, Homo sapiens
ugagaacugacuuucuc

SEQ ID NO: 454187 - RNA, 16 nt, Homo sapiens
ugagaagaacacauca

SEQ ID NO: 454188 - RNA, 19 nt, Homo sapiens
ugagaaguaauuccucuga

SEQ ID NO: 454189 - RNA, 19 nt, Homo sapiens
ugagaagucaaacauuuca

SEQ ID NO: 454190 - RNA, 18 nt, Homo sapiens
ugagaauauuaauugugg

SEQ ID NO: 454191 - RNA, 13 nt, Homo sapiens
ugagacaagcccu

SEQ ID NO: 454192 - RNA, 22 nt, Homo sapiens
gcugugucacacucuguguuuu

SEQ ID NO: 454193 - RNA, 13 nt, Homo sapiens
gcugugugcaguc

SEQ ID NO: 454194 - RNA, 18 nt, Homo sapiens
gcuguguucacacuguaa

SEQ ID NO: 454195 - RNA, 14 nt, Homo sapiens
gcuguugcauuuag

SEQ ID NO: 454196 - RNA, 14 nt, Homo sapiens
gcuguuuuauaugu

SEQ ID NO: 454197 - RNA, 17 nt, Homo sapiens
gcuuaagcgauucucau

SEQ ID NO: 454198 - RNA, 22 nt, Homo sapiens
gcuuaaucuagagcuaugcaca

SEQ ID NO: 454199 - RNA, 12 nt, Homo sapiens
gcuuaaucugag

SEQ ID NO: 454200 - RNA, 11 nt, Homo sapiens
gcuuacaggaa

SEQ ID NO: 454201 - RNA, 15 nt, Homo sapiens
gcuuagaauggggcu

SEQ ID NO: 454202 - RNA, 20 nt, Homo sapiens
gcuuauaaauggcaccacau

SEQ ID NO: 454203 - RNA, 20 nt, Homo sapiens
gcuuaucucccugcuucaua

SEQ ID NO: 454204 - RNA, 12 nt, Homo sapiens
gcuuaugauuca

SEQ ID NO: 454205 - RNA, 20 nt, Homo sapiens
gcuuauucaucuguuuuucu

SEQ ID NO: 454206 - RNA, 15 nt, Homo sapiens
gcuuauucuugagca

SEQ ID NO: 454207 - RNA, 23 nt, Homo sapiens
gcuucaaaacagaacggguucuc

SEQ ID NO: 454208 - RNA, 15 nt, Homo sapiens
gcuucaaccccauga

SEQ ID NO: 454209 - RNA, 14 nt, Homo sapiens
gcuucaaccuugag

SEQ ID NO: 454210 - RNA, 14 nt, Homo sapiens
gcuucaagagccag

SEQ ID NO: 454211 - RNA, 17 nt, Homo sapiens
gcuucaccagucugucu

SEQ ID NO: 454212 - RNA, 19 nt, Homo sapiens
gcuucaccccugcacuuca

SEQ ID NO: 454213 - RNA, 16 nt, Homo sapiens
gcuucacggacaggaa

SEQ ID NO: 454214 - RNA, 12 nt, Homo sapiens
gcuucaguccac

SEQ ID NO: 454215 - RNA, 22 nt, Homo sapiens
gcuucaugcaauccuuccaaau

SEQ ID NO: 454216 - RNA, 21 nt, Homo sapiens
gcuuccaaugugguggcaaua

SEQ ID NO: 454217 - RNA, 12 nt, Homo sapiens
gcuuccacucag

SEQ ID NO: 454218 - RNA, 20 nt, Homo sapiens
gcuucccaagcagcugggau

SEQ ID NO: 454219 - RNA, 20 nt, Homo sapiens
gcuuccgcugucacccagca

SEQ ID NO: 454220 - RNA, 12 nt, Homo sapiens
gcuuccuaacug

SEQ ID NO: 454221 - RNA, 21 nt, Homo sapiens
gcuuccuccugguguggaaga

SEQ ID NO: 454222 - RNA, 17 nt, Homo sapiens
gcuucuaugguugacau

SEQ ID NO: 454223 - RNA, 20 nt, Homo sapiens
gcuucuccuucuccuuccca

SEQ ID NO: 454224 - RNA, 22 nt, Homo sapiens
gcuucuccuucuccuucccauu

SEQ ID NO: 454225 - RNA, 22 nt, Homo sapiens
gcuucucugagcuccaguggaa

SEQ ID NO: 454226 - RNA, 19 nt, Homo sapiens
gcuucucugugacugaugu

SEQ ID NO: 454227 - RNA, 20 nt, Homo sapiens
gcuucucuugcuaccuguga

SEQ ID NO: 454228 - RNA, 20 nt, Homo sapiens
gcuucugagagcaaagggaa

SEQ ID NO: 454229 - RNA, 19 nt, Homo sapiens
gcuugaaaaggugaccuug

SEQ ID NO: 454230 - RNA, 23 nt, Homo sapiens
gcuugagcuccccuggagccagc

SEQ ID NO: 454231 - RNA, 16 nt, Homo sapiens
gcuugggaucuucaau

SEQ ID NO: 454232 - RNA, 17 nt, Homo sapiens
gcuugggccacugcccu

SEQ ID NO: 454233 - RNA, 13 nt, Homo sapiens
gcuugucaggggg

SEQ ID NO: 454234 - RNA, 11 nt, Homo sapiens
gcuuguguuaa

SEQ ID NO: 454235 - RNA, 17 nt, Homo sapiens
gcuuguuauaacgcaaa

SEQ ID NO: 454236 - RNA, 21 nt, Homo sapiens
gcuuguuuacagcacuacucu

SEQ ID NO: 454237 - RNA, 21 nt, Homo sapiens
gcuuguuuucuacuuugccac

SEQ ID NO: 454238 - RNA, 20 nt, Homo sapiens
gcuuuaaacacccuucacau

SEQ ID NO: 454239 - RNA, 14 nt, Homo sapiens
gcuuuaacaaaaca

SEQ ID NO: 454240 - RNA, 14 nt, Homo sapiens
gcuuuagcacagga

SEQ ID NO: 454241 - RNA, 19 nt, Homo sapiens
gcuuuauaccccauuugau

SEQ ID NO: 454242 - RNA, 20 nt, Homo sapiens
gcuuucauaaacuucaggga

SEQ ID NO: 454243 - RNA, 20 nt, Homo sapiens
gcuuuccacauuugucacag

SEQ ID NO: 454244 - RNA, 16 nt, Homo sapiens
gcuuucccaggcagcu

SEQ ID NO: 454245 - RNA, 14 nt, Homo sapiens
gcuuucucuucuaa

SEQ ID NO: 454246 - RNA, 20 nt, Homo sapiens
gcuuucuuaacuauccuaac

SEQ ID NO: 454247 - RNA, 20 nt, Homo sapiens
gcuuucuucuacaaccagag

SEQ ID NO: 454248 - RNA, 17 nt, Homo sapiens
gcuuucuuucugcauga

SEQ ID NO: 454249 - RNA, 19 nt, Homo sapiens
gcuuugauuguucauauca

SEQ ID NO: 454250 - RNA, 15 nt, Homo sapiens
gcuuugcacaggaaa

SEQ ID NO: 454251 - RNA, 19 nt, Homo sapiens
gcuuuggacacacacagcu

SEQ ID NO: 454252 - RNA, 20 nt, Homo sapiens
gcuuuggcucgggacuucaa

SEQ ID NO: 454253 - RNA, 13 nt, Homo sapiens
gcuuuggggagcg

SEQ ID NO: 454254 - RNA, 14 nt, Homo sapiens
gcuuuggugccugg

SEQ ID NO: 454255 - RNA, 23 nt, Homo sapiens
gcuuugugcuuguucuuccucuu

SEQ ID NO: 454256 - RNA, 23 nt, Homo sapiens
gcuuuguuaucuuccacuggaaa

SEQ ID NO: 454257 - RNA, 20 nt, Homo sapiens
gcuuuuacuaagcacugugu

SEQ ID NO: 454258 - RNA, 17 nt, Homo sapiens
gcuuuuauccacuggca

SEQ ID NO: 454259 - RNA, 18 nt, Homo sapiens
gcuuuucagccaauuugu

SEQ ID NO: 454260 - RNA, 20 nt, Homo sapiens
gcuuuucuaaucugcagugg

SEQ ID NO: 454261 - RNA, 13 nt, Homo sapiens
gcuuuucugcaau

SEQ ID NO: 454262 - RNA, 12 nt, Homo sapiens
gcuuuugaacug

SEQ ID NO: 454263 - RNA, 19 nt, Homo sapiens
gcuuuuucaaaguguugau

SEQ ID NO: 454264 - RNA, 20 nt, Homo sapiens
ggaaaaaaguuuugaugaaa

SEQ ID NO: 454265 - RNA, 17 nt, Homo sapiens
ggaaaaaauuagacaag

SEQ ID NO: 454266 - RNA, 21 nt, Homo sapiens
ggaaaaaucuuggauuaugaa

SEQ ID NO: 454267 - RNA, 22 nt, Homo sapiens
ggaaaaauggauccccagugaa

SEQ ID NO: 454268 - RNA, 17 nt, Homo sapiens
ggaaaacucaccauuuc

SEQ ID NO: 454269 - RNA, 20 nt, Homo sapiens
ggaaaacugagacucagaca

SEQ ID NO: 454270 - RNA, 17 nt, Homo sapiens
ggaaaagaaauugcaug

SEQ ID NO: 454271 - RNA, 21 nt, Homo sapiens
ggaaaagaaauugcaugcagu

SEQ ID NO: 454272 - RNA, 16 nt, Homo sapiens
ggaaaagaguaucaaa

SEQ ID NO: 454273 - RNA, 18 nt, Homo sapiens
ggaaaagauuucugucca

SEQ ID NO: 454274 - RNA, 16 nt, Homo sapiens
ggaaaaggcuggcaag

SEQ ID NO: 454275 - RNA, 20 nt, Homo sapiens
ggaaaaugcaaugucuuaaa

SEQ ID NO: 454276 - RNA, 14 nt, Homo sapiens
ggaaacaauaucaa

SEQ ID NO: 454277 - RNA, 17 nt, Homo sapiens
ggaaacucagaugucca

SEQ ID NO: 454278 - RNA, 17 nt, Homo sapiens
ggaaacugcuccagcuc

SEQ ID NO: 454279 - RNA, 18 nt, Homo sapiens
ggaaacuguugccagaga

SEQ ID NO: 454280 - RNA, 15 nt, Homo sapiens
ggaaagcagccguuu

SEQ ID NO: 454281 - RNA, 20 nt, Homo sapiens
ggaaagccauugaccaccca

SEQ ID NO: 454282 - RNA, 23 nt, Homo sapiens
ggaaaggcaucuaagacauucac

SEQ ID NO: 454283 - RNA, 13 nt, Homo sapiens
ggaaaggugcuca

SEQ ID NO: 454284 - RNA, 15 nt, Homo sapiens
ggaaaggugcucaaa

SEQ ID NO: 454285 - RNA, 21 nt, Homo sapiens
ggaaaucauugugugucuuca

SEQ ID NO: 454286 - RNA, 15 nt, Homo sapiens
ggaaaugcugacuuu

SEQ ID NO: 454287 - RNA, 12 nt, Homo sapiens
ggaaauugcaaa

SEQ ID NO: 454288 - RNA, 22 nt, Homo sapiens
ggaaccucccuagguccuuccc

SEQ ID NO: 454289 - RNA, 21 nt, Homo sapiens
ggaacucuuccuggaaugcau

SEQ ID NO: 454290 - RNA, 18 nt, Homo sapiens
ggaagaacuugucccuca

SEQ ID NO: 454291 - RNA, 21 nt, Homo sapiens
ggaagaagcaaaccugauaca

SEQ ID NO: 454292 - RNA, 16 nt, Homo sapiens
ggaagaauaaaaaaga

SEQ ID NO: 454293 - RNA, 20 nt, Homo sapiens
ggaagaccagcuuugcagug

SEQ ID NO: 454294 - RNA, 20 nt, Homo sapiens
ggaagaguucugaucuguac

SEQ ID NO: 454295 - RNA, 23 nt, Homo sapiens
ggaagaucuugagagcugcugag

SEQ ID NO: 454296 - RNA, 22 nt, Homo sapiens
ggaagcacagcagguuuaucca

SEQ ID NO: 454297 - RNA, 20 nt, Homo sapiens
ggaagcaccuaaaugaugcc

SEQ ID NO: 454298 - RNA, 16 nt, Homo sapiens
ggaagcacugccauua

SEQ ID NO: 454299 - RNA, 19 nt, Homo sapiens
ggaagcaucugucuuguca

SEQ ID NO: 454300 - RNA, 22 nt, Homo sapiens
ggaagccgccuagugcagagag

SEQ ID NO: 454301 - RNA, 17 nt, Homo sapiens
ggaagccggcggcccaa

SEQ ID NO: 454302 - RNA, 19 nt, Homo sapiens
ggaaggaugacuugacaag

SEQ ID NO: 454303 - RNA, 14 nt, Homo sapiens
ggaaggcuugcagu

SEQ ID NO: 454304 - RNA, 14 nt, Homo sapiens
ggaagggaggucuc

SEQ ID NO: 454305 - RNA, 20 nt, Homo sapiens
ggaagggucuuaacacuuac

SEQ ID NO: 454306 - RNA, 19 nt, Homo sapiens
ggaaguuauguuguucaaa

SEQ ID NO: 454307 - RNA, 15 nt, Homo sapiens
ggaauaaggccuuaa

SEQ ID NO: 454308 - RNA, 22 nt, Homo sapiens
ggaauacucuuggucaccucaa

SEQ ID NO: 454309 - RNA, 18 nt, Homo sapiens
ggaaucuuuuacugugga

SEQ ID NO: 454310 - RNA, 13 nt, Homo sapiens
ggaaugacuuggg

SEQ ID NO: 454311 - RNA, 13 nt, Homo sapiens
ugcugcuguggaa

SEQ ID NO: 454312 - RNA, 19 nt, Homo sapiens
ugcugcuuugcuucuucaa

SEQ ID NO: 454313 - RNA, 18 nt, Homo sapiens
ugcuggaaaaucuguaaa

SEQ ID NO: 454314 - RNA, 16 nt, Homo sapiens
ugcuggaaaugcugac

SEQ ID NO: 454315 - RNA, 15 nt, Homo sapiens
ugcuggcacagacuu

SEQ ID NO: 454316 - RNA, 13 nt, Homo sapiens
ugcuggcauuugc

SEQ ID NO: 454317 - RNA, 14 nt, Homo sapiens
ugcuggcauuugca

SEQ ID NO: 454318 - RNA, 21 nt, Homo sapiens
ugcuggcuccacgcccugggg

SEQ ID NO: 454319 - RNA, 14 nt, Homo sapiens
ugcuggcugccuua

SEQ ID NO: 454320 - RNA, 14 nt, Homo sapiens
ugcugggacagcua

SEQ ID NO: 454321 - RNA, 23 nt, Homo sapiens
ugcugggauuacaggcgugaucc

SEQ ID NO: 454322 - RNA, 14 nt, Homo sapiens
uucuacaaccagag

SEQ ID NO: 454323 - RNA, 15 nt, Homo sapiens
uucuacauucucuau

SEQ ID NO: 454324 - RNA, 13 nt, Homo sapiens
uucuaccaaaugu

SEQ ID NO: 454325 - RNA, 13 nt, Homo sapiens
uucuacuuugcca

SEQ ID NO: 454326 - RNA, 21 nt, Homo sapiens
uucuacuuuuuccuuccugcc

SEQ ID NO: 454327 - RNA, 20 nt, Homo sapiens
uucuagacaguauugccacc

SEQ ID NO: 454328 - RNA, 17 nt, Homo sapiens
uucuagguaggggccca

SEQ ID NO: 454329 - RNA, 18 nt, Homo sapiens
uucuagugauuucugggg

SEQ ID NO: 454330 - RNA, 24 nt, Homo sapiens
uucuaguuuugucaaacuguagaa

SEQ ID NO: 454331 - RNA, 23 nt, Homo sapiens
uucuauccugaguaguaaucuca

SEQ ID NO: 454332 - RNA, 16 nt, Homo sapiens
uucuauggauucacuu

SEQ ID NO: 454333 - RNA, 16 nt, Homo sapiens
uucuauguagaacugu

SEQ ID NO: 454334 - RNA, 22 nt, Homo sapiens
uucuaugugaccagacugcaca

SEQ ID NO: 454335 - RNA, 20 nt, Homo sapiens
uucuauuagcuuacugauua

SEQ ID NO: 454336 - RNA, 17 nt, Homo sapiens
uucucagcaaguguaca

SEQ ID NO: 454337 - RNA, 21 nt, Homo sapiens
uucucaucccccagccacagu

SEQ ID NO: 454338 - RNA, 16 nt, Homo sapiens
uucucaugcacugcaa

SEQ ID NO: 454339 - RNA, 22 nt, Homo sapiens
uucucaugugcuuuguagcuua

SEQ ID NO: 454340 - RNA, 17 nt, Homo sapiens
uucucauugaucacaga

SEQ ID NO: 454341 - RNA, 17 nt, Homo sapiens
uucucauuuagcauuga

SEQ ID NO: 454342 - RNA, 19 nt, Homo sapiens
guagaaacacaguuuugaa

SEQ ID NO: 454343 - RNA, 14 nt, Homo sapiens
guagaaagccaaau

SEQ ID NO: 454344 - RNA, 18 nt, Homo sapiens
guagaaauaauaugcauu

SEQ ID NO: 454345 - RNA, 22 nt, Homo sapiens
guagaacagauaaucagugugu

SEQ ID NO: 454346 - RNA, 12 nt, Homo sapiens
guagacauacuu

SEQ ID NO: 454347 - RNA, 14 nt, Homo sapiens
guagacauacuugu

SEQ ID NO: 454348 - RNA, 17 nt, Homo sapiens
guagacuagugccguag

SEQ ID NO: 454349 - RNA, 21 nt, Homo sapiens
guagacucacgcugacugcag

SEQ ID NO: 454350 - RNA, 14 nt, Homo sapiens
guagagccagccuu

SEQ ID NO: 454351 - RNA, 22 nt, Homo sapiens
guagagggaguugucaagucuc

SEQ ID NO: 454352 - RNA, 15 nt, Homo sapiens
guagaguuugaucau

SEQ ID NO: 454353 - RNA, 23 nt, Homo sapiens
guagauacaaucagcugcuuugu

SEQ ID NO: 454354 - RNA, 20 nt, Homo sapiens
guagcauuugggucugagau

SEQ ID NO: 454355 - RNA, 16 nt, Homo sapiens
guagccaggaagcccc

SEQ ID NO: 454356 - RNA, 22 nt, Homo sapiens
guagcccugcaccugccaguga

SEQ ID NO: 454357 - RNA, 22 nt, Homo sapiens
guagccuuagugucaccuuucu

SEQ ID NO: 454358 - RNA, 20 nt, Homo sapiens
guagcgagcugcucugcuau

SEQ ID NO: 454359 - RNA, 20 nt, Homo sapiens
guagcuaggugcacauauac

SEQ ID NO: 454360 - RNA, 21 nt, Homo sapiens
guagcuauuuuucuuguugca

SEQ ID NO: 454361 - RNA, 16 nt, Homo sapiens
guagcucuccugacuu

SEQ ID NO: 454362 - RNA, 12 nt, Homo sapiens
guagcugaugaa

SEQ ID NO: 454363 - RNA, 11 nt, Homo sapiens
guagcugugcg

SEQ ID NO: 454364 - RNA, 22 nt, Homo sapiens
guagcuuuccacauuugucaca

SEQ ID NO: 454365 - RNA, 21 nt, Homo sapiens
guagcuuuucccaaacugauc

SEQ ID NO: 454366 - RNA, 22 nt, Homo sapiens
guaggaaagcaccgcagcaugu

SEQ ID NO: 454367 - RNA, 20 nt, Homo sapiens
guaggagcugagcuuuccag

SEQ ID NO: 454368 - RNA, 23 nt, Homo sapiens
guaggcauucuuuagucuacaua

SEQ ID NO: 454369 - RNA, 21 nt, Homo sapiens
guaguccaggcugucccugaa

SEQ ID NO: 454370 - RNA, 15 nt, Homo sapiens
guagucucauuacuu

SEQ ID NO: 454371 - RNA, 16 nt, Homo sapiens
guaguuagccaucuaa

SEQ ID NO: 454372 - RNA, 20 nt, Homo sapiens
guauaaacacaauccuuugu

SEQ ID NO: 454373 - RNA, 19 nt, Homo sapiens
guauaacacaauaugaaua

SEQ ID NO: 454374 - RNA, 20 nt, Homo sapiens
guauaaccccaccuugccaa

SEQ ID NO: 454375 - RNA, 19 nt, Homo sapiens
guauaccaccuguacauac

SEQ ID NO: 454376 - RNA, 11 nt, Homo sapiens
guauacugugu

SEQ ID NO: 454377 - RNA, 16 nt, Homo sapiens
guauagaguacugcag

SEQ ID NO: 454378 - RNA, 16 nt, Homo sapiens
guauaugaacuuaaca

SEQ ID NO: 454379 - RNA, 23 nt, Homo sapiens
guauaugaacuuaacaugcugug

SEQ ID NO: 454380 - RNA, 15 nt, Homo sapiens
guauaugcaugcuga

SEQ ID NO: 454381 - RNA, 13 nt, Homo sapiens
guauaugcugaug

SEQ ID NO: 454382 - RNA, 15 nt, Homo sapiens
guauauggugauuca

SEQ ID NO: 454383 - RNA, 21 nt, Homo sapiens
guaucaaaaugaaugccaguc

SEQ ID NO: 454384 - RNA, 21 nt, Homo sapiens
guaucaugauugauugaauca

SEQ ID NO: 454385 - RNA, 12 nt, Homo sapiens
guaucauucaac

SEQ ID NO: 454386 - RNA, 19 nt, Homo sapiens
guauccaauuaugugacaa

SEQ ID NO: 454387 - RNA, 16 nt, Homo sapiens
guaucccugcucugcu

SEQ ID NO: 454388 - RNA, 10 nt, Homo sapiens
guauccucca

SEQ ID NO: 454389 - RNA, 20 nt, Homo sapiens
guaugauggcaggagaauca

SEQ ID NO: 454390 - RNA, 15 nt, Homo sapiens
guaugcaugggaugu

SEQ ID NO: 454391 - RNA, 21 nt, Homo sapiens
guaugccuuuaaaucugugau

SEQ ID NO: 454392 - RNA, 14 nt, Homo sapiens
guaugguaggguaa

SEQ ID NO: 454393 - RNA, 14 nt, Homo sapiens
guaugucugccuaa

SEQ ID NO: 454394 - RNA, 16 nt, Homo sapiens
guaugugcacugucac

SEQ ID NO: 454395 - RNA, 21 nt, Homo sapiens
guauguucccucuugucccuu

SEQ ID NO: 454396 - RNA, 21 nt, Homo sapiens
guauguugguuuuuuagugca

SEQ ID NO: 454397 - RNA, 13 nt, Homo sapiens
guauuaaagacag

SEQ ID NO: 454398 - RNA, 22 nt, Homo sapiens
guauuaaccuaccugugaauca

SEQ ID NO: 454399 - RNA, 22 nt, Homo sapiens
guauuaauguguuaagugcagg

SEQ ID NO: 454400 - RNA, 14 nt, Homo sapiens
guauuaccuauuca

SEQ ID NO: 454401 - RNA, 17 nt, Homo sapiens
guauuauauaauucaag

SEQ ID NO: 454402 - RNA, 18 nt, Homo sapiens
guauuaugcaaaguacca

SEQ ID NO: 454403 - RNA, 19 nt, Homo sapiens
guauucccaccccuggacu

SEQ ID NO: 454404 - RNA, 21 nt, Homo sapiens
guauucuagugaaugaaucuc

SEQ ID NO: 454405 - RNA, 17 nt, Homo sapiens
guauuuggauaucuguu

SEQ ID NO: 454406 - RNA, 22 nt, Homo sapiens
guauuuucaucaaguagcguug

SEQ ID NO: 454407 - RNA, 16 nt, Homo sapiens
guauuuugaaaacacu

SEQ ID NO: 454408 - RNA, 12 nt, Homo sapiens
guauuuugccac

SEQ ID NO: 454409 - RNA, 15 nt, Homo sapiens
gucaaaccugcaaau

SEQ ID NO: 454410 - RNA, 13 nt, Homo sapiens
gucaaacuguaga

SEQ ID NO: 454411 - RNA, 17 nt, Homo sapiens
gucaaauaaagcaaagu

SEQ ID NO: 454412 - RNA, 19 nt, Homo sapiens
gucaacauuuuugauucua

SEQ ID NO: 454413 - RNA, 16 nt, Homo sapiens
gucaacuuucauuuga

SEQ ID NO: 454414 - RNA, 14 nt, Homo sapiens
gucacaacacugaa

SEQ ID NO: 454415 - RNA, 21 nt, Homo sapiens
gucacaauccuaacacauuau

SEQ ID NO: 454416 - RNA, 18 nt, Homo sapiens
gucacaggacgauuucac

SEQ ID NO: 454417 - RNA, 22 nt, Homo sapiens
gucacaggggugucuugucuga

SEQ ID NO: 454418 - RNA, 20 nt, Homo sapiens
gucacaggguguuggaagau

SEQ ID NO: 454419 - RNA, 19 nt, Homo sapiens
gucacaucucugccuggaa

SEQ ID NO: 454420 - RNA, 16 nt, Homo sapiens
gucacccuucugggca

SEQ ID NO: 454421 - RNA, 20 nt, Homo sapiens
gucaccggccuugugacauu

SEQ ID NO: 454422 - RNA, 11 nt, Homo sapiens
gucaccuuccu

SEQ ID NO: 454423 - RNA, 21 nt, Homo sapiens
gucacugacucaagacacuga

SEQ ID NO: 454424 - RNA, 18 nt, Homo sapiens
gucacuuuccucuuccac

SEQ ID NO: 454425 - RNA, 19 nt, Homo sapiens
gucacuuuuuuccugucaa

SEQ ID NO: 454426 - RNA, 23 nt, Homo sapiens
gucagaauuucuuugucauucaa

SEQ ID NO: 454427 - RNA, 16 nt, Homo sapiens
gucagacaagccugag

SEQ ID NO: 454428 - RNA, 15 nt, Homo sapiens
gucagaccaguacug

SEQ ID NO: 454429 - RNA, 18 nt, Homo sapiens
gucagaccaguacuggga

SEQ ID NO: 454430 - RNA, 16 nt, Homo sapiens
gucagccuugcaucaa

SEQ ID NO: 454431 - RNA, 20 nt, Homo sapiens
gucagccuugcaucaagggc

SEQ ID NO: 454432 - RNA, 14 nt, Homo sapiens
gucaggagccagca

SEQ ID NO: 454433 - RNA, 21 nt, Homo sapiens
gucaggcucugaaucucucaa

SEQ ID NO: 454434 - RNA, 15 nt, Homo sapiens
gucaggcugcagagg

SEQ ID NO: 454435 - RNA, 16 nt, Homo sapiens
gucagguaguugcaau

SEQ ID NO: 454436 - RNA, 19 nt, Homo sapiens
gucaggugccucaagagaa

SEQ ID NO: 454437 - RNA, 15 nt, Homo sapiens
gucagucccuacuua

SEQ ID NO: 454438 - RNA, 11 nt, Homo sapiens
gucagugcagc

SEQ ID NO: 454439 - RNA, 23 nt, Homo sapiens
gucaguugcaaauuuuagcguua

SEQ ID NO: 454440 - RNA, 13 nt, Homo sapiens
gucauaaugucau

SEQ ID NO: 454441 - RNA, 18 nt, Homo sapiens
gucauacgaaccuaaaga

SEQ ID NO: 454442 - RNA, 19 nt, Homo sapiens
gucauauauggggggccaa

SEQ ID NO: 454443 - RNA, 21 nt, Homo sapiens
gucauauauuuuuugcuacuu

SEQ ID NO: 454444 - RNA, 21 nt, Homo sapiens
gucaucucucacacauuccag

SEQ ID NO: 454445 - RNA, 17 nt, Homo sapiens
gucauggaaaauguccu

SEQ ID NO: 454446 - RNA, 19 nt, Homo sapiens
gucauucaagccugugaau

SEQ ID NO: 454447 - RNA, 20 nt, Homo sapiens
gucauuccaaauaugagaug

SEQ ID NO: 454448 - RNA, 22 nt, Homo sapiens
gucauugaaggguguucaccca

SEQ ID NO: 454449 - RNA, 21 nt, Homo sapiens
gucauuguaaccucgugucua

SEQ ID NO: 454450 - RNA, 18 nt, Homo sapiens
gucauuuuuuaagugacu

SEQ ID NO: 454451 - RNA, 20 nt, Homo sapiens
guccaaaauaucgagugaau

SEQ ID NO: 454452 - RNA, 19 nt, Homo sapiens
guccaagugugugugcgug

SEQ ID NO: 454453 - RNA, 16 nt, Homo sapiens
guccaaucacauucag

SEQ ID NO: 454454 - RNA, 17 nt, Homo sapiens
guccacccccauuguga

SEQ ID NO: 454455 - RNA, 20 nt, Homo sapiens
guccaccgaccagacccugg

SEQ ID NO: 454456 - RNA, 17 nt, Homo sapiens
guccaccugccuaucca

SEQ ID NO: 454457 - RNA, 17 nt, Homo sapiens
guccaccugugcugcug

SEQ ID NO: 454458 - RNA, 12 nt, Homo sapiens
guccacugugac

SEQ ID NO: 454459 - RNA, 12 nt, Homo sapiens
guccacuuuccc

SEQ ID NO: 454460 - RNA, 17 nt, Homo sapiens
guccagccaacauuuaa

SEQ ID NO: 454461 - RNA, 19 nt, Homo sapiens
guccaggcccaaggaguaa

SEQ ID NO: 454462 - RNA, 15 nt, Homo sapiens
guccaguuucccaaa

SEQ ID NO: 454463 - RNA, 22 nt, Homo sapiens
guccaucugucuguccuacccg

SEQ ID NO: 454464 - RNA, 18 nt, Homo sapiens
guccaugugugugcaagu

SEQ ID NO: 454465 - RNA, 23 nt, Homo sapiens
guccauuuaccuggaaaccagaa

SEQ ID NO: 454466 - RNA, 13 nt, Homo sapiens
gucccaccaacuc

SEQ ID NO: 454467 - RNA, 20 nt, Homo sapiens
gucccagagguuaucugccu

SEQ ID NO: 454468 - RNA, 12 nt, Homo sapiens
gucccaucucac

SEQ ID NO: 454469 - RNA, 15 nt, Homo sapiens
gucccauugauguac

SEQ ID NO: 454470 - RNA, 12 nt, Homo sapiens
gucccuuaccug

SEQ ID NO: 454471 - RNA, 13 nt, Homo sapiens
gucccuuaccugg

SEQ ID NO: 454472 - RNA, 17 nt, Homo sapiens
guccgcgcgccagcaca

SEQ ID NO: 454473 - RNA, 19 nt, Homo sapiens
uucuccaaaggcacugacc

SEQ ID NO: 454474 - RNA, 14 nt, Homo sapiens
uucuccaaaugaga

SEQ ID NO: 454475 - RNA, 15 nt, Homo sapiens
uucuccaaccacuca

SEQ ID NO: 454476 - RNA, 17 nt, Homo sapiens
uucuccaacccaaagua

SEQ ID NO: 454477 - RNA, 11 nt, Homo sapiens
uucuccacugg

SEQ ID NO: 454478 - RNA, 19 nt, Homo sapiens
uucuccaggcccucagaug

SEQ ID NO: 454479 - RNA, 18 nt, Homo sapiens
uucucccuugauuccacu

SEQ ID NO: 454480 - RNA, 22 nt, Homo sapiens
uucuccggccccgccucugccc

SEQ ID NO: 454481 - RNA, 11 nt, Homo sapiens
uucuccugacc

SEQ ID NO: 454482 - RNA, 21 nt, Homo sapiens
uucuccugauccucuugccac

SEQ ID NO: 454483 - RNA, 13 nt, Homo sapiens
uucuccuuguaaa

SEQ ID NO: 454484 - RNA, 16 nt, Homo sapiens
uucucgugacaccacc

SEQ ID NO: 454485 - RNA, 19 nt, Homo sapiens
uucucgugguagaagccag

SEQ ID NO: 454486 - RNA, 20 nt, Homo sapiens
uucucgugguagaagccagu

SEQ ID NO: 454487 - RNA, 21 nt, Homo sapiens
uucucucaaaugauacaguca

SEQ ID NO: 454488 - RNA, 19 nt, Homo sapiens
uucucucuguguggcaaac

SEQ ID NO: 454489 - RNA, 16 nt, Homo sapiens
uucucucuuugucccg

SEQ ID NO: 454490 - RNA, 18 nt, Homo sapiens
uucucugccccguuucuu

SEQ ID NO: 454491 - RNA, 13 nt, Homo sapiens
uucucugugcucu

SEQ ID NO: 454492 - RNA, 17 nt, Homo sapiens
uucucuucucucuucaa

SEQ ID NO: 454493 - RNA, 15 nt, Homo sapiens
uucugaaacugcaua

SEQ ID NO: 454494 - RNA, 17 nt, Homo sapiens
uucugaaauaacauggc

SEQ ID NO: 454495 - RNA, 14 nt, Homo sapiens
uucugaaccauuac

SEQ ID NO: 454496 - RNA, 17 nt, Homo sapiens
uucugaaccauuacugu

SEQ ID NO: 454497 - RNA, 23 nt, Homo sapiens
uucugaauucauaaaaauaacca

SEQ ID NO: 454498 - RNA, 11 nt, Homo sapiens
uucugacccac

SEQ ID NO: 454499 - RNA, 19 nt, Homo sapiens
uucugagagugaaaccaug

SEQ ID NO: 454500 - RNA, 22 nt, Homo sapiens
uucugauugucuuagacacugu

SEQ ID NO: 454501 - RNA, 22 nt, Homo sapiens
uucugauuugucccuaugcaua

SEQ ID NO: 454502 - RNA, 13 nt, Homo sapiens
uucugcaauucaa

SEQ ID NO: 454503 - RNA, 17 nt, Homo sapiens
uucugcagagacuucua

SEQ ID NO: 454504 - RNA, 20 nt, Homo sapiens
uucugcagcaugaccuguga

SEQ ID NO: 454505 - RNA, 18 nt, Homo sapiens
uucugccacuugcacugu

SEQ ID NO: 454506 - RNA, 22 nt, Homo sapiens
uucugccucacaucagcccugu

SEQ ID NO: 454507 - RNA, 22 nt, Homo sapiens
uucugcucugguuagaaaaagg

SEQ ID NO: 454508 - RNA, 17 nt, Homo sapiens
uucuggcuucaugcaau

SEQ ID NO: 454509 - RNA, 19 nt, Homo sapiens
uucugggugcagcugagaa

SEQ ID NO: 454510 - RNA, 15 nt, Homo sapiens
uucuguaaauggaac

SEQ ID NO: 454511 - RNA, 21 nt, Homo sapiens
uucuguaaauggaacaaacaa

SEQ ID NO: 454512 - RNA, 14 nt, Homo sapiens
uucugucucuauga

SEQ ID NO: 454513 - RNA, 22 nt, Homo sapiens
uucuguuugaaugcggaaccau

SEQ ID NO: 454514 - RNA, 16 nt, Homo sapiens
uucuuacucacacaca

SEQ ID NO: 454515 - RNA, 20 nt, Homo sapiens
uucuuauuuccccuuuccaa

SEQ ID NO: 454516 - RNA, 13 nt, Homo sapiens
uucuucacugucu

SEQ ID NO: 454517 - RNA, 22 nt, Homo sapiens
uucuuccccccaaaacugauua

SEQ ID NO: 454518 - RNA, 18 nt, Homo sapiens
uucuucccucauguucuc

SEQ ID NO: 454519 - RNA, 16 nt, Homo sapiens
uucuucccuuaggcaa

SEQ ID NO: 454520 - RNA, 18 nt, Homo sapiens
uucuuccucuuaccugua

SEQ ID NO: 454521 - RNA, 21 nt, Homo sapiens
uucuuccuugagcuaagcaga

SEQ ID NO: 454522 - RNA, 21 nt, Homo sapiens
uucuuccuuuuguauccucca

SEQ ID NO: 454523 - RNA, 21 nt, Homo sapiens
uucuucuaaugagucgacuuu

SEQ ID NO: 454524 - RNA, 13 nt, Homo sapiens
uucuucuucucaa

SEQ ID NO: 454525 - RNA, 21 nt, Homo sapiens
uucuucuuugacuauaacaaa

SEQ ID NO: 454526 - RNA, 21 nt, Homo sapiens
uucuugauaaagaagauucug

SEQ ID NO: 454527 - RNA, 13 nt, Homo sapiens
uucuugcacugua

SEQ ID NO: 454528 - RNA, 20 nt, Homo sapiens
uucuuggaccccugaauuca

SEQ ID NO: 454529 - RNA, 16 nt, Homo sapiens
uucuuggcuucuggga

SEQ ID NO: 454530 - RNA, 13 nt, Homo sapiens
uucuugugccuca

SEQ ID NO: 454531 - RNA, 14 nt, Homo sapiens
uucuuuaccugaga

SEQ ID NO: 454532 - RNA, 18 nt, Homo sapiens
uucuuuaccuucauuuca

SEQ ID NO: 454533 - RNA, 14 nt, Homo sapiens
uucuuuauauucaa

SEQ ID NO: 454534 - RNA, 15 nt, Homo sapiens
uucuuuaucuugaca

SEQ ID NO: 454535 - RNA, 22 nt, Homo sapiens
uucuuucaauauuuauuuccag

SEQ ID NO: 454536 - RNA, 19 nt, Homo sapiens
uucuuucccaaaaugugcc

SEQ ID NO: 454537 - RNA, 12 nt, Homo sapiens
uucuuucucuca

SEQ ID NO: 454538 - RNA, 14 nt, Homo sapiens
uucuuucugcuaua

SEQ ID NO: 454539 - RNA, 17 nt, Homo sapiens
uucuuugcauucguccu

SEQ ID NO: 454540 - RNA, 20 nt, Homo sapiens
uucuuugcugcagucaucua

SEQ ID NO: 454541 - RNA, 16 nt, Homo sapiens
uucuuuucuccuccuc

SEQ ID NO: 454542 - RNA, 13 nt, Homo sapiens
uucuuuugaacug

SEQ ID NO: 454543 - RNA, 19 nt, Homo sapiens
uucuuuugaaucaaucugg

SEQ ID NO: 454544 - RNA, 20 nt, Homo sapiens
uucuuuuuccacaaggaaua

SEQ ID NO: 454545 - RNA, 20 nt, Homo sapiens
uugaaaaaaaacccuugauu

SEQ ID NO: 454546 - RNA, 19 nt, Homo sapiens
uugaaaauauuucuaugua

SEQ ID NO: 454547 - RNA, 19 nt, Homo sapiens
uugaaaauauuuuguugcc

SEQ ID NO: 454548 - RNA, 13 nt, Homo sapiens
uugaaagaaccag

SEQ ID NO: 454549 - RNA, 16 nt, Homo sapiens
uugaaagaaccagaga

SEQ ID NO: 454550 - RNA, 15 nt, Homo sapiens
uugaaagaagucaaa

SEQ ID NO: 454551 - RNA, 21 nt, Homo sapiens
uugaaaguuuguucugcagag

SEQ ID NO: 454552 - RNA, 20 nt, Homo sapiens
uugaaaguuuuccaguauug

SEQ ID NO: 454553 - RNA, 13 nt, Homo sapiens
uugaaauccagaa

SEQ ID NO: 454554 - RNA, 20 nt, Homo sapiens
uugaaaugagaaacuuugau

SEQ ID NO: 454555 - RNA, 18 nt, Homo sapiens
uugaacaaaaaugacaga

SEQ ID NO: 454556 - RNA, 22 nt, Homo sapiens
uugaaccucauuaaauggugau

SEQ ID NO: 454557 - RNA, 12 nt, Homo sapiens
uugaacguucuc

SEQ ID NO: 454558 - RNA, 17 nt, Homo sapiens
uugaagacauaucaugu

SEQ ID NO: 454559 - RNA, 19 nt, Homo sapiens
uugaagacccucaaugcca

SEQ ID NO: 454560 - RNA, 16 nt, Homo sapiens
uugaaggacuacaggu

SEQ ID NO: 454561 - RNA, 20 nt, Homo sapiens
uugaaggacuacagguauuu

SEQ ID NO: 454562 - RNA, 13 nt, Homo sapiens
uugaaguuuacaa

SEQ ID NO: 454563 - RNA, 15 nt, Homo sapiens
uugaaugaugagccu

SEQ ID NO: 454564 - RNA, 17 nt, Homo sapiens
uugaauguaagaacaug

SEQ ID NO: 454565 - RNA, 12 nt, Homo sapiens
uugaaugugauu

SEQ ID NO: 454566 - RNA, 19 nt, Homo sapiens
uugaaugugguuacuuccu

SEQ ID NO: 454567 - RNA, 21 nt, Homo sapiens
uugaauuuugaaccaugugac

SEQ ID NO: 454568 - RNA, 14 nt, Homo sapiens
uugacacggccaug

SEQ ID NO: 454569 - RNA, 14 nt, Homo sapiens
uugacaucagcauu

SEQ ID NO: 454570 - RNA, 13 nt, Homo sapiens
uugacaugugcaa

SEQ ID NO: 454571 - RNA, 17 nt, Homo sapiens
uugaccaagaacugcau

SEQ ID NO: 454572 - RNA, 18 nt, Homo sapiens
uugaccaagaacugcaug

SEQ ID NO: 454573 - RNA, 13 nt, Homo sapiens
uugaccacccacc

SEQ ID NO: 454574 - RNA, 13 nt, Homo sapiens
uugaccaugugau

SEQ ID NO: 454575 - RNA, 16 nt, Homo sapiens
uugacccuagccagag

SEQ ID NO: 454576 - RNA, 22 nt, Homo sapiens
uugacguaagcucuaucugcaa

SEQ ID NO: 454577 - RNA, 22 nt, Homo sapiens
uugacuagggauucaggcugcu

SEQ ID NO: 454578 - RNA, 13 nt, Homo sapiens
uugacuuugccac

SEQ ID NO: 454579 - RNA, 20 nt, Homo sapiens
uugacuuugccacauccauu

SEQ ID NO: 454580 - RNA, 19 nt, Homo sapiens
uugagaaauaaagcacauu

SEQ ID NO: 454581 - RNA, 21 nt, Homo sapiens
uugagaagcaaauauguuugc

SEQ ID NO: 454582 - RNA, 14 nt, Homo sapiens
uugagacaggagac

SEQ ID NO: 454583 - RNA, 19 nt, Homo sapiens
uugagaccuggaaccagag

SEQ ID NO: 454584 - RNA, 13 nt, Homo sapiens
uugagacuaggau

SEQ ID NO: 454585 - RNA, 16 nt, Homo sapiens
uugagacuuccaaagg

SEQ ID NO: 454586 - RNA, 16 nt, Homo sapiens
uugagagcaacgucac

SEQ ID NO: 454587 - RNA, 13 nt, Homo sapiens
uugagaucauguc

SEQ ID NO: 454588 - RNA, 20 nt, Homo sapiens
uugagaugggggucucacca

SEQ ID NO: 454589 - RNA, 19 nt, Homo sapiens
uugagcaagucccaucuca

SEQ ID NO: 454590 - RNA, 23 nt, Homo sapiens
uugagcagaacccagacccugag

SEQ ID NO: 454591 - RNA, 18 nt, Homo sapiens
uugagcccacaaagccuu

SEQ ID NO: 454592 - RNA, 14 nt, Homo sapiens
uugagcgagcccau

SEQ ID NO: 454593 - RNA, 15 nt, Homo sapiens
uugagcgugauucug

SEQ ID NO: 454594 - RNA, 19 nt, Homo sapiens
uugaggggcuggccuuccu

SEQ ID NO: 454595 - RNA, 23 nt, Homo sapiens
uugaggucaaguaagaagacaug

SEQ ID NO: 454596 - RNA, 21 nt, Homo sapiens
uugagguggugccuucucaca

SEQ ID NO: 454597 - RNA, 15 nt, Homo sapiens
uugauaaacuuugaa

SEQ ID NO: 454598 - RNA, 14 nt, Homo sapiens
uugauagcacacau

SEQ ID NO: 454599 - RNA, 22 nt, Homo sapiens
uugauauauucuuuccaugcag

SEQ ID NO: 454600 - RNA, 19 nt, Homo sapiens
uugauaucacuaauaaagu

SEQ ID NO: 454601 - RNA, 17 nt, Homo sapiens
uugauauuuuccaaaug

SEQ ID NO: 454602 - RNA, 19 nt, Homo sapiens
uugauauuuuccaaaugga

SEQ ID NO: 454603 - RNA, 17 nt, Homo sapiens
uugaucagaucuuacaa

SEQ ID NO: 454604 - RNA, 20 nt, Homo sapiens
uugaucccuguuacccagag

SEQ ID NO: 454605 - RNA, 16 nt, Homo sapiens
guccuaaagaugcuga

SEQ ID NO: 454606 - RNA, 14 nt, Homo sapiens
guccuaagcacuuu

SEQ ID NO: 454607 - RNA, 15 nt, Homo sapiens
guccuaagcccacaa

SEQ ID NO: 454608 - RNA, 16 nt, Homo sapiens
guccucucagaacucc

SEQ ID NO: 454609 - RNA, 19 nt, Homo sapiens
guccucugcuaaaacaaca

SEQ ID NO: 454610 - RNA, 15 nt, Homo sapiens
guccucuugcucaaa

SEQ ID NO: 454611 - RNA, 20 nt, Homo sapiens
guccugaggcagaaccuggu

SEQ ID NO: 454612 - RNA, 17 nt, Homo sapiens
guccugcagugugagau

SEQ ID NO: 454613 - RNA, 18 nt, Homo sapiens
guccugugucaucuguca

SEQ ID NO: 454614 - RNA, 12 nt, Homo sapiens
guccuguucuca

SEQ ID NO: 454615 - RNA, 13 nt, Homo sapiens
guccuguuugcag

SEQ ID NO: 454616 - RNA, 19 nt, Homo sapiens
guccuuagaauacuguauu

SEQ ID NO: 454617 - RNA, 12 nt, Homo sapiens
guccuuucuuuu

SEQ ID NO: 454618 - RNA, 24 nt, Homo sapiens
guccuuuuucuucccuuaggcaau

SEQ ID NO: 454619 - RNA, 22 nt, Homo sapiens
gucuaaagcagggaagugacag

SEQ ID NO: 454620 - RNA, 19 nt, Homo sapiens
gucuaacuuuagaagugca

SEQ ID NO: 454621 - RNA, 14 nt, Homo sapiens
gucuacccagacuc

SEQ ID NO: 454622 - RNA, 20 nt, Homo sapiens
gucuacccagacucagagac

SEQ ID NO: 454623 - RNA, 17 nt, Homo sapiens
gucuaggaaucaugugc

SEQ ID NO: 454624 - RNA, 15 nt, Homo sapiens
gucuaguggaaccaa

SEQ ID NO: 454625 - RNA, 22 nt, Homo sapiens
gucuauaacuccuuguuucaga

SEQ ID NO: 454626 - RNA, 13 nt, Homo sapiens
gucuauguacaau

SEQ ID NO: 454627 - RNA, 19 nt, Homo sapiens
gucuauucccuggaauuca

SEQ ID NO: 454628 - RNA, 19 nt, Homo sapiens
gucucaaacuccugaccuc

SEQ ID NO: 454629 - RNA, 19 nt, Homo sapiens
gucucaagagggcacuggu

SEQ ID NO: 454630 - RNA, 17 nt, Homo sapiens
gucucacaguguugccc

SEQ ID NO: 454631 - RNA, 23 nt, Homo sapiens
gucucaccccucauccuuuuacu

SEQ ID NO: 454632 - RNA, 17 nt, Homo sapiens
gucuccccaugugccug

SEQ ID NO: 454633 - RNA, 16 nt, Homo sapiens
gucucccugagccugc

SEQ ID NO: 454634 - RNA, 14 nt, Homo sapiens
gucuccgcucugaa

SEQ ID NO: 454635 - RNA, 22 nt, Homo sapiens
gucuccuacucuguguaaauau

SEQ ID NO: 454636 - RNA, 18 nt, Homo sapiens
gucuccuucccacugucc

SEQ ID NO: 454637 - RNA, 18 nt, Homo sapiens
gucuccuuugcacugagg

SEQ ID NO: 454638 - RNA, 17 nt, Homo sapiens
gucucuaucuugcaucu

SEQ ID NO: 454639 - RNA, 21 nt, Homo sapiens
gucucucggguucaagcaauu

SEQ ID NO: 454640 - RNA, 21 nt, Homo sapiens
gucucucucucuuuuucuuuu

SEQ ID NO: 454641 - RNA, 20 nt, Homo sapiens
gucucuuaauucugaugcua

SEQ ID NO: 454642 - RNA, 13 nt, Homo sapiens
gucugagccaaag

SEQ ID NO: 454643 - RNA, 14 nt, Homo sapiens
gucugagccaaaga

SEQ ID NO: 454644 - RNA, 14 nt, Homo sapiens
gucugagucaucaa

SEQ ID NO: 454645 - RNA, 19 nt, Homo sapiens
gucugagucaucaaaaaga

SEQ ID NO: 454646 - RNA, 15 nt, Homo sapiens
gucugccccacccuc

SEQ ID NO: 454647 - RNA, 14 nt, Homo sapiens
gucugcgugugauu

SEQ ID NO: 454648 - RNA, 20 nt, Homo sapiens
gucugcucggccgucuucac

SEQ ID NO: 454649 - RNA, 12 nt, Homo sapiens
gucuggcccaaa

SEQ ID NO: 454650 - RNA, 23 nt, Homo sapiens
gucugggaaagcagaguggugga

SEQ ID NO: 454651 - RNA, 15 nt, Homo sapiens
gucugggacuuccuu

SEQ ID NO: 454652 - RNA, 19 nt, Homo sapiens
gucuguauauacauuucau

SEQ ID NO: 454653 - RNA, 12 nt, Homo sapiens
gucugucccaaa

SEQ ID NO: 454654 - RNA, 20 nt, Homo sapiens
gucuguggacacuguggaaa

SEQ ID NO: 454655 - RNA, 15 nt, Homo sapiens
gucuguggagccauc

SEQ ID NO: 454656 - RNA, 18 nt, Homo sapiens
gucugugggaaggcaaau

SEQ ID NO: 454657 - RNA, 20 nt, Homo sapiens
gucugugugaugaacuuucu

SEQ ID NO: 454658 - RNA, 12 nt, Homo sapiens
gucuuagcuuua

SEQ ID NO: 454659 - RNA, 22 nt, Homo sapiens
gucuucaacaugguuaccucug

SEQ ID NO: 454660 - RNA, 13 nt, Homo sapiens
gucuucaaucucu

SEQ ID NO: 454661 - RNA, 16 nt, Homo sapiens
gucuuccagguacuga

SEQ ID NO: 454662 - RNA, 12 nt, Homo sapiens
gucuuccauaau

SEQ ID NO: 454663 - RNA, 9 nt, Homo sapiens
gucuucccc

SEQ ID NO: 454664 - RNA, 14 nt, Homo sapiens
gucuucccuaccuc

SEQ ID NO: 454665 - RNA, 13 nt, Homo sapiens
gucuucccuguau

SEQ ID NO: 454666 - RNA, 20 nt, Homo sapiens
gucuucccuucugauugaug

SEQ ID NO: 454667 - RNA, 17 nt, Homo sapiens
gucuuccggucauucuu

SEQ ID NO: 454668 - RNA, 22 nt, Homo sapiens
gucuuccuccucagucuucuca

SEQ ID NO: 454669 - RNA, 21 nt, Homo sapiens
gucuuccugaguggugccaaa

SEQ ID NO: 454670 - RNA, 11 nt, Homo sapiens
gucuucuucca

SEQ ID NO: 454671 - RNA, 12 nt, Homo sapiens
gucuucuuccaa

SEQ ID NO: 454672 - RNA, 21 nt, Homo sapiens
gucuuggauugguaccagagc

SEQ ID NO: 454673 - RNA, 16 nt, Homo sapiens
gucuuuguacagacaa

SEQ ID NO: 454674 - RNA, 22 nt, Homo sapiens
gucuuuuaaugauacugucuaa

SEQ ID NO: 454675 - RNA, 22 nt, Homo sapiens
gucuuuucaaaaggauuuacuu

SEQ ID NO: 454676 - RNA, 21 nt, Homo sapiens
gugaaaaaguuaaacauugaa

SEQ ID NO: 454677 - RNA, 13 nt, Homo sapiens
gugaaaaugugac

SEQ ID NO: 454678 - RNA, 19 nt, Homo sapiens
gugaaacggaugaggucau

SEQ ID NO: 454679 - RNA, 13 nt, Homo sapiens
gugaaacuaacag

SEQ ID NO: 454680 - RNA, 15 nt, Homo sapiens
gugaaaggaaagagg

SEQ ID NO: 454681 - RNA, 16 nt, Homo sapiens
gugaaaggucaucuca

SEQ ID NO: 454682 - RNA, 16 nt, Homo sapiens
gugaacacacucagca

SEQ ID NO: 454683 - RNA, 19 nt, Homo sapiens
gugaacuagggaagcucag

SEQ ID NO: 454684 - RNA, 15 nt, Homo sapiens
gugaagcagccuuac

SEQ ID NO: 454685 - RNA, 15 nt, Homo sapiens
gugaagcugggagaa

SEQ ID NO: 454686 - RNA, 18 nt, Homo sapiens
gugaauaaaaacccugua

SEQ ID NO: 454687 - RNA, 20 nt, Homo sapiens
gugaauacuugaacucuguu

SEQ ID NO: 454688 - RNA, 20 nt, Homo sapiens
gugaauuuuugcacauucua

SEQ ID NO: 454689 - RNA, 16 nt, Homo sapiens
gugacaggacuuucau

SEQ ID NO: 454690 - RNA, 16 nt, Homo sapiens
gugacauuccacagag

SEQ ID NO: 454691 - RNA, 17 nt, Homo sapiens
gugaccagacugcacag

SEQ ID NO: 454692 - RNA, 20 nt, Homo sapiens
gugacccuucagggccagaa

SEQ ID NO: 454693 - RNA, 19 nt, Homo sapiens
gugacucagaugucucugg

SEQ ID NO: 454694 - RNA, 20 nt, Homo sapiens
gugacuuucaagcuacucac

SEQ ID NO: 454695 - RNA, 16 nt, Homo sapiens
gugagaaaaggggcau

SEQ ID NO: 454696 - RNA, 12 nt, Homo sapiens
gugagcaaaaau

SEQ ID NO: 454697 - RNA, 20 nt, Homo sapiens
gugagcaauccugcaagaac

SEQ ID NO: 454698 - RNA, 19 nt, Homo sapiens
gugagcguguccacagagu

SEQ ID NO: 454699 - RNA, 23 nt, Homo sapiens
gugagcuauaauguuucccucaa

SEQ ID NO: 454700 - RNA, 14 nt, Homo sapiens
gugaggagcacagc

SEQ ID NO: 454701 - RNA, 18 nt, Homo sapiens
gugaggguccugauucuc

SEQ ID NO: 454702 - RNA, 20 nt, Homo sapiens
gugaggucaucccggggcca

SEQ ID NO: 454703 - RNA, 16 nt, Homo sapiens
gugagugagacucugc

SEQ ID NO: 454704 - RNA, 14 nt, Homo sapiens
gugagugugugcaa

SEQ ID NO: 454705 - RNA, 16 nt, Homo sapiens
gugauaacacuggagu

SEQ ID NO: 454706 - RNA, 17 nt, Homo sapiens
gugauagagccuuugau

SEQ ID NO: 454707 - RNA, 16 nt, Homo sapiens
gugauauggagcccug

SEQ ID NO: 454708 - RNA, 19 nt, Homo sapiens
gugaucaacuguucagggu

SEQ ID NO: 454709 - RNA, 13 nt, Homo sapiens
gugaucuaccugc

SEQ ID NO: 454710 - RNA, 16 nt, Homo sapiens
gugaugauagcacugg

SEQ ID NO: 454711 - RNA, 11 nt, Homo sapiens
gugaugccuga

SEQ ID NO: 454712 - RNA, 12 nt, Homo sapiens
gugauguuauag

SEQ ID NO: 454713 - RNA, 19 nt, Homo sapiens
gugauuucaccccacagac

SEQ ID NO: 454714 - RNA, 24 nt, Homo sapiens
gugauuucaccccacagacacuua

SEQ ID NO: 454715 - RNA, 13 nt, Homo sapiens
gugauuucuugcu

SEQ ID NO: 454716 - RNA, 17 nt, Homo sapiens
gugauuuggaagagagg

SEQ ID NO: 454717 - RNA, 19 nt, Homo sapiens
gugcaaauggaagacaaaa

SEQ ID NO: 454718 - RNA, 14 nt, Homo sapiens
gugcaagcaaagaa

SEQ ID NO: 454719 - RNA, 22 nt, Homo sapiens
gugcaaggccaucugcuuacca

SEQ ID NO: 454720 - RNA, 13 nt, Homo sapiens
gugcaaguguaug

SEQ ID NO: 454721 - RNA, 17 nt, Homo sapiens
gugcaagugugugcaca

SEQ ID NO: 454722 - RNA, 17 nt, Homo sapiens
gugcaagugugugcaug

SEQ ID NO: 454723 - RNA, 13 nt, Homo sapiens
gugcacauucucc

SEQ ID NO: 454724 - RNA, 21 nt, Homo sapiens
gugcaccuguggccucucagu

SEQ ID NO: 454725 - RNA, 13 nt, Homo sapiens
gugcagauaucac

SEQ ID NO: 454726 - RNA, 16 nt, Homo sapiens
gugcagugucuuguaa

SEQ ID NO: 454727 - RNA, 14 nt, Homo sapiens
gugcaucaaccagg

SEQ ID NO: 454728 - RNA, 20 nt, Homo sapiens
gugcaugaauagauucucuc

SEQ ID NO: 454729 - RNA, 23 nt, Homo sapiens
gugcaugcuuuucucuugcuaau

SEQ ID NO: 454730 - RNA, 12 nt, Homo sapiens
gugcaugugcac

SEQ ID NO: 454731 - RNA, 13 nt, Homo sapiens
gugcaugugcacu

SEQ ID NO: 454732 - RNA, 15 nt, Homo sapiens
gugcaugugugcgag

SEQ ID NO: 454733 - RNA, 22 nt, Homo sapiens
gugcauuuaaaauggacuuuug

SEQ ID NO: 454734 - RNA, 15 nt, Homo sapiens
gugcauuucuaggac

SEQ ID NO: 454735 - RNA, 21 nt, Homo sapiens
gugccacugcccgagcuggug

SEQ ID NO: 454736 - RNA, 23 nt, Homo sapiens
gugccacugcccgagcuggugca

SEQ ID NO: 454737 - RNA, 16 nt, Homo sapiens
gugccaggacugugac

SEQ ID NO: 454738 - RNA, 14 nt, Homo sapiens
uugaugaagcacau

SEQ ID NO: 454739 - RNA, 11 nt, Homo sapiens
uugaugccagu

SEQ ID NO: 454740 - RNA, 17 nt, Homo sapiens
uugaugcuguuucuaca

SEQ ID NO: 454741 - RNA, 21 nt, Homo sapiens
uugaugucgaugcucacugcu

SEQ ID NO: 454742 - RNA, 22 nt, Homo sapiens
uugaugugcgugcugucugucc

SEQ ID NO: 454743 - RNA, 15 nt, Homo sapiens
uugauuaaacuguau

SEQ ID NO: 454744 - RNA, 19 nt, Homo sapiens
uugauuaaacuguaugucu

SEQ ID NO: 454745 - RNA, 16 nt, Homo sapiens
uugauuaaguauaucu

SEQ ID NO: 454746 - RNA, 13 nt, Homo sapiens
uugauucucaugc

SEQ ID NO: 454747 - RNA, 19 nt, Homo sapiens
uugauugaguucaucauga

SEQ ID NO: 454748 - RNA, 16 nt, Homo sapiens
uugauuuacagugccu

SEQ ID NO: 454749 - RNA, 15 nt, Homo sapiens
uugauuucauuaaua

SEQ ID NO: 454750 - RNA, 18 nt, Homo sapiens
uugauuuuuacugaggaa

SEQ ID NO: 454751 - RNA, 16 nt, Homo sapiens
uugcaaauaagacucu

SEQ ID NO: 454752 - RNA, 18 nt, Homo sapiens
uugcaaauuauucuaguc

SEQ ID NO: 454753 - RNA, 17 nt, Homo sapiens
uugcaaccacugcaacg

SEQ ID NO: 454754 - RNA, 15 nt, Homo sapiens
uugcaacuuagcuca

SEQ ID NO: 454755 - RNA, 16 nt, Homo sapiens
uugcaaugcaagcccu

SEQ ID NO: 454756 - RNA, 20 nt, Homo sapiens
uugcacacuucaaaucagag

SEQ ID NO: 454757 - RNA, 14 nt, Homo sapiens
uugcacaggccacu

SEQ ID NO: 454758 - RNA, 21 nt, Homo sapiens
uugcacaggccacuugcucag

SEQ ID NO: 454759 - RNA, 19 nt, Homo sapiens
uugcacaguuaccugcaca

SEQ ID NO: 454760 - RNA, 17 nt, Homo sapiens
uugcagccugaccaaaa

SEQ ID NO: 454761 - RNA, 20 nt, Homo sapiens
uugcaggaagagaugcucua

SEQ ID NO: 454762 - RNA, 18 nt, Homo sapiens
uugcaggcucugggcuca

SEQ ID NO: 454763 - RNA, 22 nt, Homo sapiens
uugcagggaagccccacuugaa

SEQ ID NO: 454764 - RNA, 13 nt, Homo sapiens
uugcagggguccc

SEQ ID NO: 454765 - RNA, 11 nt, Homo sapiens
uugcaggugag

SEQ ID NO: 454766 - RNA, 18 nt, Homo sapiens
uugcagugaaagcuuuca

SEQ ID NO: 454767 - RNA, 22 nt, Homo sapiens
uugcagugugcauaauuuugcc

SEQ ID NO: 454768 - RNA, 13 nt, Homo sapiens
uugcaugugcugc

SEQ ID NO: 454769 - RNA, 17 nt, Homo sapiens
uugcaugugcugcaggu

SEQ ID NO: 454770 - RNA, 20 nt, Homo sapiens
uugccaaauaaaguuaaaag

SEQ ID NO: 454771 - RNA, 13 nt, Homo sapiens
uugccagagccuu

SEQ ID NO: 454772 - RNA, 15 nt, Homo sapiens
uugccagagccuuaa

SEQ ID NO: 454773 - RNA, 18 nt, Homo sapiens
uugccaggggcauccaag

SEQ ID NO: 454774 - RNA, 17 nt, Homo sapiens
uugccagugacaugaga

SEQ ID NO: 454775 - RNA, 17 nt, Homo sapiens
uugcccagacuacaggg

SEQ ID NO: 454776 - RNA, 18 nt, Homo sapiens
uugcccagacuacagggc

SEQ ID NO: 454777 - RNA, 20 nt, Homo sapiens
uugcccaggcuggucucaaa

SEQ ID NO: 454778 - RNA, 23 nt, Homo sapiens
uugcccaucauacgcaugguccu

SEQ ID NO: 454779 - RNA, 12 nt, Homo sapiens
uugccccaagau

SEQ ID NO: 454780 - RNA, 13 nt, Homo sapiens
uugccccaagaua

SEQ ID NO: 454781 - RNA, 15 nt, Homo sapiens
uugcccuaugacauu

SEQ ID NO: 454782 - RNA, 15 nt, Homo sapiens
uugccgcugggagag

SEQ ID NO: 454783 - RNA, 16 nt, Homo sapiens
uugccuccaguccagu

SEQ ID NO: 454784 - RNA, 15 nt, Homo sapiens
uugccuuaauucuua

SEQ ID NO: 454785 - RNA, 15 nt, Homo sapiens
uugccuugcauuugu

SEQ ID NO: 454786 - RNA, 20 nt, Homo sapiens
uugcuaaaggaaaaaaccau

SEQ ID NO: 454787 - RNA, 22 nt, Homo sapiens
uugcuaagaagcgagcacugac

SEQ ID NO: 454788 - RNA, 15 nt, Homo sapiens
uugcuaccucaaggg

SEQ ID NO: 454789 - RNA, 16 nt, Homo sapiens
uugcuagcaacaacuu

SEQ ID NO: 454790 - RNA, 21 nt, Homo sapiens
uugcucaaguugaugaaucau

SEQ ID NO: 454791 - RNA, 14 nt, Homo sapiens
uugcucagugccuc

SEQ ID NO: 454792 - RNA, 18 nt, Homo sapiens
uugcugaaugucauuauu

SEQ ID NO: 454793 - RNA, 13 nt, Homo sapiens
uugcugcaucucc

SEQ ID NO: 454794 - RNA, 20 nt, Homo sapiens
uugcugccuuaaugacauuc

SEQ ID NO: 454795 - RNA, 22 nt, Homo sapiens
uugcuguaacucagacauucca

SEQ ID NO: 454796 - RNA, 12 nt, Homo sapiens
uugcuguuccca

SEQ ID NO: 454797 - RNA, 19 nt, Homo sapiens
uugcuguugugcagugugc

SEQ ID NO: 454798 - RNA, 17 nt, Homo sapiens
uugcuucaagaaugugu

SEQ ID NO: 454799 - RNA, 13 nt, Homo sapiens
uugcuuguuuauu

SEQ ID NO: 454800 - RNA, 21 nt, Homo sapiens
uugcuuuauaauuucuaccca

SEQ ID NO: 454801 - RNA, 10 nt, Homo sapiens
uugcuuuaug

SEQ ID NO: 454802 - RNA, 15 nt, Homo sapiens
uuggaaaccaugcac

SEQ ID NO: 454803 - RNA, 17 nt, Homo sapiens
uuggaaauugggugugc

SEQ ID NO: 454804 - RNA, 19 nt, Homo sapiens
uuggaaucccacuuaucaa

SEQ ID NO: 454805 - RNA, 12 nt, Homo sapiens
uuggaauucugg

SEQ ID NO: 454806 - RNA, 19 nt, Homo sapiens
uuggaccuguucaaaaagg

SEQ ID NO: 454807 - RNA, 12 nt, Homo sapiens
uuggagcacucu

SEQ ID NO: 454808 - RNA, 15 nt, Homo sapiens
uuggagcuacugcaa

SEQ ID NO: 454809 - RNA, 19 nt, Homo sapiens
uuggagcuuuuuucuuuaa

SEQ ID NO: 454810 - RNA, 20 nt, Homo sapiens
uuggagggcccacuuguauc

SEQ ID NO: 454811 - RNA, 18 nt, Homo sapiens
uuggagugcgggugggcu

SEQ ID NO: 454812 - RNA, 12 nt, Homo sapiens
uuggaguuuucu

SEQ ID NO: 454813 - RNA, 16 nt, Homo sapiens
uuggauggagacucca

SEQ ID NO: 454814 - RNA, 19 nt, Homo sapiens
uuggauggagacuccauga

SEQ ID NO: 454815 - RNA, 15 nt, Homo sapiens
uuggauguggagcuc

SEQ ID NO: 454816 - RNA, 23 nt, Homo sapiens
uuggauuuuccaccaaauucuga

SEQ ID NO: 454817 - RNA, 13 nt, Homo sapiens
uuggcaacagaaa

SEQ ID NO: 454818 - RNA, 16 nt, Homo sapiens
uuggcccaagcucuug

SEQ ID NO: 454819 - RNA, 13 nt, Homo sapiens
uuggccguggcau

SEQ ID NO: 454820 - RNA, 14 nt, Homo sapiens
uuggccucaagcaa

SEQ ID NO: 454821 - RNA, 22 nt, Homo sapiens
uuggcuacacacaaaccaguau

SEQ ID NO: 454822 - RNA, 15 nt, Homo sapiens
uuggcuuaauuccaa

SEQ ID NO: 454823 - RNA, 10 nt, Homo sapiens
uuggcuugac

SEQ ID NO: 454824 - RNA, 14 nt, Homo sapiens
uugggagaacacau

SEQ ID NO: 454825 - RNA, 22 nt, Homo sapiens
uugggaggcugaggcaagagaa

SEQ ID NO: 454826 - RNA, 23 nt, Homo sapiens
uugggauugucuuacuguugcau

SEQ ID NO: 454827 - RNA, 18 nt, Homo sapiens
uuggguacugggugcugu

SEQ ID NO: 454828 - RNA, 23 nt, Homo sapiens
uugguaucuacuucuacauccaa

SEQ ID NO: 454829 - RNA, 13 nt, Homo sapiens
uuggucaugcuuc

SEQ ID NO: 454830 - RNA, 14 nt, Homo sapiens
uugguccuaagucc

SEQ ID NO: 454831 - RNA, 11 nt, Homo sapiens
uuggugcugcg

SEQ ID NO: 454832 - RNA, 20 nt, Homo sapiens
uugguggcagugacuucuuu

SEQ ID NO: 454833 - RNA, 17 nt, Homo sapiens
uugguggccuaauuuac

SEQ ID NO: 454834 - RNA, 17 nt, Homo sapiens
uugguggugguagcauu

SEQ ID NO: 454835 - RNA, 22 nt, Homo sapiens
uugguucccguguuguaccuga

SEQ ID NO: 454836 - RNA, 22 nt, Homo sapiens
uugguugagauaguugguucuu

SEQ ID NO: 454837 - RNA, 15 nt, Homo sapiens
uugguugggggcucc

SEQ ID NO: 454838 - RNA, 19 nt, Homo sapiens
uugguuuccuucacagaaa

SEQ ID NO: 454839 - RNA, 15 nt, Homo sapiens
uuguaaaacugugac

SEQ ID NO: 454840 - RNA, 21 nt, Homo sapiens
uuguaaaagggaaagaaggcc

SEQ ID NO: 454841 - RNA, 21 nt, Homo sapiens
uuguaaaccaucgcgugcaau

SEQ ID NO: 454842 - RNA, 22 nt, Homo sapiens
uuguaacuagauagaacauuaa

SEQ ID NO: 454843 - RNA, 20 nt, Homo sapiens
uuguaagaguggaaccaaca

SEQ ID NO: 454844 - RNA, 18 nt, Homo sapiens
guguugccagagccuuaa

SEQ ID NO: 454845 - RNA, 22 nt, Homo sapiens
guguugcuuuggauacacacau

SEQ ID NO: 454846 - RNA, 15 nt, Homo sapiens
guguuggcaguguuu

SEQ ID NO: 454847 - RNA, 15 nt, Homo sapiens
guguugggauuacag

SEQ ID NO: 454848 - RNA, 13 nt, Homo sapiens
guguuuagcauua

SEQ ID NO: 454849 - RNA, 21 nt, Homo sapiens
guguuuggaaauaaacugugc

SEQ ID NO: 454850 - RNA, 17 nt, Homo sapiens
guuaaaauuuaaccuac

SEQ ID NO: 454851 - RNA, 13 nt, Homo sapiens
guuaaacagugcc

SEQ ID NO: 454852 - RNA, 23 nt, Homo sapiens
guuaaacuacucuugaauuccug

SEQ ID NO: 454853 - RNA, 20 nt, Homo sapiens
guuaaacuugaugccagugg

SEQ ID NO: 454854 - RNA, 14 nt, Homo sapiens
guuaaagagacaaa

SEQ ID NO: 454855 - RNA, 22 nt, Homo sapiens
guuaaagcuuuggugccuggaa

SEQ ID NO: 454856 - RNA, 18 nt, Homo sapiens
guuaacauucaguacuuu

SEQ ID NO: 454857 - RNA, 16 nt, Homo sapiens
guuaaccucaguguca

SEQ ID NO: 454858 - RNA, 13 nt, Homo sapiens
guuaacuguguau

SEQ ID NO: 454859 - RNA, 16 nt, Homo sapiens
guuaagcagccuuucu

SEQ ID NO: 454860 - RNA, 20 nt, Homo sapiens
guuaauaaagugcacugcca

SEQ ID NO: 454861 - RNA, 16 nt, Homo sapiens
guuaauaguacuauua

SEQ ID NO: 454862 - RNA, 17 nt, Homo sapiens
guuaauaguacuauuaa

SEQ ID NO: 454863 - RNA, 13 nt, Homo sapiens
guuaauucuugcc

SEQ ID NO: 454864 - RNA, 17 nt, Homo sapiens
guuaauuuaaagcuguu

SEQ ID NO: 454865 - RNA, 16 nt, Homo sapiens
guuacagguggggcau

SEQ ID NO: 454866 - RNA, 21 nt, Homo sapiens
guuacuaagaugaaauugcca

SEQ ID NO: 454867 - RNA, 18 nt, Homo sapiens
guuacugaucuuacucac

SEQ ID NO: 454868 - RNA, 17 nt, Homo sapiens
guuacuuaccacagacu

SEQ ID NO: 454869 - RNA, 19 nt, Homo sapiens
guuagaaaaaggacucugc

SEQ ID NO: 454870 - RNA, 21 nt, Homo sapiens
guuagaaaauggacacugugc

SEQ ID NO: 454871 - RNA, 18 nt, Homo sapiens
guuagacuuaaacagcag

SEQ ID NO: 454872 - RNA, 11 nt, Homo sapiens
guuagagccau

SEQ ID NO: 454873 - RNA, 15 nt, Homo sapiens
uugugacuagugcug

SEQ ID NO: 454874 - RNA, 15 nt, Homo sapiens
uugugagccaccacg

SEQ ID NO: 454875 - RNA, 17 nt, Homo sapiens
uugugagggacugagau

SEQ ID NO: 454876 - RNA, 16 nt, Homo sapiens
uugugggggugucaca

SEQ ID NO: 454877 - RNA, 20 nt, Homo sapiens
uuguguaaaggaacaacuga

SEQ ID NO: 454878 - RNA, 13 nt, Homo sapiens
uuguguacuguaa

SEQ ID NO: 454879 - RNA, 15 nt, Homo sapiens
uuguguccacuguga

SEQ ID NO: 454880 - RNA, 17 nt, Homo sapiens
uugugugcucauguaug

SEQ ID NO: 454881 - RNA, 17 nt, Homo sapiens
uugugugugggcuguga

SEQ ID NO: 454882 - RNA, 16 nt, Homo sapiens
uugugugugugcaagu

SEQ ID NO: 454883 - RNA, 22 nt, Homo sapiens
uuguguuuauauauaagccaaa

SEQ ID NO: 454884 - RNA, 14 nt, Homo sapiens
uuguuaauacuaua

SEQ ID NO: 454885 - RNA, 14 nt, Homo sapiens
uuguuaauacugua

SEQ ID NO: 454886 - RNA, 19 nt, Homo sapiens
uuguuaucuuccacuggaa

SEQ ID NO: 454887 - RNA, 18 nt, Homo sapiens
uuguuauuuuugucucga

SEQ ID NO: 454888 - RNA, 16 nt, Homo sapiens
uuguucaguaugcaaa

SEQ ID NO: 454889 - RNA, 21 nt, Homo sapiens
uuguucagucuuucauuuaga

SEQ ID NO: 454890 - RNA, 19 nt, Homo sapiens
uuguucauccuauuguuga

SEQ ID NO: 454891 - RNA, 17 nt, Homo sapiens
uuguucauuccgaaaaa

SEQ ID NO: 454892 - RNA, 12 nt, Homo sapiens
uuguuccucuuu

SEQ ID NO: 454893 - RNA, 20 nt, Homo sapiens
uuguucuuguaaaacuguga

SEQ ID NO: 454894 - RNA, 11 nt, Homo sapiens
uuguugcucag

SEQ ID NO: 454895 - RNA, 20 nt, Homo sapiens
uuguuggaucuucaauggcu

SEQ ID NO: 454896 - RNA, 14 nt, Homo sapiens
uuguuggucagagg

SEQ ID NO: 454897 - RNA, 14 nt, Homo sapiens
uuguuuaacccaaa

SEQ ID NO: 454898 - RNA, 20 nt, Homo sapiens
uuguuucuuuugcuuaggaa

SEQ ID NO: 454899 - RNA, 21 nt, Homo sapiens
uuguuuuaugcucagggucaa

SEQ ID NO: 454900 - RNA, 22 nt, Homo sapiens
uuguuuuauucaccaucaugua

SEQ ID NO: 454901 - RNA, 19 nt, Homo sapiens
uuguuuugacggaugauug

SEQ ID NO: 454902 - RNA, 21 nt, Homo sapiens
uuuaaaaaaauaacaucugaa

SEQ ID NO: 454903 - RNA, 19 nt, Homo sapiens
uuuaaaaaagcauuauccu

SEQ ID NO: 454904 - RNA, 16 nt, Homo sapiens
uuuaaaacauucacac

SEQ ID NO: 454905 - RNA, 15 nt, Homo sapiens
uuuaaaaccacuaug

SEQ ID NO: 454906 - RNA, 14 nt, Homo sapiens
uuuaaaacuaucca

SEQ ID NO: 454907 - RNA, 16 nt, Homo sapiens
uuuaaaagcauacucu

SEQ ID NO: 454908 - RNA, 15 nt, Homo sapiens
uuuaaaagcaucuca

SEQ ID NO: 454909 - RNA, 17 nt, Homo sapiens
uuuaaaaguuucaaugu

SEQ ID NO: 454910 - RNA, 11 nt, Homo sapiens
uuuaaagacag

SEQ ID NO: 454911 - RNA, 21 nt, Homo sapiens
uuuaaauaaaaaaguuuacag

SEQ ID NO: 454912 - RNA, 14 nt, Homo sapiens
uuuaaaucugugau

SEQ ID NO: 454913 - RNA, 13 nt, Homo sapiens
uuuaaauguuacu

SEQ ID NO: 454914 - RNA, 15 nt, Homo sapiens
uuuaaauuauacugu

SEQ ID NO: 454915 - RNA, 20 nt, Homo sapiens
uuuaaauuuuugaaauucaa

SEQ ID NO: 454916 - RNA, 13 nt, Homo sapiens
uuuaacaauaacu

SEQ ID NO: 454917 - RNA, 13 nt, Homo sapiens
uuuaacaguaccu

SEQ ID NO: 454918 - RNA, 14 nt, Homo sapiens
uuuaacggcacugu

SEQ ID NO: 454919 - RNA, 22 nt, Homo sapiens
uuuaacucccuaguuacccacc

SEQ ID NO: 454920 - RNA, 14 nt, Homo sapiens
uuuaacuucaccuu

SEQ ID NO: 454921 - RNA, 20 nt, Homo sapiens
uuuaacuuuaaccacaguga

SEQ ID NO: 454922 - RNA, 19 nt, Homo sapiens
uuuaagaaaaacaugucau

SEQ ID NO: 454923 - RNA, 13 nt, Homo sapiens
uuuaagaaaucaa

SEQ ID NO: 454924 - RNA, 15 nt, Homo sapiens
uuuaagaaugacagg

SEQ ID NO: 454925 - RNA, 22 nt, Homo sapiens
uuuaagacuuuucuuuccuuaa

SEQ ID NO: 454926 - RNA, 22 nt, Homo sapiens
uuuaagccaucaucagcuuaau

SEQ ID NO: 454927 - RNA, 12 nt, Homo sapiens
uuuaaggcagca

SEQ ID NO: 454928 - RNA, 21 nt, Homo sapiens
uuuaagggcauguugggauaa

SEQ ID NO: 454929 - RNA, 17 nt, Homo sapiens
uuuaaggugaguucuca

SEQ ID NO: 454930 - RNA, 19 nt, Homo sapiens
uuuaagguuuuuacuguga

SEQ ID NO: 454931 - RNA, 12 nt, Homo sapiens
uuuaaguucaau

SEQ ID NO: 454932 - RNA, 21 nt, Homo sapiens
uuuaauaccuuuaaauaucau

SEQ ID NO: 454933 - RNA, 14 nt, Homo sapiens
uuuaauagagaacu

SEQ ID NO: 454934 - RNA, 17 nt, Homo sapiens
uuuaaugaugugucaua

SEQ ID NO: 454935 - RNA, 20 nt, Homo sapiens
uuuacauaucaccucauggc

SEQ ID NO: 454936 - RNA, 14 nt, Homo sapiens
uuuacaugaguuca

SEQ ID NO: 454937 - RNA, 17 nt, Homo sapiens
uuuacauuauuaagaaa

SEQ ID NO: 454938 - RNA, 23 nt, Homo sapiens
uuuaccauaagggacugugccag

SEQ ID NO: 454939 - RNA, 14 nt, Homo sapiens
uuuaccaucugcau

SEQ ID NO: 454940 - RNA, 16 nt, Homo sapiens
uuuaccauuuguaaua

SEQ ID NO: 454941 - RNA, 21 nt, Homo sapiens
uuuaccuucagccauagcuug

SEQ ID NO: 454942 - RNA, 16 nt, Homo sapiens
uuuacuacugcaaguu

SEQ ID NO: 454943 - RNA, 13 nt, Homo sapiens
uuuagaacagaaa

SEQ ID NO: 454944 - RNA, 20 nt, Homo sapiens
uuuagaaucaagucugugaa

SEQ ID NO: 454945 - RNA, 20 nt, Homo sapiens
uuuagacuaacuuccauggu

SEQ ID NO: 454946 - RNA, 19 nt, Homo sapiens
uuuagauguuuaccuucag

SEQ ID NO: 454947 - RNA, 14 nt, Homo sapiens
uuuagcacaaaaaa

SEQ ID NO: 454948 - RNA, 16 nt, Homo sapiens
uuuagcagaggagcca

SEQ ID NO: 454949 - RNA, 16 nt, Homo sapiens
uuuagccagugacuuu

SEQ ID NO: 454950 - RNA, 22 nt, Homo sapiens
uuuagguugcacauucacugaa

SEQ ID NO: 454951 - RNA, 12 nt, Homo sapiens
uuuaguccucac

SEQ ID NO: 454952 - RNA, 12 nt, Homo sapiens
uuuagucuugau

SEQ ID NO: 454953 - RNA, 22 nt, Homo sapiens
uuuauaauuuuaaaauugcagc

SEQ ID NO: 454954 - RNA, 14 nt, Homo sapiens
uuuauacugcacuu

SEQ ID NO: 454955 - RNA, 19 nt, Homo sapiens
uuuauaggacgaaugccaa

SEQ ID NO: 454956 - RNA, 16 nt, Homo sapiens
uuuauauuugugugag

SEQ ID NO: 454957 - RNA, 17 nt, Homo sapiens
uuuaucaauaaagcacu

SEQ ID NO: 454958 - RNA, 20 nt, Homo sapiens
uuuaucaauaaagcacuauu

SEQ ID NO: 454959 - RNA, 12 nt, Homo sapiens
uuuaucuauggg

SEQ ID NO: 454960 - RNA, 19 nt, Homo sapiens
uuuaugaucuuggcuguau

SEQ ID NO: 454961 - RNA, 16 nt, Homo sapiens
uuuauuaaccucagca

SEQ ID NO: 454962 - RNA, 13 nt, Homo sapiens
uuuauuaccucug

SEQ ID NO: 454963 - RNA, 17 nt, Homo sapiens
uuuauuauuuucaccug

SEQ ID NO: 454964 - RNA, 15 nt, Homo sapiens
uuuauucacuugugu

SEQ ID NO: 454965 - RNA, 19 nt, Homo sapiens
uuuauucuuccuugagcua

SEQ ID NO: 454966 - RNA, 15 nt, Homo sapiens
uuucaaccaguuuga

SEQ ID NO: 454967 - RNA, 19 nt, Homo sapiens
uuucaagaucaaacuucca

SEQ ID NO: 454968 - RNA, 23 nt, Homo sapiens
uuucaauaauagacuuauaugca

SEQ ID NO: 454969 - RNA, 16 nt, Homo sapiens
uuucacuguuuccuau

SEQ ID NO: 454970 - RNA, 21 nt, Homo sapiens
uuucagaaacaaagcauuuga

SEQ ID NO: 454971 - RNA, 20 nt, Homo sapiens
uuucagaagcucuucuaaaa

SEQ ID NO: 454972 - RNA, 20 nt, Homo sapiens
uuucagagaaauacuuucag

SEQ ID NO: 454973 - RNA, 16 nt, Homo sapiens
uuucagggaguacaca

SEQ ID NO: 454974 - RNA, 18 nt, Homo sapiens
uuucagggcugggcuaua

SEQ ID NO: 454975 - RNA, 19 nt, Homo sapiens
guuucuguuugaauuuuca

SEQ ID NO: 454976 - RNA, 14 nt, Homo sapiens
guuucuugcucuga

SEQ ID NO: 454977 - RNA, 20 nt, Homo sapiens
guuugaaaaagcagacagaa

SEQ ID NO: 454978 - RNA, 16 nt, Homo sapiens
guuugaaccaagaacu

SEQ ID NO: 454979 - RNA, 22 nt, Homo sapiens
guuugacauuuaauaacuuugc

SEQ ID NO: 454980 - RNA, 18 nt, Homo sapiens
guuugaucauagaauugu

SEQ ID NO: 454981 - RNA, 16 nt, Homo sapiens
guuugcaaugucacaa

SEQ ID NO: 454982 - RNA, 22 nt, Homo sapiens
guuugccaaauuuuccuuccug

SEQ ID NO: 454983 - RNA, 11 nt, Homo sapiens
guuugccaugu

SEQ ID NO: 454984 - RNA, 21 nt, Homo sapiens
guuugcuauugacaagucauu

SEQ ID NO: 454985 - RNA, 14 nt, Homo sapiens
guuugcuucuuaug

SEQ ID NO: 454986 - RNA, 18 nt, Homo sapiens
guuuggcaaugcacugaa

SEQ ID NO: 454987 - RNA, 14 nt, Homo sapiens
guuuggcgggccaa

SEQ ID NO: 454988 - RNA, 14 nt, Homo sapiens
guuuggcugggaua

SEQ ID NO: 454989 - RNA, 18 nt, Homo sapiens
guuugggccccucagagc

SEQ ID NO: 454990 - RNA, 14 nt, Homo sapiens
guuugugaaacaaa

SEQ ID NO: 454991 - RNA, 15 nt, Homo sapiens
guuugugaauugauu

SEQ ID NO: 454992 - RNA, 17 nt, Homo sapiens
guuuuaggguacaguuu

SEQ ID NO: 454993 - RNA, 21 nt, Homo sapiens
guuuuaguaugugucaaacau

SEQ ID NO: 454994 - RNA, 22 nt, Homo sapiens
guuuuaugagaaaugccagugu

SEQ ID NO: 454995 - RNA, 17 nt, Homo sapiens
guuuuccaaugugacua

SEQ ID NO: 454996 - RNA, 19 nt, Homo sapiens
guuuuccuaguauacccac

SEQ ID NO: 454997 - RNA, 15 nt, Homo sapiens
guuuucuuuuacuau

SEQ ID NO: 454998 - RNA, 15 nt, Homo sapiens
guuuugcaagggaau

SEQ ID NO: 454999 - RNA, 21 nt, Homo sapiens
guuuugugcggugugucucca

SEQ ID NO: 455000 - RNA, 15 nt, Homo sapiens
guuuuguguguauau

SEQ ID NO: 455001 - RNA, 11 nt, Homo sapiens
guuuuuacuaa

SEQ ID NO: 455002 - RNA, 17 nt, Homo sapiens
guuuuuaucauggguau

SEQ ID NO: 455003 - RNA, 22 nt, Homo sapiens
guuuuugaagaagggaaauuca

SEQ ID NO: 455004 - RNA, 19 nt, Homo sapiens
guuuuuuacuuccacagaa

SEQ ID NO: 455005 - RNA, 23 nt, Homo sapiens
uaaaaaaaaaaaaaaaagugaug

SEQ ID NO: 455006 - RNA, 17 nt, Homo sapiens
uaaaaaaaaaaguuaca

SEQ ID NO: 455007 - RNA, 19 nt, Homo sapiens
uaaaaaaauacaugcaucu

SEQ ID NO: 455008 - RNA, 16 nt, Homo sapiens
uuucuaauuugcugcu

SEQ ID NO: 455009 - RNA, 14 nt, Homo sapiens
uuucuacuuugcca

SEQ ID NO: 455010 - RNA, 20 nt, Homo sapiens
uuucuagacaguauugccac

SEQ ID NO: 455011 - RNA, 14 nt, Homo sapiens
uuucuaugugacaa

SEQ ID NO: 455012 - RNA, 11 nt, Homo sapiens
uuucucauucu

SEQ ID NO: 455013 - RNA, 18 nt, Homo sapiens
uuucucauuuagcauuga

SEQ ID NO: 455014 - RNA, 13 nt, Homo sapiens
uuucuccaugagu

SEQ ID NO: 455015 - RNA, 20 nt, Homo sapiens
uuucuccgaaaggcaaaaau

SEQ ID NO: 455016 - RNA, 19 nt, Homo sapiens
uuucucuguggccauuugu

SEQ ID NO: 455017 - RNA, 18 nt, Homo sapiens
uuucucuuuuucauucau

SEQ ID NO: 455018 - RNA, 19 nt, Homo sapiens
uuucugaaauaacauggcc

SEQ ID NO: 455019 - RNA, 14 nt, Homo sapiens
uuucugacugcaac

SEQ ID NO: 455020 - RNA, 15 nt, Homo sapiens
uuucuggccugccuu

SEQ ID NO: 455021 - RNA, 13 nt, Homo sapiens
uuucuguaaacuc

SEQ ID NO: 455022 - RNA, 22 nt, Homo sapiens
uuucuguaucaagccccugucu

SEQ ID NO: 455023 - RNA, 17 nt, Homo sapiens
uuucuuaaucaguguag

SEQ ID NO: 455024 - RNA, 15 nt, Homo sapiens
uuucuuccaccacuc

SEQ ID NO: 455025 - RNA, 17 nt, Homo sapiens
uuucuugaaccaauaau

SEQ ID NO: 455026 - RNA, 21 nt, Homo sapiens
uuucuugacaaaaccuaacuu

SEQ ID NO: 455027 - RNA, 14 nt, Homo sapiens
uuucuugcuucaaa

SEQ ID NO: 455028 - RNA, 19 nt, Homo sapiens
uuucuuggccucaaguuca

SEQ ID NO: 455029 - RNA, 19 nt, Homo sapiens
uuucuuggcguuccugcca

SEQ ID NO: 455030 - RNA, 20 nt, Homo sapiens
uuucuugggguacucuugau

SEQ ID NO: 455031 - RNA, 19 nt, Homo sapiens
uuucuuguuaagugcuuuu

SEQ ID NO: 455032 - RNA, 19 nt, Homo sapiens
uuucuuuaccugagaccag

SEQ ID NO: 455033 - RNA, 11 nt, Homo sapiens
uuucuuugauu

SEQ ID NO: 455034 - RNA, 15 nt, Homo sapiens
uuucuuuugaauaau

SEQ ID NO: 455035 - RNA, 23 nt, Homo sapiens
uuucuuuugcuuaggaaauugcu

SEQ ID NO: 455036 - RNA, 18 nt, Homo sapiens
uuucuuuuuauaacucau

SEQ ID NO: 455037 - RNA, 14 nt, Homo sapiens
uuucuuuuuccacc

SEQ ID NO: 455038 - RNA, 16 nt, Homo sapiens
uuugaaagaacaucag

SEQ ID NO: 455039 - RNA, 18 nt, Homo sapiens
uuugaaaggcuuuccuca

SEQ ID NO: 455040 - RNA, 20 nt, Homo sapiens
uuugaaauagucugugugaa

SEQ ID NO: 455041 - RNA, 19 nt, Homo sapiens
uuugaacccuugcuugcaa

SEQ ID NO: 455042 - RNA, 13 nt, Homo sapiens
uuugaauggauua

SEQ ID NO: 455043 - RNA, 22 nt, Homo sapiens
uuugaaugguuuucuaauaucu

SEQ ID NO: 455044 - RNA, 21 nt, Homo sapiens
uuugacaacgccaacugccca

SEQ ID NO: 455045 - RNA, 19 nt, Homo sapiens
uuugacugcuucacggacu

SEQ ID NO: 455046 - RNA, 13 nt, Homo sapiens
uuugagugauccu

SEQ ID NO: 455047 - RNA, 12 nt, Homo sapiens
uuugauauuuga

SEQ ID NO: 455048 - RNA, 15 nt, Homo sapiens
uuugauauuugauaa

SEQ ID NO: 455049 - RNA, 17 nt, Homo sapiens
uuugauccaggugccaa

SEQ ID NO: 455050 - RNA, 20 nt, Homo sapiens
uuugaugauuaauucaccuu

SEQ ID NO: 455051 - RNA, 17 nt, Homo sapiens
uuugauguggugucaua

SEQ ID NO: 455052 - RNA, 13 nt, Homo sapiens
uuugauugcacau

SEQ ID NO: 455053 - RNA, 21 nt, Homo sapiens
uuugcaaaauuuccaguaccu

SEQ ID NO: 455054 - RNA, 21 nt, Homo sapiens
uuugcaauggcuauauggcaa

SEQ ID NO: 455055 - RNA, 18 nt, Homo sapiens
uuugcacacuugugugug

SEQ ID NO: 455056 - RNA, 22 nt, Homo sapiens
uuugcagcuuucucuaguucaa

SEQ ID NO: 455057 - RNA, 15 nt, Homo sapiens
uuugcauguuuugua

SEQ ID NO: 455058 - RNA, 12 nt, Homo sapiens
uuugccaaaaac

SEQ ID NO: 455059 - RNA, 16 nt, Homo sapiens
uuugccaccuuuccug

SEQ ID NO: 455060 - RNA, 22 nt, Homo sapiens
uuugcucaguggaucacacaca

SEQ ID NO: 455061 - RNA, 16 nt, Homo sapiens
uuugcuggucacugcc

SEQ ID NO: 455062 - RNA, 24 nt, Homo sapiens
uuugcuguagguuuuuuauagcua

SEQ ID NO: 455063 - RNA, 20 nt, Homo sapiens
uuugcuuaggaaauugcuca

SEQ ID NO: 455064 - RNA, 18 nt, Homo sapiens
uuugcuucuucaauggca

SEQ ID NO: 455065 - RNA, 22 nt, Homo sapiens
uuuggaaaagaaacaauaugcu

SEQ ID NO: 455066 - RNA, 16 nt, Homo sapiens
uuuggaaguguuaacu

SEQ ID NO: 455067 - RNA, 16 nt, Homo sapiens
uuuggauguuuccacg

SEQ ID NO: 455068 - RNA, 12 nt, Homo sapiens
uuuggauuuucc

SEQ ID NO: 455069 - RNA, 18 nt, Homo sapiens
uuuggcuagguaucauuc

SEQ ID NO: 455070 - RNA, 19 nt, Homo sapiens
uuuggcuagguaucauuca

SEQ ID NO: 455071 - RNA, 15 nt, Homo sapiens
uuuggcucacugcag

SEQ ID NO: 455072 - RNA, 19 nt, Homo sapiens
uuugggccccucagagccc

SEQ ID NO: 455073 - RNA, 17 nt, Homo sapiens
uuuggggacaugugauu

SEQ ID NO: 455074 - RNA, 12 nt, Homo sapiens
uuuguaaccaua

SEQ ID NO: 455075 - RNA, 23 nt, Homo sapiens
uuuguaagaaauaacacugugaa

SEQ ID NO: 455076 - RNA, 15 nt, Homo sapiens
uuuguaagguacuga

SEQ ID NO: 455077 - RNA, 23 nt, Homo sapiens
uuuguacagaagaggauucaaaa

SEQ ID NO: 455078 - RNA, 20 nt, Homo sapiens
uuuguaccucuaaguacaua

SEQ ID NO: 455079 - RNA, 17 nt, Homo sapiens
uuuguauuuuuccucuu

SEQ ID NO: 455080 - RNA, 23 nt, Homo sapiens
uuugucacuggaaccucccuggg

SEQ ID NO: 455081 - RNA, 17 nt, Homo sapiens
uuugucaguguagauca

SEQ ID NO: 455082 - RNA, 23 nt, Homo sapiens
uuugucauuuugaaauacuuaau

SEQ ID NO: 455083 - RNA, 17 nt, Homo sapiens
uuuguccacccacuuag

SEQ ID NO: 455084 - RNA, 19 nt, Homo sapiens
uuugugugugugcaagugu

SEQ ID NO: 455085 - RNA, 21 nt, Homo sapiens
uuuguguucuguuuguuaaaa

SEQ ID NO: 455086 - RNA, 16 nt, Homo sapiens
uuuguugagucucuga

SEQ ID NO: 455087 - RNA, 23 nt, Homo sapiens
uuuuaaaaaagauggauuugaca

SEQ ID NO: 455088 - RNA, 23 nt, Homo sapiens
uuuuaaaaacuccuuuugguuua

SEQ ID NO: 455089 - RNA, 19 nt, Homo sapiens
uuuuaaaaggagcacauua

SEQ ID NO: 455090 - RNA, 13 nt, Homo sapiens
uuuuaaacauucu

SEQ ID NO: 455091 - RNA, 18 nt, Homo sapiens
uuuuaaaugagcuuucag

SEQ ID NO: 455092 - RNA, 19 nt, Homo sapiens
uuuuaacaaaugauuuaca

SEQ ID NO: 455093 - RNA, 21 nt, Homo sapiens
uuuuaagacuuuucuuuccuu

SEQ ID NO: 455094 - RNA, 15 nt, Homo sapiens
uuuuaauuugaugaa

SEQ ID NO: 455095 - RNA, 23 nt, Homo sapiens
uuuuacaauaaaacuuugcugcc

SEQ ID NO: 455096 - RNA, 21 nt, Homo sapiens
uuuuacacucuagugccauau

SEQ ID NO: 455097 - RNA, 20 nt, Homo sapiens
uuuuaccuuucaugugccug

SEQ ID NO: 455098 - RNA, 20 nt, Homo sapiens
uuuuacuccccuugagcuga

SEQ ID NO: 455099 - RNA, 12 nt, Homo sapiens
uuuuagaguaug

SEQ ID NO: 455100 - RNA, 16 nt, Homo sapiens
uuuuagggcuguagac

SEQ ID NO: 455101 - RNA, 17 nt, Homo sapiens
uuuuaggggaagugaca

SEQ ID NO: 455102 - RNA, 20 nt, Homo sapiens
uuuuagugacuguaauuaau

SEQ ID NO: 455103 - RNA, 16 nt, Homo sapiens
uuuuauaaaagccuug

SEQ ID NO: 455104 - RNA, 16 nt, Homo sapiens
uaaaguacccugugcu

SEQ ID NO: 455105 - RNA, 21 nt, Homo sapiens
uaaagugaauaaccacuuaaa

SEQ ID NO: 455106 - RNA, 17 nt, Homo sapiens
uaaaguuacuugaauuu

SEQ ID NO: 455107 - RNA, 14 nt, Homo sapiens
uaaaguuaucuuac

SEQ ID NO: 455108 - RNA, 13 nt, Homo sapiens
uaaaguuugcuaa

SEQ ID NO: 455109 - RNA, 23 nt, Homo sapiens
uaaauaaacacauagauucaccu

SEQ ID NO: 455110 - RNA, 19 nt, Homo sapiens
uaaauaaaccucaaaaugu

SEQ ID NO: 455111 - RNA, 21 nt, Homo sapiens
uaaauaaagaagaaaauaacc

SEQ ID NO: 455112 - RNA, 18 nt, Homo sapiens
uaaauaaaucuaaagucu

SEQ ID NO: 455113 - RNA, 16 nt, Homo sapiens
uaaauaaauugccucc

SEQ ID NO: 455114 - RNA, 18 nt, Homo sapiens
uaaauaaccaauuccuca

SEQ ID NO: 455115 - RNA, 17 nt, Homo sapiens
uaaauaccagacacgua

SEQ ID NO: 455116 - RNA, 17 nt, Homo sapiens
uaaauaccaguacuuga

SEQ ID NO: 455117 - RNA, 19 nt, Homo sapiens
uaaauacuguaacacugua

SEQ ID NO: 455118 - RNA, 18 nt, Homo sapiens
uaaauagaugaguccugu

SEQ ID NO: 455119 - RNA, 22 nt, Homo sapiens
uaaauaguauuugagaguucua

SEQ ID NO: 455120 - RNA, 16 nt, Homo sapiens
uaaauauauauuuauc

SEQ ID NO: 455121 - RNA, 19 nt, Homo sapiens
uaaauaucaacccacuuaa

SEQ ID NO: 455122 - RNA, 23 nt, Homo sapiens
uaaauaucccagagaacaaucac

SEQ ID NO: 455123 - RNA, 12 nt, Homo sapiens
uaaauaucucaa

SEQ ID NO: 455124 - RNA, 15 nt, Homo sapiens
uaaaucauuucagua

SEQ ID NO: 455125 - RNA, 16 nt, Homo sapiens
uaaauccaugcaccua

SEQ ID NO: 455126 - RNA, 15 nt, Homo sapiens
uaaaucuccaaaaac

SEQ ID NO: 455127 - RNA, 20 nt, Homo sapiens
uaaaugaauuaaauauugaa

SEQ ID NO: 455128 - RNA, 22 nt, Homo sapiens
uaaaugagagggaaucgacugu

SEQ ID NO: 455129 - RNA, 19 nt, Homo sapiens
uaaaugccaggccuggcaa

SEQ ID NO: 455130 - RNA, 16 nt, Homo sapiens
uaaauggcaccuguau

SEQ ID NO: 455131 - RNA, 15 nt, Homo sapiens
uaaauggcaugacaa

SEQ ID NO: 455132 - RNA, 19 nt, Homo sapiens
uaaauguacuacauuugca

SEQ ID NO: 455133 - RNA, 19 nt, Homo sapiens
uaaauguaucuuauucaca

SEQ ID NO: 455134 - RNA, 14 nt, Homo sapiens
uaaaugucccaaau

SEQ ID NO: 455135 - RNA, 15 nt, Homo sapiens
uaaaugucuuuucaa

SEQ ID NO: 455136 - RNA, 17 nt, Homo sapiens
uaaauguguggugcuaa

SEQ ID NO: 455137 - RNA, 12 nt, Homo sapiens
uaaauguuaaag

SEQ ID NO: 455138 - RNA, 12 nt, Homo sapiens
uaaauguuauau

SEQ ID NO: 455139 - RNA, 22 nt, Homo sapiens
uaaauguuaugacuccuugaua

SEQ ID NO: 455140 - RNA, 16 nt, Homo sapiens
uaaauucaaaccuaag

SEQ ID NO: 455141 - RNA, 13 nt, Homo sapiens
uaaauuccacacu

SEQ ID NO: 455142 - RNA, 12 nt, Homo sapiens
uuuugguaucua

SEQ ID NO: 455143 - RNA, 17 nt, Homo sapiens
uuuugucuauaugugcg

SEQ ID NO: 455144 - RNA, 11 nt, Homo sapiens
uuuugugaauc

SEQ ID NO: 455145 - RNA, 13 nt, Homo sapiens
uuuuguguguaua

SEQ ID NO: 455146 - RNA, 15 nt, Homo sapiens
uuuuguguuccucuu

SEQ ID NO: 455147 - RNA, 14 nt, Homo sapiens
uuuuguuaagcuca

SEQ ID NO: 455148 - RNA, 15 nt, Homo sapiens
uuuuguuauugggca

SEQ ID NO: 455149 - RNA, 18 nt, Homo sapiens
uuuuguuccacaaguuaa

SEQ ID NO: 455150 - RNA, 20 nt, Homo sapiens
uuuuuaaguauuucagaugc

SEQ ID NO: 455151 - RNA, 18 nt, Homo sapiens
uuuuuaauauaaagccug

SEQ ID NO: 455152 - RNA, 20 nt, Homo sapiens
uuuuuacuaaucuuucugca

SEQ ID NO: 455153 - RNA, 16 nt, Homo sapiens
uuuuuauuuugcugca

SEQ ID NO: 455154 - RNA, 16 nt, Homo sapiens
uuuuucuaagguucuc

SEQ ID NO: 455155 - RNA, 22 nt, Homo sapiens
uuuuucuuugagacugggucuc

SEQ ID NO: 455156 - RNA, 11 nt, Homo sapiens
uuuuugcagcu

SEQ ID NO: 455157 - RNA, 11 nt, Homo sapiens
uuuuugccaug

SEQ ID NO: 455158 - RNA, 21 nt, Homo sapiens
uuuuugguauuuuuguguaua

SEQ ID NO: 455159 - RNA, 19 nt, Homo sapiens
uuuuuuaaggugaguucuc

SEQ ID NO: 455160 - RNA, 13 nt, Homo sapiens
uuuuuucaccaau

SEQ ID NO: 455161 - RNA, 18 nt, Homo sapiens
uuuuuugcuaagagccag

SEQ ID NO: 455162 - RNA, 21 nt, Homo sapiens
accgcggcgccuccgcccaaa

SEQ ID NO: 455163 - RNA, 15 nt, Homo sapiens
accggcaaccuguaa

SEQ ID NO: 455164 - RNA, 16 nt, Homo sapiens
accgggaaaggcaucu

SEQ ID NO: 455165 - RNA, 23 nt, Homo sapiens
accggggccuacuagagucugaa

SEQ ID NO: 455166 - RNA, 21 nt, Homo sapiens
accgguguccuguuccugcca

SEQ ID NO: 455167 - RNA, 15 nt, Homo sapiens
accgucccacguggu

SEQ ID NO: 455168 - RNA, 16 nt, Homo sapiens
accgugugucauguca

SEQ ID NO: 455169 - RNA, 22 nt, Homo sapiens
accuaaaagacagcagggacaa

SEQ ID NO: 455170 - RNA, 19 nt, Homo sapiens
accuaaaauaauugguucu

SEQ ID NO: 455171 - RNA, 21 nt, Homo sapiens
accuaaaauuaagaaguacaa

SEQ ID NO: 455172 - RNA, 14 nt, Homo sapiens
accuaauaucauuu

SEQ ID NO: 455173 - RNA, 21 nt, Homo sapiens
accuaauguuuaugagccaga

SEQ ID NO: 455174 - RNA, 17 nt, Homo sapiens
accuacaaacuccuuaa

SEQ ID NO: 455175 - RNA, 16 nt, Homo sapiens
accuaccguagcuuuu

SEQ ID NO: 455176 - RNA, 14 nt, Homo sapiens
accuacuagacaau

SEQ ID NO: 455177 - RNA, 16 nt, Homo sapiens
accuagaguuuuauca

SEQ ID NO: 455178 - RNA, 20 nt, Homo sapiens
accuagguuaacaacccugu

SEQ ID NO: 455179 - RNA, 21 nt, Homo sapiens
accuauuuuuuucucuauucu

SEQ ID NO: 455180 - RNA, 13 nt, Homo sapiens
accucaaccugug

SEQ ID NO: 455181 - RNA, 18 nt, Homo sapiens
accucaagggcuuuccca

SEQ ID NO: 455182 - RNA, 17 nt, Homo sapiens
accucacgcucuggaca

SEQ ID NO: 455183 - RNA, 13 nt, Homo sapiens
accucacuauuca

SEQ ID NO: 455184 - RNA, 16 nt, Homo sapiens
accucacuccuguuac

SEQ ID NO: 455185 - RNA, 12 nt, Homo sapiens
accucacuguga

SEQ ID NO: 455186 - RNA, 16 nt, Homo sapiens
accucagaaagucacc

SEQ ID NO: 455187 - RNA, 16 nt, Homo sapiens
accucagacuuaccag

SEQ ID NO: 455188 - RNA, 17 nt, Homo sapiens
accucagugucauuuau

SEQ ID NO: 455189 - RNA, 18 nt, Homo sapiens
accucaucuccaagauag

SEQ ID NO: 455190 - RNA, 13 nt, Homo sapiens
accucauuugcau

SEQ ID NO: 455191 - RNA, 22 nt, Homo sapiens
accuccacccccuccugucacc

SEQ ID NO: 455192 - RNA, 16 nt, Homo sapiens
accuccagaggugaug

SEQ ID NO: 455193 - RNA, 19 nt, Homo sapiens
accuccagucccccuaucc

SEQ ID NO: 455194 - RNA, 19 nt, Homo sapiens
accucccaaacccagccuc

SEQ ID NO: 455195 - RNA, 18 nt, Homo sapiens
accucccuagguccuucc

SEQ ID NO: 455196 - RNA, 14 nt, Homo sapiens
cacccucuggagaa

SEQ ID NO: 455197 - RNA, 13 nt, Homo sapiens
cacccugagggug

SEQ ID NO: 455198 - RNA, 21 nt, Homo sapiens
cacccuggaggauuucaucuc

SEQ ID NO: 455199 - RNA, 23 nt, Homo sapiens
cacccuggggccuggaccugccu

SEQ ID NO: 455200 - RNA, 13 nt, Homo sapiens
cacccuuucaccc

SEQ ID NO: 455201 - RNA, 16 nt, Homo sapiens
caccgagaggaaaaag

SEQ ID NO: 455202 - RNA, 19 nt, Homo sapiens
caccgaguggccauggcau

SEQ ID NO: 455203 - RNA, 22 nt, Homo sapiens
caccgcgcccagccucaucucu

SEQ ID NO: 455204 - RNA, 16 nt, Homo sapiens
caccguaguaacacau

SEQ ID NO: 455205 - RNA, 19 nt, Homo sapiens
caccuagagcuagaugugu

SEQ ID NO: 455206 - RNA, 21 nt, Homo sapiens
caccuagagcuagaugugucu

SEQ ID NO: 455207 - RNA, 18 nt, Homo sapiens
caccuagcagauauguau

SEQ ID NO: 455208 - RNA, 12 nt, Homo sapiens
caccuagccucg

SEQ ID NO: 455209 - RNA, 22 nt, Homo sapiens
caccuauuuaagagggaacuua

SEQ ID NO: 455210 - RNA, 14 nt, Homo sapiens
caccucacccagcc

SEQ ID NO: 455211 - RNA, 18 nt, Homo sapiens
caccucaccccguuacag

SEQ ID NO: 455212 - RNA, 18 nt, Homo sapiens
caccuccacccccaagaa

SEQ ID NO: 455213 - RNA, 17 nt, Homo sapiens
caccuccugccucaggu

SEQ ID NO: 455214 - RNA, 11 nt, Homo sapiens
caccucucauc

SEQ ID NO: 455215 - RNA, 18 nt, Homo sapiens
caccucucuguaguuuau

SEQ ID NO: 455216 - RNA, 16 nt, Homo sapiens
caccucuuuuugaaca

SEQ ID NO: 455217 - RNA, 14 nt, Homo sapiens
caccugaaacacuu

SEQ ID NO: 455218 - RNA, 16 nt, Homo sapiens
caccugaaugugucug

SEQ ID NO: 455219 - RNA, 17 nt, Homo sapiens
caccugaaugugucugc

SEQ ID NO: 455220 - RNA, 15 nt, Homo sapiens
caccugaccucugaa

SEQ ID NO: 455221 - RNA, 23 nt, Homo sapiens
caccugcagcccuuuuaguggug

SEQ ID NO: 455222 - RNA, 18 nt, Homo sapiens
caccugcagccuguugaa

SEQ ID NO: 455223 - RNA, 17 nt, Homo sapiens
caccugccaaaugaaua

SEQ ID NO: 455224 - RNA, 18 nt, Homo sapiens
caccugccaaaugaauaa

SEQ ID NO: 455225 - RNA, 22 nt, Homo sapiens
caccugggccaccaugcacuca

SEQ ID NO: 455226 - RNA, 13 nt, Homo sapiens
caccuggucuguu

SEQ ID NO: 455227 - RNA, 18 nt, Homo sapiens
caccuguaaaacuuuauu

SEQ ID NO: 455228 - RNA, 13 nt, Homo sapiens
caccugugacaaa

SEQ ID NO: 455229 - RNA, 14 nt, Homo sapiens
caccugugcugcug

SEQ ID NO: 455230 - RNA, 16 nt, Homo sapiens
caccuguugcaccuca

SEQ ID NO: 455231 - RNA, 16 nt, Homo sapiens
caccuucagacuuugc

SEQ ID NO: 455232 - RNA, 17 nt, Homo sapiens
caccuuguacagaacca

SEQ ID NO: 455233 - RNA, 18 nt, Homo sapiens
caccuuucccagauucuc

SEQ ID NO: 455234 - RNA, 19 nt, Homo sapiens
caccuuuccuguucaugac

SEQ ID NO: 455235 - RNA, 18 nt, Homo sapiens
caccuuuugcacauaaca

SEQ ID NO: 455236 - RNA, 21 nt, Homo sapiens
cacgaaaugggccauuccagu

SEQ ID NO: 455237 - RNA, 17 nt, Homo sapiens
cacgagagagucuucca

SEQ ID NO: 455238 - RNA, 24 nt, Homo sapiens
cacgagcuaguuaaacagugccau

SEQ ID NO: 455239 - RNA, 16 nt, Homo sapiens
cacgagcugcugucca

SEQ ID NO: 455240 - RNA, 20 nt, Homo sapiens
cacgaggugguagcucugag

SEQ ID NO: 455241 - RNA, 18 nt, Homo sapiens
cacgagugggaaggacuu

SEQ ID NO: 455242 - RNA, 15 nt, Homo sapiens
cacgaucucaguuca

SEQ ID NO: 455243 - RNA, 19 nt, Homo sapiens
cacgauggagagagccuua

SEQ ID NO: 455244 - RNA, 15 nt, Homo sapiens
cacgcaagggcauca

SEQ ID NO: 455245 - RNA, 20 nt, Homo sapiens
cacgcacacacacaaacaca

SEQ ID NO: 455246 - RNA, 17 nt, Homo sapiens
cacgcucaucuugcaaa

SEQ ID NO: 455247 - RNA, 23 nt, Homo sapiens
cacgcugcccaggcucugcugac

SEQ ID NO: 455248 - RNA, 14 nt, Homo sapiens
cacgcuggcuucca

SEQ ID NO: 455249 - RNA, 18 nt, Homo sapiens
cacggaugacuuaacugc

SEQ ID NO: 455250 - RNA, 18 nt, Homo sapiens
cacgugccauugucuuuc

SEQ ID NO: 455251 - RNA, 12 nt, Homo sapiens
cacguggagcuc

SEQ ID NO: 455252 - RNA, 17 nt, Homo sapiens
cacguggcagaccguga

SEQ ID NO: 455253 - RNA, 20 nt, Homo sapiens
cacgugggcaaacaggcagu

SEQ ID NO: 455254 - RNA, 19 nt, Homo sapiens
cacguucuggacugucuuc

SEQ ID NO: 455255 - RNA, 23 nt, Homo sapiens
cacuaaagaaaaacuaaugucag

SEQ ID NO: 455256 - RNA, 19 nt, Homo sapiens
cacuaagagaauacaggaa

SEQ ID NO: 455257 - RNA, 21 nt, Homo sapiens
cacuaaguaaccucuacaggc

SEQ ID NO: 455258 - RNA, 20 nt, Homo sapiens
cacuacccuccuguaaaaua

SEQ ID NO: 455259 - RNA, 21 nt, Homo sapiens
cacuaccguaaauguccauuu

SEQ ID NO: 455260 - RNA, 14 nt, Homo sapiens
cacuaccuuuaaaa

SEQ ID NO: 455261 - RNA, 13 nt, Homo sapiens
cacuacugcaguc

SEQ ID NO: 455262 - RNA, 19 nt, Homo sapiens
cacuagaucucccuuaaua

SEQ ID NO: 455263 - RNA, 15 nt, Homo sapiens
cacuauaaccaucag

SEQ ID NO: 455264 - RNA, 22 nt, Homo sapiens
cacuaugaggaauaauuauuua

SEQ ID NO: 455265 - RNA, 18 nt, Homo sapiens
cacuaugggaagcucugu

SEQ ID NO: 455266 - RNA, 22 nt, Homo sapiens
cacuauggguggggcacuccuu

SEQ ID NO: 455267 - RNA, 17 nt, Homo sapiens
cacuauguggagcucag

SEQ ID NO: 455268 - RNA, 21 nt, Homo sapiens
cacuauguuuauuuacuaauu

SEQ ID NO: 455269 - RNA, 12 nt, Homo sapiens
cacucaaucuag

SEQ ID NO: 455270 - RNA, 15 nt, Homo sapiens
cacuccccucaucca

SEQ ID NO: 455271 - RNA, 17 nt, Homo sapiens
cacucccuaaagcccuc

SEQ ID NO: 455272 - RNA, 14 nt, Homo sapiens
cacucccugccaac

SEQ ID NO: 455273 - RNA, 20 nt, Homo sapiens
cacucucuucuuacuguauu

SEQ ID NO: 455274 - RNA, 15 nt, Homo sapiens
cacucugacaguauu

SEQ ID NO: 455275 - RNA, 13 nt, Homo sapiens
cacucuuaugaaa

SEQ ID NO: 455276 - RNA, 21 nt, Homo sapiens
cacugaaauauccuaaccccc

SEQ ID NO: 455277 - RNA, 21 nt, Homo sapiens
cacugaaccuuguugaugcca

SEQ ID NO: 455278 - RNA, 21 nt, Homo sapiens
cacugacacugcgaacucuca

SEQ ID NO: 455279 - RNA, 20 nt, Homo sapiens
cacugacagauguguuugca

SEQ ID NO: 455280 - RNA, 19 nt, Homo sapiens
cacugagaagauugugaau

SEQ ID NO: 455281 - RNA, 15 nt, Homo sapiens
cacugagagggcaau

SEQ ID NO: 455282 - RNA, 19 nt, Homo sapiens
cacugagcccuugcacagg

SEQ ID NO: 455283 - RNA, 16 nt, Homo sapiens
cacugaguagucauuu

SEQ ID NO: 455284 - RNA, 13 nt, Homo sapiens
cacugcacccucc

SEQ ID NO: 455285 - RNA, 14 nt, Homo sapiens
cacugcacuuggug

SEQ ID NO: 455286 - RNA, 18 nt, Homo sapiens
cacugccauggaggcaca

SEQ ID NO: 455287 - RNA, 19 nt, Homo sapiens
cacugcccucuguucagua

SEQ ID NO: 455288 - RNA, 20 nt, Homo sapiens
cacugcugaaccuuuccucu

SEQ ID NO: 455289 - RNA, 16 nt, Homo sapiens
cacuggaagccagaga

SEQ ID NO: 455290 - RNA, 13 nt, Homo sapiens
cacuggcauuguc

SEQ ID NO: 455291 - RNA, 14 nt, Homo sapiens
cacugggaaggcac

SEQ ID NO: 455292 - RNA, 17 nt, Homo sapiens
cacugggucucacuccu

SEQ ID NO: 455293 - RNA, 23 nt, Homo sapiens
cacuggucaucaguauuguguaa

SEQ ID NO: 455294 - RNA, 13 nt, Homo sapiens
cacuggucuguag

SEQ ID NO: 455295 - RNA, 23 nt, Homo sapiens
gagaguuucuauggauucacuuc

SEQ ID NO: 455296 - RNA, 20 nt, Homo sapiens
gagauagaggaugggcagcu

SEQ ID NO: 455297 - RNA, 21 nt, Homo sapiens
gagaugcaccaaguacagccu

SEQ ID NO: 455298 - RNA, 18 nt, Homo sapiens
gagauggggacaggugaa

SEQ ID NO: 455299 - RNA, 12 nt, Homo sapiens
gagaugucuucu

SEQ ID NO: 455300 - RNA, 21 nt, Homo sapiens
gagauguggcaaagugcugua

SEQ ID NO: 455301 - RNA, 18 nt, Homo sapiens
gagauuacuuugcugccu

SEQ ID NO: 455302 - RNA, 22 nt, Homo sapiens
gagauugcucuggggcuugcua

SEQ ID NO: 455303 - RNA, 12 nt, Homo sapiens
gagauugugcuc

SEQ ID NO: 455304 - RNA, 16 nt, Homo sapiens
gagauuucucauugau

SEQ ID NO: 455305 - RNA, 17 nt, Homo sapiens
gagcaaaaggcagcuca

SEQ ID NO: 455306 - RNA, 23 nt, Homo sapiens
gagcaaagacuuaaucauaucaa

SEQ ID NO: 455307 - RNA, 21 nt, Homo sapiens
gagcaaagucuaaaguuuaca

SEQ ID NO: 455308 - RNA, 21 nt, Homo sapiens
gagcaaccccuguacccagcu

SEQ ID NO: 455309 - RNA, 14 nt, Homo sapiens
gagcaacucuccac

SEQ ID NO: 455310 - RNA, 15 nt, Homo sapiens
gagcacagcucagga

SEQ ID NO: 455311 - RNA, 23 nt, Homo sapiens
gagcacguggagauagugccagg

SEQ ID NO: 455312 - RNA, 18 nt, Homo sapiens
gagcacuguguaaccagc

SEQ ID NO: 455313 - RNA, 19 nt, Homo sapiens
gagcacuguguaaccagca

SEQ ID NO: 455314 - RNA, 15 nt, Homo sapiens
gagcacuucacacag

SEQ ID NO: 455315 - RNA, 15 nt, Homo sapiens
gagcagaacccagac

SEQ ID NO: 455316 - RNA, 18 nt, Homo sapiens
gagcaggaccuacuagga

SEQ ID NO: 455317 - RNA, 18 nt, Homo sapiens
gagcagggauuaaccucu

SEQ ID NO: 455318 - RNA, 14 nt, Homo sapiens
gagcagugauucuc

SEQ ID NO: 455319 - RNA, 19 nt, Homo sapiens
gagcaguggcugguccagg

SEQ ID NO: 455320 - RNA, 14 nt, Homo sapiens
gagcagugucuucc

SEQ ID NO: 455321 - RNA, 15 nt, Homo sapiens
gagcaucugucucaa

SEQ ID NO: 455322 - RNA, 18 nt, Homo sapiens
gagcaugggccuggccac

SEQ ID NO: 455323 - RNA, 20 nt, Homo sapiens
gagccaaagagaaugccauu

SEQ ID NO: 455324 - RNA, 16 nt, Homo sapiens
gagccacaacacccag

SEQ ID NO: 455325 - RNA, 18 nt, Homo sapiens
gagccacaacacccagcc

SEQ ID NO: 455326 - RNA, 21 nt, Homo sapiens
cagauuacugcccaauaugca

SEQ ID NO: 455327 - RNA, 21 nt, Homo sapiens
cagauuaucuuguacagccuu

SEQ ID NO: 455328 - RNA, 22 nt, Homo sapiens
cagauuccaggcgaugugcaag

SEQ ID NO: 455329 - RNA, 17 nt, Homo sapiens
cagauuguuaucuauca

SEQ ID NO: 455330 - RNA, 16 nt, Homo sapiens
cagauuucagaucaua

SEQ ID NO: 455331 - RNA, 13 nt, Homo sapiens
cagauuucucacc

SEQ ID NO: 455332 - RNA, 14 nt, Homo sapiens
cagauuuguucauu

SEQ ID NO: 455333 - RNA, 18 nt, Homo sapiens
cagcaaccauucaucuuu

SEQ ID NO: 455334 - RNA, 21 nt, Homo sapiens
cagcaagcccgucaucuuccc

SEQ ID NO: 455335 - RNA, 16 nt, Homo sapiens
cagcaagggcugauuc

SEQ ID NO: 455336 - RNA, 18 nt, Homo sapiens
cagcaaggggacaucuua

SEQ ID NO: 455337 - RNA, 23 nt, Homo sapiens
cagcaagucccagacaaggagag

SEQ ID NO: 455338 - RNA, 17 nt, Homo sapiens
cagcaaguguacaguau

SEQ ID NO: 455339 - RNA, 18 nt, Homo sapiens
cagcaauagggugcaguu

SEQ ID NO: 455340 - RNA, 18 nt, Homo sapiens
cagcaaugccugccugaa

SEQ ID NO: 455341 - RNA, 20 nt, Homo sapiens
cagcaauucuccugccucag

SEQ ID NO: 455342 - RNA, 22 nt, Homo sapiens
cagcaauucuccugccucagcc

SEQ ID NO: 455343 - RNA, 14 nt, Homo sapiens
cagcacagccucac

SEQ ID NO: 455344 - RNA, 18 nt, Homo sapiens
cagcacaucucugagguu

SEQ ID NO: 455345 - RNA, 15 nt, Homo sapiens
cagcaccagccugag

SEQ ID NO: 455346 - RNA, 15 nt, Homo sapiens
cagcacuacucugug

SEQ ID NO: 455347 - RNA, 12 nt, Homo sapiens
cagcacuggaag

SEQ ID NO: 455348 - RNA, 20 nt, Homo sapiens
cagcacuggaagccagagaa

SEQ ID NO: 455349 - RNA, 18 nt, Homo sapiens
cagcacuuuguuucauau

SEQ ID NO: 455350 - RNA, 21 nt, Homo sapiens
cagcagagccuggaagacacc

SEQ ID NO: 455351 - RNA, 16 nt, Homo sapiens
cagcagcccaagcuua

SEQ ID NO: 455352 - RNA, 23 nt, Homo sapiens
cagcagcccuaaggaucucucag

SEQ ID NO: 455353 - RNA, 15 nt, Homo sapiens
cagcaggggugggag

SEQ ID NO: 455354 - RNA, 21 nt, Homo sapiens
cagcagggucuugcuguaacu

SEQ ID NO: 455355 - RNA, 23 nt, Homo sapiens
cagcaguugcuagcaacaacuua

SEQ ID NO: 455356 - RNA, 20 nt, Homo sapiens
cagcauauguuguugcuugu

SEQ ID NO: 455357 - RNA, 21 nt, Homo sapiens
cagcauauguuguugcuugua

SEQ ID NO: 455358 - RNA, 22 nt, Homo sapiens
cagcaucggcuucuugcugcac

SEQ ID NO: 455359 - RNA, 22 nt, Homo sapiens
cagcauuacacgccacaacucc

SEQ ID NO: 455360 - RNA, 16 nt, Homo sapiens
cagcauuauucuucag

SEQ ID NO: 455361 - RNA, 21 nt, Homo sapiens
cagcauuuucacauuuugccu

SEQ ID NO: 455362 - RNA, 17 nt, Homo sapiens
cagcauuuuuauuccca

SEQ ID NO: 455363 - RNA, 15 nt, Homo sapiens
cagccaaaaguaagu

SEQ ID NO: 455364 - RNA, 20 nt, Homo sapiens
cagccaaaccuuuccuguaa

SEQ ID NO: 455365 - RNA, 15 nt, Homo sapiens
cagccaacuuuugca

SEQ ID NO: 455366 - RNA, 21 nt, Homo sapiens
cagccacaguggccaaagagg

SEQ ID NO: 455367 - RNA, 13 nt, Homo sapiens
cagccacauucua

SEQ ID NO: 455368 - RNA, 12 nt, Homo sapiens
cagccaccacug

SEQ ID NO: 455369 - RNA, 20 nt, Homo sapiens
cagccaccccucagacuggg

SEQ ID NO: 455370 - RNA, 16 nt, Homo sapiens
cagccacuuauuucca

SEQ ID NO: 455371 - RNA, 14 nt, Homo sapiens
cagccagcccagcu

SEQ ID NO: 455372 - RNA, 19 nt, Homo sapiens
cagccaggacaucucugcc

SEQ ID NO: 455373 - RNA, 21 nt, Homo sapiens
cagccauagcuugauugcuca

SEQ ID NO: 455374 - RNA, 18 nt, Homo sapiens
cagccaugccucaugcca

SEQ ID NO: 455375 - RNA, 18 nt, Homo sapiens
cagcccaggucccagugc

SEQ ID NO: 455376 - RNA, 19 nt, Homo sapiens
cagccccggccacucccug

SEQ ID NO: 455377 - RNA, 22 nt, Homo sapiens
cagccccggccacucccugcca

SEQ ID NO: 455378 - RNA, 20 nt, Homo sapiens
cagcccucccuggcugugag

SEQ ID NO: 455379 - RNA, 14 nt, Homo sapiens
cagcccugcugcuu

SEQ ID NO: 455380 - RNA, 12 nt, Homo sapiens
cagcccuggauu

SEQ ID NO: 455381 - RNA, 13 nt, Homo sapiens
cagcccuuuccag

SEQ ID NO: 455382 - RNA, 16 nt, Homo sapiens
cagcccuuuccagggc

SEQ ID NO: 455383 - RNA, 15 nt, Homo sapiens
cagccuacuuuucag

SEQ ID NO: 455384 - RNA, 19 nt, Homo sapiens
cagccucagugccacuuga

SEQ ID NO: 455385 - RNA, 14 nt, Homo sapiens
cagccuccaagaaa

SEQ ID NO: 455386 - RNA, 18 nt, Homo sapiens
cagccuccgccauuccaa

SEQ ID NO: 455387 - RNA, 14 nt, Homo sapiens
cagccucuagaaca

SEQ ID NO: 455388 - RNA, 19 nt, Homo sapiens
cagccucuagaacagccag

SEQ ID NO: 455389 - RNA, 20 nt, Homo sapiens
cagccucuagaacagccaga

SEQ ID NO: 455390 - RNA, 19 nt, Homo sapiens
cagccucuagcaccaggac

SEQ ID NO: 455391 - RNA, 12 nt, Homo sapiens
cagccucucugc

SEQ ID NO: 455392 - RNA, 14 nt, Homo sapiens
cagccugauggcca

SEQ ID NO: 455393 - RNA, 22 nt, Homo sapiens
cagccuggacaccucucaugca

SEQ ID NO: 455394 - RNA, 21 nt, Homo sapiens
cagccuggccaucauggugaa

SEQ ID NO: 455395 - RNA, 16 nt, Homo sapiens
cagccugggugacaga

SEQ ID NO: 455396 - RNA, 16 nt, Homo sapiens
cagccuguaacugucc

SEQ ID NO: 455397 - RNA, 14 nt, Homo sapiens
cagccuuacaauac

SEQ ID NO: 455398 - RNA, 22 nt, Homo sapiens
cagccuugcaucaagggcuuua

SEQ ID NO: 455399 - RNA, 17 nt, Homo sapiens
cagcgaaugaaugcugu

SEQ ID NO: 455400 - RNA, 16 nt, Homo sapiens
cagcgauucccugugu

SEQ ID NO: 455401 - RNA, 16 nt, Homo sapiens
cagcgcuccuggaaaa

SEQ ID NO: 455402 - RNA, 12 nt, Homo sapiens
cagcuaacaugg

SEQ ID NO: 455403 - RNA, 17 nt, Homo sapiens
cagcuaagccugaugau

SEQ ID NO: 455404 - RNA, 22 nt, Homo sapiens
cagcuacacaaggaaggcauuu

SEQ ID NO: 455405 - RNA, 23 nt, Homo sapiens
cagcuacauuccucagcugccaa

SEQ ID NO: 455406 - RNA, 15 nt, Homo sapiens
cagcuaugcuggaaa

SEQ ID NO: 455407 - RNA, 18 nt, Homo sapiens
cagcucaaguuagcauuu

SEQ ID NO: 455408 - RNA, 18 nt, Homo sapiens
cagcucaggaacuagacu

SEQ ID NO: 455409 - RNA, 17 nt, Homo sapiens
cagcuccccaagaaagc

SEQ ID NO: 455410 - RNA, 15 nt, Homo sapiens
cagcucccuucucug

SEQ ID NO: 455411 - RNA, 17 nt, Homo sapiens
cagcucugggagaggau

SEQ ID NO: 455412 - RNA, 16 nt, Homo sapiens
cagcugaacacaagca

SEQ ID NO: 455413 - RNA, 18 nt, Homo sapiens
cagcugccagagaagcau

SEQ ID NO: 455414 - RNA, 23 nt, Homo sapiens
cagcugcugugccaggacuguga

SEQ ID NO: 455415 - RNA, 22 nt, Homo sapiens
cagcugcuuuguuaccuuaaaa

SEQ ID NO: 455416 - RNA, 21 nt, Homo sapiens
cagcuggaagggucaacaucu

SEQ ID NO: 455417 - RNA, 16 nt, Homo sapiens
cagcugggcaaagcca

SEQ ID NO: 455418 - RNA, 13 nt, Homo sapiens
cagcuggggagca

SEQ ID NO: 455419 - RNA, 22 nt, Homo sapiens
cagcuguaacccucacccacag

SEQ ID NO: 455420 - RNA, 19 nt, Homo sapiens
cagcuguacugaguucuca

SEQ ID NO: 455421 - RNA, 15 nt, Homo sapiens
cagcuguagccaugg

SEQ ID NO: 455422 - RNA, 16 nt, Homo sapiens
cagcuguuacuuucuu

SEQ ID NO: 455423 - RNA, 15 nt, Homo sapiens
cagcuucaaaacaga

SEQ ID NO: 455424 - RNA, 21 nt, Homo sapiens
cagcuucaccagagcauuucc

SEQ ID NO: 455425 - RNA, 20 nt, Homo sapiens
cagcuucccgaguaacugag

SEQ ID NO: 455426 - RNA, 14 nt, Homo sapiens
cagcuuccuuccaa

SEQ ID NO: 455427 - RNA, 14 nt, Homo sapiens
cagcuuggggccau

SEQ ID NO: 455428 - RNA, 14 nt, Homo sapiens
cagcuuugcaguga

SEQ ID NO: 455429 - RNA, 23 nt, Homo sapiens
cagcuuuuaguacccaccugagc

SEQ ID NO: 455430 - RNA, 14 nt, Homo sapiens
caggaaaaaaacuu

SEQ ID NO: 455431 - RNA, 17 nt, Homo sapiens
caggaaaacaaaucacu

SEQ ID NO: 455432 - RNA, 19 nt, Homo sapiens
caggaaagcguuuggaaaa

SEQ ID NO: 455433 - RNA, 20 nt, Homo sapiens
gaugcgggacugcuggcaug

SEQ ID NO: 455434 - RNA, 13 nt, Homo sapiens
gaugcucauucau

SEQ ID NO: 455435 - RNA, 17 nt, Homo sapiens
gaugcuccugguggcug

SEQ ID NO: 455436 - RNA, 16 nt, Homo sapiens
gauggaaacucuuuaa

SEQ ID NO: 455437 - RNA, 23 nt, Homo sapiens
gauggaaugaccagccuguccaa

SEQ ID NO: 455438 - RNA, 22 nt, Homo sapiens
gauggacucugaaaaacauucc

SEQ ID NO: 455439 - RNA, 19 nt, Homo sapiens
gauggagauauuuacauga

SEQ ID NO: 455440 - RNA, 18 nt, Homo sapiens
gauggagguucucagagc

SEQ ID NO: 455441 - RNA, 14 nt, Homo sapiens
gauggccacuguga

SEQ ID NO: 455442 - RNA, 13 nt, Homo sapiens
gauggcugugaaa

SEQ ID NO: 455443 - RNA, 20 nt, Homo sapiens
gaugggacacccaacacuuu

SEQ ID NO: 455444 - RNA, 15 nt, Homo sapiens
gaugggccaccgggg

SEQ ID NO: 455445 - RNA, 15 nt, Homo sapiens
gaugggggaugcuuc

SEQ ID NO: 455446 - RNA, 22 nt, Homo sapiens
gaugggguuucaccaucuuggc

SEQ ID NO: 455447 - RNA, 20 nt, Homo sapiens
gauggguuuuguuaggggug

SEQ ID NO: 455448 - RNA, 23 nt, Homo sapiens
gauggugacuuuugaagaacaaa

SEQ ID NO: 455449 - RNA, 20 nt, Homo sapiens
gaugguuuuauucuuugaga

SEQ ID NO: 455450 - RNA, 15 nt, Homo sapiens
gauguauuguugcuu

SEQ ID NO: 455451 - RNA, 18 nt, Homo sapiens
gaugucaugacaacacua

SEQ ID NO: 455452 - RNA, 13 nt, Homo sapiens
gaugugauacaaa

SEQ ID NO: 455453 - RNA, 15 nt, Homo sapiens
gaugugccuagacac

SEQ ID NO: 455454 - RNA, 21 nt, Homo sapiens
gauguggauggaggugaugaa

SEQ ID NO: 455455 - RNA, 21 nt, Homo sapiens
gcacccuggauugaucggagc

SEQ ID NO: 455456 - RNA, 14 nt, Homo sapiens
gcaccgucauggcu

SEQ ID NO: 455457 - RNA, 22 nt, Homo sapiens
gcaccuccucaccuuaauuuau

SEQ ID NO: 455458 - RNA, 13 nt, Homo sapiens
gcacgaucucagu

SEQ ID NO: 455459 - RNA, 22 nt, Homo sapiens
gcacuaccacgccaagcuaauu

SEQ ID NO: 455460 - RNA, 15 nt, Homo sapiens
gcacuagaagcacag

SEQ ID NO: 455461 - RNA, 19 nt, Homo sapiens
gcacuagagaaacuugaau

SEQ ID NO: 455462 - RNA, 13 nt, Homo sapiens
gcacuagaucucc

SEQ ID NO: 455463 - RNA, 14 nt, Homo sapiens
gcacuagaucuccc

SEQ ID NO: 455464 - RNA, 13 nt, Homo sapiens
gcacuagcauuuu

SEQ ID NO: 455465 - RNA, 21 nt, Homo sapiens
gcacucaguguggacugggaa

SEQ ID NO: 455466 - RNA, 16 nt, Homo sapiens
gcacugaggaccagcc

SEQ ID NO: 455467 - RNA, 14 nt, Homo sapiens
gcacugagggccac

SEQ ID NO: 455468 - RNA, 22 nt, Homo sapiens
gcacugauaucaucgauuagaa

SEQ ID NO: 455469 - RNA, 13 nt, Homo sapiens
gcacuguguuuau

SEQ ID NO: 455470 - RNA, 21 nt, Homo sapiens
gcacuucccauuuguguuuca

SEQ ID NO: 455471 - RNA, 22 nt, Homo sapiens
gcacuugcuugcggaacucuuc

SEQ ID NO: 455472 - RNA, 14 nt, Homo sapiens
gcacuugcuuuuau

SEQ ID NO: 455473 - RNA, 17 nt, Homo sapiens
gcagaaccaaagcucaa

SEQ ID NO: 455474 - RNA, 14 nt, Homo sapiens
gcagaauccagcua

SEQ ID NO: 455475 - RNA, 19 nt, Homo sapiens
gcagaauccuggcccucug

SEQ ID NO: 455476 - RNA, 14 nt, Homo sapiens
gcagaaucuuugca

SEQ ID NO: 455477 - RNA, 19 nt, Homo sapiens
gcagaauucauuaugcugu

SEQ ID NO: 455478 - RNA, 16 nt, Homo sapiens
gcagacaaaaagaaca

SEQ ID NO: 455479 - RNA, 15 nt, Homo sapiens
gcagacaaguggaca

SEQ ID NO: 455480 - RNA, 17 nt, Homo sapiens
gcagacaggccauguga

SEQ ID NO: 455481 - RNA, 13 nt, Homo sapiens
gcagaggcagcag

SEQ ID NO: 455482 - RNA, 15 nt, Homo sapiens
gcagagguugcagug

SEQ ID NO: 455483 - RNA, 19 nt, Homo sapiens
gcagagguugggaggccau

SEQ ID NO: 455484 - RNA, 15 nt, Homo sapiens
gcagaucaacugagu

SEQ ID NO: 455485 - RNA, 14 nt, Homo sapiens
gcagaucauuuccc

SEQ ID NO: 455486 - RNA, 14 nt, Homo sapiens
gcagaucugugcuc

SEQ ID NO: 455487 - RNA, 14 nt, Homo sapiens
gcagauuaaaagca

SEQ ID NO: 455488 - RNA, 21 nt, Homo sapiens
gcagauugaaaaggacaccuu

SEQ ID NO: 455489 - RNA, 13 nt, Homo sapiens
gcagcacugaaau

SEQ ID NO: 455490 - RNA, 20 nt, Homo sapiens
gcagccagaacuuguuucuc

SEQ ID NO: 455491 - RNA, 17 nt, Homo sapiens
gcagccaggacaccggg

SEQ ID NO: 455492 - RNA, 16 nt, Homo sapiens
gcagccaugagaacaa

SEQ ID NO: 455493 - RNA, 13 nt, Homo sapiens
gcagcccagagag

SEQ ID NO: 455494 - RNA, 14 nt, Homo sapiens
gcagcccaugccca

SEQ ID NO: 455495 - RNA, 16 nt, Homo sapiens
gcagccccacacccgc

SEQ ID NO: 455496 - RNA, 15 nt, Homo sapiens
gcagccccaggacca

SEQ ID NO: 455497 - RNA, 19 nt, Homo sapiens
gcagccccaggaccaagcu

SEQ ID NO: 455498 - RNA, 20 nt, Homo sapiens
gcagcccuaaggaucucuca

SEQ ID NO: 455499 - RNA, 23 nt, Homo sapiens
gcagccucaggcccaauucugcc

SEQ ID NO: 455500 - RNA, 14 nt, Homo sapiens
gcagccugagcucc

SEQ ID NO: 455501 - RNA, 22 nt, Homo sapiens
gcagccugugggagaagggaca

SEQ ID NO: 455502 - RNA, 13 nt, Homo sapiens
gcagcuagacacc

SEQ ID NO: 455503 - RNA, 12 nt, Homo sapiens
gcagcuggagau

SEQ ID NO: 455504 - RNA, 12 nt, Homo sapiens
gcagcugggauu

SEQ ID NO: 455505 - RNA, 17 nt, Homo sapiens
gcagcugggauuugaac

SEQ ID NO: 455506 - RNA, 20 nt, Homo sapiens
gcagcuucaccagagcauuu

SEQ ID NO: 455507 - RNA, 21 nt, Homo sapiens
gcagcuucaccagagcauuuc

SEQ ID NO: 455508 - RNA, 17 nt, Homo sapiens
gcaggagaaucgcuuga

SEQ ID NO: 455509 - RNA, 18 nt, Homo sapiens
gcaggagcagcugugcug

SEQ ID NO: 455510 - RNA, 20 nt, Homo sapiens
gcaggagcagcugugcugca

SEQ ID NO: 455511 - RNA, 13 nt, Homo sapiens
gcaggaggccauu

SEQ ID NO: 455512 - RNA, 22 nt, Homo sapiens
gcaggauccgcugccaccacgu

SEQ ID NO: 455513 - RNA, 16 nt, Homo sapiens
gcaggcagagaacugu

SEQ ID NO: 455514 - RNA, 16 nt, Homo sapiens
gcaggcgguggggaga

SEQ ID NO: 455515 - RNA, 23 nt, Homo sapiens
gcaggcuucuuccccccaaaacu

SEQ ID NO: 455516 - RNA, 16 nt, Homo sapiens
gcagggagugucugca

SEQ ID NO: 455517 - RNA, 13 nt, Homo sapiens
gcagggcaugacu

SEQ ID NO: 455518 - RNA, 13 nt, Homo sapiens
gcagggcucugau

SEQ ID NO: 455519 - RNA, 14 nt, Homo sapiens
gcagggcugugaug

SEQ ID NO: 455520 - RNA, 20 nt, Homo sapiens
gcaggggccccuccucugug

SEQ ID NO: 455521 - RNA, 23 nt, Homo sapiens
gcaggggcugggcagaggggaga

SEQ ID NO: 455522 - RNA, 19 nt, Homo sapiens
gcagggguagaagcaaagg

SEQ ID NO: 455523 - RNA, 14 nt, Homo sapiens
gcaggguucuagaa

SEQ ID NO: 455524 - RNA, 15 nt, Homo sapiens
gcagguauggaaggg

SEQ ID NO: 455525 - RNA, 13 nt, Homo sapiens
gcaggugccuugu

SEQ ID NO: 455526 - RNA, 19 nt, Homo sapiens
gcagguuguugucaucuga

SEQ ID NO: 455527 - RNA, 17 nt, Homo sapiens
gcagucagcaugaaucc

SEQ ID NO: 455528 - RNA, 19 nt, Homo sapiens
gcaguccugccucagccuc

SEQ ID NO: 455529 - RNA, 18 nt, Homo sapiens
gcagugaaagcuuucaug

SEQ ID NO: 455530 - RNA, 14 nt, Homo sapiens
gcagugagcuugua

SEQ ID NO: 455531 - RNA, 15 nt, Homo sapiens
gcagugcccagugau

SEQ ID NO: 455532 - RNA, 21 nt, Homo sapiens
gcaguggagaggggacuugga

SEQ ID NO: 455533 - RNA, 16 nt, Homo sapiens
gcaguggcuuuugccc

SEQ ID NO: 455534 - RNA, 13 nt, Homo sapiens
gcagugugcauaa

SEQ ID NO: 455535 - RNA, 21 nt, Homo sapiens
gcagugugcauaauuuugcca

SEQ ID NO: 455536 - RNA, 14 nt, Homo sapiens
gcaguuaacaucug

SEQ ID NO: 455537 - RNA, 19 nt, Homo sapiens
gcaguucagcuccuuccac

SEQ ID NO: 455538 - RNA, 17 nt, Homo sapiens
gcaguuggacucucagg

SEQ ID NO: 455539 - RNA, 19 nt, Homo sapiens
gcaguuggacucucaggga

SEQ ID NO: 455540 - RNA, 17 nt, Homo sapiens
gcaguuguuauauucau

SEQ ID NO: 455541 - RNA, 20 nt, Homo sapiens
gcaguuuccucaucugucac

SEQ ID NO: 455542 - RNA, 16 nt, Homo sapiens
gcauaaacaacaguac

SEQ ID NO: 455543 - RNA, 17 nt, Homo sapiens
gcauaaauauuagcaaa

SEQ ID NO: 455544 - RNA, 19 nt, Homo sapiens
gcauaagaaaacuaagaaa

SEQ ID NO: 455545 - RNA, 15 nt, Homo sapiens
gcauaauaaggggaa

SEQ ID NO: 455546 - RNA, 13 nt, Homo sapiens
gcauacaguuugc

SEQ ID NO: 455547 - RNA, 14 nt, Homo sapiens
gcauagccauggaa

SEQ ID NO: 455548 - RNA, 21 nt, Homo sapiens
gcauauaaauuccccauauuu

SEQ ID NO: 455549 - RNA, 21 nt, Homo sapiens
gcauauuauaucagacugcuu

SEQ ID NO: 455550 - RNA, 22 nt, Homo sapiens
gcaucaaagaugagaagccaaa

SEQ ID NO: 455551 - RNA, 15 nt, Homo sapiens
gcaucaagaugugac

SEQ ID NO: 455552 - RNA, 18 nt, Homo sapiens
gcaucacacaguggcacu

SEQ ID NO: 455553 - RNA, 22 nt, Homo sapiens
gcaucagcguggcagucaccac

SEQ ID NO: 455554 - RNA, 15 nt, Homo sapiens
gcaucauaauggacu

SEQ ID NO: 455555 - RNA, 13 nt, Homo sapiens
gcaucaucuaugg

SEQ ID NO: 455556 - RNA, 15 nt, Homo sapiens
gcaucauuaguacau

SEQ ID NO: 455557 - RNA, 22 nt, Homo sapiens
gcaucauucuuucugcuauauu

SEQ ID NO: 455558 - RNA, 20 nt, Homo sapiens
gcaucauuuucaccuccauu

SEQ ID NO: 455559 - RNA, 22 nt, Homo sapiens
gcaucauuuucaccuccauuuc

SEQ ID NO: 455560 - RNA, 14 nt, Homo sapiens
gcaucccaucucag

SEQ ID NO: 455561 - RNA, 23 nt, Homo sapiens
gcauccggcaugagggcugagau

SEQ ID NO: 455562 - RNA, 14 nt, Homo sapiens
gcauccuccagggg

SEQ ID NO: 455563 - RNA, 22 nt, Homo sapiens
gcaucguuuucuuugcugugcc

SEQ ID NO: 455564 - RNA, 16 nt, Homo sapiens
gcaucuaagacauuca

SEQ ID NO: 455565 - RNA, 17 nt, Homo sapiens
gcaucuaagacauucac

SEQ ID NO: 455566 - RNA, 16 nt, Homo sapiens
gcaucuacacaauuua

SEQ ID NO: 455567 - RNA, 15 nt, Homo sapiens
gcaucucagugcagg

SEQ ID NO: 455568 - RNA, 17 nt, Homo sapiens
gcaucuccccucagauu

SEQ ID NO: 455569 - RNA, 19 nt, Homo sapiens
gcaucugucccacugggac

SEQ ID NO: 455570 - RNA, 19 nt, Homo sapiens
gcaucuuucauaguucugu

SEQ ID NO: 455571 - RNA, 14 nt, Homo sapiens
gcaugaaagguaau

SEQ ID NO: 455572 - RNA, 24 nt, Homo sapiens
caucagcccaggucccagugccau

SEQ ID NO: 455573 - RNA, 18 nt, Homo sapiens
caucagcguggcagucac

SEQ ID NO: 455574 - RNA, 13 nt, Homo sapiens
caucaggugggaa

SEQ ID NO: 455575 - RNA, 22 nt, Homo sapiens
caucaguguccucuugcucaaa

SEQ ID NO: 455576 - RNA, 16 nt, Homo sapiens
caucaguuaggauuag

SEQ ID NO: 455577 - RNA, 22 nt, Homo sapiens
caucauaaaaggugacccuucu

SEQ ID NO: 455578 - RNA, 18 nt, Homo sapiens
caucauaggcugacacca

SEQ ID NO: 455579 - RNA, 16 nt, Homo sapiens
caucauaugccugacc

SEQ ID NO: 455580 - RNA, 23 nt, Homo sapiens
caucaucccuuaauuaaauauca

SEQ ID NO: 455581 - RNA, 13 nt, Homo sapiens
caucaucuauggc

SEQ ID NO: 455582 - RNA, 18 nt, Homo sapiens
caucaucucugccuuuga

SEQ ID NO: 455583 - RNA, 17 nt, Homo sapiens
caucaugaguggacuuu

SEQ ID NO: 455584 - RNA, 16 nt, Homo sapiens
caucaugaugcucaug

SEQ ID NO: 455585 - RNA, 16 nt, Homo sapiens
caucaugggcuggaca

SEQ ID NO: 455586 - RNA, 18 nt, Homo sapiens
cccuuaaggaauugacuu

SEQ ID NO: 455587 - RNA, 20 nt, Homo sapiens
cccuuaauaaacucacaacu

SEQ ID NO: 455588 - RNA, 22 nt, Homo sapiens
cccuucaaccauuccccauggg

SEQ ID NO: 455589 - RNA, 19 nt, Homo sapiens
cccuucaaugcaaaauaca

SEQ ID NO: 455590 - RNA, 14 nt, Homo sapiens
cccuucacgcuggc

SEQ ID NO: 455591 - RNA, 13 nt, Homo sapiens
cccuuccaguggg

SEQ ID NO: 455592 - RNA, 19 nt, Homo sapiens
cccuuccccugcugaccuu

SEQ ID NO: 455593 - RNA, 15 nt, Homo sapiens
cccuucuccuuccaa

SEQ ID NO: 455594 - RNA, 20 nt, Homo sapiens
ggaugggacacccaacacuu

SEQ ID NO: 455595 - RNA, 14 nt, Homo sapiens
ggaugugugucuca

SEQ ID NO: 455596 - RNA, 23 nt, Homo sapiens
ggauguuauucuuccuucccaac

SEQ ID NO: 455597 - RNA, 21 nt, Homo sapiens
ggauuaugaagugacucucac

SEQ ID NO: 455598 - RNA, 14 nt, Homo sapiens
ggauuauucauuua

SEQ ID NO: 455599 - RNA, 19 nt, Homo sapiens
ggauuccgucuucucucau

SEQ ID NO: 455600 - RNA, 22 nt, Homo sapiens
ggauuccuaagcagugcuugua

SEQ ID NO: 455601 - RNA, 17 nt, Homo sapiens
ggauugggagauuucau

SEQ ID NO: 455602 - RNA, 15 nt, Homo sapiens
ggauuuaccaaauag

SEQ ID NO: 455603 - RNA, 18 nt, Homo sapiens
ggauuuuagugcuugcca

SEQ ID NO: 455604 - RNA, 12 nt, Homo sapiens
ggcaaacaggca

SEQ ID NO: 455605 - RNA, 22 nt, Homo sapiens
ggcaaagagagucgcaucucag

SEQ ID NO: 455606 - RNA, 15 nt, Homo sapiens
ggcaaauggggugca

SEQ ID NO: 455607 - RNA, 16 nt, Homo sapiens
ggcaaauguagcccug

SEQ ID NO: 455608 - RNA, 21 nt, Homo sapiens
ggcaacgugcgugucucugcc

SEQ ID NO: 455609 - RNA, 13 nt, Homo sapiens
ggcaaggccuuug

SEQ ID NO: 455610 - RNA, 16 nt, Homo sapiens
ggcaagggaccugcuu

SEQ ID NO: 455611 - RNA, 16 nt, Homo sapiens
ggcaauaguguguucu

SEQ ID NO: 455612 - RNA, 19 nt, Homo sapiens
ggcaaucuuugccuuuauc

SEQ ID NO: 455613 - RNA, 15 nt, Homo sapiens
ggcaaugacugugag

SEQ ID NO: 455614 - RNA, 21 nt, Homo sapiens
ggcacagagucgaugcucaau

SEQ ID NO: 455615 - RNA, 16 nt, Homo sapiens
ggcacccaauguuuga

SEQ ID NO: 455616 - RNA, 15 nt, Homo sapiens
ggcacccccaugcug

SEQ ID NO: 455617 - RNA, 16 nt, Homo sapiens
ggcaccuucauucucc

SEQ ID NO: 455618 - RNA, 14 nt, Homo sapiens
ggcacuauccagaa

SEQ ID NO: 455619 - RNA, 14 nt, Homo sapiens
ggcacuguggccuu

SEQ ID NO: 455620 - RNA, 19 nt, Homo sapiens
ggcagaaaacuggcagugc

SEQ ID NO: 455621 - RNA, 19 nt, Homo sapiens
ggcagaauggugggcucca

SEQ ID NO: 455622 - RNA, 19 nt, Homo sapiens
ggcagaccgugaccaucuu

SEQ ID NO: 455623 - RNA, 18 nt, Homo sapiens
ggcagagguuucuagggu

SEQ ID NO: 455624 - RNA, 18 nt, Homo sapiens
ggcagcaucagggacaca

SEQ ID NO: 455625 - RNA, 14 nt, Homo sapiens
ggcagcaucuucac

SEQ ID NO: 455626 - RNA, 14 nt, Homo sapiens
ggcagcccagugga

SEQ ID NO: 455627 - RNA, 13 nt, Homo sapiens
ggcagcucuccag

SEQ ID NO: 455628 - RNA, 22 nt, Homo sapiens
ggcaggaaaaggugauauccau

SEQ ID NO: 455629 - RNA, 22 nt, Homo sapiens
ggcaggaguauaugagcauccu

SEQ ID NO: 455630 - RNA, 21 nt, Homo sapiens
ggcaggcaccugggcuuucug

SEQ ID NO: 455631 - RNA, 13 nt, Homo sapiens
ggcaggugccuug

SEQ ID NO: 455632 - RNA, 18 nt, Homo sapiens
ggcagguugaucagugag

SEQ ID NO: 455633 - RNA, 21 nt, Homo sapiens
ggcaguagacuauaagcagaa

SEQ ID NO: 455634 - RNA, 19 nt, Homo sapiens
ggcagucacugaauuccau

SEQ ID NO: 455635 - RNA, 15 nt, Homo sapiens
ggcagugcaugugga

SEQ ID NO: 455636 - RNA, 14 nt, Homo sapiens
ggcagugggaccca

SEQ ID NO: 455637 - RNA, 12 nt, Homo sapiens
ggcauacuuucu

SEQ ID NO: 455638 - RNA, 18 nt, Homo sapiens
ggcaucuaagacauucac

SEQ ID NO: 455639 - RNA, 15 nt, Homo sapiens
ggcaugacagcuguu

SEQ ID NO: 455640 - RNA, 22 nt, Homo sapiens
ggcaugguauaaggaaauauca

SEQ ID NO: 455641 - RNA, 14 nt, Homo sapiens
ggcaugugcuguga

SEQ ID NO: 455642 - RNA, 14 nt, Homo sapiens
ggcauuacucugca

SEQ ID NO: 455643 - RNA, 12 nt, Homo sapiens
ggcauuagcacu

SEQ ID NO: 455644 - RNA, 11 nt, Homo sapiens
ggcauuugccu

SEQ ID NO: 455645 - RNA, 19 nt, Homo sapiens
ggccaaaaagaaucugcau

SEQ ID NO: 455646 - RNA, 12 nt, Homo sapiens
ggccaagccugc

SEQ ID NO: 455647 - RNA, 14 nt, Homo sapiens
ggccaagguccugc

SEQ ID NO: 455648 - RNA, 23 nt, Homo sapiens
ggccaaucacugaguuuguggug

SEQ ID NO: 455649 - RNA, 14 nt, Homo sapiens
ggccacacgcugcc

SEQ ID NO: 455650 - RNA, 17 nt, Homo sapiens
ggccaccccgugccacc

SEQ ID NO: 455651 - RNA, 21 nt, Homo sapiens
ggccaccugcaggucacugaa

SEQ ID NO: 455652 - RNA, 18 nt, Homo sapiens
ggccacucccugccaacu

SEQ ID NO: 455653 - RNA, 16 nt, Homo sapiens
ggccacucuaccugaa

SEQ ID NO: 455654 - RNA, 14 nt, Homo sapiens
ggccagacuggcug

SEQ ID NO: 455655 - RNA, 17 nt, Homo sapiens
ggccagcuucgugcugg

SEQ ID NO: 455656 - RNA, 21 nt, Homo sapiens
ggccaggccauggccaagggg

SEQ ID NO: 455657 - RNA, 20 nt, Homo sapiens
ggccagggucucgucaggag

SEQ ID NO: 455658 - RNA, 13 nt, Homo sapiens
ggccagguggcca

SEQ ID NO: 455659 - RNA, 12 nt, Homo sapiens
ggccaguggaca

SEQ ID NO: 455660 - RNA, 18 nt, Homo sapiens
ggccaucucugaacuuca

SEQ ID NO: 455661 - RNA, 21 nt, Homo sapiens
ggccauggaauaaaccauuuu

SEQ ID NO: 455662 - RNA, 13 nt, Homo sapiens
ggcccaauucugc

SEQ ID NO: 455663 - RNA, 17 nt, Homo sapiens
ggcccacuucaccguac

SEQ ID NO: 455664 - RNA, 13 nt, Homo sapiens
ggcccaucugccg

SEQ ID NO: 455665 - RNA, 15 nt, Homo sapiens
ggccccacucaggga

SEQ ID NO: 455666 - RNA, 15 nt, Homo sapiens
ggccccccuccaggc

SEQ ID NO: 455667 - RNA, 15 nt, Homo sapiens
ggccccuaccagcca

SEQ ID NO: 455668 - RNA, 14 nt, Homo sapiens
ggcccgccaccuug

SEQ ID NO: 455669 - RNA, 23 nt, Homo sapiens
ggcccuuccucuccacugccuuc

SEQ ID NO: 455670 - RNA, 14 nt, Homo sapiens
ggcccuugcccaac

SEQ ID NO: 455671 - RNA, 20 nt, Homo sapiens
ggccgaaaaggauaugcagu

SEQ ID NO: 455672 - RNA, 18 nt, Homo sapiens
ggccgaaccccccacucc

SEQ ID NO: 455673 - RNA, 14 nt, Homo sapiens
ggccgccuguccuu

SEQ ID NO: 455674 - RNA, 18 nt, Homo sapiens
ggccgcucgaugccuuug

SEQ ID NO: 455675 - RNA, 20 nt, Homo sapiens
ggccuagucagauggaugua

SEQ ID NO: 455676 - RNA, 13 nt, Homo sapiens
ggccuaguggcuu

SEQ ID NO: 455677 - RNA, 16 nt, Homo sapiens
ggccucacuccaggaa

SEQ ID NO: 455678 - RNA, 16 nt, Homo sapiens
ggccucagaccaacuc

SEQ ID NO: 455679 - RNA, 13 nt, Homo sapiens
ggccucccagcca

SEQ ID NO: 455680 - RNA, 15 nt, Homo sapiens
ggccucugacucuga

SEQ ID NO: 455681 - RNA, 20 nt, Homo sapiens
ggccucugacucugagucca

SEQ ID NO: 455682 - RNA, 15 nt, Homo sapiens
ggccuggcccagcca

SEQ ID NO: 455683 - RNA, 16 nt, Homo sapiens
ggccuggccuauuuaa

SEQ ID NO: 455684 - RNA, 15 nt, Homo sapiens
ggccugggagggcaa

SEQ ID NO: 455685 - RNA, 22 nt, Homo sapiens
ggccugggggcagugacuggca

SEQ ID NO: 455686 - RNA, 22 nt, Homo sapiens
ggccuguccaccugugcugcug

SEQ ID NO: 455687 - RNA, 16 nt, Homo sapiens
ggccugucgugccagu

SEQ ID NO: 455688 - RNA, 21 nt, Homo sapiens
ggccugugagguaacugggau

SEQ ID NO: 455689 - RNA, 11 nt, Homo sapiens
ggccuucucac

SEQ ID NO: 455690 - RNA, 18 nt, Homo sapiens
ggccuucuccacagggac

SEQ ID NO: 455691 - RNA, 16 nt, Homo sapiens
ggccuucugauuucaa

SEQ ID NO: 455692 - RNA, 23 nt, Homo sapiens
ggccuugagcaagucccaucuca

SEQ ID NO: 455693 - RNA, 19 nt, Homo sapiens
ggccuugucucuuccucug

SEQ ID NO: 455694 - RNA, 14 nt, Homo sapiens
ggccuuguggcacu

SEQ ID NO: 455695 - RNA, 17 nt, Homo sapiens
ggccuuugggauuugcc

SEQ ID NO: 455696 - RNA, 21 nt, Homo sapiens
ggcgaagcugagcgggucuag

SEQ ID NO: 455697 - RNA, 20 nt, Homo sapiens
ggcgccccugccaccucccu

SEQ ID NO: 455698 - RNA, 22 nt, Homo sapiens
ggcgccccugccaccucccuga

SEQ ID NO: 455699 - RNA, 15 nt, Homo sapiens
ggcgucugucuucaa

SEQ ID NO: 455700 - RNA, 18 nt, Homo sapiens
ggcgugcuccuuuucucu

SEQ ID NO: 455701 - RNA, 14 nt, Homo sapiens
ggcgugugagucag

SEQ ID NO: 455702 - RNA, 21 nt, Homo sapiens
ggcuaacuauauuugcuuuuu

SEQ ID NO: 455703 - RNA, 20 nt, Homo sapiens
ggcuaagaaauagacaguca

SEQ ID NO: 455704 - RNA, 21 nt, Homo sapiens
ggcuaagaugagauuugccag

SEQ ID NO: 455705 - RNA, 22 nt, Homo sapiens
ggcuacuaaaauauuaguguua

SEQ ID NO: 455706 - RNA, 21 nt, Homo sapiens
ggcuagacacccauuuucaca

SEQ ID NO: 455707 - RNA, 18 nt, Homo sapiens
ggcuaugccugccucaaa

SEQ ID NO: 455708 - RNA, 17 nt, Homo sapiens
ggcuauggaggguccuc

SEQ ID NO: 455709 - RNA, 17 nt, Homo sapiens
ggcuauuuguguguaug

SEQ ID NO: 455710 - RNA, 22 nt, Homo sapiens
ggcucauaccuggcuugcaggg

SEQ ID NO: 455711 - RNA, 16 nt, Homo sapiens
ggcucccacagagaca

SEQ ID NO: 455712 - RNA, 14 nt, Homo sapiens
ggcucccaugacca

SEQ ID NO: 455713 - RNA, 18 nt, Homo sapiens
ggcucccggggcagggca

SEQ ID NO: 455714 - RNA, 21 nt, Homo sapiens
ggcuccgagggcggccaggga

SEQ ID NO: 455715 - RNA, 17 nt, Homo sapiens
ggcuccgucaguaucag

SEQ ID NO: 455716 - RNA, 13 nt, Homo sapiens
ccuggacuuuccu

SEQ ID NO: 455717 - RNA, 15 nt, Homo sapiens
ccuggagaaggcauu

SEQ ID NO: 455718 - RNA, 18 nt, Homo sapiens
ccuggagaaggcauucca

SEQ ID NO: 455719 - RNA, 14 nt, Homo sapiens
ccuggagagacaga

SEQ ID NO: 455720 - RNA, 19 nt, Homo sapiens
ccuggagauugugcucugc

SEQ ID NO: 455721 - RNA, 17 nt, Homo sapiens
ccuggagccuccacugc

SEQ ID NO: 455722 - RNA, 21 nt, Homo sapiens
ccuggauuuccugcugccauc

SEQ ID NO: 455723 - RNA, 15 nt, Homo sapiens
ccuggcaagugaccc

SEQ ID NO: 455724 - RNA, 23 nt, Homo sapiens
ccuggcaggugccccgugguaca

SEQ ID NO: 455725 - RNA, 20 nt, Homo sapiens
ccuggcaucugacacugaca

SEQ ID NO: 455726 - RNA, 17 nt, Homo sapiens
ccuggccaggagcucuu

SEQ ID NO: 455727 - RNA, 14 nt, Homo sapiens
ccuggcccaucuca

SEQ ID NO: 455728 - RNA, 16 nt, Homo sapiens
ccuggcucagccucaa

SEQ ID NO: 455729 - RNA, 21 nt, Homo sapiens
ccuggcuccaacacugcugcu

SEQ ID NO: 455730 - RNA, 16 nt, Homo sapiens
ccuggcugugcacauu

SEQ ID NO: 455731 - RNA, 16 nt, Homo sapiens
ccuggcuugcagggaa

SEQ ID NO: 455732 - RNA, 18 nt, Homo sapiens
ccugggccaccaugcacu

SEQ ID NO: 455733 - RNA, 16 nt, Homo sapiens
ccugggcccuaggcau

SEQ ID NO: 455734 - RNA, 12 nt, Homo sapiens
ccuggggaccau

SEQ ID NO: 455735 - RNA, 21 nt, Homo sapiens
ccugggggcagugacuggcag

SEQ ID NO: 455736 - RNA, 18 nt, Homo sapiens
ccugggggccgugcucac

SEQ ID NO: 455737 - RNA, 14 nt, Homo sapiens
ccuggggugcccuc

SEQ ID NO: 455738 - RNA, 22 nt, Homo sapiens
ccugggucaccuuccugggcag

SEQ ID NO: 455739 - RNA, 18 nt, Homo sapiens
ccugggugacagagugag

SEQ ID NO: 455740 - RNA, 20 nt, Homo sapiens
ccuggguggggcagggccug

SEQ ID NO: 455741 - RNA, 14 nt, Homo sapiens
ccugguaccagagg

SEQ ID NO: 455742 - RNA, 19 nt, Homo sapiens
ccuggucaacauggugaaa

SEQ ID NO: 455743 - RNA, 22 nt, Homo sapiens
ccugguccagauuguagcucuu

SEQ ID NO: 455744 - RNA, 14 nt, Homo sapiens
ccugguccaugaug

SEQ ID NO: 455745 - RNA, 19 nt, Homo sapiens
ccuggucccuuggagacaa

SEQ ID NO: 455746 - RNA, 18 nt, Homo sapiens
ccuguaaucccaacacuu

SEQ ID NO: 455747 - RNA, 20 nt, Homo sapiens
ccuguaaucccaacacuuug

SEQ ID NO: 455748 - RNA, 21 nt, Homo sapiens
ccuguaaucccaacacuuugg

SEQ ID NO: 455749 - RNA, 18 nt, Homo sapiens
ccuguagacuagugccgu

SEQ ID NO: 455750 - RNA, 21 nt, Homo sapiens
ccugucaccaaggacguuaaa

SEQ ID NO: 455751 - RNA, 16 nt, Homo sapiens
ccugucccauucuaga

SEQ ID NO: 455752 - RNA, 16 nt, Homo sapiens
ccugucccuggccauc

SEQ ID NO: 455753 - RNA, 17 nt, Homo sapiens
ccuguccuaagcacuuu

SEQ ID NO: 455754 - RNA, 17 nt, Homo sapiens
ccugucuccucugucag

SEQ ID NO: 455755 - RNA, 21 nt, Homo sapiens
ccugugagcuccccaauccaa

SEQ ID NO: 455756 - RNA, 23 nt, Homo sapiens
ccugugaugucaugaaagcaccu

SEQ ID NO: 455757 - RNA, 14 nt, Homo sapiens
ccugugcacagcca

SEQ ID NO: 455758 - RNA, 15 nt, Homo sapiens
ccugugcacagccau

SEQ ID NO: 455759 - RNA, 22 nt, Homo sapiens
ccugugccaaccugaugccccu

SEQ ID NO: 455760 - RNA, 19 nt, Homo sapiens
ccugugccuaacaccagcg

SEQ ID NO: 455761 - RNA, 16 nt, Homo sapiens
ccugugccuaacagca

SEQ ID NO: 455762 - RNA, 17 nt, Homo sapiens
ccugugccuaacagcau

SEQ ID NO: 455763 - RNA, 21 nt, Homo sapiens
ccugugcugggccaguggcug

SEQ ID NO: 455764 - RNA, 23 nt, Homo sapiens
ccugugcuuuuggagcugagauc

SEQ ID NO: 455765 - RNA, 21 nt, Homo sapiens
ccuguggggccugauggugcu

SEQ ID NO: 455766 - RNA, 17 nt, Homo sapiens
ccugugucugguccaca

SEQ ID NO: 455767 - RNA, 22 nt, Homo sapiens
ccuguguggaguuauucacucu

SEQ ID NO: 455768 - RNA, 22 nt, Homo sapiens
ccuguguuggggggcaaggugg

SEQ ID NO: 455769 - RNA, 10 nt, Homo sapiens
ccuguuaaau

SEQ ID NO: 455770 - RNA, 17 nt, Homo sapiens
ccuguucaaaguacuaa

SEQ ID NO: 455771 - RNA, 14 nt, Homo sapiens
ccuguucacucuac

SEQ ID NO: 455772 - RNA, 22 nt, Homo sapiens
ccuguucgugcuuguaaugcuc

SEQ ID NO: 455773 - RNA, 17 nt, Homo sapiens
ccuguugaauuuacucu

SEQ ID NO: 455774 - RNA, 15 nt, Homo sapiens
ccuguugcaccucag

SEQ ID NO: 455775 - RNA, 21 nt, Homo sapiens
ccuuaaaaauuaaauucucuc

SEQ ID NO: 455776 - RNA, 17 nt, Homo sapiens
ccuuaaaaugcauugaa

SEQ ID NO: 455777 - RNA, 23 nt, Homo sapiens
ccuuaagaaagcuauauaugaau

SEQ ID NO: 455778 - RNA, 21 nt, Homo sapiens
ccuuaagagcuguugccuuau

SEQ ID NO: 455779 - RNA, 19 nt, Homo sapiens
ccuuaauaugaucugugga

SEQ ID NO: 455780 - RNA, 13 nt, Homo sapiens
ccuuacuauucau

SEQ ID NO: 455781 - RNA, 19 nt, Homo sapiens
ccuuagagauugccccaga

SEQ ID NO: 455782 - RNA, 12 nt, Homo sapiens
ccuuagcagcuc

SEQ ID NO: 455783 - RNA, 15 nt, Homo sapiens
ccuuagucucaaggg

SEQ ID NO: 455784 - RNA, 23 nt, Homo sapiens
ccuucaaggaagugauaacacug

SEQ ID NO: 455785 - RNA, 20 nt, Homo sapiens
ccuucacucugacaguauua

SEQ ID NO: 455786 - RNA, 13 nt, Homo sapiens
ccuucacuggaga

SEQ ID NO: 455787 - RNA, 13 nt, Homo sapiens
ccuucacuucuga

SEQ ID NO: 455788 - RNA, 14 nt, Homo sapiens
ccuucagagugaau

SEQ ID NO: 455789 - RNA, 17 nt, Homo sapiens
ccuucagcauaauucgg

SEQ ID NO: 455790 - RNA, 20 nt, Homo sapiens
ccuucaucuucacugcaauu

SEQ ID NO: 455791 - RNA, 17 nt, Homo sapiens
ccuucaugcuuacuauu

SEQ ID NO: 455792 - RNA, 12 nt, Homo sapiens
ccuucaugcuuu

SEQ ID NO: 455793 - RNA, 15 nt, Homo sapiens
ccuucauuucaucua

SEQ ID NO: 455794 - RNA, 13 nt, Homo sapiens
ccuuccaacugcu

SEQ ID NO: 455795 - RNA, 20 nt, Homo sapiens
ccuuccacuuugaguaccaa

SEQ ID NO: 455796 - RNA, 23 nt, Homo sapiens
ccuuccagcccagacccccagug

SEQ ID NO: 455797 - RNA, 20 nt, Homo sapiens
ccuuccaggcguagggccag

SEQ ID NO: 455798 - RNA, 17 nt, Homo sapiens
ccuucccaguagcucuu

SEQ ID NO: 455799 - RNA, 14 nt, Homo sapiens
ccuuccccauuucc

SEQ ID NO: 455800 - RNA, 15 nt, Homo sapiens
ccuucccucuaagcc

SEQ ID NO: 455801 - RNA, 13 nt, Homo sapiens
ccuucccuuccac

SEQ ID NO: 455802 - RNA, 14 nt, Homo sapiens
ccuuccucacuucc

SEQ ID NO: 455803 - RNA, 17 nt, Homo sapiens
ccuuccuggacuggccc

SEQ ID NO: 455804 - RNA, 17 nt, Homo sapiens
ccuucggaauccagugc

SEQ ID NO: 455805 - RNA, 16 nt, Homo sapiens
ccuucuagacacugaa

SEQ ID NO: 455806 - RNA, 23 nt, Homo sapiens
ccuucucacagcacaugcuggcc

SEQ ID NO: 455807 - RNA, 13 nt, Homo sapiens
ccuucucagggac

SEQ ID NO: 455808 - RNA, 20 nt, Homo sapiens
ccuucuccccugcacuguaa

SEQ ID NO: 455809 - RNA, 18 nt, Homo sapiens
ccuucucuucuauccugc

SEQ ID NO: 455810 - RNA, 18 nt, Homo sapiens
ccuucucuucucuuugcu

SEQ ID NO: 455811 - RNA, 14 nt, Homo sapiens
ccuucugaccccac

SEQ ID NO: 455812 - RNA, 18 nt, Homo sapiens
ccuucugcuguauacugu

SEQ ID NO: 455813 - RNA, 19 nt, Homo sapiens
ccuucuuuaccuucauuuc

SEQ ID NO: 455814 - RNA, 23 nt, Homo sapiens
ccuugacauuguagagcuucugg

SEQ ID NO: 455815 - RNA, 18 nt, Homo sapiens
ccuugacuucugcccaaa

SEQ ID NO: 455816 - RNA, 20 nt, Homo sapiens
ccuugagcuaagcagaauaa

SEQ ID NO: 455817 - RNA, 16 nt, Homo sapiens
ccuugagcugccugcu

SEQ ID NO: 455818 - RNA, 19 nt, Homo sapiens
ccuugcacaaaaagcacaa

SEQ ID NO: 455819 - RNA, 15 nt, Homo sapiens
ccuugcacaggccac

SEQ ID NO: 455820 - RNA, 22 nt, Homo sapiens
ccuugcacaggccacuugcuca

SEQ ID NO: 455821 - RNA, 23 nt, Homo sapiens
ccuugcacaggccacuugcucag

SEQ ID NO: 455822 - RNA, 19 nt, Homo sapiens
ccuugccucaaugccagua

SEQ ID NO: 455823 - RNA, 15 nt, Homo sapiens
ccuuggaaggugaca

SEQ ID NO: 455824 - RNA, 19 nt, Homo sapiens
ccuuggcacccccaugcug

SEQ ID NO: 455825 - RNA, 18 nt, Homo sapiens
ccuuggccgcaccuaaag

SEQ ID NO: 455826 - RNA, 17 nt, Homo sapiens
ccuuguccucagggcua

SEQ ID NO: 455827 - RNA, 17 nt, Homo sapiens
ccuuguccugccagcug

SEQ ID NO: 455828 - RNA, 18 nt, Homo sapiens
ccuugucucuacuaaaaa

SEQ ID NO: 455829 - RNA, 14 nt, Homo sapiens
ccuugucugcugcu

SEQ ID NO: 455830 - RNA, 19 nt, Homo sapiens
ccuugugagagcccauucc

SEQ ID NO: 455831 - RNA, 16 nt, Homo sapiens
ccuugugcguggguga

SEQ ID NO: 455832 - RNA, 16 nt, Homo sapiens
ccuuguuaaaauccaa

SEQ ID NO: 455833 - RNA, 17 nt, Homo sapiens
ccuuuaaaucugugaug

SEQ ID NO: 455834 - RNA, 23 nt, Homo sapiens
ccuuuaaaucugugaugauccuc

SEQ ID NO: 455835 - RNA, 16 nt, Homo sapiens
ccuuucaaauuucaca

SEQ ID NO: 455836 - RNA, 12 nt, Homo sapiens
ccuuucacuuua

SEQ ID NO: 455837 - RNA, 14 nt, Homo sapiens
ccuuucagucccaa

SEQ ID NO: 455838 - RNA, 21 nt, Homo sapiens
ccuuuccuguucaugacagcu

SEQ ID NO: 455839 - RNA, 11 nt, Homo sapiens
ccuuucuaguu

SEQ ID NO: 455840 - RNA, 13 nt, Homo sapiens
ccuuucuccugau

SEQ ID NO: 455841 - RNA, 22 nt, Homo sapiens
ccuuucucgugguagaagccag

SEQ ID NO: 455842 - RNA, 20 nt, Homo sapiens
ccuuucugacaauaaauaau

SEQ ID NO: 455843 - RNA, 15 nt, Homo sapiens
ccuuucuuacauuag

SEQ ID NO: 455844 - RNA, 18 nt, Homo sapiens
ccuuugaaagcuguauaa

SEQ ID NO: 455845 - RNA, 23 nt, Homo sapiens
ccuuugagugucaggcucugaau

SEQ ID NO: 455846 - RNA, 20 nt, Homo sapiens
acagagcaagacucugucuc

SEQ ID NO: 455847 - RNA, 22 nt, Homo sapiens
acagagggaaacacagcagcuu

SEQ ID NO: 455848 - RNA, 23 nt, Homo sapiens
acagagggaaaggcugaacauaa

SEQ ID NO: 455849 - RNA, 17 nt, Homo sapiens
acagaguauauauguac

SEQ ID NO: 455850 - RNA, 15 nt, Homo sapiens
acagagucucacuuu

SEQ ID NO: 455851 - RNA, 22 nt, Homo sapiens
acagagugcagcagcgagcaaa

SEQ ID NO: 455852 - RNA, 13 nt, Homo sapiens
acagagugcauug

SEQ ID NO: 455853 - RNA, 23 nt, Homo sapiens
acagauaaugcuuuuacuaagca

SEQ ID NO: 455854 - RNA, 19 nt, Homo sapiens
acagauaggaauuccuuau

SEQ ID NO: 455855 - RNA, 21 nt, Homo sapiens
acagauauuccagaccaaaau

SEQ ID NO: 455856 - RNA, 16 nt, Homo sapiens
acagaucaaaugugaa

SEQ ID NO: 455857 - RNA, 12 nt, Homo sapiens
acagaugaaggu

SEQ ID NO: 455858 - RNA, 15 nt, Homo sapiens
acagaugcuaauaaa

SEQ ID NO: 455859 - RNA, 20 nt, Homo sapiens
acagauggaauuagaaauau

SEQ ID NO: 455860 - RNA, 16 nt, Homo sapiens
acagauggauuugccu

SEQ ID NO: 455861 - RNA, 19 nt, Homo sapiens
acagaugggcaaggccuuu

SEQ ID NO: 455862 - RNA, 15 nt, Homo sapiens
acagauugcugcuuc

SEQ ID NO: 455863 - RNA, 14 nt, Homo sapiens
acagcagcagcuca

SEQ ID NO: 455864 - RNA, 23 nt, Homo sapiens
acagcagccuggaagccucggca

SEQ ID NO: 455865 - RNA, 23 nt, Homo sapiens
acagcagcuucaccagagcauuu

SEQ ID NO: 455866 - RNA, 19 nt, Homo sapiens
acagcaggagggacaauga

SEQ ID NO: 455867 - RNA, 13 nt, Homo sapiens
acagcaguaugaa

SEQ ID NO: 455868 - RNA, 18 nt, Homo sapiens
acagcagucccaguauuc

SEQ ID NO: 455869 - RNA, 15 nt, Homo sapiens
acagcauaauugccu

SEQ ID NO: 455870 - RNA, 16 nt, Homo sapiens
acagcauaauugccuu

SEQ ID NO: 455871 - RNA, 21 nt, Homo sapiens
acagccccggaaugcuuccag

SEQ ID NO: 455872 - RNA, 23 nt, Homo sapiens
acagccucccacccccaucucuc

SEQ ID NO: 455873 - RNA, 18 nt, Homo sapiens
acagccuggcacagggca

SEQ ID NO: 455874 - RNA, 22 nt, Homo sapiens
acagcggcccggcccacgcaga

SEQ ID NO: 455875 - RNA, 21 nt, Homo sapiens
acagcucaccaacuacagaaa

SEQ ID NO: 455876 - RNA, 17 nt, Homo sapiens
acagcucaggaucucuu

SEQ ID NO: 455877 - RNA, 19 nt, Homo sapiens
acagcucuacguggcaaau

SEQ ID NO: 455878 - RNA, 17 nt, Homo sapiens
acagcugccucugccac

SEQ ID NO: 455879 - RNA, 21 nt, Homo sapiens
acagcugcuucugugcauuug

SEQ ID NO: 455880 - RNA, 20 nt, Homo sapiens
acagcuucuugcuuguaaaa

SEQ ID NO: 455881 - RNA, 21 nt, Homo sapiens
acagcuuucccagguauaaaa

SEQ ID NO: 455882 - RNA, 22 nt, Homo sapiens
acaggaacugugagagucuuug

SEQ ID NO: 455883 - RNA, 15 nt, Homo sapiens
acaggacuagcugga

SEQ ID NO: 455884 - RNA, 22 nt, Homo sapiens
acaggacuuucauuguucuugg

SEQ ID NO: 455885 - RNA, 23 nt, Homo sapiens
acaggaggcccccaucuaugagc

SEQ ID NO: 455886 - RNA, 17 nt, Homo sapiens
acaggcaacauuacaaa

SEQ ID NO: 455887 - RNA, 18 nt, Homo sapiens
acaggcagacacaugcug

SEQ ID NO: 455888 - RNA, 23 nt, Homo sapiens
acaggcccggcccagccuaggcc

SEQ ID NO: 455889 - RNA, 16 nt, Homo sapiens
acaggcccuuccucuc

SEQ ID NO: 455890 - RNA, 20 nt, Homo sapiens
acaggcgccugccaucaugc

SEQ ID NO: 455891 - RNA, 22 nt, Homo sapiens
acagggaggggcugauccugcc

SEQ ID NO: 455892 - RNA, 15 nt, Homo sapiens
acaggggacacugaa

SEQ ID NO: 455893 - RNA, 17 nt, Homo sapiens
acaggggcaucucuggg

SEQ ID NO: 455894 - RNA, 22 nt, Homo sapiens
acaggggcccauggacucuuca

SEQ ID NO: 455895 - RNA, 19 nt, Homo sapiens
acaggggccccagaucugc

SEQ ID NO: 455896 - RNA, 17 nt, Homo sapiens
acaggggugucuugucu

SEQ ID NO: 455897 - RNA, 21 nt, Homo sapiens
acaggguuuuguauucuuuac

SEQ ID NO: 455898 - RNA, 21 nt, Homo sapiens
acaggugugugccaucaugcc

SEQ ID NO: 455899 - RNA, 15 nt, Homo sapiens
acagguucuaugauu

SEQ ID NO: 455900 - RNA, 19 nt, Homo sapiens
acagguuuucagcaacuca

SEQ ID NO: 455901 - RNA, 20 nt, Homo sapiens
acagguuuucagcaacucag

SEQ ID NO: 455902 - RNA, 21 nt, Homo sapiens
acagguuuucuucuaaucaua

SEQ ID NO: 455903 - RNA, 14 nt, Homo sapiens
acaguaaaucucac

SEQ ID NO: 455904 - RNA, 19 nt, Homo sapiens
acaguacacagauaccuug

SEQ ID NO: 455905 - RNA, 19 nt, Homo sapiens
acaguacagcuauuucuca

SEQ ID NO: 455906 - RNA, 22 nt, Homo sapiens
acaguagagcaaaucuaugaga

SEQ ID NO: 455907 - RNA, 21 nt, Homo sapiens
acaguaugagucaaugugcag

SEQ ID NO: 455908 - RNA, 14 nt, Homo sapiens
acaguauguucaaa

SEQ ID NO: 455909 - RNA, 18 nt, Homo sapiens
acagucaaaauguuugau

SEQ ID NO: 455910 - RNA, 15 nt, Homo sapiens
acagucuccauaagg

SEQ ID NO: 455911 - RNA, 14 nt, Homo sapiens
acagugaggcugca

SEQ ID NO: 455912 - RNA, 21 nt, Homo sapiens
acaguggauugcucaucucag

SEQ ID NO: 455913 - RNA, 15 nt, Homo sapiens
acagugggggcacca

SEQ ID NO: 455914 - RNA, 19 nt, Homo sapiens
acaguguuagaugugcaca

SEQ ID NO: 455915 - RNA, 16 nt, Homo sapiens
acaguuaacuuucaga

SEQ ID NO: 455916 - RNA, 13 nt, Homo sapiens
acaguuaaugcca

SEQ ID NO: 455917 - RNA, 17 nt, Homo sapiens
acaguuaauuaugugca

SEQ ID NO: 455918 - RNA, 14 nt, Homo sapiens
acaguuacagagug

SEQ ID NO: 455919 - RNA, 18 nt, Homo sapiens
acaguuauacauaccucu

SEQ ID NO: 455920 - RNA, 23 nt, Homo sapiens
acaguugaguuucuucuaaagag

SEQ ID NO: 455921 - RNA, 22 nt, Homo sapiens
acaguuguaccacugcuaauaa

SEQ ID NO: 455922 - RNA, 20 nt, Homo sapiens
acaguuuagugcuuuacaug

SEQ ID NO: 455923 - RNA, 22 nt, Homo sapiens
acaguuuagugcuuuacaugcu

SEQ ID NO: 455924 - RNA, 13 nt, Homo sapiens
acaguuugagacu

SEQ ID NO: 455925 - RNA, 13 nt, Homo sapiens
acaguuugaugcu

SEQ ID NO: 455926 - RNA, 15 nt, Homo sapiens
aaaucaacuugugua

SEQ ID NO: 455927 - RNA, 12 nt, Homo sapiens
aaaucacuauaa

SEQ ID NO: 455928 - RNA, 18 nt, Homo sapiens
aaaucaguuaauggcuca

SEQ ID NO: 455929 - RNA, 19 nt, Homo sapiens
aaaucauacuuugccaaau

SEQ ID NO: 455930 - RNA, 17 nt, Homo sapiens
aaaucauuucaguauca

SEQ ID NO: 455931 - RNA, 23 nt, Homo sapiens
aaaucauuucauguuagucuuac

SEQ ID NO: 455932 - RNA, 17 nt, Homo sapiens
aaauccagaaguuuuaa

SEQ ID NO: 455933 - RNA, 22 nt, Homo sapiens
aaauccauacccccugccccag

SEQ ID NO: 455934 - RNA, 15 nt, Homo sapiens
aaauccauaucuuaa

SEQ ID NO: 455935 - RNA, 15 nt, Homo sapiens
aaauccccuccccaa

SEQ ID NO: 455936 - RNA, 18 nt, Homo sapiens
aaauccuaagcucagaga

SEQ ID NO: 455937 - RNA, 16 nt, Homo sapiens
aaauccuagacuugaa

SEQ ID NO: 455938 - RNA, 17 nt, Homo sapiens
aaauccuuccaaaaauu

SEQ ID NO: 455939 - RNA, 16 nt, Homo sapiens
aaaucuaaaucuucag

SEQ ID NO: 455940 - RNA, 19 nt, Homo sapiens
aaaucuaaucucuuauucu

SEQ ID NO: 455941 - RNA, 15 nt, Homo sapiens
aaaucucacaaauga

SEQ ID NO: 455942 - RNA, 22 nt, Homo sapiens
aaaucucacuuuucuccaugag

SEQ ID NO: 455943 - RNA, 15 nt, Homo sapiens
aaaucugaguauaua

SEQ ID NO: 455944 - RNA, 12 nt, Homo sapiens
aaaucugugaug

SEQ ID NO: 455945 - RNA, 13 nt, Homo sapiens
aaaugaacugaag

SEQ ID NO: 455946 - RNA, 21 nt, Homo sapiens
aaaugaagguuaggauuuaac

SEQ ID NO: 455947 - RNA, 19 nt, Homo sapiens
aaaugaauauucaacagcu

SEQ ID NO: 455948 - RNA, 22 nt, Homo sapiens
aaaugaauauucaacagcucac

SEQ ID NO: 455949 - RNA, 14 nt, Homo sapiens
aaaugagaacauga

SEQ ID NO: 455950 - RNA, 22 nt, Homo sapiens
aaaugagaaucugugcagucau

SEQ ID NO: 455951 - RNA, 17 nt, Homo sapiens
aaaugagcuuucaggaa

SEQ ID NO: 455952 - RNA, 21 nt, Homo sapiens
aaaugauccaguggacacuug

SEQ ID NO: 455953 - RNA, 14 nt, Homo sapiens
aaaugcagugaauu

SEQ ID NO: 455954 - RNA, 20 nt, Homo sapiens
aaaugcauauccugagccau

SEQ ID NO: 455955 - RNA, 12 nt, Homo sapiens
aaaugccagugu

SEQ ID NO: 455956 - RNA, 14 nt, Homo sapiens
aaaugccagugugc

SEQ ID NO: 455957 - RNA, 22 nt, Homo sapiens
aaaugcguuccucauccaugca

SEQ ID NO: 455958 - RNA, 13 nt, Homo sapiens
aaaugcuacucag

SEQ ID NO: 455959 - RNA, 23 nt, Homo sapiens
aaauggacguguuaugacuccag

SEQ ID NO: 455960 - RNA, 16 nt, Homo sapiens
aaauggauguaauaua

SEQ ID NO: 455961 - RNA, 13 nt, Homo sapiens
aaauggcaugaca

SEQ ID NO: 455962 - RNA, 18 nt, Homo sapiens
aaaugggacugaugucau

SEQ ID NO: 455963 - RNA, 16 nt, Homo sapiens
aaaugggccauuccag

SEQ ID NO: 455964 - RNA, 16 nt, Homo sapiens
aaauggguuggugcuu

SEQ ID NO: 455965 - RNA, 17 nt, Homo sapiens
aaaugguagcauacuuu

SEQ ID NO: 455966 - RNA, 18 nt, Homo sapiens
aaauggugauuucuugcu

SEQ ID NO: 455967 - RNA, 16 nt, Homo sapiens
aaauguaaagacaaaa

SEQ ID NO: 455968 - RNA, 22 nt, Homo sapiens
aaaugugccauuuuuuucacuc

SEQ ID NO: 455969 - RNA, 17 nt, Homo sapiens
aaaugugucugcaacau

SEQ ID NO: 455970 - RNA, 21 nt, Homo sapiens
aaauguuuucauuuacaggaa

SEQ ID NO: 455971 - RNA, 18 nt, Homo sapiens
aaauuaaagggcagauau

SEQ ID NO: 455972 - RNA, 17 nt, Homo sapiens
aaauuaauacugaagga

SEQ ID NO: 455973 - RNA, 13 nt, Homo sapiens
aaauuacaacaga

SEQ ID NO: 455974 - RNA, 16 nt, Homo sapiens
aaauuacaauugucau

SEQ ID NO: 455975 - RNA, 19 nt, Homo sapiens
aaauuaucuuuuuucuucc

SEQ ID NO: 455976 - RNA, 17 nt, Homo sapiens
aaauucacaagcugccu

SEQ ID NO: 455977 - RNA, 16 nt, Homo sapiens
aaauucaguaguaaca

SEQ ID NO: 455978 - RNA, 16 nt, Homo sapiens
aaauucaugcugcuua

SEQ ID NO: 455979 - RNA, 15 nt, Homo sapiens
aaauucuaagccaua

SEQ ID NO: 455980 - RNA, 14 nt, Homo sapiens
aaauucuagucucu

SEQ ID NO: 455981 - RNA, 21 nt, Homo sapiens
aaauucuauaggaacauauga

SEQ ID NO: 455982 - RNA, 15 nt, Homo sapiens
aaauugacagaugaa

SEQ ID NO: 455983 - RNA, 23 nt, Homo sapiens
aaauugagucauuuuauauauga

SEQ ID NO: 455984 - RNA, 17 nt, Homo sapiens
aaauuguguccacauaa

SEQ ID NO: 455985 - RNA, 15 nt, Homo sapiens
aaauuuaacugcaua

SEQ ID NO: 455986 - RNA, 13 nt, Homo sapiens
aaauuuaagcauu

SEQ ID NO: 455987 - RNA, 22 nt, Homo sapiens
aaauuugaaccaaaacauuccg

SEQ ID NO: 455988 - RNA, 14 nt, Homo sapiens
aaauuugagacaaa

SEQ ID NO: 455989 - RNA, 22 nt, Homo sapiens
aaauuuguugucauguguauga

SEQ ID NO: 455990 - RNA, 18 nt, Homo sapiens
aaauuuucacugcugcuc

SEQ ID NO: 455991 - RNA, 12 nt, Homo sapiens
aacaaaaugauc

SEQ ID NO: 455992 - RNA, 22 nt, Homo sapiens
aacaaacacuuagcaucccaca

SEQ ID NO: 455993 - RNA, 13 nt, Homo sapiens
aacaaauaugcaa

SEQ ID NO: 455994 - RNA, 18 nt, Homo sapiens
aacaacaaagcaugcuca

SEQ ID NO: 455995 - RNA, 19 nt, Homo sapiens
aacaacaauaacacugucu

SEQ ID NO: 455996 - RNA, 22 nt, Homo sapiens
aacaacaauuuaggaaugcuca

SEQ ID NO: 455997 - RNA, 12 nt, Homo sapiens
aacaacacuaau

SEQ ID NO: 455998 - RNA, 16 nt, Homo sapiens
aacaacagaucugcag

SEQ ID NO: 455999 - RNA, 19 nt, Homo sapiens
aacaacagucagccagcuu

SEQ ID NO: 456000 - RNA, 15 nt, Homo sapiens
aacaacugaccaguu

SEQ ID NO: 456001 - RNA, 14 nt, Homo sapiens
aacaacuuacuaaa

SEQ ID NO: 456002 - RNA, 19 nt, Homo sapiens
aacaacuuucucuuguaaa

SEQ ID NO: 456003 - RNA, 17 nt, Homo sapiens
aacaacuuuguuucuca

SEQ ID NO: 456004 - RNA, 18 nt, Homo sapiens
aacaacuuuguuucucau

SEQ ID NO: 456005 - RNA, 15 nt, Homo sapiens
aacaaguagcacacu

SEQ ID NO: 456006 - RNA, 14 nt, Homo sapiens
aacaaguguacaga

SEQ ID NO: 456007 - RNA, 14 nt, Homo sapiens
aacaauaugcuuua

SEQ ID NO: 456008 - RNA, 11 nt, Homo sapiens
aacaaucaaag

SEQ ID NO: 456009 - RNA, 15 nt, Homo sapiens
aacaaugaagauaaa

SEQ ID NO: 456010 - RNA, 19 nt, Homo sapiens
aacaauguuuuaaacauuc

SEQ ID NO: 456011 - RNA, 21 nt, Homo sapiens
aacaauuguguuuucgucaca

SEQ ID NO: 456012 - RNA, 19 nt, Homo sapiens
aacaauuugcauaauacua

SEQ ID NO: 456013 - RNA, 16 nt, Homo sapiens
aacacaaccauagccu

SEQ ID NO: 456014 - RNA, 13 nt, Homo sapiens
aacacaccuugcc

SEQ ID NO: 456015 - RNA, 21 nt, Homo sapiens
aacacacucuacaaaaugacu

SEQ ID NO: 456016 - RNA, 19 nt, Homo sapiens
aacacacugagacuugaau

SEQ ID NO: 456017 - RNA, 20 nt, Homo sapiens
aacacagaacucagccuuaa

SEQ ID NO: 456018 - RNA, 17 nt, Homo sapiens
aacacagcaugugccaa

SEQ ID NO: 456019 - RNA, 18 nt, Homo sapiens
aacacagcaugugccaag

SEQ ID NO: 456020 - RNA, 12 nt, Homo sapiens
aacaccacaaac

SEQ ID NO: 456021 - RNA, 13 nt, Homo sapiens
aacaccacuuaau

SEQ ID NO: 456022 - RNA, 14 nt, Homo sapiens
aacaccacuuaauc

SEQ ID NO: 456023 - RNA, 19 nt, Homo sapiens
aacacccagccagucacau

SEQ ID NO: 456024 - RNA, 15 nt, Homo sapiens
aacaccuucuuggcu

SEQ ID NO: 456025 - RNA, 19 nt, Homo sapiens
aacacggggcuugcaacuu

SEQ ID NO: 456026 - RNA, 21 nt, Homo sapiens
aacacggggcuugcaacuuag

SEQ ID NO: 456027 - RNA, 22 nt, Homo sapiens
aacacuaauaauaguacuauua

SEQ ID NO: 456028 - RNA, 17 nt, Homo sapiens
aacacucuucuugagca

SEQ ID NO: 456029 - RNA, 13 nt, Homo sapiens
aacacugcugcuc

SEQ ID NO: 456030 - RNA, 13 nt, Homo sapiens
aacacuguacuga

SEQ ID NO: 456031 - RNA, 14 nt, Homo sapiens
aacagaagcaguug

SEQ ID NO: 456032 - RNA, 20 nt, Homo sapiens
aacagacauagacugcaaaa

SEQ ID NO: 456033 - RNA, 20 nt, Homo sapiens
aacagagaaucucuagugaa

SEQ ID NO: 456034 - RNA, 19 nt, Homo sapiens
aacuguacaguuucuuccc

SEQ ID NO: 456035 - RNA, 13 nt, Homo sapiens
aacuguauuugau

SEQ ID NO: 456036 - RNA, 22 nt, Homo sapiens
aacugugaaguuuacauuguaa

SEQ ID NO: 456037 - RNA, 14 nt, Homo sapiens
aacugugcucuccc

SEQ ID NO: 456038 - RNA, 22 nt, Homo sapiens
aacuguguaacugcccaaagca

SEQ ID NO: 456039 - RNA, 17 nt, Homo sapiens
aacuguguggacuguga

SEQ ID NO: 456040 - RNA, 22 nt, Homo sapiens
aacuguuuuugaagaagggaaa

SEQ ID NO: 456041 - RNA, 15 nt, Homo sapiens
aacuuacauaugucu

SEQ ID NO: 456042 - RNA, 14 nt, Homo sapiens
aacuuagagaggua

SEQ ID NO: 456043 - RNA, 23 nt, Homo sapiens
aacuuagagcacuagaagcacag

SEQ ID NO: 456044 - RNA, 12 nt, Homo sapiens
aacuuagcucac

SEQ ID NO: 456045 - RNA, 21 nt, Homo sapiens
aacuuccauagcuucauccac

SEQ ID NO: 456046 - RNA, 15 nt, Homo sapiens
aacuucuauuuucaa

SEQ ID NO: 456047 - RNA, 19 nt, Homo sapiens
aacuucucguagaugcugc

SEQ ID NO: 456048 - RNA, 23 nt, Homo sapiens
aacuugaauuaauccacacauca

SEQ ID NO: 456049 - RNA, 20 nt, Homo sapiens
aacuuggaaugcaagcugga

SEQ ID NO: 456050 - RNA, 21 nt, Homo sapiens
aacuuggugccuaauguucca

SEQ ID NO: 456051 - RNA, 22 nt, Homo sapiens
aacuugguucugcuucaauaaa

SEQ ID NO: 456052 - RNA, 18 nt, Homo sapiens
aacuugguugugaaccaa

SEQ ID NO: 456053 - RNA, 18 nt, Homo sapiens
aacuuguauuaaagacag

SEQ ID NO: 456054 - RNA, 17 nt, Homo sapiens
aacuuguguacugauaa

SEQ ID NO: 456055 - RNA, 16 nt, Homo sapiens
aacuuuccagcaguau

SEQ ID NO: 456056 - RNA, 21 nt, Homo sapiens
aacuuucccuccaccagugug

SEQ ID NO: 456057 - RNA, 22 nt, Homo sapiens
aacuuucccuccaccagugugc

SEQ ID NO: 456058 - RNA, 23 nt, Homo sapiens
aacuuugacaaccaugagaccac

SEQ ID NO: 456059 - RNA, 21 nt, Homo sapiens
aacuuugaggaggaagcagaa

SEQ ID NO: 456060 - RNA, 20 nt, Homo sapiens
aacuuuguggaugucuuccu

SEQ ID NO: 456061 - RNA, 23 nt, Homo sapiens
aacuuuuagugggugagaaauuu

SEQ ID NO: 456062 - RNA, 17 nt, Homo sapiens
aacuuuugguaucuacu

SEQ ID NO: 456063 - RNA, 18 nt, Homo sapiens
aacuuuugguaucuacuu

SEQ ID NO: 456064 - RNA, 21 nt, Homo sapiens
aagaaaaaaauaauuuuauga

SEQ ID NO: 456065 - RNA, 14 nt, Homo sapiens
aagaaaacaacuuc

SEQ ID NO: 456066 - RNA, 13 nt, Homo sapiens
aagaaaacauaua

SEQ ID NO: 456067 - RNA, 23 nt, Homo sapiens
aagaaaacccgacaacauuucug

SEQ ID NO: 456068 - RNA, 14 nt, Homo sapiens
aagaaaagaaugua

SEQ ID NO: 456069 - RNA, 19 nt, Homo sapiens
aagaaaaucacauuuccag

SEQ ID NO: 456070 - RNA, 20 nt, Homo sapiens
aagaaaauccuaacuuucag

SEQ ID NO: 456071 - RNA, 13 nt, Homo sapiens
aagaaaauggauu

SEQ ID NO: 456072 - RNA, 18 nt, Homo sapiens
aagaaagcuauauaugaa

SEQ ID NO: 456073 - RNA, 11 nt, Homo sapiens
aagaaagugag

SEQ ID NO: 456074 - RNA, 23 nt, Homo sapiens
aagaaaguuuagaagcugagaca

SEQ ID NO: 456075 - RNA, 21 nt, Homo sapiens
aagaaauccugugugucgcuu

SEQ ID NO: 456076 - RNA, 21 nt, Homo sapiens
aagaaauuauuuaauaugcau

SEQ ID NO: 456077 - RNA, 13 nt, Homo sapiens
aagaaauugccuc

SEQ ID NO: 456078 - RNA, 23 nt, Homo sapiens
aagaacaaacacuuagcauccca

SEQ ID NO: 456079 - RNA, 15 nt, Homo sapiens
aagaaccaguguuua

SEQ ID NO: 456080 - RNA, 14 nt, Homo sapiens
aagaaccucuccau

SEQ ID NO: 456081 - RNA, 21 nt, Homo sapiens
aagaaccuuuugagugccuua

SEQ ID NO: 456082 - RNA, 19 nt, Homo sapiens
aagaacugccccaucuccu

SEQ ID NO: 456083 - RNA, 16 nt, Homo sapiens
aagaagacauggagac

SEQ ID NO: 456084 - RNA, 19 nt, Homo sapiens
aagaaggaagaucuugaga

SEQ ID NO: 456085 - RNA, 14 nt, Homo sapiens
aagaaggaaugggg

SEQ ID NO: 456086 - RNA, 14 nt, Homo sapiens
aagaagucucuuaa

SEQ ID NO: 456087 - RNA, 17 nt, Homo sapiens
aagaaguguugauugcc

SEQ ID NO: 456088 - RNA, 22 nt, Homo sapiens
aagaauaaaaaagaaauccaua

SEQ ID NO: 456089 - RNA, 15 nt, Homo sapiens
aagaauacacuguga

SEQ ID NO: 456090 - RNA, 19 nt, Homo sapiens
aagaauacacugugacuua

SEQ ID NO: 456091 - RNA, 14 nt, Homo sapiens
aagaaugcauucaa

SEQ ID NO: 456092 - RNA, 22 nt, Homo sapiens
aagaaugucuccugccacuccu

SEQ ID NO: 456093 - RNA, 21 nt, Homo sapiens
aagaauguguuaugaaucggu

SEQ ID NO: 456094 - RNA, 20 nt, Homo sapiens
aagacaaaauaaacauuuua

SEQ ID NO: 456095 - RNA, 21 nt, Homo sapiens
aagacaaaauaaacauuuuau

SEQ ID NO: 456096 - RNA, 15 nt, Homo sapiens
aagacaaaugcugcg

SEQ ID NO: 456097 - RNA, 13 nt, Homo sapiens
aagacaaaugggc

SEQ ID NO: 456098 - RNA, 20 nt, Homo sapiens
aagacaaaugggccugccaa

SEQ ID NO: 456099 - RNA, 17 nt, Homo sapiens
aagacaacaggcauuuu

SEQ ID NO: 456100 - RNA, 14 nt, Homo sapiens
aagacagagcagau

SEQ ID NO: 456101 - RNA, 17 nt, Homo sapiens
aagacagagcagaucag

SEQ ID NO: 456102 - RNA, 14 nt, Homo sapiens
aagacagagucuca

SEQ ID NO: 456103 - RNA, 13 nt, Homo sapiens
aagacagggaaua

SEQ ID NO: 456104 - RNA, 20 nt, Homo sapiens
aagacauacuccuuccauca

SEQ ID NO: 456105 - RNA, 16 nt, Homo sapiens
aagacauccucaaaag

SEQ ID NO: 456106 - RNA, 15 nt, Homo sapiens
aagaccaaaaugaca

SEQ ID NO: 456107 - RNA, 11 nt, Homo sapiens
aagaccagcuu

SEQ ID NO: 456108 - RNA, 16 nt, Homo sapiens
aagaccagcuuugcag

SEQ ID NO: 456109 - RNA, 20 nt, Homo sapiens
aagaccagucacagccauuu

SEQ ID NO: 456110 - RNA, 23 nt, Homo sapiens
aagaccuggagcggcuauuccag

SEQ ID NO: 456111 - RNA, 17 nt, Homo sapiens
aagacggagaugcaugg

SEQ ID NO: 456112 - RNA, 18 nt, Homo sapiens
aagacguccuggaaugaa

SEQ ID NO: 456113 - RNA, 15 nt, Homo sapiens
aagacuacuauacaa

SEQ ID NO: 456114 - RNA, 18 nt, Homo sapiens
aagacuacuauacaaacu

SEQ ID NO: 456115 - RNA, 14 nt, Homo sapiens
aagacuccgucuca

SEQ ID NO: 456116 - RNA, 22 nt, Homo sapiens
aagacucuacccauauuacaga

SEQ ID NO: 456117 - RNA, 14 nt, Homo sapiens
aagacucugucuca

SEQ ID NO: 456118 - RNA, 17 nt, Homo sapiens
aagacugaaucuaccug

SEQ ID NO: 456119 - RNA, 23 nt, Homo sapiens
aagacuucgcgcauaucacuaau

SEQ ID NO: 456120 - RNA, 14 nt, Homo sapiens
aagacuugaugaau

SEQ ID NO: 456121 - RNA, 15 nt, Homo sapiens
aagacuugaugaaua

SEQ ID NO: 456122 - RNA, 23 nt, Homo sapiens
aagacuuugauccaggugccaag

SEQ ID NO: 456123 - RNA, 16 nt, Homo sapiens
aagacuuuucuuucag

SEQ ID NO: 456124 - RNA, 14 nt, Homo sapiens
aagagaaaugagcu

SEQ ID NO: 456125 - RNA, 17 nt, Homo sapiens
aagagagagacccucac

SEQ ID NO: 456126 - RNA, 17 nt, Homo sapiens
aagagagucgcaucuca

SEQ ID NO: 456127 - RNA, 13 nt, Homo sapiens
aagaggagcugcu

SEQ ID NO: 456128 - RNA, 14 nt, Homo sapiens
aagaggugggguga

SEQ ID NO: 456129 - RNA, 22 nt, Homo sapiens
aagagguucucagcaaguguac

SEQ ID NO: 456130 - RNA, 22 nt, Homo sapiens
aagaguacagaagcuuuagcaa

SEQ ID NO: 456131 - RNA, 14 nt, Homo sapiens
aagaguaguuauua

SEQ ID NO: 456132 - RNA, 17 nt, Homo sapiens
aagaguccuuguuccag

SEQ ID NO: 456133 - RNA, 18 nt, Homo sapiens
aagagugacuaguacaaa

SEQ ID NO: 456134 - RNA, 16 nt, Homo sapiens
aagagugucacugagc

SEQ ID NO: 456135 - RNA, 22 nt, Homo sapiens
aagauaaaaucuucaacuaauu

SEQ ID NO: 456136 - RNA, 18 nt, Homo sapiens
aagauaagcacgcauuuu

SEQ ID NO: 456137 - RNA, 20 nt, Homo sapiens
aagauaaucuuagcugccaa

SEQ ID NO: 456138 - RNA, 13 nt, Homo sapiens
aagauaauguugc

SEQ ID NO: 456139 - RNA, 16 nt, Homo sapiens
aagauacuugaugcac

SEQ ID NO: 456140 - RNA, 15 nt, Homo sapiens
aagauagcaucccau

SEQ ID NO: 456141 - RNA, 21 nt, Homo sapiens
aagauaugugagaacuuuuca

SEQ ID NO: 456142 - RNA, 23 nt, Homo sapiens
aagaucaaaagcuuauucaucug

SEQ ID NO: 456143 - RNA, 15 nt, Homo sapiens
aauaaauaaucugua

SEQ ID NO: 456144 - RNA, 15 nt, Homo sapiens
aauaaaucuuuggaa

SEQ ID NO: 456145 - RNA, 22 nt, Homo sapiens
aauaaaugaccaguuuaccuga

SEQ ID NO: 456146 - RNA, 22 nt, Homo sapiens
aauaaaugagagggaaucgacu

SEQ ID NO: 456147 - RNA, 12 nt, Homo sapiens
aauaaaugcuca

SEQ ID NO: 456148 - RNA, 16 nt, Homo sapiens
aauaaauguacauuaa

SEQ ID NO: 456149 - RNA, 19 nt, Homo sapiens
aauaacaacagaucugcag

SEQ ID NO: 456150 - RNA, 12 nt, Homo sapiens
aauaacacugua

SEQ ID NO: 456151 - RNA, 17 nt, Homo sapiens
aauaacacuguacugca

SEQ ID NO: 456152 - RNA, 13 nt, Homo sapiens
aauaacauugcac

SEQ ID NO: 456153 - RNA, 14 nt, Homo sapiens
aauaacauugcacu

SEQ ID NO: 456154 - RNA, 16 nt, Homo sapiens
aauaaggaucuuccca

SEQ ID NO: 456155 - RNA, 14 nt, Homo sapiens
aauaauaaacagug

SEQ ID NO: 456156 - RNA, 16 nt, Homo sapiens
aauaaugauaccuccc

SEQ ID NO: 456157 - RNA, 22 nt, Homo sapiens
aauaauguucauuaaguucuga

SEQ ID NO: 456158 - RNA, 20 nt, Homo sapiens
aauaauuuuacaugucucau

SEQ ID NO: 456159 - RNA, 14 nt, Homo sapiens
aauacaacucacug

SEQ ID NO: 456160 - RNA, 17 nt, Homo sapiens
aauacaauuaaagcaaa

SEQ ID NO: 456161 - RNA, 15 nt, Homo sapiens
aauacagugcuuuau

SEQ ID NO: 456162 - RNA, 14 nt, Homo sapiens
aauacaugguuuaa

SEQ ID NO: 456163 - RNA, 14 nt, Homo sapiens
aauacucucugaaa

SEQ ID NO: 456164 - RNA, 19 nt, Homo sapiens
aauacugaauuucuuugau

SEQ ID NO: 456165 - RNA, 16 nt, Homo sapiens
aauacuuuaacuucca

SEQ ID NO: 456166 - RNA, 24 nt, Homo sapiens
aauacuuuugggauguuaccuuca

SEQ ID NO: 456167 - RNA, 19 nt, Homo sapiens
aauagaucaguauuucacu

SEQ ID NO: 456168 - RNA, 14 nt, Homo sapiens
aauagcaguuucac

SEQ ID NO: 456169 - RNA, 17 nt, Homo sapiens
aauagcauguuguagau

SEQ ID NO: 456170 - RNA, 15 nt, Homo sapiens
aauagcgugagcuaa

SEQ ID NO: 456171 - RNA, 16 nt, Homo sapiens
aauaggaacagcugaa

SEQ ID NO: 456172 - RNA, 13 nt, Homo sapiens
aauagguguguga

SEQ ID NO: 456173 - RNA, 14 nt, Homo sapiens
aauaguaaaugcuu

SEQ ID NO: 456174 - RNA, 17 nt, Homo sapiens
aauaguaccuucaauac

SEQ ID NO: 456175 - RNA, 21 nt, Homo sapiens
aauaguaggcuaaaaacauuu

SEQ ID NO: 456176 - RNA, 16 nt, Homo sapiens
aauagucuuccacaaa

SEQ ID NO: 456177 - RNA, 19 nt, Homo sapiens
aauaguuccugaacauugc

SEQ ID NO: 456178 - RNA, 12 nt, Homo sapiens
aauauaaacugu

SEQ ID NO: 456179 - RNA, 12 nt, Homo sapiens
aauauacauuca

SEQ ID NO: 456180 - RNA, 16 nt, Homo sapiens
aauauacugcauaucc

SEQ ID NO: 456181 - RNA, 20 nt, Homo sapiens
aauauauuucaaaacuucag

SEQ ID NO: 456182 - RNA, 12 nt, Homo sapiens
aauauauuugau

SEQ ID NO: 456183 - RNA, 14 nt, Homo sapiens
aauaucauaaugua

SEQ ID NO: 456184 - RNA, 17 nt, Homo sapiens
agcagaacuucugaaac

SEQ ID NO: 456185 - RNA, 15 nt, Homo sapiens
agcagaagcacauau

SEQ ID NO: 456186 - RNA, 20 nt, Homo sapiens
agcagaagcacauaugaacu

SEQ ID NO: 456187 - RNA, 17 nt, Homo sapiens
agcagagacaugacuca

SEQ ID NO: 456188 - RNA, 18 nt, Homo sapiens
agcagagcgucuggcaca

SEQ ID NO: 456189 - RNA, 19 nt, Homo sapiens
agcagccaaaccuuuccug

SEQ ID NO: 456190 - RNA, 18 nt, Homo sapiens
agcagccucaggcccaau

SEQ ID NO: 456191 - RNA, 22 nt, Homo sapiens
agcagccuguacuagcuuuuga

SEQ ID NO: 456192 - RNA, 21 nt, Homo sapiens
agcaggauggcuggaacacug

SEQ ID NO: 456193 - RNA, 22 nt, Homo sapiens
agcaggauggcuggaacacugu

SEQ ID NO: 456194 - RNA, 14 nt, Homo sapiens
agcaggcaccagca

SEQ ID NO: 456195 - RNA, 19 nt, Homo sapiens
agcagguuucuugcuucug

SEQ ID NO: 456196 - RNA, 17 nt, Homo sapiens
agcagucccaguauucu

SEQ ID NO: 456197 - RNA, 21 nt, Homo sapiens
agcagugaaauaugauaauaa

SEQ ID NO: 456198 - RNA, 17 nt, Homo sapiens
agcagugccagcuuucu

SEQ ID NO: 456199 - RNA, 16 nt, Homo sapiens
agcagugccuuccaua

SEQ ID NO: 456200 - RNA, 16 nt, Homo sapiens
agcagugucuuccaua

SEQ ID NO: 456201 - RNA, 22 nt, Homo sapiens
agcagugucuuccauaauguau

SEQ ID NO: 456202 - RNA, 14 nt, Homo sapiens
agcaguucagcucc

SEQ ID NO: 456203 - RNA, 21 nt, Homo sapiens
agcaguugaaacaagaagcca

SEQ ID NO: 456204 - RNA, 14 nt, Homo sapiens
agcaguugugucag

SEQ ID NO: 456205 - RNA, 19 nt, Homo sapiens
agcaguuguuauuuaguga

SEQ ID NO: 456206 - RNA, 13 nt, Homo sapiens
agcauaacacagc

SEQ ID NO: 456207 - RNA, 14 nt, Homo sapiens
agcauaaguauaca

SEQ ID NO: 456208 - RNA, 12 nt, Homo sapiens
agcauaauguga

SEQ ID NO: 456209 - RNA, 13 nt, Homo sapiens
agcauaaugugag

SEQ ID NO: 456210 - RNA, 19 nt, Homo sapiens
agcauaauucggaagggaa

SEQ ID NO: 456211 - RNA, 17 nt, Homo sapiens
agcauauacugaagucu

SEQ ID NO: 456212 - RNA, 14 nt, Homo sapiens
agcaucagcaagac

SEQ ID NO: 456213 - RNA, 13 nt, Homo sapiens
agcauccaugugu

SEQ ID NO: 456214 - RNA, 15 nt, Homo sapiens
agcaucccaucucag

SEQ ID NO: 456215 - RNA, 16 nt, Homo sapiens
agcaucuacuacucug

SEQ ID NO: 456216 - RNA, 17 nt, Homo sapiens
agcaucuauagcacaua

SEQ ID NO: 456217 - RNA, 14 nt, Homo sapiens
agcaucugucccac

SEQ ID NO: 456218 - RNA, 19 nt, Homo sapiens
agcaugaagauaaauccaa

SEQ ID NO: 456219 - RNA, 21 nt, Homo sapiens
agcaugcuuugcugcuaugaa

SEQ ID NO: 456220 - RNA, 14 nt, Homo sapiens
agcaugguauugaa

SEQ ID NO: 456221 - RNA, 12 nt, Homo sapiens
agcauguaauau

SEQ ID NO: 456222 - RNA, 16 nt, Homo sapiens
agcaugugugugucuc

SEQ ID NO: 456223 - RNA, 19 nt, Homo sapiens
agcaugugugugucucuau

SEQ ID NO: 456224 - RNA, 12 nt, Homo sapiens
agcauguuucau

SEQ ID NO: 456225 - RNA, 16 nt, Homo sapiens
agcauuccuauugaca

SEQ ID NO: 456226 - RNA, 18 nt, Homo sapiens
agcauucuugucacaaua

SEQ ID NO: 456227 - RNA, 20 nt, Homo sapiens
agcauucuugucacaauaaa

SEQ ID NO: 456228 - RNA, 23 nt, Homo sapiens
agcauugccagcucuuccaaucu

SEQ ID NO: 456229 - RNA, 18 nt, Homo sapiens
agcauuucuagcagugau

SEQ ID NO: 456230 - RNA, 22 nt, Homo sapiens
agcauuucuagcagugaugaaa

SEQ ID NO: 456231 - RNA, 13 nt, Homo sapiens
agcauuucuugau

SEQ ID NO: 456232 - RNA, 19 nt, Homo sapiens
agcauuucuugauguugcu

SEQ ID NO: 456233 - RNA, 17 nt, Homo sapiens
agccaaaaguaagugga

SEQ ID NO: 456234 - RNA, 16 nt, Homo sapiens
agccaaagagcucuuu

SEQ ID NO: 456235 - RNA, 16 nt, Homo sapiens
agccaaauaaaaucua

SEQ ID NO: 456236 - RNA, 15 nt, Homo sapiens
agccaaaugcaggga

SEQ ID NO: 456237 - RNA, 17 nt, Homo sapiens
agccaacacccugucua

SEQ ID NO: 456238 - RNA, 15 nt, Homo sapiens
agccaaccccugugg

SEQ ID NO: 456239 - RNA, 23 nt, Homo sapiens
agccaagaauucuuaaauaugug

SEQ ID NO: 456240 - RNA, 19 nt, Homo sapiens
agccaaggccuaugccacc

SEQ ID NO: 456241 - RNA, 19 nt, Homo sapiens
agccaaggugcuaaaagga

SEQ ID NO: 456242 - RNA, 15 nt, Homo sapiens
agccaaugaacagcu

SEQ ID NO: 456243 - RNA, 19 nt, Homo sapiens
agccacacaaacguuuacu

SEQ ID NO: 456244 - RNA, 15 nt, Homo sapiens
agccacaggcacugu

SEQ ID NO: 456245 - RNA, 17 nt, Homo sapiens
agccacaggcacugugu

SEQ ID NO: 456246 - RNA, 16 nt, Homo sapiens
agccacaguggccaaa

SEQ ID NO: 456247 - RNA, 21 nt, Homo sapiens
agccacaugggaaacuuccaa

SEQ ID NO: 456248 - RNA, 11 nt, Homo sapiens
agccaccacug

SEQ ID NO: 456249 - RNA, 20 nt, Homo sapiens
agccaccccucagacugggu

SEQ ID NO: 456250 - RNA, 14 nt, Homo sapiens
agccaccgcugcca

SEQ ID NO: 456251 - RNA, 16 nt, Homo sapiens
agccaccucacccagc

SEQ ID NO: 456252 - RNA, 21 nt, Homo sapiens
agccaccuuccugacugggaa

SEQ ID NO: 456253 - RNA, 14 nt, Homo sapiens
agccacuaccuucu

SEQ ID NO: 456254 - RNA, 19 nt, Homo sapiens
agccacugaauauuaucau

SEQ ID NO: 456255 - RNA, 14 nt, Homo sapiens
agccagacccugca

SEQ ID NO: 456256 - RNA, 15 nt, Homo sapiens
agccagcccuuccca

SEQ ID NO: 456257 - RNA, 16 nt, Homo sapiens
agccagcucugcauua

SEQ ID NO: 456258 - RNA, 14 nt, Homo sapiens
agccaggacaucuc

SEQ ID NO: 456259 - RNA, 18 nt, Homo sapiens
agccaggauucaacccug

SEQ ID NO: 456260 - RNA, 16 nt, Homo sapiens
agccaggccugaccuc

SEQ ID NO: 456261 - RNA, 22 nt, Homo sapiens
agccaggccugaccucaagcaa

SEQ ID NO: 456262 - RNA, 18 nt, Homo sapiens
agccaggguuccagacag

SEQ ID NO: 456263 - RNA, 19 nt, Homo sapiens
agccagugacuccaggaga

SEQ ID NO: 456264 - RNA, 21 nt, Homo sapiens
agccaucaauuuuaacauuug

SEQ ID NO: 456265 - RNA, 15 nt, Homo sapiens
agccaucuaaugcuu

SEQ ID NO: 456266 - RNA, 15 nt, Homo sapiens
agccaucuugaauau

SEQ ID NO: 456267 - RNA, 20 nt, Homo sapiens
agccauguaccaguguacug

SEQ ID NO: 456268 - RNA, 21 nt, Homo sapiens
agccauuauucucugaugcac

SEQ ID NO: 456269 - RNA, 15 nt, Homo sapiens
agcccacacuugaga

SEQ ID NO: 456270 - RNA, 17 nt, Homo sapiens
agcccacagaggacagu

SEQ ID NO: 456271 - RNA, 19 nt, Homo sapiens
agcccacagaggacagugc

SEQ ID NO: 456272 - RNA, 12 nt, Homo sapiens
agcccacaucca

SEQ ID NO: 456273 - RNA, 22 nt, Homo sapiens
agcccacccgccccagagacug

SEQ ID NO: 456274 - RNA, 18 nt, Homo sapiens
agcccacccugcugccuu

SEQ ID NO: 456275 - RNA, 23 nt, Homo sapiens
agcccacccugcugccuucugac

SEQ ID NO: 456276 - RNA, 21 nt, Homo sapiens
agcccacgugggccucugggg

SEQ ID NO: 456277 - RNA, 18 nt, Homo sapiens
agcccagagcauccugcc

SEQ ID NO: 456278 - RNA, 18 nt, Homo sapiens
agcccagagugaacacuc

SEQ ID NO: 456279 - RNA, 13 nt, Homo sapiens
agcccaguggaau

SEQ ID NO: 456280 - RNA, 20 nt, Homo sapiens
agcccauuucuccauacgca

SEQ ID NO: 456281 - RNA, 16 nt, Homo sapiens
agccccagccagcccu

SEQ ID NO: 456282 - RNA, 15 nt, Homo sapiens
agcccccaccugccu

SEQ ID NO: 456283 - RNA, 19 nt, Homo sapiens
agccccccacaaugaugau

SEQ ID NO: 456284 - RNA, 19 nt, Homo sapiens
agccccccaccccacagau

SEQ ID NO: 456285 - RNA, 13 nt, Homo sapiens
agccccccaugua

SEQ ID NO: 456286 - RNA, 20 nt, Homo sapiens
agccccuccuaguucuucau

SEQ ID NO: 456287 - RNA, 21 nt, Homo sapiens
agccccugggacugcugcuuc

SEQ ID NO: 456288 - RNA, 23 nt, Homo sapiens
agcccuagaggcgagccaggcaa

SEQ ID NO: 456289 - RNA, 15 nt, Homo sapiens
agcccucccagcugg

SEQ ID NO: 456290 - RNA, 20 nt, Homo sapiens
agcccucccuggcugugagc

SEQ ID NO: 456291 - RNA, 16 nt, Homo sapiens
agcccucucacugugu

SEQ ID NO: 456292 - RNA, 16 nt, Homo sapiens
agcccucuuucucucu

SEQ ID NO: 456293 - RNA, 22 nt, Homo sapiens
agcccugaguuucaaguauccu

SEQ ID NO: 456294 - RNA, 14 nt, Homo sapiens
agcccugucugcua

SEQ ID NO: 456295 - RNA, 15 nt, Homo sapiens
agcccugucugcuag

SEQ ID NO: 456296 - RNA, 18 nt, Homo sapiens
agcccuucacugccauga

SEQ ID NO: 456297 - RNA, 15 nt, Homo sapiens
agcccuugggcaguu

SEQ ID NO: 456298 - RNA, 13 nt, Homo sapiens
agccgcugccagg

SEQ ID NO: 456299 - RNA, 16 nt, Homo sapiens
agccgcugccaggggc

SEQ ID NO: 456300 - RNA, 16 nt, Homo sapiens
agccguugcuaaugcc

SEQ ID NO: 456301 - RNA, 22 nt, Homo sapiens
agccuacuuucacacuaagaaa

SEQ ID NO: 456302 - RNA, 18 nt, Homo sapiens
agccuagccugcauauca

SEQ ID NO: 456303 - RNA, 11 nt, Homo sapiens
agccuauggca

SEQ ID NO: 456304 - RNA, 23 nt, Homo sapiens
agccucaagucuuauuuccucaa

SEQ ID NO: 456305 - RNA, 15 nt, Homo sapiens
agccucagugccacu

SEQ ID NO: 456306 - RNA, 12 nt, Homo sapiens
agccuccacugc

SEQ ID NO: 456307 - RNA, 15 nt, Homo sapiens
agccuccacugccuc

SEQ ID NO: 456308 - RNA, 23 nt, Homo sapiens
agccuccccacguggcaccuccu

SEQ ID NO: 456309 - RNA, 15 nt, Homo sapiens
agccuccucucucaa

SEQ ID NO: 456310 - RNA, 20 nt, Homo sapiens
agccuccugacccugugaug

SEQ ID NO: 456311 - RNA, 20 nt, Homo sapiens
agccucggcaggaccccugg

SEQ ID NO: 456312 - RNA, 13 nt, Homo sapiens
agccucuggcuag

SEQ ID NO: 456313 - RNA, 16 nt, Homo sapiens
auaauaauggcuaacu

SEQ ID NO: 456314 - RNA, 17 nt, Homo sapiens
auaauacccacauuaca

SEQ ID NO: 456315 - RNA, 14 nt, Homo sapiens
auaauaguacuauu

SEQ ID NO: 456316 - RNA, 16 nt, Homo sapiens
auaauaguacuauuac

SEQ ID NO: 456317 - RNA, 12 nt, Homo sapiens
auaauagucaau

SEQ ID NO: 456318 - RNA, 15 nt, Homo sapiens
auaaucuuagaacag

SEQ ID NO: 456319 - RNA, 14 nt, Homo sapiens
auaaugaacacgug

SEQ ID NO: 456320 - RNA, 14 nt, Homo sapiens
auaaugaguuuuac

SEQ ID NO: 456321 - RNA, 17 nt, Homo sapiens
auaaugguuuacugcug

SEQ ID NO: 456322 - RNA, 20 nt, Homo sapiens
auaauguccuuucccuggag

SEQ ID NO: 456323 - RNA, 21 nt, Homo sapiens
auaauguuacauuauuaucaa

SEQ ID NO: 456324 - RNA, 21 nt, Homo sapiens
auaauuaaauuuugaguucua

SEQ ID NO: 456325 - RNA, 20 nt, Homo sapiens
auaugaugaucuggauccac

SEQ ID NO: 456326 - RNA, 22 nt, Homo sapiens
auaugcaccccuggaaccagca

SEQ ID NO: 456327 - RNA, 13 nt, Homo sapiens
auaugcacuugaa

SEQ ID NO: 456328 - RNA, 19 nt, Homo sapiens
auauguaaauagugcagaa

SEQ ID NO: 456329 - RNA, 14 nt, Homo sapiens
auauguaucuaguc

SEQ ID NO: 456330 - RNA, 20 nt, Homo sapiens
auaugucucaggucccugca

SEQ ID NO: 456331 - RNA, 18 nt, Homo sapiens
auaugugaagacagagca

SEQ ID NO: 456332 - RNA, 21 nt, Homo sapiens
auauguguaaauguuaugacu

SEQ ID NO: 456333 - RNA, 17 nt, Homo sapiens
auauuaaaauauggcua

SEQ ID NO: 456334 - RNA, 21 nt, Homo sapiens
auauuaacaacaauaacacug

SEQ ID NO: 456335 - RNA, 14 nt, Homo sapiens
auauuaauguggaa

SEQ ID NO: 456336 - RNA, 19 nt, Homo sapiens
auauuacugucuuuauucu

SEQ ID NO: 456337 - RNA, 22 nt, Homo sapiens
auauuaggcuauaaauguccua

SEQ ID NO: 456338 - RNA, 15 nt, Homo sapiens
auauuauaguauuca

SEQ ID NO: 456339 - RNA, 20 nt, Homo sapiens
auauuauguuuccuaauuaa

SEQ ID NO: 456340 - RNA, 20 nt, Homo sapiens
auauucaaacauuauucuca

SEQ ID NO: 456341 - RNA, 21 nt, Homo sapiens
auauucagagauguaccaugu

SEQ ID NO: 456342 - RNA, 16 nt, Homo sapiens
auauuccagaccaaaa

SEQ ID NO: 456343 - RNA, 13 nt, Homo sapiens
auauuccugcauu

SEQ ID NO: 456344 - RNA, 15 nt, Homo sapiens
auauugaccauguga

SEQ ID NO: 456345 - RNA, 11 nt, Homo sapiens
auauugcccag

SEQ ID NO: 456346 - RNA, 12 nt, Homo sapiens
auauuucaaaac

SEQ ID NO: 456347 - RNA, 12 nt, Homo sapiens
auauuucacuua

SEQ ID NO: 456348 - RNA, 19 nt, Homo sapiens
auauuugacauucuucacu

SEQ ID NO: 456349 - RNA, 19 nt, Homo sapiens
auauuugugugaggacuuc

SEQ ID NO: 456350 - RNA, 18 nt, Homo sapiens
auauuuucugaguagcau

SEQ ID NO: 456351 - RNA, 18 nt, Homo sapiens
auauuuuguaacuauuac

SEQ ID NO: 456352 - RNA, 22 nt, Homo sapiens
auauuuuuaauaaaaguugcaa

SEQ ID NO: 456353 - RNA, 20 nt, Homo sapiens
aucaaaagggagagaacaaa

SEQ ID NO: 456354 - RNA, 21 nt, Homo sapiens
aucaaaauaaaaagugacaca

SEQ ID NO: 456355 - RNA, 14 nt, Homo sapiens
aucaaaauguuguc

SEQ ID NO: 456356 - RNA, 12 nt, Homo sapiens
aucaaacagaaa

SEQ ID NO: 456357 - RNA, 12 nt, Homo sapiens
aucaaacaugaa

SEQ ID NO: 456358 - RNA, 17 nt, Homo sapiens
aucaaaggagagucaca

SEQ ID NO: 456359 - RNA, 21 nt, Homo sapiens
aucaaccaggaagaguucuau

SEQ ID NO: 456360 - RNA, 15 nt, Homo sapiens
aucaacucauguuaa

SEQ ID NO: 456361 - RNA, 21 nt, Homo sapiens
aucaacugcaucaagauguga

SEQ ID NO: 456362 - RNA, 22 nt, Homo sapiens
aucaagaaauaugaagcacuuu

SEQ ID NO: 456363 - RNA, 22 nt, Homo sapiens
aucaagagugagugaacaacua

SEQ ID NO: 456364 - RNA, 16 nt, Homo sapiens
aucaagauacacuugu

SEQ ID NO: 456365 - RNA, 16 nt, Homo sapiens
aucaagaugugacaug

SEQ ID NO: 456366 - RNA, 13 nt, Homo sapiens
aucaagcuguaca

SEQ ID NO: 456367 - RNA, 15 nt, Homo sapiens
aucaaggagugaagu

SEQ ID NO: 456368 - RNA, 14 nt, Homo sapiens
aucaagggcuuuau

SEQ ID NO: 456369 - RNA, 12 nt, Homo sapiens
aucaagucagca

SEQ ID NO: 456370 - RNA, 14 nt, Homo sapiens
aucaagucagcaac

SEQ ID NO: 456371 - RNA, 14 nt, Homo sapiens
aucaaguccuacaa

SEQ ID NO: 456372 - RNA, 14 nt, Homo sapiens
aucaagucugugaa

SEQ ID NO: 456373 - RNA, 21 nt, Homo sapiens
aucaagugugcuuuagcuuga

SEQ ID NO: 456374 - RNA, 23 nt, Homo sapiens
aucaagugugcuuuagcuugaaa

SEQ ID NO: 456375 - RNA, 15 nt, Homo sapiens
aucaauaaagcacua

SEQ ID NO: 456376 - RNA, 23 nt, Homo sapiens
aucaauaaauacuuuaacuucca

SEQ ID NO: 456377 - RNA, 21 nt, Homo sapiens
aucaauacccuuggcacugau

SEQ ID NO: 456378 - RNA, 13 nt, Homo sapiens
aucaaucucuagu

SEQ ID NO: 456379 - RNA, 23 nt, Homo sapiens
aucaauggcgcagugccucuggu

SEQ ID NO: 456380 - RNA, 16 nt, Homo sapiens
aucaaugucacuuaaa

SEQ ID NO: 456381 - RNA, 23 nt, Homo sapiens
aucacaagaaaaaggaagccacu

SEQ ID NO: 456382 - RNA, 23 nt, Homo sapiens
aucacaaggcauucaaguguaca

SEQ ID NO: 456383 - RNA, 22 nt, Homo sapiens
aucacacucucuucuuacugua

SEQ ID NO: 456384 - RNA, 17 nt, Homo sapiens
aucacauucaggcaugc

SEQ ID NO: 456385 - RNA, 13 nt, Homo sapiens
aucaccaccacac

SEQ ID NO: 456386 - RNA, 14 nt, Homo sapiens
aucaccagacuuug

SEQ ID NO: 456387 - RNA, 22 nt, Homo sapiens
aucacuauugcuuccuaaaggu

SEQ ID NO: 456388 - RNA, 15 nt, Homo sapiens
aucagaaacaauuuc

SEQ ID NO: 456389 - RNA, 16 nt, Homo sapiens
aucagaaacuugugaa

SEQ ID NO: 456390 - RNA, 17 nt, Homo sapiens
aucagaaggacauggug

SEQ ID NO: 456391 - RNA, 16 nt, Homo sapiens
aucagaccauaauguu

SEQ ID NO: 456392 - RNA, 24 nt, Homo sapiens
aucagaccugucuuccaaggagac

SEQ ID NO: 456393 - RNA, 16 nt, Homo sapiens
aucagagagcucacua

SEQ ID NO: 456394 - RNA, 20 nt, Homo sapiens
aucagcccaggucccagugc

SEQ ID NO: 456395 - RNA, 15 nt, Homo sapiens
aucagccucuggcca

SEQ ID NO: 456396 - RNA, 15 nt, Homo sapiens
aucagucaaugagga

SEQ ID NO: 456397 - RNA, 16 nt, Homo sapiens
aucagucauaacuaaa

SEQ ID NO: 456398 - RNA, 15 nt, Homo sapiens
aucagugaugggagu

SEQ ID NO: 456399 - RNA, 20 nt, Homo sapiens
aucaguggggccccaaagcc

SEQ ID NO: 456400 - RNA, 17 nt, Homo sapiens
aucaguuuccagucuca

SEQ ID NO: 456401 - RNA, 16 nt, Homo sapiens
aucauaauguaaugag

SEQ ID NO: 456402 - RNA, 15 nt, Homo sapiens
aucauagcugacuca

SEQ ID NO: 456403 - RNA, 17 nt, Homo sapiens
aucauagcugacucaga

SEQ ID NO: 456404 - RNA, 16 nt, Homo sapiens
aucauagucgggcaua

SEQ ID NO: 456405 - RNA, 20 nt, Homo sapiens
aucauauguaucuaaaugaa

SEQ ID NO: 456406 - RNA, 23 nt, Homo sapiens
aucaucuccaucauaugccugac

SEQ ID NO: 456407 - RNA, 13 nt, Homo sapiens
aucaucuguagau

SEQ ID NO: 456408 - RNA, 17 nt, Homo sapiens
aucaucuguagauacua

SEQ ID NO: 456409 - RNA, 21 nt, Homo sapiens
aucaucuuagcuuagcuuucu

SEQ ID NO: 456410 - RNA, 17 nt, Homo sapiens
aucaugaaaagugcugu

SEQ ID NO: 456411 - RNA, 18 nt, Homo sapiens
aucaugaaaagugcuguu

SEQ ID NO: 456412 - RNA, 17 nt, Homo sapiens
aucaugcaugcacucuu

SEQ ID NO: 456413 - RNA, 20 nt, Homo sapiens
aucaugugggugagccagug

SEQ ID NO: 456414 - RNA, 22 nt, Homo sapiens
aucaugugugagauaacuuccu

SEQ ID NO: 456415 - RNA, 15 nt, Homo sapiens
aucauguugaaguca

SEQ ID NO: 456416 - RNA, 21 nt, Homo sapiens
aucauguugaauaaugcuguu

SEQ ID NO: 456417 - RNA, 18 nt, Homo sapiens
aucauguuggauagucag

SEQ ID NO: 456418 - RNA, 21 nt, Homo sapiens
aucauguuggauagucagcug

SEQ ID NO: 456419 - RNA, 16 nt, Homo sapiens
aucauucuacaaguaa

SEQ ID NO: 456420 - RNA, 15 nt, Homo sapiens
aucauuuuauucaca

SEQ ID NO: 456421 - RNA, 18 nt, Homo sapiens
auccaaaucuugaauuuc

SEQ ID NO: 456422 - RNA, 13 nt, Homo sapiens
auccaacuauuaa

SEQ ID NO: 456423 - RNA, 12 nt, Homo sapiens
auccaagaccug

SEQ ID NO: 456424 - RNA, 17 nt, Homo sapiens
auccaauggauugugca

SEQ ID NO: 456425 - RNA, 15 nt, Homo sapiens
auccacaacuuuuca

SEQ ID NO: 456426 - RNA, 18 nt, Homo sapiens
auccacauugccagugac

SEQ ID NO: 456427 - RNA, 12 nt, Homo sapiens
auccaccaccuu

SEQ ID NO: 456428 - RNA, 17 nt, Homo sapiens
auccaccaccuugccaa

SEQ ID NO: 456429 - RNA, 20 nt, Homo sapiens
auccacuacauucugaaggc

SEQ ID NO: 456430 - RNA, 16 nt, Homo sapiens
auccagcaucccaaga

SEQ ID NO: 456431 - RNA, 14 nt, Homo sapiens
auccagcuaugaau

SEQ ID NO: 456432 - RNA, 16 nt, Homo sapiens
auccagcuaugaauau

SEQ ID NO: 456433 - RNA, 15 nt, Homo sapiens
auccaggcacucaga

SEQ ID NO: 456434 - RNA, 22 nt, Homo sapiens
auccauagugcacuagcauuuu

SEQ ID NO: 456435 - RNA, 24 nt, Homo sapiens
auccaucugcuuacaauucccugc

SEQ ID NO: 456436 - RNA, 20 nt, Homo sapiens
auccaugugcugcuguggca

SEQ ID NO: 456437 - RNA, 14 nt, Homo sapiens
aucccaagucaaac

SEQ ID NO: 456438 - RNA, 20 nt, Homo sapiens
aucccacggaaaaugccaau

SEQ ID NO: 456439 - RNA, 15 nt, Homo sapiens
aucccaguggccuca

SEQ ID NO: 456440 - RNA, 17 nt, Homo sapiens
aucccaucucuaaaaaa

SEQ ID NO: 456441 - RNA, 15 nt, Homo sapiens
aucccccagccucaa

SEQ ID NO: 456442 - RNA, 22 nt, Homo sapiens
aucccguaccucuucccaugac

SEQ ID NO: 456443 - RNA, 16 nt, Homo sapiens
aucccuaugcugccua

SEQ ID NO: 456444 - RNA, 18 nt, Homo sapiens
aucccucggucagcaccg

SEQ ID NO: 456445 - RNA, 13 nt, Homo sapiens
aucccugccaaga

SEQ ID NO: 456446 - RNA, 12 nt, Homo sapiens
aucccuguucau

SEQ ID NO: 456447 - RNA, 19 nt, Homo sapiens
auccgccucugagccagga

SEQ ID NO: 456448 - RNA, 17 nt, Homo sapiens
auccguaccaucgguca

SEQ ID NO: 456449 - RNA, 18 nt, Homo sapiens
auccgucaccagaauuag

SEQ ID NO: 456450 - RNA, 16 nt, Homo sapiens
aguucugaaaacuguu

SEQ ID NO: 456451 - RNA, 15 nt, Homo sapiens
aguucugaucuguac

SEQ ID NO: 456452 - RNA, 15 nt, Homo sapiens
aguucuguucauccu

SEQ ID NO: 456453 - RNA, 20 nt, Homo sapiens
aguucuuaaacucagaauau

SEQ ID NO: 456454 - RNA, 20 nt, Homo sapiens
aguucuuaggaacagacucg

SEQ ID NO: 456455 - RNA, 11 nt, Homo sapiens
aguucuuaggc

SEQ ID NO: 456456 - RNA, 19 nt, Homo sapiens
aguucuucaccucuaucca

SEQ ID NO: 456457 - RNA, 23 nt, Homo sapiens
aguucuugaacaguuuaugcagu

SEQ ID NO: 456458 - RNA, 17 nt, Homo sapiens
aguugaaauucuauucu

SEQ ID NO: 456459 - RNA, 18 nt, Homo sapiens
aguugaagcuaagauuua

SEQ ID NO: 456460 - RNA, 19 nt, Homo sapiens
aguugaauaaaagugcaca

SEQ ID NO: 456461 - RNA, 19 nt, Homo sapiens
aguugagagagaaucucaa

SEQ ID NO: 456462 - RNA, 17 nt, Homo sapiens
aguugcaauugaauuaa

SEQ ID NO: 456463 - RNA, 12 nt, Homo sapiens
aguugcacuugg

SEQ ID NO: 456464 - RNA, 16 nt, Homo sapiens
aguugcugaugaacuc

SEQ ID NO: 456465 - RNA, 22 nt, Homo sapiens
aguugcuuuaaaguaccuguag

SEQ ID NO: 456466 - RNA, 14 nt, Homo sapiens
aguuggaauguugu

SEQ ID NO: 456467 - RNA, 21 nt, Homo sapiens
aguuggacaguaagauuuuau

SEQ ID NO: 456468 - RNA, 22 nt, Homo sapiens
aguuggcuagaagaaaguaaaa

SEQ ID NO: 456469 - RNA, 20 nt, Homo sapiens
augugcaggcuccuccucuc

SEQ ID NO: 456470 - RNA, 15 nt, Homo sapiens
augugcccccagacg

SEQ ID NO: 456471 - RNA, 19 nt, Homo sapiens
augugccgucuuugguucc

SEQ ID NO: 456472 - RNA, 19 nt, Homo sapiens
augugcuuccuugcucagu

SEQ ID NO: 456473 - RNA, 15 nt, Homo sapiens
auguggaaaacucac

SEQ ID NO: 456474 - RNA, 17 nt, Homo sapiens
augugggugucagucag

SEQ ID NO: 456475 - RNA, 20 nt, Homo sapiens
auguguaaauggagcuugua

SEQ ID NO: 456476 - RNA, 14 nt, Homo sapiens
auguguaaauguua

SEQ ID NO: 456477 - RNA, 16 nt, Homo sapiens
auguguauauggugau

SEQ ID NO: 456478 - RNA, 17 nt, Homo sapiens
auguguaugugccauuu

SEQ ID NO: 456479 - RNA, 22 nt, Homo sapiens
augugucaaacauaggacugga

SEQ ID NO: 456480 - RNA, 15 nt, Homo sapiens
augugucccagugaa

SEQ ID NO: 456481 - RNA, 20 nt, Homo sapiens
auguguccuuucaaggggaa

SEQ ID NO: 456482 - RNA, 17 nt, Homo sapiens
augugucuuaccagauc

SEQ ID NO: 456483 - RNA, 22 nt, Homo sapiens
augugucuuaccagaucuaaua

SEQ ID NO: 456484 - RNA, 14 nt, Homo sapiens
augugugaggagcu

SEQ ID NO: 456485 - RNA, 14 nt, Homo sapiens
auguguggacucaa

SEQ ID NO: 456486 - RNA, 14 nt, Homo sapiens
auguguggugcuaa

SEQ ID NO: 456487 - RNA, 16 nt, Homo sapiens
augugugugcaagugu

SEQ ID NO: 456488 - RNA, 17 nt, Homo sapiens
augugugugcaagugug

SEQ ID NO: 456489 - RNA, 13 nt, Homo sapiens
auguguguucaug

SEQ ID NO: 456490 - RNA, 19 nt, Homo sapiens
auguguugcuuuggauaca

SEQ ID NO: 456491 - RNA, 14 nt, Homo sapiens
auguguugugauag

SEQ ID NO: 456492 - RNA, 16 nt, Homo sapiens
auguguuucaggugga

SEQ ID NO: 456493 - RNA, 16 nt, Homo sapiens
auguguuuuuguauga

SEQ ID NO: 456494 - RNA, 15 nt, Homo sapiens
auguuaacugaggaa

SEQ ID NO: 456495 - RNA, 18 nt, Homo sapiens
auguuaccuucacauguc

SEQ ID NO: 456496 - RNA, 16 nt, Homo sapiens
auguuacugaccagca

SEQ ID NO: 456497 - RNA, 18 nt, Homo sapiens
auguuacuuaaacaucau

SEQ ID NO: 456498 - RNA, 12 nt, Homo sapiens
auguuacuuugg

SEQ ID NO: 456499 - RNA, 21 nt, Homo sapiens
auguuaguagaaauuuuacaa

SEQ ID NO: 456500 - RNA, 19 nt, Homo sapiens
auguuaugacuccuugaua

SEQ ID NO: 456501 - RNA, 14 nt, Homo sapiens
auguucagcacugu

SEQ ID NO: 456502 - RNA, 21 nt, Homo sapiens
auguucauuguaauguuacug

SEQ ID NO: 456503 - RNA, 22 nt, Homo sapiens
auguuccccaggauucagcuau

SEQ ID NO: 456504 - RNA, 14 nt, Homo sapiens
auguucuucaucca

SEQ ID NO: 456505 - RNA, 23 nt, Homo sapiens
auguugaagaacucaugugauuu

SEQ ID NO: 456506 - RNA, 15 nt, Homo sapiens
auguugcucagucuc

SEQ ID NO: 456507 - RNA, 18 nt, Homo sapiens
auguugcuuuugcaccua

SEQ ID NO: 456508 - RNA, 22 nt, Homo sapiens
auguugguuuuuuagugcaauu

SEQ ID NO: 456509 - RNA, 20 nt, Homo sapiens
auguuuaaaagcaaaacugc

SEQ ID NO: 456510 - RNA, 16 nt, Homo sapiens
auguuuagugugauug

SEQ ID NO: 456511 - RNA, 22 nt, Homo sapiens
auguuuauauacuguuauuuca

SEQ ID NO: 456512 - RNA, 17 nt, Homo sapiens
auguuuauuuacuaauu

SEQ ID NO: 456513 - RNA, 22 nt, Homo sapiens
auguuucauguuuugugacuau

SEQ ID NO: 456514 - RNA, 22 nt, Homo sapiens
auguuucccuacuaacauccca

SEQ ID NO: 456515 - RNA, 18 nt, Homo sapiens
auguuugcacacuugugu

SEQ ID NO: 456516 - RNA, 22 nt, Homo sapiens
auguuuguaaauuaauacuuca

SEQ ID NO: 456517 - RNA, 14 nt, Homo sapiens
auguuuguacacaa

SEQ ID NO: 456518 - RNA, 16 nt, Homo sapiens
auguuuguccugaaca

SEQ ID NO: 456519 - RNA, 18 nt, Homo sapiens
auuaaaaacccauaacua

SEQ ID NO: 456520 - RNA, 20 nt, Homo sapiens
auuaaaaacccauaacuacc

SEQ ID NO: 456521 - RNA, 18 nt, Homo sapiens
auuaaaauaacuaagcaa

SEQ ID NO: 456522 - RNA, 12 nt, Homo sapiens
auuaaaauccag

SEQ ID NO: 456523 - RNA, 23 nt, Homo sapiens
auuaaaauccagcaucccaagau

SEQ ID NO: 456524 - RNA, 14 nt, Homo sapiens
auuaaacacuguaa

SEQ ID NO: 456525 - RNA, 18 nt, Homo sapiens
auuaaacucuccuuugau

SEQ ID NO: 456526 - RNA, 16 nt, Homo sapiens
auuaaacugugaaugu

SEQ ID NO: 456527 - RNA, 21 nt, Homo sapiens
auuaaacugugaauguuccaa

SEQ ID NO: 456528 - RNA, 14 nt, Homo sapiens
auuaaagacagagg

SEQ ID NO: 456529 - RNA, 12 nt, Homo sapiens
auuaacaaugac

SEQ ID NO: 456530 - RNA, 14 nt, Homo sapiens
auuaacccuauuaa

SEQ ID NO: 456531 - RNA, 22 nt, Homo sapiens
auuaaccuuaucauaaauucaa

SEQ ID NO: 456532 - RNA, 15 nt, Homo sapiens
auuaacuacauuuau

SEQ ID NO: 456533 - RNA, 13 nt, Homo sapiens
auuaacucugcau

SEQ ID NO: 456534 - RNA, 17 nt, Homo sapiens
auuaacucugcauagac

SEQ ID NO: 456535 - RNA, 18 nt, Homo sapiens
auuaacuuuaauucucuu

SEQ ID NO: 456536 - RNA, 14 nt, Homo sapiens
auuaaguggcuuuu

SEQ ID NO: 456537 - RNA, 23 nt, Homo sapiens
auuaaguggcuuuuuaacaugaa

SEQ ID NO: 456538 - RNA, 21 nt, Homo sapiens
auuaaguuaggcagucuucua

SEQ ID NO: 456539 - RNA, 14 nt, Homo sapiens
auuaaucucuaaaa

SEQ ID NO: 456540 - RNA, 12 nt, Homo sapiens
auuaaugaacua

SEQ ID NO: 456541 - RNA, 17 nt, Homo sapiens
auuaaugaacugugaca

SEQ ID NO: 456542 - RNA, 19 nt, Homo sapiens
auuaaugaguuuuauccaa

SEQ ID NO: 456543 - RNA, 16 nt, Homo sapiens
auuaauggcauguaau

SEQ ID NO: 456544 - RNA, 20 nt, Homo sapiens
auuaauuaagucaccuguau

SEQ ID NO: 456545 - RNA, 19 nt, Homo sapiens
auuaauuguuuugcacuuu

SEQ ID NO: 456546 - RNA, 16 nt, Homo sapiens
auuacaauacaucuaa

SEQ ID NO: 456547 - RNA, 16 nt, Homo sapiens
auuacaggcacccacc

SEQ ID NO: 456548 - RNA, 23 nt, Homo sapiens
auuacaggcgugagccaccucac

SEQ ID NO: 456549 - RNA, 15 nt, Homo sapiens
auuaccgucugugau

SEQ ID NO: 456550 - RNA, 18 nt, Homo sapiens
auuaccuggucauuucaa

SEQ ID NO: 456551 - RNA, 15 nt, Homo sapiens
auuacuaucauggca

SEQ ID NO: 456552 - RNA, 14 nt, Homo sapiens
auuacugauuuugu

SEQ ID NO: 456553 - RNA, 23 nt, Homo sapiens
auuacuguaaacagccuacugaa

SEQ ID NO: 456554 - RNA, 21 nt, Homo sapiens
auuacuguugcauuuacuuuu

SEQ ID NO: 456555 - RNA, 20 nt, Homo sapiens
auuacuuuuucauucuuuua

SEQ ID NO: 456556 - RNA, 17 nt, Homo sapiens
auuagaaggcaaguuuc

SEQ ID NO: 456557 - RNA, 15 nt, Homo sapiens
auuagaaugcaugua

SEQ ID NO: 456558 - RNA, 23 nt, Homo sapiens
auuagacaauguggaauuacaua

SEQ ID NO: 456559 - RNA, 13 nt, Homo sapiens
auuagacagucaa

SEQ ID NO: 456560 - RNA, 18 nt, Homo sapiens
auuagaggauugcacuag

SEQ ID NO: 456561 - RNA, 18 nt, Homo sapiens
auuagaggucuccaaaau

SEQ ID NO: 456562 - RNA, 13 nt, Homo sapiens
auuagaugaacuc

SEQ ID NO: 456563 - RNA, 20 nt, Homo sapiens
auuagcauucugguuuugac

SEQ ID NO: 456564 - RNA, 18 nt, Homo sapiens
auuagccgggcauggugg

SEQ ID NO: 456565 - RNA, 14 nt, Homo sapiens
auuaguauccuguu

SEQ ID NO: 456566 - RNA, 16 nt, Homo sapiens
auuaguugaaagggau

SEQ ID NO: 456567 - RNA, 15 nt, Homo sapiens
auuaguuucaggcaa

SEQ ID NO: 456568 - RNA, 22 nt, Homo sapiens
auuauaaaaucuuuccaucuca

SEQ ID NO: 456569 - RNA, 21 nt, Homo sapiens
auuauacagaccuaauaucau

SEQ ID NO: 456570 - RNA, 17 nt, Homo sapiens
auuauagcauguaauau

SEQ ID NO: 456571 - RNA, 20 nt, Homo sapiens
auuauaucugaggcacugau

SEQ ID NO: 456572 - RNA, 17 nt, Homo sapiens
auuaucgggagcagugu

SEQ ID NO: 456573 - RNA, 16 nt, Homo sapiens
auuaugagaggcaaug

SEQ ID NO: 456574 - RNA, 11 nt, Homo sapiens
auuauggcauu

SEQ ID NO: 456575 - RNA, 14 nt, Homo sapiens
auuaugggaacaag

SEQ ID NO: 456576 - RNA, 20 nt, Homo sapiens
auuaugggaacaaguguaca

SEQ ID NO: 456577 - RNA, 19 nt, Homo sapiens
auuauggguauguguugcc

SEQ ID NO: 456578 - RNA, 16 nt, Homo sapiens
auuauuagauucucca

SEQ ID NO: 456579 - RNA, 21 nt, Homo sapiens
auuauuucagucaucaucuca

SEQ ID NO: 456580 - RNA, 17 nt, Homo sapiens
auuauuucaucaugacu

SEQ ID NO: 456581 - RNA, 18 nt, Homo sapiens
auuauuugaaaacacugc

SEQ ID NO: 456582 - RNA, 14 nt, Homo sapiens
auuauuuuguuacu

SEQ ID NO: 456583 - RNA, 14 nt, Homo sapiens
auucaaaagcacaa

SEQ ID NO: 456584 - RNA, 13 nt, Homo sapiens
auucaaaauauaa

SEQ ID NO: 456585 - RNA, 18 nt, Homo sapiens
auucaaacauuauucuca

SEQ ID NO: 456586 - RNA, 13 nt, Homo sapiens
auucaaaugcaug

SEQ ID NO: 456587 - RNA, 23 nt, Homo sapiens
auucaacagguuuuccugaagaa

SEQ ID NO: 456588 - RNA, 16 nt, Homo sapiens
auucaaggaugcacag

SEQ ID NO: 456589 - RNA, 18 nt, Homo sapiens
auucaauaaaaugcacug

SEQ ID NO: 456590 - RNA, 18 nt, Homo sapiens
auuuaaccuacuagacaa

SEQ ID NO: 456591 - RNA, 12 nt, Homo sapiens
auuuaacugcau

SEQ ID NO: 456592 - RNA, 14 nt, Homo sapiens
auuuaacugcauau

SEQ ID NO: 456593 - RNA, 12 nt, Homo sapiens
auuuaacuugag

SEQ ID NO: 456594 - RNA, 13 nt, Homo sapiens
auuuaacuugagg

SEQ ID NO: 456595 - RNA, 15 nt, Homo sapiens
auuuaagaguccuga

SEQ ID NO: 456596 - RNA, 15 nt, Homo sapiens
auuuaaucaguguga

SEQ ID NO: 456597 - RNA, 19 nt, Homo sapiens
auuuaauguauuaguccaa

SEQ ID NO: 456598 - RNA, 20 nt, Homo sapiens
auuuaauuguaauugucuca

SEQ ID NO: 456599 - RNA, 21 nt, Homo sapiens
auuuaauuuuuuaacugcugc

SEQ ID NO: 456600 - RNA, 14 nt, Homo sapiens
auuuacaagcacga

SEQ ID NO: 456601 - RNA, 17 nt, Homo sapiens
auuuacaguuacugccu

SEQ ID NO: 456602 - RNA, 21 nt, Homo sapiens
auuuacaugaauugcauuuua

SEQ ID NO: 456603 - RNA, 13 nt, Homo sapiens
auuuaccaaauag

SEQ ID NO: 456604 - RNA, 15 nt, Homo sapiens
auuuacuugaucauu

SEQ ID NO: 456605 - RNA, 22 nt, Homo sapiens
auuuagaaaauagagcuuuuaa

SEQ ID NO: 456606 - RNA, 18 nt, Homo sapiens
auuuagaacuguauguca

SEQ ID NO: 456607 - RNA, 17 nt, Homo sapiens
auuuagauauaacacua

SEQ ID NO: 456608 - RNA, 15 nt, Homo sapiens
auuuagugucuugaa

SEQ ID NO: 456609 - RNA, 19 nt, Homo sapiens
auuuauaaacuagaucucc

SEQ ID NO: 456610 - RNA, 22 nt, Homo sapiens
auuuauaaaugagcaaauggaa

SEQ ID NO: 456611 - RNA, 22 nt, Homo sapiens
auuuauaaauuugaaauccaaa

SEQ ID NO: 456612 - RNA, 13 nt, Homo sapiens
auuuauaacucau

SEQ ID NO: 456613 - RNA, 22 nt, Homo sapiens
auuuauaguguugcuuuccuug

SEQ ID NO: 456614 - RNA, 23 nt, Homo sapiens
auuuaucagaaauuauacuauau

SEQ ID NO: 456615 - RNA, 20 nt, Homo sapiens
auuuauccaaagcauugcag

SEQ ID NO: 456616 - RNA, 17 nt, Homo sapiens
auuuauuaccucugaua

SEQ ID NO: 456617 - RNA, 19 nt, Homo sapiens
auuuauucuucuuuuccaa

SEQ ID NO: 456618 - RNA, 20 nt, Homo sapiens
auuuauugccuggaguguga

SEQ ID NO: 456619 - RNA, 16 nt, Homo sapiens
auuuauuuacauguga

SEQ ID NO: 456620 - RNA, 13 nt, Homo sapiens
auuuauuuaugua

SEQ ID NO: 456621 - RNA, 16 nt, Homo sapiens
auuuauuuaugugcaa

SEQ ID NO: 456622 - RNA, 14 nt, Homo sapiens
auuuauuucuagca

SEQ ID NO: 456623 - RNA, 15 nt, Homo sapiens
auuuauuucuagcaa

SEQ ID NO: 456624 - RNA, 15 nt, Homo sapiens
auuucaacaagaaua

SEQ ID NO: 456625 - RNA, 13 nt, Homo sapiens
auuucaacuucag

SEQ ID NO: 456626 - RNA, 13 nt, Homo sapiens
auuucaaugauug

SEQ ID NO: 456627 - RNA, 12 nt, Homo sapiens
auuucacugaca

SEQ ID NO: 456628 - RNA, 22 nt, Homo sapiens
auuucacuuaaacuuugucacu

SEQ ID NO: 456629 - RNA, 22 nt, Homo sapiens
auuucagaucauauuucacaau

SEQ ID NO: 456630 - RNA, 18 nt, Homo sapiens
auuucagcacaugcacua

SEQ ID NO: 456631 - RNA, 16 nt, Homo sapiens
auuucaggcacaucau

SEQ ID NO: 456632 - RNA, 17 nt, Homo sapiens
auuucaggcacaucauu

SEQ ID NO: 456633 - RNA, 15 nt, Homo sapiens
auuucaucuuuccaa

SEQ ID NO: 456634 - RNA, 23 nt, Homo sapiens
auuucaugauuagacaaugugga

SEQ ID NO: 456635 - RNA, 22 nt, Homo sapiens
auuucauguaaccaagaguauu

SEQ ID NO: 456636 - RNA, 13 nt, Homo sapiens
auuucaugugauc

SEQ ID NO: 456637 - RNA, 15 nt, Homo sapiens
auuuccaacaccaca

SEQ ID NO: 456638 - RNA, 16 nt, Homo sapiens
auuuccaacaccacag

SEQ ID NO: 456639 - RNA, 14 nt, Homo sapiens
auuuccagucucca

SEQ ID NO: 456640 - RNA, 15 nt, Homo sapiens
auuuccaucauguca

SEQ ID NO: 456641 - RNA, 20 nt, Homo sapiens
auuuccccuuuccaauucca

SEQ ID NO: 456642 - RNA, 21 nt, Homo sapiens
auuucccuaaaauacauuuaa

SEQ ID NO: 456643 - RNA, 13 nt, Homo sapiens
auuuccuugccuu

SEQ ID NO: 456644 - RNA, 15 nt, Homo sapiens
auuucggagcaugaa

SEQ ID NO: 456645 - RNA, 16 nt, Homo sapiens
auuucuaaaacauuaa

SEQ ID NO: 456646 - RNA, 23 nt, Homo sapiens
auuucuacuucuggaagucaucu

SEQ ID NO: 456647 - RNA, 21 nt, Homo sapiens
auuucuagacaguauugccac

SEQ ID NO: 456648 - RNA, 17 nt, Homo sapiens
auuucuauccugaguag

SEQ ID NO: 456649 - RNA, 12 nt, Homo sapiens
auuucuauucaa

SEQ ID NO: 456650 - RNA, 17 nt, Homo sapiens
auuucugaaaugugcag

SEQ ID NO: 456651 - RNA, 20 nt, Homo sapiens
auuucugagagugaaaccau

SEQ ID NO: 456652 - RNA, 18 nt, Homo sapiens
auuucugaucuauacaaa

SEQ ID NO: 456653 - RNA, 14 nt, Homo sapiens
auuucugccaggca

SEQ ID NO: 456654 - RNA, 16 nt, Homo sapiens
auuucugccaggcaug

SEQ ID NO: 456655 - RNA, 18 nt, Homo sapiens
auuucuguucacuuugua

SEQ ID NO: 456656 - RNA, 16 nt, Homo sapiens
auuucuuguugcucaa

SEQ ID NO: 456657 - RNA, 20 nt, Homo sapiens
auuucuuucccuaaagaaca

SEQ ID NO: 456658 - RNA, 18 nt, Homo sapiens
auuucuuucuuuccuuaa

SEQ ID NO: 456659 - RNA, 22 nt, Homo sapiens
auuugaaacugcuaauuacaca

SEQ ID NO: 456660 - RNA, 22 nt, Homo sapiens
auuugaaugugguuacuuccua

SEQ ID NO: 456661 - RNA, 16 nt, Homo sapiens
auuugacacauaaaag

SEQ ID NO: 456662 - RNA, 19 nt, Homo sapiens
auuugagagaaucuacuaa

SEQ ID NO: 456663 - RNA, 14 nt, Homo sapiens
auuugcauggauuu

SEQ ID NO: 456664 - RNA, 13 nt, Homo sapiens
auuugccaaaaac

SEQ ID NO: 456665 - RNA, 16 nt, Homo sapiens
auuugccccaacuuaa

SEQ ID NO: 456666 - RNA, 19 nt, Homo sapiens
auuugcccuuaaggacaaa

SEQ ID NO: 456667 - RNA, 22 nt, Homo sapiens
auuugcuagagggagggagcag

SEQ ID NO: 456668 - RNA, 21 nt, Homo sapiens
auuugcugaauaugcaauuug

SEQ ID NO: 456669 - RNA, 19 nt, Homo sapiens
auuugcugagcauguacug

SEQ ID NO: 456670 - RNA, 15 nt, Homo sapiens
auuugcugcauuuca

SEQ ID NO: 456671 - RNA, 20 nt, Homo sapiens
auuugcuucuaauguucccc

SEQ ID NO: 456672 - RNA, 16 nt, Homo sapiens
auuuggaaagcacugg

SEQ ID NO: 456673 - RNA, 19 nt, Homo sapiens
auuuggaaagcacuggaau

SEQ ID NO: 456674 - RNA, 15 nt, Homo sapiens
auuuggaaucuucuc

SEQ ID NO: 456675 - RNA, 15 nt, Homo sapiens
auuuggauugcuaau

SEQ ID NO: 456676 - RNA, 17 nt, Homo sapiens
auuuggugguacuuuau

SEQ ID NO: 456677 - RNA, 14 nt, Homo sapiens
auuuguaaguuuau

SEQ ID NO: 456678 - RNA, 23 nt, Homo sapiens
auuugucacaaauaaacauaaua

SEQ ID NO: 456679 - RNA, 14 nt, Homo sapiens
auuugucacuggaa

SEQ ID NO: 456680 - RNA, 20 nt, Homo sapiens
auuugucccuaugcauauca

SEQ ID NO: 456681 - RNA, 21 nt, Homo sapiens
auuuguguaauauuacuuuaa

SEQ ID NO: 456682 - RNA, 19 nt, Homo sapiens
auuuguguauaucauacau

SEQ ID NO: 456683 - RNA, 21 nt, Homo sapiens
auuuguuuaugaaauguuaca

SEQ ID NO: 456684 - RNA, 17 nt, Homo sapiens
auuuuaaaaagucuuca

SEQ ID NO: 456685 - RNA, 15 nt, Homo sapiens
auuuuaaaguaucau

SEQ ID NO: 456686 - RNA, 18 nt, Homo sapiens
auuuuacaaagcauguga

SEQ ID NO: 456687 - RNA, 13 nt, Homo sapiens
auuuuacuuccau

SEQ ID NO: 456688 - RNA, 19 nt, Homo sapiens
auuuuagcguuaaagucag

SEQ ID NO: 456689 - RNA, 19 nt, Homo sapiens
auuuuaggagacagucuca

SEQ ID NO: 456690 - RNA, 17 nt, Homo sapiens
auuuuagggcuguagac

SEQ ID NO: 456691 - RNA, 17 nt, Homo sapiens
auuuuauaccagcuuau

SEQ ID NO: 456692 - RNA, 17 nt, Homo sapiens
auuuuauacugcacuuu

SEQ ID NO: 456693 - RNA, 21 nt, Homo sapiens
auuuuaucaaacacacuucca

SEQ ID NO: 456694 - RNA, 17 nt, Homo sapiens
auuuuaucucuucuucc

SEQ ID NO: 456695 - RNA, 14 nt, Homo sapiens
auuuuaucuguuaa

SEQ ID NO: 456696 - RNA, 15 nt, Homo sapiens
auuuuaugucuauau

SEQ ID NO: 456697 - RNA, 13 nt, Homo sapiens
auuuuauuccagc

SEQ ID NO: 456698 - RNA, 21 nt, Homo sapiens
auuuucaagaucaaacuucca

SEQ ID NO: 456699 - RNA, 17 nt, Homo sapiens
auuuucaguaccaaaga

SEQ ID NO: 456700 - RNA, 14 nt, Homo sapiens
auuuucuacagugu

SEQ ID NO: 456701 - RNA, 18 nt, Homo sapiens
auuuucuccgaaaggcaa

SEQ ID NO: 456702 - RNA, 22 nt, Homo sapiens
auuuucucuccucgguggcauu

SEQ ID NO: 456703 - RNA, 12 nt, Homo sapiens
auuuucugaugg

SEQ ID NO: 456704 - RNA, 15 nt, Homo sapiens
auuuugaguucuaca

SEQ ID NO: 456705 - RNA, 23 nt, Homo sapiens
auuuugcacaguuaccugcacac

SEQ ID NO: 456706 - RNA, 17 nt, Homo sapiens
auuuugcauaguaccaa

SEQ ID NO: 456707 - RNA, 19 nt, Homo sapiens
ccagagagacccugccaac

SEQ ID NO: 456708 - RNA, 13 nt, Homo sapiens
ccagagagagcuc

SEQ ID NO: 456709 - RNA, 17 nt, Homo sapiens
ccagagagagcucugca

SEQ ID NO: 456710 - RNA, 20 nt, Homo sapiens
ccagagauagggaugucaua

SEQ ID NO: 456711 - RNA, 17 nt, Homo sapiens
ccagagccacuaccuuu

SEQ ID NO: 456712 - RNA, 23 nt, Homo sapiens
ccagagccuuaauaaacguccac

SEQ ID NO: 456713 - RNA, 18 nt, Homo sapiens
ccagagcuggaaggcagg

SEQ ID NO: 456714 - RNA, 15 nt, Homo sapiens
ccagaggauggugag

SEQ ID NO: 456715 - RNA, 10 nt, Homo sapiens
ccagaggcac

SEQ ID NO: 456716 - RNA, 17 nt, Homo sapiens
ccagagguuaucugccu

SEQ ID NO: 456717 - RNA, 22 nt, Homo sapiens
ccagauagucccagcagccucc

SEQ ID NO: 456718 - RNA, 15 nt, Homo sapiens
ccagauauuucacau

SEQ ID NO: 456719 - RNA, 22 nt, Homo sapiens
ccagauccuucaaagagucaua

SEQ ID NO: 456720 - RNA, 13 nt, Homo sapiens
ccagaugaucucu

SEQ ID NO: 456721 - RNA, 16 nt, Homo sapiens
ccagauguuggaccaa

SEQ ID NO: 456722 - RNA, 16 nt, Homo sapiens
ccagauguuguuccug

SEQ ID NO: 456723 - RNA, 15 nt, Homo sapiens
ccagauuccauuuca

SEQ ID NO: 456724 - RNA, 17 nt, Homo sapiens
cagauggaaagaaagca

SEQ ID NO: 456725 - RNA, 20 nt, Homo sapiens
cagauggaaugcuguguuaa

SEQ ID NO: 456726 - RNA, 15 nt, Homo sapiens
cagauggagacauug

SEQ ID NO: 456727 - RNA, 14 nt, Homo sapiens
cagauggucccauu

SEQ ID NO: 456728 - RNA, 13 nt, Homo sapiens
cagauguguuugc

SEQ ID NO: 456729 - RNA, 21 nt, Homo sapiens
cagauguuuuucuucauuaac

SEQ ID NO: 456730 - RNA, 19 nt, Homo sapiens
cagauuccaccuagagcua

SEQ ID NO: 456731 - RNA, 15 nt, Homo sapiens
cagauucuagcacau

SEQ ID NO: 456732 - RNA, 17 nt, Homo sapiens
cagauuguaccauugag

SEQ ID NO: 456733 - RNA, 15 nt, Homo sapiens
cagcaaaagugcagu

SEQ ID NO: 456734 - RNA, 16 nt, Homo sapiens
cagcaaaagugcagua

SEQ ID NO: 456735 - RNA, 13 nt, Homo sapiens
cagcaaaugagau

SEQ ID NO: 456736 - RNA, 13 nt, Homo sapiens
cagcaagagccac

SEQ ID NO: 456737 - RNA, 16 nt, Homo sapiens
cagcaaggggacaucu

SEQ ID NO: 456738 - RNA, 13 nt, Homo sapiens
cagcaagucccag

SEQ ID NO: 456739 - RNA, 20 nt, Homo sapiens
cagcacagaacacacugaga

SEQ ID NO: 456740 - RNA, 18 nt, Homo sapiens
cagcaccaugggccuucu

SEQ ID NO: 456741 - RNA, 19 nt, Homo sapiens
cagcacccagcaacuccaa

SEQ ID NO: 456742 - RNA, 19 nt, Homo sapiens
cagcaccuucccucucacc

SEQ ID NO: 456743 - RNA, 18 nt, Homo sapiens
cagcacuuagguuuuccu

SEQ ID NO: 456744 - RNA, 17 nt, Homo sapiens
cagcagaacuucugaaa

SEQ ID NO: 456745 - RNA, 20 nt, Homo sapiens
cagcagagccuggaagacac

SEQ ID NO: 456746 - RNA, 23 nt, Homo sapiens
cagcagcauauguuguugcuugu

SEQ ID NO: 456747 - RNA, 15 nt, Homo sapiens
cagcagccgcugcca

SEQ ID NO: 456748 - RNA, 22 nt, Homo sapiens
cagcagcuucaccagagcauuu

SEQ ID NO: 456749 - RNA, 22 nt, Homo sapiens
cagcagcuucucuccacugaaa

SEQ ID NO: 456750 - RNA, 23 nt, Homo sapiens
cagcagggccacugaguagucau

SEQ ID NO: 456751 - RNA, 15 nt, Homo sapiens
cagcaugauguguug

SEQ ID NO: 456752 - RNA, 19 nt, Homo sapiens
cagcauuauucuucagaag

SEQ ID NO: 456753 - RNA, 17 nt, Homo sapiens
cagcauucucacuccua

SEQ ID NO: 456754 - RNA, 17 nt, Homo sapiens
cagcauuucagcuguga

SEQ ID NO: 456755 - RNA, 18 nt, Homo sapiens
cagccaaacccugucuga

SEQ ID NO: 456756 - RNA, 13 nt, Homo sapiens
cagccaccuuccu

SEQ ID NO: 456757 - RNA, 20 nt, Homo sapiens
cagccacuuauuuccaugga

SEQ ID NO: 456758 - RNA, 15 nt, Homo sapiens
cagccagacccugca

SEQ ID NO: 456759 - RNA, 14 nt, Homo sapiens
cagccagccgugag

SEQ ID NO: 456760 - RNA, 16 nt, Homo sapiens
cagccaggacaucucu

SEQ ID NO: 456761 - RNA, 16 nt, Homo sapiens
cagccaggaccaccuc

SEQ ID NO: 456762 - RNA, 14 nt, Homo sapiens
cagccaggcugcca

SEQ ID NO: 456763 - RNA, 15 nt, Homo sapiens
cagccagucuugccu

SEQ ID NO: 456764 - RNA, 13 nt, Homo sapiens
cagccaucuguau

SEQ ID NO: 456765 - RNA, 12 nt, Homo sapiens
cagccaugagaa

SEQ ID NO: 456766 - RNA, 12 nt, Homo sapiens
cagccauuucaa

SEQ ID NO: 456767 - RNA, 19 nt, Homo sapiens
cagcccagacauccuguga

SEQ ID NO: 456768 - RNA, 16 nt, Homo sapiens
cagcccaggacucuaa

SEQ ID NO: 456769 - RNA, 18 nt, Homo sapiens
cagccccaacuccagggg

SEQ ID NO: 456770 - RNA, 15 nt, Homo sapiens
cagccccuaccuuga

SEQ ID NO: 456771 - RNA, 19 nt, Homo sapiens
cagccccuccccauggugc

SEQ ID NO: 456772 - RNA, 19 nt, Homo sapiens
cagccccucucuacuguca

SEQ ID NO: 456773 - RNA, 19 nt, Homo sapiens
cagcccugaggugaaaggg

SEQ ID NO: 456774 - RNA, 14 nt, Homo sapiens
cagcccuugcuugg

SEQ ID NO: 456775 - RNA, 17 nt, Homo sapiens
cagcccuugcuuggcca

SEQ ID NO: 456776 - RNA, 16 nt, Homo sapiens
cagccgugagugcaga

SEQ ID NO: 456777 - RNA, 23 nt, Homo sapiens
cagccucacuugaaugugucacu

SEQ ID NO: 456778 - RNA, 17 nt, Homo sapiens
cagccucagcucucagu

SEQ ID NO: 456779 - RNA, 13 nt, Homo sapiens
cagccuccaagaa

SEQ ID NO: 456780 - RNA, 17 nt, Homo sapiens
cagccucccaaagugcu

SEQ ID NO: 456781 - RNA, 12 nt, Homo sapiens
cagccucccacc

SEQ ID NO: 456782 - RNA, 20 nt, Homo sapiens
cagccucccgaguagcugga

SEQ ID NO: 456783 - RNA, 19 nt, Homo sapiens
cagccucccuaguagcugg

SEQ ID NO: 456784 - RNA, 17 nt, Homo sapiens
cagccucccugucacuc

SEQ ID NO: 456785 - RNA, 16 nt, Homo sapiens
cagccuccuccugacc

SEQ ID NO: 456786 - RNA, 17 nt, Homo sapiens
cagccuccuccugacca

SEQ ID NO: 456787 - RNA, 14 nt, Homo sapiens
cagccuccugcuaa

SEQ ID NO: 456788 - RNA, 13 nt, Homo sapiens
cagccucuacagc

SEQ ID NO: 456789 - RNA, 17 nt, Homo sapiens
cagccucuugagcugaa

SEQ ID NO: 456790 - RNA, 23 nt, Homo sapiens
cagccuggaggccgggugcucag

SEQ ID NO: 456791 - RNA, 19 nt, Homo sapiens
cagccuggccacgcagcca

SEQ ID NO: 456792 - RNA, 17 nt, Homo sapiens
cagccuggccccugugc

SEQ ID NO: 456793 - RNA, 21 nt, Homo sapiens
cagccuggucaacauggugaa

SEQ ID NO: 456794 - RNA, 20 nt, Homo sapiens
cagccugugguuacagugca

SEQ ID NO: 456795 - RNA, 22 nt, Homo sapiens
cagccugugguuacagugcaga

SEQ ID NO: 456796 - RNA, 18 nt, Homo sapiens
cagcgaaugaaugcugua

SEQ ID NO: 456797 - RNA, 14 nt, Homo sapiens
cagcgaugugucac

SEQ ID NO: 456798 - RNA, 13 nt, Homo sapiens
cagcgcauguguc

SEQ ID NO: 456799 - RNA, 12 nt, Homo sapiens
cagcgcucccug

SEQ ID NO: 456800 - RNA, 20 nt, Homo sapiens
cagcggcacaaaugcaccuc

SEQ ID NO: 456801 - RNA, 15 nt, Homo sapiens
cagcgucccagucuc

SEQ ID NO: 456802 - RNA, 22 nt, Homo sapiens
cagcuaacaaguagcacacuga

SEQ ID NO: 456803 - RNA, 16 nt, Homo sapiens
cagcuaagccugauga

SEQ ID NO: 456804 - RNA, 14 nt, Homo sapiens
cagcuaagcucaaa

SEQ ID NO: 456805 - RNA, 22 nt, Homo sapiens
cagcuacauuccucagcugcca

SEQ ID NO: 456806 - RNA, 22 nt, Homo sapiens
cagcuacgaauauagaggguuu

SEQ ID NO: 456807 - RNA, 15 nt, Homo sapiens
cagcuacuaaccugg

SEQ ID NO: 456808 - RNA, 22 nt, Homo sapiens
cagcuacucaggagacugaguu

SEQ ID NO: 456809 - RNA, 11 nt, Homo sapiens
cagcuagacac

SEQ ID NO: 456810 - RNA, 15 nt, Homo sapiens
cagcuaggcugagau

SEQ ID NO: 456811 - RNA, 14 nt, Homo sapiens
cagcuaucagcucu

SEQ ID NO: 456812 - RNA, 20 nt, Homo sapiens
cagcucaaguuagcauuuca

SEQ ID NO: 456813 - RNA, 18 nt, Homo sapiens
cagcucaccaacuacaga

SEQ ID NO: 456814 - RNA, 16 nt, Homo sapiens
cagcucagccccggcc

SEQ ID NO: 456815 - RNA, 15 nt, Homo sapiens
cagcuccacucaggg

SEQ ID NO: 456816 - RNA, 14 nt, Homo sapiens
cagcuccacucuga

SEQ ID NO: 456817 - RNA, 21 nt, Homo sapiens
cagcuccuccucuuggagcug

SEQ ID NO: 456818 - RNA, 14 nt, Homo sapiens
cagcucguucucug

SEQ ID NO: 456819 - RNA, 18 nt, Homo sapiens
cagcucucaguugcagcc

SEQ ID NO: 456820 - RNA, 13 nt, Homo sapiens
cagcucucugcaa

SEQ ID NO: 456821 - RNA, 19 nt, Homo sapiens
cagcucuuccaaucuccau

SEQ ID NO: 456822 - RNA, 22 nt, Homo sapiens
cagcucuuccccacccugggau

SEQ ID NO: 456823 - RNA, 19 nt, Homo sapiens
cagcugaacacaagcaaac

SEQ ID NO: 456824 - RNA, 22 nt, Homo sapiens
cagcugaacaguguuggcuuuc

SEQ ID NO: 456825 - RNA, 17 nt, Homo sapiens
cagcugagcuugagcuc

SEQ ID NO: 456826 - RNA, 20 nt, Homo sapiens
cagcugcauacaguuugcac

SEQ ID NO: 456827 - RNA, 16 nt, Homo sapiens
cagcugccaagugcuc

SEQ ID NO: 456828 - RNA, 19 nt, Homo sapiens
cagcugccuuggacugugu

SEQ ID NO: 456829 - RNA, 17 nt, Homo sapiens
cagcugcuucugugcau

SEQ ID NO: 456830 - RNA, 15 nt, Homo sapiens
cagcugggauuacag

SEQ ID NO: 456831 - RNA, 17 nt, Homo sapiens
cagcugggauuugaacc

SEQ ID NO: 456832 - RNA, 14 nt, Homo sapiens
cagcuuaugagcuc

SEQ ID NO: 456833 - RNA, 20 nt, Homo sapiens
cagcuucaccagagcauuuc

SEQ ID NO: 456834 - RNA, 23 nt, Homo sapiens
cagcuucuggggguagaucucaa

SEQ ID NO: 456835 - RNA, 20 nt, Homo sapiens
cagcuugaguggguucucug

SEQ ID NO: 456836 - RNA, 21 nt, Homo sapiens
cagcuuggugguuauguccca

SEQ ID NO: 456837 - RNA, 17 nt, Homo sapiens
cagcuuucaagugccuu

SEQ ID NO: 456838 - RNA, 21 nt, Homo sapiens
cagcuuucccuggcucaggga

SEQ ID NO: 456839 - RNA, 14 nt, Homo sapiens
cagcuuuucuugcc

SEQ ID NO: 456840 - RNA, 19 nt, Homo sapiens
cagcuuuuguuguuuauau

SEQ ID NO: 456841 - RNA, 23 nt, Homo sapiens
caggaaaaggugauauccauucu

SEQ ID NO: 456842 - RNA, 21 nt, Homo sapiens
caggaaagaucccaagucaaa

SEQ ID NO: 456843 - RNA, 23 nt, Homo sapiens
caggaaauauauaugugugugua

SEQ ID NO: 456844 - RNA, 19 nt, Homo sapiens
caggaacugaaaaccaguc

SEQ ID NO: 456845 - RNA, 14 nt, Homo sapiens
caggaaggagcaaa

SEQ ID NO: 456846 - RNA, 16 nt, Homo sapiens
caggaagucaggagcc

SEQ ID NO: 456847 - RNA, 18 nt, Homo sapiens
caggaagucuucagggaa

SEQ ID NO: 456848 - RNA, 17 nt, Homo sapiens
caggacagcauggugca

SEQ ID NO: 456849 - RNA, 12 nt, Homo sapiens
ccaaauugcagc

SEQ ID NO: 456850 - RNA, 14 nt, Homo sapiens
ccaaauugcagcuu

SEQ ID NO: 456851 - RNA, 13 nt, Homo sapiens
ccaaauugcugag

SEQ ID NO: 456852 - RNA, 18 nt, Homo sapiens
ccaacaaccacacuuaaa

SEQ ID NO: 456853 - RNA, 15 nt, Homo sapiens
ccaacacccugucua

SEQ ID NO: 456854 - RNA, 10 nt, Homo sapiens
ccaacacuug

SEQ ID NO: 456855 - RNA, 21 nt, Homo sapiens
ccaacagaagcuuccauucca

SEQ ID NO: 456856 - RNA, 18 nt, Homo sapiens
ccaacaguuugaugcuga

SEQ ID NO: 456857 - RNA, 14 nt, Homo sapiens
ccaaccaaugcaca

SEQ ID NO: 456858 - RNA, 17 nt, Homo sapiens
ccaaccggucacccagg

SEQ ID NO: 456859 - RNA, 14 nt, Homo sapiens
ccaacguccccucc

SEQ ID NO: 456860 - RNA, 20 nt, Homo sapiens
ccaacguggggcagcacaga

SEQ ID NO: 456861 - RNA, 13 nt, Homo sapiens
ccaacuaugucca

SEQ ID NO: 456862 - RNA, 15 nt, Homo sapiens
ccaacuccaggguua

SEQ ID NO: 456863 - RNA, 15 nt, Homo sapiens
cugaaaaacauucca

SEQ ID NO: 456864 - RNA, 15 nt, Homo sapiens
cugaaaaagaacugu

SEQ ID NO: 456865 - RNA, 23 nt, Homo sapiens
cugaaaaccauccaucuguggaa

SEQ ID NO: 456866 - RNA, 14 nt, Homo sapiens
cugaaaacuguaaa

SEQ ID NO: 456867 - RNA, 15 nt, Homo sapiens
cugaaaagugcuuug

SEQ ID NO: 456868 - RNA, 18 nt, Homo sapiens
cugaaaaucgaguuuuuc

SEQ ID NO: 456869 - RNA, 17 nt, Homo sapiens
cugaaacaaaaaugcca

SEQ ID NO: 456870 - RNA, 22 nt, Homo sapiens
cugaaacauuuggaagccccau

SEQ ID NO: 456871 - RNA, 22 nt, Homo sapiens
cugaaacuauagaauaaagccu

SEQ ID NO: 456872 - RNA, 17 nt, Homo sapiens
cugaaagagcauuauuc

SEQ ID NO: 456873 - RNA, 17 nt, Homo sapiens
cugaaauaacauggccu

SEQ ID NO: 456874 - RNA, 15 nt, Homo sapiens
cugaaauguuuccag

SEQ ID NO: 456875 - RNA, 19 nt, Homo sapiens
cugaacaguguuggcuuuc

SEQ ID NO: 456876 - RNA, 20 nt, Homo sapiens
cugaacaguguuggcuuuca

SEQ ID NO: 456877 - RNA, 18 nt, Homo sapiens
cugaacauaaaucaguua

SEQ ID NO: 456878 - RNA, 21 nt, Homo sapiens
cugaacauugcacugauauca

SEQ ID NO: 456879 - RNA, 18 nt, Homo sapiens
cugaaccauuacuguaau

SEQ ID NO: 456880 - RNA, 12 nt, Homo sapiens
cugaacuccaua

SEQ ID NO: 456881 - RNA, 23 nt, Homo sapiens
cugaacuguggggugugcacauc

SEQ ID NO: 456882 - RNA, 21 nt, Homo sapiens
cugaagaaaaugaagcccuau

SEQ ID NO: 456883 - RNA, 22 nt, Homo sapiens
cugaagagcuauuauauaaaaa

SEQ ID NO: 456884 - RNA, 22 nt, Homo sapiens
cugaagaggaacugggccuguu

SEQ ID NO: 456885 - RNA, 19 nt, Homo sapiens
cugaagcgaacaucuucau

SEQ ID NO: 456886 - RNA, 17 nt, Homo sapiens
cugaaggagauuuuccu

SEQ ID NO: 456887 - RNA, 23 nt, Homo sapiens
cugaaggcaaaucuccuuugucc

SEQ ID NO: 456888 - RNA, 13 nt, Homo sapiens
cugaaggcuuuca

SEQ ID NO: 456889 - RNA, 12 nt, Homo sapiens
cugaagugaaua

SEQ ID NO: 456890 - RNA, 15 nt, Homo sapiens
cugaaguuucauuua

SEQ ID NO: 456891 - RNA, 23 nt, Homo sapiens
cugaauaccucuuugaaagaagg

SEQ ID NO: 456892 - RNA, 13 nt, Homo sapiens
cugaauacugcag

SEQ ID NO: 456893 - RNA, 13 nt, Homo sapiens
cugaauagaaaca

SEQ ID NO: 456894 - RNA, 15 nt, Homo sapiens
cugaauaucuguuca

SEQ ID NO: 456895 - RNA, 23 nt, Homo sapiens
cugaauccauaaaggcauaccuu

SEQ ID NO: 456896 - RNA, 12 nt, Homo sapiens
cugaaucuaccu

SEQ ID NO: 456897 - RNA, 16 nt, Homo sapiens
cugaaugcauucaggg

SEQ ID NO: 456898 - RNA, 19 nt, Homo sapiens
cugaaugcuccauuaaucc

SEQ ID NO: 456899 - RNA, 17 nt, Homo sapiens
cugaaugggagccagaa

SEQ ID NO: 456900 - RNA, 21 nt, Homo sapiens
cugaaugguuccaugccugag

SEQ ID NO: 456901 - RNA, 12 nt, Homo sapiens
cugaauguucug

SEQ ID NO: 456902 - RNA, 13 nt, Homo sapiens
cugaauuaaggau

SEQ ID NO: 456903 - RNA, 16 nt, Homo sapiens
cugacaacaugcuagg

SEQ ID NO: 456904 - RNA, 17 nt, Homo sapiens
cugacacugacauuuca

SEQ ID NO: 456905 - RNA, 18 nt, Homo sapiens
cugacagaaggacucagg

SEQ ID NO: 456906 - RNA, 21 nt, Homo sapiens
cugacauaaacccaucuguaa

SEQ ID NO: 456907 - RNA, 15 nt, Homo sapiens
cugaccaccuugcac

SEQ ID NO: 456908 - RNA, 18 nt, Homo sapiens
cugaccccugcaccagcc

SEQ ID NO: 456909 - RNA, 17 nt, Homo sapiens
cugaccucacugugacc

SEQ ID NO: 456910 - RNA, 18 nt, Homo sapiens
cugaccuccuggacugua

SEQ ID NO: 456911 - RNA, 18 nt, Homo sapiens
cugacgaggcugggccaa

SEQ ID NO: 456912 - RNA, 22 nt, Homo sapiens
cugacuauucuugauguaaaau

SEQ ID NO: 456913 - RNA, 23 nt, Homo sapiens
cugacucaacauguuacugacca

SEQ ID NO: 456914 - RNA, 12 nt, Homo sapiens
cugacugacaaa

SEQ ID NO: 456915 - RNA, 11 nt, Homo sapiens
cugacugcaac

SEQ ID NO: 456916 - RNA, 15 nt, Homo sapiens
cugacuuuuaaccca

SEQ ID NO: 456917 - RNA, 17 nt, Homo sapiens
cugacuuuuaaugucau

SEQ ID NO: 456918 - RNA, 19 nt, Homo sapiens
cugacuuuuaaugucauuu

SEQ ID NO: 456919 - RNA, 23 nt, Homo sapiens
cugagaacaaauacaauucaguc

SEQ ID NO: 456920 - RNA, 21 nt, Homo sapiens
cugagaagaggagcccucauc

SEQ ID NO: 456921 - RNA, 14 nt, Homo sapiens
cugagaagccucau

SEQ ID NO: 456922 - RNA, 22 nt, Homo sapiens
cugagacccccaugguaaugua

SEQ ID NO: 456923 - RNA, 12 nt, Homo sapiens
cugagacuugaa

SEQ ID NO: 456924 - RNA, 14 nt, Homo sapiens
cugagagacaggac

SEQ ID NO: 456925 - RNA, 16 nt, Homo sapiens
cugagagacaggacua

SEQ ID NO: 456926 - RNA, 22 nt, Homo sapiens
cugagcaguuguuauauucauu

SEQ ID NO: 456927 - RNA, 22 nt, Homo sapiens
cugagcccagccuacuuuucag

SEQ ID NO: 456928 - RNA, 20 nt, Homo sapiens
cugagcccccaccugccuga

SEQ ID NO: 456929 - RNA, 23 nt, Homo sapiens
cugagccccugggacugcugcuu

SEQ ID NO: 456930 - RNA, 18 nt, Homo sapiens
cugagccuacagaugaac

SEQ ID NO: 456931 - RNA, 16 nt, Homo sapiens
cugagcgaugacucaa

SEQ ID NO: 456932 - RNA, 21 nt, Homo sapiens
cugagcgggcuugugauaugc

SEQ ID NO: 456933 - RNA, 20 nt, Homo sapiens
cugagcuguuaucuugugua

SEQ ID NO: 456934 - RNA, 22 nt, Homo sapiens
cugagcuuuggacgcacacagc

SEQ ID NO: 456935 - RNA, 18 nt, Homo sapiens
cugagcuuuguguagcuc

SEQ ID NO: 456936 - RNA, 17 nt, Homo sapiens
cugaggaaugcgguuca

SEQ ID NO: 456937 - RNA, 14 nt, Homo sapiens
cugaggccauuccc

SEQ ID NO: 456938 - RNA, 19 nt, Homo sapiens
cugaggccuggacuuuccu

SEQ ID NO: 456939 - RNA, 23 nt, Homo sapiens
cugaggcuggggcuuuugugcca

SEQ ID NO: 456940 - RNA, 15 nt, Homo sapiens
cugagggcaggguuc

SEQ ID NO: 456941 - RNA, 16 nt, Homo sapiens
cugaggugaaagggag

SEQ ID NO: 456942 - RNA, 20 nt, Homo sapiens
cugaguagcauauauaauuu

SEQ ID NO: 456943 - RNA, 15 nt, Homo sapiens
cucccaaggcucuga

SEQ ID NO: 456944 - RNA, 22 nt, Homo sapiens
cucccaagggaggcccauguga

SEQ ID NO: 456945 - RNA, 14 nt, Homo sapiens
cucccaaguccaca

SEQ ID NO: 456946 - RNA, 17 nt, Homo sapiens
cucccaaguccagugug

SEQ ID NO: 456947 - RNA, 18 nt, Homo sapiens
cucccacaucccccgugu

SEQ ID NO: 456948 - RNA, 14 nt, Homo sapiens
cucccacaugaugu

SEQ ID NO: 456949 - RNA, 13 nt, Homo sapiens
cucccacccugac

SEQ ID NO: 456950 - RNA, 23 nt, Homo sapiens
cucccaccuuugguccuaagucc

SEQ ID NO: 456951 - RNA, 23 nt, Homo sapiens
cucccagcucuagacaacccugc

SEQ ID NO: 456952 - RNA, 16 nt, Homo sapiens
cucccagggcugugaa

SEQ ID NO: 456953 - RNA, 22 nt, Homo sapiens
cucccagugaccccugaccuca

SEQ ID NO: 456954 - RNA, 14 nt, Homo sapiens
cucccagugccaaa

SEQ ID NO: 456955 - RNA, 12 nt, Homo sapiens
cuccccaacagc

SEQ ID NO: 456956 - RNA, 21 nt, Homo sapiens
cuccccaauccaacccaugca

SEQ ID NO: 456957 - RNA, 22 nt, Homo sapiens
cuccccaccagucucacccacu

SEQ ID NO: 456958 - RNA, 13 nt, Homo sapiens
cuccccacucuag

SEQ ID NO: 456959 - RNA, 21 nt, Homo sapiens
cuccccagcccuuugcaggcc

SEQ ID NO: 456960 - RNA, 18 nt, Homo sapiens
cuccccaggagcucaggu

SEQ ID NO: 456961 - RNA, 14 nt, Homo sapiens
cuccccauggugca

SEQ ID NO: 456962 - RNA, 18 nt, Homo sapiens
cuccccuccagaccccua

SEQ ID NO: 456963 - RNA, 15 nt, Homo sapiens
cuccccugcacugua

SEQ ID NO: 456964 - RNA, 11 nt, Homo sapiens
cuccccugugu

SEQ ID NO: 456965 - RNA, 19 nt, Homo sapiens
cuccccuuuuucuuccuca

SEQ ID NO: 456966 - RNA, 21 nt, Homo sapiens
cucccucgaacccacacugca

SEQ ID NO: 456967 - RNA, 18 nt, Homo sapiens
cucccucucuugccgaca

SEQ ID NO: 456968 - RNA, 18 nt, Homo sapiens
cucccugguuuuacccca

SEQ ID NO: 456969 - RNA, 21 nt, Homo sapiens
cucccugucacucagcugaga

SEQ ID NO: 456970 - RNA, 14 nt, Homo sapiens
cucccuuaauaaac

SEQ ID NO: 456971 - RNA, 17 nt, Homo sapiens
cucccuuaauaaacuca

SEQ ID NO: 456972 - RNA, 20 nt, Homo sapiens
cucccuuaauaaacucacaa

SEQ ID NO: 456973 - RNA, 21 nt, Homo sapiens
cucccuuaauaaacucacaac

SEQ ID NO: 456974 - RNA, 23 nt, Homo sapiens
cucccuuaauaaacucacaacuc

SEQ ID NO: 456975 - RNA, 20 nt, Homo sapiens
cucccuugcucagugccucc

SEQ ID NO: 456976 - RNA, 14 nt, Homo sapiens
cuccgcugcuuacu

SEQ ID NO: 456977 - RNA, 19 nt, Homo sapiens
cuccggggucugugcugug

SEQ ID NO: 456978 - RNA, 18 nt, Homo sapiens
cuccgugagccucagcca

SEQ ID NO: 456979 - RNA, 15 nt, Homo sapiens
cuccgugugucucau

SEQ ID NO: 456980 - RNA, 14 nt, Homo sapiens
cuccuaaauuucca

SEQ ID NO: 456981 - RNA, 18 nt, Homo sapiens
cuccuaaauuuccagggg

SEQ ID NO: 456982 - RNA, 14 nt, Homo sapiens
cuccuaagcaaaag

SEQ ID NO: 456983 - RNA, 20 nt, Homo sapiens
cuccuagaagcccucugagc

SEQ ID NO: 456984 - RNA, 16 nt, Homo sapiens
cuccuagacugacccu

SEQ ID NO: 456985 - RNA, 15 nt, Homo sapiens
cuccuagcaagaccu

SEQ ID NO: 456986 - RNA, 14 nt, Homo sapiens
cuccuaucuguguu

SEQ ID NO: 456987 - RNA, 15 nt, Homo sapiens
cuccuccagcccacc

SEQ ID NO: 456988 - RNA, 18 nt, Homo sapiens
cuccuccagcccacccaa

SEQ ID NO: 456989 - RNA, 17 nt, Homo sapiens
cuccucccaacucuagc

SEQ ID NO: 456990 - RNA, 13 nt, Homo sapiens
cuccucucagcuu

SEQ ID NO: 456991 - RNA, 22 nt, Homo sapiens
cuccucucugcuggguuuccac

SEQ ID NO: 456992 - RNA, 17 nt, Homo sapiens
cuccucugaagcauuug

SEQ ID NO: 456993 - RNA, 18 nt, Homo sapiens
cuccucugcagugccuug

SEQ ID NO: 456994 - RNA, 11 nt, Homo sapiens
cuccucugucc

SEQ ID NO: 456995 - RNA, 20 nt, Homo sapiens
cuccugacaucaggugaucc

SEQ ID NO: 456996 - RNA, 20 nt, Homo sapiens
cuccugaccucaggugaucc

SEQ ID NO: 456997 - RNA, 13 nt, Homo sapiens
cuccugacuuuua

SEQ ID NO: 456998 - RNA, 19 nt, Homo sapiens
cuccugaguagcuggauua

SEQ ID NO: 456999 - RNA, 16 nt, Homo sapiens
cuccugauagucuuuc

SEQ ID NO: 457000 - RNA, 18 nt, Homo sapiens
gaacaccccgcucuggca

SEQ ID NO: 457001 - RNA, 14 nt, Homo sapiens
gaacacguggguau

SEQ ID NO: 457002 - RNA, 18 nt, Homo sapiens
gaacacucuacuacaugu

SEQ ID NO: 457003 - RNA, 23 nt, Homo sapiens
gaacacuguaggguaccuuccag

SEQ ID NO: 457004 - RNA, 11 nt, Homo sapiens
gaacagccaga

SEQ ID NO: 457005 - RNA, 17 nt, Homo sapiens
gaacagcgggagaccug

SEQ ID NO: 457006 - RNA, 20 nt, Homo sapiens
gaacagcuccuccucuugga

SEQ ID NO: 457007 - RNA, 20 nt, Homo sapiens
gaacagucacccuucugggc

SEQ ID NO: 457008 - RNA, 17 nt, Homo sapiens
gaacaguuuuggcauaa

SEQ ID NO: 457009 - RNA, 17 nt, Homo sapiens
gaacauaaaucaguuaa

SEQ ID NO: 457010 - RNA, 16 nt, Homo sapiens
gaacauagaacucugg

SEQ ID NO: 457011 - RNA, 15 nt, Homo sapiens
gaacaugagugcuga

SEQ ID NO: 457012 - RNA, 18 nt, Homo sapiens
gaacauucagauuuacca

SEQ ID NO: 457013 - RNA, 23 nt, Homo sapiens
gaacauuccuuagucucaagggc

SEQ ID NO: 457014 - RNA, 23 nt, Homo sapiens
gaacauuuggaaaccaugcacua

SEQ ID NO: 457015 - RNA, 19 nt, Homo sapiens
gaaccagcaagucccagac

SEQ ID NO: 457016 - RNA, 13 nt, Homo sapiens
gaaccauuacugu

SEQ ID NO: 457017 - RNA, 15 nt, Homo sapiens
gaacccagaaggcag

SEQ ID NO: 457018 - RNA, 16 nt, Homo sapiens
gaaccccccacucccu

SEQ ID NO: 457019 - RNA, 21 nt, Homo sapiens
gaacgagcacuggccagagag

SEQ ID NO: 457020 - RNA, 12 nt, Homo sapiens
gaacgcuuucau

SEQ ID NO: 457021 - RNA, 21 nt, Homo sapiens
gaacuaaguuuuguguguaua

SEQ ID NO: 457022 - RNA, 23 nt, Homo sapiens
gaacucaaaaggagaacugugcu

SEQ ID NO: 457023 - RNA, 11 nt, Homo sapiens
gaacuccacuc

SEQ ID NO: 457024 - RNA, 21 nt, Homo sapiens
gaacucuucaaucucuugcac

SEQ ID NO: 457025 - RNA, 18 nt, Homo sapiens
gaacugaaguuucacaug

SEQ ID NO: 457026 - RNA, 17 nt, Homo sapiens
gaacugccccaucuccu

SEQ ID NO: 457027 - RNA, 20 nt, Homo sapiens
gaacugccccaucuccuccc

SEQ ID NO: 457028 - RNA, 13 nt, Homo sapiens
gaacugggccuug

SEQ ID NO: 457029 - RNA, 16 nt, Homo sapiens
gaacuguucucaugga

SEQ ID NO: 457030 - RNA, 22 nt, Homo sapiens
gaacuuguuucucaccucccac

SEQ ID NO: 457031 - RNA, 16 nt, Homo sapiens
gaagaaaagcugccau

SEQ ID NO: 457032 - RNA, 20 nt, Homo sapiens
gaagaaaagcugccauuucc

SEQ ID NO: 457033 - RNA, 20 nt, Homo sapiens
gaagaaaauggaugacaaag

SEQ ID NO: 457034 - RNA, 21 nt, Homo sapiens
gaagaacagcuguuccugugu

SEQ ID NO: 457035 - RNA, 13 nt, Homo sapiens
gaagaacauagaa

SEQ ID NO: 457036 - RNA, 20 nt, Homo sapiens
gaagaauuggggauucucua

SEQ ID NO: 457037 - RNA, 22 nt, Homo sapiens
gaagacacguucuugccagcuu

SEQ ID NO: 457038 - RNA, 23 nt, Homo sapiens
gaagacacugucaaugagguuau

SEQ ID NO: 457039 - RNA, 15 nt, Homo sapiens
gaagacaucaagaua

SEQ ID NO: 457040 - RNA, 17 nt, Homo sapiens
gaagaccagcuuugcag

SEQ ID NO: 457041 - RNA, 22 nt, Homo sapiens
gaagaccagucacagccauuuc

SEQ ID NO: 457042 - RNA, 13 nt, Homo sapiens
gaagaccuggacc

SEQ ID NO: 457043 - RNA, 21 nt, Homo sapiens
gaagaccuucugaagaucuca

SEQ ID NO: 457044 - RNA, 12 nt, Homo sapiens
gaagacuggaag

SEQ ID NO: 457045 - RNA, 15 nt, Homo sapiens
gaagacuuuaucaug

SEQ ID NO: 457046 - RNA, 17 nt, Homo sapiens
gaagagaggaguucaau

SEQ ID NO: 457047 - RNA, 12 nt, Homo sapiens
gaagauguuugc

SEQ ID NO: 457048 - RNA, 17 nt, Homo sapiens
gaagauguuuugaaaug

SEQ ID NO: 457049 - RNA, 22 nt, Homo sapiens
gaagauuauuuacugacauaua

SEQ ID NO: 457050 - RNA, 23 nt, Homo sapiens
gaagcaaaucagaaacuugugaa

SEQ ID NO: 457051 - RNA, 22 nt, Homo sapiens
gaagcaucugucuugucauucc

SEQ ID NO: 457052 - RNA, 14 nt, Homo sapiens
gaagccccacuuga

SEQ ID NO: 457053 - RNA, 15 nt, Homo sapiens
gaccuaacauucgau

SEQ ID NO: 457054 - RNA, 20 nt, Homo sapiens
gaccuacuguucggacaaaa

SEQ ID NO: 457055 - RNA, 17 nt, Homo sapiens
gaccuaugagcacauag

SEQ ID NO: 457056 - RNA, 14 nt, Homo sapiens
gaccucaacaaaga

SEQ ID NO: 457057 - RNA, 22 nt, Homo sapiens
gaccucaggugauccacccacc

SEQ ID NO: 457058 - RNA, 24 nt, Homo sapiens
gaccucaugagugucaaacgugcc

SEQ ID NO: 457059 - RNA, 22 nt, Homo sapiens
gaccucccucccuccccagugu

SEQ ID NO: 457060 - RNA, 23 nt, Homo sapiens
gaccucucaacagaucugugggc

SEQ ID NO: 457061 - RNA, 16 nt, Homo sapiens
gaccucugggcuuuga

SEQ ID NO: 457062 - RNA, 13 nt, Homo sapiens
gaccugaacucug

SEQ ID NO: 457063 - RNA, 16 nt, Homo sapiens
gaccugccuccugccu

SEQ ID NO: 457064 - RNA, 12 nt, Homo sapiens
gaccugcuucua

SEQ ID NO: 457065 - RNA, 17 nt, Homo sapiens
gaccuguaaucauauaa

SEQ ID NO: 457066 - RNA, 17 nt, Homo sapiens
gaccuguccaggugagu

SEQ ID NO: 457067 - RNA, 21 nt, Homo sapiens
gaccuucucccucacuccugc

SEQ ID NO: 457068 - RNA, 22 nt, Homo sapiens
gaccuucugaacaugaguguca

SEQ ID NO: 457069 - RNA, 13 nt, Homo sapiens
gaccuugaacucc

SEQ ID NO: 457070 - RNA, 15 nt, Homo sapiens
gaccuuggcagccca

SEQ ID NO: 457071 - RNA, 19 nt, Homo sapiens
gaccuuuaagagaaaugag

SEQ ID NO: 457072 - RNA, 14 nt, Homo sapiens
gacgacaagugcug

SEQ ID NO: 457073 - RNA, 18 nt, Homo sapiens
gacgagcaugagcuggau

SEQ ID NO: 457074 - RNA, 23 nt, Homo sapiens
gacgaggcggagcgccaguggaa

SEQ ID NO: 457075 - RNA, 17 nt, Homo sapiens
gacgcaccuugcugcag

SEQ ID NO: 457076 - RNA, 23 nt, Homo sapiens
gacggacguugguucugcacuaa

SEQ ID NO: 457077 - RNA, 15 nt, Homo sapiens
gacgugugaggaugu

SEQ ID NO: 457078 - RNA, 16 nt, Homo sapiens
gacuaagaaucccuaa

SEQ ID NO: 457079 - RNA, 15 nt, Homo sapiens
gacuaaugcaugugg

SEQ ID NO: 457080 - RNA, 13 nt, Homo sapiens
gacuacuauacaa

SEQ ID NO: 457081 - RNA, 21 nt, Homo sapiens
gacuagagacgcaccuugcug

SEQ ID NO: 457082 - RNA, 19 nt, Homo sapiens
gacuagccugaaaauccaa

SEQ ID NO: 457083 - RNA, 18 nt, Homo sapiens
gacucaacgagagcacuu

SEQ ID NO: 457084 - RNA, 22 nt, Homo sapiens
gacucaauguggaaaaaauauu

SEQ ID NO: 457085 - RNA, 14 nt, Homo sapiens
gacucacauugccu

SEQ ID NO: 457086 - RNA, 17 nt, Homo sapiens
gacucagggccaugccu

SEQ ID NO: 457087 - RNA, 18 nt, Homo sapiens
gacuccaucucaaaaaau

SEQ ID NO: 457088 - RNA, 16 nt, Homo sapiens
gacucuguaaccaccu

SEQ ID NO: 457089 - RNA, 13 nt, Homo sapiens
gacucugucucag

SEQ ID NO: 457090 - RNA, 16 nt, Homo sapiens
gacucuguggggccac

SEQ ID NO: 457091 - RNA, 20 nt, Homo sapiens
gacugaagcgaacaucuuca

SEQ ID NO: 457092 - RNA, 20 nt, Homo sapiens
gacugaagugaacuaugaag

SEQ ID NO: 457093 - RNA, 16 nt, Homo sapiens
gacugagcagacuggu

SEQ ID NO: 457094 - RNA, 16 nt, Homo sapiens
gacugaguuaggagaa

SEQ ID NO: 457095 - RNA, 14 nt, Homo sapiens
gacugaugucaucu

SEQ ID NO: 457096 - RNA, 13 nt, Homo sapiens
gacugcagggaca

SEQ ID NO: 457097 - RNA, 14 nt, Homo sapiens
gacugcagggacac

SEQ ID NO: 457098 - RNA, 11 nt, Homo sapiens
gacugcugcuc

SEQ ID NO: 457099 - RNA, 19 nt, Homo sapiens
gacugcuucaucugcugua

SEQ ID NO: 457100 - RNA, 15 nt, Homo sapiens
gacuggaggugggca

SEQ ID NO: 457101 - RNA, 22 nt, Homo sapiens
gacuggccaagguuuggggaag

SEQ ID NO: 457102 - RNA, 13 nt, Homo sapiens
gacuggcugugag

SEQ ID NO: 457103 - RNA, 20 nt, Homo sapiens
gacugguauaccuauuucau

SEQ ID NO: 457104 - RNA, 21 nt, Homo sapiens
gacugguggaaggaaaacaaa

SEQ ID NO: 457105 - RNA, 21 nt, Homo sapiens
gacugguggccccugccuugg

SEQ ID NO: 457106 - RNA, 20 nt, Homo sapiens
gacuguaggcgccccugggg

SEQ ID NO: 457107 - RNA, 13 nt, Homo sapiens
gacuguccacuuc

SEQ ID NO: 457108 - RNA, 18 nt, Homo sapiens
gacuguccuacaauauca

SEQ ID NO: 457109 - RNA, 20 nt, Homo sapiens
gacugugaaaguaugugaua

SEQ ID NO: 457110 - RNA, 15 nt, Homo sapiens
gacugugacacagcu

SEQ ID NO: 457111 - RNA, 13 nt, Homo sapiens
gacugugaccacc

SEQ ID NO: 457112 - RNA, 19 nt, Homo sapiens
gacugugaggcggcagcug

SEQ ID NO: 457113 - RNA, 24 nt, Homo sapiens
gacuguggaacuauuuuaccuuaa

SEQ ID NO: 457114 - RNA, 22 nt, Homo sapiens
gacuguguuuuuccuaugcagu

SEQ ID NO: 457115 - RNA, 22 nt, Homo sapiens
gacuuaaaauauuccugcauuu

SEQ ID NO: 457116 - RNA, 20 nt, Homo sapiens
gaugacaggcgugcaccugg

SEQ ID NO: 457117 - RNA, 16 nt, Homo sapiens
gaugagaaacaacaga

SEQ ID NO: 457118 - RNA, 14 nt, Homo sapiens
gaugagaagccaaa

SEQ ID NO: 457119 - RNA, 21 nt, Homo sapiens
gaugagauuggcauggcuuua

SEQ ID NO: 457120 - RNA, 15 nt, Homo sapiens
gaugauauucucacc

SEQ ID NO: 457121 - RNA, 18 nt, Homo sapiens
gaugcacagaugccaugg

SEQ ID NO: 457122 - RNA, 16 nt, Homo sapiens
gaugcaucuaagcagg

SEQ ID NO: 457123 - RNA, 20 nt, Homo sapiens
gaugccagcagccucugucg

SEQ ID NO: 457124 - RNA, 19 nt, Homo sapiens
gaugccagcauauacugaa

SEQ ID NO: 457125 - RNA, 14 nt, Homo sapiens
gaugccucuucuac

SEQ ID NO: 457126 - RNA, 13 nt, Homo sapiens
gaugccugacaca

SEQ ID NO: 457127 - RNA, 14 nt, Homo sapiens
gaugcgucuaccca

SEQ ID NO: 457128 - RNA, 14 nt, Homo sapiens
gauggaacacacac

SEQ ID NO: 457129 - RNA, 21 nt, Homo sapiens
gauggaauaaagcccuugaac

SEQ ID NO: 457130 - RNA, 23 nt, Homo sapiens
gauggaauaaagcccuugaacca

SEQ ID NO: 457131 - RNA, 14 nt, Homo sapiens
gauggacucugaaa

SEQ ID NO: 457132 - RNA, 18 nt, Homo sapiens
gauggagccagcucugca

SEQ ID NO: 457133 - RNA, 18 nt, Homo sapiens
gauggaggggcugacuca

SEQ ID NO: 457134 - RNA, 15 nt, Homo sapiens
gauggauaagcuugu

SEQ ID NO: 457135 - RNA, 22 nt, Homo sapiens
gauggccacugugaauaacugu

SEQ ID NO: 457136 - RNA, 21 nt, Homo sapiens
gauggccauguauuaccugaa

SEQ ID NO: 457137 - RNA, 18 nt, Homo sapiens
gauggccgggcugcugcu

SEQ ID NO: 457138 - RNA, 18 nt, Homo sapiens
gauggcuggaacacugua

SEQ ID NO: 457139 - RNA, 14 nt, Homo sapiens
gaugggagugggca

SEQ ID NO: 457140 - RNA, 14 nt, Homo sapiens
gauguaaccaagcu

SEQ ID NO: 457141 - RNA, 15 nt, Homo sapiens
gauguauuaugcaaa

SEQ ID NO: 457142 - RNA, 20 nt, Homo sapiens
gauguccagaagaauauuca

SEQ ID NO: 457143 - RNA, 14 nt, Homo sapiens
gaugucuaagacag

SEQ ID NO: 457144 - RNA, 19 nt, Homo sapiens
gaugucuucguacaguucu

SEQ ID NO: 457145 - RNA, 22 nt, Homo sapiens
gaugugaaauuaaauucuuauu

SEQ ID NO: 457146 - RNA, 16 nt, Homo sapiens
gaugugaucacugaga

SEQ ID NO: 457147 - RNA, 16 nt, Homo sapiens
gaugugcaaguguaug

SEQ ID NO: 457148 - RNA, 17 nt, Homo sapiens
gaugugcagauaucaca

SEQ ID NO: 457149 - RNA, 23 nt, Homo sapiens
gaugugcauuucaccugugacaa

SEQ ID NO: 457150 - RNA, 15 nt, Homo sapiens
gauguguaaauggag

SEQ ID NO: 457151 - RNA, 15 nt, Homo sapiens
gaugugucuuaccag

SEQ ID NO: 457152 - RNA, 17 nt, Homo sapiens
gauguucuggaccuccc

SEQ ID NO: 457153 - RNA, 20 nt, Homo sapiens
gauguuguuccuggcuagau

SEQ ID NO: 457154 - RNA, 19 nt, Homo sapiens
gauguuucuggaauugaua

SEQ ID NO: 457155 - RNA, 20 nt, Homo sapiens
gauguuugaggcuuucagaa

SEQ ID NO: 457156 - RNA, 17 nt, Homo sapiens
gauguuuuacuuuucac

SEQ ID NO: 457157 - RNA, 17 nt, Homo sapiens
gauuaaaaucacucuca

SEQ ID NO: 457158 - RNA, 20 nt, Homo sapiens
gauuaaauuuaauauacugc

SEQ ID NO: 457159 - RNA, 23 nt, Homo sapiens
gauuaaccucugcacuacugaca

SEQ ID NO: 457160 - RNA, 17 nt, Homo sapiens
gauuaagauuuuacaaa

SEQ ID NO: 457161 - RNA, 11 nt, Homo sapiens
gauuacaggug

SEQ ID NO: 457162 - RNA, 20 nt, Homo sapiens
gauuacaggugcgcacuacc

SEQ ID NO: 457163 - RNA, 12 nt, Homo sapiens
gauuacauguua

SEQ ID NO: 457164 - RNA, 18 nt, Homo sapiens
gauuauccuguuacugaa

SEQ ID NO: 457165 - RNA, 20 nt, Homo sapiens
gauuaugaagugacucucac

SEQ ID NO: 457166 - RNA, 22 nt, Homo sapiens
gauuaugaagugacucucacaa

SEQ ID NO: 457167 - RNA, 16 nt, Homo sapiens
gauucaaaugcaugau

SEQ ID NO: 457168 - RNA, 16 nt, Homo sapiens
gauucaacacauauuu

SEQ ID NO: 457169 - RNA, 17 nt, Homo sapiens
gauucagaauguguuau

SEQ ID NO: 457170 - RNA, 23 nt, Homo sapiens
gauucagcauuauuccuccagga

SEQ ID NO: 457171 - RNA, 21 nt, Homo sapiens
gauucagccaaaugcagggag

SEQ ID NO: 457172 - RNA, 14 nt, Homo sapiens
gauucauaaugacu

SEQ ID NO: 457173 - RNA, 18 nt, Homo sapiens
gauucaucaucccuuaau

SEQ ID NO: 457174 - RNA, 19 nt, Homo sapiens
gauuccaggcgaugugcaa

SEQ ID NO: 457175 - RNA, 23 nt, Homo sapiens
gauuccccuggaccacaccuccg

SEQ ID NO: 457176 - RNA, 16 nt, Homo sapiens
gauuccucuugccucu

SEQ ID NO: 457177 - RNA, 18 nt, Homo sapiens
gauucuaaaggggacaga

SEQ ID NO: 457178 - RNA, 22 nt, Homo sapiens
gauucuacucuugucauuuuua

SEQ ID NO: 457179 - RNA, 16 nt, Homo sapiens
gauucuagcacaucau

SEQ ID NO: 457180 - RNA, 15 nt, Homo sapiens
gauucuaugucucau

SEQ ID NO: 457181 - RNA, 17 nt, Homo sapiens
gauucucuccugauuau

SEQ ID NO: 457182 - RNA, 22 nt, Homo sapiens
gauucuguuuucugguguuaua

SEQ ID NO: 457183 - RNA, 18 nt, Homo sapiens
gauucuuuccauuaugau

SEQ ID NO: 457184 - RNA, 15 nt, Homo sapiens
gauugaacacaggca

SEQ ID NO: 457185 - RNA, 22 nt, Homo sapiens
gauugaaccacuaaaauguuag

SEQ ID NO: 457186 - RNA, 23 nt, Homo sapiens
gauugaagcuaaaauaaaccaga

SEQ ID NO: 457187 - RNA, 15 nt, Homo sapiens
gauugccauuucuuc

SEQ ID NO: 457188 - RNA, 23 nt, Homo sapiens
gauugcccauccaucugcuuaca

SEQ ID NO: 457189 - RNA, 12 nt, Homo sapiens
gauugcugccau

SEQ ID NO: 457190 - RNA, 20 nt, Homo sapiens
gauuggauuauucauuuaaa

SEQ ID NO: 457191 - RNA, 17 nt, Homo sapiens
gauugggucguggugga

SEQ ID NO: 457192 - RNA, 22 nt, Homo sapiens
gauugguaccagagccuaugga

SEQ ID NO: 457193 - RNA, 23 nt, Homo sapiens
gauuguaaauaaaggaugauggc

SEQ ID NO: 457194 - RNA, 17 nt, Homo sapiens
gcaagugucugugugca

SEQ ID NO: 457195 - RNA, 19 nt, Homo sapiens
gcaagugucugugugcaag

SEQ ID NO: 457196 - RNA, 15 nt, Homo sapiens
gcaaguuaaagaaaa

SEQ ID NO: 457197 - RNA, 19 nt, Homo sapiens
gcaauaaaugucccaaaua

SEQ ID NO: 457198 - RNA, 15 nt, Homo sapiens
gcaauaguguguucu

SEQ ID NO: 457199 - RNA, 21 nt, Homo sapiens
gcaauauaucugaagagcuau

SEQ ID NO: 457200 - RNA, 17 nt, Homo sapiens
gcaauccugcaagaaca

SEQ ID NO: 457201 - RNA, 22 nt, Homo sapiens
gcaaucugggugguaacugcca

SEQ ID NO: 457202 - RNA, 17 nt, Homo sapiens
gcaaucuucuacuuuaa

SEQ ID NO: 457203 - RNA, 14 nt, Homo sapiens
gcaaucuuugccuu

SEQ ID NO: 457204 - RNA, 15 nt, Homo sapiens
gcaaugacugugagc

SEQ ID NO: 457205 - RNA, 13 nt, Homo sapiens
gcaaugcacugaa

SEQ ID NO: 457206 - RNA, 17 nt, Homo sapiens
gcaauggugaacuguca

SEQ ID NO: 457207 - RNA, 11 nt, Homo sapiens
gcaauguggaa

SEQ ID NO: 457208 - RNA, 14 nt, Homo sapiens
gcaauuaacucugg

SEQ ID NO: 457209 - RNA, 22 nt, Homo sapiens
gcaauucuucuucucaagcacu

SEQ ID NO: 457210 - RNA, 19 nt, Homo sapiens
gcaauugggauggcgcuag

SEQ ID NO: 457211 - RNA, 18 nt, Homo sapiens
gcaauuuccggccaacag

SEQ ID NO: 457212 - RNA, 17 nt, Homo sapiens
gcaauuuuguguaaauu

SEQ ID NO: 457213 - RNA, 19 nt, Homo sapiens
gcacaagaccccugcuccu

SEQ ID NO: 457214 - RNA, 16 nt, Homo sapiens
gcacaaggacauuugg

SEQ ID NO: 457215 - RNA, 22 nt, Homo sapiens
gcacaauauuccuaugcugcaa

SEQ ID NO: 457216 - RNA, 22 nt, Homo sapiens
gcacaauuuuaauucaaaagau

SEQ ID NO: 457217 - RNA, 17 nt, Homo sapiens
gcacacacacaaacaca

SEQ ID NO: 457218 - RNA, 18 nt, Homo sapiens
gcacacagcugcagagac

SEQ ID NO: 457219 - RNA, 12 nt, Homo sapiens
gcacacauaaca

SEQ ID NO: 457220 - RNA, 19 nt, Homo sapiens
gcacacggagacgugauga

SEQ ID NO: 457221 - RNA, 13 nt, Homo sapiens
gcacacugccagu

SEQ ID NO: 457222 - RNA, 18 nt, Homo sapiens
gcacagaaagggcagcuu

SEQ ID NO: 457223 - RNA, 20 nt, Homo sapiens
gcacagaacaagccacagga

SEQ ID NO: 457224 - RNA, 18 nt, Homo sapiens
gcacagagagggggccac

SEQ ID NO: 457225 - RNA, 20 nt, Homo sapiens
gcacagagucgaugcucaau

SEQ ID NO: 457226 - RNA, 13 nt, Homo sapiens
gcacagauggauu

SEQ ID NO: 457227 - RNA, 15 nt, Homo sapiens
gcacagauuaaacuu

SEQ ID NO: 457228 - RNA, 17 nt, Homo sapiens
gcacagcuaacauggaa

SEQ ID NO: 457229 - RNA, 18 nt, Homo sapiens
gcacaggccacuugcuca

SEQ ID NO: 457230 - RNA, 14 nt, Homo sapiens
gcacaggggcccau

SEQ ID NO: 457231 - RNA, 19 nt, Homo sapiens
gcacaggggcccauggacu

SEQ ID NO: 457232 - RNA, 19 nt, Homo sapiens
gcacaguguaauccagggg

SEQ ID NO: 457233 - RNA, 14 nt, Homo sapiens
gcacaucauuggaa

SEQ ID NO: 457234 - RNA, 23 nt, Homo sapiens
gcacaugccgcgggcggccaggc

SEQ ID NO: 457235 - RNA, 22 nt, Homo sapiens
gcacaugugguuuuuugguguu

SEQ ID NO: 457236 - RNA, 22 nt, Homo sapiens
gcacauugaaagagaaccaguu

SEQ ID NO: 457237 - RNA, 21 nt, Homo sapiens
gcacauuuccccagaccugag

SEQ ID NO: 457238 - RNA, 18 nt, Homo sapiens
gcacauuuccucucuauc

SEQ ID NO: 457239 - RNA, 14 nt, Homo sapiens
gcaccacccuaguc

SEQ ID NO: 457240 - RNA, 20 nt, Homo sapiens
gcaccacugcacuccagccu

SEQ ID NO: 457241 - RNA, 16 nt, Homo sapiens
gcaccaucuggaagga

SEQ ID NO: 457242 - RNA, 12 nt, Homo sapiens
gcaccauugcac

SEQ ID NO: 457243 - RNA, 19 nt, Homo sapiens
gcaccauugcacuccagcu

SEQ ID NO: 457244 - RNA, 16 nt, Homo sapiens
gcaccccccauugggg

SEQ ID NO: 457245 - RNA, 22 nt, Homo sapiens
gcacccucugcuaugucuguga

SEQ ID NO: 457246 - RNA, 12 nt, Homo sapiens
gcacccuggauu

SEQ ID NO: 457247 - RNA, 23 nt, Homo sapiens
gcacccuggggccuggaccugcc

SEQ ID NO: 457248 - RNA, 19 nt, Homo sapiens
gcaccgagagagauggaau

SEQ ID NO: 457249 - RNA, 22 nt, Homo sapiens
gcaccgagagagauggaauaaa

SEQ ID NO: 457250 - RNA, 24 nt, Homo sapiens
gcaccuacuuuauguauggagcuc

SEQ ID NO: 457251 - RNA, 17 nt, Homo sapiens
gcaccucuugugcugag

SEQ ID NO: 457252 - RNA, 14 nt, Homo sapiens
gcaccugggugcuc

SEQ ID NO: 457253 - RNA, 15 nt, Homo sapiens
gcaccuuuugcacau

SEQ ID NO: 457254 - RNA, 23 nt, Homo sapiens
gcacguaguagggucaggccacg

SEQ ID NO: 457255 - RNA, 22 nt, Homo sapiens
gcacguggccucuugagcagug

SEQ ID NO: 457256 - RNA, 22 nt, Homo sapiens
gcacuaaaagugaugugauuua

SEQ ID NO: 457257 - RNA, 18 nt, Homo sapiens
gcacuccagggcaucaca

SEQ ID NO: 457258 - RNA, 13 nt, Homo sapiens
gcacuccaugagu

SEQ ID NO: 457259 - RNA, 22 nt, Homo sapiens
gcacuccucucgcauggugugg

SEQ ID NO: 457260 - RNA, 22 nt, Homo sapiens
gcacugaaggcuuucagggccu

SEQ ID NO: 457261 - RNA, 15 nt, Homo sapiens
gcacugacugggcau

SEQ ID NO: 457262 - RNA, 18 nt, Homo sapiens
gcacugaugggcacugga

SEQ ID NO: 457263 - RNA, 22 nt, Homo sapiens
gcacugcgccaccugcuucaca

SEQ ID NO: 457264 - RNA, 17 nt, Homo sapiens
gcacuguauccaaguua

SEQ ID NO: 457265 - RNA, 16 nt, Homo sapiens
gcacuguuucuucuca

SEQ ID NO: 457266 - RNA, 11 nt, Homo sapiens
gcacuucauau

SEQ ID NO: 457267 - RNA, 19 nt, Homo sapiens
gcacuucguggaugaccuc

SEQ ID NO: 457268 - RNA, 20 nt, Homo sapiens
gcacuugcacgcccaugugu

SEQ ID NO: 457269 - RNA, 15 nt, Homo sapiens
gcacuuuaacugacu

SEQ ID NO: 457270 - RNA, 19 nt, Homo sapiens
gcacuuuagaucacuugag

SEQ ID NO: 457271 - RNA, 20 nt, Homo sapiens
gcacuuuauaaacacuguau

SEQ ID NO: 457272 - RNA, 21 nt, Homo sapiens
gcacuuucccuagaaagccau

SEQ ID NO: 457273 - RNA, 14 nt, Homo sapiens
gcacuuuguuucau

SEQ ID NO: 457274 - RNA, 20 nt, Homo sapiens
gcagaaacacaaccacucac

SEQ ID NO: 457275 - RNA, 21 nt, Homo sapiens
gcaggcuauuuguucagagag

SEQ ID NO: 457276 - RNA, 16 nt, Homo sapiens
gcaggcugcagucccu

SEQ ID NO: 457277 - RNA, 23 nt, Homo sapiens
gcaggcuggcagcucuccaguca

SEQ ID NO: 457278 - RNA, 16 nt, Homo sapiens
gcagggcagccgucac

SEQ ID NO: 457279 - RNA, 22 nt, Homo sapiens
gcagggccaagugcccaugagc

SEQ ID NO: 457280 - RNA, 23 nt, Homo sapiens
gcagggcuggcaggaugccgugg

SEQ ID NO: 457281 - RNA, 13 nt, Homo sapiens
gcagggcugugau

SEQ ID NO: 457282 - RNA, 18 nt, Homo sapiens
gcagggguagaagcaaag

SEQ ID NO: 457283 - RNA, 22 nt, Homo sapiens
gcaggugaccuucugggaaaug

SEQ ID NO: 457284 - RNA, 12 nt, Homo sapiens
gcaggugccuug

SEQ ID NO: 457285 - RNA, 12 nt, Homo sapiens
gcaggugcugcc

SEQ ID NO: 457286 - RNA, 19 nt, Homo sapiens
gcagguguugggaccugcu

SEQ ID NO: 457287 - RNA, 15 nt, Homo sapiens
gcagguugaucagug

SEQ ID NO: 457288 - RNA, 17 nt, Homo sapiens
gcaguacuuuaccuccu

SEQ ID NO: 457289 - RNA, 13 nt, Homo sapiens
gcaguagugucac

SEQ ID NO: 457290 - RNA, 16 nt, Homo sapiens
gcaguaucacaggcca

SEQ ID NO: 457291 - RNA, 19 nt, Homo sapiens
gcagucacacugcugggaa

SEQ ID NO: 457292 - RNA, 19 nt, Homo sapiens
gcagucccaguauucucag

SEQ ID NO: 457293 - RNA, 14 nt, Homo sapiens
gcagucuuugcuca

SEQ ID NO: 457294 - RNA, 21 nt, Homo sapiens
gcagugagcugauaucaugcc

SEQ ID NO: 457295 - RNA, 15 nt, Homo sapiens
gcaguggagccugaa

SEQ ID NO: 457296 - RNA, 20 nt, Homo sapiens
gcaguggccaggcagggagu

SEQ ID NO: 457297 - RNA, 22 nt, Homo sapiens
gcaguguaacccaagcauuugu

SEQ ID NO: 457298 - RNA, 12 nt, Homo sapiens
gcaguguggaaa

SEQ ID NO: 457299 - RNA, 17 nt, Homo sapiens
gcaguguuuucaccuca

SEQ ID NO: 457300 - RNA, 16 nt, Homo sapiens
gcaguuaauucuugcc

SEQ ID NO: 457301 - RNA, 17 nt, Homo sapiens
gcaguuauuagaacuua

SEQ ID NO: 457302 - RNA, 23 nt, Homo sapiens
gcaguucagcuccuuccaccaca

SEQ ID NO: 457303 - RNA, 20 nt, Homo sapiens
gcaguucuggaauggaaggg

SEQ ID NO: 457304 - RNA, 14 nt, Homo sapiens
gcaguuggacucuc

SEQ ID NO: 457305 - RNA, 20 nt, Homo sapiens
gcauaaaagacaagcacuuu

SEQ ID NO: 457306 - RNA, 22 nt, Homo sapiens
gcauaaaagacaagcacuuugg

SEQ ID NO: 457307 - RNA, 21 nt, Homo sapiens
gcauaaguuucugggaccuca

SEQ ID NO: 457308 - RNA, 18 nt, Homo sapiens
gcauaauaagcuaaagag

SEQ ID NO: 457309 - RNA, 19 nt, Homo sapiens
gcauacaguuugcacuuau

SEQ ID NO: 457310 - RNA, 21 nt, Homo sapiens
gcauacucuaugugauuuauu

SEQ ID NO: 457311 - RNA, 20 nt, Homo sapiens
gcauaggcugacuuuugcag

SEQ ID NO: 457312 - RNA, 21 nt, Homo sapiens
gcauauguuguugcuuguaua

SEQ ID NO: 457313 - RNA, 21 nt, Homo sapiens
gcaucacuggggaggacguga

SEQ ID NO: 457314 - RNA, 12 nt, Homo sapiens
gcaucagcuuuc

SEQ ID NO: 457315 - RNA, 13 nt, Homo sapiens
gcaucagcuuucc

SEQ ID NO: 457316 - RNA, 14 nt, Homo sapiens
gcauccaacugaga

SEQ ID NO: 457317 - RNA, 12 nt, Homo sapiens
gcauccacagga

SEQ ID NO: 457318 - RNA, 22 nt, Homo sapiens
gcauccacuucacaguucugaa

SEQ ID NO: 457319 - RNA, 17 nt, Homo sapiens
gcauccauguaaucuau

SEQ ID NO: 457320 - RNA, 18 nt, Homo sapiens
gcaucuacuacucugucu

SEQ ID NO: 457321 - RNA, 17 nt, Homo sapiens
gcaucucagccuccuga

SEQ ID NO: 457322 - RNA, 19 nt, Homo sapiens
gcaucuccccucagauucc

SEQ ID NO: 457323 - RNA, 13 nt, Homo sapiens
gcaucuccugugc

SEQ ID NO: 457324 - RNA, 12 nt, Homo sapiens
gcaucugacaca

SEQ ID NO: 457325 - RNA, 14 nt, Homo sapiens
gcaucugcucugag

SEQ ID NO: 457326 - RNA, 17 nt, Homo sapiens
gcaucugcucugagacg

SEQ ID NO: 457327 - RNA, 18 nt, Homo sapiens
gcaucugucccacuggga

SEQ ID NO: 457328 - RNA, 22 nt, Homo sapiens
gcaucuuccccaacgaaaagca

SEQ ID NO: 457329 - RNA, 17 nt, Homo sapiens
gcaugaaaccacuggaa

SEQ ID NO: 457330 - RNA, 14 nt, Homo sapiens
gcaugaagcacauu

SEQ ID NO: 457331 - RNA, 13 nt, Homo sapiens
gcaugacacucua

SEQ ID NO: 457332 - RNA, 15 nt, Homo sapiens
gcaugacagcuguuc

SEQ ID NO: 457333 - RNA, 14 nt, Homo sapiens
gcaugaccugauca

SEQ ID NO: 457334 - RNA, 15 nt, Homo sapiens
gcaugauaagagcau

SEQ ID NO: 457335 - RNA, 18 nt, Homo sapiens
gcaugauugugaccucca

SEQ ID NO: 457336 - RNA, 17 nt, Homo sapiens
gcaugcagugcccucac

SEQ ID NO: 457337 - RNA, 19 nt, Homo sapiens
gcaugcucaguuggugcug

SEQ ID NO: 457338 - RNA, 22 nt, Homo sapiens
gcaugcuggcucccagggccau

SEQ ID NO: 457339 - RNA, 14 nt, Homo sapiens
gcauggaguguuug

SEQ ID NO: 457340 - RNA, 14 nt, Homo sapiens
gcauggggugggcc

SEQ ID NO: 457341 - RNA, 15 nt, Homo sapiens
gcaugucucugcuuc

SEQ ID NO: 457342 - RNA, 14 nt, Homo sapiens
gcaugugcauauag

SEQ ID NO: 457343 - RNA, 13 nt, Homo sapiens
gcauguguguuca

SEQ ID NO: 457344 - RNA, 21 nt, Homo sapiens
gcauuaaaaaaaaaaucaaug

SEQ ID NO: 457345 - RNA, 15 nt, Homo sapiens
gcauuaacuuuugua

SEQ ID NO: 457346 - RNA, 16 nt, Homo sapiens
gcauuagcacuaccau

SEQ ID NO: 457347 - RNA, 23 nt, Homo sapiens
gcauucaaggaugcacagcucaa

SEQ ID NO: 457348 - RNA, 19 nt, Homo sapiens
gcauucacaaggugacugg

SEQ ID NO: 457349 - RNA, 20 nt, Homo sapiens
gcauucugggguggggcuug

SEQ ID NO: 457350 - RNA, 20 nt, Homo sapiens
gcauucuguacuaauacagc

SEQ ID NO: 457351 - RNA, 18 nt, Homo sapiens
gcauuggguagcuauacu

SEQ ID NO: 457352 - RNA, 20 nt, Homo sapiens
gcauuggguagcuauacuca

SEQ ID NO: 457353 - RNA, 22 nt, Homo sapiens
gcauugucccugugccuaacac

SEQ ID NO: 457354 - RNA, 21 nt, Homo sapiens
gcauuguugagguggucugaa

SEQ ID NO: 457355 - RNA, 15 nt, Homo sapiens
gcauuguugaugcuc

SEQ ID NO: 457356 - RNA, 20 nt, Homo sapiens
gcauuugcugaauaacaaca

SEQ ID NO: 457357 - RNA, 19 nt, Homo sapiens
gcauuuucacauuuugccu

SEQ ID NO: 457358 - RNA, 16 nt, Homo sapiens
gcauuuuuagcuccuu

SEQ ID NO: 457359 - RNA, 18 nt, Homo sapiens
gcauuuuucuacugcucu

SEQ ID NO: 457360 - RNA, 16 nt, Homo sapiens
gcccugccaugcucuc

SEQ ID NO: 457361 - RNA, 16 nt, Homo sapiens
gcccugccguugggga

SEQ ID NO: 457362 - RNA, 21 nt, Homo sapiens
gcccugcgaccacagcaggga

SEQ ID NO: 457363 - RNA, 14 nt, Homo sapiens
gcccuggauccauc

SEQ ID NO: 457364 - RNA, 22 nt, Homo sapiens
gcccuggcuaauuccccuucca

SEQ ID NO: 457365 - RNA, 14 nt, Homo sapiens
gcccuuaaggacaa

SEQ ID NO: 457366 - RNA, 16 nt, Homo sapiens
gcccuuaaggacaaaa

SEQ ID NO: 457367 - RNA, 18 nt, Homo sapiens
gcccuuaaggacaaaaau

SEQ ID NO: 457368 - RNA, 18 nt, Homo sapiens
gcccuuccucuccacugc

SEQ ID NO: 457369 - RNA, 15 nt, Homo sapiens
gcccuuccugaagaa

SEQ ID NO: 457370 - RNA, 20 nt, Homo sapiens
gccgaaaaggauaugcagua

SEQ ID NO: 457371 - RNA, 22 nt, Homo sapiens
gccgaaccccccacucccugcc

SEQ ID NO: 457372 - RNA, 19 nt, Homo sapiens
gccgacugccugugaagug

SEQ ID NO: 457373 - RNA, 17 nt, Homo sapiens
gccgcaugucugcaugg

SEQ ID NO: 457374 - RNA, 23 nt, Homo sapiens
gccgcugugcuguugucugccgu

SEQ ID NO: 457375 - RNA, 17 nt, Homo sapiens
gccggaggcugcaguga

SEQ ID NO: 457376 - RNA, 13 nt, Homo sapiens
gccgggcgcagug

SEQ ID NO: 457377 - RNA, 15 nt, Homo sapiens
gccggucccccaugc

SEQ ID NO: 457378 - RNA, 23 nt, Homo sapiens
gccggucccccaugccaccaccc

SEQ ID NO: 457379 - RNA, 15 nt, Homo sapiens
gccgucacgcuuuca

SEQ ID NO: 457380 - RNA, 12 nt, Homo sapiens
gccguggcugcg

SEQ ID NO: 457381 - RNA, 22 nt, Homo sapiens
gccguuagggaaauccaacucc

SEQ ID NO: 457382 - RNA, 22 nt, Homo sapiens
gccuaaauaaaaaguauacuuu

SEQ ID NO: 457383 - RNA, 16 nt, Homo sapiens
gccuaccucagccucc

SEQ ID NO: 457384 - RNA, 21 nt, Homo sapiens
gccuaggaguugaguacagug

SEQ ID NO: 457385 - RNA, 16 nt, Homo sapiens
gccuaggggucaggga

SEQ ID NO: 457386 - RNA, 15 nt, Homo sapiens
gccuagucagccaca

SEQ ID NO: 457387 - RNA, 19 nt, Homo sapiens
gccucaagaugaaggcaaa

SEQ ID NO: 457388 - RNA, 13 nt, Homo sapiens
gccucaagccauc

SEQ ID NO: 457389 - RNA, 13 nt, Homo sapiens
gccucacaucucc

SEQ ID NO: 457390 - RNA, 18 nt, Homo sapiens
gccucagccauucacugc

SEQ ID NO: 457391 - RNA, 15 nt, Homo sapiens
gccucagcccagguc

SEQ ID NO: 457392 - RNA, 17 nt, Homo sapiens
gccucagugaaggacua

SEQ ID NO: 457393 - RNA, 18 nt, Homo sapiens
gccucauccuccacugaa

SEQ ID NO: 457394 - RNA, 11 nt, Homo sapiens
gccucaucucu

SEQ ID NO: 457395 - RNA, 22 nt, Homo sapiens
gccucaucuuucccaaaaccca

SEQ ID NO: 457396 - RNA, 16 nt, Homo sapiens
gccucauucacugucc

SEQ ID NO: 457397 - RNA, 11 nt, Homo sapiens
gccucauucua

SEQ ID NO: 457398 - RNA, 18 nt, Homo sapiens
gccucauucuagcaccuu

SEQ ID NO: 457399 - RNA, 16 nt, Homo sapiens
gccuccaagcuccauc

SEQ ID NO: 457400 - RNA, 17 nt, Homo sapiens
guaauauuacuuuaaca

SEQ ID NO: 457401 - RNA, 18 nt, Homo sapiens
guaaucccaacacuuugg

SEQ ID NO: 457402 - RNA, 20 nt, Homo sapiens
guaaucccagcuacuuggga

SEQ ID NO: 457403 - RNA, 17 nt, Homo sapiens
guaaugcuuguacaguu

SEQ ID NO: 457404 - RNA, 19 nt, Homo sapiens
guaauguauucuaucucuc

SEQ ID NO: 457405 - RNA, 22 nt, Homo sapiens
guaauuuuguaucuugaugucu

SEQ ID NO: 457406 - RNA, 17 nt, Homo sapiens
guacaagcugauguuuu

SEQ ID NO: 457407 - RNA, 11 nt, Homo sapiens
guacaauaaua

SEQ ID NO: 457408 - RNA, 22 nt, Homo sapiens
guacacagugagaguacucacu

SEQ ID NO: 457409 - RNA, 18 nt, Homo sapiens
guacagagaaauucugug

SEQ ID NO: 457410 - RNA, 19 nt, Homo sapiens
guacagcagggucuugcug

SEQ ID NO: 457411 - RNA, 15 nt, Homo sapiens
guacauaguggucau

SEQ ID NO: 457412 - RNA, 21 nt, Homo sapiens
guacauauggaaauccuguua

SEQ ID NO: 457413 - RNA, 23 nt, Homo sapiens
guacaucgaggcucuugcucaag

SEQ ID NO: 457414 - RNA, 13 nt, Homo sapiens
gucauugaugaac

SEQ ID NO: 457415 - RNA, 23 nt, Homo sapiens
gucauuggccacugucuccacuc

SEQ ID NO: 457416 - RNA, 21 nt, Homo sapiens
guccaagucuucucaagaucc

SEQ ID NO: 457417 - RNA, 22 nt, Homo sapiens
guccacccucauguuucuguag

SEQ ID NO: 457418 - RNA, 15 nt, Homo sapiens
guccacugcuccauu

SEQ ID NO: 457419 - RNA, 18 nt, Homo sapiens
guccagaagaauauucag

SEQ ID NO: 457420 - RNA, 17 nt, Homo sapiens
guccagauauuucacau

SEQ ID NO: 457421 - RNA, 14 nt, Homo sapiens
guccagcacuggaa

SEQ ID NO: 457422 - RNA, 15 nt, Homo sapiens
guccagcucguucuc

SEQ ID NO: 457423 - RNA, 12 nt, Homo sapiens
guccaggccagg

SEQ ID NO: 457424 - RNA, 17 nt, Homo sapiens
guccagggcuagugacu

SEQ ID NO: 457425 - RNA, 17 nt, Homo sapiens
guccaggucucacugcu

SEQ ID NO: 457426 - RNA, 12 nt, Homo sapiens
guccagugcaac

SEQ ID NO: 457427 - RNA, 22 nt, Homo sapiens
guccaucuccagacucuaccac

SEQ ID NO: 457428 - RNA, 11 nt, Homo sapiens
guccaugccua

SEQ ID NO: 457429 - RNA, 15 nt, Homo sapiens
guccaugccuuccau

SEQ ID NO: 457430 - RNA, 17 nt, Homo sapiens
guccaugugugugcaag

SEQ ID NO: 457431 - RNA, 16 nt, Homo sapiens
gucccaggagcaggac

SEQ ID NO: 457432 - RNA, 18 nt, Homo sapiens
guuccagagggaagggaa

SEQ ID NO: 457433 - RNA, 13 nt, Homo sapiens
guucccaugagau

SEQ ID NO: 457434 - RNA, 14 nt, Homo sapiens
guuccccacugaca

SEQ ID NO: 457435 - RNA, 20 nt, Homo sapiens
guuccccacugacagccucc

SEQ ID NO: 457436 - RNA, 14 nt, Homo sapiens
guucccccaaccuc

SEQ ID NO: 457437 - RNA, 16 nt, Homo sapiens
guucccccaguaccuc

SEQ ID NO: 457438 - RNA, 19 nt, Homo sapiens
guucccuugcagggguccc

SEQ ID NO: 457439 - RNA, 18 nt, Homo sapiens
guuccucauggcuguuau

SEQ ID NO: 457440 - RNA, 22 nt, Homo sapiens
guuccucuagguaaacuagcaa

SEQ ID NO: 457441 - RNA, 13 nt, Homo sapiens
guuccucuuugca

SEQ ID NO: 457442 - RNA, 19 nt, Homo sapiens
guuccugauagcuacccac

SEQ ID NO: 457443 - RNA, 21 nt, Homo sapiens
guuccugcagcagagccugga

SEQ ID NO: 457444 - RNA, 17 nt, Homo sapiens
guuccugcuccaugacu

SEQ ID NO: 457445 - RNA, 18 nt, Homo sapiens
guuccuucgaggguucca

SEQ ID NO: 457446 - RNA, 15 nt, Homo sapiens
guucuaaguucaugu

SEQ ID NO: 457447 - RNA, 14 nt, Homo sapiens
guucuacaguuaau

SEQ ID NO: 457448 - RNA, 18 nt, Homo sapiens
guucuacauaaguaauuc

SEQ ID NO: 457449 - RNA, 16 nt, Homo sapiens
guucuauagcagucau

SEQ ID NO: 457450 - RNA, 16 nt, Homo sapiens
guucuauccccaagcu

SEQ ID NO: 457451 - RNA, 15 nt, Homo sapiens
guucucacauaacag

SEQ ID NO: 457452 - RNA, 21 nt, Homo sapiens
guucucagagcuccacagaag

SEQ ID NO: 457453 - RNA, 20 nt, Homo sapiens
guucucagguguugccaaau

SEQ ID NO: 457454 - RNA, 22 nt, Homo sapiens
guucucauuuuuaucccauuga

SEQ ID NO: 457455 - RNA, 17 nt, Homo sapiens
guucucuccccuugcac

SEQ ID NO: 457456 - RNA, 16 nt, Homo sapiens
guucugggugcagcug

SEQ ID NO: 457457 - RNA, 18 nt, Homo sapiens
guucuuaggaacagacuc

SEQ ID NO: 457458 - RNA, 13 nt, Homo sapiens
guucuuaguguca

SEQ ID NO: 457459 - RNA, 16 nt, Homo sapiens
guucuuagugucacuu

SEQ ID NO: 457460 - RNA, 23 nt, Homo sapiens
guucuucaggagaugaugugaug

SEQ ID NO: 457461 - RNA, 17 nt, Homo sapiens
guucuuccucuuaccug

SEQ ID NO: 457462 - RNA, 18 nt, Homo sapiens
guucuuuaaaggcaucua

SEQ ID NO: 457463 - RNA, 19 nt, Homo sapiens
uaaaaugaaauuacuacaa

SEQ ID NO: 457464 - RNA, 14 nt, Homo sapiens
uaaaaugcauugaa

SEQ ID NO: 457465 - RNA, 14 nt, Homo sapiens
uaaaaugcauuuaa

SEQ ID NO: 457466 - RNA, 19 nt, Homo sapiens
uaaaauguuccuuuugaca

SEQ ID NO: 457467 - RNA, 18 nt, Homo sapiens
uaaaauguuggugcaauu

SEQ ID NO: 457468 - RNA, 19 nt, Homo sapiens
uaaaauguuggugcaauua

SEQ ID NO: 457469 - RNA, 18 nt, Homo sapiens
uaaaauuagaugaacuca

SEQ ID NO: 457470 - RNA, 16 nt, Homo sapiens
uaaaauucauagcauc

SEQ ID NO: 457471 - RNA, 15 nt, Homo sapiens
uaaaauucuagucuc

SEQ ID NO: 457472 - RNA, 21 nt, Homo sapiens
uaaaauugggcuugugauuuc

SEQ ID NO: 457473 - RNA, 14 nt, Homo sapiens
uaaaauuguaaaau

SEQ ID NO: 457474 - RNA, 22 nt, Homo sapiens
uaaaauuuaaccuacuagacaa

SEQ ID NO: 457475 - RNA, 13 nt, Homo sapiens
uaaacaacaguac

SEQ ID NO: 457476 - RNA, 20 nt, Homo sapiens
uaaacaagaguuuucuuccu

SEQ ID NO: 457477 - RNA, 22 nt, Homo sapiens
uaaacacaaauagaacauucca

SEQ ID NO: 457478 - RNA, 22 nt, Homo sapiens
uaaacacauagauucaccugua

SEQ ID NO: 457479 - RNA, 19 nt, Homo sapiens
uaaacacuagacuguauca

SEQ ID NO: 457480 - RNA, 16 nt, Homo sapiens
uaaacagaagguaaua

SEQ ID NO: 457481 - RNA, 19 nt, Homo sapiens
uaaacaguuugaaaagaca

SEQ ID NO: 457482 - RNA, 22 nt, Homo sapiens
uaaacaguuugaaaagacaaau

SEQ ID NO: 457483 - RNA, 13 nt, Homo sapiens
uaaacauguguuu

SEQ ID NO: 457484 - RNA, 11 nt, Homo sapiens
uaaacauucau

SEQ ID NO: 457485 - RNA, 21 nt, Homo sapiens
uaaacauuugagagcuaacua

SEQ ID NO: 457486 - RNA, 19 nt, Homo sapiens
uaaaccaauaaaacaagaa

SEQ ID NO: 457487 - RNA, 15 nt, Homo sapiens
uaaaccagacucacu

SEQ ID NO: 457488 - RNA, 13 nt, Homo sapiens
uaaacccaucugu

SEQ ID NO: 457489 - RNA, 15 nt, Homo sapiens
uaaacgucacagcag

SEQ ID NO: 457490 - RNA, 17 nt, Homo sapiens
uaaacgucacagcagua

SEQ ID NO: 457491 - RNA, 18 nt, Homo sapiens
uaaacuaaaauacaagua

SEQ ID NO: 457492 - RNA, 14 nt, Homo sapiens
uaaacuagaucucc

SEQ ID NO: 457493 - RNA, 21 nt, Homo sapiens
uaaacuauucuauaaacauau

SEQ ID NO: 457494 - RNA, 18 nt, Homo sapiens
uaaacucacaacucucug

SEQ ID NO: 457495 - RNA, 13 nt, Homo sapiens
uaaacucagaaua

SEQ ID NO: 457496 - RNA, 19 nt, Homo sapiens
uaaacucuaaguguaaaaa

SEQ ID NO: 457497 - RNA, 15 nt, Homo sapiens
uaaacugacuuuauc

SEQ ID NO: 457498 - RNA, 20 nt, Homo sapiens
uaaacugauggauaucccua

SEQ ID NO: 457499 - RNA, 17 nt, Homo sapiens
uaaacugcccugucuag

SEQ ID NO: 457500 - RNA, 23 nt, Homo sapiens
uaaacuguuuucauguguugcaa

SEQ ID NO: 457501 - RNA, 15 nt, Homo sapiens
uaaacuuaacuuuaa

SEQ ID NO: 457502 - RNA, 14 nt, Homo sapiens
uaaagaaaggcaga

SEQ ID NO: 457503 - RNA, 20 nt, Homo sapiens
uaaagaaauaauacccugcc

SEQ ID NO: 457504 - RNA, 18 nt, Homo sapiens
uaaagaaaugcauaaaag

SEQ ID NO: 457505 - RNA, 15 nt, Homo sapiens
uaaagaggacuugaa

SEQ ID NO: 457506 - RNA, 21 nt, Homo sapiens
uaaagcacccuguaucacaga

SEQ ID NO: 457507 - RNA, 13 nt, Homo sapiens
uaaagcagccagc

SEQ ID NO: 457508 - RNA, 24 nt, Homo sapiens
uaaagcaguagacaauccccacau

SEQ ID NO: 457509 - RNA, 17 nt, Homo sapiens
uaaagcauaaguauaca

SEQ ID NO: 457510 - RNA, 13 nt, Homo sapiens
uaaagcccuugaa

SEQ ID NO: 457511 - RNA, 14 nt, Homo sapiens
uaaagcccuugaac

SEQ ID NO: 457512 - RNA, 18 nt, Homo sapiens
uaaagccucugugcugca

SEQ ID NO: 457513 - RNA, 12 nt, Homo sapiens
uaaaguauucca

SEQ ID NO: 457514 - RNA, 15 nt, Homo sapiens
uaaaguauuccaccu

SEQ ID NO: 457515 - RNA, 16 nt, Homo sapiens
uaaagucacagaauua

SEQ ID NO: 457516 - RNA, 20 nt, Homo sapiens
uaaaguccaaagucagaucu

SEQ ID NO: 457517 - RNA, 20 nt, Homo sapiens
uaaagugaauaaccacuuaa

SEQ ID NO: 457518 - RNA, 14 nt, Homo sapiens
uaaagugauuucau

SEQ ID NO: 457519 - RNA, 15 nt, Homo sapiens
uaaagugcaauugca

SEQ ID NO: 457520 - RNA, 15 nt, Homo sapiens
uaaagugcacugcca

SEQ ID NO: 457521 - RNA, 18 nt, Homo sapiens
uaaagugccuaccccagc

SEQ ID NO: 457522 - RNA, 16 nt, Homo sapiens
uaaaguuccaugaaga

SEQ ID NO: 457523 - RNA, 23 nt, Homo sapiens
uaaaguuuaaauaccaguacuug

SEQ ID NO: 457524 - RNA, 18 nt, Homo sapiens
uaaauaaaguaucaugca

SEQ ID NO: 457525 - RNA, 13 nt, Homo sapiens
uaaauaaccaauu

SEQ ID NO: 457526 - RNA, 18 nt, Homo sapiens
uaaauacucccuuuuuga

SEQ ID NO: 457527 - RNA, 18 nt, Homo sapiens
uaaauacuuuaacuucca

SEQ ID NO: 457528 - RNA, 19 nt, Homo sapiens
uaaauagaugaguccuguu

SEQ ID NO: 457529 - RNA, 18 nt, Homo sapiens
uaaauagcuaaauggcaa

SEQ ID NO: 457530 - RNA, 17 nt, Homo sapiens
uaaauagcuauauccau

SEQ ID NO: 457531 - RNA, 23 nt, Homo sapiens
uaaauagcuauauccauguacug

SEQ ID NO: 457532 - RNA, 23 nt, Homo sapiens
uaaauaguauuugagaguucuaa

SEQ ID NO: 457533 - RNA, 14 nt, Homo sapiens
uaaauaucauucuu

SEQ ID NO: 457534 - RNA, 17 nt, Homo sapiens
uaaauauuagaagccug

SEQ ID NO: 457535 - RNA, 21 nt, Homo sapiens
uaaauccaacucugacuguaa

SEQ ID NO: 457536 - RNA, 16 nt, Homo sapiens
uaaauccuaccaaagu

SEQ ID NO: 457537 - RNA, 14 nt, Homo sapiens
uaaaucuccagugg

SEQ ID NO: 457538 - RNA, 11 nt, Homo sapiens
uaaaugaacuu

SEQ ID NO: 457539 - RNA, 19 nt, Homo sapiens
uaaaugaggggccucaggu

SEQ ID NO: 457540 - RNA, 20 nt, Homo sapiens
uaaauggaacaaacaaugaa

SEQ ID NO: 457541 - RNA, 12 nt, Homo sapiens
uaaauggagcuu

SEQ ID NO: 457542 - RNA, 14 nt, Homo sapiens
uaaauguaucuuau

SEQ ID NO: 457543 - RNA, 20 nt, Homo sapiens
uaaauguaucuuauucacau

SEQ ID NO: 457544 - RNA, 14 nt, Homo sapiens
uaaaugugaacuua

SEQ ID NO: 457545 - RNA, 19 nt, Homo sapiens
uaaauuaaugaguuuuauc

SEQ ID NO: 457546 - RNA, 17 nt, Homo sapiens
uaaauucaaaccuaagu

SEQ ID NO: 457547 - RNA, 15 nt, Homo sapiens
uaaauucuaagccau

SEQ ID NO: 457548 - RNA, 17 nt, Homo sapiens
uaaauucuaagccauau

SEQ ID NO: 457549 - RNA, 23 nt, Homo sapiens
uaaauugcuuuuguugugacuuu

SEQ ID NO: 457550 - RNA, 20 nt, Homo sapiens
uaaauuuaauauacugcaua

SEQ ID NO: 457551 - RNA, 20 nt, Homo sapiens
uaaauuuacguauauuucau

SEQ ID NO: 457552 - RNA, 15 nt, Homo sapiens
uaaauuuuaucucag

SEQ ID NO: 457553 - RNA, 17 nt, Homo sapiens
uaaauuuugaguucuac

SEQ ID NO: 457554 - RNA, 18 nt, Homo sapiens
uaacaacagcuucuugcu

SEQ ID NO: 457555 - RNA, 18 nt, Homo sapiens
uaacaagccuuggaccaa

SEQ ID NO: 457556 - RNA, 19 nt, Homo sapiens
uaacaagccuuggaccaaa

SEQ ID NO: 457557 - RNA, 21 nt, Homo sapiens
uaacaauguaugugaaagugu

SEQ ID NO: 457558 - RNA, 15 nt, Homo sapiens
uaacaauguuuguca

SEQ ID NO: 457559 - RNA, 17 nt, Homo sapiens
uaacaauguuugucauu

SEQ ID NO: 457560 - RNA, 23 nt, Homo sapiens
uaacacauuaucgggagcagugu

SEQ ID NO: 457561 - RNA, 17 nt, Homo sapiens
uaacacuaauaauagua

SEQ ID NO: 457562 - RNA, 21 nt, Homo sapiens
uaacacuaauaauaguacuau

SEQ ID NO: 457563 - RNA, 14 nt, Homo sapiens
uaacacugugaaug

SEQ ID NO: 457564 - RNA, 22 nt, Homo sapiens
uaacagaaagaacgugaucucc

SEQ ID NO: 457565 - RNA, 18 nt, Homo sapiens
uaacaggauauuuaauga

SEQ ID NO: 457566 - RNA, 21 nt, Homo sapiens
uaacaucacuauccaugcacc

SEQ ID NO: 457567 - RNA, 20 nt, Homo sapiens
gucccagugggaggcgcgag

SEQ ID NO: 457568 - RNA, 17 nt, Homo sapiens
gucccaguuaacuguua

SEQ ID NO: 457569 - RNA, 21 nt, Homo sapiens
guccccccucaagaguacaga

SEQ ID NO: 457570 - RNA, 22 nt, Homo sapiens
guccccggacgcuggcucggga

SEQ ID NO: 457571 - RNA, 11 nt, Homo sapiens
gucccuaccuc

SEQ ID NO: 457572 - RNA, 19 nt, Homo sapiens
gucccucaggcuuguugcc

SEQ ID NO: 457573 - RNA, 13 nt, Homo sapiens
gucccucucaggc

SEQ ID NO: 457574 - RNA, 13 nt, Homo sapiens
gucccuuccaggc

SEQ ID NO: 457575 - RNA, 18 nt, Homo sapiens
guccguugacgugaccaa

SEQ ID NO: 457576 - RNA, 18 nt, Homo sapiens
guccuaaagaugcugacu

SEQ ID NO: 457577 - RNA, 16 nt, Homo sapiens
guccuaaauaucucaa

SEQ ID NO: 457578 - RNA, 20 nt, Homo sapiens
guccucauccuuuccugcca

SEQ ID NO: 457579 - RNA, 20 nt, Homo sapiens
guccuccaccacaagagcuc

SEQ ID NO: 457580 - RNA, 16 nt, Homo sapiens
guccucuuaagacacu

SEQ ID NO: 457581 - RNA, 15 nt, Homo sapiens
guccugacuguccua

SEQ ID NO: 457582 - RNA, 20 nt, Homo sapiens
guccugaugcuuuugucuaa

SEQ ID NO: 457583 - RNA, 18 nt, Homo sapiens
guccugauguacuuuaaa

SEQ ID NO: 457584 - RNA, 18 nt, Homo sapiens
guccugggccuccugaca

SEQ ID NO: 457585 - RNA, 14 nt, Homo sapiens
guccuggggaccau

SEQ ID NO: 457586 - RNA, 14 nt, Homo sapiens
guccuguucuuguu

SEQ ID NO: 457587 - RNA, 15 nt, Homo sapiens
guccuuucccaccca

SEQ ID NO: 457588 - RNA, 22 nt, Homo sapiens
guccuuuccccggaguaccuau

SEQ ID NO: 457589 - RNA, 17 nt, Homo sapiens
gucgaauguuagauucc

SEQ ID NO: 457590 - RNA, 23 nt, Homo sapiens
gucgaugcucacugcuucugcuu

SEQ ID NO: 457591 - RNA, 14 nt, Homo sapiens
gucgcaucucagug

SEQ ID NO: 457592 - RNA, 16 nt, Homo sapiens
gucgggaaauucugcu

SEQ ID NO: 457593 - RNA, 19 nt, Homo sapiens
gucgucaaugaugaguccu

SEQ ID NO: 457594 - RNA, 18 nt, Homo sapiens
gucguuuuuuucauucca

SEQ ID NO: 457595 - RNA, 16 nt, Homo sapiens
gucuaaagagcuuuag

SEQ ID NO: 457596 - RNA, 15 nt, Homo sapiens
gucuaagagugaagu

SEQ ID NO: 457597 - RNA, 14 nt, Homo sapiens
gucuacaugugcca

SEQ ID NO: 457598 - RNA, 18 nt, Homo sapiens
gucuacccagacucagag

SEQ ID NO: 457599 - RNA, 17 nt, Homo sapiens
gucuacuguggugaucu

SEQ ID NO: 457600 - RNA, 19 nt, Homo sapiens
gucuaggucuccucagggu

SEQ ID NO: 457601 - RNA, 15 nt, Homo sapiens
gucucaaacuccuga

SEQ ID NO: 457602 - RNA, 16 nt, Homo sapiens
gucucacccacuagga

SEQ ID NO: 457603 - RNA, 16 nt, Homo sapiens
gucucacuuuguugcc

SEQ ID NO: 457604 - RNA, 16 nt, Homo sapiens
gucucagucauaauca

SEQ ID NO: 457605 - RNA, 19 nt, Homo sapiens
gucucauaauugucaaaaa

SEQ ID NO: 457606 - RNA, 19 nt, Homo sapiens
gucucauggcagucccaaa

SEQ ID NO: 457607 - RNA, 13 nt, Homo sapiens
gucuccucuguca

SEQ ID NO: 457608 - RNA, 21 nt, Homo sapiens
gucucgaacuccuggccucaa

SEQ ID NO: 457609 - RNA, 24 nt, Homo sapiens
gucucuaucuugcaucuaccugcu

SEQ ID NO: 457610 - RNA, 18 nt, Homo sapiens
gucucugccggcucuuuc

SEQ ID NO: 457611 - RNA, 18 nt, Homo sapiens
gucugaaaucagugccua

SEQ ID NO: 457612 - RNA, 21 nt, Homo sapiens
gucugaauacugcagcacucu

SEQ ID NO: 457613 - RNA, 17 nt, Homo sapiens
gucugacacaugcucuc

SEQ ID NO: 457614 - RNA, 18 nt, Homo sapiens
gucugacacaugcucuca

SEQ ID NO: 457615 - RNA, 16 nt, Homo sapiens
gucugagaacaaauac

SEQ ID NO: 457616 - RNA, 16 nt, Homo sapiens
gucugagcuucaguau

SEQ ID NO: 457617 - RNA, 19 nt, Homo sapiens
gucugccccacccucaaac

SEQ ID NO: 457618 - RNA, 13 nt, Homo sapiens
gucugcuuaccaa

SEQ ID NO: 457619 - RNA, 17 nt, Homo sapiens
gucugcuuaccaaaaca

SEQ ID NO: 457620 - RNA, 19 nt, Homo sapiens
gucugcuuauccuuggaag

SEQ ID NO: 457621 - RNA, 16 nt, Homo sapiens
gucuggagcucaccca

SEQ ID NO: 457622 - RNA, 19 nt, Homo sapiens
gucuggaggggcauggcca

SEQ ID NO: 457623 - RNA, 22 nt, Homo sapiens
gucugguaaauagguauuauau

SEQ ID NO: 457624 - RNA, 20 nt, Homo sapiens
gucuguagcuccucaacuca

SEQ ID NO: 457625 - RNA, 22 nt, Homo sapiens
gucugugaaagucuccuguauc

SEQ ID NO: 457626 - RNA, 16 nt, Homo sapiens
gucuguuuugccuuca

SEQ ID NO: 457627 - RNA, 14 nt, Homo sapiens
gucuuaaucguccu

SEQ ID NO: 457628 - RNA, 16 nt, Homo sapiens
gucuuaauuuucuaaa

SEQ ID NO: 457629 - RNA, 15 nt, Homo sapiens
gucuuacuguugcau

SEQ ID NO: 457630 - RNA, 16 nt, Homo sapiens
gucuuacuguugcaua

SEQ ID NO: 457631 - RNA, 17 nt, Homo sapiens
gucuuacuuugugcaaa

SEQ ID NO: 457632 - RNA, 13 nt, Homo sapiens
gucuuagcaagaa

SEQ ID NO: 457633 - RNA, 17 nt, Homo sapiens
gucuucagggaagguca

SEQ ID NO: 457634 - RNA, 18 nt, Homo sapiens
gucuucauuucauuguau

SEQ ID NO: 457635 - RNA, 15 nt, Homo sapiens
gucuucccugcuuca

SEQ ID NO: 457636 - RNA, 22 nt, Homo sapiens
gucuuccugaguggugccaaac

SEQ ID NO: 457637 - RNA, 19 nt, Homo sapiens
gucuucguagguugugaug

SEQ ID NO: 457638 - RNA, 14 nt, Homo sapiens
gucuucuuuaccuc

SEQ ID NO: 457639 - RNA, 17 nt, Homo sapiens
gucuugggggucagggg

SEQ ID NO: 457640 - RNA, 14 nt, Homo sapiens
gucuugucauucca

SEQ ID NO: 457641 - RNA, 17 nt, Homo sapiens
gucuugucauuccaggu

SEQ ID NO: 457642 - RNA, 16 nt, Homo sapiens
gucuuuaucagugaug

SEQ ID NO: 457643 - RNA, 21 nt, Homo sapiens
gucuuucgcacauucuccuga

SEQ ID NO: 457644 - RNA, 22 nt, Homo sapiens
gucuuucggggugcuccugugg

SEQ ID NO: 457645 - RNA, 13 nt, Homo sapiens
gucuuucuuugcu

SEQ ID NO: 457646 - RNA, 22 nt, Homo sapiens
gugaaaaaggcaagccacagaa

SEQ ID NO: 457647 - RNA, 14 nt, Homo sapiens
gugaaaacagcagc

SEQ ID NO: 457648 - RNA, 19 nt, Homo sapiens
gugaaaugcuggcauuugc

SEQ ID NO: 457649 - RNA, 23 nt, Homo sapiens
gugaaauuuacaguuacugccua

SEQ ID NO: 457650 - RNA, 20 nt, Homo sapiens
gugaacacucaugcggccca

SEQ ID NO: 457651 - RNA, 17 nt, Homo sapiens
gugaacagaacaaaagg

SEQ ID NO: 457652 - RNA, 16 nt, Homo sapiens
gugaacauaacuguaa

SEQ ID NO: 457653 - RNA, 17 nt, Homo sapiens
gugaaccuuaguaccua

SEQ ID NO: 457654 - RNA, 23 nt, Homo sapiens
gugaacuuaucaaaaaugcaaau

SEQ ID NO: 457655 - RNA, 14 nt, Homo sapiens
gugaagaggggcca

SEQ ID NO: 457656 - RNA, 23 nt, Homo sapiens
gugaagcugggagaaccaaaaag

SEQ ID NO: 457657 - RNA, 20 nt, Homo sapiens
gugaauauuagauugcugaa

SEQ ID NO: 457658 - RNA, 13 nt, Homo sapiens
gugaaugaucucu

SEQ ID NO: 457659 - RNA, 19 nt, Homo sapiens
gugacaaggccccagagac

SEQ ID NO: 457660 - RNA, 13 nt, Homo sapiens
gugacacagcagc

SEQ ID NO: 457661 - RNA, 18 nt, Homo sapiens
gugacaggcccaguggaa

SEQ ID NO: 457662 - RNA, 14 nt, Homo sapiens
gugacagugccugg

SEQ ID NO: 457663 - RNA, 12 nt, Homo sapiens
gugacauuccac

SEQ ID NO: 457664 - RNA, 16 nt, Homo sapiens
gugaccccugaccuca

SEQ ID NO: 457665 - RNA, 23 nt, Homo sapiens
gugagaauaaacuagacucugaa

SEQ ID NO: 457666 - RNA, 15 nt, Homo sapiens
gugagagaaucugcc

SEQ ID NO: 457667 - RNA, 15 nt, Homo sapiens
gugaggcggcagcug

SEQ ID NO: 457668 - RNA, 19 nt, Homo sapiens
gugaggcuccggauguuuc

SEQ ID NO: 457669 - RNA, 19 nt, Homo sapiens
gugagggcagcacugggaa

SEQ ID NO: 457670 - RNA, 14 nt, Homo sapiens
uaauaggaggacag

SEQ ID NO: 457671 - RNA, 14 nt, Homo sapiens
uaauaguacuauug

SEQ ID NO: 457672 - RNA, 19 nt, Homo sapiens
uaauagucaauuucuacuu

SEQ ID NO: 457673 - RNA, 14 nt, Homo sapiens
uaauauaacugccu

SEQ ID NO: 457674 - RNA, 21 nt, Homo sapiens
uaauauaggguuuguuugcug

SEQ ID NO: 457675 - RNA, 12 nt, Homo sapiens
uaauauauugcu

SEQ ID NO: 457676 - RNA, 14 nt, Homo sapiens
uaauaugcugccaa

SEQ ID NO: 457677 - RNA, 13 nt, Homo sapiens
uaauaugucuuca

SEQ ID NO: 457678 - RNA, 20 nt, Homo sapiens
uaauauuuguuccucuaggu

SEQ ID NO: 457679 - RNA, 16 nt, Homo sapiens
uaauauuuuagauuac

SEQ ID NO: 457680 - RNA, 17 nt, Homo sapiens
uaauauuuuagauuaca

SEQ ID NO: 457681 - RNA, 14 nt, Homo sapiens
uaaucaccaaagua

SEQ ID NO: 457682 - RNA, 21 nt, Homo sapiens
uaaucagaaaccccacuucca

SEQ ID NO: 457683 - RNA, 12 nt, Homo sapiens
uaaucagcauua

SEQ ID NO: 457684 - RNA, 22 nt, Homo sapiens
uaaucagggaggucauuuuggu

SEQ ID NO: 457685 - RNA, 17 nt, Homo sapiens
uaauccaggacagcauu

SEQ ID NO: 457686 - RNA, 12 nt, Homo sapiens
uaauccaugugc

SEQ ID NO: 457687 - RNA, 15 nt, Homo sapiens
uaaucccagcacuuu

SEQ ID NO: 457688 - RNA, 20 nt, Homo sapiens
uaaucccagcuacuugggag

SEQ ID NO: 457689 - RNA, 19 nt, Homo sapiens
uaaucccaguacuugggag

SEQ ID NO: 457690 - RNA, 19 nt, Homo sapiens
uaaucgaaguaauuuuggg

SEQ ID NO: 457691 - RNA, 21 nt, Homo sapiens
uaaucugcuuuguuaaugaaa

SEQ ID NO: 457692 - RNA, 16 nt, Homo sapiens
uaaucuggacuccucu

SEQ ID NO: 457693 - RNA, 16 nt, Homo sapiens
uaaucuucucucuuga

SEQ ID NO: 457694 - RNA, 21 nt, Homo sapiens
uaaucuuucauagccauaccu

SEQ ID NO: 457695 - RNA, 17 nt, Homo sapiens
uaaugaaaccugugucu

SEQ ID NO: 457696 - RNA, 22 nt, Homo sapiens
uaaugaaauaauguacaucugg

SEQ ID NO: 457697 - RNA, 18 nt, Homo sapiens
uaaugaaggugugcuaca

SEQ ID NO: 457698 - RNA, 15 nt, Homo sapiens
uaaugacaacaaaag

SEQ ID NO: 457699 - RNA, 19 nt, Homo sapiens
uaaugacuuaagcacacuu

SEQ ID NO: 457700 - RNA, 20 nt, Homo sapiens
uaaugaguuuuacauuacaa

SEQ ID NO: 457701 - RNA, 23 nt, Homo sapiens
uaaugauaguguuuuguacuugu

SEQ ID NO: 457702 - RNA, 15 nt, Homo sapiens
uaaugaucaacaauu

SEQ ID NO: 457703 - RNA, 12 nt, Homo sapiens
uaaugcucacuu

SEQ ID NO: 457704 - RNA, 21 nt, Homo sapiens
uaaugcuuuuacuaagcacug

SEQ ID NO: 457705 - RNA, 17 nt, Homo sapiens
accagaagugccaugcu

SEQ ID NO: 457706 - RNA, 20 nt, Homo sapiens
accagagaggcucugagaaa

SEQ ID NO: 457707 - RNA, 14 nt, Homo sapiens
accagagcauuucc

SEQ ID NO: 457708 - RNA, 15 nt, Homo sapiens
accagagcauuucca

SEQ ID NO: 457709 - RNA, 13 nt, Homo sapiens
accagcaagaaua

SEQ ID NO: 457710 - RNA, 15 nt, Homo sapiens
accagcaagucccag

SEQ ID NO: 457711 - RNA, 16 nt, Homo sapiens
accagcaauacaaaga

SEQ ID NO: 457712 - RNA, 13 nt, Homo sapiens
accagcacugucu

SEQ ID NO: 457713 - RNA, 19 nt, Homo sapiens
accagcgcccgcugggcug

SEQ ID NO: 457714 - RNA, 15 nt, Homo sapiens
accagcuuugcagug

SEQ ID NO: 457715 - RNA, 20 nt, Homo sapiens
accaggacucccuccucacc

SEQ ID NO: 457716 - RNA, 16 nt, Homo sapiens
accaggagacagacag

SEQ ID NO: 457717 - RNA, 18 nt, Homo sapiens
accagggcucagcuccuu

SEQ ID NO: 457718 - RNA, 22 nt, Homo sapiens
accaggguccgcaccagcugcu

SEQ ID NO: 457719 - RNA, 18 nt, Homo sapiens
accagggugguugggacg

SEQ ID NO: 457720 - RNA, 17 nt, Homo sapiens
accagucacacauuaua

SEQ ID NO: 457721 - RNA, 16 nt, Homo sapiens
accagucucacccacu

SEQ ID NO: 457722 - RNA, 18 nt, Homo sapiens
accagucugaaguuucau

SEQ ID NO: 457723 - RNA, 15 nt, Homo sapiens
accaguggugccuug

SEQ ID NO: 457724 - RNA, 16 nt, Homo sapiens
accagugugacaucua

SEQ ID NO: 457725 - RNA, 23 nt, Homo sapiens
accaguguuagugggaagagcug

SEQ ID NO: 457726 - RNA, 17 nt, Homo sapiens
accaguuaaaagcauuu

SEQ ID NO: 457727 - RNA, 15 nt, Homo sapiens
accaguuaugugaau

SEQ ID NO: 457728 - RNA, 17 nt, Homo sapiens
accaguugggagcacug

SEQ ID NO: 457729 - RNA, 15 nt, Homo sapiens
accaguuuaccugaa

SEQ ID NO: 457730 - RNA, 16 nt, Homo sapiens
accaguuucagagaaa

SEQ ID NO: 457731 - RNA, 13 nt, Homo sapiens
accauaacacuug

SEQ ID NO: 457732 - RNA, 21 nt, Homo sapiens
accauaacacuugaugccguu

SEQ ID NO: 457733 - RNA, 13 nt, Homo sapiens
accauaauguuac

SEQ ID NO: 457734 - RNA, 18 nt, Homo sapiens
accaucaaaaauauucca

SEQ ID NO: 457735 - RNA, 21 nt, Homo sapiens
accaucucuccuccuuuucac

SEQ ID NO: 457736 - RNA, 22 nt, Homo sapiens
accaucuggaaggacaucuaca

SEQ ID NO: 457737 - RNA, 14 nt, Homo sapiens
accaugacugugac

SEQ ID NO: 457738 - RNA, 16 nt, Homo sapiens
accauguggccauuaa

SEQ ID NO: 457739 - RNA, 19 nt, Homo sapiens
accauguggccauuaacaa

SEQ ID NO: 457740 - RNA, 13 nt, Homo sapiens
accauuacuguaa

SEQ ID NO: 457741 - RNA, 15 nt, Homo sapiens
accauuacuguaauu

SEQ ID NO: 457742 - RNA, 19 nt, Homo sapiens
accauuccuuuaaauucuc

SEQ ID NO: 457743 - RNA, 17 nt, Homo sapiens
accauugaccucagcug

SEQ ID NO: 457744 - RNA, 20 nt, Homo sapiens
accauugcuucacuacccau

SEQ ID NO: 457745 - RNA, 12 nt, Homo sapiens
acccaacacuuu

SEQ ID NO: 457746 - RNA, 16 nt, Homo sapiens
acccaacaggugcuga

SEQ ID NO: 457747 - RNA, 17 nt, Homo sapiens
acccaacuccucuccuc

SEQ ID NO: 457748 - RNA, 14 nt, Homo sapiens
acccaagcauuugu

SEQ ID NO: 457749 - RNA, 22 nt, Homo sapiens
acccaaguuuauuauaucauua

SEQ ID NO: 457750 - RNA, 15 nt, Homo sapiens
acccacaaacugccu

SEQ ID NO: 457751 - RNA, 12 nt, Homo sapiens
acccacccagga

SEQ ID NO: 457752 - RNA, 14 nt, Homo sapiens
acccaccccaacuc

SEQ ID NO: 457753 - RNA, 15 nt, Homo sapiens
acccaccucagccuc

SEQ ID NO: 457754 - RNA, 14 nt, Homo sapiens
acccacgcauauac

SEQ ID NO: 457755 - RNA, 13 nt, Homo sapiens
acccacuaggaua

SEQ ID NO: 457756 - RNA, 14 nt, Homo sapiens
acccacucuucaca

SEQ ID NO: 457757 - RNA, 17 nt, Homo sapiens
acccacuggagacuuug

SEQ ID NO: 457758 - RNA, 23 nt, Homo sapiens
acccagaauguagcaucugagaa

SEQ ID NO: 457759 - RNA, 18 nt, Homo sapiens
acccagcccagcuugcca

SEQ ID NO: 457760 - RNA, 21 nt, Homo sapiens
acccagccucuagaacagcca

SEQ ID NO: 457761 - RNA, 17 nt, Homo sapiens
acccaggaguguggcca

SEQ ID NO: 457762 - RNA, 14 nt, Homo sapiens
acccaggccacuga

SEQ ID NO: 457763 - RNA, 16 nt, Homo sapiens
acccaggccacugacc

SEQ ID NO: 457764 - RNA, 20 nt, Homo sapiens
acccaggcuggagugcagug

SEQ ID NO: 457765 - RNA, 22 nt, Homo sapiens
acccaggcugguucuugggcua

SEQ ID NO: 457766 - RNA, 19 nt, Homo sapiens
acccagucccagaaccaca

SEQ ID NO: 457767 - RNA, 20 nt, Homo sapiens
acccagugcugccaugccac

SEQ ID NO: 457768 - RNA, 17 nt, Homo sapiens
acccaguggaaccaaaa

SEQ ID NO: 457769 - RNA, 18 nt, Homo sapiens
acccaguggaaccaaaac

SEQ ID NO: 457770 - RNA, 23 nt, Homo sapiens
acccaucggguaagaugcuccug

SEQ ID NO: 457771 - RNA, 18 nt, Homo sapiens
acccaugagauucauuca

SEQ ID NO: 457772 - RNA, 23 nt, Homo sapiens
acccaugcacagaacaagccaca

SEQ ID NO: 457773 - RNA, 15 nt, Homo sapiens
acccauugucucauu

SEQ ID NO: 457774 - RNA, 18 nt, Homo sapiens
accccaaacuguugauua

SEQ ID NO: 457775 - RNA, 20 nt, Homo sapiens
accccaaacuuccagguucc

SEQ ID NO: 457776 - RNA, 21 nt, Homo sapiens
accccaagcaaaucccaacau

SEQ ID NO: 457777 - RNA, 18 nt, Homo sapiens
accccacagacacuuaca

SEQ ID NO: 457778 - RNA, 19 nt, Homo sapiens
accccagagggaccagcug

SEQ ID NO: 457779 - RNA, 19 nt, Homo sapiens
accccagccucuugagcug

SEQ ID NO: 457780 - RNA, 16 nt, Homo sapiens
accccagcucaugccc

SEQ ID NO: 457781 - RNA, 19 nt, Homo sapiens
accccagcuuuucuugcca

SEQ ID NO: 457782 - RNA, 16 nt, Homo sapiens
accccaguaagccacu

SEQ ID NO: 457783 - RNA, 24 nt, Homo sapiens
accccagugccugucuggagcuca

SEQ ID NO: 457784 - RNA, 12 nt, Homo sapiens
acccccaagaaa

SEQ ID NO: 457785 - RNA, 21 nt, Homo sapiens
acccccagccuggacaccucu

SEQ ID NO: 457786 - RNA, 15 nt, Homo sapiens
accccccugagagca

SEQ ID NO: 457787 - RNA, 14 nt, Homo sapiens
accccgggcucucu

SEQ ID NO: 457788 - RNA, 23 nt, Homo sapiens
accccggugugccuguggaggaa

SEQ ID NO: 457789 - RNA, 15 nt, Homo sapiens
accccucaccuugca

SEQ ID NO: 457790 - RNA, 19 nt, Homo sapiens
accccuccccuaaugccug

SEQ ID NO: 457791 - RNA, 19 nt, Homo sapiens
accccugccuuuucauugc

SEQ ID NO: 457792 - RNA, 22 nt, Homo sapiens
accccuuacuuagcaugcacaa

SEQ ID NO: 457793 - RNA, 17 nt, Homo sapiens
accccuuucuaguucaa

SEQ ID NO: 457794 - RNA, 14 nt, Homo sapiens
acccgacugugaaa

SEQ ID NO: 457795 - RNA, 23 nt, Homo sapiens
acccggagcucuacgugcuccuc

SEQ ID NO: 457796 - RNA, 16 nt, Homo sapiens
acccggaucuccaggc

SEQ ID NO: 457797 - RNA, 21 nt, Homo sapiens
acccggccccuaccagccacg

SEQ ID NO: 457798 - RNA, 15 nt, Homo sapiens
acccgggagcagugu

SEQ ID NO: 457799 - RNA, 22 nt, Homo sapiens
acccgguccugcccuuccugaa

SEQ ID NO: 457800 - RNA, 22 nt, Homo sapiens
acccuaacugagcugccagugg

SEQ ID NO: 457801 - RNA, 17 nt, Homo sapiens
acccuaagccacuggga

SEQ ID NO: 457802 - RNA, 18 nt, Homo sapiens
acccuagccagagaauag

SEQ ID NO: 457803 - RNA, 20 nt, Homo sapiens
acccuaguuucccugaagga

SEQ ID NO: 457804 - RNA, 16 nt, Homo sapiens
acccuauaaaagugau

SEQ ID NO: 457805 - RNA, 19 nt, Homo sapiens
acccuauggaguacaugga

SEQ ID NO: 457806 - RNA, 15 nt, Homo sapiens
acccucacucugcca

SEQ ID NO: 457807 - RNA, 23 nt, Homo sapiens
acccuccggccagcgagugguca

SEQ ID NO: 457808 - RNA, 14 nt, Homo sapiens
acccuccucaagaa

SEQ ID NO: 457809 - RNA, 17 nt, Homo sapiens
acccuccuccacuccac

SEQ ID NO: 457810 - RNA, 15 nt, Homo sapiens
acccucucacuuugg

SEQ ID NO: 457811 - RNA, 19 nt, Homo sapiens
acccucugcuaugucugug

SEQ ID NO: 457812 - RNA, 17 nt, Homo sapiens
acccugcaaaggacugu

SEQ ID NO: 457813 - RNA, 20 nt, Homo sapiens
acccugccaggcugcuaaag

SEQ ID NO: 457814 - RNA, 15 nt, Homo sapiens
acccugcugaccucc

SEQ ID NO: 457815 - RNA, 16 nt, Homo sapiens
acccugcugaccuccc

SEQ ID NO: 457816 - RNA, 21 nt, Homo sapiens
acccuggagcccauccagucu

SEQ ID NO: 457817 - RNA, 23 nt, Homo sapiens
acccuggagcccauccagucucc

SEQ ID NO: 457818 - RNA, 21 nt, Homo sapiens
acccugggguaaguggaguug

SEQ ID NO: 457819 - RNA, 22 nt, Homo sapiens
acccugucaaguuaacaaggaa

SEQ ID NO: 457820 - RNA, 21 nt, Homo sapiens
acccuguggcaaaugccagga

SEQ ID NO: 457821 - RNA, 19 nt, Homo sapiens
acccuguggggccugaugg

SEQ ID NO: 457822 - RNA, 23 nt, Homo sapiens
acccuguuuguugugucuugcua

SEQ ID NO: 457823 - RNA, 17 nt, Homo sapiens
acccuucagaccccagu

SEQ ID NO: 457824 - RNA, 18 nt, Homo sapiens
acccuuccacguguaugc

SEQ ID NO: 457825 - RNA, 15 nt, Homo sapiens
acccuucucagggac

SEQ ID NO: 457826 - RNA, 21 nt, Homo sapiens
acccuucugcuguauacugua

SEQ ID NO: 457827 - RNA, 17 nt, Homo sapiens
acccuucuuuugaagga

SEQ ID NO: 457828 - RNA, 14 nt, Homo sapiens
acccuugcauuaga

SEQ ID NO: 457829 - RNA, 23 nt, Homo sapiens
acccuugcgcuuuugcuggucac

SEQ ID NO: 457830 - RNA, 20 nt, Homo sapiens
acccuuggcuccugugucug

SEQ ID NO: 457831 - RNA, 18 nt, Homo sapiens
accgaccagacccuggca

SEQ ID NO: 457832 - RNA, 13 nt, Homo sapiens
accgagagacuca

SEQ ID NO: 457833 - RNA, 19 nt, Homo sapiens
accgagagagauggaauaa

SEQ ID NO: 457834 - RNA, 16 nt, Homo sapiens
accgauagcaggugaa

SEQ ID NO: 457835 - RNA, 14 nt, Homo sapiens
accgcauccuccag

SEQ ID NO: 457836 - RNA, 24 nt, Homo sapiens
acaguuuugaaagaaaaauaccau

SEQ ID NO: 457837 - RNA, 16 nt, Homo sapiens
acaguuuugauacaaa

SEQ ID NO: 457838 - RNA, 21 nt, Homo sapiens
acauaacacacaucaguccac

SEQ ID NO: 457839 - RNA, 15 nt, Homo sapiens
acauaacaugcuuua

SEQ ID NO: 457840 - RNA, 15 nt, Homo sapiens
acauaaguaauucaa

SEQ ID NO: 457841 - RNA, 23 nt, Homo sapiens
acauaauguuaguagcacugaga

SEQ ID NO: 457842 - RNA, 15 nt, Homo sapiens
acauacaucuaaguc

SEQ ID NO: 457843 - RNA, 21 nt, Homo sapiens
acauaccuaugggauuuuaca

SEQ ID NO: 457844 - RNA, 23 nt, Homo sapiens
acauaccucucaacuuacauaug

SEQ ID NO: 457845 - RNA, 12 nt, Homo sapiens
acauagcacaga

SEQ ID NO: 457846 - RNA, 21 nt, Homo sapiens
acauaugucuuacuacuuuaa

SEQ ID NO: 457847 - RNA, 22 nt, Homo sapiens
acauauuucuugaguaauuuaa

SEQ ID NO: 457848 - RNA, 13 nt, Homo sapiens
acaucaacugcau

SEQ ID NO: 457849 - RNA, 23 nt, Homo sapiens
acaucaacugcaucaagauguga

SEQ ID NO: 457850 - RNA, 12 nt, Homo sapiens
acaucaauguuc

SEQ ID NO: 457851 - RNA, 12 nt, Homo sapiens
acaucaccuuuu

SEQ ID NO: 457852 - RNA, 23 nt, Homo sapiens
acaucacuguccaccaccaccug

SEQ ID NO: 457853 - RNA, 12 nt, Homo sapiens
acauccaaacau

SEQ ID NO: 457854 - RNA, 18 nt, Homo sapiens
acauccaggcaauggccu

SEQ ID NO: 457855 - RNA, 15 nt, Homo sapiens
acauccagucacuuu

SEQ ID NO: 457856 - RNA, 17 nt, Homo sapiens
acauccauugacugacc

SEQ ID NO: 457857 - RNA, 17 nt, Homo sapiens
acaucgugaaacccugu

SEQ ID NO: 457858 - RNA, 12 nt, Homo sapiens
acaucucagaaa

SEQ ID NO: 457859 - RNA, 15 nt, Homo sapiens
acaucucccuuccac

SEQ ID NO: 457860 - RNA, 18 nt, Homo sapiens
acaucucugcuugaguca

SEQ ID NO: 457861 - RNA, 13 nt, Homo sapiens
acaucugcaauau

SEQ ID NO: 457862 - RNA, 20 nt, Homo sapiens
acaucugcacaacugggcac

SEQ ID NO: 457863 - RNA, 15 nt, Homo sapiens
acaucugcagcucuu

SEQ ID NO: 457864 - RNA, 13 nt, Homo sapiens
acaucuuuuacau

SEQ ID NO: 457865 - RNA, 17 nt, Homo sapiens
acaucuuuuacauucug

SEQ ID NO: 457866 - RNA, 15 nt, Homo sapiens
acaugaaaacauuga

SEQ ID NO: 457867 - RNA, 20 nt, Homo sapiens
acaugaaaugcccuccuaaa

SEQ ID NO: 457868 - RNA, 19 nt, Homo sapiens
acaugaacccauccaaugg

SEQ ID NO: 457869 - RNA, 17 nt, Homo sapiens
acaugaagaaugcauuc

SEQ ID NO: 457870 - RNA, 18 nt, Homo sapiens
acaugacaacuuugccag

SEQ ID NO: 457871 - RNA, 16 nt, Homo sapiens
acaugaccccacaggu

SEQ ID NO: 457872 - RNA, 15 nt, Homo sapiens
acaugagugcugaug

SEQ ID NO: 457873 - RNA, 15 nt, Homo sapiens
acaugagugucaacu

SEQ ID NO: 457874 - RNA, 19 nt, Homo sapiens
acaugaguucaaauacuuu

SEQ ID NO: 457875 - RNA, 21 nt, Homo sapiens
acaugcacacacacacaucuc

SEQ ID NO: 457876 - RNA, 23 nt, Homo sapiens
acaugcacacacacacaucucau

SEQ ID NO: 457877 - RNA, 17 nt, Homo sapiens
acaugcagcccaugccc

SEQ ID NO: 457878 - RNA, 22 nt, Homo sapiens
acaugcucaccucuagccuuaa

SEQ ID NO: 457879 - RNA, 22 nt, Homo sapiens
acaugcucaucccaaaagcuag

SEQ ID NO: 457880 - RNA, 13 nt, Homo sapiens
acaugcuucauga

SEQ ID NO: 457881 - RNA, 14 nt, Homo sapiens
acauggaaggugau

SEQ ID NO: 457882 - RNA, 17 nt, Homo sapiens
acauggacugcuucauc

SEQ ID NO: 457883 - RNA, 23 nt, Homo sapiens
acauggagcuugacuucaugcca

SEQ ID NO: 457884 - RNA, 17 nt, Homo sapiens
acauggcaacaaaggau

SEQ ID NO: 457885 - RNA, 22 nt, Homo sapiens
acaugguacgaauggcagcaua

SEQ ID NO: 457886 - RNA, 15 nt, Homo sapiens
acaugguuaccucug

SEQ ID NO: 457887 - RNA, 21 nt, Homo sapiens
acaugucauguagguugucua

SEQ ID NO: 457888 - RNA, 18 nt, Homo sapiens
acaugucucauauuuuca

SEQ ID NO: 457889 - RNA, 13 nt, Homo sapiens
acaugucuuucag

SEQ ID NO: 457890 - RNA, 16 nt, Homo sapiens
acaugugacaucuacc

SEQ ID NO: 457891 - RNA, 11 nt, Homo sapiens
acaugugauug

SEQ ID NO: 457892 - RNA, 16 nt, Homo sapiens
acaugugauugugauu

SEQ ID NO: 457893 - RNA, 15 nt, Homo sapiens
acauguggcaaaaua

SEQ ID NO: 457894 - RNA, 22 nt, Homo sapiens
acaugugugcgugugcgugcau

SEQ ID NO: 457895 - RNA, 19 nt, Homo sapiens
acauguuaacaccuaccuc

SEQ ID NO: 457896 - RNA, 21 nt, Homo sapiens
acauguuaacaccuaccucac

SEQ ID NO: 457897 - RNA, 15 nt, Homo sapiens
acauguuaucaaauc

SEQ ID NO: 457898 - RNA, 23 nt, Homo sapiens
acauguuuccaucauuucugucu

SEQ ID NO: 457899 - RNA, 20 nt, Homo sapiens
acauuaaaauaacuaagcaa

SEQ ID NO: 457900 - RNA, 23 nt, Homo sapiens
acauuaagagauuuucaagauca

SEQ ID NO: 457901 - RNA, 17 nt, Homo sapiens
acauuaaucaccaaagu

SEQ ID NO: 457902 - RNA, 12 nt, Homo sapiens
acauuacugccu

SEQ ID NO: 457903 - RNA, 20 nt, Homo sapiens
acauuaggucaccugugcac

SEQ ID NO: 457904 - RNA, 15 nt, Homo sapiens
acauuaucaacaugu

SEQ ID NO: 457905 - RNA, 21 nt, Homo sapiens
acauucaccaacaacagucag

SEQ ID NO: 457906 - RNA, 17 nt, Homo sapiens
acauucaucaagcugua

SEQ ID NO: 457907 - RNA, 17 nt, Homo sapiens
acauucauucaacagcu

SEQ ID NO: 457908 - RNA, 17 nt, Homo sapiens
acauuccauuugaagca

SEQ ID NO: 457909 - RNA, 18 nt, Homo sapiens
acauuccccucccaccuc

SEQ ID NO: 457910 - RNA, 24 nt, Homo sapiens
acauuccuuagucucaagggcuag

SEQ ID NO: 457911 - RNA, 20 nt, Homo sapiens
acauucuaaaggcuugauau

SEQ ID NO: 457912 - RNA, 20 nt, Homo sapiens
acauucuacacacagugccu

SEQ ID NO: 457913 - RNA, 23 nt, Homo sapiens
acauucugcaagcacaucugcau

SEQ ID NO: 457914 - RNA, 21 nt, Homo sapiens
acauucuugcucaaguugaug

SEQ ID NO: 457915 - RNA, 18 nt, Homo sapiens
acauucuuuaucuugaca

SEQ ID NO: 457916 - RNA, 13 nt, Homo sapiens
acauugcacuuua

SEQ ID NO: 457917 - RNA, 17 nt, Homo sapiens
acauuguauguaucuau

SEQ ID NO: 457918 - RNA, 20 nt, Homo sapiens
acauugugggauguucagca

SEQ ID NO: 457919 - RNA, 18 nt, Homo sapiens
acauuuauccaagaccug

SEQ ID NO: 457920 - RNA, 21 nt, Homo sapiens
acauuugggacugucuugaga

SEQ ID NO: 457921 - RNA, 19 nt, Homo sapiens
acauuuguacauuccugau

SEQ ID NO: 457922 - RNA, 21 nt, Homo sapiens
acauuugugcauaaauuucca

SEQ ID NO: 457923 - RNA, 17 nt, Homo sapiens
acauuuucacaacucuu

SEQ ID NO: 457924 - RNA, 14 nt, Homo sapiens
acauuuuguuauag

SEQ ID NO: 457925 - RNA, 22 nt, Homo sapiens
acauuuuguuuauguuacuuaa

SEQ ID NO: 457926 - RNA, 20 nt, Homo sapiens
acauuuuuauuuaguugaaa

SEQ ID NO: 457927 - RNA, 20 nt, Homo sapiens
acauuuuugucuuuaucuca

SEQ ID NO: 457928 - RNA, 23 nt, Homo sapiens
accaaaaauaaaacuuuucaugu

SEQ ID NO: 457929 - RNA, 20 nt, Homo sapiens
accaaaauaauacaacaauc

SEQ ID NO: 457930 - RNA, 12 nt, Homo sapiens
accaaacugugg

SEQ ID NO: 457931 - RNA, 16 nt, Homo sapiens
accaaaugacaaguca

SEQ ID NO: 457932 - RNA, 19 nt, Homo sapiens
accaaauguguaauggaga

SEQ ID NO: 457933 - RNA, 18 nt, Homo sapiens
accaacaccaucacagcu

SEQ ID NO: 457934 - RNA, 14 nt, Homo sapiens
accaaccacugcga

SEQ ID NO: 457935 - RNA, 12 nt, Homo sapiens
accaacugccuu

SEQ ID NO: 457936 - RNA, 18 nt, Homo sapiens
accaacugggcccaagac

SEQ ID NO: 457937 - RNA, 21 nt, Homo sapiens
accaaggaccccucaccuugc

SEQ ID NO: 457938 - RNA, 23 nt, Homo sapiens
accaaguuauaaaucaaugucac

SEQ ID NO: 457939 - RNA, 14 nt, Homo sapiens
accaauccuauguc

SEQ ID NO: 457940 - RNA, 20 nt, Homo sapiens
accaaugugaagacacuaca

SEQ ID NO: 457941 - RNA, 13 nt, Homo sapiens
accaauuagcauu

SEQ ID NO: 457942 - RNA, 19 nt, Homo sapiens
accaauuagcauuccauca

SEQ ID NO: 457943 - RNA, 20 nt, Homo sapiens
accacaaaaauugacucaaa

SEQ ID NO: 457944 - RNA, 17 nt, Homo sapiens
accacaagaaggaugau

SEQ ID NO: 457945 - RNA, 22 nt, Homo sapiens
accacaaggcugaaaagugcuu

SEQ ID NO: 457946 - RNA, 13 nt, Homo sapiens
accacaccaagga

SEQ ID NO: 457947 - RNA, 20 nt, Homo sapiens
accacaccuggcccuugcaa

SEQ ID NO: 457948 - RNA, 21 nt, Homo sapiens
accacaccuggcccuugcaau

SEQ ID NO: 457949 - RNA, 15 nt, Homo sapiens
accacacuucuugaa

SEQ ID NO: 457950 - RNA, 12 nt, Homo sapiens
accacagacugu

SEQ ID NO: 457951 - RNA, 18 nt, Homo sapiens
accacagagccucgggac

SEQ ID NO: 457952 - RNA, 16 nt, Homo sapiens
accacagucuuagggg

SEQ ID NO: 457953 - RNA, 15 nt, Homo sapiens
accacagugucugua

SEQ ID NO: 457954 - RNA, 17 nt, Homo sapiens
accacauccuccgucca

SEQ ID NO: 457955 - RNA, 15 nt, Homo sapiens
accacauccugaaaa

SEQ ID NO: 457956 - RNA, 16 nt, Homo sapiens
accacauccugaaaag

SEQ ID NO: 457957 - RNA, 20 nt, Homo sapiens
accacauccugaaaagggug

SEQ ID NO: 457958 - RNA, 16 nt, Homo sapiens
accaccccuugcccaa

SEQ ID NO: 457959 - RNA, 16 nt, Homo sapiens
accacccuagucccuu

SEQ ID NO: 457960 - RNA, 15 nt, Homo sapiens
accacccugggcaac

SEQ ID NO: 457961 - RNA, 18 nt, Homo sapiens
accacuacaugcagccca

SEQ ID NO: 457962 - RNA, 14 nt, Homo sapiens
accacuaggguccu

SEQ ID NO: 457963 - RNA, 17 nt, Homo sapiens
accacugagcccuugca

SEQ ID NO: 457964 - RNA, 22 nt, Homo sapiens
accacuuuccccgugggccaug

SEQ ID NO: 457965 - RNA, 21 nt, Homo sapiens
accagaaagugaggaagccua

SEQ ID NO: 457966 - RNA, 15 nt, Homo sapiens
accagaagcauuuca

SEQ ID NO: 457967 - RNA, 14 nt, Homo sapiens
aaaaaacucuugau

SEQ ID NO: 457968 - RNA, 18 nt, Homo sapiens
aaaaaagaaaacauucca

SEQ ID NO: 457969 - RNA, 20 nt, Homo sapiens
aaaaaaguguccuauaauuc

SEQ ID NO: 457970 - RNA, 17 nt, Homo sapiens
aaaaaauaacaucucuu

SEQ ID NO: 457971 - RNA, 15 nt, Homo sapiens
acaccuacucuauca

SEQ ID NO: 457972 - RNA, 20 nt, Homo sapiens
acaccucaccagaauugugc

SEQ ID NO: 457973 - RNA, 15 nt, Homo sapiens
acaccucacucauac

SEQ ID NO: 457974 - RNA, 23 nt, Homo sapiens
acaccucaguucccuuggccuca

SEQ ID NO: 457975 - RNA, 22 nt, Homo sapiens
acacggacucccgggccacgcc

SEQ ID NO: 457976 - RNA, 18 nt, Homo sapiens
acacggggcuugcaacuu

SEQ ID NO: 457977 - RNA, 17 nt, Homo sapiens
acacguaccucucauca

SEQ ID NO: 457978 - RNA, 16 nt, Homo sapiens
acacguggguauuuaa

SEQ ID NO: 457979 - RNA, 19 nt, Homo sapiens
acacguuugauuucuuccu

SEQ ID NO: 457980 - RNA, 16 nt, Homo sapiens
acacuaccacauuaaa

SEQ ID NO: 457981 - RNA, 14 nt, Homo sapiens
acacuagacuguau

SEQ ID NO: 457982 - RNA, 20 nt, Homo sapiens
acacucacuccacaacccaa

SEQ ID NO: 457983 - RNA, 19 nt, Homo sapiens
acacucauuaccgucugug

SEQ ID NO: 457984 - RNA, 16 nt, Homo sapiens
acacuccuaaaauugc

SEQ ID NO: 457985 - RNA, 20 nt, Homo sapiens
acacucgccuucugcuucca

SEQ ID NO: 457986 - RNA, 18 nt, Homo sapiens
acacucuagugacuuccu

SEQ ID NO: 457987 - RNA, 15 nt, Homo sapiens
acacucuugguagaa

SEQ ID NO: 457988 - RNA, 17 nt, Homo sapiens
acacugaaucauuaaca

SEQ ID NO: 457989 - RNA, 19 nt, Homo sapiens
acacugacuguugcuguaa

SEQ ID NO: 457990 - RNA, 17 nt, Homo sapiens
acacugagacuugaauc

SEQ ID NO: 457991 - RNA, 23 nt, Homo sapiens
acacugagagggcaaucuuugcc

SEQ ID NO: 457992 - RNA, 12 nt, Homo sapiens
acacugccagug

SEQ ID NO: 457993 - RNA, 18 nt, Homo sapiens
acacugcugcuccagugc

SEQ ID NO: 457994 - RNA, 21 nt, Homo sapiens
acacugcugcuccagugcagg

SEQ ID NO: 457995 - RNA, 22 nt, Homo sapiens
acacugcuucucggaggccagg

SEQ ID NO: 457996 - RNA, 13 nt, Homo sapiens
acacugcuuguga

SEQ ID NO: 457997 - RNA, 16 nt, Homo sapiens
acacuguaaacauuca

SEQ ID NO: 457998 - RNA, 21 nt, Homo sapiens
acacuguaaucuuaaaagugu

SEQ ID NO: 457999 - RNA, 15 nt, Homo sapiens
acacuguacugcaau

SEQ ID NO: 458000 - RNA, 18 nt, Homo sapiens
acacuguauaacauuuaa

SEQ ID NO: 458001 - RNA, 11 nt, Homo sapiens
acacugucaag

SEQ ID NO: 458002 - RNA, 12 nt, Homo sapiens
acacugugacuu

SEQ ID NO: 458003 - RNA, 17 nt, Homo sapiens
acacuguggaacacuaa

SEQ ID NO: 458004 - RNA, 19 nt, Homo sapiens
acacuugacaucaacugca

SEQ ID NO: 458005 - RNA, 23 nt, Homo sapiens
acacuugggauugucuuacuguu

SEQ ID NO: 458006 - RNA, 20 nt, Homo sapiens
acacuugugguauaguauua

SEQ ID NO: 458007 - RNA, 13 nt, Homo sapiens
acacuuucacugg

SEQ ID NO: 458008 - RNA, 13 nt, Homo sapiens
acagaaaaccuca

SEQ ID NO: 458009 - RNA, 16 nt, Homo sapiens
acagaaaagaaauuag

SEQ ID NO: 458010 - RNA, 21 nt, Homo sapiens
acagaaaauaaucugguguuc

SEQ ID NO: 458011 - RNA, 21 nt, Homo sapiens
acagaaaguucuuaaacucag

SEQ ID NO: 458012 - RNA, 16 nt, Homo sapiens
acagaacacacugaga

SEQ ID NO: 458013 - RNA, 21 nt, Homo sapiens
acagaacugcagucagcauga

SEQ ID NO: 458014 - RNA, 13 nt, Homo sapiens
acagaagcaggcu

SEQ ID NO: 458015 - RNA, 17 nt, Homo sapiens
acagaauacaagccacu

SEQ ID NO: 458016 - RNA, 18 nt, Homo sapiens
acagaauacaagccacua

SEQ ID NO: 458017 - RNA, 16 nt, Homo sapiens
acagacacuuacaugg

SEQ ID NO: 458018 - RNA, 20 nt, Homo sapiens
acagaccuaggauuucauga

SEQ ID NO: 458019 - RNA, 22 nt, Homo sapiens
acagacuacauuuucacaacuc

SEQ ID NO: 458020 - RNA, 21 nt, Homo sapiens
acagacuuccaccaugugcau

SEQ ID NO: 458021 - RNA, 14 nt, Homo sapiens
aauugacagggaaa

SEQ ID NO: 458022 - RNA, 21 nt, Homo sapiens
aauugaccuuuugacuuaaag

SEQ ID NO: 458023 - RNA, 23 nt, Homo sapiens
aauugcacacacucagugcagca

SEQ ID NO: 458024 - RNA, 10 nt, Homo sapiens
aauugcucaa

SEQ ID NO: 458025 - RNA, 11 nt, Homo sapiens
aauugcucaag

SEQ ID NO: 458026 - RNA, 16 nt, Homo sapiens
aauugcuccugcaugc

SEQ ID NO: 458027 - RNA, 23 nt, Homo sapiens
aauugcugccuuuucucauucug

SEQ ID NO: 458028 - RNA, 13 nt, Homo sapiens
aauugguguauau

SEQ ID NO: 458029 - RNA, 15 nt, Homo sapiens
aauugucaaauguca

SEQ ID NO: 458030 - RNA, 16 nt, Homo sapiens
aauugugaacagccaa

SEQ ID NO: 458031 - RNA, 19 nt, Homo sapiens
aauugugaucagaccauaa

SEQ ID NO: 458032 - RNA, 12 nt, Homo sapiens
aauugugugaug

SEQ ID NO: 458033 - RNA, 12 nt, Homo sapiens
aauuguuugacc

SEQ ID NO: 458034 - RNA, 18 nt, Homo sapiens
aauuuaaaaucagacucu

SEQ ID NO: 458035 - RNA, 15 nt, Homo sapiens
aauuuaacugcauau

SEQ ID NO: 458036 - RNA, 20 nt, Homo sapiens
aauuuaaggccugcacucuu

SEQ ID NO: 458037 - RNA, 17 nt, Homo sapiens
aauuuacuguugcccau

SEQ ID NO: 458038 - RNA, 21 nt, Homo sapiens
aauuuacuuuuuaaacagugu

SEQ ID NO: 458039 - RNA, 15 nt, Homo sapiens
aauuuagucccuuaa

SEQ ID NO: 458040 - RNA, 15 nt, Homo sapiens
aauuucaaaaugcau

SEQ ID NO: 458041 - RNA, 20 nt, Homo sapiens
aauuuccggccaacaguuaa

SEQ ID NO: 458042 - RNA, 13 nt, Homo sapiens
aauuuccugaugc

SEQ ID NO: 458043 - RNA, 16 nt, Homo sapiens
aauuucuguccagaaa

SEQ ID NO: 458044 - RNA, 24 nt, Homo sapiens
aauuucuuugauuuaacugacuua

SEQ ID NO: 458045 - RNA, 16 nt, Homo sapiens
aauuuggauuuuccac

SEQ ID NO: 458046 - RNA, 18 nt, Homo sapiens
aauuuuaaaaagcagcug

SEQ ID NO: 458047 - RNA, 16 nt, Homo sapiens
aauuuuacaugucuca

SEQ ID NO: 458048 - RNA, 13 nt, Homo sapiens
aauuuuacuucca

SEQ ID NO: 458049 - RNA, 13 nt, Homo sapiens
aauuuuaucucuu

SEQ ID NO: 458050 - RNA, 20 nt, Homo sapiens
aauuuucugaaacugcauaa

SEQ ID NO: 458051 - RNA, 15 nt, Homo sapiens
aauuuugccaaauaa

SEQ ID NO: 458052 - RNA, 19 nt, Homo sapiens
aauuuuguuuguugaugug

SEQ ID NO: 458053 - RNA, 16 nt, Homo sapiens
aauuuuuuccuaccau

SEQ ID NO: 458054 - RNA, 20 nt, Homo sapiens
aauuuuuugauccuguaauc

SEQ ID NO: 458055 - RNA, 21 nt, Homo sapiens
aauuuuuuuccagaauugaga

SEQ ID NO: 458056 - RNA, 23 nt, Homo sapiens
aauuuuuuuuuuuuaacuuuaag

SEQ ID NO: 458057 - RNA, 13 nt, Homo sapiens
acaaaaaauacuu

SEQ ID NO: 458058 - RNA, 15 nt, Homo sapiens
acaaaaacuaaaaac

SEQ ID NO: 458059 - RNA, 15 nt, Homo sapiens
acaaaaacuuuccau

SEQ ID NO: 458060 - RNA, 22 nt, Homo sapiens
acaaaaaucacaaggcauucaa

SEQ ID NO: 458061 - RNA, 17 nt, Homo sapiens
acaaaaccaagccuugg

SEQ ID NO: 458062 - RNA, 16 nt, Homo sapiens
acaaaagcaaagugaa

SEQ ID NO: 458063 - RNA, 22 nt, Homo sapiens
acaaaaggcuuuggcaacagaa

SEQ ID NO: 458064 - RNA, 22 nt, Homo sapiens
acaaaagggguaauugcauucu

SEQ ID NO: 458065 - RNA, 21 nt, Homo sapiens
acaaaauauuucuaagcuuau

SEQ ID NO: 458066 - RNA, 15 nt, Homo sapiens
acaaaaugacuagga

SEQ ID NO: 458067 - RNA, 19 nt, Homo sapiens
acaaacacuuagcauccca

SEQ ID NO: 458068 - RNA, 21 nt, Homo sapiens
acaaaccgagugcaaugaaug

SEQ ID NO: 458069 - RNA, 20 nt, Homo sapiens
acaaacuauuucuauccuga

SEQ ID NO: 458070 - RNA, 12 nt, Homo sapiens
acaaacugcaau

SEQ ID NO: 458071 - RNA, 16 nt, Homo sapiens
acaaagacaaccacug

SEQ ID NO: 458072 - RNA, 13 nt, Homo sapiens
acaaagcauggua

SEQ ID NO: 458073 - RNA, 18 nt, Homo sapiens
acaaagcccuuccauguc

SEQ ID NO: 458074 - RNA, 18 nt, Homo sapiens
acaaagccuuauccagca

SEQ ID NO: 458075 - RNA, 19 nt, Homo sapiens
acaaaggugauuuuccugu

SEQ ID NO: 458076 - RNA, 21 nt, Homo sapiens
aaugcauuuaaacucauuuga

SEQ ID NO: 458077 - RNA, 13 nt, Homo sapiens
aaugccacaaaac

SEQ ID NO: 458078 - RNA, 20 nt, Homo sapiens
aaugccagaaggauaauauu

SEQ ID NO: 458079 - RNA, 23 nt, Homo sapiens
aaugccaguuccagcuucaucua

SEQ ID NO: 458080 - RNA, 21 nt, Homo sapiens
aaugcccucaggggacuugaa

SEQ ID NO: 458081 - RNA, 22 nt, Homo sapiens
aaugcccucaggggacuugaau

SEQ ID NO: 458082 - RNA, 23 nt, Homo sapiens
aaugcccuuccagugggacccca

SEQ ID NO: 458083 - RNA, 16 nt, Homo sapiens
aaugccugguaccaga

SEQ ID NO: 458084 - RNA, 15 nt, Homo sapiens
aaugcgguucagggc

SEQ ID NO: 458085 - RNA, 17 nt, Homo sapiens
aaugcuagcacaauauu

SEQ ID NO: 458086 - RNA, 21 nt, Homo sapiens
aaugcuagcacaauauuccua

SEQ ID NO: 458087 - RNA, 14 nt, Homo sapiens
aaugcuauggacug

SEQ ID NO: 458088 - RNA, 22 nt, Homo sapiens
aaugcuccauuaauccagggaa

SEQ ID NO: 458089 - RNA, 22 nt, Homo sapiens
aaugcugcacaccaguuacugu

SEQ ID NO: 458090 - RNA, 17 nt, Homo sapiens
aaugcuggcauuugcac

SEQ ID NO: 458091 - RNA, 20 nt, Homo sapiens
aaugcuguaccuuucugaca

SEQ ID NO: 458092 - RNA, 18 nt, Homo sapiens
aaugcugugguugauauu

SEQ ID NO: 458093 - RNA, 13 nt, Homo sapiens
aaugcuuuuacua

SEQ ID NO: 458094 - RNA, 23 nt, Homo sapiens
aaugcuuuucuaaucugcagugg

SEQ ID NO: 458095 - RNA, 14 nt, Homo sapiens
aauggaaccaaaua

SEQ ID NO: 458096 - RNA, 14 nt, Homo sapiens
aauggaaucauaua

SEQ ID NO: 458097 - RNA, 14 nt, Homo sapiens
aauggacugggaaa

SEQ ID NO: 458098 - RNA, 13 nt, Homo sapiens
aauggacuugcuu

SEQ ID NO: 458099 - RNA, 19 nt, Homo sapiens
aauggauccuugucaguug

SEQ ID NO: 458100 - RNA, 19 nt, Homo sapiens
aauggaucuuaaagcauuc

SEQ ID NO: 458101 - RNA, 15 nt, Homo sapiens
aauggaugacaaaga

SEQ ID NO: 458102 - RNA, 21 nt, Homo sapiens
aauggaugcucauucauauuc

SEQ ID NO: 458103 - RNA, 22 nt, Homo sapiens
aauggcaacaaacacauuguga

SEQ ID NO: 458104 - RNA, 19 nt, Homo sapiens
aauggcaccuucauucucc

SEQ ID NO: 458105 - RNA, 16 nt, Homo sapiens
aauggcagaaccaaag

SEQ ID NO: 458106 - RNA, 18 nt, Homo sapiens
aauggcagcauacacaga

SEQ ID NO: 458107 - RNA, 20 nt, Homo sapiens
aauggccuaaacuucagagg

SEQ ID NO: 458108 - RNA, 15 nt, Homo sapiens
aauggcuaguacugu

SEQ ID NO: 458109 - RNA, 18 nt, Homo sapiens
aauggcucaucaacaauc

SEQ ID NO: 458110 - RNA, 20 nt, Homo sapiens
aauggcucaucaacaaucac

SEQ ID NO: 458111 - RNA, 15 nt, Homo sapiens
aaugggagacggggg

SEQ ID NO: 458112 - RNA, 15 nt, Homo sapiens
aauggggaauucucu

SEQ ID NO: 458113 - RNA, 20 nt, Homo sapiens
aauggguuuuguguacugua

SEQ ID NO: 458114 - RNA, 23 nt, Homo sapiens
aaugguaaccgagccagcagcug

SEQ ID NO: 458115 - RNA, 18 nt, Homo sapiens
aaugguguuguaugccuu

SEQ ID NO: 458116 - RNA, 20 nt, Homo sapiens
aaugguuuucuaauaucuua

SEQ ID NO: 458117 - RNA, 23 nt, Homo sapiens
aauguaucuuauuuauauaugaa

SEQ ID NO: 458118 - RNA, 23 nt, Homo sapiens
aauguaugugcacugucacuuug

SEQ ID NO: 458119 - RNA, 21 nt, Homo sapiens
aauguauuuaaccagucuucu

SEQ ID NO: 458120 - RNA, 16 nt, Homo sapiens
aaugucagaaaccagu

SEQ ID NO: 458121 - RNA, 13 nt, Homo sapiens
aaugucagcacau

SEQ ID NO: 458122 - RNA, 16 nt, Homo sapiens
aaugucagcacauguu

SEQ ID NO: 458123 - RNA, 12 nt, Homo sapiens
aaugucaucucu

SEQ ID NO: 458124 - RNA, 13 nt, Homo sapiens
aauguccauuuau

SEQ ID NO: 458125 - RNA, 13 nt, Homo sapiens
aaugucuaagaua

SEQ ID NO: 458126 - RNA, 13 nt, Homo sapiens
aaugucuguuuca

SEQ ID NO: 458127 - RNA, 23 nt, Homo sapiens
aaugugacuugagcccagaguga

SEQ ID NO: 458128 - RNA, 18 nt, Homo sapiens
aaugugauauguguaaua

SEQ ID NO: 458129 - RNA, 15 nt, Homo sapiens
aauguggaugcucuu

SEQ ID NO: 458130 - RNA, 17 nt, Homo sapiens
aauguggauucuuccca

SEQ ID NO: 458131 - RNA, 19 nt, Homo sapiens
aauguggcauuugugauca

SEQ ID NO: 458132 - RNA, 18 nt, Homo sapiens
aaugugggaagaaacaaa

SEQ ID NO: 458133 - RNA, 15 nt, Homo sapiens
aaugugguggcaaua

SEQ ID NO: 458134 - RNA, 21 nt, Homo sapiens
aauguguauauggugauucaa

SEQ ID NO: 458135 - RNA, 12 nt, Homo sapiens
aaugugucacua

SEQ ID NO: 458136 - RNA, 16 nt, Homo sapiens
aauauaaacugugaga

SEQ ID NO: 458137 - RNA, 16 nt, Homo sapiens
aauauaauuugaucuu

SEQ ID NO: 458138 - RNA, 14 nt, Homo sapiens
aauauacauucaaa

SEQ ID NO: 458139 - RNA, 18 nt, Homo sapiens
aauauacuaaccauuucu

SEQ ID NO: 458140 - RNA, 21 nt, Homo sapiens
aauauaggguuuguuugcugc

SEQ ID NO: 458141 - RNA, 19 nt, Homo sapiens
aauauauguuuggcugaaa

SEQ ID NO: 458142 - RNA, 20 nt, Homo sapiens
aauaucaaaaaggagcucuu

SEQ ID NO: 458143 - RNA, 22 nt, Homo sapiens
aauaucaaaaaggagcucuucu

SEQ ID NO: 458144 - RNA, 17 nt, Homo sapiens
aauaucaagcagugaaa

SEQ ID NO: 458145 - RNA, 21 nt, Homo sapiens
aauaucccagagaacaaucac

SEQ ID NO: 458146 - RNA, 20 nt, Homo sapiens
aauaucucaauuaccaauau

SEQ ID NO: 458147 - RNA, 14 nt, Homo sapiens
aauaucugcuguau

SEQ ID NO: 458148 - RNA, 19 nt, Homo sapiens
aauaucugggauucuacuu

SEQ ID NO: 458149 - RNA, 20 nt, Homo sapiens
aauaugacggaagaacauag

SEQ ID NO: 458150 - RNA, 22 nt, Homo sapiens
aauaugaggggacugcaugcaa

SEQ ID NO: 458151 - RNA, 18 nt, Homo sapiens
aauaugauuuuauuugac

SEQ ID NO: 458152 - RNA, 18 nt, Homo sapiens
aauauggaacauaugcac

SEQ ID NO: 458153 - RNA, 11 nt, Homo sapiens
aauaugggagg

SEQ ID NO: 458154 - RNA, 13 nt, Homo sapiens
aauaugucuucau

SEQ ID NO: 458155 - RNA, 12 nt, Homo sapiens
aauauuacuuua

SEQ ID NO: 458156 - RNA, 13 nt, Homo sapiens
aauauuaucuuug

SEQ ID NO: 458157 - RNA, 16 nt, Homo sapiens
aauauuauguguuucc

SEQ ID NO: 458158 - RNA, 21 nt, Homo sapiens
aauauuccuaugcugcaauac

SEQ ID NO: 458159 - RNA, 22 nt, Homo sapiens
aauauugcuuuggucauaugag

SEQ ID NO: 458160 - RNA, 23 nt, Homo sapiens
aauauuguucuauuuguauauau

SEQ ID NO: 458161 - RNA, 15 nt, Homo sapiens
aauauuuaaugaugu

SEQ ID NO: 458162 - RNA, 20 nt, Homo sapiens
aauauuuauguuuaagugcu

SEQ ID NO: 458163 - RNA, 20 nt, Homo sapiens
aauauuuauuaccucugaua

SEQ ID NO: 458164 - RNA, 13 nt, Homo sapiens
aauauuucacuua

SEQ ID NO: 458165 - RNA, 19 nt, Homo sapiens
aauauuuuaaacuacugau

SEQ ID NO: 458166 - RNA, 17 nt, Homo sapiens
aauauuuuagauuacag

SEQ ID NO: 458167 - RNA, 15 nt, Homo sapiens
aauauuuuaucuuuc

SEQ ID NO: 458168 - RNA, 17 nt, Homo sapiens
aauauuuuuuucuagcu

SEQ ID NO: 458169 - RNA, 21 nt, Homo sapiens
aauauuuuuuucuagcuauaa

SEQ ID NO: 458170 - RNA, 13 nt, Homo sapiens
aaucaaauagcau

SEQ ID NO: 458171 - RNA, 17 nt, Homo sapiens
aaucaacagcaugucua

SEQ ID NO: 458172 - RNA, 22 nt, Homo sapiens
aaucaacccaauaauucuguau

SEQ ID NO: 458173 - RNA, 17 nt, Homo sapiens
aaucaauaaacuguguc

SEQ ID NO: 458174 - RNA, 20 nt, Homo sapiens
aaucaaucuggcuucugcau

SEQ ID NO: 458175 - RNA, 16 nt, Homo sapiens
aaucacaccucugggc

SEQ ID NO: 458176 - RNA, 20 nt, Homo sapiens
aaucaccuaauuaauuucag

SEQ ID NO: 458177 - RNA, 18 nt, Homo sapiens
aaucacgccgcaugcaca

SEQ ID NO: 458178 - RNA, 19 nt, Homo sapiens
aaucacuauugcuuccuaa

SEQ ID NO: 458179 - RNA, 21 nt, Homo sapiens
aaucagaaaccccacuuccau

SEQ ID NO: 458180 - RNA, 14 nt, Homo sapiens
aaucagcauucuca

SEQ ID NO: 458181 - RNA, 15 nt, Homo sapiens
aaucagccacauucu

SEQ ID NO: 458182 - RNA, 15 nt, Homo sapiens
aaucagccuggccau

SEQ ID NO: 458183 - RNA, 23 nt, Homo sapiens
aaucagugugucuaaauuugaau

SEQ ID NO: 458184 - RNA, 11 nt, Homo sapiens
aaucaguuugc

SEQ ID NO: 458185 - RNA, 18 nt, Homo sapiens
aaucauacuguaaggaaa

SEQ ID NO: 458186 - RNA, 19 nt, Homo sapiens
aaucauauaauaaauguac

SEQ ID NO: 458187 - RNA, 16 nt, Homo sapiens
aaucaugcccugccuu

SEQ ID NO: 458188 - RNA, 23 nt, Homo sapiens
aaucauugauugucagcuacuaa

SEQ ID NO: 458189 - RNA, 17 nt, Homo sapiens
aaucauuggaauuccuu

SEQ ID NO: 458190 - RNA, 18 nt, Homo sapiens
aaucauugugugucuuca

SEQ ID NO: 458191 - RNA, 22 nt, Homo sapiens
aaucauuuauuuacaugugauu

SEQ ID NO: 458192 - RNA, 15 nt, Homo sapiens
aauccaaaugcauuc

SEQ ID NO: 458193 - RNA, 15 nt, Homo sapiens
aauccaagccuaaaa

SEQ ID NO: 458194 - RNA, 17 nt, Homo sapiens
aauccaagcugcucauu

SEQ ID NO: 458195 - RNA, 19 nt, Homo sapiens
aauccacauugccagugac

SEQ ID NO: 458196 - RNA, 11 nt, Homo sapiens
aauccagcucc

SEQ ID NO: 458197 - RNA, 23 nt, Homo sapiens
aauccaugugcugcuguggcauc

SEQ ID NO: 458198 - RNA, 14 nt, Homo sapiens
aaucccagcacuuu

SEQ ID NO: 458199 - RNA, 15 nt, Homo sapiens
aaucccagcacuuug

SEQ ID NO: 458200 - RNA, 22 nt, Homo sapiens
aauccccccagggcugggcacu

SEQ ID NO: 458201 - RNA, 13 nt, Homo sapiens
aaaggugacuggg

SEQ ID NO: 458202 - RNA, 17 nt, Homo sapiens
aaagguuaacaguaaaa

SEQ ID NO: 458203 - RNA, 15 nt, Homo sapiens
aaagguuaagccaua

SEQ ID NO: 458204 - RNA, 16 nt, Homo sapiens
aaaguaaagaaaugca

SEQ ID NO: 458205 - RNA, 22 nt, Homo sapiens
aaaguaaguggagcauuuggaa

SEQ ID NO: 458206 - RNA, 13 nt, Homo sapiens
aaaguacaaagca

SEQ ID NO: 458207 - RNA, 18 nt, Homo sapiens
aaaguacccugugcucaa

SEQ ID NO: 458208 - RNA, 19 nt, Homo sapiens
aaaguacguguuuacuugg

SEQ ID NO: 458209 - RNA, 14 nt, Homo sapiens
aaaguagacuucau

SEQ ID NO: 458210 - RNA, 12 nt, Homo sapiens
aaaguagcaauu

SEQ ID NO: 458211 - RNA, 17 nt, Homo sapiens
aaaguauaacuuauuca

SEQ ID NO: 458212 - RNA, 19 nt, Homo sapiens
aaagugcuaguauuauggg

SEQ ID NO: 458213 - RNA, 22 nt, Homo sapiens
aaaguguacaauuuucauccca

SEQ ID NO: 458214 - RNA, 15 nt, Homo sapiens
aaaguuaaacgugau

SEQ ID NO: 458215 - RNA, 19 nt, Homo sapiens
aaaguuacuugaauuucaa

SEQ ID NO: 458216 - RNA, 23 nt, Homo sapiens
aaaguucccuacuuccugugacu

SEQ ID NO: 458217 - RNA, 21 nt, Homo sapiens
aaaguucucccugccauccuu

SEQ ID NO: 458218 - RNA, 21 nt, Homo sapiens
aaaguucuuaggcaccauaga

SEQ ID NO: 458219 - RNA, 22 nt, Homo sapiens
aaaguucuuucucguggguaaa

SEQ ID NO: 458220 - RNA, 14 nt, Homo sapiens
aaaguuuacaacau

SEQ ID NO: 458221 - RNA, 13 nt, Homo sapiens
aaaguuugcucaa

SEQ ID NO: 458222 - RNA, 14 nt, Homo sapiens
aaaguuugcucaag

SEQ ID NO: 458223 - RNA, 17 nt, Homo sapiens
aaaguuugggaagggau

SEQ ID NO: 458224 - RNA, 22 nt, Homo sapiens
aaaguuuguucugcagagacuu

SEQ ID NO: 458225 - RNA, 15 nt, Homo sapiens
aaaguuuuaaccuca

SEQ ID NO: 458226 - RNA, 18 nt, Homo sapiens
aaaguuuuccaguauuga

SEQ ID NO: 458227 - RNA, 16 nt, Homo sapiens
aaaguuuuuacagugu

SEQ ID NO: 458228 - RNA, 14 nt, Homo sapiens
aaauaaaaauauuc

SEQ ID NO: 458229 - RNA, 19 nt, Homo sapiens
aaauaaaaauauuguguug

SEQ ID NO: 458230 - RNA, 20 nt, Homo sapiens
aaauaaaaucuaauuaauuc

SEQ ID NO: 458231 - RNA, 19 nt, Homo sapiens
aaauaaacacauagauuca

SEQ ID NO: 458232 - RNA, 23 nt, Homo sapiens
aaauaaacacuagacuguaucac

SEQ ID NO: 458233 - RNA, 21 nt, Homo sapiens
aaauaagaauugaaugucaau

SEQ ID NO: 458234 - RNA, 16 nt, Homo sapiens
aaauaaguaacauaua

SEQ ID NO: 458235 - RNA, 14 nt, Homo sapiens
aaauaauaauagua

SEQ ID NO: 458236 - RNA, 21 nt, Homo sapiens
aaauaauagacagcaaucaaa

SEQ ID NO: 458237 - RNA, 15 nt, Homo sapiens
aaauaauauccaccu

SEQ ID NO: 458238 - RNA, 12 nt, Homo sapiens
aaauaauaugca

SEQ ID NO: 458239 - RNA, 12 nt, Homo sapiens
aaauaaugauuu

SEQ ID NO: 458240 - RNA, 13 nt, Homo sapiens
aaauaauuguaug

SEQ ID NO: 458241 - RNA, 11 nt, Homo sapiens
aaauacaauaa

SEQ ID NO: 458242 - RNA, 14 nt, Homo sapiens
aaauacacaaugaa

SEQ ID NO: 458243 - RNA, 14 nt, Homo sapiens
aaauacagcacuuu

SEQ ID NO: 458244 - RNA, 23 nt, Homo sapiens
aaauacagugcuuuauggcucua

SEQ ID NO: 458245 - RNA, 23 nt, Homo sapiens
aaauacuauuggacagacacaga

SEQ ID NO: 458246 - RNA, 16 nt, Homo sapiens
aaauacucagcaacug

SEQ ID NO: 458247 - RNA, 16 nt, Homo sapiens
aaauacuguaacacug

SEQ ID NO: 458248 - RNA, 19 nt, Homo sapiens
aaauacuucuugaagccga

SEQ ID NO: 458249 - RNA, 22 nt, Homo sapiens
aaauagagcuuuuaaaaauguc

SEQ ID NO: 458250 - RNA, 14 nt, Homo sapiens
aaauagcaucugcu

SEQ ID NO: 458251 - RNA, 19 nt, Homo sapiens
aaauaguaagccucccucc

SEQ ID NO: 458252 - RNA, 21 nt, Homo sapiens
aaauaguaccuucaauacuua

SEQ ID NO: 458253 - RNA, 19 nt, Homo sapiens
aaauauaaacugugagaua

SEQ ID NO: 458254 - RNA, 14 nt, Homo sapiens
aaauauacauucaa

SEQ ID NO: 458255 - RNA, 14 nt, Homo sapiens
aaauauaguuugag

SEQ ID NO: 458256 - RNA, 21 nt, Homo sapiens
aaauaucauuauagcauguaa

SEQ ID NO: 458257 - RNA, 22 nt, Homo sapiens
aaauaucauucuuuguaucuua

SEQ ID NO: 458258 - RNA, 17 nt, Homo sapiens
aaauauccaaagacugu

SEQ ID NO: 458259 - RNA, 19 nt, Homo sapiens
aaauauccaaagacuguac

SEQ ID NO: 458260 - RNA, 11 nt, Homo sapiens
aaauaucucaa

SEQ ID NO: 458261 - RNA, 22 nt, Homo sapiens
aaauaugagaugcguuguuaca

SEQ ID NO: 458262 - RNA, 19 nt, Homo sapiens
aaauauuagaagccugcag

SEQ ID NO: 458263 - RNA, 21 nt, Homo sapiens
aaauauugcuuggacuaccua

SEQ ID NO: 458264 - RNA, 16 nt, Homo sapiens
aaaucaaauauauguc

SEQ ID NO: 458265 - RNA, 13 nt, Homo sapiens
aaaucacucucag

SEQ ID NO: 458266 - RNA, 16 nt, Homo sapiens
aaaucacucucagugc

SEQ ID NO: 458267 - RNA, 23 nt, Homo sapiens
aaaucagagcagugauucucucu

SEQ ID NO: 458268 - RNA, 12 nt, Homo sapiens
aaaucagccuaa

SEQ ID NO: 458269 - RNA, 14 nt, Homo sapiens
aaaucagucucaca

SEQ ID NO: 458270 - RNA, 12 nt, Homo sapiens
aaaucauugugu

SEQ ID NO: 458271 - RNA, 19 nt, Homo sapiens
aaaucauugugugucuuca

SEQ ID NO: 458272 - RNA, 16 nt, Homo sapiens
aaauccacaagccauu

SEQ ID NO: 458273 - RNA, 22 nt, Homo sapiens
aaaucccaguucauguugcuca

SEQ ID NO: 458274 - RNA, 15 nt, Homo sapiens
aaaucccccaccucc

SEQ ID NO: 458275 - RNA, 16 nt, Homo sapiens
aaauccccuccccaaa

SEQ ID NO: 458276 - RNA, 17 nt, Homo sapiens
aaauccuagacuugaaa

SEQ ID NO: 458277 - RNA, 23 nt, Homo sapiens
aaauccucagguaguacugggaa

SEQ ID NO: 458278 - RNA, 13 nt, Homo sapiens
aaaucuagaucaa

SEQ ID NO: 458279 - RNA, 23 nt, Homo sapiens
aaaucucuucuuugcugcaguca

SEQ ID NO: 458280 - RNA, 20 nt, Homo sapiens
aaaucuggggaggacaaagg

SEQ ID NO: 458281 - RNA, 14 nt, Homo sapiens
aaaucuugcaacug

SEQ ID NO: 458282 - RNA, 20 nt, Homo sapiens
aaaucuuuaagaauaguucu

SEQ ID NO: 458283 - RNA, 22 nt, Homo sapiens
aaaucuuucagaauacaauuca

SEQ ID NO: 458284 - RNA, 19 nt, Homo sapiens
aaaucuuuuaaaaauucaa

SEQ ID NO: 458285 - RNA, 16 nt, Homo sapiens
aaaugaaauacuugac

SEQ ID NO: 458286 - RNA, 12 nt, Homo sapiens
aaaugaacacau

SEQ ID NO: 458287 - RNA, 24 nt, Homo sapiens
aaaugaauagccaggccugaccuc

SEQ ID NO: 458288 - RNA, 14 nt, Homo sapiens
aaaugacaaaaagc

SEQ ID NO: 458289 - RNA, 20 nt, Homo sapiens
aaaugacugucccauucucc

SEQ ID NO: 458290 - RNA, 14 nt, Homo sapiens
aaaugaugccccag

SEQ ID NO: 458291 - RNA, 20 nt, Homo sapiens
aaaugaugccccagagcucu

SEQ ID NO: 458292 - RNA, 17 nt, Homo sapiens
aaaaugagauucaguga

SEQ ID NO: 458293 - RNA, 23 nt, Homo sapiens
aaaaugagugacuagacguucau

SEQ ID NO: 458294 - RNA, 21 nt, Homo sapiens
aaaaugaucuaguuccugaua

SEQ ID NO: 458295 - RNA, 16 nt, Homo sapiens
aaaaugauggaaugac

SEQ ID NO: 458296 - RNA, 11 nt, Homo sapiens
aaaaugcaugu

SEQ ID NO: 458297 - RNA, 23 nt, Homo sapiens
aaaaugccaaaacuuaccuauaa

SEQ ID NO: 458298 - RNA, 15 nt, Homo sapiens
aaaauggaacauuaa

SEQ ID NO: 458299 - RNA, 17 nt, Homo sapiens
aaaaugguuuguccuga

SEQ ID NO: 458300 - RNA, 14 nt, Homo sapiens
aaaauguacucagc

SEQ ID NO: 458301 - RNA, 23 nt, Homo sapiens
aaaauguacucagcuaucagcuc

SEQ ID NO: 458302 - RNA, 23 nt, Homo sapiens
aaaaugucuaagauaguaacaau

SEQ ID NO: 458303 - RNA, 16 nt, Homo sapiens
aaaaugucuguuucaa

SEQ ID NO: 458304 - RNA, 20 nt, Homo sapiens
aaaaugugucugcaacaugg

SEQ ID NO: 458305 - RNA, 16 nt, Homo sapiens
aaaaugugucuguaag

SEQ ID NO: 458306 - RNA, 20 nt, Homo sapiens
aaaauucucagaggacuugg

SEQ ID NO: 458307 - RNA, 17 nt, Homo sapiens
aaaauugugaucagacc

SEQ ID NO: 458308 - RNA, 19 nt, Homo sapiens
aaaauuguguccacauaau

SEQ ID NO: 458309 - RNA, 16 nt, Homo sapiens
aaaauuugagacuauu

SEQ ID NO: 458310 - RNA, 18 nt, Homo sapiens
aaaauuuguuuugacgga

SEQ ID NO: 458311 - RNA, 16 nt, Homo sapiens
aaaauuuuaguccaaa

SEQ ID NO: 458312 - RNA, 14 nt, Homo sapiens
aaacaaauaugcaa

SEQ ID NO: 458313 - RNA, 14 nt, Homo sapiens
aaacaacaugccau

SEQ ID NO: 458314 - RNA, 16 nt, Homo sapiens
aaacaacuuucucuug

SEQ ID NO: 458315 - RNA, 19 nt, Homo sapiens
aaacaagacugccucccuc

SEQ ID NO: 458316 - RNA, 20 nt, Homo sapiens
aaacaauggccugguucaau

SEQ ID NO: 458317 - RNA, 22 nt, Homo sapiens
aaacacaaauagaacauuccau

SEQ ID NO: 458318 - RNA, 19 nt, Homo sapiens
aaacacacuuuugcacaua

SEQ ID NO: 458319 - RNA, 20 nt, Homo sapiens
aaacacagaacucagccuua

SEQ ID NO: 458320 - RNA, 13 nt, Homo sapiens
aaacaccaaaaau

SEQ ID NO: 458321 - RNA, 16 nt, Homo sapiens
aaacacuagacuguau

SEQ ID NO: 458322 - RNA, 16 nt, Homo sapiens
aaacacucgugugcau

SEQ ID NO: 458323 - RNA, 21 nt, Homo sapiens
aaacagauaacaccaaaccaa

SEQ ID NO: 458324 - RNA, 13 nt, Homo sapiens
aaacagcaaaagu

SEQ ID NO: 458325 - RNA, 20 nt, Homo sapiens
aaacagcagauuucagauca

SEQ ID NO: 458326 - RNA, 14 nt, Homo sapiens
aaacagcaguccca

SEQ ID NO: 458327 - RNA, 16 nt, Homo sapiens
aaacagcuugaugcug

SEQ ID NO: 458328 - RNA, 22 nt, Homo sapiens
aaacaguguggcuuaaacauuu

SEQ ID NO: 458329 - RNA, 14 nt, Homo sapiens
aaacauaauaucuu

SEQ ID NO: 458330 - RNA, 19 nt, Homo sapiens
aaacauaauaucuugaaga

SEQ ID NO: 458331 - RNA, 13 nt, Homo sapiens
aaacauacguucu

SEQ ID NO: 458332 - RNA, 16 nt, Homo sapiens
aaacaugauuguuuac

SEQ ID NO: 458333 - RNA, 17 nt, Homo sapiens
aaacaugauuguuuaca

SEQ ID NO: 458334 - RNA, 24 nt, Homo sapiens
aaacaugcuaaauaguucuaucag

SEQ ID NO: 458335 - RNA, 23 nt, Homo sapiens
aaacauucacacagggcucuuug

SEQ ID NO: 458336 - RNA, 15 nt, Homo sapiens
aaacauuccaggaaa

SEQ ID NO: 458337 - RNA, 15 nt, Homo sapiens
aaacauuccugugaa

SEQ ID NO: 458338 - RNA, 18 nt, Homo sapiens
aaacauucuuuaacauac

SEQ ID NO: 458339 - RNA, 12 nt, Homo sapiens
aaaccaaaaaua

SEQ ID NO: 458340 - RNA, 19 nt, Homo sapiens
aaaccaagccguggcuucc

SEQ ID NO: 458341 - RNA, 14 nt, Homo sapiens
aaaccaggagcauu

SEQ ID NO: 458342 - RNA, 13 nt, Homo sapiens
aaaccaugacugu

SEQ ID NO: 458343 - RNA, 23 nt, Homo sapiens
aaacccacgcguguucugaaggu

SEQ ID NO: 458344 - RNA, 16 nt, Homo sapiens
aaacccaguaauucua

SEQ ID NO: 458345 - RNA, 17 nt, Homo sapiens
aaaccccagccacuucc

SEQ ID NO: 458346 - RNA, 13 nt, Homo sapiens
aaaccccgucucu

SEQ ID NO: 458347 - RNA, 22 nt, Homo sapiens
aaaccccuccagaacucccacc

SEQ ID NO: 458348 - RNA, 15 nt, Homo sapiens
aaaccgagugcaaug

SEQ ID NO: 458349 - RNA, 15 nt, Homo sapiens
aaaccuaacuugcgc

SEQ ID NO: 458350 - RNA, 21 nt, Homo sapiens
aaaccucaagggcuuucccac

SEQ ID NO: 458351 - RNA, 21 nt, Homo sapiens
aaaccugagcagcaacugugu

SEQ ID NO: 458352 - RNA, 16 nt, Homo sapiens
aaaccuguuucugcag

SEQ ID NO: 458353 - RNA, 21 nt, Homo sapiens
aaaccuugcuaauuuucucaa

SEQ ID NO: 458354 - RNA, 15 nt, Homo sapiens
aaacgagauuugcca

SEQ ID NO: 458355 - RNA, 21 nt, Homo sapiens
aaacgaggcaaugacugugag

SEQ ID NO: 458356 - RNA, 17 nt, Homo sapiens
aaacgcgaccuuggccg

SEQ ID NO: 458357 - RNA, 15 nt, Homo sapiens
aaacguuucaguaau

SEQ ID NO: 458358 - RNA, 16 nt, Homo sapiens
aaacuaaaagacauuu

SEQ ID NO: 458359 - RNA, 14 nt, Homo sapiens
aaacucacaacucu

SEQ ID NO: 458360 - RNA, 15 nt, Homo sapiens
aaacucaccauuuca

SEQ ID NO: 458361 - RNA, 13 nt, Homo sapiens
aaacuccacaggg

SEQ ID NO: 458362 - RNA, 15 nt, Homo sapiens
aaacucuauggguau

SEQ ID NO: 458363 - RNA, 21 nt, Homo sapiens
aaacugacaguaaaucucaca

SEQ ID NO: 458364 - RNA, 19 nt, Homo sapiens
aaacugauuacaacugcua

SEQ ID NO: 458365 - RNA, 22 nt, Homo sapiens
aaacugauuacaacugcuacag

SEQ ID NO: 458366 - RNA, 17 nt, Homo sapiens
aaacugccugaaagcaa

SEQ ID NO: 458367 - RNA, 21 nt, Homo sapiens
aaacugggggcucuguauaua

SEQ ID NO: 458368 - RNA, 15 nt, Homo sapiens
aaacuguacaguuuc

SEQ ID NO: 458369 - RNA, 16 nt, Homo sapiens
aaacugucauuuagcu

SEQ ID NO: 458370 - RNA, 12 nt, Homo sapiens
aaacugugagau

SEQ ID NO: 458371 - RNA, 16 nt, Homo sapiens
aaacugugucuguccc

SEQ ID NO: 458372 - RNA, 19 nt, Homo sapiens
aaacuuauuugagugauua

SEQ ID NO: 458373 - RNA, 16 nt, Homo sapiens
aaacuucagaugacaa

SEQ ID NO: 458374 - RNA, 13 nt, Homo sapiens
aaacuucagggau

SEQ ID NO: 458375 - RNA, 15 nt, Homo sapiens
aaacuuccacuaccu

SEQ ID NO: 458376 - RNA, 15 nt, Homo sapiens
aaacuugcuuaucaa

SEQ ID NO: 458377 - RNA, 16 nt, Homo sapiens
aaacuugggucucuua

SEQ ID NO: 458378 - RNA, 23 nt, Homo sapiens
aaacuuuaggguaaaaauugcca

SEQ ID NO: 458379 - RNA, 20 nt, Homo sapiens
aaacuuuuauuguaaaugag

SEQ ID NO: 458380 - RNA, 19 nt, Homo sapiens
aaagaaaaacaaguuugcu

SEQ ID NO: 458381 - RNA, 15 nt, Homo sapiens
aaagaaaacauucca

SEQ ID NO: 458382 - RNA, 20 nt, Homo sapiens
aaagaaauccauaucuuaaa

SEQ ID NO: 458383 - RNA, 12 nt, Homo sapiens
aaagaacauacc

SEQ ID NO: 458384 - RNA, 19 nt, Homo sapiens
aaagaaccccccuccccaa

SEQ ID NO: 458385 - RNA, 16 nt, Homo sapiens
aaagaacgugaucucc

SEQ ID NO: 458386 - RNA, 23 nt, Homo sapiens
aaagaacucaaaaggagaacugu

SEQ ID NO: 458387 - RNA, 19 nt, Homo sapiens
aaagaacuuuagcauggua

SEQ ID NO: 458388 - RNA, 14 nt, Homo sapiens
aaagaagacuggaa

SEQ ID NO: 458389 - RNA, 16 nt, Homo sapiens
aaagaagauucugugg

SEQ ID NO: 458390 - RNA, 17 nt, Homo sapiens
aaagaauaaaguccaaa

SEQ ID NO: 458391 - RNA, 16 nt, Homo sapiens
aaagaauagugccuca

SEQ ID NO: 458392 - RNA, 17 nt, Homo sapiens
aaagacauucuuccaaa

SEQ ID NO: 458393 - RNA, 19 nt, Homo sapiens
aaagacauucuuccaaaaa

SEQ ID NO: 458394 - RNA, 21 nt, Homo sapiens
aaagacauucuuccaaaaaga

SEQ ID NO: 458395 - RNA, 15 nt, Homo sapiens
aaagacugagucaag

SEQ ID NO: 458396 - RNA, 13 nt, Homo sapiens
aaagagacaggga

SEQ ID NO: 458397 - RNA, 19 nt, Homo sapiens
aaagagagucgcaucucag

SEQ ID NO: 458398 - RNA, 19 nt, Homo sapiens
aaagagcacuucacacaga

SEQ ID NO: 458399 - RNA, 14 nt, Homo sapiens
aaagagcuaggaaa

SEQ ID NO: 458400 - RNA, 15 nt, Homo sapiens
aaagaggugcugcuu

SEQ ID NO: 458401 - RNA, 14 nt, Homo sapiens
aaagaguaacacug

SEQ ID NO: 458402 - RNA, 22 nt, Homo sapiens
aaagaguugcaguaaaguucca

SEQ ID NO: 458403 - RNA, 12 nt, Homo sapiens
aaagauacuuga

SEQ ID NO: 458404 - RNA, 12 nt, Homo sapiens
aaagauaucuau

SEQ ID NO: 458405 - RNA, 20 nt, Homo sapiens
aaagaugcagccgccuuccu

SEQ ID NO: 458406 - RNA, 15 nt, Homo sapiens
aaagaugcccacuga

SEQ ID NO: 458407 - RNA, 16 nt, Homo sapiens
aaagauguacugagag

SEQ ID NO: 458408 - RNA, 15 nt, Homo sapiens
aaagauuauccuguu

SEQ ID NO: 458409 - RNA, 21 nt, Homo sapiens
aaagauuauccuguuacugaa

SEQ ID NO: 458410 - RNA, 14 nt, Homo sapiens
aaagauucaaagcu

SEQ ID NO: 458411 - RNA, 17 nt, Homo sapiens
aaagauucuacaaagcu

SEQ ID NO: 458412 - RNA, 22 nt, Homo sapiens
aaagauucuuuaaacuacugaa

SEQ ID NO: 458413 - RNA, 15 nt, Homo sapiens
aaagauuuucagaaa

SEQ ID NO: 458414 - RNA, 20 nt, Homo sapiens
aaagcaagacuguugcucaa

SEQ ID NO: 458415 - RNA, 19 nt, Homo sapiens
aaagcacaagcauuccuua

SEQ ID NO: 458416 - RNA, 23 nt, Homo sapiens
aaagcacuuggacucuugcucuu

SEQ ID NO: 458417 - RNA, 22 nt, Homo sapiens
aaagcaguuacuaauaugccua

SEQ ID NO: 458418 - RNA, 14 nt, Homo sapiens
aaagcauccaugug

SEQ ID NO: 458419 - RNA, 21 nt, Homo sapiens
aaagcaugucucugcuuccau

SEQ ID NO: 458420 - RNA, 20 nt, Homo sapiens
aaagcaugugaauucuggca

SEQ ID NO: 458421 - RNA, 22 nt, Homo sapiens
aaagcaugugaauucuggcauu

SEQ ID NO: 458422 - RNA, 19 nt, Homo sapiens
aaaagaauugugccucucc

SEQ ID NO: 458423 - RNA, 14 nt, Homo sapiens
aaaagacauccuca

SEQ ID NO: 458424 - RNA, 15 nt, Homo sapiens
aaaagaccaguccau

SEQ ID NO: 458425 - RNA, 15 nt, Homo sapiens
aaaagacugaaucua

SEQ ID NO: 458426 - RNA, 13 nt, Homo sapiens
aaaagacuuugau

SEQ ID NO: 458427 - RNA, 15 nt, Homo sapiens
aaaagaugugcagau

SEQ ID NO: 458428 - RNA, 19 nt, Homo sapiens
aaaagcaggaaagauccca

SEQ ID NO: 458429 - RNA, 16 nt, Homo sapiens
aaaagcaucuauguga

SEQ ID NO: 458430 - RNA, 18 nt, Homo sapiens
aaaagccauaacuugaaa

SEQ ID NO: 458431 - RNA, 18 nt, Homo sapiens
aaaagcccuuuccaaagg

SEQ ID NO: 458432 - RNA, 15 nt, Homo sapiens
aaaaggauaugcagu

SEQ ID NO: 458433 - RNA, 20 nt, Homo sapiens
aaaaggccuuugggauuugc

SEQ ID NO: 458434 - RNA, 21 nt, Homo sapiens
aaaaggccuuugggauuugcc

SEQ ID NO: 458435 - RNA, 18 nt, Homo sapiens
aaaagggaaguugugccu

SEQ ID NO: 458436 - RNA, 18 nt, Homo sapiens
aaaagggcagggcaucuc

SEQ ID NO: 458437 - RNA, 19 nt, Homo sapiens
aaaaggguguugcuaagcu

SEQ ID NO: 458438 - RNA, 15 nt, Homo sapiens
aaaaguauaacuuau

SEQ ID NO: 458439 - RNA, 13 nt, Homo sapiens
aaaaguccuguca

SEQ ID NO: 458440 - RNA, 14 nt, Homo sapiens
aaaagucuucacuc

SEQ ID NO: 458441 - RNA, 21 nt, Homo sapiens
aaaagugaucaauaaaaugug

SEQ ID NO: 458442 - RNA, 12 nt, Homo sapiens
aaaaguuaacau

SEQ ID NO: 458443 - RNA, 16 nt, Homo sapiens
aaaaguuaagugucau

SEQ ID NO: 458444 - RNA, 16 nt, Homo sapiens
aaaaguuauugugaua

SEQ ID NO: 458445 - RNA, 13 nt, Homo sapiens
aaaaguugugauu

SEQ ID NO: 458446 - RNA, 17 nt, Homo sapiens
aaaauaaguaacauaua

SEQ ID NO: 458447 - RNA, 15 nt, Homo sapiens
aaaauacaacuucau

SEQ ID NO: 458448 - RNA, 21 nt, Homo sapiens
aaaauacaauuaaagcaaaau

SEQ ID NO: 458449 - RNA, 19 nt, Homo sapiens
aaaauacaugguaucucuu

SEQ ID NO: 458450 - RNA, 13 nt, Homo sapiens
aaaauacuucuuu

SEQ ID NO: 458451 - RNA, 19 nt, Homo sapiens
aaaauagaauguuacuuug

SEQ ID NO: 458452 - RNA, 21 nt, Homo sapiens
aaaauaguaaaugcuuugugu

SEQ ID NO: 458453 - RNA, 15 nt, Homo sapiens
aaaauaguaagccuc

SEQ ID NO: 458454 - RNA, 18 nt, Homo sapiens
aaaauaguguguccaugc

SEQ ID NO: 458455 - RNA, 22 nt, Homo sapiens
aaaauaguugcaaagcauuuga

SEQ ID NO: 458456 - RNA, 14 nt, Homo sapiens
aaaauauggcuaua

SEQ ID NO: 458457 - RNA, 21 nt, Homo sapiens
aaaauaugugcuugaaaugag

SEQ ID NO: 458458 - RNA, 22 nt, Homo sapiens
aaaauauuucuaagcuuauuuc

SEQ ID NO: 458459 - RNA, 20 nt, Homo sapiens
aaaaucauucuacugaacag

SEQ ID NO: 458460 - RNA, 12 nt, Homo sapiens
aaaaucuuauca

SEQ ID NO: 458461 - RNA, 12 nt, Homo sapiens
aaaaucuuggau

SEQ ID NO: 458462 - RNA, 23 nt, Homo sapiens
aaaaucuuucagaauacaauuca

SEQ ID NO: 458463 - RNA, 24 nt, Homo sapiens
aaaaugaacugaaguuucacauga

SEQ ID NO: 458464 - RNA, 11 nt, Homo sapiens
aaaaugaagga

SEQ ID NO: 458465 - RNA, 16 nt, Homo sapiens
aaaaugaaucuucaca

SEQ ID NO: 458466 - RNA, 17 nt, Homo sapiens
aaaaugaaucuucacaa

SEQ ID NO: 458467 - RNA, 21 nt, Homo sapiens
aaaaugaaucuucacaaaaca

SEQ ID NO: 458468 - RNA, 15 nt, Homo sapiens
aaaaugaauuugacu

SEQ ID NO: 458469 - RNA, 17 nt, Homo sapiens
aaaaugaauuugacugg

SEQ ID NO: 458470 - RNA, 17 nt, Homo sapiens
aaaaugacagauacaaa

SEQ ID NO: 458471 - RNA, 21 nt, Homo sapiens
aaaaugaucuauugcagauau

SEQ ID NO: 458472 - RNA, 18 nt, Homo sapiens
aaaaugcugcuuucugcc

SEQ ID NO: 458473 - RNA, 11 nt, Homo sapiens
aaaauggacau

SEQ ID NO: 458474 - RNA, 19 nt, Homo sapiens
aaaauggauccccagugaa

SEQ ID NO: 458475 - RNA, 22 nt, Homo sapiens
aaaauguaaaaacccugcuaaa

SEQ ID NO: 458476 - RNA, 13 nt, Homo sapiens
aaaauguccauga

SEQ ID NO: 458477 - RNA, 19 nt, Homo sapiens
aaaauguccaugauggaau

SEQ ID NO: 458478 - RNA, 17 nt, Homo sapiens
aaaauguccugccuuuu

SEQ ID NO: 458479 - RNA, 15 nt, Homo sapiens
aaaaugugucugcaa

SEQ ID NO: 458480 - RNA, 21 nt, Homo sapiens
aaaauguucugacagcauuuc

SEQ ID NO: 458481 - RNA, 15 nt, Homo sapiens
aaaauguuggaagag

SEQ ID NO: 458482 - RNA, 15 nt, Homo sapiens
aaaauguuggugcaa

SEQ ID NO: 458483 - RNA, 13 nt, Homo sapiens
aaaauguuugcug

SEQ ID NO: 458484 - RNA, 16 nt, Homo sapiens
aaaauguuuucuucau

SEQ ID NO: 458485 - RNA, 17 nt, Homo sapiens
aaaauuaagaaguacaa

SEQ ID NO: 458486 - RNA, 23 nt, Homo sapiens
aaaauuaagaaguacaauaagca

SEQ ID NO: 458487 - RNA, 13 nt, Homo sapiens
aaaauuagccagg

SEQ ID NO: 458488 - RNA, 21 nt, Homo sapiens
aaaauuagccgggcauggugg

SEQ ID NO: 458489 - RNA, 13 nt, Homo sapiens
aaaauucauuucu

SEQ ID NO: 458490 - RNA, 16 nt, Homo sapiens
aaaauuccauuuacuu

SEQ ID NO: 458491 - RNA, 16 nt, Homo sapiens
aaaauucucaagugau

SEQ ID NO: 458492 - RNA, 17 nt, Homo sapiens
aaaauucuuaaguaugu

SEQ ID NO: 458493 - RNA, 20 nt, Homo sapiens
aaaauuggcauuaaaacuua

SEQ ID NO: 458494 - RNA, 22 nt, Homo sapiens
aaaauuguguccacauaaucca

SEQ ID NO: 458495 - RNA, 14 nt, Homo sapiens
aaacaaaauccuug

SEQ ID NO: 458496 - RNA, 20 nt, Homo sapiens
aaacaaaauguuaguggcau

SEQ ID NO: 458497 - RNA, 21 nt, Homo sapiens
aaacaaacauacccaucugca

SEQ ID NO: 458498 - RNA, 10 nt, Homo sapiens
aaacaaagug

SEQ ID NO: 458499 - RNA, 17 nt, Homo sapiens
aaacaaauauuucacuu

SEQ ID NO: 458500 - RNA, 22 nt, Homo sapiens
aaacaacauuggaugugcauuu

SEQ ID NO: 458501 - RNA, 23 nt, Homo sapiens
aaacaaccugccacaaugugaua

SEQ ID NO: 458502 - RNA, 20 nt, Homo sapiens
aaacaacuucaauauccaaa

SEQ ID NO: 458503 - RNA, 13 nt, Homo sapiens
aaacaaucugccc

SEQ ID NO: 458504 - RNA, 18 nt, Homo sapiens
aaacaaucuuagacauuu

SEQ ID NO: 458505 - RNA, 22 nt, Homo sapiens
aaacaauguuuuaaacauucuu

SEQ ID NO: 458506 - RNA, 19 nt, Homo sapiens
aaacaauuggcaaacuuug

SEQ ID NO: 458507 - RNA, 17 nt, Homo sapiens
aaacacaaauagaacau

SEQ ID NO: 458508 - RNA, 22 nt, Homo sapiens
aaacacaucuggccuaauguuc

SEQ ID NO: 458509 - RNA, 20 nt, Homo sapiens
aaacaccagauuccauuuca

SEQ ID NO: 458510 - RNA, 18 nt, Homo sapiens
aaacaccuggacauuccc

SEQ ID NO: 458511 - RNA, 23 nt, Homo sapiens
aaacacuuuuucucgaguccaaa

SEQ ID NO: 458512 - RNA, 22 nt, Homo sapiens
aaacagaacucgaugcacugac

SEQ ID NO: 458513 - RNA, 23 nt, Homo sapiens
aaacagaacugcagucagcauga

SEQ ID NO: 458514 - RNA, 16 nt, Homo sapiens
aaacagacccucccac

SEQ ID NO: 458515 - RNA, 22 nt, Homo sapiens
aaacagacuauuuaacuugagg

SEQ ID NO: 458516 - RNA, 19 nt, Homo sapiens
aaacagauuuguucauucc

SEQ ID NO: 458517 - RNA, 15 nt, Homo sapiens
aaacagccaugucca

SEQ ID NO: 458518 - RNA, 11 nt, Homo sapiens
aaacagucaaa

SEQ ID NO: 458519 - RNA, 13 nt, Homo sapiens
aaacaguguggau

SEQ ID NO: 458520 - RNA, 17 nt, Homo sapiens
aaacaguguggauguaa

SEQ ID NO: 458521 - RNA, 19 nt, Homo sapiens
aaacaguuguaccacugcu

SEQ ID NO: 458522 - RNA, 17 nt, Homo sapiens
aaacauacccaucugca

SEQ ID NO: 458523 - RNA, 16 nt, Homo sapiens
aaacauauguucuccc

SEQ ID NO: 458524 - RNA, 13 nt, Homo sapiens
aaacaucuuucca

SEQ ID NO: 458525 - RNA, 16 nt, Homo sapiens
aaacaugaaaacauug

SEQ ID NO: 458526 - RNA, 23 nt, Homo sapiens
aaacauucauauuugcaauaaaa

SEQ ID NO: 458527 - RNA, 18 nt, Homo sapiens
aaacauucaucaagcugu

SEQ ID NO: 458528 - RNA, 21 nt, Homo sapiens
aaacauucaucaagcuguaca

SEQ ID NO: 458529 - RNA, 22 nt, Homo sapiens
aaacauucaucaagcuguacau

SEQ ID NO: 458530 - RNA, 15 nt, Homo sapiens
aaacauucuuuaaca

SEQ ID NO: 458531 - RNA, 15 nt, Homo sapiens
aaaccacagcccugu

SEQ ID NO: 458532 - RNA, 14 nt, Homo sapiens
aaaccacagucuua

SEQ ID NO: 458533 - RNA, 18 nt, Homo sapiens
aaaccacuaugcaaagaa

SEQ ID NO: 458534 - RNA, 16 nt, Homo sapiens
aaaccacugggcauaa

SEQ ID NO: 458535 - RNA, 18 nt, Homo sapiens
aaaccacuuuuugcagcu

SEQ ID NO: 458536 - RNA, 17 nt, Homo sapiens
aaaccaggacucugccc

SEQ ID NO: 458537 - RNA, 21 nt, Homo sapiens
aaacccagauugaagcuaaaa

SEQ ID NO: 458538 - RNA, 23 nt, Homo sapiens
aaacccauuuccagcuccuagua

SEQ ID NO: 458539 - RNA, 15 nt, Homo sapiens
aaaccccaaacuguu

SEQ ID NO: 458540 - RNA, 18 nt, Homo sapiens
aaacccuaaaccucuuca

SEQ ID NO: 458541 - RNA, 19 nt, Homo sapiens
aaacccuacgaaagcacag

SEQ ID NO: 458542 - RNA, 14 nt, Homo sapiens
aaaccucaaaaugu

SEQ ID NO: 458543 - RNA, 12 nt, Homo sapiens
aaaccucaaggg

SEQ ID NO: 458544 - RNA, 22 nt, Homo sapiens
aaaccucuauauguugcugaaa

SEQ ID NO: 458545 - RNA, 12 nt, Homo sapiens
aaaccucugggu

SEQ ID NO: 458546 - RNA, 14 nt, Homo sapiens
aaaccucuucacgg

SEQ ID NO: 458547 - RNA, 22 nt, Homo sapiens
aaaccugauacaauuugcccaa

SEQ ID NO: 458548 - RNA, 14 nt, Homo sapiens
aaaccuuagcuccc

SEQ ID NO: 458549 - RNA, 19 nt, Homo sapiens
aaaccuuucaaauuucaca

SEQ ID NO: 458550 - RNA, 22 nt, Homo sapiens
aaacgauuuugaacauacuuca

SEQ ID NO: 458551 - RNA, 14 nt, Homo sapiens
aaacggaacucuuc

SEQ ID NO: 458552 - RNA, 20 nt, Homo sapiens
acaaggcugaaaagugcuuu

SEQ ID NO: 458553 - RNA, 19 nt, Homo sapiens
acaaguagcacacugaguu

SEQ ID NO: 458554 - RNA, 14 nt, Homo sapiens
acaaguccucagug

SEQ ID NO: 458555 - RNA, 18 nt, Homo sapiens
acaagugggugaaugugg

SEQ ID NO: 458556 - RNA, 15 nt, Homo sapiens
acaaguuucagacag

SEQ ID NO: 458557 - RNA, 21 nt, Homo sapiens
acaauaaaauggaaagguccu

SEQ ID NO: 458558 - RNA, 18 nt, Homo sapiens
acaauaaacgaaacacag

SEQ ID NO: 458559 - RNA, 14 nt, Homo sapiens
acaauacaacucac

SEQ ID NO: 458560 - RNA, 21 nt, Homo sapiens
acaauagaacuggucuuccau

SEQ ID NO: 458561 - RNA, 13 nt, Homo sapiens
acaauaguaugca

SEQ ID NO: 458562 - RNA, 18 nt, Homo sapiens
acaauagugauugauaga

SEQ ID NO: 458563 - RNA, 15 nt, Homo sapiens
acaaucaaagcacuu

SEQ ID NO: 458564 - RNA, 16 nt, Homo sapiens
acaaucaaagcacuug

SEQ ID NO: 458565 - RNA, 19 nt, Homo sapiens
acaaucauuggaauuccuu

SEQ ID NO: 458566 - RNA, 14 nt, Homo sapiens
acaauccuguggau

SEQ ID NO: 458567 - RNA, 20 nt, Homo sapiens
acaauccuuuguucucccaa

SEQ ID NO: 458568 - RNA, 15 nt, Homo sapiens
acaaucuguaauugc

SEQ ID NO: 458569 - RNA, 13 nt, Homo sapiens
acaaucuuagaca

SEQ ID NO: 458570 - RNA, 20 nt, Homo sapiens
acaaugcuccuccugaugac

SEQ ID NO: 458571 - RNA, 21 nt, Homo sapiens
acaaugcuccuccugaugacu

SEQ ID NO: 458572 - RNA, 20 nt, Homo sapiens
acaauggcuggguuugggca

SEQ ID NO: 458573 - RNA, 11 nt, Homo sapiens
acaaugugaua

SEQ ID NO: 458574 - RNA, 13 nt, Homo sapiens
acaaugugcccuc

SEQ ID NO: 458575 - RNA, 20 nt, Homo sapiens
acaaugugugggauaauguc

SEQ ID NO: 458576 - RNA, 23 nt, Homo sapiens
acaauguuggccugucagagcuu

SEQ ID NO: 458577 - RNA, 20 nt, Homo sapiens
acaauguuucagaagcccca

SEQ ID NO: 458578 - RNA, 18 nt, Homo sapiens
acaauuacuaaauuguau

SEQ ID NO: 458579 - RNA, 14 nt, Homo sapiens
acaauucaguuuua

SEQ ID NO: 458580 - RNA, 16 nt, Homo sapiens
acaauuccuagauaaa

SEQ ID NO: 458581 - RNA, 13 nt, Homo sapiens
acaauucuguccc

SEQ ID NO: 458582 - RNA, 20 nt, Homo sapiens
acaauuguguuuucgucaca

SEQ ID NO: 458583 - RNA, 20 nt, Homo sapiens
acaauuucaaaaugcaugug

SEQ ID NO: 458584 - RNA, 22 nt, Homo sapiens
acaauuuggucuuagcuuuaca

SEQ ID NO: 458585 - RNA, 22 nt, Homo sapiens
acaauuuucaucccacaauuga

SEQ ID NO: 458586 - RNA, 17 nt, Homo sapiens
acaauuuucugcaggau

SEQ ID NO: 458587 - RNA, 14 nt, Homo sapiens
acacaaauguguac

SEQ ID NO: 458588 - RNA, 16 nt, Homo sapiens
acacaaccauagccug

SEQ ID NO: 458589 - RNA, 18 nt, Homo sapiens
acacaaguagaugccuga

SEQ ID NO: 458590 - RNA, 21 nt, Homo sapiens
acacaaguagauugaucuaag

SEQ ID NO: 458591 - RNA, 12 nt, Homo sapiens
acacacagccau

SEQ ID NO: 458592 - RNA, 14 nt, Homo sapiens
acacacgcagacac

SEQ ID NO: 458593 - RNA, 18 nt, Homo sapiens
acacacugagacuugaau

SEQ ID NO: 458594 - RNA, 20 nt, Homo sapiens
acacagacccaagauucaua

SEQ ID NO: 458595 - RNA, 18 nt, Homo sapiens
acacagcaagacuccguc

SEQ ID NO: 458596 - RNA, 20 nt, Homo sapiens
acacagcaagacuccgucuc

SEQ ID NO: 458597 - RNA, 22 nt, Homo sapiens
acacagcagcuguucaacaaga

SEQ ID NO: 458598 - RNA, 23 nt, Homo sapiens
acacagcuaacaaguagcacacu

SEQ ID NO: 458599 - RNA, 12 nt, Homo sapiens
acacagcuuuua

SEQ ID NO: 458600 - RNA, 18 nt, Homo sapiens
acacaggcccaugcccuc

SEQ ID NO: 458601 - RNA, 19 nt, Homo sapiens
acacagucuuggcucacug

SEQ ID NO: 458602 - RNA, 15 nt, Homo sapiens
acacaguuacagagu

SEQ ID NO: 458603 - RNA, 18 nt, Homo sapiens
acacaguuuugucuucgu

SEQ ID NO: 458604 - RNA, 12 nt, Homo sapiens
acacauacacac

SEQ ID NO: 458605 - RNA, 15 nt, Homo sapiens
acacauagauaccuu

SEQ ID NO: 458606 - RNA, 19 nt, Homo sapiens
acacaugguuuccaagggu

SEQ ID NO: 458607 - RNA, 21 nt, Homo sapiens
acacauuguacaugguacgaa

SEQ ID NO: 458608 - RNA, 11 nt, Homo sapiens
acaccacaggc

SEQ ID NO: 458609 - RNA, 15 nt, Homo sapiens
acaccagggccagua

SEQ ID NO: 458610 - RNA, 13 nt, Homo sapiens
acacccaacacuu

SEQ ID NO: 458611 - RNA, 19 nt, Homo sapiens
acacccagcccagcuugcc

SEQ ID NO: 458612 - RNA, 19 nt, Homo sapiens
acacccagucuguucccca

SEQ ID NO: 458613 - RNA, 19 nt, Homo sapiens
acacccaguggaaccaaaa

SEQ ID NO: 458614 - RNA, 21 nt, Homo sapiens
acacccccaccuccugcaaua

SEQ ID NO: 458615 - RNA, 23 nt, Homo sapiens
acacccgacugugcacacuucca

SEQ ID NO: 458616 - RNA, 23 nt, Homo sapiens
acacccgccgccuccugcaccga

SEQ ID NO: 458617 - RNA, 20 nt, Homo sapiens
acaccguacaucugcaauau

SEQ ID NO: 458618 - RNA, 16 nt, Homo sapiens
acaccuagaucagaac

SEQ ID NO: 458619 - RNA, 16 nt, Homo sapiens
acaccuguaaucucag

SEQ ID NO: 458620 - RNA, 14 nt, Homo sapiens
acacgcagacacac

SEQ ID NO: 458621 - RNA, 22 nt, Homo sapiens
acacgcccuccccagacuccac

SEQ ID NO: 458622 - RNA, 22 nt, Homo sapiens
acacguguggcgggcaguggga

SEQ ID NO: 458623 - RNA, 14 nt, Homo sapiens
acacguuggcucag

SEQ ID NO: 458624 - RNA, 17 nt, Homo sapiens
acacuacaaauguuaaa

SEQ ID NO: 458625 - RNA, 12 nt, Homo sapiens
acacuaccacau

SEQ ID NO: 458626 - RNA, 21 nt, Homo sapiens
acacucaccauuuaaucauuu

SEQ ID NO: 458627 - RNA, 21 nt, Homo sapiens
acacucaucagguaaacugau

SEQ ID NO: 458628 - RNA, 19 nt, Homo sapiens
acacucaucuuagugccug

SEQ ID NO: 458629 - RNA, 23 nt, Homo sapiens
acacugacuuggugcaaggccau

SEQ ID NO: 458630 - RNA, 22 nt, Homo sapiens
acacugagacuugaaucaaguc

SEQ ID NO: 458631 - RNA, 23 nt, Homo sapiens
acacugagacuugaaucaaguca

SEQ ID NO: 458632 - RNA, 21 nt, Homo sapiens
acacugaggcccaauggccuu

SEQ ID NO: 458633 - RNA, 22 nt, Homo sapiens
acacugaggcgcucgcucccau

SEQ ID NO: 458634 - RNA, 14 nt, Homo sapiens
acacugcuugugaa

SEQ ID NO: 458635 - RNA, 17 nt, Homo sapiens
acacuguacugcaauaa

SEQ ID NO: 458636 - RNA, 14 nt, Homo sapiens
acacugucaaugag

SEQ ID NO: 458637 - RNA, 19 nt, Homo sapiens
acacugugcccagcccgga

SEQ ID NO: 458638 - RNA, 19 nt, Homo sapiens
acacuuaauucuguucuga

SEQ ID NO: 458639 - RNA, 15 nt, Homo sapiens
acacuugcacccaug

SEQ ID NO: 458640 - RNA, 16 nt, Homo sapiens
acacuugggagcaaaa

SEQ ID NO: 458641 - RNA, 17 nt, Homo sapiens
acacuugggagcaaaag

SEQ ID NO: 458642 - RNA, 19 nt, Homo sapiens
acacuugggugaaaaguau

SEQ ID NO: 458643 - RNA, 18 nt, Homo sapiens
acacuugguguacugggu

SEQ ID NO: 458644 - RNA, 17 nt, Homo sapiens
acagaaaacaauuguuc

SEQ ID NO: 458645 - RNA, 21 nt, Homo sapiens
acagaaaaccucaagggcuuu

SEQ ID NO: 458646 - RNA, 15 nt, Homo sapiens
acagaaaguucuuaa

SEQ ID NO: 458647 - RNA, 15 nt, Homo sapiens
acagaacaagccaca

SEQ ID NO: 458648 - RNA, 22 nt, Homo sapiens
acagaagcuuuagcaagugugc

SEQ ID NO: 458649 - RNA, 13 nt, Homo sapiens
acagaauuccacc

SEQ ID NO: 458650 - RNA, 24 nt, Homo sapiens
acagaauugcuuguuugcuucaac

SEQ ID NO: 458651 - RNA, 14 nt, Homo sapiens
acagacacuuacau

SEQ ID NO: 458652 - RNA, 17 nt, Homo sapiens
acagacaugaaccacca

SEQ ID NO: 458653 - RNA, 21 nt, Homo sapiens
acagacuguucccuccaaggu

SEQ ID NO: 458654 - RNA, 17 nt, Homo sapiens
acagacuucacacagca

SEQ ID NO: 458655 - RNA, 13 nt, Homo sapiens
acagagagacaga

SEQ ID NO: 458656 - RNA, 20 nt, Homo sapiens
acagagagacagacuugaga

SEQ ID NO: 458657 - RNA, 20 nt, Homo sapiens
acagagagggggccaccucc

SEQ ID NO: 458658 - RNA, 20 nt, Homo sapiens
acagagcgagacucugucuc

SEQ ID NO: 458659 - RNA, 22 nt, Homo sapiens
acagagucuguguguagccagg

SEQ ID NO: 458660 - RNA, 15 nt, Homo sapiens
acagaguuacugcca

SEQ ID NO: 458661 - RNA, 14 nt, Homo sapiens
acagaguucacuau

SEQ ID NO: 458662 - RNA, 13 nt, Homo sapiens
acagauaaggaaa

SEQ ID NO: 458663 - RNA, 14 nt, Homo sapiens
acagauaaugauag

SEQ ID NO: 458664 - RNA, 14 nt, Homo sapiens
acagaucaguuuuc

SEQ ID NO: 458665 - RNA, 13 nt, Homo sapiens
acagaugccccag

SEQ ID NO: 458666 - RNA, 14 nt, Homo sapiens
acagaugcuaauaa

SEQ ID NO: 458667 - RNA, 23 nt, Homo sapiens
acagauguuuguuuucaaaauac

SEQ ID NO: 458668 - RNA, 22 nt, Homo sapiens
acagauuaucuuguacagccuu

SEQ ID NO: 458669 - RNA, 22 nt, Homo sapiens
acagauuccaggcgaugugcaa

SEQ ID NO: 458670 - RNA, 20 nt, Homo sapiens
acagauuugagccuccuuga

SEQ ID NO: 458671 - RNA, 16 nt, Homo sapiens
acagcaaauguuauag

SEQ ID NO: 458672 - RNA, 14 nt, Homo sapiens
acagcaagagccac

SEQ ID NO: 458673 - RNA, 17 nt, Homo sapiens
acagcaauaacucggug

SEQ ID NO: 458674 - RNA, 12 nt, Homo sapiens
acagcacuggcu

SEQ ID NO: 458675 - RNA, 18 nt, Homo sapiens
acagcagauuucagauca

SEQ ID NO: 458676 - RNA, 15 nt, Homo sapiens
acagcagcaaugcaa

SEQ ID NO: 458677 - RNA, 15 nt, Homo sapiens
acagcagcaucuuca

SEQ ID NO: 458678 - RNA, 15 nt, Homo sapiens
acagcagccugugag

SEQ ID NO: 458679 - RNA, 19 nt, Homo sapiens
acagcagguuuauccagau

SEQ ID NO: 458680 - RNA, 17 nt, Homo sapiens
acagcauggugcaugcc

SEQ ID NO: 458681 - RNA, 15 nt, Homo sapiens
acagcauucuuguca

SEQ ID NO: 458682 - RNA, 15 nt, Homo sapiens
acgucacagcaguac

SEQ ID NO: 458683 - RNA, 12 nt, Homo sapiens
acgucauucagu

SEQ ID NO: 458684 - RNA, 11 nt, Homo sapiens
acguccuccac

SEQ ID NO: 458685 - RNA, 23 nt, Homo sapiens
acgucucucaccuagaccuugcc

SEQ ID NO: 458686 - RNA, 19 nt, Homo sapiens
acgugaucuccugauuaga

SEQ ID NO: 458687 - RNA, 12 nt, Homo sapiens
acguggccucuu

SEQ ID NO: 458688 - RNA, 20 nt, Homo sapiens
acguggccucuugagcagug

SEQ ID NO: 458689 - RNA, 19 nt, Homo sapiens
acgugggcaaacaggcagu

SEQ ID NO: 458690 - RNA, 15 nt, Homo sapiens
acguggggcagcaca

SEQ ID NO: 458691 - RNA, 18 nt, Homo sapiens
acguggggcagcacagag

SEQ ID NO: 458692 - RNA, 23 nt, Homo sapiens
acguguaacuugugcuuuugcaa

SEQ ID NO: 458693 - RNA, 17 nt, Homo sapiens
acguguuuacuugguga

SEQ ID NO: 458694 - RNA, 19 nt, Homo sapiens
acguguuuuuguaucuuua

SEQ ID NO: 458695 - RNA, 18 nt, Homo sapiens
acguugccucuacuuuau

SEQ ID NO: 458696 - RNA, 19 nt, Homo sapiens
acguuuguuucuucgugcc

SEQ ID NO: 458697 - RNA, 15 nt, Homo sapiens
acuaacagauaagca

SEQ ID NO: 458698 - RNA, 15 nt, Homo sapiens
acuaagagucucuau

SEQ ID NO: 458699 - RNA, 18 nt, Homo sapiens
acuaagggguauguuccc

SEQ ID NO: 458700 - RNA, 17 nt, Homo sapiens
acuaaucgaaugaacaa

SEQ ID NO: 458701 - RNA, 13 nt, Homo sapiens
acuaaugaccaca

SEQ ID NO: 458702 - RNA, 20 nt, Homo sapiens
acuaaugaggaaacugcacu

SEQ ID NO: 458703 - RNA, 23 nt, Homo sapiens
acuaaugaggaaacugcacuguu

SEQ ID NO: 458704 - RNA, 20 nt, Homo sapiens
acuaaugcccuaucuuagua

SEQ ID NO: 458705 - RNA, 19 nt, Homo sapiens
acuaaugucagcacauguu

SEQ ID NO: 458706 - RNA, 23 nt, Homo sapiens
acuaauguuagaauugauuucca

SEQ ID NO: 458707 - RNA, 18 nt, Homo sapiens
acuaauuugucacuggaa

SEQ ID NO: 458708 - RNA, 21 nt, Homo sapiens
acuacaaacauggggagccau

SEQ ID NO: 458709 - RNA, 21 nt, Homo sapiens
acuacagaauaauguguuaaa

SEQ ID NO: 458710 - RNA, 12 nt, Homo sapiens
acuacauuugca

SEQ ID NO: 458711 - RNA, 13 nt, Homo sapiens
acuacauuugcau

SEQ ID NO: 458712 - RNA, 19 nt, Homo sapiens
acuaccagugggcauguau

SEQ ID NO: 458713 - RNA, 20 nt, Homo sapiens
acuaccagugggcauguauu

SEQ ID NO: 458714 - RNA, 21 nt, Homo sapiens
acuaccccaaaguuugcucaa

SEQ ID NO: 458715 - RNA, 22 nt, Homo sapiens
acuacccgagcccagcuacauu

SEQ ID NO: 458716 - RNA, 21 nt, Homo sapiens
acuaccuuuggcuuaauucca

SEQ ID NO: 458717 - RNA, 16 nt, Homo sapiens
acuacuaaagugccua

SEQ ID NO: 458718 - RNA, 22 nt, Homo sapiens
acuacuaaagugccuaccccag

SEQ ID NO: 458719 - RNA, 21 nt, Homo sapiens
acuacuccucugcagugccuu

SEQ ID NO: 458720 - RNA, 15 nt, Homo sapiens
acuacucugugccag

SEQ ID NO: 458721 - RNA, 15 nt, Homo sapiens
acuacugacaugugg

SEQ ID NO: 458722 - RNA, 19 nt, Homo sapiens
acuagaaaguaauacaaua

SEQ ID NO: 458723 - RNA, 19 nt, Homo sapiens
acuagaagcugaucugauu

SEQ ID NO: 458724 - RNA, 16 nt, Homo sapiens
acuagaagggccaguc

SEQ ID NO: 458725 - RNA, 11 nt, Homo sapiens
acuagacugua

SEQ ID NO: 458726 - RNA, 11 nt, Homo sapiens
acuagaucucc

SEQ ID NO: 458727 - RNA, 23 nt, Homo sapiens
acuagaucucccuuaauaaacuc

SEQ ID NO: 458728 - RNA, 14 nt, Homo sapiens
acuaggcacugugg

SEQ ID NO: 458729 - RNA, 15 nt, Homo sapiens
acuagggaagcucag

SEQ ID NO: 458730 - RNA, 13 nt, Homo sapiens
acuaggguguaaa

SEQ ID NO: 458731 - RNA, 15 nt, Homo sapiens
acuaguaaagacaua

SEQ ID NO: 458732 - RNA, 15 nt, Homo sapiens
acuaguaccuucaga

SEQ ID NO: 458733 - RNA, 19 nt, Homo sapiens
acuaguaguuccugcuaca

SEQ ID NO: 458734 - RNA, 21 nt, Homo sapiens
acuaucauugcccucuucaag

SEQ ID NO: 458735 - RNA, 15 nt, Homo sapiens
acuauccuggcuuug

SEQ ID NO: 458736 - RNA, 19 nt, Homo sapiens
acuaucuacucuccucauc

SEQ ID NO: 458737 - RNA, 19 nt, Homo sapiens
acuaugaaguaagcaacaa

SEQ ID NO: 458738 - RNA, 19 nt, Homo sapiens
acuaugcaccuauaaauac

SEQ ID NO: 458739 - RNA, 17 nt, Homo sapiens
acuaugguucccaauaa

SEQ ID NO: 458740 - RNA, 20 nt, Homo sapiens
acuauguuuagugugauugu

SEQ ID NO: 458741 - RNA, 15 nt, Homo sapiens
acuauuaccaugaga

SEQ ID NO: 458742 - RNA, 21 nt, Homo sapiens
acuauuccacagggauaccuu

SEQ ID NO: 458743 - RNA, 20 nt, Homo sapiens
acuauucuuaagcacuuuga

SEQ ID NO: 458744 - RNA, 13 nt, Homo sapiens
acuauugcugcuu

SEQ ID NO: 458745 - RNA, 22 nt, Homo sapiens
acuauuuagauauaacacuaug

SEQ ID NO: 458746 - RNA, 18 nt, Homo sapiens
acuauuugauaaugcaua

SEQ ID NO: 458747 - RNA, 13 nt, Homo sapiens
acuauuuucauuc

SEQ ID NO: 458748 - RNA, 23 nt, Homo sapiens
acucaaacgccgcugacugccac

SEQ ID NO: 458749 - RNA, 12 nt, Homo sapiens
acucaacauguu

SEQ ID NO: 458750 - RNA, 12 nt, Homo sapiens
acucaaccaaau

SEQ ID NO: 458751 - RNA, 18 nt, Homo sapiens
acucaaggccuccagcca

SEQ ID NO: 458752 - RNA, 12 nt, Homo sapiens
acucaccaucug

SEQ ID NO: 458753 - RNA, 22 nt, Homo sapiens
acucaccauuuaaucauuucca

SEQ ID NO: 458754 - RNA, 17 nt, Homo sapiens
acucaccccuucuaauc

SEQ ID NO: 458755 - RNA, 20 nt, Homo sapiens
acucacuaaaaguucucaaa

SEQ ID NO: 458756 - RNA, 12 nt, Homo sapiens
acucacugugcu

SEQ ID NO: 458757 - RNA, 15 nt, Homo sapiens
acucacuuguaagaa

SEQ ID NO: 458758 - RNA, 16 nt, Homo sapiens
acucagaaggcaaagg

SEQ ID NO: 458759 - RNA, 15 nt, Homo sapiens
acucagacauuccaa

SEQ ID NO: 458760 - RNA, 16 nt, Homo sapiens
acucagacauuccaag

SEQ ID NO: 458761 - RNA, 20 nt, Homo sapiens
acucagaucaaaaaugggca

SEQ ID NO: 458762 - RNA, 17 nt, Homo sapiens
acucagaucacuacugc

SEQ ID NO: 458763 - RNA, 18 nt, Homo sapiens
acucagaucacuacugca

SEQ ID NO: 458764 - RNA, 13 nt, Homo sapiens
acucagaugucca

SEQ ID NO: 458765 - RNA, 16 nt, Homo sapiens
acucagcuaucagcuc

SEQ ID NO: 458766 - RNA, 16 nt, Homo sapiens
acucagugcagcaaua

SEQ ID NO: 458767 - RNA, 14 nt, Homo sapiens
acucauaaggcaua

SEQ ID NO: 458768 - RNA, 16 nt, Homo sapiens
acucauauucugggcu

SEQ ID NO: 458769 - RNA, 22 nt, Homo sapiens
acucaucccucuuuuucuuucu

SEQ ID NO: 458770 - RNA, 18 nt, Homo sapiens
acucaucuuagugccuga

SEQ ID NO: 458771 - RNA, 21 nt, Homo sapiens
acucaugacugagucuggcaa

SEQ ID NO: 458772 - RNA, 21 nt, Homo sapiens
acuccagaauuucccaaagca

SEQ ID NO: 458773 - RNA, 20 nt, Homo sapiens
acuccagauuuuuuacagcu

SEQ ID NO: 458774 - RNA, 18 nt, Homo sapiens
acuccagccugggugaca

SEQ ID NO: 458775 - RNA, 20 nt, Homo sapiens
acuccagcugggagacacag

SEQ ID NO: 458776 - RNA, 13 nt, Homo sapiens
acuccaguaaaaa

SEQ ID NO: 458777 - RNA, 16 nt, Homo sapiens
acuccaucugcugcca

SEQ ID NO: 458778 - RNA, 22 nt, Homo sapiens
acuccaucuugguaguucugug

SEQ ID NO: 458779 - RNA, 18 nt, Homo sapiens
acucccaaagagcugccu

SEQ ID NO: 458780 - RNA, 16 nt, Homo sapiens
acucccccagcuuucc

SEQ ID NO: 458781 - RNA, 16 nt, Homo sapiens
acucccuaaagcccuc

SEQ ID NO: 458782 - RNA, 23 nt, Homo sapiens
acucccugccaacuccaugacca

SEQ ID NO: 458783 - RNA, 13 nt, Homo sapiens
acucccugcuuag

SEQ ID NO: 458784 - RNA, 21 nt, Homo sapiens
acucccuuuccccucuucccu

SEQ ID NO: 458785 - RNA, 17 nt, Homo sapiens
acuccguuuccaaauac

SEQ ID NO: 458786 - RNA, 17 nt, Homo sapiens
acuccucaaccuugacu

SEQ ID NO: 458787 - RNA, 12 nt, Homo sapiens
acuccucagacg

SEQ ID NO: 458788 - RNA, 22 nt, Homo sapiens
acuccucagaucugaacacagu

SEQ ID NO: 458789 - RNA, 22 nt, Homo sapiens
acuccucuccuccccccaagcu

SEQ ID NO: 458790 - RNA, 19 nt, Homo sapiens
acuccucucgcauggugug

SEQ ID NO: 458791 - RNA, 21 nt, Homo sapiens
acuccucugucauaugcagaa

SEQ ID NO: 458792 - RNA, 13 nt, Homo sapiens
acuccugcaaaau

SEQ ID NO: 458793 - RNA, 16 nt, Homo sapiens
acuccugcccuguugu

SEQ ID NO: 458794 - RNA, 16 nt, Homo sapiens
acuccuguguguggaa

SEQ ID NO: 458795 - RNA, 22 nt, Homo sapiens
acuccuuuccugcaaacccauu

SEQ ID NO: 458796 - RNA, 15 nt, Homo sapiens
acucgaugcaagugu

SEQ ID NO: 458797 - RNA, 13 nt, Homo sapiens
acucgaugcacug

SEQ ID NO: 458798 - RNA, 23 nt, Homo sapiens
acucggaauucccugaagcaaca

SEQ ID NO: 458799 - RNA, 15 nt, Homo sapiens
acucggcgugcuccu

SEQ ID NO: 458800 - RNA, 16 nt, Homo sapiens
acucggcgugcuccuu

SEQ ID NO: 458801 - RNA, 22 nt, Homo sapiens
acucguucucgugacccagugg

SEQ ID NO: 458802 - RNA, 16 nt, Homo sapiens
acucuaauagugcuua

SEQ ID NO: 458803 - RNA, 21 nt, Homo sapiens
acucuaggggucaggcuccau

SEQ ID NO: 458804 - RNA, 17 nt, Homo sapiens
acucuccaaaacacuua

SEQ ID NO: 458805 - RNA, 16 nt, Homo sapiens
acucuccaauguucua

SEQ ID NO: 458806 - RNA, 21 nt, Homo sapiens
acucuccuagagacagaagca

SEQ ID NO: 458807 - RNA, 19 nt, Homo sapiens
acucucuugccagcauuuu

SEQ ID NO: 458808 - RNA, 18 nt, Homo sapiens
acucucuuucuuccacua

SEQ ID NO: 458809 - RNA, 18 nt, Homo sapiens
acucugacgcaaaaccac

SEQ ID NO: 458810 - RNA, 18 nt, Homo sapiens
acucugacuguaaaauac

SEQ ID NO: 458811 - RNA, 21 nt, Homo sapiens
acucugagcaugccccaaaaa

SEQ ID NO: 458812 - RNA, 20 nt, Homo sapiens
agagaagaccacaccaagga

SEQ ID NO: 458813 - RNA, 23 nt, Homo sapiens
agagaauccaagccuaaaauuaa

SEQ ID NO: 458814 - RNA, 14 nt, Homo sapiens
agagaaugccauuc

SEQ ID NO: 458815 - RNA, 16 nt, Homo sapiens
agagacuuuguguuua

SEQ ID NO: 458816 - RNA, 14 nt, Homo sapiens
agagagaaacagcu

SEQ ID NO: 458817 - RNA, 23 nt, Homo sapiens
agagagaaacucuauggguauca

SEQ ID NO: 458818 - RNA, 14 nt, Homo sapiens
agagagagagccuu

SEQ ID NO: 458819 - RNA, 17 nt, Homo sapiens
agagagaugaucgugcc

SEQ ID NO: 458820 - RNA, 14 nt, Homo sapiens
agagagauggaaua

SEQ ID NO: 458821 - RNA, 21 nt, Homo sapiens
agagagcaaucuugcugugaa

SEQ ID NO: 458822 - RNA, 15 nt, Homo sapiens
agagaggaguucaau

SEQ ID NO: 458823 - RNA, 12 nt, Homo sapiens
agagaguaccau

SEQ ID NO: 458824 - RNA, 16 nt, Homo sapiens
agagagucgcaucuca

SEQ ID NO: 458825 - RNA, 22 nt, Homo sapiens
agagagucgcaucucagugcag

SEQ ID NO: 458826 - RNA, 13 nt, Homo sapiens
agagaguggcucc

SEQ ID NO: 458827 - RNA, 19 nt, Homo sapiens
agagauagggaugucauag

SEQ ID NO: 458828 - RNA, 20 nt, Homo sapiens
agagauauuuuccauuuuaa

SEQ ID NO: 458829 - RNA, 23 nt, Homo sapiens
agagauggaauaaagcccuugaa

SEQ ID NO: 458830 - RNA, 20 nt, Homo sapiens
agagauggggucucacagug

SEQ ID NO: 458831 - RNA, 17 nt, Homo sapiens
agagauuagcaugaaag

SEQ ID NO: 458832 - RNA, 17 nt, Homo sapiens
agagauuuggagcacuc

SEQ ID NO: 458833 - RNA, 19 nt, Homo sapiens
agagcaagacucugucuca

SEQ ID NO: 458834 - RNA, 18 nt, Homo sapiens
agagcacuagaagcacag

SEQ ID NO: 458835 - RNA, 19 nt, Homo sapiens
agagcacuagaagcacagg

SEQ ID NO: 458836 - RNA, 15 nt, Homo sapiens
agagcagaaccaaag

SEQ ID NO: 458837 - RNA, 15 nt, Homo sapiens
agagcagccucuguc

SEQ ID NO: 458838 - RNA, 19 nt, Homo sapiens
agagcagccuggcuaacau

SEQ ID NO: 458839 - RNA, 21 nt, Homo sapiens
agagcagcuccccaggagcuc

SEQ ID NO: 458840 - RNA, 21 nt, Homo sapiens
agagcauucugggguggggcu

SEQ ID NO: 458841 - RNA, 20 nt, Homo sapiens
agagcccggcgccccugcca

SEQ ID NO: 458842 - RNA, 20 nt, Homo sapiens
agagccuauggaaagggugu

SEQ ID NO: 458843 - RNA, 21 nt, Homo sapiens
agagccuucugaugucucuaa

SEQ ID NO: 458844 - RNA, 14 nt, Homo sapiens
agagcuaugcacac

SEQ ID NO: 458845 - RNA, 23 nt, Homo sapiens
agagcuauggugagguguggaua

SEQ ID NO: 458846 - RNA, 15 nt, Homo sapiens
agagcucacuaaaau

SEQ ID NO: 458847 - RNA, 20 nt, Homo sapiens
agagcuccacagaagacacg

SEQ ID NO: 458848 - RNA, 15 nt, Homo sapiens
agagcucccaggacg

SEQ ID NO: 458849 - RNA, 10 nt, Homo sapiens
agagcucuua

SEQ ID NO: 458850 - RNA, 11 nt, Homo sapiens
agagcucuuaa

SEQ ID NO: 458851 - RNA, 22 nt, Homo sapiens
agagcugacccccugcugccau

SEQ ID NO: 458852 - RNA, 22 nt, Homo sapiens
agaggaacuccuuggccuagcc

SEQ ID NO: 458853 - RNA, 13 nt, Homo sapiens
agaggaagccacg

SEQ ID NO: 458854 - RNA, 15 nt, Homo sapiens
agaggacagugcuga

SEQ ID NO: 458855 - RNA, 17 nt, Homo sapiens
agaggacaguuuaggac

SEQ ID NO: 458856 - RNA, 15 nt, Homo sapiens
agaggagcgggaccu

SEQ ID NO: 458857 - RNA, 14 nt, Homo sapiens
agaggaugaaugua

SEQ ID NO: 458858 - RNA, 13 nt, Homo sapiens
agaggaugucaca

SEQ ID NO: 458859 - RNA, 16 nt, Homo sapiens
agaggcaaccuguuga

SEQ ID NO: 458860 - RNA, 13 nt, Homo sapiens
agaggcaccugcu

SEQ ID NO: 458861 - RNA, 15 nt, Homo sapiens
agaggccaggcaugg

SEQ ID NO: 458862 - RNA, 20 nt, Homo sapiens
agaggccucccuggcugccu

SEQ ID NO: 458863 - RNA, 21 nt, Homo sapiens
agaggcuauuccuaggccuca

SEQ ID NO: 458864 - RNA, 19 nt, Homo sapiens
agaggcugcugaaaaccau

SEQ ID NO: 458865 - RNA, 23 nt, Homo sapiens
agaggcuguagagagagccucag

SEQ ID NO: 458866 - RNA, 11 nt, Homo sapiens
agagggacaac

SEQ ID NO: 458867 - RNA, 22 nt, Homo sapiens
agagggacagaugaaugccgug

SEQ ID NO: 458868 - RNA, 14 nt, Homo sapiens
agagggaguacaaa

SEQ ID NO: 458869 - RNA, 16 nt, Homo sapiens
agaggggaagggccag

SEQ ID NO: 458870 - RNA, 21 nt, Homo sapiens
agaggggacagaguucaggga

SEQ ID NO: 458871 - RNA, 23 nt, Homo sapiens
agaggggcagccaggacaucucu

SEQ ID NO: 458872 - RNA, 16 nt, Homo sapiens
agaggggcggggccag

SEQ ID NO: 458873 - RNA, 17 nt, Homo sapiens
agaggggcggggccagg

SEQ ID NO: 458874 - RNA, 23 nt, Homo sapiens
agagggguggaguuuuaacugua

SEQ ID NO: 458875 - RNA, 13 nt, Homo sapiens
agaggguacuuua

SEQ ID NO: 458876 - RNA, 21 nt, Homo sapiens
agaggucucagguucuuucca

SEQ ID NO: 458877 - RNA, 14 nt, Homo sapiens
agaguaacccuguc

SEQ ID NO: 458878 - RNA, 21 nt, Homo sapiens
agaguaacccugucuaaugaa

SEQ ID NO: 458879 - RNA, 20 nt, Homo sapiens
agaguaccccccugagagca

SEQ ID NO: 458880 - RNA, 19 nt, Homo sapiens
agaguacuuaauauacuca

SEQ ID NO: 458881 - RNA, 17 nt, Homo sapiens
agaguagaacagauaau

SEQ ID NO: 458882 - RNA, 14 nt, Homo sapiens
agaguagagucacu

SEQ ID NO: 458883 - RNA, 13 nt, Homo sapiens
agaguauggauug

SEQ ID NO: 458884 - RNA, 14 nt, Homo sapiens
agagucaaccacca

SEQ ID NO: 458885 - RNA, 20 nt, Homo sapiens
agagucucacuuuguugccc

SEQ ID NO: 458886 - RNA, 18 nt, Homo sapiens
agagugaaaccaugacug

SEQ ID NO: 458887 - RNA, 16 nt, Homo sapiens
agagugacuaguacaa

SEQ ID NO: 458888 - RNA, 14 nt, Homo sapiens
agagugaugccggu

SEQ ID NO: 458889 - RNA, 19 nt, Homo sapiens
agagugcagaucugugcuc

SEQ ID NO: 458890 - RNA, 16 nt, Homo sapiens
agagugggcuuuccag

SEQ ID NO: 458891 - RNA, 21 nt, Homo sapiens
agaguggucuccgcucugaau

SEQ ID NO: 458892 - RNA, 17 nt, Homo sapiens
agagugucucugauaaa

SEQ ID NO: 458893 - RNA, 19 nt, Homo sapiens
agaguguuaucagucauaa

SEQ ID NO: 458894 - RNA, 21 nt, Homo sapiens
agaguuacauguuaacugagg

SEQ ID NO: 458895 - RNA, 17 nt, Homo sapiens
agaguucugaucuguac

SEQ ID NO: 458896 - RNA, 14 nt, Homo sapiens
agauaaaccaauaa

SEQ ID NO: 458897 - RNA, 18 nt, Homo sapiens
agauaaccuguacuucaa

SEQ ID NO: 458898 - RNA, 13 nt, Homo sapiens
agauaagcaagag

SEQ ID NO: 458899 - RNA, 12 nt, Homo sapiens
agauaaucagug

SEQ ID NO: 458900 - RNA, 17 nt, Homo sapiens
agauaauuauaauauac

SEQ ID NO: 458901 - RNA, 13 nt, Homo sapiens
agauaauuugcau

SEQ ID NO: 458902 - RNA, 17 nt, Homo sapiens
agauaauuugcauauuc

SEQ ID NO: 458903 - RNA, 21 nt, Homo sapiens
agauacaugguugugaccuga

SEQ ID NO: 458904 - RNA, 17 nt, Homo sapiens
agauagguggugccagu

SEQ ID NO: 458905 - RNA, 17 nt, Homo sapiens
agauaucagagcucuua

SEQ ID NO: 458906 - RNA, 19 nt, Homo sapiens
agauauugugaaguacaua

SEQ ID NO: 458907 - RNA, 20 nt, Homo sapiens
agauauuguuuggaucaaaa

SEQ ID NO: 458908 - RNA, 12 nt, Homo sapiens
agauauuucaca

SEQ ID NO: 458909 - RNA, 20 nt, Homo sapiens
agaucaguauuucacugaua

SEQ ID NO: 458910 - RNA, 21 nt, Homo sapiens
agaucaguauuucacugauac

SEQ ID NO: 458911 - RNA, 15 nt, Homo sapiens
agaucauauuucaca

SEQ ID NO: 458912 - RNA, 14 nt, Homo sapiens
agaucaucagucac

SEQ ID NO: 458913 - RNA, 15 nt, Homo sapiens
agaucauuucccaaa

SEQ ID NO: 458914 - RNA, 20 nt, Homo sapiens
agauccaaaugcugugcaaa

SEQ ID NO: 458915 - RNA, 15 nt, Homo sapiens
agauccagacuguaa

SEQ ID NO: 458916 - RNA, 23 nt, Homo sapiens
agauccagggacugaagccaaag

SEQ ID NO: 458917 - RNA, 19 nt, Homo sapiens
agaucgcaucauugcacuc

SEQ ID NO: 458918 - RNA, 19 nt, Homo sapiens
agaucguucucugccucac

SEQ ID NO: 458919 - RNA, 21 nt, Homo sapiens
agaucuaauauugacugccuc

SEQ ID NO: 458920 - RNA, 22 nt, Homo sapiens
agaucuaauauugacugccucu

SEQ ID NO: 458921 - RNA, 17 nt, Homo sapiens
agaucuaaucccuucaa

SEQ ID NO: 458922 - RNA, 22 nt, Homo sapiens
agaucucucgaaugcugagaag

SEQ ID NO: 458923 - RNA, 21 nt, Homo sapiens
agaucuguuaagugguuucau

SEQ ID NO: 458924 - RNA, 17 nt, Homo sapiens
agaucuuaagauuccau

SEQ ID NO: 458925 - RNA, 17 nt, Homo sapiens
agaugaacucuucucaa

SEQ ID NO: 458926 - RNA, 15 nt, Homo sapiens
agaugaucauuugcc

SEQ ID NO: 458927 - RNA, 19 nt, Homo sapiens
agaugaucgugccuauaaa

SEQ ID NO: 458928 - RNA, 14 nt, Homo sapiens
agaugcaccaagua

SEQ ID NO: 458929 - RNA, 17 nt, Homo sapiens
agaugcaccaaguacag

SEQ ID NO: 458930 - RNA, 15 nt, Homo sapiens
agaugccaaaaaaga

SEQ ID NO: 458931 - RNA, 20 nt, Homo sapiens
agaugccauggccugugcug

SEQ ID NO: 458932 - RNA, 18 nt, Homo sapiens
agaugccccagagcuguu

SEQ ID NO: 458933 - RNA, 13 nt, Homo sapiens
agaugccuuccag

SEQ ID NO: 458934 - RNA, 15 nt, Homo sapiens
agauggaaugcugug

SEQ ID NO: 458935 - RNA, 22 nt, Homo sapiens
agaugggcaaauuaaggcauaa

SEQ ID NO: 458936 - RNA, 12 nt, Homo sapiens
agauggggacag

SEQ ID NO: 458937 - RNA, 17 nt, Homo sapiens
agauggggacaggugaa

SEQ ID NO: 458938 - RNA, 15 nt, Homo sapiens
agaugggggucucac

SEQ ID NO: 458939 - RNA, 22 nt, Homo sapiens
agauggguauuaaacuugucag

SEQ ID NO: 458940 - RNA, 22 nt, Homo sapiens
agauguaagaaauguucuugca

SEQ ID NO: 458941 - RNA, 19 nt, Homo sapiens
agauguccucagaagucag

SEQ ID NO: 458942 - RNA, 17 nt, Homo sapiens
aggcuaguccggaccca

SEQ ID NO: 458943 - RNA, 19 nt, Homo sapiens
aggcucucccucucugcac

SEQ ID NO: 458944 - RNA, 17 nt, Homo sapiens
aggcucugcauacacau

SEQ ID NO: 458945 - RNA, 13 nt, Homo sapiens
aggcucuuagcag

SEQ ID NO: 458946 - RNA, 13 nt, Homo sapiens
aggcugacugggg

SEQ ID NO: 458947 - RNA, 14 nt, Homo sapiens
aggcugaggacuua

SEQ ID NO: 458948 - RNA, 23 nt, Homo sapiens
aggcugagucagccccacuccac

SEQ ID NO: 458949 - RNA, 15 nt, Homo sapiens
aggcugccucugggu

SEQ ID NO: 458950 - RNA, 17 nt, Homo sapiens
aggcugcgacugaugaa

SEQ ID NO: 458951 - RNA, 18 nt, Homo sapiens
aggcugcgacugaugaag

SEQ ID NO: 458952 - RNA, 17 nt, Homo sapiens
aggcugcugaaaaccau

SEQ ID NO: 458953 - RNA, 18 nt, Homo sapiens
aggcugcuggacacgucg

SEQ ID NO: 458954 - RNA, 20 nt, Homo sapiens
aggcuggagggcaguggcac

SEQ ID NO: 458955 - RNA, 20 nt, Homo sapiens
aggcuggagugcaacggcau

SEQ ID NO: 458956 - RNA, 14 nt, Homo sapiens
aggcuggcaguaca

SEQ ID NO: 458957 - RNA, 13 nt, Homo sapiens
aggcuggggcuau

SEQ ID NO: 458958 - RNA, 22 nt, Homo sapiens
aggcuucccugacuugcuuuag

SEQ ID NO: 458959 - RNA, 19 nt, Homo sapiens
aggcuugaaguaaccuuau

SEQ ID NO: 458960 - RNA, 22 nt, Homo sapiens
aggcuuggcacacugccagugu

SEQ ID NO: 458961 - RNA, 15 nt, Homo sapiens
agggaaacacagcag

SEQ ID NO: 458962 - RNA, 15 nt, Homo sapiens
agggaagaguucuga

SEQ ID NO: 458963 - RNA, 15 nt, Homo sapiens
agggaagcucagggg

SEQ ID NO: 458964 - RNA, 14 nt, Homo sapiens
agggaauugcucag

SEQ ID NO: 458965 - RNA, 13 nt, Homo sapiens
agggacagcgggu

SEQ ID NO: 458966 - RNA, 20 nt, Homo sapiens
agggaccuuggagagcucag

SEQ ID NO: 458967 - RNA, 21 nt, Homo sapiens
agggacucuuguuaacaguaa

SEQ ID NO: 458968 - RNA, 12 nt, Homo sapiens
agggacugccuc

SEQ ID NO: 458969 - RNA, 19 nt, Homo sapiens
agggagaucuuggggugca

SEQ ID NO: 458970 - RNA, 12 nt, Homo sapiens
agggagggagca

SEQ ID NO: 458971 - RNA, 20 nt, Homo sapiens
agggauauuuugaguucugu

SEQ ID NO: 458972 - RNA, 15 nt, Homo sapiens
agggaucuguuugaa

SEQ ID NO: 458973 - RNA, 23 nt, Homo sapiens
agggaugccaacaccuucuuggc

SEQ ID NO: 458974 - RNA, 12 nt, Homo sapiens
agggaugggaga

SEQ ID NO: 458975 - RNA, 18 nt, Homo sapiens
agggauggggagcagcug

SEQ ID NO: 458976 - RNA, 19 nt, Homo sapiens
agggcacugcugcugccuu

SEQ ID NO: 458977 - RNA, 12 nt, Homo sapiens
agggcagcacug

SEQ ID NO: 458978 - RNA, 15 nt, Homo sapiens
agggccacugggaag

SEQ ID NO: 458979 - RNA, 15 nt, Homo sapiens
agggcccaucugccg

SEQ ID NO: 458980 - RNA, 17 nt, Homo sapiens
agggccccacucaggga

SEQ ID NO: 458981 - RNA, 18 nt, Homo sapiens
agggccccucccucugcc

SEQ ID NO: 458982 - RNA, 22 nt, Homo sapiens
agggccgcccgggcccagagga

SEQ ID NO: 458983 - RNA, 18 nt, Homo sapiens
agggcuagcaucccugag

SEQ ID NO: 458984 - RNA, 12 nt, Homo sapiens
agggcugaccca

SEQ ID NO: 458985 - RNA, 13 nt, Homo sapiens
agggcugccugaa

SEQ ID NO: 458986 - RNA, 19 nt, Homo sapiens
agggcugguguggcugcuc

SEQ ID NO: 458987 - RNA, 22 nt, Homo sapiens
agggcuuuucuuuaguggagaa

SEQ ID NO: 458988 - RNA, 22 nt, Homo sapiens
aggggaagggccagucugggcu

SEQ ID NO: 458989 - RNA, 21 nt, Homo sapiens
aggggacacugaaccuuguug

SEQ ID NO: 458990 - RNA, 12 nt, Homo sapiens
aggggacugggg

SEQ ID NO: 458991 - RNA, 16 nt, Homo sapiens
aggggacuugaaucuu

SEQ ID NO: 458992 - RNA, 14 nt, Homo sapiens
aggggagccagggu

SEQ ID NO: 458993 - RNA, 17 nt, Homo sapiens
aggggcaaagaacugcc

SEQ ID NO: 458994 - RNA, 15 nt, Homo sapiens
aggggcaacugauga

SEQ ID NO: 458995 - RNA, 23 nt, Homo sapiens
aggggcaggccugggacccagcu

SEQ ID NO: 458996 - RNA, 16 nt, Homo sapiens
aggggcauuaguuuca

SEQ ID NO: 458997 - RNA, 14 nt, Homo sapiens
aggggcccuuggga

SEQ ID NO: 458998 - RNA, 19 nt, Homo sapiens
aggggccucagguuugccu

SEQ ID NO: 458999 - RNA, 22 nt, Homo sapiens
aggggcuuuggaagcucuguug

SEQ ID NO: 459000 - RNA, 20 nt, Homo sapiens
agggggccaugaggccucag

SEQ ID NO: 459001 - RNA, 20 nt, Homo sapiens
agggggcgcucaggacccag

SEQ ID NO: 459002 - RNA, 17 nt, Homo sapiens
agggggcugcucugcaa

SEQ ID NO: 459003 - RNA, 21 nt, Homo sapiens
agggguaauauauugcugcug

SEQ ID NO: 459004 - RNA, 17 nt, Homo sapiens
agggguagaaguggcau

SEQ ID NO: 459005 - RNA, 16 nt, Homo sapiens
agggguaugucuuuau

SEQ ID NO: 459006 - RNA, 16 nt, Homo sapiens
aggggucaccuugaga

SEQ ID NO: 459007 - RNA, 15 nt, Homo sapiens
aggggucagcagggg

SEQ ID NO: 459008 - RNA, 18 nt, Homo sapiens
aggggucgccaacacuug

SEQ ID NO: 459009 - RNA, 15 nt, Homo sapiens
aggggugggagccaa

SEQ ID NO: 459010 - RNA, 15 nt, Homo sapiens
aggggugucuugucu

SEQ ID NO: 459011 - RNA, 15 nt, Homo sapiens
aggguaaggcugugg

SEQ ID NO: 459012 - RNA, 20 nt, Homo sapiens
aggguagauaaccuguacuu

SEQ ID NO: 459013 - RNA, 16 nt, Homo sapiens
agggugcugcuucccu

SEQ ID NO: 459014 - RNA, 16 nt, Homo sapiens
agggugggcagccuau

SEQ ID NO: 459015 - RNA, 18 nt, Homo sapiens
agggugugggucagggag

SEQ ID NO: 459016 - RNA, 22 nt, Homo sapiens
aggguuacccugggcacuggcc

SEQ ID NO: 459017 - RNA, 19 nt, Homo sapiens
aggguucaaauuccugcaa

SEQ ID NO: 459018 - RNA, 19 nt, Homo sapiens
aggguugccaguccugcaa

SEQ ID NO: 459019 - RNA, 20 nt, Homo sapiens
aggguuuuaucucugucuac

SEQ ID NO: 459020 - RNA, 18 nt, Homo sapiens
agguaagggggugcagca

SEQ ID NO: 459021 - RNA, 14 nt, Homo sapiens
agguacaaguggcu

SEQ ID NO: 459022 - RNA, 13 nt, Homo sapiens
agguacccaaggu

SEQ ID NO: 459023 - RNA, 17 nt, Homo sapiens
agguaggaucaucccac

SEQ ID NO: 459024 - RNA, 17 nt, Homo sapiens
agguagggguugggaau

SEQ ID NO: 459025 - RNA, 17 nt, Homo sapiens
agguaguagaaucucag

SEQ ID NO: 459026 - RNA, 20 nt, Homo sapiens
agguagugauuaacugugaa

SEQ ID NO: 459027 - RNA, 21 nt, Homo sapiens
agguaugugucagccaugacc

SEQ ID NO: 459028 - RNA, 16 nt, Homo sapiens
aggucaccugugcaca

SEQ ID NO: 459029 - RNA, 23 nt, Homo sapiens
aggucagaaaccauuguucagaa

SEQ ID NO: 459030 - RNA, 22 nt, Homo sapiens
aggucagauggagguucucaga

SEQ ID NO: 459031 - RNA, 18 nt, Homo sapiens
aggucagcuugcugcccu

SEQ ID NO: 459032 - RNA, 22 nt, Homo sapiens
aggucaguacccaccugagcuu

SEQ ID NO: 459033 - RNA, 18 nt, Homo sapiens
aggucaucuuuuuccccu

SEQ ID NO: 459034 - RNA, 18 nt, Homo sapiens
aggucauuauuuuuuaca

SEQ ID NO: 459035 - RNA, 20 nt, Homo sapiens
agguccccugaggucaugca

SEQ ID NO: 459036 - RNA, 15 nt, Homo sapiens
aggucccucagacau

SEQ ID NO: 459037 - RNA, 18 nt, Homo sapiens
agguccuaaagaugcuga

SEQ ID NO: 459038 - RNA, 13 nt, Homo sapiens
agguccucuacuu

SEQ ID NO: 459039 - RNA, 23 nt, Homo sapiens
agguccucuacuuaaugagauag

SEQ ID NO: 459040 - RNA, 22 nt, Homo sapiens
agguccuggggaggcugagacu

SEQ ID NO: 459041 - RNA, 16 nt, Homo sapiens
agguccugugagcaaa

SEQ ID NO: 459042 - RNA, 16 nt, Homo sapiens
agguccuuucuccuga

SEQ ID NO: 459043 - RNA, 11 nt, Homo sapiens
aggucuaucaa

SEQ ID NO: 459044 - RNA, 21 nt, Homo sapiens
aggucuccaccccucaagcca

SEQ ID NO: 459045 - RNA, 15 nt, Homo sapiens
aggucucugaacuca

SEQ ID NO: 459046 - RNA, 22 nt, Homo sapiens
aggucugauaguccucugcuaa

SEQ ID NO: 459047 - RNA, 20 nt, Homo sapiens
aggucugcaggccaccagcu

SEQ ID NO: 459048 - RNA, 22 nt, Homo sapiens
aggucugcucggccgucuucac

SEQ ID NO: 459049 - RNA, 16 nt, Homo sapiens
aggugaacgcacuuau

SEQ ID NO: 459050 - RNA, 23 nt, Homo sapiens
aggugauccacccaccuuggccu

SEQ ID NO: 459051 - RNA, 20 nt, Homo sapiens
aggugaucuaccugccucag

SEQ ID NO: 459052 - RNA, 18 nt, Homo sapiens
aggugaugguaacugcac

SEQ ID NO: 459053 - RNA, 22 nt, Homo sapiens
aggugauucugaucccugauca

SEQ ID NO: 459054 - RNA, 19 nt, Homo sapiens
aggugcuaucgcaccacug

SEQ ID NO: 459055 - RNA, 20 nt, Homo sapiens
aggugcucaaagauguacug

SEQ ID NO: 459056 - RNA, 21 nt, Homo sapiens
aggugcucaaagauguacuga

SEQ ID NO: 459057 - RNA, 22 nt, Homo sapiens
aggugcuggccucaaacagcca

SEQ ID NO: 459058 - RNA, 15 nt, Homo sapiens
agguggccacuccag

SEQ ID NO: 459059 - RNA, 19 nt, Homo sapiens
agguggccaggccugccag

SEQ ID NO: 459060 - RNA, 16 nt, Homo sapiens
agguggcucagugcca

SEQ ID NO: 459061 - RNA, 21 nt, Homo sapiens
aggugggccuugcuaccucaa

SEQ ID NO: 459062 - RNA, 18 nt, Homo sapiens
aggugggggagccuggag

SEQ ID NO: 459063 - RNA, 14 nt, Homo sapiens
agguggguccagga

SEQ ID NO: 459064 - RNA, 15 nt, Homo sapiens
agguggugaggcaau

SEQ ID NO: 459065 - RNA, 13 nt, Homo sapiens
agguggugccuuc

SEQ ID NO: 459066 - RNA, 19 nt, Homo sapiens
aggugugaggacuucugca

SEQ ID NO: 459067 - RNA, 23 nt, Homo sapiens
agguuaucugccuggccuggcuc

SEQ ID NO: 459068 - RNA, 23 nt, Homo sapiens
agguuauuuuccgccagaccuca

SEQ ID NO: 459069 - RNA, 20 nt, Homo sapiens
agguucucagcaaguguaca

SEQ ID NO: 459070 - RNA, 19 nt, Homo sapiens
agguucucagguguugcca

SEQ ID NO: 459071 - RNA, 21 nt, Homo sapiens
caaauguuauucaauaacuau

SEQ ID NO: 459072 - RNA, 15 nt, Homo sapiens
caaauuaaggcauaa

SEQ ID NO: 459073 - RNA, 15 nt, Homo sapiens
caaauuauaaaaagc

SEQ ID NO: 459074 - RNA, 16 nt, Homo sapiens
caaauuauucuaguca

SEQ ID NO: 459075 - RNA, 13 nt, Homo sapiens
caaauugaucaag

SEQ ID NO: 459076 - RNA, 11 nt, Homo sapiens
caaauuucaca

SEQ ID NO: 459077 - RNA, 18 nt, Homo sapiens
caaauuucaucuuuccaa

SEQ ID NO: 459078 - RNA, 12 nt, Homo sapiens
caacaaaaggga

SEQ ID NO: 459079 - RNA, 14 nt, Homo sapiens
caacaaaagggaaa

SEQ ID NO: 459080 - RNA, 20 nt, Homo sapiens
caacaaacacauugugaaua

SEQ ID NO: 459081 - RNA, 17 nt, Homo sapiens
caacaaagcaugcucag

SEQ ID NO: 459082 - RNA, 14 nt, Homo sapiens
caacaagaaaagaa

SEQ ID NO: 459083 - RNA, 19 nt, Homo sapiens
caacaaucccagcaucuga

SEQ ID NO: 459084 - RNA, 14 nt, Homo sapiens
caacaauuguccca

SEQ ID NO: 459085 - RNA, 14 nt, Homo sapiens
caacaccacaaacc

SEQ ID NO: 459086 - RNA, 17 nt, Homo sapiens
caacaccaucacagcuu

SEQ ID NO: 459087 - RNA, 23 nt, Homo sapiens
caacacugcugcuccagugcagg

SEQ ID NO: 459088 - RNA, 19 nt, Homo sapiens
caacacuugcacaaucacg

SEQ ID NO: 459089 - RNA, 17 nt, Homo sapiens
caacagagaugccauga

SEQ ID NO: 459090 - RNA, 19 nt, Homo sapiens
caacagagaugccaugaua

SEQ ID NO: 459091 - RNA, 12 nt, Homo sapiens
caacagcacugg

SEQ ID NO: 459092 - RNA, 18 nt, Homo sapiens
caacagcugaugcccuau

SEQ ID NO: 459093 - RNA, 14 nt, Homo sapiens
caacagucagccag

SEQ ID NO: 459094 - RNA, 21 nt, Homo sapiens
caacaguuaaacuugcaauga

SEQ ID NO: 459095 - RNA, 23 nt, Homo sapiens
caacaguuaaacuugcaaugaaa

SEQ ID NO: 459096 - RNA, 21 nt, Homo sapiens
caacaguucuuguuagaauca

SEQ ID NO: 459097 - RNA, 18 nt, Homo sapiens
caacaguuuuuuaugcua

SEQ ID NO: 459098 - RNA, 16 nt, Homo sapiens
caacaucucgagcccc

SEQ ID NO: 459099 - RNA, 21 nt, Homo sapiens
caacauggugaaaccccaucu

SEQ ID NO: 459100 - RNA, 20 nt, Homo sapiens
caacauguuacugaccagca

SEQ ID NO: 459101 - RNA, 21 nt, Homo sapiens
caacauuugcuuuuugcuugu

SEQ ID NO: 459102 - RNA, 14 nt, Homo sapiens
caaccaacaccaca

SEQ ID NO: 459103 - RNA, 18 nt, Homo sapiens
caaccaagucaugugcau

SEQ ID NO: 459104 - RNA, 15 nt, Homo sapiens
caaccacacaccuca

SEQ ID NO: 459105 - RNA, 20 nt, Homo sapiens
caaccacacaccucaccaga

SEQ ID NO: 459106 - RNA, 18 nt, Homo sapiens
caaccaggaacauguaac

SEQ ID NO: 459107 - RNA, 19 nt, Homo sapiens
caaccaguuugaaccaaga

SEQ ID NO: 459108 - RNA, 17 nt, Homo sapiens
caaccauagaacugucc

SEQ ID NO: 459109 - RNA, 12 nt, Homo sapiens
caacccacuuaa

SEQ ID NO: 459110 - RNA, 13 nt, Homo sapiens
caaccccaugaga

SEQ ID NO: 459111 - RNA, 14 nt, Homo sapiens
caacccugccccug

SEQ ID NO: 459112 - RNA, 20 nt, Homo sapiens
caaccucaaugcccugccau

SEQ ID NO: 459113 - RNA, 17 nt, Homo sapiens
caaccucccaacccaga

SEQ ID NO: 459114 - RNA, 16 nt, Homo sapiens
caaccugccugugcau

SEQ ID NO: 459115 - RNA, 21 nt, Homo sapiens
caaccugcucuccucuugcca

SEQ ID NO: 459116 - RNA, 22 nt, Homo sapiens
caaccugcugaagggcagaggu

SEQ ID NO: 459117 - RNA, 20 nt, Homo sapiens
caaccuggguaacaaaguga

SEQ ID NO: 459118 - RNA, 16 nt, Homo sapiens
caaccuguuaccacuu

SEQ ID NO: 459119 - RNA, 15 nt, Homo sapiens
caaccuuuuaugugu

SEQ ID NO: 459120 - RNA, 14 nt, Homo sapiens
caacgaaaagcaca

SEQ ID NO: 459121 - RNA, 18 nt, Homo sapiens
caacgagagcacuugaaa

SEQ ID NO: 459122 - RNA, 14 nt, Homo sapiens
caacgaugaugcuu

SEQ ID NO: 459123 - RNA, 16 nt, Homo sapiens
caacggccgacugccu

SEQ ID NO: 459124 - RNA, 14 nt, Homo sapiens
caacuacagaauuu

SEQ ID NO: 459125 - RNA, 16 nt, Homo sapiens
caacuauuaagauauc

SEQ ID NO: 459126 - RNA, 15 nt, Homo sapiens
caacucacugugcuc

SEQ ID NO: 459127 - RNA, 18 nt, Homo sapiens
caacucagaaugcucuac

SEQ ID NO: 459128 - RNA, 21 nt, Homo sapiens
caacuccaaggcaaaugucca

SEQ ID NO: 459129 - RNA, 17 nt, Homo sapiens
caacuccagccacccag

SEQ ID NO: 459130 - RNA, 12 nt, Homo sapiens
caacuccagggg

SEQ ID NO: 459131 - RNA, 14 nt, Homo sapiens
caacuccaggguua

SEQ ID NO: 459132 - RNA, 15 nt, Homo sapiens
caacuccucuccucc

SEQ ID NO: 459133 - RNA, 20 nt, Homo sapiens
caacucuaccccugcuccca

SEQ ID NO: 459134 - RNA, 22 nt, Homo sapiens
caacucucuccuguauaaucuc

SEQ ID NO: 459135 - RNA, 16 nt, Homo sapiens
caacucugcacuccau

SEQ ID NO: 459136 - RNA, 13 nt, Homo sapiens
caacugaccagcc

SEQ ID NO: 459137 - RNA, 14 nt, Homo sapiens
caacugacuuccaa

SEQ ID NO: 459138 - RNA, 22 nt, Homo sapiens
caacugacuuccaagauccuuu

SEQ ID NO: 459139 - RNA, 13 nt, Homo sapiens
caacugagccaaa

SEQ ID NO: 459140 - RNA, 19 nt, Homo sapiens
caacugcaucaagauguga

SEQ ID NO: 459141 - RNA, 15 nt, Homo sapiens
caacugcugccccaa

SEQ ID NO: 459142 - RNA, 23 nt, Homo sapiens
caacuguuuuugaagaagggaaa

SEQ ID NO: 459143 - RNA, 20 nt, Homo sapiens
caacuucagcaguaccuaua

SEQ ID NO: 459144 - RNA, 22 nt, Homo sapiens
caacuuuagcuaguaucuucaa

SEQ ID NO: 459145 - RNA, 15 nt, Homo sapiens
caacuuucauuugaa

SEQ ID NO: 459146 - RNA, 12 nt, Homo sapiens
caacuuugacaa

SEQ ID NO: 459147 - RNA, 13 nt, Homo sapiens
caagaagacugua

SEQ ID NO: 459148 - RNA, 21 nt, Homo sapiens
caagaagcccuccuugccacc

SEQ ID NO: 459149 - RNA, 16 nt, Homo sapiens
caagaauacugaguca

SEQ ID NO: 459150 - RNA, 19 nt, Homo sapiens
caagaauauuguauguuaa

SEQ ID NO: 459151 - RNA, 23 nt, Homo sapiens
caagacacccaguggaaccaaaa

SEQ ID NO: 459152 - RNA, 14 nt, Homo sapiens
caagagaaggagau

SEQ ID NO: 459153 - RNA, 12 nt, Homo sapiens
caagagcucuuu

SEQ ID NO: 459154 - RNA, 16 nt, Homo sapiens
caagagggaaggugac

SEQ ID NO: 459155 - RNA, 20 nt, Homo sapiens
caagagugagugaacaacua

SEQ ID NO: 459156 - RNA, 14 nt, Homo sapiens
caagauaaacacaa

SEQ ID NO: 459157 - RNA, 21 nt, Homo sapiens
caagauacauaugaggacaag

SEQ ID NO: 459158 - RNA, 22 nt, Homo sapiens
caagauaggggcacacuacaga

SEQ ID NO: 459159 - RNA, 20 nt, Homo sapiens
caagaucacgccacugcacu

SEQ ID NO: 459160 - RNA, 13 nt, Homo sapiens
caagauccuuaau

SEQ ID NO: 459161 - RNA, 18 nt, Homo sapiens
caagauccuuaaugcaga

SEQ ID NO: 459162 - RNA, 12 nt, Homo sapiens
caagaugagauu

SEQ ID NO: 459163 - RNA, 14 nt, Homo sapiens
caagauugaagucu

SEQ ID NO: 459164 - RNA, 23 nt, Homo sapiens
caagcaaaccaauggugauccuc

SEQ ID NO: 459165 - RNA, 16 nt, Homo sapiens
caagcacugacacuca

SEQ ID NO: 459166 - RNA, 20 nt, Homo sapiens
caagcaggaaccccaggaga

SEQ ID NO: 459167 - RNA, 13 nt, Homo sapiens
caagcauucugug

SEQ ID NO: 459168 - RNA, 23 nt, Homo sapiens
caagccaaaaaccuuagcucccu

SEQ ID NO: 459169 - RNA, 15 nt, Homo sapiens
caagccacuaccuuc

SEQ ID NO: 459170 - RNA, 13 nt, Homo sapiens
caagccaggguuc

SEQ ID NO: 459171 - RNA, 18 nt, Homo sapiens
caagccaguacgugcuaa

SEQ ID NO: 459172 - RNA, 15 nt, Homo sapiens
caagcccacuggcca

SEQ ID NO: 459173 - RNA, 20 nt, Homo sapiens
caagccuggagccccugugu

SEQ ID NO: 459174 - RNA, 20 nt, Homo sapiens
caagccuuggaccaaaugga

SEQ ID NO: 459175 - RNA, 14 nt, Homo sapiens
caagcuaacugcuu

SEQ ID NO: 459176 - RNA, 18 nt, Homo sapiens
caagcuaauaaaauauca

SEQ ID NO: 459177 - RNA, 21 nt, Homo sapiens
caagcuaggacaccuguggua

SEQ ID NO: 459178 - RNA, 17 nt, Homo sapiens
caagcugccugccugag

SEQ ID NO: 459179 - RNA, 16 nt, Homo sapiens
caagcuuagaagccac

SEQ ID NO: 459180 - RNA, 16 nt, Homo sapiens
caaggacaaccugccc

SEQ ID NO: 459181 - RNA, 16 nt, Homo sapiens
caaggacauugcccca

SEQ ID NO: 459182 - RNA, 17 nt, Homo sapiens
caaggacauugccccaa

SEQ ID NO: 459183 - RNA, 17 nt, Homo sapiens
caaggaguaaguacaaa

SEQ ID NO: 459184 - RNA, 19 nt, Homo sapiens
caaggauccucuccacucc

SEQ ID NO: 459185 - RNA, 21 nt, Homo sapiens
caaggauuagaacacucauua

SEQ ID NO: 459186 - RNA, 16 nt, Homo sapiens
caaggcaaggcuguca

SEQ ID NO: 459187 - RNA, 15 nt, Homo sapiens
caaggccccagagac

SEQ ID NO: 459188 - RNA, 14 nt, Homo sapiens
caaggccucaggag

SEQ ID NO: 459189 - RNA, 15 nt, Homo sapiens
caaggcuaguuccuu

SEQ ID NO: 459190 - RNA, 15 nt, Homo sapiens
caaggcugcagugag

SEQ ID NO: 459191 - RNA, 21 nt, Homo sapiens
caaggcuggccagcaaggcag

SEQ ID NO: 459192 - RNA, 14 nt, Homo sapiens
caagggaaucugua

SEQ ID NO: 459193 - RNA, 15 nt, Homo sapiens
caagggacugggggu

SEQ ID NO: 459194 - RNA, 21 nt, Homo sapiens
caagggcagguugaucaguga

SEQ ID NO: 459195 - RNA, 15 nt, Homo sapiens
caaggggacaucuua

SEQ ID NO: 459196 - RNA, 20 nt, Homo sapiens
caagggggacugucuuucag

SEQ ID NO: 459197 - RNA, 20 nt, Homo sapiens
caagggugcuuguggucaca

SEQ ID NO: 459198 - RNA, 20 nt, Homo sapiens
caagguauguacaguucaua

SEQ ID NO: 459199 - RNA, 20 nt, Homo sapiens
caaggucagcucccaucuca

SEQ ID NO: 459200 - RNA, 15 nt, Homo sapiens
caagguccacucccu

SEQ ID NO: 459201 - RNA, 16 nt, Homo sapiens
caagguccaugucacc

SEQ ID NO: 459202 - RNA, 15 nt, Homo sapiens
cagagagaaagaaga

SEQ ID NO: 459203 - RNA, 18 nt, Homo sapiens
cagagagacccugccaac

SEQ ID NO: 459204 - RNA, 23 nt, Homo sapiens
cagagaggacuguugacauccaa

SEQ ID NO: 459205 - RNA, 17 nt, Homo sapiens
cagagaggcucugagaa

SEQ ID NO: 459206 - RNA, 13 nt, Homo sapiens
cagagagggccca

SEQ ID NO: 459207 - RNA, 15 nt, Homo sapiens
cagagagggggccac

SEQ ID NO: 459208 - RNA, 16 nt, Homo sapiens
cagagauaaaccaaua

SEQ ID NO: 459209 - RNA, 19 nt, Homo sapiens
cagagauucccaagccaaa

SEQ ID NO: 459210 - RNA, 16 nt, Homo sapiens
cagagccacuaccuuu

SEQ ID NO: 459211 - RNA, 16 nt, Homo sapiens
cagagccccuggcaca

SEQ ID NO: 459212 - RNA, 22 nt, Homo sapiens
cagagcgccccucccuagugac

SEQ ID NO: 459213 - RNA, 15 nt, Homo sapiens
cagagcucagaggag

SEQ ID NO: 459214 - RNA, 16 nt, Homo sapiens
cagagcugagcccuca

SEQ ID NO: 459215 - RNA, 13 nt, Homo sapiens
cagagcugagucg

SEQ ID NO: 459216 - RNA, 14 nt, Homo sapiens
cagagcuggaacac

SEQ ID NO: 459217 - RNA, 17 nt, Homo sapiens
cagagcugucugaacuc

SEQ ID NO: 459218 - RNA, 21 nt, Homo sapiens
cagaggauucugucuuccagg

SEQ ID NO: 459219 - RNA, 18 nt, Homo sapiens
cagaggcagcuaaggggc

SEQ ID NO: 459220 - RNA, 19 nt, Homo sapiens
cagaggcaguaaccaugcc

SEQ ID NO: 459221 - RNA, 13 nt, Homo sapiens
cagaggcugagca

SEQ ID NO: 459222 - RNA, 14 nt, Homo sapiens
cagagggaccagcu

SEQ ID NO: 459223 - RNA, 15 nt, Homo sapiens
cagagggaccagcug

SEQ ID NO: 459224 - RNA, 23 nt, Homo sapiens
cagagggccccgcccagugcagu

SEQ ID NO: 459225 - RNA, 16 nt, Homo sapiens
cagagggucccuaggu

SEQ ID NO: 459226 - RNA, 21 nt, Homo sapiens
cagagguccccugaggucaug

SEQ ID NO: 459227 - RNA, 19 nt, Homo sapiens
cagaggucuggcaugugga

SEQ ID NO: 459228 - RNA, 17 nt, Homo sapiens
cagagguggcucuggaa

SEQ ID NO: 459229 - RNA, 16 nt, Homo sapiens
cagagguugcagugag

SEQ ID NO: 459230 - RNA, 20 nt, Homo sapiens
cagagucucgcucuguugcc

SEQ ID NO: 459231 - RNA, 20 nt, Homo sapiens
cagagugaacacucuuggua

SEQ ID NO: 459232 - RNA, 16 nt, Homo sapiens
cagagugaaucaucca

SEQ ID NO: 459233 - RNA, 16 nt, Homo sapiens
cagaguggacucuucc

SEQ ID NO: 459234 - RNA, 15 nt, Homo sapiens
cagaguugcuuuaaa

SEQ ID NO: 459235 - RNA, 24 nt, Homo sapiens
cagaguugcuuuaaaguaccugua

SEQ ID NO: 459236 - RNA, 14 nt, Homo sapiens
cagaguuguugcuu

SEQ ID NO: 459237 - RNA, 14 nt, Homo sapiens
cagauaacuuugac

SEQ ID NO: 459238 - RNA, 20 nt, Homo sapiens
cagauaagacauaucucuaa

SEQ ID NO: 459239 - RNA, 14 nt, Homo sapiens
cagauagagcuggg

SEQ ID NO: 459240 - RNA, 23 nt, Homo sapiens
cagauagguggugccaguggcuu

SEQ ID NO: 459241 - RNA, 13 nt, Homo sapiens
cagauauuucaca

SEQ ID NO: 459242 - RNA, 15 nt, Homo sapiens
cagaucaacugaguu

SEQ ID NO: 459243 - RNA, 20 nt, Homo sapiens
cagaucaacugaguucagga

SEQ ID NO: 459244 - RNA, 16 nt, Homo sapiens
cagaucauauuucaca

SEQ ID NO: 459245 - RNA, 15 nt, Homo sapiens
cagauccagacugua

SEQ ID NO: 459246 - RNA, 16 nt, Homo sapiens
cagauccagacuguaa

SEQ ID NO: 459247 - RNA, 22 nt, Homo sapiens
cagauccagggacugaagccaa

SEQ ID NO: 459248 - RNA, 20 nt, Homo sapiens
cagaucugacaugauuccuu

SEQ ID NO: 459249 - RNA, 21 nt, Homo sapiens
cagaugaaaccaggucacugg

SEQ ID NO: 459250 - RNA, 20 nt, Homo sapiens
cagaugaaauuuauuuccau

SEQ ID NO: 459251 - RNA, 20 nt, Homo sapiens
cagaugaacucuuucuggcc

SEQ ID NO: 459252 - RNA, 19 nt, Homo sapiens
cagaugacaaggauuagaa

SEQ ID NO: 459253 - RNA, 14 nt, Homo sapiens
cagaugacacccua

SEQ ID NO: 459254 - RNA, 14 nt, Homo sapiens
cagaugaucucuua

SEQ ID NO: 459255 - RNA, 21 nt, Homo sapiens
cagaugccauggccugugcug

SEQ ID NO: 459256 - RNA, 19 nt, Homo sapiens
cagauggaaacucuuuaac

SEQ ID NO: 459257 - RNA, 16 nt, Homo sapiens
cagauggaguaccaug

SEQ ID NO: 459258 - RNA, 17 nt, Homo sapiens
cagauggcaauuucacu

SEQ ID NO: 459259 - RNA, 23 nt, Homo sapiens
cagauggcugugaaaauuacacc

SEQ ID NO: 459260 - RNA, 15 nt, Homo sapiens
cagauggguauuaaa

SEQ ID NO: 459261 - RNA, 15 nt, Homo sapiens
cagauggucccauua

SEQ ID NO: 459262 - RNA, 22 nt, Homo sapiens
cagaugucuucugccuguuaua

SEQ ID NO: 459263 - RNA, 11 nt, Homo sapiens
cagaugugcau

SEQ ID NO: 459264 - RNA, 17 nt, Homo sapiens
cagauuaucuuguacag

SEQ ID NO: 459265 - RNA, 21 nt, Homo sapiens
cagauuccaggcgaugugcaa

SEQ ID NO: 459266 - RNA, 15 nt, Homo sapiens
cagauuuaccauaau

SEQ ID NO: 459267 - RNA, 15 nt, Homo sapiens
cagcaacaucugcaa

SEQ ID NO: 459268 - RNA, 17 nt, Homo sapiens
cagcaacccuccuauca

SEQ ID NO: 459269 - RNA, 15 nt, Homo sapiens
cagcaacuggugacu

SEQ ID NO: 459270 - RNA, 22 nt, Homo sapiens
cagcaagcccgucaucuucccu

SEQ ID NO: 459271 - RNA, 15 nt, Homo sapiens
cagcacauguugcua

SEQ ID NO: 459272 - RNA, 11 nt, Homo sapiens
cagcacccaca

SEQ ID NO: 459273 - RNA, 17 nt, Homo sapiens
cagcacccccacccacc

SEQ ID NO: 459274 - RNA, 12 nt, Homo sapiens
cagcaccugcca

SEQ ID NO: 459275 - RNA, 15 nt, Homo sapiens
cagcacucuuaucua

SEQ ID NO: 459276 - RNA, 18 nt, Homo sapiens
cagcacuuaaacugccuc

SEQ ID NO: 459277 - RNA, 11 nt, Homo sapiens
cagcacuuugg

SEQ ID NO: 459278 - RNA, 17 nt, Homo sapiens
cagcagccucccuguca

SEQ ID NO: 459279 - RNA, 19 nt, Homo sapiens
cagcagccucccugucacu

SEQ ID NO: 459280 - RNA, 17 nt, Homo sapiens
cagcagcgguaccccag

SEQ ID NO: 459281 - RNA, 17 nt, Homo sapiens
cagcagcuucaccagag

SEQ ID NO: 459282 - RNA, 14 nt, Homo sapiens
cagcagggcuguga

SEQ ID NO: 459283 - RNA, 12 nt, Homo sapiens
cagcaggggugg

SEQ ID NO: 459284 - RNA, 14 nt, Homo sapiens
cagcaguaucacag

SEQ ID NO: 459285 - RNA, 11 nt, Homo sapiens
cagcagucaca

SEQ ID NO: 459286 - RNA, 16 nt, Homo sapiens
cagcagucacaggucu

SEQ ID NO: 459287 - RNA, 16 nt, Homo sapiens
cagcaucaaacaugaa

SEQ ID NO: 459288 - RNA, 11 nt, Homo sapiens
cagcaucaggg

SEQ ID NO: 459289 - RNA, 21 nt, Homo sapiens
cagcauuauuugaaaacacug

SEQ ID NO: 459290 - RNA, 17 nt, Homo sapiens
cagcauuggccuuaaua

SEQ ID NO: 459291 - RNA, 17 nt, Homo sapiens
cagccaaaugcagggag

SEQ ID NO: 459292 - RNA, 18 nt, Homo sapiens
cagccaagacccaacagg

SEQ ID NO: 459293 - RNA, 19 nt, Homo sapiens
cagccaagcccacccuggg

SEQ ID NO: 459294 - RNA, 17 nt, Homo sapiens
cagccaaggugcuaaaa

SEQ ID NO: 459295 - RNA, 14 nt, Homo sapiens
cagccaccaccacu

SEQ ID NO: 459296 - RNA, 22 nt, Homo sapiens
cagccacuccucaaccuugacu

SEQ ID NO: 459297 - RNA, 22 nt, Homo sapiens
cagccagcgcaggcccuggugg

SEQ ID NO: 459298 - RNA, 15 nt, Homo sapiens
cagccaggaggggcu

SEQ ID NO: 459299 - RNA, 17 nt, Homo sapiens
cagccauaaaaccuggg

SEQ ID NO: 459300 - RNA, 16 nt, Homo sapiens
cagcccaacaccaccu

SEQ ID NO: 459301 - RNA, 21 nt, Homo sapiens
cagcccacagaggacagugcu

SEQ ID NO: 459302 - RNA, 17 nt, Homo sapiens
cagccccaacuccaggg

SEQ ID NO: 459303 - RNA, 21 nt, Homo sapiens
cagccccauccuucccgcagc

SEQ ID NO: 459304 - RNA, 23 nt, Homo sapiens
cagccccccaguguccccagggg

SEQ ID NO: 459305 - RNA, 19 nt, Homo sapiens
cagcccuagaggcgagcca

SEQ ID NO: 459306 - RNA, 19 nt, Homo sapiens
cagcccuauggaagucuca

SEQ ID NO: 459307 - RNA, 22 nt, Homo sapiens
cagcccuguucugggugcagcu

SEQ ID NO: 459308 - RNA, 19 nt, Homo sapiens
cagcccuucccugcuuuga

SEQ ID NO: 459309 - RNA, 16 nt, Homo sapiens
cagccgaaaagcuuuu

SEQ ID NO: 459310 - RNA, 21 nt, Homo sapiens
cagccgucccgcguucaagac

SEQ ID NO: 459311 - RNA, 20 nt, Homo sapiens
cagccuacuuucacacuaag

SEQ ID NO: 459312 - RNA, 13 nt, Homo sapiens
cagccucaagucu

SEQ ID NO: 459313 - RNA, 15 nt, Homo sapiens
cagccucagugccac

SEQ ID NO: 459314 - RNA, 13 nt, Homo sapiens
cagccucaucucu

SEQ ID NO: 459315 - RNA, 19 nt, Homo sapiens
cagccuccacuguguccag

SEQ ID NO: 459316 - RNA, 18 nt, Homo sapiens
cagccuccaguuguagca

SEQ ID NO: 459317 - RNA, 20 nt, Homo sapiens
cagccuccccacguggcacc

SEQ ID NO: 459318 - RNA, 20 nt, Homo sapiens
cagccuccuguguagcuggg

SEQ ID NO: 459319 - RNA, 12 nt, Homo sapiens
cagccucuagaa

SEQ ID NO: 459320 - RNA, 19 nt, Homo sapiens
cagccugcacacaccugcc

SEQ ID NO: 459321 - RNA, 19 nt, Homo sapiens
cagccugcuucccaccucc

SEQ ID NO: 459322 - RNA, 17 nt, Homo sapiens
cagccuggacaccucuc

SEQ ID NO: 459323 - RNA, 20 nt, Homo sapiens
cagccuggccccugugcacc

SEQ ID NO: 459324 - RNA, 22 nt, Homo sapiens
cagccuggggggucguggcaga

SEQ ID NO: 459325 - RNA, 19 nt, Homo sapiens
cagccugggugacagagca

SEQ ID NO: 459326 - RNA, 16 nt, Homo sapiens
cagccuguccaacaga

SEQ ID NO: 459327 - RNA, 21 nt, Homo sapiens
cagccugugagggagugcaga

SEQ ID NO: 459328 - RNA, 20 nt, Homo sapiens
cagccugugggagaagggac

SEQ ID NO: 459329 - RNA, 17 nt, Homo sapiens
cagccuguuugggaugu

SEQ ID NO: 459330 - RNA, 15 nt, Homo sapiens
cagccuucacuggag

SEQ ID NO: 459331 - RNA, 22 nt, Homo sapiens
cagccuuggaggaucguggcca

SEQ ID NO: 459332 - RNA, 15 nt, Homo sapiens
caugccucagugaag

SEQ ID NO: 459333 - RNA, 22 nt, Homo sapiens
caugccugccccccucaucuca

SEQ ID NO: 459334 - RNA, 16 nt, Homo sapiens
caugcgguuuccaagg

SEQ ID NO: 459335 - RNA, 14 nt, Homo sapiens
caugcucaguauug

SEQ ID NO: 459336 - RNA, 16 nt, Homo sapiens
caugcucuuuggcacc

SEQ ID NO: 459337 - RNA, 17 nt, Homo sapiens
caugcuuuggcaauuuu

SEQ ID NO: 459338 - RNA, 22 nt, Homo sapiens
cauggaaguacuauaauuuacc

SEQ ID NO: 459339 - RNA, 17 nt, Homo sapiens
cauggaauaaaccauuu

SEQ ID NO: 459340 - RNA, 20 nt, Homo sapiens
cauggacucuggguuucaua

SEQ ID NO: 459341 - RNA, 19 nt, Homo sapiens
cauggcaauuuuuacacaa

SEQ ID NO: 459342 - RNA, 13 nt, Homo sapiens
cauggcagacuug

SEQ ID NO: 459343 - RNA, 17 nt, Homo sapiens
cauggccaaggggccag

SEQ ID NO: 459344 - RNA, 15 nt, Homo sapiens
cauggccaauaguca

SEQ ID NO: 459345 - RNA, 16 nt, Homo sapiens
cauggccaauagucau

SEQ ID NO: 459346 - RNA, 21 nt, Homo sapiens
cauggccacauccaacauuuc

SEQ ID NO: 459347 - RNA, 15 nt, Homo sapiens
cauggccuucccucc

SEQ ID NO: 459348 - RNA, 21 nt, Homo sapiens
caugggaaugaaugucagugu

SEQ ID NO: 459349 - RNA, 16 nt, Homo sapiens
cauggguccacugcac

SEQ ID NO: 459350 - RNA, 23 nt, Homo sapiens
cauggguuauguguaugugccau

SEQ ID NO: 459351 - RNA, 14 nt, Homo sapiens
caugguagacugug

SEQ ID NO: 459352 - RNA, 13 nt, Homo sapiens
caugguaucucuu

SEQ ID NO: 459353 - RNA, 18 nt, Homo sapiens
cauggugaaaauguacug

SEQ ID NO: 459354 - RNA, 20 nt, Homo sapiens
cauggugaaaccccgucucu

SEQ ID NO: 459355 - RNA, 15 nt, Homo sapiens
cauggugcagugaag

SEQ ID NO: 459356 - RNA, 20 nt, Homo sapiens
caugguggcacgugccugua

SEQ ID NO: 459357 - RNA, 20 nt, Homo sapiens
cauggugggagagacuguga

SEQ ID NO: 459358 - RNA, 21 nt, Homo sapiens
cauggugggagagacugugag

SEQ ID NO: 459359 - RNA, 16 nt, Homo sapiens
cauguaaaugcucaaa

SEQ ID NO: 459360 - RNA, 22 nt, Homo sapiens
cauguaaccaagaguauuccau

SEQ ID NO: 459361 - RNA, 16 nt, Homo sapiens
cauguaagccaaguca

SEQ ID NO: 459362 - RNA, 17 nt, Homo sapiens
cauguaagccaagucau

SEQ ID NO: 459363 - RNA, 15 nt, Homo sapiens
cauguaauugcagau

SEQ ID NO: 459364 - RNA, 23 nt, Homo sapiens
cauguacuuuauauuuucuauau

SEQ ID NO: 459365 - RNA, 14 nt, Homo sapiens
cauguagcauauaa

SEQ ID NO: 459366 - RNA, 17 nt, Homo sapiens
cauguaguaguacuuga

SEQ ID NO: 459367 - RNA, 19 nt, Homo sapiens
cauguauuagccagucauu

SEQ ID NO: 459368 - RNA, 20 nt, Homo sapiens
cauguauuagccagucauug

SEQ ID NO: 459369 - RNA, 23 nt, Homo sapiens
caugucaacuucuggcuccucaa

SEQ ID NO: 459370 - RNA, 16 nt, Homo sapiens
caugucgccucugcau

SEQ ID NO: 459371 - RNA, 20 nt, Homo sapiens
caugucucugguggugcugg

SEQ ID NO: 459372 - RNA, 20 nt, Homo sapiens
caugucugcauggcagaagc

SEQ ID NO: 459373 - RNA, 18 nt, Homo sapiens
caugugacaucuaccucc

SEQ ID NO: 459374 - RNA, 21 nt, Homo sapiens
caugugauuggcagcuucaaa

SEQ ID NO: 459375 - RNA, 13 nt, Homo sapiens
caugugcauauag

SEQ ID NO: 459376 - RNA, 16 nt, Homo sapiens
caugugccugaaggcu

SEQ ID NO: 459377 - RNA, 12 nt, Homo sapiens
caugugcugcag

SEQ ID NO: 459378 - RNA, 20 nt, Homo sapiens
cauguggcauguucaucgua

SEQ ID NO: 459379 - RNA, 19 nt, Homo sapiens
cauguggccccaggugcca

SEQ ID NO: 459380 - RNA, 20 nt, Homo sapiens
cauguguggauguguaaaug

SEQ ID NO: 459381 - RNA, 21 nt, Homo sapiens
cauguguggcccugucugcuu

SEQ ID NO: 459382 - RNA, 22 nt, Homo sapiens
cauguguguucaugcacacuug

SEQ ID NO: 459383 - RNA, 21 nt, Homo sapiens
cauguuaccaucuuacuugag

SEQ ID NO: 459384 - RNA, 17 nt, Homo sapiens
cauguuacugaccagca

SEQ ID NO: 459385 - RNA, 18 nt, Homo sapiens
cauguucuuaacuuuaaa

SEQ ID NO: 459386 - RNA, 24 nt, Homo sapiens
cauguuggccaggcuggucucaaa

SEQ ID NO: 459387 - RNA, 21 nt, Homo sapiens
cauguuugucugugugcugua

SEQ ID NO: 459388 - RNA, 18 nt, Homo sapiens
cauguuuuugcaaauacu

SEQ ID NO: 459389 - RNA, 22 nt, Homo sapiens
cauuaaauggugauuucuugcu

SEQ ID NO: 459390 - RNA, 23 nt, Homo sapiens
cauuaagagguuuauuuggguac

SEQ ID NO: 459391 - RNA, 16 nt, Homo sapiens
cauuaaucaccaaagu

SEQ ID NO: 459392 - RNA, 15 nt, Homo sapiens
cauuaauguuaauuc

SEQ ID NO: 459393 - RNA, 19 nt, Homo sapiens
cauuaccuucuguuccuua

SEQ ID NO: 459394 - RNA, 23 nt, Homo sapiens
cauuacucugcacuauagccauu

SEQ ID NO: 459395 - RNA, 12 nt, Homo sapiens
cauuacugccaa

SEQ ID NO: 459396 - RNA, 20 nt, Homo sapiens
cauuagagggacagccaaaa

SEQ ID NO: 459397 - RNA, 16 nt, Homo sapiens
cauuaggaacagagua

SEQ ID NO: 459398 - RNA, 23 nt, Homo sapiens
cauuagggggaacucuagccaaa

SEQ ID NO: 459399 - RNA, 20 nt, Homo sapiens
cauuauaaauaauguucauu

SEQ ID NO: 459400 - RNA, 16 nt, Homo sapiens
cauuaugagaggcaau

SEQ ID NO: 459401 - RNA, 21 nt, Homo sapiens
cauuauuacuccuugccauuu

SEQ ID NO: 459402 - RNA, 20 nt, Homo sapiens
cauuauuccugcacucacag

SEQ ID NO: 459403 - RNA, 17 nt, Homo sapiens
cauuauuugaguuugac

SEQ ID NO: 459404 - RNA, 18 nt, Homo sapiens
cauucaaucauuaauuca

SEQ ID NO: 459405 - RNA, 14 nt, Homo sapiens
cauucaccuuccac

SEQ ID NO: 459406 - RNA, 14 nt, Homo sapiens
cauucacuagcuuu

SEQ ID NO: 459407 - RNA, 12 nt, Homo sapiens
cauucacugucc

SEQ ID NO: 459408 - RNA, 22 nt, Homo sapiens
cauucagucugcagcuauucac

SEQ ID NO: 459409 - RNA, 11 nt, Homo sapiens
cauucauaucc

SEQ ID NO: 459410 - RNA, 17 nt, Homo sapiens
cauucaugugggcauuu

SEQ ID NO: 459411 - RNA, 15 nt, Homo sapiens
cauucauucaaucau

SEQ ID NO: 459412 - RNA, 19 nt, Homo sapiens
cauuccaaggguaugggaa

SEQ ID NO: 459413 - RNA, 12 nt, Homo sapiens
cauuccaggaaa

SEQ ID NO: 459414 - RNA, 22 nt, Homo sapiens
cauuccaggaccagaagcauuu

SEQ ID NO: 459415 - RNA, 17 nt, Homo sapiens
cauuccaggugccagaa

SEQ ID NO: 459416 - RNA, 16 nt, Homo sapiens
cauuccauuugaagca

SEQ ID NO: 459417 - RNA, 12 nt, Homo sapiens
cauuccuaacac

SEQ ID NO: 459418 - RNA, 18 nt, Homo sapiens
cauuccugagucuuccag

SEQ ID NO: 459419 - RNA, 18 nt, Homo sapiens
cauuccuguucccaugag

SEQ ID NO: 459420 - RNA, 14 nt, Homo sapiens
cauucgagguguca

SEQ ID NO: 459421 - RNA, 21 nt, Homo sapiens
cauucuccuuguaaaagccua

SEQ ID NO: 459422 - RNA, 11 nt, Homo sapiens
cauucugacca

SEQ ID NO: 459423 - RNA, 18 nt, Homo sapiens
cauucugcaagcacaucu

SEQ ID NO: 459424 - RNA, 13 nt, Homo sapiens
cauucuucuacuu

SEQ ID NO: 459425 - RNA, 11 nt, Homo sapiens
cauucuucucu

SEQ ID NO: 459426 - RNA, 20 nt, Homo sapiens
cauucuuggucaaguuuuuc

SEQ ID NO: 459427 - RNA, 17 nt, Homo sapiens
cauucuuucugcuauau

SEQ ID NO: 459428 - RNA, 18 nt, Homo sapiens
cauucuuucugcuauauu

SEQ ID NO: 459429 - RNA, 19 nt, Homo sapiens
cauugacgagcaugagcug

SEQ ID NO: 459430 - RNA, 20 nt, Homo sapiens
cauugagaaauaaagcacau

SEQ ID NO: 459431 - RNA, 18 nt, Homo sapiens
cauugaugaacugccaaa

SEQ ID NO: 459432 - RNA, 23 nt, Homo sapiens
cauugaugacaugggauugaguu

SEQ ID NO: 459433 - RNA, 21 nt, Homo sapiens
cauugcuaaacugaugacuua

SEQ ID NO: 459434 - RNA, 20 nt, Homo sapiens
cauugcucccagugccaaac

SEQ ID NO: 459435 - RNA, 19 nt, Homo sapiens
cauuggaccuguucaaaaa

SEQ ID NO: 459436 - RNA, 15 nt, Homo sapiens
cauuggacuuccucc

SEQ ID NO: 459437 - RNA, 17 nt, Homo sapiens
cauugggcacauaucuc

SEQ ID NO: 459438 - RNA, 21 nt, Homo sapiens
cauuguacccugcuguauaau

SEQ ID NO: 459439 - RNA, 17 nt, Homo sapiens
cauuguagaaacacagu

SEQ ID NO: 459440 - RNA, 19 nt, Homo sapiens
cauuguaucuucauacaaa

SEQ ID NO: 459441 - RNA, 12 nt, Homo sapiens
cauugucccuga

SEQ ID NO: 459442 - RNA, 21 nt, Homo sapiens
cauugucccugaaugcuccau

SEQ ID NO: 459443 - RNA, 19 nt, Homo sapiens
cauugucgcucagcaauag

SEQ ID NO: 459444 - RNA, 17 nt, Homo sapiens
cauugucguuucauuca

SEQ ID NO: 459445 - RNA, 19 nt, Homo sapiens
cauuguuccacacauuuaa

SEQ ID NO: 459446 - RNA, 19 nt, Homo sapiens
cauuguugagguggucuga

SEQ ID NO: 459447 - RNA, 17 nt, Homo sapiens
cauuuaaauugacuuca

SEQ ID NO: 459448 - RNA, 15 nt, Homo sapiens
cauuuacguaaaaag

SEQ ID NO: 459449 - RNA, 18 nt, Homo sapiens
cauuuaucaacuguugau

SEQ ID NO: 459450 - RNA, 21 nt, Homo sapiens
cauuuaucaacuguugauaca

SEQ ID NO: 459451 - RNA, 15 nt, Homo sapiens
cauuuauuauuucaa

SEQ ID NO: 459452 - RNA, 15 nt, Homo sapiens
cauuucaaaacccaa

SEQ ID NO: 459453 - RNA, 15 nt, Homo sapiens
cauuucaaaguuugg

SEQ ID NO: 459454 - RNA, 15 nt, Homo sapiens
cauuucaaaucugua

SEQ ID NO: 459455 - RNA, 18 nt, Homo sapiens
cauuucaaaucuguagca

SEQ ID NO: 459456 - RNA, 20 nt, Homo sapiens
cauuucaaaucuguagcaua

SEQ ID NO: 459457 - RNA, 20 nt, Homo sapiens
cauuucaccugugacaaagg

SEQ ID NO: 459458 - RNA, 12 nt, Homo sapiens
cauuucacuucc

SEQ ID NO: 459459 - RNA, 14 nt, Homo sapiens
cauuucaugugauc

SEQ ID NO: 459460 - RNA, 18 nt, Homo sapiens
cauuuccaacaccacaga

SEQ ID NO: 459461 - RNA, 13 nt, Homo sapiens
ccgagugcaauga

SEQ ID NO: 459462 - RNA, 14 nt, Homo sapiens
ccgaugguccucac

SEQ ID NO: 459463 - RNA, 23 nt, Homo sapiens
ccgcaacaguuuuuuaugcuaau

SEQ ID NO: 459464 - RNA, 18 nt, Homo sapiens
ccgcagggcgcuccggca

SEQ ID NO: 459465 - RNA, 22 nt, Homo sapiens
ccgcagguuaugucagcagcuc

SEQ ID NO: 459466 - RNA, 14 nt, Homo sapiens
ccgcccaccugggc

SEQ ID NO: 459467 - RNA, 16 nt, Homo sapiens
ccgcucagguagccac

SEQ ID NO: 459468 - RNA, 14 nt, Homo sapiens
ccgcugacugccac

SEQ ID NO: 459469 - RNA, 18 nt, Homo sapiens
ccgcugcaaugccuagac

SEQ ID NO: 459470 - RNA, 15 nt, Homo sapiens
ccgcuuggcacauga

SEQ ID NO: 459471 - RNA, 23 nt, Homo sapiens
ccggacagaggugggcagggugg

SEQ ID NO: 459472 - RNA, 22 nt, Homo sapiens
ccggccuugugacauucacuca

SEQ ID NO: 459473 - RNA, 12 nt, Homo sapiens
ccggcucuuucc

SEQ ID NO: 459474 - RNA, 14 nt, Homo sapiens
ccggcuguggagca

SEQ ID NO: 459475 - RNA, 19 nt, Homo sapiens
ccgggaccauugaccucag

SEQ ID NO: 459476 - RNA, 19 nt, Homo sapiens
ccgggcuggccugugccua

SEQ ID NO: 459477 - RNA, 20 nt, Homo sapiens
ccgggcugggagcucugcag

SEQ ID NO: 459478 - RNA, 17 nt, Homo sapiens
ccggucccccaugccac

SEQ ID NO: 459479 - RNA, 15 nt, Homo sapiens
ccgguggaaggccuu

SEQ ID NO: 459480 - RNA, 14 nt, Homo sapiens
ccgguuaucaguug

SEQ ID NO: 459481 - RNA, 19 nt, Homo sapiens
ccgucacacaguauuuauu

SEQ ID NO: 459482 - RNA, 20 nt, Homo sapiens
ccguccccugggccacccuu

SEQ ID NO: 459483 - RNA, 22 nt, Homo sapiens
ccgucgucucuucugggcaccc

SEQ ID NO: 459484 - RNA, 17 nt, Homo sapiens
ccgucuccucuccagcc

SEQ ID NO: 459485 - RNA, 18 nt, Homo sapiens
ccgucuuccggucauucu

SEQ ID NO: 459486 - RNA, 14 nt, Homo sapiens
ccgugaagucugcu

SEQ ID NO: 459487 - RNA, 13 nt, Homo sapiens
ccgugaccaucuu

SEQ ID NO: 459488 - RNA, 16 nt, Homo sapiens
ccgugcaguacaggca

SEQ ID NO: 459489 - RNA, 21 nt, Homo sapiens
ccguggacagcccgccgucag

SEQ ID NO: 459490 - RNA, 12 nt, Homo sapiens
ccguggagccuu

SEQ ID NO: 459491 - RNA, 23 nt, Homo sapiens
ccguggugugaggcccccggagg

SEQ ID NO: 459492 - RNA, 16 nt, Homo sapiens
ccguguuggauuuccg

SEQ ID NO: 459493 - RNA, 18 nt, Homo sapiens
ccguucgcugagucccag

SEQ ID NO: 459494 - RNA, 16 nt, Homo sapiens
ccguugcacaaaaagg

SEQ ID NO: 459495 - RNA, 14 nt, Homo sapiens
ccguuuccaaauac

SEQ ID NO: 459496 - RNA, 21 nt, Homo sapiens
ccuaaaagccaccccacuucu

SEQ ID NO: 459497 - RNA, 16 nt, Homo sapiens
ccuaaaucuccagugg

SEQ ID NO: 459498 - RNA, 12 nt, Homo sapiens
ccuaacaagccu

SEQ ID NO: 459499 - RNA, 19 nt, Homo sapiens
ccuaacaggauuagacagu

SEQ ID NO: 459500 - RNA, 17 nt, Homo sapiens
ccuaacccuacaugcau

SEQ ID NO: 459501 - RNA, 12 nt, Homo sapiens
ccuaagcacuuu

SEQ ID NO: 459502 - RNA, 22 nt, Homo sapiens
ccuaagcacuuuauaaauauca

SEQ ID NO: 459503 - RNA, 18 nt, Homo sapiens
ccuaaggacacacuaauc

SEQ ID NO: 459504 - RNA, 15 nt, Homo sapiens
ccuaaggaucucuca

SEQ ID NO: 459505 - RNA, 16 nt, Homo sapiens
ccuaauaugcuuuaca

SEQ ID NO: 459506 - RNA, 22 nt, Homo sapiens
ccuaaugaaggccaucaucucu

SEQ ID NO: 459507 - RNA, 21 nt, Homo sapiens
ccuaauucucuucgcugugau

SEQ ID NO: 459508 - RNA, 19 nt, Homo sapiens
ccuacaaguugaucaugca

SEQ ID NO: 459509 - RNA, 17 nt, Homo sapiens
ccuacagaggucucugc

SEQ ID NO: 459510 - RNA, 16 nt, Homo sapiens
ccuaccaaccucugaa

SEQ ID NO: 459511 - RNA, 15 nt, Homo sapiens
ccuaccacagugucu

SEQ ID NO: 459512 - RNA, 15 nt, Homo sapiens
ccuaccauacaauau

SEQ ID NO: 459513 - RNA, 21 nt, Homo sapiens
ccuaccucacagagugcauug

SEQ ID NO: 459514 - RNA, 11 nt, Homo sapiens
ccuaccuuuau

SEQ ID NO: 459515 - RNA, 20 nt, Homo sapiens
ccuacggaaggggacgcuuu

SEQ ID NO: 459516 - RNA, 16 nt, Homo sapiens
ccuacuacaugcaagg

SEQ ID NO: 459517 - RNA, 23 nt, Homo sapiens
ccuacuuuauguauggagcucua

SEQ ID NO: 459518 - RNA, 11 nt, Homo sapiens
ccuacuuuuca

SEQ ID NO: 459519 - RNA, 16 nt, Homo sapiens
ccuagaacugugccua

SEQ ID NO: 459520 - RNA, 15 nt, Homo sapiens
ccuagagcuccaguu

SEQ ID NO: 459521 - RNA, 23 nt, Homo sapiens
ccuagagcuccaguucuuuauaa

SEQ ID NO: 459522 - RNA, 16 nt, Homo sapiens
ccuagauagcuauuaa

SEQ ID NO: 459523 - RNA, 19 nt, Homo sapiens
ccuagccucgcucuuggca

SEQ ID NO: 459524 - RNA, 14 nt, Homo sapiens
ccuagcugugugca

SEQ ID NO: 459525 - RNA, 17 nt, Homo sapiens
ccuagcugugugcaguc

SEQ ID NO: 459526 - RNA, 22 nt, Homo sapiens
ccuaggacucaggccugccaau

SEQ ID NO: 459527 - RNA, 21 nt, Homo sapiens
ccuaguagcuuuccucccaaa

SEQ ID NO: 459528 - RNA, 22 nt, Homo sapiens
ccuaguaggagcugagcuuucc

SEQ ID NO: 459529 - RNA, 22 nt, Homo sapiens
ccuagugggagcccagcacacu

SEQ ID NO: 459530 - RNA, 21 nt, Homo sapiens
ccuaguuccauucuuggucaa

SEQ ID NO: 459531 - RNA, 23 nt, Homo sapiens
ccuauacauuucuguucaucuua

SEQ ID NO: 459532 - RNA, 23 nt, Homo sapiens
ccuauagagucaaccaccacaga

SEQ ID NO: 459533 - RNA, 14 nt, Homo sapiens
ccuaucaucaguua

SEQ ID NO: 459534 - RNA, 20 nt, Homo sapiens
ccuaucuuuuauuucauuca

SEQ ID NO: 459535 - RNA, 21 nt, Homo sapiens
ccuaugacuaauucacaaaaa

SEQ ID NO: 459536 - RNA, 20 nt, Homo sapiens
ccuaugcugcaauacauuaa

SEQ ID NO: 459537 - RNA, 22 nt, Homo sapiens
ccuauguacuuaauccuuuaac

SEQ ID NO: 459538 - RNA, 20 nt, Homo sapiens
ccuauguagcucugcaucuc

SEQ ID NO: 459539 - RNA, 15 nt, Homo sapiens
ccuauguccuaagga

SEQ ID NO: 459540 - RNA, 14 nt, Homo sapiens
ccuauucaugucuc

SEQ ID NO: 459541 - RNA, 18 nt, Homo sapiens
ccuauuuucuuuuccauu

SEQ ID NO: 459542 - RNA, 21 nt, Homo sapiens
ccucaacaaagaagaaccauc

SEQ ID NO: 459543 - RNA, 22 nt, Homo sapiens
ccucaacauugcauggugcuag

SEQ ID NO: 459544 - RNA, 16 nt, Homo sapiens
ccucaaccugugauga

SEQ ID NO: 459545 - RNA, 18 nt, Homo sapiens
ccucaagccaggagaccc

SEQ ID NO: 459546 - RNA, 20 nt, Homo sapiens
ccucacagagugcauuguga

SEQ ID NO: 459547 - RNA, 18 nt, Homo sapiens
ccucacccgcugcccagc

SEQ ID NO: 459548 - RNA, 17 nt, Homo sapiens
ccucacgcucuccauca

SEQ ID NO: 459549 - RNA, 19 nt, Homo sapiens
ccucacgcucuggacauga

SEQ ID NO: 459550 - RNA, 22 nt, Homo sapiens
ccucacuccuguuacuuaccua

SEQ ID NO: 459551 - RNA, 18 nt, Homo sapiens
ccucacuggugcauuuaa

SEQ ID NO: 459552 - RNA, 17 nt, Homo sapiens
ccucagaauugaucauu

SEQ ID NO: 459553 - RNA, 12 nt, Homo sapiens
ccucagacaucc

SEQ ID NO: 459554 - RNA, 13 nt, Homo sapiens
ccucagauuccac

SEQ ID NO: 459555 - RNA, 15 nt, Homo sapiens
ccucagcaacagcca

SEQ ID NO: 459556 - RNA, 17 nt, Homo sapiens
ccucagcaccugggacc

SEQ ID NO: 459557 - RNA, 14 nt, Homo sapiens
ccucagccacugaa

SEQ ID NO: 459558 - RNA, 18 nt, Homo sapiens
ccucagcucucugggacc

SEQ ID NO: 459559 - RNA, 20 nt, Homo sapiens
ccucagcugccucacuuccu

SEQ ID NO: 459560 - RNA, 15 nt, Homo sapiens
ccucagguaguacug

SEQ ID NO: 459561 - RNA, 21 nt, Homo sapiens
ccucagucuggugcuccaguu

SEQ ID NO: 459562 - RNA, 15 nt, Homo sapiens
ccucauauacuugaa

SEQ ID NO: 459563 - RNA, 20 nt, Homo sapiens
ccucauauacuugaauauua

SEQ ID NO: 459564 - RNA, 18 nt, Homo sapiens
ccucauccuuuccugcca

SEQ ID NO: 459565 - RNA, 14 nt, Homo sapiens
ccucauguucucau

SEQ ID NO: 459566 - RNA, 20 nt, Homo sapiens
ccucauuccccaaccacuuc

SEQ ID NO: 459567 - RNA, 16 nt, Homo sapiens
ccucauucuagcaccu

SEQ ID NO: 459568 - RNA, 15 nt, Homo sapiens
ccuccaaaagcacuu

SEQ ID NO: 459569 - RNA, 14 nt, Homo sapiens
ccuccaaaagcccu

SEQ ID NO: 459570 - RNA, 20 nt, Homo sapiens
ccuccaaaagcccugaguuu

SEQ ID NO: 459571 - RNA, 19 nt, Homo sapiens
ccuccacugccucuggaau

SEQ ID NO: 459572 - RNA, 13 nt, Homo sapiens
ccuccagccacuu

SEQ ID NO: 459573 - RNA, 20 nt, Homo sapiens
ccuccagcccucucacugug

SEQ ID NO: 459574 - RNA, 17 nt, Homo sapiens
ccuccagcuucaggcag

SEQ ID NO: 459575 - RNA, 22 nt, Homo sapiens
ccuccagcuucaggcaggccaa

SEQ ID NO: 459576 - RNA, 17 nt, Homo sapiens
ccuccagggacaaagag

SEQ ID NO: 459577 - RNA, 17 nt, Homo sapiens
ccuccagucuguucuca

SEQ ID NO: 459578 - RNA, 20 nt, Homo sapiens
ccucccaaagugcugggauu

SEQ ID NO: 459579 - RNA, 14 nt, Homo sapiens
ccucccaagguccu

SEQ ID NO: 459580 - RNA, 13 nt, Homo sapiens
ccucccaccagag

SEQ ID NO: 459581 - RNA, 20 nt, Homo sapiens
ccucccaguuugcuggguuu

SEQ ID NO: 459582 - RNA, 20 nt, Homo sapiens
ccuccccaaggaagaacaaa

SEQ ID NO: 459583 - RNA, 21 nt, Homo sapiens
ccuccccaauuccccagggaa

SEQ ID NO: 459584 - RNA, 13 nt, Homo sapiens
ccucccccgcaga

SEQ ID NO: 459585 - RNA, 22 nt, Homo sapiens
ccucccucgcauccgccucuga

SEQ ID NO: 459586 - RNA, 14 nt, Homo sapiens
ccucccucugcucu

SEQ ID NO: 459587 - RNA, 15 nt, Homo sapiens
ccucccugcacucau

SEQ ID NO: 459588 - RNA, 18 nt, Homo sapiens
ccucccuggcucccauga

SEQ ID NO: 459589 - RNA, 21 nt, Homo sapiens
ccucccuguccccugagguua

SEQ ID NO: 459590 - RNA, 23 nt, Homo sapiens
cuucuccacaaccuccuccucca

SEQ ID NO: 459591 - RNA, 14 nt, Homo sapiens
cuucuccacaggga

SEQ ID NO: 459592 - RNA, 15 nt, Homo sapiens
cuucuccacagggac

SEQ ID NO: 459593 - RNA, 15 nt, Homo sapiens
cuucucccacacugc

SEQ ID NO: 459594 - RNA, 18 nt, Homo sapiens
cuucuccccuccaaguga

SEQ ID NO: 459595 - RNA, 17 nt, Homo sapiens
cuucucgccccucagug

SEQ ID NO: 459596 - RNA, 19 nt, Homo sapiens
cuucucucaccuccuaaag

SEQ ID NO: 459597 - RNA, 19 nt, Homo sapiens
cuucucucccacacaagca

SEQ ID NO: 459598 - RNA, 19 nt, Homo sapiens
cuucucugagcuccagugg

SEQ ID NO: 459599 - RNA, 22 nt, Homo sapiens
cuucucuggaaaggggggagcu

SEQ ID NO: 459600 - RNA, 22 nt, Homo sapiens
cuucugauuucucuucagcuuu

SEQ ID NO: 459601 - RNA, 14 nt, Homo sapiens
cuucugcaaaaaac

SEQ ID NO: 459602 - RNA, 17 nt, Homo sapiens
cuucuggaacaccuguc

SEQ ID NO: 459603 - RNA, 19 nt, Homo sapiens
cuucugugcccagcucagu

SEQ ID NO: 459604 - RNA, 22 nt, Homo sapiens
cuucuuaauauaacugccuuaa

SEQ ID NO: 459605 - RNA, 14 nt, Homo sapiens
cuucuuacuauuaa

SEQ ID NO: 459606 - RNA, 13 nt, Homo sapiens
cuucuugcuccug

SEQ ID NO: 459607 - RNA, 15 nt, Homo sapiens
cuucuugcuuguaaa

SEQ ID NO: 459608 - RNA, 21 nt, Homo sapiens
cuucuuguaauauuucuucaa

SEQ ID NO: 459609 - RNA, 18 nt, Homo sapiens
cuucuuguguccugauga

SEQ ID NO: 459610 - RNA, 13 nt, Homo sapiens
cuucuuguucccc

SEQ ID NO: 459611 - RNA, 16 nt, Homo sapiens
cuucuuuuugcuucaa

SEQ ID NO: 459612 - RNA, 17 nt, Homo sapiens
cuugaaagaaaauacca

SEQ ID NO: 459613 - RNA, 14 nt, Homo sapiens
cuugaaaguuuucc

SEQ ID NO: 459614 - RNA, 18 nt, Homo sapiens
cuugaaaguuuuccagua

SEQ ID NO: 459615 - RNA, 14 nt, Homo sapiens
cuugaaaugcauua

SEQ ID NO: 459616 - RNA, 22 nt, Homo sapiens
cuugaagaaccucucacuucac

SEQ ID NO: 459617 - RNA, 22 nt, Homo sapiens
cuugaaucaagucagcaacaga

SEQ ID NO: 459618 - RNA, 21 nt, Homo sapiens
cuugaccccgacgccacagcc

SEQ ID NO: 459619 - RNA, 16 nt, Homo sapiens
cuugaccguacucuca

SEQ ID NO: 459620 - RNA, 18 nt, Homo sapiens
cuugaccuggagccaucu

SEQ ID NO: 459621 - RNA, 16 nt, Homo sapiens
cuugacucaggauuua

SEQ ID NO: 459622 - RNA, 18 nt, Homo sapiens
cuugacuucaugccagcu

SEQ ID NO: 459623 - RNA, 12 nt, Homo sapiens
cuugagaccaag

SEQ ID NO: 459624 - RNA, 14 nt, Homo sapiens
cuugagaccuggaa

SEQ ID NO: 459625 - RNA, 13 nt, Homo sapiens
cuugagagcugcu

SEQ ID NO: 459626 - RNA, 21 nt, Homo sapiens
cuugagcaagucccaucucac

SEQ ID NO: 459627 - RNA, 18 nt, Homo sapiens
cuugagcccagagugaac

SEQ ID NO: 459628 - RNA, 23 nt, Homo sapiens
cuugagccccagaggcagagguu

SEQ ID NO: 459629 - RNA, 17 nt, Homo sapiens
cuugaggaucauaugaa

SEQ ID NO: 459630 - RNA, 20 nt, Homo sapiens
cuugaggaucauaugaauua

SEQ ID NO: 459631 - RNA, 19 nt, Homo sapiens
cuugaguaguuuuuaucug

SEQ ID NO: 459632 - RNA, 21 nt, Homo sapiens
cuugagugugcaagcaaagaa

SEQ ID NO: 459633 - RNA, 23 nt, Homo sapiens
cuugaguuguuuaaacagucaaa

SEQ ID NO: 459634 - RNA, 22 nt, Homo sapiens
cuugauauuuccuucaccaccu

SEQ ID NO: 459635 - RNA, 13 nt, Homo sapiens
cuugauauuuucc

SEQ ID NO: 459636 - RNA, 15 nt, Homo sapiens
cuugaucauucucag

SEQ ID NO: 459637 - RNA, 18 nt, Homo sapiens
cuugauggagauauuuac

SEQ ID NO: 459638 - RNA, 19 nt, Homo sapiens
cuugauguugcuuagucac

SEQ ID NO: 459639 - RNA, 23 nt, Homo sapiens
cuugauuaagauuuuacaaaaga

SEQ ID NO: 459640 - RNA, 17 nt, Homo sapiens
cuugcacaaacuccauc

SEQ ID NO: 459641 - RNA, 20 nt, Homo sapiens
cuugcacaggccacuugcuc

SEQ ID NO: 459642 - RNA, 20 nt, Homo sapiens
cuugcaccccaaagcuuucc

SEQ ID NO: 459643 - RNA, 15 nt, Homo sapiens
cuugcaugugcugca

SEQ ID NO: 459644 - RNA, 22 nt, Homo sapiens
cuugccccuguuaccuaauuag

SEQ ID NO: 459645 - RNA, 23 nt, Homo sapiens
cuugcccgccagccucagugcca

SEQ ID NO: 459646 - RNA, 20 nt, Homo sapiens
cuugcgugcugggacagcua

SEQ ID NO: 459647 - RNA, 18 nt, Homo sapiens
cuugcuaauuuucucaaa

SEQ ID NO: 459648 - RNA, 17 nt, Homo sapiens
cuugcuaccugugagca

SEQ ID NO: 459649 - RNA, 19 nt, Homo sapiens
cuugcugccacauucuaaa

SEQ ID NO: 459650 - RNA, 16 nt, Homo sapiens
cuugcugcugagugca

SEQ ID NO: 459651 - RNA, 20 nt, Homo sapiens
cuugcuggaaaacccaaagu

SEQ ID NO: 459652 - RNA, 20 nt, Homo sapiens
cuugcugugaaaugacugca

SEQ ID NO: 459653 - RNA, 19 nt, Homo sapiens
cuugcuucaaccccaugag

SEQ ID NO: 459654 - RNA, 19 nt, Homo sapiens
cuugcuuugggcuuugcag

SEQ ID NO: 459655 - RNA, 13 nt, Homo sapiens
cuuggaccaaaug

SEQ ID NO: 459656 - RNA, 15 nt, Homo sapiens
cuuggaccaaaugga

SEQ ID NO: 459657 - RNA, 20 nt, Homo sapiens
cuuggagacaaaaucuuaaa

SEQ ID NO: 459658 - RNA, 20 nt, Homo sapiens
cuuggagcaccgaggccagc

SEQ ID NO: 459659 - RNA, 17 nt, Homo sapiens
cuuggagccacugggau

SEQ ID NO: 459660 - RNA, 20 nt, Homo sapiens
cuuggagggauaagccagcu

SEQ ID NO: 459661 - RNA, 21 nt, Homo sapiens
cuuggauaggagcuuccagau

SEQ ID NO: 459662 - RNA, 18 nt, Homo sapiens
cuuggcacccccaugcug

SEQ ID NO: 459663 - RNA, 23 nt, Homo sapiens
cuuggcacugaugggcacuggaa

SEQ ID NO: 459664 - RNA, 14 nt, Homo sapiens
cuuggcacuguuag

SEQ ID NO: 459665 - RNA, 19 nt, Homo sapiens
cuuggcagaggcagggaag

SEQ ID NO: 459666 - RNA, 23 nt, Homo sapiens
cuuggcaugguggcacgugccug

SEQ ID NO: 459667 - RNA, 11 nt, Homo sapiens
cuuggccuagc

SEQ ID NO: 459668 - RNA, 20 nt, Homo sapiens
cuuggccugaccuggcacag

SEQ ID NO: 459669 - RNA, 18 nt, Homo sapiens
cuuggccuugguuuugau

SEQ ID NO: 459670 - RNA, 14 nt, Homo sapiens
cuuggcugcaugaa

SEQ ID NO: 459671 - RNA, 21 nt, Homo sapiens
cuuggcuuccacucagcauca

SEQ ID NO: 459672 - RNA, 19 nt, Homo sapiens
cuugggcuacuggcagcuc

SEQ ID NO: 459673 - RNA, 23 nt, Homo sapiens
cuugggggaggaggaacaaauaa

SEQ ID NO: 459674 - RNA, 16 nt, Homo sapiens
cuugggggucaggggg

SEQ ID NO: 459675 - RNA, 13 nt, Homo sapiens
cuugggugaaaag

SEQ ID NO: 459676 - RNA, 17 nt, Homo sapiens
cuuggguucaagugauu

SEQ ID NO: 459677 - RNA, 12 nt, Homo sapiens
cuuggugcugcg

SEQ ID NO: 459678 - RNA, 19 nt, Homo sapiens
cuugguggcaggcagagaa

SEQ ID NO: 459679 - RNA, 22 nt, Homo sapiens
cuuggugguuaugucccaugac

SEQ ID NO: 459680 - RNA, 19 nt, Homo sapiens
cuugguguuucuuuuucca

SEQ ID NO: 459681 - RNA, 15 nt, Homo sapiens
cuugguucaucagug

SEQ ID NO: 459682 - RNA, 22 nt, Homo sapiens
cuugguucuuaaaagcauucug

SEQ ID NO: 459683 - RNA, 18 nt, Homo sapiens
cuugguuuugauguugaa

SEQ ID NO: 459684 - RNA, 21 nt, Homo sapiens
cuugguuuuuggcucuuucag

SEQ ID NO: 459685 - RNA, 21 nt, Homo sapiens
cuugguuuuuuaaaaucugua

SEQ ID NO: 459686 - RNA, 14 nt, Homo sapiens
cuuguaaaagccua

SEQ ID NO: 459687 - RNA, 14 nt, Homo sapiens
cuuguacagccuuu

SEQ ID NO: 459688 - RNA, 20 nt, Homo sapiens
cuuguauaaugaacauguua

SEQ ID NO: 459689 - RNA, 13 nt, Homo sapiens
cuugucagaauuu

SEQ ID NO: 459690 - RNA, 20 nt, Homo sapiens
cuuguccacauagguuuaga

SEQ ID NO: 459691 - RNA, 16 nt, Homo sapiens
cuugucucacuugugc

SEQ ID NO: 459692 - RNA, 16 nt, Homo sapiens
cuugucuuuaaaguua

SEQ ID NO: 459693 - RNA, 22 nt, Homo sapiens
cuugugagagcccauucccacc

SEQ ID NO: 459694 - RNA, 19 nt, Homo sapiens
cuugugagcaagguggugu

SEQ ID NO: 459695 - RNA, 16 nt, Homo sapiens
cuugugauuccagggc

SEQ ID NO: 459696 - RNA, 22 nt, Homo sapiens
cuugugauuuuuauaauacaaa

SEQ ID NO: 459697 - RNA, 21 nt, Homo sapiens
cuugugccucccuucccagug

SEQ ID NO: 459698 - RNA, 15 nt, Homo sapiens
cuuguguccugauga

SEQ ID NO: 459699 - RNA, 18 nt, Homo sapiens
cuugugugugggcuguga

SEQ ID NO: 459700 - RNA, 16 nt, Homo sapiens
cuuguguucaaucugu

SEQ ID NO: 459701 - RNA, 18 nt, Homo sapiens
cuuguguuggcuguggca

SEQ ID NO: 459702 - RNA, 17 nt, Homo sapiens
cuuguucuguacuugua

SEQ ID NO: 459703 - RNA, 23 nt, Homo sapiens
cuuguucuuagagcagauucuag

SEQ ID NO: 459704 - RNA, 22 nt, Homo sapiens
cuuguucuuccucuuaccugua

SEQ ID NO: 459705 - RNA, 18 nt, Homo sapiens
cuuguugaugacauuugg

SEQ ID NO: 459706 - RNA, 15 nt, Homo sapiens
cuuguugaugccagc

SEQ ID NO: 459707 - RNA, 16 nt, Homo sapiens
cuuguugcugcaucuc

SEQ ID NO: 459708 - RNA, 18 nt, Homo sapiens
cuuguuguuuuuaagucc

SEQ ID NO: 459709 - RNA, 17 nt, Homo sapiens
cuuguuuucuacuuugc

SEQ ID NO: 459710 - RNA, 19 nt, Homo sapiens
cuuguuuucuacuuugcca

SEQ ID NO: 459711 - RNA, 15 nt, Homo sapiens
cuuuaaaaugauuca

SEQ ID NO: 459712 - RNA, 22 nt, Homo sapiens
cuuuaaacacggggcuugcaac

SEQ ID NO: 459713 - RNA, 14 nt, Homo sapiens
cuuuaaagacuuaa

SEQ ID NO: 459714 - RNA, 15 nt, Homo sapiens
cuuuaaagacuugau

SEQ ID NO: 459715 - RNA, 17 nt, Homo sapiens
cuuuaaagacuugauga

SEQ ID NO: 459716 - RNA, 17 nt, Homo sapiens
cuuuaaaguaccuguag

SEQ ID NO: 459717 - RNA, 18 nt, Homo sapiens
cuuuaaauccuaccaaag

SEQ ID NO: 459718 - RNA, 16 nt, Homo sapiens
cuuuaacagcuuucuc

SEQ ID NO: 459719 - RNA, 13 nt, Homo sapiens
gaccuggaaccag

SEQ ID NO: 459720 - RNA, 20 nt, Homo sapiens
gaccuggaaccagagccaca

SEQ ID NO: 459721 - RNA, 12 nt, Homo sapiens
gaccuggcacag

SEQ ID NO: 459722 - RNA, 12 nt, Homo sapiens
gaccuggcacug

SEQ ID NO: 459723 - RNA, 16 nt, Homo sapiens
gaccuguguucuugcu

SEQ ID NO: 459724 - RNA, 11 nt, Homo sapiens
gaccuguguuu

SEQ ID NO: 459725 - RNA, 16 nt, Homo sapiens
gaccuguucaaaaagg

SEQ ID NO: 459726 - RNA, 17 nt, Homo sapiens
gaccuuagcguucugga

SEQ ID NO: 459727 - RNA, 17 nt, Homo sapiens
gaccuugggguacaauu

SEQ ID NO: 459728 - RNA, 17 nt, Homo sapiens
gacgacaagugcugaac

SEQ ID NO: 459729 - RNA, 15 nt, Homo sapiens
gacgagcaugagcug

SEQ ID NO: 459730 - RNA, 19 nt, Homo sapiens
gacgcaccuugcugcagug

SEQ ID NO: 459731 - RNA, 23 nt, Homo sapiens
gacgcagauaacugguuacucag

SEQ ID NO: 459732 - RNA, 18 nt, Homo sapiens
gacgcagggguugcagug

SEQ ID NO: 459733 - RNA, 22 nt, Homo sapiens
gacgcauuccaaaucauacuca

SEQ ID NO: 459734 - RNA, 21 nt, Homo sapiens
gacgguuucaaaccaggauuu

SEQ ID NO: 459735 - RNA, 15 nt, Homo sapiens
gacguagcugcaaag

SEQ ID NO: 459736 - RNA, 17 nt, Homo sapiens
gacguguuaugacucca

SEQ ID NO: 459737 - RNA, 21 nt, Homo sapiens
gacuaacauaaaaucugugaa

SEQ ID NO: 459738 - RNA, 22 nt, Homo sapiens
gacuacacugaaucauuaacag

SEQ ID NO: 459739 - RNA, 13 nt, Homo sapiens
gacuacagacauu

SEQ ID NO: 459740 - RNA, 19 nt, Homo sapiens
gacuaccuauaaauggacu

SEQ ID NO: 459741 - RNA, 20 nt, Homo sapiens
gacuagugcuuuaccuuuau

SEQ ID NO: 459742 - RNA, 16 nt, Homo sapiens
gacuaugaaacgaaua

SEQ ID NO: 459743 - RNA, 16 nt, Homo sapiens
gacucaagugucucag

SEQ ID NO: 459744 - RNA, 19 nt, Homo sapiens
gacucaccuugcucugcca

SEQ ID NO: 459745 - RNA, 13 nt, Homo sapiens
gacucaguguuga

SEQ ID NO: 459746 - RNA, 11 nt, Homo sapiens
gacucauucuu

SEQ ID NO: 459747 - RNA, 19 nt, Homo sapiens
gacuccaggagaggagcgg

SEQ ID NO: 459748 - RNA, 23 nt, Homo sapiens
gacucguucucgugacccagugg

SEQ ID NO: 459749 - RNA, 12 nt, Homo sapiens
gacucugugcuc

SEQ ID NO: 459750 - RNA, 13 nt, Homo sapiens
gacucuucagucu

SEQ ID NO: 459751 - RNA, 17 nt, Homo sapiens
gacucuuccugcaaagg

SEQ ID NO: 459752 - RNA, 18 nt, Homo sapiens
gacucuuugcaacagcac

SEQ ID NO: 459753 - RNA, 14 nt, Homo sapiens
gacugaagccaaag

SEQ ID NO: 459754 - RNA, 21 nt, Homo sapiens
gacugaagcgaacaucuucau

SEQ ID NO: 459755 - RNA, 19 nt, Homo sapiens
gacugaaggggcacaccac

SEQ ID NO: 459756 - RNA, 13 nt, Homo sapiens
gacugagcuugau

SEQ ID NO: 459757 - RNA, 14 nt, Homo sapiens
gacugccugugaag

SEQ ID NO: 459758 - RNA, 22 nt, Homo sapiens
gacugcuggcaugcagugcccu

SEQ ID NO: 459759 - RNA, 16 nt, Homo sapiens
gacuggacuguguuuu

SEQ ID NO: 459760 - RNA, 15 nt, Homo sapiens
gacuggcccuugccc

SEQ ID NO: 459761 - RNA, 14 nt, Homo sapiens
gacugggaagcauu

SEQ ID NO: 459762 - RNA, 14 nt, Homo sapiens
gacugucuuucaga

SEQ ID NO: 459763 - RNA, 13 nt, Homo sapiens
gacuguugcucaa

SEQ ID NO: 459764 - RNA, 20 nt, Homo sapiens
gacuuaaacagcagauuuca

SEQ ID NO: 459765 - RNA, 20 nt, Homo sapiens
gacuuaagcacacuugacau

SEQ ID NO: 459766 - RNA, 14 nt, Homo sapiens
gacuucacacagca

SEQ ID NO: 459767 - RNA, 13 nt, Homo sapiens
gacuucagacucu

SEQ ID NO: 459768 - RNA, 16 nt, Homo sapiens
gacuuccuggggcccc

SEQ ID NO: 459769 - RNA, 10 nt, Homo sapiens
gacuuccuug

SEQ ID NO: 459770 - RNA, 15 nt, Homo sapiens
gacuucuaaaucaua

SEQ ID NO: 459771 - RNA, 18 nt, Homo sapiens
gacuucuaauaucauuca

SEQ ID NO: 459772 - RNA, 12 nt, Homo sapiens
gacuucugcuag

SEQ ID NO: 459773 - RNA, 17 nt, Homo sapiens
gacuucuuuuuggcauu

SEQ ID NO: 459774 - RNA, 21 nt, Homo sapiens
gacuugaaaguuuuccaguau

SEQ ID NO: 459775 - RNA, 13 nt, Homo sapiens
gacuugaacaaaa

SEQ ID NO: 459776 - RNA, 14 nt, Homo sapiens
gacuugaacaaaaa

SEQ ID NO: 459777 - RNA, 21 nt, Homo sapiens
gacuugagcccagagugaaca

SEQ ID NO: 459778 - RNA, 9 nt, Homo sapiens
gacuuggaa

SEQ ID NO: 459779 - RNA, 12 nt, Homo sapiens
gacuuugccaca

SEQ ID NO: 459780 - RNA, 18 nt, Homo sapiens
gacuuuuccaagcccuuu

SEQ ID NO: 459781 - RNA, 21 nt, Homo sapiens
gagaaaacaggcucacagaga

SEQ ID NO: 459782 - RNA, 14 nt, Homo sapiens
gagaaaagccagau

SEQ ID NO: 459783 - RNA, 20 nt, Homo sapiens
gagaaaccccuggggaccau

SEQ ID NO: 459784 - RNA, 23 nt, Homo sapiens
gagaaacgaaaaccacaaaaaga

SEQ ID NO: 459785 - RNA, 22 nt, Homo sapiens
gagaaaggcaugaaucuucccu

SEQ ID NO: 459786 - RNA, 20 nt, Homo sapiens
gagaaauaaagcacauuuga

SEQ ID NO: 459787 - RNA, 19 nt, Homo sapiens
gagaaauacaucauuugca

SEQ ID NO: 459788 - RNA, 23 nt, Homo sapiens
gagaaauacuuucaggcacuaag

SEQ ID NO: 459789 - RNA, 19 nt, Homo sapiens
gagaaaugaauaauuuccc

SEQ ID NO: 459790 - RNA, 13 nt, Homo sapiens
gagaaaugagcug

SEQ ID NO: 459791 - RNA, 16 nt, Homo sapiens
gagaaauuuuaguuua

SEQ ID NO: 459792 - RNA, 20 nt, Homo sapiens
gagaacacguuggcucaguc

SEQ ID NO: 459793 - RNA, 12 nt, Homo sapiens
gagaacagugau

SEQ ID NO: 459794 - RNA, 15 nt, Homo sapiens
gagaacauggccaau

SEQ ID NO: 459795 - RNA, 18 nt, Homo sapiens
gagaaccuuuccacuccc

SEQ ID NO: 459796 - RNA, 12 nt, Homo sapiens
gagaacugauga

SEQ ID NO: 459797 - RNA, 17 nt, Homo sapiens
gagaagaggcugcugca

SEQ ID NO: 459798 - RNA, 14 nt, Homo sapiens
gagaagccucaguc

SEQ ID NO: 459799 - RNA, 12 nt, Homo sapiens
gagaagccucau

SEQ ID NO: 459800 - RNA, 14 nt, Homo sapiens
gagaaggacagcuc

SEQ ID NO: 459801 - RNA, 19 nt, Homo sapiens
gagaaggucagauuagggc

SEQ ID NO: 459802 - RNA, 21 nt, Homo sapiens
gagaaguaagcagaguucuuu

SEQ ID NO: 459803 - RNA, 18 nt, Homo sapiens
gagaaguaauuccucuga

SEQ ID NO: 459804 - RNA, 22 nt, Homo sapiens
gagaaguauccaauuaugugac

SEQ ID NO: 459805 - RNA, 14 nt, Homo sapiens
gagaaucacuggaa

SEQ ID NO: 459806 - RNA, 13 nt, Homo sapiens
gagaaugccauuc

SEQ ID NO: 459807 - RNA, 16 nt, Homo sapiens
gagaaugucauuugcu

SEQ ID NO: 459808 - RNA, 13 nt, Homo sapiens
gagacacagggca

SEQ ID NO: 459809 - RNA, 20 nt, Homo sapiens
gagacagacagagaaggcag

SEQ ID NO: 459810 - RNA, 19 nt, Homo sapiens
gagacagagccuuguucua

SEQ ID NO: 459811 - RNA, 15 nt, Homo sapiens
gagacagucaggaag

SEQ ID NO: 459812 - RNA, 14 nt, Homo sapiens
gagacagugaggcu

SEQ ID NO: 459813 - RNA, 22 nt, Homo sapiens
gagacccaccuucaagcagcug

SEQ ID NO: 459814 - RNA, 17 nt, Homo sapiens
gagaccucagauguguu

SEQ ID NO: 459815 - RNA, 14 nt, Homo sapiens
gagacgcaggaaug

SEQ ID NO: 459816 - RNA, 15 nt, Homo sapiens
gagacgggcaucgca

SEQ ID NO: 459817 - RNA, 14 nt, Homo sapiens
gagacucugucuca

SEQ ID NO: 459818 - RNA, 19 nt, Homo sapiens
gagacuggcagccagggag

SEQ ID NO: 459819 - RNA, 20 nt, Homo sapiens
gagacugggagccacuucuc

SEQ ID NO: 459820 - RNA, 18 nt, Homo sapiens
gagacuugaaucaaguca

SEQ ID NO: 459821 - RNA, 14 nt, Homo sapiens
gagagacugugagg

SEQ ID NO: 459822 - RNA, 21 nt, Homo sapiens
gagagagcaaucuugcuguga

SEQ ID NO: 459823 - RNA, 14 nt, Homo sapiens
gagagagcucugca

SEQ ID NO: 459824 - RNA, 15 nt, Homo sapiens
gagagaucuaauccc

SEQ ID NO: 459825 - RNA, 13 nt, Homo sapiens
gagagauggaaua

SEQ ID NO: 459826 - RNA, 16 nt, Homo sapiens
gagagcaaaugcuauu

SEQ ID NO: 459827 - RNA, 16 nt, Homo sapiens
gagagcaggcuggcag

SEQ ID NO: 459828 - RNA, 13 nt, Homo sapiens
gagagcagugugg

SEQ ID NO: 459829 - RNA, 21 nt, Homo sapiens
gagagcccagaaaacugucau

SEQ ID NO: 459830 - RNA, 12 nt, Homo sapiens
gagagcucuuag

SEQ ID NO: 459831 - RNA, 23 nt, Homo sapiens
gagagggagucagucuucacuug

SEQ ID NO: 459832 - RNA, 12 nt, Homo sapiens
gagagggggcca

SEQ ID NO: 459833 - RNA, 16 nt, Homo sapiens
gagagucgcaucucag

SEQ ID NO: 459834 - RNA, 15 nt, Homo sapiens
gagagugaaaccaug

SEQ ID NO: 459835 - RNA, 12 nt, Homo sapiens
gagagugcccuu

SEQ ID NO: 459836 - RNA, 16 nt, Homo sapiens
gagaguggcuccuccc

SEQ ID NO: 459837 - RNA, 17 nt, Homo sapiens
gagauauuuuccauuuu

SEQ ID NO: 459838 - RNA, 20 nt, Homo sapiens
gagaucacgccacugcacuc

SEQ ID NO: 459839 - RNA, 20 nt, Homo sapiens
gagaucgcaucauugcacuc

SEQ ID NO: 459840 - RNA, 21 nt, Homo sapiens
gagaucgcgccaguacauucc

SEQ ID NO: 459841 - RNA, 14 nt, Homo sapiens
gagaugagcuuucu

SEQ ID NO: 459842 - RNA, 14 nt, Homo sapiens
gagaugaugugaug

SEQ ID NO: 459843 - RNA, 14 nt, Homo sapiens
gagaugccuuccag

SEQ ID NO: 459844 - RNA, 20 nt, Homo sapiens
gagauggaaguugcagugag

SEQ ID NO: 459845 - RNA, 19 nt, Homo sapiens
gagauggaauaaagcccuu

SEQ ID NO: 459846 - RNA, 15 nt, Homo sapiens
gagauggccaugcuc

SEQ ID NO: 459847 - RNA, 11 nt, Homo sapiens
gagauguaucc

SEQ ID NO: 459848 - RNA, 11 nt, Homo sapiens
gagauugaacc

SEQ ID NO: 459849 - RNA, 19 nt, Homo sapiens
gagauuucauagcuauuua

SEQ ID NO: 459850 - RNA, 22 nt, Homo sapiens
gagauuuccugacagggaaaag

SEQ ID NO: 459851 - RNA, 14 nt, Homo sapiens
gcauuuaacugccu

SEQ ID NO: 459852 - RNA, 15 nt, Homo sapiens
gcauuuaacugccuu

SEQ ID NO: 459853 - RNA, 12 nt, Homo sapiens
gcauuuacuuuu

SEQ ID NO: 459854 - RNA, 23 nt, Homo sapiens
gcauuuagacucucgacuggcca

SEQ ID NO: 459855 - RNA, 14 nt, Homo sapiens
gcauuuagcacaaa

SEQ ID NO: 459856 - RNA, 16 nt, Homo sapiens
gcauuucaccugugac

SEQ ID NO: 459857 - RNA, 18 nt, Homo sapiens
gcauuucuucacgcaccu

SEQ ID NO: 459858 - RNA, 12 nt, Homo sapiens
gcauuucuugcg

SEQ ID NO: 459859 - RNA, 20 nt, Homo sapiens
gcauuuuacugucuguaaga

SEQ ID NO: 459860 - RNA, 16 nt, Homo sapiens
gcauuuuuacuacuau

SEQ ID NO: 459861 - RNA, 18 nt, Homo sapiens
gccaaacccuugucagug

SEQ ID NO: 459862 - RNA, 15 nt, Homo sapiens
gccaaacuaaauacu

SEQ ID NO: 459863 - RNA, 18 nt, Homo sapiens
gccaaagagaaugccauu

SEQ ID NO: 459864 - RNA, 12 nt, Homo sapiens
gccaaagagcuc

SEQ ID NO: 459865 - RNA, 16 nt, Homo sapiens
gccaaauaugcacuuu

SEQ ID NO: 459866 - RNA, 17 nt, Homo sapiens
gccaaauaugcacuuuc

SEQ ID NO: 459867 - RNA, 17 nt, Homo sapiens
gccaacaccuucuuggc

SEQ ID NO: 459868 - RNA, 18 nt, Homo sapiens
gccaacaccuucuuggcu

SEQ ID NO: 459869 - RNA, 17 nt, Homo sapiens
gccaaccugaugccccu

SEQ ID NO: 459870 - RNA, 16 nt, Homo sapiens
gccaacucacucuuau

SEQ ID NO: 459871 - RNA, 15 nt, Homo sapiens
gccaacuuguaaaua

SEQ ID NO: 459872 - RNA, 20 nt, Homo sapiens
gccaagaucacgccacugca

SEQ ID NO: 459873 - RNA, 21 nt, Homo sapiens
gccaagauucuacucuuguca

SEQ ID NO: 459874 - RNA, 20 nt, Homo sapiens
gccaagcagagguugggagg

SEQ ID NO: 459875 - RNA, 16 nt, Homo sapiens
gccaagcccucaauaa

SEQ ID NO: 459876 - RNA, 12 nt, Homo sapiens
gccaaggccuca

SEQ ID NO: 459877 - RNA, 16 nt, Homo sapiens
gccaaggccucaggag

SEQ ID NO: 459878 - RNA, 20 nt, Homo sapiens
gccaagggguagaaguggca

SEQ ID NO: 459879 - RNA, 14 nt, Homo sapiens
gccaagguccugcu

SEQ ID NO: 459880 - RNA, 21 nt, Homo sapiens
gccacaaccugaaagacaaaa

SEQ ID NO: 459881 - RNA, 18 nt, Homo sapiens
gccacacguuugccaaau

SEQ ID NO: 459882 - RNA, 22 nt, Homo sapiens
gccaccaagcugcucuccuuca

SEQ ID NO: 459883 - RNA, 16 nt, Homo sapiens
gccaccaagggccuca

SEQ ID NO: 459884 - RNA, 15 nt, Homo sapiens
gccaccacugagucc

SEQ ID NO: 459885 - RNA, 20 nt, Homo sapiens
gccacccaggccacugaccu

SEQ ID NO: 459886 - RNA, 20 nt, Homo sapiens
gccaccggggcaagagggaa

SEQ ID NO: 459887 - RNA, 19 nt, Homo sapiens
gccaccucucccucaacaa

SEQ ID NO: 459888 - RNA, 16 nt, Homo sapiens
gccacuagguuucacc

SEQ ID NO: 459889 - RNA, 11 nt, Homo sapiens
gccacugaccu

SEQ ID NO: 459890 - RNA, 16 nt, Homo sapiens
gccacugggaaggcac

SEQ ID NO: 459891 - RNA, 18 nt, Homo sapiens
gccacuugcacugugcuu

SEQ ID NO: 459892 - RNA, 24 nt, Homo sapiens
gccagaacacacucuacaaaauga

SEQ ID NO: 459893 - RNA, 17 nt, Homo sapiens
gccagaauccucucaga

SEQ ID NO: 459894 - RNA, 22 nt, Homo sapiens
gccagagaaaauguuggaagag

SEQ ID NO: 459895 - RNA, 15 nt, Homo sapiens
gccagagcaccucag

SEQ ID NO: 459896 - RNA, 13 nt, Homo sapiens
gccagagccuuaa

SEQ ID NO: 459897 - RNA, 16 nt, Homo sapiens
gccagcaaggcagguu

SEQ ID NO: 459898 - RNA, 12 nt, Homo sapiens
gccagcacagaa

SEQ ID NO: 459899 - RNA, 20 nt, Homo sapiens
gccagcacaggggccccaga

SEQ ID NO: 459900 - RNA, 13 nt, Homo sapiens
gccagcagcacgu

SEQ ID NO: 459901 - RNA, 11 nt, Homo sapiens
gccagcauuuu

SEQ ID NO: 459902 - RNA, 14 nt, Homo sapiens
gccagcccaaagcu

SEQ ID NO: 459903 - RNA, 23 nt, Homo sapiens
gccagcccucccuggcugugagc

SEQ ID NO: 459904 - RNA, 13 nt, Homo sapiens
gccagcgugaagg

SEQ ID NO: 459905 - RNA, 17 nt, Homo sapiens
gccagcguggcgcagug

SEQ ID NO: 459906 - RNA, 15 nt, Homo sapiens
gccagcuccacaggg

SEQ ID NO: 459907 - RNA, 20 nt, Homo sapiens
gccagcuguacugaguucuc

SEQ ID NO: 459908 - RNA, 15 nt, Homo sapiens
gccaggacagcugca

SEQ ID NO: 459909 - RNA, 23 nt, Homo sapiens
gccaggacugggguucacgucac

SEQ ID NO: 459910 - RNA, 14 nt, Homo sapiens
gccaggacugugac

SEQ ID NO: 459911 - RNA, 22 nt, Homo sapiens
gccaggagccuccugacccugu

SEQ ID NO: 459912 - RNA, 20 nt, Homo sapiens
gccaggagguuggugacuga

SEQ ID NO: 459913 - RNA, 18 nt, Homo sapiens
gccaggcugcggugggca

SEQ ID NO: 459914 - RNA, 17 nt, Homo sapiens
gccaggcuguaagcauu

SEQ ID NO: 459915 - RNA, 13 nt, Homo sapiens
gccagggaaacca

SEQ ID NO: 459916 - RNA, 23 nt, Homo sapiens
gccaggucacccuuugcugugag

SEQ ID NO: 459917 - RNA, 17 nt, Homo sapiens
gccagugagcugugauc

SEQ ID NO: 459918 - RNA, 14 nt, Homo sapiens
gccaguuucuuugg

SEQ ID NO: 459919 - RNA, 16 nt, Homo sapiens
gccauaaugacucaga

SEQ ID NO: 459920 - RNA, 14 nt, Homo sapiens
gccauaccaggugc

SEQ ID NO: 459921 - RNA, 13 nt, Homo sapiens
gccauaccuugag

SEQ ID NO: 459922 - RNA, 13 nt, Homo sapiens
gccauacugccuu

SEQ ID NO: 459923 - RNA, 22 nt, Homo sapiens
gccauauauuuuuaagacuuuu

SEQ ID NO: 459924 - RNA, 19 nt, Homo sapiens
gccaucagaggccuaguca

SEQ ID NO: 459925 - RNA, 18 nt, Homo sapiens
gccaugaggaacaaggca

SEQ ID NO: 459926 - RNA, 24 nt, Homo sapiens
gccaugauuuuggccacuuugcag

SEQ ID NO: 459927 - RNA, 22 nt, Homo sapiens
gccaugcucaaccccccuccca

SEQ ID NO: 459928 - RNA, 14 nt, Homo sapiens
gccauggcuuucau

SEQ ID NO: 459929 - RNA, 22 nt, Homo sapiens
gccauggcuuucauccuguguc

SEQ ID NO: 459930 - RNA, 15 nt, Homo sapiens
gccauucacugcccc

SEQ ID NO: 459931 - RNA, 13 nt, Homo sapiens
gccauugaccacc

SEQ ID NO: 459932 - RNA, 21 nt, Homo sapiens
gcccaaauccccucccuguga

SEQ ID NO: 459933 - RNA, 15 nt, Homo sapiens
gcccaagcaugcccc

SEQ ID NO: 459934 - RNA, 14 nt, Homo sapiens
gcccaaucacugcc

SEQ ID NO: 459935 - RNA, 17 nt, Homo sapiens
gcccaauucugccacuu

SEQ ID NO: 459936 - RNA, 15 nt, Homo sapiens
gcccaccagaccugu

SEQ ID NO: 459937 - RNA, 17 nt, Homo sapiens
gcccaccagaccuguuc

SEQ ID NO: 459938 - RNA, 19 nt, Homo sapiens
gcccacuguuaauauucua

SEQ ID NO: 459939 - RNA, 22 nt, Homo sapiens
gcccacuucaccguacuaacca

SEQ ID NO: 459940 - RNA, 19 nt, Homo sapiens
gcccagacauccugugaug

SEQ ID NO: 459941 - RNA, 21 nt, Homo sapiens
gcccagaucguucugccacuu

SEQ ID NO: 459942 - RNA, 14 nt, Homo sapiens
gcccagcuacauuc

SEQ ID NO: 459943 - RNA, 21 nt, Homo sapiens
gcccaggccggccagccucac

SEQ ID NO: 459944 - RNA, 20 nt, Homo sapiens
gcccaggcuggaguggagug

SEQ ID NO: 459945 - RNA, 20 nt, Homo sapiens
gcccaggguccugugccugg

SEQ ID NO: 459946 - RNA, 23 nt, Homo sapiens
gcccaggguucccccagcccugu

SEQ ID NO: 459947 - RNA, 16 nt, Homo sapiens
gcccaggucccagugc

SEQ ID NO: 459948 - RNA, 22 nt, Homo sapiens
gcccaucacaggguugggccca

SEQ ID NO: 459949 - RNA, 19 nt, Homo sapiens
gcccaugcccaccugccca

SEQ ID NO: 459950 - RNA, 17 nt, Homo sapiens
gcccaugggcagaagau

SEQ ID NO: 459951 - RNA, 15 nt, Homo sapiens
gcccaugugugagug

SEQ ID NO: 459952 - RNA, 20 nt, Homo sapiens
gcccaugugugagugugugc

SEQ ID NO: 459953 - RNA, 23 nt, Homo sapiens
gcccaugugugagugugugcaag

SEQ ID NO: 459954 - RNA, 16 nt, Homo sapiens
gcccauuucuccauac

SEQ ID NO: 459955 - RNA, 16 nt, Homo sapiens
gccccaaaaccacagc

SEQ ID NO: 459956 - RNA, 11 nt, Homo sapiens
gccccaaagcc

SEQ ID NO: 459957 - RNA, 20 nt, Homo sapiens
gccccacuucacccccaacu

SEQ ID NO: 459958 - RNA, 19 nt, Homo sapiens
gccccagaaccccaacucc

SEQ ID NO: 459959 - RNA, 20 nt, Homo sapiens
gccccagaaccccaacuccc

SEQ ID NO: 459960 - RNA, 23 nt, Homo sapiens
gccccagauaccagccccuguau

SEQ ID NO: 459961 - RNA, 23 nt, Homo sapiens
gccccagccguggcgugaacuga

SEQ ID NO: 459962 - RNA, 23 nt, Homo sapiens
gccccaguccugguucaguggga

SEQ ID NO: 459963 - RNA, 23 nt, Homo sapiens
gccccauagaaaacaaucugccc

SEQ ID NO: 459964 - RNA, 15 nt, Homo sapiens
gccccaugccugucc

SEQ ID NO: 459965 - RNA, 14 nt, Homo sapiens
gcccccacccggga

SEQ ID NO: 459966 - RNA, 21 nt, Homo sapiens
gcccccagcagauggaaagaa

SEQ ID NO: 459967 - RNA, 20 nt, Homo sapiens
gcccccgagcugggggccau

SEQ ID NO: 459968 - RNA, 16 nt, Homo sapiens
gcccccugcacaggga

SEQ ID NO: 459969 - RNA, 19 nt, Homo sapiens
gccccggccacucccugcc

SEQ ID NO: 459970 - RNA, 15 nt, Homo sapiens
gccccguuucuugcc

SEQ ID NO: 459971 - RNA, 15 nt, Homo sapiens
gccccucggcauuca

SEQ ID NO: 459972 - RNA, 21 nt, Homo sapiens
gccccugcccgagagcucuua

SEQ ID NO: 459973 - RNA, 20 nt, Homo sapiens
gccccuguauggcacuggca

SEQ ID NO: 459974 - RNA, 19 nt, Homo sapiens
gccccuugcaaaguaauag

SEQ ID NO: 459975 - RNA, 21 nt, Homo sapiens
gcccgcacacccucacucugc

SEQ ID NO: 459976 - RNA, 14 nt, Homo sapiens
gcccgcacagcagc

SEQ ID NO: 459977 - RNA, 13 nt, Homo sapiens
gcccgccaccuug

SEQ ID NO: 459978 - RNA, 15 nt, Homo sapiens
gcccgccccaagccc

SEQ ID NO: 459979 - RNA, 21 nt, Homo sapiens
gcccuaccugauuggugcaac

SEQ ID NO: 459980 - RNA, 22 nt, Homo sapiens
gcccuaggcuccgucaguauca

SEQ ID NO: 459981 - RNA, 15 nt, Homo sapiens
guuucuaacuuggag

SEQ ID NO: 459982 - RNA, 20 nt, Homo sapiens
guuucugaaccauuacugua

SEQ ID NO: 459983 - RNA, 22 nt, Homo sapiens
guuucugaaccauuacuguaau

SEQ ID NO: 459984 - RNA, 16 nt, Homo sapiens
guuucugcagaggcag

SEQ ID NO: 459985 - RNA, 14 nt, Homo sapiens
guuucugcagcccu

SEQ ID NO: 459986 - RNA, 16 nt, Homo sapiens
guuucuuaaauggaau

SEQ ID NO: 459987 - RNA, 11 nt, Homo sapiens
guuucuuccaa

SEQ ID NO: 459988 - RNA, 24 nt, Homo sapiens
guuucuugaaguccaguguuucca

SEQ ID NO: 459989 - RNA, 15 nt, Homo sapiens
guuucuugugggcua

SEQ ID NO: 459990 - RNA, 19 nt, Homo sapiens
guuucuuguuuaccaaaga

SEQ ID NO: 459991 - RNA, 21 nt, Homo sapiens
guuugaaaauauuuuguugcc

SEQ ID NO: 459992 - RNA, 21 nt, Homo sapiens
guuugagaccacccugggcaa

SEQ ID NO: 459993 - RNA, 19 nt, Homo sapiens
guuugagcgcagaguaaaa

SEQ ID NO: 459994 - RNA, 13 nt, Homo sapiens
guuugaguucaaa

SEQ ID NO: 459995 - RNA, 22 nt, Homo sapiens
guuugcgcuaaaaagaacucaa

SEQ ID NO: 459996 - RNA, 21 nt, Homo sapiens
guuugcugcucuauauuacaa

SEQ ID NO: 459997 - RNA, 16 nt, Homo sapiens
guuugcuuagcauucc

SEQ ID NO: 459998 - RNA, 13 nt, Homo sapiens
guuuggccaaaaa

SEQ ID NO: 459999 - RNA, 21 nt, Homo sapiens
guuuggcuagguaucauucaa

SEQ ID NO: 460000 - RNA, 18 nt, Homo sapiens
guuuggggacaugugauu

SEQ ID NO: 460001 - RNA, 17 nt, Homo sapiens
guuugggugucugcuaa

SEQ ID NO: 460002 - RNA, 20 nt, Homo sapiens
guuugguacuuuuaacauaa

SEQ ID NO: 460003 - RNA, 21 nt, Homo sapiens
guuugguaguuagccaucuaa

SEQ ID NO: 460004 - RNA, 22 nt, Homo sapiens
guuuguaggguggaugggauac

SEQ ID NO: 460005 - RNA, 20 nt, Homo sapiens
guuuguuccuacagccccuu

SEQ ID NO: 460006 - RNA, 17 nt, Homo sapiens
guuuuaacuuccagugg

SEQ ID NO: 460007 - RNA, 13 nt, Homo sapiens
guuuuauuuugaa

SEQ ID NO: 460008 - RNA, 17 nt, Homo sapiens
guuuucauccuggccuc

SEQ ID NO: 460009 - RNA, 13 nt, Homo sapiens
guuuucaugacca

SEQ ID NO: 460010 - RNA, 17 nt, Homo sapiens
guuuuccuaaaugcagu

SEQ ID NO: 460011 - RNA, 15 nt, Homo sapiens
guuuucuaauaucuu

SEQ ID NO: 460012 - RNA, 12 nt, Homo sapiens
guuuucucugua

SEQ ID NO: 460013 - RNA, 22 nt, Homo sapiens
guuuucucuguauaacuuguga

SEQ ID NO: 460014 - RNA, 18 nt, Homo sapiens
guuuucugguguuauauc

SEQ ID NO: 460015 - RNA, 21 nt, Homo sapiens
guuuucuucuaaucauaacau

SEQ ID NO: 460016 - RNA, 19 nt, Homo sapiens
guuuugcauggaguauuau

SEQ ID NO: 460017 - RNA, 12 nt, Homo sapiens
guuuugccagug

SEQ ID NO: 460018 - RNA, 16 nt, Homo sapiens
guuuugcuagagcuaa

SEQ ID NO: 460019 - RNA, 23 nt, Homo sapiens
guuuuguagagauggggucucac

SEQ ID NO: 460020 - RNA, 16 nt, Homo sapiens
guuuugucaaacugua

SEQ ID NO: 460021 - RNA, 18 nt, Homo sapiens
guuuugugugguauucaa

SEQ ID NO: 460022 - RNA, 20 nt, Homo sapiens
guuuuguugaguuaaaguau

SEQ ID NO: 460023 - RNA, 17 nt, Homo sapiens
guuuuuaaaaaggccuu

SEQ ID NO: 460024 - RNA, 22 nt, Homo sapiens
guuuuuaaaaaggucauauauu

SEQ ID NO: 460025 - RNA, 14 nt, Homo sapiens
guuuuucagcaccc

SEQ ID NO: 460026 - RNA, 13 nt, Homo sapiens
guuuuuccuccau

SEQ ID NO: 460027 - RNA, 19 nt, Homo sapiens
guuuuucuuguuguuauuc

SEQ ID NO: 460028 - RNA, 18 nt, Homo sapiens
guuuuuguuuuuugccau

SEQ ID NO: 460029 - RNA, 12 nt, Homo sapiens
guuuuuugccau

SEQ ID NO: 460030 - RNA, 23 nt, Homo sapiens
guuuuuuuuuuccacuuagaaau

SEQ ID NO: 460031 - RNA, 21 nt, Homo sapiens
uaaaaaaaaaacuucauucua

SEQ ID NO: 460032 - RNA, 19 nt, Homo sapiens
uaaaaaaaaaaggaugaaa

SEQ ID NO: 460033 - RNA, 21 nt, Homo sapiens
uaaaaaacaaagccuuaucca

SEQ ID NO: 460034 - RNA, 18 nt, Homo sapiens
uaaaaaagcauuauccuu

SEQ ID NO: 460035 - RNA, 14 nt, Homo sapiens
uaaaaaaguuuaca

SEQ ID NO: 460036 - RNA, 17 nt, Homo sapiens
uaaaaaauaacugugca

SEQ ID NO: 460037 - RNA, 22 nt, Homo sapiens
uaaaaacagaaggaaauugaga

SEQ ID NO: 460038 - RNA, 19 nt, Homo sapiens
uaaaaacugcccauuguaa

SEQ ID NO: 460039 - RNA, 13 nt, Homo sapiens
uaaaaagugacac

SEQ ID NO: 460040 - RNA, 18 nt, Homo sapiens
uaaaaagugacacagcag

SEQ ID NO: 460041 - RNA, 14 nt, Homo sapiens
uaaaaaguggcuaa

SEQ ID NO: 460042 - RNA, 17 nt, Homo sapiens
uaaaaauaaccaaaaaa

SEQ ID NO: 460043 - RNA, 15 nt, Homo sapiens
uaaaaaugcaugaua

SEQ ID NO: 460044 - RNA, 19 nt, Homo sapiens
uaaaacaacacgauuuaca

SEQ ID NO: 460045 - RNA, 18 nt, Homo sapiens
uaaaacauuccugugaaa

SEQ ID NO: 460046 - RNA, 15 nt, Homo sapiens
uaaaaccacuaugca

SEQ ID NO: 460047 - RNA, 20 nt, Homo sapiens
uaaaaccaguuuugcugcua

SEQ ID NO: 460048 - RNA, 22 nt, Homo sapiens
uaaaaccaucaaaaauauucca

SEQ ID NO: 460049 - RNA, 12 nt, Homo sapiens
uaaaaccuuuca

SEQ ID NO: 460050 - RNA, 16 nt, Homo sapiens
uaaaacgauuacugac

SEQ ID NO: 460051 - RNA, 16 nt, Homo sapiens
uaaaacguuaucucau

SEQ ID NO: 460052 - RNA, 20 nt, Homo sapiens
uaaaacugucuugugagcug

SEQ ID NO: 460053 - RNA, 12 nt, Homo sapiens
uaaaacugugac

SEQ ID NO: 460054 - RNA, 17 nt, Homo sapiens
uaaaacuuaacauucau

SEQ ID NO: 460055 - RNA, 16 nt, Homo sapiens
uaaaacuuaugcuagu

SEQ ID NO: 460056 - RNA, 17 nt, Homo sapiens
uaaaacuucugauuucu

SEQ ID NO: 460057 - RNA, 22 nt, Homo sapiens
uaaaacuuuaaucccacuugcc

SEQ ID NO: 460058 - RNA, 16 nt, Homo sapiens
uaaaagaguggaacua

SEQ ID NO: 460059 - RNA, 16 nt, Homo sapiens
uaaaagauaaguuugu

SEQ ID NO: 460060 - RNA, 16 nt, Homo sapiens
uaaaagcaaaacugca

SEQ ID NO: 460061 - RNA, 18 nt, Homo sapiens
uaaaagcaacaucagcuu

SEQ ID NO: 460062 - RNA, 18 nt, Homo sapiens
uaaaagcaucccugugag

SEQ ID NO: 460063 - RNA, 14 nt, Homo sapiens
uaaaaggagcacau

SEQ ID NO: 460064 - RNA, 20 nt, Homo sapiens
uaaaagguaugguggggaua

SEQ ID NO: 460065 - RNA, 20 nt, Homo sapiens
uaaaagguauuuugaauacc

SEQ ID NO: 460066 - RNA, 17 nt, Homo sapiens
uaaaaguauaacuuauu

SEQ ID NO: 460067 - RNA, 18 nt, Homo sapiens
uaaaaguauuuaguugau

SEQ ID NO: 460068 - RNA, 16 nt, Homo sapiens
uaaaaguccugucacc

SEQ ID NO: 460069 - RNA, 15 nt, Homo sapiens
uaaaagugacucuca

SEQ ID NO: 460070 - RNA, 16 nt, Homo sapiens
uaaaagugacucucag

SEQ ID NO: 460071 - RNA, 19 nt, Homo sapiens
uaaaagugggaauuaggag

SEQ ID NO: 460072 - RNA, 18 nt, Homo sapiens
uaaaauaaaccagacuca

SEQ ID NO: 460073 - RNA, 17 nt, Homo sapiens
uaaaauaacuaagcaag

SEQ ID NO: 460074 - RNA, 17 nt, Homo sapiens
uaaaauaagaaugauuu

SEQ ID NO: 460075 - RNA, 12 nt, Homo sapiens
uaaaauacucac

SEQ ID NO: 460076 - RNA, 19 nt, Homo sapiens
uaaaauagcuuugcaguga

SEQ ID NO: 460077 - RNA, 12 nt, Homo sapiens
uaaaauaucauu

SEQ ID NO: 460078 - RNA, 19 nt, Homo sapiens
uaaaauauuccugcauuug

SEQ ID NO: 460079 - RNA, 22 nt, Homo sapiens
uaaaaucaggauuuuagugcuu

SEQ ID NO: 460080 - RNA, 17 nt, Homo sapiens
uaaaaucauucaauauc

SEQ ID NO: 460081 - RNA, 22 nt, Homo sapiens
uaaaaucuguauugcuaagaua

SEQ ID NO: 460082 - RNA, 13 nt, Homo sapiens
uaaaaucugugaa

SEQ ID NO: 460083 - RNA, 20 nt, Homo sapiens
uaaaaucuugucauguguau

SEQ ID NO: 460084 - RNA, 23 nt, Homo sapiens
uaaaaucuuuccaucucauuaca

SEQ ID NO: 460085 - RNA, 20 nt, Homo sapiens
uaaaaugaaauuacuacaaa

SEQ ID NO: 460086 - RNA, 13 nt, Homo sapiens
uaaaaugcacuga

SEQ ID NO: 460087 - RNA, 22 nt, Homo sapiens
uaaaaugcuaauuaggcaaaga

SEQ ID NO: 460088 - RNA, 19 nt, Homo sapiens
uaaaauguacucagcuauc

SEQ ID NO: 460089 - RNA, 14 nt, Homo sapiens
uaaaauguauucaa

SEQ ID NO: 460090 - RNA, 19 nt, Homo sapiens
uaaaauuaagaaguacaau

SEQ ID NO: 460091 - RNA, 13 nt, Homo sapiens
uaaaauuagugag

SEQ ID NO: 460092 - RNA, 12 nt, Homo sapiens
uaaaauucauuu

SEQ ID NO: 460093 - RNA, 15 nt, Homo sapiens
uaaaauuguaugaaa

SEQ ID NO: 460094 - RNA, 17 nt, Homo sapiens
uaaaauuuaaccuacua

SEQ ID NO: 460095 - RNA, 21 nt, Homo sapiens
uaaacacggggcuugcaacuu

SEQ ID NO: 460096 - RNA, 20 nt, Homo sapiens
uaaacagcuucaugccuuug

SEQ ID NO: 460097 - RNA, 14 nt, Homo sapiens
uaaacagucaucuu

SEQ ID NO: 460098 - RNA, 13 nt, Homo sapiens
uaaacagugccau

SEQ ID NO: 460099 - RNA, 18 nt, Homo sapiens
uaaacauaugcaaacagc

SEQ ID NO: 460100 - RNA, 10 nt, Homo sapiens
uaaacauuca

SEQ ID NO: 460101 - RNA, 23 nt, Homo sapiens
uaaaccagguuuagacaguauga

SEQ ID NO: 460102 - RNA, 13 nt, Homo sapiens
uaaaccauaaaau

SEQ ID NO: 460103 - RNA, 21 nt, Homo sapiens
uaaacgaggcaaugacuguga

SEQ ID NO: 460104 - RNA, 14 nt, Homo sapiens
uaaacuaguacuau

SEQ ID NO: 460105 - RNA, 16 nt, Homo sapiens
uaaacuccacagggac

SEQ ID NO: 460106 - RNA, 15 nt, Homo sapiens
uaaacugaacauauu

SEQ ID NO: 460107 - RNA, 13 nt, Homo sapiens
uaaacugaugcuu

SEQ ID NO: 460108 - RNA, 21 nt, Homo sapiens
uaaacuguaucaaaucuguau

SEQ ID NO: 460109 - RNA, 22 nt, Homo sapiens
uaaacuugaguuggaguacuau

SEQ ID NO: 460110 - RNA, 21 nt, Homo sapiens
uaaacuugaugccagugggca

SEQ ID NO: 460111 - RNA, 14 nt, Homo sapiens
uacuuuuauuugca

SEQ ID NO: 460112 - RNA, 14 nt, Homo sapiens
uagaaaaaggagcu

SEQ ID NO: 460113 - RNA, 19 nt, Homo sapiens
uagaaaagcuuccuagcuu

SEQ ID NO: 460114 - RNA, 13 nt, Homo sapiens
uagaaacugaguc

SEQ ID NO: 460115 - RNA, 19 nt, Homo sapiens
uagaaagccccucaccuca

SEQ ID NO: 460116 - RNA, 18 nt, Homo sapiens
uagaaauuuuaucucuuc

SEQ ID NO: 460117 - RNA, 12 nt, Homo sapiens
uagaacagccag

SEQ ID NO: 460118 - RNA, 16 nt, Homo sapiens
uagaacuggucuucca

SEQ ID NO: 460119 - RNA, 20 nt, Homo sapiens
uagaacuucaagaaguaaga

SEQ ID NO: 460120 - RNA, 15 nt, Homo sapiens
uagaagaaaguaaaa

SEQ ID NO: 460121 - RNA, 21 nt, Homo sapiens
uagaagcaaaugacaaaaagc

SEQ ID NO: 460122 - RNA, 19 nt, Homo sapiens
uagaagcagaucauuuccc

SEQ ID NO: 460123 - RNA, 23 nt, Homo sapiens
uagaagccugcagaauccagcua

SEQ ID NO: 460124 - RNA, 22 nt, Homo sapiens
uagaagccugcagcggcacaaa

SEQ ID NO: 460125 - RNA, 21 nt, Homo sapiens
uagaagcuguaguagcccuuu

SEQ ID NO: 460126 - RNA, 19 nt, Homo sapiens
uagaauaaugugggaagaa

SEQ ID NO: 460127 - RNA, 14 nt, Homo sapiens
uagaauacuguauu

SEQ ID NO: 460128 - RNA, 15 nt, Homo sapiens
uagaauauacugucu

SEQ ID NO: 460129 - RNA, 17 nt, Homo sapiens
uagaaucaagucuguga

SEQ ID NO: 460130 - RNA, 19 nt, Homo sapiens
uagaaucaagucugugaaa

SEQ ID NO: 460131 - RNA, 19 nt, Homo sapiens
uagaaugagggaaacaaaa

SEQ ID NO: 460132 - RNA, 16 nt, Homo sapiens
uagaauggaaaacugc

SEQ ID NO: 460133 - RNA, 16 nt, Homo sapiens
uagaauggggcuucca

SEQ ID NO: 460134 - RNA, 23 nt, Homo sapiens
uagaauguuacuuuggaaugacu

SEQ ID NO: 460135 - RNA, 19 nt, Homo sapiens
uagaauuaguggcacuugc

SEQ ID NO: 460136 - RNA, 22 nt, Homo sapiens
uagacaaugaugugaguaccca

SEQ ID NO: 460137 - RNA, 14 nt, Homo sapiens
uagacacaguauug

SEQ ID NO: 460138 - RNA, 23 nt, Homo sapiens
uagacacccauuuucacauuccc

SEQ ID NO: 460139 - RNA, 15 nt, Homo sapiens
uagacaguauugcca

SEQ ID NO: 460140 - RNA, 22 nt, Homo sapiens
uagacaugcacacccauucaca

SEQ ID NO: 460141 - RNA, 18 nt, Homo sapiens
uagaccuggauguuauau

SEQ ID NO: 460142 - RNA, 14 nt, Homo sapiens
uagacgaacagcug

SEQ ID NO: 460143 - RNA, 13 nt, Homo sapiens
uagacuagugcuu

SEQ ID NO: 460144 - RNA, 11 nt, Homo sapiens
uagacugcaaa

SEQ ID NO: 460145 - RNA, 16 nt, Homo sapiens
uagacuggccaugcaa

SEQ ID NO: 460146 - RNA, 15 nt, Homo sapiens
uagacuuacuuuccu

SEQ ID NO: 460147 - RNA, 11 nt, Homo sapiens
uagacuugaaa

SEQ ID NO: 460148 - RNA, 23 nt, Homo sapiens
uagacuugaaaguuuuccaguau

SEQ ID NO: 460149 - RNA, 14 nt, Homo sapiens
uagacuuggagcug

SEQ ID NO: 460150 - RNA, 20 nt, Homo sapiens
uagagaaaauggaacauuaa

SEQ ID NO: 460151 - RNA, 14 nt, Homo sapiens
uagagacuguagau

SEQ ID NO: 460152 - RNA, 15 nt, Homo sapiens
uagagacuguagauu

SEQ ID NO: 460153 - RNA, 12 nt, Homo sapiens
uagagaggacag

SEQ ID NO: 460154 - RNA, 22 nt, Homo sapiens
uagagagggugguuuuccucaa

SEQ ID NO: 460155 - RNA, 13 nt, Homo sapiens
uagagauggagga

SEQ ID NO: 460156 - RNA, 23 nt, Homo sapiens
uagagcaucugucccacugggac

SEQ ID NO: 460157 - RNA, 15 nt, Homo sapiens
uagagcuagucuuuc

SEQ ID NO: 460158 - RNA, 22 nt, Homo sapiens
uagagcucaguauacuaaugcc

SEQ ID NO: 460159 - RNA, 16 nt, Homo sapiens
uagaggagaaccugga

SEQ ID NO: 460160 - RNA, 22 nt, Homo sapiens
uagaggcaagaaagagauacca

SEQ ID NO: 460161 - RNA, 23 nt, Homo sapiens
uagaggugggcagcugggcccca

SEQ ID NO: 460162 - RNA, 20 nt, Homo sapiens
uagagucacagcuuucccag

SEQ ID NO: 460163 - RNA, 14 nt, Homo sapiens
uagagucaucucca

SEQ ID NO: 460164 - RNA, 22 nt, Homo sapiens
uagaguccaacguggggcagca

SEQ ID NO: 460165 - RNA, 22 nt, Homo sapiens
uagagugcccuuaaaauaauga

SEQ ID NO: 460166 - RNA, 21 nt, Homo sapiens
uagaguguuuuaaaacauuca

SEQ ID NO: 460167 - RNA, 14 nt, Homo sapiens
uagauauucauuaa

SEQ ID NO: 460168 - RNA, 16 nt, Homo sapiens
uagaucaucagucacc

SEQ ID NO: 460169 - RNA, 23 nt, Homo sapiens
uagauccacacuuucaaagagaa

SEQ ID NO: 460170 - RNA, 17 nt, Homo sapiens
uagauccagauccagac

SEQ ID NO: 460171 - RNA, 15 nt, Homo sapiens
uagauguauuuucaa

SEQ ID NO: 460172 - RNA, 21 nt, Homo sapiens
uagauguauuuucaauaaaga

SEQ ID NO: 460173 - RNA, 21 nt, Homo sapiens
uagauguccucagaagucagu

SEQ ID NO: 460174 - RNA, 16 nt, Homo sapiens
uagaugugucuuacca

SEQ ID NO: 460175 - RNA, 20 nt, Homo sapiens
uagaugugucuuaccagauc

SEQ ID NO: 460176 - RNA, 12 nt, Homo sapiens
uagauguuuaca

SEQ ID NO: 460177 - RNA, 23 nt, Homo sapiens
uagauugccuuuggcaauucuuc

SEQ ID NO: 460178 - RNA, 20 nt, Homo sapiens
uagauuuuuagauuccuacu

SEQ ID NO: 460179 - RNA, 19 nt, Homo sapiens
uagcaaauggcagaaccaa

SEQ ID NO: 460180 - RNA, 20 nt, Homo sapiens
uagcaaauggcagaaccaaa

SEQ ID NO: 460181 - RNA, 12 nt, Homo sapiens
uagcaacaugcu

SEQ ID NO: 460182 - RNA, 17 nt, Homo sapiens
uagcaagaagauucuaa

SEQ ID NO: 460183 - RNA, 14 nt, Homo sapiens
uagcaagugugcac

SEQ ID NO: 460184 - RNA, 15 nt, Homo sapiens
uagcacaucauggca

SEQ ID NO: 460185 - RNA, 19 nt, Homo sapiens
uagcacccccagccaucua

SEQ ID NO: 460186 - RNA, 13 nt, Homo sapiens
uagcacuaccauu

SEQ ID NO: 460187 - RNA, 15 nt, Homo sapiens
uagcagauauguauu

SEQ ID NO: 460188 - RNA, 15 nt, Homo sapiens
uagcagguuucacua

SEQ ID NO: 460189 - RNA, 15 nt, Homo sapiens
uagcaguuucacugc

SEQ ID NO: 460190 - RNA, 13 nt, Homo sapiens
uagcauauauaau

SEQ ID NO: 460191 - RNA, 21 nt, Homo sapiens
uagcauccaaggggccuggaa

SEQ ID NO: 460192 - RNA, 16 nt, Homo sapiens
uagcauguuguagaua

SEQ ID NO: 460193 - RNA, 14 nt, Homo sapiens
uagcauuccaucaa

SEQ ID NO: 460194 - RNA, 22 nt, Homo sapiens
uagcauuggguagcuauacuca

SEQ ID NO: 460195 - RNA, 19 nt, Homo sapiens
uagcauuucaaaacccaaa

SEQ ID NO: 460196 - RNA, 18 nt, Homo sapiens
uagccaaacccuugucag

SEQ ID NO: 460197 - RNA, 13 nt, Homo sapiens
uagcccacugccu

SEQ ID NO: 460198 - RNA, 13 nt, Homo sapiens
uagcccaggucac

SEQ ID NO: 460199 - RNA, 14 nt, Homo sapiens
uagcccugucugcu

SEQ ID NO: 460200 - RNA, 23 nt, Homo sapiens
uagccgagcacgguggugcaugc

SEQ ID NO: 460201 - RNA, 20 nt, Homo sapiens
uagccuguuucguagccaua

SEQ ID NO: 460202 - RNA, 20 nt, Homo sapiens
uagcgcugcucuuaugccau

SEQ ID NO: 460203 - RNA, 14 nt, Homo sapiens
uagcgggacaaagc

SEQ ID NO: 460204 - RNA, 21 nt, Homo sapiens
uagcuaggugcacauauacau

SEQ ID NO: 460205 - RNA, 14 nt, Homo sapiens
uagcuaguaucuuc

SEQ ID NO: 460206 - RNA, 14 nt, Homo sapiens
uagcuauccuaaau

SEQ ID NO: 460207 - RNA, 17 nt, Homo sapiens
uagcuauucuuugacca

SEQ ID NO: 460208 - RNA, 14 nt, Homo sapiens
uagcucacaccuga

SEQ ID NO: 460209 - RNA, 22 nt, Homo sapiens
uagcugacggcuggguguuuca

SEQ ID NO: 460210 - RNA, 16 nt, Homo sapiens
uagcugggauuugaac

SEQ ID NO: 460211 - RNA, 20 nt, Homo sapiens
uagcuuucccaaauaaacuc

SEQ ID NO: 460212 - RNA, 20 nt, Homo sapiens
uaggaacagacucgaugcaa

SEQ ID NO: 460213 - RNA, 16 nt, Homo sapiens
uaggaacugggccuug

SEQ ID NO: 460214 - RNA, 17 nt, Homo sapiens
uaggaacugggccuugu

SEQ ID NO: 460215 - RNA, 16 nt, Homo sapiens
uaggaauaaauaaaaa

SEQ ID NO: 460216 - RNA, 13 nt, Homo sapiens
uaggacacagugu

SEQ ID NO: 460217 - RNA, 16 nt, Homo sapiens
uaggacuuuagggauc

SEQ ID NO: 460218 - RNA, 17 nt, Homo sapiens
uaggagacagucucaag

SEQ ID NO: 460219 - RNA, 21 nt, Homo sapiens
uaggagacagucucaagcacu

SEQ ID NO: 460220 - RNA, 23 nt, Homo sapiens
uaggagacagucucaagcacuaa

SEQ ID NO: 460221 - RNA, 20 nt, Homo sapiens
uaggagggcuggcaacuuag

SEQ ID NO: 460222 - RNA, 15 nt, Homo sapiens
uaggaguugcuccua

SEQ ID NO: 460223 - RNA, 22 nt, Homo sapiens
uaggaguuuuguuuagagcagu

SEQ ID NO: 460224 - RNA, 22 nt, Homo sapiens
uaggauaagcacuagaucuccc

SEQ ID NO: 460225 - RNA, 14 nt, Homo sapiens
uaggauaucuuggc

SEQ ID NO: 460226 - RNA, 15 nt, Homo sapiens
uaggauaucuuggcu

SEQ ID NO: 460227 - RNA, 19 nt, Homo sapiens
uaggcaaggaugaaagaca

SEQ ID NO: 460228 - RNA, 12 nt, Homo sapiens
uaggcacaugug

SEQ ID NO: 460229 - RNA, 13 nt, Homo sapiens
uaggcacaugugg

SEQ ID NO: 460230 - RNA, 12 nt, Homo sapiens
uaggcauacucu

SEQ ID NO: 460231 - RNA, 13 nt, Homo sapiens
uaggccucaggcc

SEQ ID NO: 460232 - RNA, 14 nt, Homo sapiens
uaggcuaaaaacau

SEQ ID NO: 460233 - RNA, 15 nt, Homo sapiens
uagggaguaccugcu

SEQ ID NO: 460234 - RNA, 16 nt, Homo sapiens
uaggucagauggaggu

SEQ ID NO: 460235 - RNA, 17 nt, Homo sapiens
uagguccaagggccaua

SEQ ID NO: 460236 - RNA, 22 nt, Homo sapiens
uaggugccaggcuguaagcauu

SEQ ID NO: 460237 - RNA, 15 nt, Homo sapiens
uagguguuaccuucu

SEQ ID NO: 460238 - RNA, 14 nt, Homo sapiens
uagguugugcaaau

SEQ ID NO: 460239 - RNA, 18 nt, Homo sapiens
uagguuucaccucccaaa

SEQ ID NO: 460240 - RNA, 17 nt, Homo sapiens
uaguaccuucaauacuu

SEQ ID NO: 460241 - RNA, 21 nt, Homo sapiens
ucaaaaacauggccacaucca

SEQ ID NO: 460242 - RNA, 14 nt, Homo sapiens
ucaaaaacauucuu

SEQ ID NO: 460243 - RNA, 14 nt, Homo sapiens
ucaaaaagagucuu

SEQ ID NO: 460244 - RNA, 13 nt, Homo sapiens
ucaaaacacuugu

SEQ ID NO: 460245 - RNA, 13 nt, Homo sapiens
ucaaaaccugugc

SEQ ID NO: 460246 - RNA, 13 nt, Homo sapiens
ucaaaacuaguuc

SEQ ID NO: 460247 - RNA, 12 nt, Homo sapiens
ucaaaagaucaa

SEQ ID NO: 460248 - RNA, 16 nt, Homo sapiens
ucaaaaggaaaccaag

SEQ ID NO: 460249 - RNA, 21 nt, Homo sapiens
ucaaaaguccuuagaaugagg

SEQ ID NO: 460250 - RNA, 22 nt, Homo sapiens
ucaaaauaaaaagugacacagc

SEQ ID NO: 460251 - RNA, 15 nt, Homo sapiens
ucaaaauccuuccaa

SEQ ID NO: 460252 - RNA, 19 nt, Homo sapiens
ucaaaaucuguagagcagg

SEQ ID NO: 460253 - RNA, 20 nt, Homo sapiens
ucaaaaucuucacugaauau

SEQ ID NO: 460254 - RNA, 24 nt, Homo sapiens
ucaaaaugucuaagauaguaacaa

SEQ ID NO: 460255 - RNA, 17 nt, Homo sapiens
ucaaaauuguguccaca

SEQ ID NO: 460256 - RNA, 11 nt, Homo sapiens
ucaaacagcuc

SEQ ID NO: 460257 - RNA, 16 nt, Homo sapiens
ucaaacauuauucuca

SEQ ID NO: 460258 - RNA, 14 nt, Homo sapiens
ucaaaccaggauuu

SEQ ID NO: 460259 - RNA, 18 nt, Homo sapiens
ucaaaccuccaaaagccc

SEQ ID NO: 460260 - RNA, 17 nt, Homo sapiens
ucaaaccugaccacaga

SEQ ID NO: 460261 - RNA, 17 nt, Homo sapiens
ucaaacuccugaccuca

SEQ ID NO: 460262 - RNA, 15 nt, Homo sapiens
ucaaagcaaguuuca

SEQ ID NO: 460263 - RNA, 20 nt, Homo sapiens
ucaaaggaaaauaguaaugu

SEQ ID NO: 460264 - RNA, 19 nt, Homo sapiens
ucaaaggcuuccaaugugg

SEQ ID NO: 460265 - RNA, 19 nt, Homo sapiens
ucaaaguuaaccuaccugu

SEQ ID NO: 460266 - RNA, 15 nt, Homo sapiens
ucaaauaaauuucug

SEQ ID NO: 460267 - RNA, 13 nt, Homo sapiens
ucaaauagcauaa

SEQ ID NO: 460268 - RNA, 17 nt, Homo sapiens
ucaaaugcuacucagua

SEQ ID NO: 460269 - RNA, 16 nt, Homo sapiens
ucaaauguauucagau

SEQ ID NO: 460270 - RNA, 21 nt, Homo sapiens
ucaacaauaaaaaaaaaccua

SEQ ID NO: 460271 - RNA, 15 nt, Homo sapiens
ucaacaaucacaacc

SEQ ID NO: 460272 - RNA, 12 nt, Homo sapiens
ucaacacuuaag

SEQ ID NO: 460273 - RNA, 22 nt, Homo sapiens
ucaacaucuuggucagauuuga

SEQ ID NO: 460274 - RNA, 20 nt, Homo sapiens
ucaacaucuuuuacauucug

SEQ ID NO: 460275 - RNA, 17 nt, Homo sapiens
ucaaccaggaacaugua

SEQ ID NO: 460276 - RNA, 12 nt, Homo sapiens
ucaaccccauga

SEQ ID NO: 460277 - RNA, 15 nt, Homo sapiens
ucaaccccaugagac

SEQ ID NO: 460278 - RNA, 14 nt, Homo sapiens
ucaacccgcugcuu

SEQ ID NO: 460279 - RNA, 18 nt, Homo sapiens
ucaacccuggcuugucua

SEQ ID NO: 460280 - RNA, 17 nt, Homo sapiens
ucaaccgaugguccuca

SEQ ID NO: 460281 - RNA, 17 nt, Homo sapiens
ucaaccugcacuucaua

SEQ ID NO: 460282 - RNA, 23 nt, Homo sapiens
ucaacuucaggaaagcagcaguu

SEQ ID NO: 460283 - RNA, 19 nt, Homo sapiens
ucaacuucuggcuccucaa

SEQ ID NO: 460284 - RNA, 20 nt, Homo sapiens
ucaacuuuggugaacaguuu

SEQ ID NO: 460285 - RNA, 23 nt, Homo sapiens
ucaacuuuugaaauuuaaaaauc

SEQ ID NO: 460286 - RNA, 16 nt, Homo sapiens
ucaagaaaacaacuuc

SEQ ID NO: 460287 - RNA, 14 nt, Homo sapiens
ucaagaaaauggau

SEQ ID NO: 460288 - RNA, 21 nt, Homo sapiens
ucaagaagucagagaaaacac

SEQ ID NO: 460289 - RNA, 13 nt, Homo sapiens
ucaagacacugag

SEQ ID NO: 460290 - RNA, 18 nt, Homo sapiens
ucaagacagccuaaugaa

SEQ ID NO: 460291 - RNA, 15 nt, Homo sapiens
ucaagauacacuugu

SEQ ID NO: 460292 - RNA, 14 nt, Homo sapiens
ucaagauucuacuu

SEQ ID NO: 460293 - RNA, 23 nt, Homo sapiens
ucaagauucuacuuggugguuug

SEQ ID NO: 460294 - RNA, 14 nt, Homo sapiens
ucaagccaggagac

SEQ ID NO: 460295 - RNA, 18 nt, Homo sapiens
ucaagcccuuuacuugac

SEQ ID NO: 460296 - RNA, 18 nt, Homo sapiens
ucaagcuuuccgagucaa

SEQ ID NO: 460297 - RNA, 15 nt, Homo sapiens
ucaaggcugcaguga

SEQ ID NO: 460298 - RNA, 18 nt, Homo sapiens
ucaaggcugcagugagcc

SEQ ID NO: 460299 - RNA, 20 nt, Homo sapiens
ucaagggauguauuggaaca

SEQ ID NO: 460300 - RNA, 13 nt, Homo sapiens
ucaaggugcucaa

SEQ ID NO: 460301 - RNA, 23 nt, Homo sapiens
ucaaggugggccuugcuaccuca

SEQ ID NO: 460302 - RNA, 21 nt, Homo sapiens
ucaaguaauccaccugccucg

SEQ ID NO: 460303 - RNA, 16 nt, Homo sapiens
ucaaguaauugugaaa

SEQ ID NO: 460304 - RNA, 23 nt, Homo sapiens
ucaaguagcguuggagacauaca

SEQ ID NO: 460305 - RNA, 22 nt, Homo sapiens
ucaagugauucuccugccucag

SEQ ID NO: 460306 - RNA, 13 nt, Homo sapiens
ucaagugccuuaa

SEQ ID NO: 460307 - RNA, 12 nt, Homo sapiens
ucaaguggcaug

SEQ ID NO: 460308 - RNA, 18 nt, Homo sapiens
ucaagugucuuccaucau

SEQ ID NO: 460309 - RNA, 14 nt, Homo sapiens
ucaaguuaauucuc

SEQ ID NO: 460310 - RNA, 16 nt, Homo sapiens
ucaauaaacugugucu

SEQ ID NO: 460311 - RNA, 18 nt, Homo sapiens
ucaauaacuauugcugcu

SEQ ID NO: 460312 - RNA, 19 nt, Homo sapiens
ucaauacccuuggcacuga

SEQ ID NO: 460313 - RNA, 22 nt, Homo sapiens
ucaauacuuuuguguauucugu

SEQ ID NO: 460314 - RNA, 20 nt, Homo sapiens
ucaaucaaccugcacuucau

SEQ ID NO: 460315 - RNA, 14 nt, Homo sapiens
ucaaugaccuguau

SEQ ID NO: 460316 - RNA, 23 nt, Homo sapiens
ucaaugaucuagguuuaacucag

SEQ ID NO: 460317 - RNA, 13 nt, Homo sapiens
ucaauggcaccuu

SEQ ID NO: 460318 - RNA, 20 nt, Homo sapiens
ucaaugguugggacaauggc

SEQ ID NO: 460319 - RNA, 12 nt, Homo sapiens
ucaaugugaaaa

SEQ ID NO: 460320 - RNA, 13 nt, Homo sapiens
ucaauuacaaagc

SEQ ID NO: 460321 - RNA, 20 nt, Homo sapiens
ucaauuccaccugcaaucaa

SEQ ID NO: 460322 - RNA, 19 nt, Homo sapiens
ucaauucugauacagccuu

SEQ ID NO: 460323 - RNA, 22 nt, Homo sapiens
ucaauuuaaaaucagacucuuu

SEQ ID NO: 460324 - RNA, 14 nt, Homo sapiens
ucaauuugaaauca

SEQ ID NO: 460325 - RNA, 20 nt, Homo sapiens
ucacaaaaaaaguaauugua

SEQ ID NO: 460326 - RNA, 23 nt, Homo sapiens
ucacaaaacacuucgagcacugu

SEQ ID NO: 460327 - RNA, 13 nt, Homo sapiens
ucacaaagaucau

SEQ ID NO: 460328 - RNA, 18 nt, Homo sapiens
ucacaaaguuaaacguga

SEQ ID NO: 460329 - RNA, 19 nt, Homo sapiens
ucacaaccucucugaucuu

SEQ ID NO: 460330 - RNA, 15 nt, Homo sapiens
ucacaacucucuggu

SEQ ID NO: 460331 - RNA, 23 nt, Homo sapiens
ucacaauccuguggaucugggca

SEQ ID NO: 460332 - RNA, 21 nt, Homo sapiens
ucacacacauggaaggugaug

SEQ ID NO: 460333 - RNA, 23 nt, Homo sapiens
ucacaccuuguggagaacaugca

SEQ ID NO: 460334 - RNA, 23 nt, Homo sapiens
ucacacugcugggaaguggcuua

SEQ ID NO: 460335 - RNA, 11 nt, Homo sapiens
ucacacuuugc

SEQ ID NO: 460336 - RNA, 19 nt, Homo sapiens
ucacagagacccaccuuca

SEQ ID NO: 460337 - RNA, 14 nt, Homo sapiens
ucacagaugggcaa

SEQ ID NO: 460338 - RNA, 20 nt, Homo sapiens
ucacaggacguugcuuuuuc

SEQ ID NO: 460339 - RNA, 19 nt, Homo sapiens
ucacaggcuauucuacuuu

SEQ ID NO: 460340 - RNA, 16 nt, Homo sapiens
ucacagugaacauaac

SEQ ID NO: 460341 - RNA, 16 nt, Homo sapiens
ucacaguguugcccag

SEQ ID NO: 460342 - RNA, 20 nt, Homo sapiens
ucacauagcugggauuugaa

SEQ ID NO: 460343 - RNA, 16 nt, Homo sapiens
ucacaucugcaucuua

SEQ ID NO: 460344 - RNA, 14 nt, Homo sapiens
ucacaucuguccag

SEQ ID NO: 460345 - RNA, 19 nt, Homo sapiens
ucacaugcuugaugguuua

SEQ ID NO: 460346 - RNA, 23 nt, Homo sapiens
ucacauuuuuuaaacaguuacau

SEQ ID NO: 460347 - RNA, 20 nt, Homo sapiens
ucaccaaaguauuaauguac

SEQ ID NO: 460348 - RNA, 22 nt, Homo sapiens
ucaccaaggacguuaaaggcau

SEQ ID NO: 460349 - RNA, 17 nt, Homo sapiens
ucaccaccccagugagg

SEQ ID NO: 460350 - RNA, 17 nt, Homo sapiens
ucaccaccucaugucau

SEQ ID NO: 460351 - RNA, 21 nt, Homo sapiens
ucaccagaauauuucuuucau

SEQ ID NO: 460352 - RNA, 19 nt, Homo sapiens
ucaccagaauuaguccuca

SEQ ID NO: 460353 - RNA, 18 nt, Homo sapiens
ucaccagaauugugcaaa

SEQ ID NO: 460354 - RNA, 14 nt, Homo sapiens
ucaccagagcauuu

SEQ ID NO: 460355 - RNA, 17 nt, Homo sapiens
ucaccagguccugugag

SEQ ID NO: 460356 - RNA, 19 nt, Homo sapiens
ucaccaguuaaaagcauuu

SEQ ID NO: 460357 - RNA, 23 nt, Homo sapiens
ucaccaucuuucuaaucuuuuuc

SEQ ID NO: 460358 - RNA, 21 nt, Homo sapiens
ucacccagcuaaucuguaggg

SEQ ID NO: 460359 - RNA, 21 nt, Homo sapiens
ucacccccaccccuguaccca

SEQ ID NO: 460360 - RNA, 14 nt, Homo sapiens
ucacccccauccac

SEQ ID NO: 460361 - RNA, 16 nt, Homo sapiens
ucaccccguuacagcu

SEQ ID NO: 460362 - RNA, 14 nt, Homo sapiens
ucaccccugcacuu

SEQ ID NO: 460363 - RNA, 16 nt, Homo sapiens
ucacccucuucaagcu

SEQ ID NO: 460364 - RNA, 13 nt, Homo sapiens
ucacccugccuua

SEQ ID NO: 460365 - RNA, 14 nt, Homo sapiens
ucacccuucugggc

SEQ ID NO: 460366 - RNA, 14 nt, Homo sapiens
ucaccgccaugcaa

SEQ ID NO: 460367 - RNA, 20 nt, Homo sapiens
ucaccgccaugcaacuccau

SEQ ID NO: 460368 - RNA, 17 nt, Homo sapiens
ucaccggccuugugaca

SEQ ID NO: 460369 - RNA, 18 nt, Homo sapiens
ucaccguggggcuggaag

SEQ ID NO: 460370 - RNA, 18 nt, Homo sapiens
ucaccuagcugcucucua

SEQ ID NO: 460371 - RNA, 22 nt, Homo sapiens
ucccguuguguggguuuacucu

SEQ ID NO: 460372 - RNA, 17 nt, Homo sapiens
ucccuaaaauacauuua

SEQ ID NO: 460373 - RNA, 13 nt, Homo sapiens
ucccuaaccacua

SEQ ID NO: 460374 - RNA, 19 nt, Homo sapiens
ucccuaacuuaacauugca

SEQ ID NO: 460375 - RNA, 23 nt, Homo sapiens
ucccuaagaauucccagauaguc

SEQ ID NO: 460376 - RNA, 12 nt, Homo sapiens
ucccuaccuccu

SEQ ID NO: 460377 - RNA, 21 nt, Homo sapiens
ucccuagauagcuauuaagau

SEQ ID NO: 460378 - RNA, 16 nt, Homo sapiens
ucccuauaaugcugga

SEQ ID NO: 460379 - RNA, 10 nt, Homo sapiens
ucccuaucua

SEQ ID NO: 460380 - RNA, 20 nt, Homo sapiens
ucccuauucuguggauacag

SEQ ID NO: 460381 - RNA, 18 nt, Homo sapiens
ucccucacuguugaauuu

SEQ ID NO: 460382 - RNA, 14 nt, Homo sapiens
ucccucagcucucu

SEQ ID NO: 460383 - RNA, 17 nt, Homo sapiens
ucccucagcucucuggg

SEQ ID NO: 460384 - RNA, 15 nt, Homo sapiens
ucccuccaccagugu

SEQ ID NO: 460385 - RNA, 23 nt, Homo sapiens
ucccuccagccaauaggcagcuu

SEQ ID NO: 460386 - RNA, 19 nt, Homo sapiens
ucccugaagucuugcauug

SEQ ID NO: 460387 - RNA, 20 nt, Homo sapiens
ucccugaagucuugcauuga

SEQ ID NO: 460388 - RNA, 12 nt, Homo sapiens
ucccugccaacu

SEQ ID NO: 460389 - RNA, 20 nt, Homo sapiens
ucccugccaagaacucuggg

SEQ ID NO: 460390 - RNA, 19 nt, Homo sapiens
ucccugcuuugaggacaaa

SEQ ID NO: 460391 - RNA, 22 nt, Homo sapiens
ucccuggaguguagaccugugu

SEQ ID NO: 460392 - RNA, 21 nt, Homo sapiens
ucccuggcucccaugaccaua

SEQ ID NO: 460393 - RNA, 11 nt, Homo sapiens
ucccugggaag

SEQ ID NO: 460394 - RNA, 14 nt, Homo sapiens
ucccugggguacua

SEQ ID NO: 460395 - RNA, 19 nt, Homo sapiens
ucccugguggggugugcau

SEQ ID NO: 460396 - RNA, 21 nt, Homo sapiens
ucccuguguggaccaugggga

SEQ ID NO: 460397 - RNA, 16 nt, Homo sapiens
ucccuguucuuugaag

SEQ ID NO: 460398 - RNA, 22 nt, Homo sapiens
ucccuuaggaauauacauaguc

SEQ ID NO: 460399 - RNA, 13 nt, Homo sapiens
ucccuucaaugcu

SEQ ID NO: 460400 - RNA, 17 nt, Homo sapiens
ucccuuccaccucacaa

SEQ ID NO: 460401 - RNA, 22 nt, Homo sapiens
ucccuuccacugccucugccuu

SEQ ID NO: 460402 - RNA, 15 nt, Homo sapiens
ucccuucccuuccac

SEQ ID NO: 460403 - RNA, 19 nt, Homo sapiens
ucccuucuaggcaucuccu

SEQ ID NO: 460404 - RNA, 15 nt, Homo sapiens
ucccuucucagaaaa

SEQ ID NO: 460405 - RNA, 19 nt, Homo sapiens
ucccuucucuuaauuuaau

SEQ ID NO: 460406 - RNA, 18 nt, Homo sapiens
ucccuucuggacacugag

SEQ ID NO: 460407 - RNA, 15 nt, Homo sapiens
ucccuugaccuuucc

SEQ ID NO: 460408 - RNA, 19 nt, Homo sapiens
ucccuugccucaaugccag

SEQ ID NO: 460409 - RNA, 17 nt, Homo sapiens
ucccuugcucagugccu

SEQ ID NO: 460410 - RNA, 16 nt, Homo sapiens
ucccuuggccucagaa

SEQ ID NO: 460411 - RNA, 22 nt, Homo sapiens
ucccuuucugugugaagaucac

SEQ ID NO: 460412 - RNA, 16 nt, Homo sapiens
ucccuuucuuggccag

SEQ ID NO: 460413 - RNA, 17 nt, Homo sapiens
ucccuuuuuauauccca

SEQ ID NO: 460414 - RNA, 13 nt, Homo sapiens
ucccuuuuucaca

SEQ ID NO: 460415 - RNA, 13 nt, Homo sapiens
uccgaaacauaca

SEQ ID NO: 460416 - RNA, 14 nt, Homo sapiens
uccgaggccaaagu

SEQ ID NO: 460417 - RNA, 20 nt, Homo sapiens
uccgcacagucgaagccaca

SEQ ID NO: 460418 - RNA, 15 nt, Homo sapiens
uccgccagaccucaa

SEQ ID NO: 460419 - RNA, 13 nt, Homo sapiens
uccgcccgcccac

SEQ ID NO: 460420 - RNA, 17 nt, Homo sapiens
uccgcgcaggugccaac

SEQ ID NO: 460421 - RNA, 20 nt, Homo sapiens
uccgcgccuugccuccucac

SEQ ID NO: 460422 - RNA, 21 nt, Homo sapiens
uccgcuuucucuugcugccac

SEQ ID NO: 460423 - RNA, 18 nt, Homo sapiens
uccggucccggcugacac

SEQ ID NO: 460424 - RNA, 13 nt, Homo sapiens
uccgugcguccuc

SEQ ID NO: 460425 - RNA, 14 nt, Homo sapiens
uccgugugucucau

SEQ ID NO: 460426 - RNA, 19 nt, Homo sapiens
uccguuaugccaccuggag

SEQ ID NO: 460427 - RNA, 14 nt, Homo sapiens
uccuaaauaucuca

SEQ ID NO: 460428 - RNA, 22 nt, Homo sapiens
uccuaacaggauuagacaguca

SEQ ID NO: 460429 - RNA, 13 nt, Homo sapiens
uccuaagcacuuu

SEQ ID NO: 460430 - RNA, 21 nt, Homo sapiens
uccuaaguuuaauuacaacag

SEQ ID NO: 460431 - RNA, 16 nt, Homo sapiens
uccuacagggccacaa

SEQ ID NO: 460432 - RNA, 15 nt, Homo sapiens
uccuaccacuuugaa

SEQ ID NO: 460433 - RNA, 14 nt, Homo sapiens
uccuacucugggaa

SEQ ID NO: 460434 - RNA, 15 nt, Homo sapiens
uccuacuuuacauau

SEQ ID NO: 460435 - RNA, 20 nt, Homo sapiens
uccuagacuugaaaguuuuc

SEQ ID NO: 460436 - RNA, 14 nt, Homo sapiens
uccuaguagcuuuc

SEQ ID NO: 460437 - RNA, 18 nt, Homo sapiens
uccuaguagcuuuccucc

SEQ ID NO: 460438 - RNA, 15 nt, Homo sapiens
uccuaugcaguguca

SEQ ID NO: 460439 - RNA, 12 nt, Homo sapiens
uccuaugcugca

SEQ ID NO: 460440 - RNA, 12 nt, Homo sapiens
uccucacccacc

SEQ ID NO: 460441 - RNA, 20 nt, Homo sapiens
uccucaccucuggacuggcu

SEQ ID NO: 460442 - RNA, 21 nt, Homo sapiens
uccucauauggcccaguguca

SEQ ID NO: 460443 - RNA, 14 nt, Homo sapiens
uccucauccaugca

SEQ ID NO: 460444 - RNA, 19 nt, Homo sapiens
uccucauccaugcagauaa

SEQ ID NO: 460445 - RNA, 13 nt, Homo sapiens
uccucauucuucu

SEQ ID NO: 460446 - RNA, 14 nt, Homo sapiens
uccuccagcaauag

SEQ ID NO: 460447 - RNA, 19 nt, Homo sapiens
uccuccagucuguucucac

SEQ ID NO: 460448 - RNA, 13 nt, Homo sapiens
uccucccagacuu

SEQ ID NO: 460449 - RNA, 21 nt, Homo sapiens
uccucccaucuccuuccccca

SEQ ID NO: 460450 - RNA, 17 nt, Homo sapiens
uccucccccagcuaucu

SEQ ID NO: 460451 - RNA, 22 nt, Homo sapiens
uccuccucucuggacuuucucc

SEQ ID NO: 460452 - RNA, 15 nt, Homo sapiens
uccuccuuccaugga

SEQ ID NO: 460453 - RNA, 16 nt, Homo sapiens
uccucgcugugccacc

SEQ ID NO: 460454 - RNA, 15 nt, Homo sapiens
uccucuaacucauuc

SEQ ID NO: 460455 - RNA, 13 nt, Homo sapiens
uccucuccacugc

SEQ ID NO: 460456 - RNA, 14 nt, Homo sapiens
uccucuccuacuuu

SEQ ID NO: 460457 - RNA, 16 nt, Homo sapiens
uccucuccugcccagc

SEQ ID NO: 460458 - RNA, 21 nt, Homo sapiens
uccucugagcuguuaucuugu

SEQ ID NO: 460459 - RNA, 15 nt, Homo sapiens
uccucugauucuguu

SEQ ID NO: 460460 - RNA, 15 nt, Homo sapiens
uccucugcagccuga

SEQ ID NO: 460461 - RNA, 13 nt, Homo sapiens
uccucugugcucc

SEQ ID NO: 460462 - RNA, 16 nt, Homo sapiens
uccucuuaagacacua

SEQ ID NO: 460463 - RNA, 12 nt, Homo sapiens
uccucuucccug

SEQ ID NO: 460464 - RNA, 14 nt, Homo sapiens
uccucuugccacug

SEQ ID NO: 460465 - RNA, 11 nt, Homo sapiens
uccucuuucac

SEQ ID NO: 460466 - RNA, 18 nt, Homo sapiens
uccucuuucacuucuuau

SEQ ID NO: 460467 - RNA, 15 nt, Homo sapiens
uccucuuugcaugga

SEQ ID NO: 460468 - RNA, 14 nt, Homo sapiens
uccugaagccucug

SEQ ID NO: 460469 - RNA, 13 nt, Homo sapiens
uccugaccucagg

SEQ ID NO: 460470 - RNA, 19 nt, Homo sapiens
uccugacuuagcccgucac

SEQ ID NO: 460471 - RNA, 19 nt, Homo sapiens
uccugaggggcaucugccc

SEQ ID NO: 460472 - RNA, 17 nt, Homo sapiens
uccugauaaacauuaaa

SEQ ID NO: 460473 - RNA, 14 nt, Homo sapiens
uccugauacugggu

SEQ ID NO: 460474 - RNA, 16 nt, Homo sapiens
uccugaugacuccucc

SEQ ID NO: 460475 - RNA, 18 nt, Homo sapiens
uccugaugcuuuugucua

SEQ ID NO: 460476 - RNA, 22 nt, Homo sapiens
uccugcaaacccauuuccagcu

SEQ ID NO: 460477 - RNA, 17 nt, Homo sapiens
uccugcaaguccauagc

SEQ ID NO: 460478 - RNA, 23 nt, Homo sapiens
uccugcaccgagagagauggaau

SEQ ID NO: 460479 - RNA, 17 nt, Homo sapiens
uccugcagaggcccagc

SEQ ID NO: 460480 - RNA, 13 nt, Homo sapiens
uccugcaucccuc

SEQ ID NO: 460481 - RNA, 19 nt, Homo sapiens
uccugccucagccuuccaa

SEQ ID NO: 460482 - RNA, 17 nt, Homo sapiens
uccugcugccauccuca

SEQ ID NO: 460483 - RNA, 23 nt, Homo sapiens
uccugcugcucgggaaggccuga

SEQ ID NO: 460484 - RNA, 21 nt, Homo sapiens
uccugcugcuguaacugcuga

SEQ ID NO: 460485 - RNA, 17 nt, Homo sapiens
uccugcugcuucugcaa

SEQ ID NO: 460486 - RNA, 12 nt, Homo sapiens
uccuggaaccaa

SEQ ID NO: 460487 - RNA, 17 nt, Homo sapiens
uccuggaauaaaccaca

SEQ ID NO: 460488 - RNA, 18 nt, Homo sapiens
uccuggaauggagcugua

SEQ ID NO: 460489 - RNA, 15 nt, Homo sapiens
uccuggacuguagga

SEQ ID NO: 460490 - RNA, 14 nt, Homo sapiens
uccuggagaaggca

SEQ ID NO: 460491 - RNA, 20 nt, Homo sapiens
uccuggagaaggcauuccag

SEQ ID NO: 460492 - RNA, 21 nt, Homo sapiens
uccuggagcagcagcugaggc

SEQ ID NO: 460493 - RNA, 18 nt, Homo sapiens
uccuggcaugacacucua

SEQ ID NO: 460494 - RNA, 22 nt, Homo sapiens
uccuggggcuggguguguuuca

SEQ ID NO: 460495 - RNA, 17 nt, Homo sapiens
uccugguuccuuccuau

SEQ ID NO: 460496 - RNA, 14 nt, Homo sapiens
uccuguaaucacaa

SEQ ID NO: 460497 - RNA, 16 nt, Homo sapiens
uccuguagucccauug

SEQ ID NO: 460498 - RNA, 15 nt, Homo sapiens
uccugucaccaagga

SEQ ID NO: 460499 - RNA, 19 nt, Homo sapiens
uccugucuccucugucagu

SEQ ID NO: 460500 - RNA, 21 nt, Homo sapiens
uccugugcuuuccucucuuca

SEQ ID NO: 460501 - RNA, 18 nt, Homo sapiens
uccuguguguggaaggca

SEQ ID NO: 460502 - RNA, 13 nt, Homo sapiens
ucuuggcugagga

SEQ ID NO: 460503 - RNA, 19 nt, Homo sapiens
ucuugggucccccacguga

SEQ ID NO: 460504 - RNA, 17 nt, Homo sapiens
ucuuguaaaacugugac

SEQ ID NO: 460505 - RNA, 22 nt, Homo sapiens
ucuuguaacuggguucaaaaag

SEQ ID NO: 460506 - RNA, 21 nt, Homo sapiens
ucuuguauaaugaacauguua

SEQ ID NO: 460507 - RNA, 14 nt, Homo sapiens
ucuuguggugcauu

SEQ ID NO: 460508 - RNA, 17 nt, Homo sapiens
ucuuguugcugcaucuc

SEQ ID NO: 460509 - RNA, 22 nt, Homo sapiens
ucuuguuucaauuccaccugca

SEQ ID NO: 460510 - RNA, 18 nt, Homo sapiens
ucuuuaaaggcaucuaca

SEQ ID NO: 460511 - RNA, 13 nt, Homo sapiens
ucuuuauacuuaa

SEQ ID NO: 460512 - RNA, 21 nt, Homo sapiens
ucuuuauacuuaaacagcuuu

SEQ ID NO: 460513 - RNA, 16 nt, Homo sapiens
ucuuuauucuuccuug

SEQ ID NO: 460514 - RNA, 22 nt, Homo sapiens
ucuuucagccaagaauucuuaa

SEQ ID NO: 460515 - RNA, 14 nt, Homo sapiens
ucuuuccacuuugu

SEQ ID NO: 460516 - RNA, 21 nt, Homo sapiens
ucuuucccuaaagaacauacc

SEQ ID NO: 460517 - RNA, 22 nt, Homo sapiens
ucuuucggggugcuccuguggg

SEQ ID NO: 460518 - RNA, 20 nt, Homo sapiens
ucuuucguugguuguuucuc

SEQ ID NO: 460519 - RNA, 20 nt, Homo sapiens
ucuuucuaaucuuuuuccag

SEQ ID NO: 460520 - RNA, 12 nt, Homo sapiens
ucuuucucucag

SEQ ID NO: 460521 - RNA, 20 nt, Homo sapiens
ucuuucucugccagugacag

SEQ ID NO: 460522 - RNA, 15 nt, Homo sapiens
ucuuucugcaugacu

SEQ ID NO: 460523 - RNA, 17 nt, Homo sapiens
ucuuucuuuaccugaga

SEQ ID NO: 460524 - RNA, 14 nt, Homo sapiens
ucuuugaaagggcu

SEQ ID NO: 460525 - RNA, 19 nt, Homo sapiens
ucuuugacaauuccuagau

SEQ ID NO: 460526 - RNA, 19 nt, Homo sapiens
ucuuugauuuaacugacuu

SEQ ID NO: 460527 - RNA, 15 nt, Homo sapiens
ucuuugcaacaauaa

SEQ ID NO: 460528 - RNA, 12 nt, Homo sapiens
ucuuugcucagu

SEQ ID NO: 460529 - RNA, 15 nt, Homo sapiens
ucuuugcugugccaa

SEQ ID NO: 460530 - RNA, 14 nt, Homo sapiens
ucuuuggugccagc

SEQ ID NO: 460531 - RNA, 12 nt, Homo sapiens
ucuuuucaaaag

SEQ ID NO: 460532 - RNA, 18 nt, Homo sapiens
ucuuuucugaucugcagu

SEQ ID NO: 460533 - RNA, 12 nt, Homo sapiens
ucuuuucuugga

SEQ ID NO: 460534 - RNA, 21 nt, Homo sapiens
ucuuuugaaagaacaucaguu

SEQ ID NO: 460535 - RNA, 19 nt, Homo sapiens
ucuuuuggggaagcuuucu

SEQ ID NO: 460536 - RNA, 14 nt, Homo sapiens
ucuuuuguucuaaa

SEQ ID NO: 460537 - RNA, 12 nt, Homo sapiens
ucuuuuuacaau

SEQ ID NO: 460538 - RNA, 18 nt, Homo sapiens
ucuuuuucccccaaccuc

SEQ ID NO: 460539 - RNA, 13 nt, Homo sapiens
ucuuuuugcuuca

SEQ ID NO: 460540 - RNA, 21 nt, Homo sapiens
ugaaaaaaaaauuauuugccu

SEQ ID NO: 460541 - RNA, 17 nt, Homo sapiens
ugaaaaaauaacacugu

SEQ ID NO: 460542 - RNA, 16 nt, Homo sapiens
ugaaaaagaacuguau

SEQ ID NO: 460543 - RNA, 16 nt, Homo sapiens
ugaaaaauaugugcuu

SEQ ID NO: 460544 - RNA, 17 nt, Homo sapiens
ugaaaaauggcaaagaa

SEQ ID NO: 460545 - RNA, 19 nt, Homo sapiens
ugaaaaauggcaaagaauu

SEQ ID NO: 460546 - RNA, 14 nt, Homo sapiens
ugaaaacaacauug

SEQ ID NO: 460547 - RNA, 21 nt, Homo sapiens
ugaaaacagcagcaaugcaau

SEQ ID NO: 460548 - RNA, 14 nt, Homo sapiens
ugaaaaccaucugg

SEQ ID NO: 460549 - RNA, 19 nt, Homo sapiens
ugaaaacccucugaacuca

SEQ ID NO: 460550 - RNA, 16 nt, Homo sapiens
ugaaaaccucuuucca

SEQ ID NO: 460551 - RNA, 15 nt, Homo sapiens
ugaaaaggguguugc

SEQ ID NO: 460552 - RNA, 17 nt, Homo sapiens
ugaaaagguugccugaa

SEQ ID NO: 460553 - RNA, 13 nt, Homo sapiens
ugaaaagugcuuu

SEQ ID NO: 460554 - RNA, 20 nt, Homo sapiens
ugaaaauauuuuguugccuu

SEQ ID NO: 460555 - RNA, 14 nt, Homo sapiens
ugaaaaucacuaua

SEQ ID NO: 460556 - RNA, 19 nt, Homo sapiens
ugaaaauguuuuucugcca

SEQ ID NO: 460557 - RNA, 17 nt, Homo sapiens
ugaaacacucgugugca

SEQ ID NO: 460558 - RNA, 18 nt, Homo sapiens
ugaaacagccauguccaa

SEQ ID NO: 460559 - RNA, 20 nt, Homo sapiens
ugaaacaggagagaaagggg

SEQ ID NO: 460560 - RNA, 11 nt, Homo sapiens
ugaaacauuug

SEQ ID NO: 460561 - RNA, 16 nt, Homo sapiens
ugaaacauuugccaaa

SEQ ID NO: 460562 - RNA, 15 nt, Homo sapiens
ugaaaccaugacugu

SEQ ID NO: 460563 - RNA, 15 nt, Homo sapiens
ugaaaccccgucucu

SEQ ID NO: 460564 - RNA, 14 nt, Homo sapiens
ugaaacuaacagau

SEQ ID NO: 460565 - RNA, 14 nt, Homo sapiens
ugaaacugacuugc

SEQ ID NO: 460566 - RNA, 13 nt, Homo sapiens
ugaaacugcauaa

SEQ ID NO: 460567 - RNA, 17 nt, Homo sapiens
ugaaacuugugcuauag

SEQ ID NO: 460568 - RNA, 22 nt, Homo sapiens
ugaaagaagagaugagaaauga

SEQ ID NO: 460569 - RNA, 14 nt, Homo sapiens
ugaaagaagucaaa

SEQ ID NO: 460570 - RNA, 20 nt, Homo sapiens
ugaaagcugauuacugucaa

SEQ ID NO: 460571 - RNA, 21 nt, Homo sapiens
ugaaagggaaagucagcuuuc

SEQ ID NO: 460572 - RNA, 14 nt, Homo sapiens
ugaaagguaaucug

SEQ ID NO: 460573 - RNA, 23 nt, Homo sapiens
ugaaaguaugugauaucugaaca

SEQ ID NO: 460574 - RNA, 16 nt, Homo sapiens
ugaaauaacauggccu

SEQ ID NO: 460575 - RNA, 22 nt, Homo sapiens
ugaaauaugauaauaaaggcau

SEQ ID NO: 460576 - RNA, 12 nt, Homo sapiens
ugaaauaugcau

SEQ ID NO: 460577 - RNA, 15 nt, Homo sapiens
ugaaauauuugcuua

SEQ ID NO: 460578 - RNA, 15 nt, Homo sapiens
ugaaaugaaaacaug

SEQ ID NO: 460579 - RNA, 14 nt, Homo sapiens
ugaaaugaugguaa

SEQ ID NO: 460580 - RNA, 15 nt, Homo sapiens
ugaaaugcuggcauu

SEQ ID NO: 460581 - RNA, 19 nt, Homo sapiens
ugaaaugcuggcauuugca

SEQ ID NO: 460582 - RNA, 15 nt, Homo sapiens
ugaaauuaugucaaa

SEQ ID NO: 460583 - RNA, 13 nt, Homo sapiens
ugaaauucacaaa

SEQ ID NO: 460584 - RNA, 19 nt, Homo sapiens
ugaaauuuguuauacuuca

SEQ ID NO: 460585 - RNA, 18 nt, Homo sapiens
ugaacaaucaaagcacuu

SEQ ID NO: 460586 - RNA, 17 nt, Homo sapiens
ugaacacaggcaaagag

SEQ ID NO: 460587 - RNA, 19 nt, Homo sapiens
ugaacacucuacuacaugu

SEQ ID NO: 460588 - RNA, 23 nt, Homo sapiens
ugaacacucuacuacaugugacu

SEQ ID NO: 460589 - RNA, 13 nt, Homo sapiens
ugaacacucuugg

SEQ ID NO: 460590 - RNA, 11 nt, Homo sapiens
ugaacagaauu

SEQ ID NO: 460591 - RNA, 17 nt, Homo sapiens
ugaacaggacaccuguu

SEQ ID NO: 460592 - RNA, 21 nt, Homo sapiens
ugaacuaaguuuuuuacuucc

SEQ ID NO: 460593 - RNA, 19 nt, Homo sapiens
ugaacuagauugcaugcuu

SEQ ID NO: 460594 - RNA, 22 nt, Homo sapiens
ugaacuagauugcaugcuuccu

SEQ ID NO: 460595 - RNA, 18 nt, Homo sapiens
ugaacuagggaagcucag

SEQ ID NO: 460596 - RNA, 17 nt, Homo sapiens
ugaacugaaguuucaca

SEQ ID NO: 460597 - RNA, 13 nt, Homo sapiens
ugaacugccaaag

SEQ ID NO: 460598 - RNA, 19 nt, Homo sapiens
ugaacuuuuuaacaaaugu

SEQ ID NO: 460599 - RNA, 22 nt, Homo sapiens
ugaagaacacagcaugugccaa

SEQ ID NO: 460600 - RNA, 21 nt, Homo sapiens
ugaagaacaggcuuggcaaag

SEQ ID NO: 460601 - RNA, 17 nt, Homo sapiens
ugaagaaugcauucaaa

SEQ ID NO: 460602 - RNA, 16 nt, Homo sapiens
ugaagaauuaaugaca

SEQ ID NO: 460603 - RNA, 19 nt, Homo sapiens
ugaagacagagcagaucag

SEQ ID NO: 460604 - RNA, 14 nt, Homo sapiens
ugaagaggggccag

SEQ ID NO: 460605 - RNA, 15 nt, Homo sapiens
ugaagaugcucugug

SEQ ID NO: 460606 - RNA, 21 nt, Homo sapiens
ugaagaugcugaaacaggaga

SEQ ID NO: 460607 - RNA, 11 nt, Homo sapiens
ugaagaugucc

SEQ ID NO: 460608 - RNA, 20 nt, Homo sapiens
ugaagauucuccugugcuag

SEQ ID NO: 460609 - RNA, 22 nt, Homo sapiens
ugaagccuccaacccuaagcca

SEQ ID NO: 460610 - RNA, 15 nt, Homo sapiens
ugaaggaacauuccu

SEQ ID NO: 460611 - RNA, 19 nt, Homo sapiens
ugaaggaccuaaauucgua

SEQ ID NO: 460612 - RNA, 14 nt, Homo sapiens
ugaaggcaugccua

SEQ ID NO: 460613 - RNA, 13 nt, Homo sapiens
ugaaguaaccuua

SEQ ID NO: 460614 - RNA, 23 nt, Homo sapiens
ugaaguaaugaauuuuuaugaua

SEQ ID NO: 460615 - RNA, 16 nt, Homo sapiens
ugaaguaggugugacu

SEQ ID NO: 460616 - RNA, 20 nt, Homo sapiens
ugaaguaggugugacuugaa

SEQ ID NO: 460617 - RNA, 15 nt, Homo sapiens
ugaaguauugcuaau

SEQ ID NO: 460618 - RNA, 17 nt, Homo sapiens
ugaagucccucuauguc

SEQ ID NO: 460619 - RNA, 15 nt, Homo sapiens
ugaaguuuacaauca

SEQ ID NO: 460620 - RNA, 15 nt, Homo sapiens
ugaaguuucacauga

SEQ ID NO: 460621 - RNA, 15 nt, Homo sapiens
ugaauaaaaacccug

SEQ ID NO: 460622 - RNA, 17 nt, Homo sapiens
ugaauaaaaacccugua

SEQ ID NO: 460623 - RNA, 15 nt, Homo sapiens
ugaauaaagccacau

SEQ ID NO: 460624 - RNA, 13 nt, Homo sapiens
ugaauaaccacuu

SEQ ID NO: 460625 - RNA, 18 nt, Homo sapiens
ugaauaaugcuguuuuau

SEQ ID NO: 460626 - RNA, 21 nt, Homo sapiens
ugaauagaaacagauggaauu

SEQ ID NO: 460627 - RNA, 21 nt, Homo sapiens
ugaauauggaacauaugcaca

SEQ ID NO: 460628 - RNA, 22 nt, Homo sapiens
ugaaucacugcaccucuuuguc

SEQ ID NO: 460629 - RNA, 16 nt, Homo sapiens
ugaaucaugaaguaaa

SEQ ID NO: 460630 - RNA, 17 nt, Homo sapiens
ugaauccucaugaggcu

SEQ ID NO: 460631 - RNA, 18 nt, Homo sapiens
ugaaucgagugagacaaa

SEQ ID NO: 460632 - RNA, 13 nt, Homo sapiens
ugaaucucucaaa

SEQ ID NO: 460633 - RNA, 22 nt, Homo sapiens
uucaccaguuuccaaguuuauu

SEQ ID NO: 460634 - RNA, 13 nt, Homo sapiens
uucaccaucaugu

SEQ ID NO: 460635 - RNA, 19 nt, Homo sapiens
uucacccaaaacaaaguaa

SEQ ID NO: 460636 - RNA, 14 nt, Homo sapiens
uucaccucuaucca

SEQ ID NO: 460637 - RNA, 20 nt, Homo sapiens
uucaccuguaaaacuuuauu

SEQ ID NO: 460638 - RNA, 16 nt, Homo sapiens
uucaccuguguacuga

SEQ ID NO: 460639 - RNA, 20 nt, Homo sapiens
uucacugaauucacugagau

SEQ ID NO: 460640 - RNA, 14 nt, Homo sapiens
uucacugauuggaa

SEQ ID NO: 460641 - RNA, 14 nt, Homo sapiens
uucacuguugaaaa

SEQ ID NO: 460642 - RNA, 15 nt, Homo sapiens
uucagaaaagacacu

SEQ ID NO: 460643 - RNA, 14 nt, Homo sapiens
uucagaaagggcag

SEQ ID NO: 460644 - RNA, 20 nt, Homo sapiens
uucagaacugcuaccaugaa

SEQ ID NO: 460645 - RNA, 22 nt, Homo sapiens
uucagaagccccauuugcacag

SEQ ID NO: 460646 - RNA, 16 nt, Homo sapiens
uucagaauaaaugggu

SEQ ID NO: 460647 - RNA, 14 nt, Homo sapiens
uucagacacuuugg

SEQ ID NO: 460648 - RNA, 23 nt, Homo sapiens
uucagagacuggcagccagggag

SEQ ID NO: 460649 - RNA, 15 nt, Homo sapiens
uucagagagcuggua

SEQ ID NO: 460650 - RNA, 13 nt, Homo sapiens
uucagagauguac

SEQ ID NO: 460651 - RNA, 17 nt, Homo sapiens
uucagaucauauuucac

SEQ ID NO: 460652 - RNA, 16 nt, Homo sapiens
uucagauuauuuccag

SEQ ID NO: 460653 - RNA, 20 nt, Homo sapiens
uucagcacccugggugccau

SEQ ID NO: 460654 - RNA, 23 nt, Homo sapiens
uucagcccacugcccaaugccug

SEQ ID NO: 460655 - RNA, 19 nt, Homo sapiens
uucagcuccuuccaccaca

SEQ ID NO: 460656 - RNA, 13 nt, Homo sapiens
uucagcucuacag

SEQ ID NO: 460657 - RNA, 20 nt, Homo sapiens
uucaggacuuaacggcucca

SEQ ID NO: 460658 - RNA, 17 nt, Homo sapiens
uucaggagaugauguga

SEQ ID NO: 460659 - RNA, 14 nt, Homo sapiens
uucaggauacaugu

SEQ ID NO: 460660 - RNA, 23 nt, Homo sapiens
uucaggccauucuccugccucag

SEQ ID NO: 460661 - RNA, 16 nt, Homo sapiens
uucagggcacugcugc

SEQ ID NO: 460662 - RNA, 21 nt, Homo sapiens
uucagggcugggcagguccug

SEQ ID NO: 460663 - RNA, 19 nt, Homo sapiens
uucagugagccccucccca

SEQ ID NO: 460664 - RNA, 19 nt, Homo sapiens
uucagugccaaaaacaaca

SEQ ID NO: 460665 - RNA, 23 nt, Homo sapiens
uucaguuccucuuugcauggaau

SEQ ID NO: 460666 - RNA, 23 nt, Homo sapiens
uucaguuuuuguuuuuacuuuug

SEQ ID NO: 460667 - RNA, 16 nt, Homo sapiens
uucauaaaaaucccuc

SEQ ID NO: 460668 - RNA, 20 nt, Homo sapiens
uucauauucucagaugggcu

SEQ ID NO: 460669 - RNA, 14 nt, Homo sapiens
uucaucaagcugua

SEQ ID NO: 460670 - RNA, 18 nt, Homo sapiens
uucaucaccgaaguguga

SEQ ID NO: 460671 - RNA, 20 nt, Homo sapiens
uucauccaggcucccaaaag

SEQ ID NO: 460672 - RNA, 15 nt, Homo sapiens
uucaucccacuccaa

SEQ ID NO: 460673 - RNA, 13 nt, Homo sapiens
uucaugagcacuu

SEQ ID NO: 460674 - RNA, 19 nt, Homo sapiens
uucaugccugggccugcag

SEQ ID NO: 460675 - RNA, 13 nt, Homo sapiens
uucaugcugcuua

SEQ ID NO: 460676 - RNA, 11 nt, Homo sapiens
uucaugucucu

SEQ ID NO: 460677 - RNA, 18 nt, Homo sapiens
uucauuaauacagggcau

SEQ ID NO: 460678 - RNA, 15 nt, Homo sapiens
uucauuacagcuuaa

SEQ ID NO: 460679 - RNA, 19 nt, Homo sapiens
uucauuaguugaaagggau

SEQ ID NO: 460680 - RNA, 23 nt, Homo sapiens
uucauuccuaacacagcaugugu

SEQ ID NO: 460681 - RNA, 13 nt, Homo sapiens
uucauugaugacc

SEQ ID NO: 460682 - RNA, 15 nt, Homo sapiens
uucauuguucuuggc

SEQ ID NO: 460683 - RNA, 22 nt, Homo sapiens
uucauuuaggugaggaagcaaa

SEQ ID NO: 460684 - RNA, 23 nt, Homo sapiens
uucauuuaggugaggaagcaaaa

SEQ ID NO: 460685 - RNA, 22 nt, Homo sapiens
uucauuuccucugagcuguuau

SEQ ID NO: 460686 - RNA, 15 nt, Homo sapiens
uucauuuucacauuu

SEQ ID NO: 460687 - RNA, 17 nt, Homo sapiens
uucauuuugagaucaag

SEQ ID NO: 460688 - RNA, 12 nt, Homo sapiens
uucauuuugcca

SEQ ID NO: 460689 - RNA, 22 nt, Homo sapiens
uuccaaagagaaggccugguca

SEQ ID NO: 460690 - RNA, 15 nt, Homo sapiens
uuccaaaugagccac

SEQ ID NO: 460691 - RNA, 21 nt, Homo sapiens
uuccaacaccacagacacaca

SEQ ID NO: 460692 - RNA, 23 nt, Homo sapiens
uuccaacaccacagacacacaca

SEQ ID NO: 460693 - RNA, 19 nt, Homo sapiens
uuccaagugugugugcaau

SEQ ID NO: 460694 - RNA, 15 nt, Homo sapiens
uuccaaugaugcuua

SEQ ID NO: 460695 - RNA, 22 nt, Homo sapiens
uuccaaugugacuaaugaccac

SEQ ID NO: 460696 - RNA, 22 nt, Homo sapiens
uuccaaugugguggcaauaaau

SEQ ID NO: 460697 - RNA, 20 nt, Homo sapiens
uuccaauuuacauacucugc

SEQ ID NO: 460698 - RNA, 20 nt, Homo sapiens
uuccaauuuuguugcaucau

SEQ ID NO: 460699 - RNA, 17 nt, Homo sapiens
uuccacaaguuaaauaa

SEQ ID NO: 460700 - RNA, 21 nt, Homo sapiens
uuccacagaauacaagccacu

SEQ ID NO: 460701 - RNA, 18 nt, Homo sapiens
uuccacuuugaguaccaa

SEQ ID NO: 460702 - RNA, 14 nt, Homo sapiens
uuccagaaaggaua

SEQ ID NO: 460703 - RNA, 10 nt, Homo sapiens
uuccagacag

SEQ ID NO: 460704 - RNA, 13 nt, Homo sapiens
uuccagauauuca

SEQ ID NO: 460705 - RNA, 18 nt, Homo sapiens
uuccagauccuucaaaga

SEQ ID NO: 460706 - RNA, 22 nt, Homo sapiens
uuccagccguguuguagcuaau

SEQ ID NO: 460707 - RNA, 20 nt, Homo sapiens
uuccagcuaagccugaugau

SEQ ID NO: 460708 - RNA, 19 nt, Homo sapiens
uuccagcugacaucuugca

SEQ ID NO: 460709 - RNA, 19 nt, Homo sapiens
uuccaggcgaugugcaagu

SEQ ID NO: 460710 - RNA, 21 nt, Homo sapiens
uuccaggggucaccuugagag

SEQ ID NO: 460711 - RNA, 21 nt, Homo sapiens
uuccagguagcugaaagggga

SEQ ID NO: 460712 - RNA, 21 nt, Homo sapiens
uuccagguuccauccaccacc

SEQ ID NO: 460713 - RNA, 16 nt, Homo sapiens
uuccaguuccacgaaa

SEQ ID NO: 460714 - RNA, 23 nt, Homo sapiens
uuccauaugugggugucagucag

SEQ ID NO: 460715 - RNA, 17 nt, Homo sapiens
uuccauauguuauauca

SEQ ID NO: 460716 - RNA, 22 nt, Homo sapiens
uuccaucauuucugucuuuaag

SEQ ID NO: 460717 - RNA, 16 nt, Homo sapiens
uuccaucucauuacag

SEQ ID NO: 460718 - RNA, 12 nt, Homo sapiens
uuccaugguggu

SEQ ID NO: 460719 - RNA, 23 nt, Homo sapiens
uuccaugucgccucugcauucag

SEQ ID NO: 460720 - RNA, 23 nt, Homo sapiens
uuccaugucugaaguuugcccca

SEQ ID NO: 460721 - RNA, 15 nt, Homo sapiens
uuccauuugcaacag

SEQ ID NO: 460722 - RNA, 12 nt, Homo sapiens
uuccauuuugcc

SEQ ID NO: 460723 - RNA, 22 nt, Homo sapiens
uuccauuuugccaccuuuccug

SEQ ID NO: 460724 - RNA, 13 nt, Homo sapiens
uucccaaacugau

SEQ ID NO: 460725 - RNA, 20 nt, Homo sapiens
uucccaaauaaacucuaaac

SEQ ID NO: 460726 - RNA, 15 nt, Homo sapiens
uucccaacaauacuu

SEQ ID NO: 460727 - RNA, 21 nt, Homo sapiens
uucccaacacuucagacugca

SEQ ID NO: 460728 - RNA, 20 nt, Homo sapiens
uucccaacuucccuguucuu

SEQ ID NO: 460729 - RNA, 15 nt, Homo sapiens
uucccacaauggcug

SEQ ID NO: 460730 - RNA, 15 nt, Homo sapiens
uucccacuuugccac

SEQ ID NO: 460731 - RNA, 16 nt, Homo sapiens
uucccacuuugccacu

SEQ ID NO: 460732 - RNA, 17 nt, Homo sapiens
uucccagauagucccag

SEQ ID NO: 460733 - RNA, 22 nt, Homo sapiens
uucccagcuaccagcuaugcca

SEQ ID NO: 460734 - RNA, 16 nt, Homo sapiens
uucccaggccagcgag

SEQ ID NO: 460735 - RNA, 14 nt, Homo sapiens
uuccccaccaguga

SEQ ID NO: 460736 - RNA, 17 nt, Homo sapiens
uuccccucauugcauuu

SEQ ID NO: 460737 - RNA, 21 nt, Homo sapiens
uuccccugcucacucuuccac

SEQ ID NO: 460738 - RNA, 13 nt, Homo sapiens
uuccccugcugac

SEQ ID NO: 460739 - RNA, 19 nt, Homo sapiens
uucccuaaagaacauaccu

SEQ ID NO: 460740 - RNA, 12 nt, Homo sapiens
uucccuaucacu

SEQ ID NO: 460741 - RNA, 15 nt, Homo sapiens
uucccuaucacugaa

SEQ ID NO: 460742 - RNA, 13 nt, Homo sapiens
uucccucccuauc

SEQ ID NO: 460743 - RNA, 18 nt, Homo sapiens
uucccugaccucccucua

SEQ ID NO: 460744 - RNA, 21 nt, Homo sapiens
uucccuggaccagaugcugaa

SEQ ID NO: 460745 - RNA, 19 nt, Homo sapiens
uucccugggguacuacucu

SEQ ID NO: 460746 - RNA, 22 nt, Homo sapiens
uucccuguguauucuagugaau

SEQ ID NO: 460747 - RNA, 15 nt, Homo sapiens
uucccuguucuuuga

SEQ ID NO: 460748 - RNA, 14 nt, Homo sapiens
uucccuuccacugc

SEQ ID NO: 460749 - RNA, 16 nt, Homo sapiens
uucccuuguauggaua

SEQ ID NO: 460750 - RNA, 22 nt, Homo sapiens
uucccuuugauuuuuugcugca

SEQ ID NO: 460751 - RNA, 12 nt, Homo sapiens
uuccguuuccag

SEQ ID NO: 460752 - RNA, 19 nt, Homo sapiens
uuccuaauaugcuuuacaa

SEQ ID NO: 460753 - RNA, 21 nt, Homo sapiens
uuccuaguauacccacugcau

SEQ ID NO: 460754 - RNA, 22 nt, Homo sapiens
uuccuaugcugcaauacauuaa

SEQ ID NO: 460755 - RNA, 12 nt, Homo sapiens
uuccucacauuc

SEQ ID NO: 460756 - RNA, 14 nt, Homo sapiens
uuccucagcugcca

SEQ ID NO: 460757 - RNA, 23 nt, Homo sapiens
uuccucccaaaggcuuucuuucc

SEQ ID NO: 460758 - RNA, 21 nt, Homo sapiens
uuccuccuaaauuuccagggg

SEQ ID NO: 460759 - RNA, 17 nt, Homo sapiens
uuccuccuggcuuccag

SEQ ID NO: 460760 - RNA, 20 nt, Homo sapiens
uuccuccuggcuuccagggg

SEQ ID NO: 460761 - RNA, 14 nt, Homo sapiens
uuccucgccugaca

SEQ ID NO: 460762 - RNA, 16 nt, Homo sapiens
uuguacagacaacaaa

SEQ ID NO: 460763 - RNA, 21 nt, Homo sapiens
uuguagagauggggucucaca

SEQ ID NO: 460764 - RNA, 16 nt, Homo sapiens
uuguagauacaaucag

SEQ ID NO: 460765 - RNA, 19 nt, Homo sapiens
uuguauaggccaucuguaa

SEQ ID NO: 460766 - RNA, 18 nt, Homo sapiens
uuguauccuccauuguau

SEQ ID NO: 460767 - RNA, 15 nt, Homo sapiens
uuguaucuccuucag

SEQ ID NO: 460768 - RNA, 16 nt, Homo sapiens
uuguaucuuaagccaa

SEQ ID NO: 460769 - RNA, 16 nt, Homo sapiens
uuguauugucugacac

SEQ ID NO: 460770 - RNA, 21 nt, Homo sapiens
uuguauuuuacuuugugcaau

SEQ ID NO: 460771 - RNA, 16 nt, Homo sapiens
uugucaaaugucauua

SEQ ID NO: 460772 - RNA, 22 nt, Homo sapiens
uugucaacaguauacaaaagaa

SEQ ID NO: 460773 - RNA, 15 nt, Homo sapiens
uugucaauaguauua

SEQ ID NO: 460774 - RNA, 22 nt, Homo sapiens
uugucaauaguauuaacuauua

SEQ ID NO: 460775 - RNA, 18 nt, Homo sapiens
uugucauucaagccugug

SEQ ID NO: 460776 - RNA, 21 nt, Homo sapiens
uugucauuuugaaauacuuaa

SEQ ID NO: 460777 - RNA, 18 nt, Homo sapiens
uugucauuuuuaauauua

SEQ ID NO: 460778 - RNA, 14 nt, Homo sapiens
uuguccaugauguc

SEQ ID NO: 460779 - RNA, 16 nt, Homo sapiens
uuguccaugauguccu

SEQ ID NO: 460780 - RNA, 14 nt, Homo sapiens
uugucccccaacuu

SEQ ID NO: 460781 - RNA, 16 nt, Homo sapiens
uugucccugugccuaa

SEQ ID NO: 460782 - RNA, 20 nt, Homo sapiens
uugucucuagagcagggauu

SEQ ID NO: 460783 - RNA, 16 nt, Homo sapiens
uugucuuaaggucaua

SEQ ID NO: 460784 - RNA, 17 nt, Homo sapiens
uugucuuacuguugcau

SEQ ID NO: 460785 - RNA, 19 nt, Homo sapiens
uugucuuagacacuguggu

SEQ ID NO: 460786 - RNA, 16 nt, Homo sapiens
uugugaacagccaaaa

SEQ ID NO: 460787 - RNA, 15 nt, Homo sapiens
uugugaugaugcugu

SEQ ID NO: 460788 - RNA, 20 nt, Homo sapiens
uugugauuuuuauaauacaa

SEQ ID NO: 460789 - RNA, 18 nt, Homo sapiens
uugugauuuuugaacaau

SEQ ID NO: 460790 - RNA, 13 nt, Homo sapiens
uugugcagugugc

SEQ ID NO: 460791 - RNA, 16 nt, Homo sapiens
uuguggaugucuuccu

SEQ ID NO: 460792 - RNA, 19 nt, Homo sapiens
uuguggcacacaacugugg

SEQ ID NO: 460793 - RNA, 15 nt, Homo sapiens
uuguggcgugugagu

SEQ ID NO: 460794 - RNA, 21 nt, Homo sapiens
uuguggucugagccaaagaga

SEQ ID NO: 460795 - RNA, 14 nt, Homo sapiens
uuguggugcauuga

SEQ ID NO: 460796 - RNA, 23 nt, Homo sapiens
uuguguaugauuuugaugcacaa

SEQ ID NO: 460797 - RNA, 21 nt, Homo sapiens
uugugugcucauguaugugcg

SEQ ID NO: 460798 - RNA, 16 nt, Homo sapiens
uuguguguaugcugau

SEQ ID NO: 460799 - RNA, 15 nt, Homo sapiens
uuguguucaaucugu

SEQ ID NO: 460800 - RNA, 15 nt, Homo sapiens
uuguguucaguucca

SEQ ID NO: 460801 - RNA, 19 nt, Homo sapiens
uuguuaaaaccuuacuuaa

SEQ ID NO: 460802 - RNA, 15 nt, Homo sapiens
uuguuaauucuuccu

SEQ ID NO: 460803 - RNA, 19 nt, Homo sapiens
uuguuacuguccacccuca

SEQ ID NO: 460804 - RNA, 18 nt, Homo sapiens
uuguuagugauuugcuau

SEQ ID NO: 460805 - RNA, 16 nt, Homo sapiens
uuguuaucaguacaau

SEQ ID NO: 460806 - RNA, 19 nt, Homo sapiens
uuguuaugagggcauguga

SEQ ID NO: 460807 - RNA, 12 nt, Homo sapiens
uuguuaugcuau

SEQ ID NO: 460808 - RNA, 13 nt, Homo sapiens
uuguuaugcuauu

SEQ ID NO: 460809 - RNA, 23 nt, Homo sapiens
uuguuaugugaauugagcacaua

SEQ ID NO: 460810 - RNA, 13 nt, Homo sapiens
uuguuauuuugga

SEQ ID NO: 460811 - RNA, 16 nt, Homo sapiens
uuguucagucuuucau

SEQ ID NO: 460812 - RNA, 13 nt, Homo sapiens
uuguuccugcuuu

SEQ ID NO: 460813 - RNA, 21 nt, Homo sapiens
uuguugaugcucacauaugau

SEQ ID NO: 460814 - RNA, 16 nt, Homo sapiens
uuguugcaaaugugau

SEQ ID NO: 460815 - RNA, 23 nt, Homo sapiens
uuguuuaaagaauaaaguccaaa

SEQ ID NO: 460816 - RNA, 18 nt, Homo sapiens
uuguuuaacauugcugau

SEQ ID NO: 460817 - RNA, 22 nt, Homo sapiens
uuguuuaccucuuugucccaga

SEQ ID NO: 460818 - RNA, 12 nt, Homo sapiens
uuguuucuuaag

SEQ ID NO: 460819 - RNA, 22 nt, Homo sapiens
uuguuugaaaaagcagacagaa

SEQ ID NO: 460820 - RNA, 23 nt, Homo sapiens
uuguuuucccgagcaaagucuaa

SEQ ID NO: 460821 - RNA, 20 nt, Homo sapiens
uuguuuuuaaguccuguaua

SEQ ID NO: 460822 - RNA, 14 nt, Homo sapiens
uuguuuuuugccau

SEQ ID NO: 460823 - RNA, 20 nt, Homo sapiens
uuuaaaaaaaaaaguuacag

SEQ ID NO: 460824 - RNA, 16 nt, Homo sapiens
uuuaaaaaaauaacau

SEQ ID NO: 460825 - RNA, 15 nt, Homo sapiens
uuuaaaaaaucucaa

SEQ ID NO: 460826 - RNA, 19 nt, Homo sapiens
uuuaaaaaguuaacucuua

SEQ ID NO: 460827 - RNA, 14 nt, Homo sapiens
uuuaaaacauucac

SEQ ID NO: 460828 - RNA, 22 nt, Homo sapiens
uuuaaacacggggcuugcaacu

SEQ ID NO: 460829 - RNA, 12 nt, Homo sapiens
uuuaaacagugu

SEQ ID NO: 460830 - RNA, 20 nt, Homo sapiens
uuuaaacuacugaacuguua

SEQ ID NO: 460831 - RNA, 12 nt, Homo sapiens
uuuaaagacaga

SEQ ID NO: 460832 - RNA, 17 nt, Homo sapiens
uuuaaagacagaaggcc

SEQ ID NO: 460833 - RNA, 18 nt, Homo sapiens
uuuaaauaaaguaucaug

SEQ ID NO: 460834 - RNA, 19 nt, Homo sapiens
uuuaaauaaaugugagaac

SEQ ID NO: 460835 - RNA, 22 nt, Homo sapiens
uuuaaauaauauccaccucucc

SEQ ID NO: 460836 - RNA, 20 nt, Homo sapiens
uuuaaauaccaguacuugag

SEQ ID NO: 460837 - RNA, 17 nt, Homo sapiens
uuuaaauguuacuggua

SEQ ID NO: 460838 - RNA, 13 nt, Homo sapiens
uuuaaauuacaca

SEQ ID NO: 460839 - RNA, 17 nt, Homo sapiens
uuuaaauuuucaccugu

SEQ ID NO: 460840 - RNA, 22 nt, Homo sapiens
uuuaaccagucugaaguuucau

SEQ ID NO: 460841 - RNA, 21 nt, Homo sapiens
uuuaacuagaauuuauucaau

SEQ ID NO: 460842 - RNA, 18 nt, Homo sapiens
uuuaagagaaaugagcug

SEQ ID NO: 460843 - RNA, 12 nt, Homo sapiens
uuuaaggcuaaa

SEQ ID NO: 460844 - RNA, 13 nt, Homo sapiens
uuuaagguacuua

SEQ ID NO: 460845 - RNA, 19 nt, Homo sapiens
uuuaauacaggguagauaa

SEQ ID NO: 460846 - RNA, 22 nt, Homo sapiens
uuuaauacaggguagauaaccu

SEQ ID NO: 460847 - RNA, 16 nt, Homo sapiens
uuuaauagagaacuuc

SEQ ID NO: 460848 - RNA, 12 nt, Homo sapiens
uuuaauaggacu

SEQ ID NO: 460849 - RNA, 14 nt, Homo sapiens
uuuaauaggacuuc

SEQ ID NO: 460850 - RNA, 16 nt, Homo sapiens
uuuaauauacuuuaaa

SEQ ID NO: 460851 - RNA, 15 nt, Homo sapiens
uuuaaucauuuccag

SEQ ID NO: 460852 - RNA, 12 nt, Homo sapiens
uuuaaugagcac

SEQ ID NO: 460853 - RNA, 16 nt, Homo sapiens
uuuaaugauaaguaaa

SEQ ID NO: 460854 - RNA, 14 nt, Homo sapiens
uuuaauggggugca

SEQ ID NO: 460855 - RNA, 20 nt, Homo sapiens
uuuaauguagacauuaucuu

SEQ ID NO: 460856 - RNA, 17 nt, Homo sapiens
uuuaauuuaugauauaa

SEQ ID NO: 460857 - RNA, 12 nt, Homo sapiens
uuuaauuugacc

SEQ ID NO: 460858 - RNA, 16 nt, Homo sapiens
uuuacaaaagauguau

SEQ ID NO: 460859 - RNA, 14 nt, Homo sapiens
uuuacaaagcaugu

SEQ ID NO: 460860 - RNA, 15 nt, Homo sapiens
uuuacaaggugacaa

SEQ ID NO: 460861 - RNA, 15 nt, Homo sapiens
uuuacaaucugcacu

SEQ ID NO: 460862 - RNA, 13 nt, Homo sapiens
uuuacagcugccu

SEQ ID NO: 460863 - RNA, 13 nt, Homo sapiens
uuuacauaugcuu

SEQ ID NO: 460864 - RNA, 21 nt, Homo sapiens
uuuacaucuguguucuaugca

SEQ ID NO: 460865 - RNA, 16 nt, Homo sapiens
uuuacauggguucaau

SEQ ID NO: 460866 - RNA, 13 nt, Homo sapiens
uuuacaugugauu

SEQ ID NO: 460867 - RNA, 13 nt, Homo sapiens
uuuaccaggguag

SEQ ID NO: 460868 - RNA, 14 nt, Homo sapiens
uuuacccucaggca

SEQ ID NO: 460869 - RNA, 19 nt, Homo sapiens
uuuacccuuuauagaacau

SEQ ID NO: 460870 - RNA, 14 nt, Homo sapiens
uuuaccguucacuu

SEQ ID NO: 460871 - RNA, 18 nt, Homo sapiens
uuuaccuggaaaccagaa

SEQ ID NO: 460872 - RNA, 16 nt, Homo sapiens
uuuaccuugcauuuua

SEQ ID NO: 460873 - RNA, 13 nt, Homo sapiens
uuuacgacaagga

SEQ ID NO: 460874 - RNA, 20 nt, Homo sapiens
uuuacuaagacauagucucu

SEQ ID NO: 460875 - RNA, 24 nt, Homo sapiens
uuuacuuccauaggacauacugca

SEQ ID NO: 460876 - RNA, 13 nt, Homo sapiens
uuuacuugaucau

SEQ ID NO: 460877 - RNA, 17 nt, Homo sapiens
uuuagaacuguauguca

SEQ ID NO: 460878 - RNA, 18 nt, Homo sapiens
uuuagaaucaagucugug

SEQ ID NO: 460879 - RNA, 13 nt, Homo sapiens
uuuagauauucau

SEQ ID NO: 460880 - RNA, 20 nt, Homo sapiens
uuuagcaauuuauacaauau

SEQ ID NO: 460881 - RNA, 12 nt, Homo sapiens
uuuagcacaaaa

SEQ ID NO: 460882 - RNA, 14 nt, Homo sapiens
uuuagccagugacu

SEQ ID NO: 460883 - RNA, 21 nt, Homo sapiens
uuuaggagacagucucaagca

SEQ ID NO: 460884 - RNA, 22 nt, Homo sapiens
uuuagguaguagaaucucagca

SEQ ID NO: 460885 - RNA, 18 nt, Homo sapiens
uuuaguguuuugcaaggg

SEQ ID NO: 460886 - RNA, 17 nt, Homo sapiens
uuuauaaaagacaugaa

SEQ ID NO: 460887 - RNA, 14 nt, Homo sapiens
uuuauaauacccuu

SEQ ID NO: 460888 - RNA, 22 nt, Homo sapiens
uuuauaccagcuuaugagcuca

SEQ ID NO: 460889 - RNA, 15 nt, Homo sapiens
uuuauacuguuuacu

SEQ ID NO: 460890 - RNA, 14 nt, Homo sapiens
uuuauaguguugcu

SEQ ID NO: 460891 - RNA, 13 nt, Homo sapiens
uuuauauagcuug

SEQ ID NO: 460892 - RNA, 12 nt, Homo sapiens
uuuauauaugaa

SEQ ID NO: 460893 - RNA, 14 nt, Homo sapiens
cauuauuacuccuu

SEQ ID NO: 460894 - RNA, 21 nt, Homo sapiens
cauuauuacuccuugccauuu

SEQ ID NO: 460895 - RNA, 11 nt, Homo sapiens
cauucuucucu

SEQ ID NO: 460896 - RNA, 17 nt, Homo sapiens
cauugcuucacuaccca

SEQ ID NO: 460897 - RNA, 22 nt, Homo sapiens
cauuguaauaugacuccugugu

SEQ ID NO: 460898 - RNA, 13 nt, Homo sapiens
cauuguagacaug

SEQ ID NO: 460899 - RNA, 11 nt, Homo sapiens
cauugugauca

SEQ ID NO: 460900 - RNA, 19 nt, Homo sapiens
cauuuuagucccauuugac

SEQ ID NO: 460901 - RNA, 22 nt, Homo sapiens
cauuuugggaccuauaucucag

SEQ ID NO: 460902 - RNA, 20 nt, Homo sapiens
ccaacaucaacaucuugguc

SEQ ID NO: 460903 - RNA, 16 nt, Homo sapiens
ccaagagggacaucag

SEQ ID NO: 460904 - RNA, 17 nt, Homo sapiens
ccaagagguuaggugaa

SEQ ID NO: 460905 - RNA, 12 nt, Homo sapiens
ccaagucuuccu

SEQ ID NO: 460906 - RNA, 13 nt, Homo sapiens
ccaaucuccauca

SEQ ID NO: 460907 - RNA, 13 nt, Homo sapiens
ccaccucccaggu

SEQ ID NO: 460908 - RNA, 15 nt, Homo sapiens
ccaccuccugcaaua

SEQ ID NO: 460909 - RNA, 19 nt, Homo sapiens
ccacgcccccagcugugac

SEQ ID NO: 460910 - RNA, 20 nt, Homo sapiens
ccagaagccugaugugagug

SEQ ID NO: 460911 - RNA, 14 nt, Homo sapiens
ccagacuuaaucuu

SEQ ID NO: 460912 - RNA, 16 nt, Homo sapiens
ccaggaugcugcugca

SEQ ID NO: 460913 - RNA, 18 nt, Homo sapiens
ccaggcuggagugcagug

SEQ ID NO: 460914 - RNA, 20 nt, Homo sapiens
ccaggcuggagugcaguggu

SEQ ID NO: 460915 - RNA, 15 nt, Homo sapiens
ccaggcuggucuuga

SEQ ID NO: 460916 - RNA, 19 nt, Homo sapiens
ccaguggaagcagguguau

SEQ ID NO: 460917 - RNA, 21 nt, Homo sapiens
ccaugacugcauuuuacugua

SEQ ID NO: 460918 - RNA, 12 nt, Homo sapiens
ccauuguaauau

SEQ ID NO: 460919 - RNA, 18 nt, Homo sapiens
cccaggcuggagugcagu

SEQ ID NO: 460920 - RNA, 20 nt, Homo sapiens
cccaggcuggagugcagugg

SEQ ID NO: 460921 - RNA, 21 nt, Homo sapiens
ccccagcaaaguuaacuacac

SEQ ID NO: 460922 - RNA, 16 nt, Homo sapiens
cccggcgugugcagug

SEQ ID NO: 460923 - RNA, 19 nt, Homo sapiens
cccguugauaacucagugg

SEQ ID NO: 460924 - RNA, 14 nt, Homo sapiens
cccugauaagcaaa

SEQ ID NO: 460925 - RNA, 17 nt, Homo sapiens
cccugguggguggcacu

SEQ ID NO: 460926 - RNA, 21 nt, Homo sapiens
cccugguggguggcacucuca

SEQ ID NO: 460927 - RNA, 15 nt, Homo sapiens
cccugucucuacuaa

SEQ ID NO: 460928 - RNA, 14 nt, Homo sapiens
cccuguuaagcaau

SEQ ID NO: 460929 - RNA, 22 nt, Homo sapiens
cccuuacucuugcugagucaga

SEQ ID NO: 460930 - RNA, 14 nt, Homo sapiens
ccgggcaguguccc

SEQ ID NO: 460931 - RNA, 16 nt, Homo sapiens
ccggggguggugacau

SEQ ID NO: 460932 - RNA, 14 nt, Homo sapiens
ccuaaaaaauuccu

SEQ ID NO: 460933 - RNA, 16 nt, Homo sapiens
ccuaagggggacacau

SEQ ID NO: 460934 - RNA, 18 nt, Homo sapiens
ccuaagugcaacugcaag

SEQ ID NO: 460935 - RNA, 15 nt, Homo sapiens
ccuacugcugugagc

SEQ ID NO: 460936 - RNA, 23 nt, Homo sapiens
ccuacugcugugagcaugacuua

SEQ ID NO: 460937 - RNA, 19 nt, Homo sapiens
ccuagaagggucacuuuaa

SEQ ID NO: 460938 - RNA, 11 nt, Homo sapiens
ccucacacugu

SEQ ID NO: 460939 - RNA, 20 nt, Homo sapiens
ccucagaaccccacggcaag

SEQ ID NO: 460940 - RNA, 16 nt, Homo sapiens
ccucagggcagggaua

SEQ ID NO: 460941 - RNA, 15 nt, Homo sapiens
ccucauucuucucuc

SEQ ID NO: 460942 - RNA, 19 nt, Homo sapiens
ccucccaaagugcagggau

SEQ ID NO: 460943 - RNA, 12 nt, Homo sapiens
ccucugacugua

SEQ ID NO: 460944 - RNA, 16 nt, Homo sapiens
ccucugaggggcacuc

SEQ ID NO: 460945 - RNA, 14 nt, Homo sapiens
ccugagacauauua

SEQ ID NO: 460946 - RNA, 22 nt, Homo sapiens
ccugaugugaguguguggcacc

SEQ ID NO: 460947 - RNA, 23 nt, Homo sapiens
ccuggauuccucgaaacugccau

SEQ ID NO: 460948 - RNA, 16 nt, Homo sapiens
ccuggcggggucuugc

SEQ ID NO: 460949 - RNA, 12 nt, Homo sapiens
ccuguauuccca

SEQ ID NO: 460950 - RNA, 12 nt, Homo sapiens
ccugugauggca

SEQ ID NO: 460951 - RNA, 15 nt, Homo sapiens
ccuguggauguauau

SEQ ID NO: 460952 - RNA, 23 nt, Homo sapiens
ccuguguccacaucuaacaaagu

SEQ ID NO: 460953 - RNA, 22 nt, Homo sapiens
ccuguguuuuucuuugggucua

SEQ ID NO: 460954 - RNA, 14 nt, Homo sapiens
ccuuccagugcagg

SEQ ID NO: 460955 - RNA, 13 nt, Homo sapiens
ccuugaaaacugc

SEQ ID NO: 460956 - RNA, 21 nt, Homo sapiens
ccuugcacuauuggacuuugg

SEQ ID NO: 460957 - RNA, 16 nt, Homo sapiens
ccuugguaaaaacugc

SEQ ID NO: 460958 - RNA, 18 nt, Homo sapiens
ccuuguaucuugcauuca

SEQ ID NO: 460959 - RNA, 14 nt, Homo sapiens
ccuuuccucagugu

SEQ ID NO: 460960 - RNA, 15 nt, Homo sapiens
ccuuugcauguuugu

SEQ ID NO: 460961 - RNA, 17 nt, Homo sapiens
ccuuuggcaauucuucu

SEQ ID NO: 460962 - RNA, 15 nt, Homo sapiens
ccuuuucaucuccag

SEQ ID NO: 460963 - RNA, 21 nt, Homo sapiens
ccuuuucuuuuucccuugaac

SEQ ID NO: 460964 - RNA, 17 nt, Homo sapiens
cgaacuccugaccucag

SEQ ID NO: 460965 - RNA, 18 nt, Homo sapiens
cgacuguggugugcagug

SEQ ID NO: 460966 - RNA, 20 nt, Homo sapiens
cgagauugcaccacugcacu

SEQ ID NO: 460967 - RNA, 18 nt, Homo sapiens
cgagggaugggauuucau

SEQ ID NO: 460968 - RNA, 14 nt, Homo sapiens
cgauuucacugaca

SEQ ID NO: 460969 - RNA, 20 nt, Homo sapiens
cgcccaggcuggagugcagu

SEQ ID NO: 460970 - RNA, 16 nt, Homo sapiens
cggagguugcagugag

SEQ ID NO: 460971 - RNA, 20 nt, Homo sapiens
cggccuuccacccugacugc

SEQ ID NO: 460972 - RNA, 15 nt, Homo sapiens
cggccuuuguugcuc

SEQ ID NO: 460973 - RNA, 18 nt, Homo sapiens
cgggcagcuggugcugug

SEQ ID NO: 460974 - RNA, 20 nt, Homo sapiens
cgggcgguccuacugcugug

SEQ ID NO: 460975 - RNA, 18 nt, Homo sapiens
cggucagaagcaccaaga

SEQ ID NO: 460976 - RNA, 18 nt, Homo sapiens
cgguccuacugcugugag

SEQ ID NO: 460977 - RNA, 23 nt, Homo sapiens
cggugcauacacccccaccuccu

SEQ ID NO: 460978 - RNA, 16 nt, Homo sapiens
cguaggugugacacuu

SEQ ID NO: 460979 - RNA, 20 nt, Homo sapiens
cguguccugaggggcugcuu

SEQ ID NO: 460980 - RNA, 18 nt, Homo sapiens
cguuaccgccacacuuga

SEQ ID NO: 460981 - RNA, 17 nt, Homo sapiens
cguugauaacucagugg

SEQ ID NO: 460982 - RNA, 13 nt, Homo sapiens
cguuuuaugauuu

SEQ ID NO: 460983 - RNA, 23 nt, Homo sapiens
cuaaaaccuugguuaucaaauac

SEQ ID NO: 460984 - RNA, 16 nt, Homo sapiens
cuaagaaaauacugga

SEQ ID NO: 460985 - RNA, 15 nt, Homo sapiens
cuaagucauguauau

SEQ ID NO: 460986 - RNA, 14 nt, Homo sapiens
cuaauuauuauuaa

SEQ ID NO: 460987 - RNA, 23 nt, Homo sapiens
cuacacagaggacccaggggaaa

SEQ ID NO: 460988 - RNA, 20 nt, Homo sapiens
cuacacuuuuuuggucuguu

SEQ ID NO: 460989 - RNA, 12 nt, Homo sapiens
cuacuucucacc

SEQ ID NO: 460990 - RNA, 18 nt, Homo sapiens
cuagaucuuacaucugca

SEQ ID NO: 460991 - RNA, 19 nt, Homo sapiens
cuaucaccucuuaugcaca

SEQ ID NO: 460992 - RNA, 20 nt, Homo sapiens
cuaucaccucuuaugcacac

SEQ ID NO: 460993 - RNA, 16 nt, Homo sapiens
cuauuuaugaauauua

SEQ ID NO: 460994 - RNA, 18 nt, Homo sapiens
cucaaacuccugaccuca

SEQ ID NO: 460995 - RNA, 15 nt, Homo sapiens
cucaagcacugacac

SEQ ID NO: 460996 - RNA, 20 nt, Homo sapiens
cucacacuguaagaguucac

SEQ ID NO: 460997 - RNA, 16 nt, Homo sapiens
cucacugccagugcag

SEQ ID NO: 460998 - RNA, 14 nt, Homo sapiens
cucagaacugcaau

SEQ ID NO: 460999 - RNA, 17 nt, Homo sapiens
cucagcaacagccagug

SEQ ID NO: 461000 - RNA, 16 nt, Homo sapiens
cucagccucccaaagu

SEQ ID NO: 461001 - RNA, 15 nt, Homo sapiens
cucagggcagggaua

SEQ ID NO: 461002 - RNA, 14 nt, Homo sapiens
cucauccaaaaagu

SEQ ID NO: 461003 - RNA, 22 nt, Homo sapiens
cucauggauuugaaugaaaugc

SEQ ID NO: 461004 - RNA, 21 nt, Homo sapiens
cuccaaaacaauuuucugcag

SEQ ID NO: 461005 - RNA, 16 nt, Homo sapiens
cuccagugugaauaua

SEQ ID NO: 461006 - RNA, 14 nt, Homo sapiens
cuccauguuugaug

SEQ ID NO: 461007 - RNA, 15 nt, Homo sapiens
cuccccaccacugag

SEQ ID NO: 461008 - RNA, 16 nt, Homo sapiens
cuccugaacagaagau

SEQ ID NO: 461009 - RNA, 13 nt, Homo sapiens
cuccuuaugaugc

SEQ ID NO: 461010 - RNA, 13 nt, Homo sapiens
cucgaacuccuga

SEQ ID NO: 461011 - RNA, 20 nt, Homo sapiens
cucgaacuccugaccucagg

SEQ ID NO: 461012 - RNA, 19 nt, Homo sapiens
cucgcuagguucuuaucaa

SEQ ID NO: 461013 - RNA, 21 nt, Homo sapiens
cucgcuggugaagacccagag

SEQ ID NO: 461014 - RNA, 21 nt, Homo sapiens
cucggcccugcccagcuuugu

SEQ ID NO: 461015 - RNA, 13 nt, Homo sapiens
cucgucucaaaaa

SEQ ID NO: 461016 - RNA, 14 nt, Homo sapiens
cucuacaaccuaaa

SEQ ID NO: 461017 - RNA, 13 nt, Homo sapiens
cucucacauuaag

SEQ ID NO: 461018 - RNA, 23 nt, Homo sapiens
cucucagcgccgucgccacucgg

SEQ ID NO: 461019 - RNA, 11 nt, Homo sapiens
cucugaaaugu

SEQ ID NO: 461020 - RNA, 13 nt, Homo sapiens
agcugugugagaa

SEQ ID NO: 461021 - RNA, 12 nt, Homo sapiens
agcuucuugcca

SEQ ID NO: 461022 - RNA, 18 nt, Homo sapiens
aggaaaagggcaaaaaga

SEQ ID NO: 461023 - RNA, 15 nt, Homo sapiens
aggaacuuuccagca

SEQ ID NO: 461024 - RNA, 13 nt, Homo sapiens
aggacgauuucac

SEQ ID NO: 461025 - RNA, 23 nt, Homo sapiens
aggagcaaucuaagcuguguuac

SEQ ID NO: 461026 - RNA, 14 nt, Homo sapiens
aggagcuuacugaa

SEQ ID NO: 461027 - RNA, 17 nt, Homo sapiens
aggagugacuuugcagg

SEQ ID NO: 461028 - RNA, 13 nt, Homo sapiens
aggcaugagccac

SEQ ID NO: 461029 - RNA, 16 nt, Homo sapiens
aggccuuccagugcag

SEQ ID NO: 461030 - RNA, 22 nt, Homo sapiens
agggaggaccauuggcuugcca

SEQ ID NO: 461031 - RNA, 17 nt, Homo sapiens
agggcaaaaagaccaag

SEQ ID NO: 461032 - RNA, 18 nt, Homo sapiens
agggcaaaaagaccaaga

SEQ ID NO: 461033 - RNA, 19 nt, Homo sapiens
agggcccacccaugucacc

SEQ ID NO: 461034 - RNA, 13 nt, Homo sapiens
agggugacugugu

SEQ ID NO: 461035 - RNA, 17 nt, Homo sapiens
agggugcuggacuguau

SEQ ID NO: 461036 - RNA, 14 nt, Homo sapiens
aggugaacaaauaa

SEQ ID NO: 461037 - RNA, 21 nt, Homo sapiens
aggugguggcagcaauggugu

SEQ ID NO: 461038 - RNA, 14 nt, Homo sapiens
agguucaagagauu

SEQ ID NO: 461039 - RNA, 14 nt, Homo sapiens
agguucaagcgauu

SEQ ID NO: 461040 - RNA, 13 nt, Homo sapiens
agguuccaaauuc

SEQ ID NO: 461041 - RNA, 15 nt, Homo sapiens
agguuucaucauguu

SEQ ID NO: 461042 - RNA, 13 nt, Homo sapiens
aguaauuguaagu

SEQ ID NO: 461043 - RNA, 19 nt, Homo sapiens
aguaauuguaaguaccccu

SEQ ID NO: 461044 - RNA, 19 nt, Homo sapiens
aguaauugucaauaccccu

SEQ ID NO: 461045 - RNA, 14 nt, Homo sapiens
aguagaauuuacaa

SEQ ID NO: 461046 - RNA, 21 nt, Homo sapiens
agucaaauauguagauugccu

SEQ ID NO: 461047 - RNA, 13 nt, Homo sapiens
agucccauuugac

SEQ ID NO: 461048 - RNA, 19 nt, Homo sapiens
agucuggagcacccugaga

SEQ ID NO: 461049 - RNA, 18 nt, Homo sapiens
agugagaacccagcuguc

SEQ ID NO: 461050 - RNA, 21 nt, Homo sapiens
agugcaguggcacgaucucag

SEQ ID NO: 461051 - RNA, 21 nt, Homo sapiens
agugcugggauuacaggcaug

SEQ ID NO: 461052 - RNA, 23 nt, Homo sapiens
aguggcuuccaucucagcacucu

SEQ ID NO: 461053 - RNA, 22 nt, Homo sapiens
aguguaggccuuccagugcagg

SEQ ID NO: 461054 - RNA, 20 nt, Homo sapiens
agugucugaacaggaugcug

SEQ ID NO: 461055 - RNA, 16 nt, Homo sapiens
aguguuuucaccucau

SEQ ID NO: 461056 - RNA, 17 nt, Homo sapiens
aguugagacuugccagu

SEQ ID NO: 461057 - RNA, 18 nt, Homo sapiens
aguugauagguuguuaaa

SEQ ID NO: 461058 - RNA, 14 nt, Homo sapiens
aguugaugacuguu

SEQ ID NO: 461059 - RNA, 13 nt, Homo sapiens
aguuucacuggcu

SEQ ID NO: 461060 - RNA, 21 nt, Homo sapiens
aguuucugauuuuuauucuca

SEQ ID NO: 461061 - RNA, 14 nt, Homo sapiens
aguuugauacgugu

SEQ ID NO: 461062 - RNA, 16 nt, Homo sapiens
auaaccccaccuugcc

SEQ ID NO: 461063 - RNA, 14 nt, Homo sapiens
auaagaacgucauu

SEQ ID NO: 461064 - RNA, 15 nt, Homo sapiens
auaauauuuuuacag

SEQ ID NO: 461065 - RNA, 16 nt, Homo sapiens
auaauuauuacauggu

SEQ ID NO: 461066 - RNA, 11 nt, Homo sapiens
auaauucacac

SEQ ID NO: 461067 - RNA, 16 nt, Homo sapiens
auaauucuacuuugag

SEQ ID NO: 461068 - RNA, 19 nt, Homo sapiens
auacaaacauucuaauuaa

SEQ ID NO: 461069 - RNA, 23 nt, Homo sapiens
auacaaagcggggagaggguaca

SEQ ID NO: 461070 - RNA, 18 nt, Homo sapiens
auaccccuguuaagcaau

SEQ ID NO: 461071 - RNA, 23 nt, Homo sapiens
auagaucuuaggcaaaauaccag

SEQ ID NO: 461072 - RNA, 22 nt, Homo sapiens
auaguuauuguuuuauguucua

SEQ ID NO: 461073 - RNA, 20 nt, Homo sapiens
auaugaaauuuuuaaaggag

SEQ ID NO: 461074 - RNA, 17 nt, Homo sapiens
auauucagaaaaugaag

SEQ ID NO: 461075 - RNA, 17 nt, Homo sapiens
aucaaacuagugcauga

SEQ ID NO: 461076 - RNA, 13 nt, Homo sapiens
aucacagcugcca

SEQ ID NO: 461077 - RNA, 22 nt, Homo sapiens
aucacaugugcccucugccagg

SEQ ID NO: 461078 - RNA, 22 nt, Homo sapiens
aucaccucuuaugcacaccucc

SEQ ID NO: 461079 - RNA, 22 nt, Homo sapiens
aucaguaauguauucuaucucu

SEQ ID NO: 461080 - RNA, 16 nt, Homo sapiens
aucauaaaacuugaug

SEQ ID NO: 461081 - RNA, 14 nt, Homo sapiens
aucccagcuacuca

SEQ ID NO: 461082 - RNA, 19 nt, Homo sapiens
aucgcuuucuacacuguau

SEQ ID NO: 461083 - RNA, 17 nt, Homo sapiens
aucuaauaaauacuuaa

SEQ ID NO: 461084 - RNA, 23 nt, Homo sapiens
aucucaguggcacagguuuaaga

SEQ ID NO: 461085 - RNA, 14 nt, Homo sapiens
aucucucuuuacau

SEQ ID NO: 461086 - RNA, 18 nt, Homo sapiens
aucuguaugucugccuaa

SEQ ID NO: 461087 - RNA, 19 nt, Homo sapiens
aucugucucauccaaaaag

SEQ ID NO: 461088 - RNA, 20 nt, Homo sapiens
aucugucucauccaaaaagu

SEQ ID NO: 461089 - RNA, 20 nt, Homo sapiens
aucuuagaaaauuaaaugaa

SEQ ID NO: 461090 - RNA, 14 nt, Homo sapiens
aucuuaggcaaaau

SEQ ID NO: 461091 - RNA, 23 nt, Homo sapiens
aucuuugggccuuuccucagugu

SEQ ID NO: 461092 - RNA, 19 nt, Homo sapiens
augaaaaaacggucugccg

SEQ ID NO: 461093 - RNA, 23 nt, Homo sapiens
augacucaauaaauacauguuaa

SEQ ID NO: 461094 - RNA, 14 nt, Homo sapiens
augacuguuuguua

SEQ ID NO: 461095 - RNA, 15 nt, Homo sapiens
augagccacugugcc

SEQ ID NO: 461096 - RNA, 21 nt, Homo sapiens
augaguguaguugaugacugu

SEQ ID NO: 461097 - RNA, 19 nt, Homo sapiens
augcauuagaagucagcca

SEQ ID NO: 461098 - RNA, 11 nt, Homo sapiens
augcauuuuaa

SEQ ID NO: 461099 - RNA, 22 nt, Homo sapiens
augcccaauauuaaguaaaaaa

SEQ ID NO: 461100 - RNA, 14 nt, Homo sapiens
augccgacuaggug

SEQ ID NO: 461101 - RNA, 19 nt, Homo sapiens
augcuguguccacggggug

SEQ ID NO: 461102 - RNA, 19 nt, Homo sapiens
augcuuacgucaaaacagc

SEQ ID NO: 461103 - RNA, 13 nt, Homo sapiens
auggacuguacua

SEQ ID NO: 461104 - RNA, 21 nt, Homo sapiens
auggauuugaaugaaaugcca

SEQ ID NO: 461105 - RNA, 19 nt, Homo sapiens
auguacagauauacuucag

SEQ ID NO: 461106 - RNA, 18 nt, Homo sapiens
auguuagaaguccaggca

SEQ ID NO: 461107 - RNA, 23 nt, Homo sapiens
auguuaguuuauuugagcacuuu

SEQ ID NO: 461108 - RNA, 14 nt, Homo sapiens
auuaaaauauccca

SEQ ID NO: 461109 - RNA, 16 nt, Homo sapiens
auuaaaauaucccaag

SEQ ID NO: 461110 - RNA, 13 nt, Homo sapiens
auuaaacaccuga

SEQ ID NO: 461111 - RNA, 20 nt, Homo sapiens
auuaacugaauucugaacuu

SEQ ID NO: 461112 - RNA, 17 nt, Homo sapiens
auuaauaaacaaucucc

SEQ ID NO: 461113 - RNA, 16 nt, Homo sapiens
auuaauuuaauucaug

SEQ ID NO: 461114 - RNA, 21 nt, Homo sapiens
auuaccgucugugauugccau

SEQ ID NO: 461115 - RNA, 13 nt, Homo sapiens
auuacuaauuaau

SEQ ID NO: 461116 - RNA, 16 nt, Homo sapiens
auuccaggaugcugcu

SEQ ID NO: 461117 - RNA, 17 nt, Homo sapiens
auucuucagaaugucag

SEQ ID NO: 461118 - RNA, 21 nt, Homo sapiens
auugccagugagauauauuca

SEQ ID NO: 461119 - RNA, 17 nt, Homo sapiens
auugggauagaaguauu

SEQ ID NO: 461120 - RNA, 18 nt, Homo sapiens
auuggugcucacugccag

SEQ ID NO: 461121 - RNA, 21 nt, Homo sapiens
auuuaaaauggaaagcugugu

SEQ ID NO: 461122 - RNA, 21 nt, Homo sapiens
auuucacacucauuuaaucug

SEQ ID NO: 461123 - RNA, 15 nt, Homo sapiens
auuucagaggaggaa

SEQ ID NO: 461124 - RNA, 15 nt, Homo sapiens
auuucauguaaccaa

SEQ ID NO: 461125 - RNA, 21 nt, Homo sapiens
auuuccccuucaaacaaauaa

SEQ ID NO: 461126 - RNA, 17 nt, Homo sapiens
auuucugaaaugacaga

SEQ ID NO: 461127 - RNA, 18 nt, Homo sapiens
auuucuuuuucauuugac

SEQ ID NO: 461128 - RNA, 18 nt, Homo sapiens
auuugauuaauuuaauuc

SEQ ID NO: 461129 - RNA, 22 nt, Homo sapiens
auuugcgguuagaaucccaugg

SEQ ID NO: 461130 - RNA, 16 nt, Homo sapiens
auuuuaaaacauaaga

SEQ ID NO: 461131 - RNA, 18 nt, Homo sapiens
auuuuagucccauuugac

SEQ ID NO: 461132 - RNA, 14 nt, Homo sapiens
auuuucuacagugu

SEQ ID NO: 461133 - RNA, 15 nt, Homo sapiens
auuuugauuucuuaa

SEQ ID NO: 461134 - RNA, 17 nt, Homo sapiens
auuuuuauaaagauaua

SEQ ID NO: 461135 - RNA, 19 nt, Homo sapiens
auuuuuugcugcagacuca

SEQ ID NO: 461136 - RNA, 21 nt, Homo sapiens
auuuuuuuagguuaaaguuaa

SEQ ID NO: 461137 - RNA, 22 nt, Homo sapiens
caaaaacaguaaaaauaaccac

SEQ ID NO: 461138 - RNA, 20 nt, Homo sapiens
caaaaauagcccugcaaaaa

SEQ ID NO: 461139 - RNA, 23 nt, Homo sapiens
caaaauaauggugauacauucua

SEQ ID NO: 461140 - RNA, 16 nt, Homo sapiens
caaacauucuaauuaa

SEQ ID NO: 461141 - RNA, 16 nt, Homo sapiens
caaacuccugaccuca

SEQ ID NO: 461142 - RNA, 14 nt, Homo sapiens
caaagcuguuauug

SEQ ID NO: 461143 - RNA, 15 nt, Homo sapiens
caaaggugauuuucc

SEQ ID NO: 461144 - RNA, 16 nt, Homo sapiens
caaaggugauuuuccu

SEQ ID NO: 461145 - RNA, 11 nt, Homo sapiens
aaaaacugcag

SEQ ID NO: 461146 - RNA, 22 nt, Homo sapiens
aaaagauuguuuuauauguagu

SEQ ID NO: 461147 - RNA, 15 nt, Homo sapiens
aaaagguuaucuuaa

SEQ ID NO: 461148 - RNA, 18 nt, Homo sapiens
aaaauugccaucauucua

SEQ ID NO: 461149 - RNA, 13 nt, Homo sapiens
aaacaaucuccca

SEQ ID NO: 461150 - RNA, 21 nt, Homo sapiens
aaaccccggcgugugcagugc

SEQ ID NO: 461151 - RNA, 14 nt, Homo sapiens
aaacccugucucua

SEQ ID NO: 461152 - RNA, 14 nt, Homo sapiens
aaacggaacucuuc

SEQ ID NO: 461153 - RNA, 20 nt, Homo sapiens
aaacucacugaaucuaacca

SEQ ID NO: 461154 - RNA, 12 nt, Homo sapiens
aaacucuuccac

SEQ ID NO: 461155 - RNA, 16 nt, Homo sapiens
aaacucuuccacuaga

SEQ ID NO: 461156 - RNA, 19 nt, Homo sapiens
aaacuguuaaacuaaugag

SEQ ID NO: 461157 - RNA, 17 nt, Homo sapiens
aaagcggggagagggua

SEQ ID NO: 461158 - RNA, 13 nt, Homo sapiens
aaaggaaacuacu

SEQ ID NO: 461159 - RNA, 20 nt, Homo sapiens
aaaggaguagaauaccaaau

SEQ ID NO: 461160 - RNA, 20 nt, Homo sapiens
aaaggcaaauuuuauacaaa

SEQ ID NO: 461161 - RNA, 12 nt, Homo sapiens
aaaggugcuguu

SEQ ID NO: 461162 - RNA, 20 nt, Homo sapiens
aaaucuggggaggacaaagg

SEQ ID NO: 461163 - RNA, 19 nt, Homo sapiens
aaauggacaaacagugcac

SEQ ID NO: 461164 - RNA, 14 nt, Homo sapiens
aaauguuugugaug

SEQ ID NO: 461165 - RNA, 16 nt, Homo sapiens
aacacauacaaugaag

SEQ ID NO: 461166 - RNA, 17 nt, Homo sapiens
aacacguucauauucca

SEQ ID NO: 461167 - RNA, 12 nt, Homo sapiens
aacacuaacuuu

SEQ ID NO: 461168 - RNA, 19 nt, Homo sapiens
aacauucuuuccuaaauau

SEQ ID NO: 461169 - RNA, 19 nt, Homo sapiens
aaccaaacggaacucuuca

SEQ ID NO: 461170 - RNA, 11 nt, Homo sapiens
aacccagcugu

SEQ ID NO: 461171 - RNA, 20 nt, Homo sapiens
aaccuccgccucccagguuc

SEQ ID NO: 461172 - RNA, 14 nt, Homo sapiens
aacggaacucuuca

SEQ ID NO: 461173 - RNA, 22 nt, Homo sapiens
aacgugggaguucagcugcuuc

SEQ ID NO: 461174 - RNA, 16 nt, Homo sapiens
aacuaccagauuugag

SEQ ID NO: 461175 - RNA, 16 nt, Homo sapiens
aacuaccauuguaaua

SEQ ID NO: 461176 - RNA, 21 nt, Homo sapiens
aacuccugaccucaggugauc

SEQ ID NO: 461177 - RNA, 22 nt, Homo sapiens
aacucucuccuguauaaucucu

SEQ ID NO: 461178 - RNA, 20 nt, Homo sapiens
aacugcaagcccacagauga

SEQ ID NO: 461179 - RNA, 11 nt, Homo sapiens
aacugcagugu

SEQ ID NO: 461180 - RNA, 15 nt, Homo sapiens
aacuuccaauuuaca

SEQ ID NO: 461181 - RNA, 23 nt, Homo sapiens
aacuugaauuaauccacacauca

SEQ ID NO: 461182 - RNA, 20 nt, Homo sapiens
aacuugauguguuaucucuu

SEQ ID NO: 461183 - RNA, 15 nt, Homo sapiens
aagaaagcauugcca

SEQ ID NO: 461184 - RNA, 13 nt, Homo sapiens
aagaaauauucug

SEQ ID NO: 461185 - RNA, 16 nt, Homo sapiens
aagaauuauuuacuga

SEQ ID NO: 461186 - RNA, 14 nt, Homo sapiens
aagacauguacuga

SEQ ID NO: 461187 - RNA, 22 nt, Homo sapiens
aagagauauaauguucacuaau

SEQ ID NO: 461188 - RNA, 17 nt, Homo sapiens
aagauaguaucuuuuaa

SEQ ID NO: 461189 - RNA, 20 nt, Homo sapiens
aagauucauauuuacuucuu

SEQ ID NO: 461190 - RNA, 19 nt, Homo sapiens
aagcagaaggugugcuauu

SEQ ID NO: 461191 - RNA, 14 nt, Homo sapiens
aagccugugcaggu

SEQ ID NO: 461192 - RNA, 12 nt, Homo sapiens
aaggagugacuu

SEQ ID NO: 461193 - RNA, 21 nt, Homo sapiens
aaggcaggagaaucgcuuaaa

SEQ ID NO: 461194 - RNA, 16 nt, Homo sapiens
aaggggauacuguaau

SEQ ID NO: 461195 - RNA, 20 nt, Homo sapiens
aaggucccauaauaaaaaga

SEQ ID NO: 461196 - RNA, 15 nt, Homo sapiens
aaguaaggcaugguu

SEQ ID NO: 461197 - RNA, 19 nt, Homo sapiens
aaguaccccugauaagcaa

SEQ ID NO: 461198 - RNA, 20 nt, Homo sapiens
aaguaccccugauaagcaaa

SEQ ID NO: 461199 - RNA, 18 nt, Homo sapiens
aaguagcugggauuacag

SEQ ID NO: 461200 - RNA, 13 nt, Homo sapiens
aaguaugaucuau

SEQ ID NO: 461201 - RNA, 20 nt, Homo sapiens
aagugcugggauuacaggca

SEQ ID NO: 461202 - RNA, 19 nt, Homo sapiens
aaguggcagaacacuggau

SEQ ID NO: 461203 - RNA, 19 nt, Homo sapiens
aaguguuuuguaacuucau

SEQ ID NO: 461204 - RNA, 20 nt, Homo sapiens
aaguuaaugcaaaugacugu

SEQ ID NO: 461205 - RNA, 18 nt, Homo sapiens
aaguuaugcaugauguaa

SEQ ID NO: 461206 - RNA, 15 nt, Homo sapiens
aaguuuuaaccucag

SEQ ID NO: 461207 - RNA, 21 nt, Homo sapiens
aauaaagcugcugagaaucua

SEQ ID NO: 461208 - RNA, 14 nt, Homo sapiens
aauaaauacuuaag

SEQ ID NO: 461209 - RNA, 16 nt, Homo sapiens
aauaauuacuaauuaa

SEQ ID NO: 461210 - RNA, 19 nt, Homo sapiens
aaucauaaaacuugaugug

SEQ ID NO: 461211 - RNA, 23 nt, Homo sapiens
aaucugaaauaaaaggugcuguu

SEQ ID NO: 461212 - RNA, 13 nt, Homo sapiens
aaugacugucuaa

SEQ ID NO: 461213 - RNA, 22 nt, Homo sapiens
aaugcuguuuuaaaaacaaaga

SEQ ID NO: 461214 - RNA, 20 nt, Homo sapiens
aauguaacucuauaguuauu

SEQ ID NO: 461215 - RNA, 14 nt, Homo sapiens
accauuuacaguau

SEQ ID NO: 461216 - RNA, 22 nt, Homo sapiens
acccaauuaaguccuacuuuac

SEQ ID NO: 461217 - RNA, 18 nt, Homo sapiens
acccacucuccugugaga

SEQ ID NO: 461218 - RNA, 18 nt, Homo sapiens
accccgggcaagacuuuu

SEQ ID NO: 461219 - RNA, 16 nt, Homo sapiens
acccguccauggcugg

SEQ ID NO: 461220 - RNA, 21 nt, Homo sapiens
acccucugacuguauuugaga

SEQ ID NO: 461221 - RNA, 19 nt, Homo sapiens
accgucugagcccagcuca

SEQ ID NO: 461222 - RNA, 21 nt, Homo sapiens
accugaagugagaacccagcu

SEQ ID NO: 461223 - RNA, 14 nt, Homo sapiens
accugagacauauu

SEQ ID NO: 461224 - RNA, 17 nt, Homo sapiens
acgaggaggagugcaug

SEQ ID NO: 461225 - RNA, 18 nt, Homo sapiens
acgauuuugaacauacuu

SEQ ID NO: 461226 - RNA, 18 nt, Homo sapiens
acguaggugugacacuuu

SEQ ID NO: 461227 - RNA, 15 nt, Homo sapiens
acgucaacgugagcu

SEQ ID NO: 461228 - RNA, 22 nt, Homo sapiens
acucaauaaauacauguuaaau

SEQ ID NO: 461229 - RNA, 22 nt, Homo sapiens
acucauccuuuuuaaaugagac

SEQ ID NO: 461230 - RNA, 12 nt, Homo sapiens
acuccuugccau

SEQ ID NO: 461231 - RNA, 11 nt, Homo sapiens
acucucaggug

SEQ ID NO: 461232 - RNA, 13 nt, Homo sapiens
acugacacucauu

SEQ ID NO: 461233 - RNA, 17 nt, Homo sapiens
acugagccauccucagc

SEQ ID NO: 461234 - RNA, 16 nt, Homo sapiens
acugcuuuguauccau

SEQ ID NO: 461235 - RNA, 21 nt, Homo sapiens
acuggcccggaggacccagcu

SEQ ID NO: 461236 - RNA, 14 nt, Homo sapiens
acuuauuuuaauuc

SEQ ID NO: 461237 - RNA, 17 nt, Homo sapiens
acuucuuauacauuuga

SEQ ID NO: 461238 - RNA, 23 nt, Homo sapiens
acuugaggacacauguccagugg

SEQ ID NO: 461239 - RNA, 15 nt, Homo sapiens
agaaaaucaguaauu

SEQ ID NO: 461240 - RNA, 18 nt, Homo sapiens
agaaaaucaguaauugga

SEQ ID NO: 461241 - RNA, 16 nt, Homo sapiens
agaaaauuaguaauug

SEQ ID NO: 461242 - RNA, 18 nt, Homo sapiens
agaaaauuaguaauugua

SEQ ID NO: 461243 - RNA, 13 nt, Homo sapiens
agaaacagacugc

SEQ ID NO: 461244 - RNA, 19 nt, Homo sapiens
agaaacauucuuuccuaaa

SEQ ID NO: 461245 - RNA, 15 nt, Homo sapiens
agaaagcauugccag

SEQ ID NO: 461246 - RNA, 13 nt, Homo sapiens
agaaccagugcuu

SEQ ID NO: 461247 - RNA, 21 nt, Homo sapiens
agaacuccccuugaaaacugc

SEQ ID NO: 461248 - RNA, 16 nt, Homo sapiens
agaacuucucuuccca

SEQ ID NO: 461249 - RNA, 16 nt, Homo sapiens
agaagcuggcccugca

SEQ ID NO: 461250 - RNA, 13 nt, Homo sapiens
agaaucuagccuc

SEQ ID NO: 461251 - RNA, 18 nt, Homo sapiens
agaccaccucucaauauu

SEQ ID NO: 461252 - RNA, 24 nt, Homo sapiens
agaccagccugaccaacaugguga

SEQ ID NO: 461253 - RNA, 21 nt, Homo sapiens
agacuuaaucuugaaugauac

SEQ ID NO: 461254 - RNA, 18 nt, Homo sapiens
agagacaauaaaacauuc

SEQ ID NO: 461255 - RNA, 21 nt, Homo sapiens
agagacaauaaaacauuccug

SEQ ID NO: 461256 - RNA, 17 nt, Homo sapiens
agaggcagucagaggac

SEQ ID NO: 461257 - RNA, 19 nt, Homo sapiens
agagugagacucgucucaa

SEQ ID NO: 461258 - RNA, 18 nt, Homo sapiens
agaguggcuuccaucuca

SEQ ID NO: 461259 - RNA, 23 nt, Homo sapiens
agaucccauccaucagcucccuu

SEQ ID NO: 461260 - RNA, 23 nt, Homo sapiens
agaugcagucucugcugaucaca

SEQ ID NO: 461261 - RNA, 15 nt, Homo sapiens
agauuuggcccucau

SEQ ID NO: 461262 - RNA, 12 nt, Homo sapiens
agcacugacacu

SEQ ID NO: 461263 - RNA, 22 nt, Homo sapiens
agcagauggucccauuauucua

SEQ ID NO: 461264 - RNA, 24 nt, Homo sapiens
agcaguuggcuggaauguguucac

SEQ ID NO: 461265 - RNA, 21 nt, Homo sapiens
agcaugacauuggcaucagcu

SEQ ID NO: 461266 - RNA, 23 nt, Homo sapiens
agcauugccagcucuuccaaucu

SEQ ID NO: 461267 - RNA, 16 nt, Homo sapiens
agccacugacuugcuc

SEQ ID NO: 461268 - RNA, 15 nt, Homo sapiens
agcccugcugucaga

SEQ ID NO: 461269 - RNA, 21 nt, Homo sapiens
agccgagauugcaccacugca

SEQ ID NO: 461270 - RNA, 15 nt, Homo sapiens
agccgccaggacaca

SEQ ID NO: 461271 - RNA, 13 nt, Homo sapiens
agccucacuccuc

SEQ ID NO: 461272 - RNA, 14 nt, Homo sapiens
agccucacuccuca

SEQ ID NO: 461273 - RNA, 15 nt, Homo sapiens
agccucacuccucag

SEQ ID NO: 461274 - RNA, 19 nt, Homo sapiens
agccuccugcucugugaag

SEQ ID NO: 461275 - RNA, 19 nt, Homo sapiens
agccuucugugcugugagu

SEQ ID NO: 461276 - RNA, 15 nt, Homo sapiens
agcgaggagugacug

SEQ ID NO: 461277 - RNA, 15 nt, Homo sapiens
agcgauucuccugcc

SEQ ID NO: 461278 - RNA, 23 nt, Homo sapiens
agcgcugugugguaacucagugu

SEQ ID NO: 461279 - RNA, 20 nt, Homo sapiens
agcguuaccgccacacuuga

SEQ ID NO: 461280 - RNA, 21 nt, Homo sapiens
agcguuaccgccacacuugaa

SEQ ID NO: 461281 - RNA, 23 nt, Homo sapiens
agcucugcggcuugccacucuga

SEQ ID NO: 461282 - RNA, 20 nt, Homo sapiens
agcucuuucuucuuugaauu

SEQ ID NO: 461283 - RNA, 22 nt, Homo sapiens
agcugaucgacgaggaggagug

SEQ ID NO: 461284 - RNA, 20 nt, Homo sapiens
agcugcaccccggacgggcg

SEQ ID NO: 461285 - RNA, 20 nt, Homo sapiens
agcugcucggagcucagugc

SEQ ID NO: 461286 - RNA, 20 nt, Homo sapiens
agcuggcccugcagguggug

SEQ ID NO: 461287 - RNA, 13 nt, Homo sapiens
agcuggugcugug

SEQ ID NO: 461288 - RNA, 17 nt, Homo sapiens
agcuguucucauugcca

SEQ ID NO: 461289 - RNA, 23 nt, Homo sapiens
aggaaguuucuaguuuguguaac

SEQ ID NO: 461290 - RNA, 21 nt, Homo sapiens
aggaauuaagugaaaggucac

SEQ ID NO: 461291 - RNA, 15 nt, Homo sapiens
aggacaaaggugauu

SEQ ID NO: 461292 - RNA, 13 nt, Homo sapiens
aggacgagugcuu

SEQ ID NO: 461293 - RNA, 16 nt, Homo sapiens
aggacgauuucacuga

SEQ ID NO: 461294 - RNA, 15 nt, Homo sapiens
aggacguggugacuu

SEQ ID NO: 461295 - RNA, 16 nt, Homo sapiens
aggagguggguggaaa

SEQ ID NO: 461296 - RNA, 20 nt, Homo sapiens
aggaugauuguacagaauca

SEQ ID NO: 461297 - RNA, 14 nt, Homo sapiens
aggaugcucaguga

SEQ ID NO: 461298 - RNA, 16 nt, Homo sapiens
aggaugcugugugaga

SEQ ID NO: 461299 - RNA, 15 nt, Homo sapiens
aggauuccuuggcau

SEQ ID NO: 461300 - RNA, 13 nt, Homo sapiens
aaaaagacauaau

SEQ ID NO: 461301 - RNA, 22 nt, Homo sapiens
aaaacuugauguguuaucucuu

SEQ ID NO: 461302 - RNA, 11 nt, Homo sapiens
aaaagaccaag

SEQ ID NO: 461303 - RNA, 17 nt, Homo sapiens
aaaaguuguuuuaucca

SEQ ID NO: 461304 - RNA, 17 nt, Homo sapiens
aaaauacaaacauucua

SEQ ID NO: 461305 - RNA, 20 nt, Homo sapiens
aaaaugguguuuucauguaa

SEQ ID NO: 461306 - RNA, 21 nt, Homo sapiens
aaaaugucaguguuugggaaa

SEQ ID NO: 461307 - RNA, 14 nt, Homo sapiens
aaacaaucucccaa

SEQ ID NO: 461308 - RNA, 13 nt, Homo sapiens
aaacacaaaaacc

SEQ ID NO: 461309 - RNA, 19 nt, Homo sapiens
aaacagccucacuccucag

SEQ ID NO: 461310 - RNA, 15 nt, Homo sapiens
aaacauuccugugaa

SEQ ID NO: 461311 - RNA, 16 nt, Homo sapiens
aaaccagcaucugcac

SEQ ID NO: 461312 - RNA, 20 nt, Homo sapiens
aaaccagcaucugcaccuaa

SEQ ID NO: 461313 - RNA, 18 nt, Homo sapiens
aaacuauuuaugaauauu

SEQ ID NO: 461314 - RNA, 12 nt, Homo sapiens
aaacucacugaa

SEQ ID NO: 461315 - RNA, 19 nt, Homo sapiens
aaacucuucaggcaccuga

SEQ ID NO: 461316 - RNA, 12 nt, Homo sapiens
aaacugcagugu

SEQ ID NO: 461317 - RNA, 19 nt, Homo sapiens
aaagaaaauuaguaauugu

SEQ ID NO: 461318 - RNA, 22 nt, Homo sapiens
aaagaaucccuguucauuguaa

SEQ ID NO: 461319 - RNA, 17 nt, Homo sapiens
aaagagagcaagacaga

SEQ ID NO: 461320 - RNA, 15 nt, Homo sapiens
aaagcaguguuuuca

SEQ ID NO: 461321 - RNA, 22 nt, Homo sapiens
aaagcauugccagcucuuccaa

SEQ ID NO: 461322 - RNA, 22 nt, Homo sapiens
aaagccucagcaacagccagug

SEQ ID NO: 461323 - RNA, 22 nt, Homo sapiens
aaaggucauuuacaguuccaaa

SEQ ID NO: 461324 - RNA, 15 nt, Homo sapiens
aaagugcuccugaga

SEQ ID NO: 461325 - RNA, 14 nt, Homo sapiens
aaaguuaacuacac

SEQ ID NO: 461326 - RNA, 23 nt, Homo sapiens
aaauacaucuccaguacauuccg

SEQ ID NO: 461327 - RNA, 23 nt, Homo sapiens
aaauauaaaugaaaaucuauccu

SEQ ID NO: 461328 - RNA, 14 nt, Homo sapiens
aaauauaauugaca

SEQ ID NO: 461329 - RNA, 14 nt, Homo sapiens
aaauguaccugaga

SEQ ID NO: 461330 - RNA, 20 nt, Homo sapiens
aaauguaccugagacauauu

SEQ ID NO: 461331 - RNA, 15 nt, Homo sapiens
aaauuacacacuugc

SEQ ID NO: 461332 - RNA, 17 nt, Homo sapiens
aaauucauuaugcugcu

SEQ ID NO: 461333 - RNA, 17 nt, Homo sapiens
aaauugcuguuccuuaa

SEQ ID NO: 461334 - RNA, 13 nt, Homo sapiens
aacagccagugga

SEQ ID NO: 461335 - RNA, 15 nt, Homo sapiens
aacagccucacuccu

SEQ ID NO: 461336 - RNA, 22 nt, Homo sapiens
aacaucagcuucaauccuccau

SEQ ID NO: 461337 - RNA, 15 nt, Homo sapiens
aacaucuagcccuuu

SEQ ID NO: 461338 - RNA, 13 nt, Homo sapiens
aaccaaacggaac

SEQ ID NO: 461339 - RNA, 21 nt, Homo sapiens
aacccagcuguccguccucag

SEQ ID NO: 461340 - RNA, 22 nt, Homo sapiens
aaccuaagggggacacauccau

SEQ ID NO: 461341 - RNA, 18 nt, Homo sapiens
aaccuauuucacaaauca

SEQ ID NO: 461342 - RNA, 20 nt, Homo sapiens
aaccuccaccucccagguuc

SEQ ID NO: 461343 - RNA, 18 nt, Homo sapiens
aacguaggugugacacuu

SEQ ID NO: 461344 - RNA, 12 nt, Homo sapiens
aacuacagaugg

SEQ ID NO: 461345 - RNA, 15 nt, Homo sapiens
aacuccugaccucag

SEQ ID NO: 461346 - RNA, 19 nt, Homo sapiens
aacuccugaccucagguga

SEQ ID NO: 461347 - RNA, 21 nt, Homo sapiens
aacuccugaccucaggugaug

SEQ ID NO: 461348 - RNA, 19 nt, Homo sapiens
aacugaaguaucugucuca

SEQ ID NO: 461349 - RNA, 21 nt, Homo sapiens
aacugaauucugaacuuuuca

SEQ ID NO: 461350 - RNA, 19 nt, Homo sapiens
aacuugaggacacaugucc

SEQ ID NO: 461351 - RNA, 16 nt, Homo sapiens
aacuugggaacuacag

SEQ ID NO: 461352 - RNA, 16 nt, Homo sapiens
aacuuuccagcaguau

SEQ ID NO: 461353 - RNA, 13 nt, Homo sapiens
aagaaaacuuuga

SEQ ID NO: 461354 - RNA, 13 nt, Homo sapiens
aagacauaauuca

SEQ ID NO: 461355 - RNA, 15 nt, Homo sapiens
aagacauaauucaca

SEQ ID NO: 461356 - RNA, 12 nt, Homo sapiens
aagacauuugaa

SEQ ID NO: 461357 - RNA, 18 nt, Homo sapiens
aagagaaacauucuuucc

SEQ ID NO: 461358 - RNA, 13 nt, Homo sapiens
aagagucuucaaa

SEQ ID NO: 461359 - RNA, 17 nt, Homo sapiens
aagcagucuuuuucuac

SEQ ID NO: 461360 - RNA, 21 nt, Homo sapiens
aagcaguguuuucaccucaua

SEQ ID NO: 461361 - RNA, 20 nt, Homo sapiens
aagcauugccagcucuucca

SEQ ID NO: 461362 - RNA, 15 nt, Homo sapiens
aagcauuuugugaug

SEQ ID NO: 461363 - RNA, 16 nt, Homo sapiens
aagcauuuugugaugu

SEQ ID NO: 461364 - RNA, 21 nt, Homo sapiens
aagccucagcaacagccagug

SEQ ID NO: 461365 - RNA, 23 nt, Homo sapiens
aagccucagcaacagccagugga

SEQ ID NO: 461366 - RNA, 19 nt, Homo sapiens
aagcgauucuccugccuca

SEQ ID NO: 461367 - RNA, 22 nt, Homo sapiens
aagcggggagaggguacacaau

SEQ ID NO: 461368 - RNA, 21 nt, Homo sapiens
aagcugcugagaaucuagccu

SEQ ID NO: 461369 - RNA, 21 nt, Homo sapiens
aaggcaagagaaacauucuuu

SEQ ID NO: 461370 - RNA, 15 nt, Homo sapiens
aaggcagcucugucg

SEQ ID NO: 461371 - RNA, 20 nt, Homo sapiens
aaggccagucugaaccugag

SEQ ID NO: 461372 - RNA, 16 nt, Homo sapiens
aaggcuuuuggugaaa

SEQ ID NO: 461373 - RNA, 14 nt, Homo sapiens
aagggucacuuuaa

SEQ ID NO: 461374 - RNA, 16 nt, Homo sapiens
aaggucacacuaccau

SEQ ID NO: 461375 - RNA, 14 nt, Homo sapiens
aaggugauuuuccu

SEQ ID NO: 461376 - RNA, 19 nt, Homo sapiens
aagguucccucccacucua

SEQ ID NO: 461377 - RNA, 23 nt, Homo sapiens
aaguaugaucuaugcuauauuca

SEQ ID NO: 461378 - RNA, 23 nt, Homo sapiens
aaguggcagacagaagcuucucu

SEQ ID NO: 461379 - RNA, 18 nt, Homo sapiens
aaguguguuucuuucuaa

SEQ ID NO: 461380 - RNA, 19 nt, Homo sapiens
aaguucugguaugaacuug

SEQ ID NO: 461381 - RNA, 14 nt, Homo sapiens
aaguucuugacaga

SEQ ID NO: 461382 - RNA, 22 nt, Homo sapiens
aaguuuugcucuugucacccag

SEQ ID NO: 461383 - RNA, 22 nt, Homo sapiens
aauaaucauaaacuauauucug

SEQ ID NO: 461384 - RNA, 14 nt, Homo sapiens
aauacaaacauucu

SEQ ID NO: 461385 - RNA, 16 nt, Homo sapiens
aauacccucugacugu

SEQ ID NO: 461386 - RNA, 15 nt, Homo sapiens
aauacugggugcugu

SEQ ID NO: 461387 - RNA, 23 nt, Homo sapiens
aauauguuucucccccuuuccaa

SEQ ID NO: 461388 - RNA, 19 nt, Homo sapiens
aauauuccaggaugcugcu

SEQ ID NO: 461389 - RNA, 16 nt, Homo sapiens
aauauuuuuacagaag

SEQ ID NO: 461390 - RNA, 23 nt, Homo sapiens
aauccugcuccugacucggucaa

SEQ ID NO: 461391 - RNA, 22 nt, Homo sapiens
aaucucccaaguauugauuuaa

SEQ ID NO: 461392 - RNA, 14 nt, Homo sapiens
aaucucuugcacuc

SEQ ID NO: 461393 - RNA, 16 nt, Homo sapiens
aaucucuugcacucaa

SEQ ID NO: 461394 - RNA, 20 nt, Homo sapiens
aaucuuggcucgcaaccucc

SEQ ID NO: 461395 - RNA, 17 nt, Homo sapiens
aaugaagaaaacagaua

SEQ ID NO: 461396 - RNA, 22 nt, Homo sapiens
aaugauagaaacagacugccug

SEQ ID NO: 461397 - RNA, 15 nt, Homo sapiens
aaugcacacuuauuu

SEQ ID NO: 461398 - RNA, 16 nt, Homo sapiens
aaugcucagacuucau

SEQ ID NO: 461399 - RNA, 19 nt, Homo sapiens
aauggacaaacagugcacu

SEQ ID NO: 461400 - RNA, 21 nt, Homo sapiens
aauggugauacauucuagccu

SEQ ID NO: 461401 - RNA, 15 nt, Homo sapiens
aauguauaugucauu

SEQ ID NO: 461402 - RNA, 19 nt, Homo sapiens
aaugucaguguuugggaaa

SEQ ID NO: 461403 - RNA, 18 nt, Homo sapiens
ggacaucagaaagggaga

SEQ ID NO: 461404 - RNA, 19 nt, Homo sapiens
ggaccaauuagcauuccau

SEQ ID NO: 461405 - RNA, 12 nt, Homo sapiens
ggacgaggucaa

SEQ ID NO: 461406 - RNA, 11 nt, Homo sapiens
ggacugugucc

SEQ ID NO: 461407 - RNA, 22 nt, Homo sapiens
ggagaagaggcagauucaauuu

SEQ ID NO: 461408 - RNA, 15 nt, Homo sapiens
ggagaggguacacaa

SEQ ID NO: 461409 - RNA, 19 nt, Homo sapiens
ggagccuccaauugcagug

SEQ ID NO: 461410 - RNA, 22 nt, Homo sapiens
ggaggaccauuggcuugccaag

SEQ ID NO: 461411 - RNA, 14 nt, Homo sapiens
ggaguagaauacca

SEQ ID NO: 461412 - RNA, 18 nt, Homo sapiens
ggauuuuccaccaaauuc

SEQ ID NO: 461413 - RNA, 18 nt, Homo sapiens
ggcaaaguguaguguuau

SEQ ID NO: 461414 - RNA, 22 nt, Homo sapiens
ggcaauauaaggggaugaggaa

SEQ ID NO: 461415 - RNA, 13 nt, Homo sapiens
ggcaauaugaaau

SEQ ID NO: 461416 - RNA, 20 nt, Homo sapiens
ggcagcuggugcugugugac

SEQ ID NO: 461417 - RNA, 13 nt, Homo sapiens
ggcagucagagga

SEQ ID NO: 461418 - RNA, 14 nt, Homo sapiens
ggcaucauugugac

SEQ ID NO: 461419 - RNA, 12 nt, Homo sapiens
ggccacauucag

SEQ ID NO: 461420 - RNA, 14 nt, Homo sapiens
ggccuugcuugccc

SEQ ID NO: 461421 - RNA, 23 nt, Homo sapiens
ggcuggagugcaguggugcaauc

SEQ ID NO: 461422 - RNA, 21 nt, Homo sapiens
ggcugggaagaagcugcacuu

SEQ ID NO: 461423 - RNA, 13 nt, Homo sapiens
ggcuuugcagugc

SEQ ID NO: 461424 - RNA, 16 nt, Homo sapiens
gggaaaaguccuuggc

SEQ ID NO: 461425 - RNA, 17 nt, Homo sapiens
gggagagggcgagcaug

SEQ ID NO: 461426 - RNA, 13 nt, Homo sapiens
gggauuacaggcg

SEQ ID NO: 461427 - RNA, 14 nt, Homo sapiens
gggauuucauuuga

SEQ ID NO: 461428 - RNA, 22 nt, Homo sapiens
gggcgguccuacugcugugagc

SEQ ID NO: 461429 - RNA, 19 nt, Homo sapiens
ggggaaacgagcuguguag

SEQ ID NO: 461430 - RNA, 20 nt, Homo sapiens
ggggagccuucugugcugug

SEQ ID NO: 461431 - RNA, 14 nt, Homo sapiens
ggggcggugcaggg

SEQ ID NO: 461432 - RNA, 21 nt, Homo sapiens
ggucucuauacuacauuauua

SEQ ID NO: 461433 - RNA, 15 nt, Homo sapiens
ggugaagacccagag

SEQ ID NO: 461434 - RNA, 14 nt, Homo sapiens
gguggaguggugcu

SEQ ID NO: 461435 - RNA, 15 nt, Homo sapiens
gguggcugucccuuc

SEQ ID NO: 461436 - RNA, 13 nt, Homo sapiens
gguggguggcacu

SEQ ID NO: 461437 - RNA, 18 nt, Homo sapiens
gguuaucuuaaauagauc

SEQ ID NO: 461438 - RNA, 17 nt, Homo sapiens
gguuauuuuacauuaag

SEQ ID NO: 461439 - RNA, 22 nt, Homo sapiens
gguuuaagaacgaaggagaaaa

SEQ ID NO: 461440 - RNA, 12 nt, Homo sapiens
guaaaaacugca

SEQ ID NO: 461441 - RNA, 23 nt, Homo sapiens
guaaaaugcuguguccacggggu

SEQ ID NO: 461442 - RNA, 19 nt, Homo sapiens
guaaagaauuuagcuguau

SEQ ID NO: 461443 - RNA, 13 nt, Homo sapiens
guaaagccucagc

SEQ ID NO: 461444 - RNA, 22 nt, Homo sapiens
guaaagccucagcaacagccag

SEQ ID NO: 461445 - RNA, 15 nt, Homo sapiens
guaaauaaauacauu

SEQ ID NO: 461446 - RNA, 12 nt, Homo sapiens
guaacauuuuau

SEQ ID NO: 461447 - RNA, 22 nt, Homo sapiens
guaagucugcguugguucugaa

SEQ ID NO: 461448 - RNA, 22 nt, Homo sapiens
guacacacucagugacauuucu

SEQ ID NO: 461449 - RNA, 21 nt, Homo sapiens
guacagccuuuuauggaccaa

SEQ ID NO: 461450 - RNA, 19 nt, Homo sapiens
guacuaagaggcuauuuaa

SEQ ID NO: 461451 - RNA, 14 nt, Homo sapiens
guagacauacuugu

SEQ ID NO: 461452 - RNA, 16 nt, Homo sapiens
guagcccucacacugu

SEQ ID NO: 461453 - RNA, 16 nt, Homo sapiens
guagcugggauuacag

SEQ ID NO: 461454 - RNA, 23 nt, Homo sapiens
guauaaaaugguguuuucaugua

SEQ ID NO: 461455 - RNA, 10 nt, Homo sapiens
guauaaucuc

SEQ ID NO: 461456 - RNA, 15 nt, Homo sapiens
guauccucgcuggug

SEQ ID NO: 461457 - RNA, 19 nt, Homo sapiens
guauucccaccccuggacu

SEQ ID NO: 461458 - RNA, 21 nt, Homo sapiens
guauuucaggugaagcuggag

SEQ ID NO: 461459 - RNA, 18 nt, Homo sapiens
ccccaaaggaaacuacuc

SEQ ID NO: 461460 - RNA, 20 nt, Homo sapiens
ccccaccuugccaagcuuuc

SEQ ID NO: 461461 - RNA, 14 nt, Homo sapiens
ccccucucuuugag

SEQ ID NO: 461462 - RNA, 17 nt, Homo sapiens
cccugagcuugcagggu

SEQ ID NO: 461463 - RNA, 18 nt, Homo sapiens
cccugucucuacuaaaaa

SEQ ID NO: 461464 - RNA, 18 nt, Homo sapiens
cccuucucccaucagggu

SEQ ID NO: 461465 - RNA, 17 nt, Homo sapiens
gcacuuuuccuuuccaa

SEQ ID NO: 461466 - RNA, 14 nt, Homo sapiens
gcagacagugcaca

SEQ ID NO: 461467 - RNA, 17 nt, Homo sapiens
gcagagcaaaaggggaa

SEQ ID NO: 461468 - RNA, 21 nt, Homo sapiens
gcagagugagacucgucucaa

SEQ ID NO: 461469 - RNA, 17 nt, Homo sapiens
gcagcauuggugcucac

SEQ ID NO: 461470 - RNA, 19 nt, Homo sapiens
gcagcugggauuacaggug

SEQ ID NO: 461471 - RNA, 19 nt, Homo sapiens
gcaggaugauuguacagaa

SEQ ID NO: 461472 - RNA, 18 nt, Homo sapiens
gcauaaguuaacuuccaa

SEQ ID NO: 461473 - RNA, 22 nt, Homo sapiens
gcauagaucccauagugugcau

SEQ ID NO: 461474 - RNA, 13 nt, Homo sapiens
gcaucaucugcac

SEQ ID NO: 461475 - RNA, 15 nt, Homo sapiens
gcaugaauagauucu

SEQ ID NO: 461476 - RNA, 22 nt, Homo sapiens
gccaaaaacaacaaauagccac

SEQ ID NO: 461477 - RNA, 18 nt, Homo sapiens
gccaagagggacaucaga

SEQ ID NO: 461478 - RNA, 18 nt, Homo sapiens
uacaggugcgugccacca

SEQ ID NO: 461479 - RNA, 16 nt, Homo sapiens
uacaguaaauguuugu

SEQ ID NO: 461480 - RNA, 21 nt, Homo sapiens
uacauuuugaaggugaugcau

SEQ ID NO: 461481 - RNA, 12 nt, Homo sapiens
uaccagauuuga

SEQ ID NO: 461482 - RNA, 15 nt, Homo sapiens
uacccagagaccaag

SEQ ID NO: 461483 - RNA, 23 nt, Homo sapiens
uacccagagaccaagaucaucaa

SEQ ID NO: 461484 - RNA, 18 nt, Homo sapiens
uaccccuguuaagcaauu

SEQ ID NO: 461485 - RNA, 14 nt, Homo sapiens
uaccgucugugauu

SEQ ID NO: 461486 - RNA, 14 nt, Homo sapiens
uaccugagacauau

SEQ ID NO: 461487 - RNA, 17 nt, Homo sapiens
uacguguagauaauuaa

SEQ ID NO: 461488 - RNA, 19 nt, Homo sapiens
uacuagaucuuacaucugc

SEQ ID NO: 461489 - RNA, 18 nt, Homo sapiens
uacuccuugccauuuuca

SEQ ID NO: 461490 - RNA, 20 nt, Homo sapiens
uacuucagucuugaugcagu

SEQ ID NO: 461491 - RNA, 14 nt, Homo sapiens
uagaauuaugcugu

SEQ ID NO: 461492 - RNA, 13 nt, Homo sapiens
uagagaguugaga

SEQ ID NO: 461493 - RNA, 20 nt, Homo sapiens
uagagaguugagacuugcca

SEQ ID NO: 461494 - RNA, 16 nt, Homo sapiens
uagaucuuaggcaaaa

SEQ ID NO: 461495 - RNA, 14 nt, Homo sapiens
uagcauuccaucaa

SEQ ID NO: 461496 - RNA, 20 nt, Homo sapiens
uagccccuuagccaguugua

SEQ ID NO: 461497 - RNA, 20 nt, Homo sapiens
uaggagggcuggcaacuuag

SEQ ID NO: 461498 - RNA, 17 nt, Homo sapiens
uaggccuuccagugcag

SEQ ID NO: 461499 - RNA, 19 nt, Homo sapiens
uaggccuuccagugcagga

SEQ ID NO: 461500 - RNA, 23 nt, Homo sapiens
uaggugaccaugagaauugcugu

SEQ ID NO: 461501 - RNA, 15 nt, Homo sapiens
uaguagaauuuacaa

SEQ ID NO: 461502 - RNA, 17 nt, Homo sapiens
uagugauuuccuguaua

SEQ ID NO: 461503 - RNA, 21 nt, Homo sapiens
uagugugcaucauguuccuua

SEQ ID NO: 461504 - RNA, 21 nt, Homo sapiens
uaguugggggcuguccagagc

SEQ ID NO: 461505 - RNA, 20 nt, Homo sapiens
uauaaaaaacagccuguuga

SEQ ID NO: 461506 - RNA, 18 nt, Homo sapiens
uauaauuacaaugcacaa

SEQ ID NO: 461507 - RNA, 19 nt, Homo sapiens
uaucaaacuagugcaugaa

SEQ ID NO: 461508 - RNA, 19 nt, Homo sapiens
uaucacagcggggaugcuu

SEQ ID NO: 461509 - RNA, 19 nt, Homo sapiens
uaugaaucacagcugccag

SEQ ID NO: 461510 - RNA, 22 nt, Homo sapiens
uaugaguguaguugaugacugu

SEQ ID NO: 461511 - RNA, 20 nt, Homo sapiens
uaugaucuaugcuauauuca

SEQ ID NO: 461512 - RNA, 20 nt, Homo sapiens
uaugccuugguaaaaacugc

SEQ ID NO: 461513 - RNA, 12 nt, Homo sapiens
uauguuucuccc

SEQ ID NO: 461514 - RNA, 16 nt, Homo sapiens
uauuaaaauaucccaa

SEQ ID NO: 461515 - RNA, 17 nt, Homo sapiens
uauuacuccuugccauu

SEQ ID NO: 461516 - RNA, 16 nt, Homo sapiens
uauuccaggaugcugc

SEQ ID NO: 461517 - RNA, 19 nt, Homo sapiens
uauugguuugagaacuucu

SEQ ID NO: 461518 - RNA, 12 nt, Homo sapiens
uauuucagaaau

SEQ ID NO: 461519 - RNA, 19 nt, Homo sapiens
uauuucaggugaagcugga

SEQ ID NO: 461520 - RNA, 16 nt, Homo sapiens
uauuuuuuaaagucua

SEQ ID NO: 461521 - RNA, 14 nt, Homo sapiens
ucaaagaggccuua

SEQ ID NO: 461522 - RNA, 16 nt, Homo sapiens
ucaaauacaucuccag

SEQ ID NO: 461523 - RNA, 19 nt, Homo sapiens
ucaagaaaugacugaggua

SEQ ID NO: 461524 - RNA, 22 nt, Homo sapiens
ucaagagauucuccugccucag

SEQ ID NO: 461525 - RNA, 14 nt, Homo sapiens
ucaaggagauauga

SEQ ID NO: 461526 - RNA, 21 nt, Homo sapiens
ucaagguucccucccacucua

SEQ ID NO: 461527 - RNA, 22 nt, Homo sapiens
ucaauaccccuguuaagcaauu

SEQ ID NO: 461528 - RNA, 16 nt, Homo sapiens
ucaauuuuauaucuag

SEQ ID NO: 461529 - RNA, 22 nt, Homo sapiens
ucacaggacgauuucacugaca

SEQ ID NO: 461530 - RNA, 17 nt, Homo sapiens
ucacucugcucucagga

SEQ ID NO: 461531 - RNA, 16 nt, Homo sapiens
ucacugccagugcaga

SEQ ID NO: 461532 - RNA, 14 nt, Homo sapiens
ucagaguccuugca

SEQ ID NO: 461533 - RNA, 16 nt, Homo sapiens
ucagaguccuugcaaa

SEQ ID NO: 461534 - RNA, 19 nt, Homo sapiens
ucaggagaucuggcuguga

SEQ ID NO: 461535 - RNA, 20 nt, Homo sapiens
ucaggagaucuggcugugag

SEQ ID NO: 461536 - RNA, 15 nt, Homo sapiens
ucagggcagggauac

SEQ ID NO: 461537 - RNA, 15 nt, Homo sapiens
ucaguguuugggaaa

SEQ ID NO: 461538 - RNA, 16 nt, Homo sapiens
ucaguuugcaaauaga

SEQ ID NO: 461539 - RNA, 16 nt, Homo sapiens
ucauaaacuauauucu

SEQ ID NO: 461540 - RNA, 15 nt, Homo sapiens
ucaucuccaaaaaca

SEQ ID NO: 461541 - RNA, 19 nt, Homo sapiens
ucauguaaccaagaguauu

SEQ ID NO: 461542 - RNA, 22 nt, Homo sapiens
ucauguugaagucaaauuugga

SEQ ID NO: 461543 - RNA, 22 nt, Homo sapiens
ucauuaccgucugugauugcca

SEQ ID NO: 461544 - RNA, 16 nt, Homo sapiens
ucauugaaacuacacu

SEQ ID NO: 461545 - RNA, 23 nt, Homo sapiens
ucauuuugggaccuauaucucag

SEQ ID NO: 461546 - RNA, 22 nt, Homo sapiens
ucauuuuuuuguacuaauguga

SEQ ID NO: 461547 - RNA, 12 nt, Homo sapiens
uccaaaaacugu

SEQ ID NO: 461548 - RNA, 22 nt, Homo sapiens
uccaagucuuccugaccaccuu

SEQ ID NO: 461549 - RNA, 22 nt, Homo sapiens
uccaaugcugaaugccuguuag

SEQ ID NO: 461550 - RNA, 15 nt, Homo sapiens
uccacaucuaacaaa

SEQ ID NO: 461551 - RNA, 11 nt, Homo sapiens
uccagugcagg

SEQ ID NO: 461552 - RNA, 23 nt, Homo sapiens
uccaugacugcauuuuacuguac

SEQ ID NO: 461553 - RNA, 14 nt, Homo sapiens
ucccauccaucagc

SEQ ID NO: 461554 - RNA, 16 nt, Homo sapiens
uccccuugaaaacugc

SEQ ID NO: 461555 - RNA, 19 nt, Homo sapiens
ucccuaagugcaacugcaa

SEQ ID NO: 461556 - RNA, 20 nt, Homo sapiens
uccugagcagcugggauuac

SEQ ID NO: 461557 - RNA, 22 nt, Homo sapiens
uccugcaauaaaauaguagcau

SEQ ID NO: 461558 - RNA, 15 nt, Homo sapiens
uccugccccaggugu

SEQ ID NO: 461559 - RNA, 22 nt, Homo sapiens
uccugccucagccuccugagca

SEQ ID NO: 461560 - RNA, 20 nt, Homo sapiens
uccugccugggccuuggcaa

SEQ ID NO: 461561 - RNA, 20 nt, Homo sapiens
uccuguuuuugucauguuua

SEQ ID NO: 461562 - RNA, 22 nt, Homo sapiens
uccuucccucaaagaggccuua

SEQ ID NO: 461563 - RNA, 16 nt, Homo sapiens
uccuucuuaacucucu

SEQ ID NO: 461564 - RNA, 22 nt, Homo sapiens
uccuucuuaacucucuguuaca

SEQ ID NO: 461565 - RNA, 19 nt, Homo sapiens
ucgaacuccugaccucagg

SEQ ID NO: 461566 - RNA, 24 nt, Homo sapiens
ucgcaaccuccgccucccagguuc

SEQ ID NO: 461567 - RNA, 12 nt, Homo sapiens
ucuacacuguau

SEQ ID NO: 461568 - RNA, 17 nt, Homo sapiens
ucuacacuguauuacau

SEQ ID NO: 461569 - RNA, 22 nt, Homo sapiens
ucuagggacaggccgggcagug

SEQ ID NO: 461570 - RNA, 11 nt, Homo sapiens
ucuauccuuua

SEQ ID NO: 461571 - RNA, 23 nt, Homo sapiens
ucuaucucucuuuacauuuuggu

SEQ ID NO: 461572 - RNA, 13 nt, Homo sapiens
ucucaucucugua

SEQ ID NO: 461573 - RNA, 17 nt, Homo sapiens
ucucaucucuguauucc

SEQ ID NO: 461574 - RNA, 18 nt, Homo sapiens
ucuccagugugaauauau

SEQ ID NO: 461575 - RNA, 20 nt, Homo sapiens
ucucccaucaggguccccag

SEQ ID NO: 461576 - RNA, 13 nt, Homo sapiens
ucuccugccucag

SEQ ID NO: 461577 - RNA, 16 nt, Homo sapiens
ucucgaacuccugacc

SEQ ID NO: 461578 - RNA, 14 nt, Homo sapiens
ucucgccaucagcu

SEQ ID NO: 461579 - RNA, 21 nt, Homo sapiens
ucucggcccugcccagcuuug

SEQ ID NO: 461580 - RNA, 21 nt, Homo sapiens
ucucuaucauguugaagucaa

SEQ ID NO: 461581 - RNA, 18 nt, Homo sapiens
ucucuugcacucaaagcu

SEQ ID NO: 461582 - RNA, 20 nt, Homo sapiens
ucugaggcagaugagcuuac

SEQ ID NO: 461583 - RNA, 19 nt, Homo sapiens
ucugcaaccuugaagacua

SEQ ID NO: 461584 - RNA, 13 nt, Homo sapiens
ucugcacugccca

SEQ ID NO: 461585 - RNA, 19 nt, Homo sapiens
ucuggccuuguaucuugca

SEQ ID NO: 461586 - RNA, 16 nt, Homo sapiens
ucugugauugccauuu

SEQ ID NO: 461587 - RNA, 12 nt, Homo sapiens
ucuuaaacuaca

SEQ ID NO: 461588 - RNA, 16 nt, Homo sapiens
ucuuaacucucuguua

SEQ ID NO: 461589 - RNA, 20 nt, Homo sapiens
ucuucaaaaacgcacugcaa

SEQ ID NO: 461590 - RNA, 21 nt, Homo sapiens
ucuuccugaccaccuugcacu

SEQ ID NO: 461591 - RNA, 23 nt, Homo sapiens
ucuucucaagcacugacacucau

SEQ ID NO: 461592 - RNA, 18 nt, Homo sapiens
ucuucucuguuauuccug

SEQ ID NO: 461593 - RNA, 23 nt, Homo sapiens
ucuucuuugacuauaacaaaauc

SEQ ID NO: 461594 - RNA, 14 nt, Homo sapiens
ucuugucacccagg

SEQ ID NO: 461595 - RNA, 18 nt, Homo sapiens
ucuuugacuauaacaaaa

SEQ ID NO: 461596 - RNA, 16 nt, Homo sapiens
ucuuugagucaaguca

SEQ ID NO: 461597 - RNA, 17 nt, Homo sapiens
ugaacuacaguaaaugu

SEQ ID NO: 461598 - RNA, 17 nt, Homo sapiens
ugaaggaauguauuucu

SEQ ID NO: 461599 - RNA, 16 nt, Homo sapiens
ugaauuguuccucaga

SEQ ID NO: 461600 - RNA, 14 nt, Homo sapiens
ugaccucaggugau

SEQ ID NO: 461601 - RNA, 18 nt, Homo sapiens
ugaccuuuguaguagaau

SEQ ID NO: 461602 - RNA, 19 nt, Homo sapiens
ugacucaacgagagcacuu

SEQ ID NO: 461603 - RNA, 18 nt, Homo sapiens
ugacuccagguguaguua

SEQ ID NO: 461604 - RNA, 13 nt, Homo sapiens
aagcagacuggau

SEQ ID NO: 461605 - RNA, 19 nt, Homo sapiens
aagcaguugagauucucua

SEQ ID NO: 461606 - RNA, 21 nt, Homo sapiens
aagcugcucggagcucagugc

SEQ ID NO: 461607 - RNA, 13 nt, Homo sapiens
aagcuugcugcuc

SEQ ID NO: 461608 - RNA, 17 nt, Homo sapiens
aaggaguagaauaccaa

SEQ ID NO: 461609 - RNA, 22 nt, Homo sapiens
aagggagguucaccugcagcga

SEQ ID NO: 461610 - RNA, 21 nt, Homo sapiens
aagguccaguucuacagagug

SEQ ID NO: 461611 - RNA, 17 nt, Homo sapiens
aagguucccucccacuc

SEQ ID NO: 461612 - RNA, 15 nt, Homo sapiens
aaguauuccuuuccu

SEQ ID NO: 461613 - RNA, 22 nt, Homo sapiens
aagucaaauauguagauugccu

SEQ ID NO: 461614 - RNA, 21 nt, Homo sapiens
aagucaaauuuggauuuucca

SEQ ID NO: 461615 - RNA, 23 nt, Homo sapiens
aagucugagcgaggagugacugc

SEQ ID NO: 461616 - RNA, 18 nt, Homo sapiens
aagucuggagcacccuga

SEQ ID NO: 461617 - RNA, 20 nt, Homo sapiens
aagugcagggauuacaggca

SEQ ID NO: 461618 - RNA, 22 nt, Homo sapiens
aagugcagggauuacaggcaug

SEQ ID NO: 461619 - RNA, 15 nt, Homo sapiens
aaguuauucuugaca

SEQ ID NO: 461620 - RNA, 19 nt, Homo sapiens
aauaaacacauacaaugaa

SEQ ID NO: 461621 - RNA, 22 nt, Homo sapiens
aauaaugaaguuauucuugaca

SEQ ID NO: 461622 - RNA, 18 nt, Homo sapiens
aauaccccuguuaagcaa

SEQ ID NO: 461623 - RNA, 19 nt, Homo sapiens
aauaccccuguuaagcaau

SEQ ID NO: 461624 - RNA, 22 nt, Homo sapiens
aauacccguugauaacucagug

SEQ ID NO: 461625 - RNA, 16 nt, Homo sapiens
aauauguauuuauguc

SEQ ID NO: 461626 - RNA, 22 nt, Homo sapiens
aaucaacccaauaauucuguau

SEQ ID NO: 461627 - RNA, 16 nt, Homo sapiens
aaucauaaaacuugau

SEQ ID NO: 461628 - RNA, 12 nt, Homo sapiens
aaucuccucuga

SEQ ID NO: 461629 - RNA, 16 nt, Homo sapiens
aaucucucuccuguau

SEQ ID NO: 461630 - RNA, 16 nt, Homo sapiens
aaucuuagaaaauuaa

SEQ ID NO: 461631 - RNA, 21 nt, Homo sapiens
aaugauacgauuaugcccaau

SEQ ID NO: 461632 - RNA, 17 nt, Homo sapiens
aaugauguaauauucca

SEQ ID NO: 461633 - RNA, 23 nt, Homo sapiens
aauggguaucuaauaaauacuua

SEQ ID NO: 461634 - RNA, 21 nt, Homo sapiens
aauggguuuuguguacuguaa

SEQ ID NO: 461635 - RNA, 20 nt, Homo sapiens
aauuaaaauuacacacuugc

SEQ ID NO: 461636 - RNA, 16 nt, Homo sapiens
aauuaaaggcuuugca

SEQ ID NO: 461637 - RNA, 18 nt, Homo sapiens
aauuaaguccuacuuuac

SEQ ID NO: 461638 - RNA, 19 nt, Homo sapiens
aauuacaauauguauuuau

SEQ ID NO: 461639 - RNA, 14 nt, Homo sapiens
aauucagaguccuu

SEQ ID NO: 461640 - RNA, 23 nt, Homo sapiens
aauucguucuguaaggagcacca

SEQ ID NO: 461641 - RNA, 16 nt, Homo sapiens
aauucugaacuuuuca

SEQ ID NO: 461642 - RNA, 13 nt, Homo sapiens
aauucuucugccu

SEQ ID NO: 461643 - RNA, 18 nt, Homo sapiens
aauucuucuucucaagca

SEQ ID NO: 461644 - RNA, 13 nt, Homo sapiens
aauugacaggauu

SEQ ID NO: 461645 - RNA, 16 nt, Homo sapiens
aauugcuguuccuuaa

SEQ ID NO: 461646 - RNA, 23 nt, Homo sapiens
aauuuaauucuuguucuuugcac

SEQ ID NO: 461647 - RNA, 22 nt, Homo sapiens
aauuuacaacuuauaauuacaa

SEQ ID NO: 461648 - RNA, 15 nt, Homo sapiens
aauuuauaauuacaa

SEQ ID NO: 461649 - RNA, 18 nt, Homo sapiens
aauuucuccgaaugucaa

SEQ ID NO: 461650 - RNA, 17 nt, Homo sapiens
acaaaagccugugcagg

SEQ ID NO: 461651 - RNA, 13 nt, Homo sapiens
acaaacagugcac

SEQ ID NO: 461652 - RNA, 14 nt, Homo sapiens
acaacuuauaauua

SEQ ID NO: 461653 - RNA, 20 nt, Homo sapiens
acaagugcugggucugucac

SEQ ID NO: 461654 - RNA, 19 nt, Homo sapiens
acaauggguaucuaauaaa

SEQ ID NO: 461655 - RNA, 20 nt, Homo sapiens
acaauuuauaauuacaauau

SEQ ID NO: 461656 - RNA, 16 nt, Homo sapiens
acacaaccauagccug

SEQ ID NO: 461657 - RNA, 14 nt, Homo sapiens
acacauacaaugaa

SEQ ID NO: 461658 - RNA, 19 nt, Homo sapiens
acacauuaauaaacaaucu

SEQ ID NO: 461659 - RNA, 24 nt, Homo sapiens
acacauuaauaaacaaucucccaa

SEQ ID NO: 461660 - RNA, 21 nt, Homo sapiens
acacccccaccuccugcaaua

SEQ ID NO: 461661 - RNA, 16 nt, Homo sapiens
acagagccaugacuca

SEQ ID NO: 461662 - RNA, 15 nt, Homo sapiens
acagagucugugucc

SEQ ID NO: 461663 - RNA, 12 nt, Homo sapiens
acagcuaauaau

SEQ ID NO: 461664 - RNA, 14 nt, Homo sapiens
acaggaagugacaa

SEQ ID NO: 461665 - RNA, 15 nt, Homo sapiens
acaggcaugagccac

SEQ ID NO: 461666 - RNA, 19 nt, Homo sapiens
acaggccgggcaguguccc

SEQ ID NO: 461667 - RNA, 19 nt, Homo sapiens
acaggccucaucuuuuugg

SEQ ID NO: 461668 - RNA, 21 nt, Homo sapiens
acagggcuguugucauuugua

SEQ ID NO: 461669 - RNA, 19 nt, Homo sapiens
acaguacagcuauuucuca

SEQ ID NO: 461670 - RNA, 20 nt, Homo sapiens
acaguagagagaacauggag

SEQ ID NO: 461671 - RNA, 21 nt, Homo sapiens
acagugcccuuuucaucucca

SEQ ID NO: 461672 - RNA, 21 nt, Homo sapiens
acauacucugcuuagaauuug

SEQ ID NO: 461673 - RNA, 15 nt, Homo sapiens
acaucagaaagggag

SEQ ID NO: 461674 - RNA, 12 nt, Homo sapiens
acaucucagugc

SEQ ID NO: 461675 - RNA, 21 nt, Homo sapiens
guaaagacucuaucuugaaag

SEQ ID NO: 461676 - RNA, 23 nt, Homo sapiens
guaaguuaggaacgaacauguua

SEQ ID NO: 461677 - RNA, 19 nt, Homo sapiens
guaauguauucuaucucuc

SEQ ID NO: 461678 - RNA, 16 nt, Homo sapiens
guacagauugcugcuu

SEQ ID NO: 461679 - RNA, 17 nt, Homo sapiens
guacugaugacacacca

SEQ ID NO: 461680 - RNA, 12 nt, Homo sapiens
guagacauacuu

SEQ ID NO: 461681 - RNA, 12 nt, Homo sapiens
guagcugggauu

SEQ ID NO: 461682 - RNA, 18 nt, Homo sapiens
guagcugggauuacaggc

SEQ ID NO: 461683 - RNA, 19 nt, Homo sapiens
guaggccuuccagugcagg

SEQ ID NO: 461684 - RNA, 16 nt, Homo sapiens
guaguugaugacuguu

SEQ ID NO: 461685 - RNA, 20 nt, Homo sapiens
guaguuuacgcggagcacuu

SEQ ID NO: 461686 - RNA, 17 nt, Homo sapiens
guauacagaccagguga

SEQ ID NO: 461687 - RNA, 21 nt, Homo sapiens
guaucugucucauccaaaaag

SEQ ID NO: 461688 - RNA, 17 nt, Homo sapiens
guauuaaaauaucccaa

SEQ ID NO: 461689 - RNA, 17 nt, Homo sapiens
gucaaguuggauuugaa

SEQ ID NO: 461690 - RNA, 23 nt, Homo sapiens
gucaauaccccuguuaagcaauu

SEQ ID NO: 461691 - RNA, 18 nt, Homo sapiens
gucacaggacgauuucac

SEQ ID NO: 461692 - RNA, 23 nt, Homo sapiens
gucacaggacgauuucacugaca

SEQ ID NO: 461693 - RNA, 18 nt, Homo sapiens
gucaccggucagugccuu

SEQ ID NO: 461694 - RNA, 22 nt, Homo sapiens
gucaguugccaaauaucuugau

SEQ ID NO: 461695 - RNA, 23 nt, Homo sapiens
gucauuuugggaccuauaucuca

SEQ ID NO: 461696 - RNA, 17 nt, Homo sapiens
guccagaucuacacagc

SEQ ID NO: 461697 - RNA, 14 nt, Homo sapiens
guccugaggggcug

SEQ ID NO: 461698 - RNA, 17 nt, Homo sapiens
guccuuggcucguuuga

SEQ ID NO: 461699 - RNA, 16 nt, Homo sapiens
gucuggagcacccuga

SEQ ID NO: 461700 - RNA, 13 nt, Homo sapiens
gugaccaugagaa

SEQ ID NO: 461701 - RNA, 17 nt, Homo sapiens
gugaucauuacucugcu

SEQ ID NO: 461702 - RNA, 14 nt, Homo sapiens
gugcagaaacuacc

SEQ ID NO: 461703 - RNA, 19 nt, Homo sapiens
gugcaguggcacgaucuca

SEQ ID NO: 461704 - RNA, 11 nt, Homo sapiens
gugcugggauu

SEQ ID NO: 461705 - RNA, 22 nt, Homo sapiens
guggcucuugccuguaauccca

SEQ ID NO: 461706 - RNA, 22 nt, Homo sapiens
guguuuggaaaauuguguauga

SEQ ID NO: 461707 - RNA, 23 nt, Homo sapiens
guuaaaaucuuagaaaauuaaau

SEQ ID NO: 461708 - RNA, 13 nt, Homo sapiens
guuacugugccca

SEQ ID NO: 461709 - RNA, 18 nt, Homo sapiens
guuagaagacgacugugg

SEQ ID NO: 461710 - RNA, 20 nt, Homo sapiens
guuaguuuauuugagcacuu

SEQ ID NO: 461711 - RNA, 15 nt, Homo sapiens
guuaugggcacuggu

SEQ ID NO: 461712 - RNA, 22 nt, Homo sapiens
guucuaaaaacguaaguacucc

SEQ ID NO: 461713 - RNA, 15 nt, Homo sapiens
guucucagagacuca

SEQ ID NO: 461714 - RNA, 12 nt, Homo sapiens
guugggcaauau

SEQ ID NO: 461715 - RNA, 23 nt, Homo sapiens
guuucguguguaaagagagcaag

SEQ ID NO: 461716 - RNA, 23 nt, Homo sapiens
guuucucccccuuuccaaaaacu

SEQ ID NO: 461717 - RNA, 15 nt, Homo sapiens
guuugauccaguuga

SEQ ID NO: 461718 - RNA, 23 nt, Homo sapiens
guuugugauguuuccaaugcuga

SEQ ID NO: 461719 - RNA, 18 nt, Homo sapiens
guuuuauguucuagugau

SEQ ID NO: 461720 - RNA, 15 nt, Homo sapiens
uaaaaaaagacauaa

SEQ ID NO: 461721 - RNA, 22 nt, Homo sapiens
uaaaaaaagacauaauucacac

SEQ ID NO: 461722 - RNA, 14 nt, Homo sapiens
uaaaauaguagcau

SEQ ID NO: 461723 - RNA, 21 nt, Homo sapiens
uaaaaugguguuuucauguaa

SEQ ID NO: 461724 - RNA, 12 nt, Homo sapiens
uaaacucuucca

SEQ ID NO: 461725 - RNA, 22 nt, Homo sapiens
uaaagcaguguuuucaccucau

SEQ ID NO: 461726 - RNA, 13 nt, Homo sapiens
uaaauacauuuau

SEQ ID NO: 461727 - RNA, 19 nt, Homo sapiens
uaaauguauaugucauuua

SEQ ID NO: 461728 - RNA, 18 nt, Homo sapiens
uaacacguccacuuucaa

SEQ ID NO: 461729 - RNA, 16 nt, Homo sapiens
uaacuacacagaggac

SEQ ID NO: 461730 - RNA, 15 nt, Homo sapiens
uaagugcaacugcaa

SEQ ID NO: 461731 - RNA, 20 nt, Homo sapiens
uaauccugguggucuugccu

SEQ ID NO: 461732 - RNA, 19 nt, Homo sapiens
uaaucgaaguaauuuuggg

SEQ ID NO: 461733 - RNA, 20 nt, Homo sapiens
uaaugaguuuuucuguuauc

SEQ ID NO: 461734 - RNA, 17 nt, Homo sapiens
uaaugugaagcaaaaca

SEQ ID NO: 461735 - RNA, 14 nt, Homo sapiens
uaauuaauuucaaa

SEQ ID NO: 461736 - RNA, 21 nt, Homo sapiens
uacacaauggguaucuaauaa

SEQ ID NO: 461737 - RNA, 21 nt, Homo sapiens
uacacacucagugacauuucu

SEQ ID NO: 461738 - RNA, 18 nt, Homo sapiens
uacacacuugcaugacaa

SEQ ID NO: 461739 - RNA, 13 nt, Homo sapiens
uacaccugaguca

SEQ ID NO: 461740 - RNA, 18 nt, Homo sapiens
uacaccuuccuacauuuu

SEQ ID NO: 461741 - RNA, 16 nt, Homo sapiens
uacagacauuaaauaa

SEQ ID NO: 461742 - RNA, 13 nt, Homo sapiens
uacagagugagac

SEQ ID NO: 461743 - RNA, 18 nt, Homo sapiens
uacagauugcugcuucug

SEQ ID NO: 461744 - RNA, 13 nt, Homo sapiens
aaaaagaccaaga

SEQ ID NO: 461745 - RNA, 15 nt, Homo sapiens
aaaaccuugguuauc

SEQ ID NO: 461746 - RNA, 23 nt, Homo sapiens
aaaagaaucccuguucauuguaa

SEQ ID NO: 461747 - RNA, 16 nt, Homo sapiens
aaaagacauaauucac

SEQ ID NO: 461748 - RNA, 13 nt, Homo sapiens
aaaauuuaccuaa

SEQ ID NO: 461749 - RNA, 14 nt, Homo sapiens
aaacagccucacuc

SEQ ID NO: 461750 - RNA, 20 nt, Homo sapiens
aaaccgccccaaucccucag

SEQ ID NO: 461751 - RNA, 21 nt, Homo sapiens
aaacguaaguacuccauugua

SEQ ID NO: 461752 - RNA, 22 nt, Homo sapiens
aaagauuguuuuauauguagua

SEQ ID NO: 461753 - RNA, 14 nt, Homo sapiens
aaagccucucacua

SEQ ID NO: 461754 - RNA, 14 nt, Homo sapiens
aaagggcaaaaaga

SEQ ID NO: 461755 - RNA, 17 nt, Homo sapiens
aaaggucacacuaccau

SEQ ID NO: 461756 - RNA, 15 nt, Homo sapiens
aaaguuuuaaccuca

SEQ ID NO: 461757 - RNA, 19 nt, Homo sapiens
aaauaacaaaauaguuacu

SEQ ID NO: 461758 - RNA, 18 nt, Homo sapiens
aaauaccauuuacaguau

SEQ ID NO: 461759 - RNA, 15 nt, Homo sapiens
aaauaguuacugugc

SEQ ID NO: 461760 - RNA, 17 nt, Homo sapiens
aaauauggccuuucuuc

SEQ ID NO: 461761 - RNA, 21 nt, Homo sapiens
aaaucaccaccgacugaagug

SEQ ID NO: 461762 - RNA, 22 nt, Homo sapiens
aaaucccuaagugcaacugcaa

SEQ ID NO: 461763 - RNA, 14 nt, Homo sapiens
aaaugccaauaaca

SEQ ID NO: 461764 - RNA, 19 nt, Homo sapiens
aaauuuggggggucuugca

SEQ ID NO: 461765 - RNA, 16 nt, Homo sapiens
aaauuuuaagaccaag

SEQ ID NO: 461766 - RNA, 16 nt, Homo sapiens
aacacaaccauagccu

SEQ ID NO: 461767 - RNA, 12 nt, Homo sapiens
aacaugacacuu

SEQ ID NO: 461768 - RNA, 15 nt, Homo sapiens
aacauuccugugaaa

SEQ ID NO: 461769 - RNA, 13 nt, Homo sapiens
aaccagucugaag

SEQ ID NO: 461770 - RNA, 17 nt, Homo sapiens
aaccccgggcaagacuu

SEQ ID NO: 461771 - RNA, 13 nt, Homo sapiens
aacuccccuugaa

SEQ ID NO: 461772 - RNA, 16 nt, Homo sapiens
aacuccugaccucagg

SEQ ID NO: 461773 - RNA, 22 nt, Homo sapiens
aacuguucuggccucagaccaa

SEQ ID NO: 461774 - RNA, 23 nt, Homo sapiens
aacuucauuuuucuaauaaucau

SEQ ID NO: 461775 - RNA, 23 nt, Homo sapiens
aacuugaggacacauguccagug

SEQ ID NO: 461776 - RNA, 23 nt, Homo sapiens
aacuugguacuaucuuauucuga

SEQ ID NO: 461777 - RNA, 14 nt, Homo sapiens
aagaacgucauuuu

SEQ ID NO: 461778 - RNA, 21 nt, Homo sapiens
aagaauguguuaugaaucggu

SEQ ID NO: 461779 - RNA, 19 nt, Homo sapiens
aagagauucuccugccuca

SEQ ID NO: 461780 - RNA, 17 nt, Homo sapiens
auuauuacuccuugcca

SEQ ID NO: 461781 - RNA, 18 nt, Homo sapiens
auuauuacuccuugccau

SEQ ID NO: 461782 - RNA, 16 nt, Homo sapiens
auucaguaaauuuugg

SEQ ID NO: 461783 - RNA, 17 nt, Homo sapiens
auucccggcuggacuuu

SEQ ID NO: 461784 - RNA, 20 nt, Homo sapiens
auucccggcuggacuuuugc

SEQ ID NO: 461785 - RNA, 21 nt, Homo sapiens
auuccucggggauagaccaaa

SEQ ID NO: 461786 - RNA, 23 nt, Homo sapiens
auucuucuucucaagcacugaca

SEQ ID NO: 461787 - RNA, 18 nt, Homo sapiens
auuggaaauuuguuauaa

SEQ ID NO: 461788 - RNA, 14 nt, Homo sapiens
auuggcucugcuca

SEQ ID NO: 461789 - RNA, 22 nt, Homo sapiens
auuguaaacagcuaauaaugaa

SEQ ID NO: 461790 - RNA, 20 nt, Homo sapiens
auuguaacaugacacuuaga

SEQ ID NO: 461791 - RNA, 23 nt, Homo sapiens
auuuaauccgucacauucaucuc

SEQ ID NO: 461792 - RNA, 13 nt, Homo sapiens
auuuaaucugcug

SEQ ID NO: 461793 - RNA, 20 nt, Homo sapiens
auuuacauacucugcuuaga

SEQ ID NO: 461794 - RNA, 15 nt, Homo sapiens
auuuauaauuacaau

SEQ ID NO: 461795 - RNA, 18 nt, Homo sapiens
auuuauauaauacauuaa

SEQ ID NO: 461796 - RNA, 21 nt, Homo sapiens
auuucauaagaaccucaaaau

SEQ ID NO: 461797 - RNA, 17 nt, Homo sapiens
auuucuccgaaugucaa

SEQ ID NO: 461798 - RNA, 18 nt, Homo sapiens
auuuuaauuccacuuuaa

SEQ ID NO: 461799 - RNA, 13 nt, Homo sapiens
auuuuacauuaag

SEQ ID NO: 461800 - RNA, 22 nt, Homo sapiens
auuuucaagaaagcauugccag

SEQ ID NO: 461801 - RNA, 16 nt, Homo sapiens
auuuuuaauuaauuuc

SEQ ID NO: 461802 - RNA, 18 nt, Homo sapiens
auuuuuaguuacuugagu

SEQ ID NO: 461803 - RNA, 22 nt, Homo sapiens
auuuuuauaaagauauaccaag

SEQ ID NO: 461804 - RNA, 14 nt, Homo sapiens
auuuuucugaagga

SEQ ID NO: 461805 - RNA, 20 nt, Homo sapiens
caaaaacgcacugcaagaag

SEQ ID NO: 461806 - RNA, 13 nt, Homo sapiens
caaacuccugacc

SEQ ID NO: 461807 - RNA, 15 nt, Homo sapiens
caaagcaacuggaua

SEQ ID NO: 461808 - RNA, 22 nt, Homo sapiens
caaagugcagggauuacaggca

SEQ ID NO: 461809 - RNA, 17 nt, Homo sapiens
caaagugcugggauuac

SEQ ID NO: 461810 - RNA, 14 nt, Homo sapiens
caacgagagcacuu

SEQ ID NO: 461811 - RNA, 18 nt, Homo sapiens
caacgagagcacuugaaa

SEQ ID NO: 461812 - RNA, 12 nt, Homo sapiens
caagacagaugu

SEQ ID NO: 461813 - RNA, 14 nt, Homo sapiens
caagagauucuccu

SEQ ID NO: 461814 - RNA, 21 nt, Homo sapiens
caagauucccggcuggacuuu

SEQ ID NO: 461815 - RNA, 14 nt, Homo sapiens
caagcgauucuccu

SEQ ID NO: 461816 - RNA, 16 nt, Homo sapiens
caagcgauucuccugc

SEQ ID NO: 461817 - RNA, 19 nt, Homo sapiens
caagugaacucagcacucu

SEQ ID NO: 461818 - RNA, 24 nt, Homo sapiens
caagugcugggucugucacagaga

SEQ ID NO: 461819 - RNA, 21 nt, Homo sapiens
caauaaaacauuccugugaaa

SEQ ID NO: 461820 - RNA, 19 nt, Homo sapiens
caauaccccuguuaagcaa

SEQ ID NO: 461821 - RNA, 21 nt, Homo sapiens
caaucugugucauggacugua

SEQ ID NO: 461822 - RNA, 14 nt, Homo sapiens
caaugaugauuaaa

SEQ ID NO: 461823 - RNA, 12 nt, Homo sapiens
caauugcagugg

SEQ ID NO: 461824 - RNA, 15 nt, Homo sapiens
cacagacagauccca

SEQ ID NO: 461825 - RNA, 23 nt, Homo sapiens
cacagauuaucuuguacagccuu

SEQ ID NO: 461826 - RNA, 18 nt, Homo sapiens
cacaucuaacaaagucaa

SEQ ID NO: 461827 - RNA, 16 nt, Homo sapiens
caccaaauucugaauu

SEQ ID NO: 461828 - RNA, 17 nt, Homo sapiens
caccaccgacugaagug

SEQ ID NO: 461829 - RNA, 22 nt, Homo sapiens
caccacgcccacgucaacguga

SEQ ID NO: 461830 - RNA, 19 nt, Homo sapiens
caccauguuagccaggcug

SEQ ID NO: 461831 - RNA, 20 nt, Homo sapiens
cacccaggcuggagugcagu

SEQ ID NO: 461832 - RNA, 15 nt, Homo sapiens
caccucuuaugcaca

SEQ ID NO: 461833 - RNA, 17 nt, Homo sapiens
caccuugccaagcuuuc

SEQ ID NO: 461834 - RNA, 21 nt, Homo sapiens
cacgaucucagcucacugcaa

SEQ ID NO: 461835 - RNA, 12 nt, Homo sapiens
cacgcugcagug

SEQ ID NO: 461836 - RNA, 15 nt, Homo sapiens
cacguccacuuucaa

SEQ ID NO: 461837 - RNA, 21 nt, Homo sapiens
cacucauuaccgucugugauu

SEQ ID NO: 461838 - RNA, 20 nt, Homo sapiens
cacucgccgguuaagacagg

SEQ ID NO: 461839 - RNA, 22 nt, Homo sapiens
cacucgccgguuaagacagggu

SEQ ID NO: 461840 - RNA, 15 nt, Homo sapiens
cacucuccugugaga

SEQ ID NO: 461841 - RNA, 16 nt, Homo sapiens
cacucugcucucagga

SEQ ID NO: 461842 - RNA, 14 nt, Homo sapiens
cacugccagugcag

SEQ ID NO: 461843 - RNA, 18 nt, Homo sapiens
cacuuacacuuuaugcac

SEQ ID NO: 461844 - RNA, 20 nt, Homo sapiens
cagaacuaccauuguaauau

SEQ ID NO: 461845 - RNA, 17 nt, Homo sapiens
cagaagcaggagcaaaa

SEQ ID NO: 461846 - RNA, 20 nt, Homo sapiens
cagagaauucucuuauccaa

SEQ ID NO: 461847 - RNA, 10 nt, Homo sapiens
cagagcaaaa

SEQ ID NO: 461848 - RNA, 12 nt, Homo sapiens
cagaguacauga

SEQ ID NO: 461849 - RNA, 18 nt, Homo sapiens
cagagugagaccuaucua

SEQ ID NO: 461850 - RNA, 19 nt, Homo sapiens
cagagugagacucgucuca

SEQ ID NO: 461851 - RNA, 23 nt, Homo sapiens
cagaugccuccucuguccucauu

SEQ ID NO: 461852 - RNA, 17 nt, Homo sapiens
cagauuaucuuguacag

SEQ ID NO: 461853 - RNA, 16 nt, Homo sapiens
cagcaaaccucaguca

SEQ ID NO: 461854 - RNA, 22 nt, Homo sapiens
cagcagaaucggcuuugcagug

SEQ ID NO: 461855 - RNA, 13 nt, Homo sapiens
cagcaggaugcuc

SEQ ID NO: 461856 - RNA, 18 nt, Homo sapiens
cagcaggaugcucaguga

SEQ ID NO: 461857 - RNA, 24 nt, Homo sapiens
cagcauuggugcucacugccagug

SEQ ID NO: 461858 - RNA, 16 nt, Homo sapiens
cagccucacuccucag

SEQ ID NO: 461859 - RNA, 19 nt, Homo sapiens
cagccucccaaagugcagg

SEQ ID NO: 461860 - RNA, 20 nt, Homo sapiens
cagccuccugagcagcuggg

SEQ ID NO: 461861 - RNA, 19 nt, Homo sapiens
cagcuaauaaugaaguuau

SEQ ID NO: 461862 - RNA, 15 nt, Homo sapiens
cagcugggauuacag

SEQ ID NO: 461863 - RNA, 16 nt, Homo sapiens
caggagcaaaauaugg

SEQ ID NO: 461864 - RNA, 15 nt, Homo sapiens
caggaugcucaguga

SEQ ID NO: 461865 - RNA, 12 nt, Homo sapiens
caggaugcugcu

SEQ ID NO: 461866 - RNA, 14 nt, Homo sapiens
caggcaugagccac

SEQ ID NO: 461867 - RNA, 14 nt, Homo sapiens
caggccggccuuuc

SEQ ID NO: 461868 - RNA, 17 nt, Homo sapiens
caggcuggagugcagug

SEQ ID NO: 461869 - RNA, 18 nt, Homo sapiens
caggcuggagugcagugg

SEQ ID NO: 461870 - RNA, 22 nt, Homo sapiens
cagggauuacaggcaugagcca

SEQ ID NO: 461871 - RNA, 20 nt, Homo sapiens
cagggccuuugucugucuca

SEQ ID NO: 461872 - RNA, 17 nt, Homo sapiens
cagggcuguugucauuu

SEQ ID NO: 461873 - RNA, 15 nt, Homo sapiens
cagggggaugugucc

SEQ ID NO: 461874 - RNA, 20 nt, Homo sapiens
caggugguggcagcaauggu

SEQ ID NO: 461875 - RNA, 14 nt, Homo sapiens
caguaaguggcaca

SEQ ID NO: 461876 - RNA, 15 nt, Homo sapiens
cagucccugcacuuu

SEQ ID NO: 461877 - RNA, 15 nt, Homo sapiens
cagugcccaucuucc

SEQ ID NO: 461878 - RNA, 22 nt, Homo sapiens
caguggcacgaucucagcucac

SEQ ID NO: 461879 - RNA, 19 nt, Homo sapiens
cagugucuguguacaugua

SEQ ID NO: 461880 - RNA, 13 nt, Homo sapiens
caguuugcaaaua

SEQ ID NO: 461881 - RNA, 14 nt, Homo sapiens
cauaagaacgucau

SEQ ID NO: 461882 - RNA, 19 nt, Homo sapiens
cauacauggaaccauuuua

SEQ ID NO: 461883 - RNA, 17 nt, Homo sapiens
cauacucugcuuagaau

SEQ ID NO: 461884 - RNA, 20 nt, Homo sapiens
cauaugaggcaaaguguagu

SEQ ID NO: 461885 - RNA, 14 nt, Homo sapiens
cauaugcuauguua

SEQ ID NO: 461886 - RNA, 13 nt, Homo sapiens
caucaauucucua

SEQ ID NO: 461887 - RNA, 16 nt, Homo sapiens
caucaauucucuauca

SEQ ID NO: 461888 - RNA, 19 nt, Homo sapiens
caucagaggaaaagggcaa

SEQ ID NO: 461889 - RNA, 18 nt, Homo sapiens
caucagcuguucucauug

SEQ ID NO: 461890 - RNA, 20 nt, Homo sapiens
caucauguuccuuauaugaa

SEQ ID NO: 461891 - RNA, 13 nt, Homo sapiens
cauccuagugaga

SEQ ID NO: 461892 - RNA, 19 nt, Homo sapiens
caucguacacacucaguga

SEQ ID NO: 461893 - RNA, 11 nt, Homo sapiens
caucucagugc

SEQ ID NO: 461894 - RNA, 13 nt, Homo sapiens
caucugaugccuu

SEQ ID NO: 461895 - RNA, 15 nt, Homo sapiens
caucugcagcucuuu

SEQ ID NO: 461896 - RNA, 23 nt, Homo sapiens
caucuuggucagauuugaacucu

SEQ ID NO: 461897 - RNA, 22 nt, Homo sapiens
caugaaauggacaaacagugca

SEQ ID NO: 461898 - RNA, 17 nt, Homo sapiens
caugagaaaaucaguaa

SEQ ID NO: 461899 - RNA, 22 nt, Homo sapiens
caugagguuucaucauguuggc

SEQ ID NO: 461900 - RNA, 22 nt, Homo sapiens
caugaucgcuuucuacacugua

SEQ ID NO: 461901 - RNA, 19 nt, Homo sapiens
caugauguaaaaaauacaa

SEQ ID NO: 461902 - RNA, 20 nt, Homo sapiens
cauggcgaaaggagugacuu

SEQ ID NO: 461903 - RNA, 23 nt, Homo sapiens
cauguauuaugauuaaaucugag

SEQ ID NO: 461904 - RNA, 24 nt, Homo sapiens
cauguuggccaggccggucucaaa

SEQ ID NO: 461905 - RNA, 13 nt, Homo sapiens
gcaggugugcgug

SEQ ID NO: 461906 - RNA, 15 nt, Homo sapiens
gcagugagcuucuau

SEQ ID NO: 461907 - RNA, 13 nt, Homo sapiens
gcaguuguccuga

SEQ ID NO: 461908 - RNA, 19 nt, Homo sapiens
gcauacugacuccaggugu

SEQ ID NO: 461909 - RNA, 19 nt, Homo sapiens
gcaucaucugcacugccca

SEQ ID NO: 461910 - RNA, 19 nt, Homo sapiens
gccaauauuuuaagguaaa

SEQ ID NO: 461911 - RNA, 20 nt, Homo sapiens
gccaccaugccgggccauga

SEQ ID NO: 461912 - RNA, 15 nt, Homo sapiens
gccacugacuugcuc

SEQ ID NO: 461913 - RNA, 22 nt, Homo sapiens
gccagguaugacacccacucuc

SEQ ID NO: 461914 - RNA, 22 nt, Homo sapiens
gccaguggagacuggaacacaa

SEQ ID NO: 461915 - RNA, 23 nt, Homo sapiens
gccaugauucuuaagagaauuga

SEQ ID NO: 461916 - RNA, 16 nt, Homo sapiens
gcccacguguccugag

SEQ ID NO: 461917 - RNA, 19 nt, Homo sapiens
gcccucugccagggcaccu

SEQ ID NO: 461918 - RNA, 19 nt, Homo sapiens
gccggcagaaguuugccau

SEQ ID NO: 461919 - RNA, 15 nt, Homo sapiens
gccgggccaugauuc

SEQ ID NO: 461920 - RNA, 21 nt, Homo sapiens
gccuccccaccacugagccau

SEQ ID NO: 461921 - RNA, 15 nt, Homo sapiens
gccucccugagcacu

SEQ ID NO: 461922 - RNA, 18 nt, Homo sapiens
gccuugguaaaaacugca

SEQ ID NO: 461923 - RNA, 17 nt, Homo sapiens
gcgcccgccaccaugcc

SEQ ID NO: 461924 - RNA, 19 nt, Homo sapiens
gcgguccuacugcugugag

SEQ ID NO: 461925 - RNA, 15 nt, Homo sapiens
gcgguuuaucuuuga

SEQ ID NO: 461926 - RNA, 14 nt, Homo sapiens
gcgucugcacugau

SEQ ID NO: 461927 - RNA, 16 nt, Homo sapiens
gcgucugcacugauga

SEQ ID NO: 461928 - RNA, 15 nt, Homo sapiens
gcuaauuuuuugcau

SEQ ID NO: 461929 - RNA, 21 nt, Homo sapiens
gcuauuuucuuauccuuugua

SEQ ID NO: 461930 - RNA, 17 nt, Homo sapiens
gcucacugcaaccucca

SEQ ID NO: 461931 - RNA, 20 nt, Homo sapiens
gcuggagugcaguggcacga

SEQ ID NO: 461932 - RNA, 19 nt, Homo sapiens
gcuggagugcaguggugca

SEQ ID NO: 461933 - RNA, 20 nt, Homo sapiens
gcuggagugcaguggugcaa

SEQ ID NO: 461934 - RNA, 17 nt, Homo sapiens
gcuggccccaaaggaaa

SEQ ID NO: 461935 - RNA, 13 nt, Homo sapiens
gcuggucuucaau

SEQ ID NO: 461936 - RNA, 12 nt, Homo sapiens
gcuggugcugug

SEQ ID NO: 461937 - RNA, 20 nt, Homo sapiens
gcugguucugcaaugacugc

SEQ ID NO: 461938 - RNA, 21 nt, Homo sapiens
gcugguucugcaaugacugca

SEQ ID NO: 461939 - RNA, 15 nt, Homo sapiens
gcugucacuugccca

SEQ ID NO: 461940 - RNA, 19 nt, Homo sapiens
gcuguccaggaacuuucca

SEQ ID NO: 461941 - RNA, 20 nt, Homo sapiens
gcuguuuuaaaaacaaagaa

SEQ ID NO: 461942 - RNA, 18 nt, Homo sapiens
gcuuacaaguauugaaau

SEQ ID NO: 461943 - RNA, 17 nt, Homo sapiens
gcuucccuuugauuuuu

SEQ ID NO: 461944 - RNA, 20 nt, Homo sapiens
gcuuucuucuacaaccagag

SEQ ID NO: 461945 - RNA, 18 nt, Homo sapiens
ggaaaaggcuuacuugcc

SEQ ID NO: 461946 - RNA, 15 nt, Homo sapiens
ggaaacgagcugugu

SEQ ID NO: 461947 - RNA, 23 nt, Homo sapiens
ggaaucucugcaaucugugucau

SEQ ID NO: 461948 - RNA, 22 nt, Homo sapiens
ggaccaauuagcauuccaucaa

SEQ ID NO: 461949 - RNA, 14 nt, Homo sapiens
ggacggagcugacu

SEQ ID NO: 461950 - RNA, 22 nt, Homo sapiens
ggacuucuccuccaguggaccu

SEQ ID NO: 461951 - RNA, 13 nt, Homo sapiens
ggagguacuguga

SEQ ID NO: 461952 - RNA, 19 nt, Homo sapiens
ggauuccucgaaacugcca

SEQ ID NO: 461953 - RNA, 15 nt, Homo sapiens
ggcaaaaagaccaag

SEQ ID NO: 461954 - RNA, 13 nt, Homo sapiens
ggcaaaguguagu

SEQ ID NO: 461955 - RNA, 19 nt, Homo sapiens
ggcaaaguguaguguuaua

SEQ ID NO: 461956 - RNA, 19 nt, Homo sapiens
ggcagguaagggacuacca

SEQ ID NO: 461957 - RNA, 21 nt, Homo sapiens
ggccuguuugccgucugugac

SEQ ID NO: 461958 - RNA, 14 nt, Homo sapiens
ggcuggagugcagu

SEQ ID NO: 461959 - RNA, 20 nt, Homo sapiens
ggcuggagugcaguggugca

SEQ ID NO: 461960 - RNA, 18 nt, Homo sapiens
ggcugggaagaagcugca

SEQ ID NO: 461961 - RNA, 22 nt, Homo sapiens
gggagccuucugugcugugagu

SEQ ID NO: 461962 - RNA, 24 nt, Homo sapiens
gggagccuucugugcugugagucc

SEQ ID NO: 461963 - RNA, 21 nt, Homo sapiens
gggaggacaaaggugauuuuc

SEQ ID NO: 461964 - RNA, 15 nt, Homo sapiens
gggaugggauuucau

SEQ ID NO: 461965 - RNA, 15 nt, Homo sapiens
gggcacagugucagu

SEQ ID NO: 461966 - RNA, 15 nt, Homo sapiens
gggcaccuacugaga

SEQ ID NO: 461967 - RNA, 11 nt, Homo sapiens
gggcagggaua

SEQ ID NO: 461968 - RNA, 16 nt, Homo sapiens
gggcgaguucugccag

SEQ ID NO: 461969 - RNA, 17 nt, Homo sapiens
gggcuguugucauuugu

SEQ ID NO: 461970 - RNA, 23 nt, Homo sapiens
gggcuuguuuucuacuuugccac

SEQ ID NO: 461971 - RNA, 23 nt, Homo sapiens
ggggagccuucugugcugugagu

SEQ ID NO: 461972 - RNA, 21 nt, Homo sapiens
gggggcaccaugugugccuuu

SEQ ID NO: 461973 - RNA, 23 nt, Homo sapiens
ggguaucuaauaaauacuuaaga

SEQ ID NO: 461974 - RNA, 19 nt, Homo sapiens
gggugggaguagugcuuuc

SEQ ID NO: 461975 - RNA, 17 nt, Homo sapiens
gguaaaaacugcagugu

SEQ ID NO: 461976 - RNA, 23 nt, Homo sapiens
gguaaagccucagcaacagccag

SEQ ID NO: 461977 - RNA, 13 nt, Homo sapiens
gguauaugugaua

SEQ ID NO: 461978 - RNA, 20 nt, Homo sapiens
gguccuacugcugugagcau

SEQ ID NO: 461979 - RNA, 12 nt, Homo sapiens
ggucuaggccag

SEQ ID NO: 461980 - RNA, 22 nt, Homo sapiens
ggucuuuuccauuaaacuacuu

SEQ ID NO: 461981 - RNA, 18 nt, Homo sapiens
ggugauuuuccugugucc

SEQ ID NO: 461982 - RNA, 14 nt, Homo sapiens
gguggcucuugccu

SEQ ID NO: 461983 - RNA, 16 nt, Homo sapiens
gguuaagacagggugg

SEQ ID NO: 461984 - RNA, 21 nt, Homo sapiens
guaaaaaauacaaacauucua

SEQ ID NO: 461985 - RNA, 21 nt, Homo sapiens
guaaauuuuggaaacaguaca

SEQ ID NO: 461986 - RNA, 17 nt, Homo sapiens
guaaggcagcucugucg

SEQ ID NO: 461987 - RNA, 22 nt, Homo sapiens
guaaguaccccugauaagcaaa

SEQ ID NO: 461988 - RNA, 16 nt, Homo sapiens
guaauaugacuccugu

SEQ ID NO: 461989 - RNA, 13 nt, Homo sapiens
guacuaaugugaa

SEQ ID NO: 461990 - RNA, 19 nt, Homo sapiens
guacuuugcucuccuugcg

SEQ ID NO: 461991 - RNA, 14 nt, Homo sapiens
guagugcuuuccag

SEQ ID NO: 461992 - RNA, 20 nt, Homo sapiens
guauaaccccaccuugccaa

SEQ ID NO: 461993 - RNA, 14 nt, Homo sapiens
guaugucugccuaa

SEQ ID NO: 461994 - RNA, 19 nt, Homo sapiens
guaugugugccagcugugu

SEQ ID NO: 461995 - RNA, 16 nt, Homo sapiens
guauuaauaaacacau

SEQ ID NO: 461996 - RNA, 19 nt, Homo sapiens
guauuuuaaaacauaagaa

SEQ ID NO: 461997 - RNA, 18 nt, Homo sapiens
gucagaggacgagugcuu

SEQ ID NO: 461998 - RNA, 13 nt, Homo sapiens
gucauggacugua

SEQ ID NO: 461999 - RNA, 16 nt, Homo sapiens
guccuacugcugugag

SEQ ID NO: 462000 - RNA, 16 nt, Homo sapiens
guccugccccaggugu

SEQ ID NO: 462001 - RNA, 19 nt, Homo sapiens
gucucaaacuccugaccuc

SEQ ID NO: 462002 - RNA, 17 nt, Homo sapiens
gucucucucacauuaag

SEQ ID NO: 462003 - RNA, 18 nt, Homo sapiens
gucugaacaggaugcuga

SEQ ID NO: 462004 - RNA, 21 nt, Homo sapiens
gucugcacugaugaccgucug

SEQ ID NO: 462005 - RNA, 12 nt, Homo sapiens
gucugucccaaa

SEQ ID NO: 462006 - RNA, 15 nt, Homo sapiens
gugaggcccguguga

SEQ ID NO: 462007 - RNA, 16 nt, Homo sapiens
gugaguguguggcacc

SEQ ID NO: 462008 - RNA, 20 nt, Homo sapiens
gugcaugaauagauucucuc

SEQ ID NO: 462009 - RNA, 19 nt, Homo sapiens
gugcccacggagccuaccc

SEQ ID NO: 462010 - RNA, 21 nt, Homo sapiens
gugcccacggagccuacccga

SEQ ID NO: 462011 - RNA, 15 nt, Homo sapiens
gugccuguaauccca

SEQ ID NO: 462012 - RNA, 15 nt, Homo sapiens
gugcugggauuacag

SEQ ID NO: 462013 - RNA, 15 nt, Homo sapiens
gugggaguagugcuu

SEQ ID NO: 462014 - RNA, 21 nt, Homo sapiens
guggggagaugggcauuugga

SEQ ID NO: 462015 - RNA, 23 nt, Homo sapiens
guggugacuuccugaacaucagc

SEQ ID NO: 462016 - RNA, 19 nt, Homo sapiens
gugguuauuuuacauuaag

SEQ ID NO: 462017 - RNA, 16 nt, Homo sapiens
guguguuuacugaugc

SEQ ID NO: 462018 - RNA, 14 nt, Homo sapiens
guuaaaacuacuuu

SEQ ID NO: 462019 - RNA, 18 nt, Homo sapiens
guuaaugcaaaugacugu

SEQ ID NO: 462020 - RNA, 22 nt, Homo sapiens
guuauaauaauguuaacaugga

SEQ ID NO: 462021 - RNA, 16 nt, Homo sapiens
guucacuaaugugguu

SEQ ID NO: 462022 - RNA, 15 nt, Homo sapiens
guucagucaucucca

SEQ ID NO: 462023 - RNA, 19 nt, Homo sapiens
guucuacagagugagaccu

SEQ ID NO: 462024 - RNA, 23 nt, Homo sapiens
guucuccgugaugcuguuuuucu

SEQ ID NO: 462025 - RNA, 12 nt, Homo sapiens
guugaugacugu

SEQ ID NO: 462026 - RNA, 13 nt, Homo sapiens
guugaugacuguu

SEQ ID NO: 462027 - RNA, 16 nt, Homo sapiens
guuuaaguacuucaca

SEQ ID NO: 462028 - RNA, 16 nt, Homo sapiens
guuucacuggcuggug

SEQ ID NO: 462029 - RNA, 16 nt, Homo sapiens
guuucauuguguguua

SEQ ID NO: 462030 - RNA, 15 nt, Homo sapiens
gcccugcccugccac

SEQ ID NO: 462031 - RNA, 21 nt, Homo sapiens
gccgagauugcaccacugcac

SEQ ID NO: 462032 - RNA, 20 nt, Homo sapiens
gccuacccgauuauagcaga

SEQ ID NO: 462033 - RNA, 17 nt, Homo sapiens
gccuccaauugcagugg

SEQ ID NO: 462034 - RNA, 21 nt, Homo sapiens
gccucccaaagugcugggauu

SEQ ID NO: 462035 - RNA, 15 nt, Homo sapiens
gccugugccuaucac

SEQ ID NO: 462036 - RNA, 16 nt, Homo sapiens
gccuugggcuuucccg

SEQ ID NO: 462037 - RNA, 21 nt, Homo sapiens
gccuuugcccacguguccuga

SEQ ID NO: 462038 - RNA, 16 nt, Homo sapiens
gccuuuuauggaccaa

SEQ ID NO: 462039 - RNA, 17 nt, Homo sapiens
gcgacacccguccaugg

SEQ ID NO: 462040 - RNA, 18 nt, Homo sapiens
gcgagcaugaacuggccc

SEQ ID NO: 462041 - RNA, 19 nt, Homo sapiens
gcggcccugagcuccaugg

SEQ ID NO: 462042 - RNA, 20 nt, Homo sapiens
gcggcccugagcuugcaggg

SEQ ID NO: 462043 - RNA, 16 nt, Homo sapiens
gcuaaauguaccugag

SEQ ID NO: 462044 - RNA, 17 nt, Homo sapiens
gcuaugggaaaugcaaa

SEQ ID NO: 462045 - RNA, 18 nt, Homo sapiens
gcucaggacacaguggga

SEQ ID NO: 462046 - RNA, 20 nt, Homo sapiens
gcucaggacacagugggaca

SEQ ID NO: 462047 - RNA, 22 nt, Homo sapiens
gcugaccacgcccccagcugug

SEQ ID NO: 462048 - RNA, 16 nt, Homo sapiens
gcugaggugugcgguu

SEQ ID NO: 462049 - RNA, 20 nt, Homo sapiens
gcugauggggguuugcucag

SEQ ID NO: 462050 - RNA, 16 nt, Homo sapiens
gcugcgucugcacuga

SEQ ID NO: 462051 - RNA, 10 nt, Homo sapiens
gcugcugaga

SEQ ID NO: 462052 - RNA, 13 nt, Homo sapiens
gcuggagugcagu

SEQ ID NO: 462053 - RNA, 14 nt, Homo sapiens
gcuggagugcagug

SEQ ID NO: 462054 - RNA, 18 nt, Homo sapiens
gcuggcccugcagguggu

SEQ ID NO: 462055 - RNA, 22 nt, Homo sapiens
gcugguacuaagaggcuauuua

SEQ ID NO: 462056 - RNA, 21 nt, Homo sapiens
gcuucucucugcaaccuugaa

SEQ ID NO: 462057 - RNA, 13 nt, Homo sapiens
ggaacacaaccau

SEQ ID NO: 462058 - RNA, 15 nt, Homo sapiens
ggaacacaaccauag

SEQ ID NO: 462059 - RNA, 19 nt, Homo sapiens
ggaaggucuccccaugugc

SEQ ID NO: 462060 - RNA, 13 nt, Homo sapiens
ggaaugauagugu

SEQ ID NO: 462061 - RNA, 15 nt, Homo sapiens
ggaauuaagugaaag

SEQ ID NO: 462062 - RNA, 23 nt, Homo sapiens
ggacaaacagccucacuccucag

SEQ ID NO: 462063 - RNA, 18 nt, Homo sapiens
ggacaaaggugauuuucc

SEQ ID NO: 462064 - RNA, 19 nt, Homo sapiens
ggagacugcauucccugcc

SEQ ID NO: 462065 - RNA, 11 nt, Homo sapiens
ggagcacuuuc

SEQ ID NO: 462066 - RNA, 20 nt, Homo sapiens
ggagccuucugugcugugag

SEQ ID NO: 462067 - RNA, 22 nt, Homo sapiens
ggcacucgccgguuaagacagg

SEQ ID NO: 462068 - RNA, 15 nt, Homo sapiens
ggcagcaaugguguu

SEQ ID NO: 462069 - RNA, 20 nt, Homo sapiens
ggcagcaggaugcucaguga

SEQ ID NO: 462070 - RNA, 17 nt, Homo sapiens
ggcaggcagaucacaag

SEQ ID NO: 462071 - RNA, 18 nt, Homo sapiens
ggcaugaaaagugguccu

SEQ ID NO: 462072 - RNA, 14 nt, Homo sapiens
ggcccugcaggguc

SEQ ID NO: 462073 - RNA, 12 nt, Homo sapiens
ggccuacuucuc

SEQ ID NO: 462074 - RNA, 13 nt, Homo sapiens
ggccucacucugg

SEQ ID NO: 462075 - RNA, 23 nt, Homo sapiens
ggccuguuugccgucugugacau

SEQ ID NO: 462076 - RNA, 14 nt, Homo sapiens
ggcgugugcagugc

SEQ ID NO: 462077 - RNA, 22 nt, Homo sapiens
ggcuacuccgugguuuugugac

SEQ ID NO: 462078 - RNA, 21 nt, Homo sapiens
ggcucauacaggucacccuga

SEQ ID NO: 462079 - RNA, 20 nt, Homo sapiens
ggcuggagugcaguggcgca

SEQ ID NO: 462080 - RNA, 18 nt, Homo sapiens
ggcuuucccggaggccag

SEQ ID NO: 462081 - RNA, 22 nt, Homo sapiens
gggagcagccugguguccugcc

SEQ ID NO: 462082 - RNA, 15 nt, Homo sapiens
gggauuucauuugaa

SEQ ID NO: 462083 - RNA, 24 nt, Homo sapiens
ggguuucaccauguuagccaggcu

SEQ ID NO: 462084 - RNA, 16 nt, Homo sapiens
gguaaaaacugcagug

SEQ ID NO: 462085 - RNA, 17 nt, Homo sapiens
gguaauugcugaggugu

SEQ ID NO: 462086 - RNA, 13 nt, Homo sapiens
ggucaauauuuga

SEQ ID NO: 462087 - RNA, 18 nt, Homo sapiens
gguccuacugcugugagc

SEQ ID NO: 462088 - RNA, 14 nt, Homo sapiens
uguagauugccuuu

SEQ ID NO: 462089 - RNA, 15 nt, Homo sapiens
uguauuaugauuaaa

SEQ ID NO: 462090 - RNA, 13 nt, Homo sapiens
ugucaauaccccu

SEQ ID NO: 462091 - RNA, 15 nt, Homo sapiens
ugucagaaguugaua

SEQ ID NO: 462092 - RNA, 13 nt, Homo sapiens
uguccguccucag

SEQ ID NO: 462093 - RNA, 17 nt, Homo sapiens
ugucucauccaaaaagu

SEQ ID NO: 462094 - RNA, 17 nt, Homo sapiens
ugucucucucacauuaa

SEQ ID NO: 462095 - RNA, 19 nt, Homo sapiens
ugucugaacaggaugcuga

SEQ ID NO: 462096 - RNA, 18 nt, Homo sapiens
ugugaggcccucagggca

SEQ ID NO: 462097 - RNA, 22 nt, Homo sapiens
ugugauuuuuaaucgcuuugau

SEQ ID NO: 462098 - RNA, 13 nt, Homo sapiens
ugugccagcugug

SEQ ID NO: 462099 - RNA, 18 nt, Homo sapiens
ugugccccaucagcagcu

SEQ ID NO: 462100 - RNA, 15 nt, Homo sapiens
ugugcuagacuguaa

SEQ ID NO: 462101 - RNA, 14 nt, Homo sapiens
uguguuaucucuua

SEQ ID NO: 462102 - RNA, 13 nt, Homo sapiens
uguuaagcaauuc

SEQ ID NO: 462103 - RNA, 20 nt, Homo sapiens
uguucucaugcauuucaugg

SEQ ID NO: 462104 - RNA, 18 nt, Homo sapiens
uguugcuaggacauauac

SEQ ID NO: 462105 - RNA, 23 nt, Homo sapiens
uguuucucccccuuuccaaaaac

SEQ ID NO: 462106 - RNA, 20 nt, Homo sapiens
uguuucuucuuugacuauaa

SEQ ID NO: 462107 - RNA, 18 nt, Homo sapiens
uguuuuaaucuccucuga

SEQ ID NO: 462108 - RNA, 15 nt, Homo sapiens
uuaaaacuacuuuag

SEQ ID NO: 462109 - RNA, 11 nt, Homo sapiens
uuaaaacuauu

SEQ ID NO: 462110 - RNA, 13 nt, Homo sapiens
uuaaaauucucaa

SEQ ID NO: 462111 - RNA, 17 nt, Homo sapiens
uuaaacaccugacacau

SEQ ID NO: 462112 - RNA, 21 nt, Homo sapiens
uuaaauuuuaauucuucagaa

SEQ ID NO: 462113 - RNA, 20 nt, Homo sapiens
uuaagagaauguuucuuaaa

SEQ ID NO: 462114 - RNA, 20 nt, Homo sapiens
uuaagugaaaggucacacua

SEQ ID NO: 462115 - RNA, 23 nt, Homo sapiens
uuaauggguuuuguguacuguaa

SEQ ID NO: 462116 - RNA, 21 nt, Homo sapiens
uuaauugguuugugccuuaca

SEQ ID NO: 462117 - RNA, 16 nt, Homo sapiens
uuacgcggagcacuuu

SEQ ID NO: 462118 - RNA, 11 nt, Homo sapiens
uuacuaauuaa

SEQ ID NO: 462119 - RNA, 18 nt, Homo sapiens
uuacucuugcugagucag

SEQ ID NO: 462120 - RNA, 19 nt, Homo sapiens
uuagaaaagguuucuuaaa

SEQ ID NO: 462121 - RNA, 17 nt, Homo sapiens
uuauaaagauauaccaa

SEQ ID NO: 462122 - RNA, 14 nt, Homo sapiens
uuaucaucauuaga

SEQ ID NO: 462123 - RNA, 12 nt, Homo sapiens
uuaugacaugau

SEQ ID NO: 462124 - RNA, 22 nt, Homo sapiens
uuaugccuugguaaaaacugca

SEQ ID NO: 462125 - RNA, 11 nt, Homo sapiens
uuaugcugcua

SEQ ID NO: 462126 - RNA, 20 nt, Homo sapiens
uuaugcuguuaaaacuacuu

SEQ ID NO: 462127 - RNA, 13 nt, Homo sapiens
uuaugggcacugg

SEQ ID NO: 462128 - RNA, 17 nt, Homo sapiens
uuauuacuccuugccau

SEQ ID NO: 462129 - RNA, 16 nt, Homo sapiens
uuauuggcuucuuaac

SEQ ID NO: 462130 - RNA, 15 nt, Homo sapiens
uuauuuuuuucccaa

SEQ ID NO: 462131 - RNA, 22 nt, Homo sapiens
uucaaaauauguauucaguguu

SEQ ID NO: 462132 - RNA, 18 nt, Homo sapiens
uucaagaaagcauugcca

SEQ ID NO: 462133 - RNA, 15 nt, Homo sapiens
uucagucaucuccaa

SEQ ID NO: 462134 - RNA, 19 nt, Homo sapiens
uucaugacacaaccuuuca

SEQ ID NO: 462135 - RNA, 16 nt, Homo sapiens
uuccaaaaacuguuaa

SEQ ID NO: 462136 - RNA, 22 nt, Homo sapiens
uuccaaauucaguaaauuuugg

SEQ ID NO: 462137 - RNA, 17 nt, Homo sapiens
uuccacaaguuaaauaa

SEQ ID NO: 462138 - RNA, 18 nt, Homo sapiens
uuccacuuuaacauuuua

SEQ ID NO: 462139 - RNA, 14 nt, Homo sapiens
uuccaucaauuuua

SEQ ID NO: 462140 - RNA, 16 nt, Homo sapiens
uuccauuaaacuacuu

SEQ ID NO: 462141 - RNA, 15 nt, Homo sapiens
uucccaaggccaguc

SEQ ID NO: 462142 - RNA, 23 nt, Homo sapiens
uucccggcuggacuuuugcagcu

SEQ ID NO: 462143 - RNA, 16 nt, Homo sapiens
uuccucuggccaggua

SEQ ID NO: 462144 - RNA, 21 nt, Homo sapiens
uucuaauaaucauaaacuaua

SEQ ID NO: 462145 - RNA, 12 nt, Homo sapiens
uucucauuguag

SEQ ID NO: 462146 - RNA, 20 nt, Homo sapiens
uucucccccuuuccaaaaac

SEQ ID NO: 462147 - RNA, 21 nt, Homo sapiens
uucugaauuuguagacauacu

SEQ ID NO: 462148 - RNA, 17 nt, Homo sapiens
uucuguauuaacugaau

SEQ ID NO: 462149 - RNA, 16 nt, Homo sapiens
uucuuaaaauacucac

SEQ ID NO: 462150 - RNA, 19 nt, Homo sapiens
uucuucucaagcacugaca

SEQ ID NO: 462151 - RNA, 16 nt, Homo sapiens
uucuuuaccaguuucu

SEQ ID NO: 462152 - RNA, 11 nt, Homo sapiens
uugaaaacugc

SEQ ID NO: 462153 - RNA, 21 nt, Homo sapiens
uugaaccuugguaaauuguaa

SEQ ID NO: 462154 - RNA, 18 nt, Homo sapiens
uugaauuucuccgaaugu

SEQ ID NO: 462155 - RNA, 18 nt, Homo sapiens
uugagcugacauauacug

SEQ ID NO: 462156 - RNA, 22 nt, Homo sapiens
uugcauggguggccagccagcu

SEQ ID NO: 462157 - RNA, 16 nt, Homo sapiens
uugccaucccaaaaau

SEQ ID NO: 462158 - RNA, 19 nt, Homo sapiens
uugcuuccagaccuaggcu

SEQ ID NO: 462159 - RNA, 22 nt, Homo sapiens
uuggcauccgaaaccagcaucu

SEQ ID NO: 462160 - RNA, 16 nt, Homo sapiens
uugggagauuucauuu

SEQ ID NO: 462161 - RNA, 20 nt, Homo sapiens
uugggcuuguuuucuacuuu

SEQ ID NO: 462162 - RNA, 14 nt, Homo sapiens
uguuaaaacuacuu

SEQ ID NO: 462163 - RNA, 17 nt, Homo sapiens
uguuucguagccauauu

SEQ ID NO: 462164 - RNA, 21 nt, Homo sapiens
uguuugagguccacacugaca

SEQ ID NO: 462165 - RNA, 12 nt, Homo sapiens
uguuuucaccuc

SEQ ID NO: 462166 - RNA, 19 nt, Homo sapiens
uguuuucaccucauaugcu

SEQ ID NO: 462167 - RNA, 13 nt, Homo sapiens
uuaaacaccugac

SEQ ID NO: 462168 - RNA, 17 nt, Homo sapiens
uuaaauuuuaauucuuc

SEQ ID NO: 462169 - RNA, 18 nt, Homo sapiens
uuaacauggacaugaucu

SEQ ID NO: 462170 - RNA, 16 nt, Homo sapiens
uuaaguaaaaaauaua

SEQ ID NO: 462171 - RNA, 18 nt, Homo sapiens
uuaaguccuacuuuacau

SEQ ID NO: 462172 - RNA, 19 nt, Homo sapiens
uuaaucuccucugaaaugu

SEQ ID NO: 462173 - RNA, 17 nt, Homo sapiens
uuaaugcaaaugacugu

SEQ ID NO: 462174 - RNA, 21 nt, Homo sapiens
uuaaugugaagcaaaacacaa

SEQ ID NO: 462175 - RNA, 23 nt, Homo sapiens
uuaauugguuugugccuuacauu

SEQ ID NO: 462176 - RNA, 20 nt, Homo sapiens
uuacaaaaccaucauuucaa

SEQ ID NO: 462177 - RNA, 18 nt, Homo sapiens
uuacaguauuauugugaa

SEQ ID NO: 462178 - RNA, 17 nt, Homo sapiens
uuacauuauuacuccuu

SEQ ID NO: 462179 - RNA, 16 nt, Homo sapiens
uuacauuuuggucucu

SEQ ID NO: 462180 - RNA, 17 nt, Homo sapiens
uuaggacuuuuugucaa

SEQ ID NO: 462181 - RNA, 16 nt, Homo sapiens
uuagguuaaaguuaau

SEQ ID NO: 462182 - RNA, 16 nt, Homo sapiens
uuagucuugauuucac

SEQ ID NO: 462183 - RNA, 12 nt, Homo sapiens
uuauaauuacaa

SEQ ID NO: 462184 - RNA, 14 nt, Homo sapiens
uuauagaauuaugc

SEQ ID NO: 462185 - RNA, 21 nt, Homo sapiens
uuauucucaauauauuuuugc

SEQ ID NO: 462186 - RNA, 22 nt, Homo sapiens
uucaaaaacgcacugcaagaag

SEQ ID NO: 462187 - RNA, 15 nt, Homo sapiens
uucaauuaccaagaa

SEQ ID NO: 462188 - RNA, 17 nt, Homo sapiens
uucacucugcucucagg

SEQ ID NO: 462189 - RNA, 23 nt, Homo sapiens
uucagcauacugacuccaggugu

SEQ ID NO: 462190 - RNA, 21 nt, Homo sapiens
uucaggugaagcuggagcuca

SEQ ID NO: 462191 - RNA, 22 nt, Homo sapiens
uucaucgcaguggacugugucc

SEQ ID NO: 462192 - RNA, 15 nt, Homo sapiens
uucauguaaccaaga

SEQ ID NO: 462193 - RNA, 13 nt, Homo sapiens
uuccaaaaacugu

SEQ ID NO: 462194 - RNA, 17 nt, Homo sapiens
uuccaccaaauucugaa

SEQ ID NO: 462195 - RNA, 22 nt, Homo sapiens
uucccuuugauuuuuugcugca

SEQ ID NO: 462196 - RNA, 22 nt, Homo sapiens
uuccuguguccacaucuaacaa

SEQ ID NO: 462197 - RNA, 19 nt, Homo sapiens
uucgagaccagccugacca

SEQ ID NO: 462198 - RNA, 19 nt, Homo sapiens
uucuacacuguauuacaua

SEQ ID NO: 462199 - RNA, 15 nt, Homo sapiens
uucuauuaagauaua

SEQ ID NO: 462200 - RNA, 22 nt, Homo sapiens
uucuccaaaacaauuuucugca

SEQ ID NO: 462201 - RNA, 19 nt, Homo sapiens
uucucccaaaguguccuaa

SEQ ID NO: 462202 - RNA, 13 nt, Homo sapiens
uucuccugccuca

SEQ ID NO: 462203 - RNA, 15 nt, Homo sapiens
uucucgccacugggg

SEQ ID NO: 462204 - RNA, 15 nt, Homo sapiens
uucugcaaugacugc

SEQ ID NO: 462205 - RNA, 13 nt, Homo sapiens
uucuucuucucaa

SEQ ID NO: 462206 - RNA, 12 nt, Homo sapiens
uugaaaacugcu

SEQ ID NO: 462207 - RNA, 16 nt, Homo sapiens
uugaacauacuucauc

SEQ ID NO: 462208 - RNA, 20 nt, Homo sapiens
uugaauuaauccacacauca

SEQ ID NO: 462209 - RNA, 15 nt, Homo sapiens
uugauaacucagugg

SEQ ID NO: 462210 - RNA, 16 nt, Homo sapiens
uugcagggcgugagac

SEQ ID NO: 462211 - RNA, 15 nt, Homo sapiens
uugccgucugugaca

SEQ ID NO: 462212 - RNA, 23 nt, Homo sapiens
uugcuguuccuuaauuugauuaa

SEQ ID NO: 462213 - RNA, 22 nt, Homo sapiens
uugggagauuucauuuucuaca

SEQ ID NO: 462214 - RNA, 21 nt, Homo sapiens
uugguccgguuauucacuuga

SEQ ID NO: 462215 - RNA, 16 nt, Homo sapiens
uugguccuugcugcca

SEQ ID NO: 462216 - RNA, 16 nt, Homo sapiens
uuguaucuugcauuca

SEQ ID NO: 462217 - RNA, 11 nt, Homo sapiens
uuguugcucag

SEQ ID NO: 462218 - RNA, 17 nt, Homo sapiens
uuuaagguaaaacucac

SEQ ID NO: 462219 - RNA, 22 nt, Homo sapiens
uuuaccaugaggcuugugugaa

SEQ ID NO: 462220 - RNA, 17 nt, Homo sapiens
uuuagaguaaugcauga

SEQ ID NO: 462221 - RNA, 20 nt, Homo sapiens
uuuauggaagaugugugaua

SEQ ID NO: 462222 - RNA, 23 nt, Homo sapiens
uuuauggaccaauuagcauucca

SEQ ID NO: 462223 - RNA, 19 nt, Homo sapiens
uuucaagaaagcauugcca

SEQ ID NO: 462224 - RNA, 21 nt, Homo sapiens
uuucaagaaaugacugaggua

SEQ ID NO: 462225 - RNA, 12 nt, Homo sapiens
uuucacugacac

SEQ ID NO: 462226 - RNA, 22 nt, Homo sapiens
uuucagaggaggaaguacggag

SEQ ID NO: 462227 - RNA, 18 nt, Homo sapiens
uuucaggagguacuguga

SEQ ID NO: 462228 - RNA, 19 nt, Homo sapiens
uuuccauccuagugagaag

SEQ ID NO: 462229 - RNA, 15 nt, Homo sapiens
uuucccuugaacugu

SEQ ID NO: 462230 - RNA, 21 nt, Homo sapiens
uuucuaauaaucauaaacuau

SEQ ID NO: 462231 - RNA, 19 nt, Homo sapiens
uuucucccccuuuccaaaa

SEQ ID NO: 462232 - RNA, 19 nt, Homo sapiens
uuucuucuacaaccagagc

SEQ ID NO: 462233 - RNA, 20 nt, Homo sapiens
uuugggguagcggcccugag

SEQ ID NO: 462234 - RNA, 13 nt, Homo sapiens
uuuuaagaccaag

SEQ ID NO: 462235 - RNA, 19 nt, Homo sapiens
uuuuaagaugugucuucaa

SEQ ID NO: 462236 - RNA, 12 nt, Homo sapiens
uuuuaaguauuu

SEQ ID NO: 462237 - RNA, 18 nt, Homo sapiens
uuuuccaugacugcauuu

SEQ ID NO: 462238 - RNA, 15 nt, Homo sapiens
uuuuggaacuguccu

SEQ ID NO: 462239 - RNA, 17 nt, Homo sapiens
uuuuuagggauuaccuu

SEQ ID NO: 462240 - RNA, 22 nt, Homo sapiens
agaaggcagcaggcggccuuug

SEQ ID NO: 462241 - RNA, 19 nt, Homo sapiens
agaaucgcuuaaacccagg

SEQ ID NO: 462242 - RNA, 13 nt, Homo sapiens
agacaaaguuuug

SEQ ID NO: 462243 - RNA, 18 nt, Homo sapiens
agacaaaguuuugcucuu

SEQ ID NO: 462244 - RNA, 18 nt, Homo sapiens
agacuggaacacaaccau

SEQ ID NO: 462245 - RNA, 18 nt, Homo sapiens
agacuuccucuguucuca

SEQ ID NO: 462246 - RNA, 14 nt, Homo sapiens
agagaauaaauuaa

SEQ ID NO: 462247 - RNA, 15 nt, Homo sapiens
agagauucuccugcc

SEQ ID NO: 462248 - RNA, 22 nt, Homo sapiens
agagggcgagcaugaacuggcc

SEQ ID NO: 462249 - RNA, 16 nt, Homo sapiens
agagggugacugugug

SEQ ID NO: 462250 - RNA, 23 nt, Homo sapiens
agaucuucucuguuauuccugau

SEQ ID NO: 462251 - RNA, 13 nt, Homo sapiens
agaugcagucucu

SEQ ID NO: 462252 - RNA, 19 nt, Homo sapiens
agauguuguagacugagau

SEQ ID NO: 462253 - RNA, 19 nt, Homo sapiens
agauuuaugcuccuuauga

SEQ ID NO: 462254 - RNA, 16 nt, Homo sapiens
agcaaaccucagucau

SEQ ID NO: 462255 - RNA, 15 nt, Homo sapiens
agcagaaggugugcu

SEQ ID NO: 462256 - RNA, 18 nt, Homo sapiens
agcagagcagcucugcua

SEQ ID NO: 462257 - RNA, 15 nt, Homo sapiens
agcagcugggauuac

SEQ ID NO: 462258 - RNA, 21 nt, Homo sapiens
agcagcugggauuacaggugc

SEQ ID NO: 462259 - RNA, 13 nt, Homo sapiens
agcaggagcaaaa

SEQ ID NO: 462260 - RNA, 14 nt, Homo sapiens
agcaugaacuggcc

SEQ ID NO: 462261 - RNA, 19 nt, Homo sapiens
agcauugccagcucuucca

SEQ ID NO: 462262 - RNA, 17 nt, Homo sapiens
agcccacagaugagaau

SEQ ID NO: 462263 - RNA, 22 nt, Homo sapiens
agccggggguggugacaugugc

SEQ ID NO: 462264 - RNA, 21 nt, Homo sapiens
agccucaccauacccuguuga

SEQ ID NO: 462265 - RNA, 12 nt, Homo sapiens
agcggcccugag

SEQ ID NO: 462266 - RNA, 18 nt, Homo sapiens
agcugacauauacugggu

SEQ ID NO: 462267 - RNA, 13 nt, Homo sapiens
agcugcuguccag

SEQ ID NO: 462268 - RNA, 14 nt, Homo sapiens
agcugcuguccagg

SEQ ID NO: 462269 - RNA, 16 nt, Homo sapiens
agcugcuguccaggaa

SEQ ID NO: 462270 - RNA, 18 nt, Homo sapiens
agcuguguuuggaaaauu

SEQ ID NO: 462271 - RNA, 15 nt, Homo sapiens
aggaacgaacauguu

SEQ ID NO: 462272 - RNA, 18 nt, Homo sapiens
aggaacuuuccagcagua

SEQ ID NO: 462273 - RNA, 16 nt, Homo sapiens
aggaagagcaggcacc

SEQ ID NO: 462274 - RNA, 16 nt, Homo sapiens
aggaauuaaugugauu

SEQ ID NO: 462275 - RNA, 14 nt, Homo sapiens
aggacacaguggga

SEQ ID NO: 462276 - RNA, 13 nt, Homo sapiens
aggacccagcucg

SEQ ID NO: 462277 - RNA, 21 nt, Homo sapiens
aggacugacccuggauuccuc

SEQ ID NO: 462278 - RNA, 19 nt, Homo sapiens
aggagaucuggcugugagg

SEQ ID NO: 462279 - RNA, 15 nt, Homo sapiens
aggagcaagcuugcu

SEQ ID NO: 462280 - RNA, 22 nt, Homo sapiens
aggagcaaucuaagcuguguua

SEQ ID NO: 462281 - RNA, 22 nt, Homo sapiens
aggaguucgagaccagccugac

SEQ ID NO: 462282 - RNA, 16 nt, Homo sapiens
aggaugacuacagaca

SEQ ID NO: 462283 - RNA, 14 nt, Homo sapiens
aggcaaaauaccag

SEQ ID NO: 462284 - RNA, 22 nt, Homo sapiens
aggcaaaauaccagcugaugaa

SEQ ID NO: 462285 - RNA, 18 nt, Homo sapiens
aggcauauaguauuuuca

SEQ ID NO: 462286 - RNA, 16 nt, Homo sapiens
aggcgcgguggcucuu

SEQ ID NO: 462287 - RNA, 15 nt, Homo sapiens
aggcuggagugcagu

SEQ ID NO: 462288 - RNA, 16 nt, Homo sapiens
aggcuggagugcagua

SEQ ID NO: 462289 - RNA, 18 nt, Homo sapiens
agggaaaaguccuuggcu

SEQ ID NO: 462290 - RNA, 16 nt, Homo sapiens
agggcaaaaagaccaa

SEQ ID NO: 462291 - RNA, 22 nt, Homo sapiens
agggggacacauccaucuugca

SEQ ID NO: 462292 - RNA, 22 nt, Homo sapiens
aggguacacaauggguaucuaa

SEQ ID NO: 462293 - RNA, 21 nt, Homo sapiens
agguaguuuugguuuccugau

SEQ ID NO: 462294 - RNA, 15 nt, Homo sapiens
aggugagaccaccuc

SEQ ID NO: 462295 - RNA, 15 nt, Homo sapiens
aggugagagcccuuu

SEQ ID NO: 462296 - RNA, 20 nt, Homo sapiens
aguaagaauuauuuacugaa

SEQ ID NO: 462297 - RNA, 19 nt, Homo sapiens
aguaccccugauaagcaaa

SEQ ID NO: 462298 - RNA, 17 nt, Homo sapiens
aguauuucagaugcuuu

SEQ ID NO: 462299 - RNA, 19 nt, Homo sapiens
agucucccuggccuaggca

SEQ ID NO: 462300 - RNA, 23 nt, Homo sapiens
agucuucaaaaacgcacugcaag

SEQ ID NO: 462301 - RNA, 21 nt, Homo sapiens
agugaaaggucacacuaccau

SEQ ID NO: 462302 - RNA, 18 nt, Homo sapiens
agugacauuucuaucaca

SEQ ID NO: 462303 - RNA, 22 nt, Homo sapiens
agugacauuucuaucacaauca

SEQ ID NO: 462304 - RNA, 17 nt, Homo sapiens
agugacugccaaaaagg

SEQ ID NO: 462305 - RNA, 23 nt, Homo sapiens
agugaucgccuccaacagcauca

SEQ ID NO: 462306 - RNA, 19 nt, Homo sapiens
agugccacccgcaggugug

SEQ ID NO: 462307 - RNA, 18 nt, Homo sapiens
agugcugggucugucaca

SEQ ID NO: 462308 - RNA, 20 nt, Homo sapiens
aguggcgcaaucucggcuca

SEQ ID NO: 462309 - RNA, 20 nt, Homo sapiens
agugggaauguccuuggcau

SEQ ID NO: 462310 - RNA, 19 nt, Homo sapiens
agugggaggugagaccacc

SEQ ID NO: 462311 - RNA, 20 nt, Homo sapiens
aguguuugucugucuugaca

SEQ ID NO: 462312 - RNA, 18 nt, Homo sapiens
aguucgaaagccucucac

SEQ ID NO: 462313 - RNA, 21 nt, Homo sapiens
aguuugcaaauagaacuaaua

SEQ ID NO: 462314 - RNA, 14 nt, Homo sapiens
auaaagauauacca

SEQ ID NO: 462315 - RNA, 13 nt, Homo sapiens
auaaaucauaaaa

SEQ ID NO: 462316 - RNA, 17 nt, Homo sapiens
auaaauuaaaauuacac

SEQ ID NO: 462317 - RNA, 16 nt, Homo sapiens
auaaguuaacuuccaa

SEQ ID NO: 462318 - RNA, 15 nt, Homo sapiens
auaaucgaaguaauu

SEQ ID NO: 462319 - RNA, 17 nt, Homo sapiens
auaauuacaaugcacaa

SEQ ID NO: 462320 - RNA, 14 nt, Homo sapiens
auaauuacuaauua

SEQ ID NO: 462321 - RNA, 13 nt, Homo sapiens
auaauuauuacau

SEQ ID NO: 462322 - RNA, 16 nt, Homo sapiens
auaauucuguauuaac

SEQ ID NO: 462323 - RNA, 13 nt, Homo sapiens
auacccguugaua

SEQ ID NO: 462324 - RNA, 21 nt, Homo sapiens
auacugacuccagguguaguu

SEQ ID NO: 462325 - RNA, 18 nt, Homo sapiens
auagucuuuugccagaga

SEQ ID NO: 462326 - RNA, 14 nt, Homo sapiens
auaguuacugugcc

SEQ ID NO: 462327 - RNA, 14 nt, Homo sapiens
auauaauacauuaa

SEQ ID NO: 462328 - RNA, 20 nt, Homo sapiens
auaugcuuauacacuuacac

SEQ ID NO: 462329 - RNA, 17 nt, Homo sapiens
auauguagauugccuuu

SEQ ID NO: 462330 - RNA, 23 nt, Homo sapiens
auauguagauugccuuuggcaau

SEQ ID NO: 462331 - RNA, 18 nt, Homo sapiens
auauuaaaaaaagacaua

SEQ ID NO: 462332 - RNA, 15 nt, Homo sapiens
auauuagucuuugaa

SEQ ID NO: 462333 - RNA, 18 nt, Homo sapiens
auauucaauaaagcugcu

SEQ ID NO: 462334 - RNA, 14 nt, Homo sapiens
aucagaaagggaga

SEQ ID NO: 462335 - RNA, 18 nt, Homo sapiens
aucagaggaaaagggcaa

SEQ ID NO: 462336 - RNA, 23 nt, Homo sapiens
aucauuguaacaugacacuuaga

SEQ ID NO: 462337 - RNA, 17 nt, Homo sapiens
aucccauccaucagcuc

SEQ ID NO: 462338 - RNA, 23 nt, Homo sapiens
aucccuguucauuguaagcacuu

SEQ ID NO: 462339 - RNA, 17 nt, Homo sapiens
aucggucagaagcacca

SEQ ID NO: 462340 - RNA, 17 nt, Homo sapiens
aucggugcugucagccc

SEQ ID NO: 462341 - RNA, 13 nt, Homo sapiens
aucuauccuuuaa

SEQ ID NO: 462342 - RNA, 15 nt, Homo sapiens
aucucagcacucugu

SEQ ID NO: 462343 - RNA, 19 nt, Homo sapiens
aucucuugcacucaaagcu

SEQ ID NO: 462344 - RNA, 15 nt, Homo sapiens
aucuugauccuauga

SEQ ID NO: 462345 - RNA, 22 nt, Homo sapiens
augaaauggacaaacagugcac

SEQ ID NO: 462346 - RNA, 18 nt, Homo sapiens
augaaguuauucuugaca

SEQ ID NO: 462347 - RNA, 16 nt, Homo sapiens
augaugcccuaacuug

SEQ ID NO: 462348 - RNA, 13 nt, Homo sapiens
augauuuacucau

SEQ ID NO: 462349 - RNA, 21 nt, Homo sapiens
augcacaauuuauaauuacaa

SEQ ID NO: 462350 - RNA, 21 nt, Homo sapiens
augcuguuuuaaaaacaaaga

SEQ ID NO: 462351 - RNA, 17 nt, Homo sapiens
augcuuggacuagugag

SEQ ID NO: 462352 - RNA, 14 nt, Homo sapiens
augcuugucuggca

SEQ ID NO: 462353 - RNA, 18 nt, Homo sapiens
auggacaaacagugcacu

SEQ ID NO: 462354 - RNA, 20 nt, Homo sapiens
auggaccaauuagcauucca

SEQ ID NO: 462355 - RNA, 13 nt, Homo sapiens
auguagauugccu

SEQ ID NO: 462356 - RNA, 17 nt, Homo sapiens
augugaguguguggcac

SEQ ID NO: 462357 - RNA, 12 nt, Homo sapiens
augugucuucaa

SEQ ID NO: 462358 - RNA, 14 nt, Homo sapiens
auguucuagugauu

SEQ ID NO: 462359 - RNA, 16 nt, Homo sapiens
auuaaaaaaagacaua

SEQ ID NO: 462360 - RNA, 22 nt, Homo sapiens
auuaaaaaaagacauaauucac

SEQ ID NO: 462361 - RNA, 16 nt, Homo sapiens
auuaacugaauucuga

SEQ ID NO: 462362 - RNA, 16 nt, Homo sapiens
auuaauccacacauca

SEQ ID NO: 462363 - RNA, 16 nt, Homo sapiens
auuacucugcucuuug

SEQ ID NO: 462364 - RNA, 24 nt, Homo sapiens
auuauagcagagguaaguuaggaa

SEQ ID NO: 462365 - RNA, 13 nt, Homo sapiens
auuauauauuaac

SEQ ID NO: 462366 - RNA, 22 nt, Homo sapiens
auuaugacacuagauacaguaa

SEQ ID NO: 462367 - RNA, 21 nt, Homo sapiens
auuaugcuguuaaaacuacuu

SEQ ID NO: 462368 - RNA, 21 nt, Homo sapiens
auucaauaaagcugcugagaa

SEQ ID NO: 462369 - RNA, 22 nt, Homo sapiens
auucacucauguuucgugugua

SEQ ID NO: 462370 - RNA, 17 nt, Homo sapiens
auucagaguccuugcaa

SEQ ID NO: 462371 - RNA, 15 nt, Homo sapiens
auucuccugccucag

SEQ ID NO: 462372 - RNA, 17 nt, Homo sapiens
auucuugacaugagaaa

SEQ ID NO: 462373 - RNA, 21 nt, Homo sapiens
auugaaauaauuacuaauuaa

SEQ ID NO: 462374 - RNA, 17 nt, Homo sapiens
auugauaugcuuauaca

SEQ ID NO: 462375 - RNA, 15 nt, Homo sapiens
auugccaucauucua

SEQ ID NO: 462376 - RNA, 21 nt, Homo sapiens
auugccuuuggcaauucuucu

SEQ ID NO: 462377 - RNA, 20 nt, Homo sapiens
auugguuugagaacuucucu

SEQ ID NO: 462378 - RNA, 15 nt, Homo sapiens
auuguaaguaccccu

SEQ ID NO: 462379 - RNA, 14 nt, Homo sapiens
auuguacagaauca

SEQ ID NO: 462380 - RNA, 14 nt, Homo sapiens
auugucuuaauguc

SEQ ID NO: 462381 - RNA, 16 nt, Homo sapiens
auuucacaaaucacca

SEQ ID NO: 462382 - RNA, 12 nt, Homo sapiens
auuucacugaca

SEQ ID NO: 462383 - RNA, 17 nt, Homo sapiens
auuucauguaaccaaga

SEQ ID NO: 462384 - RNA, 16 nt, Homo sapiens
auuuggauuuuccacc

SEQ ID NO: 462385 - RNA, 16 nt, Homo sapiens
auuuuccaccaaauuc

SEQ ID NO: 462386 - RNA, 19 nt, Homo sapiens
auuuuuacuaaagcagugu

SEQ ID NO: 462387 - RNA, 16 nt, Homo sapiens
caaaaacaguaaaaau

SEQ ID NO: 462388 - RNA, 10 nt, Homo sapiens
caaaaacugu

SEQ ID NO: 462389 - RNA, 16 nt, Homo sapiens
caaaaagaccaagaag

SEQ ID NO: 462390 - RNA, 21 nt, Homo sapiens
caaaaaguuguuuuauccauu

SEQ ID NO: 462391 - RNA, 19 nt, Homo sapiens
caaacagccucacuccuca

SEQ ID NO: 462392 - RNA, 22 nt, Homo sapiens
caaagugcugggauuacaggca

SEQ ID NO: 462393 - RNA, 20 nt, Homo sapiens
caaauauucagaaaaugaag

SEQ ID NO: 462394 - RNA, 17 nt, Homo sapiens
caaaugguguccaaaga

SEQ ID NO: 462395 - RNA, 17 nt, Homo sapiens
caacuagaaacagcucc

SEQ ID NO: 462396 - RNA, 22 nt, Homo sapiens
caacucucuccuguauaaucuc

SEQ ID NO: 462397 - RNA, 18 nt, Homo sapiens
caacuuguguucuauuaa

SEQ ID NO: 462398 - RNA, 12 nt, Homo sapiens
caagacagaugg

SEQ ID NO: 462399 - RNA, 16 nt, Homo sapiens
caagcacugacacuca

SEQ ID NO: 462400 - RNA, 18 nt, Homo sapiens
caagcccacagaugagaa

SEQ ID NO: 462401 - RNA, 21 nt, Homo sapiens
caagggccauucaguacauca

SEQ ID NO: 462402 - RNA, 15 nt, Homo sapiens
caaggucuguaauug

SEQ ID NO: 462403 - RNA, 19 nt, Homo sapiens
caaugcugaaugccuguua

SEQ ID NO: 462404 - RNA, 17 nt, Homo sapiens
caauuuauaauuacaau

SEQ ID NO: 462405 - RNA, 15 nt, Homo sapiens
caauuuguauaaaau

SEQ ID NO: 462406 - RNA, 18 nt, Homo sapiens
cacaaaagccugugcagg

SEQ ID NO: 462407 - RNA, 20 nt, Homo sapiens
cacaaaauguaggguuauaa

SEQ ID NO: 462408 - RNA, 20 nt, Homo sapiens
cacacucaauagucacggaa

SEQ ID NO: 462409 - RNA, 13 nt, Homo sapiens
cacacucagugac

SEQ ID NO: 462410 - RNA, 13 nt, Homo sapiens
cacaggaagugac

SEQ ID NO: 462411 - RNA, 19 nt, Homo sapiens
cacaucuaacaaagucaag

SEQ ID NO: 462412 - RNA, 15 nt, Homo sapiens
caccaagacugagaa

SEQ ID NO: 462413 - RNA, 20 nt, Homo sapiens
caccacugagccauccucag

SEQ ID NO: 462414 - RNA, 19 nt, Homo sapiens
cacccacucuccugugaga

SEQ ID NO: 462415 - RNA, 13 nt, Homo sapiens
caccucagccucc

SEQ ID NO: 462416 - RNA, 16 nt, Homo sapiens
caccuccugcaauaaa

SEQ ID NO: 462417 - RNA, 23 nt, Homo sapiens
caccugugauggcagggcuguga

SEQ ID NO: 462418 - RNA, 15 nt, Homo sapiens
caccuugccaagcuu

SEQ ID NO: 462419 - RNA, 16 nt, Homo sapiens
cacgagcugcugucca

SEQ ID NO: 462420 - RNA, 14 nt, Homo sapiens
cacgcacacgagaa

SEQ ID NO: 462421 - RNA, 18 nt, Homo sapiens
cacgcccccagcugugac

SEQ ID NO: 462422 - RNA, 21 nt, Homo sapiens
cacgccucccugagcacugac

SEQ ID NO: 462423 - RNA, 12 nt, Homo sapiens
cacucucaggug

SEQ ID NO: 462424 - RNA, 23 nt, Homo sapiens
cacucugcucucaggagaucugg

SEQ ID NO: 462425 - RNA, 16 nt, Homo sapiens
cacugagccauccuca

SEQ ID NO: 462426 - RNA, 14 nt, Homo sapiens
cacugcaaccucca

SEQ ID NO: 462427 - RNA, 19 nt, Homo sapiens
cagaaucggcuuugcagug

SEQ ID NO: 462428 - RNA, 15 nt, Homo sapiens
cagaccuucuuccac

SEQ ID NO: 462429 - RNA, 14 nt, Homo sapiens
cagacgaaacacaa

SEQ ID NO: 462430 - RNA, 14 nt, Homo sapiens
cagacguacaggcc

SEQ ID NO: 462431 - RNA, 16 nt, Homo sapiens
cagaggacgagugcuu

SEQ ID NO: 462432 - RNA, 17 nt, Homo sapiens
cagaguccuugcaaaau

SEQ ID NO: 462433 - RNA, 18 nt, Homo sapiens
cagaucccauccaucagc

SEQ ID NO: 462434 - RNA, 16 nt, Homo sapiens
cagaugagcuuacaag

SEQ ID NO: 462435 - RNA, 21 nt, Homo sapiens
cagauuaucuuguacagccuu

SEQ ID NO: 462436 - RNA, 23 nt, Homo sapiens
cagcacucugugggucuggugau

SEQ ID NO: 462437 - RNA, 17 nt, Homo sapiens
cagcaggaugcucagug

SEQ ID NO: 462438 - RNA, 15 nt, Homo sapiens
cagcauacugacucc

SEQ ID NO: 462439 - RNA, 15 nt, Homo sapiens
cagcccaacugugag

SEQ ID NO: 462440 - RNA, 20 nt, Homo sapiens
cagccuccgaaguagcuggg

SEQ ID NO: 462441 - RNA, 15 nt, Homo sapiens
cagccucugaaguug

SEQ ID NO: 462442 - RNA, 21 nt, Homo sapiens
cagccugaccaacauggugaa

SEQ ID NO: 462443 - RNA, 19 nt, Homo sapiens
cagcuacucaggaggcuaa

SEQ ID NO: 462444 - RNA, 19 nt, Homo sapiens
cagcucacugcaaccucca

SEQ ID NO: 462445 - RNA, 19 nt, Homo sapiens
cagcucuuccaaucuccau

SEQ ID NO: 462446 - RNA, 23 nt, Homo sapiens
cagcugccagcccaacugugaga

SEQ ID NO: 462447 - RNA, 17 nt, Homo sapiens
cagcugugcuguaacac

SEQ ID NO: 462448 - RNA, 20 nt, Homo sapiens
caggaggcggagguugcagu

SEQ ID NO: 462449 - RNA, 16 nt, Homo sapiens
caggagguacugugag

SEQ ID NO: 462450 - RNA, 18 nt, Homo sapiens
caggaugauuguacagaa

SEQ ID NO: 462451 - RNA, 12 nt, Homo sapiens
caggcaccagca

SEQ ID NO: 462452 - RNA, 20 nt, Homo sapiens
caggcaugagccacugugcc

SEQ ID NO: 462453 - RNA, 15 nt, Homo sapiens
cagggccaggugcuu

SEQ ID NO: 462454 - RNA, 18 nt, Homo sapiens
cagggccaggugcuuuag

SEQ ID NO: 462455 - RNA, 12 nt, Homo sapiens
cagguagacuuu

SEQ ID NO: 462456 - RNA, 19 nt, Homo sapiens
caguaaauguuugugaugu

SEQ ID NO: 462457 - RNA, 21 nt, Homo sapiens
caguaagaauuauuuacugaa

SEQ ID NO: 462458 - RNA, 20 nt, Homo sapiens
caguaauguauucuaucucu

SEQ ID NO: 462459 - RNA, 13 nt, Homo sapiens
cagucaucuccaa

SEQ ID NO: 462460 - RNA, 24 nt, Homo sapiens
cagucucugcugaucacaugugcc

SEQ ID NO: 462461 - RNA, 18 nt, Homo sapiens
caguggugcaaucuuggc

SEQ ID NO: 462462 - RNA, 16 nt, Homo sapiens
caguguuuucaccuca

SEQ ID NO: 462463 - RNA, 17 nt, Homo sapiens
caguguuuucaccucau

SEQ ID NO: 462464 - RNA, 14 nt, Homo sapiens
caguuuugucauug

SEQ ID NO: 462465 - RNA, 22 nt, Homo sapiens
caucagcccucauguuucauug

SEQ ID NO: 462466 - RNA, 19 nt, Homo sapiens
cauccuuuuuaaaugagac

SEQ ID NO: 462467 - RNA, 18 nt, Homo sapiens
caucgcaguggacugugu

SEQ ID NO: 462468 - RNA, 17 nt, Homo sapiens
caugaaaauuaugucag

SEQ ID NO: 462469 - RNA, 14 nt, Homo sapiens
caugauguaaaaaa

SEQ ID NO: 462470 - RNA, 15 nt, Homo sapiens
cauggagccugcuga

SEQ ID NO: 462471 - RNA, 13 nt, Homo sapiens
cauguaaccaaga

SEQ ID NO: 462472 - RNA, 22 nt, Homo sapiens
cauguaaccaagaguauuccau

SEQ ID NO: 462473 - RNA, 17 nt, Homo sapiens
cauguauuaugauuaaa

SEQ ID NO: 462474 - RNA, 16 nt, Homo sapiens
cauuaccgucugugau

SEQ ID NO: 462475 - RNA, 12 nt, Homo sapiens
cauuaugcugcu

SEQ ID NO: 462476 - RNA, 20 nt, Homo sapiens
cauuauuacuccuugccauu

SEQ ID NO: 462477 - RNA, 18 nt, Homo sapiens
cauuauuuccccuucaaa

SEQ ID NO: 462478 - RNA, 23 nt, Homo sapiens
cauuggauccuccccgacugugg

SEQ ID NO: 462479 - RNA, 21 nt, Homo sapiens
cauuuuuuuguacuaauguga

SEQ ID NO: 462480 - RNA, 18 nt, Homo sapiens
ccaaaaucauaaugccau

SEQ ID NO: 462481 - RNA, 18 nt, Homo sapiens
ccaaagugcagggauuac

SEQ ID NO: 462482 - RNA, 18 nt, Homo sapiens
ccaaagugcugggauuac

SEQ ID NO: 462483 - RNA, 12 nt, Homo sapiens
ccaagcuuucuu

SEQ ID NO: 462484 - RNA, 14 nt, Homo sapiens
ccaauuuacauacu

SEQ ID NO: 462485 - RNA, 12 nt, Homo sapiens
ccacacuugaau

SEQ ID NO: 462486 - RNA, 10 nt, Homo sapiens
ccaccucuca

SEQ ID NO: 462487 - RNA, 13 nt, Homo sapiens
ccaccuugcacua

SEQ ID NO: 462488 - RNA, 22 nt, Homo sapiens
ccacuagacguuguaaugcaca

SEQ ID NO: 462489 - RNA, 21 nt, Homo sapiens
ccagagccccccacaaugaug

SEQ ID NO: 462490 - RNA, 23 nt, Homo sapiens
ccaggagacagacagagaaggca

SEQ ID NO: 462491 - RNA, 17 nt, Homo sapiens
ccaggcuggagugcagu

SEQ ID NO: 462492 - RNA, 19 nt, Homo sapiens
ccaggcuggagugcagugg

SEQ ID NO: 462493 - RNA, 23 nt, Homo sapiens
ccaggcuggagugcaguggcacg

SEQ ID NO: 462494 - RNA, 23 nt, Homo sapiens
ccaggcuggagugcaguggugca

SEQ ID NO: 462495 - RNA, 13 nt, Homo sapiens
ccagguagacuuu

SEQ ID NO: 462496 - RNA, 17 nt, Homo sapiens
ccaggugagagcccuuu

SEQ ID NO: 462497 - RNA, 15 nt, Homo sapiens
ccaguauaagcauuu

SEQ ID NO: 462498 - RNA, 13 nt, Homo sapiens
ccaucccaaaaau

SEQ ID NO: 462499 - RNA, 20 nt, Homo sapiens
ccaugugccugcaccaggag

SEQ ID NO: 462500 - RNA, 13 nt, Homo sapiens
cccaacugugaga

SEQ ID NO: 462501 - RNA, 23 nt, Homo sapiens
cccaaguauugauuuaacuucau

SEQ ID NO: 462502 - RNA, 17 nt, Homo sapiens
cccaccuccugcaauaa

SEQ ID NO: 462503 - RNA, 13 nt, Homo sapiens
cccauagugugca

SEQ ID NO: 462504 - RNA, 23 nt, Homo sapiens
cccauggauguuucuucuuugac

SEQ ID NO: 462505 - RNA, 18 nt, Homo sapiens
ccccaccacugagccauc

SEQ ID NO: 462506 - RNA, 16 nt, Homo sapiens
cccccuuuccaaaaac

SEQ ID NO: 462507 - RNA, 23 nt, Homo sapiens
ccccuuagccaguuguauauuau

SEQ ID NO: 462508 - RNA, 11 nt, Homo sapiens
cccgugugagg

SEQ ID NO: 462509 - RNA, 15 nt, Homo sapiens
cccugauaagcaaau

SEQ ID NO: 462510 - RNA, 16 nt, Homo sapiens
cccuggccuaggcagu

SEQ ID NO: 462511 - RNA, 15 nt, Homo sapiens
cccuguuaagcaauu

SEQ ID NO: 462512 - RNA, 15 nt, Homo sapiens
cccuugaaaacugcu

SEQ ID NO: 462513 - RNA, 18 nt, Homo sapiens
ccgcauuuggauuggaug

SEQ ID NO: 462514 - RNA, 20 nt, Homo sapiens
ccgccaccacgcccggcuaa

SEQ ID NO: 462515 - RNA, 21 nt, Homo sapiens
ccggaaguugcugugccccau

SEQ ID NO: 462516 - RNA, 16 nt, Homo sapiens
ccuagagaaacgcaag

SEQ ID NO: 462517 - RNA, 11 nt, Homo sapiens
ccuaucaccuc

SEQ ID NO: 462518 - RNA, 16 nt, Homo sapiens
ccuaucuguaugucug

SEQ ID NO: 462519 - RNA, 16 nt, Homo sapiens
ccucaaagaggccuua

SEQ ID NO: 462520 - RNA, 15 nt, Homo sapiens
ccucagcaacagcca

SEQ ID NO: 462521 - RNA, 19 nt, Homo sapiens
ccucagggcagggauacaa

SEQ ID NO: 462522 - RNA, 20 nt, Homo sapiens
ccuccaucauuaaugugaag

SEQ ID NO: 462523 - RNA, 21 nt, Homo sapiens
ccucccaaagugcugggauua

SEQ ID NO: 462524 - RNA, 21 nt, Homo sapiens
ccuccugagcagcugggauua

SEQ ID NO: 462525 - RNA, 14 nt, Homo sapiens
ccugagcacugacu

SEQ ID NO: 462526 - RNA, 20 nt, Homo sapiens
ccugagguugcuuuauccua

SEQ ID NO: 462527 - RNA, 12 nt, Homo sapiens
ccugauaagcaa

SEQ ID NO: 462528 - RNA, 13 nt, Homo sapiens
ccugauaagcaaa

SEQ ID NO: 462529 - RNA, 16 nt, Homo sapiens
ccuggggacauuggga

SEQ ID NO: 462530 - RNA, 22 nt, Homo sapiens
ccuguucauuguaagcacuuuu

SEQ ID NO: 462531 - RNA, 16 nt, Homo sapiens
ccuguuuuauaauuca

SEQ ID NO: 462532 - RNA, 15 nt, Homo sapiens
ccuucuugcuucuca

SEQ ID NO: 462533 - RNA, 17 nt, Homo sapiens
ccuugguaaaaacugca

SEQ ID NO: 462534 - RNA, 16 nt, Homo sapiens
ccuuuccaaaaacugu

SEQ ID NO: 462535 - RNA, 19 nt, Homo sapiens
ccuuuccaaaaacuguuaa

SEQ ID NO: 462536 - RNA, 18 nt, Homo sapiens
ccuuuucaucuccagugu

SEQ ID NO: 462537 - RNA, 20 nt, Homo sapiens
ccuuuugacagcugugcugu

SEQ ID NO: 462538 - RNA, 16 nt, Homo sapiens
cgaacuccugaccuca

SEQ ID NO: 462539 - RNA, 14 nt, Homo sapiens
cgacugaagugugu

SEQ ID NO: 462540 - RNA, 17 nt, Homo sapiens
cgagcaugaacuggccc

SEQ ID NO: 462541 - RNA, 21 nt, Homo sapiens
cgagcuguguagccacugacu

SEQ ID NO: 462542 - RNA, 22 nt, Homo sapiens
cgagggaugggauuucauguaa

SEQ ID NO: 462543 - RNA, 20 nt, Homo sapiens
cgauugucugggcaaugaaa

SEQ ID NO: 462544 - RNA, 20 nt, Homo sapiens
cgccccugguggguggcacu

SEQ ID NO: 462545 - RNA, 21 nt, Homo sapiens
cgccuccccaccacugagcca

SEQ ID NO: 462546 - RNA, 22 nt, Homo sapiens
cggcagcugguucugcaaugac

SEQ ID NO: 462547 - RNA, 17 nt, Homo sapiens
cggccuuuguugcucag

SEQ ID NO: 462548 - RNA, 16 nt, Homo sapiens
cguacacacucaguga

SEQ ID NO: 462549 - RNA, 16 nt, Homo sapiens
cgucgccacucgggag

SEQ ID NO: 462550 - RNA, 22 nt, Homo sapiens
cgugagaccgcagucugcuuag

SEQ ID NO: 462551 - RNA, 21 nt, Homo sapiens
cuaaacuucauacaauguaag

SEQ ID NO: 462552 - RNA, 23 nt, Homo sapiens
cuaaagcaguguuuucaccucau

SEQ ID NO: 462553 - RNA, 15 nt, Homo sapiens
cuaaguaugaucuau

SEQ ID NO: 462554 - RNA, 14 nt, Homo sapiens
cuaauuaaucacaa

SEQ ID NO: 462555 - RNA, 13 nt, Homo sapiens
cuacacuguauua

SEQ ID NO: 462556 - RNA, 13 nt, Homo sapiens
cuacagacauuaa

SEQ ID NO: 462557 - RNA, 19 nt, Homo sapiens
cuacuuugccacagauuau

SEQ ID NO: 462558 - RNA, 14 nt, Homo sapiens
cuagaaguggcaga

SEQ ID NO: 462559 - RNA, 12 nt, Homo sapiens
cuaggacauaua

SEQ ID NO: 462560 - RNA, 17 nt, Homo sapiens
cuauauucaaaauucaa

SEQ ID NO: 462561 - RNA, 20 nt, Homo sapiens
cuauuaaauguauaugucau

SEQ ID NO: 462562 - RNA, 19 nt, Homo sapiens
cucaaaagauuguuuuaua

SEQ ID NO: 462563 - RNA, 13 nt, Homo sapiens
cucaaacuccuga

SEQ ID NO: 462564 - RNA, 19 nt, Homo sapiens
cucaaacuccugaccucag

SEQ ID NO: 462565 - RNA, 13 nt, Homo sapiens
cucagcacucugc

SEQ ID NO: 462566 - RNA, 18 nt, Homo sapiens
cucagcacugugccagug

SEQ ID NO: 462567 - RNA, 17 nt, Homo sapiens
cucagccucccaaagug

SEQ ID NO: 462568 - RNA, 18 nt, Homo sapiens
cucagccucccaaagugc

SEQ ID NO: 462569 - RNA, 19 nt, Homo sapiens
cucagguuccaaauucagu

SEQ ID NO: 462570 - RNA, 18 nt, Homo sapiens
cucauccaaaaagucuga

SEQ ID NO: 462571 - RNA, 15 nt, Homo sapiens
cucauggauuugaau

SEQ ID NO: 462572 - RNA, 18 nt, Homo sapiens
cucauuguagacaugggu

SEQ ID NO: 462573 - RNA, 15 nt, Homo sapiens
cucccaaaguguccu

SEQ ID NO: 462574 - RNA, 15 nt, Homo sapiens
cucccaucagggucc

SEQ ID NO: 462575 - RNA, 18 nt, Homo sapiens
cuccccagccaggcugcc

SEQ ID NO: 462576 - RNA, 20 nt, Homo sapiens
cucccgaguagcugggauua

SEQ ID NO: 462577 - RNA, 11 nt, Homo sapiens
cuccucugucc

SEQ ID NO: 462578 - RNA, 20 nt, Homo sapiens
cuccugagcagcugggauua

SEQ ID NO: 462579 - RNA, 12 nt, Homo sapiens
cucgccacuggg

SEQ ID NO: 462580 - RNA, 20 nt, Homo sapiens
cucuaucauguugaagucaa

SEQ ID NO: 462581 - RNA, 20 nt, Homo sapiens
cucucacuaaguaugaucua

SEQ ID NO: 462582 - RNA, 22 nt, Homo sapiens
cucuccugauuauuuaucacau

SEQ ID NO: 462583 - RNA, 13 nt, Homo sapiens
cucuccugugaga

SEQ ID NO: 462584 - RNA, 14 nt, Homo sapiens
cucucugcuucugu

SEQ ID NO: 462585 - RNA, 12 nt, Homo sapiens
cucucuuuacau

SEQ ID NO: 462586 - RNA, 17 nt, Homo sapiens
cucugcucucaggagau

SEQ ID NO: 462587 - RNA, 13 nt, Homo sapiens
cucuuaugcacac

SEQ ID NO: 462588 - RNA, 13 nt, Homo sapiens
cucuugcacucaa

SEQ ID NO: 462589 - RNA, 17 nt, Homo sapiens
cugaaggaaauaaugca

SEQ ID NO: 462590 - RNA, 17 nt, Homo sapiens
cugaagugagaacccag

SEQ ID NO: 462591 - RNA, 15 nt, Homo sapiens
cugaaguuucauuua

SEQ ID NO: 462592 - RNA, 22 nt, Homo sapiens
cugaaguuucauuuaugauaca

SEQ ID NO: 462593 - RNA, 19 nt, Homo sapiens
cugaauuuguagacauacu

SEQ ID NO: 462594 - RNA, 17 nt, Homo sapiens
cugaccaacauggugaa

SEQ ID NO: 462595 - RNA, 20 nt, Homo sapiens
cugaccauccaggcauauag

SEQ ID NO: 462596 - RNA, 14 nt, Homo sapiens
cugagaaucuagcc

SEQ ID NO: 462597 - RNA, 22 nt, Homo sapiens
cugaggacguggugacuuccug

SEQ ID NO: 462598 - RNA, 18 nt, Homo sapiens
cugagguaacugucauua

SEQ ID NO: 462599 - RNA, 12 nt, Homo sapiens
cugauaagcaaa

SEQ ID NO: 462600 - RNA, 13 nt, Homo sapiens
cugauaagcaaau

SEQ ID NO: 462601 - RNA, 22 nt, Homo sapiens
cugcaggccccggggaccccag

SEQ ID NO: 462602 - RNA, 18 nt, Homo sapiens
cugcauuuuacuguacag

SEQ ID NO: 462603 - RNA, 21 nt, Homo sapiens
cugccagggcaccuacugaga

SEQ ID NO: 462604 - RNA, 18 nt, Homo sapiens
cugcccugccaccugucu

SEQ ID NO: 462605 - RNA, 23 nt, Homo sapiens
cugccugaauugagaauuuugau

SEQ ID NO: 462606 - RNA, 18 nt, Homo sapiens
cugcucuuuggaaauggc

SEQ ID NO: 462607 - RNA, 13 nt, Homo sapiens
cugcugaggcucc

SEQ ID NO: 462608 - RNA, 22 nt, Homo sapiens
cugcuguccaggaacuuuccag

SEQ ID NO: 462609 - RNA, 18 nt, Homo sapiens
cuggaacacaaccauagc

SEQ ID NO: 462610 - RNA, 23 nt, Homo sapiens
cuggaacacaaccauagccuguu

SEQ ID NO: 462611 - RNA, 12 nt, Homo sapiens
cuggacgcauca

SEQ ID NO: 462612 - RNA, 19 nt, Homo sapiens
cuggacuugcagaguacau

SEQ ID NO: 462613 - RNA, 20 nt, Homo sapiens
cuggagugcaguggcacgau

SEQ ID NO: 462614 - RNA, 20 nt, Homo sapiens
cuggagugcaguggcgcaau

SEQ ID NO: 462615 - RNA, 19 nt, Homo sapiens
cuggauuccucgaaacugc

SEQ ID NO: 462616 - RNA, 22 nt, Homo sapiens
cuggcagcaggaugcucaguga

SEQ ID NO: 462617 - RNA, 13 nt, Homo sapiens
cuguauuaacuga

SEQ ID NO: 462618 - RNA, 16 nt, Homo sapiens
cuguauuacauaaaua

SEQ ID NO: 462619 - RNA, 15 nt, Homo sapiens
cugucaccagguuug

SEQ ID NO: 462620 - RNA, 14 nt, Homo sapiens
cugucagaccuucu

SEQ ID NO: 462621 - RNA, 12 nt, Homo sapiens
cugucccaaaga

SEQ ID NO: 462622 - RNA, 17 nt, Homo sapiens
uagaagggucacuuuaa

SEQ ID NO: 462623 - RNA, 13 nt, Homo sapiens
uagaagucagcca

SEQ ID NO: 462624 - RNA, 20 nt, Homo sapiens
uagccuguuucguagccaua

SEQ ID NO: 462625 - RNA, 18 nt, Homo sapiens
uagcugggauuacaggcg

SEQ ID NO: 462626 - RNA, 18 nt, Homo sapiens
uaggccuuccagugcagg

SEQ ID NO: 462627 - RNA, 19 nt, Homo sapiens
uaggguaauugcugaggug

SEQ ID NO: 462628 - RNA, 14 nt, Homo sapiens
uagugaaaucuugu

SEQ ID NO: 462629 - RNA, 13 nt, Homo sapiens
uagugcuuuccag

SEQ ID NO: 462630 - RNA, 17 nt, Homo sapiens
uagugcuuuccaguuca

SEQ ID NO: 462631 - RNA, 20 nt, Homo sapiens
uaguuagacuuaaaaacuug

SEQ ID NO: 462632 - RNA, 17 nt, Homo sapiens
uaguuuuuucuccucau

SEQ ID NO: 462633 - RNA, 19 nt, Homo sapiens
uauaagauucauauuuacu

SEQ ID NO: 462634 - RNA, 22 nt, Homo sapiens
uauaauuacaaugcacaauuua

SEQ ID NO: 462635 - RNA, 23 nt, Homo sapiens
uauacacuuacacuuuaugcaca

SEQ ID NO: 462636 - RNA, 12 nt, Homo sapiens
uauacauuugau

SEQ ID NO: 462637 - RNA, 18 nt, Homo sapiens
uauagaaaacgauuuuga

SEQ ID NO: 462638 - RNA, 21 nt, Homo sapiens
uauaguuguuggccuuuuugc

SEQ ID NO: 462639 - RNA, 15 nt, Homo sapiens
uauauaauacauuaa

SEQ ID NO: 462640 - RNA, 20 nt, Homo sapiens
uauauguaguacuaacuaag

SEQ ID NO: 462641 - RNA, 12 nt, Homo sapiens
uauaugugauaa

SEQ ID NO: 462642 - RNA, 19 nt, Homo sapiens
uauauuuuugcuaaaccua

SEQ ID NO: 462643 - RNA, 14 nt, Homo sapiens
uauccuuuaaacuc

SEQ ID NO: 462644 - RNA, 23 nt, Homo sapiens
uauccuuuguacuguagcuaaau

SEQ ID NO: 462645 - RNA, 15 nt, Homo sapiens
uaucgccuuuugaca

SEQ ID NO: 462646 - RNA, 19 nt, Homo sapiens
uaucuaauaaauacuuaag

SEQ ID NO: 462647 - RNA, 19 nt, Homo sapiens
uaugaggagaugauaacug

SEQ ID NO: 462648 - RNA, 13 nt, Homo sapiens
uaugcacaccucc

SEQ ID NO: 462649 - RNA, 21 nt, Homo sapiens
uauggaccaauuagcauucca

SEQ ID NO: 462650 - RNA, 22 nt, Homo sapiens
uauguauuaaaauaucccaagc

SEQ ID NO: 462651 - RNA, 13 nt, Homo sapiens
uauucaaaauuca

SEQ ID NO: 462652 - RNA, 11 nt, Homo sapiens
uauucagaaaa

SEQ ID NO: 462653 - RNA, 13 nt, Homo sapiens
uauucaucugauu

SEQ ID NO: 462654 - RNA, 17 nt, Homo sapiens
uauuccauuuuuacuaa

SEQ ID NO: 462655 - RNA, 16 nt, Homo sapiens
uauucuugacaugaga

SEQ ID NO: 462656 - RNA, 20 nt, Homo sapiens
uauuuagagacagagucuca

SEQ ID NO: 462657 - RNA, 15 nt, Homo sapiens
uauuuaucacauagc

SEQ ID NO: 462658 - RNA, 16 nt, Homo sapiens
uauuuuaaaacauaag

SEQ ID NO: 462659 - RNA, 13 nt, Homo sapiens
uauuuuaucucuu

SEQ ID NO: 462660 - RNA, 16 nt, Homo sapiens
uauuuuuuucccaagg

SEQ ID NO: 462661 - RNA, 17 nt, Homo sapiens
ucaaacuccugaccuca

SEQ ID NO: 462662 - RNA, 19 nt, Homo sapiens
ucaaacuccugaccucagg

SEQ ID NO: 462663 - RNA, 20 nt, Homo sapiens
ucaaacuccugaccucaggu

SEQ ID NO: 462664 - RNA, 20 nt, Homo sapiens
ucaagagauucuccugccuc

SEQ ID NO: 462665 - RNA, 21 nt, Homo sapiens
ucaagagauucuccugccuca

SEQ ID NO: 462666 - RNA, 18 nt, Homo sapiens
ucaagcuucuugccaguu

SEQ ID NO: 462667 - RNA, 20 nt, Homo sapiens
ucaauaccccuguuaagcaa

SEQ ID NO: 462668 - RNA, 14 nt, Homo sapiens
ucaauauuugaucu

SEQ ID NO: 462669 - RNA, 21 nt, Homo sapiens
ucacaaaugugaaguuaugca

SEQ ID NO: 462670 - RNA, 18 nt, Homo sapiens
ucaccggucagugccuuu

SEQ ID NO: 462671 - RNA, 17 nt, Homo sapiens
ucaccucuuaugcacac

SEQ ID NO: 462672 - RNA, 23 nt, Homo sapiens
ucacuaaugugguuauuuuacau

SEQ ID NO: 462673 - RNA, 19 nt, Homo sapiens
ucacucuggccacagguga

SEQ ID NO: 462674 - RNA, 15 nt, Homo sapiens
ucacugcaaccucca

SEQ ID NO: 462675 - RNA, 23 nt, Homo sapiens
ucacugccagugcagauguuuua

SEQ ID NO: 462676 - RNA, 19 nt, Homo sapiens
ucacugcucggaaggggaa

SEQ ID NO: 462677 - RNA, 18 nt, Homo sapiens
ucacuugaguuguugcuu

SEQ ID NO: 462678 - RNA, 13 nt, Homo sapiens
ucagaaugucaga

SEQ ID NO: 462679 - RNA, 16 nt, Homo sapiens
ucagaccaacucucuc

SEQ ID NO: 462680 - RNA, 12 nt, Homo sapiens
ucagauucauga

SEQ ID NO: 462681 - RNA, 20 nt, Homo sapiens
ccgccaccaugcccggcuaa

SEQ ID NO: 462682 - RNA, 15 nt, Homo sapiens
ccgccucagccuccc

SEQ ID NO: 462683 - RNA, 18 nt, Homo sapiens
ccgcugcgucugcacuga

SEQ ID NO: 462684 - RNA, 14 nt, Homo sapiens
ccgggcaagacuuu

SEQ ID NO: 462685 - RNA, 19 nt, Homo sapiens
ccgggcuggccugugccua

SEQ ID NO: 462686 - RNA, 10 nt, Homo sapiens
ccgugaugcu

SEQ ID NO: 462687 - RNA, 22 nt, Homo sapiens
ccucagccucccaaagugcagg

SEQ ID NO: 462688 - RNA, 14 nt, Homo sapiens
ccucagccuccuga

SEQ ID NO: 462689 - RNA, 14 nt, Homo sapiens
ccucauucuucucu

SEQ ID NO: 462690 - RNA, 20 nt, Homo sapiens
ccucccaaagugcugggauu

SEQ ID NO: 462691 - RNA, 13 nt, Homo sapiens
ccucccacucuau

SEQ ID NO: 462692 - RNA, 20 nt, Homo sapiens
ccuccgaaguagcugggauu

SEQ ID NO: 462693 - RNA, 20 nt, Homo sapiens
ccuccugagcagcugggauu

SEQ ID NO: 462694 - RNA, 13 nt, Homo sapiens
ccugaacaucagc

SEQ ID NO: 462695 - RNA, 15 nt, Homo sapiens
ccugggccuuggcaa

SEQ ID NO: 462696 - RNA, 14 nt, Homo sapiens
ccuguuaagcaauu

SEQ ID NO: 462697 - RNA, 12 nt, Homo sapiens
ccuuaauuugau

SEQ ID NO: 462698 - RNA, 23 nt, Homo sapiens
ccuuacauuauuacuccuugcca

SEQ ID NO: 462699 - RNA, 19 nt, Homo sapiens
ccuucaaacaaauaauauu

SEQ ID NO: 462700 - RNA, 22 nt, Homo sapiens
ccuucuuucaagcuucuugcca

SEQ ID NO: 462701 - RNA, 15 nt, Homo sapiens
ccuugccauuuucaa

SEQ ID NO: 462702 - RNA, 16 nt, Homo sapiens
ccuugguuaucaaaua

SEQ ID NO: 462703 - RNA, 18 nt, Homo sapiens
ccuugguuaucaaauaca

SEQ ID NO: 462704 - RNA, 14 nt, Homo sapiens
ccuuguaucuugca

SEQ ID NO: 462705 - RNA, 22 nt, Homo sapiens
ccuuuccugaucacuaugcauu

SEQ ID NO: 462706 - RNA, 22 nt, Homo sapiens
cgaggagugacugccaaaaagg

SEQ ID NO: 462707 - RNA, 21 nt, Homo sapiens
cgcggccguggccucugaggg

SEQ ID NO: 462708 - RNA, 21 nt, Homo sapiens
cgcuaccagggggucagaggg

SEQ ID NO: 462709 - RNA, 16 nt, Homo sapiens
cgcugcagugugagua

SEQ ID NO: 462710 - RNA, 20 nt, Homo sapiens
cgcuuugauaauacuuccaa

SEQ ID NO: 462711 - RNA, 16 nt, Homo sapiens
cggaacucuucaucuu

SEQ ID NO: 462712 - RNA, 14 nt, Homo sapiens
cggccuaugauucu

SEQ ID NO: 462713 - RNA, 16 nt, Homo sapiens
cggcgugugcagugcc

SEQ ID NO: 462714 - RNA, 14 nt, Homo sapiens
cggcuuugcagugc

SEQ ID NO: 462715 - RNA, 14 nt, Homo sapiens
cgggccaugauucu

SEQ ID NO: 462716 - RNA, 17 nt, Homo sapiens
cggggauagaccaaaga

SEQ ID NO: 462717 - RNA, 18 nt, Homo sapiens
cgguggcucuugccugua

SEQ ID NO: 462718 - RNA, 15 nt, Homo sapiens
cguacacacucagug

SEQ ID NO: 462719 - RNA, 19 nt, Homo sapiens
cguaguuuuuucuccucau

SEQ ID NO: 462720 - RNA, 17 nt, Homo sapiens
cgucugugauugccauu

SEQ ID NO: 462721 - RNA, 14 nt, Homo sapiens
cgugugaggacuga

SEQ ID NO: 462722 - RNA, 21 nt, Homo sapiens
cuaaaaaauuccuaggugcua

SEQ ID NO: 462723 - RNA, 22 nt, Homo sapiens
cuaaaccccggcgugugcagug

SEQ ID NO: 462724 - RNA, 14 nt, Homo sapiens
cuaauaaauacuua

SEQ ID NO: 462725 - RNA, 23 nt, Homo sapiens
cuaaugugguuauuuuacauuaa

SEQ ID NO: 462726 - RNA, 15 nt, Homo sapiens
cuacaaccagagccc

SEQ ID NO: 462727 - RNA, 13 nt, Homo sapiens
cuacacagaggac

SEQ ID NO: 462728 - RNA, 17 nt, Homo sapiens
cuacacagaggacccag

SEQ ID NO: 462729 - RNA, 22 nt, Homo sapiens
cuacaguaaauguuugugaugu

SEQ ID NO: 462730 - RNA, 21 nt, Homo sapiens
cuacauuuugaaggugaugca

SEQ ID NO: 462731 - RNA, 13 nt, Homo sapiens
cuaccagauuuga

SEQ ID NO: 462732 - RNA, 21 nt, Homo sapiens
cuaccagggggucagagggau

SEQ ID NO: 462733 - RNA, 21 nt, Homo sapiens
cuaccauuauuuccccuucaa

SEQ ID NO: 462734 - RNA, 13 nt, Homo sapiens
cuacugcugugag

SEQ ID NO: 462735 - RNA, 13 nt, Homo sapiens
cuacuuugccaca

SEQ ID NO: 462736 - RNA, 18 nt, Homo sapiens
cuagaagggucacuuuaa

SEQ ID NO: 462737 - RNA, 20 nt, Homo sapiens
cuagccuuaagacauuugaa

SEQ ID NO: 462738 - RNA, 19 nt, Homo sapiens
cuauagaaaacgauuuuga

SEQ ID NO: 462739 - RNA, 20 nt, Homo sapiens
cuaucacagcggggaugcuu

SEQ ID NO: 462740 - RNA, 14 nt, Homo sapiens
cuaucauguugaag

SEQ ID NO: 462741 - RNA, 20 nt, Homo sapiens
cucaaacuccugaccucagg

SEQ ID NO: 462742 - RNA, 22 nt, Homo sapiens
cucaaacuccugaccucaggug

SEQ ID NO: 462743 - RNA, 19 nt, Homo sapiens
cucaacgagagcacuugaa

SEQ ID NO: 462744 - RNA, 14 nt, Homo sapiens
cucaagcacugaca

SEQ ID NO: 462745 - RNA, 21 nt, Homo sapiens
cucaagcacugacacucauua

SEQ ID NO: 462746 - RNA, 13 nt, Homo sapiens
cucagaacugcaa

SEQ ID NO: 462747 - RNA, 21 nt, Homo sapiens
cucagccucccaaagugcagg

SEQ ID NO: 462748 - RNA, 19 nt, Homo sapiens
cucagcguuccuggacaaa

SEQ ID NO: 462749 - RNA, 19 nt, Homo sapiens
cucaggacacagugggaca

SEQ ID NO: 462750 - RNA, 13 nt, Homo sapiens
cucaggagaucug

SEQ ID NO: 462751 - RNA, 12 nt, Homo sapiens
cucagugcuguc

SEQ ID NO: 462752 - RNA, 20 nt, Homo sapiens
cucauccuuuuuaaaugaga

SEQ ID NO: 462753 - RNA, 17 nt, Homo sapiens
cuccaauugcaguggau

SEQ ID NO: 462754 - RNA, 16 nt, Homo sapiens
cuccauguuugaugua

SEQ ID NO: 462755 - RNA, 18 nt, Homo sapiens
cucccaaagugcagggau

SEQ ID NO: 462756 - RNA, 14 nt, Homo sapiens
cucccagguucaag

SEQ ID NO: 462757 - RNA, 18 nt, Homo sapiens
cucccuggccuaggcagu

SEQ ID NO: 462758 - RNA, 19 nt, Homo sapiens
cuccgaaugucaagguucc

SEQ ID NO: 462759 - RNA, 17 nt, Homo sapiens
cuccgugaugcuguuuu

SEQ ID NO: 462760 - RNA, 23 nt, Homo sapiens
cuccgugaugcuguuuuucucau

SEQ ID NO: 462761 - RNA, 16 nt, Homo sapiens
cuccugaccucaggug

SEQ ID NO: 462762 - RNA, 23 nt, Homo sapiens
cuccuguguucuggacuugcaga

SEQ ID NO: 462763 - RNA, 18 nt, Homo sapiens
cucgccgguuaagacagg

SEQ ID NO: 462764 - RNA, 15 nt, Homo sapiens
cucggagcucagugc

SEQ ID NO: 462765 - RNA, 21 nt, Homo sapiens
cucuaucauguugaagucaaa

SEQ ID NO: 462766 - RNA, 14 nt, Homo sapiens
cucucuuuacauuu

SEQ ID NO: 462767 - RNA, 11 nt, Homo sapiens
cucugacugua

SEQ ID NO: 462768 - RNA, 17 nt, Homo sapiens
cucuuauccaacaucaa

SEQ ID NO: 462769 - RNA, 19 nt, Homo sapiens
cugaaauaaaaggugcugu

SEQ ID NO: 462770 - RNA, 20 nt, Homo sapiens
cugaaauaaaaggugcuguu

SEQ ID NO: 462771 - RNA, 18 nt, Homo sapiens
cugaacagaagauuuggc

SEQ ID NO: 462772 - RNA, 14 nt, Homo sapiens
cugaacuugaauua

SEQ ID NO: 462773 - RNA, 23 nt, Homo sapiens
cugaccacgcccccagcugugac

SEQ ID NO: 462774 - RNA, 18 nt, Homo sapiens
cugaccucaggugaugca

SEQ ID NO: 462775 - RNA, 21 nt, Homo sapiens
cugaugaccgucugagcccag

SEQ ID NO: 462776 - RNA, 14 nt, Homo sapiens
cugauuccuguugc

SEQ ID NO: 462777 - RNA, 12 nt, Homo sapiens
cugcacuuccag

SEQ ID NO: 462778 - RNA, 19 nt, Homo sapiens
cugcagugugaguaaugcu

SEQ ID NO: 462779 - RNA, 16 nt, Homo sapiens
cugcauuuuacuguac

SEQ ID NO: 462780 - RNA, 21 nt, Homo sapiens
cugccacccagaguggcuucc

SEQ ID NO: 462781 - RNA, 15 nt, Homo sapiens
cugccauugugauca

SEQ ID NO: 462782 - RNA, 13 nt, Homo sapiens
cugcccacuucac

SEQ ID NO: 462783 - RNA, 21 nt, Homo sapiens
cugcccagcuuuguucugagg

SEQ ID NO: 462784 - RNA, 20 nt, Homo sapiens
cugcccaugagucaggggag

SEQ ID NO: 462785 - RNA, 14 nt, Homo sapiens
cugccucagccucc

SEQ ID NO: 462786 - RNA, 20 nt, Homo sapiens
cugccucagccuccugagca

SEQ ID NO: 462787 - RNA, 16 nt, Homo sapiens
cugccuggcaggugug

SEQ ID NO: 462788 - RNA, 14 nt, Homo sapiens
cugcuggucuucaa

SEQ ID NO: 462789 - RNA, 19 nt, Homo sapiens
cuggaaguuucacuggcug

SEQ ID NO: 462790 - RNA, 17 nt, Homo sapiens
cuggacaaacagccuca

SEQ ID NO: 462791 - RNA, 16 nt, Homo sapiens
cuggagaaaaggcagu

SEQ ID NO: 462792 - RNA, 13 nt, Homo sapiens
cuggagugcagug

SEQ ID NO: 462793 - RNA, 20 nt, Homo sapiens
cuggcacauuuuuaguuacu

SEQ ID NO: 462794 - RNA, 17 nt, Homo sapiens
cuggcagcaggaugcuc

SEQ ID NO: 462795 - RNA, 18 nt, Homo sapiens
cuggccuuguaucuugca

SEQ ID NO: 462796 - RNA, 22 nt, Homo sapiens
cuggguccccuucgcaguguuu

SEQ ID NO: 462797 - RNA, 16 nt, Homo sapiens
cuggugcugugugacc

SEQ ID NO: 462798 - RNA, 19 nt, Homo sapiens
cuggugcuucgugugcucc

SEQ ID NO: 462799 - RNA, 19 nt, Homo sapiens
cugguucugcaaugacugc

SEQ ID NO: 462800 - RNA, 18 nt, Homo sapiens
cuguaagaguucacaugg

SEQ ID NO: 462801 - RNA, 19 nt, Homo sapiens
cuguaaucccagcuacuca

SEQ ID NO: 462802 - RNA, 20 nt, Homo sapiens
cuguauaaccccaccuugcc

SEQ ID NO: 462803 - RNA, 13 nt, Homo sapiens
cuguauuacauaa

SEQ ID NO: 462804 - RNA, 21 nt, Homo sapiens
cuguccaggaacuuuccagca

SEQ ID NO: 462805 - RNA, 14 nt, Homo sapiens
cugucccuucuccc

SEQ ID NO: 462806 - RNA, 17 nt, Homo sapiens
cugucucauccaaaaag

SEQ ID NO: 462807 - RNA, 16 nt, Homo sapiens
cugucugucccaaaga

SEQ ID NO: 462808 - RNA, 18 nt, Homo sapiens
gucuuuuucuacagccag

SEQ ID NO: 462809 - RNA, 19 nt, Homo sapiens
gugaaaggucacacuacca

SEQ ID NO: 462810 - RNA, 13 nt, Homo sapiens
gugaagacaugua

SEQ ID NO: 462811 - RNA, 16 nt, Homo sapiens
gugaagcaaaacacaa

SEQ ID NO: 462812 - RNA, 19 nt, Homo sapiens
gugaccgcaaguucugcac

SEQ ID NO: 462813 - RNA, 23 nt, Homo sapiens
gugagaccaccucucaauauuca

SEQ ID NO: 462814 - RNA, 20 nt, Homo sapiens
gugaugucaaauugacugua

SEQ ID NO: 462815 - RNA, 10 nt, Homo sapiens
gugauuuucc

SEQ ID NO: 462816 - RNA, 16 nt, Homo sapiens
gugauuuuuaaucgcu

SEQ ID NO: 462817 - RNA, 17 nt, Homo sapiens
gugcagacgaaacacaa

SEQ ID NO: 462818 - RNA, 18 nt, Homo sapiens
gugcugggauuacaggca

SEQ ID NO: 462819 - RNA, 19 nt, Homo sapiens
guggaauuccuucauuuca

SEQ ID NO: 462820 - RNA, 12 nt, Homo sapiens
guggacaccugc

SEQ ID NO: 462821 - RNA, 16 nt, Homo sapiens
guggcacucucaggug

SEQ ID NO: 462822 - RNA, 18 nt, Homo sapiens
guggcucuccaguguaaa

SEQ ID NO: 462823 - RNA, 13 nt, Homo sapiens
guggcucuugccu

SEQ ID NO: 462824 - RNA, 17 nt, Homo sapiens
gugugaguaaugcucag

SEQ ID NO: 462825 - RNA, 19 nt, Homo sapiens
cagaggacccaggggaaac

SEQ ID NO: 462826 - RNA, 15 nt, Homo sapiens
cagaugagcuuacaa

SEQ ID NO: 462827 - RNA, 14 nt, Homo sapiens
cagcagcuugacgc

SEQ ID NO: 462828 - RNA, 20 nt, Homo sapiens
cagcagugagcuucuauuaa

SEQ ID NO: 462829 - RNA, 21 nt, Homo sapiens
cagcagugagcuucuauuaaa

SEQ ID NO: 462830 - RNA, 23 nt, Homo sapiens
cagccucccaaagugcugggauu

SEQ ID NO: 462831 - RNA, 23 nt, Homo sapiens
cagccuccgaaguagcugggauu

SEQ ID NO: 462832 - RNA, 23 nt, Homo sapiens
cagccuccugagcagcugggauu

SEQ ID NO: 462833 - RNA, 18 nt, Homo sapiens
cagcugggauuacaggug

SEQ ID NO: 462834 - RNA, 22 nt, Homo sapiens
cagcugguucugcaaugacugc

SEQ ID NO: 462835 - RNA, 19 nt, Homo sapiens
caggacgauuucacugaca

SEQ ID NO: 462836 - RNA, 15 nt, Homo sapiens
caggcaccugaagug

SEQ ID NO: 462837 - RNA, 16 nt, Homo sapiens
caggcaccugaaguga

SEQ ID NO: 462838 - RNA, 17 nt, Homo sapiens
caggcagaucacaaggu

SEQ ID NO: 462839 - RNA, 17 nt, Homo sapiens
caggccgggcagugucc

SEQ ID NO: 462840 - RNA, 16 nt, Homo sapiens
caggcuggagugcagu

SEQ ID NO: 462841 - RNA, 20 nt, Homo sapiens
caggcuggagugcaguggca

SEQ ID NO: 462842 - RNA, 22 nt, Homo sapiens
caggcuggagugcaguggcacg

SEQ ID NO: 462843 - RNA, 23 nt, Homo sapiens
cagggauuacaggcaugagccac

SEQ ID NO: 462844 - RNA, 17 nt, Homo sapiens
cagggcaccuacugaga

SEQ ID NO: 462845 - RNA, 20 nt, Homo sapiens
cagguagaaaauuauuugua

SEQ ID NO: 462846 - RNA, 16 nt, Homo sapiens
caggugagagcccuuu

SEQ ID NO: 462847 - RNA, 17 nt, Homo sapiens
caggugcgugccaccac

SEQ ID NO: 462848 - RNA, 23 nt, Homo sapiens
cagguguaguuacaucucagugc

SEQ ID NO: 462849 - RNA, 21 nt, Homo sapiens
cagguuagaagacgacugugg

SEQ ID NO: 462850 - RNA, 22 nt, Homo sapiens
caguaagaauuauuuacugaaa

SEQ ID NO: 462851 - RNA, 19 nt, Homo sapiens
caguaaggcagcucugucg

SEQ ID NO: 462852 - RNA, 18 nt, Homo sapiens
caguacccagagaccaag

SEQ ID NO: 462853 - RNA, 12 nt, Homo sapiens
cagucagaggac

SEQ ID NO: 462854 - RNA, 14 nt, Homo sapiens
cagucugaaccuga

SEQ ID NO: 462855 - RNA, 20 nt, Homo sapiens
cagucuugaugcaguuucau

SEQ ID NO: 462856 - RNA, 22 nt, Homo sapiens
cagugaugucaaauugacugua

SEQ ID NO: 462857 - RNA, 23 nt, Homo sapiens
cauacacccccaccuccugcaau

SEQ ID NO: 462858 - RNA, 13 nt, Homo sapiens
cauauuuacuucu

SEQ ID NO: 462859 - RNA, 12 nt, Homo sapiens
cauccaaaaagu

SEQ ID NO: 462860 - RNA, 12 nt, Homo sapiens
cauccaucagcu

SEQ ID NO: 462861 - RNA, 14 nt, Homo sapiens
cauccuagugagaa

SEQ ID NO: 462862 - RNA, 17 nt, Homo sapiens
caucuaacaaagucaag

SEQ ID NO: 462863 - RNA, 20 nt, Homo sapiens
caucuguucagucaucucca

SEQ ID NO: 462864 - RNA, 20 nt, Homo sapiens
caugacugcauuuuacugua

SEQ ID NO: 462865 - RNA, 21 nt, Homo sapiens
caugguguguguguccagagg

SEQ ID NO: 462866 - RNA, 14 nt, Homo sapiens
cauuccaucaauuu

SEQ ID NO: 462867 - RNA, 18 nt, Homo sapiens
cauucuuuccuaaauaua

SEQ ID NO: 462868 - RNA, 20 nt, Homo sapiens
cauugggccaucaagccuuu

SEQ ID NO: 462869 - RNA, 12 nt, Homo sapiens
cauuuauagaau

SEQ ID NO: 462870 - RNA, 19 nt, Homo sapiens
cauuucuuuuucauuugac

SEQ ID NO: 462871 - RNA, 17 nt, Homo sapiens
cauuuuuaaguauuuca

SEQ ID NO: 462872 - RNA, 15 nt, Homo sapiens
ccaaagugcugggau

SEQ ID NO: 462873 - RNA, 17 nt, Homo sapiens
ccaagaauucuccaaaa

SEQ ID NO: 462874 - RNA, 15 nt, Homo sapiens
ccaagucuuccugac

SEQ ID NO: 462875 - RNA, 22 nt, Homo sapiens
ccaauaacacguccacuuucaa

SEQ ID NO: 462876 - RNA, 21 nt, Homo sapiens
ccaauuucuuucuaaaacaca

SEQ ID NO: 462877 - RNA, 15 nt, Homo sapiens
ccacaucuaacaaag

SEQ ID NO: 462878 - RNA, 23 nt, Homo sapiens
ccaccaaauucugaauuuguaga

SEQ ID NO: 462879 - RNA, 13 nt, Homo sapiens
ccacccaaaauca

SEQ ID NO: 462880 - RNA, 20 nt, Homo sapiens
ccagagccccccacaaugau

SEQ ID NO: 462881 - RNA, 23 nt, Homo sapiens
ccagagccccccacaaugaugau

SEQ ID NO: 462882 - RNA, 14 nt, Homo sapiens
ccagcugugugaga

SEQ ID NO: 462883 - RNA, 18 nt, Homo sapiens
ccaggcuggagugcagua

SEQ ID NO: 462884 - RNA, 19 nt, Homo sapiens
ccaguaaggcagcucuguc

SEQ ID NO: 462885 - RNA, 14 nt, Homo sapiens
ccagugagauauau

SEQ ID NO: 462886 - RNA, 17 nt, Homo sapiens
ccaguggaccugaagga

SEQ ID NO: 462887 - RNA, 17 nt, Homo sapiens
cccaggcuggagugcag

SEQ ID NO: 462888 - RNA, 19 nt, Homo sapiens
cccaggcuggagugcagug

SEQ ID NO: 462889 - RNA, 20 nt, Homo sapiens
cccauaccacccaaaaucau

SEQ ID NO: 462890 - RNA, 20 nt, Homo sapiens
ccccagaugccuccucuguc

SEQ ID NO: 462891 - RNA, 15 nt, Homo sapiens
ccccaugugccugca

SEQ ID NO: 462892 - RNA, 16 nt, Homo sapiens
ccccuuuccaaaaacu

SEQ ID NO: 462893 - RNA, 14 nt, Homo sapiens
cccgagaaacacag

SEQ ID NO: 462894 - RNA, 18 nt, Homo sapiens
cccuccacagcuguguga

SEQ ID NO: 462895 - RNA, 22 nt, Homo sapiens
cccuggauuccucgaaacugcc

SEQ ID NO: 462896 - RNA, 19 nt, Homo sapiens
ccgaaguagcugggauuac

SEQ ID NO: 462897 - RNA, 14 nt, Homo sapiens
ccggccacauucag

SEQ ID NO: 462898 - RNA, 15 nt, Homo sapiens
ccggcgugugcagug

SEQ ID NO: 462899 - RNA, 15 nt, Homo sapiens
ccgugugaggacuga

SEQ ID NO: 462900 - RNA, 11 nt, Homo sapiens
ccuacuucuca

SEQ ID NO: 462901 - RNA, 15 nt, Homo sapiens
ccuagaaguggcaga

SEQ ID NO: 462902 - RNA, 13 nt, Homo sapiens
ccucacuccucag

SEQ ID NO: 462903 - RNA, 17 nt, Homo sapiens
ccuccccaccacugagc

SEQ ID NO: 462904 - RNA, 14 nt, Homo sapiens
gaaagcauugccag

SEQ ID NO: 462905 - RNA, 22 nt, Homo sapiens
gaaaggcagagggugacugugu

SEQ ID NO: 462906 - RNA, 15 nt, Homo sapiens
gaaaugccaauaaca

SEQ ID NO: 462907 - RNA, 21 nt, Homo sapiens
gaaaugccaauaacacgucca

SEQ ID NO: 462908 - RNA, 16 nt, Homo sapiens
gaacagaagauuuggc

SEQ ID NO: 462909 - RNA, 21 nt, Homo sapiens
gaacuccccuugaaaacugcu

SEQ ID NO: 462910 - RNA, 15 nt, Homo sapiens
gaacuccugaccuca

SEQ ID NO: 462911 - RNA, 21 nt, Homo sapiens
gaacucuucaaucucuugcac

SEQ ID NO: 462912 - RNA, 21 nt, Homo sapiens
gaagagcaggcaccagcagca

SEQ ID NO: 462913 - RNA, 21 nt, Homo sapiens
gaagaugcagucucugcugau

SEQ ID NO: 462914 - RNA, 14 nt, Homo sapiens
gaagaugugugaua

SEQ ID NO: 462915 - RNA, 19 nt, Homo sapiens
gaagcaccaagacugagaa

SEQ ID NO: 462916 - RNA, 13 nt, Homo sapiens
gaaguaucugucu

SEQ ID NO: 462917 - RNA, 22 nt, Homo sapiens
gaagucuggagcacccugagaa

SEQ ID NO: 462918 - RNA, 19 nt, Homo sapiens
gaauaaauuaaaauuacac

SEQ ID NO: 462919 - RNA, 22 nt, Homo sapiens
gaauaccaaaugauagaaacag

SEQ ID NO: 462920 - RNA, 20 nt, Homo sapiens
gaaucauugcuuaugacaug

SEQ ID NO: 462921 - RNA, 19 nt, Homo sapiens
gaaucccauggauguuucu

SEQ ID NO: 462922 - RNA, 17 nt, Homo sapiens
gaauuuugauuucuuaa

SEQ ID NO: 462923 - RNA, 22 nt, Homo sapiens
gacaaacagccucacuccucag

SEQ ID NO: 462924 - RNA, 15 nt, Homo sapiens
gacaaacagugcacu

SEQ ID NO: 462925 - RNA, 20 nt, Homo sapiens
gacaaaguuuugcucuuguc

SEQ ID NO: 462926 - RNA, 21 nt, Homo sapiens
gacacccacucuccugugaga

SEQ ID NO: 462927 - RNA, 18 nt, Homo sapiens
gaccaauuagcauuccau

SEQ ID NO: 462928 - RNA, 19 nt, Homo sapiens
gaccaccucucaauauuca

SEQ ID NO: 462929 - RNA, 22 nt, Homo sapiens
gaccaccucucaauauucaaua

SEQ ID NO: 462930 - RNA, 15 nt, Homo sapiens
gaccaccuugcacua

SEQ ID NO: 462931 - RNA, 16 nt, Homo sapiens
gaccuaggcucaugga

SEQ ID NO: 462932 - RNA, 11 nt, Homo sapiens
gaccucaggug

SEQ ID NO: 462933 - RNA, 13 nt, Homo sapiens
gaccucaggugau

SEQ ID NO: 462934 - RNA, 18 nt, Homo sapiens
gacgaggaggagugcaug

SEQ ID NO: 462935 - RNA, 13 nt, Homo sapiens
gacgccacucuga

SEQ ID NO: 462936 - RNA, 21 nt, Homo sapiens
gacugguggccccugccuugg

SEQ ID NO: 462937 - RNA, 16 nt, Homo sapiens
gagaacuucucuuccc

SEQ ID NO: 462938 - RNA, 19 nt, Homo sapiens
gagaacuucucuucccaua

SEQ ID NO: 462939 - RNA, 18 nt, Homo sapiens
gagaguugagacuugcca

SEQ ID NO: 462940 - RNA, 19 nt, Homo sapiens
gagauguaugcccaaagac

SEQ ID NO: 462941 - RNA, 20 nt, Homo sapiens
gagcaaauccaggaaggcaa

SEQ ID NO: 462942 - RNA, 20 nt, Homo sapiens
gagccacugcgcccggccac

SEQ ID NO: 462943 - RNA, 19 nt, Homo sapiens
gagccacugugcccggccu

SEQ ID NO: 462944 - RNA, 21 nt, Homo sapiens
gagccgagauugcaccacugc

SEQ ID NO: 462945 - RNA, 19 nt, Homo sapiens
gagccuccaauugcagugg

SEQ ID NO: 462946 - RNA, 18 nt, Homo sapiens
gagccuucugugcuguga

SEQ ID NO: 462947 - RNA, 17 nt, Homo sapiens
gagcugcuguccaggaa

SEQ ID NO: 462948 - RNA, 22 nt, Homo sapiens
gagcuugcaggguuucucgcca

SEQ ID NO: 462949 - RNA, 14 nt, Homo sapiens
gaggcuugugugaa

SEQ ID NO: 462950 - RNA, 19 nt, Homo sapiens
gagugccacccgcaggugu

SEQ ID NO: 462951 - RNA, 15 nt, Homo sapiens
gaucacuaugcauuu

SEQ ID NO: 462952 - RNA, 15 nt, Homo sapiens
gaucaucaagacaga

SEQ ID NO: 462953 - RNA, 16 nt, Homo sapiens
gaugccuccucugucc

SEQ ID NO: 462954 - RNA, 13 nt, Homo sapiens
gaugcggcccuga

SEQ ID NO: 462955 - RNA, 16 nt, Homo sapiens
cugugccuaucaccuc

SEQ ID NO: 462956 - RNA, 12 nt, Homo sapiens
cuguuaagcaau

SEQ ID NO: 462957 - RNA, 13 nt, Homo sapiens
cuguuaagcaauu

SEQ ID NO: 462958 - RNA, 19 nt, Homo sapiens
cuguucuggccucagacca

SEQ ID NO: 462959 - RNA, 19 nt, Homo sapiens
cuuacaucugcagcucuuu

SEQ ID NO: 462960 - RNA, 22 nt, Homo sapiens
cuuaucaacauuugggggauaa

SEQ ID NO: 462961 - RNA, 21 nt, Homo sapiens
cuuauuuuaauuccacuuuaa

SEQ ID NO: 462962 - RNA, 14 nt, Homo sapiens
cuucaaacaaauaa

SEQ ID NO: 462963 - RNA, 20 nt, Homo sapiens
cuucacucugcucucaggag

SEQ ID NO: 462964 - RNA, 23 nt, Homo sapiens
cuucagucuugaugcaguuucau

SEQ ID NO: 462965 - RNA, 21 nt, Homo sapiens
cuucaucgcaguggacugugu

SEQ ID NO: 462966 - RNA, 14 nt, Homo sapiens
cuuccugcuucugg

SEQ ID NO: 462967 - RNA, 16 nt, Homo sapiens
cuucuaagagauauaa

SEQ ID NO: 462968 - RNA, 15 nt, Homo sapiens
cuucucaagcacuga

SEQ ID NO: 462969 - RNA, 13 nt, Homo sapiens
cuucugugcugug

SEQ ID NO: 462970 - RNA, 15 nt, Homo sapiens
cuucugugcugugag

SEQ ID NO: 462971 - RNA, 14 nt, Homo sapiens
cuucuucucaagca

SEQ ID NO: 462972 - RNA, 23 nt, Homo sapiens
cuugaggggcccacagacagauc

SEQ ID NO: 462973 - RNA, 18 nt, Homo sapiens
cuugcaggguuucucgcc

SEQ ID NO: 462974 - RNA, 19 nt, Homo sapiens
cuugccaguugggggaaaa

SEQ ID NO: 462975 - RNA, 13 nt, Homo sapiens
cuuggacuaguga

SEQ ID NO: 462976 - RNA, 14 nt, Homo sapiens
cuugggaacuacag

SEQ ID NO: 462977 - RNA, 23 nt, Homo sapiens
cuugguaaaaacugcagugucuu

SEQ ID NO: 462978 - RNA, 15 nt, Homo sapiens
cuugguaaauuguaa

SEQ ID NO: 462979 - RNA, 17 nt, Homo sapiens
cuugguuaucaaauaca

SEQ ID NO: 462980 - RNA, 22 nt, Homo sapiens
cuugucuggcagcaggaugcuc

SEQ ID NO: 462981 - RNA, 18 nt, Homo sapiens
cuuguuuucuacuuugcc

SEQ ID NO: 462982 - RNA, 22 nt, Homo sapiens
cuuuaacauuuuacugugcugu

SEQ ID NO: 462983 - RNA, 15 nt, Homo sapiens
cuuuauauaucugcu

SEQ ID NO: 462984 - RNA, 15 nt, Homo sapiens
cuuucaucagaggaa

SEQ ID NO: 462985 - RNA, 13 nt, Homo sapiens
cuuuccucagugu

SEQ ID NO: 462986 - RNA, 20 nt, Homo sapiens
cuuuccugaucacuaugcau

SEQ ID NO: 462987 - RNA, 15 nt, Homo sapiens
cuuucuacacuguau

SEQ ID NO: 462988 - RNA, 21 nt, Homo sapiens
cuuugggccuuuccucagugu

SEQ ID NO: 462989 - RNA, 17 nt, Homo sapiens
cuuuggucaauauuuga

SEQ ID NO: 462990 - RNA, 14 nt, Homo sapiens
cuuuguauccauga

SEQ ID NO: 462991 - RNA, 12 nt, Homo sapiens
cuuuguucucau

SEQ ID NO: 462992 - RNA, 14 nt, Homo sapiens
cuuuucaucuccag

SEQ ID NO: 462993 - RNA, 18 nt, Homo sapiens
cuuuuccauccuagugag

SEQ ID NO: 462994 - RNA, 14 nt, Homo sapiens
cuuuuugcauauaa

SEQ ID NO: 462995 - RNA, 15 nt, Homo sapiens
gaaacauucuuuccu

SEQ ID NO: 462996 - RNA, 18 nt, Homo sapiens
gaaacauucuuuccuaaa

SEQ ID NO: 462997 - RNA, 17 nt, Homo sapiens
gaaaccagcaucugcac

SEQ ID NO: 462998 - RNA, 18 nt, Homo sapiens
gaaacgcuucuuuuccau

SEQ ID NO: 462999 - RNA, 17 nt, Homo sapiens
gaaacugccauugugau

SEQ ID NO: 463000 - RNA, 23 nt, Homo sapiens
gaaaggucacacuaccauuauuu

SEQ ID NO: 463001 - RNA, 14 nt, Homo sapiens
gaaaugccaauaac

SEQ ID NO: 463002 - RNA, 15 nt, Homo sapiens
gaacauacuucaucg

SEQ ID NO: 463003 - RNA, 13 nt, Homo sapiens
gaacucuucaucu

SEQ ID NO: 463004 - RNA, 20 nt, Homo sapiens
gaagaaaacagauaacaaau

SEQ ID NO: 463005 - RNA, 17 nt, Homo sapiens
gaagagucuucaaaaac

SEQ ID NO: 463006 - RNA, 15 nt, Homo sapiens
gaaggaaauaaugca

SEQ ID NO: 463007 - RNA, 17 nt, Homo sapiens
gaauacugggugcuguc

SEQ ID NO: 463008 - RNA, 18 nt, Homo sapiens
gaaucggcuuugcagugc

SEQ ID NO: 463009 - RNA, 14 nt, Homo sapiens
gaaugauacgauua

SEQ ID NO: 463010 - RNA, 14 nt, Homo sapiens
gaauuaugcuguua

SEQ ID NO: 463011 - RNA, 15 nt, Homo sapiens
gaauucuccaaaaca

SEQ ID NO: 463012 - RNA, 15 nt, Homo sapiens
gaauucugaacuuuu

SEQ ID NO: 463013 - RNA, 16 nt, Homo sapiens
gaauuuuccuucuuca

SEQ ID NO: 463014 - RNA, 21 nt, Homo sapiens
gacaaaguuuugcucuuguca

SEQ ID NO: 463015 - RNA, 23 nt, Homo sapiens
gacaauaaaacauuccugugaaa

SEQ ID NO: 463016 - RNA, 17 nt, Homo sapiens
gacagacagagaaggca

SEQ ID NO: 463017 - RNA, 21 nt, Homo sapiens
gacagauguuaagcgcugugu

SEQ ID NO: 463018 - RNA, 20 nt, Homo sapiens
gacaggccgggcaguguccc

SEQ ID NO: 463019 - RNA, 22 nt, Homo sapiens
gacaguagugaaaucuugugau

SEQ ID NO: 463020 - RNA, 17 nt, Homo sapiens
gacauauaccuucucaa

SEQ ID NO: 463021 - RNA, 24 nt, Homo sapiens
gacaugaucgcuuucuacacugua

SEQ ID NO: 463022 - RNA, 16 nt, Homo sapiens
gacauuccugcaggga

SEQ ID NO: 463023 - RNA, 22 nt, Homo sapiens
gaccaacauggugaaacccugu

SEQ ID NO: 463024 - RNA, 20 nt, Homo sapiens
gaccccagcacgugggucua

SEQ ID NO: 463025 - RNA, 17 nt, Homo sapiens
gacgauuucacugacac

SEQ ID NO: 463026 - RNA, 14 nt, Homo sapiens
gacuagugagcaag

SEQ ID NO: 463027 - RNA, 15 nt, Homo sapiens
gacucgucucaaaaa

SEQ ID NO: 463028 - RNA, 13 nt, Homo sapiens
gacuuccugaaca

SEQ ID NO: 463029 - RNA, 23 nt, Homo sapiens
gacuucuccuccaguggaccuga

SEQ ID NO: 463030 - RNA, 15 nt, Homo sapiens
gagaaggcucuugcc

SEQ ID NO: 463031 - RNA, 20 nt, Homo sapiens
gagacagacagagaaggcag

SEQ ID NO: 463032 - RNA, 13 nt, Homo sapiens
gagcagcugggau

SEQ ID NO: 463033 - RNA, 17 nt, Homo sapiens
gagccccccacaaugau

SEQ ID NO: 463034 - RNA, 15 nt, Homo sapiens
gaggcuccucugaug

SEQ ID NO: 463035 - RNA, 18 nt, Homo sapiens
gagggaggaugcugugug

SEQ ID NO: 463036 - RNA, 13 nt, Homo sapiens
gaguaaugcauga

SEQ ID NO: 463037 - RNA, 19 nt, Homo sapiens
gagucuagcucuccugcca

SEQ ID NO: 463038 - RNA, 17 nt, Homo sapiens
gagugagacucgucuca

SEQ ID NO: 463039 - RNA, 11 nt, Homo sapiens
gauauauuugu

SEQ ID NO: 463040 - RNA, 13 nt, Homo sapiens
gaucuggcuguga

SEQ ID NO: 463041 - RNA, 22 nt, Homo sapiens
gaucuggcugugaggcccucag

SEQ ID NO: 463042 - RNA, 21 nt, Homo sapiens
gaugccugacggcagcugguu

SEQ ID NO: 463043 - RNA, 14 nt, Homo sapiens
gaugcggcccugag

SEQ ID NO: 463044 - RNA, 17 nt, Homo sapiens
gauguuguagacugaga

SEQ ID NO: 463045 - RNA, 14 nt, Homo sapiens
gauguuuguugcua

SEQ ID NO: 463046 - RNA, 15 nt, Homo sapiens
gauuaauuuaauuca

SEQ ID NO: 463047 - RNA, 19 nt, Homo sapiens
gauuacaggcaugagccac

SEQ ID NO: 463048 - RNA, 22 nt, Homo sapiens
gauuacaggcgugagccacugc

SEQ ID NO: 463049 - RNA, 23 nt, Homo sapiens
gauuaccuucauagagcuuugga

SEQ ID NO: 463050 - RNA, 17 nt, Homo sapiens
gauuaugcccaauauua

SEQ ID NO: 463051 - RNA, 21 nt, Homo sapiens
gauucauauuuacuucuuaua

SEQ ID NO: 463052 - RNA, 17 nt, Homo sapiens
gauuuaaguguuuugua

SEQ ID NO: 463053 - RNA, 13 nt, Homo sapiens
gauuucauuugaa

SEQ ID NO: 463054 - RNA, 20 nt, Homo sapiens
gauuucuuuguucucaugca

SEQ ID NO: 463055 - RNA, 18 nt, Homo sapiens
gauuugaaugaaaugcca

SEQ ID NO: 463056 - RNA, 22 nt, Homo sapiens
gauuugaauuguuuuaagccaa

SEQ ID NO: 463057 - RNA, 23 nt, Homo sapiens
gauuugagggacgaggucaagga

SEQ ID NO: 463058 - RNA, 21 nt, Homo sapiens
gcagcagugagcuucuauuaa

SEQ ID NO: 463059 - RNA, 20 nt, Homo sapiens
gcagccuccugcucugugaa

SEQ ID NO: 463060 - RNA, 12 nt, Homo sapiens
gcagcugggauu

SEQ ID NO: 463061 - RNA, 16 nt, Homo sapiens
gcagcugggauuacag

SEQ ID NO: 463062 - RNA, 15 nt, Homo sapiens
gcagcuggugcugug

SEQ ID NO: 463063 - RNA, 19 nt, Homo sapiens
gcagggcccacccauguca

SEQ ID NO: 463064 - RNA, 21 nt, Homo sapiens
gcagggccuuugucugucuca

SEQ ID NO: 463065 - RNA, 21 nt, Homo sapiens
gcaggguauugcgaaacaacu

SEQ ID NO: 463066 - RNA, 18 nt, Homo sapiens
gcagugagcuucuauuaa

SEQ ID NO: 463067 - RNA, 18 nt, Homo sapiens
gcagugcccaucuuccag

SEQ ID NO: 463068 - RNA, 19 nt, Homo sapiens
gcaguggugcaaucuuggc

SEQ ID NO: 463069 - RNA, 18 nt, Homo sapiens
gcaguguuuucaccucau

SEQ ID NO: 463070 - RNA, 22 nt, Homo sapiens
gcauccgaaaccagcaucugca

SEQ ID NO: 463071 - RNA, 14 nt, Homo sapiens
gcauggcugccucu

SEQ ID NO: 463072 - RNA, 15 nt, Homo sapiens
gcauugccagcucuu

SEQ ID NO: 463073 - RNA, 17 nt, Homo sapiens
gcauuuggagagucuca

SEQ ID NO: 463074 - RNA, 12 nt, Homo sapiens
gccaggugcuuu

SEQ ID NO: 463075 - RNA, 16 nt, Homo sapiens
gccaguaaggcagcuc

SEQ ID NO: 463076 - RNA, 20 nt, Homo sapiens
gccaguauaagcauuuccaa

SEQ ID NO: 463077 - RNA, 14 nt, Homo sapiens
gccaucccaaaaau

SEQ ID NO: 463078 - RNA, 17 nt, Homo sapiens
gcccaggcuggagugca

SEQ ID NO: 463079 - RNA, 20 nt, Homo sapiens
gcccaggcuggagugcagug

SEQ ID NO: 463080 - RNA, 16 nt, Homo sapiens
gccccaucagcagcuu

SEQ ID NO: 463081 - RNA, 16 nt, Homo sapiens
gcccggccuaugauuc

SEQ ID NO: 463082 - RNA, 18 nt, Homo sapiens
uguaaagaauuuagcugu

SEQ ID NO: 463083 - RNA, 20 nt, Homo sapiens
uguaaagagagcaagacaga

SEQ ID NO: 463084 - RNA, 23 nt, Homo sapiens
uguaaguaccccugauaagcaaa

SEQ ID NO: 463085 - RNA, 20 nt, Homo sapiens
uguaauauuccaggaugcug

SEQ ID NO: 463086 - RNA, 17 nt, Homo sapiens
uguaauuguauuucaaa

SEQ ID NO: 463087 - RNA, 23 nt, Homo sapiens
uguaccgggcuggccugugccua

SEQ ID NO: 463088 - RNA, 13 nt, Homo sapiens
uguagauugccuu

SEQ ID NO: 463089 - RNA, 13 nt, Homo sapiens
uguagauuucaag

SEQ ID NO: 463090 - RNA, 17 nt, Homo sapiens
uguaguugaugacuguu

SEQ ID NO: 463091 - RNA, 21 nt, Homo sapiens
uguauaaccccaccuugccaa

SEQ ID NO: 463092 - RNA, 23 nt, Homo sapiens
uguauaaccccaccuugccaagc

SEQ ID NO: 463093 - RNA, 15 nt, Homo sapiens
uguaugucugccuaa

SEQ ID NO: 463094 - RNA, 18 nt, Homo sapiens
uguccugaggggcugcuu

SEQ ID NO: 463095 - RNA, 17 nt, Homo sapiens
ugucuaaaaugucagug

SEQ ID NO: 463096 - RNA, 16 nt, Homo sapiens
ugucucauccaaaaag

SEQ ID NO: 463097 - RNA, 14 nt, Homo sapiens
ugucugucccaaag

SEQ ID NO: 463098 - RNA, 23 nt, Homo sapiens
ugugaagggauuuguuuugucaa

SEQ ID NO: 463099 - RNA, 12 nt, Homo sapiens
ugugauguuugg

SEQ ID NO: 463100 - RNA, 23 nt, Homo sapiens
ugugauuuuuaaucgcuuugaua

SEQ ID NO: 463101 - RNA, 16 nt, Homo sapiens
ugugcuagacuguaag

SEQ ID NO: 463102 - RNA, 16 nt, Homo sapiens
ugugguaacucagugu

SEQ ID NO: 463103 - RNA, 12 nt, Homo sapiens
ugugucuucaau

SEQ ID NO: 463104 - RNA, 14 nt, Homo sapiens
ugugucuucaauuu

SEQ ID NO: 463105 - RNA, 13 nt, Homo sapiens
ugugugagcugcc

SEQ ID NO: 463106 - RNA, 21 nt, Homo sapiens
uguuaacauggacaugaucuu

SEQ ID NO: 463107 - RNA, 14 nt, Homo sapiens
uguuaugggcacug

SEQ ID NO: 463108 - RNA, 13 nt, Homo sapiens
uguugagguguga

SEQ ID NO: 463109 - RNA, 14 nt, Homo sapiens
uguugaggugugaa

SEQ ID NO: 463110 - RNA, 14 nt, Homo sapiens
uguugcuuauacug

SEQ ID NO: 463111 - RNA, 15 nt, Homo sapiens
uguuuaaguggcuuu

SEQ ID NO: 463112 - RNA, 22 nt, Homo sapiens
uguuuaaguggcuuucagcaaa

SEQ ID NO: 463113 - RNA, 19 nt, Homo sapiens
uguuucuucuuugacuaua

SEQ ID NO: 463114 - RNA, 18 nt, Homo sapiens
uguuuucuacuuugccac

SEQ ID NO: 463115 - RNA, 14 nt, Homo sapiens
uuaaaaucuuagaa

SEQ ID NO: 463116 - RNA, 17 nt, Homo sapiens
uuaaauauuucugcaca

SEQ ID NO: 463117 - RNA, 15 nt, Homo sapiens
uuaacucucuguuac

SEQ ID NO: 463118 - RNA, 18 nt, Homo sapiens
uuaacuuccaauuuacau

SEQ ID NO: 463119 - RNA, 11 nt, Homo sapiens
uuaagaccaag

SEQ ID NO: 463120 - RNA, 12 nt, Homo sapiens
uuaauacaccuu

SEQ ID NO: 463121 - RNA, 22 nt, Homo sapiens
uuaauucauguauuaugauuaa

SEQ ID NO: 463122 - RNA, 19 nt, Homo sapiens
uuacaacuuauaauuacaa

SEQ ID NO: 463123 - RNA, 23 nt, Homo sapiens
uuacaacuuauaauuacaaugca

SEQ ID NO: 463124 - RNA, 23 nt, Homo sapiens
uuacacgucauugaaacuacacu

SEQ ID NO: 463125 - RNA, 22 nt, Homo sapiens
uuacugguauuaauaaacacau

SEQ ID NO: 463126 - RNA, 21 nt, Homo sapiens
uuaggaauacugggugcuguc

SEQ ID NO: 463127 - RNA, 13 nt, Homo sapiens
uuagggaggacca

SEQ ID NO: 463128 - RNA, 13 nt, Homo sapiens
uuaguaauuguaa

SEQ ID NO: 463129 - RNA, 13 nt, Homo sapiens
uuaguaauuguca

SEQ ID NO: 463130 - RNA, 13 nt, Homo sapiens
uuauacauuugau

SEQ ID NO: 463131 - RNA, 16 nt, Homo sapiens
uuauauguaguacuaa

SEQ ID NO: 463132 - RNA, 18 nt, Homo sapiens
uuaucaaauacaucucca

SEQ ID NO: 463133 - RNA, 18 nt, Homo sapiens
uuaugcuccuuaugaugc

SEQ ID NO: 463134 - RNA, 22 nt, Homo sapiens
uuauuuagagacagagucucac

SEQ ID NO: 463135 - RNA, 20 nt, Homo sapiens
uucaaaaacgaugucguauu

SEQ ID NO: 463136 - RNA, 23 nt, Homo sapiens
uucaaguuaaugcaaaugacugu

SEQ ID NO: 463137 - RNA, 20 nt, Homo sapiens
uucaauaaagcugcugagaa

SEQ ID NO: 463138 - RNA, 12 nt, Homo sapiens
uucaaucucuug

SEQ ID NO: 463139 - RNA, 18 nt, Homo sapiens
uucacacucaauagucac

SEQ ID NO: 463140 - RNA, 17 nt, Homo sapiens
uucagcagcaggugcuu

SEQ ID NO: 463141 - RNA, 22 nt, Homo sapiens
uucaggcaccugaagugagaac

SEQ ID NO: 463142 - RNA, 12 nt, Homo sapiens
uucaucagagga

SEQ ID NO: 463143 - RNA, 14 nt, Homo sapiens
uuccgagaggacca

SEQ ID NO: 463144 - RNA, 12 nt, Homo sapiens
uuccuaaauaua

SEQ ID NO: 463145 - RNA, 21 nt, Homo sapiens
uuccuacauuuugaaggugau

SEQ ID NO: 463146 - RNA, 15 nt, Homo sapiens
uuccucgaaacugcc

SEQ ID NO: 463147 - RNA, 16 nt, Homo sapiens
uuccugaucacuaugc

SEQ ID NO: 463148 - RNA, 13 nt, Homo sapiens
uuccuucauuuca

SEQ ID NO: 463149 - RNA, 18 nt, Homo sapiens
uuccuuccaagucuuccu

SEQ ID NO: 463150 - RNA, 17 nt, Homo sapiens
uuccuuuccugaucacu

SEQ ID NO: 463151 - RNA, 23 nt, Homo sapiens
uucuaaaauuuggggggucuugc

SEQ ID NO: 463152 - RNA, 13 nt, Homo sapiens
uucuacuuugcca

SEQ ID NO: 463153 - RNA, 14 nt, Homo sapiens
uucuacuuugccac

SEQ ID NO: 463154 - RNA, 21 nt, Homo sapiens
uucuagccuuaagacauuuga

SEQ ID NO: 463155 - RNA, 12 nt, Homo sapiens
uucucuugaaua

SEQ ID NO: 463156 - RNA, 19 nt, Homo sapiens
uucugauuuuuauucucaa

SEQ ID NO: 463157 - RNA, 18 nt, Homo sapiens
uucuggccucagaccaac

SEQ ID NO: 463158 - RNA, 16 nt, Homo sapiens
uucuucccaaggccag

SEQ ID NO: 463159 - RNA, 21 nt, Homo sapiens
uucuucuuugacuauaacaaa

SEQ ID NO: 463160 - RNA, 21 nt, Homo sapiens
uugaaaaugaaaugacugucu

SEQ ID NO: 463161 - RNA, 12 nt, Homo sapiens
uugaacauacuu

SEQ ID NO: 463162 - RNA, 13 nt, Homo sapiens
uugacaggauuau

SEQ ID NO: 463163 - RNA, 17 nt, Homo sapiens
uugagaccaaaucuugc

SEQ ID NO: 463164 - RNA, 18 nt, Homo sapiens
uugagaccaaaucuugcu

SEQ ID NO: 463165 - RNA, 20 nt, Homo sapiens
uugagggacgaggucaagga

SEQ ID NO: 463166 - RNA, 14 nt, Homo sapiens
uugaggugagucag

SEQ ID NO: 463167 - RNA, 11 nt, Homo sapiens
uugaugacugu

SEQ ID NO: 463168 - RNA, 14 nt, Homo sapiens
uugccuaaguauuc

SEQ ID NO: 463169 - RNA, 15 nt, Homo sapiens
uugcugguacuaaga

SEQ ID NO: 463170 - RNA, 22 nt, Homo sapiens
uuggcucguuugauccaguuga

SEQ ID NO: 463171 - RNA, 12 nt, Homo sapiens
uuguauccuuuu

SEQ ID NO: 463172 - RNA, 11 nt, Homo sapiens
uuuaagaacga

SEQ ID NO: 463173 - RNA, 12 nt, Homo sapiens
uuuaagaccaag

SEQ ID NO: 463174 - RNA, 13 nt, Homo sapiens
uuuacauaugcuu

SEQ ID NO: 463175 - RNA, 14 nt, Homo sapiens
uuuaguuacuugag

SEQ ID NO: 463176 - RNA, 17 nt, Homo sapiens
uuuauaaagauauacca

SEQ ID NO: 463177 - RNA, 14 nt, Homo sapiens
uuuauaauuacaau

SEQ ID NO: 463178 - RNA, 16 nt, Homo sapiens
uuuauuuccucaaaac

SEQ ID NO: 463179 - RNA, 22 nt, Homo sapiens
uuucacuuaaguugagauuuuu

SEQ ID NO: 463180 - RNA, 21 nt, Homo sapiens
uuucaucagaggaaaagggca

SEQ ID NO: 463181 - RNA, 17 nt, Homo sapiens
uuuccauuaaacuacuu

SEQ ID NO: 463182 - RNA, 22 nt, Homo sapiens
uuuccuaucuguaugucugccu

SEQ ID NO: 463183 - RNA, 14 nt, Homo sapiens
uuucuacuuugcca

SEQ ID NO: 463184 - RNA, 17 nt, Homo sapiens
uuucucccccuuuccaa

SEQ ID NO: 463185 - RNA, 22 nt, Homo sapiens
uuugagaccaaaucuugcucug

SEQ ID NO: 463186 - RNA, 12 nt, Homo sapiens
uuuguugcucag

SEQ ID NO: 463187 - RNA, 12 nt, Homo sapiens
uuuucaccucau

SEQ ID NO: 463188 - RNA, 19 nt, Homo sapiens
uuuuccauccuagugagaa

SEQ ID NO: 463189 - RNA, 16 nt, Homo sapiens
uuuucuacuuugccac

SEQ ID NO: 463190 - RNA, 15 nt, Homo sapiens
uuuucuccucaugga

SEQ ID NO: 463191 - RNA, 18 nt, Homo sapiens
uuuuguuccacaaguuaa

SEQ ID NO: 463192 - RNA, 19 nt, Homo sapiens
ucuuuuccauuaaacuacu

SEQ ID NO: 463193 - RNA, 17 nt, Homo sapiens
ugaaaaucaacccaaua

SEQ ID NO: 463194 - RNA, 15 nt, Homo sapiens
ugaaaugacugucua

SEQ ID NO: 463195 - RNA, 20 nt, Homo sapiens
ugaaaugccccgucagaaau

SEQ ID NO: 463196 - RNA, 15 nt, Homo sapiens
ugaacaggaugcuga

SEQ ID NO: 463197 - RNA, 18 nt, Homo sapiens
ugaacucuucaaucucuu

SEQ ID NO: 463198 - RNA, 14 nt, Homo sapiens
ugacgcguggucac

SEQ ID NO: 463199 - RNA, 14 nt, Homo sapiens
ugacugccaaaaag

SEQ ID NO: 463200 - RNA, 20 nt, Homo sapiens
ugagaacuucucuucccaua

SEQ ID NO: 463201 - RNA, 15 nt, Homo sapiens
ugagcagcugggauu

SEQ ID NO: 463202 - RNA, 13 nt, Homo sapiens
ugagcccagcuca

SEQ ID NO: 463203 - RNA, 20 nt, Homo sapiens
ugaggaagagaauaaauuaa

SEQ ID NO: 463204 - RNA, 16 nt, Homo sapiens
ugaggcaaaguguagu

SEQ ID NO: 463205 - RNA, 16 nt, Homo sapiens
ugauccuaagucaugu

SEQ ID NO: 463206 - RNA, 18 nt, Homo sapiens
ugaucuaugcuauauuca

SEQ ID NO: 463207 - RNA, 13 nt, Homo sapiens
ugaugacacacca

SEQ ID NO: 463208 - RNA, 16 nt, Homo sapiens
ugaugcacccaccuca

SEQ ID NO: 463209 - RNA, 14 nt, Homo sapiens
ugauuaaaucugag

SEQ ID NO: 463210 - RNA, 18 nt, Homo sapiens
ugcaaaaauaacaaaaua

SEQ ID NO: 463211 - RNA, 15 nt, Homo sapiens
ugcacacauuaggca

SEQ ID NO: 463212 - RNA, 13 nt, Homo sapiens
ugcacccaccuca

SEQ ID NO: 463213 - RNA, 14 nt, Homo sapiens
ugcagaguacauga

SEQ ID NO: 463214 - RNA, 23 nt, Homo sapiens
ugcagggcugggaagaagcugca

SEQ ID NO: 463215 - RNA, 15 nt, Homo sapiens
ugccaccugucuguc

SEQ ID NO: 463216 - RNA, 12 nt, Homo sapiens
ugccagugcaga

SEQ ID NO: 463217 - RNA, 21 nt, Homo sapiens
ugccaucauuguaacaugaca

SEQ ID NO: 463218 - RNA, 15 nt, Homo sapiens
ugccaucccaaaaau

SEQ ID NO: 463219 - RNA, 14 nt, Homo sapiens
ugcccaugagucag

SEQ ID NO: 463220 - RNA, 19 nt, Homo sapiens
ugcccggccuaugauucuu

SEQ ID NO: 463221 - RNA, 13 nt, Homo sapiens
ugcccucugccag

SEQ ID NO: 463222 - RNA, 18 nt, Homo sapiens
ugccucagccucccgagu

SEQ ID NO: 463223 - RNA, 18 nt, Homo sapiens
ugccuugguaaaaacugc

SEQ ID NO: 463224 - RNA, 23 nt, Homo sapiens
ugcggugcauacacccccaccuc

SEQ ID NO: 463225 - RNA, 20 nt, Homo sapiens
ugcgugccucguacgugugu

SEQ ID NO: 463226 - RNA, 20 nt, Homo sapiens
ugcuauuuucuuauccuuug

SEQ ID NO: 463227 - RNA, 23 nt, Homo sapiens
ugcuggucuucaauuaccaagaa

SEQ ID NO: 463228 - RNA, 23 nt, Homo sapiens
ugcuucauuucuuuuucauuuga

SEQ ID NO: 463229 - RNA, 14 nt, Homo sapiens
uggaacacaaccau

SEQ ID NO: 463230 - RNA, 16 nt, Homo sapiens
uggaagaugugugaua

SEQ ID NO: 463231 - RNA, 16 nt, Homo sapiens
uggacaaacagccuca

SEQ ID NO: 463232 - RNA, 21 nt, Homo sapiens
uggagccuccaauugcagugg

SEQ ID NO: 463233 - RNA, 20 nt, Homo sapiens
uggauuccucgaaacugcca

SEQ ID NO: 463234 - RNA, 17 nt, Homo sapiens
uggauugggagauuuca

SEQ ID NO: 463235 - RNA, 15 nt, Homo sapiens
uggcacucucaggug

SEQ ID NO: 463236 - RNA, 15 nt, Homo sapiens
uggcucgcaaccucc

SEQ ID NO: 463237 - RNA, 22 nt, Homo sapiens
uggcucgcaaccuccgccuccc

SEQ ID NO: 463238 - RNA, 22 nt, Homo sapiens
uggcucucagcgccgucgccac

SEQ ID NO: 463239 - RNA, 15 nt, Homo sapiens
uggcucuugccugua

SEQ ID NO: 463240 - RNA, 17 nt, Homo sapiens
ugggaauguccuuggca

SEQ ID NO: 463241 - RNA, 20 nt, Homo sapiens
ugggaguucagcugcuucuc

SEQ ID NO: 463242 - RNA, 13 nt, Homo sapiens
ugggcaauaugaa

SEQ ID NO: 463243 - RNA, 12 nt, Homo sapiens
ugggggaaaaua

SEQ ID NO: 463244 - RNA, 13 nt, Homo sapiens
ugguaaaaacugc

SEQ ID NO: 463245 - RNA, 14 nt, Homo sapiens
ugguaaaaacugca

SEQ ID NO: 463246 - RNA, 22 nt, Homo sapiens
ugguaaaaacugcagugucuuu

SEQ ID NO: 463247 - RNA, 19 nt, Homo sapiens
ugguaaagccucagcaaca

SEQ ID NO: 463248 - RNA, 14 nt, Homo sapiens
ugguaacucagugu

SEQ ID NO: 463249 - RNA, 21 nt, Homo sapiens
ugguauuaauaaacacauaca

SEQ ID NO: 463250 - RNA, 15 nt, Homo sapiens
uggucaaagcaacug

SEQ ID NO: 463251 - RNA, 22 nt, Homo sapiens
ugguccgguuauucacuugagu

SEQ ID NO: 463252 - RNA, 20 nt, Homo sapiens
uggucgagaccuguucacgg

SEQ ID NO: 463253 - RNA, 21 nt, Homo sapiens
ugguuaucaaauacaucucca

SEQ ID NO: 463254 - RNA, 21 nt, Homo sapiens
uguaaacagcuaauaaugaag

SEQ ID NO: 463255 - RNA, 17 nt, Homo sapiens
caaagugcagggauuac

SEQ ID NO: 463256 - RNA, 19 nt, Homo sapiens
caaagugcagggauuacag

SEQ ID NO: 463257 - RNA, 17 nt, Homo sapiens
agaauuaugcuguuaaa

SEQ ID NO: 463258 - RNA, 14 nt, Homo sapiens
agaauuuagcugua

SEQ ID NO: 463259 - RNA, 22 nt, Homo sapiens
agacagggugggaguagugcuu

SEQ ID NO: 463260 - RNA, 13 nt, Homo sapiens
agacauacuugua

SEQ ID NO: 463261 - RNA, 20 nt, Homo sapiens
agaccaacucucuccuguau

SEQ ID NO: 463262 - RNA, 23 nt, Homo sapiens
agaccucgacgacccuuucauca

SEQ ID NO: 463263 - RNA, 14 nt, Homo sapiens
agacgacuguggug

SEQ ID NO: 463264 - RNA, 20 nt, Homo sapiens
agagaauucucuuauccaac

SEQ ID NO: 463265 - RNA, 24 nt, Homo sapiens
agagaauugacugggccucaugaa

SEQ ID NO: 463266 - RNA, 15 nt, Homo sapiens
agagaguugagacuu

SEQ ID NO: 463267 - RNA, 20 nt, Homo sapiens
agaggugaaaacuugucaga

SEQ ID NO: 463268 - RNA, 17 nt, Homo sapiens
agagucucauguagcug

SEQ ID NO: 463269 - RNA, 12 nt, Homo sapiens
agauaguaucuu

SEQ ID NO: 463270 - RNA, 19 nt, Homo sapiens
agcaaaaggggaagggaag

SEQ ID NO: 463271 - RNA, 22 nt, Homo sapiens
agcaaaugagauguaugcccaa

SEQ ID NO: 463272 - RNA, 16 nt, Homo sapiens
agcaacagccagugga

SEQ ID NO: 463273 - RNA, 14 nt, Homo sapiens
agcaaugguguugu

SEQ ID NO: 463274 - RNA, 18 nt, Homo sapiens
agcacacucccuguggga

SEQ ID NO: 463275 - RNA, 22 nt, Homo sapiens
agcacgcacacgagaacgacau

SEQ ID NO: 463276 - RNA, 11 nt, Homo sapiens
agcacugacac

SEQ ID NO: 463277 - RNA, 13 nt, Homo sapiens
agcacuugaaaau

SEQ ID NO: 463278 - RNA, 22 nt, Homo sapiens
agcagcagugagcuucuauuaa

SEQ ID NO: 463279 - RNA, 17 nt, Homo sapiens
agcaggaugcucaguga

SEQ ID NO: 463280 - RNA, 14 nt, Homo sapiens
agccucccaaagug

SEQ ID NO: 463281 - RNA, 19 nt, Homo sapiens
agcgagugugccucaggga

SEQ ID NO: 463282 - RNA, 15 nt, Homo sapiens
agcuauuucucauca

SEQ ID NO: 463283 - RNA, 21 nt, Homo sapiens
agcuccauggcgaaaggagug

SEQ ID NO: 463284 - RNA, 19 nt, Homo sapiens
agcugacuuuuaacuacaa

SEQ ID NO: 463285 - RNA, 15 nt, Homo sapiens
agcuuccucuggcca

SEQ ID NO: 463286 - RNA, 13 nt, Homo sapiens
agcuucucucugc

SEQ ID NO: 463287 - RNA, 21 nt, Homo sapiens
agcuugcaggguuucucgcca

SEQ ID NO: 463288 - RNA, 19 nt, Homo sapiens
agcuuucuucuacaaccag

SEQ ID NO: 463289 - RNA, 21 nt, Homo sapiens
agcuuucuucuacaaccagag

SEQ ID NO: 463290 - RNA, 20 nt, Homo sapiens
aggacgauuucacugacacu

SEQ ID NO: 463291 - RNA, 19 nt, Homo sapiens
aggacguggugacuuccug

SEQ ID NO: 463292 - RNA, 15 nt, Homo sapiens
aggagcaugcuuccu

SEQ ID NO: 463293 - RNA, 15 nt, Homo sapiens
aggagcuuacugaaa

SEQ ID NO: 463294 - RNA, 13 nt, Homo sapiens
aggaggagugcau

SEQ ID NO: 463295 - RNA, 20 nt, Homo sapiens
aggaggcggagguugcagug

SEQ ID NO: 463296 - RNA, 14 nt, Homo sapiens
aggauuccuuggca

SEQ ID NO: 463297 - RNA, 15 nt, Homo sapiens
aggcagagacaauaa

SEQ ID NO: 463298 - RNA, 23 nt, Homo sapiens
aggcagagacaauaaaacauucc

SEQ ID NO: 463299 - RNA, 21 nt, Homo sapiens
aggcagucagaggacgagugc

SEQ ID NO: 463300 - RNA, 19 nt, Homo sapiens
aggcaugagccaccaugcc

SEQ ID NO: 463301 - RNA, 12 nt, Homo sapiens
aggccagguaug

SEQ ID NO: 463302 - RNA, 22 nt, Homo sapiens
aggccagucugaaccugagguu

SEQ ID NO: 463303 - RNA, 14 nt, Homo sapiens
aggcuggagugcag

SEQ ID NO: 463304 - RNA, 17 nt, Homo sapiens
aggcugguuuucuugua

SEQ ID NO: 463305 - RNA, 15 nt, Homo sapiens
agggacuaccaaugc

SEQ ID NO: 463306 - RNA, 18 nt, Homo sapiens
agggauuuguuuugucaa

SEQ ID NO: 463307 - RNA, 17 nt, Homo sapiens
agggcagggauacaaag

SEQ ID NO: 463308 - RNA, 13 nt, Homo sapiens
agggccaggugcu

SEQ ID NO: 463309 - RNA, 23 nt, Homo sapiens
agguagauuuaaaauggggugcu

SEQ ID NO: 463310 - RNA, 13 nt, Homo sapiens
aggugagcgcuuu

SEQ ID NO: 463311 - RNA, 22 nt, Homo sapiens
aggugagcgcuuugcagucaca

SEQ ID NO: 463312 - RNA, 23 nt, Homo sapiens
agguuaaaaucuuagaaaauuaa

SEQ ID NO: 463313 - RNA, 13 nt, Homo sapiens
aguaauugucaau

SEQ ID NO: 463314 - RNA, 23 nt, Homo sapiens
aguaucugucucauccaaaaagu

SEQ ID NO: 463315 - RNA, 21 nt, Homo sapiens
aguauuccuuuccugaucacu

SEQ ID NO: 463316 - RNA, 21 nt, Homo sapiens
agucaaauuuggauuuuccac

SEQ ID NO: 463317 - RNA, 12 nt, Homo sapiens
aguccuugcaaa

SEQ ID NO: 463318 - RNA, 16 nt, Homo sapiens
agugacugccaaaaag

SEQ ID NO: 463319 - RNA, 13 nt, Homo sapiens
agugacuuugcag

SEQ ID NO: 463320 - RNA, 23 nt, Homo sapiens
agugaugucaaauugacuguaau

SEQ ID NO: 463321 - RNA, 16 nt, Homo sapiens
agugcagggauuacag

SEQ ID NO: 463322 - RNA, 20 nt, Homo sapiens
agugcaguggcacgaucuca

SEQ ID NO: 463323 - RNA, 16 nt, Homo sapiens
aguguaggccuuccag

SEQ ID NO: 463324 - RNA, 16 nt, Homo sapiens
aguuacaucucagugc

SEQ ID NO: 463325 - RNA, 14 nt, Homo sapiens
aguuauucuugaca

SEQ ID NO: 463326 - RNA, 18 nt, Homo sapiens
aguucagacucuaacuuc

SEQ ID NO: 463327 - RNA, 14 nt, Homo sapiens
aguugagacuugcc

SEQ ID NO: 463328 - RNA, 16 nt, Homo sapiens
aguugagauucucuac

SEQ ID NO: 463329 - RNA, 14 nt, Homo sapiens
aguuggacagcaaa

SEQ ID NO: 463330 - RNA, 22 nt, Homo sapiens
aguuugcaaauagaacuaauac

SEQ ID NO: 463331 - RNA, 16 nt, Homo sapiens
aguuuuuucuccucau

SEQ ID NO: 463332 - RNA, 19 nt, Homo sapiens
auaacacguccacuuucaa

SEQ ID NO: 463333 - RNA, 19 nt, Homo sapiens
auaauguuaacauggacau

SEQ ID NO: 463334 - RNA, 20 nt, Homo sapiens
auaauuacuaauuaaucaca

SEQ ID NO: 463335 - RNA, 15 nt, Homo sapiens
auaauuauuacaugg

SEQ ID NO: 463336 - RNA, 23 nt, Homo sapiens
auacacccccaccuccugcaaua

SEQ ID NO: 463337 - RNA, 13 nt, Homo sapiens
auacacuuacacu

SEQ ID NO: 463338 - RNA, 15 nt, Homo sapiens
auacacuuacacuuu

SEQ ID NO: 463339 - RNA, 20 nt, Homo sapiens
auaccaagggccauucagua

SEQ ID NO: 463340 - RNA, 24 nt, Homo sapiens
auaccacccaaaaucauaaugcca

SEQ ID NO: 463341 - RNA, 20 nt, Homo sapiens
auacccuguugaggugugaa

SEQ ID NO: 463342 - RNA, 23 nt, Homo sapiens
auagaaguauuuguguaccugga

SEQ ID NO: 463343 - RNA, 12 nt, Homo sapiens
auagaccaaaga

SEQ ID NO: 463344 - RNA, 21 nt, Homo sapiens
auagaucguagauguuguaga

SEQ ID NO: 463345 - RNA, 15 nt, Homo sapiens
auaggcaacuuggua

SEQ ID NO: 463346 - RNA, 19 nt, Homo sapiens
auauauucaguauuguaga

SEQ ID NO: 463347 - RNA, 20 nt, Homo sapiens
auauauuuuugcuaaaccua

SEQ ID NO: 463348 - RNA, 19 nt, Homo sapiens
auaugugaaauuaauacac

SEQ ID NO: 463349 - RNA, 13 nt, Homo sapiens
auauuugaucuaa

SEQ ID NO: 463350 - RNA, 18 nt, Homo sapiens
aucaacaucuuggucaga

SEQ ID NO: 463351 - RNA, 20 nt, Homo sapiens
aucacaugugcccucugcca

SEQ ID NO: 463352 - RNA, 22 nt, Homo sapiens
aucauaaacuauauucugugac

SEQ ID NO: 463353 - RNA, 15 nt, Homo sapiens
aucauguugaaguca

SEQ ID NO: 463354 - RNA, 17 nt, Homo sapiens
aucauugugacgugugu

SEQ ID NO: 463355 - RNA, 12 nt, Homo sapiens
aucccagcacuu

SEQ ID NO: 463356 - RNA, 12 nt, Homo sapiens
aucccuguucau

SEQ ID NO: 463357 - RNA, 20 nt, Homo sapiens
auccgggugaagacauguac

SEQ ID NO: 463358 - RNA, 16 nt, Homo sapiens
aucggcuuugcagugc

SEQ ID NO: 463359 - RNA, 15 nt, Homo sapiens
aucuaacaaagucaa

SEQ ID NO: 463360 - RNA, 14 nt, Homo sapiens
aucuaauaaauacu

SEQ ID NO: 463361 - RNA, 14 nt, Homo sapiens
aucucaguggcaca

SEQ ID NO: 463362 - RNA, 14 nt, Homo sapiens
aucucucuccugua

SEQ ID NO: 463363 - RNA, 18 nt, Homo sapiens
aucuugcauucacacuca

SEQ ID NO: 463364 - RNA, 14 nt, Homo sapiens
augaacuaugauuu

SEQ ID NO: 463365 - RNA, 20 nt, Homo sapiens
augacagaaugcuguuuuaa

SEQ ID NO: 463366 - RNA, 17 nt, Homo sapiens
augaccgucugagccca

SEQ ID NO: 463367 - RNA, 23 nt, Homo sapiens
augauagaaacagacugccugaa

SEQ ID NO: 463368 - RNA, 19 nt, Homo sapiens
augaucuaugcuauauuca

SEQ ID NO: 463369 - RNA, 22 nt, Homo sapiens
augcauuagaagucagccagcg

SEQ ID NO: 463370 - RNA, 11 nt, Homo sapiens
augcuuccaac

SEQ ID NO: 463371 - RNA, 19 nt, Homo sapiens
auggaccaauuagcauucc

SEQ ID NO: 463372 - RNA, 17 nt, Homo sapiens
auggcugacaucaguca

SEQ ID NO: 463373 - RNA, 13 nt, Homo sapiens
auggcuguugaag

SEQ ID NO: 463374 - RNA, 22 nt, Homo sapiens
augggauuucauguaaccaaga

SEQ ID NO: 463375 - RNA, 14 nt, Homo sapiens
augggggaugcuuc

SEQ ID NO: 463376 - RNA, 12 nt, Homo sapiens
auguaaccaaga

SEQ ID NO: 463377 - RNA, 18 nt, Homo sapiens
auguaguacuaacuaagg

SEQ ID NO: 463378 - RNA, 17 nt, Homo sapiens
auguuuggacacacugg

SEQ ID NO: 463379 - RNA, 12 nt, Homo sapiens
auuaaaauaucc

SEQ ID NO: 463380 - RNA, 19 nt, Homo sapiens
auuaaaauuacacacuugc

SEQ ID NO: 463381 - RNA, 16 nt, Homo sapiens
auuaagggaguaggaa

SEQ ID NO: 463382 - RNA, 17 nt, Homo sapiens
auuaaguccuacuuuac

SEQ ID NO: 463383 - RNA, 18 nt, Homo sapiens
guuugagguccacacuga

SEQ ID NO: 463384 - RNA, 17 nt, Homo sapiens
guuugccgucugugaca

SEQ ID NO: 463385 - RNA, 21 nt, Homo sapiens
guuuuuuguuuaaguacuuca

SEQ ID NO: 463386 - RNA, 17 nt, Homo sapiens
uaaaaacugcagugucu

SEQ ID NO: 463387 - RNA, 12 nt, Homo sapiens
uaaaacauuccu

SEQ ID NO: 463388 - RNA, 18 nt, Homo sapiens
uaaaacauuccugugaaa

SEQ ID NO: 463389 - RNA, 22 nt, Homo sapiens
uaaaacucacugaaucuaacca

SEQ ID NO: 463390 - RNA, 14 nt, Homo sapiens
uaaaagaccacaga

SEQ ID NO: 463391 - RNA, 20 nt, Homo sapiens
uaaaaguuuuaaccucaggu

SEQ ID NO: 463392 - RNA, 19 nt, Homo sapiens
uaaacauuuuuaaguauuu

SEQ ID NO: 463393 - RNA, 10 nt, Homo sapiens
uaaaccaaac

SEQ ID NO: 463394 - RNA, 22 nt, Homo sapiens
uaaaccccggcgugugcagugc

SEQ ID NO: 463395 - RNA, 13 nt, Homo sapiens
uaaacuauauucu

SEQ ID NO: 463396 - RNA, 21 nt, Homo sapiens
uaaagccucagcaacagccag

SEQ ID NO: 463397 - RNA, 21 nt, Homo sapiens
uaaaggaguagaauaccaaau

SEQ ID NO: 463398 - RNA, 16 nt, Homo sapiens
uaaauguauaugucau

SEQ ID NO: 463399 - RNA, 17 nt, Homo sapiens
uaaauguuugugauguu

SEQ ID NO: 463400 - RNA, 15 nt, Homo sapiens
uaaccccaccuugcc

SEQ ID NO: 463401 - RNA, 11 nt, Homo sapiens
uaacucagugg

SEQ ID NO: 463402 - RNA, 14 nt, Homo sapiens
uaagaggcuauuua

SEQ ID NO: 463403 - RNA, 17 nt, Homo sapiens
uaagcauuuugugaugu

SEQ ID NO: 463404 - RNA, 22 nt, Homo sapiens
uaagcugcucggagcucagugc

SEQ ID NO: 463405 - RNA, 22 nt, Homo sapiens
uaaguaccccugauaagcaaau

SEQ ID NO: 463406 - RNA, 14 nt, Homo sapiens
uaauaaauacuuaa

SEQ ID NO: 463407 - RNA, 12 nt, Homo sapiens
uaauacuuccaa

SEQ ID NO: 463408 - RNA, 15 nt, Homo sapiens
uaaucccagcacuuu

SEQ ID NO: 463409 - RNA, 16 nt, Homo sapiens
uaaugcaaaugacugu

SEQ ID NO: 463410 - RNA, 14 nt, Homo sapiens
uaauuccacuuuaa

SEQ ID NO: 463411 - RNA, 15 nt, Homo sapiens
uaauuguauuucaaa

SEQ ID NO: 463412 - RNA, 19 nt, Homo sapiens
uacaaccuaaaaaauuccu

SEQ ID NO: 463413 - RNA, 20 nt, Homo sapiens
uacaaccuaaaaaauuccua

SEQ ID NO: 463414 - RNA, 16 nt, Homo sapiens
uacacacucagugaca

SEQ ID NO: 463415 - RNA, 17 nt, Homo sapiens
uacacacucagugacau

SEQ ID NO: 463416 - RNA, 18 nt, Homo sapiens
uacacacucagugacauu

SEQ ID NO: 463417 - RNA, 18 nt, Homo sapiens
uacacguugaaaaucaac

SEQ ID NO: 463418 - RNA, 15 nt, Homo sapiens
uacacuguauuacau

SEQ ID NO: 463419 - RNA, 21 nt, Homo sapiens
uacaguaaauguuugugaugu

SEQ ID NO: 463420 - RNA, 21 nt, Homo sapiens
uacauuauuacuccuugccau

SEQ ID NO: 463421 - RNA, 13 nt, Homo sapiens
uacauucuagccu

SEQ ID NO: 463422 - RNA, 20 nt, Homo sapiens
uaccaugaggcuugugugaa

SEQ ID NO: 463423 - RNA, 17 nt, Homo sapiens
uaccgggcuggccugug

SEQ ID NO: 463424 - RNA, 15 nt, Homo sapiens
uacuaauuaaucaca

SEQ ID NO: 463425 - RNA, 22 nt, Homo sapiens
uacuguaaagaauuuagcugua

SEQ ID NO: 463426 - RNA, 18 nt, Homo sapiens
uacuucagucuugaugca

SEQ ID NO: 463427 - RNA, 18 nt, Homo sapiens
uacuucuuauacauuuga

SEQ ID NO: 463428 - RNA, 17 nt, Homo sapiens
uagaaaacgauuuugaa

SEQ ID NO: 463429 - RNA, 15 nt, Homo sapiens
uagaaaauuaaauga

SEQ ID NO: 463430 - RNA, 18 nt, Homo sapiens
uagaauuaugcuguuaaa

SEQ ID NO: 463431 - RNA, 18 nt, Homo sapiens
uagaauuuacaacuuaua

SEQ ID NO: 463432 - RNA, 14 nt, Homo sapiens
uagauucauuuuac

SEQ ID NO: 463433 - RNA, 18 nt, Homo sapiens
uagauugccuuuggcaau

SEQ ID NO: 463434 - RNA, 23 nt, Homo sapiens
uagauugccuuuggcaauucuuc

SEQ ID NO: 463435 - RNA, 15 nt, Homo sapiens
uagcccucacacugu

SEQ ID NO: 463436 - RNA, 18 nt, Homo sapiens
uagccggggguggugaca

SEQ ID NO: 463437 - RNA, 14 nt, Homo sapiens
uagcucuccugcca

SEQ ID NO: 463438 - RNA, 15 nt, Homo sapiens
uagcucuccugccac

SEQ ID NO: 463439 - RNA, 15 nt, Homo sapiens
uaggagcuuacugaa

SEQ ID NO: 463440 - RNA, 20 nt, Homo sapiens
uaguaauuguaaguaccccu

SEQ ID NO: 463441 - RNA, 22 nt, Homo sapiens
uaguaauuguaaguaccccuga

SEQ ID NO: 463442 - RNA, 20 nt, Homo sapiens
uaguaauugucaauaccccu

SEQ ID NO: 463443 - RNA, 21 nt, Homo sapiens
uagugcaugaauagauucucu

SEQ ID NO: 463444 - RNA, 13 nt, Homo sapiens
uaguuacuugagu

SEQ ID NO: 463445 - RNA, 19 nt, Homo sapiens
uaguuuuuucuccucaugg

SEQ ID NO: 463446 - RNA, 16 nt, Homo sapiens
uauaaagauauaccaa

SEQ ID NO: 463447 - RNA, 19 nt, Homo sapiens
uauaaccccaccuugccaa

SEQ ID NO: 463448 - RNA, 16 nt, Homo sapiens
uauaauguucacuaau

SEQ ID NO: 463449 - RNA, 21 nt, Homo sapiens
uauacuguugucagguacagu

SEQ ID NO: 463450 - RNA, 23 nt, Homo sapiens
uaucaaauacaucuccaguacau

SEQ ID NO: 463451 - RNA, 15 nt, Homo sapiens
uauccucgcugguga

SEQ ID NO: 463452 - RNA, 22 nt, Homo sapiens
uauccuuuucuauuaagauaua

SEQ ID NO: 463453 - RNA, 23 nt, Homo sapiens
uauccuuuucuauuaagauauau

SEQ ID NO: 463454 - RNA, 22 nt, Homo sapiens
uaugaucuaugcuauauucaaa

SEQ ID NO: 463455 - RNA, 15 nt, Homo sapiens
uauguagauugccuu

SEQ ID NO: 463456 - RNA, 12 nt, Homo sapiens
uaugucugccua

SEQ ID NO: 463457 - RNA, 22 nt, Homo sapiens
uaugugugccagcugugugaga

SEQ ID NO: 463458 - RNA, 21 nt, Homo sapiens
uauuaacgcgacugaacuaca

SEQ ID NO: 463459 - RNA, 12 nt, Homo sapiens
uauuaagauaua

SEQ ID NO: 463460 - RNA, 15 nt, Homo sapiens
uauuacuccuugcca

SEQ ID NO: 463461 - RNA, 13 nt, Homo sapiens
uauucacuugagu

SEQ ID NO: 463462 - RNA, 18 nt, Homo sapiens
uauuccaggaugcugcug

SEQ ID NO: 463463 - RNA, 20 nt, Homo sapiens
uauuccaggaugcugcugca

SEQ ID NO: 463464 - RNA, 16 nt, Homo sapiens
uauuuaaaaguauaaa

SEQ ID NO: 463465 - RNA, 21 nt, Homo sapiens
uauuucugcacaguguuccca

SEQ ID NO: 463466 - RNA, 19 nt, Homo sapiens
uauuuuaauuccacuuuaa

SEQ ID NO: 463467 - RNA, 17 nt, Homo sapiens
ucaaacuagugcaugaa

SEQ ID NO: 463468 - RNA, 15 nt, Homo sapiens
ucaaauacaucucca

SEQ ID NO: 463469 - RNA, 22 nt, Homo sapiens
ucaaauauguagauugccuuug

SEQ ID NO: 463470 - RNA, 21 nt, Homo sapiens
ucaacccaauaauucuguauu

SEQ ID NO: 463471 - RNA, 14 nt, Homo sapiens
ucaaguuaaugcaa

SEQ ID NO: 463472 - RNA, 21 nt, Homo sapiens
ucacccaggcuggagugcagu

SEQ ID NO: 463473 - RNA, 16 nt, Homo sapiens
ucacuaaguaugaucu

SEQ ID NO: 463474 - RNA, 16 nt, Homo sapiens
ucacugcaaccuccac

SEQ ID NO: 463475 - RNA, 15 nt, Homo sapiens
ucacugccagugcag

SEQ ID NO: 463476 - RNA, 18 nt, Homo sapiens
ucagaacuaccauuguaa

SEQ ID NO: 463477 - RNA, 21 nt, Homo sapiens
ucagaacuaccauuguaauau

SEQ ID NO: 463478 - RNA, 14 nt, Homo sapiens
ucagauucaugaaa

SEQ ID NO: 463479 - RNA, 15 nt, Homo sapiens
ucagcaaaccucagu

SEQ ID NO: 463480 - RNA, 14 nt, Homo sapiens
ucagccucccaaag

SEQ ID NO: 463481 - RNA, 13 nt, Homo sapiens
ucagcugcuucuc

SEQ ID NO: 463482 - RNA, 12 nt, Homo sapiens
ucaggcaccuga

SEQ ID NO: 463483 - RNA, 11 nt, Homo sapiens
ucagggucccc

SEQ ID NO: 463484 - RNA, 15 nt, Homo sapiens
ucaguaaauuuugga

SEQ ID NO: 463485 - RNA, 17 nt, Homo sapiens
ucaguaaauuuuggaaa

SEQ ID NO: 463486 - RNA, 15 nt, Homo sapiens
ucaguguggaaaauu

SEQ ID NO: 463487 - RNA, 13 nt, Homo sapiens
ucauaaacuauau

SEQ ID NO: 463488 - RNA, 13 nt, Homo sapiens
ucauccaaaaagu

SEQ ID NO: 463489 - RNA, 21 nt, Homo sapiens
ucaucuccaaaaacaguaaaa

SEQ ID NO: 463490 - RNA, 13 nt, Homo sapiens
ucauguaaccaag

SEQ ID NO: 463491 - RNA, 14 nt, Homo sapiens
ucauguaaccaaga

SEQ ID NO: 463492 - RNA, 15 nt, Homo sapiens
ucauguugaagucaa

SEQ ID NO: 463493 - RNA, 23 nt, Homo sapiens
ucauuaccgucugugauugccau

SEQ ID NO: 463494 - RNA, 19 nt, Homo sapiens
ucauuuugucucucucaca

SEQ ID NO: 463495 - RNA, 20 nt, Homo sapiens
uccaaaaauagcccugcaaa

SEQ ID NO: 463496 - RNA, 14 nt, Homo sapiens
uccaaucuccauca

SEQ ID NO: 463497 - RNA, 15 nt, Homo sapiens
uccaaucuccaucac

SEQ ID NO: 463498 - RNA, 13 nt, Homo sapiens
uccacagcugugu

SEQ ID NO: 463499 - RNA, 20 nt, Homo sapiens
uccaccucccagguucaagc

SEQ ID NO: 463500 - RNA, 18 nt, Homo sapiens
uccaggaacuuuccagca

SEQ ID NO: 463501 - RNA, 17 nt, Homo sapiens
uccaggggcggugcagg

SEQ ID NO: 463502 - RNA, 16 nt, Homo sapiens
uccaucauuaauguga

SEQ ID NO: 463503 - RNA, 20 nt, Homo sapiens
ucccaaagugcagggauuac

SEQ ID NO: 463504 - RNA, 15 nt, Homo sapiens
uccccucucuuugag

SEQ ID NO: 463505 - RNA, 20 nt, Homo sapiens
uccgaaguagcugggauuac

SEQ ID NO: 463506 - RNA, 17 nt, Homo sapiens
uccgagugggauuuucu

SEQ ID NO: 463507 - RNA, 22 nt, Homo sapiens
uccgcugcgucugcacugauga

SEQ ID NO: 463508 - RNA, 23 nt, Homo sapiens
uccggcagguaagggacuaccaa

SEQ ID NO: 463509 - RNA, 23 nt, Homo sapiens
uuguaaacagcuaauaaugaagu

SEQ ID NO: 463510 - RNA, 18 nt, Homo sapiens
uuguaguuuaaauucuuc

SEQ ID NO: 463511 - RNA, 17 nt, Homo sapiens
uuguccugaccuugaga

SEQ ID NO: 463512 - RNA, 13 nt, Homo sapiens
uugugacgugugu

SEQ ID NO: 463513 - RNA, 18 nt, Homo sapiens
uugugcuugcugguacua

SEQ ID NO: 463514 - RNA, 14 nt, Homo sapiens
uugugguuaaucug

SEQ ID NO: 463515 - RNA, 14 nt, Homo sapiens
uuguuuuaagccaa

SEQ ID NO: 463516 - RNA, 20 nt, Homo sapiens
uuguuuuauauguaguacua

SEQ ID NO: 463517 - RNA, 22 nt, Homo sapiens
uuuaaccagucugaaguuucau

SEQ ID NO: 463518 - RNA, 14 nt, Homo sapiens
uuuaagaacgaagg

SEQ ID NO: 463519 - RNA, 20 nt, Homo sapiens
uuuaaguggcuuucagcaaa

SEQ ID NO: 463520 - RNA, 20 nt, Homo sapiens
uuuaaucuccucugaaaugu

SEQ ID NO: 463521 - RNA, 21 nt, Homo sapiens
uuuacgcggagcacuuucgag

SEQ ID NO: 463522 - RNA, 17 nt, Homo sapiens
uuuagcagcauggcugc

SEQ ID NO: 463523 - RNA, 20 nt, Homo sapiens
uuuaguggcucagaacugca

SEQ ID NO: 463524 - RNA, 15 nt, Homo sapiens
uuuauguucuaguga

SEQ ID NO: 463525 - RNA, 11 nt, Homo sapiens
uuucacugaca

SEQ ID NO: 463526 - RNA, 16 nt, Homo sapiens
uuucaucagaggaaaa

SEQ ID NO: 463527 - RNA, 20 nt, Homo sapiens
uuuccauuaaacuacuuuug

SEQ ID NO: 463528 - RNA, 18 nt, Homo sapiens
uuuccugaucacuaugca

SEQ ID NO: 463529 - RNA, 20 nt, Homo sapiens
uuucugauuuuuauucucaa

SEQ ID NO: 463530 - RNA, 10 nt, Homo sapiens
uuugagacaa

SEQ ID NO: 463531 - RNA, 14 nt, Homo sapiens
uuugcauguuugua

SEQ ID NO: 463532 - RNA, 15 nt, Homo sapiens
uuugcugcagacuca

SEQ ID NO: 463533 - RNA, 16 nt, Homo sapiens
uuugcugcagacucau

SEQ ID NO: 463534 - RNA, 12 nt, Homo sapiens
uuuggauuuucc

SEQ ID NO: 463535 - RNA, 20 nt, Homo sapiens
uuuucuccucauggauuuga

SEQ ID NO: 463536 - RNA, 22 nt, Homo sapiens
uuuugcuaaaccuauuucacaa

SEQ ID NO: 463537 - RNA, 13 nt, Homo sapiens
uuuuguguacugu

SEQ ID NO: 463538 - RNA, 17 nt, Homo sapiens
ugacugucaguugccaa

SEQ ID NO: 463539 - RNA, 22 nt, Homo sapiens
ugagacauauuagucuuugaaa

SEQ ID NO: 463540 - RNA, 18 nt, Homo sapiens
ugagauauauucaguauu

SEQ ID NO: 463541 - RNA, 16 nt, Homo sapiens
ugagcagcugggauua

SEQ ID NO: 463542 - RNA, 17 nt, Homo sapiens
ugaggacguggugacuu

SEQ ID NO: 463543 - RNA, 13 nt, Homo sapiens
ugauaagcaaauu

SEQ ID NO: 463544 - RNA, 22 nt, Homo sapiens
ugaugacuguuuguuagucagu

SEQ ID NO: 463545 - RNA, 20 nt, Homo sapiens
ugaugcauagaucccauagu

SEQ ID NO: 463546 - RNA, 18 nt, Homo sapiens
ugcaaccuugaagacuau

SEQ ID NO: 463547 - RNA, 18 nt, Homo sapiens
ugcaauaaaauaguagca

SEQ ID NO: 463548 - RNA, 17 nt, Homo sapiens
ugcagggacggagcuga

SEQ ID NO: 463549 - RNA, 19 nt, Homo sapiens
ugcaguggugcaaucuugg

SEQ ID NO: 463550 - RNA, 13 nt, Homo sapiens
ugcaugauguaaa

SEQ ID NO: 463551 - RNA, 17 nt, Homo sapiens
ugccagcugugugagaa

SEQ ID NO: 463552 - RNA, 22 nt, Homo sapiens
ugcccacgcugcagugugagua

SEQ ID NO: 463553 - RNA, 18 nt, Homo sapiens
ugcccacuucacugcucg

SEQ ID NO: 463554 - RNA, 22 nt, Homo sapiens
ugcccaugguguguguguccag

SEQ ID NO: 463555 - RNA, 20 nt, Homo sapiens
ugcccggcuaauuuuuugca

SEQ ID NO: 463556 - RNA, 16 nt, Homo sapiens
ugccuggcaggugugc

SEQ ID NO: 463557 - RNA, 19 nt, Homo sapiens
ugcuagcugcuaugggaaa

SEQ ID NO: 463558 - RNA, 18 nt, Homo sapiens
ugcuauggagcaaaucca

SEQ ID NO: 463559 - RNA, 19 nt, Homo sapiens
ugcucacugccagugcaga

SEQ ID NO: 463560 - RNA, 13 nt, Homo sapiens
ugcuggucuucaa

SEQ ID NO: 463561 - RNA, 21 nt, Homo sapiens
ugcuguccaggaacuuuccag

SEQ ID NO: 463562 - RNA, 14 nt, Homo sapiens
ugcuuuguauccau

SEQ ID NO: 463563 - RNA, 23 nt, Homo sapiens
uggacaaacagccucacuccuca

SEQ ID NO: 463564 - RNA, 17 nt, Homo sapiens
uggacagcaaaaccauu

SEQ ID NO: 463565 - RNA, 19 nt, Homo sapiens
uggacuuuugcagcuuccu

SEQ ID NO: 463566 - RNA, 20 nt, Homo sapiens
uggcaauauaaggggaugag

SEQ ID NO: 463567 - RNA, 22 nt, Homo sapiens
uggcaauucuucuucucaagca

SEQ ID NO: 463568 - RNA, 12 nt, Homo sapiens
uggcacucucag

SEQ ID NO: 463569 - RNA, 18 nt, Homo sapiens
uggccaggccggucucaa

SEQ ID NO: 463570 - RNA, 21 nt, Homo sapiens
uggcccaggcuggagugcagu

SEQ ID NO: 463571 - RNA, 16 nt, Homo sapiens
uggcccugcagggucc

SEQ ID NO: 463572 - RNA, 13 nt, Homo sapiens
uggccuaggcagu

SEQ ID NO: 463573 - RNA, 17 nt, Homo sapiens
uggccuuguaucuugca

SEQ ID NO: 463574 - RNA, 20 nt, Homo sapiens
uggcgaaaggagugacuuug

SEQ ID NO: 463575 - RNA, 19 nt, Homo sapiens
uggcguaucaucguacaca

SEQ ID NO: 463576 - RNA, 16 nt, Homo sapiens
uggcucagaacugcaa

SEQ ID NO: 463577 - RNA, 17 nt, Homo sapiens
uggcuggcugggucccc

SEQ ID NO: 463578 - RNA, 22 nt, Homo sapiens
uggcuuccaucucagcacucug

SEQ ID NO: 463579 - RNA, 16 nt, Homo sapiens
ugggaagaagcugcac

SEQ ID NO: 463580 - RNA, 22 nt, Homo sapiens
ugggcagggguuccagcuuccc

SEQ ID NO: 463581 - RNA, 12 nt, Homo sapiens
ugggccuuggca

SEQ ID NO: 463582 - RNA, 20 nt, Homo sapiens
ugggugaggcccgugugagg

SEQ ID NO: 463583 - RNA, 15 nt, Homo sapiens
uggucccauuauucu

SEQ ID NO: 463584 - RNA, 17 nt, Homo sapiens
uggugacaugugccugu

SEQ ID NO: 463585 - RNA, 19 nt, Homo sapiens
uggugacaugugccuguaa

SEQ ID NO: 463586 - RNA, 19 nt, Homo sapiens
ugguucugcaaugacugca

SEQ ID NO: 463587 - RNA, 12 nt, Homo sapiens
uguaacaugaca

SEQ ID NO: 463588 - RNA, 16 nt, Homo sapiens
uguaacaugacacuua

SEQ ID NO: 463589 - RNA, 15 nt, Homo sapiens
uguaaugcacacuua

SEQ ID NO: 463590 - RNA, 12 nt, Homo sapiens
uguacagccuuu

SEQ ID NO: 463591 - RNA, 16 nt, Homo sapiens
aauguccuuggcauca

SEQ ID NO: 463592 - RNA, 12 nt, Homo sapiens
aaugugguuauu

SEQ ID NO: 463593 - RNA, 18 nt, Homo sapiens
aauuaaaggcuuugcaac

SEQ ID NO: 463594 - RNA, 23 nt, Homo sapiens
aauuacacacuugcaugacaaag

SEQ ID NO: 463595 - RNA, 21 nt, Homo sapiens
aauuauuacaugguacuacau

SEQ ID NO: 463596 - RNA, 14 nt, Homo sapiens
aauucuacuuugag

SEQ ID NO: 463597 - RNA, 23 nt, Homo sapiens
aauucucuaucauguugaaguca

SEQ ID NO: 463598 - RNA, 15 nt, Homo sapiens
aauucuggcacauuu

SEQ ID NO: 463599 - RNA, 14 nt, Homo sapiens
aauucuucuucuca

SEQ ID NO: 463600 - RNA, 22 nt, Homo sapiens
aauugucaauaccccuguuaag

SEQ ID NO: 463601 - RNA, 19 nt, Homo sapiens
aauuuagaaauauaauuga

SEQ ID NO: 463602 - RNA, 22 nt, Homo sapiens
acaaacagccucacuccucagc

SEQ ID NO: 463603 - RNA, 20 nt, Homo sapiens
acaaagcggggagaggguac

SEQ ID NO: 463604 - RNA, 20 nt, Homo sapiens
acaaaguuuugcucuuguca

SEQ ID NO: 463605 - RNA, 13 nt, Homo sapiens
acaaucauuuuau

SEQ ID NO: 463606 - RNA, 17 nt, Homo sapiens
acaauuuucugcaggau

SEQ ID NO: 463607 - RNA, 13 nt, Homo sapiens
acacacucaguga

SEQ ID NO: 463608 - RNA, 21 nt, Homo sapiens
acacagaggacccaggggaaa

SEQ ID NO: 463609 - RNA, 16 nt, Homo sapiens
acacauccaucuugca

SEQ ID NO: 463610 - RNA, 22 nt, Homo sapiens
acacccccaccuccugcaauaa

SEQ ID NO: 463611 - RNA, 14 nt, Homo sapiens
acacuaauuuccaa

SEQ ID NO: 463612 - RNA, 16 nt, Homo sapiens
acacucaauagucacg

SEQ ID NO: 463613 - RNA, 15 nt, Homo sapiens
acacuuacacuuuau

SEQ ID NO: 463614 - RNA, 19 nt, Homo sapiens
acagauugcugcuucugcu

SEQ ID NO: 463615 - RNA, 21 nt, Homo sapiens
acagcaaaaccauugcuucac

SEQ ID NO: 463616 - RNA, 16 nt, Homo sapiens
acagcagccucugaag

SEQ ID NO: 463617 - RNA, 14 nt, Homo sapiens
acagcuauuucuca

SEQ ID NO: 463618 - RNA, 21 nt, Homo sapiens
acaggcgcccgccaccaugcc

SEQ ID NO: 463619 - RNA, 17 nt, Homo sapiens
acaggugaaugugccac

SEQ ID NO: 463620 - RNA, 16 nt, Homo sapiens
acauauaccuucucaa

SEQ ID NO: 463621 - RNA, 13 nt, Homo sapiens
acaucuaacaaag

SEQ ID NO: 463622 - RNA, 18 nt, Homo sapiens
acaugaucuucuuuauaa

SEQ ID NO: 463623 - RNA, 17 nt, Homo sapiens
acauggugaaacccugu

SEQ ID NO: 463624 - RNA, 13 nt, Homo sapiens
acaugugccugua

SEQ ID NO: 463625 - RNA, 19 nt, Homo sapiens
acauuauuacuccuugcca

SEQ ID NO: 463626 - RNA, 20 nt, Homo sapiens
acauuuauauaauacauuaa

SEQ ID NO: 463627 - RNA, 14 nt, Homo sapiens
accaaaucuugcuc

SEQ ID NO: 463628 - RNA, 18 nt, Homo sapiens
accaaauucugaauuugu

SEQ ID NO: 463629 - RNA, 23 nt, Homo sapiens
accaagaauucuccaaaacaauu

SEQ ID NO: 463630 - RNA, 20 nt, Homo sapiens
accaagaucaucaagacaga

SEQ ID NO: 463631 - RNA, 15 nt, Homo sapiens
accacccaaaaucau

SEQ ID NO: 463632 - RNA, 19 nt, Homo sapiens
accacugagccauccucag

SEQ ID NO: 463633 - RNA, 18 nt, Homo sapiens
accauguuagccaggcug

SEQ ID NO: 463634 - RNA, 19 nt, Homo sapiens
acccaggcuggagugcagu

SEQ ID NO: 463635 - RNA, 20 nt, Homo sapiens
acccaggcuggagugcagug

SEQ ID NO: 463636 - RNA, 17 nt, Homo sapiens
accccaccuugccaagc

SEQ ID NO: 463637 - RNA, 18 nt, Homo sapiens
accccugauaagcaaauu

SEQ ID NO: 463638 - RNA, 15 nt, Homo sapiens
accguggguguggcu

SEQ ID NO: 463639 - RNA, 14 nt, Homo sapiens
accucauaugcuau

SEQ ID NO: 463640 - RNA, 15 nt, Homo sapiens
accucuuaugcacac

SEQ ID NO: 463641 - RNA, 20 nt, Homo sapiens
accugaaggacgagggaugg

SEQ ID NO: 463642 - RNA, 15 nt, Homo sapiens
accuugaagacuauu

SEQ ID NO: 463643 - RNA, 22 nt, Homo sapiens
accuugagaagacauagaugaa

SEQ ID NO: 463644 - RNA, 21 nt, Homo sapiens
acgacccuuucaucagaggaa

SEQ ID NO: 463645 - RNA, 16 nt, Homo sapiens
acgagaacgacaucac

SEQ ID NO: 463646 - RNA, 19 nt, Homo sapiens
acgagggaugggauuucau

SEQ ID NO: 463647 - RNA, 16 nt, Homo sapiens
acguguagauaauuaa

SEQ ID NO: 463648 - RNA, 19 nt, Homo sapiens
acguuuguuucuucgugcc

SEQ ID NO: 463649 - RNA, 15 nt, Homo sapiens
acuaacuuugaaugu

SEQ ID NO: 463650 - RNA, 13 nt, Homo sapiens
acuaaugagcaag

SEQ ID NO: 463651 - RNA, 18 nt, Homo sapiens
acuauuuaugaauauuaa

SEQ ID NO: 463652 - RNA, 20 nt, Homo sapiens
acucacugaaucuaaccaua

SEQ ID NO: 463653 - RNA, 21 nt, Homo sapiens
acucacugaaucuaaccauag

SEQ ID NO: 463654 - RNA, 15 nt, Homo sapiens
acugagccauccuca

SEQ ID NO: 463655 - RNA, 19 nt, Homo sapiens
acugaugaccgucugagcc

SEQ ID NO: 463656 - RNA, 24 nt, Homo sapiens
acugaugaccgucugagcccagcu

SEQ ID NO: 463657 - RNA, 17 nt, Homo sapiens
acugcauuuuacuguac

SEQ ID NO: 463658 - RNA, 12 nt, Homo sapiens
acugcugugagc

SEQ ID NO: 463659 - RNA, 21 nt, Homo sapiens
acuggugaaaauuuaccuaaa

SEQ ID NO: 463660 - RNA, 13 nt, Homo sapiens
acuguaaagaauu

SEQ ID NO: 463661 - RNA, 16 nt, Homo sapiens
acuguggugugcagug

SEQ ID NO: 463662 - RNA, 15 nt, Homo sapiens
acuuauaauuacaau

SEQ ID NO: 463663 - RNA, 13 nt, Homo sapiens
acuucaagcuuuu

SEQ ID NO: 463664 - RNA, 22 nt, Homo sapiens
acuucauacaauguaaggucag

SEQ ID NO: 463665 - RNA, 22 nt, Homo sapiens
acuucauuuuucuaauaaucau

SEQ ID NO: 463666 - RNA, 22 nt, Homo sapiens
acuugaguuguugcuuauacug

SEQ ID NO: 463667 - RNA, 19 nt, Homo sapiens
acuugauguguuaucucuu

SEQ ID NO: 463668 - RNA, 11 nt, Homo sapiens
acuugccaguu

SEQ ID NO: 463669 - RNA, 16 nt, Homo sapiens
agaaaaucaguaauug

SEQ ID NO: 463670 - RNA, 13 nt, Homo sapiens
agaaagcauugcc

SEQ ID NO: 463671 - RNA, 14 nt, Homo sapiens
agaaggcggcacuu

SEQ ID NO: 463672 - RNA, 15 nt, Homo sapiens
agaaggcucuugcca

SEQ ID NO: 463673 - RNA, 19 nt, Homo sapiens
agaaggugugcuauucaca

SEQ ID NO: 463674 - RNA, 11 nt, Homo sapiens
agaaguauuug

SEQ ID NO: 463675 - RNA, 17 nt, Homo sapiens
agaauaccaaaugauag

SEQ ID NO: 463676 - RNA, 16 nt, Homo sapiens
agaaucggcuuugcag

SEQ ID NO: 463677 - RNA, 18 nt, Homo sapiens
agaaucggcuuugcagug

SEQ ID NO: 463678 - RNA, 23 nt, Homo sapiens
agaaucggcuuugcagugcacuu

SEQ ID NO: 463679 - RNA, 19 nt, Homo sapiens
agaauguuguguucugugu

SEQ ID NO: 463680 - RNA, 18 nt, Homo sapiens
agaccaaaucuugcucug

SEQ ID NO: 463681 - RNA, 13 nt, Homo sapiens
agaccaccucuca

SEQ ID NO: 463682 - RNA, 21 nt, Homo sapiens
agacucgucucaaaaaaaaga

SEQ ID NO: 463683 - RNA, 15 nt, Homo sapiens
agacucuaacuucuc

SEQ ID NO: 463684 - RNA, 17 nt, Homo sapiens
agacuuaaaaacuugaa

SEQ ID NO: 463685 - RNA, 22 nt, Homo sapiens
agagaaacgcaagcagacugga

SEQ ID NO: 463686 - RNA, 14 nt, Homo sapiens
agagaaacugaggu

SEQ ID NO: 463687 - RNA, 18 nt, Homo sapiens
agagugagacucgucuca

SEQ ID NO: 463688 - RNA, 15 nt, Homo sapiens
agauauaauguucac

SEQ ID NO: 463689 - RNA, 15 nt, Homo sapiens
agaucuuaggcaaaa

SEQ ID NO: 463690 - RNA, 13 nt, Homo sapiens
agaugagcuuaca

SEQ ID NO: 463691 - RNA, 20 nt, Homo sapiens
agaugccuccucuguccuca

SEQ ID NO: 463692 - RNA, 19 nt, Homo sapiens
agauucuuuggcuguguuu

SEQ ID NO: 463693 - RNA, 15 nt, Homo sapiens
agauugcaccacugc

SEQ ID NO: 463694 - RNA, 12 nt, Homo sapiens
agauuguagcug

SEQ ID NO: 463695 - RNA, 12 nt, Homo sapiens
agcaaaugagau

SEQ ID NO: 463696 - RNA, 14 nt, Homo sapiens
agcaaauuaguaau

SEQ ID NO: 463697 - RNA, 15 nt, Homo sapiens
agcaaauuaguaauu

SEQ ID NO: 463698 - RNA, 16 nt, Homo sapiens
agcaaauuaguaauug

SEQ ID NO: 463699 - RNA, 14 nt, Homo sapiens
agcaggcaccagca

SEQ ID NO: 463700 - RNA, 23 nt, Homo sapiens
agcaggcggccuuuguugcucag

SEQ ID NO: 463701 - RNA, 19 nt, Homo sapiens
agcaguguuuucaccucau

SEQ ID NO: 463702 - RNA, 14 nt, Homo sapiens
agcauuuaaaaugg

SEQ ID NO: 463703 - RNA, 15 nt, Homo sapiens
agcccaacugugaga

SEQ ID NO: 463704 - RNA, 19 nt, Homo sapiens
agccccccacaaugaugau

SEQ ID NO: 463705 - RNA, 23 nt, Homo sapiens
agccccggugugcggugcauaca

SEQ ID NO: 463706 - RNA, 20 nt, Homo sapiens
agccgagauugcaccacugc

SEQ ID NO: 463707 - RNA, 18 nt, Homo sapiens
agccggggguggugacau

SEQ ID NO: 463708 - RNA, 20 nt, Homo sapiens
agccuacccgauuauagcag

SEQ ID NO: 463709 - RNA, 18 nt, Homo sapiens
agccucagcaacagccag

SEQ ID NO: 463710 - RNA, 18 nt, Homo sapiens
agccuucugugcugugag

SEQ ID NO: 463711 - RNA, 22 nt, Homo sapiens
agcgccuccccaccacugagcc

SEQ ID NO: 463712 - RNA, 24 nt, Homo sapiens
agcgugcauaaguuaacuuccaau

SEQ ID NO: 463713 - RNA, 18 nt, Homo sapiens
agcucugcggcuugccac

SEQ ID NO: 463714 - RNA, 22 nt, Homo sapiens
agcugccagcccaacugugaga

SEQ ID NO: 463715 - RNA, 14 nt, Homo sapiens
agcugggauuacag

SEQ ID NO: 463716 - RNA, 17 nt, Homo sapiens
agcugggauuacaggcg

SEQ ID NO: 463717 - RNA, 18 nt, Homo sapiens
agcuggugcuucgugugc

SEQ ID NO: 463718 - RNA, 14 nt, Homo sapiens
caaauacaucucca

SEQ ID NO: 463719 - RNA, 18 nt, Homo sapiens
caaauagaacuaauacug

SEQ ID NO: 463720 - RNA, 20 nt, Homo sapiens
caaaugagauguaugcccaa

SEQ ID NO: 463721 - RNA, 15 nt, Homo sapiens
caacgagagcacuug

SEQ ID NO: 463722 - RNA, 19 nt, Homo sapiens
caagaaagcauugccagcu

SEQ ID NO: 463723 - RNA, 16 nt, Homo sapiens
caagagauucuccugc

SEQ ID NO: 463724 - RNA, 14 nt, Homo sapiens
caagcacugacacu

SEQ ID NO: 463725 - RNA, 22 nt, Homo sapiens
caaguuaaugcaaaugacuguc

SEQ ID NO: 463726 - RNA, 15 nt, Homo sapiens
caauauuaaguaaaa

SEQ ID NO: 463727 - RNA, 14 nt, Homo sapiens
caauauuugaucua

SEQ ID NO: 463728 - RNA, 15 nt, Homo sapiens
caauauuugaucuaa

SEQ ID NO: 463729 - RNA, 20 nt, Homo sapiens
caaugcacaauuuauaauua

SEQ ID NO: 463730 - RNA, 16 nt, Homo sapiens
caauggguaucuaaua

SEQ ID NO: 463731 - RNA, 15 nt, Homo sapiens
caauuagcauuccau

SEQ ID NO: 463732 - RNA, 12 nt, Homo sapiens
cacaauggguau

SEQ ID NO: 463733 - RNA, 19 nt, Homo sapiens
cacacccccuuugcauguu

SEQ ID NO: 463734 - RNA, 21 nt, Homo sapiens
cacaccucccacccccuguau

SEQ ID NO: 463735 - RNA, 12 nt, Homo sapiens
cacacucaguga

SEQ ID NO: 463736 - RNA, 20 nt, Homo sapiens
cacacuggagaaaaggcagu

SEQ ID NO: 463737 - RNA, 15 nt, Homo sapiens
cacagcugugugagc

SEQ ID NO: 463738 - RNA, 19 nt, Homo sapiens
cacaggacgauuucacuga

SEQ ID NO: 463739 - RNA, 14 nt, Homo sapiens
caccaaauucugaa

SEQ ID NO: 463740 - RNA, 21 nt, Homo sapiens
caccaggagacagacagagaa

SEQ ID NO: 463741 - RNA, 15 nt, Homo sapiens
caccaugcccggcua

SEQ ID NO: 463742 - RNA, 18 nt, Homo sapiens
cacccacucuccugugag

SEQ ID NO: 463743 - RNA, 17 nt, Homo sapiens
caccucccagguucaag

SEQ ID NO: 463744 - RNA, 14 nt, Homo sapiens
cacuauuggacuuu

SEQ ID NO: 463745 - RNA, 15 nt, Homo sapiens
cacucugugggucug

SEQ ID NO: 463746 - RNA, 17 nt, Homo sapiens
cacugagccauccucag

SEQ ID NO: 463747 - RNA, 15 nt, Homo sapiens
cacugcaaccuccac

SEQ ID NO: 463748 - RNA, 16 nt, Homo sapiens
cacugcgcccggccac

SEQ ID NO: 463749 - RNA, 20 nt, Homo sapiens
cacuuagaaugauguaauau

SEQ ID NO: 463750 - RNA, 22 nt, Homo sapiens
cacuuuuuguugggcaauauga

SEQ ID NO: 463751 - RNA, 22 nt, Homo sapiens
cagacgaaacacaaacugaagu

SEQ ID NO: 463752 - RNA, 13 nt, Homo sapiens
cagagccaugacu

SEQ ID NO: 463753 - RNA, 21 nt, Homo sapiens
cagagggaucggaagagucuu

SEQ ID NO: 463754 - RNA, 16 nt, Homo sapiens
cagagggugacugugu

SEQ ID NO: 463755 - RNA, 19 nt, Homo sapiens
cagaguggcuuccaucuca

SEQ ID NO: 463756 - RNA, 23 nt, Homo sapiens
cagauaacaaauuuuaagaccaa

SEQ ID NO: 463757 - RNA, 18 nt, Homo sapiens
cagaugccuccucugucc

SEQ ID NO: 463758 - RNA, 14 nt, Homo sapiens
cagauggucccauu

SEQ ID NO: 463759 - RNA, 15 nt, Homo sapiens
cagauggucccauua

SEQ ID NO: 463760 - RNA, 14 nt, Homo sapiens
cagcaaaccucagu

SEQ ID NO: 463761 - RNA, 13 nt, Homo sapiens
cagcaaaugagau

SEQ ID NO: 463762 - RNA, 17 nt, Homo sapiens
cagcaucaucugcacug

SEQ ID NO: 463763 - RNA, 21 nt, Homo sapiens
cagcaucaucugcacugccca

SEQ ID NO: 463764 - RNA, 14 nt, Homo sapiens
cagcccaacuguga

SEQ ID NO: 463765 - RNA, 16 nt, Homo sapiens
cagcccaacugugaga

SEQ ID NO: 463766 - RNA, 23 nt, Homo sapiens
cagccucaccauacccuguugag

SEQ ID NO: 463767 - RNA, 16 nt, Homo sapiens
cagccuggguggcaga

SEQ ID NO: 463768 - RNA, 14 nt, Homo sapiens
cagcggggaugcuu

SEQ ID NO: 463769 - RNA, 13 nt, Homo sapiens
cagcugugcugua

SEQ ID NO: 463770 - RNA, 22 nt, Homo sapiens
cagcuguucucauugccaguga

SEQ ID NO: 463771 - RNA, 14 nt, Homo sapiens
cagcuuccuuccaa

SEQ ID NO: 463772 - RNA, 20 nt, Homo sapiens
caggauggucucgaucuccu

SEQ ID NO: 463773 - RNA, 19 nt, Homo sapiens
caggcaugagccaccaugc

SEQ ID NO: 463774 - RNA, 20 nt, Homo sapiens
caggcaugagccaccaugcc

SEQ ID NO: 463775 - RNA, 20 nt, Homo sapiens
caggcgcccgccaccaugcc

SEQ ID NO: 463776 - RNA, 22 nt, Homo sapiens
cagggccccgcugucacuugcc

SEQ ID NO: 463777 - RNA, 16 nt, Homo sapiens
cagguagacuuuugua

SEQ ID NO: 463778 - RNA, 16 nt, Homo sapiens
caggugaugcacccac

SEQ ID NO: 463779 - RNA, 19 nt, Homo sapiens
caggugcgugccaccacac

SEQ ID NO: 463780 - RNA, 21 nt, Homo sapiens
caguacagagccaugacucaa

SEQ ID NO: 463781 - RNA, 17 nt, Homo sapiens
caguacccagagaccaa

SEQ ID NO: 463782 - RNA, 14 nt, Homo sapiens
caguauaagcauuu

SEQ ID NO: 463783 - RNA, 19 nt, Homo sapiens
cagugcccuuuucaucucc

SEQ ID NO: 463784 - RNA, 21 nt, Homo sapiens
caguugagcugacauauacug

SEQ ID NO: 463785 - RNA, 18 nt, Homo sapiens
cauaaguuaacuuccaau

SEQ ID NO: 463786 - RNA, 16 nt, Homo sapiens
cauaauucacacauua

SEQ ID NO: 463787 - RNA, 16 nt, Homo sapiens
cauaugcuuuaagaau

SEQ ID NO: 463788 - RNA, 22 nt, Homo sapiens
cauauuaauugguuugugccuu

SEQ ID NO: 463789 - RNA, 12 nt, Homo sapiens
caucaagacaga

SEQ ID NO: 463790 - RNA, 15 nt, Homo sapiens
caucauuaaugugaa

SEQ ID NO: 463791 - RNA, 19 nt, Homo sapiens
caucauugugacgugugug

SEQ ID NO: 463792 - RNA, 22 nt, Homo sapiens
caucguacacacucagugacau

SEQ ID NO: 463793 - RNA, 13 nt, Homo sapiens
caucuagcccuuu

SEQ ID NO: 463794 - RNA, 20 nt, Homo sapiens
caucuccaaaaacaguaaaa

SEQ ID NO: 463795 - RNA, 23 nt, Homo sapiens
caugaaauggacaaacagugcac

SEQ ID NO: 463796 - RNA, 22 nt, Homo sapiens
caugacucaauaaauacauguu

SEQ ID NO: 463797 - RNA, 20 nt, Homo sapiens
caugauguaaaaaauacaaa

SEQ ID NO: 463798 - RNA, 18 nt, Homo sapiens
cauggccccuugcauuuc

SEQ ID NO: 463799 - RNA, 18 nt, Homo sapiens
cauggcgaaaggagugac

SEQ ID NO: 463800 - RNA, 19 nt, Homo sapiens
cauggcugccucugaagag

SEQ ID NO: 463801 - RNA, 12 nt, Homo sapiens
caugugccugua

SEQ ID NO: 463802 - RNA, 14 nt, Homo sapiens
cauuaaacuacuuu

SEQ ID NO: 463803 - RNA, 17 nt, Homo sapiens
cauuaaauaugugaaau

SEQ ID NO: 463804 - RNA, 19 nt, Homo sapiens
cauucagcagcaggugcuu

SEQ ID NO: 463805 - RNA, 17 nt, Homo sapiens
cauucaguucuuaucaa

SEQ ID NO: 463806 - RNA, 18 nt, Homo sapiens
cauucaguucuuaucaaa

SEQ ID NO: 463807 - RNA, 15 nt, Homo sapiens
cauugcuuaugacau

SEQ ID NO: 463808 - RNA, 12 nt, Homo sapiens
cauuguaacaug

SEQ ID NO: 463809 - RNA, 18 nt, Homo sapiens
cauuguaacaugacacuu

SEQ ID NO: 463810 - RNA, 23 nt, Homo sapiens
cauuguguguuagcagcagugag

SEQ ID NO: 463811 - RNA, 13 nt, Homo sapiens
cauuuaaucugcu

SEQ ID NO: 463812 - RNA, 15 nt, Homo sapiens
cauuuuggucucuau

SEQ ID NO: 463813 - RNA, 23 nt, Homo sapiens
cauuuugucucucucacauuaag

SEQ ID NO: 463814 - RNA, 14 nt, Homo sapiens
ccaaaaacaguaaa

SEQ ID NO: 463815 - RNA, 18 nt, Homo sapiens
ccaaacggaacucuucau

SEQ ID NO: 463816 - RNA, 12 nt, Homo sapiens
ccaaaguguccu

SEQ ID NO: 463817 - RNA, 11 nt, Homo sapiens
ccaaauucuga

SEQ ID NO: 463818 - RNA, 16 nt, Homo sapiens
ccaaugcuuacgucaa

SEQ ID NO: 463819 - RNA, 22 nt, Homo sapiens
ccaauuaaguccuacuuuacau

SEQ ID NO: 463820 - RNA, 16 nt, Homo sapiens
ccaauuagcauuccau

SEQ ID NO: 463821 - RNA, 18 nt, Homo sapiens
ccaauuagcauuccauca

SEQ ID NO: 463822 - RNA, 13 nt, Homo sapiens
ccaccaaauucug

SEQ ID NO: 463823 - RNA, 18 nt, Homo sapiens
ccacuuucaacguguagu

SEQ ID NO: 463824 - RNA, 12 nt, Homo sapiens
ccagagaccaag

SEQ ID NO: 463825 - RNA, 12 nt, Homo sapiens
ccagcucuucca

SEQ ID NO: 463826 - RNA, 16 nt, Homo sapiens
ccaggcuggagugcag

SEQ ID NO: 463827 - RNA, 16 nt, Homo sapiens
ccaggggcggugcagg

SEQ ID NO: 463828 - RNA, 21 nt, Homo sapiens
ccaguggaagcagguguauug

SEQ ID NO: 463829 - RNA, 15 nt, Homo sapiens
ccaguucuacagagu

SEQ ID NO: 463830 - RNA, 23 nt, Homo sapiens
ccaguuucugauuuuuauucuca

SEQ ID NO: 463831 - RNA, 13 nt, Homo sapiens
ccaucaagccuuu

SEQ ID NO: 463832 - RNA, 15 nt, Homo sapiens
ccaucauuguaacau

SEQ ID NO: 463833 - RNA, 21 nt, Homo sapiens
ccauuuagcugcccacgcugc

SEQ ID NO: 463834 - RNA, 13 nt, Homo sapiens
ccauuugauuuga

SEQ ID NO: 463835 - RNA, 13 nt, Homo sapiens
cccaaagugcagg

SEQ ID NO: 463836 - RNA, 14 nt, Homo sapiens
cccaauaauucugu

SEQ ID NO: 463837 - RNA, 17 nt, Homo sapiens
cccagcacgugggucua

SEQ ID NO: 463838 - RNA, 20 nt, Homo sapiens
cccagcugcucuguacugca

SEQ ID NO: 463839 - RNA, 16 nt, Homo sapiens
cccauguguggcagca

SEQ ID NO: 463840 - RNA, 19 nt, Homo sapiens
ucgccuuuugacagcugug

SEQ ID NO: 463841 - RNA, 18 nt, Homo sapiens
ucgcuggugaagacccag

SEQ ID NO: 463842 - RNA, 14 nt, Homo sapiens
ucggccucccaaag

SEQ ID NO: 463843 - RNA, 15 nt, Homo sapiens
ucggcuuugcagugc

SEQ ID NO: 463844 - RNA, 23 nt, Homo sapiens
ucuaaccauagcugaccuuugua

SEQ ID NO: 463845 - RNA, 13 nt, Homo sapiens
ucuacaaccagag

SEQ ID NO: 463846 - RNA, 12 nt, Homo sapiens
ucuacaaccuaa

SEQ ID NO: 463847 - RNA, 18 nt, Homo sapiens
ucuaucauguugaaguca

SEQ ID NO: 463848 - RNA, 15 nt, Homo sapiens
ucuaugcuauauuca

SEQ ID NO: 463849 - RNA, 16 nt, Homo sapiens
ucucaaacuccugacc

SEQ ID NO: 463850 - RNA, 21 nt, Homo sapiens
ucucaagcacugacacucauu

SEQ ID NO: 463851 - RNA, 21 nt, Homo sapiens
ucucaccugggccuaucuucu

SEQ ID NO: 463852 - RNA, 17 nt, Homo sapiens
ucucaggugcuccugaa

SEQ ID NO: 463853 - RNA, 15 nt, Homo sapiens
ucucauugccaguga

SEQ ID NO: 463854 - RNA, 19 nt, Homo sapiens
ucucccaaaguguccuaag

SEQ ID NO: 463855 - RNA, 15 nt, Homo sapiens
ucucccccuuuccaa

SEQ ID NO: 463856 - RNA, 19 nt, Homo sapiens
ucucgaacuccugaccuca

SEQ ID NO: 463857 - RNA, 12 nt, Homo sapiens
ucucuguuacac

SEQ ID NO: 463858 - RNA, 20 nt, Homo sapiens
ucugaaagggcacaguguca

SEQ ID NO: 463859 - RNA, 16 nt, Homo sapiens
ucugaggacgugguga

SEQ ID NO: 463860 - RNA, 19 nt, Homo sapiens
ucugaggcagaugagcuua

SEQ ID NO: 463861 - RNA, 18 nt, Homo sapiens
ucugauuuuuauucucaa

SEQ ID NO: 463862 - RNA, 22 nt, Homo sapiens
ucugccagggcaccuacugaga

SEQ ID NO: 463863 - RNA, 19 nt, Homo sapiens
ucugcucuuuggaaauggc

SEQ ID NO: 463864 - RNA, 12 nt, Homo sapiens
ucuggccucaga

SEQ ID NO: 463865 - RNA, 14 nt, Homo sapiens
ucugucccaaagaa

SEQ ID NO: 463866 - RNA, 23 nt, Homo sapiens
ucuuauuuuuuucgccuucacug

SEQ ID NO: 463867 - RNA, 23 nt, Homo sapiens
ucuucaggcaccugaagugagaa

SEQ ID NO: 463868 - RNA, 15 nt, Homo sapiens
ucuucuacaaccaga

SEQ ID NO: 463869 - RNA, 22 nt, Homo sapiens
ucuuggcuaacucagauucaug

SEQ ID NO: 463870 - RNA, 17 nt, Homo sapiens
ucuuuaccaguuucuga

SEQ ID NO: 463871 - RNA, 16 nt, Homo sapiens
ucuuugacuauaacaa

SEQ ID NO: 463872 - RNA, 23 nt, Homo sapiens
ugaaaaaauacccucugacugua

SEQ ID NO: 463873 - RNA, 18 nt, Homo sapiens
ugaaaauuaugucaguuu

SEQ ID NO: 463874 - RNA, 21 nt, Homo sapiens
ugaaauggacaaacagugcac

SEQ ID NO: 463875 - RNA, 18 nt, Homo sapiens
ugaacaggaugcugaugu

SEQ ID NO: 463876 - RNA, 19 nt, Homo sapiens
ugaacaucgagaugccuga

SEQ ID NO: 463877 - RNA, 19 nt, Homo sapiens
ugaaccugagguugcuuua

SEQ ID NO: 463878 - RNA, 21 nt, Homo sapiens
ugaagacuauugguuugagaa

SEQ ID NO: 463879 - RNA, 19 nt, Homo sapiens
ugaagaggaguugcuugau

SEQ ID NO: 463880 - RNA, 15 nt, Homo sapiens
ugaauauauggucug

SEQ ID NO: 463881 - RNA, 22 nt, Homo sapiens
ugaauauuaaaaaaagacauaa

SEQ ID NO: 463882 - RNA, 18 nt, Homo sapiens
ugaaugaaaugccaauaa

SEQ ID NO: 463883 - RNA, 20 nt, Homo sapiens
ugaauuucuccgaaugucaa

SEQ ID NO: 463884 - RNA, 19 nt, Homo sapiens
ugaauuuguagacauacuu

SEQ ID NO: 463885 - RNA, 12 nt, Homo sapiens
ugaccuugagaa

SEQ ID NO: 463886 - RNA, 15 nt, Homo sapiens
ugacugccaaaaagg

SEQ ID NO: 463887 - RNA, 13 nt, Homo sapiens
ugagaaaaucagu

SEQ ID NO: 463888 - RNA, 17 nt, Homo sapiens
ugagaaggcucuugcca

SEQ ID NO: 463889 - RNA, 12 nt, Homo sapiens
ugagagcccuuu

SEQ ID NO: 463890 - RNA, 19 nt, Homo sapiens
ugagguccacacugacaca

SEQ ID NO: 463891 - RNA, 23 nt, Homo sapiens
ugaguuguugcuuauacuguugu

SEQ ID NO: 463892 - RNA, 23 nt, Homo sapiens
ugauagguuguuaaauacauuua

SEQ ID NO: 463893 - RNA, 22 nt, Homo sapiens
ugaucacaugugcccucugcca

SEQ ID NO: 463894 - RNA, 18 nt, Homo sapiens
ugaugaaggcaucugaug

SEQ ID NO: 463895 - RNA, 18 nt, Homo sapiens
ugauguaaaaaauacaaa

SEQ ID NO: 463896 - RNA, 14 nt, Homo sapiens
ugcaaaugacuguc

SEQ ID NO: 463897 - RNA, 15 nt, Homo sapiens
ugcaaccuccaccuc

SEQ ID NO: 463898 - RNA, 21 nt, Homo sapiens
ugcacagccugcugucugcag

SEQ ID NO: 463899 - RNA, 15 nt, Homo sapiens
ugcacauauuggcaa

SEQ ID NO: 463900 - RNA, 17 nt, Homo sapiens
ugcaccaggagacagac

SEQ ID NO: 463901 - RNA, 16 nt, Homo sapiens
ugcagaguacaugaua

SEQ ID NO: 463902 - RNA, 14 nt, Homo sapiens
ugcagcgagugugc

SEQ ID NO: 463903 - RNA, 16 nt, Homo sapiens
ugcagggauuacaggc

SEQ ID NO: 463904 - RNA, 18 nt, Homo sapiens
ugcagggcugggaagaag

SEQ ID NO: 463905 - RNA, 12 nt, Homo sapiens
ugcaggguccca

SEQ ID NO: 463906 - RNA, 23 nt, Homo sapiens
ugcaggguuucucgccacugggg

SEQ ID NO: 463907 - RNA, 14 nt, Homo sapiens
ugcagugcacuuug

SEQ ID NO: 463908 - RNA, 22 nt, Homo sapiens
ugcauuuccuucuuaacucucu

SEQ ID NO: 463909 - RNA, 24 nt, Homo sapiens
ugccaaauaucuugauccuaugag

SEQ ID NO: 463910 - RNA, 20 nt, Homo sapiens
ugccagcccaacugugagac

SEQ ID NO: 463911 - RNA, 11 nt, Homo sapiens
ugccagugcag

SEQ ID NO: 463912 - RNA, 19 nt, Homo sapiens
ugcccccuccacagcugug

SEQ ID NO: 463913 - RNA, 16 nt, Homo sapiens
ugccgucugugacauu

SEQ ID NO: 463914 - RNA, 12 nt, Homo sapiens
ugccucagggau

SEQ ID NO: 463915 - RNA, 21 nt, Homo sapiens
ugccuuugcccacguguccug

SEQ ID NO: 463916 - RNA, 23 nt, Homo sapiens
ugcggagcuuuccaccucgccug

SEQ ID NO: 463917 - RNA, 15 nt, Homo sapiens
ugcgucugcacugau

SEQ ID NO: 463918 - RNA, 20 nt, Homo sapiens
ugcuccuuaugaugcccuaa

SEQ ID NO: 463919 - RNA, 11 nt, Homo sapiens
ugcucucagga

SEQ ID NO: 463920 - RNA, 18 nt, Homo sapiens
ugcucugcuggucuucaa

SEQ ID NO: 463921 - RNA, 18 nt, Homo sapiens
ugcuguuccuuaauuuga

SEQ ID NO: 463922 - RNA, 22 nt, Homo sapiens
uggaaacagggccaggugcuuu

SEQ ID NO: 463923 - RNA, 15 nt, Homo sapiens
uggaaguaagucugc

SEQ ID NO: 463924 - RNA, 23 nt, Homo sapiens
uggaauguuuuaaucuccucuga

SEQ ID NO: 463925 - RNA, 17 nt, Homo sapiens
uggacaaacagugcacu

SEQ ID NO: 463926 - RNA, 19 nt, Homo sapiens
uggaccaauuagcauucca

SEQ ID NO: 463927 - RNA, 15 nt, Homo sapiens
uggagaaaaggcagu

SEQ ID NO: 463928 - RNA, 17 nt, Homo sapiens
uggagaaaguauuuuca

SEQ ID NO: 463929 - RNA, 20 nt, Homo sapiens
uggagacuggaacacaacca

SEQ ID NO: 463930 - RNA, 22 nt, Homo sapiens
uggauacuagaucuuacaucug

SEQ ID NO: 463931 - RNA, 19 nt, Homo sapiens
uggauuccucgaaacugcc

SEQ ID NO: 463932 - RNA, 18 nt, Homo sapiens
uggcaauucuucuucuca

SEQ ID NO: 463933 - RNA, 20 nt, Homo sapiens
uggcccaggcuggagugcag

SEQ ID NO: 463934 - RNA, 23 nt, Homo sapiens
uggcugugaggcccucagggcag

SEQ ID NO: 463935 - RNA, 16 nt, Homo sapiens
uggcuuuucuuuacca

SEQ ID NO: 463936 - RNA, 13 nt, Homo sapiens
ugggauuacaggc

SEQ ID NO: 463937 - RNA, 18 nt, Homo sapiens
ugggccuuuccucagugu

SEQ ID NO: 463938 - RNA, 15 nt, Homo sapiens
uggggaggggugcuc

SEQ ID NO: 463939 - RNA, 14 nt, Homo sapiens
uggucagauuugaa

SEQ ID NO: 463940 - RNA, 16 nt, Homo sapiens
uguuccuuaauuugau

SEQ ID NO: 463941 - RNA, 20 nt, Homo sapiens
uguucuggccucagaccaac

SEQ ID NO: 463942 - RNA, 20 nt, Homo sapiens
uguuuuucucauuguagaca

SEQ ID NO: 463943 - RNA, 16 nt, Homo sapiens
uguuuuuuucuagccu

SEQ ID NO: 463944 - RNA, 17 nt, Homo sapiens
uuaaaacauaagaacgu

SEQ ID NO: 463945 - RNA, 17 nt, Homo sapiens
uuaaaagguccaguucu

SEQ ID NO: 463946 - RNA, 16 nt, Homo sapiens
uuaaaccaaacggaac

SEQ ID NO: 463947 - RNA, 14 nt, Homo sapiens
uuaaaggcuuugca

SEQ ID NO: 463948 - RNA, 17 nt, Homo sapiens
uuaaauaaaucauaaaa

SEQ ID NO: 463949 - RNA, 23 nt, Homo sapiens
uuaaauaaaucauaaaacuugau

SEQ ID NO: 463950 - RNA, 17 nt, Homo sapiens
uuaaauucuucuugaaa

SEQ ID NO: 463951 - RNA, 18 nt, Homo sapiens
uuaaccagucugaaguuu

SEQ ID NO: 463952 - RNA, 16 nt, Homo sapiens
uuaacucucuguuaca

SEQ ID NO: 463953 - RNA, 21 nt, Homo sapiens
uuaacuuccaauuuacauacu

SEQ ID NO: 463954 - RNA, 14 nt, Homo sapiens
uuaaguguuuugua

SEQ ID NO: 463955 - RNA, 19 nt, Homo sapiens
uuaaugcaaaugacuguca

SEQ ID NO: 463956 - RNA, 15 nt, Homo sapiens
uuaauuccacuuuaa

SEQ ID NO: 463957 - RNA, 13 nt, Homo sapiens
uuaauuuaauuca

SEQ ID NO: 463958 - RNA, 17 nt, Homo sapiens
uuacauuaagccuacaa

SEQ ID NO: 463959 - RNA, 20 nt, Homo sapiens
uuaccuggcagugaugucaa

SEQ ID NO: 463960 - RNA, 13 nt, Homo sapiens
uuacgucaaaaca

SEQ ID NO: 463961 - RNA, 16 nt, Homo sapiens
uuacuaauuaaucaca

SEQ ID NO: 463962 - RNA, 22 nt, Homo sapiens
uuagagcacaggaagugacaac

SEQ ID NO: 463963 - RNA, 16 nt, Homo sapiens
uuagcagcauggcugc

SEQ ID NO: 463964 - RNA, 19 nt, Homo sapiens
uuaggaauacugggugcug

SEQ ID NO: 463965 - RNA, 17 nt, Homo sapiens
uuaucuuguacagccuu

SEQ ID NO: 463966 - RNA, 23 nt, Homo sapiens
uuauggaccaauuagcauuccau

SEQ ID NO: 463967 - RNA, 18 nt, Homo sapiens
uuauucuagggucuuacu

SEQ ID NO: 463968 - RNA, 12 nt, Homo sapiens
uucaaaauucaa

SEQ ID NO: 463969 - RNA, 15 nt, Homo sapiens
uucacucugcucuca

SEQ ID NO: 463970 - RNA, 21 nt, Homo sapiens
uucagaaugucagaaguugau

SEQ ID NO: 463971 - RNA, 17 nt, Homo sapiens
uucagaguccuugcaaa

SEQ ID NO: 463972 - RNA, 18 nt, Homo sapiens
uucagaguccuugcaaaa

SEQ ID NO: 463973 - RNA, 23 nt, Homo sapiens
uucagcucauuuugucucucuca

SEQ ID NO: 463974 - RNA, 14 nt, Homo sapiens
uucagucaucucca

SEQ ID NO: 463975 - RNA, 21 nt, Homo sapiens
uucauuucuuuuucauuugac

SEQ ID NO: 463976 - RNA, 17 nt, Homo sapiens
uucauuuuucuaauaau

SEQ ID NO: 463977 - RNA, 14 nt, Homo sapiens
uuccaauuuacaua

SEQ ID NO: 463978 - RNA, 20 nt, Homo sapiens
uuccaauuuacauacucugc

SEQ ID NO: 463979 - RNA, 11 nt, Homo sapiens
uuccagugcag

SEQ ID NO: 463980 - RNA, 18 nt, Homo sapiens
uuccauccuagugagaag

SEQ ID NO: 463981 - RNA, 18 nt, Homo sapiens
uuccugaucacuaugcau

SEQ ID NO: 463982 - RNA, 11 nt, Homo sapiens
uuccugugaaa

SEQ ID NO: 463983 - RNA, 14 nt, Homo sapiens
uucuacaaccagag

SEQ ID NO: 463984 - RNA, 16 nt, Homo sapiens
uucuacagagugagac

SEQ ID NO: 463985 - RNA, 15 nt, Homo sapiens
uucuacuuugccaca

SEQ ID NO: 463986 - RNA, 12 nt, Homo sapiens
uucucaugcauu

SEQ ID NO: 463987 - RNA, 16 nt, Homo sapiens
uucuccgugaugcugu

SEQ ID NO: 463988 - RNA, 18 nt, Homo sapiens
uucugcacaguguuccca

SEQ ID NO: 463989 - RNA, 18 nt, Homo sapiens
uucuuauccuuuguacug

SEQ ID NO: 463990 - RNA, 17 nt, Homo sapiens
uugaggacacaugucca

SEQ ID NO: 463991 - RNA, 16 nt, Homo sapiens
uugagguccacacuga

SEQ ID NO: 463992 - RNA, 18 nt, Homo sapiens
uugcaccucucucuccac

SEQ ID NO: 463993 - RNA, 20 nt, Homo sapiens
uugccagagaaacugaggua

SEQ ID NO: 463994 - RNA, 16 nt, Homo sapiens
uugccagcucuuccaa

SEQ ID NO: 463995 - RNA, 14 nt, Homo sapiens
uugccuuuggcaau

SEQ ID NO: 463996 - RNA, 20 nt, Homo sapiens
uugcuaaaccuauuucacaa

SEQ ID NO: 463997 - RNA, 20 nt, Homo sapiens
uugcuuaugacaugaucgcu

SEQ ID NO: 463998 - RNA, 13 nt, Homo sapiens
uuggacacacugg

SEQ ID NO: 463999 - RNA, 23 nt, Homo sapiens
uuggauuuuccaccaaauucuga

SEQ ID NO: 464000 - RNA, 23 nt, Homo sapiens
uuggcaauucuucuucucaagca

SEQ ID NO: 464001 - RNA, 19 nt, Homo sapiens
uugguccgguuauucacuu

SEQ ID NO: 464002 - RNA, 19 nt, Homo sapiens
uugguccuuuaaauucugg

SEQ ID NO: 464003 - RNA, 12 nt, Homo sapiens
uugucugucuca

SEQ ID NO: 464004 - RNA, 13 nt, Homo sapiens
uuguguacuguaa

SEQ ID NO: 464005 - RNA, 15 nt, Homo sapiens
uuguuccucagaaac

SEQ ID NO: 464006 - RNA, 14 nt, Homo sapiens
uuuauaaagauaua

SEQ ID NO: 464007 - RNA, 18 nt, Homo sapiens
uuuauccauuugauuuga

SEQ ID NO: 464008 - RNA, 11 nt, Homo sapiens
uuucaccucau

SEQ ID NO: 464009 - RNA, 15 nt, Homo sapiens
uuucaucuccagugu

SEQ ID NO: 464010 - RNA, 21 nt, Homo sapiens
uuuccaaugcugaaugccugu

SEQ ID NO: 464011 - RNA, 15 nt, Homo sapiens
uuuccacucauuaga

SEQ ID NO: 464012 - RNA, 13 nt, Homo sapiens
uuucuaauaauca

SEQ ID NO: 464013 - RNA, 16 nt, Homo sapiens
uuucuauuaagauaua

SEQ ID NO: 464014 - RNA, 14 nt, Homo sapiens
uuucucauuguaga

SEQ ID NO: 464015 - RNA, 22 nt, Homo sapiens
uuucucccccuuuccaaaaacu

SEQ ID NO: 464016 - RNA, 17 nt, Homo sapiens
uuugacagcugugcugu

SEQ ID NO: 464017 - RNA, 22 nt, Homo sapiens
uuugagacaaaguuuugcucuu

SEQ ID NO: 464018 - RNA, 17 nt, Homo sapiens
uuugcagggcgugagac

SEQ ID NO: 464019 - RNA, 19 nt, Homo sapiens
uuugcuaaaccuauuucac

SEQ ID NO: 464020 - RNA, 20 nt, Homo sapiens
uuugcuuuaaagagcuuuua

SEQ ID NO: 464021 - RNA, 19 nt, Homo sapiens
uuuggcuuuucuuuaccag

SEQ ID NO: 464022 - RNA, 21 nt, Homo sapiens
uuugucauauaagauucauau

SEQ ID NO: 464023 - RNA, 24 nt, Homo sapiens
uuuuaaaaucaauagauucaucac

SEQ ID NO: 464024 - RNA, 16 nt, Homo sapiens
uuuuaaaggaguagaa

SEQ ID NO: 464025 - RNA, 12 nt, Homo sapiens
uuuuaauuccac

SEQ ID NO: 464026 - RNA, 21 nt, Homo sapiens
uuuucaagaaagcauugccag

SEQ ID NO: 464027 - RNA, 13 nt, Homo sapiens
uuuugaacauacu

SEQ ID NO: 464028 - RNA, 20 nt, Homo sapiens
uuuuuaaguauuucagaugc

SEQ ID NO: 464029 - RNA, 16 nt, Homo sapiens
uuuuugagaccaaauc

SEQ ID NO: 464030 - RNA, 15 nt, Homo sapiens
gaugggggaugcuuc

SEQ ID NO: 464031 - RNA, 20 nt, Homo sapiens
gauuaucuuguacagccuuu

SEQ ID NO: 464032 - RNA, 15 nt, Homo sapiens
gauuauuuaucacau

SEQ ID NO: 464033 - RNA, 22 nt, Homo sapiens
gauucauuuuaccuuugacaag

SEQ ID NO: 464034 - RNA, 16 nt, Homo sapiens
gauucuccugccucag

SEQ ID NO: 464035 - RNA, 17 nt, Homo sapiens
gauucucuccugauuau

SEQ ID NO: 464036 - RNA, 14 nt, Homo sapiens
gauuuacucauuau

SEQ ID NO: 464037 - RNA, 16 nt, Homo sapiens
gauuuaugcuccuuau

SEQ ID NO: 464038 - RNA, 13 nt, Homo sapiens
gauuucacugaca

SEQ ID NO: 464039 - RNA, 23 nt, Homo sapiens
gauuugaacccagcugcucugua

SEQ ID NO: 464040 - RNA, 15 nt, Homo sapiens
gauuuugaacauacu

SEQ ID NO: 464041 - RNA, 14 nt, Homo sapiens
gcaaaaagaccaag

SEQ ID NO: 464042 - RNA, 15 nt, Homo sapiens
gcaaaauaaagccau

SEQ ID NO: 464043 - RNA, 21 nt, Homo sapiens
gcaaaauugucuaaaauguca

SEQ ID NO: 464044 - RNA, 22 nt, Homo sapiens
gcacacuuauuuuuuucccaag

SEQ ID NO: 464045 - RNA, 22 nt, Homo sapiens
gcacagugucaguugagcugac

SEQ ID NO: 464046 - RNA, 15 nt, Homo sapiens
gcaccaagacugaga

SEQ ID NO: 464047 - RNA, 13 nt, Homo sapiens
gcacucucaggug

SEQ ID NO: 464048 - RNA, 18 nt, Homo sapiens
gcagacuggauugggaua

SEQ ID NO: 464049 - RNA, 15 nt, Homo sapiens
gcagcaggaugcuca

SEQ ID NO: 464050 - RNA, 11 nt, Homo sapiens
gcaguggugcu

SEQ ID NO: 464051 - RNA, 19 nt, Homo sapiens
gcagugucuuuggaccuga

SEQ ID NO: 464052 - RNA, 17 nt, Homo sapiens
gcaguguuuucaccuca

SEQ ID NO: 464053 - RNA, 14 nt, Homo sapiens
gcaugacauuggca

SEQ ID NO: 464054 - RNA, 13 nt, Homo sapiens
gcauuggugcuca

SEQ ID NO: 464055 - RNA, 16 nt, Homo sapiens
gccaggcuggucuuga

SEQ ID NO: 464056 - RNA, 14 nt, Homo sapiens
gccagggcaccuac

SEQ ID NO: 464057 - RNA, 15 nt, Homo sapiens
gcccacuucacugcu

SEQ ID NO: 464058 - RNA, 17 nt, Homo sapiens
gccccccccagagccag

SEQ ID NO: 464059 - RNA, 18 nt, Homo sapiens
gccccgcugucacuugcc

SEQ ID NO: 464060 - RNA, 15 nt, Homo sapiens
gccgagagcauugga

SEQ ID NO: 464061 - RNA, 16 nt, Homo sapiens
gccgucaaaagguaaa

SEQ ID NO: 464062 - RNA, 22 nt, Homo sapiens
gccuccaacagcaucaucugca

SEQ ID NO: 464063 - RNA, 17 nt, Homo sapiens
gccucccagguucaaga

SEQ ID NO: 464064 - RNA, 16 nt, Homo sapiens
gccucccugagcacug

SEQ ID NO: 464065 - RNA, 22 nt, Homo sapiens
gccuccucgggagggagcgccu

SEQ ID NO: 464066 - RNA, 18 nt, Homo sapiens
gccuccugcucugugaag

SEQ ID NO: 464067 - RNA, 14 nt, Homo sapiens
gccugaauugagaa

SEQ ID NO: 464068 - RNA, 21 nt, Homo sapiens
gccugaugugaguguguggca

SEQ ID NO: 464069 - RNA, 22 nt, Homo sapiens
gccuugguaaaaacugcagugu

SEQ ID NO: 464070 - RNA, 15 nt, Homo sapiens
gccuuuccucagugu

SEQ ID NO: 464071 - RNA, 14 nt, Homo sapiens
gcggagcuuuccac

SEQ ID NO: 464072 - RNA, 20 nt, Homo sapiens
gcgugagaccgcagucugcu

SEQ ID NO: 464073 - RNA, 22 nt, Homo sapiens
gcuaaauguaccugagacauau

SEQ ID NO: 464074 - RNA, 16 nt, Homo sapiens
gcucacugcaaccucc

SEQ ID NO: 464075 - RNA, 17 nt, Homo sapiens
gcucugcuggucuucaa

SEQ ID NO: 464076 - RNA, 19 nt, Homo sapiens
gcucuguacugcacuuaga

SEQ ID NO: 464077 - RNA, 20 nt, Homo sapiens
gcugaauaaccaggggcaca

SEQ ID NO: 464078 - RNA, 18 nt, Homo sapiens
gcugagcacagggcuguu

SEQ ID NO: 464079 - RNA, 22 nt, Homo sapiens
gcugcaggccccggggacccca

SEQ ID NO: 464080 - RNA, 13 nt, Homo sapiens
gcugcagugugag

SEQ ID NO: 464081 - RNA, 16 nt, Homo sapiens
gcugccaugcuuccaa

SEQ ID NO: 464082 - RNA, 19 nt, Homo sapiens
gcugcugagaaucuagccu

SEQ ID NO: 464083 - RNA, 20 nt, Homo sapiens
gcugcugagaaucuagccuc

SEQ ID NO: 464084 - RNA, 22 nt, Homo sapiens
gcuggagugcaguggugcaauc

SEQ ID NO: 464085 - RNA, 20 nt, Homo sapiens
gcugggauuacaggugcgug

SEQ ID NO: 464086 - RNA, 14 nt, Homo sapiens
gcugguacuaagag

SEQ ID NO: 464087 - RNA, 20 nt, Homo sapiens
gcuguccaggaacuuuccag

SEQ ID NO: 464088 - RNA, 18 nt, Homo sapiens
gcuuagauuguagcuguu

SEQ ID NO: 464089 - RNA, 21 nt, Homo sapiens
gcuuauacacuuacacuuuau

SEQ ID NO: 464090 - RNA, 15 nt, Homo sapiens
gcuucucuugccuaa

SEQ ID NO: 464091 - RNA, 23 nt, Homo sapiens
gcuucuggccuuguaucuugcau

SEQ ID NO: 464092 - RNA, 15 nt, Homo sapiens
gcuuuggaguuuuaa

SEQ ID NO: 464093 - RNA, 12 nt, Homo sapiens
gcuuuguucuga

SEQ ID NO: 464094 - RNA, 22 nt, Homo sapiens
ggaaacggcucuuguuugaaag

SEQ ID NO: 464095 - RNA, 21 nt, Homo sapiens
ggaaaggagggaggaugcugu

SEQ ID NO: 464096 - RNA, 16 nt, Homo sapiens
ggaaaguucuugacag

SEQ ID NO: 464097 - RNA, 16 nt, Homo sapiens
ggaacuuuccagcagu

SEQ ID NO: 464098 - RNA, 14 nt, Homo sapiens
ggaagaugugugau

SEQ ID NO: 464099 - RNA, 16 nt, Homo sapiens
ggaaguuucacuggcu

SEQ ID NO: 464100 - RNA, 16 nt, Homo sapiens
ggaauaauuauuacau

SEQ ID NO: 464101 - RNA, 23 nt, Homo sapiens
ggacaaaggugauuuuccugugu

SEQ ID NO: 464102 - RNA, 14 nt, Homo sapiens
cugucugucugucu

SEQ ID NO: 464103 - RNA, 23 nt, Homo sapiens
cugugauugccauuucuucccaa

SEQ ID NO: 464104 - RNA, 17 nt, Homo sapiens
cugugccuaucaccucu

SEQ ID NO: 464105 - RNA, 13 nt, Homo sapiens
cugugcugugagu

SEQ ID NO: 464106 - RNA, 19 nt, Homo sapiens
cugugugguaacucagugu

SEQ ID NO: 464107 - RNA, 19 nt, Homo sapiens
cuguucauuguaagcacuu

SEQ ID NO: 464108 - RNA, 20 nt, Homo sapiens
cuguuugagguccacacuga

SEQ ID NO: 464109 - RNA, 17 nt, Homo sapiens
cuguuuuaugugcacac

SEQ ID NO: 464110 - RNA, 18 nt, Homo sapiens
cuuacacuuuaugcacaa

SEQ ID NO: 464111 - RNA, 20 nt, Homo sapiens
cuuacauuauuacuccuugc

SEQ ID NO: 464112 - RNA, 14 nt, Homo sapiens
cuuauaauuacaau

SEQ ID NO: 464113 - RNA, 14 nt, Homo sapiens
cuuauacauuugau

SEQ ID NO: 464114 - RNA, 20 nt, Homo sapiens
cuucaaaaacgcacugcaag

SEQ ID NO: 464115 - RNA, 19 nt, Homo sapiens
cuucaaucucuugcacuca

SEQ ID NO: 464116 - RNA, 21 nt, Homo sapiens
cuucaucuguucagucaucuc

SEQ ID NO: 464117 - RNA, 21 nt, Homo sapiens
cuuccaauuuacauacucugc

SEQ ID NO: 464118 - RNA, 12 nt, Homo sapiens
cuucgugccugu

SEQ ID NO: 464119 - RNA, 17 nt, Homo sapiens
cuucucaagcacugaca

SEQ ID NO: 464120 - RNA, 19 nt, Homo sapiens
cuucucaagcacugacacu

SEQ ID NO: 464121 - RNA, 17 nt, Homo sapiens
cuucucaccugggccua

SEQ ID NO: 464122 - RNA, 17 nt, Homo sapiens
cuucucccaaagugucc

SEQ ID NO: 464123 - RNA, 19 nt, Homo sapiens
cuucucucccacacaagca

SEQ ID NO: 464124 - RNA, 20 nt, Homo sapiens
cuucuggccuuguaucuugc

SEQ ID NO: 464125 - RNA, 18 nt, Homo sapiens
cuucuuaacucucuguua

SEQ ID NO: 464126 - RNA, 20 nt, Homo sapiens
cuucuuaacucucuguuaca

SEQ ID NO: 464127 - RNA, 14 nt, Homo sapiens
cuucuuccacagca

SEQ ID NO: 464128 - RNA, 14 nt, Homo sapiens
cuugaaaacugcug

SEQ ID NO: 464129 - RNA, 20 nt, Homo sapiens
cuugaagacuauugguuuga

SEQ ID NO: 464130 - RNA, 12 nt, Homo sapiens
cuugcacuauug

SEQ ID NO: 464131 - RNA, 22 nt, Homo sapiens
cuugcaugacaaaggccuguga

SEQ ID NO: 464132 - RNA, 17 nt, Homo sapiens
cuugccuguaaucccag

SEQ ID NO: 464133 - RNA, 19 nt, Homo sapiens
cuuguuuucuacuuugcca

SEQ ID NO: 464134 - RNA, 15 nt, Homo sapiens
cuuuacauaugcuuu

SEQ ID NO: 464135 - RNA, 21 nt, Homo sapiens
cuuugauuuuuugcugcagac

SEQ ID NO: 464136 - RNA, 17 nt, Homo sapiens
cuuugcagugcacuuug

SEQ ID NO: 464137 - RNA, 16 nt, Homo sapiens
cuuugcccacgugucc

SEQ ID NO: 464138 - RNA, 11 nt, Homo sapiens
cuuugggucua

SEQ ID NO: 464139 - RNA, 16 nt, Homo sapiens
cuuuguugcucagcaa

SEQ ID NO: 464140 - RNA, 13 nt, Homo sapiens
cuuuuaacuacaa

SEQ ID NO: 464141 - RNA, 20 nt, Homo sapiens
cuuuuaagaugugucuucaa

SEQ ID NO: 464142 - RNA, 19 nt, Homo sapiens
cuuuugcuauggagcaaau

SEQ ID NO: 464143 - RNA, 15 nt, Homo sapiens
cuuuuugcuggagaa

SEQ ID NO: 464144 - RNA, 14 nt, Homo sapiens
gaaaaggcaaauuu

SEQ ID NO: 464145 - RNA, 21 nt, Homo sapiens
gaaaagggcaaaaagaccaag

SEQ ID NO: 464146 - RNA, 18 nt, Homo sapiens
gaaaauacaaaagguaaa

SEQ ID NO: 464147 - RNA, 15 nt, Homo sapiens
gaaaaucaacccaau

SEQ ID NO: 464148 - RNA, 17 nt, Homo sapiens
gaaaaucuauccuuuaa

SEQ ID NO: 464149 - RNA, 22 nt, Homo sapiens
gaaacaguacagcuauuucuca

SEQ ID NO: 464150 - RNA, 20 nt, Homo sapiens
gaaacgcaagcagacuggau

SEQ ID NO: 464151 - RNA, 14 nt, Homo sapiens
gaaacgcuucuuuu

SEQ ID NO: 464152 - RNA, 21 nt, Homo sapiens
gaaacugccauugugaucauu

SEQ ID NO: 464153 - RNA, 19 nt, Homo sapiens
gaaagggcacagugucagu

SEQ ID NO: 464154 - RNA, 17 nt, Homo sapiens
gaaauggcuguaucauu

SEQ ID NO: 464155 - RNA, 21 nt, Homo sapiens
gaaauuuuuaaaggaguagaa

SEQ ID NO: 464156 - RNA, 20 nt, Homo sapiens
gaacauggagccugcugaga

SEQ ID NO: 464157 - RNA, 23 nt, Homo sapiens
gaaccauuuuagucccauuugac

SEQ ID NO: 464158 - RNA, 20 nt, Homo sapiens
gaacuccccuugaaaacugc

SEQ ID NO: 464159 - RNA, 14 nt, Homo sapiens
gaacuccugaccuc

SEQ ID NO: 464160 - RNA, 19 nt, Homo sapiens
gaacuccugaccucaggug

SEQ ID NO: 464161 - RNA, 18 nt, Homo sapiens
gaacucgcuagguucuua

SEQ ID NO: 464162 - RNA, 22 nt, Homo sapiens
gaacucuucaucuuaaacuaca

SEQ ID NO: 464163 - RNA, 20 nt, Homo sapiens
gaaggcaucugaugccuuca

SEQ ID NO: 464164 - RNA, 17 nt, Homo sapiens
gaagggccacgugcuuu

SEQ ID NO: 464165 - RNA, 14 nt, Homo sapiens
gaaguagcugggau

SEQ ID NO: 464166 - RNA, 16 nt, Homo sapiens
gaagucuggagcaccc

SEQ ID NO: 464167 - RNA, 16 nt, Homo sapiens
gaagugagaacccagc

SEQ ID NO: 464168 - RNA, 21 nt, Homo sapiens
gaagugagaacccagcugucc

SEQ ID NO: 464169 - RNA, 16 nt, Homo sapiens
gaaguuauucuugaca

SEQ ID NO: 464170 - RNA, 23 nt, Homo sapiens
gaauauauggucugugugucuga

SEQ ID NO: 464171 - RNA, 22 nt, Homo sapiens
gaaucggcuuugcagugcacuu

SEQ ID NO: 464172 - RNA, 14 nt, Homo sapiens
gaaucggugcuguc

SEQ ID NO: 464173 - RNA, 18 nt, Homo sapiens
gaauugagaauuuugauu

SEQ ID NO: 464174 - RNA, 20 nt, Homo sapiens
gacaauaaaacauuccugug

SEQ ID NO: 464175 - RNA, 22 nt, Homo sapiens
gacagaucccauccaucagcuc

SEQ ID NO: 464176 - RNA, 16 nt, Homo sapiens
gacauauaccuucuca

SEQ ID NO: 464177 - RNA, 21 nt, Homo sapiens
gaccacgcccccagcugugac

SEQ ID NO: 464178 - RNA, 13 nt, Homo sapiens
gacuacagacauu

SEQ ID NO: 464179 - RNA, 19 nt, Homo sapiens
gacucaaaccaacucagug

SEQ ID NO: 464180 - RNA, 22 nt, Homo sapiens
gacucaauaaauacauguuaaa

SEQ ID NO: 464181 - RNA, 23 nt, Homo sapiens
gacugaucugagagccauugggc

SEQ ID NO: 464182 - RNA, 13 nt, Homo sapiens
gacugccaaaaag

SEQ ID NO: 464183 - RNA, 13 nt, Homo sapiens
gacugccugaaca

SEQ ID NO: 464184 - RNA, 11 nt, Homo sapiens
gagacuugcca

SEQ ID NO: 464185 - RNA, 14 nt, Homo sapiens
gagagcaagacaga

SEQ ID NO: 464186 - RNA, 13 nt, Homo sapiens
gagccaccaugcc

SEQ ID NO: 464187 - RNA, 20 nt, Homo sapiens
gagccaccaugccgggccau

SEQ ID NO: 464188 - RNA, 20 nt, Homo sapiens
gagccuucugugcugugagu

SEQ ID NO: 464189 - RNA, 22 nt, Homo sapiens
gaggcauucacuagaggugaaa

SEQ ID NO: 464190 - RNA, 20 nt, Homo sapiens
gaggccugccuggcaggugu

SEQ ID NO: 464191 - RNA, 12 nt, Homo sapiens
gagggcugguug

SEQ ID NO: 464192 - RNA, 10 nt, Homo sapiens
gaggguacac

SEQ ID NO: 464193 - RNA, 16 nt, Homo sapiens
gaggugagaccaccuc

SEQ ID NO: 464194 - RNA, 22 nt, Homo sapiens
gaguauuuuuguauuaaaaaca

SEQ ID NO: 464195 - RNA, 16 nt, Homo sapiens
gagucacgagcugcug

SEQ ID NO: 464196 - RNA, 17 nt, Homo sapiens
gagucaggggagcucag

SEQ ID NO: 464197 - RNA, 21 nt, Homo sapiens
gagugcuuccgcugcggugau

SEQ ID NO: 464198 - RNA, 15 nt, Homo sapiens
gaguuguugcuuaua

SEQ ID NO: 464199 - RNA, 15 nt, Homo sapiens
gaugcacccaccuca

SEQ ID NO: 464200 - RNA, 18 nt, Homo sapiens
gauggcgggcagcuggug

SEQ ID NO: 464201 - RNA, 13 nt, Homo sapiens
gaugugucuucaa

SEQ ID NO: 464202 - RNA, 18 nt, Homo sapiens
gauguuuccaaugcugaa

SEQ ID NO: 464203 - RNA, 19 nt, Homo sapiens
gauucggagugucugaaca

SEQ ID NO: 464204 - RNA, 15 nt, Homo sapiens
gauucuccugccuca

SEQ ID NO: 464205 - RNA, 15 nt, Homo sapiens
gauugccauuucuuc

SEQ ID NO: 464206 - RNA, 21 nt, Homo sapiens
gauugccuuuggcaauucuuc

SEQ ID NO: 464207 - RNA, 14 nt, Homo sapiens
gauuucacugacac

SEQ ID NO: 464208 - RNA, 15 nt, Homo sapiens
gauuucacugacacu

SEQ ID NO: 464209 - RNA, 13 nt, Homo sapiens
gcaaaugacuguc

SEQ ID NO: 464210 - RNA, 23 nt, Homo sapiens
gcaaucuuggcucgcaaccuccg

SEQ ID NO: 464211 - RNA, 18 nt, Homo sapiens
gcaauucuucugccucag

SEQ ID NO: 464212 - RNA, 20 nt, Homo sapiens
gcaccacugcacuccagccu

SEQ ID NO: 464213 - RNA, 18 nt, Homo sapiens
gcacucaaagcuuguuaa

SEQ ID NO: 464214 - RNA, 12 nt, Homo sapiens
gcacucucaggu

SEQ ID NO: 464215 - RNA, 16 nt, Homo sapiens
gcacucugugggucug

SEQ ID NO: 464216 - RNA, 18 nt, Homo sapiens
guuacaucucagugcugu

SEQ ID NO: 464217 - RNA, 23 nt, Homo sapiens
guuagaaucccauggauguuucu

SEQ ID NO: 464218 - RNA, 22 nt, Homo sapiens
guucaagagauucuccugccuc

SEQ ID NO: 464219 - RNA, 16 nt, Homo sapiens
guucugccagaaccag

SEQ ID NO: 464220 - RNA, 12 nt, Homo sapiens
guugacugcugg

SEQ ID NO: 464221 - RNA, 19 nt, Homo sapiens
guuucaccauguuagccag

SEQ ID NO: 464222 - RNA, 21 nt, Homo sapiens
guuucaucauguuggccaggc

SEQ ID NO: 464223 - RNA, 14 nt, Homo sapiens
guuuccugauuuuu

SEQ ID NO: 464224 - RNA, 22 nt, Homo sapiens
guuugaagaugccgcauuugga

SEQ ID NO: 464225 - RNA, 18 nt, Homo sapiens
guuugccaucccaaaaau

SEQ ID NO: 464226 - RNA, 23 nt, Homo sapiens
guuuguugugcuugcugguacua

SEQ ID NO: 464227 - RNA, 15 nt, Homo sapiens
guuuuuucuccucau

SEQ ID NO: 464228 - RNA, 16 nt, Homo sapiens
uaaaaacaaagaaaua

SEQ ID NO: 464229 - RNA, 15 nt, Homo sapiens
uaaaaacugcagugu

SEQ ID NO: 464230 - RNA, 19 nt, Homo sapiens
uaaaaccuugguuaucaaa

SEQ ID NO: 464231 - RNA, 21 nt, Homo sapiens
uaaacuaaugagcaaguaaca

SEQ ID NO: 464232 - RNA, 16 nt, Homo sapiens
uaaagcaguugagauu

SEQ ID NO: 464233 - RNA, 22 nt, Homo sapiens
uaaaugugccuauuggugucua

SEQ ID NO: 464234 - RNA, 11 nt, Homo sapiens
uaacauuuuac

SEQ ID NO: 464235 - RNA, 22 nt, Homo sapiens
uaaccuagaagggucacuuuaa

SEQ ID NO: 464236 - RNA, 15 nt, Homo sapiens
uaacugaauucugaa

SEQ ID NO: 464237 - RNA, 20 nt, Homo sapiens
uaacuucauuuuucuaauaa

SEQ ID NO: 464238 - RNA, 17 nt, Homo sapiens
uaagaaaagguuaucuu

SEQ ID NO: 464239 - RNA, 13 nt, Homo sapiens
uaagacauuugaa

SEQ ID NO: 464240 - RNA, 15 nt, Homo sapiens
uaagaggcuauuuaa

SEQ ID NO: 464241 - RNA, 20 nt, Homo sapiens
uaaguaccccugauaagcaa

SEQ ID NO: 464242 - RNA, 15 nt, Homo sapiens
uaauacuggugaaaa

SEQ ID NO: 464243 - RNA, 21 nt, Homo sapiens
uaauauuccaggaugcugcug

SEQ ID NO: 464244 - RNA, 22 nt, Homo sapiens
uaaugugguuauuuuacauuaa

SEQ ID NO: 464245 - RNA, 21 nt, Homo sapiens
uaauuugauuaauuuaauuca

SEQ ID NO: 464246 - RNA, 11 nt, Homo sapiens
uacaaccagag

SEQ ID NO: 464247 - RNA, 11 nt, Homo sapiens
uacacaauggg

SEQ ID NO: 464248 - RNA, 14 nt, Homo sapiens
uacacacucaguga

SEQ ID NO: 464249 - RNA, 15 nt, Homo sapiens
uacacacuugcauga

SEQ ID NO: 464250 - RNA, 15 nt, Homo sapiens
uacacccccaccucc

SEQ ID NO: 464251 - RNA, 23 nt, Homo sapiens
uacagaaucauugcuuaugacau

SEQ ID NO: 464252 - RNA, 14 nt, Homo sapiens
uacagaccagguga

SEQ ID NO: 464253 - RNA, 19 nt, Homo sapiens
uacagauugcugcuucugc

SEQ ID NO: 464254 - RNA, 18 nt, Homo sapiens
uacaggccuccucgggag

SEQ ID NO: 464255 - RNA, 20 nt, Homo sapiens
uacauuuugaaggugaugca

SEQ ID NO: 464256 - RNA, 22 nt, Homo sapiens
uaccaagggccauucaguacau

SEQ ID NO: 464257 - RNA, 18 nt, Homo sapiens
uaccaaugcuuacgucaa

SEQ ID NO: 464258 - RNA, 17 nt, Homo sapiens
uaccccugauaagcaaa

SEQ ID NO: 464259 - RNA, 14 nt, Homo sapiens
uacgaaagugcaga

SEQ ID NO: 464260 - RNA, 15 nt, Homo sapiens
uacgauuaugcccaa

SEQ ID NO: 464261 - RNA, 15 nt, Homo sapiens
uacuaaaaauacaaa

SEQ ID NO: 464262 - RNA, 18 nt, Homo sapiens
uacuaauuaaucacaaau

SEQ ID NO: 464263 - RNA, 19 nt, Homo sapiens
uacucuuuguaugaugaaa

SEQ ID NO: 464264 - RNA, 13 nt, Homo sapiens
uacugcugugagc

SEQ ID NO: 464265 - RNA, 19 nt, Homo sapiens
uagaauaaugugggaagaa

SEQ ID NO: 464266 - RNA, 20 nt, Homo sapiens
uagaauuugggggaaaauuu

SEQ ID NO: 464267 - RNA, 21 nt, Homo sapiens
uagaucccauagugugcauca

SEQ ID NO: 464268 - RNA, 23 nt, Homo sapiens
uagaucuuacaucugcagcucuu

SEQ ID NO: 464269 - RNA, 21 nt, Homo sapiens
uagaucuuaggcaaaauacca

SEQ ID NO: 464270 - RNA, 17 nt, Homo sapiens
uagauucaucaccuuag

SEQ ID NO: 464271 - RNA, 20 nt, Homo sapiens
uagauuuaugcuccuuauga

SEQ ID NO: 464272 - RNA, 16 nt, Homo sapiens
uagccacugacuugcu

SEQ ID NO: 464273 - RNA, 17 nt, Homo sapiens
uaggacauauaccuucu

SEQ ID NO: 464274 - RNA, 13 nt, Homo sapiens
uaggacuuuuugu

SEQ ID NO: 464275 - RNA, 14 nt, Homo sapiens
uagucccauuugac

SEQ ID NO: 464276 - RNA, 13 nt, Homo sapiens
uauauaucugcuu

SEQ ID NO: 464277 - RNA, 16 nt, Homo sapiens
uauauaucugcuucua

SEQ ID NO: 464278 - RNA, 17 nt, Homo sapiens
uaucaaauacaucucca

SEQ ID NO: 464279 - RNA, 18 nt, Homo sapiens
uaucaccucuuaugcaca

SEQ ID NO: 464280 - RNA, 19 nt, Homo sapiens
uaucaccucuuaugcacac

SEQ ID NO: 464281 - RNA, 13 nt, Homo sapiens
uaugaacuugagg

SEQ ID NO: 464282 - RNA, 14 nt, Homo sapiens
uaugaacuugagga

SEQ ID NO: 464283 - RNA, 22 nt, Homo sapiens
uaugacacccacucuccuguga

SEQ ID NO: 464284 - RNA, 21 nt, Homo sapiens
uaugacaugaucgcuuucuac

SEQ ID NO: 464285 - RNA, 15 nt, Homo sapiens
uaugcuauauucaaa

SEQ ID NO: 464286 - RNA, 18 nt, Homo sapiens
uauggaagaugugugaua

SEQ ID NO: 464287 - RNA, 18 nt, Homo sapiens
uaugugugccagcugugu

SEQ ID NO: 464288 - RNA, 20 nt, Homo sapiens
uauuaaacauuuuucacuua

SEQ ID NO: 464289 - RNA, 12 nt, Homo sapiens
uauuaaguaaaa

SEQ ID NO: 464290 - RNA, 17 nt, Homo sapiens
uauucaauaaagcugcu

SEQ ID NO: 464291 - RNA, 14 nt, Homo sapiens
uauuuaaaaguaua

SEQ ID NO: 464292 - RNA, 22 nt, Homo sapiens
uauuugguucuccgugaugcug

SEQ ID NO: 464293 - RNA, 17 nt, Homo sapiens
uauuuuaaaacauaaga

SEQ ID NO: 464294 - RNA, 21 nt, Homo sapiens
uauuuuuuaaagucuauuguu

SEQ ID NO: 464295 - RNA, 21 nt, Homo sapiens
ucaaacuccugaccucaggug

SEQ ID NO: 464296 - RNA, 19 nt, Homo sapiens
ucaaagcuuccucuggcca

SEQ ID NO: 464297 - RNA, 22 nt, Homo sapiens
ucaacaucuuggucagauuuga

SEQ ID NO: 464298 - RNA, 18 nt, Homo sapiens
ucaacccaauaauucugu

SEQ ID NO: 464299 - RNA, 18 nt, Homo sapiens
ucaagaaagcauugccag

SEQ ID NO: 464300 - RNA, 20 nt, Homo sapiens
ucaagcgauucuccugccuc

SEQ ID NO: 464301 - RNA, 21 nt, Homo sapiens
ucaagcgauucuccugccuca

SEQ ID NO: 464302 - RNA, 22 nt, Homo sapiens
ucaagcgauucuccugccucag

SEQ ID NO: 464303 - RNA, 18 nt, Homo sapiens
ucaaguggacagugaaug

SEQ ID NO: 464304 - RNA, 21 nt, Homo sapiens
ucaauaccccuguuaagcaau

SEQ ID NO: 464305 - RNA, 23 nt, Homo sapiens
ucaauauuugaucuaaguugcau

SEQ ID NO: 464306 - RNA, 12 nt, Homo sapiens
ucacacuguaag

SEQ ID NO: 464307 - RNA, 21 nt, Homo sapiens
ucacccacuucuacaugcuca

SEQ ID NO: 464308 - RNA, 19 nt, Homo sapiens
ucacccaggcuggagugca

SEQ ID NO: 464309 - RNA, 16 nt, Homo sapiens
ucaccucauaugcuau

SEQ ID NO: 464310 - RNA, 21 nt, Homo sapiens
ucaccucuuaugcacaccucc

SEQ ID NO: 464311 - RNA, 15 nt, Homo sapiens
ucacuaugcauuuua

SEQ ID NO: 464312 - RNA, 14 nt, Homo sapiens
ucacugcaaccucc

SEQ ID NO: 464313 - RNA, 21 nt, Homo sapiens
ucagaccaacucucuccugua

SEQ ID NO: 464314 - RNA, 15 nt, Homo sapiens
ucagaccuucuucca

SEQ ID NO: 464315 - RNA, 21 nt, Homo sapiens
ucagacuucauaagcgcagca

SEQ ID NO: 464316 - RNA, 21 nt, Homo sapiens
ucagaggaaaagggcaaaaag

SEQ ID NO: 464317 - RNA, 22 nt, Homo sapiens
ucagaggaaaagggcaaaaaga

SEQ ID NO: 464318 - RNA, 18 nt, Homo sapiens
ucagcaaggggcucugcc

SEQ ID NO: 464319 - RNA, 17 nt, Homo sapiens
ucaggcaccugaaguga

SEQ ID NO: 464320 - RNA, 17 nt, Homo sapiens
ucaucgcucuacaccug

SEQ ID NO: 464321 - RNA, 24 nt, Homo sapiens
cuccaaaaacaguaaaaauaacca

SEQ ID NO: 464322 - RNA, 17 nt, Homo sapiens
cuccaucauuaauguga

SEQ ID NO: 464323 - RNA, 15 nt, Homo sapiens
cucccaaagugcagg

SEQ ID NO: 464324 - RNA, 20 nt, Homo sapiens
cucccaaagugcagggauua

SEQ ID NO: 464325 - RNA, 19 nt, Homo sapiens
cucccaaagugcugggauu

SEQ ID NO: 464326 - RNA, 20 nt, Homo sapiens
cucccaaagugcugggauua

SEQ ID NO: 464327 - RNA, 17 nt, Homo sapiens
cuccccuugaaaacugc

SEQ ID NO: 464328 - RNA, 22 nt, Homo sapiens
cuccugccucagccuccugagc

SEQ ID NO: 464329 - RNA, 22 nt, Homo sapiens
cucgaacuccugaccucaggug

SEQ ID NO: 464330 - RNA, 20 nt, Homo sapiens
cucgagccgccaggacacag

SEQ ID NO: 464331 - RNA, 18 nt, Homo sapiens
cucgcuagguucuuauca

SEQ ID NO: 464332 - RNA, 17 nt, Homo sapiens
cucggggauagaccaaa

SEQ ID NO: 464333 - RNA, 18 nt, Homo sapiens
cucucaggagaucuggcu

SEQ ID NO: 464334 - RNA, 10 nt, Homo sapiens
cucucaggug

SEQ ID NO: 464335 - RNA, 16 nt, Homo sapiens
cucuucaaucucuugc

SEQ ID NO: 464336 - RNA, 23 nt, Homo sapiens
cucuucaggcaccugaagugaga

SEQ ID NO: 464337 - RNA, 18 nt, Homo sapiens
cucuugaauauguauuaa

SEQ ID NO: 464338 - RNA, 16 nt, Homo sapiens
cucuuucuucuuugaa

SEQ ID NO: 464339 - RNA, 15 nt, Homo sapiens
cugaccaccuugcac

SEQ ID NO: 464340 - RNA, 19 nt, Homo sapiens
cugaccucaggugauccac

SEQ ID NO: 464341 - RNA, 16 nt, Homo sapiens
cugcagacucauccuu

SEQ ID NO: 464342 - RNA, 11 nt, Homo sapiens
cugcagggucc

SEQ ID NO: 464343 - RNA, 12 nt, Homo sapiens
cugccaaaaagg

SEQ ID NO: 464344 - RNA, 15 nt, Homo sapiens
cugccagggcaccua

SEQ ID NO: 464345 - RNA, 13 nt, Homo sapiens
cugccagugcaga

SEQ ID NO: 464346 - RNA, 15 nt, Homo sapiens
cugccaucauuguaa

SEQ ID NO: 464347 - RNA, 20 nt, Homo sapiens
cugccaucauuguaacauga

SEQ ID NO: 464348 - RNA, 13 nt, Homo sapiens
cugccaugcuucc

SEQ ID NO: 464349 - RNA, 13 nt, Homo sapiens
cugccauugugau

SEQ ID NO: 464350 - RNA, 21 nt, Homo sapiens
cugcccacgcugcagugugag

SEQ ID NO: 464351 - RNA, 19 nt, Homo sapiens
cugcccagcggccuuccac

SEQ ID NO: 464352 - RNA, 18 nt, Homo sapiens
cugcucggagcucagugc

SEQ ID NO: 464353 - RNA, 17 nt, Homo sapiens
cuggacuuuugcagcuu

SEQ ID NO: 464354 - RNA, 12 nt, Homo sapiens
cuggagugcagu

SEQ ID NO: 464355 - RNA, 21 nt, Homo sapiens
cuggauuccucgaaacugcca

SEQ ID NO: 464356 - RNA, 15 nt, Homo sapiens
cugggauuacaggcg

SEQ ID NO: 464357 - RNA, 20 nt, Homo sapiens
cuggggaggacaaaggugau

SEQ ID NO: 464358 - RNA, 21 nt, Homo sapiens
cuggggguggaggccugccug

SEQ ID NO: 464359 - RNA, 14 nt, Homo sapiens
cuggucuucaauua

SEQ ID NO: 464360 - RNA, 18 nt, Homo sapiens
cuguauuaacugaauucu

SEQ ID NO: 464361 - RNA, 19 nt, Homo sapiens
cuguccaggaacuuuccag

SEQ ID NO: 464362 - RNA, 13 nt, Homo sapiens
cugucucuacuaa

SEQ ID NO: 464363 - RNA, 14 nt, Homo sapiens
cuguugagguguga

SEQ ID NO: 464364 - RNA, 12 nt, Homo sapiens
cuuaauuugauu

SEQ ID NO: 464365 - RNA, 19 nt, Homo sapiens
cuuagaauuugggggaaaa

SEQ ID NO: 464366 - RNA, 16 nt, Homo sapiens
cuuaggcaaaauacca

SEQ ID NO: 464367 - RNA, 21 nt, Homo sapiens
cuucaaucucuugcacucaaa

SEQ ID NO: 464368 - RNA, 20 nt, Homo sapiens
cuucauuuuucuaauaauca

SEQ ID NO: 464369 - RNA, 16 nt, Homo sapiens
cuuccaaucuccauca

SEQ ID NO: 464370 - RNA, 12 nt, Homo sapiens
cuuccagugcag

SEQ ID NO: 464371 - RNA, 23 nt, Homo sapiens
cuuccaucucagcacucuguggg

SEQ ID NO: 464372 - RNA, 12 nt, Homo sapiens
cuugaaaacugc

SEQ ID NO: 464373 - RNA, 19 nt, Homo sapiens
cuugaaaaugaaaugacug

SEQ ID NO: 464374 - RNA, 13 nt, Homo sapiens
cuugacugcauua

SEQ ID NO: 464375 - RNA, 17 nt, Homo sapiens
cuugcagaguacaugau

SEQ ID NO: 464376 - RNA, 14 nt, Homo sapiens
cuugccauuuucaa

SEQ ID NO: 464377 - RNA, 17 nt, Homo sapiens
cuuguuuucuacuuugc

SEQ ID NO: 464378 - RNA, 23 nt, Homo sapiens
cuuuaacauuuuacugugcuguu

SEQ ID NO: 464379 - RNA, 20 nt, Homo sapiens
cuuucaagcuucuugccagu

SEQ ID NO: 464380 - RNA, 18 nt, Homo sapiens
cuuuccagcaguauccuc

SEQ ID NO: 464381 - RNA, 19 nt, Homo sapiens
cuuucuaaaacacauuuaa

SEQ ID NO: 464382 - RNA, 15 nt, Homo sapiens
cuuugagucaaguca

SEQ ID NO: 464383 - RNA, 14 nt, Homo sapiens
cuuugccacagauu

SEQ ID NO: 464384 - RNA, 22 nt, Homo sapiens
cuuugcccacguguccugaggg

SEQ ID NO: 464385 - RNA, 20 nt, Homo sapiens
cuuuggaaauggcuguauca

SEQ ID NO: 464386 - RNA, 21 nt, Homo sapiens
cuuuggucaauauuugaucua

SEQ ID NO: 464387 - RNA, 18 nt, Homo sapiens
cuuuguaguagaauuuac

SEQ ID NO: 464388 - RNA, 18 nt, Homo sapiens
cuuuuauggaccaauuag

SEQ ID NO: 464389 - RNA, 19 nt, Homo sapiens
cuuuucuuuuuuuguccac

SEQ ID NO: 464390 - RNA, 22 nt, Homo sapiens
gaaaaagguauaugugauaaau

SEQ ID NO: 464391 - RNA, 18 nt, Homo sapiens
gaaaacguuuaaauuacu

SEQ ID NO: 464392 - RNA, 22 nt, Homo sapiens
gaaacaacuuguguucuauuaa

SEQ ID NO: 464393 - RNA, 17 nt, Homo sapiens
gaaacacaaacugaagu

SEQ ID NO: 464394 - RNA, 20 nt, Homo sapiens
gaaacagggccaggugcuuu

SEQ ID NO: 464395 - RNA, 21 nt, Homo sapiens
gaaacucuucaggcaccugaa

SEQ ID NO: 464396 - RNA, 13 nt, Homo sapiens
gaaagcauugcca

SEQ ID NO: 464397 - RNA, 21 nt, Homo sapiens
aagaggcuauuuaaaaguaua

SEQ ID NO: 464398 - RNA, 15 nt, Homo sapiens
aagaugugucuucaa

SEQ ID NO: 464399 - RNA, 22 nt, Homo sapiens
aagcaaaaaguuguuuuaucca

SEQ ID NO: 464400 - RNA, 18 nt, Homo sapiens
aagcaaauuaguaauugu

SEQ ID NO: 464401 - RNA, 14 nt, Homo sapiens
aagccaauauuuua

SEQ ID NO: 464402 - RNA, 19 nt, Homo sapiens
aaggacgagggaugggauu

SEQ ID NO: 464403 - RNA, 20 nt, Homo sapiens
aaggaguaaccaauuucuuu

SEQ ID NO: 464404 - RNA, 17 nt, Homo sapiens
aagggauuucauuugaa

SEQ ID NO: 464405 - RNA, 24 nt, Homo sapiens
aagguaaagcaguugagauucucu

SEQ ID NO: 464406 - RNA, 15 nt, Homo sapiens
aaggucuauauucug

SEQ ID NO: 464407 - RNA, 20 nt, Homo sapiens
aaggugauuuuccugugucc

SEQ ID NO: 464408 - RNA, 17 nt, Homo sapiens
aagguuuuuuuuaucuu

SEQ ID NO: 464409 - RNA, 19 nt, Homo sapiens
aaguaacacuaacuuugaa

SEQ ID NO: 464410 - RNA, 19 nt, Homo sapiens
aagucuuccugaccaccuu

SEQ ID NO: 464411 - RNA, 15 nt, Homo sapiens
aaguuaacuuccaau

SEQ ID NO: 464412 - RNA, 21 nt, Homo sapiens
aaguuaggaacgaacauguua

SEQ ID NO: 464413 - RNA, 22 nt, Homo sapiens
aaguugcugugccccaucagca

SEQ ID NO: 464414 - RNA, 14 nt, Homo sapiens
aaguuguuuuaucc

SEQ ID NO: 464415 - RNA, 23 nt, Homo sapiens
aaguuucacuggcugguggcugu

SEQ ID NO: 464416 - RNA, 14 nt, Homo sapiens
aauaaaacauuccu

SEQ ID NO: 464417 - RNA, 20 nt, Homo sapiens
aauaacacguccacuuucaa

SEQ ID NO: 464418 - RNA, 11 nt, Homo sapiens
aauaaugcaaa

SEQ ID NO: 464419 - RNA, 20 nt, Homo sapiens
aauacaaacauucuaauuaa

SEQ ID NO: 464420 - RNA, 21 nt, Homo sapiens
aauacaucuccaguacauucc

SEQ ID NO: 464421 - RNA, 20 nt, Homo sapiens
aauacccguugauaacucag

SEQ ID NO: 464422 - RNA, 15 nt, Homo sapiens
aauagaucuuaggca

SEQ ID NO: 464423 - RNA, 11 nt, Homo sapiens
aauauucaaua

SEQ ID NO: 464424 - RNA, 23 nt, Homo sapiens
aauauucaauaaagcugcugaga

SEQ ID NO: 464425 - RNA, 23 nt, Homo sapiens
aauauucagaaaaugaagcacga

SEQ ID NO: 464426 - RNA, 15 nt, Homo sapiens
aaucauaaacuauau

SEQ ID NO: 464427 - RNA, 21 nt, Homo sapiens
aaucauugcuuaugacaugau

SEQ ID NO: 464428 - RNA, 14 nt, Homo sapiens
aaucgugucuucaa

SEQ ID NO: 464429 - RNA, 22 nt, Homo sapiens
aaucuuggcucgcaaccuccgc

SEQ ID NO: 464430 - RNA, 22 nt, Homo sapiens
aaugacagaaugcuguuuuaaa

SEQ ID NO: 464431 - RNA, 20 nt, Homo sapiens
aaugaguuuuucuguuauca

SEQ ID NO: 464432 - RNA, 20 nt, Homo sapiens
aauggguuuuguguacugua

SEQ ID NO: 464433 - RNA, 17 nt, Homo sapiens
aauguauaugucauuua

SEQ ID NO: 464434 - RNA, 20 nt, Homo sapiens
aaugugguuauuuuacauua

SEQ ID NO: 464435 - RNA, 22 nt, Homo sapiens
aaugugguuauuuuacauuaag

SEQ ID NO: 464436 - RNA, 18 nt, Homo sapiens
aauuaaaauucucaaaaa

SEQ ID NO: 464437 - RNA, 14 nt, Homo sapiens
aauuagcauuccau

SEQ ID NO: 464438 - RNA, 15 nt, Homo sapiens
aauuccuuuuugcag

SEQ ID NO: 464439 - RNA, 13 nt, Homo sapiens
aauucuacuuuga

SEQ ID NO: 464440 - RNA, 21 nt, Homo sapiens
aauucucuuauccaacaucaa

SEQ ID NO: 464441 - RNA, 19 nt, Homo sapiens
aauucuguauuaacugaau

SEQ ID NO: 464442 - RNA, 22 nt, Homo sapiens
aauuguaaguaccccugauaag

SEQ ID NO: 464443 - RNA, 19 nt, Homo sapiens
aauugucuaaaaugucagu

SEQ ID NO: 464444 - RNA, 13 nt, Homo sapiens
aauuuuaagacca

SEQ ID NO: 464445 - RNA, 18 nt, Homo sapiens
acaaacauucuaauuaaa

SEQ ID NO: 464446 - RNA, 14 nt, Homo sapiens
acaaaguuuugcuc

SEQ ID NO: 464447 - RNA, 21 nt, Homo sapiens
acaaaugugaaguuaugcaug

SEQ ID NO: 464448 - RNA, 22 nt, Homo sapiens
acaacauuuuucaguuugcaaa

SEQ ID NO: 464449 - RNA, 16 nt, Homo sapiens
acaauaaaacauuccu

SEQ ID NO: 464450 - RNA, 14 nt, Homo sapiens
acaauuuauaauua

SEQ ID NO: 464451 - RNA, 18 nt, Homo sapiens
acacaaguagaugccuga

SEQ ID NO: 464452 - RNA, 17 nt, Homo sapiens
acacacucagugacauu

SEQ ID NO: 464453 - RNA, 20 nt, Homo sapiens
acaccacaccugauuccugu

SEQ ID NO: 464454 - RNA, 23 nt, Homo sapiens
acacuguaagaguucacauggaa

SEQ ID NO: 464455 - RNA, 12 nt, Homo sapiens
acagacuuuguu

SEQ ID NO: 464456 - RNA, 15 nt, Homo sapiens
acagauugcugcuuc

SEQ ID NO: 464457 - RNA, 16 nt, Homo sapiens
acagccucacuccuca

SEQ ID NO: 464458 - RNA, 17 nt, Homo sapiens
acagccucacuccucag

SEQ ID NO: 464459 - RNA, 14 nt, Homo sapiens
acagcugugugagc

SEQ ID NO: 464460 - RNA, 15 nt, Homo sapiens
acagcugugugagcu

SEQ ID NO: 464461 - RNA, 19 nt, Homo sapiens
acaggauuauuggaaauuu

SEQ ID NO: 464462 - RNA, 19 nt, Homo sapiens
acaguaaaaauaaccacuu

SEQ ID NO: 464463 - RNA, 19 nt, Homo sapiens
acagugcccuuuucaucuc

SEQ ID NO: 464464 - RNA, 17 nt, Homo sapiens
acagugucuguguacau

SEQ ID NO: 464465 - RNA, 13 nt, Homo sapiens
acauacaaugaag

SEQ ID NO: 464466 - RNA, 15 nt, Homo sapiens
acauuauuacuccuu

SEQ ID NO: 464467 - RNA, 17 nt, Homo sapiens
acauucaguucuuauca

SEQ ID NO: 464468 - RNA, 18 nt, Homo sapiens
acauuuauauauuuccau

SEQ ID NO: 464469 - RNA, 15 nt, Homo sapiens
accaacauggugaaa

SEQ ID NO: 464470 - RNA, 16 nt, Homo sapiens
accaagaguauuccau

SEQ ID NO: 464471 - RNA, 13 nt, Homo sapiens
accaauuagcauu

SEQ ID NO: 464472 - RNA, 19 nt, Homo sapiens
accaauuagcauuccauca

SEQ ID NO: 464473 - RNA, 14 nt, Homo sapiens
accacaccaggcug

SEQ ID NO: 464474 - RNA, 17 nt, Homo sapiens
accacgcccccagcugu

SEQ ID NO: 464475 - RNA, 18 nt, Homo sapiens
accacugagccauccuca

SEQ ID NO: 464476 - RNA, 18 nt, Homo sapiens
accagucugaaguuucau

SEQ ID NO: 464477 - RNA, 21 nt, Homo sapiens
acccaggggaaacgagcugug

SEQ ID NO: 464478 - RNA, 22 nt, Homo sapiens
acccaggggaaacgagcugugu

SEQ ID NO: 464479 - RNA, 20 nt, Homo sapiens
acccguugauaacucagugg

SEQ ID NO: 464480 - RNA, 21 nt, Homo sapiens
acccucaaguggacagugaau

SEQ ID NO: 464481 - RNA, 21 nt, Homo sapiens
accgggcuggccugugccuau

SEQ ID NO: 464482 - RNA, 19 nt, Homo sapiens
accucagccucccaaagug

SEQ ID NO: 464483 - RNA, 18 nt, Homo sapiens
accucagguuccaaauuc

SEQ ID NO: 464484 - RNA, 16 nt, Homo sapiens
accugagguugcuuua

SEQ ID NO: 464485 - RNA, 22 nt, Homo sapiens
accugauuccuguugcuuccag

SEQ ID NO: 464486 - RNA, 16 nt, Homo sapiens
accuucuuccacagca

SEQ ID NO: 464487 - RNA, 19 nt, Homo sapiens
accuugagaagacauagau

SEQ ID NO: 464488 - RNA, 23 nt, Homo sapiens
acgcacacagugucuguguacau

SEQ ID NO: 464489 - RNA, 16 nt, Homo sapiens
acgcccccagcuguga

SEQ ID NO: 464490 - RNA, 16 nt, Homo sapiens
acguuguaaugcacac

SEQ ID NO: 464491 - RNA, 15 nt, Homo sapiens
acuacagacauuaaa

SEQ ID NO: 464492 - RNA, 21 nt, Homo sapiens
acuagacguuguaaugcacac

SEQ ID NO: 464493 - RNA, 17 nt, Homo sapiens
acuauuguaaggucuau

SEQ ID NO: 464494 - RNA, 18 nt, Homo sapiens
acucaguggagccaggcu

SEQ ID NO: 464495 - RNA, 17 nt, Homo sapiens
acuccugaccucaggug

SEQ ID NO: 464496 - RNA, 20 nt, Homo sapiens
acuccugaccucaggugaug

SEQ ID NO: 464497 - RNA, 15 nt, Homo sapiens
acucuccugugagau

SEQ ID NO: 464498 - RNA, 14 nt, Homo sapiens
acucucuguuacac

SEQ ID NO: 464499 - RNA, 15 nt, Homo sapiens
acucugaauccucag

SEQ ID NO: 464500 - RNA, 15 nt, Homo sapiens
acucugcucucagga

SEQ ID NO: 464501 - RNA, 18 nt, Homo sapiens
acucugcucucaggagau

SEQ ID NO: 464502 - RNA, 21 nt, Homo sapiens
acugacacugcgaacucucag

SEQ ID NO: 464503 - RNA, 13 nt, Homo sapiens
acugcugugagca

SEQ ID NO: 464504 - RNA, 17 nt, Homo sapiens
acuguaagaguucacau

SEQ ID NO: 464505 - RNA, 16 nt, Homo sapiens
acuguaaucagguuau

SEQ ID NO: 464506 - RNA, 22 nt, Homo sapiens
acuuauaauuacaaugcacaau

SEQ ID NO: 464507 - RNA, 14 nt, Homo sapiens
acuucagaccaucu

SEQ ID NO: 464508 - RNA, 17 nt, Homo sapiens
acuucauacaauguaag

SEQ ID NO: 464509 - RNA, 19 nt, Homo sapiens
acuucucccaaaguguccu

SEQ ID NO: 464510 - RNA, 20 nt, Homo sapiens
acuucucuaacaucuagccc

SEQ ID NO: 464511 - RNA, 19 nt, Homo sapiens
acuucuuauacauuugaua

SEQ ID NO: 464512 - RNA, 17 nt, Homo sapiens
acuugauguguuaucuc

SEQ ID NO: 464513 - RNA, 20 nt, Homo sapiens
acuuggauugggagauuuca

SEQ ID NO: 464514 - RNA, 19 nt, Homo sapiens
acuuuaggugaacaaauaa

SEQ ID NO: 464515 - RNA, 14 nt, Homo sapiens
acuuuccagcagua

SEQ ID NO: 464516 - RNA, 15 nt, Homo sapiens
agaaaauuaguaauu

SEQ ID NO: 464517 - RNA, 14 nt, Homo sapiens
agaaaguauuuuca

SEQ ID NO: 464518 - RNA, 20 nt, Homo sapiens
agaaauucauuaugcugcua

SEQ ID NO: 464519 - RNA, 22 nt, Homo sapiens
agaacuccccuugaaaacugcu

SEQ ID NO: 464520 - RNA, 20 nt, Homo sapiens
agaacuuagggaggaccauu

SEQ ID NO: 464521 - RNA, 18 nt, Homo sapiens
agaaucccuguucauugu

SEQ ID NO: 464522 - RNA, 16 nt, Homo sapiens
cucuuccaaucuccau

SEQ ID NO: 464523 - RNA, 21 nt, Homo sapiens
cucuucccauaccacccaaaa

SEQ ID NO: 464524 - RNA, 18 nt, Homo sapiens
cucuugccuaaguauucc

SEQ ID NO: 464525 - RNA, 19 nt, Homo sapiens
cucuuugagucaagucaaa

SEQ ID NO: 464526 - RNA, 21 nt, Homo sapiens
cugaaagggcacagugucagu

SEQ ID NO: 464527 - RNA, 15 nt, Homo sapiens
cugaacaggaugcug

SEQ ID NO: 464528 - RNA, 22 nt, Homo sapiens
cugacacugcgaacucucagga

SEQ ID NO: 464529 - RNA, 13 nt, Homo sapiens
cugaccucaggug

SEQ ID NO: 464530 - RNA, 17 nt, Homo sapiens
cugaccuugugauccac

SEQ ID NO: 464531 - RNA, 14 nt, Homo sapiens
cugagcacugacug

SEQ ID NO: 464532 - RNA, 16 nt, Homo sapiens
cugagcgaggagugac

SEQ ID NO: 464533 - RNA, 15 nt, Homo sapiens
cugaucacaugugcc

SEQ ID NO: 464534 - RNA, 18 nt, Homo sapiens
cugauuauuuaucacaua

SEQ ID NO: 464535 - RNA, 13 nt, Homo sapiens
cugcaaugacugc

SEQ ID NO: 464536 - RNA, 15 nt, Homo sapiens
cugcauuuuacugua

SEQ ID NO: 464537 - RNA, 11 nt, Homo sapiens
cugccaaaaag

SEQ ID NO: 464538 - RNA, 12 nt, Homo sapiens
cugccagugcag

SEQ ID NO: 464539 - RNA, 12 nt, Homo sapiens
cugcucucagga

SEQ ID NO: 464540 - RNA, 23 nt, Homo sapiens
cugcugagaucuucucuguuauu

SEQ ID NO: 464541 - RNA, 21 nt, Homo sapiens
cugcuguccaggaacuuucca

SEQ ID NO: 464542 - RNA, 18 nt, Homo sapiens
cugcuuuguauccaugag

SEQ ID NO: 464543 - RNA, 23 nt, Homo sapiens
cuggacaaacagccucacuccuc

SEQ ID NO: 464544 - RNA, 20 nt, Homo sapiens
cuggagugcaguggugcaau

SEQ ID NO: 464545 - RNA, 15 nt, Homo sapiens
cuggauuaaugaacu

SEQ ID NO: 464546 - RNA, 13 nt, Homo sapiens
cuggauuccucga

SEQ ID NO: 464547 - RNA, 22 nt, Homo sapiens
cugggauuacaggcaugagcca

SEQ ID NO: 464548 - RNA, 17 nt, Homo sapiens
cuguaauuguauuucaa

SEQ ID NO: 464549 - RNA, 16 nt, Homo sapiens
cuguccucauucuucu

SEQ ID NO: 464550 - RNA, 21 nt, Homo sapiens
cugugcccacggagccuaccc

SEQ ID NO: 464551 - RNA, 13 nt, Homo sapiens
cugugggggaaac

SEQ ID NO: 464552 - RNA, 13 nt, Homo sapiens
cugugugagcugc

SEQ ID NO: 464553 - RNA, 20 nt, Homo sapiens
cuguucauuguaagcacuuu

SEQ ID NO: 464554 - RNA, 17 nt, Homo sapiens
cuguuccuuaauuugau

SEQ ID NO: 464555 - RNA, 20 nt, Homo sapiens
cuuacacuuuaugcacaaaa

SEQ ID NO: 464556 - RNA, 19 nt, Homo sapiens
cuuauaauuacaaugcaca

SEQ ID NO: 464557 - RNA, 15 nt, Homo sapiens
cuuauacauuugaua

SEQ ID NO: 464558 - RNA, 15 nt, Homo sapiens
cuuaucaacauuugg

SEQ ID NO: 464559 - RNA, 14 nt, Homo sapiens
cuucaggcaccuga

SEQ ID NO: 464560 - RNA, 13 nt, Homo sapiens
cuucagucuugau

SEQ ID NO: 464561 - RNA, 18 nt, Homo sapiens
cuucagucuugaugcagu

SEQ ID NO: 464562 - RNA, 20 nt, Homo sapiens
cuucauacaauguaagguca

SEQ ID NO: 464563 - RNA, 13 nt, Homo sapiens
cuucccuuugauu

SEQ ID NO: 464564 - RNA, 11 nt, Homo sapiens
cuucucaaaag

SEQ ID NO: 464565 - RNA, 21 nt, Homo sapiens
cuucucaagcacugacacuca

SEQ ID NO: 464566 - RNA, 17 nt, Homo sapiens
cuugaaugauacgauua

SEQ ID NO: 464567 - RNA, 19 nt, Homo sapiens
cuugaauuucuccgaaugu

SEQ ID NO: 464568 - RNA, 15 nt, Homo sapiens
cuugacagagucugu

SEQ ID NO: 464569 - RNA, 22 nt, Homo sapiens
cuugacucaacgagagcacuug

SEQ ID NO: 464570 - RNA, 16 nt, Homo sapiens
cuugaugcaguuucau

SEQ ID NO: 464571 - RNA, 16 nt, Homo sapiens
cuugcagaguacauga

SEQ ID NO: 464572 - RNA, 23 nt, Homo sapiens
cuugccauuuucaagaaagcauu

SEQ ID NO: 464573 - RNA, 15 nt, Homo sapiens
cuugguaaaaacugc

SEQ ID NO: 464574 - RNA, 19 nt, Homo sapiens
cuugguaaaaacugcagug

SEQ ID NO: 464575 - RNA, 14 nt, Homo sapiens
cuuguacagccuuu

SEQ ID NO: 464576 - RNA, 20 nt, Homo sapiens
cuuguuuucuacuuugccac

SEQ ID NO: 464577 - RNA, 18 nt, Homo sapiens
cuuucuaaaacacauuua

SEQ ID NO: 464578 - RNA, 15 nt, Homo sapiens
cuuuggcaauucuuc

SEQ ID NO: 464579 - RNA, 18 nt, Homo sapiens
cuuuucaucuccagugug

SEQ ID NO: 464580 - RNA, 17 nt, Homo sapiens
cuuuuccauccuaguga

SEQ ID NO: 464581 - RNA, 15 nt, Homo sapiens
cuuuucuuuaccagu

SEQ ID NO: 464582 - RNA, 23 nt, Homo sapiens
cuuuucuuugaaggaugacuaca

SEQ ID NO: 464583 - RNA, 23 nt, Homo sapiens
cuuuugacagcugugcuguaaca

SEQ ID NO: 464584 - RNA, 20 nt, Homo sapiens
cuuuuuaauauugauaugcu

SEQ ID NO: 464585 - RNA, 16 nt, Homo sapiens
gaaaaaaagaugguau

SEQ ID NO: 464586 - RNA, 15 nt, Homo sapiens
gaaaacuuugaaaag

SEQ ID NO: 464587 - RNA, 16 nt, Homo sapiens
gaaaagggcaaaaaga

SEQ ID NO: 464588 - RNA, 19 nt, Homo sapiens
gaaacaacuuguguucuau

SEQ ID NO: 464589 - RNA, 17 nt, Homo sapiens
gaaacagacugccugaa

SEQ ID NO: 464590 - RNA, 19 nt, Homo sapiens
gaaaggagugacuuugcag

SEQ ID NO: 464591 - RNA, 18 nt, Homo sapiens
gaaaggucacacuaccau

SEQ ID NO: 464592 - RNA, 17 nt, Homo sapiens
gaaauaacccagacuua

SEQ ID NO: 464593 - RNA, 18 nt, Homo sapiens
gaagaggaguugcuugau

SEQ ID NO: 464594 - RNA, 19 nt, Homo sapiens
gaagaguaaaauggcuguu

SEQ ID NO: 464595 - RNA, 13 nt, Homo sapiens
gaagaugugugau

SEQ ID NO: 464596 - RNA, 20 nt, Homo sapiens
gaaggcaagagaaacauucu

SEQ ID NO: 464597 - RNA, 18 nt, Homo sapiens
gaagggauuucauuugaa

SEQ ID NO: 464598 - RNA, 15 nt, Homo sapiens
gaagggucacuuuaa

SEQ ID NO: 464599 - RNA, 15 nt, Homo sapiens
gaaguagcugggauu

SEQ ID NO: 464600 - RNA, 21 nt, Homo sapiens
gaaguauuuguguaccuggau

SEQ ID NO: 464601 - RNA, 19 nt, Homo sapiens
gaagugguuuaaaccaaac

SEQ ID NO: 464602 - RNA, 15 nt, Homo sapiens
gaaucggcuuugcag

SEQ ID NO: 464603 - RNA, 18 nt, Homo sapiens
gaaugauaguguaucuca

SEQ ID NO: 464604 - RNA, 24 nt, Homo sapiens
gaaugucaagguucccucccacuc

SEQ ID NO: 464605 - RNA, 22 nt, Homo sapiens
gacacacuggagaaaaggcagu

SEQ ID NO: 464606 - RNA, 17 nt, Homo sapiens
gacacauccaucuugca

SEQ ID NO: 464607 - RNA, 20 nt, Homo sapiens
gacacugcgaacucucagga

SEQ ID NO: 464608 - RNA, 16 nt, Homo sapiens
gacaggccgggcagug

SEQ ID NO: 464609 - RNA, 22 nt, Homo sapiens
gacgagugcuuccgcugcggug

SEQ ID NO: 464610 - RNA, 22 nt, Homo sapiens
gacgggacagccuucagcugca

SEQ ID NO: 464611 - RNA, 18 nt, Homo sapiens
gacucaacgagagcacuu

SEQ ID NO: 464612 - RNA, 14 nt, Homo sapiens
gacugccaaaaagg

SEQ ID NO: 464613 - RNA, 23 nt, Homo sapiens
gacuuauuuuaauuccacuuuaa

SEQ ID NO: 464614 - RNA, 17 nt, Homo sapiens
gagaauccuuguggcuu

SEQ ID NO: 464615 - RNA, 17 nt, Homo sapiens
gagacaggguuucaccg

SEQ ID NO: 464616 - RNA, 16 nt, Homo sapiens
gagaccaaaucuugcu

SEQ ID NO: 464617 - RNA, 15 nt, Homo sapiens
gagcacagggcuguu

SEQ ID NO: 464618 - RNA, 14 nt, Homo sapiens
gagcagcugggauu

SEQ ID NO: 464619 - RNA, 18 nt, Homo sapiens
gagccacugcgcccggcc

SEQ ID NO: 464620 - RNA, 17 nt, Homo sapiens
gagccuucugugcugug

SEQ ID NO: 464621 - RNA, 14 nt, Homo sapiens
gaggcccucagggc

SEQ ID NO: 464622 - RNA, 17 nt, Homo sapiens
gaggcuccugucugaua

SEQ ID NO: 464623 - RNA, 19 nt, Homo sapiens
gagguuucaucauguuggc

SEQ ID NO: 464624 - RNA, 23 nt, Homo sapiens
gagugcaguggugcaaucuuggc

SEQ ID NO: 464625 - RNA, 13 nt, Homo sapiens
gaguggcuuccau

SEQ ID NO: 464626 - RNA, 19 nt, Homo sapiens
gaguguaguugaugacugu

SEQ ID NO: 464627 - RNA, 13 nt, Homo sapiens
gauaacucagugg

SEQ ID NO: 464628 - RNA, 13 nt, Homo sapiens
gauaauacuucca

SEQ ID NO: 464629 - RNA, 14 nt, Homo sapiens
gauagaccaaagac

SEQ ID NO: 464630 - RNA, 18 nt, Homo sapiens
gauccacccaccucggcc

SEQ ID NO: 464631 - RNA, 18 nt, Homo sapiens
gauccuccccgacugugg

SEQ ID NO: 464632 - RNA, 13 nt, Homo sapiens
gaugggauuucau

SEQ ID NO: 464633 - RNA, 22 nt, Homo sapiens
gauuaauuuaauucauguauua

SEQ ID NO: 464634 - RNA, 19 nt, Homo sapiens
gauuacaggcgugagccac

SEQ ID NO: 464635 - RNA, 21 nt, Homo sapiens
gauuauuggaaauuuguuaua

SEQ ID NO: 464636 - RNA, 14 nt, Homo sapiens
gauuauuuaucaca

SEQ ID NO: 464637 - RNA, 22 nt, Homo sapiens
gauuccucggggauagaccaaa

SEQ ID NO: 464638 - RNA, 23 nt, Homo sapiens
gauucuccuguauuucaggugaa

SEQ ID NO: 464639 - RNA, 19 nt, Homo sapiens
gcaaaugaccaaauggugu

SEQ ID NO: 464640 - RNA, 14 nt, Homo sapiens
gcaaaugacuguca

SEQ ID NO: 464641 - RNA, 16 nt, Homo sapiens
gcaagcccacagauga

SEQ ID NO: 464642 - RNA, 16 nt, Homo sapiens
gcaauucuucuucuca

SEQ ID NO: 464643 - RNA, 22 nt, Homo sapiens
gcaauucuucuucucaagcacu

SEQ ID NO: 464644 - RNA, 23 nt, Homo sapiens
gcacacagugucuguguacaugu

SEQ ID NO: 464645 - RNA, 20 nt, Homo sapiens
gcaccuggcggggucuugcu

SEQ ID NO: 464646 - RNA, 13 nt, Homo sapiens
gcacugacacuca

SEQ ID NO: 464647 - RNA, 14 nt, Homo sapiens
gcagcaggugcuuu

SEQ ID NO: 464648 - RNA, 13 nt, Homo sapiens
aaaacugcagugu

SEQ ID NO: 464649 - RNA, 15 nt, Homo sapiens
aaaauaaagccauuu

SEQ ID NO: 464650 - RNA, 21 nt, Homo sapiens
aaaauacaaacauucuaauua

SEQ ID NO: 464651 - RNA, 13 nt, Homo sapiens
aaaauaccagcug

SEQ ID NO: 464652 - RNA, 13 nt, Homo sapiens
aaaauaccauuua

SEQ ID NO: 464653 - RNA, 22 nt, Homo sapiens
aaaaucaacccaauaauucugu

SEQ ID NO: 464654 - RNA, 20 nt, Homo sapiens
aaaaugaaaugacugucuaa

SEQ ID NO: 464655 - RNA, 21 nt, Homo sapiens
aaaauucagaguccuugcaaa

SEQ ID NO: 464656 - RNA, 21 nt, Homo sapiens
aaacaacuuguguucuauuaa

SEQ ID NO: 464657 - RNA, 22 nt, Homo sapiens
aaacgauuuugaacauacuuca

SEQ ID NO: 464658 - RNA, 20 nt, Homo sapiens
aaacggaacucuucaucuua

SEQ ID NO: 464659 - RNA, 16 nt, Homo sapiens
aaacuccugaccucag

SEQ ID NO: 464660 - RNA, 17 nt, Homo sapiens
aaacugccauugugauc

SEQ ID NO: 464661 - RNA, 14 nt, Homo sapiens
aaagaaaauuagua

SEQ ID NO: 464662 - RNA, 16 nt, Homo sapiens
aaagcaguguuuucac

SEQ ID NO: 464663 - RNA, 22 nt, Homo sapiens
aaagcaguguuuucaccucaua

SEQ ID NO: 464664 - RNA, 22 nt, Homo sapiens
aaagcugcugagaaucuagccu

SEQ ID NO: 464665 - RNA, 23 nt, Homo sapiens
aaaggaguaugugugccagcugu

SEQ ID NO: 464666 - RNA, 21 nt, Homo sapiens
aaagugcugggauuacaggca

SEQ ID NO: 464667 - RNA, 15 nt, Homo sapiens
aaauaaauacauucu

SEQ ID NO: 464668 - RNA, 15 nt, Homo sapiens
aaauacaaacauucu

SEQ ID NO: 464669 - RNA, 16 nt, Homo sapiens
aaauagaacuaauacu

SEQ ID NO: 464670 - RNA, 21 nt, Homo sapiens
aaauagcucuguggguuuuaa

SEQ ID NO: 464671 - RNA, 22 nt, Homo sapiens
aaauaucuugauccuaugagug

SEQ ID NO: 464672 - RNA, 19 nt, Homo sapiens
aaauuauagucuuuugcca

SEQ ID NO: 464673 - RNA, 13 nt, Homo sapiens
aaauuguguauga

SEQ ID NO: 464674 - RNA, 19 nt, Homo sapiens
aacaaaauaguuacugugc

SEQ ID NO: 464675 - RNA, 13 nt, Homo sapiens
aacaaaaucuggg

SEQ ID NO: 464676 - RNA, 18 nt, Homo sapiens
aacagccucacuccucag

SEQ ID NO: 464677 - RNA, 21 nt, Homo sapiens
aacaucuuggucagauuugaa

SEQ ID NO: 464678 - RNA, 21 nt, Homo sapiens
aacaugaaaauuaugucaguu

SEQ ID NO: 464679 - RNA, 22 nt, Homo sapiens
aacauuuauauauuuccauuca

SEQ ID NO: 464680 - RNA, 19 nt, Homo sapiens
aacauuuuacugugcuguu

SEQ ID NO: 464681 - RNA, 15 nt, Homo sapiens
aacauuuuucacuua

SEQ ID NO: 464682 - RNA, 21 nt, Homo sapiens
aacauuuuucaguuugcaaau

SEQ ID NO: 464683 - RNA, 17 nt, Homo sapiens
aaccaagaguauuccau

SEQ ID NO: 464684 - RNA, 20 nt, Homo sapiens
aacccaggaggcggagguug

SEQ ID NO: 464685 - RNA, 20 nt, Homo sapiens
aaccuccaccucccggguuc

SEQ ID NO: 464686 - RNA, 14 nt, Homo sapiens
aacuccugaccuca

SEQ ID NO: 464687 - RNA, 18 nt, Homo sapiens
aacucuucaggcaccuga

SEQ ID NO: 464688 - RNA, 13 nt, Homo sapiens
aacugcaagccca

SEQ ID NO: 464689 - RNA, 17 nt, Homo sapiens
aacugccauugugauca

SEQ ID NO: 464690 - RNA, 20 nt, Homo sapiens
aacuugaggacacaugucca

SEQ ID NO: 464691 - RNA, 15 nt, Homo sapiens
aagaaaauuaguaau

SEQ ID NO: 464692 - RNA, 17 nt, Homo sapiens
aagacauguacugauga

SEQ ID NO: 464693 - RNA, 14 nt, Homo sapiens
aagacgacuguggu

SEQ ID NO: 464694 - RNA, 14 nt, Homo sapiens
aagaugcagucucu

SEQ ID NO: 464695 - RNA, 16 nt, Homo sapiens
aagaugugucuucaau

SEQ ID NO: 464696 - RNA, 14 nt, Homo sapiens
aagaugugugauaa

SEQ ID NO: 464697 - RNA, 21 nt, Homo sapiens
aagauucauauuuacuucuua

SEQ ID NO: 464698 - RNA, 18 nt, Homo sapiens
acaucuuggucagauuug

SEQ ID NO: 464699 - RNA, 23 nt, Homo sapiens
acaucuuggucagauuugaacuc

SEQ ID NO: 464700 - RNA, 23 nt, Homo sapiens
acauuuguguuuuuuucuagccu

SEQ ID NO: 464701 - RNA, 18 nt, Homo sapiens
accaaacggaacucuuca

SEQ ID NO: 464702 - RNA, 13 nt, Homo sapiens
accaaaucuugcu

SEQ ID NO: 464703 - RNA, 12 nt, Homo sapiens
accaaauucuga

SEQ ID NO: 464704 - RNA, 17 nt, Homo sapiens
accacccaaaaucauaa

SEQ ID NO: 464705 - RNA, 23 nt, Homo sapiens
accauagccuguuucguagccau

SEQ ID NO: 464706 - RNA, 15 nt, Homo sapiens
accauuggcuugcca

SEQ ID NO: 464707 - RNA, 14 nt, Homo sapiens
acccagaguggcuu

SEQ ID NO: 464708 - RNA, 22 nt, Homo sapiens
acccauuuacuuuggucaauau

SEQ ID NO: 464709 - RNA, 22 nt, Homo sapiens
accccaccuugccaagcuuucu

SEQ ID NO: 464710 - RNA, 17 nt, Homo sapiens
accccuguuaagcaauu

SEQ ID NO: 464711 - RNA, 20 nt, Homo sapiens
acccugucucuacuaaaaau

SEQ ID NO: 464712 - RNA, 18 nt, Homo sapiens
accgacugaagugugugu

SEQ ID NO: 464713 - RNA, 18 nt, Homo sapiens
accgucugugauugccau

SEQ ID NO: 464714 - RNA, 17 nt, Homo sapiens
accuccaccucccgggu

SEQ ID NO: 464715 - RNA, 21 nt, Homo sapiens
accuucgacuucauuuugcca

SEQ ID NO: 464716 - RNA, 13 nt, Homo sapiens
accuucuuccaca

SEQ ID NO: 464717 - RNA, 20 nt, Homo sapiens
accuugcacuauuggacuuu

SEQ ID NO: 464718 - RNA, 17 nt, Homo sapiens
acgaacauguuagucaa

SEQ ID NO: 464719 - RNA, 19 nt, Homo sapiens
acgacuguggugugcagug

SEQ ID NO: 464720 - RNA, 19 nt, Homo sapiens
acgagcugcuguccaggaa

SEQ ID NO: 464721 - RNA, 23 nt, Homo sapiens
acgagcuguguagccacugacuu

SEQ ID NO: 464722 - RNA, 23 nt, Homo sapiens
acgagugcuuccgcugcggugau

SEQ ID NO: 464723 - RNA, 15 nt, Homo sapiens
acgauuucacugaca

SEQ ID NO: 464724 - RNA, 17 nt, Homo sapiens
acgccucccugagcacu

SEQ ID NO: 464725 - RNA, 16 nt, Homo sapiens
acgcggagcacuuucg

SEQ ID NO: 464726 - RNA, 13 nt, Homo sapiens
acguccacuuuca

SEQ ID NO: 464727 - RNA, 13 nt, Homo sapiens
acuaagaggcuau

SEQ ID NO: 464728 - RNA, 14 nt, Homo sapiens
acuagauacaguaa

SEQ ID NO: 464729 - RNA, 16 nt, Homo sapiens
acuauuuaugaauauu

SEQ ID NO: 464730 - RNA, 14 nt, Homo sapiens
acuccugaccucag

SEQ ID NO: 464731 - RNA, 19 nt, Homo sapiens
acucgcuagguucuuauca

SEQ ID NO: 464732 - RNA, 18 nt, Homo sapiens
acucuucaggcaccugaa

SEQ ID NO: 464733 - RNA, 13 nt, Homo sapiens
acucuuuguauga

SEQ ID NO: 464734 - RNA, 16 nt, Homo sapiens
acugaaucuaaccaua

SEQ ID NO: 464735 - RNA, 13 nt, Homo sapiens
acugaauucugaa

SEQ ID NO: 464736 - RNA, 11 nt, Homo sapiens
acugagccauc

SEQ ID NO: 464737 - RNA, 13 nt, Homo sapiens
acugaugacacac

SEQ ID NO: 464738 - RNA, 21 nt, Homo sapiens
acugcaauuuaauucuuguuc

SEQ ID NO: 464739 - RNA, 20 nt, Homo sapiens
acugcacuccagccugggug

SEQ ID NO: 464740 - RNA, 12 nt, Homo sapiens
acugccaaaaag

SEQ ID NO: 464741 - RNA, 13 nt, Homo sapiens
acugccaaaaagg

SEQ ID NO: 464742 - RNA, 14 nt, Homo sapiens
acugccagugcaga

SEQ ID NO: 464743 - RNA, 22 nt, Homo sapiens
acugcugcugaggcuccuguua

SEQ ID NO: 464744 - RNA, 22 nt, Homo sapiens
acugcugggcccgauucugaua

SEQ ID NO: 464745 - RNA, 16 nt, Homo sapiens
acuguauuacauaaau

SEQ ID NO: 464746 - RNA, 13 nt, Homo sapiens
acuuaaaaacuug

SEQ ID NO: 464747 - RNA, 17 nt, Homo sapiens
acuuauuuuuuucccaa

SEQ ID NO: 464748 - RNA, 20 nt, Homo sapiens
acuucucccaaaguguccua

SEQ ID NO: 464749 - RNA, 18 nt, Homo sapiens
acuucuuauacauuugau

SEQ ID NO: 464750 - RNA, 18 nt, Homo sapiens
acuugcagaguacaugau

SEQ ID NO: 464751 - RNA, 17 nt, Homo sapiens
acuugcccuucagcuca

SEQ ID NO: 464752 - RNA, 21 nt, Homo sapiens
acuuuugcagcuuccuuccaa

SEQ ID NO: 464753 - RNA, 23 nt, Homo sapiens
agaacuucucuucccauaccacc

SEQ ID NO: 464754 - RNA, 23 nt, Homo sapiens
uccgggugaagacauguacugau

SEQ ID NO: 464755 - RNA, 12 nt, Homo sapiens
uccucaucagcu

SEQ ID NO: 464756 - RNA, 13 nt, Homo sapiens
uccucauucuucu

SEQ ID NO: 464757 - RNA, 16 nt, Homo sapiens
uccucgaaacugccau

SEQ ID NO: 464758 - RNA, 12 nt, Homo sapiens
uccugaccucag

SEQ ID NO: 464759 - RNA, 17 nt, Homo sapiens
uccugaccucaggugau

SEQ ID NO: 464760 - RNA, 17 nt, Homo sapiens
uccugagcagcugggau

SEQ ID NO: 464761 - RNA, 11 nt, Homo sapiens
uccuucuugcu

SEQ ID NO: 464762 - RNA, 14 nt, Homo sapiens
uccuugacccuggg

SEQ ID NO: 464763 - RNA, 19 nt, Homo sapiens
uccuugcugccaccugcuu

SEQ ID NO: 464764 - RNA, 19 nt, Homo sapiens
ucgacgaggaggagugcau

SEQ ID NO: 464765 - RNA, 23 nt, Homo sapiens
ucgccaagagggacaucagaaag

SEQ ID NO: 464766 - RNA, 14 nt, Homo sapiens
ucggagcucagugc

SEQ ID NO: 464767 - RNA, 23 nt, Homo sapiens
ucuaaaccccggcgugugcagug

SEQ ID NO: 464768 - RNA, 14 nt, Homo sapiens
ucuaagagaucugg

SEQ ID NO: 464769 - RNA, 15 nt, Homo sapiens
ucuacagagugagac

SEQ ID NO: 464770 - RNA, 20 nt, Homo sapiens
ucucaggagaucuggcugug

SEQ ID NO: 464771 - RNA, 16 nt, Homo sapiens
ucuccaguacauuccg

SEQ ID NO: 464772 - RNA, 13 nt, Homo sapiens
ucuccccaugugc

SEQ ID NO: 464773 - RNA, 16 nt, Homo sapiens
ucuccuguauaaucuc

SEQ ID NO: 464774 - RNA, 18 nt, Homo sapiens
ucuccuguauaaucucuc

SEQ ID NO: 464775 - RNA, 19 nt, Homo sapiens
ucucuuugagucaagucaa

SEQ ID NO: 464776 - RNA, 23 nt, Homo sapiens
ucugagcgaggagugacugccaa

SEQ ID NO: 464777 - RNA, 13 nt, Homo sapiens
ucugcacaguguu

SEQ ID NO: 464778 - RNA, 19 nt, Homo sapiens
ucugucucauccaaaaagu

SEQ ID NO: 464779 - RNA, 23 nt, Homo sapiens
ucugucucaucucuguauuccca

SEQ ID NO: 464780 - RNA, 18 nt, Homo sapiens
ucugugacaugcuaauua

SEQ ID NO: 464781 - RNA, 11 nt, Homo sapiens
ucugugacauu

SEQ ID NO: 464782 - RNA, 16 nt, Homo sapiens
ucuuacucuuuguaug

SEQ ID NO: 464783 - RNA, 18 nt, Homo sapiens
ucuuaggcaaaauaccag

SEQ ID NO: 464784 - RNA, 19 nt, Homo sapiens
ucuuaucaaagaaauaacc

SEQ ID NO: 464785 - RNA, 21 nt, Homo sapiens
ucuuauccaacaucaacaucu

SEQ ID NO: 464786 - RNA, 16 nt, Homo sapiens
ucuucucaagcacuga

SEQ ID NO: 464787 - RNA, 13 nt, Homo sapiens
ucuuuauaauucu

SEQ ID NO: 464788 - RNA, 20 nt, Homo sapiens
ucuuucaagcuucuugccag

SEQ ID NO: 464789 - RNA, 17 nt, Homo sapiens
ucuuuggaaauggcugu

SEQ ID NO: 464790 - RNA, 22 nt, Homo sapiens
ugaaaaaauacccucugacugu

SEQ ID NO: 464791 - RNA, 23 nt, Homo sapiens
ugaacucgcuagguucuuaucaa

SEQ ID NO: 464792 - RNA, 19 nt, Homo sapiens
ugaagacauguacugauga

SEQ ID NO: 464793 - RNA, 17 nt, Homo sapiens
ugaaggaaauaaugcaa

SEQ ID NO: 464794 - RNA, 14 nt, Homo sapiens
ugaaugaaaugcca

SEQ ID NO: 464795 - RNA, 15 nt, Homo sapiens
ugaauuuccuaucug

SEQ ID NO: 464796 - RNA, 19 nt, Homo sapiens
ugaauuucuccgaauguca

SEQ ID NO: 464797 - RNA, 18 nt, Homo sapiens
ugacaaaggccugugaag

SEQ ID NO: 464798 - RNA, 23 nt, Homo sapiens
ugacacccacucuccugugagau

SEQ ID NO: 464799 - RNA, 21 nt, Homo sapiens
ugaccacgcccccagcuguga

SEQ ID NO: 464800 - RNA, 22 nt, Homo sapiens
ugacggcagcugguucugcaau

SEQ ID NO: 464801 - RNA, 16 nt, Homo sapiens
ugagaccaaaucuugc

SEQ ID NO: 464802 - RNA, 17 nt, Homo sapiens
ugagaccaaaucuugcu

SEQ ID NO: 464803 - RNA, 13 nt, Homo sapiens
ugagacuugccag

SEQ ID NO: 464804 - RNA, 23 nt, Homo sapiens
ugagcaaguaacacuaacuuuga

SEQ ID NO: 464805 - RNA, 11 nt, Homo sapiens
ugagcacugac

SEQ ID NO: 464806 - RNA, 21 nt, Homo sapiens
ugagcagcugggauuacaggu

SEQ ID NO: 464807 - RNA, 20 nt, Homo sapiens
ugagccacugcgcccggcca

SEQ ID NO: 464808 - RNA, 16 nt, Homo sapiens
ugaggggcacucgccg

SEQ ID NO: 464809 - RNA, 12 nt, Homo sapiens
ugagucaaguca

SEQ ID NO: 464810 - RNA, 23 nt, Homo sapiens
ugaucacaugugcccucugccag

SEQ ID NO: 464811 - RNA, 15 nt, Homo sapiens
ugaucauuacucugc

SEQ ID NO: 464812 - RNA, 17 nt, Homo sapiens
ugauccacccgccucag

SEQ ID NO: 464813 - RNA, 15 nt, Homo sapiens
ugaucgcuuucuaca

SEQ ID NO: 464814 - RNA, 15 nt, Homo sapiens
ugaucuaugcuauau

SEQ ID NO: 464815 - RNA, 15 nt, Homo sapiens
ugaugcacccaccuc

SEQ ID NO: 464816 - RNA, 17 nt, Homo sapiens
ugaugcaguuucauagu

SEQ ID NO: 464817 - RNA, 16 nt, Homo sapiens
ugauggaagaugcagu

SEQ ID NO: 464818 - RNA, 15 nt, Homo sapiens
ugauggcuggaucuu

SEQ ID NO: 464819 - RNA, 21 nt, Homo sapiens
ugauguaaaaaauacaaacau

SEQ ID NO: 464820 - RNA, 16 nt, Homo sapiens
ugauugccauuucuuc

SEQ ID NO: 464821 - RNA, 23 nt, Homo sapiens
ugauuuuuugcugcagacucauc

SEQ ID NO: 464822 - RNA, 18 nt, Homo sapiens
ugcaaauagaacuaauac

SEQ ID NO: 464823 - RNA, 15 nt, Homo sapiens
ugcaaaugacuguca

SEQ ID NO: 464824 - RNA, 17 nt, Homo sapiens
ugcacacauuaggcauu

SEQ ID NO: 464825 - RNA, 20 nt, Homo sapiens
ugcacccaccucagccuccc

SEQ ID NO: 464826 - RNA, 21 nt, Homo sapiens
ugcagaaacuaccagauuuga

SEQ ID NO: 464827 - RNA, 17 nt, Homo sapiens
ugcagggauuacaggca

SEQ ID NO: 464828 - RNA, 18 nt, Homo sapiens
ugcaggguuucucgccac

SEQ ID NO: 464829 - RNA, 23 nt, Homo sapiens
ugcaguauauuucugaaaugaca

SEQ ID NO: 464830 - RNA, 16 nt, Homo sapiens
ugccaaauaucuugau

SEQ ID NO: 464831 - RNA, 19 nt, Homo sapiens
ugccagcccaacugugaga

SEQ ID NO: 464832 - RNA, 18 nt, Homo sapiens
ugccagcugugugagaag

SEQ ID NO: 464833 - RNA, 15 nt, Homo sapiens
ugccauuucuuccca

SEQ ID NO: 464834 - RNA, 18 nt, Homo sapiens
ugcccacggagccuaccc

SEQ ID NO: 464835 - RNA, 17 nt, Homo sapiens
ugcccacguguccugag

SEQ ID NO: 464836 - RNA, 16 nt, Homo sapiens
ugcccggccuaugauu

SEQ ID NO: 464837 - RNA, 12 nt, Homo sapiens
ugccgcauuugg

SEQ ID NO: 464838 - RNA, 13 nt, Homo sapiens
ugccuaaguauuc

SEQ ID NO: 464839 - RNA, 21 nt, Homo sapiens
ugccugaauugagaauuuuga

SEQ ID NO: 464840 - RNA, 17 nt, Homo sapiens
ugccugggccuuggcaa

SEQ ID NO: 464841 - RNA, 20 nt, Homo sapiens
ugccuguaaucccagcacuu

SEQ ID NO: 464842 - RNA, 15 nt, Homo sapiens
ugccuuagugugaaa

SEQ ID NO: 464843 - RNA, 12 nt, Homo sapiens
ugcggugcauac

SEQ ID NO: 464844 - RNA, 17 nt, Homo sapiens
ugcgugccaccacacca

SEQ ID NO: 464845 - RNA, 17 nt, Homo sapiens
ugcucacugccagugca

SEQ ID NO: 464846 - RNA, 19 nt, Homo sapiens
ugcucugcuggucuucaau

SEQ ID NO: 464847 - RNA, 14 nt, Homo sapiens
ugcucuguacugca

SEQ ID NO: 464848 - RNA, 16 nt, Homo sapiens
ugcugaucacaugugc

SEQ ID NO: 464849 - RNA, 18 nt, Homo sapiens
ugcugcggagcuuuccac

SEQ ID NO: 464850 - RNA, 23 nt, Homo sapiens
ugcuuccagaccuaggcucaugg

SEQ ID NO: 464851 - RNA, 23 nt, Homo sapiens
ugcuucuggccuuguaucuugca

SEQ ID NO: 464852 - RNA, 15 nt, Homo sapiens
uggaacuguccuucc

SEQ ID NO: 464853 - RNA, 22 nt, Homo sapiens
uggaacuguccuucccucaaag

SEQ ID NO: 464854 - RNA, 14 nt, Homo sapiens
uggaagauguguga

SEQ ID NO: 464855 - RNA, 22 nt, Homo sapiens
uggagacuuccucuguucucag

SEQ ID NO: 464856 - RNA, 11 nt, Homo sapiens
uggagugcagu

SEQ ID NO: 464857 - RNA, 23 nt, Homo sapiens
uggauccuccccgacuguggcua

SEQ ID NO: 464858 - RNA, 18 nt, Homo sapiens
uggauuuuccaccaaauu

SEQ ID NO: 464859 - RNA, 16 nt, Homo sapiens
uggcucuugccuguaa

SEQ ID NO: 464860 - RNA, 21 nt, Homo sapiens
ugggaaugauaguguaucuca

SEQ ID NO: 464861 - RNA, 19 nt, Homo sapiens
ugggauggccgcugcucag

SEQ ID NO: 464862 - RNA, 14 nt, Homo sapiens
ugggggaugcuuca

SEQ ID NO: 464863 - RNA, 15 nt, Homo sapiens
ugguaaaaacugcag

SEQ ID NO: 464864 - RNA, 20 nt, Homo sapiens
ugguaugaacuugaggacac

SEQ ID NO: 464865 - RNA, 16 nt, Homo sapiens
uggucucuauacuaca

SEQ ID NO: 464866 - RNA, 22 nt, Homo sapiens
uggugaaaaugaagggauuuca

SEQ ID NO: 464867 - RNA, 16 nt, Homo sapiens
ugguggccggcagaag

SEQ ID NO: 464868 - RNA, 19 nt, Homo sapiens
uguaguuacaucucagugc

SEQ ID NO: 464869 - RNA, 21 nt, Homo sapiens
uguaucuugcauucacacuca

SEQ ID NO: 464870 - RNA, 20 nt, Homo sapiens
uguauuaacugaauucugaa

SEQ ID NO: 464871 - RNA, 20 nt, Homo sapiens
ugucaccggucagugccuuu

SEQ ID NO: 464872 - RNA, 12 nt, Homo sapiens
ugucaguugcca

SEQ ID NO: 464873 - RNA, 16 nt, Homo sapiens
ugucccacugcugcuu

SEQ ID NO: 464874 - RNA, 23 nt, Homo sapiens
ugucccuucucccaucagggucc

SEQ ID NO: 464875 - RNA, 19 nt, Homo sapiens
uguccuaagaaaauacugg

SEQ ID NO: 464876 - RNA, 17 nt, Homo sapiens
ugugaauuguuccucag

SEQ ID NO: 464877 - RNA, 17 nt, Homo sapiens
ugugauguuuggacaca

SEQ ID NO: 464878 - RNA, 16 nt, Homo sapiens
ugugccuuacauuauu

SEQ ID NO: 464879 - RNA, 12 nt, Homo sapiens
uguggcuuugau

SEQ ID NO: 464880 - RNA, 13 nt, Homo sapiens
gucagaaguugau

SEQ ID NO: 464881 - RNA, 16 nt, Homo sapiens
gucagaccuucuucca

SEQ ID NO: 464882 - RNA, 20 nt, Homo sapiens
gucagauuugaacucuucaa

SEQ ID NO: 464883 - RNA, 18 nt, Homo sapiens
gucccacgccucccugag

SEQ ID NO: 464884 - RNA, 16 nt, Homo sapiens
guccugaccuugagaa

SEQ ID NO: 464885 - RNA, 18 nt, Homo sapiens
guccuguuuuugucaugu

SEQ ID NO: 464886 - RNA, 15 nt, Homo sapiens
gucucaaacuccuga

SEQ ID NO: 464887 - RNA, 16 nt, Homo sapiens
gucucauccaaaaagu

SEQ ID NO: 464888 - RNA, 17 nt, Homo sapiens
gucuccccaugugccug

SEQ ID NO: 464889 - RNA, 14 nt, Homo sapiens
gucucuacuaaaaa

SEQ ID NO: 464890 - RNA, 22 nt, Homo sapiens
gucuugauuucacacucauuua

SEQ ID NO: 464891 - RNA, 21 nt, Homo sapiens
gugaaacccugucucuacuaa

SEQ ID NO: 464892 - RNA, 20 nt, Homo sapiens
gugaagcaaaacacaaaaac

SEQ ID NO: 464893 - RNA, 15 nt, Homo sapiens
gugaagugguuuaaa

SEQ ID NO: 464894 - RNA, 21 nt, Homo sapiens
gugaauaagccuuacgggaaa

SEQ ID NO: 464895 - RNA, 19 nt, Homo sapiens
gugacacuugguccuugcu

SEQ ID NO: 464896 - RNA, 13 nt, Homo sapiens
gugagaccaccuc

SEQ ID NO: 464897 - RNA, 19 nt, Homo sapiens
gugauggaagaugcagucu

SEQ ID NO: 464898 - RNA, 18 nt, Homo sapiens
gugauggcagggcuguga

SEQ ID NO: 464899 - RNA, 18 nt, Homo sapiens
gugccaccacaccaggcu

SEQ ID NO: 464900 - RNA, 13 nt, Homo sapiens
gugcggugcauac

SEQ ID NO: 464901 - RNA, 13 nt, Homo sapiens
guggcacgaucuc

SEQ ID NO: 464902 - RNA, 18 nt, Homo sapiens
guguagcccucacacugu

SEQ ID NO: 464903 - RNA, 18 nt, Homo sapiens
guguugaggugagucaga

SEQ ID NO: 464904 - RNA, 13 nt, Homo sapiens
guuauucuugaca

SEQ ID NO: 464905 - RNA, 17 nt, Homo sapiens
guuccuggacaaacagc

SEQ ID NO: 464906 - RNA, 16 nt, Homo sapiens
guucugguaugaacuu

SEQ ID NO: 464907 - RNA, 13 nt, Homo sapiens
guuggggagcuga

SEQ ID NO: 464908 - RNA, 19 nt, Homo sapiens
guuucaccguguuagccag

SEQ ID NO: 464909 - RNA, 22 nt, Homo sapiens
guuucucccccuuuccaaaaac

SEQ ID NO: 464910 - RNA, 17 nt, Homo sapiens
guuucuuaaaauacuca

SEQ ID NO: 464911 - RNA, 15 nt, Homo sapiens
guuuggacacacugg

SEQ ID NO: 464912 - RNA, 15 nt, Homo sapiens
guuuuaaucuccucu

SEQ ID NO: 464913 - RNA, 18 nt, Homo sapiens
guuuuauauguaguacua

SEQ ID NO: 464914 - RNA, 15 nt, Homo sapiens
uaaaaauaaccacuu

SEQ ID NO: 464915 - RNA, 16 nt, Homo sapiens
uaaaaugcugugucca

SEQ ID NO: 464916 - RNA, 17 nt, Homo sapiens
uaaacaaucucccaagu

SEQ ID NO: 464917 - RNA, 17 nt, Homo sapiens
uaaacuucauacaaugu

SEQ ID NO: 464918 - RNA, 21 nt, Homo sapiens
uaaagcaguguuuucaccuca

SEQ ID NO: 464919 - RNA, 13 nt, Homo sapiens
uaaagcugcugag

SEQ ID NO: 464920 - RNA, 19 nt, Homo sapiens
uaaaggaguagaauaccaa

SEQ ID NO: 464921 - RNA, 18 nt, Homo sapiens
uaaaugaaaaucuauccu

SEQ ID NO: 464922 - RNA, 12 nt, Homo sapiens
uaaaugugccua

SEQ ID NO: 464923 - RNA, 15 nt, Homo sapiens
uaacacguccacuuu

SEQ ID NO: 464924 - RNA, 16 nt, Homo sapiens
uaacaucuagcccuuu

SEQ ID NO: 464925 - RNA, 16 nt, Homo sapiens
uaacaugacacuuaga

SEQ ID NO: 464926 - RNA, 21 nt, Homo sapiens
uaacauuuuuauaaagauaua

SEQ ID NO: 464927 - RNA, 20 nt, Homo sapiens
uaaccaauuucuuucuaaaa

SEQ ID NO: 464928 - RNA, 22 nt, Homo sapiens
uaacuucucccaaaguguccua

SEQ ID NO: 464929 - RNA, 23 nt, Homo sapiens
uaaguaccccugauaagcaaauu

SEQ ID NO: 464930 - RNA, 17 nt, Homo sapiens
uaaguacuccauuguaa

SEQ ID NO: 464931 - RNA, 20 nt, Homo sapiens
uaaguauuucagaugcuuua

SEQ ID NO: 464932 - RNA, 14 nt, Homo sapiens
uaagucauguauau

SEQ ID NO: 464933 - RNA, 22 nt, Homo sapiens
uaauacauuaaauaugugaaau

SEQ ID NO: 464934 - RNA, 14 nt, Homo sapiens
uaauacuuccaaau

SEQ ID NO: 464935 - RNA, 13 nt, Homo sapiens
uaaucgugucuuc

SEQ ID NO: 464936 - RNA, 22 nt, Homo sapiens
uaauuaagcauuuugugauguu

SEQ ID NO: 464937 - RNA, 19 nt, Homo sapiens
uaauucuguauuaacugaa

SEQ ID NO: 464938 - RNA, 10 nt, Homo sapiens
uaauuucaaa

SEQ ID NO: 464939 - RNA, 19 nt, Homo sapiens
uaauuuuggguggggagaa

SEQ ID NO: 464940 - RNA, 20 nt, Homo sapiens
uacaaaaccaucauuucaac

SEQ ID NO: 464941 - RNA, 18 nt, Homo sapiens
uacaaacauucuaauuaa

SEQ ID NO: 464942 - RNA, 20 nt, Homo sapiens
uacaauauguauuuaugucu

SEQ ID NO: 464943 - RNA, 16 nt, Homo sapiens
uacacacgcacacagu

SEQ ID NO: 464944 - RNA, 14 nt, Homo sapiens
uacauaugcuuuaa

SEQ ID NO: 464945 - RNA, 13 nt, Homo sapiens
uacaucucagugc

SEQ ID NO: 464946 - RNA, 13 nt, Homo sapiens
uacuacauuauua

SEQ ID NO: 464947 - RNA, 13 nt, Homo sapiens
uacugcacuuaga

SEQ ID NO: 464948 - RNA, 19 nt, Homo sapiens
uacuucucgccaucagcuu

SEQ ID NO: 464949 - RNA, 23 nt, Homo sapiens
gccaagcuuucuucuacaaccag

SEQ ID NO: 464950 - RNA, 22 nt, Homo sapiens
gccacagaacguaggugugaca

SEQ ID NO: 464951 - RNA, 17 nt, Homo sapiens
gccagaacaagugcugg

SEQ ID NO: 464952 - RNA, 16 nt, Homo sapiens
gccagcccaacuguga

SEQ ID NO: 464953 - RNA, 18 nt, Homo sapiens
gccagcccaacugugaga

SEQ ID NO: 464954 - RNA, 18 nt, Homo sapiens
gccaggacacagacguac

SEQ ID NO: 464955 - RNA, 14 nt, Homo sapiens
gccaggagugggcu

SEQ ID NO: 464956 - RNA, 13 nt, Homo sapiens
gccagggcaccua

SEQ ID NO: 464957 - RNA, 11 nt, Homo sapiens
gccagugcaga

SEQ ID NO: 464958 - RNA, 16 nt, Homo sapiens
gccauuggaaagcaaa

SEQ ID NO: 464959 - RNA, 13 nt, Homo sapiens
gccauuucuuccc

SEQ ID NO: 464960 - RNA, 14 nt, Homo sapiens
gccauuucuuccca

SEQ ID NO: 464961 - RNA, 19 nt, Homo sapiens
gcccaggcuggagugcagu

SEQ ID NO: 464962 - RNA, 14 nt, Homo sapiens
gcccaugagucagg

SEQ ID NO: 464963 - RNA, 15 nt, Homo sapiens
gccccaucagcagcu

SEQ ID NO: 464964 - RNA, 17 nt, Homo sapiens
gcccccagcugugaccg

SEQ ID NO: 464965 - RNA, 22 nt, Homo sapiens
gcccucagggcagggauacaaa

SEQ ID NO: 464966 - RNA, 20 nt, Homo sapiens
gcccucauuuucccucagaa

SEQ ID NO: 464967 - RNA, 14 nt, Homo sapiens
gccucacuccucag

SEQ ID NO: 464968 - RNA, 22 nt, Homo sapiens
gccucacucuggccacagguga

SEQ ID NO: 464969 - RNA, 17 nt, Homo sapiens
gccucccaaagugcagg

SEQ ID NO: 464970 - RNA, 17 nt, Homo sapiens
gccucccaaagugcugg

SEQ ID NO: 464971 - RNA, 15 nt, Homo sapiens
gccuccccaccacug

SEQ ID NO: 464972 - RNA, 16 nt, Homo sapiens
gccucguacguguguu

SEQ ID NO: 464973 - RNA, 17 nt, Homo sapiens
gccugaugugagugugu

SEQ ID NO: 464974 - RNA, 14 nt, Homo sapiens
gccuguaaucccag

SEQ ID NO: 464975 - RNA, 16 nt, Homo sapiens
gccuguugacugcugg

SEQ ID NO: 464976 - RNA, 20 nt, Homo sapiens
gccuguuugccgucugugac

SEQ ID NO: 464977 - RNA, 17 nt, Homo sapiens
gccuuaagacauuugaa

SEQ ID NO: 464978 - RNA, 14 nt, Homo sapiens
gccuugaauuggga

SEQ ID NO: 464979 - RNA, 21 nt, Homo sapiens
gccuugguaaaaacugcagug

SEQ ID NO: 464980 - RNA, 15 nt, Homo sapiens
gccuuguaucuugca

SEQ ID NO: 464981 - RNA, 14 nt, Homo sapiens
gccuuuguugcuca

SEQ ID NO: 464982 - RNA, 15 nt, Homo sapiens
gccuuuguugcucag

SEQ ID NO: 464983 - RNA, 13 nt, Homo sapiens
gcgaguucugcca

SEQ ID NO: 464984 - RNA, 15 nt, Homo sapiens
gcucugcuaugagug

SEQ ID NO: 464985 - RNA, 18 nt, Homo sapiens
gcugaaugccuguuagca

SEQ ID NO: 464986 - RNA, 17 nt, Homo sapiens
gcugagcacagggcugu

SEQ ID NO: 464987 - RNA, 19 nt, Homo sapiens
gcugccccuggugcacugg

SEQ ID NO: 464988 - RNA, 18 nt, Homo sapiens
gcugcugagaaucuagcc

SEQ ID NO: 464989 - RNA, 23 nt, Homo sapiens
gcuggagugcaguaaguggcaca

SEQ ID NO: 464990 - RNA, 17 nt, Homo sapiens
gcuggcccugcaggugg

SEQ ID NO: 464991 - RNA, 23 nt, Homo sapiens
gcuguaucaaacuagugcaugaa

SEQ ID NO: 464992 - RNA, 22 nt, Homo sapiens
gcuguguccacggggugucaca

SEQ ID NO: 464993 - RNA, 22 nt, Homo sapiens
gcuguuccuuaauuugauuaau

SEQ ID NO: 464994 - RNA, 18 nt, Homo sapiens
gcuuccucuggccaggua

SEQ ID NO: 464995 - RNA, 21 nt, Homo sapiens
gcuuguuuucuacuuugccac

SEQ ID NO: 464996 - RNA, 16 nt, Homo sapiens
ggaagaugugugauaa

SEQ ID NO: 464997 - RNA, 21 nt, Homo sapiens
ggaauagaucguagauguugu

SEQ ID NO: 464998 - RNA, 16 nt, Homo sapiens
ggacaaacagugcacu

SEQ ID NO: 464999 - RNA, 21 nt, Homo sapiens
ggaccaauuagcauuccauca

SEQ ID NO: 465000 - RNA, 17 nt, Homo sapiens
ggaccugagaguggcua

SEQ ID NO: 465001 - RNA, 20 nt, Homo sapiens
ggaggcggagguugcaguga

SEQ ID NO: 465002 - RNA, 15 nt, Homo sapiens
ggaguucagcugcuu

SEQ ID NO: 465003 - RNA, 21 nt, Homo sapiens
ggauuacaggcaugagccacu

SEQ ID NO: 465004 - RNA, 18 nt, Homo sapiens
ggauuccucgaaacugcc

SEQ ID NO: 465005 - RNA, 17 nt, Homo sapiens
ggauugggagauuucau

SEQ ID NO: 465006 - RNA, 19 nt, Homo sapiens
ggcaccaugugugccuuug

SEQ ID NO: 465007 - RNA, 22 nt, Homo sapiens
ggcagagacaauaaaacauucc

SEQ ID NO: 465008 - RNA, 20 nt, Homo sapiens
ggcagcagaggcuccucuga

SEQ ID NO: 465009 - RNA, 16 nt, Homo sapiens
ggcagcaggaugcuca

SEQ ID NO: 465010 - RNA, 21 nt, Homo sapiens
ggcagccuccugcucugugaa

SEQ ID NO: 465011 - RNA, 22 nt, Homo sapiens
ggcagggccuuugucugucuca

SEQ ID NO: 465012 - RNA, 15 nt, Homo sapiens
ggcaucauugugacg

SEQ ID NO: 465013 - RNA, 20 nt, Homo sapiens
ggcccaggcuggagugcagu

SEQ ID NO: 465014 - RNA, 16 nt, Homo sapiens
ggccucagaccaacuc

SEQ ID NO: 465015 - RNA, 20 nt, Homo sapiens
ggccuccccagccaggcugc

SEQ ID NO: 465016 - RNA, 20 nt, Homo sapiens
ggccugccuggcaggugugc

SEQ ID NO: 465017 - RNA, 16 nt, Homo sapiens
ggccuuccagugcagg

SEQ ID NO: 465018 - RNA, 20 nt, Homo sapiens
ggccuuucuucuaagagaua

SEQ ID NO: 465019 - RNA, 21 nt, Homo sapiens
ggcgguccuacugcugugagc

SEQ ID NO: 465020 - RNA, 19 nt, Homo sapiens
ggcuggacuuuugcagcuu

SEQ ID NO: 465021 - RNA, 15 nt, Homo sapiens
ggcuggagugcagug

SEQ ID NO: 465022 - RNA, 20 nt, Homo sapiens
ggcuggagugcaguggcacg

SEQ ID NO: 465023 - RNA, 23 nt, Homo sapiens
ggcuggguccccuucgcaguguu

SEQ ID NO: 465024 - RNA, 15 nt, Homo sapiens
gggaccuauaucuca

SEQ ID NO: 465025 - RNA, 13 nt, Homo sapiens
gggauuacaggca

SEQ ID NO: 465026 - RNA, 16 nt, Homo sapiens
gggcccacccauguca

SEQ ID NO: 465027 - RNA, 11 nt, Homo sapiens
ggggucuugca

SEQ ID NO: 465028 - RNA, 18 nt, Homo sapiens
ggguggcacucucaggug

SEQ ID NO: 465029 - RNA, 20 nt, Homo sapiens
gguaauaucaucuugaaaag

SEQ ID NO: 465030 - RNA, 20 nt, Homo sapiens
gguacugugaggaagagcag

SEQ ID NO: 465031 - RNA, 23 nt, Homo sapiens
gguuagaaucccauggauguuuc

SEQ ID NO: 465032 - RNA, 20 nt, Homo sapiens
guaaaaacugcagugucuuu

SEQ ID NO: 465033 - RNA, 23 nt, Homo sapiens
guaaagccucagcaacagccagu

SEQ ID NO: 465034 - RNA, 17 nt, Homo sapiens
guaaccaagaguauucc

SEQ ID NO: 465035 - RNA, 18 nt, Homo sapiens
guaaccaagaguauucca

SEQ ID NO: 465036 - RNA, 12 nt, Homo sapiens
guaacucagugu

SEQ ID NO: 465037 - RNA, 18 nt, Homo sapiens
guaagaguucacauggaa

SEQ ID NO: 465038 - RNA, 13 nt, Homo sapiens
guaaggagcacca

SEQ ID NO: 465039 - RNA, 17 nt, Homo sapiens
guaaucccagcuacuca

SEQ ID NO: 465040 - RNA, 18 nt, Homo sapiens
guaaucccagcuacucag

SEQ ID NO: 465041 - RNA, 20 nt, Homo sapiens
guacacacucagugacauuu

SEQ ID NO: 465042 - RNA, 16 nt, Homo sapiens
guacccagagaccaag

SEQ ID NO: 465043 - RNA, 18 nt, Homo sapiens
guaccccugauaagcaaa

SEQ ID NO: 465044 - RNA, 19 nt, Homo sapiens
guagaguaaaaugcugugu

SEQ ID NO: 465045 - RNA, 13 nt, Homo sapiens
guagcggcccuga

SEQ ID NO: 465046 - RNA, 13 nt, Homo sapiens
guagggcgcugca

SEQ ID NO: 465047 - RNA, 11 nt, Homo sapiens
guauccaaaaa

SEQ ID NO: 465048 - RNA, 16 nt, Homo sapiens
guauuuuuaguagaga

SEQ ID NO: 465049 - RNA, 18 nt, Homo sapiens
gucaaauuuggauuuucc

SEQ ID NO: 465050 - RNA, 17 nt, Homo sapiens
gucaacgugagcuggug

SEQ ID NO: 465051 - RNA, 22 nt, Homo sapiens
gucacccaggcuggagugcagu

SEQ ID NO: 465052 - RNA, 18 nt, Homo sapiens
gucagcccugcugucaga

SEQ ID NO: 465053 - RNA, 21 nt, Homo sapiens
gucccuucucccaucaggguc

SEQ ID NO: 465054 - RNA, 15 nt, Homo sapiens
gucucgaacuccuga

SEQ ID NO: 465055 - RNA, 15 nt, Homo sapiens
gucucuauacuacau

SEQ ID NO: 465056 - RNA, 14 nt, Homo sapiens
gucugucccaaaga

SEQ ID NO: 465057 - RNA, 15 nt, Homo sapiens
gucugugauugccau

SEQ ID NO: 465058 - RNA, 18 nt, Homo sapiens
gucuuacucuuuguauga

SEQ ID NO: 465059 - RNA, 20 nt, Homo sapiens
ccucccgaguagcugggauu

SEQ ID NO: 465060 - RNA, 21 nt, Homo sapiens
ccuccgaaguagcugggauua

SEQ ID NO: 465061 - RNA, 13 nt, Homo sapiens
ccucgaaacugcc

SEQ ID NO: 465062 - RNA, 21 nt, Homo sapiens
ccucucacuaaguaugaucua

SEQ ID NO: 465063 - RNA, 20 nt, Homo sapiens
ccugaauugagaauuuugau

SEQ ID NO: 465064 - RNA, 19 nt, Homo sapiens
ccugaccaacauggugaaa

SEQ ID NO: 465065 - RNA, 17 nt, Homo sapiens
ccugaccucaggugauc

SEQ ID NO: 465066 - RNA, 17 nt, Homo sapiens
ccugaccucaggugaug

SEQ ID NO: 465067 - RNA, 17 nt, Homo sapiens
ccugaucacuaugcauu

SEQ ID NO: 465068 - RNA, 15 nt, Homo sapiens
ccuggccuaggcagu

SEQ ID NO: 465069 - RNA, 13 nt, Homo sapiens
ccuuccagugcag

SEQ ID NO: 465070 - RNA, 20 nt, Homo sapiens
ccuuccuucuugcuucucau

SEQ ID NO: 465071 - RNA, 12 nt, Homo sapiens
ccuucucaaaag

SEQ ID NO: 465072 - RNA, 17 nt, Homo sapiens
ccuucugugcugugagu

SEQ ID NO: 465073 - RNA, 13 nt, Homo sapiens
ccuuuccaaaaac

SEQ ID NO: 465074 - RNA, 21 nt, Homo sapiens
ccuuuggcaauucuucuucuc

SEQ ID NO: 465075 - RNA, 13 nt, Homo sapiens
cgaacuccugacc

SEQ ID NO: 465076 - RNA, 20 nt, Homo sapiens
cgaacuccugaccucaggug

SEQ ID NO: 465077 - RNA, 18 nt, Homo sapiens
cgaaguagcugggauuac

SEQ ID NO: 465078 - RNA, 12 nt, Homo sapiens
cgagaaacacag

SEQ ID NO: 465079 - RNA, 17 nt, Homo sapiens
cgaggagugacugccaa

SEQ ID NO: 465080 - RNA, 17 nt, Homo sapiens
cgagugugccucaggga

SEQ ID NO: 465081 - RNA, 15 nt, Homo sapiens
cgcagacagugcaca

SEQ ID NO: 465082 - RNA, 17 nt, Homo sapiens
cgcagcauuggugcuca

SEQ ID NO: 465083 - RNA, 22 nt, Homo sapiens
cgccccaaucccucaggauucc

SEQ ID NO: 465084 - RNA, 20 nt, Homo sapiens
cgcugcgucugcacugauga

SEQ ID NO: 465085 - RNA, 21 nt, Homo sapiens
cgcugugugguaacucagugu

SEQ ID NO: 465086 - RNA, 12 nt, Homo sapiens
cggagcacuuuc

SEQ ID NO: 465087 - RNA, 13 nt, Homo sapiens
cggagcucagugc

SEQ ID NO: 465088 - RNA, 20 nt, Homo sapiens
cggcagcugguucugcaaug

SEQ ID NO: 465089 - RNA, 15 nt, Homo sapiens
cggcgugugcagugc

SEQ ID NO: 465090 - RNA, 21 nt, Homo sapiens
cgggcgguccuacugcuguga

SEQ ID NO: 465091 - RNA, 14 nt, Homo sapiens
cggucagugccuuu

SEQ ID NO: 465092 - RNA, 19 nt, Homo sapiens
cuaaaaguuuuaaccucag

SEQ ID NO: 465093 - RNA, 22 nt, Homo sapiens
cuaaccauagcugaccuuugua

SEQ ID NO: 465094 - RNA, 12 nt, Homo sapiens
cuaagagaucug

SEQ ID NO: 465095 - RNA, 22 nt, Homo sapiens
cuaaguuaaauauuucugcaca

SEQ ID NO: 465096 - RNA, 15 nt, Homo sapiens
cuaauuaaucacaaa

SEQ ID NO: 465097 - RNA, 11 nt, Homo sapiens
cuacuucucac

SEQ ID NO: 465098 - RNA, 20 nt, Homo sapiens
cuagacguuguaaugcacac

SEQ ID NO: 465099 - RNA, 14 nt, Homo sapiens
cuauacuacauuau

SEQ ID NO: 465100 - RNA, 23 nt, Homo sapiens
cuaugaguguaguugaugacugu

SEQ ID NO: 465101 - RNA, 20 nt, Homo sapiens
cucaaaccaacucaguggug

SEQ ID NO: 465102 - RNA, 22 nt, Homo sapiens
cucacacuguaagaguucacau

SEQ ID NO: 465103 - RNA, 17 nt, Homo sapiens
cucacugccagugcaga

SEQ ID NO: 465104 - RNA, 17 nt, Homo sapiens
cucagcacucugcagug

SEQ ID NO: 465105 - RNA, 15 nt, Homo sapiens
cucagugcugucuug

SEQ ID NO: 465106 - RNA, 21 nt, Homo sapiens
cucauccaaaaagucugagcg

SEQ ID NO: 465107 - RNA, 20 nt, Homo sapiens
ucagccucccaaagugcagg

SEQ ID NO: 465108 - RNA, 19 nt, Homo sapiens
ucaggugaagcuggagcuc

SEQ ID NO: 465109 - RNA, 20 nt, Homo sapiens
ucagucaucuccaaaaacag

SEQ ID NO: 465110 - RNA, 12 nt, Homo sapiens
ucauaaacuaua

SEQ ID NO: 465111 - RNA, 18 nt, Homo sapiens
ucaucaauucucuaucau

SEQ ID NO: 465112 - RNA, 17 nt, Homo sapiens
ucaucucuguauuccca

SEQ ID NO: 465113 - RNA, 21 nt, Homo sapiens
ucauguaaauaaauacauucu

SEQ ID NO: 465114 - RNA, 12 nt, Homo sapiens
ucauguuccuua

SEQ ID NO: 465115 - RNA, 22 nt, Homo sapiens
ucauuuuauggaagauguguga

SEQ ID NO: 465116 - RNA, 22 nt, Homo sapiens
uccaaaaacaguaaaaauaacc

SEQ ID NO: 465117 - RNA, 16 nt, Homo sapiens
uccaaucuccaucacc

SEQ ID NO: 465118 - RNA, 16 nt, Homo sapiens
uccaccaaauucugaa

SEQ ID NO: 465119 - RNA, 18 nt, Homo sapiens
uccagcuucccuuugauu

SEQ ID NO: 465120 - RNA, 22 nt, Homo sapiens
uccagugggaggugagaccacc

SEQ ID NO: 465121 - RNA, 17 nt, Homo sapiens
uccaugacugcauuuua

SEQ ID NO: 465122 - RNA, 20 nt, Homo sapiens
uccauguuugauguaucuga

SEQ ID NO: 465123 - RNA, 10 nt, Homo sapiens
ucccaaagaa

SEQ ID NO: 465124 - RNA, 14 nt, Homo sapiens
ucccaaaguguccu

SEQ ID NO: 465125 - RNA, 17 nt, Homo sapiens
ucccauagugugcauca

SEQ ID NO: 465126 - RNA, 21 nt, Homo sapiens
ucccauggccccuugcauuuc

SEQ ID NO: 465127 - RNA, 22 nt, Homo sapiens
ucccggcuggacuuuugcagcu

SEQ ID NO: 465128 - RNA, 17 nt, Homo sapiens
uccgaaguagcugggau

SEQ ID NO: 465129 - RNA, 16 nt, Homo sapiens
uccgguuauucacuug

SEQ ID NO: 465130 - RNA, 13 nt, Homo sapiens
uccgucacauuca

SEQ ID NO: 465131 - RNA, 15 nt, Homo sapiens
uccuacugcugugag

SEQ ID NO: 465132 - RNA, 15 nt, Homo sapiens
uccuacuuuacauau

SEQ ID NO: 465133 - RNA, 21 nt, Homo sapiens
uccuacuuuacauaugcuuua

SEQ ID NO: 465134 - RNA, 19 nt, Homo sapiens
uccuccaucauuaauguga

SEQ ID NO: 465135 - RNA, 14 nt, Homo sapiens
uccucuguccucau

SEQ ID NO: 465136 - RNA, 11 nt, Homo sapiens
uccugugaaag

SEQ ID NO: 465137 - RNA, 16 nt, Homo sapiens
uccuugauggcuggau

SEQ ID NO: 465138 - RNA, 21 nt, Homo sapiens
uccuuuccugaucacuaugca

SEQ ID NO: 465139 - RNA, 18 nt, Homo sapiens
uccuuuuaggaauacugg

SEQ ID NO: 465140 - RNA, 13 nt, Homo sapiens
uccuuuucuauua

SEQ ID NO: 465141 - RNA, 18 nt, Homo sapiens
uccuuuucuauuaagaua

SEQ ID NO: 465142 - RNA, 16 nt, Homo sapiens
uccuuuuugcaguaua

SEQ ID NO: 465143 - RNA, 15 nt, Homo sapiens
ucgaaacugccauug

SEQ ID NO: 465144 - RNA, 20 nt, Homo sapiens
ucgaacuccugaccucaggu

SEQ ID NO: 465145 - RNA, 17 nt, Homo sapiens
ucggugcagaaacuacc

SEQ ID NO: 465146 - RNA, 15 nt, Homo sapiens
ucuaacaucuagccc

SEQ ID NO: 465147 - RNA, 15 nt, Homo sapiens
ucuaggccagguaug

SEQ ID NO: 465148 - RNA, 15 nt, Homo sapiens
ucuauuaaauguaua

SEQ ID NO: 465149 - RNA, 20 nt, Homo sapiens
ucucaaacuccugaccucag

SEQ ID NO: 465150 - RNA, 17 nt, Homo sapiens
ucucagcgccgucgcca

SEQ ID NO: 465151 - RNA, 13 nt, Homo sapiens
ucuccaucaccuu

SEQ ID NO: 465152 - RNA, 22 nt, Homo sapiens
ucuccauguuugauguaucuga

SEQ ID NO: 465153 - RNA, 16 nt, Homo sapiens
ucuccugauuauuuau

SEQ ID NO: 465154 - RNA, 12 nt, Homo sapiens
ucucucacauua

SEQ ID NO: 465155 - RNA, 15 nt, Homo sapiens
ucugagcccagcuca

SEQ ID NO: 465156 - RNA, 22 nt, Homo sapiens
ucugagcgaggagugacugcca

SEQ ID NO: 465157 - RNA, 22 nt, Homo sapiens
ucugcacaguguucccauggcc

SEQ ID NO: 465158 - RNA, 15 nt, Homo sapiens
ucugcuggucuucaa

SEQ ID NO: 465159 - RNA, 20 nt, Homo sapiens
ucugguugguaaagccucag

SEQ ID NO: 465160 - RNA, 15 nt, Homo sapiens
ucuguacugcacuua

SEQ ID NO: 465161 - RNA, 18 nt, Homo sapiens
ucugucccacugcugcuu

SEQ ID NO: 465162 - RNA, 14 nt, Homo sapiens
ucugugauugccau

SEQ ID NO: 465163 - RNA, 13 nt, Homo sapiens
ucugugcugugag

SEQ ID NO: 465164 - RNA, 18 nt, Homo sapiens
ucuguguacauguacaga

SEQ ID NO: 465165 - RNA, 14 nt, Homo sapiens
ucuuauccuuugua

SEQ ID NO: 465166 - RNA, 22 nt, Homo sapiens
ucuuccaaucuccaucaccuuu

SEQ ID NO: 465167 - RNA, 16 nt, Homo sapiens
ucuucuacaaccagag

SEQ ID NO: 465168 - RNA, 12 nt, Homo sapiens
ucuucucaagca

SEQ ID NO: 465169 - RNA, 21 nt, Homo sapiens
ucuucuucucaagcacugaca

SEQ ID NO: 465170 - RNA, 23 nt, Homo sapiens
ucuugaauauguauuaaaauauc

SEQ ID NO: 465171 - RNA, 21 nt, Homo sapiens
ucuugauccuaugaguguagu

SEQ ID NO: 465172 - RNA, 14 nt, Homo sapiens
aggcaccagcagca

SEQ ID NO: 465173 - RNA, 18 nt, Homo sapiens
aggcauugagacuucaag

SEQ ID NO: 465174 - RNA, 19 nt, Homo sapiens
aggcgcccgccaccaugcc

SEQ ID NO: 465175 - RNA, 20 nt, Homo sapiens
aggcggcggcggaggggcug

SEQ ID NO: 465176 - RNA, 16 nt, Homo sapiens
aggcuggagugcagug

SEQ ID NO: 465177 - RNA, 20 nt, Homo sapiens
aggcuggagugcaguggcac

SEQ ID NO: 465178 - RNA, 13 nt, Homo sapiens
agggaccuaggca

SEQ ID NO: 465179 - RNA, 23 nt, Homo sapiens
agggagcgccuccccaccacuga

SEQ ID NO: 465180 - RNA, 17 nt, Homo sapiens
aggguaauugcugaggu

SEQ ID NO: 465181 - RNA, 15 nt, Homo sapiens
aggguugccuuggca

SEQ ID NO: 465182 - RNA, 15 nt, Homo sapiens
agguauaugugauaa

SEQ ID NO: 465183 - RNA, 21 nt, Homo sapiens
aggucauguuguaguuuaaau

SEQ ID NO: 465184 - RNA, 20 nt, Homo sapiens
aggugauccacccgccucag

SEQ ID NO: 465185 - RNA, 20 nt, Homo sapiens
aggugaugcacccaccucag

SEQ ID NO: 465186 - RNA, 16 nt, Homo sapiens
agguucuuaucaacau

SEQ ID NO: 465187 - RNA, 21 nt, Homo sapiens
agguuguucuagggacaggcc

SEQ ID NO: 465188 - RNA, 19 nt, Homo sapiens
aguacagagccaugacuca

SEQ ID NO: 465189 - RNA, 20 nt, Homo sapiens
agucaaauuuggauuuucca

SEQ ID NO: 465190 - RNA, 17 nt, Homo sapiens
agucugcuuagagcaca

SEQ ID NO: 465191 - RNA, 13 nt, Homo sapiens
agugacauuucua

SEQ ID NO: 465192 - RNA, 12 nt, Homo sapiens
agugacuuugca

SEQ ID NO: 465193 - RNA, 22 nt, Homo sapiens
agugauuuccuguauaauuuaa

SEQ ID NO: 465194 - RNA, 12 nt, Homo sapiens
agugcagggauu

SEQ ID NO: 465195 - RNA, 16 nt, Homo sapiens
agugcaguggugcaau

SEQ ID NO: 465196 - RNA, 19 nt, Homo sapiens
agugcugggauuacaggcg

SEQ ID NO: 465197 - RNA, 20 nt, Homo sapiens
aguggcacaaucucggcuca

SEQ ID NO: 465198 - RNA, 20 nt, Homo sapiens
aguggcacgaucucagcuca

SEQ ID NO: 465199 - RNA, 22 nt, Homo sapiens
aguggucaauguagauuucaag

SEQ ID NO: 465200 - RNA, 22 nt, Homo sapiens
aguuauucuugacaugagaaaa

SEQ ID NO: 465201 - RNA, 13 nt, Homo sapiens
aguugaugacugu

SEQ ID NO: 465202 - RNA, 22 nt, Homo sapiens
aguugcuugauuuuaguggcuc

SEQ ID NO: 465203 - RNA, 16 nt, Homo sapiens
aguugggggcugucca

SEQ ID NO: 465204 - RNA, 19 nt, Homo sapiens
aguuguugcuuauacuguu

SEQ ID NO: 465205 - RNA, 18 nt, Homo sapiens
aguuucauuuaugauaca

SEQ ID NO: 465206 - RNA, 20 nt, Homo sapiens
aguuucauuuaugauacaaa

SEQ ID NO: 465207 - RNA, 21 nt, Homo sapiens
aguuuuccgagaggaccaucu

SEQ ID NO: 465208 - RNA, 22 nt, Homo sapiens
auaaaaugguguuuucauguaa

SEQ ID NO: 465209 - RNA, 15 nt, Homo sapiens
auaaacaaucuccca

SEQ ID NO: 465210 - RNA, 20 nt, Homo sapiens
auaaacuauauucugugaca

SEQ ID NO: 465211 - RNA, 15 nt, Homo sapiens
auaaaugaaaaucua

SEQ ID NO: 465212 - RNA, 13 nt, Homo sapiens
auaauacuuccaa

SEQ ID NO: 465213 - RNA, 15 nt, Homo sapiens
auacauuugauaaag

SEQ ID NO: 465214 - RNA, 15 nt, Homo sapiens
auacugggugcuguc

SEQ ID NO: 465215 - RNA, 19 nt, Homo sapiens
auacugggugcugucacca

SEQ ID NO: 465216 - RNA, 21 nt, Homo sapiens
auacuguugucagguacagua

SEQ ID NO: 465217 - RNA, 16 nt, Homo sapiens
auagucuuuugccaga

SEQ ID NO: 465218 - RNA, 14 nt, Homo sapiens
auauauuuuaucuc

SEQ ID NO: 465219 - RNA, 23 nt, Homo sapiens
auauguuucucccccuuuccaaa

SEQ ID NO: 465220 - RNA, 15 nt, Homo sapiens
auauuaaguaaaaaa

SEQ ID NO: 465221 - RNA, 19 nt, Homo sapiens
auauucaguauuguagaua

SEQ ID NO: 465222 - RNA, 12 nt, Homo sapiens
auauuucugcac

SEQ ID NO: 465223 - RNA, 22 nt, Homo sapiens
auauuuuaggacuuuuugucaa

SEQ ID NO: 465224 - RNA, 20 nt, Homo sapiens
aucaacccaauaauucugua

SEQ ID NO: 465225 - RNA, 13 nt, Homo sapiens
aucauaaugccau

SEQ ID NO: 465226 - RNA, 19 nt, Homo sapiens
aucaucguacacacucagu

SEQ ID NO: 465227 - RNA, 20 nt, Homo sapiens
auccaaaaauagcccugcaa

SEQ ID NO: 465228 - RNA, 18 nt, Homo sapiens
aucguacacacucaguga

SEQ ID NO: 465229 - RNA, 16 nt, Homo sapiens
aucugucucauccaaa

SEQ ID NO: 465230 - RNA, 18 nt, Homo sapiens
aucuguucagucaucucc

SEQ ID NO: 465231 - RNA, 22 nt, Homo sapiens
aucuucuuuauaauucuacuuu

SEQ ID NO: 465232 - RNA, 15 nt, Homo sapiens
aucuuguacagccuu

SEQ ID NO: 465233 - RNA, 22 nt, Homo sapiens
augaaaaaacggucugccggug

SEQ ID NO: 465234 - RNA, 16 nt, Homo sapiens
augaaacauuuuguca

SEQ ID NO: 465235 - RNA, 17 nt, Homo sapiens
augaaaugacugucuaa

SEQ ID NO: 465236 - RNA, 23 nt, Homo sapiens
augacacccacucuccugugaga

SEQ ID NO: 465237 - RNA, 15 nt, Homo sapiens
augacugcagggcug

SEQ ID NO: 465238 - RNA, 15 nt, Homo sapiens
augacugcauuuuac

SEQ ID NO: 465239 - RNA, 20 nt, Homo sapiens
augacugcauuuuacuguac

SEQ ID NO: 465240 - RNA, 15 nt, Homo sapiens
augagauguaugccc

SEQ ID NO: 465241 - RNA, 22 nt, Homo sapiens
augaucgcuuucuacacuguau

SEQ ID NO: 465242 - RNA, 16 nt, Homo sapiens
augauguaaaaaauac

SEQ ID NO: 465243 - RNA, 16 nt, Homo sapiens
augcacccaccucagc

SEQ ID NO: 465244 - RNA, 12 nt, Homo sapiens
augcaguuucau

SEQ ID NO: 465245 - RNA, 23 nt, Homo sapiens
augccaauaacacguccacuuuc

SEQ ID NO: 465246 - RNA, 19 nt, Homo sapiens
augccgggccaugauucuu

SEQ ID NO: 465247 - RNA, 20 nt, Homo sapiens
augcugaccauccaggcaua

SEQ ID NO: 465248 - RNA, 20 nt, Homo sapiens
augcugggauuacaggcgua

SEQ ID NO: 465249 - RNA, 18 nt, Homo sapiens
augcuguguccacggggu

SEQ ID NO: 465250 - RNA, 18 nt, Homo sapiens
augcuguuaaaacuacuu

SEQ ID NO: 465251 - RNA, 15 nt, Homo sapiens
auggaaccauuuuag

SEQ ID NO: 465252 - RNA, 18 nt, Homo sapiens
auggacaugaucuucuuu

SEQ ID NO: 465253 - RNA, 22 nt, Homo sapiens
auggguaucuaauaaauacuua

SEQ ID NO: 465254 - RNA, 15 nt, Homo sapiens
auggugugugugucc

SEQ ID NO: 465255 - RNA, 20 nt, Homo sapiens
auguuucucccccuuuccaa

SEQ ID NO: 465256 - RNA, 14 nt, Homo sapiens
auguuuuaaucucc

SEQ ID NO: 465257 - RNA, 19 nt, Homo sapiens
auuaaacaccugacacauc

SEQ ID NO: 465258 - RNA, 12 nt, Homo sapiens
auuaaacuacuu

SEQ ID NO: 465259 - RNA, 14 nt, Homo sapiens
auuaaauccaauaa

SEQ ID NO: 465260 - RNA, 21 nt, Homo sapiens
auuaauaaacaaucucccaag

SEQ ID NO: 465261 - RNA, 23 nt, Homo sapiens
auuaauugguuugugccuuacau

SEQ ID NO: 465262 - RNA, 16 nt, Homo sapiens
auuacaggcaugagcc

SEQ ID NO: 465263 - RNA, 15 nt, Homo sapiens
auuaccgucugugau

SEQ ID NO: 465264 - RNA, 13 nt, Homo sapiens
auuagcauuccau

SEQ ID NO: 465265 - RNA, 13 nt, Homo sapiens
auuauuuacugaa

SEQ ID NO: 465266 - RNA, 14 nt, Homo sapiens
auuauuuaucacau

SEQ ID NO: 465267 - RNA, 15 nt, Homo sapiens
auuauuuccccuuca

SEQ ID NO: 465268 - RNA, 16 nt, Homo sapiens
auucaacccauuuacu

SEQ ID NO: 465269 - RNA, 17 nt, Homo sapiens
auucauauuuacuucuu

SEQ ID NO: 465270 - RNA, 22 nt, Homo sapiens
auucauauuuacuucuuauaca

SEQ ID NO: 465271 - RNA, 14 nt, Homo sapiens
auuccaggaugcug

SEQ ID NO: 465272 - RNA, 21 nt, Homo sapiens
auuccugcagggacggagcug

SEQ ID NO: 465273 - RNA, 14 nt, Homo sapiens
auucggagugucug

SEQ ID NO: 465274 - RNA, 16 nt, Homo sapiens
auugccagcucuucca

SEQ ID NO: 465275 - RNA, 15 nt, Homo sapiens
auugcuguuccuuaa

SEQ ID NO: 465276 - RNA, 15 nt, Homo sapiens
auuggcaucagcuga

SEQ ID NO: 465277 - RNA, 16 nt, Homo sapiens
auuguuuuaagccaau

SEQ ID NO: 465278 - RNA, 16 nt, Homo sapiens
auuguuuuauguucua

SEQ ID NO: 465279 - RNA, 15 nt, Homo sapiens
auuuaauccgucaca

SEQ ID NO: 465280 - RNA, 15 nt, Homo sapiens
auuucacugacacug

SEQ ID NO: 465281 - RNA, 22 nt, Homo sapiens
auuucauguaaccaagaguauu

SEQ ID NO: 465282 - RNA, 19 nt, Homo sapiens
auuugaacucuucaaucuc

SEQ ID NO: 465283 - RNA, 17 nt, Homo sapiens
auuuuccuguguccaca

SEQ ID NO: 465284 - RNA, 19 nt, Homo sapiens
auuuuccuucuucagcuca

SEQ ID NO: 465285 - RNA, 20 nt, Homo sapiens
auuuuucacuuaaguugaga

SEQ ID NO: 465286 - RNA, 14 nt, Homo sapiens
auuuuuuucccaag

SEQ ID NO: 465287 - RNA, 10 nt, Homo sapiens
caaaagggga

SEQ ID NO: 465288 - RNA, 13 nt, Homo sapiens
caaaauaccagcu

SEQ ID NO: 465289 - RNA, 20 nt, Homo sapiens
caaacagccucacuccucag

SEQ ID NO: 465290 - RNA, 12 nt, Homo sapiens
caaacagugcac

SEQ ID NO: 465291 - RNA, 15 nt, Homo sapiens
caaacuccugaccuc

SEQ ID NO: 465292 - RNA, 18 nt, Homo sapiens
caaagugcugggauuaca

SEQ ID NO: 465293 - RNA, 19 nt, Homo sapiens
caaagugcugggauuacag

SEQ ID NO: 465294 - RNA, 15 nt, Homo sapiens
caaauacaucuccag

SEQ ID NO: 465295 - RNA, 22 nt, Homo sapiens
caaaucaccaccgacugaagug

SEQ ID NO: 465296 - RNA, 14 nt, Homo sapiens
caaaugacugucag

SEQ ID NO: 465297 - RNA, 19 nt, Homo sapiens
caaccuccgccucccaggu

SEQ ID NO: 465298 - RNA, 17 nt, Homo sapiens
caacuuauaauuacaau

SEQ ID NO: 465299 - RNA, 19 nt, Homo sapiens
caacuuguguucuauuaau

SEQ ID NO: 465300 - RNA, 16 nt, Homo sapiens
caagagguuaggugaa

SEQ ID NO: 465301 - RNA, 13 nt, Homo sapiens
caagaguauucca

SEQ ID NO: 465302 - RNA, 12 nt, Homo sapiens
caagcacugaca

SEQ ID NO: 465303 - RNA, 15 nt, Homo sapiens
caagcccacagauga

SEQ ID NO: 465304 - RNA, 16 nt, Homo sapiens
caaggagacugcauuc

SEQ ID NO: 465305 - RNA, 21 nt, Homo sapiens
caaguuaaugcaaaugacugu

SEQ ID NO: 465306 - RNA, 14 nt, Homo sapiens
caauaaaacauucc

SEQ ID NO: 465307 - RNA, 15 nt, Homo sapiens
caauaaaacauuccu

SEQ ID NO: 465308 - RNA, 16 nt, Homo sapiens
caauaaaacauuccug

SEQ ID NO: 465309 - RNA, 16 nt, Homo sapiens
caauaauucuguauua

SEQ ID NO: 465310 - RNA, 13 nt, Homo sapiens
caaucuccaucac

SEQ ID NO: 465311 - RNA, 14 nt, Homo sapiens
caaucugugucaug

SEQ ID NO: 465312 - RNA, 11 nt, Homo sapiens
caaucuuggcu

SEQ ID NO: 465313 - RNA, 18 nt, Homo sapiens
caauuaaguccuacuuua

SEQ ID NO: 465314 - RNA, 15 nt, Homo sapiens
caauucuucuucuca

SEQ ID NO: 465315 - RNA, 23 nt, Homo sapiens
cacacaagcagucuuuuucuaca

SEQ ID NO: 465316 - RNA, 23 nt, Homo sapiens
cacacagugucuguguacaugua

SEQ ID NO: 465317 - RNA, 20 nt, Homo sapiens
cacacaucaguaauguauuc

SEQ ID NO: 465318 - RNA, 21 nt, Homo sapiens
cacacuggagaaaaggcagua

SEQ ID NO: 465319 - RNA, 13 nt, Homo sapiens
cacacuugcauga

SEQ ID NO: 465320 - RNA, 16 nt, Homo sapiens
cacagcaaaugagaug

SEQ ID NO: 465321 - RNA, 19 nt, Homo sapiens
cacagugucuguguacaug

SEQ ID NO: 465322 - RNA, 15 nt, Homo sapiens
caccacaccaggcug

SEQ ID NO: 465323 - RNA, 16 nt, Homo sapiens
caccaccgacugaagu

SEQ ID NO: 465324 - RNA, 21 nt, Homo sapiens
caccaccgacugaagugugug

SEQ ID NO: 465325 - RNA, 20 nt, Homo sapiens
caccauggauuucagaggag

SEQ ID NO: 465326 - RNA, 18 nt, Homo sapiens
cacccaggcuggagugca

SEQ ID NO: 465327 - RNA, 14 nt, Homo sapiens
caccuccugcaaua

SEQ ID NO: 465328 - RNA, 14 nt, Homo sapiens
caccugaagugaga

SEQ ID NO: 465329 - RNA, 19 nt, Homo sapiens
cacucugcucucaggagau

SEQ ID NO: 465330 - RNA, 21 nt, Homo sapiens
cacugacacugcgaacucuca

SEQ ID NO: 465331 - RNA, 12 nt, Homo sapiens
cacugacuggaa

SEQ ID NO: 465332 - RNA, 12 nt, Homo sapiens
cacugcaucucu

SEQ ID NO: 465333 - RNA, 15 nt, Homo sapiens
cacugccagugcaga

SEQ ID NO: 465334 - RNA, 18 nt, Homo sapiens
cacuggagaaaaggcagu

SEQ ID NO: 465335 - RNA, 12 nt, Homo sapiens
cacuugccccag

SEQ ID NO: 465336 - RNA, 19 nt, Homo sapiens
cagaaacuaccagauuuga

SEQ ID NO: 465337 - RNA, 15 nt, Homo sapiens
cagaacacuggauuu

SEQ ID NO: 465338 - RNA, 18 nt, Homo sapiens
cagaauggggaauggaga

SEQ ID NO: 465339 - RNA, 20 nt, Homo sapiens
cagagacaauaaaacauucc

SEQ ID NO: 465340 - RNA, 15 nt, Homo sapiens
cagagccaugacuca

SEQ ID NO: 465341 - RNA, 21 nt, Homo sapiens
aaugucaagguucccucccac

SEQ ID NO: 465342 - RNA, 18 nt, Homo sapiens
aaugugggaagaaacaaa

SEQ ID NO: 465343 - RNA, 20 nt, Homo sapiens
aauguuuuaaucuccucuga

SEQ ID NO: 465344 - RNA, 23 nt, Homo sapiens
aauuaagugaaaggucacacuac

SEQ ID NO: 465345 - RNA, 16 nt, Homo sapiens
aauuaguaauugucaa

SEQ ID NO: 465346 - RNA, 18 nt, Homo sapiens
aauucaaguuaaugcaaa

SEQ ID NO: 465347 - RNA, 20 nt, Homo sapiens
aauucauguauuaugauuaa

SEQ ID NO: 465348 - RNA, 13 nt, Homo sapiens
aauucucuaucau

SEQ ID NO: 465349 - RNA, 17 nt, Homo sapiens
aauugacugggccucau

SEQ ID NO: 465350 - RNA, 16 nt, Homo sapiens
aauuguauuucaaaaa

SEQ ID NO: 465351 - RNA, 18 nt, Homo sapiens
aauuucuuucuaaaacac

SEQ ID NO: 465352 - RNA, 16 nt, Homo sapiens
aauuuggauuuuccac

SEQ ID NO: 465353 - RNA, 17 nt, Homo sapiens
aauuuguagacauacuu

SEQ ID NO: 465354 - RNA, 20 nt, Homo sapiens
acaaacccguuuuaugauuu

SEQ ID NO: 465355 - RNA, 19 nt, Homo sapiens
acaaaggugauuuuccugu

SEQ ID NO: 465356 - RNA, 20 nt, Homo sapiens
acaaaggugauuuuccugug

SEQ ID NO: 465357 - RNA, 21 nt, Homo sapiens
acaaaguuuugcucuugucac

SEQ ID NO: 465358 - RNA, 20 nt, Homo sapiens
acaacuuguguucuauuaau

SEQ ID NO: 465359 - RNA, 19 nt, Homo sapiens
acaagcagucuuuuucuac

SEQ ID NO: 465360 - RNA, 14 nt, Homo sapiens
acacagaggaccca

SEQ ID NO: 465361 - RNA, 17 nt, Homo sapiens
acacauguccaguggga

SEQ ID NO: 465362 - RNA, 16 nt, Homo sapiens
acaccugacacaucuu

SEQ ID NO: 465363 - RNA, 15 nt, Homo sapiens
acacguccacuuuca

SEQ ID NO: 465364 - RNA, 14 nt, Homo sapiens
acacucagugacau

SEQ ID NO: 465365 - RNA, 19 nt, Homo sapiens
acacucauuaccgucugug

SEQ ID NO: 465366 - RNA, 19 nt, Homo sapiens
acacugcgaacucucagga

SEQ ID NO: 465367 - RNA, 16 nt, Homo sapiens
acagacagagaaggca

SEQ ID NO: 465368 - RNA, 15 nt, Homo sapiens
acagagccaugacuc

SEQ ID NO: 465369 - RNA, 22 nt, Homo sapiens
acagaugagaauccuuguggcu

SEQ ID NO: 465370 - RNA, 22 nt, Homo sapiens
acagauuaucuuguacagccuu

SEQ ID NO: 465371 - RNA, 13 nt, Homo sapiens
acagugucugugu

SEQ ID NO: 465372 - RNA, 16 nt, Homo sapiens
acaucucagugcuguc

SEQ ID NO: 465373 - RNA, 15 nt, Homo sapiens
acaucugcagcucuu

SEQ ID NO: 465374 - RNA, 22 nt, Homo sapiens
acauguacugaugacacaccau

SEQ ID NO: 465375 - RNA, 17 nt, Homo sapiens
acaugugcccucugcca

SEQ ID NO: 465376 - RNA, 16 nt, Homo sapiens
accaggagacagacag

SEQ ID NO: 465377 - RNA, 15 nt, Homo sapiens
accauccaggcauau

SEQ ID NO: 465378 - RNA, 20 nt, Homo sapiens
accauugcuucacuacccau

SEQ ID NO: 465379 - RNA, 12 nt, Homo sapiens
ucauuaauguga

SEQ ID NO: 465380 - RNA, 21 nt, Homo sapiens
uccaaaaauagcccugcaaaa

SEQ ID NO: 465381 - RNA, 13 nt, Homo sapiens
uccaacagcauca

SEQ ID NO: 465382 - RNA, 17 nt, Homo sapiens
uccacagcugugugagc

SEQ ID NO: 465383 - RNA, 13 nt, Homo sapiens
uccacguaucuuu

SEQ ID NO: 465384 - RNA, 22 nt, Homo sapiens
uccaugacugcauuuuacugua

SEQ ID NO: 465385 - RNA, 14 nt, Homo sapiens
ucccaaagugcagg

SEQ ID NO: 465386 - RNA, 20 nt, Homo sapiens
ucccaaagugcugggauuac

SEQ ID NO: 465387 - RNA, 19 nt, Homo sapiens
ucccagguucaagagauuc

SEQ ID NO: 465388 - RNA, 18 nt, Homo sapiens
uccccuucaaacaaauaa

SEQ ID NO: 465389 - RNA, 20 nt, Homo sapiens
uccccuucaaacaaauaaua

SEQ ID NO: 465390 - RNA, 20 nt, Homo sapiens
ucccgaguagcugggauuac

SEQ ID NO: 465391 - RNA, 22 nt, Homo sapiens
ucccgcgggcgaguucugccag

SEQ ID NO: 465392 - RNA, 13 nt, Homo sapiens
ucccuaagugcaa

SEQ ID NO: 465393 - RNA, 21 nt, Homo sapiens
ucccucaggauuccuuggcau

SEQ ID NO: 465394 - RNA, 23 nt, Homo sapiens
ucccuuucaucacauuuguuuga

SEQ ID NO: 465395 - RNA, 15 nt, Homo sapiens
uccuaggugcuauuu

SEQ ID NO: 465396 - RNA, 13 nt, Homo sapiens
uccugaccucagg

SEQ ID NO: 465397 - RNA, 15 nt, Homo sapiens
uccugaccucaggug

SEQ ID NO: 465398 - RNA, 14 nt, Homo sapiens
uccuugauggcugg

SEQ ID NO: 465399 - RNA, 10 nt, Homo sapiens
uccuuggcau

SEQ ID NO: 465400 - RNA, 18 nt, Homo sapiens
ucgacuucauuuugccac

SEQ ID NO: 465401 - RNA, 15 nt, Homo sapiens
uggugcaaucuuggc

SEQ ID NO: 465402 - RNA, 14 nt, Homo sapiens
ugguuuaaaccaaa

SEQ ID NO: 465403 - RNA, 19 nt, Homo sapiens
uguaaagagagcaagacag

SEQ ID NO: 465404 - RNA, 12 nt, Homo sapiens
uguaaauaaaua

SEQ ID NO: 465405 - RNA, 15 nt, Homo sapiens
uguaauuguauuuca

SEQ ID NO: 465406 - RNA, 15 nt, Homo sapiens
uguagcuaaauguac

SEQ ID NO: 465407 - RNA, 19 nt, Homo sapiens
uguaggccuuccagugcag

SEQ ID NO: 465408 - RNA, 20 nt, Homo sapiens
uguaggccuuccagugcagg

SEQ ID NO: 465409 - RNA, 22 nt, Homo sapiens
uguauaauuuaacagugcccuu

SEQ ID NO: 465410 - RNA, 21 nt, Homo sapiens
uguauauuuuuuucauuuggc

SEQ ID NO: 465411 - RNA, 17 nt, Homo sapiens
uguaucaaacuagugca

SEQ ID NO: 465412 - RNA, 17 nt, Homo sapiens
ugucauauaagauucau

SEQ ID NO: 465413 - RNA, 14 nt, Homo sapiens
uguccaaguucagg

SEQ ID NO: 465414 - RNA, 13 nt, Homo sapiens
uguccacaucuaa

SEQ ID NO: 465415 - RNA, 22 nt, Homo sapiens
uguccacguaucuuugggucuu

SEQ ID NO: 465416 - RNA, 12 nt, Homo sapiens
ugucccaaagaa

SEQ ID NO: 465417 - RNA, 15 nt, Homo sapiens
ugucccuucucccau

SEQ ID NO: 465418 - RNA, 18 nt, Homo sapiens
ugucuguguacauguaca

SEQ ID NO: 465419 - RNA, 15 nt, Homo sapiens
ugugagcaugacuua

SEQ ID NO: 465420 - RNA, 12 nt, Homo sapiens
ugugauugccau

SEQ ID NO: 465421 - RNA, 17 nt, Homo sapiens
ugugcacacauuaggca

SEQ ID NO: 465422 - RNA, 15 nt, Homo sapiens
ugugcccucugccag

SEQ ID NO: 465423 - RNA, 12 nt, Homo sapiens
ugugcugugagu

SEQ ID NO: 465424 - RNA, 11 nt, Homo sapiens
ugugugccuuu

SEQ ID NO: 465425 - RNA, 13 nt, Homo sapiens
uguuaaaacuacu

SEQ ID NO: 465426 - RNA, 18 nt, Homo sapiens
uguuaacauggacaugau

SEQ ID NO: 465427 - RNA, 12 nt, Homo sapiens
uguuaagcaauu

SEQ ID NO: 465428 - RNA, 24 nt, Homo sapiens
agaucagcauucaaaauaguucua

SEQ ID NO: 465429 - RNA, 22 nt, Homo sapiens
agaugagaaaacaggcucacag

SEQ ID NO: 465430 - RNA, 15 nt, Homo sapiens
agaugcaaccucacu

SEQ ID NO: 465431 - RNA, 12 nt, Homo sapiens
agauguccucag

SEQ ID NO: 465432 - RNA, 23 nt, Homo sapiens
agauguuuguuuucaaaauacuu

SEQ ID NO: 465433 - RNA, 14 nt, Homo sapiens
agauuuuccucucc

SEQ ID NO: 465434 - RNA, 23 nt, Homo sapiens
agcaagcaggaucgcugcucaga

SEQ ID NO: 465435 - RNA, 20 nt, Homo sapiens
agcaaguauauuuauuucua

SEQ ID NO: 465436 - RNA, 15 nt, Homo sapiens
agcaauauguuagca

SEQ ID NO: 465437 - RNA, 13 nt, Homo sapiens
agcaaugugguag

SEQ ID NO: 465438 - RNA, 20 nt, Homo sapiens
agcacaagaaguuucuucag

SEQ ID NO: 465439 - RNA, 20 nt, Homo sapiens
agcacauaguguuuaaagac

SEQ ID NO: 465440 - RNA, 14 nt, Homo sapiens
agcaccagccugag

SEQ ID NO: 465441 - RNA, 17 nt, Homo sapiens
agcacuagaagcacagg

SEQ ID NO: 465442 - RNA, 20 nt, Homo sapiens
agcacugccauuagacugaa

SEQ ID NO: 465443 - RNA, 21 nt, Homo sapiens
agcaggaaagaucccaaguca

SEQ ID NO: 465444 - RNA, 17 nt, Homo sapiens
agcaugaagauaaaucc

SEQ ID NO: 465445 - RNA, 19 nt, Homo sapiens
agcauuucuugauguugcu

SEQ ID NO: 465446 - RNA, 17 nt, Homo sapiens
agccacaauaagccacu

SEQ ID NO: 465447 - RNA, 16 nt, Homo sapiens
agccagaggcucuaau

SEQ ID NO: 465448 - RNA, 19 nt, Homo sapiens
agccagaggcucuaaugua

SEQ ID NO: 465449 - RNA, 15 nt, Homo sapiens
agcccagauggaaag

SEQ ID NO: 465450 - RNA, 23 nt, Homo sapiens
agccccggugugcggugcauaca

SEQ ID NO: 465451 - RNA, 14 nt, Homo sapiens
aauaguaaaugcuu

SEQ ID NO: 465452 - RNA, 18 nt, Homo sapiens
aauauuccuaugcugcaa

SEQ ID NO: 465453 - RNA, 12 nt, Homo sapiens
aauauuucacuu

SEQ ID NO: 465454 - RNA, 13 nt, Homo sapiens
aauauuucacuua

SEQ ID NO: 465455 - RNA, 19 nt, Homo sapiens
aauauuuuaaacuacugau

SEQ ID NO: 465456 - RNA, 20 nt, Homo sapiens
aaucaaucuggcuucugcau

SEQ ID NO: 465457 - RNA, 23 nt, Homo sapiens
aaucaaucuggcuucugcauuac

SEQ ID NO: 465458 - RNA, 22 nt, Homo sapiens
aaucagugagaagaauagcuua

SEQ ID NO: 465459 - RNA, 13 nt, Homo sapiens
aauccaccugcag

SEQ ID NO: 465460 - RNA, 12 nt, Homo sapiens
aauccauaucag

SEQ ID NO: 465461 - RNA, 14 nt, Homo sapiens
aaucuacaacauaa

SEQ ID NO: 465462 - RNA, 17 nt, Homo sapiens
aaucugauuggacauuu

SEQ ID NO: 465463 - RNA, 14 nt, Homo sapiens
aaucuuugugacag

SEQ ID NO: 465464 - RNA, 16 nt, Homo sapiens
aaugcaaugugaaaua

SEQ ID NO: 465465 - RNA, 15 nt, Homo sapiens
aaugcuuucucaugc

SEQ ID NO: 465466 - RNA, 16 nt, Homo sapiens
aaugcuuucucaugca

SEQ ID NO: 465467 - RNA, 15 nt, Homo sapiens
aauggcaagcauagu

SEQ ID NO: 465468 - RNA, 20 nt, Homo sapiens
aauguacaauaaagcaaugu

SEQ ID NO: 465469 - RNA, 22 nt, Homo sapiens
aauguuucccucaagaacaaac

SEQ ID NO: 465470 - RNA, 23 nt, Homo sapiens
aauuacuuacucaaauucaauga

SEQ ID NO: 465471 - RNA, 23 nt, Homo sapiens
aauuauccacaugaaaauaaaga

SEQ ID NO: 465472 - RNA, 12 nt, Homo sapiens
aauuauccuccu

SEQ ID NO: 465473 - RNA, 22 nt, Homo sapiens
aauuauuucagucaucaucuca

SEQ ID NO: 465474 - RNA, 22 nt, Homo sapiens
aauucauaaaaauaaccaaaaa

SEQ ID NO: 465475 - RNA, 23 nt, Homo sapiens
auaccagcuagaaucacuugacu

SEQ ID NO: 465476 - RNA, 19 nt, Homo sapiens
auacuacaaauuaguguca

SEQ ID NO: 465477 - RNA, 14 nt, Homo sapiens
auacucaccaaaau

SEQ ID NO: 465478 - RNA, 18 nt, Homo sapiens
auagccucaccuucccua

SEQ ID NO: 465479 - RNA, 19 nt, Homo sapiens
auaggugcucuuccucauc

SEQ ID NO: 465480 - RNA, 23 nt, Homo sapiens
auagucauguuucugcaguauuc

SEQ ID NO: 465481 - RNA, 22 nt, Homo sapiens
auauacauagucuuuguuuaca

SEQ ID NO: 465482 - RNA, 18 nt, Homo sapiens
auauuaaggcaguaugcc

SEQ ID NO: 465483 - RNA, 18 nt, Homo sapiens
auauuccauccauauacu

SEQ ID NO: 465484 - RNA, 22 nt, Homo sapiens
auauuuuaucuugguaguacau

SEQ ID NO: 465485 - RNA, 19 nt, Homo sapiens
aucaaaaauauuccaucca

SEQ ID NO: 465486 - RNA, 19 nt, Homo sapiens
aucaaucuggcuucugcau

SEQ ID NO: 465487 - RNA, 15 nt, Homo sapiens
aucacaauucucuga

SEQ ID NO: 465488 - RNA, 22 nt, Homo sapiens
aucacacucucuucuuacugua

SEQ ID NO: 465489 - RNA, 19 nt, Homo sapiens
aucaccagaaaugauagcg

SEQ ID NO: 465490 - RNA, 14 nt, Homo sapiens
aucagaauguuuca

SEQ ID NO: 465491 - RNA, 21 nt, Homo sapiens
aucagggggcaugaagcacau

SEQ ID NO: 465492 - RNA, 23 nt, Homo sapiens
aucauucuccuuguaaaagccua

SEQ ID NO: 465493 - RNA, 17 nt, Homo sapiens
auccaauggauugugca

SEQ ID NO: 465494 - RNA, 20 nt, Homo sapiens
auccacagaaccuuugucaa

SEQ ID NO: 465495 - RNA, 18 nt, Homo sapiens
auccaccgccaccccacu

SEQ ID NO: 465496 - RNA, 16 nt, Homo sapiens
auccagagagaagcac

SEQ ID NO: 465497 - RNA, 15 nt, Homo sapiens
auccauaucagcucu

SEQ ID NO: 465498 - RNA, 20 nt, Homo sapiens
auccauaucagcucugcaua

SEQ ID NO: 465499 - RNA, 21 nt, Homo sapiens
aucccacgacauaagcuggua

SEQ ID NO: 465500 - RNA, 18 nt, Homo sapiens
aucccucggucagcaccg

SEQ ID NO: 465501 - RNA, 17 nt, Homo sapiens
aucccuuccuacaguaa

SEQ ID NO: 465502 - RNA, 19 nt, Homo sapiens
auccuaugguaacugauga

SEQ ID NO: 465503 - RNA, 18 nt, Homo sapiens
auccugcuagcuguagaa

SEQ ID NO: 465504 - RNA, 18 nt, Homo sapiens
auccuucccgcagcacca

SEQ ID NO: 465505 - RNA, 13 nt, Homo sapiens
auccuuuuaucuc

SEQ ID NO: 465506 - RNA, 16 nt, Homo sapiens
aucguuucacaucugu

SEQ ID NO: 465507 - RNA, 13 nt, Homo sapiens
aucuacaacauaa

SEQ ID NO: 465508 - RNA, 20 nt, Homo sapiens
aucuagcaagaagauucuaa

SEQ ID NO: 465509 - RNA, 12 nt, Homo sapiens
aucuaugggaga

SEQ ID NO: 465510 - RNA, 15 nt, Homo sapiens
aucucuucuuccuuu

SEQ ID NO: 465511 - RNA, 14 nt, Homo sapiens
aucuggagucuucc

SEQ ID NO: 465512 - RNA, 16 nt, Homo sapiens
aucugggaccaaaaca

SEQ ID NO: 465513 - RNA, 14 nt, Homo sapiens
aucuguaaauuuaa

SEQ ID NO: 465514 - RNA, 14 nt, Homo sapiens
aucugugaagccuu

SEQ ID NO: 465515 - RNA, 16 nt, Homo sapiens
aucuguuauccugcua

SEQ ID NO: 465516 - RNA, 13 nt, Homo sapiens
aucuuauguugau

SEQ ID NO: 465517 - RNA, 17 nt, Homo sapiens
aucuuccauaugcucuu

SEQ ID NO: 465518 - RNA, 17 nt, Homo sapiens
aucuucccacuuugcca

SEQ ID NO: 465519 - RNA, 17 nt, Homo sapiens
augaaagaggcauuccc

SEQ ID NO: 465520 - RNA, 18 nt, Homo sapiens
augaacccauccaaugga

SEQ ID NO: 465521 - RNA, 15 nt, Homo sapiens
augaaguuguaagaa

SEQ ID NO: 465522 - RNA, 13 nt, Homo sapiens
augaauacagaua

SEQ ID NO: 465523 - RNA, 22 nt, Homo sapiens
augaauguacauuuucuaacaa

SEQ ID NO: 465524 - RNA, 23 nt, Homo sapiens
augagaaaacaggcucacagaga

SEQ ID NO: 465525 - RNA, 22 nt, Homo sapiens
augagguuggaaagaguugcca

SEQ ID NO: 465526 - RNA, 22 nt, Homo sapiens
augauuaggcccgccaaacuuc

SEQ ID NO: 465527 - RNA, 20 nt, Homo sapiens
augauuguuugaaagucugu

SEQ ID NO: 465528 - RNA, 13 nt, Homo sapiens
augccagcuauaa

SEQ ID NO: 465529 - RNA, 21 nt, Homo sapiens
augccagggcgcacuuuccac

SEQ ID NO: 465530 - RNA, 14 nt, Homo sapiens
augcccuauuguaa

SEQ ID NO: 465531 - RNA, 20 nt, Homo sapiens
augcuacagagagugaauac

SEQ ID NO: 465532 - RNA, 19 nt, Homo sapiens
auggagaggcggccucgug

SEQ ID NO: 465533 - RNA, 12 nt, Homo sapiens
auggauucacuu

SEQ ID NO: 465534 - RNA, 21 nt, Homo sapiens
auggcuuccgugagacacaag

SEQ ID NO: 465535 - RNA, 20 nt, Homo sapiens
augggaagaaaaaggaaaca

SEQ ID NO: 465536 - RNA, 16 nt, Homo sapiens
augggagagguucugu

SEQ ID NO: 465537 - RNA, 22 nt, Homo sapiens
augggagagguucugugcaaaa

SEQ ID NO: 465538 - RNA, 13 nt, Homo sapiens
auggugggcucca

SEQ ID NO: 465539 - RNA, 20 nt, Homo sapiens
auguacaauaaagcaaugug

SEQ ID NO: 465540 - RNA, 15 nt, Homo sapiens
auguagcugaaugug

SEQ ID NO: 465541 - RNA, 17 nt, Homo sapiens
auguauaaaacuaggaa

SEQ ID NO: 465542 - RNA, 11 nt, Homo sapiens
augucugugau

SEQ ID NO: 465543 - RNA, 14 nt, Homo sapiens
auguggaugcucuu

SEQ ID NO: 465544 - RNA, 14 nt, Homo sapiens
auguguuuccauau

SEQ ID NO: 465545 - RNA, 16 nt, Homo sapiens
auguuccguucaucug

SEQ ID NO: 465546 - RNA, 18 nt, Homo sapiens
auguugcuuuugcaccua

SEQ ID NO: 465547 - RNA, 19 nt, Homo sapiens
auguuuaccucacuggugc

SEQ ID NO: 465548 - RNA, 14 nt, Homo sapiens
auuaaaaccagaga

SEQ ID NO: 465549 - RNA, 13 nt, Homo sapiens
auuaaaagaaucc

SEQ ID NO: 465550 - RNA, 15 nt, Homo sapiens
auugcuucugugcaa

SEQ ID NO: 465551 - RNA, 17 nt, Homo sapiens
auugcuucugugcaaua

SEQ ID NO: 465552 - RNA, 20 nt, Homo sapiens
auuggcagcuucaaaacaga

SEQ ID NO: 465553 - RNA, 17 nt, Homo sapiens
auuuaacugcauauaga

SEQ ID NO: 465554 - RNA, 22 nt, Homo sapiens
auuucacuuaaacuuugucacu

SEQ ID NO: 465555 - RNA, 15 nt, Homo sapiens
auuucauaaacaacu

SEQ ID NO: 465556 - RNA, 13 nt, Homo sapiens
auuucccuaaaaa

SEQ ID NO: 465557 - RNA, 16 nt, Homo sapiens
auuucuguuagcaaua

SEQ ID NO: 465558 - RNA, 16 nt, Homo sapiens
auuuuacuuugugcaa

SEQ ID NO: 465559 - RNA, 19 nt, Homo sapiens
auuuuagcguuaaagucag

SEQ ID NO: 465560 - RNA, 14 nt, Homo sapiens
caaaaauauuccau

SEQ ID NO: 465561 - RNA, 16 nt, Homo sapiens
caaaaguuuaaaaagc

SEQ ID NO: 465562 - RNA, 19 nt, Homo sapiens
caaacacugcuuaaggaaa

SEQ ID NO: 465563 - RNA, 23 nt, Homo sapiens
caaacacugcuuaaggaaaagag

SEQ ID NO: 465564 - RNA, 18 nt, Homo sapiens
caaacaguuccauaccaa

SEQ ID NO: 465565 - RNA, 18 nt, Homo sapiens
caaacccacccauaccag

SEQ ID NO: 465566 - RNA, 22 nt, Homo sapiens
caaagaggccaguacuuugcca

SEQ ID NO: 465567 - RNA, 14 nt, Homo sapiens
caaaguauguuuca

SEQ ID NO: 465568 - RNA, 20 nt, Homo sapiens
caaaguuuuaaaccuguuaa

SEQ ID NO: 465569 - RNA, 18 nt, Homo sapiens
caaauaaguuacccucaa

SEQ ID NO: 465570 - RNA, 16 nt, Homo sapiens
caaauaggagucuucu

SEQ ID NO: 465571 - RNA, 16 nt, Homo sapiens
caaauauugcuauugu

SEQ ID NO: 465572 - RNA, 19 nt, Homo sapiens
caaauauuggguugggcac

SEQ ID NO: 465573 - RNA, 15 nt, Homo sapiens
caaauuauucuaguc

SEQ ID NO: 465574 - RNA, 15 nt, Homo sapiens
caacacaccuugccc

SEQ ID NO: 465575 - RNA, 18 nt, Homo sapiens
caacaggguuuuuuucca

SEQ ID NO: 465576 - RNA, 17 nt, Homo sapiens
caaccauagaacugucc

SEQ ID NO: 465577 - RNA, 23 nt, Homo sapiens
caagaaccagaucguacuugaaa

SEQ ID NO: 465578 - RNA, 14 nt, Homo sapiens
caagauaaacacaa

SEQ ID NO: 465579 - RNA, 15 nt, Homo sapiens
caagcauuuguggac

SEQ ID NO: 465580 - RNA, 16 nt, Homo sapiens
caaguaacaauaugau

SEQ ID NO: 465581 - RNA, 22 nt, Homo sapiens
caaguauauuuauuucuagcaa

SEQ ID NO: 465582 - RNA, 20 nt, Homo sapiens
caagugugugugcaauguuc

SEQ ID NO: 465583 - RNA, 18 nt, Homo sapiens
caauaaacgaaacacaga

SEQ ID NO: 465584 - RNA, 15 nt, Homo sapiens
caauaaacuguuaca

SEQ ID NO: 465585 - RNA, 13 nt, Homo sapiens
caauaaagcaaug

SEQ ID NO: 465586 - RNA, 18 nt, Homo sapiens
caauaaagcaauguggua

SEQ ID NO: 465587 - RNA, 13 nt, Homo sapiens
caauagcauccaa

SEQ ID NO: 465588 - RNA, 17 nt, Homo sapiens
caauauuccuaugcugc

SEQ ID NO: 465589 - RNA, 16 nt, Homo sapiens
caaugccauuuugcua

SEQ ID NO: 465590 - RNA, 20 nt, Homo sapiens
caaugccugccugaacaaag

SEQ ID NO: 465591 - RNA, 19 nt, Homo sapiens
caaugccuuguuguauucc

SEQ ID NO: 465592 - RNA, 20 nt, Homo sapiens
caauugcuucugugcaauaa

SEQ ID NO: 465593 - RNA, 21 nt, Homo sapiens
caauugucauuuauaaaacca

SEQ ID NO: 465594 - RNA, 16 nt, Homo sapiens
caauuucaaaaugcau

SEQ ID NO: 465595 - RNA, 18 nt, Homo sapiens
caauuucaaaaugcaugu

SEQ ID NO: 465596 - RNA, 14 nt, Homo sapiens
cacacccauucaca

SEQ ID NO: 465597 - RNA, 18 nt, Homo sapiens
caccaagcugcucuccuu

SEQ ID NO: 465598 - RNA, 21 nt, Homo sapiens
caccaggagacagacagagaa

SEQ ID NO: 465599 - RNA, 14 nt, Homo sapiens
caccauguugccaa

SEQ ID NO: 465600 - RNA, 23 nt, Homo sapiens
cacccucugcuaugucugugaug

SEQ ID NO: 465601 - RNA, 16 nt, Homo sapiens
caccuccugcaauaaa

SEQ ID NO: 465602 - RNA, 15 nt, Homo sapiens
caccucuuaugcaca

SEQ ID NO: 465603 - RNA, 14 nt, Homo sapiens
caccucuuugucac

SEQ ID NO: 465604 - RNA, 18 nt, Homo sapiens
cacuaaggccgugucucu

SEQ ID NO: 465605 - RNA, 21 nt, Homo sapiens
cacuagguuucaccucccaaa

SEQ ID NO: 465606 - RNA, 14 nt, Homo sapiens
cacucgacucugcu

SEQ ID NO: 465607 - RNA, 17 nt, Homo sapiens
cacuggcccucuuugaa

SEQ ID NO: 465608 - RNA, 19 nt, Homo sapiens
cacugguuuguuucucaag

SEQ ID NO: 465609 - RNA, 15 nt, Homo sapiens
cagaacucagccuua

SEQ ID NO: 465610 - RNA, 20 nt, Homo sapiens
cagaagagucuuugauucac

SEQ ID NO: 465611 - RNA, 15 nt, Homo sapiens
cagacggacgggaca

SEQ ID NO: 465612 - RNA, 16 nt, Homo sapiens
cagacucugcccaucc

SEQ ID NO: 465613 - RNA, 21 nt, Homo sapiens
cagagagugaauacacuggaa

SEQ ID NO: 465614 - RNA, 21 nt, Homo sapiens
cagagauuugguuaagcucac

SEQ ID NO: 465615 - RNA, 19 nt, Homo sapiens
cagagauuuuccucuccaa

SEQ ID NO: 465616 - RNA, 24 nt, Homo sapiens
cagaguugcuuuaaaguaccugua

SEQ ID NO: 465617 - RNA, 23 nt, Homo sapiens
cagauguuuguuuucaaaauacu

SEQ ID NO: 465618 - RNA, 14 nt, Homo sapiens
cagcaauagcaucc

SEQ ID NO: 465619 - RNA, 18 nt, Homo sapiens
cagcaaugccugccugaa

SEQ ID NO: 465620 - RNA, 11 nt, Homo sapiens
cagcacccucc

SEQ ID NO: 465621 - RNA, 15 nt, Homo sapiens
cagccagacccugca

SEQ ID NO: 465622 - RNA, 21 nt, Homo sapiens
cagccuccuaggcucccugag

SEQ ID NO: 465623 - RNA, 12 nt, Homo sapiens
cagccucuagaa

SEQ ID NO: 465624 - RNA, 14 nt, Homo sapiens
cagccucuagaaca

SEQ ID NO: 465625 - RNA, 19 nt, Homo sapiens
cagccucuagaacagccag

SEQ ID NO: 465626 - RNA, 11 nt, Homo sapiens
gaggucucccu

SEQ ID NO: 465627 - RNA, 18 nt, Homo sapiens
gagguggauucaugucca

SEQ ID NO: 465628 - RNA, 21 nt, Homo sapiens
gagucuuugauucaccaaaca

SEQ ID NO: 465629 - RNA, 15 nt, Homo sapiens
gauagauaaugccuu

SEQ ID NO: 465630 - RNA, 20 nt, Homo sapiens
gauauuguauguaccuggga

SEQ ID NO: 465631 - RNA, 12 nt, Homo sapiens
gauccugcacuc

SEQ ID NO: 465632 - RNA, 13 nt, Homo sapiens
gauccugcacucu

SEQ ID NO: 465633 - RNA, 22 nt, Homo sapiens
gauccugcacucuaacacucga

SEQ ID NO: 465634 - RNA, 13 nt, Homo sapiens
gaucguacuugaa

SEQ ID NO: 465635 - RNA, 18 nt, Homo sapiens
gaucuaaaaggaggacag

SEQ ID NO: 465636 - RNA, 12 nt, Homo sapiens
gaugaagcacau

SEQ ID NO: 465637 - RNA, 14 nt, Homo sapiens
gauggcccagcuga

SEQ ID NO: 465638 - RNA, 15 nt, Homo sapiens
gauggcuuaagccug

SEQ ID NO: 465639 - RNA, 17 nt, Homo sapiens
gaugggaccagggaugg

SEQ ID NO: 465640 - RNA, 15 nt, Homo sapiens
gauguauuaugcaaa

SEQ ID NO: 465641 - RNA, 15 nt, Homo sapiens
gauguuuguuuucaa

SEQ ID NO: 465642 - RNA, 13 nt, Homo sapiens
gauucaauuuaaa

SEQ ID NO: 465643 - RNA, 18 nt, Homo sapiens
gauucaggaaugggccaa

SEQ ID NO: 465644 - RNA, 19 nt, Homo sapiens
gauuuaugaucacuuggaa

SEQ ID NO: 465645 - RNA, 14 nt, Homo sapiens
gauuugccaaaaac

SEQ ID NO: 465646 - RNA, 17 nt, Homo sapiens
gcaaaguaccaacugag

SEQ ID NO: 465647 - RNA, 19 nt, Homo sapiens
ggauguugcuuuugcaccu

SEQ ID NO: 465648 - RNA, 16 nt, Homo sapiens
ggauucacagccuuug

SEQ ID NO: 465649 - RNA, 15 nt, Homo sapiens
ggcaaccuguugaau

SEQ ID NO: 465650 - RNA, 19 nt, Homo sapiens
ggcagaauggugggcucca

SEQ ID NO: 465651 - RNA, 22 nt, Homo sapiens
ggcagccccuccccauggugca

SEQ ID NO: 465652 - RNA, 22 nt, Homo sapiens
ggcaggagcugcugugguguuc

SEQ ID NO: 465653 - RNA, 18 nt, Homo sapiens
ggcauggccagguggcca

SEQ ID NO: 465654 - RNA, 15 nt, Homo sapiens
ggccacugaauuaug

SEQ ID NO: 465655 - RNA, 16 nt, Homo sapiens
ggccagagggacuuug

SEQ ID NO: 465656 - RNA, 13 nt, Homo sapiens
ggccagguggcca

SEQ ID NO: 465657 - RNA, 18 nt, Homo sapiens
ggccuccauuuguaccga

SEQ ID NO: 465658 - RNA, 16 nt, Homo sapiens
ggccuggccuauuuaa

SEQ ID NO: 465659 - RNA, 20 nt, Homo sapiens
ggccuguccaccugugcugc

SEQ ID NO: 465660 - RNA, 15 nt, Homo sapiens
ggcucuaauguacaa

SEQ ID NO: 465661 - RNA, 18 nt, Homo sapiens
ggcuggaugugcuuucau

SEQ ID NO: 465662 - RNA, 16 nt, Homo sapiens
ggcuuggaagggcgcu

SEQ ID NO: 465663 - RNA, 23 nt, Homo sapiens
gggaacucaucaaauaaucacaa

SEQ ID NO: 465664 - RNA, 23 nt, Homo sapiens
gggaagcaguguguacuucuuca

SEQ ID NO: 465665 - RNA, 13 nt, Homo sapiens
gggacuuggauag

SEQ ID NO: 465666 - RNA, 22 nt, Homo sapiens
gggagaaccucguugacaugca

SEQ ID NO: 465667 - RNA, 17 nt, Homo sapiens
gggaggauugaaaggga

SEQ ID NO: 465668 - RNA, 17 nt, Homo sapiens
uccuauucuauugcagu

SEQ ID NO: 465669 - RNA, 14 nt, Homo sapiens
uccuccagcaauag

SEQ ID NO: 465670 - RNA, 16 nt, Homo sapiens
uccucgugccguccuc

SEQ ID NO: 465671 - RNA, 19 nt, Homo sapiens
uccucucgagcccagaugg

SEQ ID NO: 465672 - RNA, 15 nt, Homo sapiens
uccucugcuugucau

SEQ ID NO: 465673 - RNA, 22 nt, Homo sapiens
uccugcaauaaaauaguagcau

SEQ ID NO: 465674 - RNA, 16 nt, Homo sapiens
uccuguuccugccaca

SEQ ID NO: 465675 - RNA, 21 nt, Homo sapiens
uccuucacucugacaguauua

SEQ ID NO: 465676 - RNA, 15 nt, Homo sapiens
uccuuccccacccca

SEQ ID NO: 465677 - RNA, 13 nt, Homo sapiens
uccuuccugcugu

SEQ ID NO: 465678 - RNA, 13 nt, Homo sapiens
uccuucuccggcc

SEQ ID NO: 465679 - RNA, 11 nt, Homo sapiens
uccuuguacuu

SEQ ID NO: 465680 - RNA, 14 nt, Homo sapiens
uccuuucccaccca

SEQ ID NO: 465681 - RNA, 16 nt, Homo sapiens
uccuuuguacugauga

SEQ ID NO: 465682 - RNA, 20 nt, Homo sapiens
uccuuuuaucucacaaauaa

SEQ ID NO: 465683 - RNA, 16 nt, Homo sapiens
uccuuuuguauccucc

SEQ ID NO: 465684 - RNA, 17 nt, Homo sapiens
uccuuuuuuauugaaua

SEQ ID NO: 465685 - RNA, 21 nt, Homo sapiens
ucgccccaggcccucccugac

SEQ ID NO: 465686 - RNA, 11 nt, Homo sapiens
ucguacuugaa

SEQ ID NO: 465687 - RNA, 22 nt, Homo sapiens
ucuaaaaacaguuaagacaaca

SEQ ID NO: 465688 - RNA, 13 nt, Homo sapiens
ucuaaaacauucu

SEQ ID NO: 465689 - RNA, 13 nt, Homo sapiens
ucuaaaggggaca

SEQ ID NO: 465690 - RNA, 21 nt, Homo sapiens
ucuaacaaacucaaaaucugg

SEQ ID NO: 465691 - RNA, 11 nt, Homo sapiens
ucuaauaaccu

SEQ ID NO: 465692 - RNA, 14 nt, Homo sapiens
ucuaauguacaaua

SEQ ID NO: 465693 - RNA, 21 nt, Homo sapiens
ucuaauguacaauaaagcaau

SEQ ID NO: 465694 - RNA, 20 nt, Homo sapiens
ucuacaacauaaugauacug

SEQ ID NO: 465695 - RNA, 22 nt, Homo sapiens
ucuaguccuauucuauugcagu

SEQ ID NO: 465696 - RNA, 20 nt, Homo sapiens
ucuauaaauucaacacuuau

SEQ ID NO: 465697 - RNA, 13 nt, Homo sapiens
ucuauucauuuga

SEQ ID NO: 465698 - RNA, 17 nt, Homo sapiens
ucucacaaauaaguaau

SEQ ID NO: 465699 - RNA, 17 nt, Homo sapiens
ucucauguauaaaacua

SEQ ID NO: 465700 - RNA, 22 nt, Homo sapiens
aaugugaaauaaagaguucucc

SEQ ID NO: 465701 - RNA, 18 nt, Homo sapiens
aauguuaauggucaaugc

SEQ ID NO: 465702 - RNA, 19 nt, Homo sapiens
aauguuggcuguaauguaa

SEQ ID NO: 465703 - RNA, 13 nt, Homo sapiens
aauuauaugauau

SEQ ID NO: 465704 - RNA, 14 nt, Homo sapiens
aauuauucuaguca

SEQ ID NO: 465705 - RNA, 22 nt, Homo sapiens
aauucaaugaaucaaauccaau

SEQ ID NO: 465706 - RNA, 21 nt, Homo sapiens
aauucauaaaaauaaccaaaa

SEQ ID NO: 465707 - RNA, 16 nt, Homo sapiens
aauucuagucucugau

SEQ ID NO: 465708 - RNA, 16 nt, Homo sapiens
aauugcuccugcaugc

SEQ ID NO: 465709 - RNA, 21 nt, Homo sapiens
aauugucauuuauaaaaccau

SEQ ID NO: 465710 - RNA, 17 nt, Homo sapiens
aauuucaaaaugcaugu

SEQ ID NO: 465711 - RNA, 12 nt, Homo sapiens
aauuuucacuuu

SEQ ID NO: 465712 - RNA, 23 nt, Homo sapiens
acaaaaggcuggaugugcuuuca

SEQ ID NO: 465713 - RNA, 21 nt, Homo sapiens
acaaaauauuucuaagcuuau

SEQ ID NO: 465714 - RNA, 14 nt, Homo sapiens
acaaccacugggau

SEQ ID NO: 465715 - RNA, 18 nt, Homo sapiens
acaaguagcacacugagu

SEQ ID NO: 465716 - RNA, 14 nt, Homo sapiens
acaauaaagcaaug

SEQ ID NO: 465717 - RNA, 23 nt, Homo sapiens
acaauggcuggguuugggcagug

SEQ ID NO: 465718 - RNA, 15 nt, Homo sapiens
acaauuaugauagcu

SEQ ID NO: 465719 - RNA, 16 nt, Homo sapiens
acaauuaugauagcuu

SEQ ID NO: 465720 - RNA, 20 nt, Homo sapiens
acaauuucaaaaugcaugug

SEQ ID NO: 465721 - RNA, 13 nt, Homo sapiens
acacagcuaacaa

SEQ ID NO: 465722 - RNA, 23 nt, Homo sapiens
acacagcuaacaaguagcacacu

SEQ ID NO: 465723 - RNA, 22 nt, Homo sapiens
acacaguagggcuuggugaaug

SEQ ID NO: 465724 - RNA, 21 nt, Homo sapiens
acacccccaccuccugcaaua

SEQ ID NO: 465725 - RNA, 17 nt, Homo sapiens
acacuuagcaucccaca

SEQ ID NO: 465726 - RNA, 19 nt, Homo sapiens
acagaaacgagauuugcca

SEQ ID NO: 465727 - RNA, 14 nt, Homo sapiens
acagaccagcauag

SEQ ID NO: 465728 - RNA, 15 nt, Homo sapiens
acagaccuccagauu

SEQ ID NO: 465729 - RNA, 22 nt, Homo sapiens
acagagagugaauacacuggaa

SEQ ID NO: 465730 - RNA, 13 nt, Homo sapiens
acagaucuucaac

SEQ ID NO: 465731 - RNA, 14 nt, Homo sapiens
acagccuggcacag

SEQ ID NO: 465732 - RNA, 22 nt, Homo sapiens
acagcggcccggcccacgcaga

SEQ ID NO: 465733 - RNA, 16 nt, Homo sapiens
acaggcccuuccucuc

SEQ ID NO: 465734 - RNA, 21 nt, Homo sapiens
acaggcccuuccucuccacug

SEQ ID NO: 465735 - RNA, 22 nt, Homo sapiens
acaggggccccuccucuaauga

SEQ ID NO: 465736 - RNA, 18 nt, Homo sapiens
acaguauuaacaucaaag

SEQ ID NO: 465737 - RNA, 16 nt, Homo sapiens
acauaaacuuguacuu

SEQ ID NO: 465738 - RNA, 15 nt, Homo sapiens
acauacaucuaaguc

SEQ ID NO: 465739 - RNA, 13 nt, Homo sapiens
acauaggugcucu

SEQ ID NO: 465740 - RNA, 14 nt, Homo sapiens
acauaggugcucuu

SEQ ID NO: 465741 - RNA, 23 nt, Homo sapiens
acauaggugcucuuccucaucuc

SEQ ID NO: 465742 - RNA, 19 nt, Homo sapiens
acauauauaugaaugcuug

SEQ ID NO: 465743 - RNA, 15 nt, Homo sapiens
acauccggaacagcc

SEQ ID NO: 465744 - RNA, 23 nt, Homo sapiens
acauggagcuugacuucaugcca

SEQ ID NO: 465745 - RNA, 15 nt, Homo sapiens
cccucugccuuugag

SEQ ID NO: 465746 - RNA, 18 nt, Homo sapiens
cccugcucacucuuccac

SEQ ID NO: 465747 - RNA, 15 nt, Homo sapiens
cccugugggagucca

SEQ ID NO: 465748 - RNA, 16 nt, Homo sapiens
cccuuggagccaaugg

SEQ ID NO: 465749 - RNA, 21 nt, Homo sapiens
ccgagggacagcagauuccac

SEQ ID NO: 465750 - RNA, 22 nt, Homo sapiens
ccgccucugcccucauccuccc

SEQ ID NO: 465751 - RNA, 20 nt, Homo sapiens
ccgcucccgcgggaagccag

SEQ ID NO: 465752 - RNA, 21 nt, Homo sapiens
ccgcucccgcgggaagccagc

SEQ ID NO: 465753 - RNA, 20 nt, Homo sapiens
ccguggugagcauacagagu

SEQ ID NO: 465754 - RNA, 23 nt, Homo sapiens
ccguuguguggguuuacucugug

SEQ ID NO: 465755 - RNA, 12 nt, Homo sapiens
ccuaagagccac

SEQ ID NO: 465756 - RNA, 13 nt, Homo sapiens
ccuaguagcuuuc

SEQ ID NO: 465757 - RNA, 20 nt, Homo sapiens
ccuaugcugcaauacauuaa

SEQ ID NO: 465758 - RNA, 14 nt, Homo sapiens
ccuauggaaagggu

SEQ ID NO: 465759 - RNA, 17 nt, Homo sapiens
ccuaugguaacugauga

SEQ ID NO: 465760 - RNA, 13 nt, Homo sapiens
ccucacuccacuc

SEQ ID NO: 465761 - RNA, 20 nt, Homo sapiens
ccucacuggugcauuuaaaa

SEQ ID NO: 465762 - RNA, 14 nt, Homo sapiens
ccucagaugaucuc

SEQ ID NO: 465763 - RNA, 22 nt, Homo sapiens
ccuccagggcgagcacuuucca

SEQ ID NO: 465764 - RNA, 21 nt, Homo sapiens
ccucccuguccccugagguua

SEQ ID NO: 465765 - RNA, 22 nt, Homo sapiens
ccucggagccccccacucagua

SEQ ID NO: 465766 - RNA, 17 nt, Homo sapiens
ccucuagaacagccaga

SEQ ID NO: 465767 - RNA, 18 nt, Homo sapiens
ccucuagaacagccagac

SEQ ID NO: 465768 - RNA, 22 nt, Homo sapiens
ccucucgucuuucgcacauucu

SEQ ID NO: 465769 - RNA, 17 nt, Homo sapiens
ccucucuguuuacccuc

SEQ ID NO: 465770 - RNA, 14 nt, Homo sapiens
ccucugcagccuga

SEQ ID NO: 465771 - RNA, 13 nt, Homo sapiens
ccucuuaccugua

SEQ ID NO: 465772 - RNA, 16 nt, Homo sapiens
ccugagggaagcccac

SEQ ID NO: 465773 - RNA, 11 nt, Homo sapiens
ccugcccaguc

SEQ ID NO: 465774 - RNA, 15 nt, Homo sapiens
ccugcccaugugucc

SEQ ID NO: 465775 - RNA, 22 nt, Homo sapiens
ccugcuuagugucccuuaccug

SEQ ID NO: 465776 - RNA, 23 nt, Homo sapiens
ccuggcuuagcguucuguuucac

SEQ ID NO: 465777 - RNA, 18 nt, Homo sapiens
ccugggaaauuugccgau

SEQ ID NO: 465778 - RNA, 17 nt, Homo sapiens
ccugguggcaccagaug

SEQ ID NO: 465779 - RNA, 12 nt, Homo sapiens
ccuguauuccca

SEQ ID NO: 465780 - RNA, 10 nt, Homo sapiens
ccuguuaaau

SEQ ID NO: 465781 - RNA, 14 nt, Homo sapiens
ccuguuccugccac

SEQ ID NO: 465782 - RNA, 20 nt, Homo sapiens
ccuuaacucaucuguuaucc

SEQ ID NO: 465783 - RNA, 23 nt, Homo sapiens
ccuuaagaaagcuauauaugaau

SEQ ID NO: 465784 - RNA, 13 nt, Homo sapiens
ccuucucagggac

SEQ ID NO: 465785 - RNA, 14 nt, Homo sapiens
ccuucuguuuucca

SEQ ID NO: 465786 - RNA, 15 nt, Homo sapiens
ccuucuguuuuccaa

SEQ ID NO: 465787 - RNA, 16 nt, Homo sapiens
ccuucuguuuuccaaa

SEQ ID NO: 465788 - RNA, 23 nt, Homo sapiens
ccuugcuuucucuucuaauggaa

SEQ ID NO: 465789 - RNA, 14 nt, Homo sapiens
ccuuguuguauucc

SEQ ID NO: 465790 - RNA, 14 nt, Homo sapiens
ccuuuauagcuuug

SEQ ID NO: 465791 - RNA, 19 nt, Homo sapiens
cgaaacacagaacucagcc

SEQ ID NO: 465792 - RNA, 19 nt, Homo sapiens
cgagucucuucuccacugg

SEQ ID NO: 465793 - RNA, 14 nt, Homo sapiens
cgccuucagguucc

SEQ ID NO: 465794 - RNA, 17 nt, Homo sapiens
cgcugagggcaggguuc

SEQ ID NO: 465795 - RNA, 16 nt, Homo sapiens
cgcugguaacuguuaa

SEQ ID NO: 465796 - RNA, 18 nt, Homo sapiens
cguccuuagaauacugua

SEQ ID NO: 465797 - RNA, 19 nt, Homo sapiens
cguccuuagaauacuguau

SEQ ID NO: 465798 - RNA, 13 nt, Homo sapiens
cgugcccccagcg

SEQ ID NO: 465799 - RNA, 23 nt, Homo sapiens
cuaaaucacuuugagccugggaa

SEQ ID NO: 465800 - RNA, 14 nt, Homo sapiens
cuaacaacugggaa

SEQ ID NO: 465801 - RNA, 14 nt, Homo sapiens
cuaacagccagcuu

SEQ ID NO: 465802 - RNA, 23 nt, Homo sapiens
cuaacucuuacggcuaucuaguu

SEQ ID NO: 465803 - RNA, 21 nt, Homo sapiens
cuaagaaauggcuuuccacau

SEQ ID NO: 465804 - RNA, 22 nt, Homo sapiens
cuaaucagcauucucacuccua

SEQ ID NO: 465805 - RNA, 13 nt, Homo sapiens
cuaaucugcagug

SEQ ID NO: 465806 - RNA, 21 nt, Homo sapiens
cuaaugaguggucggaccgug

SEQ ID NO: 465807 - RNA, 19 nt, Homo sapiens
cuaauguacaauaaagcaa

SEQ ID NO: 465808 - RNA, 22 nt, Homo sapiens
cuacagaguguuauaacaccau

SEQ ID NO: 465809 - RNA, 15 nt, Homo sapiens
cuacaggcauuuaac

SEQ ID NO: 465810 - RNA, 13 nt, Homo sapiens
cuacaguauauaa

SEQ ID NO: 465811 - RNA, 13 nt, Homo sapiens
cuacaugaaguug

SEQ ID NO: 465812 - RNA, 15 nt, Homo sapiens
cuacgaaagcacagu

SEQ ID NO: 465813 - RNA, 13 nt, Homo sapiens
cuacuuauuucag

SEQ ID NO: 465814 - RNA, 24 nt, Homo sapiens
cuacuuuauaaucaagacaagugu

SEQ ID NO: 465815 - RNA, 19 nt, Homo sapiens
cuagguuucaccucccaaa

SEQ ID NO: 465816 - RNA, 12 nt, Homo sapiens
cuaguagcuuuc

SEQ ID NO: 465817 - RNA, 18 nt, Homo sapiens
cuauaagagacaaaguuu

SEQ ID NO: 465818 - RNA, 16 nt, Homo sapiens
cuauaccgagacccac

SEQ ID NO: 465819 - RNA, 17 nt, Homo sapiens
cuauagaauaaagccuc

SEQ ID NO: 465820 - RNA, 19 nt, Homo sapiens
cuaucaccucuuaugcaca

SEQ ID NO: 465821 - RNA, 16 nt, Homo sapiens
gagccagucccucagc

SEQ ID NO: 465822 - RNA, 21 nt, Homo sapiens
gaggaacaaagacaaccacug

SEQ ID NO: 465823 - RNA, 20 nt, Homo sapiens
gaggcauucccagaauuugc

SEQ ID NO: 465824 - RNA, 18 nt, Homo sapiens
gagggaauccauaucagc

SEQ ID NO: 465825 - RNA, 21 nt, Homo sapiens
gagguaccuuuccacccagac

SEQ ID NO: 465826 - RNA, 19 nt, Homo sapiens
gaguauguuaagcucuuua

SEQ ID NO: 465827 - RNA, 14 nt, Homo sapiens
gagugccaauccaa

SEQ ID NO: 465828 - RNA, 13 nt, Homo sapiens
gaguggaucugga

SEQ ID NO: 465829 - RNA, 21 nt, Homo sapiens
gagugucuuaaaauguuucaa

SEQ ID NO: 465830 - RNA, 12 nt, Homo sapiens
gauacacuguau

SEQ ID NO: 465831 - RNA, 20 nt, Homo sapiens
gauaucccuuccuacaguaa

SEQ ID NO: 465832 - RNA, 19 nt, Homo sapiens
gaucaugaaucacugcacc

SEQ ID NO: 465833 - RNA, 21 nt, Homo sapiens
gaucuaaaaggaggacaggga

SEQ ID NO: 465834 - RNA, 16 nt, Homo sapiens
gaugaacaucuuuuaa

SEQ ID NO: 465835 - RNA, 23 nt, Homo sapiens
gaugcagaaauguggaugcucuu

SEQ ID NO: 465836 - RNA, 21 nt, Homo sapiens
gaugcugagagaccucaggga

SEQ ID NO: 465837 - RNA, 20 nt, Homo sapiens
gauuaaauuuaauauacugc

SEQ ID NO: 465838 - RNA, 14 nt, Homo sapiens
gauucaaaugcaug

SEQ ID NO: 465839 - RNA, 18 nt, Homo sapiens
gcaaaagguuaagccaua

SEQ ID NO: 465840 - RNA, 11 nt, Homo sapiens
gcaaacauuua

SEQ ID NO: 465841 - RNA, 23 nt, Homo sapiens
gcaaauuuuagcguuaaagucag

SEQ ID NO: 465842 - RNA, 17 nt, Homo sapiens
gcaacugacagaugacc

SEQ ID NO: 465843 - RNA, 20 nt, Homo sapiens
gcaauaugggaggaacaaag

SEQ ID NO: 465844 - RNA, 16 nt, Homo sapiens
gcaauauguuagcaag

SEQ ID NO: 465845 - RNA, 15 nt, Homo sapiens
gcaaucuaugacuca

SEQ ID NO: 465846 - RNA, 15 nt, Homo sapiens
gcacacccauucaca

SEQ ID NO: 465847 - RNA, 18 nt, Homo sapiens
gcacauuugucacugaau

SEQ ID NO: 465848 - RNA, 15 nt, Homo sapiens
gcacuagaagcacag

SEQ ID NO: 465849 - RNA, 20 nt, Homo sapiens
gcagagauugggggggcuug

SEQ ID NO: 465850 - RNA, 16 nt, Homo sapiens
gcagauuuucuucuag

SEQ ID NO: 465851 - RNA, 20 nt, Homo sapiens
gcagcccucuccacccagag

SEQ ID NO: 465852 - RNA, 12 nt, Homo sapiens
gcagcuggagau

SEQ ID NO: 465853 - RNA, 20 nt, Homo sapiens
gcaguaaaguuccaugaaga

SEQ ID NO: 465854 - RNA, 20 nt, Homo sapiens
gcaguggggagcgggggcua

SEQ ID NO: 465855 - RNA, 16 nt, Homo sapiens
gcaguuaauucuugcc

SEQ ID NO: 465856 - RNA, 13 nt, Homo sapiens
gcauagccauuca

SEQ ID NO: 465857 - RNA, 14 nt, Homo sapiens
gcaugaagcacauu

SEQ ID NO: 465858 - RNA, 20 nt, Homo sapiens
gcaugauauuguauguaccu

SEQ ID NO: 465859 - RNA, 13 nt, Homo sapiens
gcaugucucaggc

SEQ ID NO: 465860 - RNA, 12 nt, Homo sapiens
gcaugugcugca

SEQ ID NO: 465861 - RNA, 15 nt, Homo sapiens
gcauuuaacugccuu

SEQ ID NO: 465862 - RNA, 19 nt, Homo sapiens
gccacauggagcuugacuu

SEQ ID NO: 465863 - RNA, 19 nt, Homo sapiens
gccagggcgcacuuuccac

SEQ ID NO: 465864 - RNA, 19 nt, Homo sapiens
gcccaaauguccgaucccc

SEQ ID NO: 465865 - RNA, 12 nt, Homo sapiens
gcccagaacggg

SEQ ID NO: 465866 - RNA, 15 nt, Homo sapiens
gcccagcugaucuaa

SEQ ID NO: 465867 - RNA, 14 nt, Homo sapiens
gccccccuucccac

SEQ ID NO: 465868 - RNA, 20 nt, Homo sapiens
gccccucagugguuuccucg

SEQ ID NO: 465869 - RNA, 23 nt, Homo sapiens
gcccuccccaggcgauggacaau

SEQ ID NO: 465870 - RNA, 13 nt, Homo sapiens
gcccugcaccuug

SEQ ID NO: 465871 - RNA, 22 nt, Homo sapiens
gcccuggggucucugagcagug

SEQ ID NO: 465872 - RNA, 15 nt, Homo sapiens
cuuagaauacuguau

SEQ ID NO: 465873 - RNA, 16 nt, Homo sapiens
cuuagaauacuguauu

SEQ ID NO: 465874 - RNA, 21 nt, Homo sapiens
cuuagagcacuagaagcacag

SEQ ID NO: 465875 - RNA, 19 nt, Homo sapiens
cuuauguagcugaauguga

SEQ ID NO: 465876 - RNA, 12 nt, Homo sapiens
cuucaacuaauu

SEQ ID NO: 465877 - RNA, 18 nt, Homo sapiens
cuucacucugacaguauu

SEQ ID NO: 465878 - RNA, 13 nt, Homo sapiens
cuuccgugagaca

SEQ ID NO: 465879 - RNA, 14 nt, Homo sapiens
cuucuaccagagau

SEQ ID NO: 465880 - RNA, 17 nt, Homo sapiens
cuucuaucaaagcacau

SEQ ID NO: 465881 - RNA, 19 nt, Homo sapiens
cuucuaucaaagcacauaa

SEQ ID NO: 465882 - RNA, 16 nt, Homo sapiens
cuugaguuuuccugcu

SEQ ID NO: 465883 - RNA, 19 nt, Homo sapiens
cuugaucaugaaucacugc

SEQ ID NO: 465884 - RNA, 16 nt, Homo sapiens
cuugauucuaaagggg

SEQ ID NO: 465885 - RNA, 21 nt, Homo sapiens
cuugcccuuugagaaacccaa

SEQ ID NO: 465886 - RNA, 19 nt, Homo sapiens
cuugcugccccacaacaca

SEQ ID NO: 465887 - RNA, 15 nt, Homo sapiens
cuuggccuaugauaa

SEQ ID NO: 465888 - RNA, 19 nt, Homo sapiens
cuugguguuguuauggcaa

SEQ ID NO: 465889 - RNA, 14 nt, Homo sapiens
cuuuauagcuuugg

SEQ ID NO: 465890 - RNA, 15 nt, Homo sapiens
cuuucccaucuuaaa

SEQ ID NO: 465891 - RNA, 18 nt, Homo sapiens
cuuucuauuggcauggau

SEQ ID NO: 465892 - RNA, 15 nt, Homo sapiens
cuuucucucuuucca

SEQ ID NO: 465893 - RNA, 11 nt, Homo sapiens
cuuugccaaau

SEQ ID NO: 465894 - RNA, 17 nt, Homo sapiens
cuuugccauccuugcac

SEQ ID NO: 465895 - RNA, 22 nt, Homo sapiens
cuuuggagagcucaguacaggg

SEQ ID NO: 465896 - RNA, 15 nt, Homo sapiens
cuuuguaugcacuuu

SEQ ID NO: 465897 - RNA, 22 nt, Homo sapiens
cuuugucauucaagccugugaa

SEQ ID NO: 465898 - RNA, 13 nt, Homo sapiens
cuuugugcaauau

SEQ ID NO: 465899 - RNA, 16 nt, Homo sapiens
cuuuguugcucagcaa

SEQ ID NO: 465900 - RNA, 23 nt, Homo sapiens
cuuuguuuacaugaguucaaaua

SEQ ID NO: 465901 - RNA, 14 nt, Homo sapiens
cuuuuaucucacaa

SEQ ID NO: 465902 - RNA, 15 nt, Homo sapiens
cuuuuaucucacaaa

SEQ ID NO: 465903 - RNA, 21 nt, Homo sapiens
cuuuuauguguugaugacuca

SEQ ID NO: 465904 - RNA, 22 nt, Homo sapiens
cuuuugggauguuaccuucaca

SEQ ID NO: 465905 - RNA, 15 nt, Homo sapiens
cuuuuuccaucucaa

SEQ ID NO: 465906 - RNA, 18 nt, Homo sapiens
cuuuuucuaagcuguuuc

SEQ ID NO: 465907 - RNA, 12 nt, Homo sapiens
gaaaacaggcuc

SEQ ID NO: 465908 - RNA, 20 nt, Homo sapiens
gaaacccuacgaaagcacag

SEQ ID NO: 465909 - RNA, 20 nt, Homo sapiens
gaaagagaaaaugcuuucuc

SEQ ID NO: 465910 - RNA, 22 nt, Homo sapiens
gaaagagcuggcaaacugugaa

SEQ ID NO: 465911 - RNA, 15 nt, Homo sapiens
gaaagaguugcagua

SEQ ID NO: 465912 - RNA, 22 nt, Homo sapiens
gaaaggguucagggcaugggga

SEQ ID NO: 465913 - RNA, 16 nt, Homo sapiens
gaaauaaccugugaau

SEQ ID NO: 465914 - RNA, 21 nt, Homo sapiens
gaaauuucaaaguauguuuca

SEQ ID NO: 465915 - RNA, 14 nt, Homo sapiens
gaacagccagaccc

SEQ ID NO: 465916 - RNA, 18 nt, Homo sapiens
gaaccaacgggucugugg

SEQ ID NO: 465917 - RNA, 22 nt, Homo sapiens
gaacccuuggagccaauggaga

SEQ ID NO: 465918 - RNA, 15 nt, Homo sapiens
gaacuuuuaaacugc

SEQ ID NO: 465919 - RNA, 12 nt, Homo sapiens
gaagaaacugcu

SEQ ID NO: 465920 - RNA, 20 nt, Homo sapiens
gaagaacuugucccucaggc

SEQ ID NO: 465921 - RNA, 22 nt, Homo sapiens
gaagacacguucuugccagcuu

SEQ ID NO: 465922 - RNA, 14 nt, Homo sapiens
gaagagaugcucua

SEQ ID NO: 465923 - RNA, 12 nt, Homo sapiens
cuacuacagagu

SEQ ID NO: 465924 - RNA, 17 nt, Homo sapiens
cuacuggagauaccaga

SEQ ID NO: 465925 - RNA, 17 nt, Homo sapiens
cuagaacacaaauccaa

SEQ ID NO: 465926 - RNA, 14 nt, Homo sapiens
cuagaacagccaga

SEQ ID NO: 465927 - RNA, 19 nt, Homo sapiens
cuagccagaggcucuaaug

SEQ ID NO: 465928 - RNA, 13 nt, Homo sapiens
cuagcuauaacaa

SEQ ID NO: 465929 - RNA, 17 nt, Homo sapiens
cuaggcucccugaggua

SEQ ID NO: 465930 - RNA, 22 nt, Homo sapiens
cuaguccccagccugcucccua

SEQ ID NO: 465931 - RNA, 22 nt, Homo sapiens
cuagugcucccuuccuccucaa

SEQ ID NO: 465932 - RNA, 14 nt, Homo sapiens
cuauaaaaacugcc

SEQ ID NO: 465933 - RNA, 21 nt, Homo sapiens
cuauauuuggauucacagccu

SEQ ID NO: 465934 - RNA, 21 nt, Homo sapiens
cuauccacagaaccuuuguca

SEQ ID NO: 465935 - RNA, 13 nt, Homo sapiens
cuaucugcaaaua

SEQ ID NO: 465936 - RNA, 15 nt, Homo sapiens
cuaugauaaguucca

SEQ ID NO: 465937 - RNA, 14 nt, Homo sapiens
cuauuaacucugca

SEQ ID NO: 465938 - RNA, 17 nt, Homo sapiens
cuauuuugaaaaaccau

SEQ ID NO: 465939 - RNA, 21 nt, Homo sapiens
cuauuuuuuacuacauaauua

SEQ ID NO: 465940 - RNA, 18 nt, Homo sapiens
cucaaaccgagagacuca

SEQ ID NO: 465941 - RNA, 16 nt, Homo sapiens
cucaacuaccauuccu

SEQ ID NO: 465942 - RNA, 17 nt, Homo sapiens
cucaaucucugcaggau

SEQ ID NO: 465943 - RNA, 18 nt, Homo sapiens
cucaccaaaauauaguua

SEQ ID NO: 465944 - RNA, 17 nt, Homo sapiens
cucagaacaauccgauu

SEQ ID NO: 465945 - RNA, 23 nt, Homo sapiens
cucagaagagucccggagcucaa

SEQ ID NO: 465946 - RNA, 13 nt, Homo sapiens
cucaggcuuucua

SEQ ID NO: 465947 - RNA, 14 nt, Homo sapiens
cucaguacagggca

SEQ ID NO: 465948 - RNA, 19 nt, Homo sapiens
cucaucuguuauccugcua

SEQ ID NO: 465949 - RNA, 20 nt, Homo sapiens
cucauguauaaaacuaggaa

SEQ ID NO: 465950 - RNA, 19 nt, Homo sapiens
cucauucuuuucagcuugu

SEQ ID NO: 465951 - RNA, 20 nt, Homo sapiens
cuccaaaguuuuaaaccugu

SEQ ID NO: 465952 - RNA, 13 nt, Homo sapiens
cuccauuaaccaa

SEQ ID NO: 465953 - RNA, 21 nt, Homo sapiens
cuccauuaaccaagaaaacca

SEQ ID NO: 465954 - RNA, 12 nt, Homo sapiens
cucccuagccag

SEQ ID NO: 465955 - RNA, 18 nt, Homo sapiens
cucccucucuugccgaca

SEQ ID NO: 465956 - RNA, 23 nt, Homo sapiens
cuccuugaguuuuccugcugcga

SEQ ID NO: 465957 - RNA, 16 nt, Homo sapiens
cuccuuguacuugaau

SEQ ID NO: 465958 - RNA, 22 nt, Homo sapiens
cuccuuuccaaauaagugcauu

SEQ ID NO: 465959 - RNA, 16 nt, Homo sapiens
cucgugccguccuccc

SEQ ID NO: 465960 - RNA, 16 nt, Homo sapiens
cucuaaaauucuaguc

SEQ ID NO: 465961 - RNA, 13 nt, Homo sapiens
cucuaugugcaac

SEQ ID NO: 465962 - RNA, 23 nt, Homo sapiens
cucucugaauacccaaaacacac

SEQ ID NO: 465963 - RNA, 21 nt, Homo sapiens
cucugacaguauuaacaucaa

SEQ ID NO: 465964 - RNA, 17 nt, Homo sapiens
cucugauuuugagcuca

SEQ ID NO: 465965 - RNA, 12 nt, Homo sapiens
cucugcauagac

SEQ ID NO: 465966 - RNA, 13 nt, Homo sapiens
cucugccuuugag

SEQ ID NO: 465967 - RNA, 21 nt, Homo sapiens
cucuggguuuugggauuuggg

SEQ ID NO: 465968 - RNA, 21 nt, Homo sapiens
cucugguccuucugaccccac

SEQ ID NO: 465969 - RNA, 13 nt, Homo sapiens
cucugugcugcac

SEQ ID NO: 465970 - RNA, 18 nt, Homo sapiens
cucuguugcuguccucca

SEQ ID NO: 465971 - RNA, 22 nt, Homo sapiens
cugaaacauuuggaagccccau

SEQ ID NO: 465972 - RNA, 22 nt, Homo sapiens
cugaaacuauagaauaaagccu

SEQ ID NO: 465973 - RNA, 18 nt, Homo sapiens
cugacagaaggacucagg

SEQ ID NO: 465974 - RNA, 16 nt, Homo sapiens
aaugugauacaugccg

SEQ ID NO: 465975 - RNA, 11 nt, Homo sapiens
aaugugccaaa

SEQ ID NO: 465976 - RNA, 15 nt, Homo sapiens
aauguggaugcucuu

SEQ ID NO: 465977 - RNA, 13 nt, Homo sapiens
aauguuauaucau

SEQ ID NO: 465978 - RNA, 20 nt, Homo sapiens
aauguugguuacaugaauga

SEQ ID NO: 465979 - RNA, 17 nt, Homo sapiens
aauguuucccucaagaa

SEQ ID NO: 465980 - RNA, 15 nt, Homo sapiens
aauuggguugugaaa

SEQ ID NO: 465981 - RNA, 17 nt, Homo sapiens
aauuuaauauacugcau

SEQ ID NO: 465982 - RNA, 20 nt, Homo sapiens
aauuuaggauggaauacuuc

SEQ ID NO: 465983 - RNA, 16 nt, Homo sapiens
aauuuaugaagauagu

SEQ ID NO: 465984 - RNA, 23 nt, Homo sapiens
aauuucagugaaaugguguauag

SEQ ID NO: 465985 - RNA, 16 nt, Homo sapiens
aauuuuuuccuaccau

SEQ ID NO: 465986 - RNA, 19 nt, Homo sapiens
acaaacacuuagcauccca

SEQ ID NO: 465987 - RNA, 16 nt, Homo sapiens
acaaagacaaccacug

SEQ ID NO: 465988 - RNA, 13 nt, Homo sapiens
acaaguagcacac

SEQ ID NO: 465989 - RNA, 16 nt, Homo sapiens
acaauaaagcaaugug

SEQ ID NO: 465990 - RNA, 20 nt, Homo sapiens
acaauuaugauagcuuaugu

SEQ ID NO: 465991 - RNA, 18 nt, Homo sapiens
acaauuucaaaaugcaug

SEQ ID NO: 465992 - RNA, 22 nt, Homo sapiens
acaauuuucacuuuuucugucu

SEQ ID NO: 465993 - RNA, 16 nt, Homo sapiens
acacaauuuucacuuu

SEQ ID NO: 465994 - RNA, 22 nt, Homo sapiens
acacagaucagauuaucugguc

SEQ ID NO: 465995 - RNA, 16 nt, Homo sapiens
acaccagaagugccau

SEQ ID NO: 465996 - RNA, 20 nt, Homo sapiens
acaccaucuggagucuuccu

SEQ ID NO: 465997 - RNA, 15 nt, Homo sapiens
acaccgacucugagc

SEQ ID NO: 465998 - RNA, 17 nt, Homo sapiens
acaccguggugagcaua

SEQ ID NO: 465999 - RNA, 16 nt, Homo sapiens
acacuaguagcuguuu

SEQ ID NO: 466000 - RNA, 21 nt, Homo sapiens
acagaaccaacgggucugugg

SEQ ID NO: 466001 - RNA, 14 nt, Homo sapiens
acagaauugcuccu

SEQ ID NO: 466002 - RNA, 16 nt, Homo sapiens
acagacagagaaggca

SEQ ID NO: 466003 - RNA, 21 nt, Homo sapiens
acagaccagcauaguucugca

SEQ ID NO: 466004 - RNA, 17 nt, Homo sapiens
acagaccucggcugugu

SEQ ID NO: 466005 - RNA, 23 nt, Homo sapiens
acagagauuugguuaagcucaca

SEQ ID NO: 466006 - RNA, 13 nt, Homo sapiens
acagcagauucca

SEQ ID NO: 466007 - RNA, 14 nt, Homo sapiens
acagcagauuccac

SEQ ID NO: 466008 - RNA, 17 nt, Homo sapiens
acagcuaacaaguagca

SEQ ID NO: 466009 - RNA, 15 nt, Homo sapiens
acagugggggcacca

SEQ ID NO: 466010 - RNA, 17 nt, Homo sapiens
acaguucuuggugacug

SEQ ID NO: 466011 - RNA, 19 nt, Homo sapiens
acauagucuuuguuuacau

SEQ ID NO: 466012 - RNA, 21 nt, Homo sapiens
acauagucuuuguuuacauga

SEQ ID NO: 466013 - RNA, 19 nt, Homo sapiens
acaugaacccauccaaugg

SEQ ID NO: 466014 - RNA, 19 nt, Homo sapiens
acaugaguucaaauacuuu

SEQ ID NO: 466015 - RNA, 17 nt, Homo sapiens
acauggcaacaaaggau

SEQ ID NO: 466016 - RNA, 14 nt, Homo sapiens
acauguccuauuac

SEQ ID NO: 466017 - RNA, 21 nt, Homo sapiens
acauuuucuaacaaacucaaa

SEQ ID NO: 466018 - RNA, 12 nt, Homo sapiens
accaaauacuuu

SEQ ID NO: 466019 - RNA, 20 nt, Homo sapiens
accaaauacuuucugagaug

SEQ ID NO: 466020 - RNA, 13 nt, Homo sapiens
accaaaugcaaug

SEQ ID NO: 466021 - RNA, 19 nt, Homo sapiens
accaagaaaaccaguggaa

SEQ ID NO: 466022 - RNA, 21 nt, Homo sapiens
accacauucuguccccaaaau

SEQ ID NO: 466023 - RNA, 20 nt, Homo sapiens
accagaagugccaugcucag

SEQ ID NO: 466024 - RNA, 21 nt, Homo sapiens
accagcuaucugucaucucuc

SEQ ID NO: 466025 - RNA, 16 nt, Homo sapiens
accaggagacagacag

SEQ ID NO: 466026 - RNA, 14 nt, Homo sapiens
accagguuaccuca

SEQ ID NO: 466027 - RNA, 17 nt, Homo sapiens
accaguggaagauuucu

SEQ ID NO: 466028 - RNA, 21 nt, Homo sapiens
accaguucuuggccuaugaua

SEQ ID NO: 466029 - RNA, 21 nt, Homo sapiens
acccacccucugguccuucug

SEQ ID NO: 466030 - RNA, 21 nt, Homo sapiens
acccagccucuagaacagcca

SEQ ID NO: 466031 - RNA, 22 nt, Homo sapiens
acccagccucuagaacagccag

SEQ ID NO: 466032 - RNA, 17 nt, Homo sapiens
acccaguguucagcaua

SEQ ID NO: 466033 - RNA, 17 nt, Homo sapiens
accccacuuaugcugcu

SEQ ID NO: 466034 - RNA, 20 nt, Homo sapiens
acccccuccuccagcaauag

SEQ ID NO: 466035 - RNA, 21 nt, Homo sapiens
acccgagggacagcagauucc

SEQ ID NO: 466036 - RNA, 19 nt, Homo sapiens
acccucugcuaugucugug

SEQ ID NO: 466037 - RNA, 15 nt, Homo sapiens
acccuucucagggac

SEQ ID NO: 466038 - RNA, 13 nt, Homo sapiens
accgagagacuca

SEQ ID NO: 466039 - RNA, 16 nt, Homo sapiens
accgagucucuucucc

SEQ ID NO: 466040 - RNA, 22 nt, Homo sapiens
accgcucccgcgggaagccagc

SEQ ID NO: 466041 - RNA, 21 nt, Homo sapiens
accgguguccuguuccugcca

SEQ ID NO: 466042 - RNA, 13 nt, Homo sapiens
accgucaauguga

SEQ ID NO: 466043 - RNA, 19 nt, Homo sapiens
accuaguccccagccugcu

SEQ ID NO: 466044 - RNA, 12 nt, Homo sapiens
accuauucccaa

SEQ ID NO: 466045 - RNA, 17 nt, Homo sapiens
accuauucccaaaugcc

SEQ ID NO: 466046 - RNA, 24 nt, Homo sapiens
accucacuuuuaauuagugaugca

SEQ ID NO: 466047 - RNA, 19 nt, Homo sapiens
accucccaaacccagccuc

SEQ ID NO: 466048 - RNA, 12 nt, Homo sapiens
accucggcugug

SEQ ID NO: 466049 - RNA, 16 nt, Homo sapiens
accucuuugucacagg

SEQ ID NO: 466050 - RNA, 15 nt, Homo sapiens
accuguaauagccuc

SEQ ID NO: 466051 - RNA, 17 nt, Homo sapiens
accuguagaaaagugag

SEQ ID NO: 466052 - RNA, 20 nt, Homo sapiens
accuguagugagaaacugau

SEQ ID NO: 466053 - RNA, 16 nt, Homo sapiens
accuguauuuugccag

SEQ ID NO: 466054 - RNA, 12 nt, Homo sapiens
accuuugucaac

SEQ ID NO: 466055 - RNA, 18 nt, Homo sapiens
acgaaacacagaacucag

SEQ ID NO: 466056 - RNA, 13 nt, Homo sapiens
acgaaagcacagu

SEQ ID NO: 466057 - RNA, 12 nt, Homo sapiens
acgccuccccaa

SEQ ID NO: 466058 - RNA, 13 nt, Homo sapiens
acgccuccccaau

SEQ ID NO: 466059 - RNA, 18 nt, Homo sapiens
acguaauuuguuauauca

SEQ ID NO: 466060 - RNA, 15 nt, Homo sapiens
acgucacagcaguac

SEQ ID NO: 466061 - RNA, 15 nt, Homo sapiens
acguccuuccacuuc

SEQ ID NO: 466062 - RNA, 14 nt, Homo sapiens
acuaaacauuuugu

SEQ ID NO: 466063 - RNA, 14 nt, Homo sapiens
acuaacaacuggga

SEQ ID NO: 466064 - RNA, 24 nt, Homo sapiens
acuaguaaucuuggcccuauucau

SEQ ID NO: 466065 - RNA, 15 nt, Homo sapiens
acuauuugaaaaaag

SEQ ID NO: 466066 - RNA, 20 nt, Homo sapiens
acucacuaaaaguucucaaa

SEQ ID NO: 466067 - RNA, 23 nt, Homo sapiens
acucagccuuaagaaagcuauau

SEQ ID NO: 466068 - RNA, 19 nt, Homo sapiens
acuccacuccccucaucca

SEQ ID NO: 466069 - RNA, 15 nt, Homo sapiens
acucccgccuuugac

SEQ ID NO: 466070 - RNA, 22 nt, Homo sapiens
acuccuuuccugcaaacccauu

SEQ ID NO: 466071 - RNA, 19 nt, Homo sapiens
auggucaaugcuagcacaa

SEQ ID NO: 466072 - RNA, 18 nt, Homo sapiens
auguacaauaaagcaaug

SEQ ID NO: 466073 - RNA, 20 nt, Homo sapiens
auguagaauuauaacuaauu

SEQ ID NO: 466074 - RNA, 18 nt, Homo sapiens
auguagcugaaugugaua

SEQ ID NO: 466075 - RNA, 13 nt, Homo sapiens
auguauuaugcaa

SEQ ID NO: 466076 - RNA, 14 nt, Homo sapiens
auguauuaugcaaa

SEQ ID NO: 466077 - RNA, 12 nt, Homo sapiens
auguccuauuac

SEQ ID NO: 466078 - RNA, 23 nt, Homo sapiens
augucuguuucaaugaccuguau

SEQ ID NO: 466079 - RNA, 18 nt, Homo sapiens
auguggcaaaauguuaca

SEQ ID NO: 466080 - RNA, 19 nt, Homo sapiens
auguggcaaaauguuacag

SEQ ID NO: 466081 - RNA, 22 nt, Homo sapiens
auguguccccucacucugucag

SEQ ID NO: 466082 - RNA, 14 nt, Homo sapiens
auguuaccuucaca

SEQ ID NO: 466083 - RNA, 18 nt, Homo sapiens
auguuaccuucacauguc

SEQ ID NO: 466084 - RNA, 19 nt, Homo sapiens
auguugguuacaugaauga

SEQ ID NO: 466085 - RNA, 18 nt, Homo sapiens
auguuuaagaaaugagaa

SEQ ID NO: 466086 - RNA, 20 nt, Homo sapiens
auuaaacuugucagaauuuc

SEQ ID NO: 466087 - RNA, 21 nt, Homo sapiens
auuaaagaaguugauggauau

SEQ ID NO: 466088 - RNA, 15 nt, Homo sapiens
auuaacaucaaagac

SEQ ID NO: 466089 - RNA, 13 nt, Homo sapiens
auuaacucugcau

SEQ ID NO: 466090 - RNA, 21 nt, Homo sapiens
auuacauccucugcuugucau

SEQ ID NO: 466091 - RNA, 14 nt, Homo sapiens
auuauagucuguac

SEQ ID NO: 466092 - RNA, 13 nt, Homo sapiens
auuaugaaccgca

SEQ ID NO: 466093 - RNA, 23 nt, Homo sapiens
auuaugccagggcgcacuuucca

SEQ ID NO: 466094 - RNA, 13 nt, Homo sapiens
auuauguauaaca

SEQ ID NO: 466095 - RNA, 13 nt, Homo sapiens
auucaaaugcaug

SEQ ID NO: 466096 - RNA, 16 nt, Homo sapiens
auuccuaugcugcaau

SEQ ID NO: 466097 - RNA, 22 nt, Homo sapiens
auuccuaugcugcaauacauua

SEQ ID NO: 466098 - RNA, 14 nt, Homo sapiens
auucuaaaacauuc

SEQ ID NO: 466099 - RNA, 20 nt, Homo sapiens
auucuagucucugauuugca

SEQ ID NO: 466100 - RNA, 14 nt, Homo sapiens
auucuauaagagac

SEQ ID NO: 466101 - RNA, 18 nt, Homo sapiens
auucuguggauucuauau

SEQ ID NO: 466102 - RNA, 19 nt, Homo sapiens
auucuuccaaguucauuca

SEQ ID NO: 466103 - RNA, 19 nt, Homo sapiens
auugagaaauaaagcacau

SEQ ID NO: 466104 - RNA, 23 nt, Homo sapiens
auugccucuaugugcaacugaca

SEQ ID NO: 466105 - RNA, 16 nt, Homo sapiens
auugcuucugugcaau

SEQ ID NO: 466106 - RNA, 12 nt, Homo sapiens
auuuaacugcau

SEQ ID NO: 466107 - RNA, 14 nt, Homo sapiens
auuuaacugcauau

SEQ ID NO: 466108 - RNA, 16 nt, Homo sapiens
auuuaauauacugcau

SEQ ID NO: 466109 - RNA, 21 nt, Homo sapiens
auuuagauuuuucucaucucc

SEQ ID NO: 466110 - RNA, 14 nt, Homo sapiens
auuuauuucuagca

SEQ ID NO: 466111 - RNA, 21 nt, Homo sapiens
auuuccugacagaaggacuca

SEQ ID NO: 466112 - RNA, 17 nt, Homo sapiens
auuucuguuagcaauau

SEQ ID NO: 466113 - RNA, 14 nt, Homo sapiens
auuugauauacaga

SEQ ID NO: 466114 - RNA, 21 nt, Homo sapiens
auuuguguuaagugacugaga

SEQ ID NO: 466115 - RNA, 20 nt, Homo sapiens
auuuuaaaaaauaacauauu

SEQ ID NO: 466116 - RNA, 15 nt, Homo sapiens
auuuuaaacuacuga

SEQ ID NO: 466117 - RNA, 13 nt, Homo sapiens
auuuuaauaaaga

SEQ ID NO: 466118 - RNA, 18 nt, Homo sapiens
auuuuggaaaaugauuag

SEQ ID NO: 466119 - RNA, 19 nt, Homo sapiens
caaaaaaugugagcuauaa

SEQ ID NO: 466120 - RNA, 16 nt, Homo sapiens
caaaaaugggcagcca

SEQ ID NO: 466121 - RNA, 19 nt, Homo sapiens
caaaacuaccacauucugu

SEQ ID NO: 466122 - RNA, 20 nt, Homo sapiens
caaaaggcuggaugugcuuu

SEQ ID NO: 466123 - RNA, 23 nt, Homo sapiens
caaaaggcuggaugugcuuucau

SEQ ID NO: 466124 - RNA, 20 nt, Homo sapiens
caaaaguuuaaaaagcucac

SEQ ID NO: 466125 - RNA, 22 nt, Homo sapiens
caaaauaguucuauuucuaucu

SEQ ID NO: 466126 - RNA, 17 nt, Homo sapiens
caaaaucacaauucucu

SEQ ID NO: 466127 - RNA, 21 nt, Homo sapiens
caaacagauguuuguuuucaa

SEQ ID NO: 466128 - RNA, 19 nt, Homo sapiens
caaacaggaauuucuguua

SEQ ID NO: 466129 - RNA, 18 nt, Homo sapiens
caaacccagccucuagaa

SEQ ID NO: 466130 - RNA, 19 nt, Homo sapiens
caaacguaauuuguuauau

SEQ ID NO: 466131 - RNA, 21 nt, Homo sapiens
caaaggcuuucuuuccaaucc

SEQ ID NO: 466132 - RNA, 17 nt, Homo sapiens
caaauaaguaauaucuu

SEQ ID NO: 466133 - RNA, 15 nt, Homo sapiens
caaauaaguuacccu

SEQ ID NO: 466134 - RNA, 13 nt, Homo sapiens
caaauaguuucaa

SEQ ID NO: 466135 - RNA, 16 nt, Homo sapiens
caaauccccuccccaa

SEQ ID NO: 466136 - RNA, 11 nt, Homo sapiens
caaaugcauga

SEQ ID NO: 466137 - RNA, 17 nt, Homo sapiens
caaaugcuacucaguau

SEQ ID NO: 466138 - RNA, 23 nt, Homo sapiens
caaauguccgauccccgaccuuc

SEQ ID NO: 466139 - RNA, 23 nt, Homo sapiens
caacagacacccuccacucugag

SEQ ID NO: 466140 - RNA, 19 nt, Homo sapiens
caaccaggcuccugugaua

SEQ ID NO: 466141 - RNA, 17 nt, Homo sapiens
caacccuacaguauaua

SEQ ID NO: 466142 - RNA, 20 nt, Homo sapiens
caaccuguugaauuuacucu

SEQ ID NO: 466143 - RNA, 15 nt, Homo sapiens
caaccuuuuaugugu

SEQ ID NO: 466144 - RNA, 13 nt, Homo sapiens
caacggaagccag

SEQ ID NO: 466145 - RNA, 14 nt, Homo sapiens
caacuaauacaugg

SEQ ID NO: 466146 - RNA, 15 nt, Homo sapiens
caacuaccauuccuu

SEQ ID NO: 466147 - RNA, 14 nt, Homo sapiens
caacuccaggguua

SEQ ID NO: 466148 - RNA, 13 nt, Homo sapiens
caacugagccaaa

SEQ ID NO: 466149 - RNA, 20 nt, Homo sapiens
caagaagugggauucaggaa

SEQ ID NO: 466150 - RNA, 21 nt, Homo sapiens
caagaagugggauucaggaau

SEQ ID NO: 466151 - RNA, 17 nt, Homo sapiens
caagccacguugcagaa

SEQ ID NO: 466152 - RNA, 23 nt, Homo sapiens
caagcugcucuccuucacucuga

SEQ ID NO: 466153 - RNA, 20 nt, Homo sapiens
caaggaucagaguaacacaa

SEQ ID NO: 466154 - RNA, 15 nt, Homo sapiens
caaguagcacacuga

SEQ ID NO: 466155 - RNA, 19 nt, Homo sapiens
caaguucauucauacucaa

SEQ ID NO: 466156 - RNA, 19 nt, Homo sapiens
caauaaaaccaagugcuua

SEQ ID NO: 466157 - RNA, 20 nt, Homo sapiens
caauaaacgaaacacagaac

SEQ ID NO: 466158 - RNA, 19 nt, Homo sapiens
caauaaagcaaugugguag

SEQ ID NO: 466159 - RNA, 18 nt, Homo sapiens
caauaaugaaugagcagu

SEQ ID NO: 466160 - RNA, 20 nt, Homo sapiens
caauaugggaggaacaaaga

SEQ ID NO: 466161 - RNA, 22 nt, Homo sapiens
caaugaccuguauuuugccaga

SEQ ID NO: 466162 - RNA, 19 nt, Homo sapiens
caauguuccguucaucuga

SEQ ID NO: 466163 - RNA, 23 nt, Homo sapiens
caauuauuucagucaucaucuca

SEQ ID NO: 466164 - RNA, 13 nt, Homo sapiens
caauuauuuugca

SEQ ID NO: 466165 - RNA, 17 nt, Homo sapiens
caauugcuucugugcaa

SEQ ID NO: 466166 - RNA, 23 nt, Homo sapiens
caauuuuaaaaaauaacauauuc

SEQ ID NO: 466167 - RNA, 19 nt, Homo sapiens
cacaauaagccacugguau

SEQ ID NO: 466168 - RNA, 16 nt, Homo sapiens
aagccucugugcugca

SEQ ID NO: 466169 - RNA, 20 nt, Homo sapiens
aagccuguguauaaaaaaga

SEQ ID NO: 466170 - RNA, 14 nt, Homo sapiens
aagcuauauaugaa

SEQ ID NO: 466171 - RNA, 20 nt, Homo sapiens
aagcugcucuccuucacucu

SEQ ID NO: 466172 - RNA, 17 nt, Homo sapiens
aagcuggggauguuuag

SEQ ID NO: 466173 - RNA, 13 nt, Homo sapiens
aagcugucacuca

SEQ ID NO: 466174 - RNA, 21 nt, Homo sapiens
aagcuguuucuugaugggaga

SEQ ID NO: 466175 - RNA, 14 nt, Homo sapiens
aaggaaguggaaug

SEQ ID NO: 466176 - RNA, 18 nt, Homo sapiens
aaggauggaaagggaaug

SEQ ID NO: 466177 - RNA, 18 nt, Homo sapiens
aagggccccacucaggga

SEQ ID NO: 466178 - RNA, 16 nt, Homo sapiens
aaggguaugucagcua

SEQ ID NO: 466179 - RNA, 15 nt, Homo sapiens
aagguuaagccauau

SEQ ID NO: 466180 - RNA, 15 nt, Homo sapiens
aagguucuugcugcc

SEQ ID NO: 466181 - RNA, 21 nt, Homo sapiens
aaguaacacuaguagcuguuu

SEQ ID NO: 466182 - RNA, 17 nt, Homo sapiens
aaguaaccucuacaggc

SEQ ID NO: 466183 - RNA, 14 nt, Homo sapiens
aaguaauaucuuuc

SEQ ID NO: 466184 - RNA, 15 nt, Homo sapiens
aaguaauaucuuuca

SEQ ID NO: 466185 - RNA, 17 nt, Homo sapiens
aagucacguagcacaga

SEQ ID NO: 466186 - RNA, 19 nt, Homo sapiens
aaguucauucauacucaaa

SEQ ID NO: 466187 - RNA, 14 nt, Homo sapiens
aaguuccaaaaaua

SEQ ID NO: 466188 - RNA, 20 nt, Homo sapiens
aaguuguugguuuauacugu

SEQ ID NO: 466189 - RNA, 15 nt, Homo sapiens
aauaaaaacccugua

SEQ ID NO: 466190 - RNA, 17 nt, Homo sapiens
aauaaacgaaacacaga

SEQ ID NO: 466191 - RNA, 15 nt, Homo sapiens
aauaaagcaaugugg

SEQ ID NO: 466192 - RNA, 12 nt, Homo sapiens
aauaaagccucu

SEQ ID NO: 466193 - RNA, 18 nt, Homo sapiens
aauaaauuuguaugcuca

SEQ ID NO: 466194 - RNA, 17 nt, Homo sapiens
aauaaugcuuaacauaa

SEQ ID NO: 466195 - RNA, 14 nt, Homo sapiens
aauacaugguuuaa

SEQ ID NO: 466196 - RNA, 14 nt, Homo sapiens
aauacccuagaaga

SEQ ID NO: 466197 - RNA, 23 nt, Homo sapiens
aauacucuuccaaaagccugcau

SEQ ID NO: 466198 - RNA, 15 nt, Homo sapiens
aauagcaaaagugau

SEQ ID NO: 466199 - RNA, 16 nt, Homo sapiens
aauauacugcauaucc

SEQ ID NO: 466200 - RNA, 17 nt, Homo sapiens
aauauuccaauacccua

SEQ ID NO: 466201 - RNA, 13 nt, Homo sapiens
aauauucugucau

SEQ ID NO: 466202 - RNA, 17 nt, Homo sapiens
aauauuuuuuucuagcu

SEQ ID NO: 466203 - RNA, 23 nt, Homo sapiens
aaucacacucucuucuuacugua

SEQ ID NO: 466204 - RNA, 12 nt, Homo sapiens
aaucacuuugag

SEQ ID NO: 466205 - RNA, 14 nt, Homo sapiens
aaucagcauucuca

SEQ ID NO: 466206 - RNA, 20 nt, Homo sapiens
aauccauaucagcucugcau

SEQ ID NO: 466207 - RNA, 13 nt, Homo sapiens
aauccauuuucua

SEQ ID NO: 466208 - RNA, 16 nt, Homo sapiens
agaaaaugcuuucuca

SEQ ID NO: 466209 - RNA, 20 nt, Homo sapiens
agaaaaugcuuucucaugca

SEQ ID NO: 466210 - RNA, 20 nt, Homo sapiens
agaaacacggcugauaucuu

SEQ ID NO: 466211 - RNA, 20 nt, Homo sapiens
agaaacgagauuugccaaaa

SEQ ID NO: 466212 - RNA, 22 nt, Homo sapiens
agaaaggaacuuuuaaacugca

SEQ ID NO: 466213 - RNA, 15 nt, Homo sapiens
agaaauaaagcacau

SEQ ID NO: 466214 - RNA, 21 nt, Homo sapiens
agaaauacauuaugcuugaga

SEQ ID NO: 466215 - RNA, 15 nt, Homo sapiens
agaaauggcuuucca

SEQ ID NO: 466216 - RNA, 15 nt, Homo sapiens
agaaauguauccuga

SEQ ID NO: 466217 - RNA, 22 nt, Homo sapiens
agaacaguguugaaauuggaaa

SEQ ID NO: 466218 - RNA, 18 nt, Homo sapiens
agaacccuuggagccaau

SEQ ID NO: 466219 - RNA, 19 nt, Homo sapiens
agaacuccuuucuaaggag

SEQ ID NO: 466220 - RNA, 13 nt, Homo sapiens
agaacuguucauu

SEQ ID NO: 466221 - RNA, 20 nt, Homo sapiens
agaagccacgcuguccucuc

SEQ ID NO: 466222 - RNA, 11 nt, Homo sapiens
agaagcucucg

SEQ ID NO: 466223 - RNA, 18 nt, Homo sapiens
agaauacaguaagcugcu

SEQ ID NO: 466224 - RNA, 12 nt, Homo sapiens
agaauacuguau

SEQ ID NO: 466225 - RNA, 21 nt, Homo sapiens
agaaugagaacauccaucuac

SEQ ID NO: 466226 - RNA, 16 nt, Homo sapiens
agaauggugggcucca

SEQ ID NO: 466227 - RNA, 20 nt, Homo sapiens
agaauuucuuugucauucaa

SEQ ID NO: 466228 - RNA, 22 nt, Homo sapiens
agacaagaaauccuaguggccu

SEQ ID NO: 466229 - RNA, 15 nt, Homo sapiens
agacacguucuugcc

SEQ ID NO: 466230 - RNA, 17 nt, Homo sapiens
agacucgagagggcuga

SEQ ID NO: 466231 - RNA, 20 nt, Homo sapiens
agacucuuuaguugauuuaa

SEQ ID NO: 466232 - RNA, 18 nt, Homo sapiens
agacugcaggguccccaa

SEQ ID NO: 466233 - RNA, 19 nt, Homo sapiens
agacugucucaagagggca

SEQ ID NO: 466234 - RNA, 17 nt, Homo sapiens
agagacucacacuggac

SEQ ID NO: 466235 - RNA, 13 nt, Homo sapiens
agagagcaaagau

SEQ ID NO: 466236 - RNA, 19 nt, Homo sapiens
agagagugaauacacugga

SEQ ID NO: 466237 - RNA, 20 nt, Homo sapiens
agagauuugguuaagcucac

SEQ ID NO: 466238 - RNA, 20 nt, Homo sapiens
agagccuauggaaagggugu

SEQ ID NO: 466239 - RNA, 15 nt, Homo sapiens
agaggaagugcacug

SEQ ID NO: 466240 - RNA, 19 nt, Homo sapiens
agaggcucuaauguacaau

SEQ ID NO: 466241 - RNA, 11 nt, Homo sapiens
agagggggcca

SEQ ID NO: 466242 - RNA, 15 nt, Homo sapiens
agaguaaaucccacg

SEQ ID NO: 466243 - RNA, 19 nt, Homo sapiens
agauaagugcucaguauug

SEQ ID NO: 466244 - RNA, 15 nt, Homo sapiens
agaugcauccaugua

SEQ ID NO: 466245 - RNA, 22 nt, Homo sapiens
agauggcuuccgugagacacaa

SEQ ID NO: 466246 - RNA, 19 nt, Homo sapiens
agauguccucagaagucag

SEQ ID NO: 466247 - RNA, 12 nt, Homo sapiens
agauucaccucc

SEQ ID NO: 466248 - RNA, 22 nt, Homo sapiens
agauucaccuccauuaaccaag

SEQ ID NO: 466249 - RNA, 15 nt, Homo sapiens
agauuugccaaaaac

SEQ ID NO: 466250 - RNA, 16 nt, Homo sapiens
agauuuugaaugauau

SEQ ID NO: 466251 - RNA, 16 nt, Homo sapiens
agcacuagaaugagaa

SEQ ID NO: 466252 - RNA, 20 nt, Homo sapiens
agcagacacuccaguuugcc

SEQ ID NO: 466253 - RNA, 13 nt, Homo sapiens
agcagauuccaca

SEQ ID NO: 466254 - RNA, 23 nt, Homo sapiens
agcaggcggccuuuguugcucag

SEQ ID NO: 466255 - RNA, 12 nt, Homo sapiens
agcauacagagu

SEQ ID NO: 466256 - RNA, 18 nt, Homo sapiens
agcauucucauuuugcuu

SEQ ID NO: 466257 - RNA, 14 nt, Homo sapiens
agccagacccugca

SEQ ID NO: 466258 - RNA, 15 nt, Homo sapiens
agccagaggcucuaa

SEQ ID NO: 466259 - RNA, 23 nt, Homo sapiens
agccagaggcucuaauguacaau

SEQ ID NO: 466260 - RNA, 15 nt, Homo sapiens
agccccccacucagu

SEQ ID NO: 466261 - RNA, 17 nt, Homo sapiens
agcccucuccacccaga

SEQ ID NO: 466262 - RNA, 21 nt, Homo sapiens
agccucccccucagaugaucu

SEQ ID NO: 466263 - RNA, 22 nt, Homo sapiens
agccucccccucagaugaucuc

SEQ ID NO: 466264 - RNA, 12 nt, Homo sapiens
agccugcucccu

SEQ ID NO: 466265 - RNA, 13 nt, Homo sapiens
agucaggauuuau

SEQ ID NO: 466266 - RNA, 19 nt, Homo sapiens
agucaguugcaaauuuuag

SEQ ID NO: 466267 - RNA, 16 nt, Homo sapiens
aguccacuuuccucuc

SEQ ID NO: 466268 - RNA, 20 nt, Homo sapiens
aguccacuuuccucucucuc

SEQ ID NO: 466269 - RNA, 23 nt, Homo sapiens
agucuuccuccucagucuucuca

SEQ ID NO: 466270 - RNA, 13 nt, Homo sapiens
agucuuccuguag

SEQ ID NO: 466271 - RNA, 18 nt, Homo sapiens
agucuuugauucaccaaa

SEQ ID NO: 466272 - RNA, 18 nt, Homo sapiens
agucuuuguuuacaugag

SEQ ID NO: 466273 - RNA, 17 nt, Homo sapiens
agugaaaggucaucuca

SEQ ID NO: 466274 - RNA, 18 nt, Homo sapiens
agugaaaggucaucucau

SEQ ID NO: 466275 - RNA, 15 nt, Homo sapiens
agugacaugcggcug

SEQ ID NO: 466276 - RNA, 13 nt, Homo sapiens
agugagaaacuga

SEQ ID NO: 466277 - RNA, 14 nt, Homo sapiens
agugccaauccaag

SEQ ID NO: 466278 - RNA, 18 nt, Homo sapiens
agugcgugugaaacagcg

SEQ ID NO: 466279 - RNA, 22 nt, Homo sapiens
aguggucaagcccuugcccaga

SEQ ID NO: 466280 - RNA, 15 nt, Homo sapiens
aguguguacuucuuc

SEQ ID NO: 466281 - RNA, 16 nt, Homo sapiens
aguuaaauuggcuugu

SEQ ID NO: 466282 - RNA, 23 nt, Homo sapiens
aguuagcccggccaaggacacug

SEQ ID NO: 466283 - RNA, 20 nt, Homo sapiens
aguucuccuuguacuugaau

SEQ ID NO: 466284 - RNA, 16 nt, Homo sapiens
aguucuuuuaagccca

SEQ ID NO: 466285 - RNA, 19 nt, Homo sapiens
aguuguauuuuaauaaaga

SEQ ID NO: 466286 - RNA, 21 nt, Homo sapiens
aguuguugguuuauacuguau

SEQ ID NO: 466287 - RNA, 20 nt, Homo sapiens
aguuuaggacccaagguggu

SEQ ID NO: 466288 - RNA, 17 nt, Homo sapiens
aguuuauaaaagacugu

SEQ ID NO: 466289 - RNA, 20 nt, Homo sapiens
aguuucuauggauucacuuc

SEQ ID NO: 466290 - RNA, 21 nt, Homo sapiens
auaaaaccaucaaaaauauuc

SEQ ID NO: 466291 - RNA, 19 nt, Homo sapiens
auaaacauuaaacacugua

SEQ ID NO: 466292 - RNA, 17 nt, Homo sapiens
auaaacuuguacuuaca

SEQ ID NO: 466293 - RNA, 19 nt, Homo sapiens
auaaagccucugugcugca

SEQ ID NO: 466294 - RNA, 16 nt, Homo sapiens
auaaguaacacuagua

SEQ ID NO: 466295 - RNA, 18 nt, Homo sapiens
auaagugcucaguauuga

SEQ ID NO: 466296 - RNA, 17 nt, Homo sapiens
auacacuggaauucaga

SEQ ID NO: 466297 - RNA, 13 nt, Homo sapiens
auacagaccucca

SEQ ID NO: 466298 - RNA, 13 nt, Homo sapiens
auacauuaugcuu

SEQ ID NO: 466299 - RNA, 23 nt, Homo sapiens
auacucaaagaggccaguacuuu

SEQ ID NO: 466300 - RNA, 19 nt, Homo sapiens
auacuucuuuuucauuauu

SEQ ID NO: 466301 - RNA, 12 nt, Homo sapiens
auagaauccaaa

SEQ ID NO: 466302 - RNA, 22 nt, Homo sapiens
auagcgugcaguagagagcaaa

SEQ ID NO: 466303 - RNA, 13 nt, Homo sapiens
auaggagccacaa

SEQ ID NO: 466304 - RNA, 12 nt, Homo sapiens
auaggaggacag

SEQ ID NO: 466305 - RNA, 23 nt, Homo sapiens
auaggugcucuuccucaucucau

SEQ ID NO: 466306 - RNA, 22 nt, Homo sapiens
auagucuguacuucaguucuca

SEQ ID NO: 466307 - RNA, 23 nt, Homo sapiens
auauacauauguuaauucuaguc

SEQ ID NO: 466308 - RNA, 13 nt, Homo sapiens
auauacugcauau

SEQ ID NO: 466309 - RNA, 17 nt, Homo sapiens
auaucagcucugcauaa

SEQ ID NO: 466310 - RNA, 20 nt, Homo sapiens
auaucuuugagggcugacaa

SEQ ID NO: 466311 - RNA, 14 nt, Homo sapiens
auauguaucuaguc

SEQ ID NO: 466312 - RNA, 13 nt, Homo sapiens
auauuccuaugcu

SEQ ID NO: 466313 - RNA, 21 nt, Homo sapiens
auauuuauuauuuucauauaa

SEQ ID NO: 466314 - RNA, 22 nt, Homo sapiens
aucaauuuaaaggaaaguucua

SEQ ID NO: 466315 - RNA, 22 nt, Homo sapiens
aucaccucuuaugcacaccucc

SEQ ID NO: 466316 - RNA, 22 nt, Homo sapiens
aucagggggcaugaagcacauu

SEQ ID NO: 466317 - RNA, 23 nt, Homo sapiens
aucauugagaaauaaagcacauu

SEQ ID NO: 466318 - RNA, 19 nt, Homo sapiens
auccaaauucucugagaug

SEQ ID NO: 466319 - RNA, 12 nt, Homo sapiens
auccaauggauu

SEQ ID NO: 466320 - RNA, 18 nt, Homo sapiens
auccauagacacaguauu

SEQ ID NO: 466321 - RNA, 13 nt, Homo sapiens
uaucucaugacaa

SEQ ID NO: 466322 - RNA, 22 nt, Homo sapiens
uaucuggguuuuagaaauucua

SEQ ID NO: 466323 - RNA, 14 nt, Homo sapiens
uaucugucaucucu

SEQ ID NO: 466324 - RNA, 16 nt, Homo sapiens
uaucugucaucucucu

SEQ ID NO: 466325 - RNA, 19 nt, Homo sapiens
uaugaaccgcaauauggga

SEQ ID NO: 466326 - RNA, 21 nt, Homo sapiens
uaugacuguuuuuguaguggu

SEQ ID NO: 466327 - RNA, 22 nt, Homo sapiens
uaugauaugcauguagcauaua

SEQ ID NO: 466328 - RNA, 16 nt, Homo sapiens
uaugcauguagcauau

SEQ ID NO: 466329 - RNA, 12 nt, Homo sapiens
uaugcuggccag

SEQ ID NO: 466330 - RNA, 15 nt, Homo sapiens
uaugguaacugauga

SEQ ID NO: 466331 - RNA, 19 nt, Homo sapiens
uauguaagaagaaacugcu

SEQ ID NO: 466332 - RNA, 18 nt, Homo sapiens
uauguauaacaagccaaa

SEQ ID NO: 466333 - RNA, 19 nt, Homo sapiens
uaugucagcuacaugaagu

SEQ ID NO: 466334 - RNA, 13 nt, Homo sapiens
uauucaacuaaua

SEQ ID NO: 466335 - RNA, 14 nt, Homo sapiens
uauucccccaaagc

SEQ ID NO: 466336 - RNA, 22 nt, Homo sapiens
uauugguaauuuuaugagcugu

SEQ ID NO: 466337 - RNA, 22 nt, Homo sapiens
uauugguuuuaaaaaagcauua

SEQ ID NO: 466338 - RNA, 23 nt, Homo sapiens
uauugguuuuaaaaaagcauuau

SEQ ID NO: 466339 - RNA, 20 nt, Homo sapiens
uauuuacggaggcguuguga

SEQ ID NO: 466340 - RNA, 17 nt, Homo sapiens
uauuucagauucaccuc

SEQ ID NO: 466341 - RNA, 16 nt, Homo sapiens
uauuucauccaguuug

SEQ ID NO: 466342 - RNA, 21 nt, Homo sapiens
uauuucuaucugcaaauaguu

SEQ ID NO: 466343 - RNA, 20 nt, Homo sapiens
uauuuuaaacuacugauuga

SEQ ID NO: 466344 - RNA, 14 nt, Homo sapiens
ucaaaauaguucua

SEQ ID NO: 466345 - RNA, 19 nt, Homo sapiens
ucaaaaucugggaccaaaa

SEQ ID NO: 466346 - RNA, 17 nt, Homo sapiens
ucaaacuuucaccucag

SEQ ID NO: 466347 - RNA, 14 nt, Homo sapiens
ucaaaugcaugaua

SEQ ID NO: 466348 - RNA, 17 nt, Homo sapiens
ucaaaugcuacucagua

SEQ ID NO: 466349 - RNA, 22 nt, Homo sapiens
ucaauacuuuuguguauucugu

SEQ ID NO: 466350 - RNA, 12 nt, Homo sapiens
ucaaugaccugu

SEQ ID NO: 466351 - RNA, 15 nt, Homo sapiens
ucaaugcuagcacaa

SEQ ID NO: 466352 - RNA, 20 nt, Homo sapiens
ucaauuuuuaacuuaucucc

SEQ ID NO: 466353 - RNA, 23 nt, Homo sapiens
ucacaaauaaguaauaucuuuca

SEQ ID NO: 466354 - RNA, 21 nt, Homo sapiens
ucacacacacacaauggcaag

SEQ ID NO: 466355 - RNA, 23 nt, Homo sapiens
ucacacucucuucuuacuguauu

SEQ ID NO: 466356 - RNA, 24 nt, Homo sapiens
ucacagagauuugguuaagcucac

SEQ ID NO: 466357 - RNA, 22 nt, Homo sapiens
ucacauguccuauuacugaugu

SEQ ID NO: 466358 - RNA, 14 nt, Homo sapiens
ucaccaaacaugaa

SEQ ID NO: 466359 - RNA, 18 nt, Homo sapiens
ucaccuagcugcucucua

SEQ ID NO: 466360 - RNA, 15 nt, Homo sapiens
ucacuaugguaugcu

SEQ ID NO: 466361 - RNA, 16 nt, Homo sapiens
ucacucugacaguauu

SEQ ID NO: 466362 - RNA, 12 nt, Homo sapiens
ucacucugucag

SEQ ID NO: 466363 - RNA, 17 nt, Homo sapiens
ucacugcaccucuuugu

SEQ ID NO: 466364 - RNA, 14 nt, Homo sapiens
ucacuuauuucaua

SEQ ID NO: 466365 - RNA, 15 nt, Homo sapiens
ucacuucugcuguac

SEQ ID NO: 466366 - RNA, 17 nt, Homo sapiens
ucacuucugcuguacag

SEQ ID NO: 466367 - RNA, 22 nt, Homo sapiens
ucagaauuucuuugucauucaa

SEQ ID NO: 466368 - RNA, 15 nt, Homo sapiens
ucagauuuucuggac

SEQ ID NO: 466369 - RNA, 20 nt, Homo sapiens
ucagcaacccuacaguauau

SEQ ID NO: 466370 - RNA, 13 nt, Homo sapiens
ucagcucugcaua

SEQ ID NO: 466371 - RNA, 14 nt, Homo sapiens
ucagggaucucaga

SEQ ID NO: 466372 - RNA, 20 nt, Homo sapiens
ucagggggcaugaagcacau

SEQ ID NO: 466373 - RNA, 23 nt, Homo sapiens
ucaguagugcuaucucaugacaa

SEQ ID NO: 466374 - RNA, 15 nt, Homo sapiens
ucagucaucaucuca

SEQ ID NO: 466375 - RNA, 21 nt, Homo sapiens
ucagucuuugggggauucaaa

SEQ ID NO: 466376 - RNA, 15 nt, Homo sapiens
ucaguuucacauauu

SEQ ID NO: 466377 - RNA, 19 nt, Homo sapiens
ucaguuucacauauuugua

SEQ ID NO: 466378 - RNA, 22 nt, Homo sapiens
ucauaaauuggcuccuuuccca

SEQ ID NO: 466379 - RNA, 24 nt, Homo sapiens
ucauacaaaggacaguacacacuu

SEQ ID NO: 466380 - RNA, 15 nt, Homo sapiens
ucauccaacuggaag

SEQ ID NO: 466381 - RNA, 19 nt, Homo sapiens
ucaucucaaacacugcuua

SEQ ID NO: 466382 - RNA, 19 nt, Homo sapiens
ucauguauaaaacuaggaa

SEQ ID NO: 466383 - RNA, 17 nt, Homo sapiens
ucauucauacucaaaga

SEQ ID NO: 466384 - RNA, 11 nt, Homo sapiens
ucauucuugcc

SEQ ID NO: 466385 - RNA, 17 nt, Homo sapiens
ucauugaagacccucaa

SEQ ID NO: 466386 - RNA, 23 nt, Homo sapiens
ucauuuuugcuuuucaaaugaca

SEQ ID NO: 466387 - RNA, 23 nt, Homo sapiens
uccaaaauagucauguuucugca

SEQ ID NO: 466388 - RNA, 21 nt, Homo sapiens
uccaaaguuuuaaaccuguua

SEQ ID NO: 466389 - RNA, 19 nt, Homo sapiens
uccaacuggaaggcuuuau

SEQ ID NO: 466390 - RNA, 13 nt, Homo sapiens
uccacuccuccca

SEQ ID NO: 466391 - RNA, 14 nt, Homo sapiens
uccacucugagguc

SEQ ID NO: 466392 - RNA, 17 nt, Homo sapiens
uccacucugaggucuca

SEQ ID NO: 466393 - RNA, 16 nt, Homo sapiens
uccagaccccuacccu

SEQ ID NO: 466394 - RNA, 18 nt, Homo sapiens
uccaggguuaaagaaagg

SEQ ID NO: 466395 - RNA, 13 nt, Homo sapiens
uccauaugcucuu

SEQ ID NO: 466396 - RNA, 16 nt, Homo sapiens
uccauuaaccaagaaa

SEQ ID NO: 466397 - RNA, 16 nt, Homo sapiens
ucccaaaggcuuucuu

SEQ ID NO: 466398 - RNA, 13 nt, Homo sapiens
ucccaaaugccuu

SEQ ID NO: 466399 - RNA, 16 nt, Homo sapiens
ucccacaggcccuucc

SEQ ID NO: 466400 - RNA, 19 nt, Homo sapiens
ucccacccuucucagggac

SEQ ID NO: 466401 - RNA, 18 nt, Homo sapiens
ucccagcaccuggcacac

SEQ ID NO: 466402 - RNA, 15 nt, Homo sapiens
uccccacccaccacc

SEQ ID NO: 466403 - RNA, 18 nt, Homo sapiens
uccccagccugcucccua

SEQ ID NO: 466404 - RNA, 13 nt, Homo sapiens
ucccgccuuugac

SEQ ID NO: 466405 - RNA, 18 nt, Homo sapiens
ucccgccuuugaccugac

SEQ ID NO: 466406 - RNA, 13 nt, Homo sapiens
ucccggagcucaa

SEQ ID NO: 466407 - RNA, 21 nt, Homo sapiens
ucccgguguaugcagugguga

SEQ ID NO: 466408 - RNA, 21 nt, Homo sapiens
ucccucaggcuuguugcccuc

SEQ ID NO: 466409 - RNA, 14 nt, Homo sapiens
ucccucucuugccg

SEQ ID NO: 466410 - RNA, 14 nt, Homo sapiens
ucccuuaggaauau

SEQ ID NO: 466411 - RNA, 13 nt, Homo sapiens
uccgugcguccuc

SEQ ID NO: 466412 - RNA, 14 nt, Homo sapiens
uccuauuacugaug

SEQ ID NO: 466413 - RNA, 14 nt, Homo sapiens
uccucacauucaca

SEQ ID NO: 466414 - RNA, 21 nt, Homo sapiens
uccucagaagucaguugcaaa

SEQ ID NO: 466415 - RNA, 16 nt, Homo sapiens
uccucaguuuuuccua

SEQ ID NO: 466416 - RNA, 14 nt, Homo sapiens
uccuccuucacucc

SEQ ID NO: 466417 - RNA, 13 nt, Homo sapiens
uccucuccacugc

SEQ ID NO: 466418 - RNA, 12 nt, Homo sapiens
uccucuucccug

SEQ ID NO: 466419 - RNA, 21 nt, Homo sapiens
uccugauaaacauuaaacacu

SEQ ID NO: 466420 - RNA, 22 nt, Homo sapiens
uccugcaaacccauuuccagcu

SEQ ID NO: 466421 - RNA, 20 nt, Homo sapiens
uccuucacucugacaguauu

SEQ ID NO: 466422 - RNA, 14 nt, Homo sapiens
uccuuccacuucag

SEQ ID NO: 466423 - RNA, 13 nt, Homo sapiens
uccuuuaauccca

SEQ ID NO: 466424 - RNA, 23 nt, Homo sapiens
ucggcaccuuccccugaggaccu

SEQ ID NO: 466425 - RNA, 19 nt, Homo sapiens
ucguccuuagaauacugua

SEQ ID NO: 466426 - RNA, 20 nt, Homo sapiens
ucguccuuagaauacuguau

SEQ ID NO: 466427 - RNA, 13 nt, Homo sapiens
ucgugccguccuc

SEQ ID NO: 466428 - RNA, 14 nt, Homo sapiens
ucuaaaaaauaacu

SEQ ID NO: 466429 - RNA, 21 nt, Homo sapiens
ucuaauugcccacccaguaug

SEQ ID NO: 466430 - RNA, 21 nt, Homo sapiens
ucuacugcuuggauccauaca

SEQ ID NO: 466431 - RNA, 15 nt, Homo sapiens
ucuagaacagccaga

SEQ ID NO: 466432 - RNA, 13 nt, Homo sapiens
ucuauaaauucaa

SEQ ID NO: 466433 - RNA, 15 nt, Homo sapiens
ucuauauccauaacu

SEQ ID NO: 466434 - RNA, 18 nt, Homo sapiens
ucuauauuuggauucaca

SEQ ID NO: 466435 - RNA, 12 nt, Homo sapiens
ucuaugugcaac

SEQ ID NO: 466436 - RNA, 14 nt, Homo sapiens
ucuaugugcaacug

SEQ ID NO: 466437 - RNA, 14 nt, Homo sapiens
ucucaaacacugcu

SEQ ID NO: 466438 - RNA, 22 nt, Homo sapiens
ucucaccuucgccuuugcugaa

SEQ ID NO: 466439 - RNA, 16 nt, Homo sapiens
ucucaucuaguuugau

SEQ ID NO: 466440 - RNA, 13 nt, Homo sapiens
ucucauucuugcc

SEQ ID NO: 466441 - RNA, 19 nt, Homo sapiens
ucuccaauuggguugugaa

SEQ ID NO: 466442 - RNA, 21 nt, Homo sapiens
ucuccaauuggguugugaaau

SEQ ID NO: 466443 - RNA, 21 nt, Homo sapiens
ucuccagccaauuucaaagaa

SEQ ID NO: 466444 - RNA, 13 nt, Homo sapiens
ucuccccaugugc

SEQ ID NO: 466445 - RNA, 21 nt, Homo sapiens
ucuccuuguaaaagccuaugu

SEQ ID NO: 466446 - RNA, 16 nt, Homo sapiens
ucucgggugcauuuga

SEQ ID NO: 466447 - RNA, 16 nt, Homo sapiens
ucucuguuuacccucc

SEQ ID NO: 466448 - RNA, 24 nt, Homo sapiens
ucugaaaauauuuuuuucuagcua

SEQ ID NO: 466449 - RNA, 13 nt, Homo sapiens
ucugcagccugag

SEQ ID NO: 466450 - RNA, 16 nt, Homo sapiens
ucugccccuccguccc

SEQ ID NO: 466451 - RNA, 21 nt, Homo sapiens
ucuguaaauuuaacugcauau

SEQ ID NO: 466452 - RNA, 17 nt, Homo sapiens
ucugugcaaaacuacca

SEQ ID NO: 466453 - RNA, 12 nt, Homo sapiens
ucugugcugcac

SEQ ID NO: 466454 - RNA, 17 nt, Homo sapiens
ucuguguaaucucugau

SEQ ID NO: 466455 - RNA, 18 nt, Homo sapiens
ucuuaaccuauucccaaa

SEQ ID NO: 466456 - RNA, 18 nt, Homo sapiens
ucuucaaaauaucaagug

SEQ ID NO: 466457 - RNA, 23 nt, Homo sapiens
ucuucaaacaguuccauaccaag

SEQ ID NO: 466458 - RNA, 21 nt, Homo sapiens
ucuucagagagcuaaauuaca

SEQ ID NO: 466459 - RNA, 17 nt, Homo sapiens
ucuuccaaguucauuca

SEQ ID NO: 466460 - RNA, 16 nt, Homo sapiens
ucuuccauaugcucuu

SEQ ID NO: 466461 - RNA, 16 nt, Homo sapiens
ucuucccacuuugcca

SEQ ID NO: 466462 - RNA, 17 nt, Homo sapiens
ucuucccacuuugccac

SEQ ID NO: 466463 - RNA, 19 nt, Homo sapiens
ucuucccacuuugccacug

SEQ ID NO: 466464 - RNA, 14 nt, Homo sapiens
ucuuccucuuaccu

SEQ ID NO: 466465 - RNA, 15 nt, Homo sapiens
ucuuccucuuaccug

SEQ ID NO: 466466 - RNA, 13 nt, Homo sapiens
ucuucuccacugg

SEQ ID NO: 466467 - RNA, 22 nt, Homo sapiens
ucuugagauguauuaugcaaag

SEQ ID NO: 466468 - RNA, 13 nt, Homo sapiens
ucuuggauuggua

SEQ ID NO: 466469 - RNA, 12 nt, Homo sapiens
ucuugguguugu

SEQ ID NO: 466470 - RNA, 14 nt, Homo sapiens
ucuuuaacauacau

SEQ ID NO: 466471 - RNA, 12 nt, Homo sapiens
ucuuuccaaucc

SEQ ID NO: 466472 - RNA, 22 nt, Homo sapiens
uuguauuuuaauaaagauucca

SEQ ID NO: 466473 - RNA, 18 nt, Homo sapiens
uugucauucaagccugug

SEQ ID NO: 466474 - RNA, 21 nt, Homo sapiens
uugugaaugugucccaugcau

SEQ ID NO: 466475 - RNA, 20 nt, Homo sapiens
uugugacaggaaagcccucc

SEQ ID NO: 466476 - RNA, 23 nt, Homo sapiens
uuguuaugugaauugagcacaua

SEQ ID NO: 466477 - RNA, 11 nt, Homo sapiens
uuguugcucag

SEQ ID NO: 466478 - RNA, 20 nt, Homo sapiens
uuuaaaaaaaaauugaacaa

SEQ ID NO: 466479 - RNA, 16 nt, Homo sapiens
uuuaaaaaaauaacau

SEQ ID NO: 466480 - RNA, 21 nt, Homo sapiens
uuuaaacuacugauugaaugu

SEQ ID NO: 466481 - RNA, 12 nt, Homo sapiens
uuuaaagggagg

SEQ ID NO: 466482 - RNA, 12 nt, Homo sapiens
uuuaaagucaca

SEQ ID NO: 466483 - RNA, 18 nt, Homo sapiens
uuuacaugaguucaaaua

SEQ ID NO: 466484 - RNA, 20 nt, Homo sapiens
uuuaccaaucaacagcaugu

SEQ ID NO: 466485 - RNA, 24 nt, Homo sapiens
uuuauugccucuaugugcaacuga

SEQ ID NO: 466486 - RNA, 13 nt, Homo sapiens
uuucaccucagau

SEQ ID NO: 466487 - RNA, 18 nt, Homo sapiens
uuucagggcugggcuaua

SEQ ID NO: 466488 - RNA, 17 nt, Homo sapiens
uuucagucaucaucuca

SEQ ID NO: 466489 - RNA, 21 nt, Homo sapiens
uuuccaacaaacuuacuguca

SEQ ID NO: 466490 - RNA, 22 nt, Homo sapiens
uuuccaauccuuuauagcuuug

SEQ ID NO: 466491 - RNA, 12 nt, Homo sapiens
uuuccacuucca

SEQ ID NO: 466492 - RNA, 22 nt, Homo sapiens
uuuccagcuccuaguagcuuuc

SEQ ID NO: 466493 - RNA, 12 nt, Homo sapiens
uuuccaucuccc

SEQ ID NO: 466494 - RNA, 15 nt, Homo sapiens
uuuccuuugaccucu

SEQ ID NO: 466495 - RNA, 22 nt, Homo sapiens
uuucuucagagagcuaaauuac

SEQ ID NO: 466496 - RNA, 15 nt, Homo sapiens
uuugcaagaaccaga

SEQ ID NO: 466497 - RNA, 15 nt, Homo sapiens
uuugcucuacuuuau

SEQ ID NO: 466498 - RNA, 20 nt, Homo sapiens
uuugcucuagggaagcagug

SEQ ID NO: 466499 - RNA, 15 nt, Homo sapiens
uuuggcagauuuucu

SEQ ID NO: 466500 - RNA, 13 nt, Homo sapiens
uuugggaaauucu

SEQ ID NO: 466501 - RNA, 13 nt, Homo sapiens
uuugggggauuca

SEQ ID NO: 466502 - RNA, 15 nt, Homo sapiens
uuuggugaauaaccu

SEQ ID NO: 466503 - RNA, 18 nt, Homo sapiens
uuugguuuugugugguau

SEQ ID NO: 466504 - RNA, 12 nt, Homo sapiens
uuugucacuucu

SEQ ID NO: 466505 - RNA, 16 nt, Homo sapiens
uuuguccaugugcaaa

SEQ ID NO: 466506 - RNA, 12 nt, Homo sapiens
uuuguugcucag

SEQ ID NO: 466507 - RNA, 14 nt, Homo sapiens
uuuuaaacuacuga

SEQ ID NO: 466508 - RNA, 19 nt, Homo sapiens
uuuuauguguugaugacuc

SEQ ID NO: 466509 - RNA, 13 nt, Homo sapiens
uuuuccacuuaga

SEQ ID NO: 466510 - RNA, 17 nt, Homo sapiens
uuuucugucuuuaugua

SEQ ID NO: 466511 - RNA, 22 nt, Homo sapiens
uuuuucccccaaccucccccuc

SEQ ID NO: 466512 - RNA, 17 nt, Homo sapiens
uuuuuggauggcuuaag

SEQ ID NO: 466513 - RNA, 22 nt, Homo sapiens
ugugaagccuuuaucuauggga

SEQ ID NO: 466514 - RNA, 20 nt, Homo sapiens
ugugaauaaaaacccuguau

SEQ ID NO: 466515 - RNA, 19 nt, Homo sapiens
ugugacuuuuucagaguug

SEQ ID NO: 466516 - RNA, 19 nt, Homo sapiens
ugugccaaaaugucaauuu

SEQ ID NO: 466517 - RNA, 9 nt, Homo sapiens
ugugcucca

SEQ ID NO: 466518 - RNA, 12 nt, Homo sapiens
ugugcuuucauc

SEQ ID NO: 466519 - RNA, 15 nt, Homo sapiens
uguggauucuauauu

SEQ ID NO: 466520 - RNA, 23 nt, Homo sapiens
ugugugcaucaugucucuuugcc

SEQ ID NO: 466521 - RNA, 17 nt, Homo sapiens
ugugugguauucaacua

SEQ ID NO: 466522 - RNA, 15 nt, Homo sapiens
ugugugugcaauguu

SEQ ID NO: 466523 - RNA, 17 nt, Homo sapiens
uguguucaaucugugaa

SEQ ID NO: 466524 - RNA, 23 nt, Homo sapiens
uguuaauggucaaugcuagcaca

SEQ ID NO: 466525 - RNA, 16 nt, Homo sapiens
uguuagagugucuuaa

SEQ ID NO: 466526 - RNA, 22 nt, Homo sapiens
uguuagcaauauguuagcaaga

SEQ ID NO: 466527 - RNA, 23 nt, Homo sapiens
uguucccacucccucucuugccg

SEQ ID NO: 466528 - RNA, 14 nt, Homo sapiens
uguuccuacuggag

SEQ ID NO: 466529 - RNA, 19 nt, Homo sapiens
uguucuccggguguggccu

SEQ ID NO: 466530 - RNA, 18 nt, Homo sapiens
uguucuuccucuuaccug

SEQ ID NO: 466531 - RNA, 17 nt, Homo sapiens
uguugaugaagcacauu

SEQ ID NO: 466532 - RNA, 19 nt, Homo sapiens
uguugguuacaugaaugaa

SEQ ID NO: 466533 - RNA, 16 nt, Homo sapiens
uguugugucuugcuau

SEQ ID NO: 466534 - RNA, 16 nt, Homo sapiens
uguuucugcaguauuc

SEQ ID NO: 466535 - RNA, 14 nt, Homo sapiens
uuaaaaaaauaaca

SEQ ID NO: 466536 - RNA, 14 nt, Homo sapiens
uuaaaaaauaacau

SEQ ID NO: 466537 - RNA, 22 nt, Homo sapiens
uuaaaauaaauuuguaugcuca

SEQ ID NO: 466538 - RNA, 20 nt, Homo sapiens
uuaaaggaaaguucuauuau

SEQ ID NO: 466539 - RNA, 17 nt, Homo sapiens
uuaaagucaggauuuau

SEQ ID NO: 466540 - RNA, 21 nt, Homo sapiens
uuaacugccuuacagacagaa

SEQ ID NO: 466541 - RNA, 18 nt, Homo sapiens
uuaagacaacaggcauuu

SEQ ID NO: 466542 - RNA, 13 nt, Homo sapiens
uuaauauuccaau

SEQ ID NO: 466543 - RNA, 22 nt, Homo sapiens
uuaauggucaaugcuagcacaa

SEQ ID NO: 466544 - RNA, 20 nt, Homo sapiens
uuacaugaguucaaauacuu

SEQ ID NO: 466545 - RNA, 15 nt, Homo sapiens
uuagaaugagccuua

SEQ ID NO: 466546 - RNA, 13 nt, Homo sapiens
uuagauugccacu

SEQ ID NO: 466547 - RNA, 21 nt, Homo sapiens
uuagugguaaaugucacauug

SEQ ID NO: 466548 - RNA, 20 nt, Homo sapiens
uuauauacuggaaauaaccu

SEQ ID NO: 466549 - RNA, 16 nt, Homo sapiens
uuauccuuuuaucuca

SEQ ID NO: 466550 - RNA, 12 nt, Homo sapiens
uuaugacuguuu

SEQ ID NO: 466551 - RNA, 15 nt, Homo sapiens
uuaugaggcuauuaa

SEQ ID NO: 466552 - RNA, 11 nt, Homo sapiens
uuaugcugcug

SEQ ID NO: 466553 - RNA, 14 nt, Homo sapiens
uuauguagcugaau

SEQ ID NO: 466554 - RNA, 18 nt, Homo sapiens
uuauguguugaugacuca

SEQ ID NO: 466555 - RNA, 14 nt, Homo sapiens
ccacuuaugcugcu

SEQ ID NO: 466556 - RNA, 14 nt, Homo sapiens
ccagaagugccaug

SEQ ID NO: 466557 - RNA, 19 nt, Homo sapiens
ccagacccuccuuccccac

SEQ ID NO: 466558 - RNA, 15 nt, Homo sapiens
ccagagaguggcucc

SEQ ID NO: 466559 - RNA, 16 nt, Homo sapiens
ccagagggacuuugcc

SEQ ID NO: 466560 - RNA, 15 nt, Homo sapiens
ccagaucguacuuga

SEQ ID NO: 466561 - RNA, 22 nt, Homo sapiens
ccagccucuagaacagccagac

SEQ ID NO: 466562 - RNA, 20 nt, Homo sapiens
ccagccugcucccuagccag

SEQ ID NO: 466563 - RNA, 19 nt, Homo sapiens
ccagggggaagaugccaag

SEQ ID NO: 466564 - RNA, 20 nt, Homo sapiens
ccagggugcaggcgcgcacc

SEQ ID NO: 466565 - RNA, 14 nt, Homo sapiens
ccaggguuccagac

SEQ ID NO: 466566 - RNA, 17 nt, Homo sapiens
ccagucccucagccacu

SEQ ID NO: 466567 - RNA, 12 nt, Homo sapiens
ccauaauuguuc

SEQ ID NO: 466568 - RNA, 13 nt, Homo sapiens
ccaucccacugau

SEQ ID NO: 466569 - RNA, 23 nt, Homo sapiens
ccauugcaaaagguuaagccaua

SEQ ID NO: 466570 - RNA, 19 nt, Homo sapiens
cccaaggaagaacaaauau

SEQ ID NO: 466571 - RNA, 16 nt, Homo sapiens
cccaagguggucuugg

SEQ ID NO: 466572 - RNA, 14 nt, Homo sapiens
cccacucagggauc

SEQ ID NO: 466573 - RNA, 16 nt, Homo sapiens
cccacuuaugcugcug

SEQ ID NO: 466574 - RNA, 20 nt, Homo sapiens
cccagccucuagaacagcca

SEQ ID NO: 466575 - RNA, 22 nt, Homo sapiens
cccagucuuuggagagcucagu

SEQ ID NO: 466576 - RNA, 22 nt, Homo sapiens
ccccagccugcucccuagccag

SEQ ID NO: 466577 - RNA, 15 nt, Homo sapiens
ccccaugugccugca

SEQ ID NO: 466578 - RNA, 15 nt, Homo sapiens
ccccucacucuguca

SEQ ID NO: 466579 - RNA, 17 nt, Homo sapiens
ccccucagugguuuccu

SEQ ID NO: 466580 - RNA, 20 nt, Homo sapiens
ccccucccgccucgcugggc

SEQ ID NO: 466581 - RNA, 14 nt, Homo sapiens
ccccuggcuuuuca

SEQ ID NO: 466582 - RNA, 15 nt, Homo sapiens
cccgcucacgcugac

SEQ ID NO: 466583 - RNA, 19 nt, Homo sapiens
cccgugcaacggaagccag

SEQ ID NO: 466584 - RNA, 20 nt, Homo sapiens
cccgugcaacggaagccagg

SEQ ID NO: 466585 - RNA, 16 nt, Homo sapiens
cccuacgaaagcacag

SEQ ID NO: 466586 - RNA, 13 nt, Homo sapiens
cccuccaauccca

SEQ ID NO: 466587 - RNA, 14 nt, Homo sapiens
cccuccuuuccaaa

SEQ ID NO: 466588 - RNA, 15 nt, Homo sapiens
ccgagacccaccauc

SEQ ID NO: 466589 - RNA, 19 nt, Homo sapiens
ccgggcuggccugugccua

SEQ ID NO: 466590 - RNA, 18 nt, Homo sapiens
ccgucuuccggucauucu

SEQ ID NO: 466591 - RNA, 23 nt, Homo sapiens
ccguggugugaggcccccggagg

SEQ ID NO: 466592 - RNA, 15 nt, Homo sapiens
ccuaaaucacuuuga

SEQ ID NO: 466593 - RNA, 13 nt, Homo sapiens
ccuacaucugaaa

SEQ ID NO: 466594 - RNA, 15 nt, Homo sapiens
ccuacgaaagcacag

SEQ ID NO: 466595 - RNA, 20 nt, Homo sapiens
ccuacuuauuucagauucac

SEQ ID NO: 466596 - RNA, 18 nt, Homo sapiens
ccuagccagaggcucuaa

SEQ ID NO: 466597 - RNA, 11 nt, Homo sapiens
ccuaucaccuc

SEQ ID NO: 466598 - RNA, 16 nt, Homo sapiens
ccuauggaaagggugu

SEQ ID NO: 466599 - RNA, 15 nt, Homo sapiens
ccuaugguuuugcug

SEQ ID NO: 466600 - RNA, 16 nt, Homo sapiens
ccuauucuauugcagu

SEQ ID NO: 466601 - RNA, 18 nt, Homo sapiens
ccucaagccaggagaccc

SEQ ID NO: 466602 - RNA, 14 nt, Homo sapiens
ccucaccuucccua

SEQ ID NO: 466603 - RNA, 18 nt, Homo sapiens
ccucacuggugcauuuaa

SEQ ID NO: 466604 - RNA, 19 nt, Homo sapiens
ccucacuggugcauuuaaa

SEQ ID NO: 466605 - RNA, 23 nt, Homo sapiens
ccucagauuuucuggacuuaguc

SEQ ID NO: 466606 - RNA, 18 nt, Homo sapiens
ccuccagggcgagcacuu

SEQ ID NO: 466607 - RNA, 19 nt, Homo sapiens
ccuccagggcgagcacuuu

SEQ ID NO: 466608 - RNA, 20 nt, Homo sapiens
ccuccccaaggaagaacaaa

SEQ ID NO: 466609 - RNA, 22 nt, Homo sapiens
ccucuaugugcaacugacagau

SEQ ID NO: 466610 - RNA, 12 nt, Homo sapiens
ccucucuccuuc

SEQ ID NO: 466611 - RNA, 19 nt, Homo sapiens
ccucucuccuuccugcugu

SEQ ID NO: 466612 - RNA, 14 nt, Homo sapiens
ccucucuugccgac

SEQ ID NO: 466613 - RNA, 13 nt, Homo sapiens
ccucugcccucau

SEQ ID NO: 466614 - RNA, 19 nt, Homo sapiens
ccucugugccauggaugau

SEQ ID NO: 466615 - RNA, 17 nt, Homo sapiens
ccucuucuugcggcacc

SEQ ID NO: 466616 - RNA, 18 nt, Homo sapiens
ccugacagaaggacucag

SEQ ID NO: 466617 - RNA, 18 nt, Homo sapiens
ccugaggaaguuuugcau

SEQ ID NO: 466618 - RNA, 16 nt, Homo sapiens
ccugcucacucuucca

SEQ ID NO: 466619 - RNA, 16 nt, Homo sapiens
ccugcucccuagccag

SEQ ID NO: 466620 - RNA, 17 nt, Homo sapiens
ccugcucccuagccaga

SEQ ID NO: 466621 - RNA, 22 nt, Homo sapiens
ccugcucccuagccagaggcuc

SEQ ID NO: 466622 - RNA, 13 nt, Homo sapiens
ccuggcacaccag

SEQ ID NO: 466623 - RNA, 23 nt, Homo sapiens
ccuggcacaccagaagugccaug

SEQ ID NO: 466624 - RNA, 17 nt, Homo sapiens
ccugggaaauaagcccc

SEQ ID NO: 466625 - RNA, 15 nt, Homo sapiens
ccuggggguggcagg

SEQ ID NO: 466626 - RNA, 22 nt, Homo sapiens
ccuguggcccucgcucugccuc

SEQ ID NO: 466627 - RNA, 15 nt, Homo sapiens
ccuuaagaaagcuau

SEQ ID NO: 466628 - RNA, 15 nt, Homo sapiens
ccuuaccaauaauaa

SEQ ID NO: 466629 - RNA, 20 nt, Homo sapiens
ccuucacucugacaguauua

SEQ ID NO: 466630 - RNA, 14 nt, Homo sapiens
ccuucagguuccuc

SEQ ID NO: 466631 - RNA, 19 nt, Homo sapiens
ccuuccugcuguccuucuc

SEQ ID NO: 466632 - RNA, 21 nt, Homo sapiens
ccuuccugcuguccuucuccg

SEQ ID NO: 466633 - RNA, 14 nt, Homo sapiens
ccuucuguggcuca

SEQ ID NO: 466634 - RNA, 15 nt, Homo sapiens
ccuucuugcuucuca

SEQ ID NO: 466635 - RNA, 14 nt, Homo sapiens
ccuucuuuaaacac

SEQ ID NO: 466636 - RNA, 15 nt, Homo sapiens
ccuugcuuucucuuc

SEQ ID NO: 466637 - RNA, 20 nt, Homo sapiens
ccuuguugaugaagcacauu

SEQ ID NO: 466638 - RNA, 15 nt, Homo sapiens
ccuuuagcuuucuaa

SEQ ID NO: 466639 - RNA, 12 nt, Homo sapiens
ccuuucacuuua

SEQ ID NO: 466640 - RNA, 23 nt, Homo sapiens
ccuuucugaggaguaaaaagacu

SEQ ID NO: 466641 - RNA, 18 nt, Homo sapiens
ccuuugcgcucuggguuu

SEQ ID NO: 466642 - RNA, 22 nt, Homo sapiens
ccuuugcuagggggcaaauaca

SEQ ID NO: 466643 - RNA, 18 nt, Homo sapiens
cgaucuuagauugccacu

SEQ ID NO: 466644 - RNA, 11 nt, Homo sapiens
cgauguuaaac

SEQ ID NO: 466645 - RNA, 16 nt, Homo sapiens
cgcuccucugccuugg

SEQ ID NO: 466646 - RNA, 21 nt, Homo sapiens
cgcuggagcuccuacauggug

SEQ ID NO: 466647 - RNA, 15 nt, Homo sapiens
cggaacagccaaaga

SEQ ID NO: 466648 - RNA, 15 nt, Homo sapiens
cggccuuuguugcuc

SEQ ID NO: 466649 - RNA, 17 nt, Homo sapiens
cggccuuuguugcucag

SEQ ID NO: 466650 - RNA, 14 nt, Homo sapiens
cgggacccccaugu

SEQ ID NO: 466651 - RNA, 14 nt, Homo sapiens
cguccguccgcccg

SEQ ID NO: 466652 - RNA, 15 nt, Homo sapiens
cuaaacuguuuucau

SEQ ID NO: 466653 - RNA, 21 nt, Homo sapiens
gcuuauaccagguuaccucac

SEQ ID NO: 466654 - RNA, 13 nt, Homo sapiens
gcuucugugcaau

SEQ ID NO: 466655 - RNA, 16 nt, Homo sapiens
gcuucugugcaauaaa

SEQ ID NO: 466656 - RNA, 15 nt, Homo sapiens
gcuugcaugugcugc

SEQ ID NO: 466657 - RNA, 12 nt, Homo sapiens
gcuuuccuccca

SEQ ID NO: 466658 - RNA, 16 nt, Homo sapiens
gcuuuccucccaaagg

SEQ ID NO: 466659 - RNA, 22 nt, Homo sapiens
gcuuuggcuuuuuccaucucaa

SEQ ID NO: 466660 - RNA, 14 nt, Homo sapiens
ggaaacaauaucaa

SEQ ID NO: 466661 - RNA, 16 nt, Homo sapiens
ggaagcacugccauua

SEQ ID NO: 466662 - RNA, 21 nt, Homo sapiens
ggaagggccccacucagggau

SEQ ID NO: 466663 - RNA, 23 nt, Homo sapiens
ggaauugaagacacguucuugcc

SEQ ID NO: 466664 - RNA, 20 nt, Homo sapiens
ggacaauuaugauagcuuau

SEQ ID NO: 466665 - RNA, 16 nt, Homo sapiens
ggacuucugcagcuau

SEQ ID NO: 466666 - RNA, 13 nt, Homo sapiens
ggacuuuauuuaa

SEQ ID NO: 466667 - RNA, 23 nt, Homo sapiens
ggagaaccucguugacaugcaca

SEQ ID NO: 466668 - RNA, 16 nt, Homo sapiens
ggagacugucucaaga

SEQ ID NO: 466669 - RNA, 14 nt, Homo sapiens
ggagauaccagaga

SEQ ID NO: 466670 - RNA, 13 nt, Homo sapiens
ggauccugcacuc

SEQ ID NO: 466671 - RNA, 13 nt, Homo sapiens
ggauggaaaggga

SEQ ID NO: 466672 - RNA, 18 nt, Homo sapiens
ggauggcuuaagccugug

SEQ ID NO: 466673 - RNA, 19 nt, Homo sapiens
ggauucacuucuauuuauu

SEQ ID NO: 466674 - RNA, 14 nt, Homo sapiens
ggcaaaaaagaaca

SEQ ID NO: 466675 - RNA, 20 nt, Homo sapiens
ggcauaucuuguuguucagu

SEQ ID NO: 466676 - RNA, 18 nt, Homo sapiens
ggccccccucugccuuug

SEQ ID NO: 466677 - RNA, 19 nt, Homo sapiens
ggcccugggccucaguuca

SEQ ID NO: 466678 - RNA, 13 nt, Homo sapiens
ggcgagcacuuuc

SEQ ID NO: 466679 - RNA, 20 nt, Homo sapiens
ggcgcacuuuccacuggagu

SEQ ID NO: 466680 - RNA, 14 nt, Homo sapiens
ggcgugacuucaga

SEQ ID NO: 466681 - RNA, 19 nt, Homo sapiens
ggcucuaauguacaauaaa

SEQ ID NO: 466682 - RNA, 21 nt, Homo sapiens
ggcuuaucagaacuccuuucu

SEQ ID NO: 466683 - RNA, 23 nt, Homo sapiens
ggcuuguugcccucugcaguuga

SEQ ID NO: 466684 - RNA, 16 nt, Homo sapiens
gggaaggccugaggga

SEQ ID NO: 466685 - RNA, 15 nt, Homo sapiens
gggacugcaugcaag

SEQ ID NO: 466686 - RNA, 20 nt, Homo sapiens
gggacugcaugcaagcucag

SEQ ID NO: 466687 - RNA, 13 nt, Homo sapiens
gggagacugagcu

SEQ ID NO: 466688 - RNA, 18 nt, Homo sapiens
gggagauuaaaaccagag

SEQ ID NO: 466689 - RNA, 13 nt, Homo sapiens
gggaggaacaaag

SEQ ID NO: 466690 - RNA, 23 nt, Homo sapiens
gggauuccaccuacuuauuucag

SEQ ID NO: 466691 - RNA, 19 nt, Homo sapiens
gggccccacucagggaucu

SEQ ID NO: 466692 - RNA, 14 nt, Homo sapiens
gggccgccuccucc

SEQ ID NO: 466693 - RNA, 16 nt, Homo sapiens
ggggacugcaugcaag

SEQ ID NO: 466694 - RNA, 15 nt, Homo sapiens
ggggagaauggcucu

SEQ ID NO: 466695 - RNA, 22 nt, Homo sapiens
ggggccggggacuggccacuga

SEQ ID NO: 466696 - RNA, 14 nt, Homo sapiens
gggggccgugccuc

SEQ ID NO: 466697 - RNA, 18 nt, Homo sapiens
gggguuggguuccagaca

SEQ ID NO: 466698 - RNA, 23 nt, Homo sapiens
ggguaccuaguccccagccugcu

SEQ ID NO: 466699 - RNA, 13 nt, Homo sapiens
ggguccccaagga

SEQ ID NO: 466700 - RNA, 14 nt, Homo sapiens
gggugucugcuaaa

SEQ ID NO: 466701 - RNA, 14 nt, Homo sapiens
ggguuccagacagg

SEQ ID NO: 466702 - RNA, 23 nt, Homo sapiens
ggguuuuuaaucuuugugacagg

SEQ ID NO: 466703 - RNA, 20 nt, Homo sapiens
ggucauucuuuucuccuccu

SEQ ID NO: 466704 - RNA, 15 nt, Homo sapiens
gguccuucugacccc

SEQ ID NO: 466705 - RNA, 15 nt, Homo sapiens
ggugcccagucuuga

SEQ ID NO: 466706 - RNA, 13 nt, Homo sapiens
ggugucuguaauc

SEQ ID NO: 466707 - RNA, 13 nt, Homo sapiens
gguguggccucag

SEQ ID NO: 466708 - RNA, 12 nt, Homo sapiens
gguuucaccucc

SEQ ID NO: 466709 - RNA, 12 nt, Homo sapiens
guaaaagacuga

SEQ ID NO: 466710 - RNA, 19 nt, Homo sapiens
guaagcugcucuauuguag

SEQ ID NO: 466711 - RNA, 12 nt, Homo sapiens
guaaucucugau

SEQ ID NO: 466712 - RNA, 16 nt, Homo sapiens
guaauuuuaugagcug

SEQ ID NO: 466713 - RNA, 21 nt, Homo sapiens
guacaauaaagcaauguggua

SEQ ID NO: 466714 - RNA, 13 nt, Homo sapiens
guacuccucagac

SEQ ID NO: 466715 - RNA, 23 nt, Homo sapiens
guagacaugcacacccauucaca

SEQ ID NO: 466716 - RNA, 15 nt, Homo sapiens
guagauaagugcuca

SEQ ID NO: 466717 - RNA, 14 nt, Homo sapiens
guagcuguuuugaa

SEQ ID NO: 466718 - RNA, 13 nt, Homo sapiens
guagggaugccuu

SEQ ID NO: 466719 - RNA, 21 nt, Homo sapiens
guauaacaagccaaacauucu

SEQ ID NO: 466720 - RNA, 16 nt, Homo sapiens
guauaaguaacacuag

SEQ ID NO: 466721 - RNA, 19 nt, Homo sapiens
guauauuuauuucuagcaa

SEQ ID NO: 466722 - RNA, 10 nt, Homo sapiens
guauccucca

SEQ ID NO: 466723 - RNA, 21 nt, Homo sapiens
guaugcucaauuauuuugcau

SEQ ID NO: 466724 - RNA, 18 nt, Homo sapiens
guaugcuggccagcaccc

SEQ ID NO: 466725 - RNA, 18 nt, Homo sapiens
guauuaugcaaaguacca

SEQ ID NO: 466726 - RNA, 23 nt, Homo sapiens
guauuuuacuuugugcaauauga

SEQ ID NO: 466727 - RNA, 22 nt, Homo sapiens
guauuuucaucaaguagcguug

SEQ ID NO: 466728 - RNA, 14 nt, Homo sapiens
guauuuugccagac

SEQ ID NO: 466729 - RNA, 20 nt, Homo sapiens
gucaaacuuucaccucagau

SEQ ID NO: 466730 - RNA, 18 nt, Homo sapiens
gucaguagugccugugau

SEQ ID NO: 466731 - RNA, 20 nt, Homo sapiens
gucauguuucugcaguauuc

SEQ ID NO: 466732 - RNA, 13 nt, Homo sapiens
gucauucugcuaa

SEQ ID NO: 466733 - RNA, 18 nt, Homo sapiens
guccccucacucugucag

SEQ ID NO: 466734 - RNA, 12 nt, Homo sapiens
gucccuuaccug

SEQ ID NO: 466735 - RNA, 14 nt, Homo sapiens
guccuggggugguu

SEQ ID NO: 466736 - RNA, 15 nt, Homo sapiens
guccuguuccugcca

SEQ ID NO: 466737 - RNA, 19 nt, Homo sapiens
gucucaagagggcacuggu

SEQ ID NO: 466738 - RNA, 14 nt, Homo sapiens
gucugucaccagcu

SEQ ID NO: 466739 - RNA, 16 nt, Homo sapiens
gucuguccuuucccac

SEQ ID NO: 466740 - RNA, 17 nt, Homo sapiens
gucuuccggucauucuu

SEQ ID NO: 466741 - RNA, 23 nt, Homo sapiens
gugaaauuuacaguuacugccua

SEQ ID NO: 466742 - RNA, 18 nt, Homo sapiens
gugacaugcggcugccca

SEQ ID NO: 466743 - RNA, 23 nt, Homo sapiens
gugcaauaaaaccaagugcuuau

SEQ ID NO: 466744 - RNA, 22 nt, Homo sapiens
gugcaucaugucucuuugccaa

SEQ ID NO: 466745 - RNA, 22 nt, Homo sapiens
gugcauuuaaaauggacuuuug

SEQ ID NO: 466746 - RNA, 12 nt, Homo sapiens
guggagggguca

SEQ ID NO: 466747 - RNA, 15 nt, Homo sapiens
guggauucaugucca

SEQ ID NO: 466748 - RNA, 17 nt, Homo sapiens
guggcugcuucauauga

SEQ ID NO: 466749 - RNA, 17 nt, Homo sapiens
guguaauuccucccuaa

SEQ ID NO: 466750 - RNA, 19 nt, Homo sapiens
guguccccucacucuguca

SEQ ID NO: 466751 - RNA, 15 nt, Homo sapiens
ugccucuaugugcaa

SEQ ID NO: 466752 - RNA, 16 nt, Homo sapiens
ugccucuaugugcaac

SEQ ID NO: 466753 - RNA, 20 nt, Homo sapiens
ugccucuaugugcaacugac

SEQ ID NO: 466754 - RNA, 15 nt, Homo sapiens
ugccuguauuuccaa

SEQ ID NO: 466755 - RNA, 21 nt, Homo sapiens
ugccuuguugaugaagcacau

SEQ ID NO: 466756 - RNA, 16 nt, Homo sapiens
ugccuuugauguggau

SEQ ID NO: 466757 - RNA, 13 nt, Homo sapiens
ugcgcucuggguu

SEQ ID NO: 466758 - RNA, 15 nt, Homo sapiens
ugcgugugaaacagc

SEQ ID NO: 466759 - RNA, 13 nt, Homo sapiens
ugcuagcuguaga

SEQ ID NO: 466760 - RNA, 20 nt, Homo sapiens
ugcucaauaaaggucauauu

SEQ ID NO: 466761 - RNA, 20 nt, Homo sapiens
ugcucccuagccagaggcuc

SEQ ID NO: 466762 - RNA, 16 nt, Homo sapiens
ugcucggacacaguuu

SEQ ID NO: 466763 - RNA, 18 nt, Homo sapiens
ugcucuccuucacucuga

SEQ ID NO: 466764 - RNA, 17 nt, Homo sapiens
ugcuuucucaugcauag

SEQ ID NO: 466765 - RNA, 18 nt, Homo sapiens
ugcuuuggggcuuaucag

SEQ ID NO: 466766 - RNA, 15 nt, Homo sapiens
ugcuuuuccaucuaa

SEQ ID NO: 466767 - RNA, 17 nt, Homo sapiens
uggaagauuucuugacu

SEQ ID NO: 466768 - RNA, 16 nt, Homo sapiens
uggagacgccucccca

SEQ ID NO: 466769 - RNA, 18 nt, Homo sapiens
uggccauguucauucaca

SEQ ID NO: 466770 - RNA, 20 nt, Homo sapiens
uggcccagcugaucuaagga

SEQ ID NO: 466771 - RNA, 14 nt, Homo sapiens
uggccgucgcugug

SEQ ID NO: 466772 - RNA, 14 nt, Homo sapiens
uggcugccuuagaa

SEQ ID NO: 466773 - RNA, 21 nt, Homo sapiens
ugggaagggaucccuuuguau

SEQ ID NO: 466774 - RNA, 15 nt, Homo sapiens
ugggaggaacaaaga

SEQ ID NO: 466775 - RNA, 18 nt, Homo sapiens
ugggccaagccaggguuc

SEQ ID NO: 466776 - RNA, 23 nt, Homo sapiens
uggggagaggagugggaaauuga

SEQ ID NO: 466777 - RNA, 17 nt, Homo sapiens
ugggguagagaggacag

SEQ ID NO: 466778 - RNA, 12 nt, Homo sapiens
uggggugccuga

SEQ ID NO: 466779 - RNA, 16 nt, Homo sapiens
ugggguuccccuggaa

SEQ ID NO: 466780 - RNA, 17 nt, Homo sapiens
ugggguuccccuggaaa

SEQ ID NO: 466781 - RNA, 15 nt, Homo sapiens
uggguuccagacaga

SEQ ID NO: 466782 - RNA, 17 nt, Homo sapiens
uggguuccagacagagu

SEQ ID NO: 466783 - RNA, 19 nt, Homo sapiens
ugguacaacacuugcacaa

SEQ ID NO: 466784 - RNA, 23 nt, Homo sapiens
ugguauucaacuaauacaugguu

SEQ ID NO: 466785 - RNA, 21 nt, Homo sapiens
ugguuacaugaaugaaugaac

SEQ ID NO: 466786 - RNA, 22 nt, Homo sapiens
uguaaauaaugcuuaacauaaa

SEQ ID NO: 466787 - RNA, 14 nt, Homo sapiens
uguaauauacaguu

SEQ ID NO: 466788 - RNA, 18 nt, Homo sapiens
uguacauuuucuaacaaa

SEQ ID NO: 466789 - RNA, 19 nt, Homo sapiens
uguagaauuauaacuaauu

SEQ ID NO: 466790 - RNA, 13 nt, Homo sapiens
uguagcauauaaa

SEQ ID NO: 466791 - RNA, 13 nt, Homo sapiens
uguauccaaguua

SEQ ID NO: 466792 - RNA, 18 nt, Homo sapiens
uguauuccugccuuugau

SEQ ID NO: 466793 - RNA, 20 nt, Homo sapiens
uguauuuuacuuugugcaau

SEQ ID NO: 466794 - RNA, 16 nt, Homo sapiens
uguccguccucuuccc

SEQ ID NO: 466795 - RNA, 16 nt, Homo sapiens
ugucuacugcuuggau

SEQ ID NO: 466796 - RNA, 21 nt, Homo sapiens
ugucugauucuaugccuguau

SEQ ID NO: 466797 - RNA, 16 nt, Homo sapiens
ugugaauaaaaacccu

SEQ ID NO: 466798 - RNA, 12 nt, Homo sapiens
ugugccaaagau

SEQ ID NO: 466799 - RNA, 20 nt, Homo sapiens
ugugccauggaugauucuuu

SEQ ID NO: 466800 - RNA, 19 nt, Homo sapiens
ugugcuaaguugucuuaca

SEQ ID NO: 466801 - RNA, 17 nt, Homo sapiens
ugugcucggacacaguu

SEQ ID NO: 466802 - RNA, 14 nt, Homo sapiens
ugugcuuucauguu

SEQ ID NO: 466803 - RNA, 16 nt, Homo sapiens
uguggaaugcauccaa

SEQ ID NO: 466804 - RNA, 13 nt, Homo sapiens
uguggaugcucuu

SEQ ID NO: 466805 - RNA, 13 nt, Homo sapiens
uguggcaccucaa

SEQ ID NO: 466806 - RNA, 20 nt, Homo sapiens
uguguacuucuucauccaua

SEQ ID NO: 466807 - RNA, 13 nt, Homo sapiens
uguuaccuucaca

SEQ ID NO: 466808 - RNA, 18 nt, Homo sapiens
uguuagauguccucagaa

SEQ ID NO: 466809 - RNA, 19 nt, Homo sapiens
uguuauaucaucaauacuu

SEQ ID NO: 466810 - RNA, 14 nt, Homo sapiens
uguucccacucccu

SEQ ID NO: 466811 - RNA, 23 nt, Homo sapiens
uguucugaauaauuucuuacuaa

SEQ ID NO: 466812 - RNA, 16 nt, Homo sapiens
uguuggaaggggguca

SEQ ID NO: 466813 - RNA, 12 nt, Homo sapiens
uguuuuccaaag

SEQ ID NO: 466814 - RNA, 19 nt, Homo sapiens
uguuuuuuuuuuccacuua

SEQ ID NO: 466815 - RNA, 15 nt, Homo sapiens
uuaaaauaacuaagc

SEQ ID NO: 466816 - RNA, 20 nt, Homo sapiens
uuaacauaaacuuguacuua

SEQ ID NO: 466817 - RNA, 21 nt, Homo sapiens
uuaagaaagcuauauaugaau

SEQ ID NO: 466818 - RNA, 21 nt, Homo sapiens
uuaagauuccauuuuggaaaa

SEQ ID NO: 466819 - RNA, 19 nt, Homo sapiens
uuaagccauaugacaauuu

SEQ ID NO: 466820 - RNA, 13 nt, Homo sapiens
uuaauaaagauuc

SEQ ID NO: 466821 - RNA, 12 nt, Homo sapiens
uuaauauacugc

SEQ ID NO: 466822 - RNA, 22 nt, Homo sapiens
uuaaucucuaaaauucuagucu

SEQ ID NO: 466823 - RNA, 14 nt, Homo sapiens
uuaaugucaucucu

SEQ ID NO: 466824 - RNA, 14 nt, Homo sapiens
uuacaugaguucaa

SEQ ID NO: 466825 - RNA, 18 nt, Homo sapiens
uuaccucacuggugcauu

SEQ ID NO: 466826 - RNA, 13 nt, Homo sapiens
uuacuaaacauuu

SEQ ID NO: 466827 - RNA, 20 nt, Homo sapiens
uuagacaaccauagaacugu

SEQ ID NO: 466828 - RNA, 17 nt, Homo sapiens
uuagauuuugaaugaua

SEQ ID NO: 466829 - RNA, 14 nt, Homo sapiens
uuaguccucaccuu

SEQ ID NO: 466830 - RNA, 19 nt, Homo sapiens
uuauaccagguuaccucac

SEQ ID NO: 466831 - RNA, 21 nt, Homo sapiens
uuauaucagcagacacuccag

SEQ ID NO: 466832 - RNA, 15 nt, Homo sapiens
uuauauuaaagaagu

SEQ ID NO: 466833 - RNA, 17 nt, Homo sapiens
uuauccugcuagcugua

SEQ ID NO: 466834 - RNA, 20 nt, Homo sapiens
uuaugaaguuaacagucuca

SEQ ID NO: 466835 - RNA, 15 nt, Homo sapiens
uuaugagcugugaga

SEQ ID NO: 466836 - RNA, 23 nt, Homo sapiens
uuaugccagggcgcacuuuccac

SEQ ID NO: 466837 - RNA, 15 nt, Homo sapiens
uuauucccccaaagc

SEQ ID NO: 466838 - RNA, 17 nt, Homo sapiens
uucaaaaugcaugugau

SEQ ID NO: 466839 - RNA, 21 nt, Homo sapiens
uucaacuaauacaugguuuaa

SEQ ID NO: 466840 - RNA, 15 nt, Homo sapiens
uucacagauggaauc

SEQ ID NO: 466841 - RNA, 18 nt, Homo sapiens
uucaccuccauuaaccaa

SEQ ID NO: 466842 - RNA, 17 nt, Homo sapiens
uucacuuucaauugcuu

SEQ ID NO: 466843 - RNA, 19 nt, Homo sapiens
uucacuuuuucugucuuua

SEQ ID NO: 466844 - RNA, 14 nt, Homo sapiens
uucagaaagggcag

SEQ ID NO: 466845 - RNA, 13 nt, Homo sapiens
uucagcucuacag

SEQ ID NO: 466846 - RNA, 21 nt, Homo sapiens
uucauaaaaauaaccaaaaaa

SEQ ID NO: 466847 - RNA, 16 nt, Homo sapiens
uucauagcauccugau

SEQ ID NO: 466848 - RNA, 17 nt, Homo sapiens
uucauucacaguuugau

SEQ ID NO: 466849 - RNA, 17 nt, Homo sapiens
ugggaggaacaaagaca

SEQ ID NO: 466850 - RNA, 15 nt, Homo sapiens
ugggccucaguucaa

SEQ ID NO: 466851 - RNA, 15 nt, Homo sapiens
ugggcugucugucac

SEQ ID NO: 466852 - RNA, 22 nt, Homo sapiens
uggggcuuccauggugguuuca

SEQ ID NO: 466853 - RNA, 23 nt, Homo sapiens
uggguugugaaauacucuuccaa

SEQ ID NO: 466854 - RNA, 20 nt, Homo sapiens
ugguaugcuggccagcaccc

SEQ ID NO: 466855 - RNA, 18 nt, Homo sapiens
uggucaagcccuugccca

SEQ ID NO: 466856 - RNA, 23 nt, Homo sapiens
uggucgccugcauuucuccgugc

SEQ ID NO: 466857 - RNA, 12 nt, Homo sapiens
uggugcagugaa

SEQ ID NO: 466858 - RNA, 14 nt, Homo sapiens
ugguguucccaaga

SEQ ID NO: 466859 - RNA, 16 nt, Homo sapiens
ugguuuauacuguaua

SEQ ID NO: 466860 - RNA, 20 nt, Homo sapiens
ugguuuuaaaaaagcauuau

SEQ ID NO: 466861 - RNA, 20 nt, Homo sapiens
uguacaauaaagcaaugugg

SEQ ID NO: 466862 - RNA, 20 nt, Homo sapiens
uguagcauuucuugauguug

SEQ ID NO: 466863 - RNA, 22 nt, Homo sapiens
uguagcauuucuugauguugcu

SEQ ID NO: 466864 - RNA, 23 nt, Homo sapiens
uguauauauuuauuauuuucaua

SEQ ID NO: 466865 - RNA, 13 nt, Homo sapiens
uguauccugauaa

SEQ ID NO: 466866 - RNA, 12 nt, Homo sapiens
uguaugcacuuu

SEQ ID NO: 466867 - RNA, 16 nt, Homo sapiens
uguauucggcaccuuc

SEQ ID NO: 466868 - RNA, 16 nt, Homo sapiens
ugucaacuucaguuga

SEQ ID NO: 466869 - RNA, 14 nt, Homo sapiens
ugucacucacaaaa

SEQ ID NO: 466870 - RNA, 19 nt, Homo sapiens
ugucauucaagccugugaa

SEQ ID NO: 466871 - RNA, 18 nt, Homo sapiens
ugucauugguuacaaauu

SEQ ID NO: 466872 - RNA, 18 nt, Homo sapiens
uguccaccugugcugcug

SEQ ID NO: 466873 - RNA, 23 nt, Homo sapiens
uguccuccagggcgagcacuuuc

SEQ ID NO: 466874 - RNA, 18 nt, Homo sapiens
ugucuaguuugcauacuu

SEQ ID NO: 466875 - RNA, 14 nt, Homo sapiens
ugucucuuugccaa

SEQ ID NO: 466876 - RNA, 13 nt, Homo sapiens
ugucugauucuau

SEQ ID NO: 466877 - RNA, 15 nt, Homo sapiens
ugucugucaccagcu

SEQ ID NO: 466878 - RNA, 15 nt, Homo sapiens
ugucugugaugucag

SEQ ID NO: 466879 - RNA, 21 nt, Homo sapiens
ugucuguuucaaugaccugua

SEQ ID NO: 466880 - RNA, 11 nt, Homo sapiens
ugucuuuaugu

SEQ ID NO: 466881 - RNA, 23 nt, Homo sapiens
ugugaagccuuuaucuaugggag

SEQ ID NO: 466882 - RNA, 20 nt, Homo sapiens
ugugacuuuuucagaguugc

SEQ ID NO: 466883 - RNA, 22 nt, Homo sapiens
ugugauuggcagcuucaaaaca

SEQ ID NO: 466884 - RNA, 21 nt, Homo sapiens
ugugcaaauccccuccccaaa

SEQ ID NO: 466885 - RNA, 21 nt, Homo sapiens
ugugcaauaaaaccaagugcu

SEQ ID NO: 466886 - RNA, 12 nt, Homo sapiens
ugugcuuucaug

SEQ ID NO: 466887 - RNA, 21 nt, Homo sapiens
uguguauucuguggauucuau

SEQ ID NO: 466888 - RNA, 14 nt, Homo sapiens
ugugugcaauguuc

SEQ ID NO: 466889 - RNA, 12 nt, Homo sapiens
uguucauucaca

SEQ ID NO: 466890 - RNA, 19 nt, Homo sapiens
uguugaaauuggaaaggac

SEQ ID NO: 466891 - RNA, 12 nt, Homo sapiens
uguuuacaugag

SEQ ID NO: 466892 - RNA, 12 nt, Homo sapiens
uguuucuauacu

SEQ ID NO: 466893 - RNA, 22 nt, Homo sapiens
uguuuuccccaauuauccuccu

SEQ ID NO: 466894 - RNA, 21 nt, Homo sapiens
uuaaaauggacuuuuguucau

SEQ ID NO: 466895 - RNA, 15 nt, Homo sapiens
uuaaacuacugauug

SEQ ID NO: 466896 - RNA, 13 nt, Homo sapiens
uuaaaguaccugu

SEQ ID NO: 466897 - RNA, 14 nt, Homo sapiens
uuaaauacuacaaa

SEQ ID NO: 466898 - RNA, 14 nt, Homo sapiens
uuaagaugggcaua

SEQ ID NO: 466899 - RNA, 19 nt, Homo sapiens
uuaauauacugcauauccu

SEQ ID NO: 466900 - RNA, 22 nt, Homo sapiens
uuacaugaaugaaugaaccaug

SEQ ID NO: 466901 - RNA, 22 nt, Homo sapiens
uuaccuguaauagccucaccuu

SEQ ID NO: 466902 - RNA, 16 nt, Homo sapiens
uuacugaugugugcaa

SEQ ID NO: 466903 - RNA, 14 nt, Homo sapiens
uuacuuugugcaau

SEQ ID NO: 466904 - RNA, 15 nt, Homo sapiens
uuagaaauugcauuu

SEQ ID NO: 466905 - RNA, 17 nt, Homo sapiens
uuagaauggggcuucca

SEQ ID NO: 466906 - RNA, 19 nt, Homo sapiens
uuagauuuuucucaucucc

SEQ ID NO: 466907 - RNA, 16 nt, Homo sapiens
uuauagucuguacuuc

SEQ ID NO: 466908 - RNA, 22 nt, Homo sapiens
uuauauacaaagcugucacuca

SEQ ID NO: 466909 - RNA, 17 nt, Homo sapiens
uuauccuccuucacucc

SEQ ID NO: 466910 - RNA, 15 nt, Homo sapiens
uuaucuuaucuagca

SEQ ID NO: 466911 - RNA, 22 nt, Homo sapiens
uuaugacuguuuuuguaguggu

SEQ ID NO: 466912 - RNA, 14 nt, Homo sapiens
uuauguaaacauca

SEQ ID NO: 466913 - RNA, 18 nt, Homo sapiens
uuauucuuccaaguucau

SEQ ID NO: 466914 - RNA, 12 nt, Homo sapiens
uucaaaauacuu

SEQ ID NO: 466915 - RNA, 12 nt, Homo sapiens
uucaaaaugcau

SEQ ID NO: 466916 - RNA, 14 nt, Homo sapiens
uucaaaaugcaugu

SEQ ID NO: 466917 - RNA, 15 nt, Homo sapiens
uucaagacucaaugu

SEQ ID NO: 466918 - RNA, 16 nt, Homo sapiens
uucaagccugugaaua

SEQ ID NO: 466919 - RNA, 20 nt, Homo sapiens
uucaaugaaucaaauccaau

SEQ ID NO: 466920 - RNA, 20 nt, Homo sapiens
uucaauugcuucugugcaau

SEQ ID NO: 466921 - RNA, 21 nt, Homo sapiens
uucaauugcuucugugcaaua

SEQ ID NO: 466922 - RNA, 21 nt, Homo sapiens
uucacaaauauaguugaacaa

SEQ ID NO: 466923 - RNA, 22 nt, Homo sapiens
uucaccaguuuccaaguuuauu

SEQ ID NO: 466924 - RNA, 21 nt, Homo sapiens
uucaccuccauuaaccaagaa

SEQ ID NO: 466925 - RNA, 14 nt, Homo sapiens
uucaccucccaaac

SEQ ID NO: 466926 - RNA, 18 nt, Homo sapiens
uucacucugacaguauua

SEQ ID NO: 466927 - RNA, 16 nt, Homo sapiens
uucauccaacuggaag

SEQ ID NO: 466928 - RNA, 21 nt, Homo sapiens
uucaugccagcuauaaucucc

SEQ ID NO: 466929 - RNA, 17 nt, Homo sapiens
uucauuauugguuuuaa

SEQ ID NO: 466930 - RNA, 14 nt, Homo sapiens
uucauucauacuca

SEQ ID NO: 466931 - RNA, 18 nt, Homo sapiens
uuccaagugugugugcaa

SEQ ID NO: 466932 - RNA, 19 nt, Homo sapiens
uuccaagugugugugcaau

SEQ ID NO: 466933 - RNA, 18 nt, Homo sapiens
uuccaaguuuauugcccu

SEQ ID NO: 466934 - RNA, 19 nt, Homo sapiens
uuccaguagagcuucuuau

SEQ ID NO: 466935 - RNA, 15 nt, Homo sapiens
uucccacuuugccac

SEQ ID NO: 466936 - RNA, 16 nt, Homo sapiens
uucccacuuugccacu

SEQ ID NO: 466937 - RNA, 13 nt, Homo sapiens
uucccauggaaug

SEQ ID NO: 466938 - RNA, 21 nt, Homo sapiens
uuccccugcucacucuuccac

SEQ ID NO: 466939 - RNA, 18 nt, Homo sapiens
uucccuuggauguagucu

SEQ ID NO: 466940 - RNA, 14 nt, Homo sapiens
uuccguucaucuga

SEQ ID NO: 466941 - RNA, 22 nt, Homo sapiens
uuccuaugcugcaauacauuaa

SEQ ID NO: 466942 - RNA, 16 nt, Homo sapiens
uuccucuuaccuguaa

SEQ ID NO: 466943 - RNA, 16 nt, Homo sapiens
uucgccccucugggcu

SEQ ID NO: 466944 - RNA, 21 nt, Homo sapiens
uucguccuuagaauacuguau

SEQ ID NO: 466945 - RNA, 12 nt, Homo sapiens
uucuagcuauaa

SEQ ID NO: 466946 - RNA, 16 nt, Homo sapiens
uucuauggauucacuu

SEQ ID NO: 466947 - RNA, 11 nt, Homo sapiens
uucucaucucc

SEQ ID NO: 466948 - RNA, 21 nt, Homo sapiens
uucuccugauccucuugccac

SEQ ID NO: 466949 - RNA, 13 nt, Homo sapiens
uucuccuuguaaa

SEQ ID NO: 466950 - RNA, 15 nt, Homo sapiens
uucuccuuguacuug

SEQ ID NO: 466951 - RNA, 23 nt, Homo sapiens
uucucucuguguggcaaacauuu

SEQ ID NO: 466952 - RNA, 23 nt, Homo sapiens
uucugaauucauaaaaauaacca

SEQ ID NO: 466953 - RNA, 14 nt, Homo sapiens
uucugcauuacuau

SEQ ID NO: 466954 - RNA, 18 nt, Homo sapiens
uucugggucagcuugaau

SEQ ID NO: 466955 - RNA, 11 nt, Homo sapiens
uucugugcaaa

SEQ ID NO: 466956 - RNA, 12 nt, Homo sapiens
uucuuacuguau

SEQ ID NO: 466957 - RNA, 13 nt, Homo sapiens
uucuuacuguauu

SEQ ID NO: 466958 - RNA, 22 nt, Homo sapiens
uucuuagugaaaggucaucuca

SEQ ID NO: 466959 - RNA, 16 nt, Homo sapiens
uucuucaaacaggaau

SEQ ID NO: 466960 - RNA, 15 nt, Homo sapiens
uucuucauccauaga

SEQ ID NO: 466961 - RNA, 18 nt, Homo sapiens
uucuuccucuuaccugua

SEQ ID NO: 466962 - RNA, 13 nt, Homo sapiens
uucuugcacugua

SEQ ID NO: 466963 - RNA, 17 nt, Homo sapiens
uucuuugcauucguccu

SEQ ID NO: 466964 - RNA, 19 nt, Homo sapiens
uucuuuucccaucaccaga

SEQ ID NO: 466965 - RNA, 19 nt, Homo sapiens
uucuuuugaaucaaucugg

SEQ ID NO: 466966 - RNA, 14 nt, Homo sapiens
uugaaaaaagaaga

SEQ ID NO: 466967 - RNA, 20 nt, Homo sapiens
uugaaaagagguggauucau

SEQ ID NO: 466968 - RNA, 14 nt, Homo sapiens
uugacuucaugcca

SEQ ID NO: 466969 - RNA, 18 nt, Homo sapiens
uugagaaauaaagcacau

SEQ ID NO: 466970 - RNA, 19 nt, Homo sapiens
uugagaaauaaagcacauu

SEQ ID NO: 466971 - RNA, 14 nt, Homo sapiens
uugaugaagcacau

SEQ ID NO: 466972 - RNA, 16 nt, Homo sapiens
uugccucuaugugcaa

SEQ ID NO: 466973 - RNA, 18 nt, Homo sapiens
uugccucuaugugcaacu

SEQ ID NO: 466974 - RNA, 23 nt, Homo sapiens
uugcuuucucuucuaauggaaua

SEQ ID NO: 466975 - RNA, 14 nt, Homo sapiens
uuggagaaaggauu

SEQ ID NO: 466976 - RNA, 20 nt, Homo sapiens
uuggagaggagguguggagu

SEQ ID NO: 466977 - RNA, 19 nt, Homo sapiens
uuggccauguucauucaca

SEQ ID NO: 466978 - RNA, 13 nt, Homo sapiens
uugggggauucaa

SEQ ID NO: 466979 - RNA, 21 nt, Homo sapiens
uuguagaggggcaacugauga

SEQ ID NO: 466980 - RNA, 13 nt, Homo sapiens
uuguaguuuauaa

SEQ ID NO: 466981 - RNA, 12 nt, Homo sapiens
uugucagaauuu

SEQ ID NO: 466982 - RNA, 16 nt, Homo sapiens
uuguccaugugcaaac

SEQ ID NO: 466983 - RNA, 20 nt, Homo sapiens
uugugcugugggcagcaccc

SEQ ID NO: 466984 - RNA, 15 nt, Homo sapiens
uuguguucaaucugu

SEQ ID NO: 466985 - RNA, 18 nt, Homo sapiens
uuguugaugaagcacauu

SEQ ID NO: 466986 - RNA, 21 nt, Homo sapiens
uuuaaaaaaauaacaucugaa

SEQ ID NO: 466987 - RNA, 15 nt, Homo sapiens
uuuaaaaaauaacau

SEQ ID NO: 466988 - RNA, 21 nt, Homo sapiens
uuuaauucuuuucccagaaga

SEQ ID NO: 466989 - RNA, 12 nt, Homo sapiens
uuuaucuauggg

SEQ ID NO: 466990 - RNA, 19 nt, Homo sapiens
uuucacaaauauaguugaa

SEQ ID NO: 466991 - RNA, 15 nt, Homo sapiens
uuucucgggugcauu

SEQ ID NO: 466992 - RNA, 16 nt, Homo sapiens
uuucugaggaguaaaa

SEQ ID NO: 466993 - RNA, 16 nt, Homo sapiens
uuugauucaccaaaca

SEQ ID NO: 466994 - RNA, 14 nt, Homo sapiens
uuugcucuacuuua

SEQ ID NO: 466995 - RNA, 11 nt, Homo sapiens
uuugggagacu

SEQ ID NO: 466996 - RNA, 19 nt, Homo sapiens
uuuggggacuuguagggau

SEQ ID NO: 466997 - RNA, 20 nt, Homo sapiens
uuugggggauucaaaugcau

SEQ ID NO: 466998 - RNA, 19 nt, Homo sapiens
uuuuaauuuauuucaucca

SEQ ID NO: 466999 - RNA, 16 nt, Homo sapiens
uuuuaucucacaaaua

SEQ ID NO: 467000 - RNA, 10 nt, Homo sapiens
uuuucacugc

SEQ ID NO: 467001 - RNA, 21 nt, Homo sapiens
uuuucacugcuggcugccuua

SEQ ID NO: 467002 - RNA, 13 nt, Homo sapiens
uuuucucaucucc

SEQ ID NO: 467003 - RNA, 18 nt, Homo sapiens
uuuucugucuuuauguaa

SEQ ID NO: 467004 - RNA, 13 nt, Homo sapiens
uuuugcucuacuu

SEQ ID NO: 467005 - RNA, 12 nt, Homo sapiens
uuuuuacuauua

SEQ ID NO: 467006 - RNA, 16 nt, Homo sapiens
cuccacugccuucgau

SEQ ID NO: 467007 - RNA, 21 nt, Homo sapiens
cuccagggcgagcacuuucca

SEQ ID NO: 467008 - RNA, 14 nt, Homo sapiens
cucccaaacccagc

SEQ ID NO: 467009 - RNA, 18 nt, Homo sapiens
cucccacccuucucaggg

SEQ ID NO: 467010 - RNA, 20 nt, Homo sapiens
cuccccauggugcagugaag

SEQ ID NO: 467011 - RNA, 22 nt, Homo sapiens
cucccuagccagaggcucuaau

SEQ ID NO: 467012 - RNA, 17 nt, Homo sapiens
cucccuccucagucuuu

SEQ ID NO: 467013 - RNA, 14 nt, Homo sapiens
cuccuaaaacacac

SEQ ID NO: 467014 - RNA, 20 nt, Homo sapiens
cuccuucacucccugucaua

SEQ ID NO: 467015 - RNA, 17 nt, Homo sapiens
cuccuuguaaaagccua

SEQ ID NO: 467016 - RNA, 21 nt, Homo sapiens
cucgggugcauuugagagaag

SEQ ID NO: 467017 - RNA, 18 nt, Homo sapiens
cucgucuuucgcacauuc

SEQ ID NO: 467018 - RNA, 22 nt, Homo sapiens
cucuaauguacaauaaagcaau

SEQ ID NO: 467019 - RNA, 23 nt, Homo sapiens
cucuaauguacaauaaagcaaug

SEQ ID NO: 467020 - RNA, 23 nt, Homo sapiens
cucugacuguaaaauacauggua

SEQ ID NO: 467021 - RNA, 19 nt, Homo sapiens
cucugcuaugucugugaug

SEQ ID NO: 467022 - RNA, 19 nt, Homo sapiens
cucugguccuucugacccc

SEQ ID NO: 467023 - RNA, 12 nt, Homo sapiens
cucugugcugca

SEQ ID NO: 467024 - RNA, 14 nt, Homo sapiens
cucuguuuacccuc

SEQ ID NO: 467025 - RNA, 15 nt, Homo sapiens
cucuuacaaaacucu

SEQ ID NO: 467026 - RNA, 13 nt, Homo sapiens
cucuucaaacagu

SEQ ID NO: 467027 - RNA, 16 nt, Homo sapiens
cucuuccucaucucau

SEQ ID NO: 467028 - RNA, 21 nt, Homo sapiens
cucuugcccagccggcugcaa

SEQ ID NO: 467029 - RNA, 21 nt, Homo sapiens
cugaaaagaaaugcuaaugua

SEQ ID NO: 467030 - RNA, 18 nt, Homo sapiens
cugaauccaccugcaguu

SEQ ID NO: 467031 - RNA, 18 nt, Homo sapiens
cugaaugugauacaugcc

SEQ ID NO: 467032 - RNA, 18 nt, Homo sapiens
cugacagccuccuaggcu

SEQ ID NO: 467033 - RNA, 14 nt, Homo sapiens
cugagagaccucag

SEQ ID NO: 467034 - RNA, 18 nt, Homo sapiens
cugagagaccucagggau

SEQ ID NO: 467035 - RNA, 15 nt, Homo sapiens
cugagcugcuaggaa

SEQ ID NO: 467036 - RNA, 14 nt, Homo sapiens
cugaggaguccaaa

SEQ ID NO: 467037 - RNA, 20 nt, Homo sapiens
cugauaaacauuaaacacug

SEQ ID NO: 467038 - RNA, 14 nt, Homo sapiens
cugcaauacauuaa

SEQ ID NO: 467039 - RNA, 18 nt, Homo sapiens
cugcacagugcaucucag

SEQ ID NO: 467040 - RNA, 17 nt, Homo sapiens
cugcagaugacuggaaa

SEQ ID NO: 467041 - RNA, 23 nt, Homo sapiens
cugcaucgauccccagccuggug

SEQ ID NO: 467042 - RNA, 19 nt, Homo sapiens
cugccaauaaacuguuaca

SEQ ID NO: 467043 - RNA, 21 nt, Homo sapiens
cugcgcuccucugcagccuga

SEQ ID NO: 467044 - RNA, 19 nt, Homo sapiens
cugcuaugucugugauguc

SEQ ID NO: 467045 - RNA, 13 nt, Homo sapiens
cugcugagugaau

SEQ ID NO: 467046 - RNA, 15 nt, Homo sapiens
cugcugagugaauga

SEQ ID NO: 467047 - RNA, 16 nt, Homo sapiens
cugcuguuuuauguca

SEQ ID NO: 467048 - RNA, 21 nt, Homo sapiens
cugcuuagugucccuuaccug

SEQ ID NO: 467049 - RNA, 14 nt, Homo sapiens
cuggaguucacuuu

SEQ ID NO: 467050 - RNA, 19 nt, Homo sapiens
cuggcagccgugccuucag

SEQ ID NO: 467051 - RNA, 18 nt, Homo sapiens
cuggcagcgccucccgcc

SEQ ID NO: 467052 - RNA, 17 nt, Homo sapiens
cugggaucagcuggugu

SEQ ID NO: 467053 - RNA, 15 nt, Homo sapiens
cugggccucaguuca

SEQ ID NO: 467054 - RNA, 16 nt, Homo sapiens
cugggcugucugucac

SEQ ID NO: 467055 - RNA, 16 nt, Homo sapiens
cugguugccaaauacu

SEQ ID NO: 467056 - RNA, 14 nt, Homo sapiens
cugguuugccugaa

SEQ ID NO: 467057 - RNA, 23 nt, Homo sapiens
cuguaauguaacagcaauuuuca

SEQ ID NO: 467058 - RNA, 16 nt, Homo sapiens
cuguagaaauguaucc

SEQ ID NO: 467059 - RNA, 17 nt, Homo sapiens
cuguagugagaaacuga

SEQ ID NO: 467060 - RNA, 14 nt, Homo sapiens
cuguauaaguaaca

SEQ ID NO: 467061 - RNA, 14 nt, Homo sapiens
cuguauuccaaggc

SEQ ID NO: 467062 - RNA, 16 nt, Homo sapiens
cugucugucaccagcu

SEQ ID NO: 467063 - RNA, 19 nt, Homo sapiens
cugucugucaccagcuauc

SEQ ID NO: 467064 - RNA, 14 nt, Homo sapiens
cugugaagccuuua

SEQ ID NO: 467065 - RNA, 20 nt, Homo sapiens
cugugaauaaaaacccugua

SEQ ID NO: 467066 - RNA, 14 nt, Homo sapiens
cugugggaguccac

SEQ ID NO: 467067 - RNA, 15 nt, Homo sapiens
cugugggcagcaccc

SEQ ID NO: 467068 - RNA, 21 nt, Homo sapiens
cuguugcuguccuccagggcg

SEQ ID NO: 467069 - RNA, 22 nt, Homo sapiens
cuguuggaagggggucacuuaa

SEQ ID NO: 467070 - RNA, 15 nt, Homo sapiens
cuguuuuccaaagga

SEQ ID NO: 467071 - RNA, 19 nt, Homo sapiens
cuuaaaccugugcuuucau

SEQ ID NO: 467072 - RNA, 18 nt, Homo sapiens
cuuaacuuaaaagaacau

SEQ ID NO: 467073 - RNA, 21 nt, Homo sapiens
cuuaagauuccauuuuggaaa

SEQ ID NO: 467074 - RNA, 11 nt, Homo sapiens
cuuaauuaccu

SEQ ID NO: 467075 - RNA, 13 nt, Homo sapiens
cuuagcauguccc

SEQ ID NO: 467076 - RNA, 19 nt, Homo sapiens
cuuauaccagguuaccuca

SEQ ID NO: 467077 - RNA, 18 nt, Homo sapiens
cuuauuucagauucaccu

SEQ ID NO: 467078 - RNA, 17 nt, Homo sapiens
cuuauuucuaacuauua

SEQ ID NO: 467079 - RNA, 22 nt, Homo sapiens
cuucauccauagacacaguauu

SEQ ID NO: 467080 - RNA, 15 nt, Homo sapiens
cuuccaccaaauacu

SEQ ID NO: 467081 - RNA, 19 nt, Homo sapiens
cuucccaacguacuccuca

SEQ ID NO: 467082 - RNA, 20 nt, Homo sapiens
aaaaaggaugcauucccuac

SEQ ID NO: 467083 - RNA, 19 nt, Homo sapiens
aaaagcaggaaagauccca

SEQ ID NO: 467084 - RNA, 23 nt, Homo sapiens
aaaagcauuauccuuuuaucuca

SEQ ID NO: 467085 - RNA, 22 nt, Homo sapiens
aaaagucaaacuuucaccucag

SEQ ID NO: 467086 - RNA, 19 nt, Homo sapiens
aaaaucugggaccaaaaca

SEQ ID NO: 467087 - RNA, 16 nt, Homo sapiens
aaaaugucuguuucaa

SEQ ID NO: 467088 - RNA, 20 nt, Homo sapiens
aaaauguggaaugcauccaa

SEQ ID NO: 467089 - RNA, 18 nt, Homo sapiens
aaacaaauauuucacuua

SEQ ID NO: 467090 - RNA, 14 nt, Homo sapiens
aaacaugaauguac

SEQ ID NO: 467091 - RNA, 18 nt, Homo sapiens
aaacauucuuuaacauac

SEQ ID NO: 467092 - RNA, 19 nt, Homo sapiens
aaaccaagccguggcuucc

SEQ ID NO: 467093 - RNA, 23 nt, Homo sapiens
aaacccauuuccagcuccuagua

SEQ ID NO: 467094 - RNA, 15 nt, Homo sapiens
aaacuaccacauucu

SEQ ID NO: 467095 - RNA, 13 nt, Homo sapiens
aaagaccuugaaa

SEQ ID NO: 467096 - RNA, 18 nt, Homo sapiens
aaagauggcuuccgugag

SEQ ID NO: 467097 - RNA, 21 nt, Homo sapiens
aaaggcuggaugugcuuucau

SEQ ID NO: 467098 - RNA, 18 nt, Homo sapiens
aaagggagccaugcucuu

SEQ ID NO: 467099 - RNA, 19 nt, Homo sapiens
aaaggggacagaucuugag

SEQ ID NO: 467100 - RNA, 13 nt, Homo sapiens
aaaggucaucuca

SEQ ID NO: 467101 - RNA, 15 nt, Homo sapiens
aaagguuaagccaua

SEQ ID NO: 467102 - RNA, 20 nt, Homo sapiens
aaagucaaacuuucaccuca

SEQ ID NO: 467103 - RNA, 23 nt, Homo sapiens
aaauaaguaauaucuuucaguua

SEQ ID NO: 467104 - RNA, 19 nt, Homo sapiens
aaauaaugauucaauguga

SEQ ID NO: 467105 - RNA, 13 nt, Homo sapiens
aaauaaugcuuaa

SEQ ID NO: 467106 - RNA, 15 nt, Homo sapiens
aaauacucuuccaaa

SEQ ID NO: 467107 - RNA, 19 nt, Homo sapiens
aaauaggagucuucugccu

SEQ ID NO: 467108 - RNA, 22 nt, Homo sapiens
aaauauucugucauugguuaca

SEQ ID NO: 467109 - RNA, 18 nt, Homo sapiens
aaauauuuuaaacuacug

SEQ ID NO: 467110 - RNA, 13 nt, Homo sapiens
aaaucacuuugag

SEQ ID NO: 467111 - RNA, 19 nt, Homo sapiens
aaaucugggaccaaaacau

SEQ ID NO: 467112 - RNA, 18 nt, Homo sapiens
aaaugacaccacuaaaga

SEQ ID NO: 467113 - RNA, 13 nt, Homo sapiens
aaauugugccaaa

SEQ ID NO: 467114 - RNA, 15 nt, Homo sapiens
aaauuuaacugcaua

SEQ ID NO: 467115 - RNA, 19 nt, Homo sapiens
aaauuuaauauacugcaua

SEQ ID NO: 467116 - RNA, 22 nt, Homo sapiens
aacaaacacuuagcaucccaca

SEQ ID NO: 467117 - RNA, 16 nt, Homo sapiens
aacaaggaaggacauu

SEQ ID NO: 467118 - RNA, 15 nt, Homo sapiens
aacaaguagcacacu

SEQ ID NO: 467119 - RNA, 16 nt, Homo sapiens
aacacuaauggccaag

SEQ ID NO: 467120 - RNA, 13 nt, Homo sapiens
aacacuuauuuuc

SEQ ID NO: 467121 - RNA, 23 nt, Homo sapiens
aacagaaacgagauuugccaaaa

SEQ ID NO: 467122 - RNA, 17 nt, Homo sapiens
aacaggaauuucuguua

SEQ ID NO: 467123 - RNA, 24 nt, Homo sapiens
aacaggaauuucuguuagcaauau

SEQ ID NO: 467124 - RNA, 17 nt, Homo sapiens
aacauauucuugcuuuc

SEQ ID NO: 467125 - RNA, 17 nt, Homo sapiens
aacauccggaacagcca

SEQ ID NO: 467126 - RNA, 18 nt, Homo sapiens
aacauuuggaagccccau

SEQ ID NO: 467127 - RNA, 12 nt, Homo sapiens
aaccaagugcuu

SEQ ID NO: 467128 - RNA, 13 nt, Homo sapiens
aaccaagugcuua

SEQ ID NO: 467129 - RNA, 13 nt, Homo sapiens
aaccaaugcacac

SEQ ID NO: 467130 - RNA, 23 nt, Homo sapiens
aacccgagggacagcagauucca

SEQ ID NO: 467131 - RNA, 17 nt, Homo sapiens
aaccugguggcaccaga

SEQ ID NO: 467132 - RNA, 17 nt, Homo sapiens
aaccugugcuuucaugu

SEQ ID NO: 467133 - RNA, 21 nt, Homo sapiens
aacgaaacacagaacucagcc

SEQ ID NO: 467134 - RNA, 13 nt, Homo sapiens
aacggaagccagg

SEQ ID NO: 467135 - RNA, 18 nt, Homo sapiens
aacguccuuccacuucag

SEQ ID NO: 467136 - RNA, 23 nt, Homo sapiens
aacuaagcaaguauauuuauuuc

SEQ ID NO: 467137 - RNA, 19 nt, Homo sapiens
aacucugauuaugaauaca

SEQ ID NO: 467138 - RNA, 23 nt, Homo sapiens
aacucugcauagacaaaggccuu

SEQ ID NO: 467139 - RNA, 22 nt, Homo sapiens
aacucuuacggcuaucuaguug

SEQ ID NO: 467140 - RNA, 12 nt, Homo sapiens
aacuuaauguuc

SEQ ID NO: 467141 - RNA, 23 nt, Homo sapiens
aacuuaauuaccuaagagccaca

SEQ ID NO: 467142 - RNA, 23 nt, Homo sapiens
aacuuagagcacuagaagcacag

SEQ ID NO: 467143 - RNA, 15 nt, Homo sapiens
aacuuugucacuucu

SEQ ID NO: 467144 - RNA, 21 nt, Homo sapiens
aagaaaacuuguguucaaucu

SEQ ID NO: 467145 - RNA, 18 nt, Homo sapiens
aagaaagcuauauaugaa

SEQ ID NO: 467146 - RNA, 19 nt, Homo sapiens
aagaaagcuauauaugaau

SEQ ID NO: 467147 - RNA, 16 nt, Homo sapiens
aagaacuugucccuca

SEQ ID NO: 467148 - RNA, 18 nt, Homo sapiens
aagaauaauaauggcuaa

SEQ ID NO: 467149 - RNA, 14 nt, Homo sapiens
aagaggcauuccca

SEQ ID NO: 467150 - RNA, 11 nt, Homo sapiens
aagaguucucc

SEQ ID NO: 467151 - RNA, 13 nt, Homo sapiens
aagauaaauccaa

SEQ ID NO: 467152 - RNA, 21 nt, Homo sapiens
aagcauuauccuuuuaucuca

SEQ ID NO: 467153 - RNA, 23 nt, Homo sapiens
aagcauuauccuuuuaucucaca

SEQ ID NO: 467154 - RNA, 16 nt, Homo sapiens
aagccuaugugccuuu

SEQ ID NO: 467155 - RNA, 17 nt, Homo sapiens
aagccugguggcaauaa

SEQ ID NO: 467156 - RNA, 17 nt, Homo sapiens
aagcucagggugcuccc

SEQ ID NO: 467157 - RNA, 19 nt, Homo sapiens
aagcucuuuaugacuguuu

SEQ ID NO: 467158 - RNA, 15 nt, Homo sapiens
aagcugucacucaca

SEQ ID NO: 467159 - RNA, 15 nt, Homo sapiens
aagcuguuucuugau

SEQ ID NO: 467160 - RNA, 21 nt, Homo sapiens
aagcuuccaguagagcuucuu

SEQ ID NO: 467161 - RNA, 22 nt, Homo sapiens
aaggaucuucccacuuugccac

SEQ ID NO: 467162 - RNA, 15 nt, Homo sapiens
aaggcaguaugccaa

SEQ ID NO: 467163 - RNA, 13 nt, Homo sapiens
aagggaggggaga

SEQ ID NO: 467164 - RNA, 17 nt, Homo sapiens
aagggagguaaaaaauc

SEQ ID NO: 467165 - RNA, 16 nt, Homo sapiens
aaggggcugucuccca

SEQ ID NO: 467166 - RNA, 20 nt, Homo sapiens
aaggggcugucucccaauga

SEQ ID NO: 467167 - RNA, 16 nt, Homo sapiens
aaggguucagggcaug

SEQ ID NO: 467168 - RNA, 13 nt, Homo sapiens
aagguaauacuuu

SEQ ID NO: 467169 - RNA, 17 nt, Homo sapiens
aaguaagagagcacagu

SEQ ID NO: 467170 - RNA, 15 nt, Homo sapiens
aaguaccuguaguga

SEQ ID NO: 467171 - RNA, 19 nt, Homo sapiens
aaguauuguggcaccucaa

SEQ ID NO: 467172 - RNA, 18 nt, Homo sapiens
aagucaaacaguguggcu

SEQ ID NO: 467173 - RNA, 15 nt, Homo sapiens
aagucaaacuuucac

SEQ ID NO: 467174 - RNA, 14 nt, Homo sapiens
aagugauguuauag

SEQ ID NO: 467175 - RNA, 20 nt, Homo sapiens
aagugcauuuauugccucua

SEQ ID NO: 467176 - RNA, 14 nt, Homo sapiens
aagugccaugcuca

SEQ ID NO: 467177 - RNA, 15 nt, Homo sapiens
aaguuaaaaagucaa

SEQ ID NO: 467178 - RNA, 12 nt, Homo sapiens
aauaaaacaaca

SEQ ID NO: 467179 - RNA, 11 nt, Homo sapiens
aauaaagccuc

SEQ ID NO: 467180 - RNA, 13 nt, Homo sapiens
aauaaguaauauc

SEQ ID NO: 467181 - RNA, 15 nt, Homo sapiens
aauaauuauguuuac

SEQ ID NO: 467182 - RNA, 24 nt, Homo sapiens
aauacuuuugggauguuaccuuca

SEQ ID NO: 467183 - RNA, 15 nt, Homo sapiens
accgucccacguggu

SEQ ID NO: 467184 - RNA, 22 nt, Homo sapiens
accuaaagaauaugaauggauu

SEQ ID NO: 467185 - RNA, 19 nt, Homo sapiens
accuauucccaaaugccuu

SEQ ID NO: 467186 - RNA, 16 nt, Homo sapiens
accucccaaacccagc

SEQ ID NO: 467187 - RNA, 17 nt, Homo sapiens
accucguugacaugcac

SEQ ID NO: 467188 - RNA, 17 nt, Homo sapiens
accucuacaggcauuua

SEQ ID NO: 467189 - RNA, 22 nt, Homo sapiens
accucuuuggauguuuucccca

SEQ ID NO: 467190 - RNA, 23 nt, Homo sapiens
accucuuuggauguuuuccccaa

SEQ ID NO: 467191 - RNA, 13 nt, Homo sapiens
accugugcugcug

SEQ ID NO: 467192 - RNA, 14 nt, Homo sapiens
accugugcuuucau

SEQ ID NO: 467193 - RNA, 15 nt, Homo sapiens
accuuccccugagga

SEQ ID NO: 467194 - RNA, 20 nt, Homo sapiens
accuucuguggcucacagaa

SEQ ID NO: 467195 - RNA, 11 nt, Homo sapiens
accuugcccau

SEQ ID NO: 467196 - RNA, 21 nt, Homo sapiens
accuuguacagaaccagcacu

SEQ ID NO: 467197 - RNA, 19 nt, Homo sapiens
accuuucugaggaguaaaa

SEQ ID NO: 467198 - RNA, 22 nt, Homo sapiens
accuuuuauguguugaugacuc

SEQ ID NO: 467199 - RNA, 12 nt, Homo sapiens
acgaaagcacag

SEQ ID NO: 467200 - RNA, 15 nt, Homo sapiens
acgccuccuggccag

SEQ ID NO: 467201 - RNA, 18 nt, Homo sapiens
acgcuuuucccaccucuu

SEQ ID NO: 467202 - RNA, 16 nt, Homo sapiens
acuacagaguguuaua

SEQ ID NO: 467203 - RNA, 21 nt, Homo sapiens
acuacagguauuuucaucaag

SEQ ID NO: 467204 - RNA, 18 nt, Homo sapiens
acuagaacacaaauccaa

SEQ ID NO: 467205 - RNA, 18 nt, Homo sapiens
acuagcccucuuucucuc

SEQ ID NO: 467206 - RNA, 13 nt, Homo sapiens
acuagguuucacc

SEQ ID NO: 467207 - RNA, 18 nt, Homo sapiens
aguuauguaauaaccaaa

SEQ ID NO: 467208 - RNA, 12 nt, Homo sapiens
aguucaaauacu

SEQ ID NO: 467209 - RNA, 18 nt, Homo sapiens
aguucuauuaucuggguu

SEQ ID NO: 467210 - RNA, 18 nt, Homo sapiens
aguucuuggccuaugaua

SEQ ID NO: 467211 - RNA, 21 nt, Homo sapiens
aguugcaaauuuuagcguuaa

SEQ ID NO: 467212 - RNA, 22 nt, Homo sapiens
aguugcuuuaaaguaccuguag

SEQ ID NO: 467213 - RNA, 22 nt, Homo sapiens
aguuguugguuuauacuguaua

SEQ ID NO: 467214 - RNA, 18 nt, Homo sapiens
aguuugggugucugcuaa

SEQ ID NO: 467215 - RNA, 14 nt, Homo sapiens
aguuuuuccuaguc

SEQ ID NO: 467216 - RNA, 13 nt, Homo sapiens
auaaaaacccugu

SEQ ID NO: 467217 - RNA, 14 nt, Homo sapiens
auaaaaacccugua

SEQ ID NO: 467218 - RNA, 21 nt, Homo sapiens
auaaacaacuuaauguucuga

SEQ ID NO: 467219 - RNA, 17 nt, Homo sapiens
auaaagagccauaguuu

SEQ ID NO: 467220 - RNA, 15 nt, Homo sapiens
auaaaggucauauug

SEQ ID NO: 467221 - RNA, 11 nt, Homo sapiens
auaaauccaac

SEQ ID NO: 467222 - RNA, 14 nt, Homo sapiens
auaaguaauaucuu

SEQ ID NO: 467223 - RNA, 12 nt, Homo sapiens
auaauguuauag

SEQ ID NO: 467224 - RNA, 17 nt, Homo sapiens
auacagaaaaaccacau

SEQ ID NO: 467225 - RNA, 18 nt, Homo sapiens
auacaguaagcugcucua

SEQ ID NO: 467226 - RNA, 17 nt, Homo sapiens
auacaugccgaaugcca

SEQ ID NO: 467227 - RNA, 15 nt, Homo sapiens
auacauuaugcuuga

SEQ ID NO: 467228 - RNA, 17 nt, Homo sapiens
auaccagagacucugaa

SEQ ID NO: 467229 - RNA, 18 nt, Homo sapiens
auuaaaauaacuaagcaa

SEQ ID NO: 467230 - RNA, 14 nt, Homo sapiens
auuaaacacuguaa

SEQ ID NO: 467231 - RNA, 18 nt, Homo sapiens
auuacugaugugugcaac

SEQ ID NO: 467232 - RNA, 14 nt, Homo sapiens
auuauccacaugaa

SEQ ID NO: 467233 - RNA, 12 nt, Homo sapiens
auuaucuacuac

SEQ ID NO: 467234 - RNA, 21 nt, Homo sapiens
auuaugcuugagaugucuuaa

SEQ ID NO: 467235 - RNA, 18 nt, Homo sapiens
auuauggugauacuccaa

SEQ ID NO: 467236 - RNA, 23 nt, Homo sapiens
auuauuugguauguguuuugcuu

SEQ ID NO: 467237 - RNA, 15 nt, Homo sapiens
auucaaucauuuugg

SEQ ID NO: 467238 - RNA, 14 nt, Homo sapiens
auucuaaaggggac

SEQ ID NO: 467239 - RNA, 16 nt, Homo sapiens
auucuagucucugauu

SEQ ID NO: 467240 - RNA, 20 nt, Homo sapiens
auucuaugccuguauuucca

SEQ ID NO: 467241 - RNA, 14 nt, Homo sapiens
auucucacuccuac

SEQ ID NO: 467242 - RNA, 20 nt, Homo sapiens
auucugcuaauuuaugaaga

SEQ ID NO: 467243 - RNA, 18 nt, Homo sapiens
auucuguagccaacuuaa

SEQ ID NO: 467244 - RNA, 15 nt, Homo sapiens
auugaagacccucaa

SEQ ID NO: 467245 - RNA, 20 nt, Homo sapiens
auugaagacccucaaugcca

SEQ ID NO: 467246 - RNA, 18 nt, Homo sapiens
auugaauguuaaugguca

SEQ ID NO: 467247 - RNA, 12 nt, Homo sapiens
auugacuucuuu

SEQ ID NO: 467248 - RNA, 12 nt, Homo sapiens
auugagcacaua

SEQ ID NO: 467249 - RNA, 17 nt, Homo sapiens
auugccucuaugugcaa

SEQ ID NO: 467250 - RNA, 14 nt, Homo sapiens
cuucccuaguucuu

SEQ ID NO: 467251 - RNA, 16 nt, Homo sapiens
cuuccgugagacacaa

SEQ ID NO: 467252 - RNA, 14 nt, Homo sapiens
cuuccucaucucau

SEQ ID NO: 467253 - RNA, 14 nt, Homo sapiens
cuuccucuuaccug

SEQ ID NO: 467254 - RNA, 17 nt, Homo sapiens
cuucuccccuccagacc

SEQ ID NO: 467255 - RNA, 17 nt, Homo sapiens
cuucucgccccucagug

SEQ ID NO: 467256 - RNA, 17 nt, Homo sapiens
cuucuucauccauagac

SEQ ID NO: 467257 - RNA, 13 nt, Homo sapiens
cuugaaaacugga

SEQ ID NO: 467258 - RNA, 14 nt, Homo sapiens
cuugacuauuucac

SEQ ID NO: 467259 - RNA, 14 nt, Homo sapiens
cuugacuuugccac

SEQ ID NO: 467260 - RNA, 19 nt, Homo sapiens
cuugagauguauuaugcaa

SEQ ID NO: 467261 - RNA, 12 nt, Homo sapiens
cuugcuuucaca

SEQ ID NO: 467262 - RNA, 12 nt, Homo sapiens
cuuggacaccau

SEQ ID NO: 467263 - RNA, 19 nt, Homo sapiens
cuugugagcaagguggugu

SEQ ID NO: 467264 - RNA, 16 nt, Homo sapiens
cuuguguucaaucugu

SEQ ID NO: 467265 - RNA, 19 nt, Homo sapiens
cuuguugcccucugcaguu

SEQ ID NO: 467266 - RNA, 22 nt, Homo sapiens
cuuuaaacacucuucagagaaa

SEQ ID NO: 467267 - RNA, 17 nt, Homo sapiens
cuuuaaaguaccuguag

SEQ ID NO: 467268 - RNA, 21 nt, Homo sapiens
cuuuaauucuuuucccagaag

SEQ ID NO: 467269 - RNA, 13 nt, Homo sapiens
cuuuauagcuuug

SEQ ID NO: 467270 - RNA, 23 nt, Homo sapiens
uuauugaauaacgcacaguauuu

SEQ ID NO: 467271 - RNA, 20 nt, Homo sapiens
uuauugaauguuauaucauc

SEQ ID NO: 467272 - RNA, 14 nt, Homo sapiens
uuauuucagauuca

SEQ ID NO: 467273 - RNA, 14 nt, Homo sapiens
uucaaauacuuuug

SEQ ID NO: 467274 - RNA, 11 nt, Homo sapiens
uucaaaugcau

SEQ ID NO: 467275 - RNA, 20 nt, Homo sapiens
uucaaccugguggcaccaga

SEQ ID NO: 467276 - RNA, 19 nt, Homo sapiens
uucaacucugugucccagc

SEQ ID NO: 467277 - RNA, 15 nt, Homo sapiens
uucaauguacuguau

SEQ ID NO: 467278 - RNA, 13 nt, Homo sapiens
uucaaugugaauu

SEQ ID NO: 467279 - RNA, 21 nt, Homo sapiens
uucacaucuguauaucagcuc

SEQ ID NO: 467280 - RNA, 16 nt, Homo sapiens
uucaccauguugccaa

SEQ ID NO: 467281 - RNA, 15 nt, Homo sapiens
uucaccuccauuaac

SEQ ID NO: 467282 - RNA, 17 nt, Homo sapiens
uucaccucccaaaccca

SEQ ID NO: 467283 - RNA, 17 nt, Homo sapiens
uucacucccugucauag

SEQ ID NO: 467284 - RNA, 22 nt, Homo sapiens
uucacuuuuucugucuuuaugu

SEQ ID NO: 467285 - RNA, 23 nt, Homo sapiens
uucagaguugcuuuaaaguaccu

SEQ ID NO: 467286 - RNA, 16 nt, Homo sapiens
uucagucaucaucuca

SEQ ID NO: 467287 - RNA, 16 nt, Homo sapiens
uuccaaauaagugcau

SEQ ID NO: 467288 - RNA, 12 nt, Homo sapiens
uuccacaggaca

SEQ ID NO: 467289 - RNA, 19 nt, Homo sapiens
uuccacuucaggguucuaa

SEQ ID NO: 467290 - RNA, 10 nt, Homo sapiens
uuccagacag

SEQ ID NO: 467291 - RNA, 15 nt, Homo sapiens
uuccauuuuggaaaa

SEQ ID NO: 467292 - RNA, 24 nt, Homo sapiens
uucccacucccucucuugccgaca

SEQ ID NO: 467293 - RNA, 20 nt, Homo sapiens
uucccuauacuucacacuga

SEQ ID NO: 467294 - RNA, 21 nt, Homo sapiens
uucccuuggcaaaugaaaguu

SEQ ID NO: 467295 - RNA, 19 nt, Homo sapiens
uuccgugagagucaucuca

SEQ ID NO: 467296 - RNA, 12 nt, Homo sapiens
uuccuacuggag

SEQ ID NO: 467297 - RNA, 13 nt, Homo sapiens
uuccucuuaccug

SEQ ID NO: 467298 - RNA, 23 nt, Homo sapiens
uuccugccuuugauguggaugaa

SEQ ID NO: 467299 - RNA, 15 nt, Homo sapiens
uucgaccacuacagc

SEQ ID NO: 467300 - RNA, 22 nt, Homo sapiens
uucuaaaaacaguuaagacaac

SEQ ID NO: 467301 - RNA, 19 nt, Homo sapiens
uucuaaggagcacuagaau

SEQ ID NO: 467302 - RNA, 16 nt, Homo sapiens
uucuauguagaacugu

SEQ ID NO: 467303 - RNA, 16 nt, Homo sapiens
uucuccuuguacuuga

SEQ ID NO: 467304 - RNA, 18 nt, Homo sapiens
uucuccuuguacuugaau

SEQ ID NO: 467305 - RNA, 19 nt, Homo sapiens
uucucucuguguggcaaac

SEQ ID NO: 467306 - RNA, 12 nt, Homo sapiens
uucugugcaaaa

SEQ ID NO: 467307 - RNA, 13 nt, Homo sapiens
uucuguuuuccaa

SEQ ID NO: 467308 - RNA, 21 nt, Homo sapiens
uucuuccuuuuguauccucca

SEQ ID NO: 467309 - RNA, 16 nt, Homo sapiens
uucuuuucuccuccuc

SEQ ID NO: 467310 - RNA, 16 nt, Homo sapiens
uugaaggacuacaggu

SEQ ID NO: 467311 - RNA, 13 nt, Homo sapiens
uugacuuugccac

SEQ ID NO: 467312 - RNA, 20 nt, Homo sapiens
uugacuuugccacauccauu

SEQ ID NO: 467313 - RNA, 14 nt, Homo sapiens
uugcaugugcugca

SEQ ID NO: 467314 - RNA, 15 nt, Homo sapiens
uugcaugugcugcag

SEQ ID NO: 467315 - RNA, 17 nt, Homo sapiens
uugcaugugcugcaggu

SEQ ID NO: 467316 - RNA, 11 nt, Homo sapiens
uugccaaaaac

SEQ ID NO: 467317 - RNA, 17 nt, Homo sapiens
uugccucuaugugcaac

SEQ ID NO: 467318 - RNA, 13 nt, Homo sapiens
uugcuguccucca

SEQ ID NO: 467319 - RNA, 15 nt, Homo sapiens
uugcuucugugcaau

SEQ ID NO: 467320 - RNA, 14 nt, Homo sapiens
uugcuuuaaaguac

SEQ ID NO: 467321 - RNA, 20 nt, Homo sapiens
uugcuuuaaaguaccuguag

SEQ ID NO: 467322 - RNA, 16 nt, Homo sapiens
uuggacauuuucuuca

SEQ ID NO: 467323 - RNA, 13 nt, Homo sapiens
uuggguuccagac

SEQ ID NO: 467324 - RNA, 13 nt, Homo sapiens
uuguacuugaaua

SEQ ID NO: 467325 - RNA, 21 nt, Homo sapiens
uuguagugguauagaguacug

SEQ ID NO: 467326 - RNA, 18 nt, Homo sapiens
uuguauuuuaauaaagau

SEQ ID NO: 467327 - RNA, 12 nt, Homo sapiens
uugucauucaag

SEQ ID NO: 467328 - RNA, 13 nt, Homo sapiens
uugucauuuauaa

SEQ ID NO: 467329 - RNA, 15 nt, Homo sapiens
uugugaugauagcac

SEQ ID NO: 467330 - RNA, 15 nt, Homo sapiens
uuguuauggcaaguu

SEQ ID NO: 467331 - RNA, 22 nt, Homo sapiens
uuuauauuguuuuuauauauua

SEQ ID NO: 467332 - RNA, 19 nt, Homo sapiens
uuuauguguugaugacuca

SEQ ID NO: 467333 - RNA, 15 nt, Homo sapiens
uuuauucccccaaag

SEQ ID NO: 467334 - RNA, 16 nt, Homo sapiens
uuuauucccccaaagc

SEQ ID NO: 467335 - RNA, 15 nt, Homo sapiens
uuucaaaaugcaugu

SEQ ID NO: 467336 - RNA, 15 nt, Homo sapiens
uuucaaugaccugua

SEQ ID NO: 467337 - RNA, 21 nt, Homo sapiens
uuucagggcugggcuauaaca

SEQ ID NO: 467338 - RNA, 17 nt, Homo sapiens
uuucauauaauuugcca

SEQ ID NO: 467339 - RNA, 20 nt, Homo sapiens
uuuccgugagagucaucuca

SEQ ID NO: 467340 - RNA, 13 nt, Homo sapiens
uuucuagcaaaca

SEQ ID NO: 467341 - RNA, 19 nt, Homo sapiens
uuucucucuguguggcaaa

SEQ ID NO: 467342 - RNA, 12 nt, Homo sapiens
uuugauaccagu

SEQ ID NO: 467343 - RNA, 12 nt, Homo sapiens
uuugccaaaaac

SEQ ID NO: 467344 - RNA, 20 nt, Homo sapiens
uuuggcuuuuuccaucucaa

SEQ ID NO: 467345 - RNA, 16 nt, Homo sapiens
uuuguaaccauaugau

SEQ ID NO: 467346 - RNA, 19 nt, Homo sapiens
uuuguaccgaaacaccccg

SEQ ID NO: 467347 - RNA, 13 nt, Homo sapiens
uuugucacuucug

SEQ ID NO: 467348 - RNA, 19 nt, Homo sapiens
uuuguugugucuugcuaua

SEQ ID NO: 467349 - RNA, 12 nt, Homo sapiens
uuuuaucucaca

SEQ ID NO: 467350 - RNA, 15 nt, Homo sapiens
uuuucauuauugguu

SEQ ID NO: 467351 - RNA, 20 nt, Homo sapiens
uuuucgucuucccugcuuca

SEQ ID NO: 467352 - RNA, 15 nt, Homo sapiens
uuuuguuauugggca

SEQ ID NO: 467353 - RNA, 22 nt, Homo sapiens
uagacaugcacacccauucaca

SEQ ID NO: 467354 - RNA, 12 nt, Homo sapiens
uagagaggacag

SEQ ID NO: 467355 - RNA, 17 nt, Homo sapiens
uagaugcugacuguacu

SEQ ID NO: 467356 - RNA, 21 nt, Homo sapiens
uaggagucuucugccucuuaa

SEQ ID NO: 467357 - RNA, 21 nt, Homo sapiens
uaggugcucuuccucaucuca

SEQ ID NO: 467358 - RNA, 22 nt, Homo sapiens
uagucaacugcuguuuuauguc

SEQ ID NO: 467359 - RNA, 20 nt, Homo sapiens
uaguccccagccugcucccu

SEQ ID NO: 467360 - RNA, 23 nt, Homo sapiens
uauaacaccaucuggagucuucc

SEQ ID NO: 467361 - RNA, 13 nt, Homo sapiens
uauaagaaauaca

SEQ ID NO: 467362 - RNA, 22 nt, Homo sapiens
uauaaguaacacuaguagcugu

SEQ ID NO: 467363 - RNA, 12 nt, Homo sapiens
uauaccgagacc

SEQ ID NO: 467364 - RNA, 16 nt, Homo sapiens
uauacuucacacugaa

SEQ ID NO: 467365 - RNA, 13 nt, Homo sapiens
uauagucacauuu

SEQ ID NO: 467366 - RNA, 19 nt, Homo sapiens
uauaucagcagacacucca

SEQ ID NO: 467367 - RNA, 23 nt, Homo sapiens
uauauuuuaucuugguaguacau

SEQ ID NO: 467368 - RNA, 18 nt, Homo sapiens
uaucaccucuuaugcaca

SEQ ID NO: 467369 - RNA, 20 nt, Homo sapiens
uauccugcuagcuguagaaa

SEQ ID NO: 467370 - RNA, 20 nt, Homo sapiens
uaucucacaaauaaguaaua

SEQ ID NO: 467371 - RNA, 14 nt, Homo sapiens
uaugaggcuauuaa

SEQ ID NO: 467372 - RNA, 21 nt, Homo sapiens
uaugauucuccucucccaaau

SEQ ID NO: 467373 - RNA, 23 nt, Homo sapiens
uaugccagggcgcacuuuccacu

SEQ ID NO: 467374 - RNA, 14 nt, Homo sapiens
uauggauucacuuc

SEQ ID NO: 467375 - RNA, 16 nt, Homo sapiens
uauguaaacaucauaa

SEQ ID NO: 467376 - RNA, 16 nt, Homo sapiens
uauguaauaaccaaau

SEQ ID NO: 467377 - RNA, 15 nt, Homo sapiens
uauguauaacaagcc

SEQ ID NO: 467378 - RNA, 21 nt, Homo sapiens
uauguauaacaagccaaacau

SEQ ID NO: 467379 - RNA, 17 nt, Homo sapiens
uaugugcaacugacaga

SEQ ID NO: 467380 - RNA, 13 nt, Homo sapiens
uauuaacucugca

SEQ ID NO: 467381 - RNA, 16 nt, Homo sapiens
uauucccaaaugccuu

SEQ ID NO: 467382 - RNA, 17 nt, Homo sapiens
uauuccucacauucaca

SEQ ID NO: 467383 - RNA, 19 nt, Homo sapiens
uauucuguagccaacuuaa

SEQ ID NO: 467384 - RNA, 22 nt, Homo sapiens
uauucuuccaaguucauucaua

SEQ ID NO: 467385 - RNA, 14 nt, Homo sapiens
uauuguauguaccu

SEQ ID NO: 467386 - RNA, 20 nt, Homo sapiens
uauuucacuuaaacuuuguc

SEQ ID NO: 467387 - RNA, 16 nt, Homo sapiens
uauuuugccagacuua

SEQ ID NO: 467388 - RNA, 19 nt, Homo sapiens
uauuuuuuacuacauaauu

SEQ ID NO: 467389 - RNA, 12 nt, Homo sapiens
ucaaaauacuuc

SEQ ID NO: 467390 - RNA, 13 nt, Homo sapiens
ucaaugaccugua

SEQ ID NO: 467391 - RNA, 14 nt, Homo sapiens
ucaaugaccuguau

SEQ ID NO: 467392 - RNA, 19 nt, Homo sapiens
ucaauugcuucugugcaau

SEQ ID NO: 467393 - RNA, 13 nt, Homo sapiens
ucaauuuaaagga

SEQ ID NO: 467394 - RNA, 21 nt, Homo sapiens
ucacagcaguacuugcucaau

SEQ ID NO: 467395 - RNA, 12 nt, Homo sapiens
ucacauguccua

SEQ ID NO: 467396 - RNA, 14 nt, Homo sapiens
ucacuccacucccc

SEQ ID NO: 467397 - RNA, 15 nt, Homo sapiens
ucacuuaaacuuugu

SEQ ID NO: 467398 - RNA, 20 nt, Homo sapiens
ucacuuauuucauaaacaac

SEQ ID NO: 467399 - RNA, 20 nt, Homo sapiens
ucagaacuccuuucuaagga

SEQ ID NO: 467400 - RNA, 18 nt, Homo sapiens
ucagaagucaguugcaaa

SEQ ID NO: 467401 - RNA, 21 nt, Homo sapiens
ucagaucccucggucagcacc

SEQ ID NO: 467402 - RNA, 16 nt, Homo sapiens
ucagaugaucucucca

SEQ ID NO: 467403 - RNA, 13 nt, Homo sapiens
ucaggagaaggcc

SEQ ID NO: 467404 - RNA, 12 nt, Homo sapiens
ucaggcuuucua

SEQ ID NO: 467405 - RNA, 19 nt, Homo sapiens
ucagggugcucccuccuca

SEQ ID NO: 467406 - RNA, 18 nt, Homo sapiens
ucaguagugccugugauc

SEQ ID NO: 467407 - RNA, 14 nt, Homo sapiens
ucauaaaaauaacc

SEQ ID NO: 467408 - RNA, 14 nt, Homo sapiens
ucauacucaaagag

SEQ ID NO: 467409 - RNA, 23 nt, Homo sapiens
ucauacucuguguaaucucugau

SEQ ID NO: 467410 - RNA, 23 nt, Homo sapiens
ucaucagggggcaugaagcacau

SEQ ID NO: 467411 - RNA, 19 nt, Homo sapiens
ucauguuucugcaguauuc

SEQ ID NO: 467412 - RNA, 12 nt, Homo sapiens
ucauucugcuaa

SEQ ID NO: 467413 - RNA, 22 nt, Homo sapiens
ucauugaagacccucaaugcca

SEQ ID NO: 467414 - RNA, 21 nt, Homo sapiens
ucauugagaaauaaagcacau

SEQ ID NO: 467415 - RNA, 17 nt, Homo sapiens
ucauuuauaaaaccauc

SEQ ID NO: 467416 - RNA, 19 nt, Homo sapiens
uccaaaauaucgagugaau

SEQ ID NO: 467417 - RNA, 15 nt, Homo sapiens
uccaaauaagugcau

SEQ ID NO: 467418 - RNA, 19 nt, Homo sapiens
uccaaccaggcuccuguga

SEQ ID NO: 467419 - RNA, 18 nt, Homo sapiens
uccaacucugacuguaaa

SEQ ID NO: 467420 - RNA, 14 nt, Homo sapiens
uccaagguggcaua

SEQ ID NO: 467421 - RNA, 18 nt, Homo sapiens
uccaagugugugugcaau

SEQ ID NO: 467422 - RNA, 20 nt, Homo sapiens
uccaauccuuuauagcuuug

SEQ ID NO: 467423 - RNA, 19 nt, Homo sapiens
uccaauuggguugugaaau

SEQ ID NO: 467424 - RNA, 18 nt, Homo sapiens
uccaccugugcugcugca

SEQ ID NO: 467425 - RNA, 20 nt, Homo sapiens
uccacuuagaaauugcauuu

SEQ ID NO: 467426 - RNA, 14 nt, Homo sapiens
uccagagagaagca

SEQ ID NO: 467427 - RNA, 15 nt, Homo sapiens
uccagagaguggcuc

SEQ ID NO: 467428 - RNA, 19 nt, Homo sapiens
uccagaguaggugggucuu

SEQ ID NO: 467429 - RNA, 11 nt, Homo sapiens
uccagcacauc

SEQ ID NO: 467430 - RNA, 17 nt, Homo sapiens
uccagucaugugugcau

SEQ ID NO: 467431 - RNA, 18 nt, Homo sapiens
uccagucaugugugcauc

SEQ ID NO: 467432 - RNA, 12 nt, Homo sapiens
uccaugugcaaa

SEQ ID NO: 467433 - RNA, 17 nt, Homo sapiens
ucccaaacccagccucu

SEQ ID NO: 467434 - RNA, 19 nt, Homo sapiens
ucccaaacccagccucuag

SEQ ID NO: 467435 - RNA, 14 nt, Homo sapiens
ucccaagucaaaca

SEQ ID NO: 467436 - RNA, 12 nt, Homo sapiens
ucccaauuuccc

SEQ ID NO: 467437 - RNA, 17 nt, Homo sapiens
uccccaaaauguggaau

SEQ ID NO: 467438 - RNA, 18 nt, Homo sapiens
uccccaaacccacccaua

SEQ ID NO: 467439 - RNA, 13 nt, Homo sapiens
uccccauggugca

SEQ ID NO: 467440 - RNA, 21 nt, Homo sapiens
ucccccacggccgucccugac

SEQ ID NO: 467441 - RNA, 13 nt, Homo sapiens
ucccuagccagag

SEQ ID NO: 467442 - RNA, 23 nt, Homo sapiens
ucccuagccagaggcucuaaugu

SEQ ID NO: 467443 - RNA, 11 nt, Homo sapiens
ucccuccacuc

SEQ ID NO: 467444 - RNA, 15 nt, Homo sapiens
uccggaacagccaaa

SEQ ID NO: 467445 - RNA, 11 nt, Homo sapiens
uccguuugcaa

SEQ ID NO: 467446 - RNA, 14 nt, Homo sapiens
uccuaguagcuuuc

SEQ ID NO: 467447 - RNA, 17 nt, Homo sapiens
uccuaugcugcaauaca

SEQ ID NO: 467448 - RNA, 18 nt, Homo sapiens
uccuauuacugaugugug

SEQ ID NO: 467449 - RNA, 16 nt, Homo sapiens
uccucugcaugucuca

SEQ ID NO: 467450 - RNA, 23 nt, Homo sapiens
uccucugcuugucauucugcuaa

SEQ ID NO: 467451 - RNA, 12 nt, Homo sapiens
uccucuuaccug

SEQ ID NO: 467452 - RNA, 19 nt, Homo sapiens
uccugacagaaggacucag

SEQ ID NO: 467453 - RNA, 14 nt, Homo sapiens
uccugauaaacauu

SEQ ID NO: 467454 - RNA, 23 nt, Homo sapiens
uccugauaaacauuaaacacugu

SEQ ID NO: 467455 - RNA, 17 nt, Homo sapiens
uccuuagaauacuguau

SEQ ID NO: 467456 - RNA, 17 nt, Homo sapiens
uccuuccaccaaauacu

SEQ ID NO: 467457 - RNA, 15 nt, Homo sapiens
uccuuucacaaccuu

SEQ ID NO: 467458 - RNA, 16 nt, Homo sapiens
ucgccccucugggcug

SEQ ID NO: 467459 - RNA, 16 nt, Homo sapiens
ucguugacaugcacag

SEQ ID NO: 467460 - RNA, 21 nt, Homo sapiens
ucuaaagcagagauguauuau

SEQ ID NO: 467461 - RNA, 15 nt, Homo sapiens
ucuaaccuuucuaac

SEQ ID NO: 467462 - RNA, 18 nt, Homo sapiens
ucuaagcuuauuucuaac

SEQ ID NO: 467463 - RNA, 15 nt, Homo sapiens
ucuacaggcauuuaa

SEQ ID NO: 467464 - RNA, 16 nt, Homo sapiens
ucuacuacagaguguu

SEQ ID NO: 467465 - RNA, 13 nt, Homo sapiens
ucuauagcacaua

SEQ ID NO: 467466 - RNA, 14 nt, Homo sapiens
ucuauauuucauau

SEQ ID NO: 467467 - RNA, 12 nt, Homo sapiens
ucuaugacucac

SEQ ID NO: 467468 - RNA, 13 nt, Homo sapiens
ucuaugccuguau

SEQ ID NO: 467469 - RNA, 13 nt, Homo sapiens
ucuauggauucac

SEQ ID NO: 467470 - RNA, 16 nt, Homo sapiens
ucuauggauucacuuc

SEQ ID NO: 467471 - RNA, 14 nt, Homo sapiens
ucuauucauuugau

SEQ ID NO: 467472 - RNA, 17 nt, Homo sapiens
ucucaaacacugcuuaa

SEQ ID NO: 467473 - RNA, 20 nt, Homo sapiens
ucucaagcgcuauccacaga

SEQ ID NO: 467474 - RNA, 14 nt, Homo sapiens
ucucauucuugccc

SEQ ID NO: 467475 - RNA, 20 nt, Homo sapiens
ucuccaccccucaagccagg

SEQ ID NO: 467476 - RNA, 20 nt, Homo sapiens
ucuccacgguagcacuugac

SEQ ID NO: 467477 - RNA, 15 nt, Homo sapiens
ucuccucugcuccaa

SEQ ID NO: 467478 - RNA, 17 nt, Homo sapiens
ucucgagcccagaugga

SEQ ID NO: 467479 - RNA, 23 nt, Homo sapiens
ucucuaaaauucuagucucugau

SEQ ID NO: 467480 - RNA, 21 nt, Homo sapiens
ucucuccacgguagcacuuga

SEQ ID NO: 467481 - RNA, 16 nt, Homo sapiens
ucucuccccauauaua

SEQ ID NO: 467482 - RNA, 13 nt, Homo sapiens
ucucugauuuuga

SEQ ID NO: 467483 - RNA, 23 nt, Homo sapiens
ucugacuguaaaauacaugguau

SEQ ID NO: 467484 - RNA, 23 nt, Homo sapiens
ucugagcccugcccucacuccac

SEQ ID NO: 467485 - RNA, 13 nt, Homo sapiens
ucugcaugucuca

SEQ ID NO: 467486 - RNA, 12 nt, Homo sapiens
ucugccuuugag

SEQ ID NO: 467487 - RNA, 16 nt, Homo sapiens
ucuggagucugaagga

SEQ ID NO: 467488 - RNA, 18 nt, Homo sapiens
ucugggaccaaaacauca

SEQ ID NO: 467489 - RNA, 16 nt, Homo sapiens
ucugucaucucucugg

SEQ ID NO: 467490 - RNA, 20 nt, Homo sapiens
ucuguccccaaaauguggaa

SEQ ID NO: 467491 - RNA, 22 nt, Homo sapiens
ucuguuccaagugugugugcaa

SEQ ID NO: 467492 - RNA, 13 nt, Homo sapiens
ucuuacaguauuu

SEQ ID NO: 467493 - RNA, 21 nt, Homo sapiens
ucuuagugaaaggucaucuca

SEQ ID NO: 467494 - RNA, 17 nt, Homo sapiens
ucuuauauuaaagaagu

SEQ ID NO: 467495 - RNA, 14 nt, Homo sapiens
ucuuauuuuagaca

SEQ ID NO: 467496 - RNA, 20 nt, Homo sapiens
ucuucucagcuccacucuga

SEQ ID NO: 467497 - RNA, 14 nt, Homo sapiens
ucuucuccacugga

SEQ ID NO: 467498 - RNA, 14 nt, Homo sapiens
ucuucuuacuguau

SEQ ID NO: 467499 - RNA, 20 nt, Homo sapiens
ucuugagauguauuaugcaa

SEQ ID NO: 467500 - RNA, 18 nt, Homo sapiens
ucuugcggcaccgcccac

SEQ ID NO: 467501 - RNA, 22 nt, Homo sapiens
ucuuguaaauaaugcuuaacau

SEQ ID NO: 467502 - RNA, 23 nt, Homo sapiens
ucuuuauguaagaagaaacugcu

SEQ ID NO: 467503 - RNA, 21 nt, Homo sapiens
ucuuucuauguagaacuguuc

SEQ ID NO: 467504 - RNA, 15 nt, Homo sapiens
ucuuucucucuuucc

SEQ ID NO: 467505 - RNA, 16 nt, Homo sapiens
ucuuugccaagggagg

SEQ ID NO: 467506 - RNA, 18 nt, Homo sapiens
ucuuuuaaugucaucucu

SEQ ID NO: 467507 - RNA, 23 nt, Homo sapiens
ugaaaucuacaacauaaugauac

SEQ ID NO: 467508 - RNA, 17 nt, Homo sapiens
ugaacccauccaaugga

SEQ ID NO: 467509 - RNA, 16 nt, Homo sapiens
ugaaccgucaauguga

SEQ ID NO: 467510 - RNA, 15 nt, Homo sapiens
ugaauaaaaacccug

SEQ ID NO: 467511 - RNA, 20 nt, Homo sapiens
ugaaugagcaguuagaaaua

SEQ ID NO: 467512 - RNA, 20 nt, Homo sapiens
ugaaugcugcugagugaaug

SEQ ID NO: 467513 - RNA, 20 nt, Homo sapiens
ugaaugugucccaugcauaa

SEQ ID NO: 467514 - RNA, 20 nt, Homo sapiens
ugacaugcacaguuugcaau

SEQ ID NO: 467515 - RNA, 18 nt, Homo sapiens
ugacuauaaaaacugccc

SEQ ID NO: 467516 - RNA, 13 nt, Homo sapiens
ugacuucaugcca

SEQ ID NO: 467517 - RNA, 12 nt, Homo sapiens
ugagaagauuca

SEQ ID NO: 467518 - RNA, 14 nt, Homo sapiens
ugagccaaaaacaa

SEQ ID NO: 467519 - RNA, 13 nt, Homo sapiens
ugaggggacugca

SEQ ID NO: 467520 - RNA, 24 nt, Homo sapiens
ugagguuaaggggaucuaaaagga

SEQ ID NO: 467521 - RNA, 16 nt, Homo sapiens
ugaguuugaacacaga

SEQ ID NO: 467522 - RNA, 13 nt, Homo sapiens
ugauaaacauuaa

SEQ ID NO: 467523 - RNA, 14 nt, Homo sapiens
ugauaaacauuaaa

SEQ ID NO: 467524 - RNA, 14 nt, Homo sapiens
ugaugcaggcagug

SEQ ID NO: 467525 - RNA, 15 nt, Homo sapiens
ugauuaugaauacag

SEQ ID NO: 467526 - RNA, 15 nt, Homo sapiens
ugauucuaaagggga

SEQ ID NO: 467527 - RNA, 19 nt, Homo sapiens
ugauuggacauuuucuuca

SEQ ID NO: 467528 - RNA, 12 nt, Homo sapiens
ugauugugaaac

SEQ ID NO: 467529 - RNA, 15 nt, Homo sapiens
ugcaaacgcuguauu

SEQ ID NO: 467530 - RNA, 18 nt, Homo sapiens
ugcaaacgcuguauucca

SEQ ID NO: 467531 - RNA, 23 nt, Homo sapiens
ugcaaauuuuagcguuaaaguca

SEQ ID NO: 467532 - RNA, 16 nt, Homo sapiens
ugcaacggaagccagg

SEQ ID NO: 467533 - RNA, 18 nt, Homo sapiens
ugcaauaugaggggacug

SEQ ID NO: 467534 - RNA, 17 nt, Homo sapiens
ugcacgucaccaaguaa

SEQ ID NO: 467535 - RNA, 16 nt, Homo sapiens
ugcagaugacuggaaa

SEQ ID NO: 467536 - RNA, 20 nt, Homo sapiens
ugcauccauguaaucuauuc

SEQ ID NO: 467537 - RNA, 16 nt, Homo sapiens
ugcaugcaggcugugu

SEQ ID NO: 467538 - RNA, 22 nt, Homo sapiens
ugcaugcaggcuguguuuucga

SEQ ID NO: 467539 - RNA, 16 nt, Homo sapiens
ugcaugugauuggcag

SEQ ID NO: 467540 - RNA, 13 nt, Homo sapiens
ugcaugugcugca

SEQ ID NO: 467541 - RNA, 14 nt, Homo sapiens
ugcauuuauugccu

SEQ ID NO: 467542 - RNA, 18 nt, Homo sapiens
ugccagcuauaaucuccc

SEQ ID NO: 467543 - RNA, 16 nt, Homo sapiens
ugccagggcgcacuuu

SEQ ID NO: 467544 - RNA, 21 nt, Homo sapiens
ugccagggcgcacuuuccacu

SEQ ID NO: 467545 - RNA, 15 nt, Homo sapiens
ugccaugcucagaaa

SEQ ID NO: 467546 - RNA, 21 nt, Homo sapiens
ugccauuagacugaauuuaac

SEQ ID NO: 467547 - RNA, 13 nt, Homo sapiens
ugccccuccgucc

SEQ ID NO: 467548 - RNA, 23 nt, Homo sapiens
ugccucccacccuucucagggac

SEQ ID NO: 467549 - RNA, 22 nt, Homo sapiens
ugccucuuuuaaugucaucucu

SEQ ID NO: 467550 - RNA, 15 nt, Homo sapiens
ugcggugugucucca

SEQ ID NO: 467551 - RNA, 12 nt, Homo sapiens
ugcgugugaaac

SEQ ID NO: 467552 - RNA, 20 nt, Homo sapiens
ugcucagaaauguugguuac

SEQ ID NO: 467553 - RNA, 15 nt, Homo sapiens
ugcucccuagccaga

SEQ ID NO: 467554 - RNA, 20 nt, Homo sapiens
ugcuuagugucccuuaccug

SEQ ID NO: 467555 - RNA, 17 nt, Homo sapiens
ugcuuuucuaaucugca

SEQ ID NO: 467556 - RNA, 12 nt, Homo sapiens
uggaagauuucu

SEQ ID NO: 467557 - RNA, 12 nt, Homo sapiens
uggaagauuugu

SEQ ID NO: 467558 - RNA, 22 nt, Homo sapiens
uggagauaccagagacucugaa

SEQ ID NO: 467559 - RNA, 13 nt, Homo sapiens
uggaguucacuuu

SEQ ID NO: 467560 - RNA, 16 nt, Homo sapiens
uggauccugcacucua

SEQ ID NO: 467561 - RNA, 21 nt, Homo sapiens
uggauguugcuuuugcaccua

SEQ ID NO: 467562 - RNA, 13 nt, Homo sapiens
uggcaaacauuua

SEQ ID NO: 467563 - RNA, 16 nt, Homo sapiens
uggcagauuuucuucu

SEQ ID NO: 467564 - RNA, 14 nt, Homo sapiens
uggcagcgccuccc

SEQ ID NO: 467565 - RNA, 20 nt, Homo sapiens
uggcauagagcagcacuaaa

SEQ ID NO: 467566 - RNA, 15 nt, Homo sapiens
uggcauuaucucuuu

SEQ ID NO: 467567 - RNA, 15 nt, Homo sapiens
uggcccucuuugaaa

SEQ ID NO: 467568 - RNA, 19 nt, Homo sapiens
uggcccucuuugaaagggc

SEQ ID NO: 467569 - RNA, 15 nt, Homo sapiens
uggccucugugccau

SEQ ID NO: 467570 - RNA, 15 nt, Homo sapiens
uggcuuaagccugug

SEQ ID NO: 467571 - RNA, 17 nt, Homo sapiens
uggcuuaagccugugua

SEQ ID NO: 467572 - RNA, 18 nt, Homo sapiens
uggcuuuuuccaucucaa

SEQ ID NO: 467573 - RNA, 18 nt, Homo sapiens
ugggaaauaagcaaaaaa

SEQ ID NO: 467574 - RNA, 15 nt, Homo sapiens
ugggaaauucuugca

SEQ ID NO: 467575 - RNA, 23 nt, Homo sapiens
ugggagaaccucguugacaugca

SEQ ID NO: 467576 - RNA, 20 nt, Homo sapiens
ugggccaagccaggguucca

SEQ ID NO: 467577 - RNA, 14 nt, Homo sapiens
ugggcugucuguca

SEQ ID NO: 467578 - RNA, 19 nt, Homo sapiens
ugggggauucaaaugcaug

SEQ ID NO: 467579 - RNA, 22 nt, Homo sapiens
ugggggcaccaagaccccaaag

SEQ ID NO: 467580 - RNA, 12 nt, Homo sapiens
ugguaucucuuu

SEQ ID NO: 467581 - RNA, 14 nt, Homo sapiens
uggugaaugcugcu

SEQ ID NO: 467582 - RNA, 12 nt, Homo sapiens
uggugacugucc

SEQ ID NO: 467583 - RNA, 19 nt, Homo sapiens
uggugugaggcccccggag

SEQ ID NO: 467584 - RNA, 15 nt, Homo sapiens
ugguuacaugaauga

SEQ ID NO: 467585 - RNA, 14 nt, Homo sapiens
ugguuuaaagucac

SEQ ID NO: 467586 - RNA, 21 nt, Homo sapiens
uguaaauaaugcuuaacauaa

SEQ ID NO: 467587 - RNA, 16 nt, Homo sapiens
uguaaauuuaacugca

SEQ ID NO: 467588 - RNA, 18 nt, Homo sapiens
uguaaauuuaacugcaua

SEQ ID NO: 467589 - RNA, 17 nt, Homo sapiens
uguaagaagaaacugcu

SEQ ID NO: 467590 - RNA, 16 nt, Homo sapiens
uguaauguaacagcaa

SEQ ID NO: 467591 - RNA, 18 nt, Homo sapiens
uguaauuccucccuaaga

SEQ ID NO: 467592 - RNA, 18 nt, Homo sapiens
uguacaauaaagcaaugu

SEQ ID NO: 467593 - RNA, 23 nt, Homo sapiens
uguacaauaaagcaaugugguag

SEQ ID NO: 467594 - RNA, 23 nt, Homo sapiens
uguaccgggcuggccugugccua

SEQ ID NO: 467595 - RNA, 14 nt, Homo sapiens
uguacuuacacuga

SEQ ID NO: 467596 - RNA, 15 nt, Homo sapiens
uguagcauuucuuga

SEQ ID NO: 467597 - RNA, 15 nt, Homo sapiens
uguaguggcaaaaaa

SEQ ID NO: 467598 - RNA, 23 nt, Homo sapiens
uguauaaaaaagaaaacuugugu

SEQ ID NO: 467599 - RNA, 13 nt, Homo sapiens
uguauaacaagcc

SEQ ID NO: 467600 - RNA, 11 nt, Homo sapiens
uguauccucca

SEQ ID NO: 467601 - RNA, 23 nt, Homo sapiens
uguaucuaaaaaauaacugugca

SEQ ID NO: 467602 - RNA, 19 nt, Homo sapiens
uguauuccaaggccuguga

SEQ ID NO: 467603 - RNA, 19 nt, Homo sapiens
uguauuccucacauucaca

SEQ ID NO: 467604 - RNA, 22 nt, Homo sapiens
ugucaccagcuaucugucaucu

SEQ ID NO: 467605 - RNA, 17 nt, Homo sapiens
uguccaccugugcugcu

SEQ ID NO: 467606 - RNA, 16 nt, Homo sapiens
uguccuguuccugcca

SEQ ID NO: 467607 - RNA, 17 nt, Homo sapiens
uguccuguuccugccac

SEQ ID NO: 467608 - RNA, 22 nt, Homo sapiens
ugugaauaaaaacccuguaugg

SEQ ID NO: 467609 - RNA, 20 nt, Homo sapiens
ugugacaugaacccauccaa

SEQ ID NO: 467610 - RNA, 20 nt, Homo sapiens
uguggacaaugaguggaaua

SEQ ID NO: 467611 - RNA, 22 nt, Homo sapiens
uguguccccucacucugucagc

SEQ ID NO: 467612 - RNA, 14 nt, Homo sapiens
uguuaccuucacau

SEQ ID NO: 467613 - RNA, 23 nt, Homo sapiens
uguuaucuucuaucaaagcacau

SEQ ID NO: 467614 - RNA, 13 nt, Homo sapiens
uguucccuuggca

SEQ ID NO: 467615 - RNA, 14 nt, Homo sapiens
uguuccugccacau

SEQ ID NO: 467616 - RNA, 15 nt, Homo sapiens
uguuguguccaaucc

SEQ ID NO: 467617 - RNA, 14 nt, Homo sapiens
uguuguuauggcaa

SEQ ID NO: 467618 - RNA, 17 nt, Homo sapiens
uguuuacaugaguucaa

SEQ ID NO: 467619 - RNA, 19 nt, Homo sapiens
uguuuacaugaguucaaau

SEQ ID NO: 467620 - RNA, 13 nt, Homo sapiens
uguuugaauuauc

SEQ ID NO: 467621 - RNA, 21 nt, Homo sapiens
uguuuuccccaauuauccucc

SEQ ID NO: 467622 - RNA, 15 nt, Homo sapiens
uuaaaaaaauaacau

SEQ ID NO: 467623 - RNA, 15 nt, Homo sapiens
uuaaaaaauaacaua

SEQ ID NO: 467624 - RNA, 12 nt, Homo sapiens
uuaaaaagucaa

SEQ ID NO: 467625 - RNA, 22 nt, Homo sapiens
uuaaaauaacuaagcaaguaua

SEQ ID NO: 467626 - RNA, 14 nt, Homo sapiens
uuaaacuuugucac

SEQ ID NO: 467627 - RNA, 18 nt, Homo sapiens
uuaaaguaccuguaguga

SEQ ID NO: 467628 - RNA, 22 nt, Homo sapiens
uuaaaucacagauggguauuaa

SEQ ID NO: 467629 - RNA, 15 nt, Homo sapiens
uuaacaucaaagacu

SEQ ID NO: 467630 - RNA, 13 nt, Homo sapiens
uuaacucugcaua

SEQ ID NO: 467631 - RNA, 19 nt, Homo sapiens
uuaagacaacaggcauuuu

SEQ ID NO: 467632 - RNA, 16 nt, Homo sapiens
uuaagccauaugacaa

SEQ ID NO: 467633 - RNA, 12 nt, Homo sapiens
uuaauaagcaac

SEQ ID NO: 467634 - RNA, 18 nt, Homo sapiens
uuaaucucuaaaauucua

SEQ ID NO: 467635 - RNA, 14 nt, Homo sapiens
uuaauuacuuuuga

SEQ ID NO: 467636 - RNA, 21 nt, Homo sapiens
uuacagacagaauauacauau

SEQ ID NO: 467637 - RNA, 18 nt, Homo sapiens
uuacuuugugcaauauga

SEQ ID NO: 467638 - RNA, 15 nt, Homo sapiens
uuagagugucuuaaa

SEQ ID NO: 467639 - RNA, 11 nt, Homo sapiens
uuauacuguau

SEQ ID NO: 467640 - RNA, 20 nt, Homo sapiens
uuaucauggguaucacauug

SEQ ID NO: 467641 - RNA, 21 nt, Homo sapiens
uuaucuagcaagaagauucua

SEQ ID NO: 467642 - RNA, 21 nt, Homo sapiens
uuaugaaccgcaauaugggag

SEQ ID NO: 467643 - RNA, 12 nt, Homo sapiens
uuauucuaguca

SEQ ID NO: 467644 - RNA, 16 nt, Homo sapiens
gucaaacuuucaccuc

SEQ ID NO: 467645 - RNA, 20 nt, Homo sapiens
gucacagcaguacuugcuca

SEQ ID NO: 467646 - RNA, 18 nt, Homo sapiens
gucaccagcuaucuguca

SEQ ID NO: 467647 - RNA, 17 nt, Homo sapiens
guccaccugugcugcug

SEQ ID NO: 467648 - RNA, 22 nt, Homo sapiens
guccccggacgcuggcucggga

SEQ ID NO: 467649 - RNA, 13 nt, Homo sapiens
gucccuuaccugg

SEQ ID NO: 467650 - RNA, 23 nt, Homo sapiens
gucccuuccagucaugugugcau

SEQ ID NO: 467651 - RNA, 17 nt, Homo sapiens
gucuccccaugugccug

SEQ ID NO: 467652 - RNA, 19 nt, Homo sapiens
gucuucguagguugugaug

SEQ ID NO: 467653 - RNA, 23 nt, Homo sapiens
gucuuugauucaccaaacaugaa

SEQ ID NO: 467654 - RNA, 12 nt, Homo sapiens
gugaagccuuua

SEQ ID NO: 467655 - RNA, 18 nt, Homo sapiens
gugaauaaaaacccugua

SEQ ID NO: 467656 - RNA, 23 nt, Homo sapiens
gugacaugaacccauccaaugga

SEQ ID NO: 467657 - RNA, 16 nt, Homo sapiens
gugaugauagcacugg

SEQ ID NO: 467658 - RNA, 12 nt, Homo sapiens
gugcaacugaca

SEQ ID NO: 467659 - RNA, 22 nt, Homo sapiens
gugcaauguuccguucaucuga

SEQ ID NO: 467660 - RNA, 22 nt, Homo sapiens
gugccucccacccuucucaggg

SEQ ID NO: 467661 - RNA, 23 nt, Homo sapiens
gugccucccacccuucucaggga

SEQ ID NO: 467662 - RNA, 13 nt, Homo sapiens
gugcggugcauac

SEQ ID NO: 467663 - RNA, 20 nt, Homo sapiens
gugcugagaauaaaaccagc

SEQ ID NO: 467664 - RNA, 23 nt, Homo sapiens
gugcuuguucuuccucuuaccug

SEQ ID NO: 467665 - RNA, 21 nt, Homo sapiens
gugggaagaacuugucccuca

SEQ ID NO: 467666 - RNA, 12 nt, Homo sapiens
gugggaguccac

SEQ ID NO: 467667 - RNA, 18 nt, Homo sapiens
gugggaguccacuuuccu

SEQ ID NO: 467668 - RNA, 14 nt, Homo sapiens
guguggcuuggaac

SEQ ID NO: 467669 - RNA, 20 nt, Homo sapiens
gugugguauucaacuaauac

SEQ ID NO: 467670 - RNA, 12 nt, Homo sapiens
guguugcaaauu

SEQ ID NO: 467671 - RNA, 13 nt, Homo sapiens
guuaaaaagucaa

SEQ ID NO: 467672 - RNA, 23 nt, Homo sapiens
guuaauggucaaugcuagcacaa

SEQ ID NO: 467673 - RNA, 10 nt, Homo sapiens
guuaaugugc

SEQ ID NO: 467674 - RNA, 14 nt, Homo sapiens
guuaauucuugcca

SEQ ID NO: 467675 - RNA, 22 nt, Homo sapiens
guuagaauuagguaauggauau

SEQ ID NO: 467676 - RNA, 22 nt, Homo sapiens
guucaaagaaccccccucccca

SEQ ID NO: 467677 - RNA, 21 nt, Homo sapiens
guucccacucccucucuugcc

SEQ ID NO: 467678 - RNA, 13 nt, Homo sapiens
guuccccuggaaa

SEQ ID NO: 467679 - RNA, 17 nt, Homo sapiens
guucuucccuauacuuc

SEQ ID NO: 467680 - RNA, 19 nt, Homo sapiens
guugcaguuaauucuugcc

SEQ ID NO: 467681 - RNA, 16 nt, Homo sapiens
guuuaagaaaugagaa

SEQ ID NO: 467682 - RNA, 15 nt, Homo sapiens
guuuaagguucuugc

SEQ ID NO: 467683 - RNA, 19 nt, Homo sapiens
guuuauuaaaauacuguuu

SEQ ID NO: 467684 - RNA, 14 nt, Homo sapiens
guuucaccucccaa

SEQ ID NO: 467685 - RNA, 13 nt, Homo sapiens
guuucuauacugu

SEQ ID NO: 467686 - RNA, 18 nt, Homo sapiens
guuucuauggauucacuu

SEQ ID NO: 467687 - RNA, 20 nt, Homo sapiens
guuuguuuucaaaauacuuc

SEQ ID NO: 467688 - RNA, 15 nt, Homo sapiens
guuuuuggauggcuu

SEQ ID NO: 467689 - RNA, 23 nt, Homo sapiens
guuuuuuuuuuccacuuagaaau

SEQ ID NO: 467690 - RNA, 14 nt, Homo sapiens
uaaaaccaagugcu

SEQ ID NO: 467691 - RNA, 16 nt, Homo sapiens
uaaaaccaagugcuua

SEQ ID NO: 467692 - RNA, 20 nt, Homo sapiens
uaaaaccaagugcuuauaaa

SEQ ID NO: 467693 - RNA, 22 nt, Homo sapiens
uaaaagccuaugugccuuucac

SEQ ID NO: 467694 - RNA, 17 nt, Homo sapiens
uaaaauaacuaagcaag

SEQ ID NO: 467695 - RNA, 13 nt, Homo sapiens
uaaacuacugauu

SEQ ID NO: 467696 - RNA, 21 nt, Homo sapiens
uaaagaccuugaaaagcagua

SEQ ID NO: 467697 - RNA, 23 nt, Homo sapiens
uaaagaguucuccuuguacuuga

SEQ ID NO: 467698 - RNA, 17 nt, Homo sapiens
uaaagguuuauguggaa

SEQ ID NO: 467699 - RNA, 16 nt, Homo sapiens
uaaagucaggauuuau

SEQ ID NO: 467700 - RNA, 22 nt, Homo sapiens
uaaauaaagaagaaaauaaccu

SEQ ID NO: 467701 - RNA, 12 nt, Homo sapiens
uaaauguuaaag

SEQ ID NO: 467702 - RNA, 17 nt, Homo sapiens
uaaauuuaauauacugc

SEQ ID NO: 467703 - RNA, 19 nt, Homo sapiens
uaacauaaacuuguacuua

SEQ ID NO: 467704 - RNA, 22 nt, Homo sapiens
uaaccuauucccaaaugccuuc

SEQ ID NO: 467705 - RNA, 14 nt, Homo sapiens
uaaccucuacaggc

SEQ ID NO: 467706 - RNA, 20 nt, Homo sapiens
uaacuuacaagaauggaauu

SEQ ID NO: 467707 - RNA, 15 nt, Homo sapiens
uaagaagaaacugcu

SEQ ID NO: 467708 - RNA, 14 nt, Homo sapiens
uaagacaacaggca

SEQ ID NO: 467709 - RNA, 13 nt, Homo sapiens
uaagcaacuguaa

SEQ ID NO: 467710 - RNA, 15 nt, Homo sapiens
uaagcaacuguaaaa

SEQ ID NO: 467711 - RNA, 23 nt, Homo sapiens
uaaguacucacuaaaaguucuca

SEQ ID NO: 467712 - RNA, 19 nt, Homo sapiens
uaagugcauuuauugccuc

SEQ ID NO: 467713 - RNA, 14 nt, Homo sapiens
uaauaggaggacag

SEQ ID NO: 467714 - RNA, 18 nt, Homo sapiens
uaaucuuggcccuauuca

SEQ ID NO: 467715 - RNA, 15 nt, Homo sapiens
uaaugauucaaugug

SEQ ID NO: 467716 - RNA, 14 nt, Homo sapiens
uaaugugccaaaau

SEQ ID NO: 467717 - RNA, 19 nt, Homo sapiens
uaauuaggguccacgccca

SEQ ID NO: 467718 - RNA, 22 nt, Homo sapiens
uacaaaaguuuaaaaagcucac

SEQ ID NO: 467719 - RNA, 21 nt, Homo sapiens
uacaauaaagcaaugugguag

SEQ ID NO: 467720 - RNA, 21 nt, Homo sapiens
uacagaguguuauaacaccau

SEQ ID NO: 467721 - RNA, 17 nt, Homo sapiens
uacagcaaauguuauag

SEQ ID NO: 467722 - RNA, 13 nt, Homo sapiens
uacauagucuuug

SEQ ID NO: 467723 - RNA, 20 nt, Homo sapiens
uacauuugauuugauauaca

SEQ ID NO: 467724 - RNA, 23 nt, Homo sapiens
uaccaacugagccaaaaacaaua

SEQ ID NO: 467725 - RNA, 19 nt, Homo sapiens
uaccaagugcuuugcucua

SEQ ID NO: 467726 - RNA, 17 nt, Homo sapiens
uaccauuuaucuacuau

SEQ ID NO: 467727 - RNA, 12 nt, Homo sapiens
uaccucacuuuu

SEQ ID NO: 467728 - RNA, 13 nt, Homo sapiens
uaccucacuuuua

SEQ ID NO: 467729 - RNA, 16 nt, Homo sapiens
uaccuuuccacccaga

SEQ ID NO: 467730 - RNA, 16 nt, Homo sapiens
uacuauuaacucugca

SEQ ID NO: 467731 - RNA, 16 nt, Homo sapiens
uacucuuuucccaaga

SEQ ID NO: 467732 - RNA, 14 nt, Homo sapiens
uacugaacaguauu

SEQ ID NO: 467733 - RNA, 21 nt, Homo sapiens
uacuucuucauccauagacac

SEQ ID NO: 467734 - RNA, 15 nt, Homo sapiens
uagaaauacauuaug

SEQ ID NO: 467735 - RNA, 14 nt, Homo sapiens
uagaacagccagac

SEQ ID NO: 467736 - RNA, 18 nt, Homo sapiens
uagaauauccuauacugg

SEQ ID NO: 467737 - RNA, 18 nt, Homo sapiens
uagaaugagaacauccau

SEQ ID NO: 467738 - RNA, 23 nt, Homo sapiens
uagaauggggcuuccaugguggu

SEQ ID NO: 467739 - RNA, 22 nt, Homo sapiens
uagacaaaggccuuaacaaacg

SEQ ID NO: 467740 - RNA, 21 nt, Homo sapiens
gccucccccucagaugaucuc

SEQ ID NO: 467741 - RNA, 15 nt, Homo sapiens
gccucccguccgucc

SEQ ID NO: 467742 - RNA, 17 nt, Homo sapiens
gccucgugccaugaucu

SEQ ID NO: 467743 - RNA, 14 nt, Homo sapiens
gccucuagaacagc

SEQ ID NO: 467744 - RNA, 21 nt, Homo sapiens
gccucuuuuaaugucaucucu

SEQ ID NO: 467745 - RNA, 23 nt, Homo sapiens
gccugcucccuagccagaggcuc

SEQ ID NO: 467746 - RNA, 20 nt, Homo sapiens
gccuggcagccgugccuuca

SEQ ID NO: 467747 - RNA, 16 nt, Homo sapiens
gccuuugauguggaug

SEQ ID NO: 467748 - RNA, 11 nt, Homo sapiens
gcgagcacuuu

SEQ ID NO: 467749 - RNA, 14 nt, Homo sapiens
gcgagcacuuucca

SEQ ID NO: 467750 - RNA, 12 nt, Homo sapiens
gcgccacccgcc

SEQ ID NO: 467751 - RNA, 13 nt, Homo sapiens
gcggaggggcuug

SEQ ID NO: 467752 - RNA, 23 nt, Homo sapiens
gcguauccuaugguaacugauga

SEQ ID NO: 467753 - RNA, 21 nt, Homo sapiens
gcuaaagaggaagugcacugg

SEQ ID NO: 467754 - RNA, 22 nt, Homo sapiens
gcuaacuuuuauuaucuucuau

SEQ ID NO: 467755 - RNA, 15 nt, Homo sapiens
gcucacgucugugag

SEQ ID NO: 467756 - RNA, 12 nt, Homo sapiens
gcuccacucuga

SEQ ID NO: 467757 - RNA, 13 nt, Homo sapiens
gcucccuagccag

SEQ ID NO: 467758 - RNA, 19 nt, Homo sapiens
gcucccugagguaccuuuc

SEQ ID NO: 467759 - RNA, 16 nt, Homo sapiens
gcuccuaguagcuuuc

SEQ ID NO: 467760 - RNA, 23 nt, Homo sapiens
gcucuaaagcagagauguauuau

SEQ ID NO: 467761 - RNA, 22 nt, Homo sapiens
gcucuacuuuauaaucaagaca

SEQ ID NO: 467762 - RNA, 17 nt, Homo sapiens
gcucugcauaagauuau

SEQ ID NO: 467763 - RNA, 20 nt, Homo sapiens
gcucuggauccugcacucua

SEQ ID NO: 467764 - RNA, 22 nt, Homo sapiens
gcugaaagaaggggugccaaaa

SEQ ID NO: 467765 - RNA, 15 nt, Homo sapiens
gcugaaagacaguaa

SEQ ID NO: 467766 - RNA, 18 nt, Homo sapiens
gcugcagaugacuggaaa

SEQ ID NO: 467767 - RNA, 13 nt, Homo sapiens
gcuuaaacauuuu

SEQ ID NO: 467768 - RNA, 12 nt, Homo sapiens
gcuuagaugacg

SEQ ID NO: 467769 - RNA, 12 nt, Homo sapiens
gcuucugugcaa

SEQ ID NO: 467770 - RNA, 15 nt, Homo sapiens
gcuucugugcaauaa

SEQ ID NO: 467771 - RNA, 13 nt, Homo sapiens
gcuucuuauauua

SEQ ID NO: 467772 - RNA, 19 nt, Homo sapiens
gcuuucauccaacuggaag

SEQ ID NO: 467773 - RNA, 14 nt, Homo sapiens
gcuuucucuucuaa

SEQ ID NO: 467774 - RNA, 17 nt, Homo sapiens
gcuuucuuuccaauccu

SEQ ID NO: 467775 - RNA, 20 nt, Homo sapiens
gcuuuggagacgccucccca

SEQ ID NO: 467776 - RNA, 14 nt, Homo sapiens
ggaaaaauguuucc

SEQ ID NO: 467777 - RNA, 17 nt, Homo sapiens
ggaaaagagaaacacua

SEQ ID NO: 467778 - RNA, 19 nt, Homo sapiens
ggaaacuguuguguccaau

SEQ ID NO: 467779 - RNA, 22 nt, Homo sapiens
ggaaagacguuuuugugcugug

SEQ ID NO: 467780 - RNA, 21 nt, Homo sapiens
ggaaauaagcaaaaaacugca

SEQ ID NO: 467781 - RNA, 22 nt, Homo sapiens
ggaacaaagacaaccacuggga

SEQ ID NO: 467782 - RNA, 14 nt, Homo sapiens
ggaaggacauuucc

SEQ ID NO: 467783 - RNA, 19 nt, Homo sapiens
ggaaguuauguuguucaaa

SEQ ID NO: 467784 - RNA, 13 nt, Homo sapiens
ggaaugcauccaa

SEQ ID NO: 467785 - RNA, 18 nt, Homo sapiens
ggaaugggccaagccagg

SEQ ID NO: 467786 - RNA, 22 nt, Homo sapiens
ggacgauagcuuggagggaugg

SEQ ID NO: 467787 - RNA, 13 nt, Homo sapiens
ggagaacuagaga

SEQ ID NO: 467788 - RNA, 19 nt, Homo sapiens
ggaguccacuuuccucucu

SEQ ID NO: 467789 - RNA, 19 nt, Homo sapiens
ggaucaugguuuuugcucu

SEQ ID NO: 467790 - RNA, 15 nt, Homo sapiens
ggcauagccauucau

SEQ ID NO: 467791 - RNA, 14 nt, Homo sapiens
ggcaugaagcacau

SEQ ID NO: 467792 - RNA, 18 nt, Homo sapiens
ggccaaguguacauuuga

SEQ ID NO: 467793 - RNA, 23 nt, Homo sapiens
ggcccuuccucuccacugccuuc

SEQ ID NO: 467794 - RNA, 22 nt, Homo sapiens
ggccuguccaccugugcugcug

SEQ ID NO: 467795 - RNA, 16 nt, Homo sapiens
ggccuuagaaaacaug

SEQ ID NO: 467796 - RNA, 17 nt, Homo sapiens
ggcucuaauguacaaua

SEQ ID NO: 467797 - RNA, 21 nt, Homo sapiens
ggcucuaauguacaauaaagc

SEQ ID NO: 467798 - RNA, 12 nt, Homo sapiens
ggcuucuucaac

SEQ ID NO: 467799 - RNA, 21 nt, Homo sapiens
ggcuugggguagagaggacag

SEQ ID NO: 467800 - RNA, 17 nt, Homo sapiens
ggcuuuaagcgaggcag

SEQ ID NO: 467801 - RNA, 17 nt, Homo sapiens
ggcuuuuuccaucucaa

SEQ ID NO: 467802 - RNA, 20 nt, Homo sapiens
gggagauuggcuuugccuuu

SEQ ID NO: 467803 - RNA, 21 nt, Homo sapiens
gggaucuaaaaggaggacagg

SEQ ID NO: 467804 - RNA, 13 nt, Homo sapiens
gggcaacugauga

SEQ ID NO: 467805 - RNA, 21 nt, Homo sapiens
gggcaccaagaccccaaaggg

SEQ ID NO: 467806 - RNA, 16 nt, Homo sapiens
gggcccugggccucag

SEQ ID NO: 467807 - RNA, 20 nt, Homo sapiens
gggcugagccccuccucucc

SEQ ID NO: 467808 - RNA, 20 nt, Homo sapiens
gggcuucucgccccucagug

SEQ ID NO: 467809 - RNA, 13 nt, Homo sapiens
ggggagaauggcu

SEQ ID NO: 467810 - RNA, 21 nt, Homo sapiens
ggggaugucuugagauguauu

SEQ ID NO: 467811 - RNA, 13 nt, Homo sapiens
gggggcaagagcu

SEQ ID NO: 467812 - RNA, 21 nt, Homo sapiens
ggucagcuugaauguccccau

SEQ ID NO: 467813 - RNA, 23 nt, Homo sapiens
ggugaaacccuacgaaagcacag

SEQ ID NO: 467814 - RNA, 11 nt, Homo sapiens
gguggggcuua

SEQ ID NO: 467815 - RNA, 14 nt, Homo sapiens
gguggucuuggaga

SEQ ID NO: 467816 - RNA, 18 nt, Homo sapiens
gguguaauuccucccuaa

SEQ ID NO: 467817 - RNA, 17 nt, Homo sapiens
gguuaaagaaaggcaga

SEQ ID NO: 467818 - RNA, 13 nt, Homo sapiens
gguucugugcaaa

SEQ ID NO: 467819 - RNA, 21 nt, Homo sapiens
gguuuaacaaaauguauguga

SEQ ID NO: 467820 - RNA, 22 nt, Homo sapiens
gguuucaccucccaaacccagc

SEQ ID NO: 467821 - RNA, 17 nt, Homo sapiens
guaaaagccuaugugcc

SEQ ID NO: 467822 - RNA, 13 nt, Homo sapiens
guaaaauguuuca

SEQ ID NO: 467823 - RNA, 16 nt, Homo sapiens
guaaccucuacaggca

SEQ ID NO: 467824 - RNA, 16 nt, Homo sapiens
guaagagucuguguua

SEQ ID NO: 467825 - RNA, 21 nt, Homo sapiens
guaauaaccaaaugcaaugug

SEQ ID NO: 467826 - RNA, 17 nt, Homo sapiens
guaauuccucccuaaga

SEQ ID NO: 467827 - RNA, 16 nt, Homo sapiens
guacaauaaagcaaug

SEQ ID NO: 467828 - RNA, 14 nt, Homo sapiens
guagcacacugagu

SEQ ID NO: 467829 - RNA, 17 nt, Homo sapiens
guagggcuuggugaaug

SEQ ID NO: 467830 - RNA, 15 nt, Homo sapiens
guagggugaggcgug

SEQ ID NO: 467831 - RNA, 14 nt, Homo sapiens
guaguggcaaaaaa

SEQ ID NO: 467832 - RNA, 18 nt, Homo sapiens
guaguuuauaaaagacug

SEQ ID NO: 467833 - RNA, 22 nt, Homo sapiens
guauaacaagccaaacauucuu

SEQ ID NO: 467834 - RNA, 13 nt, Homo sapiens
guaugcuggccag

SEQ ID NO: 467835 - RNA, 12 nt, Homo sapiens
guauuuugccag

SEQ ID NO: 467836 - RNA, 13 nt, Homo sapiens
aaaaaaggacugu

SEQ ID NO: 467837 - RNA, 15 nt, Homo sapiens
aaaaagucaaacuuu

SEQ ID NO: 467838 - RNA, 14 nt, Homo sapiens
aaaaauaacaucug

SEQ ID NO: 467839 - RNA, 24 nt, Homo sapiens
aaaacagaccagcauaguucugca

SEQ ID NO: 467840 - RNA, 19 nt, Homo sapiens
aaaacuaggaauccuccaa

SEQ ID NO: 467841 - RNA, 23 nt, Homo sapiens
aaaacugccccccuccuuuccaa

SEQ ID NO: 467842 - RNA, 13 nt, Homo sapiens
aaaagagcuuuau

SEQ ID NO: 467843 - RNA, 21 nt, Homo sapiens
aaaaggacuguauaguuuaaa

SEQ ID NO: 467844 - RNA, 16 nt, Homo sapiens
aaaagguuaagccaua

SEQ ID NO: 467845 - RNA, 19 nt, Homo sapiens
aaaaguaagagagcacagu

SEQ ID NO: 467846 - RNA, 19 nt, Homo sapiens
aaaauacaugguaucucuu

SEQ ID NO: 467847 - RNA, 20 nt, Homo sapiens
aaaauaccauuuaucuacua

SEQ ID NO: 467848 - RNA, 17 nt, Homo sapiens
aaaauccaaaaugcaug

SEQ ID NO: 467849 - RNA, 12 nt, Homo sapiens
aaacacuguaau

SEQ ID NO: 467850 - RNA, 19 nt, Homo sapiens
aaacagaacggguucuccc

SEQ ID NO: 467851 - RNA, 21 nt, Homo sapiens
aaacaguuaagacaacaggca

SEQ ID NO: 467852 - RNA, 20 nt, Homo sapiens
aaacgucacagcaguacuug

SEQ ID NO: 467853 - RNA, 11 nt, Homo sapiens
gagcagugggg

SEQ ID NO: 467854 - RNA, 22 nt, Homo sapiens
gagcaguuagaaauacauuaug

SEQ ID NO: 467855 - RNA, 20 nt, Homo sapiens
gagcaugaagauaaauccaa

SEQ ID NO: 467856 - RNA, 18 nt, Homo sapiens
gagcuugacuucaugcca

SEQ ID NO: 467857 - RNA, 20 nt, Homo sapiens
gaggaagugcacuggcccuc

SEQ ID NO: 467858 - RNA, 21 nt, Homo sapiens
gaggcucuaauguacaauaaa

SEQ ID NO: 467859 - RNA, 17 nt, Homo sapiens
gagggcaggguucuaga

SEQ ID NO: 467860 - RNA, 12 nt, Homo sapiens
gagggggccaga

SEQ ID NO: 467861 - RNA, 17 nt, Homo sapiens
gagucucuucuccacug

SEQ ID NO: 467862 - RNA, 18 nt, Homo sapiens
gagucucuucuccacugg

SEQ ID NO: 467863 - RNA, 15 nt, Homo sapiens
gaguuucuauggauu

SEQ ID NO: 467864 - RNA, 19 nt, Homo sapiens
gaguuucuauggauucacu

SEQ ID NO: 467865 - RNA, 21 nt, Homo sapiens
gauaaugcauaaauguuauau

SEQ ID NO: 467866 - RNA, 11 nt, Homo sapiens
gauaaugccuu

SEQ ID NO: 467867 - RNA, 19 nt, Homo sapiens
gauacaugccgaaugccac

SEQ ID NO: 467868 - RNA, 23 nt, Homo sapiens
gaucagacagaucuggaauguga

SEQ ID NO: 467869 - RNA, 19 nt, Homo sapiens
gaucuugagcaaggcaaga

SEQ ID NO: 467870 - RNA, 16 nt, Homo sapiens
gaugagaaaacaggcu

SEQ ID NO: 467871 - RNA, 22 nt, Homo sapiens
gauggguauuaaacuugucaga

SEQ ID NO: 467872 - RNA, 22 nt, Homo sapiens
gaugggucacuuguccucaguu

SEQ ID NO: 467873 - RNA, 13 nt, Homo sapiens
gaugugcuuucau

SEQ ID NO: 467874 - RNA, 18 nt, Homo sapiens
gauguugcuuuugcaccu

SEQ ID NO: 467875 - RNA, 18 nt, Homo sapiens
gauguuuaguaauacagc

SEQ ID NO: 467876 - RNA, 16 nt, Homo sapiens
gauucaaaugcaugau

SEQ ID NO: 467877 - RNA, 21 nt, Homo sapiens
gauucaagacucaauguggaa

SEQ ID NO: 467878 - RNA, 13 nt, Homo sapiens
gauucaccaaaca

SEQ ID NO: 467879 - RNA, 12 nt, Homo sapiens
gauuccagagag

SEQ ID NO: 467880 - RNA, 17 nt, Homo sapiens
gauucuaaaacauucuu

SEQ ID NO: 467881 - RNA, 18 nt, Homo sapiens
gauucuuuuuucaaugua

SEQ ID NO: 467882 - RNA, 13 nt, Homo sapiens
gauugaaagggag

SEQ ID NO: 467883 - RNA, 22 nt, Homo sapiens
gauugguaccagagccuaugga

SEQ ID NO: 467884 - RNA, 22 nt, Homo sapiens
gauuugguuaagcucacacagc

SEQ ID NO: 467885 - RNA, 16 nt, Homo sapiens
gauuuuucucaucucc

SEQ ID NO: 467886 - RNA, 21 nt, Homo sapiens
gcaaaguaccaacugagccaa

SEQ ID NO: 467887 - RNA, 16 nt, Homo sapiens
gcaccccccauugggg

SEQ ID NO: 467888 - RNA, 14 nt, Homo sapiens
gcacuuuccacugg

SEQ ID NO: 467889 - RNA, 10 nt, Homo sapiens
gcagauucca

SEQ ID NO: 467890 - RNA, 21 nt, Homo sapiens
gcagccccuccccauggugca

SEQ ID NO: 467891 - RNA, 17 nt, Homo sapiens
gcagcuggagaucuuaa

SEQ ID NO: 467892 - RNA, 24 nt, Homo sapiens
gcaguggagaggggacuuggauag

SEQ ID NO: 467893 - RNA, 22 nt, Homo sapiens
gcaguguaacccaagcauuugu

SEQ ID NO: 467894 - RNA, 14 nt, Homo sapiens
gcaguugaucucca

SEQ ID NO: 467895 - RNA, 18 nt, Homo sapiens
gcaugcaggcuguguuuu

SEQ ID NO: 467896 - RNA, 20 nt, Homo sapiens
gcauucugggguggggcuug

SEQ ID NO: 467897 - RNA, 16 nt, Homo sapiens
gcauuuaaaauggacu

SEQ ID NO: 467898 - RNA, 14 nt, Homo sapiens
gcauuuaacugccu

SEQ ID NO: 467899 - RNA, 22 nt, Homo sapiens
gcauuuauugccucuaugugca

SEQ ID NO: 467900 - RNA, 19 nt, Homo sapiens
gccacaauaagccacuggu

SEQ ID NO: 467901 - RNA, 21 nt, Homo sapiens
gccacuagguuucaccuccca

SEQ ID NO: 467902 - RNA, 21 nt, Homo sapiens
gccagaggcucuaauguacaa

SEQ ID NO: 467903 - RNA, 22 nt, Homo sapiens
gccagaggcucuaauguacaau

SEQ ID NO: 467904 - RNA, 16 nt, Homo sapiens
gccaggccaacugccc

SEQ ID NO: 467905 - RNA, 13 nt, Homo sapiens
gccagucccucag

SEQ ID NO: 467906 - RNA, 22 nt, Homo sapiens
gcccagucuuuggagagcucag

SEQ ID NO: 467907 - RNA, 20 nt, Homo sapiens
gcccauucuaaacuccuuuc

SEQ ID NO: 467908 - RNA, 16 nt, Homo sapiens
gccccccguguucaca

SEQ ID NO: 467909 - RNA, 20 nt, Homo sapiens
gccccucucuguuuacccuc

SEQ ID NO: 467910 - RNA, 13 nt, Homo sapiens
gcccgccaccuug

SEQ ID NO: 467911 - RNA, 15 nt, Homo sapiens
gcccucacuccacuc

SEQ ID NO: 467912 - RNA, 16 nt, Homo sapiens
gcccucagaacaaucc

SEQ ID NO: 467913 - RNA, 16 nt, Homo sapiens
gcccucccucccucca

SEQ ID NO: 467914 - RNA, 23 nt, Homo sapiens
gcccugagcccagaaaaaaggac

SEQ ID NO: 467915 - RNA, 21 nt, Homo sapiens
gcccugcaccuugggcacggg

SEQ ID NO: 467916 - RNA, 13 nt, Homo sapiens
gccuccuggccag

SEQ ID NO: 467917 - RNA, 19 nt, Homo sapiens
gccucuagaacagccagac

SEQ ID NO: 467918 - RNA, 21 nt, Homo sapiens
gccucuagaacagccagaccc

SEQ ID NO: 467919 - RNA, 18 nt, Homo sapiens
gccucugugccauggaug

SEQ ID NO: 467920 - RNA, 16 nt, Homo sapiens
gccugcucccuagcca

SEQ ID NO: 467921 - RNA, 17 nt, Homo sapiens
gccuuaagaaagcuaua

SEQ ID NO: 467922 - RNA, 22 nt, Homo sapiens
gccuucuguuuuccaaaggagu

SEQ ID NO: 467923 - RNA, 19 nt, Homo sapiens
gccuuuaauaauguuauag

SEQ ID NO: 467924 - RNA, 20 nt, Homo sapiens
gcgagcacuuuccacuucca

SEQ ID NO: 467925 - RNA, 14 nt, Homo sapiens
gcgcacuuuccacu

SEQ ID NO: 467926 - RNA, 15 nt, Homo sapiens
gcgcuauccacagaa

SEQ ID NO: 467927 - RNA, 21 nt, Homo sapiens
gcggccucgugccaugaucug

SEQ ID NO: 467928 - RNA, 20 nt, Homo sapiens
gcgugcuugcaugugcugca

SEQ ID NO: 467929 - RNA, 13 nt, Homo sapiens
gcguuaaagucag

SEQ ID NO: 467930 - RNA, 15 nt, Homo sapiens
gcguuggagacauac

SEQ ID NO: 467931 - RNA, 15 nt, Homo sapiens
gcuaugucugugaug

SEQ ID NO: 467932 - RNA, 13 nt, Homo sapiens
gcucagggugcuc

SEQ ID NO: 467933 - RNA, 20 nt, Homo sapiens
gcucccuagccagaggcucu

SEQ ID NO: 467934 - RNA, 17 nt, Homo sapiens
gcucccuuccuccucaa

SEQ ID NO: 467935 - RNA, 14 nt, Homo sapiens
gcuccgggugcgug

SEQ ID NO: 467936 - RNA, 18 nt, Homo sapiens
gcuccucugcagccugag

SEQ ID NO: 467937 - RNA, 14 nt, Homo sapiens
gcucuaauguacaa

SEQ ID NO: 467938 - RNA, 15 nt, Homo sapiens
gcucuaauguacaau

SEQ ID NO: 467939 - RNA, 23 nt, Homo sapiens
gcucuaauguacaauaaagcaau

SEQ ID NO: 467940 - RNA, 17 nt, Homo sapiens
gcucuagggaagcagug

SEQ ID NO: 467941 - RNA, 21 nt, Homo sapiens
gcugacaaggcgucucuucaa

SEQ ID NO: 467942 - RNA, 18 nt, Homo sapiens
gcugacuguacuccuccc

SEQ ID NO: 467943 - RNA, 15 nt, Homo sapiens
gcugcaauacauuaa

SEQ ID NO: 467944 - RNA, 20 nt, Homo sapiens
gcugccaauaaacuguuaca

SEQ ID NO: 467945 - RNA, 12 nt, Homo sapiens
gcugcucauggg

SEQ ID NO: 467946 - RNA, 14 nt, Homo sapiens
gcugcucuauugua

SEQ ID NO: 467947 - RNA, 19 nt, Homo sapiens
gcugcuguagcaacagagc

SEQ ID NO: 467948 - RNA, 18 nt, Homo sapiens
gcuggguuugggcagugg

SEQ ID NO: 467949 - RNA, 23 nt, Homo sapiens
gcuguauuccaaggccugugaau

SEQ ID NO: 467950 - RNA, 12 nt, Homo sapiens
ucuagaacagcc

SEQ ID NO: 467951 - RNA, 13 nt, Homo sapiens
ucuagaacagcca

SEQ ID NO: 467952 - RNA, 14 nt, Homo sapiens
ucuagaacagccag

SEQ ID NO: 467953 - RNA, 16 nt, Homo sapiens
ucuagaacagccagac

SEQ ID NO: 467954 - RNA, 17 nt, Homo sapiens
ucuagaacagccagacc

SEQ ID NO: 467955 - RNA, 18 nt, Homo sapiens
ucuagucucugauuugca

SEQ ID NO: 467956 - RNA, 14 nt, Homo sapiens
ucuaguggccuuag

SEQ ID NO: 467957 - RNA, 17 nt, Homo sapiens
ucuauauuaaggcagua

SEQ ID NO: 467958 - RNA, 15 nt, Homo sapiens
ucuaucaaagcacau

SEQ ID NO: 467959 - RNA, 18 nt, Homo sapiens
ucuauguagaacuguuca

SEQ ID NO: 467960 - RNA, 20 nt, Homo sapiens
ucuauucccaucgcuggaaa

SEQ ID NO: 467961 - RNA, 16 nt, Homo sapiens
ucuauuuucaaguaca

SEQ ID NO: 467962 - RNA, 19 nt, Homo sapiens
ucucacaaauaaguaauau

SEQ ID NO: 467963 - RNA, 10 nt, Homo sapiens
ucucaucucc

SEQ ID NO: 467964 - RNA, 23 nt, Homo sapiens
ucuccuucacucugacaguauua

SEQ ID NO: 467965 - RNA, 12 nt, Homo sapiens
ucucuucuaaug

SEQ ID NO: 467966 - RNA, 13 nt, Homo sapiens
ucucuucuuccuu

SEQ ID NO: 467967 - RNA, 19 nt, Homo sapiens
ucucuugccgacaagggca

SEQ ID NO: 467968 - RNA, 17 nt, Homo sapiens
ucugaagucacugcaca

SEQ ID NO: 467969 - RNA, 15 nt, Homo sapiens
ucugaggaguccaaa

SEQ ID NO: 467970 - RNA, 14 nt, Homo sapiens
ucugaucaguauug

SEQ ID NO: 467971 - RNA, 17 nt, Homo sapiens
ucugauuuugagcucaa

SEQ ID NO: 467972 - RNA, 18 nt, Homo sapiens
ucugcaaauaguuucaaa

SEQ ID NO: 467973 - RNA, 20 nt, Homo sapiens
ucugcuugucauucugcuaa

SEQ ID NO: 467974 - RNA, 18 nt, Homo sapiens
ucuggcuacgacuuggga

SEQ ID NO: 467975 - RNA, 14 nt, Homo sapiens
ucugggguggggcu

SEQ ID NO: 467976 - RNA, 15 nt, Homo sapiens
ucuguauaucagcuc

SEQ ID NO: 467977 - RNA, 14 nt, Homo sapiens
ucugucaccagcua

SEQ ID NO: 467978 - RNA, 21 nt, Homo sapiens
ucugucaccagcuaucuguca

SEQ ID NO: 467979 - RNA, 22 nt, Homo sapiens
ucuuaacuuaaaagaacauagg

SEQ ID NO: 467980 - RNA, 12 nt, Homo sapiens
ucuuacaguauu

SEQ ID NO: 467981 - RNA, 15 nt, Homo sapiens
ucuuacauuagcagu

SEQ ID NO: 467982 - RNA, 20 nt, Homo sapiens
ucuuauuuuagacaaccaua

SEQ ID NO: 467983 - RNA, 14 nt, Homo sapiens
ucuucaaacaguuc

SEQ ID NO: 467984 - RNA, 18 nt, Homo sapiens
ucuucguagguugugaug

SEQ ID NO: 467985 - RNA, 19 nt, Homo sapiens
ucuucuaucaaagcacaua

SEQ ID NO: 467986 - RNA, 14 nt, Homo sapiens
ucuucucuuucuca

SEQ ID NO: 467987 - RNA, 13 nt, Homo sapiens
ucuucuuacugua

SEQ ID NO: 467988 - RNA, 23 nt, Homo sapiens
ucuuggagaggagguguggagug

SEQ ID NO: 467989 - RNA, 22 nt, Homo sapiens
ucuuguuuuuuuuuuccacuua

SEQ ID NO: 467990 - RNA, 14 nt, Homo sapiens
ucuuuaugacuguu

SEQ ID NO: 467991 - RNA, 21 nt, Homo sapiens
ucuuucgcacauucuccugau

SEQ ID NO: 467992 - RNA, 14 nt, Homo sapiens
ucuuucucucugug

SEQ ID NO: 467993 - RNA, 18 nt, Homo sapiens
ucuuuguuuacaugaguu

SEQ ID NO: 467994 - RNA, 15 nt, Homo sapiens
ucuuuucagcuuguu

SEQ ID NO: 467995 - RNA, 15 nt, Homo sapiens
ucuuuucuccuccuc

SEQ ID NO: 467996 - RNA, 18 nt, Homo sapiens
ucuuuuucccccaaccuc

SEQ ID NO: 467997 - RNA, 15 nt, Homo sapiens
ucuuuuuucaaugua

SEQ ID NO: 467998 - RNA, 18 nt, Homo sapiens
ucuuuuuucaauguacug

SEQ ID NO: 467999 - RNA, 17 nt, Homo sapiens
ugaaagaggcauuccca

SEQ ID NO: 468000 - RNA, 16 nt, Homo sapiens
ugaaaggucaucucau

SEQ ID NO: 468001 - RNA, 13 nt, Homo sapiens
ugaaauccaaaau

SEQ ID NO: 468002 - RNA, 14 nt, Homo sapiens
ugaaggacuacagg

SEQ ID NO: 468003 - RNA, 13 nt, Homo sapiens
ugaaucaaucugg

SEQ ID NO: 468004 - RNA, 23 nt, Homo sapiens
ugaaucaaucuggcuucugcauu

SEQ ID NO: 468005 - RNA, 22 nt, Homo sapiens
ugaaucacugcaccucuuuguc

SEQ ID NO: 468006 - RNA, 21 nt, Homo sapiens
ugaaugcugcugagugaauga

SEQ ID NO: 468007 - RNA, 23 nt, Homo sapiens
ugacaaaaguaagagagcacagu

SEQ ID NO: 468008 - RNA, 18 nt, Homo sapiens
ugacaaccgacgaagaaa

SEQ ID NO: 468009 - RNA, 16 nt, Homo sapiens
ugacaggaaagcccuc

SEQ ID NO: 468010 - RNA, 20 nt, Homo sapiens
ugaccccacuuaugcugcug

SEQ ID NO: 468011 - RNA, 21 nt, Homo sapiens
ugacuuugccacauccauuga

SEQ ID NO: 468012 - RNA, 17 nt, Homo sapiens
ugacuuuuucagaguug

SEQ ID NO: 468013 - RNA, 16 nt, Homo sapiens
ugagaaaacaggcuca

SEQ ID NO: 468014 - RNA, 18 nt, Homo sapiens
ugagcaaacugaagccca

SEQ ID NO: 468015 - RNA, 14 nt, Homo sapiens
ugagcuugauucua

SEQ ID NO: 468016 - RNA, 16 nt, Homo sapiens
ugaggcccacucuguu

SEQ ID NO: 468017 - RNA, 16 nt, Homo sapiens
ugaggcgugggaucca

SEQ ID NO: 468018 - RNA, 15 nt, Homo sapiens
ugagguuaaggggau

SEQ ID NO: 468019 - RNA, 21 nt, Homo sapiens
ugauaaacauuaaacacugua

SEQ ID NO: 468020 - RNA, 15 nt, Homo sapiens
ugauacaugccgaau

SEQ ID NO: 468021 - RNA, 19 nt, Homo sapiens
ugauacaugccgaaugcca

SEQ ID NO: 468022 - RNA, 14 nt, Homo sapiens
ugauguggaugaaa

SEQ ID NO: 468023 - RNA, 17 nt, Homo sapiens
ugauucuaugccuguau

SEQ ID NO: 468024 - RNA, 16 nt, Homo sapiens
ugauucuccucuccca

SEQ ID NO: 468025 - RNA, 20 nt, Homo sapiens
ugauucuuuucccaucacca

SEQ ID NO: 468026 - RNA, 19 nt, Homo sapiens
ugauugaaaauaguaaaug

SEQ ID NO: 468027 - RNA, 17 nt, Homo sapiens
ugcaaauccccucccca

SEQ ID NO: 468028 - RNA, 17 nt, Homo sapiens
ugcaacuaauucaauaa

SEQ ID NO: 468029 - RNA, 23 nt, Homo sapiens
ugcaaucuuauguugaucgaugu

SEQ ID NO: 468030 - RNA, 15 nt, Homo sapiens
ugcacaguuugcaau

SEQ ID NO: 468031 - RNA, 22 nt, Homo sapiens
ugcacaguuugcaaucuuaugu

SEQ ID NO: 468032 - RNA, 18 nt, Homo sapiens
ugcacauuugucacugaa

SEQ ID NO: 468033 - RNA, 17 nt, Homo sapiens
ugcaccaggagacagac

SEQ ID NO: 468034 - RNA, 12 nt, Homo sapiens
ugcagcaguacc

SEQ ID NO: 468035 - RNA, 21 nt, Homo sapiens
ugcaggaugggugaaaccaca

SEQ ID NO: 468036 - RNA, 17 nt, Homo sapiens
ugcaggguccccaagga

SEQ ID NO: 468037 - RNA, 17 nt, Homo sapiens
ugcaguggugaugccua

SEQ ID NO: 468038 - RNA, 15 nt, Homo sapiens
ugcauuuauugccuc

SEQ ID NO: 468039 - RNA, 17 nt, Homo sapiens
ugcauuuauugccucua

SEQ ID NO: 468040 - RNA, 17 nt, Homo sapiens
ugccacuagguuucacc

SEQ ID NO: 468041 - RNA, 22 nt, Homo sapiens
ugccacuagguuucaccuccca

SEQ ID NO: 468042 - RNA, 15 nt, Homo sapiens
ugccagcaacgcuca

SEQ ID NO: 468043 - RNA, 17 nt, Homo sapiens
ugcccaggaaaauaaca

SEQ ID NO: 468044 - RNA, 18 nt, Homo sapiens
ugccccccuccuuuccaa

SEQ ID NO: 468045 - RNA, 22 nt, Homo sapiens
ugccccccuccuuuccaaauaa

SEQ ID NO: 468046 - RNA, 21 nt, Homo sapiens
ugccucccacccuucucaggg

SEQ ID NO: 468047 - RNA, 22 nt, Homo sapiens
ugccucccacccuucucaggga

SEQ ID NO: 468048 - RNA, 19 nt, Homo sapiens
aauucauagcauccugauu

SEQ ID NO: 468049 - RNA, 19 nt, Homo sapiens
aauugaaccgucaauguga

SEQ ID NO: 468050 - RNA, 21 nt, Homo sapiens
aauugaagacacguucuugcc

SEQ ID NO: 468051 - RNA, 12 nt, Homo sapiens
aauugcauuucc

SEQ ID NO: 468052 - RNA, 16 nt, Homo sapiens
aauugcuucugugcaa

SEQ ID NO: 468053 - RNA, 12 nt, Homo sapiens
aauugugccaaa

SEQ ID NO: 468054 - RNA, 19 nt, Homo sapiens
aauuuaugaagauaguuua

SEQ ID NO: 468055 - RNA, 15 nt, Homo sapiens
aauuucaaaaugcau

SEQ ID NO: 468056 - RNA, 13 nt, Homo sapiens
aauuuuaucucuu

SEQ ID NO: 468057 - RNA, 17 nt, Homo sapiens
aauuuuaucucuucuuc

SEQ ID NO: 468058 - RNA, 20 nt, Homo sapiens
acaaaaggcuggaugugcuu

SEQ ID NO: 468059 - RNA, 14 nt, Homo sapiens
acaaagacuacuaa

SEQ ID NO: 468060 - RNA, 17 nt, Homo sapiens
acaaauaaguaauaucu

SEQ ID NO: 468061 - RNA, 21 nt, Homo sapiens
acaaauccaacgcuuuuccca

SEQ ID NO: 468062 - RNA, 19 nt, Homo sapiens
acaaguagcacacugaguu

SEQ ID NO: 468063 - RNA, 13 nt, Homo sapiens
acaauaaagcaau

SEQ ID NO: 468064 - RNA, 13 nt, Homo sapiens
acaauaagccacu

SEQ ID NO: 468065 - RNA, 19 nt, Homo sapiens
acaauuucaaaaugcaugu

SEQ ID NO: 468066 - RNA, 13 nt, Homo sapiens
acacaaauccaac

SEQ ID NO: 468067 - RNA, 18 nt, Homo sapiens
acacaguuuugucuucgu

SEQ ID NO: 468068 - RNA, 16 nt, Homo sapiens
acacauaaaucugucu

SEQ ID NO: 468069 - RNA, 17 nt, Homo sapiens
acaccagaagugccaug

SEQ ID NO: 468070 - RNA, 22 nt, Homo sapiens
acacccccaccuccugcaauaa

SEQ ID NO: 468071 - RNA, 13 nt, Homo sapiens
acacccuucccca

SEQ ID NO: 468072 - RNA, 14 nt, Homo sapiens
acacuaguagcugu

SEQ ID NO: 468073 - RNA, 23 nt, Homo sapiens
acagacacccuccacucugaggu

SEQ ID NO: 468074 - RNA, 15 nt, Homo sapiens
acagagagugaauac

SEQ ID NO: 468075 - RNA, 14 nt, Homo sapiens
acagagaucagaau

SEQ ID NO: 468076 - RNA, 19 nt, Homo sapiens
acagagaucagaauugaac

SEQ ID NO: 468077 - RNA, 17 nt, Homo sapiens
acagaguggaucuggag

SEQ ID NO: 468078 - RNA, 19 nt, Homo sapiens
acagaucuugagcaaggca

SEQ ID NO: 468079 - RNA, 23 nt, Homo sapiens
acagauguuuguuuucaaaauac

SEQ ID NO: 468080 - RNA, 16 nt, Homo sapiens
acagcaaauguuauag

SEQ ID NO: 468081 - RNA, 14 nt, Homo sapiens
acagccguuugaau

SEQ ID NO: 468082 - RNA, 15 nt, Homo sapiens
acagccuccuaggcu

SEQ ID NO: 468083 - RNA, 17 nt, Homo sapiens
acaggauucucuucuca

SEQ ID NO: 468084 - RNA, 15 nt, Homo sapiens
acagggcauggccag

SEQ ID NO: 468085 - RNA, 20 nt, Homo sapiens
acaguagggcuuggugaaug

SEQ ID NO: 468086 - RNA, 17 nt, Homo sapiens
acagugggggugccugg

SEQ ID NO: 468087 - RNA, 19 nt, Homo sapiens
acaguguugaaauuggaaa

SEQ ID NO: 468088 - RNA, 16 nt, Homo sapiens
acaguuaagacaacag

SEQ ID NO: 468089 - RNA, 13 nt, Homo sapiens
acaugaacccauc

SEQ ID NO: 468090 - RNA, 23 nt, Homo sapiens
acaugaaugaaugaaccaugaau

SEQ ID NO: 468091 - RNA, 16 nt, Homo sapiens
acaugaguucaaauac

SEQ ID NO: 468092 - RNA, 15 nt, Homo sapiens
acaugcggcugccca

SEQ ID NO: 468093 - RNA, 15 nt, Homo sapiens
acauguccuauuacu

SEQ ID NO: 468094 - RNA, 12 nt, Homo sapiens
accaaaugcaau

SEQ ID NO: 468095 - RNA, 15 nt, Homo sapiens
accaacccucagagc

SEQ ID NO: 468096 - RNA, 12 nt, Homo sapiens
accaaugcacac

SEQ ID NO: 468097 - RNA, 16 nt, Homo sapiens
accaccccuugcccaa

SEQ ID NO: 468098 - RNA, 15 nt, Homo sapiens
accagaagugccaug

SEQ ID NO: 468099 - RNA, 14 nt, Homo sapiens
accagagacucuga

SEQ ID NO: 468100 - RNA, 12 nt, Homo sapiens
accagagauuuu

SEQ ID NO: 468101 - RNA, 21 nt, Homo sapiens
accagagauuuuccucuccaa

SEQ ID NO: 468102 - RNA, 15 nt, Homo sapiens
accagguuaccucac

SEQ ID NO: 468103 - RNA, 16 nt, Homo sapiens
accagguuaccucacu

SEQ ID NO: 468104 - RNA, 18 nt, Homo sapiens
accaucaaaaauauucca

SEQ ID NO: 468105 - RNA, 21 nt, Homo sapiens
accauccuuccauccugagga

SEQ ID NO: 468106 - RNA, 11 nt, Homo sapiens
accaugaauga

SEQ ID NO: 468107 - RNA, 14 nt, Homo sapiens
accauguugccaau

SEQ ID NO: 468108 - RNA, 14 nt, Homo sapiens
acccaagcauuugu

SEQ ID NO: 468109 - RNA, 14 nt, Homo sapiens
acccagaggucucc

SEQ ID NO: 468110 - RNA, 13 nt, Homo sapiens
acccagccucuag

SEQ ID NO: 468111 - RNA, 18 nt, Homo sapiens
acccagccucuagaacag

SEQ ID NO: 468112 - RNA, 23 nt, Homo sapiens
acccaugcccaggaaaauaacag

SEQ ID NO: 468113 - RNA, 16 nt, Homo sapiens
acccccauguccuccg

SEQ ID NO: 468114 - RNA, 18 nt, Homo sapiens
accccgauccguuugcaa

SEQ ID NO: 468115 - RNA, 19 nt, Homo sapiens
accccgucugccccuugac

SEQ ID NO: 468116 - RNA, 18 nt, Homo sapiens
acccucaaugccaagaaa

SEQ ID NO: 468117 - RNA, 17 nt, Homo sapiens
accgcaauaaugaauga

SEQ ID NO: 468118 - RNA, 16 nt, Homo sapiens
accgcaauaugggagg

SEQ ID NO: 468119 - RNA, 22 nt, Homo sapiens
accgggagccucccccucagau

SEQ ID NO: 468120 - RNA, 21 nt, Homo sapiens
accgggcuggccugugccuau

SEQ ID NO: 468121 - RNA, 19 nt, Homo sapiens
acuaucgguucaaguugau

SEQ ID NO: 468122 - RNA, 16 nt, Homo sapiens
acuauuaacucugcau

SEQ ID NO: 468123 - RNA, 14 nt, Homo sapiens
acucaccaaaauau

SEQ ID NO: 468124 - RNA, 18 nt, Homo sapiens
acucaccuugcucugcca

SEQ ID NO: 468125 - RNA, 20 nt, Homo sapiens
acucagaucaaaaaugggca

SEQ ID NO: 468126 - RNA, 23 nt, Homo sapiens
acucagcaacuguuagcugggaa

SEQ ID NO: 468127 - RNA, 14 nt, Homo sapiens
acucaggaugggaa

SEQ ID NO: 468128 - RNA, 17 nt, Homo sapiens
acucaucaaauaaucac

SEQ ID NO: 468129 - RNA, 16 nt, Homo sapiens
acucccucucuugccg

SEQ ID NO: 468130 - RNA, 18 nt, Homo sapiens
acucuacccccaacacca

SEQ ID NO: 468131 - RNA, 14 nt, Homo sapiens
acucugacaguauu

SEQ ID NO: 468132 - RNA, 18 nt, Homo sapiens
acucugacuguaaaauac

SEQ ID NO: 468133 - RNA, 15 nt, Homo sapiens
acucugagcugcuag

SEQ ID NO: 468134 - RNA, 20 nt, Homo sapiens
acucugcccauccccacccc

SEQ ID NO: 468135 - RNA, 18 nt, Homo sapiens
acugagccaaaaacaaua

SEQ ID NO: 468136 - RNA, 18 nt, Homo sapiens
acugaguuugaacacaga

SEQ ID NO: 468137 - RNA, 14 nt, Homo sapiens
acugaugugugcaa

SEQ ID NO: 468138 - RNA, 22 nt, Homo sapiens
acugauuuaugaucacuuggaa

SEQ ID NO: 468139 - RNA, 19 nt, Homo sapiens
acugcacagugcaucucag

SEQ ID NO: 468140 - RNA, 21 nt, Homo sapiens
acugcauccuguaaggucugu

SEQ ID NO: 468141 - RNA, 14 nt, Homo sapiens
acuguaucuaaaaa

SEQ ID NO: 468142 - RNA, 14 nt, Homo sapiens
acugucccacaaaa

SEQ ID NO: 468143 - RNA, 13 nt, Homo sapiens
acuuaauuaccua

SEQ ID NO: 468144 - RNA, 21 nt, Homo sapiens
acuuaauuaccuaagagccac

SEQ ID NO: 468145 - RNA, 14 nt, Homo sapiens
acuuagucaugagg

SEQ ID NO: 468146 - RNA, 13 nt, Homo sapiens
acuuaugcugcug

SEQ ID NO: 468147 - RNA, 19 nt, Homo sapiens
acuuauuucauaaacaacu

SEQ ID NO: 468148 - RNA, 22 nt, Homo sapiens
acuucuuuuuggcauuaucucu

SEQ ID NO: 468149 - RNA, 20 nt, Homo sapiens
acuugcucaauaaaggucau

SEQ ID NO: 468150 - RNA, 20 nt, Homo sapiens
acuuggauaggagcuuccag

SEQ ID NO: 468151 - RNA, 18 nt, Homo sapiens
acuuguacuuacacugaa

SEQ ID NO: 468152 - RNA, 19 nt, Homo sapiens
acuuguacuuacacugaaa

SEQ ID NO: 468153 - RNA, 20 nt, Homo sapiens
acuuguguucaaucugugaa

SEQ ID NO: 468154 - RNA, 23 nt, Homo sapiens
acuuucaauugcuucugugcaau

SEQ ID NO: 468155 - RNA, 15 nt, Homo sapiens
acuuuccacuggagu

SEQ ID NO: 468156 - RNA, 16 nt, Homo sapiens
acuuugucacuucugc

SEQ ID NO: 468157 - RNA, 17 nt, Homo sapiens
acuuuuaaacugcaguu

SEQ ID NO: 468158 - RNA, 21 nt, Homo sapiens
agaaaaccaguggaagauuuc

SEQ ID NO: 468159 - RNA, 15 nt, Homo sapiens
agaaaaucacacuua

SEQ ID NO: 468160 - RNA, 17 nt, Homo sapiens
agaaacacggcugauau

SEQ ID NO: 468161 - RNA, 22 nt, Homo sapiens
agaaauugcauuuccugacaga

SEQ ID NO: 468162 - RNA, 13 nt, Homo sapiens
agaagaaacugcu

SEQ ID NO: 468163 - RNA, 21 nt, Homo sapiens
agaagagucuuugauucacca

SEQ ID NO: 468164 - RNA, 22 nt, Homo sapiens
agaaggcagcaggcggccuuug

SEQ ID NO: 468165 - RNA, 16 nt, Homo sapiens
agaagucaguugcaaa

SEQ ID NO: 468166 - RNA, 22 nt, Homo sapiens
agaauaaagccucugugcugca

SEQ ID NO: 468167 - RNA, 20 nt, Homo sapiens
agaaucacuugacuuugcca

SEQ ID NO: 468168 - RNA, 13 nt, Homo sapiens
agacaaauugauc

SEQ ID NO: 468169 - RNA, 15 nt, Homo sapiens
agacaaccacuggga

SEQ ID NO: 468170 - RNA, 13 nt, Homo sapiens
agacaaguguuua

SEQ ID NO: 468171 - RNA, 14 nt, Homo sapiens
agacaaguguuuau

SEQ ID NO: 468172 - RNA, 13 nt, Homo sapiens
agacacaguauug

SEQ ID NO: 468173 - RNA, 21 nt, Homo sapiens
agacacaguauugacuucuuu

SEQ ID NO: 468174 - RNA, 17 nt, Homo sapiens
agaccaguucuuggccu

SEQ ID NO: 468175 - RNA, 21 nt, Homo sapiens
agaccccuacccuuucccaaa

SEQ ID NO: 468176 - RNA, 14 nt, Homo sapiens
agacgccuccccaa

SEQ ID NO: 468177 - RNA, 19 nt, Homo sapiens
agacuacuaaugacuuugu

SEQ ID NO: 468178 - RNA, 14 nt, Homo sapiens
agacuaucaaagac

SEQ ID NO: 468179 - RNA, 16 nt, Homo sapiens
agagaucagaauugaa

SEQ ID NO: 468180 - RNA, 16 nt, Homo sapiens
agagauuuuccucucc

SEQ ID NO: 468181 - RNA, 18 nt, Homo sapiens
agagcacuagaagcacag

SEQ ID NO: 468182 - RNA, 19 nt, Homo sapiens
agagcacuagaagcacagg

SEQ ID NO: 468183 - RNA, 20 nt, Homo sapiens
agagcagcacuaaaugacac

SEQ ID NO: 468184 - RNA, 21 nt, Homo sapiens
agagcauucugggguggggcu

SEQ ID NO: 468185 - RNA, 13 nt, Homo sapiens
agagcuggaugcu

SEQ ID NO: 468186 - RNA, 17 nt, Homo sapiens
agaggacaguuuaggac

SEQ ID NO: 468187 - RNA, 16 nt, Homo sapiens
agaggcaaccuguuga

SEQ ID NO: 468188 - RNA, 16 nt, Homo sapiens
agaggccgcucugggg

SEQ ID NO: 468189 - RNA, 14 nt, Homo sapiens
agagggacuuugcc

SEQ ID NO: 468190 - RNA, 18 nt, Homo sapiens
agagucccggagcucaag

SEQ ID NO: 468191 - RNA, 17 nt, Homo sapiens
agagugaauacacugga

SEQ ID NO: 468192 - RNA, 21 nt, Homo sapiens
agagugucuuaaaauguuuca

SEQ ID NO: 468193 - RNA, 21 nt, Homo sapiens
agaguucuccuuguacuugaa

SEQ ID NO: 468194 - RNA, 16 nt, Homo sapiens
agcccucuuucucucu

SEQ ID NO: 468195 - RNA, 13 nt, Homo sapiens
agcccuugcccag

SEQ ID NO: 468196 - RNA, 15 nt, Homo sapiens
agccucugugcugca

SEQ ID NO: 468197 - RNA, 20 nt, Homo sapiens
agccugaggaaguuuugcau

SEQ ID NO: 468198 - RNA, 14 nt, Homo sapiens
agccugcucccuag

SEQ ID NO: 468199 - RNA, 17 nt, Homo sapiens
agccugcucccuagcca

SEQ ID NO: 468200 - RNA, 18 nt, Homo sapiens
agccugcucccuagccag

SEQ ID NO: 468201 - RNA, 20 nt, Homo sapiens
agccugcucccuagccagag

SEQ ID NO: 468202 - RNA, 19 nt, Homo sapiens
agccuuaagucuuacuguu

SEQ ID NO: 468203 - RNA, 19 nt, Homo sapiens
agccuuuaucuaugggaga

SEQ ID NO: 468204 - RNA, 19 nt, Homo sapiens
agcuaccaacuaaguugua

SEQ ID NO: 468205 - RNA, 20 nt, Homo sapiens
agcucacauagauaugacuu

SEQ ID NO: 468206 - RNA, 23 nt, Homo sapiens
agcuccccccaagaugagcugca

SEQ ID NO: 468207 - RNA, 21 nt, Homo sapiens
agcugaaugugauacaugccg

SEQ ID NO: 468208 - RNA, 14 nt, Homo sapiens
agcugaucuaagga

SEQ ID NO: 468209 - RNA, 21 nt, Homo sapiens
agcuggggauguuuaguaaua

SEQ ID NO: 468210 - RNA, 10 nt, Homo sapiens
agcugugaaa

SEQ ID NO: 468211 - RNA, 13 nt, Homo sapiens
agcuucaaaacag

SEQ ID NO: 468212 - RNA, 14 nt, Homo sapiens
agcuuggagggaug

SEQ ID NO: 468213 - RNA, 13 nt, Homo sapiens
aggaaagauccca

SEQ ID NO: 468214 - RNA, 14 nt, Homo sapiens
aggaaagcccuccc

SEQ ID NO: 468215 - RNA, 13 nt, Homo sapiens
aggaacaaagaca

SEQ ID NO: 468216 - RNA, 23 nt, Homo sapiens
aggaacaaagacaaccacuggga

SEQ ID NO: 468217 - RNA, 12 nt, Homo sapiens
aggaacuuuuaa

SEQ ID NO: 468218 - RNA, 17 nt, Homo sapiens
aggacuucugcagcuau

SEQ ID NO: 468219 - RNA, 18 nt, Homo sapiens
aggaguucuccuggagca

SEQ ID NO: 468220 - RNA, 20 nt, Homo sapiens
aggaucuucccacuuugcca

SEQ ID NO: 468221 - RNA, 19 nt, Homo sapiens
aggaugggugaaaccacau

SEQ ID NO: 468222 - RNA, 15 nt, Homo sapiens
aggauugaaagggag

SEQ ID NO: 468223 - RNA, 18 nt, Homo sapiens
aggccaccaagcugcucu

SEQ ID NO: 468224 - RNA, 13 nt, Homo sapiens
aggcccacucugu

SEQ ID NO: 468225 - RNA, 23 nt, Homo sapiens
aggcccacucuguuccuacugga

SEQ ID NO: 468226 - RNA, 23 nt, Homo sapiens
aggcccuuccucuccacugccuu

SEQ ID NO: 468227 - RNA, 21 nt, Homo sapiens
aggcgccccuucccccuccaa

SEQ ID NO: 468228 - RNA, 23 nt, Homo sapiens
aggcguauguggcaaaauguuac

SEQ ID NO: 468229 - RNA, 23 nt, Homo sapiens
aggcuugaucaugaaucacugca

SEQ ID NO: 468230 - RNA, 20 nt, Homo sapiens
agggaauccauaucagcucu

SEQ ID NO: 468231 - RNA, 17 nt, Homo sapiens
agggacagcagauucca

SEQ ID NO: 468232 - RNA, 12 nt, Homo sapiens
aggggccuggaa

SEQ ID NO: 468233 - RNA, 20 nt, Homo sapiens
aggggcugucucccaaugaa

SEQ ID NO: 468234 - RNA, 18 nt, Homo sapiens
agggggcaugaagcacau

SEQ ID NO: 468235 - RNA, 19 nt, Homo sapiens
agggugaggcccacucugu

SEQ ID NO: 468236 - RNA, 19 nt, Homo sapiens
aggguguuggaagaugcau

SEQ ID NO: 468237 - RNA, 19 nt, Homo sapiens
aggguuaaagaaaggcaga

SEQ ID NO: 468238 - RNA, 14 nt, Homo sapiens
agguucugugcaaa

SEQ ID NO: 468239 - RNA, 15 nt, Homo sapiens
agguucugugcaaaa

SEQ ID NO: 468240 - RNA, 21 nt, Homo sapiens
agguugucugaagucacugca

SEQ ID NO: 468241 - RNA, 22 nt, Homo sapiens
agguugugaugauagcacuggu

SEQ ID NO: 468242 - RNA, 12 nt, Homo sapiens
agguuucaccuc

SEQ ID NO: 468243 - RNA, 13 nt, Homo sapiens
agguuucaccucc

SEQ ID NO: 468244 - RNA, 21 nt, Homo sapiens
agguuucaccucccaaaccca

SEQ ID NO: 468245 - RNA, 23 nt, Homo sapiens
agguuucaccucccaaacccagc

SEQ ID NO: 468246 - RNA, 16 nt, Homo sapiens
aguaagagagcacagu

SEQ ID NO: 468247 - RNA, 21 nt, Homo sapiens
aguaauaucuuucaguuauua

SEQ ID NO: 468248 - RNA, 15 nt, Homo sapiens
aguaccaacugagcc

SEQ ID NO: 468249 - RNA, 20 nt, Homo sapiens
aguauauagccuuaagucuu

SEQ ID NO: 468250 - RNA, 19 nt, Homo sapiens
agucaaacuuucaccucag

SEQ ID NO: 468251 - RNA, 14 nt, Homo sapiens
agucaucaucucau

SEQ ID NO: 468252 - RNA, 21 nt, Homo sapiens
aguccaaaauaucgagugaau

SEQ ID NO: 468253 - RNA, 15 nt, Homo sapiens
aguccauugcaaaag

SEQ ID NO: 468254 - RNA, 13 nt, Homo sapiens
agucccucagcca

SEQ ID NO: 468255 - RNA, 22 nt, Homo sapiens
agucccuucucucuuccuugcu

SEQ ID NO: 468256 - RNA, 21 nt, Homo sapiens
agucugaggccccuuaacuca

SEQ ID NO: 468257 - RNA, 20 nt, Homo sapiens
agucuguacuucaguucuca

SEQ ID NO: 468258 - RNA, 10 nt, Homo sapiens
agucuucuca

SEQ ID NO: 468259 - RNA, 19 nt, Homo sapiens
agucuucugccucuuaacu

SEQ ID NO: 468260 - RNA, 17 nt, Homo sapiens
agucuuuguuuacauga

SEQ ID NO: 468261 - RNA, 13 nt, Homo sapiens
agugccugugauc

SEQ ID NO: 468262 - RNA, 12 nt, Homo sapiens
aguggcaaaaaa

SEQ ID NO: 468263 - RNA, 14 nt, Homo sapiens
aguggccugagaag

SEQ ID NO: 468264 - RNA, 14 nt, Homo sapiens
agugugugugcaau

SEQ ID NO: 468265 - RNA, 15 nt, Homo sapiens
aguguugaaauugga

SEQ ID NO: 468266 - RNA, 15 nt, Homo sapiens
aguuaaugugccaaa

SEQ ID NO: 468267 - RNA, 22 nt, Homo sapiens
aguuagaaaggguucagggcau

SEQ ID NO: 468268 - RNA, 17 nt, Homo sapiens
cuuuaucccuaacuucu

SEQ ID NO: 468269 - RNA, 19 nt, Homo sapiens
cuuuaugaaguuaacaguc

SEQ ID NO: 468270 - RNA, 18 nt, Homo sapiens
cuuucauccaacuggaag

SEQ ID NO: 468271 - RNA, 14 nt, Homo sapiens
cuuuccaauccuuu

SEQ ID NO: 468272 - RNA, 15 nt, Homo sapiens
cuuuccucccaaagg

SEQ ID NO: 468273 - RNA, 16 nt, Homo sapiens
cuuugauucaccaaac

SEQ ID NO: 468274 - RNA, 19 nt, Homo sapiens
cuuuggaugggucacuugu

SEQ ID NO: 468275 - RNA, 21 nt, Homo sapiens
cuuuggcuuuuuccaucucaa

SEQ ID NO: 468276 - RNA, 21 nt, Homo sapiens
cuuugggggauucaaaugcau

SEQ ID NO: 468277 - RNA, 23 nt, Homo sapiens
cuuugggggauucaaaugcauga

SEQ ID NO: 468278 - RNA, 14 nt, Homo sapiens
cuuuguacugauga

SEQ ID NO: 468279 - RNA, 15 nt, Homo sapiens
cuuugucacagggug

SEQ ID NO: 468280 - RNA, 19 nt, Homo sapiens
cuuuguuuacaugaguuca

SEQ ID NO: 468281 - RNA, 18 nt, Homo sapiens
cuuuuaaacugcaguuuu

SEQ ID NO: 468282 - RNA, 17 nt, Homo sapiens
cuuuuaaugucaucucu

SEQ ID NO: 468283 - RNA, 21 nt, Homo sapiens
cuuuuaucucacaaauaagua

SEQ ID NO: 468284 - RNA, 13 nt, Homo sapiens
cuuuuuucucuga

SEQ ID NO: 468285 - RNA, 16 nt, Homo sapiens
gaaaaugcuuucucau

SEQ ID NO: 468286 - RNA, 16 nt, Homo sapiens
gaaacaaggaaggaca

SEQ ID NO: 468287 - RNA, 19 nt, Homo sapiens
gaaacauuuggaagcccca

SEQ ID NO: 468288 - RNA, 12 nt, Homo sapiens
gaaagcuauaua

SEQ ID NO: 468289 - RNA, 17 nt, Homo sapiens
gaaauaaagaguucucc

SEQ ID NO: 468290 - RNA, 13 nt, Homo sapiens
gaaauaagccccc

SEQ ID NO: 468291 - RNA, 12 nt, Homo sapiens
gaaauaguucca

SEQ ID NO: 468292 - RNA, 19 nt, Homo sapiens
gaaaucaauuuaaaggaaa

SEQ ID NO: 468293 - RNA, 15 nt, Homo sapiens
gaaauguauccugau

SEQ ID NO: 468294 - RNA, 17 nt, Homo sapiens
gaacaaagacuacuaau

SEQ ID NO: 468295 - RNA, 17 nt, Homo sapiens
gaacaaauaugauucuc

SEQ ID NO: 468296 - RNA, 11 nt, Homo sapiens
gaacagccaga

SEQ ID NO: 468297 - RNA, 15 nt, Homo sapiens
gaaccgucaauguga

SEQ ID NO: 468298 - RNA, 18 nt, Homo sapiens
gaaccuuugucaacuuca

SEQ ID NO: 468299 - RNA, 13 nt, Homo sapiens
gaagaaaaaggau

SEQ ID NO: 468300 - RNA, 16 nt, Homo sapiens
gaagaacuugucccuc

SEQ ID NO: 468301 - RNA, 22 nt, Homo sapiens
gaagacaaauaguguggaguga

SEQ ID NO: 468302 - RNA, 18 nt, Homo sapiens
gaagggccccacucaggg

SEQ ID NO: 468303 - RNA, 20 nt, Homo sapiens
gaauaauuauguuuaccuca

SEQ ID NO: 468304 - RNA, 12 nt, Homo sapiens
gaauacaguaag

SEQ ID NO: 468305 - RNA, 14 nt, Homo sapiens
gaauauacauaguc

SEQ ID NO: 468306 - RNA, 12 nt, Homo sapiens
gaauccauauca

SEQ ID NO: 468307 - RNA, 13 nt, Homo sapiens
gaaucuaacuggu

SEQ ID NO: 468308 - RNA, 20 nt, Homo sapiens
gaauugaaccgucaauguga

SEQ ID NO: 468309 - RNA, 20 nt, Homo sapiens
gacaaauaaguuacccucaa

SEQ ID NO: 468310 - RNA, 17 nt, Homo sapiens
gacaauuucaaaaugca

SEQ ID NO: 468311 - RNA, 21 nt, Homo sapiens
gacaccgacucugagcugcua

SEQ ID NO: 468312 - RNA, 17 nt, Homo sapiens
gacagacacugcugaac

SEQ ID NO: 468313 - RNA, 14 nt, Homo sapiens
gacagcagauucca

SEQ ID NO: 468314 - RNA, 18 nt, Homo sapiens
gacaguggucuaauucaa

SEQ ID NO: 468315 - RNA, 20 nt, Homo sapiens
gacccggaggggccuggcag

SEQ ID NO: 468316 - RNA, 12 nt, Homo sapiens
gaccgcaauaau

SEQ ID NO: 468317 - RNA, 19 nt, Homo sapiens
gacucaccuugcucugcca

SEQ ID NO: 468318 - RNA, 14 nt, Homo sapiens
gacuggccacugaa

SEQ ID NO: 468319 - RNA, 13 nt, Homo sapiens
gacuucagacucu

SEQ ID NO: 468320 - RNA, 21 nt, Homo sapiens
gacuucagacucucuccucuc

SEQ ID NO: 468321 - RNA, 21 nt, Homo sapiens
gagaaaacaggcucacagaga

SEQ ID NO: 468322 - RNA, 18 nt, Homo sapiens
gagaaaauuugaaugugg

SEQ ID NO: 468323 - RNA, 16 nt, Homo sapiens
gagaaauaaagcacau

SEQ ID NO: 468324 - RNA, 20 nt, Homo sapiens
gagaaauaaagcacauuuga

SEQ ID NO: 468325 - RNA, 19 nt, Homo sapiens
gagaaauacaucauuugca

SEQ ID NO: 468326 - RNA, 23 nt, Homo sapiens
gagaaccucguugacaugcacag

SEQ ID NO: 468327 - RNA, 15 nt, Homo sapiens
gagaccucagggaug

SEQ ID NO: 468328 - RNA, 21 nt, Homo sapiens
gagacugucucaagagggcac

SEQ ID NO: 468329 - RNA, 23 nt, Homo sapiens
gagagguucugugcaaaacuacc

SEQ ID NO: 468330 - RNA, 17 nt, Homo sapiens
gagaucuuaagauucca

SEQ ID NO: 468331 - RNA, 17 nt, Homo sapiens
gagcacuagaagcacag

SEQ ID NO: 468332 - RNA, 23 nt, Homo sapiens
gagcccaauguauuaugaucucu

SEQ ID NO: 468333 - RNA, 17 nt, Homo sapiens
gagccuuaccaauaaua

SEQ ID NO: 468334 - RNA, 23 nt, Homo sapiens
gaggagcaagguuuaaauuuguu

SEQ ID NO: 468335 - RNA, 20 nt, Homo sapiens
gaggcaaccuguugaauuua

SEQ ID NO: 468336 - RNA, 15 nt, Homo sapiens
gaggcagaauggugg

SEQ ID NO: 468337 - RNA, 19 nt, Homo sapiens
gaggcgugggauccagaga

SEQ ID NO: 468338 - RNA, 12 nt, Homo sapiens
gaggcuauuaaa

SEQ ID NO: 468339 - RNA, 20 nt, Homo sapiens
gaggcugggccccugggaug

SEQ ID NO: 468340 - RNA, 14 nt, Homo sapiens
gagggaagcagugu

SEQ ID NO: 468341 - RNA, 18 nt, Homo sapiens
gagggaagcccacccgcc

SEQ ID NO: 468342 - RNA, 20 nt, Homo sapiens
gagggcagcuggagaucuua

SEQ ID NO: 468343 - RNA, 17 nt, Homo sapiens
gaggggacugcaugcaa

SEQ ID NO: 468344 - RNA, 19 nt, Homo sapiens
gcaagaagugggauucagg

SEQ ID NO: 468345 - RNA, 18 nt, Homo sapiens
gcaauaaggaucuuccca

SEQ ID NO: 468346 - RNA, 22 nt, Homo sapiens
gcacaauauuccuaugcugcaa

SEQ ID NO: 468347 - RNA, 18 nt, Homo sapiens
gcaccaagaccccaaagg

SEQ ID NO: 468348 - RNA, 17 nt, Homo sapiens
gcaccagccugagccac

SEQ ID NO: 468349 - RNA, 22 nt, Homo sapiens
gcacccucugcuaugucuguga

SEQ ID NO: 468350 - RNA, 19 nt, Homo sapiens
gcaccuugggcacgggaga

SEQ ID NO: 468351 - RNA, 14 nt, Homo sapiens
gcagccugagcucc

SEQ ID NO: 468352 - RNA, 14 nt, Homo sapiens
gcaguacuugcuca

SEQ ID NO: 468353 - RNA, 21 nt, Homo sapiens
gcaguggagaggggacuugga

SEQ ID NO: 468354 - RNA, 21 nt, Homo sapiens
gcaguuugcuuuguaugcacu

SEQ ID NO: 468355 - RNA, 17 nt, Homo sapiens
gcauaacacacuacugg

SEQ ID NO: 468356 - RNA, 14 nt, Homo sapiens
gcauagacaagugu

SEQ ID NO: 468357 - RNA, 19 nt, Homo sapiens
gcauccaaggggccuggaa

SEQ ID NO: 468358 - RNA, 13 nt, Homo sapiens
gcaugcaagcuca

SEQ ID NO: 468359 - RNA, 22 nt, Homo sapiens
gccaccaagcugcucuccuuca

SEQ ID NO: 468360 - RNA, 16 nt, Homo sapiens
gccacuagguuucacc

SEQ ID NO: 468361 - RNA, 20 nt, Homo sapiens
gccacuccagaccccuggcu

SEQ ID NO: 468362 - RNA, 18 nt, Homo sapiens
gccagaggcucuaaugua

SEQ ID NO: 468363 - RNA, 20 nt, Homo sapiens
gccagaggcucuaauguaca

SEQ ID NO: 468364 - RNA, 23 nt, Homo sapiens
gccagaggcucuaauguacaaua

SEQ ID NO: 468365 - RNA, 19 nt, Homo sapiens
gccauaugacaauuucaaa

SEQ ID NO: 468366 - RNA, 14 nt, Homo sapiens
gcccaagaauagau

SEQ ID NO: 468367 - RNA, 17 nt, Homo sapiens
gcccaccacaacuaaca

SEQ ID NO: 468368 - RNA, 14 nt, Homo sapiens
gccccacucaggga

SEQ ID NO: 468369 - RNA, 22 nt, Homo sapiens
gccccuccccauggugcaguga

SEQ ID NO: 468370 - RNA, 14 nt, Homo sapiens
gccccuccucgggc

SEQ ID NO: 468371 - RNA, 18 nt, Homo sapiens
gccucccacccuucucag

SEQ ID NO: 468372 - RNA, 21 nt, Homo sapiens
gccucccacccuucucaggga

SEQ ID NO: 468373 - RNA, 20 nt, Homo sapiens
gccucccccucagaugaucu

SEQ ID NO: 468374 - RNA, 19 nt, Homo sapiens
gccucccgccgccucgggc

SEQ ID NO: 468375 - RNA, 17 nt, Homo sapiens
gccucuagaacagccag

SEQ ID NO: 468376 - RNA, 14 nt, Homo sapiens
gccucuaugugcaa

SEQ ID NO: 468377 - RNA, 15 nt, Homo sapiens
gccucuaugugcaac

SEQ ID NO: 468378 - RNA, 18 nt, Homo sapiens
gccucugcccucauccuc

SEQ ID NO: 468379 - RNA, 22 nt, Homo sapiens
gccugguuuuuaaguacucacu

SEQ ID NO: 468380 - RNA, 15 nt, Homo sapiens
gccugugccuaucac

SEQ ID NO: 468381 - RNA, 12 nt, Homo sapiens
gccuuaacaaac

SEQ ID NO: 468382 - RNA, 21 nt, Homo sapiens
gccuuguugaugaagcacauu

SEQ ID NO: 468383 - RNA, 14 nt, Homo sapiens
gccuuuguugcuca

SEQ ID NO: 468384 - RNA, 17 nt, Homo sapiens
gcgauggacaauuauga

SEQ ID NO: 468385 - RNA, 23 nt, Homo sapiens
gcgcacuuuccacuggaguucac

SEQ ID NO: 468386 - RNA, 15 nt, Homo sapiens
gcuaauguacuacgu

SEQ ID NO: 468387 - RNA, 16 nt, Homo sapiens
gcuaugucugugaugu

SEQ ID NO: 468388 - RNA, 13 nt, Homo sapiens
gcucacucuucca

SEQ ID NO: 468389 - RNA, 20 nt, Homo sapiens
gcuccuaguagcuuuccucc

SEQ ID NO: 468390 - RNA, 12 nt, Homo sapiens
gcucgggacugu

SEQ ID NO: 468391 - RNA, 15 nt, Homo sapiens
gcucuccuucacucu

SEQ ID NO: 468392 - RNA, 23 nt, Homo sapiens
gcucuguugcuguccuccagggc

SEQ ID NO: 468393 - RNA, 17 nt, Homo sapiens
gcucuuccucaucucau

SEQ ID NO: 468394 - RNA, 22 nt, Homo sapiens
gcuggagcuccuacauggugca

SEQ ID NO: 468395 - RNA, 21 nt, Homo sapiens
gcuggguuugggcaguggaga

SEQ ID NO: 468396 - RNA, 23 nt, Homo sapiens
gcuguccuccagggcgagcacuu

SEQ ID NO: 468397 - RNA, 15 nt, Homo sapiens
gcuuagaauggggcu

SEQ ID NO: 468398 - RNA, 19 nt, Homo sapiens
gcuuauaccagguuaccuc

SEQ ID NO: 468399 - RNA, 23 nt, Homo sapiens
gcuucaaaacagaacggguucuc

SEQ ID NO: 468400 - RNA, 20 nt, Homo sapiens
gcuuguuuaagguucuugcu

SEQ ID NO: 468401 - RNA, 17 nt, Homo sapiens
gcuuguuucuauacugu

SEQ ID NO: 468402 - RNA, 23 nt, Homo sapiens
gcuuugugcuuguucuuccucuu

SEQ ID NO: 468403 - RNA, 20 nt, Homo sapiens
gcuuuucuaaucugcagugg

SEQ ID NO: 468404 - RNA, 20 nt, Homo sapiens
ggaaaacaaauauuucacuu

SEQ ID NO: 468405 - RNA, 20 nt, Homo sapiens
ggaaacaaggaaggacauuu

SEQ ID NO: 468406 - RNA, 22 nt, Homo sapiens
ggaaagaaaaaaggaaguggaa

SEQ ID NO: 468407 - RNA, 18 nt, Homo sapiens
ggaagaacuugucccuca

SEQ ID NO: 468408 - RNA, 23 nt, Homo sapiens
ggacucagguugucugaagucac

SEQ ID NO: 468409 - RNA, 13 nt, Homo sapiens
ggacuuguaggga

SEQ ID NO: 468410 - RNA, 12 nt, Homo sapiens
ggacuuugccug

SEQ ID NO: 468411 - RNA, 14 nt, Homo sapiens
ggagaacuagagaa

SEQ ID NO: 468412 - RNA, 22 nt, Homo sapiens
ggagaggcggccucgugccaug

SEQ ID NO: 468413 - RNA, 14 nt, Homo sapiens
ggagccaugcucuu

SEQ ID NO: 468414 - RNA, 15 nt, Homo sapiens
ggagcugcuguggug

SEQ ID NO: 468415 - RNA, 22 nt, Homo sapiens
ggagucuucugccucuuaacuu

SEQ ID NO: 468416 - RNA, 20 nt, Homo sapiens
ggaucuucccacuuugccac

SEQ ID NO: 468417 - RNA, 18 nt, Homo sapiens
ggauguugcuuuugcacc

SEQ ID NO: 468418 - RNA, 20 nt, Homo sapiens
acuugggacggaaguggccu

SEQ ID NO: 468419 - RNA, 17 nt, Homo sapiens
acuuguagggaugccuu

SEQ ID NO: 468420 - RNA, 9 nt, Homo sapiens
acuuuccac

SEQ ID NO: 468421 - RNA, 20 nt, Homo sapiens
acuuugucacuucugcugua

SEQ ID NO: 468422 - RNA, 14 nt, Homo sapiens
acuuugugcaauau

SEQ ID NO: 468423 - RNA, 17 nt, Homo sapiens
acuuuuaauuagugaug

SEQ ID NO: 468424 - RNA, 16 nt, Homo sapiens
agaaaaaggaugcauu

SEQ ID NO: 468425 - RNA, 16 nt, Homo sapiens
agaaaggaacuuuuaa

SEQ ID NO: 468426 - RNA, 16 nt, Homo sapiens
agaaauacauuaugcu

SEQ ID NO: 468427 - RNA, 13 nt, Homo sapiens
agaaauccuagug

SEQ ID NO: 468428 - RNA, 23 nt, Homo sapiens
agaaauggcuuuccacaucccca

SEQ ID NO: 468429 - RNA, 16 nt, Homo sapiens
agaaauuuuaucucuu

SEQ ID NO: 468430 - RNA, 21 nt, Homo sapiens
agaaauuuuaucucuucuucc

SEQ ID NO: 468431 - RNA, 13 nt, Homo sapiens
agaacagccagac

SEQ ID NO: 468432 - RNA, 14 nt, Homo sapiens
agaacagccagacc

SEQ ID NO: 468433 - RNA, 17 nt, Homo sapiens
agaacuguucauuucca

SEQ ID NO: 468434 - RNA, 15 nt, Homo sapiens
agaacuugucccuca

SEQ ID NO: 468435 - RNA, 16 nt, Homo sapiens
agaacuugucccucag

SEQ ID NO: 468436 - RNA, 14 nt, Homo sapiens
agaagaaacugcuu

SEQ ID NO: 468437 - RNA, 11 nt, Homo sapiens
agaagugccau

SEQ ID NO: 468438 - RNA, 13 nt, Homo sapiens
agaauaaagccuc

SEQ ID NO: 468439 - RNA, 23 nt, Homo sapiens
agaauaaagccucugugcugcac

SEQ ID NO: 468440 - RNA, 18 nt, Homo sapiens
agacaaguguuuauuaaa

SEQ ID NO: 468441 - RNA, 15 nt, Homo sapiens
agacaggguggggcu

SEQ ID NO: 468442 - RNA, 17 nt, Homo sapiens
agacagugggggugccu

SEQ ID NO: 468443 - RNA, 14 nt, Homo sapiens
agacccaccauccu

SEQ ID NO: 468444 - RNA, 20 nt, Homo sapiens
agaccccuacccuuucccaa

SEQ ID NO: 468445 - RNA, 15 nt, Homo sapiens
agacccucaaugcca

SEQ ID NO: 468446 - RNA, 13 nt, Homo sapiens
agacugaauuuaa

SEQ ID NO: 468447 - RNA, 13 nt, Homo sapiens
agagaguggcucc

SEQ ID NO: 468448 - RNA, 15 nt, Homo sapiens
agagcuuuaucccua

SEQ ID NO: 468449 - RNA, 21 nt, Homo sapiens
agaggagugggaaauugauua

SEQ ID NO: 468450 - RNA, 18 nt, Homo sapiens
agaggcucuaauguacaa

SEQ ID NO: 468451 - RNA, 20 nt, Homo sapiens
agaggcucuaauguacaaua

SEQ ID NO: 468452 - RNA, 20 nt, Homo sapiens
agagguggaacuuaauuacc

SEQ ID NO: 468453 - RNA, 12 nt, Homo sapiens
agagucaucuca

SEQ ID NO: 468454 - RNA, 23 nt, Homo sapiens
agagucuuugauucaccaaacau

SEQ ID NO: 468455 - RNA, 16 nt, Homo sapiens
agauaaaaucuucaac

SEQ ID NO: 468456 - RNA, 19 nt, Homo sapiens
agauaccagagacucugaa

SEQ ID NO: 468457 - RNA, 17 nt, Homo sapiens
agaucaguagugcuauc

SEQ ID NO: 468458 - RNA, 14 nt, Homo sapiens
agaucuuaagauuc

SEQ ID NO: 468459 - RNA, 17 nt, Homo sapiens
agaucuuaagauuccau

SEQ ID NO: 468460 - RNA, 19 nt, Homo sapiens
agaugacuggaaacaagga

SEQ ID NO: 468461 - RNA, 13 nt, Homo sapiens
agaugaucucucc

SEQ ID NO: 468462 - RNA, 15 nt, Homo sapiens
agauguauuaugcaa

SEQ ID NO: 468463 - RNA, 17 nt, Homo sapiens
agauuccauuuuggaaa

SEQ ID NO: 468464 - RNA, 18 nt, Homo sapiens
uauuauagucuguacuuc

SEQ ID NO: 468465 - RNA, 18 nt, Homo sapiens
uauugccucuaugugcaa

SEQ ID NO: 468466 - RNA, 20 nt, Homo sapiens
uauugccucuaugugcaacu

SEQ ID NO: 468467 - RNA, 11 nt, Homo sapiens
uauuucacuua

SEQ ID NO: 468468 - RNA, 19 nt, Homo sapiens
uauuucagucaucaucuca

SEQ ID NO: 468469 - RNA, 15 nt, Homo sapiens
uauuuccaacaaacu

SEQ ID NO: 468470 - RNA, 20 nt, Homo sapiens
uauuucuaagcuuauuucua

SEQ ID NO: 468471 - RNA, 18 nt, Homo sapiens
uauuuugaaaaaccaucu

SEQ ID NO: 468472 - RNA, 13 nt, Homo sapiens
ucaaaaguauugu

SEQ ID NO: 468473 - RNA, 21 nt, Homo sapiens
ucaaauaaucacaaaaucaca

SEQ ID NO: 468474 - RNA, 14 nt, Homo sapiens
ucaaaugcauuuug

SEQ ID NO: 468475 - RNA, 16 nt, Homo sapiens
ucaacauuucaguguu

SEQ ID NO: 468476 - RNA, 22 nt, Homo sapiens
ucaaccugguggcaccagaugc

SEQ ID NO: 468477 - RNA, 12 nt, Homo sapiens
ucaagccaggag

SEQ ID NO: 468478 - RNA, 22 nt, Homo sapiens
ucaaguagcguuggagacauac

SEQ ID NO: 468479 - RNA, 22 nt, Homo sapiens
ucaauuuaaaaucagacucuuu

SEQ ID NO: 468480 - RNA, 20 nt, Homo sapiens
ucacaaaaucacaauucucu

SEQ ID NO: 468481 - RNA, 20 nt, Homo sapiens
ucacagcaguacuugcucaa

SEQ ID NO: 468482 - RNA, 18 nt, Homo sapiens
ucaccagcuaucugucau

SEQ ID NO: 468483 - RNA, 22 nt, Homo sapiens
ucaccucccaaacccagccucu

SEQ ID NO: 468484 - RNA, 21 nt, Homo sapiens
ucaccucuuaugcacaccucc

SEQ ID NO: 468485 - RNA, 14 nt, Homo sapiens
ucacucacaaaagg

SEQ ID NO: 468486 - RNA, 17 nt, Homo sapiens
ucacucugacaguauua

SEQ ID NO: 468487 - RNA, 18 nt, Homo sapiens
ucacugcuggcugccuua

SEQ ID NO: 468488 - RNA, 21 nt, Homo sapiens
ucacuuaaacuuugucacuuc

SEQ ID NO: 468489 - RNA, 21 nt, Homo sapiens
ucacuuuuaauuagugaugca

SEQ ID NO: 468490 - RNA, 19 nt, Homo sapiens
ucagaauuucuuugucauu

SEQ ID NO: 468491 - RNA, 20 nt, Homo sapiens
ucagagagcuaaauuacaau

SEQ ID NO: 468492 - RNA, 15 nt, Homo sapiens
ucagagccaccccua

SEQ ID NO: 468493 - RNA, 12 nt, Homo sapiens
ucagauucaccu

SEQ ID NO: 468494 - RNA, 21 nt, Homo sapiens
ucagcaacccuacaguauaua

SEQ ID NO: 468495 - RNA, 18 nt, Homo sapiens
ucagcaaggggcucugcc

SEQ ID NO: 468496 - RNA, 21 nt, Homo sapiens
ucagcauucaaaauaguucua

SEQ ID NO: 468497 - RNA, 21 nt, Homo sapiens
ucagugaagcccaggaggacc

SEQ ID NO: 468498 - RNA, 12 nt, Homo sapiens
ucaguugcaaau

SEQ ID NO: 468499 - RNA, 20 nt, Homo sapiens
ucauaaaaauaaccaaaaaa

SEQ ID NO: 468500 - RNA, 22 nt, Homo sapiens
ucaucacuuaauuacuuacuca

SEQ ID NO: 468501 - RNA, 18 nt, Homo sapiens
ucauccauagacacagua

SEQ ID NO: 468502 - RNA, 22 nt, Homo sapiens
ucaucuuguaaauaaugcuuaa

SEQ ID NO: 468503 - RNA, 22 nt, Homo sapiens
ucauuacagauuuaguuuacca

SEQ ID NO: 468504 - RNA, 18 nt, Homo sapiens
uccaaaauaucgagugaa

SEQ ID NO: 468505 - RNA, 14 nt, Homo sapiens
uccaaauaagugca

SEQ ID NO: 468506 - RNA, 17 nt, Homo sapiens
uccaagugugugugcaa

SEQ ID NO: 468507 - RNA, 21 nt, Homo sapiens
uccagaguaggugggucuugg

SEQ ID NO: 468508 - RNA, 14 nt, Homo sapiens
uccaguuugcccac

SEQ ID NO: 468509 - RNA, 17 nt, Homo sapiens
uccauagacacaguauu

SEQ ID NO: 468510 - RNA, 18 nt, Homo sapiens
uccauagacacaguauug

SEQ ID NO: 468511 - RNA, 13 nt, Homo sapiens
uccauaucagcuc

SEQ ID NO: 468512 - RNA, 14 nt, Homo sapiens
uccauaucagcucu

SEQ ID NO: 468513 - RNA, 12 nt, Homo sapiens
uccaugugaaau

SEQ ID NO: 468514 - RNA, 14 nt, Homo sapiens
ucccaaacccagcc

SEQ ID NO: 468515 - RNA, 13 nt, Homo sapiens
uccccagccugcu

SEQ ID NO: 468516 - RNA, 19 nt, Homo sapiens
uccccagccugcucccuag

SEQ ID NO: 468517 - RNA, 12 nt, Homo sapiens
uccccagggugc

SEQ ID NO: 468518 - RNA, 19 nt, Homo sapiens
uccccuacggccacagggg

SEQ ID NO: 468519 - RNA, 21 nt, Homo sapiens
uccccucauccacuaggugcc

SEQ ID NO: 468520 - RNA, 13 nt, Homo sapiens
uccccuccagacc

SEQ ID NO: 468521 - RNA, 22 nt, Homo sapiens
ucccguuguguggguuuacucu

SEQ ID NO: 468522 - RNA, 20 nt, Homo sapiens
ucccuagccagaggcucuaa

SEQ ID NO: 468523 - RNA, 22 nt, Homo sapiens
ucccuuaggaauauacauaguc

SEQ ID NO: 468524 - RNA, 13 nt, Homo sapiens
uccgcccgcccac

SEQ ID NO: 468525 - RNA, 23 nt, Homo sapiens
uccggaacagccaaagaaacuca

SEQ ID NO: 468526 - RNA, 19 nt, Homo sapiens
uccgugagagucaucucaa

SEQ ID NO: 468527 - RNA, 15 nt, Homo sapiens
uccuaugcugcaaua

SEQ ID NO: 468528 - RNA, 19 nt, Homo sapiens
ugcaguagagagcaaagau

SEQ ID NO: 468529 - RNA, 16 nt, Homo sapiens
ugcaucggggauucca

SEQ ID NO: 468530 - RNA, 14 nt, Homo sapiens
ugcaugucucaggc

SEQ ID NO: 468531 - RNA, 15 nt, Homo sapiens
ugcauuucuccgugc

SEQ ID NO: 468532 - RNA, 22 nt, Homo sapiens
ugccacauggagcuugacuuca

SEQ ID NO: 468533 - RNA, 12 nt, Homo sapiens
ugccaugaucug

SEQ ID NO: 468534 - RNA, 12 nt, Homo sapiens
ugccaugcucag

SEQ ID NO: 468535 - RNA, 20 nt, Homo sapiens
ugccccccuccuuuccaaau

SEQ ID NO: 468536 - RNA, 15 nt, Homo sapiens
ugccuuguuguauuc

SEQ ID NO: 468537 - RNA, 14 nt, Homo sapiens
ugccuuucacuuua

SEQ ID NO: 468538 - RNA, 16 nt, Homo sapiens
ugcucccuagccagag

SEQ ID NO: 468539 - RNA, 20 nt, Homo sapiens
ugcugaguauguuaagcucu

SEQ ID NO: 468540 - RNA, 14 nt, Homo sapiens
ugcuggcugccuua

SEQ ID NO: 468541 - RNA, 19 nt, Homo sapiens
ugcuguuagauguccucag

SEQ ID NO: 468542 - RNA, 22 nt, Homo sapiens
ugcuuaacauaaacuuguacuu

SEQ ID NO: 468543 - RNA, 16 nt, Homo sapiens
ugcuugcaugugcugc

SEQ ID NO: 468544 - RNA, 19 nt, Homo sapiens
ugcuuuaaaguaccuguag

SEQ ID NO: 468545 - RNA, 17 nt, Homo sapiens
ugcuuuguaugcacuuu

SEQ ID NO: 468546 - RNA, 12 nt, Homo sapiens
uggaagcacugc

SEQ ID NO: 468547 - RNA, 21 nt, Homo sapiens
uggagauaccagagacucuga

SEQ ID NO: 468548 - RNA, 23 nt, Homo sapiens
uggaugcugagagaccucaggga

SEQ ID NO: 468549 - RNA, 19 nt, Homo sapiens
uggauuuucuuucuaugua

SEQ ID NO: 468550 - RNA, 15 nt, Homo sapiens
uggcaaaugaaaguu

SEQ ID NO: 468551 - RNA, 19 nt, Homo sapiens
uggcaauaaggaucuuccc

SEQ ID NO: 468552 - RNA, 15 nt, Homo sapiens
uggcaccagaugcaa

SEQ ID NO: 468553 - RNA, 16 nt, Homo sapiens
uggcagccgugccuuc

SEQ ID NO: 468554 - RNA, 17 nt, Homo sapiens
uggcagccgugccuuca

SEQ ID NO: 468555 - RNA, 18 nt, Homo sapiens
uggcccucgcucugccuc

SEQ ID NO: 468556 - RNA, 16 nt, Homo sapiens
uggcuuugugcuuguu

SEQ ID NO: 468557 - RNA, 20 nt, Homo sapiens
ugggaaauucuugcacugua

SEQ ID NO: 468558 - RNA, 13 nt, Homo sapiens
ugggacagaggag

SEQ ID NO: 468559 - RNA, 23 nt, Homo sapiens
ugggagagguucugugcaaaacu

SEQ ID NO: 468560 - RNA, 13 nt, Homo sapiens
gggcacugguggc

SEQ ID NO: 468561 - RNA, 13 nt, Homo sapiens
gggcaggguucua

SEQ ID NO: 468562 - RNA, 12 nt, Homo sapiens
gggcauguuucu

SEQ ID NO: 468563 - RNA, 15 nt, Homo sapiens
gggccagagggacuu

SEQ ID NO: 468564 - RNA, 19 nt, Homo sapiens
gggcgcacuuuccacugga

SEQ ID NO: 468565 - RNA, 15 nt, Homo sapiens
gggcugcccuggugc

SEQ ID NO: 468566 - RNA, 17 nt, Homo sapiens
ggggguuuuuaaucuuu

SEQ ID NO: 468567 - RNA, 13 nt, Homo sapiens
ggguggggugccu

SEQ ID NO: 468568 - RNA, 20 nt, Homo sapiens
gguaaugaugauucaaucau

SEQ ID NO: 468569 - RNA, 19 nt, Homo sapiens
gguaucugcugccucugaa

SEQ ID NO: 468570 - RNA, 10 nt, Homo sapiens
ggucaucuca

SEQ ID NO: 468571 - RNA, 21 nt, Homo sapiens
ggucauucuuuucuccuccuc

SEQ ID NO: 468572 - RNA, 22 nt, Homo sapiens
ggucuccaccccucaagccagg

SEQ ID NO: 468573 - RNA, 18 nt, Homo sapiens
ggugaggcgugggaucca

SEQ ID NO: 468574 - RNA, 12 nt, Homo sapiens
ggugcacuggaa

SEQ ID NO: 468575 - RNA, 20 nt, Homo sapiens
ggugcucuuccucaucucau

SEQ ID NO: 468576 - RNA, 18 nt, Homo sapiens
gguguccuguuccugcca

SEQ ID NO: 468577 - RNA, 15 nt, Homo sapiens
gguuccagacagggu

SEQ ID NO: 468578 - RNA, 21 nt, Homo sapiens
gguuggaaagaguugccauaa

SEQ ID NO: 468579 - RNA, 14 nt, Homo sapiens
gguuggguuccaga

SEQ ID NO: 468580 - RNA, 12 nt, Homo sapiens
guaaaagacugg

SEQ ID NO: 468581 - RNA, 14 nt, Homo sapiens
guaaaagacugggg

SEQ ID NO: 468582 - RNA, 19 nt, Homo sapiens
guaaacacuugacuauaaa

SEQ ID NO: 468583 - RNA, 21 nt, Homo sapiens
guaacagcaauuuucauaaua

SEQ ID NO: 468584 - RNA, 17 nt, Homo sapiens
guacaauaaagcaaugu

SEQ ID NO: 468585 - RNA, 18 nt, Homo sapiens
guacaauaaagcaaugug

SEQ ID NO: 468586 - RNA, 19 nt, Homo sapiens
guacaauaaagcaaugugg

SEQ ID NO: 468587 - RNA, 20 nt, Homo sapiens
guacuucuucauccauagac

SEQ ID NO: 468588 - RNA, 23 nt, Homo sapiens
guacuugcucaauaaaggucaua

SEQ ID NO: 468589 - RNA, 16 nt, Homo sapiens
guaggugggucuugga

SEQ ID NO: 468590 - RNA, 19 nt, Homo sapiens
guaguuuauaaaagacugu

SEQ ID NO: 468591 - RNA, 16 nt, Homo sapiens
guauagaguacugcag

SEQ ID NO: 468592 - RNA, 13 nt, Homo sapiens
guauaucagcucu

SEQ ID NO: 468593 - RNA, 18 nt, Homo sapiens
guauguagacaugcacac

SEQ ID NO: 468594 - RNA, 18 nt, Homo sapiens
guaugucagcuacaugaa

SEQ ID NO: 468595 - RNA, 12 nt, Homo sapiens
guauuaaacuug

SEQ ID NO: 468596 - RNA, 19 nt, Homo sapiens
guauucaacuaauacaugg

SEQ ID NO: 468597 - RNA, 19 nt, Homo sapiens
guauucccaccccuggacu

SEQ ID NO: 468598 - RNA, 23 nt, Homo sapiens
gucaauuuuuaacuuaucuccag

SEQ ID NO: 468599 - RNA, 23 nt, Homo sapiens
gucagaauuucuuugucauucaa

SEQ ID NO: 468600 - RNA, 23 nt, Homo sapiens
gucagcagggggguuggguucca

SEQ ID NO: 468601 - RNA, 18 nt, Homo sapiens
gucauacgaaccuaaaga

SEQ ID NO: 468602 - RNA, 12 nt, Homo sapiens
gucaucaucuca

SEQ ID NO: 468603 - RNA, 21 nt, Homo sapiens
gucauguuucugcaguauucu

SEQ ID NO: 468604 - RNA, 19 nt, Homo sapiens
gucauucaagccugugaau

SEQ ID NO: 468605 - RNA, 20 nt, Homo sapiens
guccaaaauaucgagugaau

SEQ ID NO: 468606 - RNA, 13 nt, Homo sapiens
guccaugugcaaa

SEQ ID NO: 468607 - RNA, 14 nt, Homo sapiens
gucccaugcauaac

SEQ ID NO: 468608 - RNA, 20 nt, Homo sapiens
guccccagccugcucccuag

SEQ ID NO: 468609 - RNA, 19 nt, Homo sapiens
gucccucaggcuuguugcc

SEQ ID NO: 468610 - RNA, 21 nt, Homo sapiens
guccuccagggcgagcacuuu

SEQ ID NO: 468611 - RNA, 15 nt, Homo sapiens
guccuugucgcugug

SEQ ID NO: 468612 - RNA, 15 nt, Homo sapiens
guccuuucccaccca

SEQ ID NO: 468613 - RNA, 15 nt, Homo sapiens
gucucucccuacccu

SEQ ID NO: 468614 - RNA, 17 nt, Homo sapiens
gucucugauuugcaaau

SEQ ID NO: 468615 - RNA, 22 nt, Homo sapiens
gucugaaggagaggagugcgcu

SEQ ID NO: 468616 - RNA, 22 nt, Homo sapiens
gucugcuuuggggcuuaucaga

SEQ ID NO: 468617 - RNA, 22 nt, Homo sapiens
gucuuccuccucagucuucuca

SEQ ID NO: 468618 - RNA, 21 nt, Homo sapiens
gucuuggauugguaccagagc

SEQ ID NO: 468619 - RNA, 17 nt, Homo sapiens
gucuuucgcacauucuc

SEQ ID NO: 468620 - RNA, 22 nt, Homo sapiens
gucuuucgcacauucuccugau

SEQ ID NO: 468621 - RNA, 16 nt, Homo sapiens
gugaaaggucaucuca

SEQ ID NO: 468622 - RNA, 13 nt, Homo sapiens
gugaauacacugg

SEQ ID NO: 468623 - RNA, 20 nt, Homo sapiens
gugaauuuuaaaaugcaaau

SEQ ID NO: 468624 - RNA, 22 nt, Homo sapiens
gugagacagugggggugccugg

SEQ ID NO: 468625 - RNA, 17 nt, Homo sapiens
gugaugauagcacuggu

SEQ ID NO: 468626 - RNA, 17 nt, Homo sapiens
gugcaacggaagccagg

SEQ ID NO: 468627 - RNA, 23 nt, Homo sapiens
gugccucuuuuaaugucaucucu

SEQ ID NO: 468628 - RNA, 20 nt, Homo sapiens
gugcgugcuugcaugugcug

SEQ ID NO: 468629 - RNA, 15 nt, Homo sapiens
gugcuuguucuuccu

SEQ ID NO: 468630 - RNA, 23 nt, Homo sapiens
guggaagauuucuugacuauuuc

SEQ ID NO: 468631 - RNA, 15 nt, Homo sapiens
guggaaugcauccaa

SEQ ID NO: 468632 - RNA, 21 nt, Homo sapiens
guggagaaauacaucauuugc

SEQ ID NO: 468633 - RNA, 19 nt, Homo sapiens
guggccucagcccucagaa

SEQ ID NO: 468634 - RNA, 18 nt, Homo sapiens
guggcuucccgcucagcc

SEQ ID NO: 468635 - RNA, 13 nt, Homo sapiens
guggggugccuga

SEQ ID NO: 468636 - RNA, 20 nt, Homo sapiens
gugguugggaaacucauuua

SEQ ID NO: 468637 - RNA, 21 nt, Homo sapiens
guguacauuugauuugauaua

SEQ ID NO: 468638 - RNA, 17 nt, Homo sapiens
gugucuaguuugcauac

SEQ ID NO: 468639 - RNA, 15 nt, Homo sapiens
gugugcaucaugucu

SEQ ID NO: 468640 - RNA, 15 nt, Homo sapiens
guguggcaaacauuu

SEQ ID NO: 468641 - RNA, 17 nt, Homo sapiens
guguggcuuaaacauuu

SEQ ID NO: 468642 - RNA, 16 nt, Homo sapiens
gugugugugcaauguu

SEQ ID NO: 468643 - RNA, 21 nt, Homo sapiens
guguugaugacucacucauaa

SEQ ID NO: 468644 - RNA, 16 nt, Homo sapiens
guguuuugucuucaac

SEQ ID NO: 468645 - RNA, 22 nt, Homo sapiens
guuaaagcuuuggugccuggaa

SEQ ID NO: 468646 - RNA, 18 nt, Homo sapiens
guuaauaagcaacuguaa

SEQ ID NO: 468647 - RNA, 16 nt, Homo sapiens
guuaauuacuuuugaa

SEQ ID NO: 468648 - RNA, 13 nt, Homo sapiens
guuaauucuugcc

SEQ ID NO: 468649 - RNA, 13 nt, Homo sapiens
guuagcaauaugu

SEQ ID NO: 468650 - RNA, 17 nt, Homo sapiens
guucacucuacuuagca

SEQ ID NO: 468651 - RNA, 13 nt, Homo sapiens
guuccuacuggag

SEQ ID NO: 468652 - RNA, 15 nt, Homo sapiens
guugaugaagcacau

SEQ ID NO: 468653 - RNA, 15 nt, Homo sapiens
guuggguuccagaca

SEQ ID NO: 468654 - RNA, 21 nt, Homo sapiens
guugucugaagucacugcaca

SEQ ID NO: 468655 - RNA, 17 nt, Homo sapiens
guugugucuugcuauac

SEQ ID NO: 468656 - RNA, 14 nt, Homo sapiens
guuuaauauuccaa

SEQ ID NO: 468657 - RNA, 20 nt, Homo sapiens
guuuaccucacuggugcauu

SEQ ID NO: 468658 - RNA, 17 nt, Homo sapiens
guuuauuaaaauacugu

SEQ ID NO: 468659 - RNA, 13 nt, Homo sapiens
guuugaacacaga

SEQ ID NO: 468660 - RNA, 13 nt, Homo sapiens
guuugcaagaacc

SEQ ID NO: 468661 - RNA, 17 nt, Homo sapiens
guuugggugucugcuaa

SEQ ID NO: 468662 - RNA, 18 nt, Homo sapiens
uaaaaaagcauuauccuu

SEQ ID NO: 468663 - RNA, 22 nt, Homo sapiens
uaaaaagucaaacuuucaccuc

SEQ ID NO: 468664 - RNA, 22 nt, Homo sapiens
uaaaauaaauuuguaugcucaa

SEQ ID NO: 468665 - RNA, 12 nt, Homo sapiens
uaaaauacucac

SEQ ID NO: 468666 - RNA, 14 nt, Homo sapiens
uaaaauaguagcau

SEQ ID NO: 468667 - RNA, 14 nt, Homo sapiens
uaaaaucagacucu

SEQ ID NO: 468668 - RNA, 15 nt, Homo sapiens
uaaacgucacagcag

SEQ ID NO: 468669 - RNA, 17 nt, Homo sapiens
uaaacgucacagcagua

SEQ ID NO: 468670 - RNA, 23 nt, Homo sapiens
uaaacuguuuucauguguugcaa

SEQ ID NO: 468671 - RNA, 18 nt, Homo sapiens
uaaagccucugugcugca

SEQ ID NO: 468672 - RNA, 18 nt, Homo sapiens
uaaagggaggauugaaag

SEQ ID NO: 468673 - RNA, 13 nt, Homo sapiens
uaaauaaugcuua

SEQ ID NO: 468674 - RNA, 21 nt, Homo sapiens
uaaauccaacucugacuguaa

SEQ ID NO: 468675 - RNA, 20 nt, Homo sapiens
uaaauuuaauauacugcaua

SEQ ID NO: 468676 - RNA, 23 nt, Homo sapiens
uaaauuuguuauuguguauuaug

SEQ ID NO: 468677 - RNA, 20 nt, Homo sapiens
uaacauaaacuuguacuuac

SEQ ID NO: 468678 - RNA, 13 nt, Homo sapiens
uaacucugcauag

SEQ ID NO: 468679 - RNA, 18 nt, Homo sapiens
uaagacaacaggcauuuu

SEQ ID NO: 468680 - RNA, 11 nt, Homo sapiens
uaagcaaaaaa

SEQ ID NO: 468681 - RNA, 16 nt, Homo sapiens
uaagcaaaaaacugca

SEQ ID NO: 468682 - RNA, 18 nt, Homo sapiens
uaagcauuuaggaaugaa

SEQ ID NO: 468683 - RNA, 20 nt, Homo sapiens
uaagcccccucaacuaccau

SEQ ID NO: 468684 - RNA, 14 nt, Homo sapiens
uaagcucacacagc

SEQ ID NO: 468685 - RNA, 16 nt, Homo sapiens
uaagcucacacagcua

SEQ ID NO: 468686 - RNA, 10 nt, Homo sapiens
uaagcuguuu

SEQ ID NO: 468687 - RNA, 16 nt, Homo sapiens
uaaggacuucugcagc

SEQ ID NO: 468688 - RNA, 23 nt, Homo sapiens
uaaguaaccucuacaggcauuua

SEQ ID NO: 468689 - RNA, 18 nt, Homo sapiens
uaagugcauuuauugccu

SEQ ID NO: 468690 - RNA, 21 nt, Homo sapiens
uaagugcauuuauugccucua

SEQ ID NO: 468691 - RNA, 16 nt, Homo sapiens
uaagugcucaguauug

SEQ ID NO: 468692 - RNA, 18 nt, Homo sapiens
uaauaagcaacuguaaaa

SEQ ID NO: 468693 - RNA, 20 nt, Homo sapiens
uaaucucuaaaauucuaguc

SEQ ID NO: 468694 - RNA, 16 nt, Homo sapiens
uaauguaaaauucaua

SEQ ID NO: 468695 - RNA, 14 nt, Homo sapiens
uaauguacaauaaa

SEQ ID NO: 468696 - RNA, 16 nt, Homo sapiens
uaauuuauuucaucca

SEQ ID NO: 468697 - RNA, 17 nt, Homo sapiens
uaauuucuuacuaaaca

SEQ ID NO: 468698 - RNA, 22 nt, Homo sapiens
uacaaauuuuuacucaggcuuu

SEQ ID NO: 468699 - RNA, 18 nt, Homo sapiens
uacaauaaagcaaugugg

SEQ ID NO: 468700 - RNA, 23 nt, Homo sapiens
uacacccaauuuuaaaaaauaac

SEQ ID NO: 468701 - RNA, 17 nt, Homo sapiens
uacagaaucuaacuggu

SEQ ID NO: 468702 - RNA, 18 nt, Homo sapiens
uacagauuuaguuuacca

SEQ ID NO: 468703 - RNA, 22 nt, Homo sapiens
uacagcuaaucagcauucucac

SEQ ID NO: 468704 - RNA, 18 nt, Homo sapiens
uacagggcaggagcugcu

SEQ ID NO: 468705 - RNA, 13 nt, Homo sapiens
uacaucuaaguca

SEQ ID NO: 468706 - RNA, 24 nt, Homo sapiens
uacauuaaaauaacuaagcaagua

SEQ ID NO: 468707 - RNA, 20 nt, Homo sapiens
uaccaagugcuuugcucuag

SEQ ID NO: 468708 - RNA, 19 nt, Homo sapiens
uaccagagauuuuccucuc

SEQ ID NO: 468709 - RNA, 16 nt, Homo sapiens
uacccagugggacaga

SEQ ID NO: 468710 - RNA, 17 nt, Homo sapiens
uaccuguaauagccuca

SEQ ID NO: 468711 - RNA, 15 nt, Homo sapiens
uacuauuaacucugc

SEQ ID NO: 468712 - RNA, 22 nt, Homo sapiens
uacuuacacugaaauccaaaau

SEQ ID NO: 468713 - RNA, 23 nt, Homo sapiens
uacuuuaauucuuuucccagaag

SEQ ID NO: 468714 - RNA, 19 nt, Homo sapiens
uagaaauguauccugauaa

SEQ ID NO: 468715 - RNA, 18 nt, Homo sapiens
uagaaauuuuaucucuuc

SEQ ID NO: 468716 - RNA, 19 nt, Homo sapiens
uagaacugucccacaaaau

SEQ ID NO: 468717 - RNA, 17 nt, Homo sapiens
uagcaagaagauucuaa

SEQ ID NO: 468718 - RNA, 17 nt, Homo sapiens
uagccagaggcucuaau

SEQ ID NO: 468719 - RNA, 19 nt, Homo sapiens
uagccagaggcucuaaugu

SEQ ID NO: 468720 - RNA, 23 nt, Homo sapiens
uagccagaggcucuaauguacaa

SEQ ID NO: 468721 - RNA, 17 nt, Homo sapiens
aaagccucugugcugca

SEQ ID NO: 468722 - RNA, 15 nt, Homo sapiens
aaaggaggacaggga

SEQ ID NO: 468723 - RNA, 14 nt, Homo sapiens
aaagguuaagccau

SEQ ID NO: 468724 - RNA, 21 nt, Homo sapiens
aaauaaacucuucaaggccaa

SEQ ID NO: 468725 - RNA, 13 nt, Homo sapiens
aaauaagugcauu

SEQ ID NO: 468726 - RNA, 18 nt, Homo sapiens
aaauaccauuuaucuacu

SEQ ID NO: 468727 - RNA, 13 nt, Homo sapiens
aaauaggagucuu

SEQ ID NO: 468728 - RNA, 12 nt, Homo sapiens
aaauauugcuau

SEQ ID NO: 468729 - RNA, 10 nt, Homo sapiens
aaaucacuuu

SEQ ID NO: 468730 - RNA, 18 nt, Homo sapiens
aaaugcacauuugucacu

SEQ ID NO: 468731 - RNA, 21 nt, Homo sapiens
aaaugucuguuucaaugaccu

SEQ ID NO: 468732 - RNA, 16 nt, Homo sapiens
aaauguuucaaauggu

SEQ ID NO: 468733 - RNA, 15 nt, Homo sapiens
aaauuacaauuguca

SEQ ID NO: 468734 - RNA, 14 nt, Homo sapiens
aaauucuagucucu

SEQ ID NO: 468735 - RNA, 19 nt, Homo sapiens
aaauugauuaaaggggcug

SEQ ID NO: 468736 - RNA, 21 nt, Homo sapiens
aaauuuuaauguaaaauucau

SEQ ID NO: 468737 - RNA, 21 nt, Homo sapiens
aaauuuuagcguuaaagucag

SEQ ID NO: 468738 - RNA, 15 nt, Homo sapiens
aacaaacuuacuguc

SEQ ID NO: 468739 - RNA, 16 nt, Homo sapiens
aacaaauauuucacuu

SEQ ID NO: 468740 - RNA, 18 nt, Homo sapiens
aacaagccacguugcaga

SEQ ID NO: 468741 - RNA, 22 nt, Homo sapiens
aacaagcuuuggcuuuuuccau

SEQ ID NO: 468742 - RNA, 21 nt, Homo sapiens
aacacuaguagcuguuuugaa

SEQ ID NO: 468743 - RNA, 23 nt, Homo sapiens
aacacuugacuauaaaaacugcc

SEQ ID NO: 468744 - RNA, 16 nt, Homo sapiens
aacagaccagcauagu

SEQ ID NO: 468745 - RNA, 22 nt, Homo sapiens
aacagaccagcauaguucugca

SEQ ID NO: 468746 - RNA, 12 nt, Homo sapiens
aacagccagcuu

SEQ ID NO: 468747 - RNA, 18 nt, Homo sapiens
aacagcuugaaaacugga

SEQ ID NO: 468748 - RNA, 18 nt, Homo sapiens
aacaggcucacagagauu

SEQ ID NO: 468749 - RNA, 16 nt, Homo sapiens
aacccagccucuagaa

SEQ ID NO: 468750 - RNA, 20 nt, Homo sapiens
aacccaguguucagcauaga

SEQ ID NO: 468751 - RNA, 14 nt, Homo sapiens
aaccucacugcccu

SEQ ID NO: 468752 - RNA, 23 nt, Homo sapiens
aacguccuuccacuucaggguuc

SEQ ID NO: 468753 - RNA, 23 nt, Homo sapiens
aacucagccuuaagaaagcuaua

SEQ ID NO: 468754 - RNA, 13 nt, Homo sapiens
aacuccuuucuaa

SEQ ID NO: 468755 - RNA, 17 nt, Homo sapiens
aacugggaaauaagcaa

SEQ ID NO: 468756 - RNA, 15 nt, Homo sapiens
aacuuaauuaccuaa

SEQ ID NO: 468757 - RNA, 21 nt, Homo sapiens
aagaaagcuauauaugaauaa

SEQ ID NO: 468758 - RNA, 22 nt, Homo sapiens
aagaacaguguugaaauuggaa

SEQ ID NO: 468759 - RNA, 17 nt, Homo sapiens
aagacaacaggcauuuu

SEQ ID NO: 468760 - RNA, 21 nt, Homo sapiens
aagacacguucuugccagcuu

SEQ ID NO: 468761 - RNA, 20 nt, Homo sapiens
aagacccucaaugccaagaa

SEQ ID NO: 468762 - RNA, 21 nt, Homo sapiens
aagaggccaguacuuugccau

SEQ ID NO: 468763 - RNA, 23 nt, Homo sapiens
aagaguucuccuuguacuugaau

SEQ ID NO: 468764 - RNA, 15 nt, Homo sapiens
aagauaaaacuaauu

SEQ ID NO: 468765 - RNA, 22 nt, Homo sapiens
aagauaaaaucuucaacuaauu

SEQ ID NO: 468766 - RNA, 15 nt, Homo sapiens
aagcaaaaaacugca

SEQ ID NO: 468767 - RNA, 23 nt, Homo sapiens
aagcccuugcccagagcucucua

SEQ ID NO: 468768 - RNA, 16 nt, Homo sapiens
aagcucuuguguauac

SEQ ID NO: 468769 - RNA, 14 nt, Homo sapiens
aaggaaacaagcuu

SEQ ID NO: 468770 - RNA, 19 nt, Homo sapiens
aagggccccacucagggau

SEQ ID NO: 468771 - RNA, 14 nt, Homo sapiens
aaggggccuggaag

SEQ ID NO: 468772 - RNA, 12 nt, Homo sapiens
aaggguauguca

SEQ ID NO: 468773 - RNA, 18 nt, Homo sapiens
aagguuaagccauaugac

SEQ ID NO: 468774 - RNA, 16 nt, Homo sapiens
aaguaccaacugagcc

SEQ ID NO: 468775 - RNA, 16 nt, Homo sapiens
aaguagcacacugagu

SEQ ID NO: 468776 - RNA, 23 nt, Homo sapiens
aagucaaacuuucaccucagauu

SEQ ID NO: 468777 - RNA, 23 nt, Homo sapiens
aagucacugcacagugcaucuca

SEQ ID NO: 468778 - RNA, 15 nt, Homo sapiens
aagugcucaguauug

SEQ ID NO: 468779 - RNA, 10 nt, Homo sapiens
aaguggaaug

SEQ ID NO: 468780 - RNA, 20 nt, Homo sapiens
aaguuaaaaagucaaacuuu

SEQ ID NO: 468781 - RNA, 19 nt, Homo sapiens
aaguugucuuacacuucuc

SEQ ID NO: 468782 - RNA, 18 nt, Homo sapiens
aauaaaaacccuguaugg

SEQ ID NO: 468783 - RNA, 18 nt, Homo sapiens
aauaaagcaaugugguag

SEQ ID NO: 468784 - RNA, 13 nt, Homo sapiens
aauaaccaaaaaa

SEQ ID NO: 468785 - RNA, 22 nt, Homo sapiens
aauaacuaagcaaguauauuua

SEQ ID NO: 468786 - RNA, 16 nt, Homo sapiens
aauaagcaacuguaaa

SEQ ID NO: 468787 - RNA, 16 nt, Homo sapiens
aauaaggaucuuccca

SEQ ID NO: 468788 - RNA, 14 nt, Homo sapiens
aauacucaccaaaa

SEQ ID NO: 468789 - RNA, 22 nt, Homo sapiens
aauaugaggggacugcaugcaa

SEQ ID NO: 468790 - RNA, 11 nt, Homo sapiens
aauaugggagg

SEQ ID NO: 468791 - RNA, 16 nt, Homo sapiens
aauaugggaggaacaa

SEQ ID NO: 468792 - RNA, 21 nt, Homo sapiens
aauauuccuaugcugcaauac

SEQ ID NO: 468793 - RNA, 22 nt, Homo sapiens
aauauuuuaaacuacugauuga

SEQ ID NO: 468794 - RNA, 21 nt, Homo sapiens
aauauuuuuuucuagcuauaa

SEQ ID NO: 468795 - RNA, 15 nt, Homo sapiens
aaucagacucuuuag

SEQ ID NO: 468796 - RNA, 17 nt, Homo sapiens
aaucagcauucucacuc

SEQ ID NO: 468797 - RNA, 23 nt, Homo sapiens
aaucauugagaaauaaagcacau

SEQ ID NO: 468798 - RNA, 16 nt, Homo sapiens
aauccaccugcaguua

SEQ ID NO: 468799 - RNA, 16 nt, Homo sapiens
aauccauaucagcucu

SEQ ID NO: 468800 - RNA, 18 nt, Homo sapiens
aauccuuuguacugauga

SEQ ID NO: 468801 - RNA, 15 nt, Homo sapiens
aaucugcaguggcuc

SEQ ID NO: 468802 - RNA, 16 nt, Homo sapiens
aaucugggaccaaaac

SEQ ID NO: 468803 - RNA, 14 nt, Homo sapiens
aaugaaguguuaga

SEQ ID NO: 468804 - RNA, 19 nt, Homo sapiens
aaugaauuuuuuccuacca

SEQ ID NO: 468805 - RNA, 20 nt, Homo sapiens
aaugagaaauugugccaaag

SEQ ID NO: 468806 - RNA, 22 nt, Homo sapiens
aaugaguaaauaaacucuucaa

SEQ ID NO: 468807 - RNA, 13 nt, Homo sapiens
aaugcaaugugaa

SEQ ID NO: 468808 - RNA, 20 nt, Homo sapiens
aaugcagcaguaaauccaag

SEQ ID NO: 468809 - RNA, 23 nt, Homo sapiens
aaugccuuguugaugaagcacau

SEQ ID NO: 468810 - RNA, 17 nt, Homo sapiens
aaugcuagcacaauauu

SEQ ID NO: 468811 - RNA, 21 nt, Homo sapiens
aaugcuagcacaauauuccua

SEQ ID NO: 468812 - RNA, 19 nt, Homo sapiens
aaugcuuguaauagucugu

SEQ ID NO: 468813 - RNA, 16 nt, Homo sapiens
aauguacaauaaagca

SEQ ID NO: 468814 - RNA, 18 nt, Homo sapiens
aauguacaauaaagcaau

SEQ ID NO: 468815 - RNA, 19 nt, Homo sapiens
aauguacaauaaagcaaug

SEQ ID NO: 468816 - RNA, 12 nt, Homo sapiens
aaugucaucucu

SEQ ID NO: 468817 - RNA, 22 nt, Homo sapiens
aaaacugccccccuccuuucca

SEQ ID NO: 468818 - RNA, 22 nt, Homo sapiens
aaaauauuucuaagcuuauuuc

SEQ ID NO: 468819 - RNA, 17 nt, Homo sapiens
aaaaucacaauucucug

SEQ ID NO: 468820 - RNA, 11 nt, Homo sapiens
aaaaugcuuuc

SEQ ID NO: 468821 - RNA, 12 nt, Homo sapiens
aaaauguuucaa

SEQ ID NO: 468822 - RNA, 17 nt, Homo sapiens
aaaauuugaauguggau

SEQ ID NO: 468823 - RNA, 19 nt, Homo sapiens
aaacagauguuuguuuuca

SEQ ID NO: 468824 - RNA, 20 nt, Homo sapiens
aaaccaucaaaaauauucca

SEQ ID NO: 468825 - RNA, 14 nt, Homo sapiens
aaacuuucaccuca

SEQ ID NO: 468826 - RNA, 19 nt, Homo sapiens
aaagaaccccccuccccaa

SEQ ID NO: 468827 - RNA, 21 nt, Homo sapiens
aaagacugucuuaauuugcau

SEQ ID NO: 468828 - RNA, 22 nt, Homo sapiens
aaagaguugcaguaaaguucca

SEQ ID NO: 468829 - RNA, 16 nt, Homo sapiens
aaagcaaugugguagu

SEQ ID NO: 468830 - RNA, 11 nt, Homo sapiens
aaagcauuauc

SEQ ID NO: 468831 - RNA, 20 nt, Homo sapiens
acauuaaaauaacuaagcaa

SEQ ID NO: 468832 - RNA, 23 nt, Homo sapiens
acauucccuuggauguagucuga

SEQ ID NO: 468833 - RNA, 23 nt, Homo sapiens
acauugcaggaagagaugcucua

SEQ ID NO: 468834 - RNA, 12 nt, Homo sapiens
accaacugagcc

SEQ ID NO: 468835 - RNA, 19 nt, Homo sapiens
accaagaccccaaagggcc

SEQ ID NO: 468836 - RNA, 21 nt, Homo sapiens
accacacacacccuuccccac

SEQ ID NO: 468837 - RNA, 11 nt, Homo sapiens
accagggaugg

SEQ ID NO: 468838 - RNA, 22 nt, Homo sapiens
accauuauggcuuugugcuugu

SEQ ID NO: 468839 - RNA, 15 nt, Homo sapiens
acccagccucuagaa

SEQ ID NO: 468840 - RNA, 23 nt, Homo sapiens
accccuugcccaaccaaugcaca

SEQ ID NO: 468841 - RNA, 22 nt, Homo sapiens
acccgagggacagcagauucca

SEQ ID NO: 468842 - RNA, 16 nt, Homo sapiens
acccuacaguauauaa

SEQ ID NO: 468843 - RNA, 17 nt, Homo sapiens
acccuacgaaagcacag

SEQ ID NO: 468844 - RNA, 15 nt, Homo sapiens
acccuaggucuccac

SEQ ID NO: 468845 - RNA, 16 nt, Homo sapiens
acccuauaaaagugau

SEQ ID NO: 468846 - RNA, 22 nt, Homo sapiens
acccucugcuaugucugugaug

SEQ ID NO: 468847 - RNA, 19 nt, Homo sapiens
acccuuggagccaauggag

SEQ ID NO: 468848 - RNA, 21 nt, Homo sapiens
accgagucucuucuccacugg

SEQ ID NO: 468849 - RNA, 15 nt, Homo sapiens
accgcaauaaugaau

SEQ ID NO: 468850 - RNA, 17 nt, Homo sapiens
accucccccuccugucc

SEQ ID NO: 468851 - RNA, 12 nt, Homo sapiens
acgucugugagu

SEQ ID NO: 468852 - RNA, 23 nt, Homo sapiens
acuaaguaaccucuacaggcauu

SEQ ID NO: 468853 - RNA, 14 nt, Homo sapiens
acuaaugacuuugu

SEQ ID NO: 468854 - RNA, 15 nt, Homo sapiens
acuacagaguguuau

SEQ ID NO: 468855 - RNA, 23 nt, Homo sapiens
acuaccauuccuucuuuaaacac

SEQ ID NO: 468856 - RNA, 17 nt, Homo sapiens
acuacuaaugacuuugu

SEQ ID NO: 468857 - RNA, 13 nt, Homo sapiens
acuagaagcacag

SEQ ID NO: 468858 - RNA, 21 nt, Homo sapiens
acuaucauugcccucuucaag

SEQ ID NO: 468859 - RNA, 18 nt, Homo sapiens
acuauuugauaaugcaua

SEQ ID NO: 468860 - RNA, 22 nt, Homo sapiens
acucagccuuaagaaagcuaua

SEQ ID NO: 468861 - RNA, 14 nt, Homo sapiens
acucagggaucuca

SEQ ID NO: 468862 - RNA, 23 nt, Homo sapiens
acucagggaucucagaccuagug

SEQ ID NO: 468863 - RNA, 15 nt, Homo sapiens
acucaucuguuaucc

SEQ ID NO: 468864 - RNA, 21 nt, Homo sapiens
acuccaguuugcccaccacaa

SEQ ID NO: 468865 - RNA, 18 nt, Homo sapiens
acucccugucauaguuac

SEQ ID NO: 468866 - RNA, 12 nt, Homo sapiens
acuccucagacg

SEQ ID NO: 468867 - RNA, 18 nt, Homo sapiens
acucggucugagaagauu

SEQ ID NO: 468868 - RNA, 18 nt, Homo sapiens
acugcacagugcaucuca

SEQ ID NO: 468869 - RNA, 15 nt, Homo sapiens
acuggugcauuuaaa

SEQ ID NO: 468870 - RNA, 12 nt, Homo sapiens
acugucucaaga

SEQ ID NO: 468871 - RNA, 16 nt, Homo sapiens
acuguuagcugggaag

SEQ ID NO: 468872 - RNA, 20 nt, Homo sapiens
acuuaaaccugugcuuucau

SEQ ID NO: 468873 - RNA, 22 nt, Homo sapiens
acuuagaaauugcauuuccuga

SEQ ID NO: 468874 - RNA, 17 nt, Homo sapiens
acuuagcaugucccuac

SEQ ID NO: 468875 - RNA, 21 nt, Homo sapiens
acuuauuaugaggcuauuaaa

SEQ ID NO: 468876 - RNA, 15 nt, Homo sapiens
acuuauuucauaaac

SEQ ID NO: 468877 - RNA, 14 nt, Homo sapiens
acuucagacucucu

SEQ ID NO: 468878 - RNA, 14 nt, Homo sapiens
acuucugcagcuau

SEQ ID NO: 468879 - RNA, 20 nt, Homo sapiens
acuucugcuguacagauauc

SEQ ID NO: 468880 - RNA, 13 nt, Homo sapiens
acuugacuuugcc

SEQ ID NO: 468881 - RNA, 15 nt, Homo sapiens
acuugacuuugccac

SEQ ID NO: 468882 - RNA, 14 nt, Homo sapiens
cagucccucagcca

SEQ ID NO: 468883 - RNA, 19 nt, Homo sapiens
caguguaacccaagcauuu

SEQ ID NO: 468884 - RNA, 16 nt, Homo sapiens
caguguugaaauugga

SEQ ID NO: 468885 - RNA, 20 nt, Homo sapiens
caguuaagacaacaggcauu

SEQ ID NO: 468886 - RNA, 21 nt, Homo sapiens
caguuagaaauacauuaugcu

SEQ ID NO: 468887 - RNA, 22 nt, Homo sapiens
caguuagcccggccaaggacac

SEQ ID NO: 468888 - RNA, 17 nt, Homo sapiens
caguuuaauauuccaau

SEQ ID NO: 468889 - RNA, 15 nt, Homo sapiens
caguuugcaaucuua

SEQ ID NO: 468890 - RNA, 20 nt, Homo sapiens
caguuugcuuuguaugcacu

SEQ ID NO: 468891 - RNA, 21 nt, Homo sapiens
cauaaacaacuuaauguucug

SEQ ID NO: 468892 - RNA, 23 nt, Homo sapiens
cauacacccccaccuccugcaau

SEQ ID NO: 468893 - RNA, 23 nt, Homo sapiens
cauacgaaccuaaagaauaugaa

SEQ ID NO: 468894 - RNA, 20 nt, Homo sapiens
cauagaacugucccacaaaa

SEQ ID NO: 468895 - RNA, 22 nt, Homo sapiens
cauagacaaaggccuuaacaaa

SEQ ID NO: 468896 - RNA, 21 nt, Homo sapiens
cauauacuuuggggacuugua

SEQ ID NO: 468897 - RNA, 12 nt, Homo sapiens
cauaucagcucu

SEQ ID NO: 468898 - RNA, 22 nt, Homo sapiens
cauaucuuguuguucaguuugg

SEQ ID NO: 468899 - RNA, 15 nt, Homo sapiens
cauaugacaauuuca

SEQ ID NO: 468900 - RNA, 23 nt, Homo sapiens
cauaugacaauuucaaaaugcau

SEQ ID NO: 468901 - RNA, 15 nt, Homo sapiens
cauauuaaucccucg

SEQ ID NO: 468902 - RNA, 22 nt, Homo sapiens
caucagggggcaugaagcacau

SEQ ID NO: 468903 - RNA, 19 nt, Homo sapiens
caucuaagucaguuucaca

SEQ ID NO: 468904 - RNA, 19 nt, Homo sapiens
caugaaucacugcaccucu

SEQ ID NO: 468905 - RNA, 14 nt, Homo sapiens
caugaaugaaugaa

SEQ ID NO: 468906 - RNA, 22 nt, Homo sapiens
caugaaugaaugaaccaugaau

SEQ ID NO: 468907 - RNA, 16 nt, Homo sapiens
caugccgaaugccaca

SEQ ID NO: 468908 - RNA, 23 nt, Homo sapiens
cauggagcuugacuucaugccag

SEQ ID NO: 468909 - RNA, 21 nt, Homo sapiens
cauggccagguggccacucca

SEQ ID NO: 468910 - RNA, 12 nt, Homo sapiens
cauggugcagug

SEQ ID NO: 468911 - RNA, 21 nt, Homo sapiens
caugguuuuugcucuacuuua

SEQ ID NO: 468912 - RNA, 23 nt, Homo sapiens
caugucuacugcuuggauccaua

SEQ ID NO: 468913 - RNA, 11 nt, Homo sapiens
caugugcugca

SEQ ID NO: 468914 - RNA, 23 nt, Homo sapiens
cauguguccccucacucugucag

SEQ ID NO: 468915 - RNA, 13 nt, Homo sapiens
cauuaaccaagaa

SEQ ID NO: 468916 - RNA, 19 nt, Homo sapiens
cauucuaugacucuugucu

SEQ ID NO: 468917 - RNA, 17 nt, Homo sapiens
cauucuguccccaaaau

SEQ ID NO: 468918 - RNA, 20 nt, Homo sapiens
cauugagaaauaaagcacau

SEQ ID NO: 468919 - RNA, 13 nt, Homo sapiens
cauuuagauuuug

SEQ ID NO: 468920 - RNA, 18 nt, Homo sapiens
cauuuguccaugugcaaa

SEQ ID NO: 468921 - RNA, 18 nt, Homo sapiens
ccaaaaacuaaaauucaa

SEQ ID NO: 468922 - RNA, 16 nt, Homo sapiens
ccaaacccagccucua

SEQ ID NO: 468923 - RNA, 18 nt, Homo sapiens
ccaaacccagccucuaga

SEQ ID NO: 468924 - RNA, 19 nt, Homo sapiens
ccaaacccagccucuagaa

SEQ ID NO: 468925 - RNA, 21 nt, Homo sapiens
ccaaauaaaacuugagcccac

SEQ ID NO: 468926 - RNA, 15 nt, Homo sapiens
ccaacuccaggguua

SEQ ID NO: 468927 - RNA, 20 nt, Homo sapiens
ccaacuccgcccagccucuc

SEQ ID NO: 468928 - RNA, 14 nt, Homo sapiens
ccaagccaggguuc

SEQ ID NO: 468929 - RNA, 19 nt, Homo sapiens
ccaagggacaguggucuaa

SEQ ID NO: 468930 - RNA, 19 nt, Homo sapiens
ccaauccuuuauagcuuug

SEQ ID NO: 468931 - RNA, 13 nt, Homo sapiens
ccacccuucucag

SEQ ID NO: 468932 - RNA, 15 nt, Homo sapiens
ccaccuccugcaaua

SEQ ID NO: 468933 - RNA, 14 nt, Homo sapiens
ccaccugugcugcu

SEQ ID NO: 468934 - RNA, 14 nt, Homo sapiens
ccacgacauaagcu

SEQ ID NO: 468935 - RNA, 18 nt, Homo sapiens
ccagaggcucuaauguac

SEQ ID NO: 468936 - RNA, 21 nt, Homo sapiens
ccagaggcucuaauguacaau

SEQ ID NO: 468937 - RNA, 23 nt, Homo sapiens
ccagaggcucuaauguacaauaa

SEQ ID NO: 468938 - RNA, 21 nt, Homo sapiens
ccagcaccuggcacaccagaa

SEQ ID NO: 468939 - RNA, 22 nt, Homo sapiens
ccagccgggguggggugccuga

SEQ ID NO: 468940 - RNA, 14 nt, Homo sapiens
ccagccucuagaac

SEQ ID NO: 468941 - RNA, 15 nt, Homo sapiens
ccagccugcucccua

SEQ ID NO: 468942 - RNA, 23 nt, Homo sapiens
ccaggagacagacagagaaggca

SEQ ID NO: 468943 - RNA, 23 nt, Homo sapiens
ccagggaugggggaugggccagg

SEQ ID NO: 468944 - RNA, 16 nt, Homo sapiens
ccagggcgagcacuuu

SEQ ID NO: 468945 - RNA, 17 nt, Homo sapiens
ccagggcgagcacuuuc

SEQ ID NO: 468946 - RNA, 21 nt, Homo sapiens
ccaggguuccagacagggugg

SEQ ID NO: 468947 - RNA, 12 nt, Homo sapiens
ccagucccucag

SEQ ID NO: 468948 - RNA, 16 nt, Homo sapiens
ccagucccucagccac

SEQ ID NO: 468949 - RNA, 16 nt, Homo sapiens
ccauagacacaguauu

SEQ ID NO: 468950 - RNA, 20 nt, Homo sapiens
ccauccaauggauugugcaa

SEQ ID NO: 468951 - RNA, 14 nt, Homo sapiens
ccauccauauacuu

SEQ ID NO: 468952 - RNA, 15 nt, Homo sapiens
ccauccuucccgcag

SEQ ID NO: 468953 - RNA, 17 nt, Homo sapiens
ccaucuuaaauuucuaa

SEQ ID NO: 468954 - RNA, 15 nt, Homo sapiens
ccauggccccagcug

SEQ ID NO: 468955 - RNA, 20 nt, Homo sapiens
ccaugggggcuccagacauu

SEQ ID NO: 468956 - RNA, 18 nt, Homo sapiens
cuaugccuguauuuccaa

SEQ ID NO: 468957 - RNA, 14 nt, Homo sapiens
cuaugcugcaauac

SEQ ID NO: 468958 - RNA, 12 nt, Homo sapiens
cuaugucuguga

SEQ ID NO: 468959 - RNA, 12 nt, Homo sapiens
cuaugugcaacu

SEQ ID NO: 468960 - RNA, 19 nt, Homo sapiens
cuauuacugaugugugcaa

SEQ ID NO: 468961 - RNA, 15 nt, Homo sapiens
cuauuaucuggguuu

SEQ ID NO: 468962 - RNA, 12 nt, Homo sapiens
cuauucauuaca

SEQ ID NO: 468963 - RNA, 21 nt, Homo sapiens
cucaaagaggccaguacuuug

SEQ ID NO: 468964 - RNA, 18 nt, Homo sapiens
cucaaaugcuacucagua

SEQ ID NO: 468965 - RNA, 22 nt, Homo sapiens
cucaauaaaggucauauuggaa

SEQ ID NO: 468966 - RNA, 12 nt, Homo sapiens
cucacauucaca

SEQ ID NO: 468967 - RNA, 20 nt, Homo sapiens
cucaccuucccuaguucuuu

SEQ ID NO: 468968 - RNA, 22 nt, Homo sapiens
cucacgggugcaugaaaccacu

SEQ ID NO: 468969 - RNA, 12 nt, Homo sapiens
cucacuggagau

SEQ ID NO: 468970 - RNA, 15 nt, Homo sapiens
cucacuggugcauuu

SEQ ID NO: 468971 - RNA, 18 nt, Homo sapiens
cucagaagucaguugcaa

SEQ ID NO: 468972 - RNA, 13 nt, Homo sapiens
cucagaugaucuc

SEQ ID NO: 468973 - RNA, 22 nt, Homo sapiens
cucagggaucucagaccuagug

SEQ ID NO: 468974 - RNA, 18 nt, Homo sapiens
cucaguuucucuggagac

SEQ ID NO: 468975 - RNA, 18 nt, Homo sapiens
cucaugcauagacaagug

SEQ ID NO: 468976 - RNA, 12 nt, Homo sapiens
cuccacuccucc

SEQ ID NO: 468977 - RNA, 15 nt, Homo sapiens
ccugagaagagucga

SEQ ID NO: 468978 - RNA, 16 nt, Homo sapiens
ccugagccugucucuc

SEQ ID NO: 468979 - RNA, 13 nt, Homo sapiens
ccugaugcaaggg

SEQ ID NO: 468980 - RNA, 14 nt, Homo sapiens
ccugcccuccccca

SEQ ID NO: 468981 - RNA, 16 nt, Homo sapiens
ccugcuagcuguagaa

SEQ ID NO: 468982 - RNA, 21 nt, Homo sapiens
ccuggauuuucuuucuaugua

SEQ ID NO: 468983 - RNA, 16 nt, Homo sapiens
ccuggcacaccagaag

SEQ ID NO: 468984 - RNA, 21 nt, Homo sapiens
ccuggcgggcagccccugcug

SEQ ID NO: 468985 - RNA, 17 nt, Homo sapiens
ccugggcugucugucac

SEQ ID NO: 468986 - RNA, 14 nt, Homo sapiens
ccuguucacucuac

SEQ ID NO: 468987 - RNA, 15 nt, Homo sapiens
ccuguuccugccaca

SEQ ID NO: 468988 - RNA, 22 nt, Homo sapiens
ccuucccgcagcaccagccuga

SEQ ID NO: 468989 - RNA, 20 nt, Homo sapiens
ccuuccuucuugcuucucau

SEQ ID NO: 468990 - RNA, 17 nt, Homo sapiens
ccuucgccuuugcugaa

SEQ ID NO: 468991 - RNA, 20 nt, Homo sapiens
ccuugcccaaccaaugcaca

SEQ ID NO: 468992 - RNA, 15 nt, Homo sapiens
ccuuguaaaagccua

SEQ ID NO: 468993 - RNA, 19 nt, Homo sapiens
ccuuguugaugaagcacau

SEQ ID NO: 468994 - RNA, 19 nt, Homo sapiens
ccuuuccaaauaagugcau

SEQ ID NO: 468995 - RNA, 17 nt, Homo sapiens
ccuuugauguggaugaa

SEQ ID NO: 468996 - RNA, 14 nt, Homo sapiens
ccuuuuauguguug

SEQ ID NO: 468997 - RNA, 18 nt, Homo sapiens
cgaauuucucacucccuu

SEQ ID NO: 468998 - RNA, 14 nt, Homo sapiens
cgagucucuucucc

SEQ ID NO: 468999 - RNA, 15 nt, Homo sapiens
cgauccguuugcaag

SEQ ID NO: 469000 - RNA, 16 nt, Homo sapiens
cgcacuuuccacugga

SEQ ID NO: 469001 - RNA, 13 nt, Homo sapiens
cgcgcaccgccca

SEQ ID NO: 469002 - RNA, 15 nt, Homo sapiens
cgcuaauguacuacg

SEQ ID NO: 469003 - RNA, 19 nt, Homo sapiens
cgcucccgcgggaagccag

SEQ ID NO: 469004 - RNA, 17 nt, Homo sapiens
cgcugcucagaccugug

SEQ ID NO: 469005 - RNA, 17 nt, Homo sapiens
cgcuuucccaucuuaaa

SEQ ID NO: 469006 - RNA, 15 nt, Homo sapiens
cggaaguggccugag

SEQ ID NO: 469007 - RNA, 14 nt, Homo sapiens
cgggccuccccggg

SEQ ID NO: 469008 - RNA, 21 nt, Homo sapiens
cgggccuggagaacuagagaa

SEQ ID NO: 469009 - RNA, 9 nt, Homo sapiens
cgucuuccc

SEQ ID NO: 469010 - RNA, 17 nt, Homo sapiens
cgugccuuccccgugcg

SEQ ID NO: 469011 - RNA, 15 nt, Homo sapiens
cgugggauccagaga

SEQ ID NO: 469012 - RNA, 20 nt, Homo sapiens
cguguucacacacacacaau

SEQ ID NO: 469013 - RNA, 15 nt, Homo sapiens
cguucuugccagcuu

SEQ ID NO: 469014 - RNA, 18 nt, Homo sapiens
cuaaacuccuuuccugca

SEQ ID NO: 469015 - RNA, 15 nt, Homo sapiens
cuaaaucacuuugag

SEQ ID NO: 469016 - RNA, 19 nt, Homo sapiens
cuaacaaguagcacacuga

SEQ ID NO: 469017 - RNA, 21 nt, Homo sapiens
cuaaccuggguuguugcagag

SEQ ID NO: 469018 - RNA, 17 nt, Homo sapiens
cuaagcaaguauauuua

SEQ ID NO: 469019 - RNA, 22 nt, Homo sapiens
cuaauccugaagggaagcccau

SEQ ID NO: 469020 - RNA, 20 nt, Homo sapiens
cuacagagagugaauacacu

SEQ ID NO: 469021 - RNA, 23 nt, Homo sapiens
cuaccgagucucuucuccacugg

SEQ ID NO: 469022 - RNA, 17 nt, Homo sapiens
caugaagauaaauccaa

SEQ ID NO: 469023 - RNA, 12 nt, Homo sapiens
caugaagcacau

SEQ ID NO: 469024 - RNA, 14 nt, Homo sapiens
caugaguucaaaua

SEQ ID NO: 469025 - RNA, 18 nt, Homo sapiens
caugcacacccauucaca

SEQ ID NO: 469026 - RNA, 12 nt, Homo sapiens
caugcauaacac

SEQ ID NO: 469027 - RNA, 18 nt, Homo sapiens
cauggaugauucuuuucc

SEQ ID NO: 469028 - RNA, 21 nt, Homo sapiens
cauguagaauuauaacuaauu

SEQ ID NO: 469029 - RNA, 15 nt, Homo sapiens
cauguguugcaaauu

SEQ ID NO: 469030 - RNA, 18 nt, Homo sapiens
cauuaaccaagaaaacca

SEQ ID NO: 469031 - RNA, 15 nt, Homo sapiens
cauuauucuuucuaa

SEQ ID NO: 469032 - RNA, 21 nt, Homo sapiens
cauucuccuuguaaaagccua

SEQ ID NO: 469033 - RNA, 22 nt, Homo sapiens
cauuguauuuuacuuugugcaa

SEQ ID NO: 469034 - RNA, 14 nt, Homo sapiens
cauuuaggaaugaa

SEQ ID NO: 469035 - RNA, 14 nt, Homo sapiens
cauuuaucuacuau

SEQ ID NO: 469036 - RNA, 22 nt, Homo sapiens
cauuuauugccucuaugugcaa

SEQ ID NO: 469037 - RNA, 23 nt, Homo sapiens
cauuuauugccucuaugugcaac

SEQ ID NO: 469038 - RNA, 14 nt, Homo sapiens
cauuucaguguuuu

SEQ ID NO: 469039 - RNA, 19 nt, Homo sapiens
cauuuccugacagaaggac

SEQ ID NO: 469040 - RNA, 18 nt, Homo sapiens
cauuugauuugauauaca

SEQ ID NO: 469041 - RNA, 16 nt, Homo sapiens
ccaaacaugaauguac

SEQ ID NO: 469042 - RNA, 15 nt, Homo sapiens
ccaaagaaacucaga

SEQ ID NO: 469043 - RNA, 16 nt, Homo sapiens
ccaaaggaguggucaa

SEQ ID NO: 469044 - RNA, 19 nt, Homo sapiens
ccaagauuuuuuauuugag

SEQ ID NO: 469045 - RNA, 21 nt, Homo sapiens
ccaaguguacauuugauuuga

SEQ ID NO: 469046 - RNA, 17 nt, Homo sapiens
ccaagugugugugcaau

SEQ ID NO: 469047 - RNA, 15 nt, Homo sapiens
ccaaucaacagcaug

SEQ ID NO: 469048 - RNA, 17 nt, Homo sapiens
ccaccgcuggagcuccu

SEQ ID NO: 469049 - RNA, 16 nt, Homo sapiens
ccaccugcagccuguu

SEQ ID NO: 469050 - RNA, 17 nt, Homo sapiens
ccaccugugcugcugca

SEQ ID NO: 469051 - RNA, 19 nt, Homo sapiens
ccacuagguuucaccuccc

SEQ ID NO: 469052 - RNA, 12 nt, Homo sapiens
ccacucagggau

SEQ ID NO: 469053 - RNA, 10 nt, Homo sapiens
ccacucuguu

SEQ ID NO: 469054 - RNA, 22 nt, Homo sapiens
ccacucuguuccuacuggagau

SEQ ID NO: 469055 - RNA, 19 nt, Homo sapiens
ccacuuaugcugcugugaa

SEQ ID NO: 469056 - RNA, 17 nt, Homo sapiens
ccagagagagcucugca

SEQ ID NO: 469057 - RNA, 22 nt, Homo sapiens
ccagaggcucuaauguacaaua

SEQ ID NO: 469058 - RNA, 17 nt, Homo sapiens
ccagagggacuuugccu

SEQ ID NO: 469059 - RNA, 13 nt, Homo sapiens
ccagcaacgcuca

SEQ ID NO: 469060 - RNA, 12 nt, Homo sapiens
ccagcacccucu

SEQ ID NO: 469061 - RNA, 18 nt, Homo sapiens
ccagcauaguucugcaau

SEQ ID NO: 469062 - RNA, 19 nt, Homo sapiens
ccagccucuagaacagcca

SEQ ID NO: 469063 - RNA, 20 nt, Homo sapiens
ccagccucuagaacagccag

SEQ ID NO: 469064 - RNA, 21 nt, Homo sapiens
ccagccucuagaacagccaga

SEQ ID NO: 469065 - RNA, 14 nt, Homo sapiens
ccagcuaucuguca

SEQ ID NO: 469066 - RNA, 19 nt, Homo sapiens
ccagcuccuaguagcuuuc

SEQ ID NO: 469067 - RNA, 20 nt, Homo sapiens
aaaaauaaccaaaaaaugug

SEQ ID NO: 469068 - RNA, 13 nt, Homo sapiens
aaaaauaacugug

SEQ ID NO: 469069 - RNA, 15 nt, Homo sapiens
aaaaauaccauuuau

SEQ ID NO: 469070 - RNA, 14 nt, Homo sapiens
aaaaaugugagcua

SEQ ID NO: 469071 - RNA, 19 nt, Homo sapiens
aaaacauucuuuaacauac

SEQ ID NO: 469072 - RNA, 21 nt, Homo sapiens
aaaaguauuguggcaccucaa

SEQ ID NO: 469073 - RNA, 18 nt, Homo sapiens
aaaaguuuaaaaagcuca

SEQ ID NO: 469074 - RNA, 21 nt, Homo sapiens
aaaauaguaaaugcuuugugu

SEQ ID NO: 469075 - RNA, 11 nt, Homo sapiens
aaaaugcaugu

SEQ ID NO: 469076 - RNA, 17 nt, Homo sapiens
aaacaaauauuucacuu

SEQ ID NO: 469077 - RNA, 20 nt, Homo sapiens
aaacacagaacucagccuua

SEQ ID NO: 469078 - RNA, 14 nt, Homo sapiens
aaacacggcugaua

SEQ ID NO: 469079 - RNA, 17 nt, Homo sapiens
aaacacuugacuauaaa

SEQ ID NO: 469080 - RNA, 22 nt, Homo sapiens
aaacagcguaacggagggugaa

SEQ ID NO: 469081 - RNA, 22 nt, Homo sapiens
aaacaguguggcuuaaacauuu

SEQ ID NO: 469082 - RNA, 15 nt, Homo sapiens
aaacauucuuuaaca

SEQ ID NO: 469083 - RNA, 16 nt, Homo sapiens
aaaccaagugcuuaua

SEQ ID NO: 469084 - RNA, 18 nt, Homo sapiens
aaaccaagugcuuauaaa

SEQ ID NO: 469085 - RNA, 18 nt, Homo sapiens
aaaccaucaaaaauauuc

SEQ ID NO: 469086 - RNA, 16 nt, Homo sapiens
aaacccagccucuaga

SEQ ID NO: 469087 - RNA, 19 nt, Homo sapiens
aaacccuacgaaagcacag

SEQ ID NO: 469088 - RNA, 15 nt, Homo sapiens
aaaccugugcuuuca

SEQ ID NO: 469089 - RNA, 15 nt, Homo sapiens
aaacgagauuugcca

SEQ ID NO: 469090 - RNA, 17 nt, Homo sapiens
aaacuggauuaucuacu

SEQ ID NO: 469091 - RNA, 18 nt, Homo sapiens
aaacuggauuaucuacua

SEQ ID NO: 469092 - RNA, 15 nt, Homo sapiens
aaacuuguacuuaca

SEQ ID NO: 469093 - RNA, 19 nt, Homo sapiens
aaacuuguacuuacacuga

SEQ ID NO: 469094 - RNA, 18 nt, Homo sapiens
aaagacaccuacugagug

SEQ ID NO: 469095 - RNA, 14 nt, Homo sapiens
aaagacugucuuaa

SEQ ID NO: 469096 - RNA, 15 nt, Homo sapiens
aaagacugucuuaau

SEQ ID NO: 469097 - RNA, 18 nt, Homo sapiens
aaagcuauauaugaauaa

SEQ ID NO: 469098 - RNA, 15 nt, Homo sapiens
aaaggaaguggaaug

SEQ ID NO: 469099 - RNA, 16 nt, Homo sapiens
aaagggaaaacaaaua

SEQ ID NO: 469100 - RNA, 19 nt, Homo sapiens
aaaguuuaaaaagcucaca

SEQ ID NO: 469101 - RNA, 22 nt, Homo sapiens
aaaguuuuauuuguuuacuuua

SEQ ID NO: 469102 - RNA, 16 nt, Homo sapiens
aaauaaagaguucucc

SEQ ID NO: 469103 - RNA, 20 nt, Homo sapiens
aaauaaucacaaaaucacaa

SEQ ID NO: 469104 - RNA, 14 nt, Homo sapiens
acucuucaaggcca

SEQ ID NO: 469105 - RNA, 16 nt, Homo sapiens
acugcaugcaagcuca

SEQ ID NO: 469106 - RNA, 17 nt, Homo sapiens
acugcaugcaagcucag

SEQ ID NO: 469107 - RNA, 19 nt, Homo sapiens
acugccuuacagacagaau

SEQ ID NO: 469108 - RNA, 20 nt, Homo sapiens
acuggaaauaaccugugaau

SEQ ID NO: 469109 - RNA, 16 nt, Homo sapiens
acuggcccaccccucu

SEQ ID NO: 469110 - RNA, 14 nt, Homo sapiens
acuguaaaauacau

SEQ ID NO: 469111 - RNA, 16 nt, Homo sapiens
acuguauaaguaacac

SEQ ID NO: 469112 - RNA, 20 nt, Homo sapiens
acuguauaguuuaaagggag

SEQ ID NO: 469113 - RNA, 18 nt, Homo sapiens
acugucuucaacccugcc

SEQ ID NO: 469114 - RNA, 19 nt, Homo sapiens
acuuaaaccugugcuuuca

SEQ ID NO: 469115 - RNA, 23 nt, Homo sapiens
acuuagaaauugcauuuccugac

SEQ ID NO: 469116 - RNA, 17 nt, Homo sapiens
acuuauuucagauucac

SEQ ID NO: 469117 - RNA, 14 nt, Homo sapiens
acuugacuuugcca

SEQ ID NO: 469118 - RNA, 13 nt, Homo sapiens
acuuuccucucuc

SEQ ID NO: 469119 - RNA, 15 nt, Homo sapiens
acuuugccacuggau

SEQ ID NO: 469120 - RNA, 16 nt, Homo sapiens
acuuugugcaauauga

SEQ ID NO: 469121 - RNA, 23 nt, Homo sapiens
acuuuuucugucuuuauguaaga

SEQ ID NO: 469122 - RNA, 20 nt, Homo sapiens
agaaaacaggcucacagaga

SEQ ID NO: 469123 - RNA, 21 nt, Homo sapiens
agaaacaagguguacaacuuc

SEQ ID NO: 469124 - RNA, 14 nt, Homo sapiens
agaaacugcuuaga

SEQ ID NO: 469125 - RNA, 17 nt, Homo sapiens
agaagaaacugcuuaga

SEQ ID NO: 469126 - RNA, 21 nt, Homo sapiens
agaagaguagauaagugcuca

SEQ ID NO: 469127 - RNA, 21 nt, Homo sapiens
agaagagucccggagcucaag

SEQ ID NO: 469128 - RNA, 17 nt, Homo sapiens
agaaucacuugacuuug

SEQ ID NO: 469129 - RNA, 21 nt, Homo sapiens
agaaucacuugacuuugccac

SEQ ID NO: 469130 - RNA, 23 nt, Homo sapiens
agaaucacuugacuuugccacau

SEQ ID NO: 469131 - RNA, 21 nt, Homo sapiens
agaauggggcuuccauggugg

SEQ ID NO: 469132 - RNA, 13 nt, Homo sapiens
agaauggugggcu

SEQ ID NO: 469133 - RNA, 23 nt, Homo sapiens
agaauugcuccugcaugcaacua

SEQ ID NO: 469134 - RNA, 14 nt, Homo sapiens
agacaguaaagacc

SEQ ID NO: 469135 - RNA, 23 nt, Homo sapiens
agaccaguucuuggccuaugaua

SEQ ID NO: 469136 - RNA, 17 nt, Homo sapiens
agacuacuaaugacuuu

SEQ ID NO: 469137 - RNA, 18 nt, Homo sapiens
agacugucuuaauuugca

SEQ ID NO: 469138 - RNA, 19 nt, Homo sapiens
agacugucuuaauuugcau

SEQ ID NO: 469139 - RNA, 17 nt, Homo sapiens
agacuuaaaucacagau

SEQ ID NO: 469140 - RNA, 13 nt, Homo sapiens
agagaccucaggg

SEQ ID NO: 469141 - RNA, 14 nt, Homo sapiens
agagcucaggagaa

SEQ ID NO: 469142 - RNA, 13 nt, Homo sapiens
agagggggccaga

SEQ ID NO: 469143 - RNA, 17 nt, Homo sapiens
agagguucugugcaaaa

SEQ ID NO: 469144 - RNA, 18 nt, Homo sapiens
agagucuuugauucacca

SEQ ID NO: 469145 - RNA, 20 nt, Homo sapiens
agagucuuugauucaccaaa

SEQ ID NO: 469146 - RNA, 22 nt, Homo sapiens
agagucuuugauucaccaaaca

SEQ ID NO: 469147 - RNA, 18 nt, Homo sapiens
agagugaauacacuggaa

SEQ ID NO: 469148 - RNA, 19 nt, Homo sapiens
agagugaauacacuggaau

SEQ ID NO: 469149 - RNA, 12 nt, Homo sapiens
agauaaauccaa

SEQ ID NO: 469150 - RNA, 20 nt, Homo sapiens
agaugagaaaacaggcucac

SEQ ID NO: 469151 - RNA, 20 nt, Homo sapiens
agaugcugacuguacuccuc

SEQ ID NO: 469152 - RNA, 22 nt, Homo sapiens
agauggguauuaaacuugucag

SEQ ID NO: 469153 - RNA, 19 nt, Homo sapiens
agaugucuuaaccuauucc

SEQ ID NO: 469154 - RNA, 22 nt, Homo sapiens
agaugucuuaaccuauucccaa

SEQ ID NO: 469155 - RNA, 21 nt, Homo sapiens
agauguuuguuuucaaaauac

SEQ ID NO: 469156 - RNA, 14 nt, Homo sapiens
agauucaccuccau

SEQ ID NO: 469157 - RNA, 21 nt, Homo sapiens
agauuucccuaaaaauuccac

SEQ ID NO: 469158 - RNA, 17 nt, Homo sapiens
agauuuuucucaucucc

SEQ ID NO: 469159 - RNA, 14 nt, Homo sapiens
agcaaaaaacugca

SEQ ID NO: 469160 - RNA, 13 nt, Homo sapiens
agcaacuguaaaa

SEQ ID NO: 469161 - RNA, 22 nt, Homo sapiens
agcaguuugcuuuguaugcacu

SEQ ID NO: 469162 - RNA, 17 nt, Homo sapiens
agcauaguucugcaaua

SEQ ID NO: 469163 - RNA, 17 nt, Homo sapiens
agcauuuaggaaugaag

SEQ ID NO: 469164 - RNA, 13 nt, Homo sapiens
agccacagugggg

SEQ ID NO: 469165 - RNA, 21 nt, Homo sapiens
agccacaguggggcccauggc

SEQ ID NO: 469166 - RNA, 14 nt, Homo sapiens
agccagucccucag

SEQ ID NO: 469167 - RNA, 15 nt, Homo sapiens
agccauaugacaauu

SEQ ID NO: 469168 - RNA, 22 nt, Homo sapiens
agcccacccgccccagagacug

SEQ ID NO: 469169 - RNA, 18 nt, Homo sapiens
agcccucuccacccagag

SEQ ID NO: 469170 - RNA, 22 nt, Homo sapiens
agcccucuuucucucugugugg

SEQ ID NO: 469171 - RNA, 17 nt, Homo sapiens
agccucuagaacagcca

SEQ ID NO: 469172 - RNA, 17 nt, Homo sapiens
agccugucucucccuac

SEQ ID NO: 469173 - RNA, 20 nt, Homo sapiens
agccugugaauaaaaacccu

SEQ ID NO: 469174 - RNA, 18 nt, Homo sapiens
agcgaauucccugagaua

SEQ ID NO: 469175 - RNA, 21 nt, Homo sapiens
agcgugcaguagagagcaaag

SEQ ID NO: 469176 - RNA, 17 nt, Homo sapiens
agcuaacaaguagcaca

SEQ ID NO: 469177 - RNA, 16 nt, Homo sapiens
agcuaucugucaucuc

SEQ ID NO: 469178 - RNA, 13 nt, Homo sapiens
agcuccacucuga

SEQ ID NO: 469179 - RNA, 17 nt, Homo sapiens
agcuccuaguagcuuuc

SEQ ID NO: 469180 - RNA, 22 nt, Homo sapiens
agcucucugagccagucccuca

SEQ ID NO: 469181 - RNA, 14 nt, Homo sapiens
agcuguuucuugau

SEQ ID NO: 469182 - RNA, 18 nt, Homo sapiens
agcuguuuugaauaacau

SEQ ID NO: 469183 - RNA, 23 nt, Homo sapiens
agcuuauguagcugaaugugaua

SEQ ID NO: 469184 - RNA, 15 nt, Homo sapiens
agcuugaaaacugga

SEQ ID NO: 469185 - RNA, 17 nt, Homo sapiens
agcuugacuucaugcca

SEQ ID NO: 469186 - RNA, 15 nt, Homo sapiens
agcuuggagggaugg

SEQ ID NO: 469187 - RNA, 18 nt, Homo sapiens
agcuuguuucuauacugu

SEQ ID NO: 469188 - RNA, 22 nt, Homo sapiens
aggaaacuguuguguccaaucc

SEQ ID NO: 469189 - RNA, 14 nt, Homo sapiens
aggaaagaucccaa

SEQ ID NO: 469190 - RNA, 20 nt, Homo sapiens
aggaacauccggaacagcca

SEQ ID NO: 469191 - RNA, 18 nt, Homo sapiens
aggaacuuuuaaacugca

SEQ ID NO: 469192 - RNA, 16 nt, Homo sapiens
aggaauauacauaguc

SEQ ID NO: 469193 - RNA, 17 nt, Homo sapiens
aggaauauacauagucu

SEQ ID NO: 469194 - RNA, 22 nt, Homo sapiens
aggauaucccuuccuacaguaa

SEQ ID NO: 469195 - RNA, 22 nt, Homo sapiens
aggaucuucccacuuugccacu

SEQ ID NO: 469196 - RNA, 14 nt, Homo sapiens
aggcccacucuguu

SEQ ID NO: 469197 - RNA, 10 nt, Homo sapiens
aggcccuccc

SEQ ID NO: 469198 - RNA, 22 nt, Homo sapiens
aggcccuuccucuccacugccu

SEQ ID NO: 469199 - RNA, 20 nt, Homo sapiens
aggcgauggacaauuaugau

SEQ ID NO: 469200 - RNA, 12 nt, Homo sapiens
aggcggagcgcc

SEQ ID NO: 469201 - RNA, 13 nt, Homo sapiens
cacaauauuccua

SEQ ID NO: 469202 - RNA, 21 nt, Homo sapiens
cacaccucccacccccuguau

SEQ ID NO: 469203 - RNA, 20 nt, Homo sapiens
cacaccuugcccaugcacaa

SEQ ID NO: 469204 - RNA, 15 nt, Homo sapiens
cacagcaguacuugc

SEQ ID NO: 469205 - RNA, 19 nt, Homo sapiens
cacaggggccccuccucua

SEQ ID NO: 469206 - RNA, 15 nt, Homo sapiens
cacagugcaucucag

SEQ ID NO: 469207 - RNA, 12 nt, Homo sapiens
cacaguuugcaa

SEQ ID NO: 469208 - RNA, 21 nt, Homo sapiens
cacauguccuauuacugaugu

SEQ ID NO: 469209 - RNA, 16 nt, Homo sapiens
cacccagaggucuccc

SEQ ID NO: 469210 - RNA, 14 nt, Homo sapiens
caccccucaagcca

SEQ ID NO: 469211 - RNA, 18 nt, Homo sapiens
caccuacgggggcaucug

SEQ ID NO: 469212 - RNA, 19 nt, Homo sapiens
caccuccauuaaccaagaa

SEQ ID NO: 469213 - RNA, 14 nt, Homo sapiens
caccuccugcaaua

SEQ ID NO: 469214 - RNA, 21 nt, Homo sapiens
caccuucgccuuugcugaagu

SEQ ID NO: 469215 - RNA, 19 nt, Homo sapiens
cacggcugauaucuuugag

SEQ ID NO: 469216 - RNA, 15 nt, Homo sapiens
cacuaaguaaccucu

SEQ ID NO: 469217 - RNA, 21 nt, Homo sapiens
cacuaaguaaccucuacaggc

SEQ ID NO: 469218 - RNA, 16 nt, Homo sapiens
cacuagguuucaccuc

SEQ ID NO: 469219 - RNA, 17 nt, Homo sapiens
cacuagguuucaccucc

SEQ ID NO: 469220 - RNA, 20 nt, Homo sapiens
cacugcacagugcaucucag

SEQ ID NO: 469221 - RNA, 16 nt, Homo sapiens
cacuuugccacuggau

SEQ ID NO: 469222 - RNA, 16 nt, Homo sapiens
cagaaaaaaggacugu

SEQ ID NO: 469223 - RNA, 19 nt, Homo sapiens
cagaaaaaaggacuguaua

SEQ ID NO: 469224 - RNA, 14 nt, Homo sapiens
cagaacuccuuucu

SEQ ID NO: 469225 - RNA, 14 nt, Homo sapiens
cagaggcucuaaug

SEQ ID NO: 469226 - RNA, 18 nt, Homo sapiens
cagaggcucuaauguaca

SEQ ID NO: 469227 - RNA, 20 nt, Homo sapiens
cagaggcucuaauguacaau

SEQ ID NO: 469228 - RNA, 22 nt, Homo sapiens
cagaggcucuaauguacaauaa

SEQ ID NO: 469229 - RNA, 14 nt, Homo sapiens
cagaugaucucucc

SEQ ID NO: 469230 - RNA, 11 nt, Homo sapiens
cagauuccaca

SEQ ID NO: 469231 - RNA, 15 nt, Homo sapiens
cagcaccagccugag

SEQ ID NO: 469232 - RNA, 12 nt, Homo sapiens
cagcauagagcu

SEQ ID NO: 469233 - RNA, 19 nt, Homo sapiens
cagccccuccccauggugc

SEQ ID NO: 469234 - RNA, 20 nt, Homo sapiens
cagccucuagaacagccaga

SEQ ID NO: 469235 - RNA, 20 nt, Homo sapiens
cagcuaucugucaucucucu

SEQ ID NO: 469236 - RNA, 21 nt, Homo sapiens
caggaaagaucccaagucaaa

SEQ ID NO: 469237 - RNA, 12 nt, Homo sapiens
caggaugggaag

SEQ ID NO: 469238 - RNA, 11 nt, Homo sapiens
caggcauuuaa

SEQ ID NO: 469239 - RNA, 21 nt, Homo sapiens
caggcccuuccucuccacugc

SEQ ID NO: 469240 - RNA, 14 nt, Homo sapiens
caggcgauggacaa

SEQ ID NO: 469241 - RNA, 16 nt, Homo sapiens
cagggcgagcacuuuc

SEQ ID NO: 469242 - RNA, 17 nt, Homo sapiens
cagggcgcuccggcaga

SEQ ID NO: 469243 - RNA, 22 nt, Homo sapiens
caggguauaccucuaauaaccu

SEQ ID NO: 469244 - RNA, 23 nt, Homo sapiens
caggguuuacccagugggacaga

SEQ ID NO: 469245 - RNA, 21 nt, Homo sapiens
caguaaagaccauuuaguccu

SEQ ID NO: 469246 - RNA, 18 nt, Homo sapiens
caguauuaacaucaaaga

SEQ ID NO: 469247 - RNA, 20 nt, Homo sapiens
caguggagaggggacuugga

SEQ ID NO: 469248 - RNA, 15 nt, Homo sapiens
cagugggggugccug

SEQ ID NO: 469249 - RNA, 15 nt, Homo sapiens
caguuaauucuugcc

SEQ ID NO: 469250 - RNA, 16 nt, Homo sapiens
caguuuaauauuccaa

SEQ ID NO: 469251 - RNA, 16 nt, Homo sapiens
cauaaugucauacgaa

SEQ ID NO: 469252 - RNA, 18 nt, Homo sapiens
cauacagaguguccugau

SEQ ID NO: 469253 - RNA, 15 nt, Homo sapiens
cauaccaagugcuuu

SEQ ID NO: 469254 - RNA, 18 nt, Homo sapiens
cauagccauucauuuaca

SEQ ID NO: 469255 - RNA, 14 nt, Homo sapiens
cauauaauuugcca

SEQ ID NO: 469256 - RNA, 19 nt, Homo sapiens
cauaucagcucugcauaag

SEQ ID NO: 469257 - RNA, 11 nt, Homo sapiens
cauauguuaau

SEQ ID NO: 469258 - RNA, 15 nt, Homo sapiens
caucauuugcauaug

SEQ ID NO: 469259 - RNA, 20 nt, Homo sapiens
cauccauagacacaguauug

SEQ ID NO: 469260 - RNA, 20 nt, Homo sapiens
caucuaagucaguuucacau

SEQ ID NO: 469261 - RNA, 18 nt, Homo sapiens
caucucuccccauauaua

SEQ ID NO: 469262 - RNA, 21 nt, Homo sapiens
caucugaaaagaaaugcuaau

SEQ ID NO: 469263 - RNA, 14 nt, Homo sapiens
caucuggagucuuc

SEQ ID NO: 469264 - RNA, 13 nt, Homo sapiens
caugggguuuugg

SEQ ID NO: 469265 - RNA, 15 nt, Homo sapiens
cauggugcagugaag

SEQ ID NO: 469266 - RNA, 17 nt, Homo sapiens
caugguuuaaagucaca

SEQ ID NO: 469267 - RNA, 14 nt, Homo sapiens
cauguagcauauaa

SEQ ID NO: 469268 - RNA, 16 nt, Homo sapiens
caugucucuuugccaa

SEQ ID NO: 469269 - RNA, 21 nt, Homo sapiens
caugugauuggcagcuucaaa

SEQ ID NO: 469270 - RNA, 12 nt, Homo sapiens
caugugcugcag

SEQ ID NO: 469271 - RNA, 18 nt, Homo sapiens
caugugugcaucaugucu

SEQ ID NO: 469272 - RNA, 23 nt, Homo sapiens
cauguugacauaugucuaugucc

SEQ ID NO: 469273 - RNA, 15 nt, Homo sapiens
cauuaaacacuguaa

SEQ ID NO: 469274 - RNA, 20 nt, Homo sapiens
cauuauccuuuuaucucaca

SEQ ID NO: 469275 - RNA, 22 nt, Homo sapiens
cauuauccuuuuaucucacaaa

SEQ ID NO: 469276 - RNA, 15 nt, Homo sapiens
cauucaaaauaguuc

SEQ ID NO: 469277 - RNA, 21 nt, Homo sapiens
cauucccagaauuugcugcau

SEQ ID NO: 469278 - RNA, 23 nt, Homo sapiens
cauucguccuuagaauacuguau

SEQ ID NO: 469279 - RNA, 20 nt, Homo sapiens
cauuugggauuuucuuugcc

SEQ ID NO: 469280 - RNA, 18 nt, Homo sapiens
ccaaaauguggaaugcau

SEQ ID NO: 469281 - RNA, 11 nt, Homo sapiens
ccaaacccagc

SEQ ID NO: 469282 - RNA, 16 nt, Homo sapiens
ccaaauaaaacuugag

SEQ ID NO: 469283 - RNA, 14 nt, Homo sapiens
ccaaauaagugcau

SEQ ID NO: 469284 - RNA, 15 nt, Homo sapiens
ccaaaugcaauguga

SEQ ID NO: 469285 - RNA, 14 nt, Homo sapiens
ccaacguacuccuc

SEQ ID NO: 469286 - RNA, 21 nt, Homo sapiens
ccaacugagccaaaaacaaua

SEQ ID NO: 469287 - RNA, 17 nt, Homo sapiens
ccaagauuuuuuauuug

SEQ ID NO: 469288 - RNA, 18 nt, Homo sapiens
ccaagugugugugcaaug

SEQ ID NO: 469289 - RNA, 19 nt, Homo sapiens
ccaaucccaccaacccuca

SEQ ID NO: 469290 - RNA, 21 nt, Homo sapiens
ccacaauaagccacugguauc

SEQ ID NO: 469291 - RNA, 18 nt, Homo sapiens
ccacacguaaacacuuga

SEQ ID NO: 469292 - RNA, 16 nt, Homo sapiens
ccacccagaggucucc

SEQ ID NO: 469293 - RNA, 14 nt, Homo sapiens
ccacccauaccagc

SEQ ID NO: 469294 - RNA, 17 nt, Homo sapiens
ccaccccuaaagagaua

SEQ ID NO: 469295 - RNA, 19 nt, Homo sapiens
ccacgcagagccccggagc

SEQ ID NO: 469296 - RNA, 11 nt, Homo sapiens
ccacucaggga

SEQ ID NO: 469297 - RNA, 16 nt, Homo sapiens
ccacugaauuaugcca

SEQ ID NO: 469298 - RNA, 19 nt, Homo sapiens
ccacuuagaaauugcauuu

SEQ ID NO: 469299 - RNA, 13 nt, Homo sapiens
aaacugaagccca

SEQ ID NO: 469300 - RNA, 22 nt, Homo sapiens
aaacuuguguucaaucugugaa

SEQ ID NO: 469301 - RNA, 17 nt, Homo sapiens
aaacuuucaccucagau

SEQ ID NO: 469302 - RNA, 20 nt, Homo sapiens
aaagaaaacuuguguucaau

SEQ ID NO: 469303 - RNA, 17 nt, Homo sapiens
aaagacaguaaagacca

SEQ ID NO: 469304 - RNA, 20 nt, Homo sapiens
aaagcuuuggugccuggaaa

SEQ ID NO: 469305 - RNA, 14 nt, Homo sapiens
aaaggaaaguucua

SEQ ID NO: 469306 - RNA, 15 nt, Homo sapiens
aaaggaguggucaag

SEQ ID NO: 469307 - RNA, 20 nt, Homo sapiens
aaaggcuggaugugcuuuca

SEQ ID NO: 469308 - RNA, 20 nt, Homo sapiens
aaaguauuguggcaccucaa

SEQ ID NO: 469309 - RNA, 19 nt, Homo sapiens
aaauacuucuuuuucauua

SEQ ID NO: 469310 - RNA, 18 nt, Homo sapiens
aaauaugauucuccucuc

SEQ ID NO: 469311 - RNA, 22 nt, Homo sapiens
aaauaugauucuccucucccaa

SEQ ID NO: 469312 - RNA, 15 nt, Homo sapiens
aaaugcaaauauugc

SEQ ID NO: 469313 - RNA, 13 nt, Homo sapiens
aaaugcuacucag

SEQ ID NO: 469314 - RNA, 16 nt, Homo sapiens
aaauuacaauugucau

SEQ ID NO: 469315 - RNA, 18 nt, Homo sapiens
aaauuauucuagucaacu

SEQ ID NO: 469316 - RNA, 13 nt, Homo sapiens
aaauuggcuccuu

SEQ ID NO: 469317 - RNA, 16 nt, Homo sapiens
aaauuuguaugcucaa

SEQ ID NO: 469318 - RNA, 13 nt, Homo sapiens
aaauuuuuacuca

SEQ ID NO: 469319 - RNA, 23 nt, Homo sapiens
aaauuuuuacucaggcuuucuau

SEQ ID NO: 469320 - RNA, 19 nt, Homo sapiens
aacaacuuaauguucugaa

SEQ ID NO: 469321 - RNA, 22 nt, Homo sapiens
aacaauaaacgaaacacagaac

SEQ ID NO: 469322 - RNA, 21 nt, Homo sapiens
aacaaugccuuguuguauucc

SEQ ID NO: 469323 - RNA, 22 nt, Homo sapiens
aacaaugccuuguuguauuccu

SEQ ID NO: 469324 - RNA, 13 nt, Homo sapiens
aacacaaauccaa

SEQ ID NO: 469325 - RNA, 14 nt, Homo sapiens
aacacaauuuucac

SEQ ID NO: 469326 - RNA, 13 nt, Homo sapiens
aacacaccuugcc

SEQ ID NO: 469327 - RNA, 19 nt, Homo sapiens
aacaguguugaaauuggaa

SEQ ID NO: 469328 - RNA, 18 nt, Homo sapiens
aacauaggugcucuuccu

SEQ ID NO: 469329 - RNA, 20 nt, Homo sapiens
aacaucaacuuuuuucuuuc

SEQ ID NO: 469330 - RNA, 18 nt, Homo sapiens
aacauuaaacacuguaau

SEQ ID NO: 469331 - RNA, 20 nt, Homo sapiens
aacauuuuguuauugggcaa

SEQ ID NO: 469332 - RNA, 16 nt, Homo sapiens
aaccaacgggucugug

SEQ ID NO: 469333 - RNA, 15 nt, Homo sapiens
aaccaagugcuuaua

SEQ ID NO: 469334 - RNA, 17 nt, Homo sapiens
aacccugcccugcaccu

SEQ ID NO: 469335 - RNA, 19 nt, Homo sapiens
aaccugguggcaccagaug

SEQ ID NO: 469336 - RNA, 20 nt, Homo sapiens
aaccugugcuuucauguuua

SEQ ID NO: 469337 - RNA, 21 nt, Homo sapiens
aacgggucugugggacuggcc

SEQ ID NO: 469338 - RNA, 14 nt, Homo sapiens
aacuaacaaugccu

SEQ ID NO: 469339 - RNA, 13 nt, Homo sapiens
aacucagccuuaa

SEQ ID NO: 469340 - RNA, 14 nt, Homo sapiens
aacugaagcccaca

SEQ ID NO: 469341 - RNA, 14 nt, Homo sapiens
aacugagccaaaaa

SEQ ID NO: 469342 - RNA, 18 nt, Homo sapiens
aacugauuuaugaucacu

SEQ ID NO: 469343 - RNA, 21 nt, Homo sapiens
aacugggaaauaagcaaaaaa

SEQ ID NO: 469344 - RNA, 18 nt, Homo sapiens
aacugucuugugagcuga

SEQ ID NO: 469345 - RNA, 19 nt, Homo sapiens
aacuguuguguccaauccc

SEQ ID NO: 469346 - RNA, 23 nt, Homo sapiens
aagaaauggcuuuccacaucccc

SEQ ID NO: 469347 - RNA, 18 nt, Homo sapiens
aagaagaaacugcuuaga

SEQ ID NO: 469348 - RNA, 21 nt, Homo sapiens
aagacaaauugaucagugcuu

SEQ ID NO: 469349 - RNA, 16 nt, Homo sapiens
aagacacguucuugcc

SEQ ID NO: 469350 - RNA, 15 nt, Homo sapiens
aagaggaagugcacu

SEQ ID NO: 469351 - RNA, 12 nt, Homo sapiens
aagcaauguggu

SEQ ID NO: 469352 - RNA, 17 nt, Homo sapiens
aagcauuauccuuuuau

SEQ ID NO: 469353 - RNA, 16 nt, Homo sapiens
aagccacguugcagaa

SEQ ID NO: 469354 - RNA, 12 nt, Homo sapiens
aagccaggguuc

SEQ ID NO: 469355 - RNA, 18 nt, Homo sapiens
aagccaggguuccagaca

SEQ ID NO: 469356 - RNA, 16 nt, Homo sapiens
aaucucugcaggaugg

SEQ ID NO: 469357 - RNA, 18 nt, Homo sapiens
aaucuuuagaauaguuaa

SEQ ID NO: 469358 - RNA, 19 nt, Homo sapiens
aaugauacugaauuguuau

SEQ ID NO: 469359 - RNA, 15 nt, Homo sapiens
aaugauucaauguga

SEQ ID NO: 469360 - RNA, 13 nt, Homo sapiens
aaugcaugugauu

SEQ ID NO: 469361 - RNA, 14 nt, Homo sapiens
aauggggcuuccau

SEQ ID NO: 469362 - RNA, 13 nt, Homo sapiens
aauggucaaugcu

SEQ ID NO: 469363 - RNA, 13 nt, Homo sapiens
aaugucuguuuca

SEQ ID NO: 469364 - RNA, 12 nt, Homo sapiens
aaugugccaaaa

SEQ ID NO: 469365 - RNA, 16 nt, Homo sapiens
aauguuauagguuugu

SEQ ID NO: 469366 - RNA, 18 nt, Homo sapiens
aauguuccguucaucuga

SEQ ID NO: 469367 - RNA, 15 nt, Homo sapiens
aauuauccacaugaa

SEQ ID NO: 469368 - RNA, 15 nt, Homo sapiens
aauuaugauagcuua

SEQ ID NO: 469369 - RNA, 23 nt, Homo sapiens
aauucaucuuucuaacucaagga

SEQ ID NO: 469370 - RNA, 21 nt, Homo sapiens
aauuccaccaggauuaaucuc

SEQ ID NO: 469371 - RNA, 19 nt, Homo sapiens
aauugcuucugugcaauaa

SEQ ID NO: 469372 - RNA, 18 nt, Homo sapiens
aauuuaaaaucagacucu

SEQ ID NO: 469373 - RNA, 15 nt, Homo sapiens
aauuuaacugcauau

SEQ ID NO: 469374 - RNA, 19 nt, Homo sapiens
aauuuaauauacugcauau

SEQ ID NO: 469375 - RNA, 19 nt, Homo sapiens
aauuucaaaaugcauguga

SEQ ID NO: 469376 - RNA, 15 nt, Homo sapiens
aauuucuuacuaaac

SEQ ID NO: 469377 - RNA, 14 nt, Homo sapiens
aauuucuuugucau

SEQ ID NO: 469378 - RNA, 18 nt, Homo sapiens
aauuuuuaacuuaucucc

SEQ ID NO: 469379 - RNA, 18 nt, Homo sapiens
acaaauaaguuacccuca

SEQ ID NO: 469380 - RNA, 13 nt, Homo sapiens
acaaccacuggga

SEQ ID NO: 469381 - RNA, 14 nt, Homo sapiens
acaacuuccagauu

SEQ ID NO: 469382 - RNA, 17 nt, Homo sapiens
acaagagacaugagauu

SEQ ID NO: 469383 - RNA, 22 nt, Homo sapiens
acaaggcgucucuucaaacagu

SEQ ID NO: 469384 - RNA, 23 nt, Homo sapiens
acaaguguuuauuaaaauacugu

SEQ ID NO: 469385 - RNA, 15 nt, Homo sapiens
acaauaaaagagcuu

SEQ ID NO: 469386 - RNA, 18 nt, Homo sapiens
acaauaaacgaaacacag

SEQ ID NO: 469387 - RNA, 17 nt, Homo sapiens
acaauaaagcaaugugg

SEQ ID NO: 469388 - RNA, 20 nt, Homo sapiens
acaauggcuggguuugggca

SEQ ID NO: 469389 - RNA, 14 nt, Homo sapiens
acacaccuugccca

SEQ ID NO: 469390 - RNA, 17 nt, Homo sapiens
acaccaucuggagucuu

SEQ ID NO: 469391 - RNA, 23 nt, Homo sapiens
acaccguggugagcauacagagu

SEQ ID NO: 469392 - RNA, 17 nt, Homo sapiens
acacuccaguuugccca

SEQ ID NO: 469393 - RNA, 20 nt, Homo sapiens
acacucucuucuuacuguau

SEQ ID NO: 469394 - RNA, 20 nt, Homo sapiens
acacucugccuuccugaguc

SEQ ID NO: 469395 - RNA, 18 nt, Homo sapiens
acacugaguuugaacaca

SEQ ID NO: 469396 - RNA, 21 nt, Homo sapiens
acacuguaaucuuaaaagugu

SEQ ID NO: 469397 - RNA, 12 nt, Homo sapiens
acagaguguccu

SEQ ID NO: 469398 - RNA, 21 nt, Homo sapiens
acagauuuuuggagaaaggau

SEQ ID NO: 469399 - RNA, 18 nt, Homo sapiens
acagccuggcacagggca

SEQ ID NO: 469400 - RNA, 22 nt, Homo sapiens
acaggcccuuccucuccacugc

SEQ ID NO: 469401 - RNA, 20 nt, Homo sapiens
acauacacaaaugggcauac

SEQ ID NO: 469402 - RNA, 17 nt, Homo sapiens
acauccauugacugacc

SEQ ID NO: 469403 - RNA, 19 nt, Homo sapiens
acaucuguauaucagcucu

SEQ ID NO: 469404 - RNA, 22 nt, Homo sapiens
acaugcacaguuugcaaucuua

SEQ ID NO: 469405 - RNA, 18 nt, Homo sapiens
acaugguaucucuuucuc

SEQ ID NO: 469406 - RNA, 16 nt, Homo sapiens
acauuaaacacuguaa

SEQ ID NO: 469407 - RNA, 23 nt, Homo sapiens
acauuuccgugagagucaucuca

SEQ ID NO: 469408 - RNA, 17 nt, Homo sapiens
accagaagugccaugcu

SEQ ID NO: 469409 - RNA, 21 nt, Homo sapiens
accagguuaccucacuuuuaa

SEQ ID NO: 469410 - RNA, 15 nt, Homo sapiens
accauccccuccuag

SEQ ID NO: 469411 - RNA, 19 nt, Homo sapiens
accauuauggcuuugugcu

SEQ ID NO: 469412 - RNA, 23 nt, Homo sapiens
acccuguuuguugugucuugcua

SEQ ID NO: 469413 - RNA, 14 nt, Homo sapiens
acccuucucaggga

SEQ ID NO: 469414 - RNA, 14 nt, Homo sapiens
accgcuggagcucc

SEQ ID NO: 469415 - RNA, 18 nt, Homo sapiens
accuauucccaaaugccu

SEQ ID NO: 469416 - RNA, 23 nt, Homo sapiens
accucauuuguccaugugcaaac

SEQ ID NO: 469417 - RNA, 15 nt, Homo sapiens
accucuuaugcacac

SEQ ID NO: 469418 - RNA, 16 nt, Homo sapiens
accuguaauagccuca

SEQ ID NO: 469419 - RNA, 13 nt, Homo sapiens
accuguagugaga

SEQ ID NO: 469420 - RNA, 14 nt, Homo sapiens
accuugcucugcca

SEQ ID NO: 469421 - RNA, 16 nt, Homo sapiens
acggccgucccugacu

SEQ ID NO: 469422 - RNA, 18 nt, Homo sapiens
acuaacugcaaaugcauc

SEQ ID NO: 469423 - RNA, 14 nt, Homo sapiens
acuacagaguguua

SEQ ID NO: 469424 - RNA, 14 nt, Homo sapiens
acuagaagcacagg

SEQ ID NO: 469425 - RNA, 17 nt, Homo sapiens
acuagguuucaccuccc

SEQ ID NO: 469426 - RNA, 19 nt, Homo sapiens
acuagguuucaccucccaa

SEQ ID NO: 469427 - RNA, 16 nt, Homo sapiens
acuauaaaaacugccc

SEQ ID NO: 469428 - RNA, 17 nt, Homo sapiens
acucaccccuucuaauc

SEQ ID NO: 469429 - RNA, 17 nt, Homo sapiens
acucaguauauagccuu

SEQ ID NO: 469430 - RNA, 18 nt, Homo sapiens
acucucuucuuacuguau

SEQ ID NO: 469431 - RNA, 15 nt, Homo sapiens
acucugacaguauua

SEQ ID NO: 469432 - RNA, 20 nt, Homo sapiens
acucuguguaaucucugauu

SEQ ID NO: 469433 - RNA, 22 nt, Homo sapiens
acucuguuccuacuggagauac

SEQ ID NO: 469434 - RNA, 18 nt, Homo sapiens
acucuuuaguugauuuaa

SEQ ID NO: 469435 - RNA, 21 nt, Homo sapiens
acugacagaugaccgcaauaa

SEQ ID NO: 469436 - RNA, 13 nt, Homo sapiens
acugagccaaaaa

SEQ ID NO: 469437 - RNA, 20 nt, Homo sapiens
acugccccccuccuuuccaa

SEQ ID NO: 469438 - RNA, 15 nt, Homo sapiens
acuggaguucacuuu

SEQ ID NO: 469439 - RNA, 13 nt, Homo sapiens
acuggccacugaa

SEQ ID NO: 469440 - RNA, 18 nt, Homo sapiens
acugggaaauaagcaaaa

SEQ ID NO: 469441 - RNA, 13 nt, Homo sapiens
acuguacuccucc

SEQ ID NO: 469442 - RNA, 16 nt, Homo sapiens
acuuaaaccugugcuu

SEQ ID NO: 469443 - RNA, 22 nt, Homo sapiens
acuuagagcacuagaagcacag

SEQ ID NO: 469444 - RNA, 16 nt, Homo sapiens
acuuauuucagauuca

SEQ ID NO: 469445 - RNA, 21 nt, Homo sapiens
acuuauuucagauucaccucc

SEQ ID NO: 469446 - RNA, 16 nt, Homo sapiens
acuucaguucucaucu

SEQ ID NO: 469447 - RNA, 20 nt, Homo sapiens
acuucaguucucaucuugua

SEQ ID NO: 469448 - RNA, 17 nt, Homo sapiens
acuucaugccagcuaua

SEQ ID NO: 469449 - RNA, 12 nt, Homo sapiens
acuucuguuacu

SEQ ID NO: 469450 - RNA, 19 nt, Homo sapiens
acuuuaauucuuuucccag

SEQ ID NO: 469451 - RNA, 22 nt, Homo sapiens
acuuuuucagaguugcuuuaaa

SEQ ID NO: 469452 - RNA, 13 nt, Homo sapiens
agcguggggcuaa

SEQ ID NO: 469453 - RNA, 15 nt, Homo sapiens
agcuaacaaguagca

SEQ ID NO: 469454 - RNA, 21 nt, Homo sapiens
agcuaacaaguagcacacuga

SEQ ID NO: 469455 - RNA, 19 nt, Homo sapiens
agcuagaaucacuugacuu

SEQ ID NO: 469456 - RNA, 18 nt, Homo sapiens
agcuauaacaacucuauu

SEQ ID NO: 469457 - RNA, 19 nt, Homo sapiens
agcuaucugucaucucucu

SEQ ID NO: 469458 - RNA, 17 nt, Homo sapiens
agcucuaaagcagagau

SEQ ID NO: 469459 - RNA, 15 nt, Homo sapiens
agcucugcauaagau

SEQ ID NO: 469460 - RNA, 15 nt, Homo sapiens
agcugcucuccuuca

SEQ ID NO: 469461 - RNA, 18 nt, Homo sapiens
agcuggcaaacugugaau

SEQ ID NO: 469462 - RNA, 19 nt, Homo sapiens
agcuguuuugaauaacaua

SEQ ID NO: 469463 - RNA, 21 nt, Homo sapiens
agcuucccuuuucucccaaga

SEQ ID NO: 469464 - RNA, 20 nt, Homo sapiens
aggaacaaagacaaccacug

SEQ ID NO: 469465 - RNA, 15 nt, Homo sapiens
aggacacugaugggu

SEQ ID NO: 469466 - RNA, 22 nt, Homo sapiens
aggaccuuucugaggaguaaaa

SEQ ID NO: 469467 - RNA, 23 nt, Homo sapiens
aggacuguauaguuuaaagggag

SEQ ID NO: 469468 - RNA, 13 nt, Homo sapiens
aggaggacaggga

SEQ ID NO: 469469 - RNA, 22 nt, Homo sapiens
aggaggaccuggggggggcaag

SEQ ID NO: 469470 - RNA, 17 nt, Homo sapiens
aggaugggaagaaaaag

SEQ ID NO: 469471 - RNA, 15 nt, Homo sapiens
aggcagaaugguggg

SEQ ID NO: 469472 - RNA, 12 nt, Homo sapiens
aggcucuucucc

SEQ ID NO: 469473 - RNA, 17 nt, Homo sapiens
agggcauggccaggugg

SEQ ID NO: 469474 - RNA, 17 nt, Homo sapiens
agggccccacucaggga

SEQ ID NO: 469475 - RNA, 18 nt, Homo sapiens
agggccccacucagggau

SEQ ID NO: 469476 - RNA, 14 nt, Homo sapiens
agggcuucuaccag

SEQ ID NO: 469477 - RNA, 15 nt, Homo sapiens
aggggucagcagggg

SEQ ID NO: 469478 - RNA, 15 nt, Homo sapiens
aggguucagggcaug

SEQ ID NO: 469479 - RNA, 23 nt, Homo sapiens
aggucuccaccccucaagccagg

SEQ ID NO: 469480 - RNA, 21 nt, Homo sapiens
aggugcucuuccucaucucau

SEQ ID NO: 469481 - RNA, 17 nt, Homo sapiens
agguggauucaugucca

SEQ ID NO: 469482 - RNA, 15 nt, Homo sapiens
agguggccacuccag

SEQ ID NO: 469483 - RNA, 14 nt, Homo sapiens
agguuccuccuagg

SEQ ID NO: 469484 - RNA, 22 nt, Homo sapiens
agguucugugcaaaacuaccac

SEQ ID NO: 469485 - RNA, 23 nt, Homo sapiens
agguugucugaagucacugcaca

SEQ ID NO: 469486 - RNA, 16 nt, Homo sapiens
aguaaaggguauguca

SEQ ID NO: 469487 - RNA, 15 nt, Homo sapiens
aguaauaucuuucag

SEQ ID NO: 469488 - RNA, 20 nt, Homo sapiens
aguacagggcaggagcugcu

SEQ ID NO: 469489 - RNA, 16 nt, Homo sapiens
aguagauaagugcuca

SEQ ID NO: 469490 - RNA, 13 nt, Homo sapiens
aguaggugggucu

SEQ ID NO: 469491 - RNA, 17 nt, Homo sapiens
aguauguuaagcucuuu

SEQ ID NO: 469492 - RNA, 15 nt, Homo sapiens
cuuauuucauaaaca

SEQ ID NO: 469493 - RNA, 20 nt, Homo sapiens
cuucacacugaacucaggau

SEQ ID NO: 469494 - RNA, 12 nt, Homo sapiens
cuucacauccac

SEQ ID NO: 469495 - RNA, 23 nt, Homo sapiens
cuucagagaaaucugcauucuau

SEQ ID NO: 469496 - RNA, 20 nt, Homo sapiens
cuucagguuccuccuaggcg

SEQ ID NO: 469497 - RNA, 13 nt, Homo sapiens
cuuccaaaagccu

SEQ ID NO: 469498 - RNA, 13 nt, Homo sapiens
cuuccaugguggu

SEQ ID NO: 469499 - RNA, 17 nt, Homo sapiens
cuucccacuuugccacu

SEQ ID NO: 469500 - RNA, 20 nt, Homo sapiens
cuuccucgugccguccuccc

SEQ ID NO: 469501 - RNA, 15 nt, Homo sapiens
cuuccucuccacugc

SEQ ID NO: 469502 - RNA, 18 nt, Homo sapiens
cuuccuuuuguauccucc

SEQ ID NO: 469503 - RNA, 23 nt, Homo sapiens
cuucgauacaccgggccuggaga

SEQ ID NO: 469504 - RNA, 12 nt, Homo sapiens
cuucucagggac

SEQ ID NO: 469505 - RNA, 23 nt, Homo sapiens
cuucucaguagaaaggaacagaa

SEQ ID NO: 469506 - RNA, 14 nt, Homo sapiens
cuucuccacuggau

SEQ ID NO: 469507 - RNA, 16 nt, Homo sapiens
cuucugccucuuaacu

SEQ ID NO: 469508 - RNA, 18 nt, Homo sapiens
cuucugccucuuaacuua

SEQ ID NO: 469509 - RNA, 17 nt, Homo sapiens
cuucuguuuuccaaagg

SEQ ID NO: 469510 - RNA, 13 nt, Homo sapiens
cuucuuacuguau

SEQ ID NO: 469511 - RNA, 17 nt, Homo sapiens
cuucuucaaacaggaau

SEQ ID NO: 469512 - RNA, 12 nt, Homo sapiens
cuugaaaacugg

SEQ ID NO: 469513 - RNA, 21 nt, Homo sapiens
cuugaauguccccauucuaua

SEQ ID NO: 469514 - RNA, 18 nt, Homo sapiens
cuugacuucaugccagcu

SEQ ID NO: 469515 - RNA, 16 nt, Homo sapiens
cuugagcaaggcaaga

SEQ ID NO: 469516 - RNA, 18 nt, Homo sapiens
cuugaucaugaaucacug

SEQ ID NO: 469517 - RNA, 19 nt, Homo sapiens
cuugauguugcuuagucac

SEQ ID NO: 469518 - RNA, 14 nt, Homo sapiens
cuugcacuguaucc

SEQ ID NO: 469519 - RNA, 16 nt, Homo sapiens
cuugcacuguauccaa

SEQ ID NO: 469520 - RNA, 16 nt, Homo sapiens
cuugcaugugcugcag

SEQ ID NO: 469521 - RNA, 21 nt, Homo sapiens
cuuggauaggagcuuccagau

SEQ ID NO: 469522 - RNA, 15 nt, Homo sapiens
cuuggguaauuaaaa

SEQ ID NO: 469523 - RNA, 14 nt, Homo sapiens
cuuguaaaagccua

SEQ ID NO: 469524 - RNA, 16 nt, Homo sapiens
cuugucauucugcuaa

SEQ ID NO: 469525 - RNA, 17 nt, Homo sapiens
cuuuaguugauuuaaac

SEQ ID NO: 469526 - RNA, 20 nt, Homo sapiens
cuuuaguugauuuaaacucu

SEQ ID NO: 469527 - RNA, 22 nt, Homo sapiens
cuuucaauugcuucugugcaau

SEQ ID NO: 469528 - RNA, 22 nt, Homo sapiens
cuuuccaaauaagugcauuuau

SEQ ID NO: 469529 - RNA, 17 nt, Homo sapiens
cuuucucaugcauagac

SEQ ID NO: 469530 - RNA, 16 nt, Homo sapiens
cuuucucauucuugcc

SEQ ID NO: 469531 - RNA, 16 nt, Homo sapiens
cuuugagccugggaaa

SEQ ID NO: 469532 - RNA, 16 nt, Homo sapiens
cuuugagggcugacaa

SEQ ID NO: 469533 - RNA, 15 nt, Homo sapiens
cuuugauucaccaaa

SEQ ID NO: 469534 - RNA, 19 nt, Homo sapiens
cuuugccacauccauugac

SEQ ID NO: 469535 - RNA, 17 nt, Homo sapiens
cuuuguaugcacuuugu

SEQ ID NO: 469536 - RNA, 14 nt, Homo sapiens
cuuuguuuacauga

SEQ ID NO: 469537 - RNA, 17 nt, Homo sapiens
cuuuugaaucaaucugg

SEQ ID NO: 469538 - RNA, 15 nt, Homo sapiens
cuuuuguucauggga

SEQ ID NO: 469539 - RNA, 18 nt, Homo sapiens
gaaaacaaauauuucacu

SEQ ID NO: 469540 - RNA, 20 nt, Homo sapiens
gaaaacaaauauuucacuua

SEQ ID NO: 469541 - RNA, 22 nt, Homo sapiens
gaaaaugcuuucucaugcauag

SEQ ID NO: 469542 - RNA, 19 nt, Homo sapiens
gaaagacaguaaagaccau

SEQ ID NO: 469543 - RNA, 22 nt, Homo sapiens
gaaagcguuuuguuaucuucua

SEQ ID NO: 469544 - RNA, 14 nt, Homo sapiens
gaaauaaagcacau

SEQ ID NO: 469545 - RNA, 15 nt, Homo sapiens
gaaauacucuuccaa

SEQ ID NO: 469546 - RNA, 20 nt, Homo sapiens
gaaauccaacuccaggguua

SEQ ID NO: 469547 - RNA, 21 nt, Homo sapiens
gaaauuggaaaggacuuugug

SEQ ID NO: 469548 - RNA, 21 nt, Homo sapiens
gaaauuuuaucucuucuuccu

SEQ ID NO: 469549 - RNA, 13 nt, Homo sapiens
gaacacagaucau

SEQ ID NO: 469550 - RNA, 19 nt, Homo sapiens
gaacagaauugcuccugca

SEQ ID NO: 469551 - RNA, 12 nt, Homo sapiens
gaacagccagac

SEQ ID NO: 469552 - RNA, 18 nt, Homo sapiens
gaacauccggaacagcca

SEQ ID NO: 469553 - RNA, 18 nt, Homo sapiens
gaaccgcaauaugggagg

SEQ ID NO: 469554 - RNA, 15 nt, Homo sapiens
gaacuagagaaggac

SEQ ID NO: 469555 - RNA, 13 nt, Homo sapiens
gaacugucccaca

SEQ ID NO: 469556 - RNA, 23 nt, Homo sapiens
gaacuuaauuaccuaagagccac

SEQ ID NO: 469557 - RNA, 19 nt, Homo sapiens
gaagaauuuaucugugaau

SEQ ID NO: 469558 - RNA, 20 nt, Homo sapiens
gaagauguuaauuacuuuug

SEQ ID NO: 469559 - RNA, 19 nt, Homo sapiens
gaagggccccacucaggga

SEQ ID NO: 469560 - RNA, 16 nt, Homo sapiens
gaagucacugcacagu

SEQ ID NO: 469561 - RNA, 11 nt, Homo sapiens
gaauacuguau

SEQ ID NO: 469562 - RNA, 17 nt, Homo sapiens
gaauaggaguucuccug

SEQ ID NO: 469563 - RNA, 15 nt, Homo sapiens
gaauauccuauacug

SEQ ID NO: 469564 - RNA, 15 nt, Homo sapiens
gaauaugaauggauu

SEQ ID NO: 469565 - RNA, 14 nt, Homo sapiens
gaaucacuugacuu

SEQ ID NO: 469566 - RNA, 13 nt, Homo sapiens
gaaugaaguguua

SEQ ID NO: 469567 - RNA, 20 nt, Homo sapiens
gaaugcagcaguaaauccaa

SEQ ID NO: 469568 - RNA, 15 nt, Homo sapiens
gaauuagguaaugga

SEQ ID NO: 469569 - RNA, 20 nt, Homo sapiens
gaauuguuauguaaacauca

SEQ ID NO: 469570 - RNA, 22 nt, Homo sapiens
gacaagaaauccuaguggccuc

SEQ ID NO: 469571 - RNA, 16 nt, Homo sapiens
gacacaguauugacuu

SEQ ID NO: 469572 - RNA, 14 nt, Homo sapiens
gacacguucuugcc

SEQ ID NO: 469573 - RNA, 15 nt, Homo sapiens
gacaguaaagaccau

SEQ ID NO: 469574 - RNA, 19 nt, Homo sapiens
gaccccacuuaugcugcug

SEQ ID NO: 469575 - RNA, 17 nt, Homo sapiens
gaccuugaaaagcagua

SEQ ID NO: 469576 - RNA, 13 nt, Homo sapiens
gaccuuuauuuau

SEQ ID NO: 469577 - RNA, 19 nt, Homo sapiens
gacuagaacacaaauccaa

SEQ ID NO: 469578 - RNA, 15 nt, Homo sapiens
gacuauaaaaacugc

SEQ ID NO: 469579 - RNA, 22 nt, Homo sapiens
gacucaauguggaaaaaauauu

SEQ ID NO: 469580 - RNA, 19 nt, Homo sapiens
gacugagaagauguuaauu

SEQ ID NO: 469581 - RNA, 13 nt, Homo sapiens
gacugagcuugau

SEQ ID NO: 469582 - RNA, 17 nt, Homo sapiens
gacuucuuuuuggcauu

SEQ ID NO: 469583 - RNA, 16 nt, Homo sapiens
gacuuugccacaucca

SEQ ID NO: 469584 - RNA, 14 nt, Homo sapiens
gacuuuguguuauu

SEQ ID NO: 469585 - RNA, 19 nt, Homo sapiens
gagaaauugugccaaagau

SEQ ID NO: 469586 - RNA, 19 nt, Homo sapiens
gagacaagaaauccuagug

SEQ ID NO: 469587 - RNA, 21 nt, Homo sapiens
gagaucuuaagauuccauuuu

SEQ ID NO: 469588 - RNA, 16 nt, Homo sapiens
gagauuugccaaaaac

SEQ ID NO: 469589 - RNA, 22 nt, Homo sapiens
gagcaggacuaacaacugggaa

SEQ ID NO: 469590 - RNA, 18 nt, Homo sapiens
uaugcauguagcauauaa

SEQ ID NO: 469591 - RNA, 13 nt, Homo sapiens
uauggaaagggug

SEQ ID NO: 469592 - RNA, 17 nt, Homo sapiens
uaugggaggaacaaaga

SEQ ID NO: 469593 - RNA, 17 nt, Homo sapiens
uaugucagcuacaugaa

SEQ ID NO: 469594 - RNA, 19 nt, Homo sapiens
uaugugccuuucacuuuag

SEQ ID NO: 469595 - RNA, 14 nt, Homo sapiens
uauuccuaugcugc

SEQ ID NO: 469596 - RNA, 15 nt, Homo sapiens
uauuccuaugcugca

SEQ ID NO: 469597 - RNA, 20 nt, Homo sapiens
uauugacgaccuacaucuga

SEQ ID NO: 469598 - RNA, 16 nt, Homo sapiens
uauuguggcaccucaa

SEQ ID NO: 469599 - RNA, 14 nt, Homo sapiens
uauuucauaaacaa

SEQ ID NO: 469600 - RNA, 15 nt, Homo sapiens
uauuucauaaacaac

SEQ ID NO: 469601 - RNA, 14 nt, Homo sapiens
ucaaaauacuucuu

SEQ ID NO: 469602 - RNA, 14 nt, Homo sapiens
ucaaaugaguuuaa

SEQ ID NO: 469603 - RNA, 21 nt, Homo sapiens
ucaaccugguggcaccagaug

SEQ ID NO: 469604 - RNA, 14 nt, Homo sapiens
ucaagccaggagac

SEQ ID NO: 469605 - RNA, 23 nt, Homo sapiens
ucaaguagcguuggagacauaca

SEQ ID NO: 469606 - RNA, 12 nt, Homo sapiens
ucaaucucugca

SEQ ID NO: 469607 - RNA, 20 nt, Homo sapiens
ucaaucuggcuucugcauua

SEQ ID NO: 469608 - RNA, 16 nt, Homo sapiens
ucaaugcuagcacaau

SEQ ID NO: 469609 - RNA, 18 nt, Homo sapiens
ucaaugugaaauaaagag

SEQ ID NO: 469610 - RNA, 20 nt, Homo sapiens
ucaauugcuucugugcaaua

SEQ ID NO: 469611 - RNA, 22 nt, Homo sapiens
ucacaaauaaguaauaucuuuc

SEQ ID NO: 469612 - RNA, 16 nt, Homo sapiens
ucaccucccaaaccca

SEQ ID NO: 469613 - RNA, 18 nt, Homo sapiens
ucaccucccaaacccagc

SEQ ID NO: 469614 - RNA, 17 nt, Homo sapiens
ucaccucuuaugcacac

SEQ ID NO: 469615 - RNA, 17 nt, Homo sapiens
ucaccuugcucugccau

SEQ ID NO: 469616 - RNA, 17 nt, Homo sapiens
ucacucugucagccagc

SEQ ID NO: 469617 - RNA, 16 nt, Homo sapiens
ucacuugacuuugcca

SEQ ID NO: 469618 - RNA, 20 nt, Homo sapiens
ucacuuggaagauuuguaua

SEQ ID NO: 469619 - RNA, 21 nt, Homo sapiens
ucagaagagucccggagcuca

SEQ ID NO: 469620 - RNA, 22 nt, Homo sapiens
ucagaauugaaccgucaaugug

SEQ ID NO: 469621 - RNA, 23 nt, Homo sapiens
ucagacgggcugagaggaugaac

SEQ ID NO: 469622 - RNA, 20 nt, Homo sapiens
ucagcaacuguuagcuggga

SEQ ID NO: 469623 - RNA, 18 nt, Homo sapiens
ucagcauucucacuccua

SEQ ID NO: 469624 - RNA, 13 nt, Homo sapiens
ucagcccucagaa

SEQ ID NO: 469625 - RNA, 14 nt, Homo sapiens
ucagcucuaaagca

SEQ ID NO: 469626 - RNA, 20 nt, Homo sapiens
ucaggaaugggccaagccag

SEQ ID NO: 469627 - RNA, 12 nt, Homo sapiens
ucaguacagggc

SEQ ID NO: 469628 - RNA, 16 nt, Homo sapiens
ucaguagugccuguga

SEQ ID NO: 469629 - RNA, 17 nt, Homo sapiens
ucagugaagcccaggag

SEQ ID NO: 469630 - RNA, 21 nt, Homo sapiens
ucauccauagacacaguauug

SEQ ID NO: 469631 - RNA, 17 nt, Homo sapiens
ucaucugaggaguccaa

SEQ ID NO: 469632 - RNA, 14 nt, Homo sapiens
ucaugcuacagaga

SEQ ID NO: 469633 - RNA, 21 nt, Homo sapiens
ucaugcuacagagagugaaua

SEQ ID NO: 469634 - RNA, 16 nt, Homo sapiens
ucauucaagccuguga

SEQ ID NO: 469635 - RNA, 17 nt, Homo sapiens
uccaaaggaguggucaa

SEQ ID NO: 469636 - RNA, 17 nt, Homo sapiens
uccaacaaacuuacugu

SEQ ID NO: 469637 - RNA, 16 nt, Homo sapiens
uccaaggccugugaau

SEQ ID NO: 469638 - RNA, 18 nt, Homo sapiens
uccacaugaaaauaaaga

SEQ ID NO: 469639 - RNA, 16 nt, Homo sapiens
uccaccugugcugcug

SEQ ID NO: 469640 - RNA, 22 nt, Homo sapiens
uccacuaggugcccagucuuga

SEQ ID NO: 469641 - RNA, 12 nt, Homo sapiens
uccacucugagg

SEQ ID NO: 469642 - RNA, 11 nt, Homo sapiens
uccacuuagaa

SEQ ID NO: 469643 - RNA, 17 nt, Homo sapiens
uccagcuccccccaaga

SEQ ID NO: 469644 - RNA, 19 nt, Homo sapiens
uccauaucagcucugcaua

SEQ ID NO: 469645 - RNA, 14 nt, Homo sapiens
uccauuaaccaaga

SEQ ID NO: 469646 - RNA, 21 nt, Homo sapiens
ucccaaacccagccucuagaa

SEQ ID NO: 469647 - RNA, 15 nt, Homo sapiens
ucccaagaugcagaa

SEQ ID NO: 469648 - RNA, 19 nt, Homo sapiens
ucccaggggacaugaguaa

SEQ ID NO: 469649 - RNA, 21 nt, Homo sapiens
ucccauggaaugcagcaguaa

SEQ ID NO: 469650 - RNA, 14 nt, Homo sapiens
uccccaauuauccu

SEQ ID NO: 469651 - RNA, 12 nt, Homo sapiens
uccccacccacc

SEQ ID NO: 469652 - RNA, 20 nt, Homo sapiens
uccccaguuaaugugccaaa

SEQ ID NO: 469653 - RNA, 13 nt, Homo sapiens
ucccccuuucucc

SEQ ID NO: 469654 - RNA, 14 nt, Homo sapiens
uccccucacucugu

SEQ ID NO: 469655 - RNA, 21 nt, Homo sapiens
uccccugccuuccuuuaaucc

SEQ ID NO: 469656 - RNA, 17 nt, Homo sapiens
ucccgcgggaagccagc

SEQ ID NO: 469657 - RNA, 16 nt, Homo sapiens
ucccgucuuccgguca

SEQ ID NO: 469658 - RNA, 15 nt, Homo sapiens
ucccuaaaaauucca

SEQ ID NO: 469659 - RNA, 19 nt, Homo sapiens
uccuaggcucccugaggua

SEQ ID NO: 469660 - RNA, 18 nt, Homo sapiens
uccuaguagcuuuccucc

SEQ ID NO: 469661 - RNA, 12 nt, Homo sapiens
uccuaugcugca

SEQ ID NO: 469662 - RNA, 20 nt, Homo sapiens
uccucagucuuugggggauu

SEQ ID NO: 469663 - RNA, 16 nt, Homo sapiens
uccucuccacugccuu

SEQ ID NO: 469664 - RNA, 18 nt, Homo sapiens
uccucuccacugccuucg

SEQ ID NO: 469665 - RNA, 18 nt, Homo sapiens
uccucuccucguccggcc

SEQ ID NO: 469666 - RNA, 15 nt, Homo sapiens
uccucugcagccuga

SEQ ID NO: 469667 - RNA, 23 nt, Homo sapiens
uccucuuaccuguaauagccuca

SEQ ID NO: 469668 - RNA, 17 nt, Homo sapiens
uccugauaaacauuaaa

SEQ ID NO: 469669 - RNA, 12 nt, Homo sapiens
uccugcacucua

SEQ ID NO: 469670 - RNA, 22 nt, Homo sapiens
uccugccacuagguuucaccuc

SEQ ID NO: 469671 - RNA, 16 nt, Homo sapiens
uccugcuagcuguaga

SEQ ID NO: 469672 - RNA, 23 nt, Homo sapiens
uccugcugcucgggaaggccuga

SEQ ID NO: 469673 - RNA, 18 nt, Homo sapiens
uccuuagaauacuguauu

SEQ ID NO: 469674 - RNA, 19 nt, Homo sapiens
uccuucacucccugucaua

SEQ ID NO: 469675 - RNA, 23 nt, Homo sapiens
uccuucccgcagcaccagccuga

SEQ ID NO: 469676 - RNA, 11 nt, Homo sapiens
uccuucuugcu

SEQ ID NO: 469677 - RNA, 15 nt, Homo sapiens
uccuuucccacccac

SEQ ID NO: 469678 - RNA, 21 nt, Homo sapiens
ucguagguugugaugauagca

SEQ ID NO: 469679 - RNA, 18 nt, Homo sapiens
ucguuucacaucuguaua

SEQ ID NO: 469680 - RNA, 17 nt, Homo sapiens
ucuaaaggggacagauc

SEQ ID NO: 469681 - RNA, 22 nt, Homo sapiens
ucuaaauaauaauaaaacaaca

SEQ ID NO: 469682 - RNA, 20 nt, Homo sapiens
ucuaagaaauggcuuuccac

SEQ ID NO: 469683 - RNA, 18 nt, Homo sapiens
ucuaagcuguuucuugau

SEQ ID NO: 469684 - RNA, 13 nt, Homo sapiens
ucuaauguacaau

SEQ ID NO: 469685 - RNA, 14 nt, Homo sapiens
ucuacaggcauuua

SEQ ID NO: 469686 - RNA, 17 nt, Homo sapiens
ucuaccagagauuuucc

SEQ ID NO: 469687 - RNA, 13 nt, Homo sapiens
ucuacuacagagu

SEQ ID NO: 469688 - RNA, 14 nt, Homo sapiens
aucccaagucaaac

SEQ ID NO: 469689 - RNA, 20 nt, Homo sapiens
aucccaagucaaacagugug

SEQ ID NO: 469690 - RNA, 15 nt, Homo sapiens
auccguuugcaagaa

SEQ ID NO: 469691 - RNA, 20 nt, Homo sapiens
auccucuugccaccguccca

SEQ ID NO: 469692 - RNA, 19 nt, Homo sapiens
aucuacaacauaaugauac

SEQ ID NO: 469693 - RNA, 14 nt, Homo sapiens
aucuacuacagagu

SEQ ID NO: 469694 - RNA, 14 nt, Homo sapiens
aucuauagcacaua

SEQ ID NO: 469695 - RNA, 21 nt, Homo sapiens
aucuauuuaucugucugagcc

SEQ ID NO: 469696 - RNA, 21 nt, Homo sapiens
aucuccagccaauuucaaaga

SEQ ID NO: 469697 - RNA, 19 nt, Homo sapiens
aucucuaaaauucuagucu

SEQ ID NO: 469698 - RNA, 14 nt, Homo sapiens
aucuggaaugugaa

SEQ ID NO: 469699 - RNA, 15 nt, Homo sapiens
aucugucaucucucu

SEQ ID NO: 469700 - RNA, 17 nt, Homo sapiens
aucuuaagauuccauuu

SEQ ID NO: 469701 - RNA, 13 nt, Homo sapiens
augaaagaggcau

SEQ ID NO: 469702 - RNA, 18 nt, Homo sapiens
augaaccauuaagaacaa

SEQ ID NO: 469703 - RNA, 20 nt, Homo sapiens
augaacccauccaauggauu

SEQ ID NO: 469704 - RNA, 11 nt, Homo sapiens
augaagcacau

SEQ ID NO: 469705 - RNA, 22 nt, Homo sapiens
augacggggccuccuucuucaa

SEQ ID NO: 469706 - RNA, 15 nt, Homo sapiens
augauaaguuccaaa

SEQ ID NO: 469707 - RNA, 17 nt, Homo sapiens
augcaagcucagggugc

SEQ ID NO: 469708 - RNA, 12 nt, Homo sapiens
augcaugugauu

SEQ ID NO: 469709 - RNA, 22 nt, Homo sapiens
augccuuguugaugaagcacau

SEQ ID NO: 469710 - RNA, 22 nt, Homo sapiens
augcugagagaccucagggaug

SEQ ID NO: 469711 - RNA, 16 nt, Homo sapiens
augcugcaauacauua

SEQ ID NO: 469712 - RNA, 21 nt, Homo sapiens
auggacaauuaugauagcuua

SEQ ID NO: 469713 - RNA, 21 nt, Homo sapiens
auggagcuugacuucaugcca

SEQ ID NO: 469714 - RNA, 21 nt, Homo sapiens
augggccaagccaggguucca

SEQ ID NO: 469715 - RNA, 16 nt, Homo sapiens
augggugaaaccacau

SEQ ID NO: 469716 - RNA, 14 nt, Homo sapiens
augguaacugauga

SEQ ID NO: 469717 - RNA, 21 nt, Homo sapiens
augguaugcuggccagcaccc

SEQ ID NO: 469718 - RNA, 20 nt, Homo sapiens
auggucaaugcuagcacaau

SEQ ID NO: 469719 - RNA, 12 nt, Homo sapiens
auguaagaagaa

SEQ ID NO: 469720 - RNA, 23 nt, Homo sapiens
auguacaauaaagcaauguggua

SEQ ID NO: 469721 - RNA, 12 nt, Homo sapiens
auguauuaugca

SEQ ID NO: 469722 - RNA, 14 nt, Homo sapiens
augucuacugcuug

SEQ ID NO: 469723 - RNA, 15 nt, Homo sapiens
augugauacaugccg

SEQ ID NO: 469724 - RNA, 19 nt, Homo sapiens
augugauuggcagcuucaa

SEQ ID NO: 469725 - RNA, 18 nt, Homo sapiens
auguuaagcucuuuauga

SEQ ID NO: 469726 - RNA, 15 nt, Homo sapiens
auguuacagaaucua

SEQ ID NO: 469727 - RNA, 17 nt, Homo sapiens
auguuccguucaucuga

SEQ ID NO: 469728 - RNA, 17 nt, Homo sapiens
auguugcacaacacaga

SEQ ID NO: 469729 - RNA, 17 nt, Homo sapiens
auguugcuuuugcaccu

SEQ ID NO: 469730 - RNA, 13 nt, Homo sapiens
auuaaacacugua

SEQ ID NO: 469731 - RNA, 19 nt, Homo sapiens
auuaaacuugucagaauuu

SEQ ID NO: 469732 - RNA, 21 nt, Homo sapiens
auuaaaggggcugucucccaa

SEQ ID NO: 469733 - RNA, 22 nt, Homo sapiens
auuaaauuuuaauguaaaauuc

SEQ ID NO: 469734 - RNA, 16 nt, Homo sapiens
auuaaggcaguaugcc

SEQ ID NO: 469735 - RNA, 14 nt, Homo sapiens
auuaaucucuaaaa

SEQ ID NO: 469736 - RNA, 17 nt, Homo sapiens
auuaaucucuaaaauuc

SEQ ID NO: 469737 - RNA, 16 nt, Homo sapiens
auuacugaugugugca

SEQ ID NO: 469738 - RNA, 18 nt, Homo sapiens
auuagcucucaucuaguu

SEQ ID NO: 469739 - RNA, 22 nt, Homo sapiens
auuagguagaugagaaaacagg

SEQ ID NO: 469740 - RNA, 18 nt, Homo sapiens
auuauagucuguacuuca

SEQ ID NO: 469741 - RNA, 12 nt, Homo sapiens
auuaugauagcu

SEQ ID NO: 469742 - RNA, 16 nt, Homo sapiens
auucaaaauaguucua

SEQ ID NO: 469743 - RNA, 14 nt, Homo sapiens
auucaagccuguga

SEQ ID NO: 469744 - RNA, 18 nt, Homo sapiens
auucauuuacaacuucca

SEQ ID NO: 469745 - RNA, 18 nt, Homo sapiens
auuccaaggccugugaau

SEQ ID NO: 469746 - RNA, 19 nt, Homo sapiens
auuccaaggccugugaaug

SEQ ID NO: 469747 - RNA, 14 nt, Homo sapiens
auucuauaaauuca

SEQ ID NO: 469748 - RNA, 18 nt, Homo sapiens
auugcacccuaaauccac

SEQ ID NO: 469749 - RNA, 13 nt, Homo sapiens
auuguuuuuggau

SEQ ID NO: 469750 - RNA, 18 nt, Homo sapiens
auuuaaaggaaaguucua

SEQ ID NO: 469751 - RNA, 18 nt, Homo sapiens
auuuacaacuuccagauu

SEQ ID NO: 469752 - RNA, 20 nt, Homo sapiens
auuuacggaggcguugugaa

SEQ ID NO: 469753 - RNA, 21 nt, Homo sapiens
auuuacggaggcguugugaau

SEQ ID NO: 469754 - RNA, 14 nt, Homo sapiens
auuuaucugugaau

SEQ ID NO: 469755 - RNA, 21 nt, Homo sapiens
auuuauugccucuaugugcaa

SEQ ID NO: 469756 - RNA, 16 nt, Homo sapiens
auuuauuucauccagu

SEQ ID NO: 469757 - RNA, 15 nt, Homo sapiens
auuuauuucuagcaa

SEQ ID NO: 469758 - RNA, 18 nt, Homo sapiens
auuucagucaucaucuca

SEQ ID NO: 469759 - RNA, 21 nt, Homo sapiens
auuuccgugagagucaucuca

SEQ ID NO: 469760 - RNA, 13 nt, Homo sapiens
auuuccugacaga

SEQ ID NO: 469761 - RNA, 16 nt, Homo sapiens
auuugcaaaugcacau

SEQ ID NO: 469762 - RNA, 14 nt, Homo sapiens
auuugcauacuuaa

SEQ ID NO: 469763 - RNA, 13 nt, Homo sapiens
auuugccaaaaac

SEQ ID NO: 469764 - RNA, 18 nt, Homo sapiens
auuuuaauguaaaauuca

SEQ ID NO: 469765 - RNA, 17 nt, Homo sapiens
auuuuaucucuucuucc

SEQ ID NO: 469766 - RNA, 13 nt, Homo sapiens
auuuugaaugaua

SEQ ID NO: 469767 - RNA, 16 nt, Homo sapiens
auuuuuuacuacauaa

SEQ ID NO: 469768 - RNA, 12 nt, Homo sapiens
caaaagguuaag

SEQ ID NO: 469769 - RNA, 18 nt, Homo sapiens
caaaagguuaagccauau

SEQ ID NO: 469770 - RNA, 17 nt, Homo sapiens
caaaagugauguuauag

SEQ ID NO: 469771 - RNA, 11 nt, Homo sapiens
caaaauacuuc

SEQ ID NO: 469772 - RNA, 18 nt, Homo sapiens
caaaaucugggaccaaaa

SEQ ID NO: 469773 - RNA, 15 nt, Homo sapiens
caaacccagccucua

SEQ ID NO: 469774 - RNA, 17 nt, Homo sapiens
caaacccagccucuaga

SEQ ID NO: 469775 - RNA, 17 nt, Homo sapiens
caaacgcuguauuccaa

SEQ ID NO: 469776 - RNA, 21 nt, Homo sapiens
caaagacuacuaaugacuuug

SEQ ID NO: 469777 - RNA, 18 nt, Homo sapiens
caaagaggccaguacuuu

SEQ ID NO: 469778 - RNA, 15 nt, Homo sapiens
caaaggaaacccaau

SEQ ID NO: 469779 - RNA, 15 nt, Homo sapiens
caaaggaguggucaa

SEQ ID NO: 469780 - RNA, 22 nt, Homo sapiens
caaaggccguuagggaaaucca

SEQ ID NO: 469781 - RNA, 16 nt, Homo sapiens
caaauaacaguggcaa

SEQ ID NO: 469782 - RNA, 15 nt, Homo sapiens
caaauauuucacuua

SEQ ID NO: 469783 - RNA, 20 nt, Homo sapiens
caaaugccuucuguuuucca

SEQ ID NO: 469784 - RNA, 12 nt, Homo sapiens
caaauguuauag

SEQ ID NO: 469785 - RNA, 13 nt, Homo sapiens
cuuuccuguaaag

SEQ ID NO: 469786 - RNA, 22 nt, Homo sapiens
cuuucuuacauuagcaguuugc

SEQ ID NO: 469787 - RNA, 16 nt, Homo sapiens
cuuugugugauugaau

SEQ ID NO: 469788 - RNA, 15 nt, Homo sapiens
cuuuguuuacaugag

SEQ ID NO: 469789 - RNA, 23 nt, Homo sapiens
cuuuucacugcuggcugccuuag

SEQ ID NO: 469790 - RNA, 22 nt, Homo sapiens
cuuuucccagaagagucuuuga

SEQ ID NO: 469791 - RNA, 23 nt, Homo sapiens
cuuuugggauguuaccuucacau

SEQ ID NO: 469792 - RNA, 13 nt, Homo sapiens
cuuuuuccaucuc

SEQ ID NO: 469793 - RNA, 22 nt, Homo sapiens
gaaaaaaggaaguggaaugggu

SEQ ID NO: 469794 - RNA, 16 nt, Homo sapiens
gaaacacagaacucag

SEQ ID NO: 469795 - RNA, 12 nt, Homo sapiens
gaaagacaguaa

SEQ ID NO: 469796 - RNA, 23 nt, Homo sapiens
gaaagagcuggcaaacugugaau

SEQ ID NO: 469797 - RNA, 19 nt, Homo sapiens
gaaagaguugccauaauga

SEQ ID NO: 469798 - RNA, 21 nt, Homo sapiens
gaaagaucccaagucaaacag

SEQ ID NO: 469799 - RNA, 14 nt, Homo sapiens
gaaaggucaucuca

SEQ ID NO: 469800 - RNA, 20 nt, Homo sapiens
gaaauccuaguggccuccca

SEQ ID NO: 469801 - RNA, 17 nt, Homo sapiens
gaaauggcuuuccacau

SEQ ID NO: 469802 - RNA, 19 nt, Homo sapiens
gaaauucuauaagagacaa

SEQ ID NO: 469803 - RNA, 19 nt, Homo sapiens
gaaauugcauuuccugaca

SEQ ID NO: 469804 - RNA, 18 nt, Homo sapiens
gaaccucguugacaugca

SEQ ID NO: 469805 - RNA, 13 nt, Homo sapiens
gaaccuuuccucu

SEQ ID NO: 469806 - RNA, 22 nt, Homo sapiens
gaagaacagaauugcuccugca

SEQ ID NO: 469807 - RNA, 21 nt, Homo sapiens
gaagcagugcgugugaaacag

SEQ ID NO: 469808 - RNA, 12 nt, Homo sapiens
gaaggccagcuu

SEQ ID NO: 469809 - RNA, 20 nt, Homo sapiens
gaagggccccacucagggau

SEQ ID NO: 469810 - RNA, 19 nt, Homo sapiens
gaagugacaccaguucuuu

SEQ ID NO: 469811 - RNA, 16 nt, Homo sapiens
gaagugccaugcucag

SEQ ID NO: 469812 - RNA, 12 nt, Homo sapiens
gaauaaagccuc

SEQ ID NO: 469813 - RNA, 24 nt, Homo sapiens
gaauacuguauuguuacagcugaa

SEQ ID NO: 469814 - RNA, 16 nt, Homo sapiens
gaauccauaucagcuc

SEQ ID NO: 469815 - RNA, 17 nt, Homo sapiens
gaaugaaugaaccauga

SEQ ID NO: 469816 - RNA, 13 nt, Homo sapiens
gaauguucugcug

SEQ ID NO: 469817 - RNA, 16 nt, Homo sapiens
gaauuuaucugugaau

SEQ ID NO: 469818 - RNA, 15 nt, Homo sapiens
gaauuucuuugucau

SEQ ID NO: 469819 - RNA, 12 nt, Homo sapiens
gacacaguauug

SEQ ID NO: 469820 - RNA, 15 nt, Homo sapiens
gacacguucuugcca

SEQ ID NO: 469821 - RNA, 16 nt, Homo sapiens
gacagacacugcugaa

SEQ ID NO: 469822 - RNA, 14 nt, Homo sapiens
gacagccuccuagg

SEQ ID NO: 469823 - RNA, 16 nt, Homo sapiens
gacaugcggcugccca

SEQ ID NO: 469824 - RNA, 15 nt, Homo sapiens
gacccucaaugccaa

SEQ ID NO: 469825 - RNA, 16 nt, Homo sapiens
gaccuggauguuauau

SEQ ID NO: 469826 - RNA, 23 nt, Homo sapiens
gacgaggcggagcgccaguggaa

SEQ ID NO: 469827 - RNA, 14 nt, Homo sapiens
gacggaaguggccu

SEQ ID NO: 469828 - RNA, 17 nt, Homo sapiens
gacuaacaacugggaaa

SEQ ID NO: 469829 - RNA, 19 nt, Homo sapiens
gacuagccugaaaauccaa

SEQ ID NO: 469830 - RNA, 18 nt, Homo sapiens
gacuauaaaaacugcccc

SEQ ID NO: 469831 - RNA, 16 nt, Homo sapiens
gacucccgccuuugac

SEQ ID NO: 469832 - RNA, 21 nt, Homo sapiens
gacuguauaguuuaaagggag

SEQ ID NO: 469833 - RNA, 12 nt, Homo sapiens
gacuuugccaca

SEQ ID NO: 469834 - RNA, 16 nt, Homo sapiens
gagaagauucaauuua

SEQ ID NO: 469835 - RNA, 23 nt, Homo sapiens
gagacaagaaauccuaguggccu

SEQ ID NO: 469836 - RNA, 17 nt, Homo sapiens
gagagacucacacugga

SEQ ID NO: 469837 - RNA, 23 nt, Homo sapiens
gagagcuaaauuacaauugucau

SEQ ID NO: 469838 - RNA, 16 nt, Homo sapiens
gagaguggcuccuccc

SEQ ID NO: 469839 - RNA, 22 nt, Homo sapiens
gagaguuucuauggauucacuu

SEQ ID NO: 469840 - RNA, 23 nt, Homo sapiens
gagaguuucuauggauucacuuc

SEQ ID NO: 469841 - RNA, 15 nt, Homo sapiens
gagcacuuuccacuu

SEQ ID NO: 469842 - RNA, 16 nt, Homo sapiens
gagcaugaagauaaau

SEQ ID NO: 469843 - RNA, 15 nt, Homo sapiens
gagccagucccucag

SEQ ID NO: 469844 - RNA, 13 nt, Homo sapiens
gagccaugcucuu

SEQ ID NO: 469845 - RNA, 23 nt, Homo sapiens
gagccucccccucagaugaucuc

SEQ ID NO: 469846 - RNA, 13 nt, Homo sapiens
gagcgggggcuaa

SEQ ID NO: 469847 - RNA, 11 nt, Homo sapiens
gagcuugacuu

SEQ ID NO: 469848 - RNA, 13 nt, Homo sapiens
gagcuugacuuca

SEQ ID NO: 469849 - RNA, 15 nt, Homo sapiens
gaggacagaaccaac

SEQ ID NO: 469850 - RNA, 21 nt, Homo sapiens
gaggacagggagggaacagac

SEQ ID NO: 469851 - RNA, 21 nt, Homo sapiens
gaggcagaauggugggcucca

SEQ ID NO: 469852 - RNA, 16 nt, Homo sapiens
gaggcguauguggcaa

SEQ ID NO: 469853 - RNA, 22 nt, Homo sapiens
gagugaauacacuggaauucag

SEQ ID NO: 469854 - RNA, 21 nt, Homo sapiens
gauagaguucuuuuaagccca

SEQ ID NO: 469855 - RNA, 14 nt, Homo sapiens
gauagauaaugccu

SEQ ID NO: 469856 - RNA, 18 nt, Homo sapiens
gauagcuuggagggaugg

SEQ ID NO: 469857 - RNA, 14 nt, Homo sapiens
gauaggagcuucca

SEQ ID NO: 469858 - RNA, 15 nt, Homo sapiens
gauauaagaaauaca

SEQ ID NO: 469859 - RNA, 15 nt, Homo sapiens
gaucagaauguuuca

SEQ ID NO: 469860 - RNA, 12 nt, Homo sapiens
gaucagcuggug

SEQ ID NO: 469861 - RNA, 21 nt, Homo sapiens
gaugggagagguucugugcaa

SEQ ID NO: 469862 - RNA, 20 nt, Homo sapiens
gauggguuuuguuaggggug

SEQ ID NO: 469863 - RNA, 14 nt, Homo sapiens
gauuaaaaccagag

SEQ ID NO: 469864 - RNA, 11 nt, Homo sapiens
gauucaaugug

SEQ ID NO: 469865 - RNA, 22 nt, Homo sapiens
gauucaccuccauuaaccaaga

SEQ ID NO: 469866 - RNA, 16 nt, Homo sapiens
gauucuaaaacauucu

SEQ ID NO: 469867 - RNA, 18 nt, Homo sapiens
gauucuaaaggggacaga

SEQ ID NO: 469868 - RNA, 16 nt, Homo sapiens
gauuuaugaucacuug

SEQ ID NO: 469869 - RNA, 22 nt, Homo sapiens
gcaagugauugaaaauaguaaa

SEQ ID NO: 469870 - RNA, 19 nt, Homo sapiens
gcaauaaaaccaagugcuu

SEQ ID NO: 469871 - RNA, 13 nt, Homo sapiens
gcaauaacaguuu

SEQ ID NO: 469872 - RNA, 17 nt, Homo sapiens
gcacuguauccaaguua

SEQ ID NO: 469873 - RNA, 16 nt, Homo sapiens
gcacuguuucuucuca

SEQ ID NO: 469874 - RNA, 15 nt, Homo sapiens
gcacuuuccacugga

SEQ ID NO: 469875 - RNA, 16 nt, Homo sapiens
gcacuuuccacuucca

SEQ ID NO: 469876 - RNA, 21 nt, Homo sapiens
gcagagcccucaugugacaug

SEQ ID NO: 469877 - RNA, 14 nt, Homo sapiens
gcaggguucuagaa

SEQ ID NO: 469878 - RNA, 22 nt, Homo sapiens
gcaguguguacuucuucaucca

SEQ ID NO: 469879 - RNA, 17 nt, Homo sapiens
gcauccauguaaucuau

SEQ ID NO: 469880 - RNA, 17 nt, Homo sapiens
gcaugaaaccacuggaa

SEQ ID NO: 469881 - RNA, 13 nt, Homo sapiens
gcaugaagcacau

SEQ ID NO: 469882 - RNA, 15 nt, Homo sapiens
gccaaggacacugau

SEQ ID NO: 469883 - RNA, 18 nt, Homo sapiens
gccaauggagacugucuc

SEQ ID NO: 469884 - RNA, 22 nt, Homo sapiens
gccaccccacugagagcugcuc

SEQ ID NO: 469885 - RNA, 17 nt, Homo sapiens
gccacugaauuaugcca

SEQ ID NO: 469886 - RNA, 15 nt, Homo sapiens
gccagaggcucuaau

SEQ ID NO: 469887 - RNA, 15 nt, Homo sapiens
gccaggccaacugcc

SEQ ID NO: 469888 - RNA, 12 nt, Homo sapiens
gccagguggcca

SEQ ID NO: 469889 - RNA, 17 nt, Homo sapiens
gcccaguuagcccggcc

SEQ ID NO: 469890 - RNA, 17 nt, Homo sapiens
gcccccucucuuacccc

SEQ ID NO: 469891 - RNA, 18 nt, Homo sapiens
gcccgacagccuggcaca

SEQ ID NO: 469892 - RNA, 21 nt, Homo sapiens
gcccuccccaggcgauggaca

SEQ ID NO: 469893 - RNA, 15 nt, Homo sapiens
gcccuggugcugcca

SEQ ID NO: 469894 - RNA, 18 nt, Homo sapiens
gcccuuccucuccacugc

SEQ ID NO: 469895 - RNA, 19 nt, Homo sapiens
gccgugccuucagcucuac

SEQ ID NO: 469896 - RNA, 22 nt, Homo sapiens
gccguuagggaaauccaacucc

SEQ ID NO: 469897 - RNA, 18 nt, Homo sapiens
gccucgugccaugaucug

SEQ ID NO: 469898 - RNA, 15 nt, Homo sapiens
gccucuagaacagcc

SEQ ID NO: 469899 - RNA, 16 nt, Homo sapiens
gccucuagaacagcca

SEQ ID NO: 469900 - RNA, 19 nt, Homo sapiens
gccucucugguugccaaau

SEQ ID NO: 469901 - RNA, 14 nt, Homo sapiens
gccucugugcugca

SEQ ID NO: 469902 - RNA, 17 nt, Homo sapiens
gccugaauccaccugca

SEQ ID NO: 469903 - RNA, 14 nt, Homo sapiens
gccugacauugggg

SEQ ID NO: 469904 - RNA, 18 nt, Homo sapiens
gccugaggaaguuuugca

SEQ ID NO: 469905 - RNA, 19 nt, Homo sapiens
gccugcucccuagccagag

SEQ ID NO: 469906 - RNA, 19 nt, Homo sapiens
gccugugaucguguguugc

SEQ ID NO: 469907 - RNA, 21 nt, Homo sapiens
gccuuucuaguccuauucuau

SEQ ID NO: 469908 - RNA, 15 nt, Homo sapiens
gccuuuguugcucag

SEQ ID NO: 469909 - RNA, 20 nt, Homo sapiens
gcgcuccucugcagccugag

SEQ ID NO: 469910 - RNA, 16 nt, Homo sapiens
gcggggagcaugaaga

SEQ ID NO: 469911 - RNA, 20 nt, Homo sapiens
gcguuaaagucaggauuuau

SEQ ID NO: 469912 - RNA, 20 nt, Homo sapiens
gcuagaauauccuauacugg

SEQ ID NO: 469913 - RNA, 19 nt, Homo sapiens
gcuauacagaaaaaccaca

SEQ ID NO: 469914 - RNA, 12 nt, Homo sapiens
gcucacacagcu

SEQ ID NO: 469915 - RNA, 22 nt, Homo sapiens
gcucagaaauguugguuacaug

SEQ ID NO: 469916 - RNA, 19 nt, Homo sapiens
gcucccgcgggaagccagc

SEQ ID NO: 469917 - RNA, 23 nt, Homo sapiens
gcucccucccccgcggugccuuc

SEQ ID NO: 469918 - RNA, 17 nt, Homo sapiens
gcucuaauguacaauaa

SEQ ID NO: 469919 - RNA, 19 nt, Homo sapiens
gcucuccuucacucugaca

SEQ ID NO: 469920 - RNA, 14 nt, Homo sapiens
gcugaagucucccc

SEQ ID NO: 469921 - RNA, 23 nt, Homo sapiens
gcugaaugugauacaugccgaau

SEQ ID NO: 469922 - RNA, 19 nt, Homo sapiens
gcuggaugugcuuucaucc

SEQ ID NO: 469923 - RNA, 17 nt, Homo sapiens
gcuggcaaacugugaau

SEQ ID NO: 469924 - RNA, 23 nt, Homo sapiens
gcuguauuuucuuuuauaucugu

SEQ ID NO: 469925 - RNA, 15 nt, Homo sapiens
gcuucaaaacagaac

SEQ ID NO: 469926 - RNA, 14 nt, Homo sapiens
gcuucuaccagaga

SEQ ID NO: 469927 - RNA, 21 nt, Homo sapiens
gcuuguucuuccucuuaccug

SEQ ID NO: 469928 - RNA, 22 nt, Homo sapiens
gcuuguucuuccucuuaccugu

SEQ ID NO: 469929 - RNA, 16 nt, Homo sapiens
gcuuuccacaucccca

SEQ ID NO: 469930 - RNA, 17 nt, Homo sapiens
gcuuuccucccaaaggc

SEQ ID NO: 469931 - RNA, 14 nt, Homo sapiens
gcuuuggugccugg

SEQ ID NO: 469932 - RNA, 16 nt, Homo sapiens
gcuuuuuccaucucaa

SEQ ID NO: 469933 - RNA, 20 nt, Homo sapiens
ggaaauaagcaaaaaacugc

SEQ ID NO: 469934 - RNA, 19 nt, Homo sapiens
ggaaggucuccccaugugc

SEQ ID NO: 469935 - RNA, 15 nt, Homo sapiens
ggaaugcauccaaau

SEQ ID NO: 469936 - RNA, 19 nt, Homo sapiens
ggaauuucuguuagcaaua

SEQ ID NO: 469937 - RNA, 12 nt, Homo sapiens
ggaccagggaug

SEQ ID NO: 469938 - RNA, 18 nt, Homo sapiens
ggagccucccccucagau

SEQ ID NO: 469939 - RNA, 14 nt, Homo sapiens
ggaguaggcuguau

SEQ ID NO: 469940 - RNA, 17 nt, Homo sapiens
ggauaggagcuuccaga

SEQ ID NO: 469941 - RNA, 14 nt, Homo sapiens
ggauccugcacucu

SEQ ID NO: 469942 - RNA, 19 nt, Homo sapiens
ggaucuucccacuuugcca

SEQ ID NO: 469943 - RNA, 20 nt, Homo sapiens
ggaugcauucccuacagauu

SEQ ID NO: 469944 - RNA, 12 nt, Homo sapiens
ggauuaaucucu

SEQ ID NO: 469945 - RNA, 21 nt, Homo sapiens
ggauucauguccagagcucau

SEQ ID NO: 469946 - RNA, 20 nt, Homo sapiens
ggcaacucacgggugcauga

SEQ ID NO: 469947 - RNA, 22 nt, Homo sapiens
ggcaccccuuaauggaaacacg

SEQ ID NO: 469948 - RNA, 16 nt, Homo sapiens
ggcagaauggugggcu

SEQ ID NO: 469949 - RNA, 19 nt, Homo sapiens
ggccacugaauuaugccag

SEQ ID NO: 469950 - RNA, 15 nt, Homo sapiens
ggccccacucaggga

SEQ ID NO: 469951 - RNA, 19 nt, Homo sapiens
ggcccgacagccuggcaca

SEQ ID NO: 469952 - RNA, 14 nt, Homo sapiens
ggcccgccaccuug

SEQ ID NO: 469953 - RNA, 17 nt, Homo sapiens
ggcggagcgccagugga

SEQ ID NO: 469954 - RNA, 21 nt, Homo sapiens
ggcugucugucaccagcuauc

SEQ ID NO: 469955 - RNA, 16 nt, Homo sapiens
ggcuuagaauggggcu

SEQ ID NO: 469956 - RNA, 14 nt, Homo sapiens
ggcuuggugaaugc

SEQ ID NO: 469957 - RNA, 16 nt, Homo sapiens
gggacaacguccuucc

SEQ ID NO: 469958 - RNA, 14 nt, Homo sapiens
gggaccagggaugg

SEQ ID NO: 469959 - RNA, 14 nt, Homo sapiens
gggaggaacaaaga

SEQ ID NO: 469960 - RNA, 23 nt, Homo sapiens
gggccaagccaggguuccagaca

SEQ ID NO: 469961 - RNA, 19 nt, Homo sapiens
gggccgccuccuccagacu

SEQ ID NO: 469962 - RNA, 23 nt, Homo sapiens
ggggaagggccccacucagggau

SEQ ID NO: 469963 - RNA, 14 nt, Homo sapiens
ggggcacuguuucu

SEQ ID NO: 469964 - RNA, 14 nt, Homo sapiens
gggugaaaccacau

SEQ ID NO: 469965 - RNA, 21 nt, Homo sapiens
gguccucugcaugucucaggc

SEQ ID NO: 469966 - RNA, 19 nt, Homo sapiens
ggucucaccuucgccuuug

SEQ ID NO: 469967 - RNA, 16 nt, Homo sapiens
ggucucccuauaccga

SEQ ID NO: 469968 - RNA, 15 nt, Homo sapiens
ggugcucuuccucau

SEQ ID NO: 469969 - RNA, 15 nt, Homo sapiens
gguggggcuuggaag

SEQ ID NO: 469970 - RNA, 21 nt, Homo sapiens
gguguccuguuccugccacau

SEQ ID NO: 469971 - RNA, 14 nt, Homo sapiens
gguguggcuuggaa

SEQ ID NO: 469972 - RNA, 17 nt, Homo sapiens
gguguucccuuggcaaa

SEQ ID NO: 469973 - RNA, 23 nt, Homo sapiens
gguucugugcaaaacuaccacau

SEQ ID NO: 469974 - RNA, 14 nt, Homo sapiens
gguuucaccuccca

SEQ ID NO: 469975 - RNA, 16 nt, Homo sapiens
gguuucaccucccaaa

SEQ ID NO: 469976 - RNA, 18 nt, Homo sapiens
guaacacaauuuucacuu

SEQ ID NO: 469977 - RNA, 15 nt, Homo sapiens
guaaguugaagggaa

SEQ ID NO: 469978 - RNA, 15 nt, Homo sapiens
guacuuacacugaaa

SEQ ID NO: 469979 - RNA, 15 nt, Homo sapiens
guacuucaguucuca

SEQ ID NO: 469980 - RNA, 12 nt, Homo sapiens
guagcacacuga

SEQ ID NO: 469981 - RNA, 18 nt, Homo sapiens
guagcauuucuugauguu

SEQ ID NO: 469982 - RNA, 12 nt, Homo sapiens
guauaucagcuc

SEQ ID NO: 469983 - RNA, 17 nt, Homo sapiens
guauuauggugauacuc

SEQ ID NO: 469984 - RNA, 13 nt, Homo sapiens
guauuugggauau

SEQ ID NO: 469985 - RNA, 21 nt, Homo sapiens
guauuuuacuuugugcaauau

SEQ ID NO: 469986 - RNA, 18 nt, Homo sapiens
gucaagcccuugcccaga

SEQ ID NO: 469987 - RNA, 20 nt, Homo sapiens
gucacaggguguuggaagau

SEQ ID NO: 469988 - RNA, 15 nt, Homo sapiens
gucagucccuacuua

SEQ ID NO: 469989 - RNA, 23 nt, Homo sapiens
gucaguugcaaauuuuagcguua

SEQ ID NO: 469990 - RNA, 13 nt, Homo sapiens
gucauaaugucau

SEQ ID NO: 469991 - RNA, 16 nt, Homo sapiens
gucaucucaaacacug

SEQ ID NO: 469992 - RNA, 14 nt, Homo sapiens
guccccagccugcu

SEQ ID NO: 469993 - RNA, 22 nt, Homo sapiens
guccccagccugcucccuagcc

SEQ ID NO: 469994 - RNA, 19 nt, Homo sapiens
guccuuagaauacuguauu

SEQ ID NO: 469995 - RNA, 14 nt, Homo sapiens
gucgcugugcccug

SEQ ID NO: 469996 - RNA, 16 nt, Homo sapiens
gucugagaagauucaa

SEQ ID NO: 469997 - RNA, 15 nt, Homo sapiens
gucuguccuuuccca

SEQ ID NO: 469998 - RNA, 21 nt, Homo sapiens
gucuguuucaaugaccuguau

SEQ ID NO: 469999 - RNA, 15 nt, Homo sapiens
gucuucccugcuuca

SEQ ID NO: 470000 - RNA, 21 nt, Homo sapiens
gucuuucgcacauucuccuga

SEQ ID NO: 470001 - RNA, 22 nt, Homo sapiens
gugaaacccuacgaaagcacag

SEQ ID NO: 470002 - RNA, 21 nt, Homo sapiens
gugaauccuuuguacugauga

SEQ ID NO: 470003 - RNA, 22 nt, Homo sapiens
gugaaugcugcugagugaauga

SEQ ID NO: 470004 - RNA, 23 nt, Homo sapiens
gugagcuauaauguuucccucaa

SEQ ID NO: 470005 - RNA, 15 nt, Homo sapiens
gugauguguuuccau

SEQ ID NO: 470006 - RNA, 12 nt, Homo sapiens
gugauguuauag

SEQ ID NO: 470007 - RNA, 13 nt, Homo sapiens
gugccaugaucug

SEQ ID NO: 470008 - RNA, 12 nt, Homo sapiens
gugccugugauc

SEQ ID NO: 470009 - RNA, 19 nt, Homo sapiens
gugcucuuccucaucucau

SEQ ID NO: 470010 - RNA, 15 nt, Homo sapiens
gugcugcagguguaa

SEQ ID NO: 470011 - RNA, 18 nt, Homo sapiens
gugcugugggcagcaccc

SEQ ID NO: 470012 - RNA, 14 nt, Homo sapiens
gugcuuguucuucc

SEQ ID NO: 470013 - RNA, 23 nt, Homo sapiens
guguacuucuucauccauagaca

SEQ ID NO: 470014 - RNA, 19 nt, Homo sapiens
gugucuaguuugcauacuu

SEQ ID NO: 470015 - RNA, 14 nt, Homo sapiens
guguggaguggagg

SEQ ID NO: 470016 - RNA, 22 nt, Homo sapiens
guguggcuuggaacauuuggga

SEQ ID NO: 470017 - RNA, 14 nt, Homo sapiens
guuaagccauauga

SEQ ID NO: 470018 - RNA, 16 nt, Homo sapiens
guuaagugacugagaa

SEQ ID NO: 470019 - RNA, 17 nt, Homo sapiens
guuaauggucaaugcua

SEQ ID NO: 470020 - RNA, 14 nt, Homo sapiens
guuaaugugccaaa

SEQ ID NO: 470021 - RNA, 16 nt, Homo sapiens
guuaaugugccaaaau

SEQ ID NO: 470022 - RNA, 13 nt, Homo sapiens
guuagauguccuc

SEQ ID NO: 470023 - RNA, 17 nt, Homo sapiens
guuagauguccucagaa

SEQ ID NO: 470024 - RNA, 14 nt, Homo sapiens
guuauaguugauau

SEQ ID NO: 470025 - RNA, 22 nt, Homo sapiens
guuauccugcuagcuguagaaa

SEQ ID NO: 470026 - RNA, 22 nt, Homo sapiens
guuaucuucuaucaaagcacau

SEQ ID NO: 470027 - RNA, 17 nt, Homo sapiens
guuccaugaagacaaau

SEQ ID NO: 470028 - RNA, 17 nt, Homo sapiens
guucuuccucuuaccug

SEQ ID NO: 470029 - RNA, 20 nt, Homo sapiens
guuggccauguucauucaca

SEQ ID NO: 470030 - RNA, 16 nt, Homo sapiens
guugguuuauacugua

SEQ ID NO: 470031 - RNA, 18 nt, Homo sapiens
guugugugugcuuucuaa

SEQ ID NO: 470032 - RNA, 18 nt, Homo sapiens
guuuccaaguuuauugcc

SEQ ID NO: 470033 - RNA, 16 nt, Homo sapiens
guuucucaagcgcuau

SEQ ID NO: 470034 - RNA, 20 nt, Homo sapiens
guuugcaaucuuauguugau

SEQ ID NO: 470035 - RNA, 22 nt, Homo sapiens
guuuguaggguggaugggauac

SEQ ID NO: 470036 - RNA, 17 nt, Homo sapiens
guuuuuaucauggguau

SEQ ID NO: 470037 - RNA, 12 nt, Homo sapiens
uaaaaaagcauu

SEQ ID NO: 470038 - RNA, 23 nt, Homo sapiens
uaaaaacccuguauggcacuuau

SEQ ID NO: 470039 - RNA, 20 nt, Homo sapiens
uaaaacugucuugugagcug

SEQ ID NO: 470040 - RNA, 16 nt, Homo sapiens
uaaaagacugucuuaa

SEQ ID NO: 470041 - RNA, 18 nt, Homo sapiens
uaaaauaacuaagcaagu

SEQ ID NO: 470042 - RNA, 12 nt, Homo sapiens
uaaacugcaguu

SEQ ID NO: 470043 - RNA, 14 nt, Homo sapiens
uaaagaaaggcaga

SEQ ID NO: 470044 - RNA, 15 nt, Homo sapiens
uaaagcaauguggua

SEQ ID NO: 470045 - RNA, 17 nt, Homo sapiens
uaaagcaaugugguagu

SEQ ID NO: 470046 - RNA, 17 nt, Homo sapiens
uaaagccucugugcugc

SEQ ID NO: 470047 - RNA, 20 nt, Homo sapiens
uaaaggggcugucucccaau

SEQ ID NO: 470048 - RNA, 15 nt, Homo sapiens
uaaagucaggauuua

SEQ ID NO: 470049 - RNA, 16 nt, Homo sapiens
uaaaguuccaugaaga

SEQ ID NO: 470050 - RNA, 21 nt, Homo sapiens
uaaauaaagaagaaaauaacc

SEQ ID NO: 470051 - RNA, 13 nt, Homo sapiens
uaaauaaugauuc

SEQ ID NO: 470052 - RNA, 12 nt, Homo sapiens
uaaauguuauau

SEQ ID NO: 470053 - RNA, 18 nt, Homo sapiens
uaacacaauuuucacuuu

SEQ ID NO: 470054 - RNA, 15 nt, Homo sapiens
uaacaucaaagacuc

SEQ ID NO: 470055 - RNA, 22 nt, Homo sapiens
uaaccaaaugcaaugugaaaua

SEQ ID NO: 470056 - RNA, 21 nt, Homo sapiens
uaaccuauucccaaaugccuu

SEQ ID NO: 470057 - RNA, 20 nt, Homo sapiens
uaaccucuacaggcauuuaa

SEQ ID NO: 470058 - RNA, 15 nt, Homo sapiens
uaagaaaagcuucca

SEQ ID NO: 470059 - RNA, 22 nt, Homo sapiens
uaagccauaugacaauuucaaa

SEQ ID NO: 470060 - RNA, 19 nt, Homo sapiens
uaagcccccucaacuacca

SEQ ID NO: 470061 - RNA, 18 nt, Homo sapiens
uaagcccccucuugagag

SEQ ID NO: 470062 - RNA, 23 nt, Homo sapiens
uaaggaucuucccacuuugccac

SEQ ID NO: 470063 - RNA, 19 nt, Homo sapiens
uaaguuccaaaaauaccau

SEQ ID NO: 470064 - RNA, 13 nt, Homo sapiens
uaaguugucuuac

SEQ ID NO: 470065 - RNA, 17 nt, Homo sapiens
uaauaauaaaacaacag

SEQ ID NO: 470066 - RNA, 18 nt, Homo sapiens
uaaucccaauuuccccug

SEQ ID NO: 470067 - RNA, 18 nt, Homo sapiens
uaauggucaaugcuagca

SEQ ID NO: 470068 - RNA, 13 nt, Homo sapiens
uaaugucaucucu

SEQ ID NO: 470069 - RNA, 11 nt, Homo sapiens
uaauguuauag

SEQ ID NO: 470070 - RNA, 17 nt, Homo sapiens
uaauuauguuuaccuca

SEQ ID NO: 470071 - RNA, 15 nt, Homo sapiens
uacaauaaagcaaug

SEQ ID NO: 470072 - RNA, 15 nt, Homo sapiens
uacacccccaccucc

SEQ ID NO: 470073 - RNA, 24 nt, Homo sapiens
uacagaaucuaacugguggacaug

SEQ ID NO: 470074 - RNA, 22 nt, Homo sapiens
uacauaauuaaauuuuaaugua

SEQ ID NO: 470075 - RNA, 15 nt, Homo sapiens
uaccagagacucuga

SEQ ID NO: 470076 - RNA, 16 nt, Homo sapiens
uaccagguuaccucac

SEQ ID NO: 470077 - RNA, 21 nt, Homo sapiens
uaccccgauccguuugcaaga

SEQ ID NO: 470078 - RNA, 13 nt, Homo sapiens
uacgaaagcacag

SEQ ID NO: 470079 - RNA, 22 nt, Homo sapiens
uacguagggcuucuaccagaga

SEQ ID NO: 470080 - RNA, 22 nt, Homo sapiens
uacucagcaacuguuagcuggg

SEQ ID NO: 470081 - RNA, 15 nt, Homo sapiens
uacuguauuguuaca

SEQ ID NO: 470082 - RNA, 19 nt, Homo sapiens
uacuuaggaaauacucagc

SEQ ID NO: 470083 - RNA, 16 nt, Homo sapiens
uacuucuuuuucauua

SEQ ID NO: 470084 - RNA, 12 nt, Homo sapiens
uagaacagccag

SEQ ID NO: 470085 - RNA, 20 nt, Homo sapiens
uagaacagccagacccugca

SEQ ID NO: 470086 - RNA, 15 nt, Homo sapiens
uagaagauaacuggc

SEQ ID NO: 470087 - RNA, 14 nt, Homo sapiens
uagaauacuguauu

SEQ ID NO: 470088 - RNA, 16 nt, Homo sapiens
uagaauggggcuucca

SEQ ID NO: 470089 - RNA, 17 nt, Homo sapiens
uagaauggggcuuccau

SEQ ID NO: 470090 - RNA, 14 nt, Homo sapiens
uagacacaguauug

SEQ ID NO: 470091 - RNA, 18 nt, Homo sapiens
uagaccuggauguuauau

SEQ ID NO: 470092 - RNA, 19 nt, Homo sapiens
uagagcacuagaagcacag

SEQ ID NO: 470093 - RNA, 18 nt, Homo sapiens
uagaggcuugaucaugaa

SEQ ID NO: 470094 - RNA, 18 nt, Homo sapiens
uagaggggcaacugauga

SEQ ID NO: 470095 - RNA, 14 nt, Homo sapiens
uagauaagugcuca

SEQ ID NO: 470096 - RNA, 23 nt, Homo sapiens
uagcaccccccauuggggcuaua

SEQ ID NO: 470097 - RNA, 21 nt, Homo sapiens
uagcauccaaggggccuggaa

SEQ ID NO: 470098 - RNA, 14 nt, Homo sapiens
uagccucaccuucc

SEQ ID NO: 470099 - RNA, 20 nt, Homo sapiens
uagcuuggagggauggagag

SEQ ID NO: 470100 - RNA, 22 nt, Homo sapiens
uagggaugccuuucuaguccua

SEQ ID NO: 470101 - RNA, 22 nt, Homo sapiens
uaggugcucuuccucaucucau

SEQ ID NO: 470102 - RNA, 20 nt, Homo sapiens
uagguuaauaggaggacaga

SEQ ID NO: 470103 - RNA, 18 nt, Homo sapiens
uaguccuauucuauugca

SEQ ID NO: 470104 - RNA, 18 nt, Homo sapiens
uagugaaaggucaucuca

SEQ ID NO: 470105 - RNA, 18 nt, Homo sapiens
uaguggccacacucugcc

SEQ ID NO: 470106 - RNA, 22 nt, Homo sapiens
uagugguauagaguacugcaga

SEQ ID NO: 470107 - RNA, 19 nt, Homo sapiens
uaguuaauuguggcuuuau

SEQ ID NO: 470108 - RNA, 14 nt, Homo sapiens
uaguuagaaagggu

SEQ ID NO: 470109 - RNA, 14 nt, Homo sapiens
uaguucuauuucua

SEQ ID NO: 470110 - RNA, 22 nt, Homo sapiens
uauaacacagacgagccccaga

SEQ ID NO: 470111 - RNA, 19 nt, Homo sapiens
uauacaaagcugucacuca

SEQ ID NO: 470112 - RNA, 21 nt, Homo sapiens
uauacauagucuuuguuuaca

SEQ ID NO: 470113 - RNA, 15 nt, Homo sapiens
uauacuucacacuga

SEQ ID NO: 470114 - RNA, 18 nt, Homo sapiens
uaucagaacuccuuucua

SEQ ID NO: 470115 - RNA, 16 nt, Homo sapiens
uauccugcuagcugua

SEQ ID NO: 470116 - RNA, 14 nt, Homo sapiens
ucuuugaaagggcu

SEQ ID NO: 470117 - RNA, 22 nt, Homo sapiens
ucuuuucuucuccgccaguaug

SEQ ID NO: 470118 - RNA, 23 nt, Homo sapiens
ucuuuuuucaauguacuguauug

SEQ ID NO: 470119 - RNA, 15 nt, Homo sapiens
ugaaaacuggauuau

SEQ ID NO: 470120 - RNA, 14 nt, Homo sapiens
ugaaaccacuggaa

SEQ ID NO: 470121 - RNA, 15 nt, Homo sapiens
ugaaaggucaucuca

SEQ ID NO: 470122 - RNA, 15 nt, Homo sapiens
ugaaauccaaaauag

SEQ ID NO: 470123 - RNA, 15 nt, Homo sapiens
ugaaauuggaaagga

SEQ ID NO: 470124 - RNA, 14 nt, Homo sapiens
ugaaauuuacaguu

SEQ ID NO: 470125 - RNA, 20 nt, Homo sapiens
ugaacaaagacuacuaauga

SEQ ID NO: 470126 - RNA, 18 nt, Homo sapiens
ugaacaagauuucccuaa

SEQ ID NO: 470127 - RNA, 15 nt, Homo sapiens
ugaaccgucaaugug

SEQ ID NO: 470128 - RNA, 15 nt, Homo sapiens
ugaaggacuacaggu

SEQ ID NO: 470129 - RNA, 21 nt, Homo sapiens
ugaaguguuagagugucuuaa

SEQ ID NO: 470130 - RNA, 17 nt, Homo sapiens
ugaauaaaaacccugua

SEQ ID NO: 470131 - RNA, 16 nt, Homo sapiens
ugaauguuaaugguca

SEQ ID NO: 470132 - RNA, 18 nt, Homo sapiens
ugaauuuuaaaaugcaaa

SEQ ID NO: 470133 - RNA, 13 nt, Homo sapiens
ugacaccacuaaa

SEQ ID NO: 470134 - RNA, 17 nt, Homo sapiens
ugacuauaaaaacugcc

SEQ ID NO: 470135 - RNA, 22 nt, Homo sapiens
ugacuauuucaccauguugcca

SEQ ID NO: 470136 - RNA, 20 nt, Homo sapiens
ugacucaccuugcucugcca

SEQ ID NO: 470137 - RNA, 19 nt, Homo sapiens
ugacucacucauaaagguu

SEQ ID NO: 470138 - RNA, 13 nt, Homo sapiens
ugagacacaagau

SEQ ID NO: 470139 - RNA, 23 nt, Homo sapiens
ugagcccaauguauuaugaucuc

SEQ ID NO: 470140 - RNA, 15 nt, Homo sapiens
ugaggaguaaaaaga

SEQ ID NO: 470141 - RNA, 15 nt, Homo sapiens
ugaggcccacucugu

SEQ ID NO: 470142 - RNA, 18 nt, Homo sapiens
ugagucccuuccagucau

SEQ ID NO: 470143 - RNA, 14 nt, Homo sapiens
ugaguucaaauacu

SEQ ID NO: 470144 - RNA, 17 nt, Homo sapiens
ugaguuugaacacagau

SEQ ID NO: 470145 - RNA, 13 nt, Homo sapiens
ugauucuaaaggg

SEQ ID NO: 470146 - RNA, 20 nt, Homo sapiens
ugauugaaucugauuggaca

SEQ ID NO: 470147 - RNA, 16 nt, Homo sapiens
ugauuuaaacucuuag

SEQ ID NO: 470148 - RNA, 16 nt, Homo sapiens
ugauuuaugaucacuu

SEQ ID NO: 470149 - RNA, 19 nt, Homo sapiens
ugcaaaagguuaagccaua

SEQ ID NO: 470150 - RNA, 18 nt, Homo sapiens
ugcaauaaaauaguagca

SEQ ID NO: 470151 - RNA, 11 nt, Homo sapiens
ugcaaugugaa

SEQ ID NO: 470152 - RNA, 21 nt, Homo sapiens
ugcaccuacgggggcaucuga

SEQ ID NO: 470153 - RNA, 18 nt, Homo sapiens
ugcaccucuuugucacag

SEQ ID NO: 470154 - RNA, 14 nt, Homo sapiens
ugcagcaguaccau

SEQ ID NO: 470155 - RNA, 13 nt, Homo sapiens
ugcaggcuguguu

SEQ ID NO: 470156 - RNA, 15 nt, Homo sapiens
ugcaggguccccaag

SEQ ID NO: 470157 - RNA, 17 nt, Homo sapiens
ugcaguagagagcaaag

SEQ ID NO: 470158 - RNA, 17 nt, Homo sapiens
ugcaugaaaccacugga

SEQ ID NO: 470159 - RNA, 15 nt, Homo sapiens
ugcauucguccuuag

SEQ ID NO: 470160 - RNA, 20 nt, Homo sapiens
ugccaaaaacuaaaauucaa

SEQ ID NO: 470161 - RNA, 21 nt, Homo sapiens
ugccaaaaacuaaaauucaac

SEQ ID NO: 470162 - RNA, 23 nt, Homo sapiens
ugccacauggagcuugacuucau

SEQ ID NO: 470163 - RNA, 19 nt, Homo sapiens
ugccacugcuuucauugaa

SEQ ID NO: 470164 - RNA, 11 nt, Homo sapiens
ugccacuggau

SEQ ID NO: 470165 - RNA, 18 nt, Homo sapiens
ugccagacuuaaaucaca

SEQ ID NO: 470166 - RNA, 18 nt, Homo sapiens
ugcccaaccaaugcacac

SEQ ID NO: 470167 - RNA, 18 nt, Homo sapiens
ugcccaccacaacuaaca

SEQ ID NO: 470168 - RNA, 16 nt, Homo sapiens
ugcccagagcucucua

SEQ ID NO: 470169 - RNA, 21 nt, Homo sapiens
ugccgauuuccuaagcuguug

SEQ ID NO: 470170 - RNA, 19 nt, Homo sapiens
ugccgcuggaggccaccaa

SEQ ID NO: 470171 - RNA, 19 nt, Homo sapiens
ugccuggagggaauccaua

SEQ ID NO: 470172 - RNA, 16 nt, Homo sapiens
ugccuguauuuccaac

SEQ ID NO: 470173 - RNA, 19 nt, Homo sapiens
ugccuuacagacagaauau

SEQ ID NO: 470174 - RNA, 15 nt, Homo sapiens
ugcgcaauguggcau

SEQ ID NO: 470175 - RNA, 12 nt, Homo sapiens
ugcggugcauac

SEQ ID NO: 470176 - RNA, 23 nt, Homo sapiens
ugcggugcauacacccccaccuc

SEQ ID NO: 470177 - RNA, 21 nt, Homo sapiens
ugcucccuagccagaggcucu

SEQ ID NO: 470178 - RNA, 18 nt, Homo sapiens
ugcucuuccucaucucau

SEQ ID NO: 470179 - RNA, 19 nt, Homo sapiens
ugcugagagaccucaggga

SEQ ID NO: 470180 - RNA, 13 nt, Homo sapiens
ugcuucugugcaa

SEQ ID NO: 470181 - RNA, 14 nt, Homo sapiens
ugcuucugugcaau

SEQ ID NO: 470182 - RNA, 13 nt, Homo sapiens
uggaaaaugauua

SEQ ID NO: 470183 - RNA, 14 nt, Homo sapiens
uggaaguacauaaa

SEQ ID NO: 470184 - RNA, 16 nt, Homo sapiens
uggaauacuaaaguua

SEQ ID NO: 470185 - RNA, 19 nt, Homo sapiens
uggagauaccagagacucu

SEQ ID NO: 470186 - RNA, 17 nt, Homo sapiens
uggagaucuuaagauuc

SEQ ID NO: 470187 - RNA, 21 nt, Homo sapiens
uggauuuagacucauggaaua

SEQ ID NO: 470188 - RNA, 17 nt, Homo sapiens
uggcagauuuucuucua

SEQ ID NO: 470189 - RNA, 21 nt, Homo sapiens
uggcuggguuugggcagugga

SEQ ID NO: 470190 - RNA, 20 nt, Homo sapiens
ugggagagguucugugcaaa

SEQ ID NO: 470191 - RNA, 16 nt, Homo sapiens
ugggccaagccagggu

SEQ ID NO: 470192 - RNA, 15 nt, Homo sapiens
ugggucagcuugaau

SEQ ID NO: 470193 - RNA, 14 nt, Homo sapiens
ugggugucugcuaa

SEQ ID NO: 470194 - RNA, 15 nt, Homo sapiens
uggguuuacucugug

SEQ ID NO: 470195 - RNA, 14 nt, Homo sapiens
ugguaaaugucaca

SEQ ID NO: 470196 - RNA, 13 nt, Homo sapiens
uggugccuggaaa

SEQ ID NO: 470197 - RNA, 14 nt, Homo sapiens
ugguggcaccagau

SEQ ID NO: 470198 - RNA, 17 nt, Homo sapiens
ugguuuuaaaaaagcau

SEQ ID NO: 470199 - RNA, 19 nt, Homo sapiens
ugguuuuuaaguacucacu

SEQ ID NO: 470200 - RNA, 17 nt, Homo sapiens
uguaaaauucauagcau

SEQ ID NO: 470201 - RNA, 15 nt, Homo sapiens
uguaaacaucauaaa

SEQ ID NO: 470202 - RNA, 20 nt, Homo sapiens
uguaaauggaagcacugcca

SEQ ID NO: 470203 - RNA, 17 nt, Homo sapiens
uguaagaaaagcuucca

SEQ ID NO: 470204 - RNA, 13 nt, Homo sapiens
uguacaauaaagc

SEQ ID NO: 470205 - RNA, 14 nt, Homo sapiens
uguacaauaaagca

SEQ ID NO: 470206 - RNA, 14 nt, Homo sapiens
uguccaugugcaaa

SEQ ID NO: 470207 - RNA, 20 nt, Homo sapiens
ugucccagcaccuggcacac

SEQ ID NO: 470208 - RNA, 22 nt, Homo sapiens
uguccuccagggcgagcacuuu

SEQ ID NO: 470209 - RNA, 17 nt, Homo sapiens
ugucugucaccagcuau

SEQ ID NO: 470210 - RNA, 19 nt, Homo sapiens
ugucuuaaccuauucccaa

SEQ ID NO: 470211 - RNA, 16 nt, Homo sapiens
ugugaaauacucuucc

SEQ ID NO: 470212 - RNA, 18 nt, Homo sapiens
ugugaaauacucuuccaa

SEQ ID NO: 470213 - RNA, 19 nt, Homo sapiens
uuauugggcaagugauuga

SEQ ID NO: 470214 - RNA, 13 nt, Homo sapiens
uuauuucuagcaa

SEQ ID NO: 470215 - RNA, 13 nt, Homo sapiens
uuauuugaucugg

SEQ ID NO: 470216 - RNA, 19 nt, Homo sapiens
uucaaaacagaacggguuc

SEQ ID NO: 470217 - RNA, 17 nt, Homo sapiens
uucaaacaguuccauac

SEQ ID NO: 470218 - RNA, 20 nt, Homo sapiens
uucaaacaguuccauaccaa

SEQ ID NO: 470219 - RNA, 16 nt, Homo sapiens
uucaaagaaaacagac

SEQ ID NO: 470220 - RNA, 13 nt, Homo sapiens
uucaaaugcauga

SEQ ID NO: 470221 - RNA, 15 nt, Homo sapiens
uucaaugaccuguau

SEQ ID NO: 470222 - RNA, 22 nt, Homo sapiens
uucaauugcuucugugcaauaa

SEQ ID NO: 470223 - RNA, 21 nt, Homo sapiens
uucacauauuuguagcuagaa

SEQ ID NO: 470224 - RNA, 13 nt, Homo sapiens
uucacaucuguau

SEQ ID NO: 470225 - RNA, 14 nt, Homo sapiens
uucagacucucucc

SEQ ID NO: 470226 - RNA, 18 nt, Homo sapiens
uucaggaaugggccaagc

SEQ ID NO: 470227 - RNA, 22 nt, Homo sapiens
uucaucaaguagcguuggagac

SEQ ID NO: 470228 - RNA, 22 nt, Homo sapiens
uucauccaguuuguucuccggg

SEQ ID NO: 470229 - RNA, 18 nt, Homo sapiens
uucaucugaggaguccaa

SEQ ID NO: 470230 - RNA, 15 nt, Homo sapiens
uucauuuucacauuu

SEQ ID NO: 470231 - RNA, 21 nt, Homo sapiens
uuccaacccaggucugcuuug

SEQ ID NO: 470232 - RNA, 19 nt, Homo sapiens
uuccacuggaguucacuuu

SEQ ID NO: 470233 - RNA, 13 nt, Homo sapiens
uucccaucgcugg

SEQ ID NO: 470234 - RNA, 16 nt, Homo sapiens
uucccccuucccgccu

SEQ ID NO: 470235 - RNA, 19 nt, Homo sapiens
uucccuaaaagaaaaccaa

SEQ ID NO: 470236 - RNA, 18 nt, Homo sapiens
uuccuagucauaauguca

SEQ ID NO: 470237 - RNA, 13 nt, Homo sapiens
uuccuccuaggcg

SEQ ID NO: 470238 - RNA, 18 nt, Homo sapiens
uuccuucuuuaaacacuc

SEQ ID NO: 470239 - RNA, 23 nt, Homo sapiens
uucgauacaccgggccuggagaa

SEQ ID NO: 470240 - RNA, 20 nt, Homo sapiens
uucguccuuagaauacugua

SEQ ID NO: 470241 - RNA, 22 nt, Homo sapiens
uucuaaaggggacagaucuuga

SEQ ID NO: 470242 - RNA, 20 nt, Homo sapiens
uucuaaccuuucuaacccac

SEQ ID NO: 470243 - RNA, 21 nt, Homo sapiens
uucucaagcgcuauccacaga

SEQ ID NO: 470244 - RNA, 20 nt, Homo sapiens
uucucacuccuaccugguaa

SEQ ID NO: 470245 - RNA, 14 nt, Homo sapiens
uucucauucuugcc

SEQ ID NO: 470246 - RNA, 22 nt, Homo sapiens
uucuccggccccgccucugccc

SEQ ID NO: 470247 - RNA, 12 nt, Homo sapiens
uucucucugugu

SEQ ID NO: 470248 - RNA, 23 nt, Homo sapiens
uucugaccccacuuaugcugcug

SEQ ID NO: 470249 - RNA, 14 nt, Homo sapiens
uucuguggauucua

SEQ ID NO: 470250 - RNA, 19 nt, Homo sapiens
uucuuuuuccccaauaaau

SEQ ID NO: 470251 - RNA, 19 nt, Homo sapiens
uugaaaagcaguaacuugg

SEQ ID NO: 470252 - RNA, 17 nt, Homo sapiens
uugaacaaagacuacua

SEQ ID NO: 470253 - RNA, 19 nt, Homo sapiens
uugaaccgucaaugugaaa

SEQ ID NO: 470254 - RNA, 19 nt, Homo sapiens
uugaagacacguucuugcc

SEQ ID NO: 470255 - RNA, 19 nt, Homo sapiens
uugaagacccucaaugcca

SEQ ID NO: 470256 - RNA, 14 nt, Homo sapiens
uugagaaacccaag

SEQ ID NO: 470257 - RNA, 18 nt, Homo sapiens
uugcaaauuauucuaguc

SEQ ID NO: 470258 - RNA, 13 nt, Homo sapiens
uugcaugugcugc

SEQ ID NO: 470259 - RNA, 23 nt, Homo sapiens
uugcccaccacaacuaacaaugc

SEQ ID NO: 470260 - RNA, 14 nt, Homo sapiens
uugcccagagcucu

SEQ ID NO: 470261 - RNA, 16 nt, Homo sapiens
uugcccagagcucucu

SEQ ID NO: 470262 - RNA, 14 nt, Homo sapiens
uugcuucugugcaa

SEQ ID NO: 470263 - RNA, 15 nt, Homo sapiens
uuggaagccccauaa

SEQ ID NO: 470264 - RNA, 13 nt, Homo sapiens
uuggcagcuucaa

SEQ ID NO: 470265 - RNA, 17 nt, Homo sapiens
uuggcauuaucucuuuc

SEQ ID NO: 470266 - RNA, 15 nt, Homo sapiens
uuggguuccagacag

SEQ ID NO: 470267 - RNA, 16 nt, Homo sapiens
aaauacucagcaacug

SEQ ID NO: 470268 - RNA, 11 nt, Homo sapiens
aaauacuucuu

SEQ ID NO: 470269 - RNA, 15 nt, Homo sapiens
aaauccccuccccaa

SEQ ID NO: 470270 - RNA, 16 nt, Homo sapiens
aaauccccuccccaaa

SEQ ID NO: 470271 - RNA, 20 nt, Homo sapiens
aaaugccuucuguuuuccaa

SEQ ID NO: 470272 - RNA, 12 nt, Homo sapiens
aaaugcuuucuc

SEQ ID NO: 470273 - RNA, 13 nt, Homo sapiens
aaaugcuuucuca

SEQ ID NO: 470274 - RNA, 20 nt, Homo sapiens
aaauggcuuuccacaucccc

SEQ ID NO: 470275 - RNA, 23 nt, Homo sapiens
aaauguuacagaaucuaacuggu

SEQ ID NO: 470276 - RNA, 15 nt, Homo sapiens
aaauguuucaaagac

SEQ ID NO: 470277 - RNA, 11 nt, Homo sapiens
aaauugaacaa

SEQ ID NO: 470278 - RNA, 14 nt, Homo sapiens
aaauugaacaaaga

SEQ ID NO: 470279 - RNA, 20 nt, Homo sapiens
aaauuuacaguuacugccua

SEQ ID NO: 470280 - RNA, 14 nt, Homo sapiens
aacaaagacaacca

SEQ ID NO: 470281 - RNA, 17 nt, Homo sapiens
aacaaguagcacacuga

SEQ ID NO: 470282 - RNA, 17 nt, Homo sapiens
aacacaauuuucacuuu

SEQ ID NO: 470283 - RNA, 16 nt, Homo sapiens
aacacagaacucagcc

SEQ ID NO: 470284 - RNA, 20 nt, Homo sapiens
aacacagaacucagccuuaa

SEQ ID NO: 470285 - RNA, 16 nt, Homo sapiens
aacaccaucuggaguc

SEQ ID NO: 470286 - RNA, 17 nt, Homo sapiens
aacaggcucacagagau

SEQ ID NO: 470287 - RNA, 19 nt, Homo sapiens
aacauuugggagacugagc

SEQ ID NO: 470288 - RNA, 13 nt, Homo sapiens
aaccacugggauc

SEQ ID NO: 470289 - RNA, 18 nt, Homo sapiens
aaccagaucguacuugaa

SEQ ID NO: 470290 - RNA, 23 nt, Homo sapiens
aacccagccucuagaacagccag

SEQ ID NO: 470291 - RNA, 15 nt, Homo sapiens
aaccccccuccccaa

SEQ ID NO: 470292 - RNA, 19 nt, Homo sapiens
aacccuacgaaagcacagu

SEQ ID NO: 470293 - RNA, 19 nt, Homo sapiens
aacccuguauggcacuuau

SEQ ID NO: 470294 - RNA, 19 nt, Homo sapiens
aaccuggguuguugcagag

SEQ ID NO: 470295 - RNA, 18 nt, Homo sapiens
aaccuugugagcaaggug

SEQ ID NO: 470296 - RNA, 22 nt, Homo sapiens
aacgccuguaggaagaaaaagg

SEQ ID NO: 470297 - RNA, 22 nt, Homo sapiens
aacggagggugaagagcauagu

SEQ ID NO: 470298 - RNA, 14 nt, Homo sapiens
aacucaucuguuau

SEQ ID NO: 470299 - RNA, 13 nt, Homo sapiens
aacuccaggguua

SEQ ID NO: 470300 - RNA, 14 nt, Homo sapiens
aacucugacuguaa

SEQ ID NO: 470301 - RNA, 20 nt, Homo sapiens
aacucugugucccagcaccu

SEQ ID NO: 470302 - RNA, 17 nt, Homo sapiens
aacucuucaaggccaag

SEQ ID NO: 470303 - RNA, 12 nt, Homo sapiens
aacugaagccca

SEQ ID NO: 470304 - RNA, 21 nt, Homo sapiens
aacugccccccuccuuuccaa

SEQ ID NO: 470305 - RNA, 13 nt, Homo sapiens
aacuuugucacuu

SEQ ID NO: 470306 - RNA, 19 nt, Homo sapiens
aacuuuuucuaagcuguuu

SEQ ID NO: 470307 - RNA, 18 nt, Homo sapiens
aagaaacgaucagacaga

SEQ ID NO: 470308 - RNA, 22 nt, Homo sapiens
aagaaaugagaaauugugccaa

SEQ ID NO: 470309 - RNA, 23 nt, Homo sapiens
aagaacaaacacuuagcauccca

SEQ ID NO: 470310 - RNA, 13 nt, Homo sapiens
aagaauguauucg

SEQ ID NO: 470311 - RNA, 18 nt, Homo sapiens
aagacaguaaagaccauu

SEQ ID NO: 470312 - RNA, 17 nt, Homo sapiens
aagacuaucaaagacaa

SEQ ID NO: 470313 - RNA, 13 nt, Homo sapiens
aagacugucuuaa

SEQ ID NO: 470314 - RNA, 21 nt, Homo sapiens
aagagaaacacuaauggccaa

SEQ ID NO: 470315 - RNA, 21 nt, Homo sapiens
aagagcgcuccucugccuugg

SEQ ID NO: 470316 - RNA, 16 nt, Homo sapiens
aagagcuuuaucccua

SEQ ID NO: 470317 - RNA, 20 nt, Homo sapiens
aagaggcauucccagaauuu

SEQ ID NO: 470318 - RNA, 23 nt, Homo sapiens
aagagucuuugauucaccaaaca

SEQ ID NO: 470319 - RNA, 22 nt, Homo sapiens
aagauggcuuccgugagacaca

SEQ ID NO: 470320 - RNA, 11 nt, Homo sapiens
aagcaaugugg

SEQ ID NO: 470321 - RNA, 19 nt, Homo sapiens
aagcaguguguacuucuuc

SEQ ID NO: 470322 - RNA, 13 nt, Homo sapiens
aagccauaugaca

SEQ ID NO: 470323 - RNA, 19 nt, Homo sapiens
aagcugguuaaaguggaug

SEQ ID NO: 470324 - RNA, 19 nt, Homo sapiens
aaggaacuuuuaaacugca

SEQ ID NO: 470325 - RNA, 18 nt, Homo sapiens
aaggagugcccgccuuga

SEQ ID NO: 470326 - RNA, 14 nt, Homo sapiens
aaggcauucaucuu

SEQ ID NO: 470327 - RNA, 19 nt, Homo sapiens
aaggcgucucuucaaacag

SEQ ID NO: 470328 - RNA, 12 nt, Homo sapiens
aaggcugcagga

SEQ ID NO: 470329 - RNA, 23 nt, Homo sapiens
aagggaaaacaaauauuucacuu

SEQ ID NO: 470330 - RNA, 22 nt, Homo sapiens
aagggcaacucacgggugcaug

SEQ ID NO: 470331 - RNA, 22 nt, Homo sapiens
aagggcgcugagggcaggguuc

SEQ ID NO: 470332 - RNA, 12 nt, Homo sapiens
aaggucaucuca

SEQ ID NO: 470333 - RNA, 22 nt, Homo sapiens
aaguaaccucuacaggcauuua

SEQ ID NO: 470334 - RNA, 18 nt, Homo sapiens
aaguaccuguagugagaa

SEQ ID NO: 470335 - RNA, 22 nt, Homo sapiens
aaguagcguuggagacauacac

SEQ ID NO: 470336 - RNA, 13 nt, Homo sapiens
aagucacugcaca

SEQ ID NO: 470337 - RNA, 13 nt, Homo sapiens
aagucuaugcuua

SEQ ID NO: 470338 - RNA, 13 nt, Homo sapiens
aagucuuacuguu

SEQ ID NO: 470339 - RNA, 23 nt, Homo sapiens
aagugcauuuauugccucuaugu

SEQ ID NO: 470340 - RNA, 15 nt, Homo sapiens
aagugccaugcucag

SEQ ID NO: 470341 - RNA, 13 nt, Homo sapiens
aaguuccaaaaau

SEQ ID NO: 470342 - RNA, 22 nt, Homo sapiens
aauaaauuuguaugcucaauua

SEQ ID NO: 470343 - RNA, 19 nt, Homo sapiens
aauaaucacaaaaucacaa

SEQ ID NO: 470344 - RNA, 17 nt, Homo sapiens
aauacacuggaauucag

SEQ ID NO: 470345 - RNA, 18 nt, Homo sapiens
aauacagauauaagaaau

SEQ ID NO: 470346 - RNA, 23 nt, Homo sapiens
aauacauuaaaauaacuaagcaa

SEQ ID NO: 470347 - RNA, 20 nt, Homo sapiens
aauagcuuaucuuucaaggu

SEQ ID NO: 470348 - RNA, 14 nt, Homo sapiens
aauaggaguucucc

SEQ ID NO: 470349 - RNA, 16 nt, Homo sapiens
aauaguuccauucuau

SEQ ID NO: 470350 - RNA, 15 nt, Homo sapiens
aauauauuuuaucuu

SEQ ID NO: 470351 - RNA, 12 nt, Homo sapiens
aauaucuuucag

SEQ ID NO: 470352 - RNA, 19 nt, Homo sapiens
aauaugaggggacugcaug

SEQ ID NO: 470353 - RNA, 17 nt, Homo sapiens
aaucaacagcaugucua

SEQ ID NO: 470354 - RNA, 18 nt, Homo sapiens
aaucacacucucuucuua

SEQ ID NO: 470355 - RNA, 17 nt, Homo sapiens
aauccuuuauagcuuug

SEQ ID NO: 470356 - RNA, 15 nt, Homo sapiens
aaucugggaccaaaa

SEQ ID NO: 470357 - RNA, 12 nt, Homo sapiens
aaugaccuguau

SEQ ID NO: 470358 - RNA, 14 nt, Homo sapiens
aaugagccuuacca

SEQ ID NO: 470359 - RNA, 22 nt, Homo sapiens
aaugcauccaaauaggagucuu

SEQ ID NO: 470360 - RNA, 19 nt, Homo sapiens
aaugccuucuguuuuccaa

SEQ ID NO: 470361 - RNA, 23 nt, Homo sapiens
aaugcuuuucuaaucugcagugg

SEQ ID NO: 470362 - RNA, 21 nt, Homo sapiens
aauggccaaguguacauuuga

SEQ ID NO: 470363 - RNA, 17 nt, Homo sapiens
aauguacaauaaagcaa

SEQ ID NO: 470364 - RNA, 19 nt, Homo sapiens
aggcggagcgccaguggaa

SEQ ID NO: 470365 - RNA, 23 nt, Homo sapiens
aggcggccucgugccaugaucug

SEQ ID NO: 470366 - RNA, 22 nt, Homo sapiens
aggcguugugaaugugucccau

SEQ ID NO: 470367 - RNA, 14 nt, Homo sapiens
aggcucuaauguac

SEQ ID NO: 470368 - RNA, 15 nt, Homo sapiens
aggcucuaauguaca

SEQ ID NO: 470369 - RNA, 19 nt, Homo sapiens
aggcucuaauguacaauaa

SEQ ID NO: 470370 - RNA, 22 nt, Homo sapiens
aggcucuaauguacaauaaagc

SEQ ID NO: 470371 - RNA, 23 nt, Homo sapiens
agggaaaacaaauauuucacuua

SEQ ID NO: 470372 - RNA, 14 nt, Homo sapiens
agggaauccauauc

SEQ ID NO: 470373 - RNA, 17 nt, Homo sapiens
agggcaggguucuagaa

SEQ ID NO: 470374 - RNA, 13 nt, Homo sapiens
agggcgagcacuu

SEQ ID NO: 470375 - RNA, 19 nt, Homo sapiens
agggcgcugagggcagggu

SEQ ID NO: 470376 - RNA, 22 nt, Homo sapiens
aggggaucuaaaaggaggacag

SEQ ID NO: 470377 - RNA, 15 nt, Homo sapiens
agggugucuguaauc

SEQ ID NO: 470378 - RNA, 17 nt, Homo sapiens
aggguuccagacagggu

SEQ ID NO: 470379 - RNA, 20 nt, Homo sapiens
agguaccuuuccacccagac

SEQ ID NO: 470380 - RNA, 17 nt, Homo sapiens
aggucuccaccccucaa

SEQ ID NO: 470381 - RNA, 21 nt, Homo sapiens
aggucuccaccccucaagcca

SEQ ID NO: 470382 - RNA, 18 nt, Homo sapiens
agguugucugaagucacu

SEQ ID NO: 470383 - RNA, 19 nt, Homo sapiens
aguaaccucuacaggcauu

SEQ ID NO: 470384 - RNA, 14 nt, Homo sapiens
aguaccuguaguga

SEQ ID NO: 470385 - RNA, 20 nt, Homo sapiens
aguacucacuaaaaguucuc

SEQ ID NO: 470386 - RNA, 18 nt, Homo sapiens
aguagggcuuggugaaug

SEQ ID NO: 470387 - RNA, 16 nt, Homo sapiens
aguagugccugugauc

SEQ ID NO: 470388 - RNA, 14 nt, Homo sapiens
agucacugcacagu

SEQ ID NO: 470389 - RNA, 23 nt, Homo sapiens
agucacugcacagugcaucucag

SEQ ID NO: 470390 - RNA, 12 nt, Homo sapiens
agucaguugcaa

SEQ ID NO: 470391 - RNA, 13 nt, Homo sapiens
agucaucaucuca

SEQ ID NO: 470392 - RNA, 14 nt, Homo sapiens
agucaugugugcau

SEQ ID NO: 470393 - RNA, 20 nt, Homo sapiens
aguccccagccugcucccua

SEQ ID NO: 470394 - RNA, 17 nt, Homo sapiens
aguccuauucuauugca

SEQ ID NO: 470395 - RNA, 16 nt, Homo sapiens
agugaauacacuggaa

SEQ ID NO: 470396 - RNA, 21 nt, Homo sapiens
agugaaugaguaaauaaacuc

SEQ ID NO: 470397 - RNA, 14 nt, Homo sapiens
agugcaucucagcc

SEQ ID NO: 470398 - RNA, 14 nt, Homo sapiens
aguggaauacuaaa

SEQ ID NO: 470399 - RNA, 21 nt, Homo sapiens
aguggcaaaaaagaacagugu

SEQ ID NO: 470400 - RNA, 16 nt, Homo sapiens
agugugcucggacaca

SEQ ID NO: 470401 - RNA, 19 nt, Homo sapiens
aguuaagacaacaggcauu

SEQ ID NO: 470402 - RNA, 17 nt, Homo sapiens
aguucauucauacucaa

SEQ ID NO: 470403 - RNA, 15 nt, Homo sapiens
aguuuaauauuccaa

SEQ ID NO: 470404 - RNA, 22 nt, Homo sapiens
aguuuauaaaagacugucuuaa

SEQ ID NO: 470405 - RNA, 18 nt, Homo sapiens
aguuucaaaugaguuuaa

SEQ ID NO: 470406 - RNA, 22 nt, Homo sapiens
aguuugcaaucuuauguugauc

SEQ ID NO: 470407 - RNA, 21 nt, Homo sapiens
aguuugcccaccacaacuaac

SEQ ID NO: 470408 - RNA, 17 nt, Homo sapiens
aguuugcuuuguaugca

SEQ ID NO: 470409 - RNA, 16 nt, Homo sapiens
auaaacuuguacuuac

SEQ ID NO: 470410 - RNA, 12 nt, Homo sapiens
auaaagauucca

SEQ ID NO: 470411 - RNA, 15 nt, Homo sapiens
auaaagcaauguggu

SEQ ID NO: 470412 - RNA, 17 nt, Homo sapiens
auaaagcaaugugguag

SEQ ID NO: 470413 - RNA, 21 nt, Homo sapiens
auaaauaaagaagaaaauaac

SEQ ID NO: 470414 - RNA, 16 nt, Homo sapiens
auaaauccaacucuga

SEQ ID NO: 470415 - RNA, 17 nt, Homo sapiens
auaagugcucaguauug

SEQ ID NO: 470416 - RNA, 12 nt, Homo sapiens
auacaaugcaug

SEQ ID NO: 470417 - RNA, 23 nt, Homo sapiens
auacacccccaccuccugcaaua

SEQ ID NO: 470418 - RNA, 13 nt, Homo sapiens
auacauauguuaa

SEQ ID NO: 470419 - RNA, 16 nt, Homo sapiens
auaccagguuaccuca

SEQ ID NO: 470420 - RNA, 14 nt, Homo sapiens
auacuucacacuga

SEQ ID NO: 470421 - RNA, 20 nt, Homo sapiens
auacuucuuuuucauuauug

SEQ ID NO: 470422 - RNA, 19 nt, Homo sapiens
auagacacaguauugacuu

SEQ ID NO: 470423 - RNA, 13 nt, Homo sapiens
auagaguacugca

SEQ ID NO: 470424 - RNA, 21 nt, Homo sapiens
auagcacugguuuguuucuca

SEQ ID NO: 470425 - RNA, 17 nt, Homo sapiens
auaguugauauguaaca

SEQ ID NO: 470426 - RNA, 11 nt, Homo sapiens
auaucagcucu

SEQ ID NO: 470427 - RNA, 16 nt, Homo sapiens
auaugggaggaacaaa

SEQ ID NO: 470428 - RNA, 18 nt, Homo sapiens
auaugggaggaacaaaga

SEQ ID NO: 470429 - RNA, 16 nt, Homo sapiens
auauuccaauacccua

SEQ ID NO: 470430 - RNA, 17 nt, Homo sapiens
aucacuugacuuugcca

SEQ ID NO: 470431 - RNA, 19 nt, Homo sapiens
aucacuugacuuugccaca

SEQ ID NO: 470432 - RNA, 17 nt, Homo sapiens
aucagcauucaaaauag

SEQ ID NO: 470433 - RNA, 18 nt, Homo sapiens
auccaacuggaaggcuuu

SEQ ID NO: 470434 - RNA, 20 nt, Homo sapiens
auccauacaaaacuaucggu

SEQ ID NO: 470435 - RNA, 20 nt, Homo sapiens
auccauagacacaguauuga

SEQ ID NO: 470436 - RNA, 14 nt, Homo sapiens
auccauaucagcuc

SEQ ID NO: 470437 - RNA, 18 nt, Homo sapiens
auccauaucagcucugca

SEQ ID NO: 470438 - RNA, 21 nt, Homo sapiens
auccuccuucacucccuguca

SEQ ID NO: 470439 - RNA, 22 nt, Homo sapiens
auccugauaaacauuaaacacu

SEQ ID NO: 470440 - RNA, 21 nt, Homo sapiens
aucguucugggucagcuugaa

SEQ ID NO: 470441 - RNA, 18 nt, Homo sapiens
aucucugauuaaauuuaa

SEQ ID NO: 470442 - RNA, 15 nt, Homo sapiens
aucucugcaggaugg

SEQ ID NO: 470443 - RNA, 16 nt, Homo sapiens
aucugaggaguccaaa

SEQ ID NO: 470444 - RNA, 18 nt, Homo sapiens
aucugcaaauaguuucaa

SEQ ID NO: 470445 - RNA, 17 nt, Homo sapiens
aucuguauaucagcucu

SEQ ID NO: 470446 - RNA, 14 nt, Homo sapiens
aucuuaagauucca

SEQ ID NO: 470447 - RNA, 14 nt, Homo sapiens
augaagacaaauag

SEQ ID NO: 470448 - RNA, 12 nt, Homo sapiens
augaaucacugc

SEQ ID NO: 470449 - RNA, 18 nt, Homo sapiens
augaccuguauuuugcca

SEQ ID NO: 470450 - RNA, 18 nt, Homo sapiens
augagccuuaccaauaau

SEQ ID NO: 470451 - RNA, 17 nt, Homo sapiens
augaguucaaauacuuu

SEQ ID NO: 470452 - RNA, 14 nt, Homo sapiens
augcacacaguagg

SEQ ID NO: 470453 - RNA, 16 nt, Homo sapiens
augcagaaauguggau

SEQ ID NO: 470454 - RNA, 17 nt, Homo sapiens
augcauguagcauauaa

SEQ ID NO: 470455 - RNA, 23 nt, Homo sapiens
augccuuguugaugaagcacauu

SEQ ID NO: 470456 - RNA, 15 nt, Homo sapiens
auggaaggccagcuu

SEQ ID NO: 470457 - RNA, 15 nt, Homo sapiens
auggauucacuucua

SEQ ID NO: 470458 - RNA, 20 nt, Homo sapiens
augggagauuaaaaccagag

SEQ ID NO: 470459 - RNA, 15 nt, Homo sapiens
augggccaagccagg

SEQ ID NO: 470460 - RNA, 16 nt, Homo sapiens
auggucaaugcuagca

SEQ ID NO: 470461 - RNA, 19 nt, Homo sapiens
gaagagucccggagcucaa

SEQ ID NO: 470462 - RNA, 13 nt, Homo sapiens
gaagauaacuggc

SEQ ID NO: 470463 - RNA, 13 nt, Homo sapiens
gaagcacugccau

SEQ ID NO: 470464 - RNA, 14 nt, Homo sapiens
gaagcccacccgcc

SEQ ID NO: 470465 - RNA, 21 nt, Homo sapiens
gaagccuuuaucuaugggaga

SEQ ID NO: 470466 - RNA, 22 nt, Homo sapiens
gaagcucucgagggaagcagug

SEQ ID NO: 470467 - RNA, 18 nt, Homo sapiens
gaaguuaacagucucauu

SEQ ID NO: 470468 - RNA, 22 nt, Homo sapiens
gaauacaguaagcugcucuauu

SEQ ID NO: 470469 - RNA, 15 nt, Homo sapiens
gaauagaugcugacu

SEQ ID NO: 470470 - RNA, 13 nt, Homo sapiens
gaaucaaauccaa

SEQ ID NO: 470471 - RNA, 19 nt, Homo sapiens
gaaucacuugacuuugcca

SEQ ID NO: 470472 - RNA, 21 nt, Homo sapiens
gaaugccacacguaaacacuu

SEQ ID NO: 470473 - RNA, 15 nt, Homo sapiens
gaaugugaagcguua

SEQ ID NO: 470474 - RNA, 22 nt, Homo sapiens
gaauugaagacacguucuugcc

SEQ ID NO: 470475 - RNA, 22 nt, Homo sapiens
gaauugcuccugcaugcaacua

SEQ ID NO: 470476 - RNA, 20 nt, Homo sapiens
gaauuuuguuuuugguuucu

SEQ ID NO: 470477 - RNA, 20 nt, Homo sapiens
gacaaaggccuuaacaaacg

SEQ ID NO: 470478 - RNA, 11 nt, Homo sapiens
gacaacaggca

SEQ ID NO: 470479 - RNA, 14 nt, Homo sapiens
gacaaguguuuauu

SEQ ID NO: 470480 - RNA, 19 nt, Homo sapiens
gacaauuucaaaaugcaug

SEQ ID NO: 470481 - RNA, 18 nt, Homo sapiens
gacacugcugaaccuuuc

SEQ ID NO: 470482 - RNA, 17 nt, Homo sapiens
gacagacagagaaggca

SEQ ID NO: 470483 - RNA, 15 nt, Homo sapiens
gacagaucuggaaug

SEQ ID NO: 470484 - RNA, 19 nt, Homo sapiens
gacagaugaccgcaauaau

SEQ ID NO: 470485 - RNA, 21 nt, Homo sapiens
gacagaugaccgcaauaauga

SEQ ID NO: 470486 - RNA, 19 nt, Homo sapiens
gacagcagauuccacagga

SEQ ID NO: 470487 - RNA, 13 nt, Homo sapiens
gacagccuggcac

SEQ ID NO: 470488 - RNA, 18 nt, Homo sapiens
gaccuggggggggcaaga

SEQ ID NO: 470489 - RNA, 15 nt, Homo sapiens
gacucaauguggaaa

SEQ ID NO: 470490 - RNA, 16 nt, Homo sapiens
gacugagaagauguua

SEQ ID NO: 470491 - RNA, 13 nt, Homo sapiens
gacuggccacuga

SEQ ID NO: 470492 - RNA, 21 nt, Homo sapiens
gacugguggccccugccuugg

SEQ ID NO: 470493 - RNA, 14 nt, Homo sapiens
gacuguacuccucc

SEQ ID NO: 470494 - RNA, 19 nt, Homo sapiens
gagaaaacaggcucacaga

SEQ ID NO: 470495 - RNA, 23 nt, Homo sapiens
gagaaaggaacuuuuaaacugca

SEQ ID NO: 470496 - RNA, 15 nt, Homo sapiens
gagaaauugugccaa

SEQ ID NO: 470497 - RNA, 17 nt, Homo sapiens
gagaagcucucgaggga

SEQ ID NO: 470498 - RNA, 20 nt, Homo sapiens
gagacagacagagaaggcag

SEQ ID NO: 470499 - RNA, 14 nt, Homo sapiens
gagagagcucugca

SEQ ID NO: 470500 - RNA, 16 nt, Homo sapiens
gagagcgccacccgcc

SEQ ID NO: 470501 - RNA, 17 nt, Homo sapiens
gagauguauuaugcaaa

SEQ ID NO: 470502 - RNA, 16 nt, Homo sapiens
gagauuggcuuugccu

SEQ ID NO: 470503 - RNA, 11 nt, Homo sapiens
gagauuugcca

SEQ ID NO: 470504 - RNA, 18 nt, Homo sapiens
gagcacuuuccacuucca

SEQ ID NO: 470505 - RNA, 17 nt, Homo sapiens
gagccaccccuaaagag

SEQ ID NO: 470506 - RNA, 22 nt, Homo sapiens
cagcuaacaaguagcacacuga

SEQ ID NO: 470507 - RNA, 22 nt, Homo sapiens
cagcucuucagguuugcaaggg

SEQ ID NO: 470508 - RNA, 17 nt, Homo sapiens
cagcuggugucaguccc

SEQ ID NO: 470509 - RNA, 19 nt, Homo sapiens
caggaauuucuguuagcaa

SEQ ID NO: 470510 - RNA, 23 nt, Homo sapiens
caggaccucaccuuggcucuguu

SEQ ID NO: 470511 - RNA, 14 nt, Homo sapiens
caggacuaacaacu

SEQ ID NO: 470512 - RNA, 16 nt, Homo sapiens
caggacuaacaacugg

SEQ ID NO: 470513 - RNA, 19 nt, Homo sapiens
caggacuaacaacugggaa

SEQ ID NO: 470514 - RNA, 20 nt, Homo sapiens
caggacuaacaacugggaaa

SEQ ID NO: 470515 - RNA, 18 nt, Homo sapiens
caggauguguggcucauu

SEQ ID NO: 470516 - RNA, 21 nt, Homo sapiens
caggccaggagacuguuaaag

SEQ ID NO: 470517 - RNA, 16 nt, Homo sapiens
caggcucacagagauu

SEQ ID NO: 470518 - RNA, 18 nt, Homo sapiens
cagggcgagcacuuucca

SEQ ID NO: 470519 - RNA, 15 nt, Homo sapiens
cagggcgcacuuucc

SEQ ID NO: 470520 - RNA, 22 nt, Homo sapiens
cagggugcucccuccucagucu

SEQ ID NO: 470521 - RNA, 15 nt, Homo sapiens
cagguuccuccuagg

SEQ ID NO: 470522 - RNA, 12 nt, Homo sapiens
caguaaauccaa

SEQ ID NO: 470523 - RNA, 20 nt, Homo sapiens
caguaagcugcucuauugua

SEQ ID NO: 470524 - RNA, 19 nt, Homo sapiens
caguagggcuuggugaaug

SEQ ID NO: 470525 - RNA, 15 nt, Homo sapiens
cagucaugugugcau

SEQ ID NO: 470526 - RNA, 13 nt, Homo sapiens
ccauggugcagug

SEQ ID NO: 470527 - RNA, 19 nt, Homo sapiens
ccauggugcagugaagaaa

SEQ ID NO: 470528 - RNA, 13 nt, Homo sapiens
ccauucauuuaca

SEQ ID NO: 470529 - RNA, 11 nt, Homo sapiens
cccaaccuccc

SEQ ID NO: 470530 - RNA, 20 nt, Homo sapiens
cccaagauuuuuuauuugag

SEQ ID NO: 470531 - RNA, 20 nt, Homo sapiens
cccaauuuuaaaaaauaaca

SEQ ID NO: 470532 - RNA, 12 nt, Homo sapiens
cccacaaaauau

SEQ ID NO: 470533 - RNA, 21 nt, Homo sapiens
cccacguggucgccugcauuu

SEQ ID NO: 470534 - RNA, 22 nt, Homo sapiens
cccacguggucgccugcauuuc

SEQ ID NO: 470535 - RNA, 12 nt, Homo sapiens
cccacuuugcca

SEQ ID NO: 470536 - RNA, 13 nt, Homo sapiens
cccacuuugccac

SEQ ID NO: 470537 - RNA, 19 nt, Homo sapiens
cccagccucccccaggcug

SEQ ID NO: 470538 - RNA, 22 nt, Homo sapiens
cccagccugcucccuagccaga

SEQ ID NO: 470539 - RNA, 13 nt, Homo sapiens
cccagggugcagg

SEQ ID NO: 470540 - RNA, 16 nt, Homo sapiens
cccauuugggauuuuc

SEQ ID NO: 470541 - RNA, 21 nt, Homo sapiens
ccccacccacccucugguccu

SEQ ID NO: 470542 - RNA, 19 nt, Homo sapiens
ccccaggcgauggacaauu

SEQ ID NO: 470543 - RNA, 20 nt, Homo sapiens
cccccucuugagagggguga

SEQ ID NO: 470544 - RNA, 16 nt, Homo sapiens
ccccucagaugaucuc

SEQ ID NO: 470545 - RNA, 14 nt, Homo sapiens
ccccuucuguguca

SEQ ID NO: 470546 - RNA, 13 nt, Homo sapiens
cccgccccagaga

SEQ ID NO: 470547 - RNA, 14 nt, Homo sapiens
cccuaaaaauucca

SEQ ID NO: 470548 - RNA, 16 nt, Homo sapiens
cugacuguacuccucc

SEQ ID NO: 470549 - RNA, 23 nt, Homo sapiens
cugaguccagcuccccccaagau

SEQ ID NO: 470550 - RNA, 14 nt, Homo sapiens
cugagugaaugagu

SEQ ID NO: 470551 - RNA, 22 nt, Homo sapiens
cugauaaacauuaaacacugua

SEQ ID NO: 470552 - RNA, 19 nt, Homo sapiens
cugauuugcaaaugcacau

SEQ ID NO: 470553 - RNA, 15 nt, Homo sapiens
cugcagccccccaga

SEQ ID NO: 470554 - RNA, 23 nt, Homo sapiens
cugcauaacagcuugaaaacugg

SEQ ID NO: 470555 - RNA, 17 nt, Homo sapiens
cugccuuugagcuucuc

SEQ ID NO: 470556 - RNA, 17 nt, Homo sapiens
cugcucacgucugugag

SEQ ID NO: 470557 - RNA, 14 nt, Homo sapiens
cugcucaugacaca

SEQ ID NO: 470558 - RNA, 13 nt, Homo sapiens
cuggaaauaaccu

SEQ ID NO: 470559 - RNA, 20 nt, Homo sapiens
cuggagaacuagagaaggac

SEQ ID NO: 470560 - RNA, 23 nt, Homo sapiens
cuggagggaauccauaucagcuc

SEQ ID NO: 470561 - RNA, 21 nt, Homo sapiens
cuggauuaucuacuacagagu

SEQ ID NO: 470562 - RNA, 19 nt, Homo sapiens
cuggccacugaauuaugcc

SEQ ID NO: 470563 - RNA, 16 nt, Homo sapiens
cuggccagcacccucu

SEQ ID NO: 470564 - RNA, 13 nt, Homo sapiens
cuggccccaggcg

SEQ ID NO: 470565 - RNA, 16 nt, Homo sapiens
cuggcuucugcauuac

SEQ ID NO: 470566 - RNA, 18 nt, Homo sapiens
cugggaagaauguauucg

SEQ ID NO: 470567 - RNA, 21 nt, Homo sapiens
cugggcugucugucaccagcu

SEQ ID NO: 470568 - RNA, 19 nt, Homo sapiens
cuggguuugggcaguggag

SEQ ID NO: 470569 - RNA, 16 nt, Homo sapiens
cugguggcaccagaug

SEQ ID NO: 470570 - RNA, 20 nt, Homo sapiens
cugguggcaccagaugcaac

SEQ ID NO: 470571 - RNA, 14 nt, Homo sapiens
cuguaaaagacuga

SEQ ID NO: 470572 - RNA, 18 nt, Homo sapiens
cuguauaaguaacacuag

SEQ ID NO: 470573 - RNA, 15 nt, Homo sapiens
cuguauaucagcucu

SEQ ID NO: 470574 - RNA, 13 nt, Homo sapiens
cuguauccaaguu

SEQ ID NO: 470575 - RNA, 20 nt, Homo sapiens
cuguauuuugccagacuuaa

SEQ ID NO: 470576 - RNA, 19 nt, Homo sapiens
cuguccaccugugcugcug

SEQ ID NO: 470577 - RNA, 16 nt, Homo sapiens
cugucuugugagcuga

SEQ ID NO: 470578 - RNA, 19 nt, Homo sapiens
cugugaauggcagccugag

SEQ ID NO: 470579 - RNA, 23 nt, Homo sapiens
cugugaugucaguagugccugug

SEQ ID NO: 470580 - RNA, 16 nt, Homo sapiens
cugugccuaucaccuc

SEQ ID NO: 470581 - RNA, 23 nt, Homo sapiens
cuguuauccugcuagcuguagaa

SEQ ID NO: 470582 - RNA, 12 nt, Homo sapiens
cuguuccaagug

SEQ ID NO: 470583 - RNA, 23 nt, Homo sapiens
cuguugaaggacuacagguauuu

SEQ ID NO: 470584 - RNA, 18 nt, Homo sapiens
cuguuucaaugaccugua

SEQ ID NO: 470585 - RNA, 17 nt, Homo sapiens
cuguuucuugaugggag

SEQ ID NO: 470586 - RNA, 17 nt, Homo sapiens
cuguuuuuguaguggua

SEQ ID NO: 470587 - RNA, 18 nt, Homo sapiens
cuuaaaagaacauaggaa

SEQ ID NO: 470588 - RNA, 17 nt, Homo sapiens
cuuaaaccugugcuuuc

SEQ ID NO: 470589 - RNA, 19 nt, Homo sapiens
cuuaacuuaaaagaacaua

SEQ ID NO: 470590 - RNA, 22 nt, Homo sapiens
cuuaagaaagcuauauaugaau

SEQ ID NO: 470591 - RNA, 18 nt, Homo sapiens
cuuagaaauugcauuucc

SEQ ID NO: 470592 - RNA, 14 nt, Homo sapiens
cuuagaauacugua

SEQ ID NO: 470593 - RNA, 19 nt, Homo sapiens
ccaggguuccagacagggu

SEQ ID NO: 470594 - RNA, 20 nt, Homo sapiens
ccagguuaccucacuuuuaa

SEQ ID NO: 470595 - RNA, 13 nt, Homo sapiens
ccaguucuuuuaa

SEQ ID NO: 470596 - RNA, 11 nt, Homo sapiens
ccauaccagcu

SEQ ID NO: 470597 - RNA, 22 nt, Homo sapiens
ccauccaauggauugugcaaau

SEQ ID NO: 470598 - RNA, 19 nt, Homo sapiens
ccauccuucccgcagcacc

SEQ ID NO: 470599 - RNA, 20 nt, Homo sapiens
ccaugugccugcaccaggag

SEQ ID NO: 470600 - RNA, 19 nt, Homo sapiens
ccauguuuuugcaaauacu

SEQ ID NO: 470601 - RNA, 22 nt, Homo sapiens
cccacagagguggaacuuaauu

SEQ ID NO: 470602 - RNA, 23 nt, Homo sapiens
cccaccucccgguguaugcagug

SEQ ID NO: 470603 - RNA, 17 nt, Homo sapiens
cccaccuccugcaauaa

SEQ ID NO: 470604 - RNA, 21 nt, Homo sapiens
cccagaaaaaaggacuguaua

SEQ ID NO: 470605 - RNA, 18 nt, Homo sapiens
cccagaagagucuuugau

SEQ ID NO: 470606 - RNA, 16 nt, Homo sapiens
cccagaauuugcugca

SEQ ID NO: 470607 - RNA, 19 nt, Homo sapiens
cccagccgggguggggugc

SEQ ID NO: 470608 - RNA, 18 nt, Homo sapiens
cccaguuuaauauuccaa

SEQ ID NO: 470609 - RNA, 21 nt, Homo sapiens
cccauccaauggauugugcaa

SEQ ID NO: 470610 - RNA, 14 nt, Homo sapiens
ccccagccugcucc

SEQ ID NO: 470611 - RNA, 16 nt, Homo sapiens
cccgguguaugcagug

SEQ ID NO: 470612 - RNA, 17 nt, Homo sapiens
cccuagccagaggcucu

SEQ ID NO: 470613 - RNA, 20 nt, Homo sapiens
cccucugcuaugucugugau

SEQ ID NO: 470614 - RNA, 17 nt, Homo sapiens
cccugacuucccagcug

SEQ ID NO: 470615 - RNA, 18 nt, Homo sapiens
cccugccagcaacgcuca

SEQ ID NO: 470616 - RNA, 18 nt, Homo sapiens
cccuuaggaauauacaua

SEQ ID NO: 470617 - RNA, 22 nt, Homo sapiens
cccuugcccaaccaaugcacac

SEQ ID NO: 470618 - RNA, 20 nt, Homo sapiens
ccgagucucuucuccacugg

SEQ ID NO: 470619 - RNA, 22 nt, Homo sapiens
ccgcucuggauccugcacucua

SEQ ID NO: 470620 - RNA, 21 nt, Homo sapiens
ccggcgggacccccauguccu

SEQ ID NO: 470621 - RNA, 21 nt, Homo sapiens
ccgguguccuguuccugccac

SEQ ID NO: 470622 - RNA, 11 nt, Homo sapiens
ccgugccuuca

SEQ ID NO: 470623 - RNA, 14 nt, Homo sapiens
ccuaaaucacuuug

SEQ ID NO: 470624 - RNA, 14 nt, Homo sapiens
ccuaaccuggguug

SEQ ID NO: 470625 - RNA, 16 nt, Homo sapiens
ccuacccucuucucag

SEQ ID NO: 470626 - RNA, 22 nt, Homo sapiens
ccuaguccccagccugcucccu

SEQ ID NO: 470627 - RNA, 20 nt, Homo sapiens
ccuaugauaaguuccaaaaa

SEQ ID NO: 470628 - RNA, 14 nt, Homo sapiens
ccuaugcugcaaua

SEQ ID NO: 470629 - RNA, 11 nt, Homo sapiens
ccucagaugau

SEQ ID NO: 470630 - RNA, 23 nt, Homo sapiens
ccucagucuuugggggauucaaa

SEQ ID NO: 470631 - RNA, 19 nt, Homo sapiens
ccucaguuuuuccuaguca

SEQ ID NO: 470632 - RNA, 14 nt, Homo sapiens
ccucaucucaucuc

SEQ ID NO: 470633 - RNA, 19 nt, Homo sapiens
ccuccacucugaggucuca

SEQ ID NO: 470634 - RNA, 16 nt, Homo sapiens
ccuccauuaaccaaga

SEQ ID NO: 470635 - RNA, 21 nt, Homo sapiens
ccuccccaauuccccagggaa

SEQ ID NO: 470636 - RNA, 14 nt, Homo sapiens
ccuccccauggugc

SEQ ID NO: 470637 - RNA, 21 nt, Homo sapiens
ccuccuaggcucccugaggua

SEQ ID NO: 470638 - RNA, 16 nt, Homo sapiens
ccuccuggguuuacuc

SEQ ID NO: 470639 - RNA, 12 nt, Homo sapiens
ccuccuuuccaa

SEQ ID NO: 470640 - RNA, 15 nt, Homo sapiens
ccucuagaacagcca

SEQ ID NO: 470641 - RNA, 23 nt, Homo sapiens
ccucugcuccaacagacacccuc

SEQ ID NO: 470642 - RNA, 17 nt, Homo sapiens
ccucugugccauggaug

SEQ ID NO: 470643 - RNA, 13 nt, Homo sapiens
ccugaaaauccaa

SEQ ID NO: 470644 - RNA, 16 nt, Homo sapiens
caaauuauucuaguca

SEQ ID NO: 470645 - RNA, 23 nt, Homo sapiens
caaauucaaugaaucaaauccaa

SEQ ID NO: 470646 - RNA, 16 nt, Homo sapiens
caaauucucugagaug

SEQ ID NO: 470647 - RNA, 12 nt, Homo sapiens
caacagacaccc

SEQ ID NO: 470648 - RNA, 15 nt, Homo sapiens
caacuaauacauggu

SEQ ID NO: 470649 - RNA, 18 nt, Homo sapiens
caacucacgggugcauga

SEQ ID NO: 470650 - RNA, 22 nt, Homo sapiens
caacuccaggguuaaagaaagg

SEQ ID NO: 470651 - RNA, 23 nt, Homo sapiens
caacugacagaugaccgcaauaa

SEQ ID NO: 470652 - RNA, 10 nt, Homo sapiens
caacugauga

SEQ ID NO: 470653 - RNA, 23 nt, Homo sapiens
caagaauagaugcugacuguacu

SEQ ID NO: 470654 - RNA, 15 nt, Homo sapiens
caagaccccaaaggg

SEQ ID NO: 470655 - RNA, 13 nt, Homo sapiens
caagccaggguuc

SEQ ID NO: 470656 - RNA, 18 nt, Homo sapiens
caagccaggguuccagac

SEQ ID NO: 470657 - RNA, 12 nt, Homo sapiens
caaguucauuca

SEQ ID NO: 470658 - RNA, 18 nt, Homo sapiens
caauaaaaccaagugcuu

SEQ ID NO: 470659 - RNA, 17 nt, Homo sapiens
caauaaacgaaacacag

SEQ ID NO: 470660 - RNA, 14 nt, Homo sapiens
caauaaagcaaugu

SEQ ID NO: 470661 - RNA, 15 nt, Homo sapiens
caauaaagcaaugug

SEQ ID NO: 470662 - RNA, 17 nt, Homo sapiens
caauaaagcaauguggu

SEQ ID NO: 470663 - RNA, 19 nt, Homo sapiens
caauaaugaaugagcaguu

SEQ ID NO: 470664 - RNA, 16 nt, Homo sapiens
caauauguuagcaaga

SEQ ID NO: 470665 - RNA, 18 nt, Homo sapiens
caauccuuuauagcuuug

SEQ ID NO: 470666 - RNA, 15 nt, Homo sapiens
caaugccugccugaa

SEQ ID NO: 470667 - RNA, 16 nt, Homo sapiens
caauggagacugucuc

SEQ ID NO: 470668 - RNA, 19 nt, Homo sapiens
caauugcuucugugcaaua

SEQ ID NO: 470669 - RNA, 21 nt, Homo sapiens
caauuucaaaaugcaugugau

SEQ ID NO: 470670 - RNA, 14 nt, Homo sapiens
caauuuucacuuuu

SEQ ID NO: 470671 - RNA, 23 nt, Homo sapiens
cacaaaaggcuggaugugcuuuc

SEQ ID NO: 470672 - RNA, 17 nt, Homo sapiens
cacaauauuccuaugcu

SEQ ID NO: 470673 - RNA, 12 nt, Homo sapiens
cacacaauggca

SEQ ID NO: 470674 - RNA, 20 nt, Homo sapiens
cacacucucuucuuacugua

SEQ ID NO: 470675 - RNA, 21 nt, Homo sapiens
cacacucucuucuuacuguau

SEQ ID NO: 470676 - RNA, 17 nt, Homo sapiens
cacacugaguuugaaca

SEQ ID NO: 470677 - RNA, 14 nt, Homo sapiens
cacagaacucagcc

SEQ ID NO: 470678 - RNA, 21 nt, Homo sapiens
cacagauggaaucuuguuuaa

SEQ ID NO: 470679 - RNA, 22 nt, Homo sapiens
cacagcaguacuugcucaauaa

SEQ ID NO: 470680 - RNA, 15 nt, Homo sapiens
cacaggguguuggaa

SEQ ID NO: 470681 - RNA, 21 nt, Homo sapiens
cacaguagggcuuggugaaug

SEQ ID NO: 470682 - RNA, 23 nt, Homo sapiens
cacauguagaauuauaacuaauu

SEQ ID NO: 470683 - RNA, 20 nt, Homo sapiens
caccaagcugcucuccuuca

SEQ ID NO: 470684 - RNA, 15 nt, Homo sapiens
caccagaagugccau

SEQ ID NO: 470685 - RNA, 16 nt, Homo sapiens
caccagaagugccaug

SEQ ID NO: 470686 - RNA, 20 nt, Homo sapiens
caccagaagugccaugcuca

SEQ ID NO: 470687 - RNA, 15 nt, Homo sapiens
caccagccugagcca

SEQ ID NO: 470688 - RNA, 15 nt, Homo sapiens
cacccauaccagcua

SEQ ID NO: 470689 - RNA, 15 nt, Homo sapiens
caccccuaaagagau

SEQ ID NO: 470690 - RNA, 18 nt, Homo sapiens
cacccuccacucugaggu

SEQ ID NO: 470691 - RNA, 16 nt, Homo sapiens
caccuacuuauuucag

SEQ ID NO: 470692 - RNA, 18 nt, Homo sapiens
caccugcagccuguugaa

SEQ ID NO: 470693 - RNA, 15 nt, Homo sapiens
caccuggcacaccag

SEQ ID NO: 470694 - RNA, 14 nt, Homo sapiens
caccugugcugcug

SEQ ID NO: 470695 - RNA, 19 nt, Homo sapiens
caccuugcccaugcacaag

SEQ ID NO: 470696 - RNA, 17 nt, Homo sapiens
caccuuguacagaacca

SEQ ID NO: 470697 - RNA, 17 nt, Homo sapiens
cacggcguuuuuuuaca

SEQ ID NO: 470698 - RNA, 13 nt, Homo sapiens
cacgggugcauga

SEQ ID NO: 470699 - RNA, 11 nt, Homo sapiens
cacucagggau

SEQ ID NO: 470700 - RNA, 20 nt, Homo sapiens
cacucucuucuuacuguauu

SEQ ID NO: 470701 - RNA, 15 nt, Homo sapiens
cacucugacaguauu

SEQ ID NO: 470702 - RNA, 16 nt, Homo sapiens
cacucugaggucucac

SEQ ID NO: 470703 - RNA, 17 nt, Homo sapiens
cacugaauuaugccagg

SEQ ID NO: 470704 - RNA, 21 nt, Homo sapiens
cacugcaccucuuugucacag

SEQ ID NO: 470705 - RNA, 17 nt, Homo sapiens
cacuggaguucacuuuc

SEQ ID NO: 470706 - RNA, 22 nt, Homo sapiens
cacuguaaucuuaaaaguguaa

SEQ ID NO: 470707 - RNA, 21 nt, Homo sapiens
cacuucaggguucuaaccuuu

SEQ ID NO: 470708 - RNA, 21 nt, Homo sapiens
cacuugacuauaaaaacugcc

SEQ ID NO: 470709 - RNA, 15 nt, Homo sapiens
cacuugacuuugcca

SEQ ID NO: 470710 - RNA, 16 nt, Homo sapiens
cacuugacuuugccac

SEQ ID NO: 470711 - RNA, 23 nt, Homo sapiens
cacuuuccacuggaguucacuuu

SEQ ID NO: 470712 - RNA, 23 nt, Homo sapiens
cagaacaaaagauaaaacuaauu

SEQ ID NO: 470713 - RNA, 14 nt, Homo sapiens
cagaaccuuuguca

SEQ ID NO: 470714 - RNA, 17 nt, Homo sapiens
cagaacucagccuuaag

SEQ ID NO: 470715 - RNA, 13 nt, Homo sapiens
cagaaggacucag

SEQ ID NO: 470716 - RNA, 20 nt, Homo sapiens
cagaaucuaacugguggaca

SEQ ID NO: 470717 - RNA, 21 nt, Homo sapiens
cagaauggugggcuccagagu

SEQ ID NO: 470718 - RNA, 13 nt, Homo sapiens
cagacacccucca

SEQ ID NO: 470719 - RNA, 15 nt, Homo sapiens
cagacagaucuggaa

SEQ ID NO: 470720 - RNA, 21 nt, Homo sapiens
cagacagaucuggaaugugaa

SEQ ID NO: 470721 - RNA, 20 nt, Homo sapiens
cagaccuagugcucccuucc

SEQ ID NO: 470722 - RNA, 16 nt, Homo sapiens
cagaccucggcugugu

SEQ ID NO: 470723 - RNA, 13 nt, Homo sapiens
cagacuuaaauca

SEQ ID NO: 470724 - RNA, 15 nt, Homo sapiens
cagagaaaucugcau

SEQ ID NO: 470725 - RNA, 19 nt, Homo sapiens
cagagaaaucugcauucua

SEQ ID NO: 470726 - RNA, 16 nt, Homo sapiens
cagagagagcucugca

SEQ ID NO: 470727 - RNA, 13 nt, Homo sapiens
cagagcugagucg

SEQ ID NO: 470728 - RNA, 19 nt, Homo sapiens
cagaggcucuaauguacaa

SEQ ID NO: 470729 - RNA, 11 nt, Homo sapiens
cagaggucucc

SEQ ID NO: 470730 - RNA, 15 nt, Homo sapiens
cagaguugcuuuaaa

SEQ ID NO: 470731 - RNA, 15 nt, Homo sapiens
cagaucguacuugaa

SEQ ID NO: 470732 - RNA, 12 nt, Homo sapiens
cagaugaucucu

SEQ ID NO: 470733 - RNA, 15 nt, Homo sapiens
cagauggguauuaaa

SEQ ID NO: 470734 - RNA, 18 nt, Homo sapiens
cagcacaucucugagguu

SEQ ID NO: 470735 - RNA, 14 nt, Homo sapiens
cagccggcugcaag

SEQ ID NO: 470736 - RNA, 23 nt, Homo sapiens
cagccuccuaggcucccugaggu

SEQ ID NO: 470737 - RNA, 14 nt, Homo sapiens
cagccugcucccua

SEQ ID NO: 470738 - RNA, 18 nt, Homo sapiens
cagcuaucugucaucucu

SEQ ID NO: 470739 - RNA, 14 nt, Homo sapiens
cagcuccacucuga

SEQ ID NO: 470740 - RNA, 12 nt, Homo sapiens
cagcuccuagua

SEQ ID NO: 470741 - RNA, 15 nt, Homo sapiens
cagcuucaaaacaga

SEQ ID NO: 470742 - RNA, 13 nt, Homo sapiens
caggaaaauaaca

SEQ ID NO: 470743 - RNA, 21 nt, Homo sapiens
caggaccucaccuuggcucug

SEQ ID NO: 470744 - RNA, 16 nt, Homo sapiens
caggauucucuucuca

SEQ ID NO: 470745 - RNA, 17 nt, Homo sapiens
caggcaguucccagaaa

SEQ ID NO: 470746 - RNA, 14 nt, Homo sapiens
caggccaacugccc

SEQ ID NO: 470747 - RNA, 19 nt, Homo sapiens
caggccaggagacuguuaa

SEQ ID NO: 470748 - RNA, 13 nt, Homo sapiens
caggcucuucucc

SEQ ID NO: 470749 - RNA, 15 nt, Homo sapiens
cagggcaaucaucua

SEQ ID NO: 470750 - RNA, 15 nt, Homo sapiens
cagggcgagcacuuu

SEQ ID NO: 470751 - RNA, 22 nt, Homo sapiens
cagggggaagaugccaagggca

SEQ ID NO: 470752 - RNA, 22 nt, Homo sapiens
caguaaagaccauuuaguccuc

SEQ ID NO: 470753 - RNA, 17 nt, Homo sapiens
caguagugcuaucucau

SEQ ID NO: 470754 - RNA, 14 nt, Homo sapiens
cagucaucaucuca

SEQ ID NO: 470755 - RNA, 11 nt, Homo sapiens
cagucuucuca

SEQ ID NO: 470756 - RNA, 22 nt, Homo sapiens
caguuaagacaacaggcauuuu

SEQ ID NO: 470757 - RNA, 15 nt, Homo sapiens
caguuaaugugccaa

SEQ ID NO: 470758 - RNA, 15 nt, Homo sapiens
caguuucacauauuu

SEQ ID NO: 470759 - RNA, 17 nt, Homo sapiens
cauaaaaauaaccaaaa

SEQ ID NO: 470760 - RNA, 14 nt, Homo sapiens
cauaacucugauua

SEQ ID NO: 470761 - RNA, 22 nt, Homo sapiens
cauaauaaaaggcauucaucuu

SEQ ID NO: 470762 - RNA, 22 nt, Homo sapiens
cauacucuguguaaucucugau

SEQ ID NO: 470763 - RNA, 21 nt, Homo sapiens
cauagucuuuguuuacaugag

SEQ ID NO: 470764 - RNA, 17 nt, Homo sapiens
cauaguucugcaauaac

SEQ ID NO: 470765 - RNA, 22 nt, Homo sapiens
cauauauaaauuauuacuuuaa

SEQ ID NO: 470766 - RNA, 15 nt, Homo sapiens
cauauuagcaucaug

SEQ ID NO: 470767 - RNA, 16 nt, Homo sapiens
caucaugaugcucaug

SEQ ID NO: 470768 - RNA, 15 nt, Homo sapiens
cauccauagacacag

SEQ ID NO: 470769 - RNA, 23 nt, Homo sapiens
cauccugauuauugaauguuaua

SEQ ID NO: 470770 - RNA, 22 nt, Homo sapiens
cauccuucccgcagcaccagcc

SEQ ID NO: 470771 - RNA, 19 nt, Homo sapiens
caucucaaacacugcuuaa

SEQ ID NO: 470772 - RNA, 15 nt, Homo sapiens
caucugaggagucca

SEQ ID NO: 470773 - RNA, 11 nt, Homo sapiens
caucuuucuaa

SEQ ID NO: 470774 - RNA, 18 nt, Homo sapiens
caugaguucaaauacuuu

SEQ ID NO: 470775 - RNA, 16 nt, Homo sapiens
caugauauuguaugua

SEQ ID NO: 470776 - RNA, 19 nt, Homo sapiens
caugcacaguuugcaaucu

SEQ ID NO: 470777 - RNA, 13 nt, Homo sapiens
caugguaucucuu

SEQ ID NO: 470778 - RNA, 20 nt, Homo sapiens
caugguuuuugcucuacuuu

SEQ ID NO: 470779 - RNA, 13 nt, Homo sapiens
cauguaccugaaa

SEQ ID NO: 470780 - RNA, 20 nt, Homo sapiens
cauguaccugaaacauuugg

SEQ ID NO: 470781 - RNA, 13 nt, Homo sapiens
cauguagcauaua

SEQ ID NO: 470782 - RNA, 16 nt, Homo sapiens
cauguccuauuacuga

SEQ ID NO: 470783 - RNA, 18 nt, Homo sapiens
caugucucuuugccaagg

SEQ ID NO: 470784 - RNA, 22 nt, Homo sapiens
caugugacaugaacccauccaa

SEQ ID NO: 470785 - RNA, 14 nt, Homo sapiens
cauguucauucaca

SEQ ID NO: 470786 - RNA, 18 nt, Homo sapiens
cauguuuuugcaaauacu

SEQ ID NO: 470787 - RNA, 13 nt, Homo sapiens
cauuaaacacugu

SEQ ID NO: 470788 - RNA, 20 nt, Homo sapiens
cauucccagaauuugcugca

SEQ ID NO: 470789 - RNA, 22 nt, Homo sapiens
cauucguccuuagaauacugua

SEQ ID NO: 470790 - RNA, 23 nt, Homo sapiens
cauucuuuucagcuuguuucuau

SEQ ID NO: 470791 - RNA, 19 nt, Homo sapiens
cauuguaucuucauacaaa

SEQ ID NO: 470792 - RNA, 22 nt, Homo sapiens
cauuuaacugccuuacagacag

SEQ ID NO: 470793 - RNA, 15 nt, Homo sapiens
cauuuacaacuucca

SEQ ID NO: 470794 - RNA, 23 nt, Homo sapiens
cauuuagauuuugauaccaguga

SEQ ID NO: 470795 - RNA, 15 nt, Homo sapiens
cauuuauaaaaccau

SEQ ID NO: 470796 - RNA, 16 nt, Homo sapiens
cauuuauugccucuau

SEQ ID NO: 470797 - RNA, 13 nt, Homo sapiens
cauuucuugaugu

SEQ ID NO: 470798 - RNA, 17 nt, Homo sapiens
cauuucuugauguugcu

SEQ ID NO: 470799 - RNA, 18 nt, Homo sapiens
cauuuucucccuuaggaa

SEQ ID NO: 470800 - RNA, 11 nt, Homo sapiens
cauuuuugcuu

SEQ ID NO: 470801 - RNA, 13 nt, Homo sapiens
ccaaaaauaccau

SEQ ID NO: 470802 - RNA, 22 nt, Homo sapiens
ccaaacccagccucuagaacag

SEQ ID NO: 470803 - RNA, 12 nt, Homo sapiens
ccaaagggccca

SEQ ID NO: 470804 - RNA, 15 nt, Homo sapiens
ccaaauaagugcauu

SEQ ID NO: 470805 - RNA, 14 nt, Homo sapiens
ccaaccaaugcaca

SEQ ID NO: 470806 - RNA, 15 nt, Homo sapiens
ccaaccaaugcacac

SEQ ID NO: 470807 - RNA, 14 nt, Homo sapiens
ccaagaugagcugc

SEQ ID NO: 470808 - RNA, 21 nt, Homo sapiens
ccaagccaggguuccagacag

SEQ ID NO: 470809 - RNA, 14 nt, Homo sapiens
ccaagggacagugg

SEQ ID NO: 470810 - RNA, 16 nt, Homo sapiens
ccaaugcacacaguag

SEQ ID NO: 470811 - RNA, 17 nt, Homo sapiens
ccacccuucucagggac

SEQ ID NO: 470812 - RNA, 23 nt, Homo sapiens
ccaccgguguccuguuccugcca

SEQ ID NO: 470813 - RNA, 22 nt, Homo sapiens
ccaccuacuuauuucagauuca

SEQ ID NO: 470814 - RNA, 21 nt, Homo sapiens
ccacguugcagaaaaagagcu

SEQ ID NO: 470815 - RNA, 17 nt, Homo sapiens
ccacuagguuucaccuc

SEQ ID NO: 470816 - RNA, 18 nt, Homo sapiens
ccagaauuugcugcauuu

SEQ ID NO: 470817 - RNA, 13 nt, Homo sapiens
ccagagagagcuc

SEQ ID NO: 470818 - RNA, 20 nt, Homo sapiens
ccagagccuauggaaagggu

SEQ ID NO: 470819 - RNA, 14 nt, Homo sapiens
ccagaggcucuaau

SEQ ID NO: 470820 - RNA, 14 nt, Homo sapiens
ccagaugacacaua

SEQ ID NO: 470821 - RNA, 20 nt, Homo sapiens
ccagcaccuggcacaccaga

SEQ ID NO: 470822 - RNA, 13 nt, Homo sapiens
ccagccucuagaa

SEQ ID NO: 470823 - RNA, 15 nt, Homo sapiens
ccaggguuccagaca

SEQ ID NO: 470824 - RNA, 16 nt, Homo sapiens
ccagguuaccucacuu

SEQ ID NO: 470825 - RNA, 10 nt, Homo sapiens
ccaugcucuu

SEQ ID NO: 470826 - RNA, 16 nt, Homo sapiens
ccauggugguuucaga

SEQ ID NO: 470827 - RNA, 12 nt, Homo sapiens
ccauguccuccg

SEQ ID NO: 470828 - RNA, 23 nt, Homo sapiens
ccaugugcaaacgcuguauucca

SEQ ID NO: 470829 - RNA, 12 nt, Homo sapiens
ccauugcaaaag

SEQ ID NO: 470830 - RNA, 22 nt, Homo sapiens
ccauugcaaaagguuaagccau

SEQ ID NO: 470831 - RNA, 19 nt, Homo sapiens
ccauuuaucuacuauuuga

SEQ ID NO: 470832 - RNA, 13 nt, Homo sapiens
cccaaacccagcc

SEQ ID NO: 470833 - RNA, 16 nt, Homo sapiens
cccaagaugagcugca

SEQ ID NO: 470834 - RNA, 19 nt, Homo sapiens
cccacuuaugcugcuguga

SEQ ID NO: 470835 - RNA, 15 nt, Homo sapiens
cccagagagagcucu

SEQ ID NO: 470836 - RNA, 23 nt, Homo sapiens
cccagccucuagaacagccagac

SEQ ID NO: 470837 - RNA, 14 nt, Homo sapiens
cccaggaggaccug

SEQ ID NO: 470838 - RNA, 15 nt, Homo sapiens
cccaucgcuggaaaa

SEQ ID NO: 470839 - RNA, 20 nt, Homo sapiens
ccccacaacacaccuugccc

SEQ ID NO: 470840 - RNA, 21 nt, Homo sapiens
ccccagccugcucccuagcca

SEQ ID NO: 470841 - RNA, 23 nt, Homo sapiens
ccccagccugcucccuagccaga

SEQ ID NO: 470842 - RNA, 19 nt, Homo sapiens
ccccauucuauaaauucaa

SEQ ID NO: 470843 - RNA, 12 nt, Homo sapiens
cccccauguccu

SEQ ID NO: 470844 - RNA, 13 nt, Homo sapiens
cccgacagccugg

SEQ ID NO: 470845 - RNA, 15 nt, Homo sapiens
cccuagcuguauaua

SEQ ID NO: 470846 - RNA, 12 nt, Homo sapiens
cccucggagccc

SEQ ID NO: 470847 - RNA, 19 nt, Homo sapiens
cccugagcccagaaaaaag

SEQ ID NO: 470848 - RNA, 19 nt, Homo sapiens
cccugccagcaacgcucac

SEQ ID NO: 470849 - RNA, 19 nt, Homo sapiens
cccugcucacucuuccaca

SEQ ID NO: 470850 - RNA, 13 nt, Homo sapiens
cccugcuggacca

SEQ ID NO: 470851 - RNA, 18 nt, Homo sapiens
cccuggggucucugagca

SEQ ID NO: 470852 - RNA, 22 nt, Homo sapiens
cccuucaaccauuccccauggg

SEQ ID NO: 470853 - RNA, 15 nt, Homo sapiens
ccgagucucuucucc

SEQ ID NO: 470854 - RNA, 18 nt, Homo sapiens
ccgcagggcgcuccggca

SEQ ID NO: 470855 - RNA, 21 nt, Homo sapiens
ccgcgcucugccccuccgucc

SEQ ID NO: 470856 - RNA, 16 nt, Homo sapiens
ccuaaaucacuuugag

SEQ ID NO: 470857 - RNA, 16 nt, Homo sapiens
ccuagccagaggcucu

SEQ ID NO: 470858 - RNA, 21 nt, Homo sapiens
ccuaguagcuuuccucccaaa

SEQ ID NO: 470859 - RNA, 20 nt, Homo sapiens
ccuauucccaaaugccuucu

SEQ ID NO: 470860 - RNA, 22 nt, Homo sapiens
ccucaccuuggcucuguugcug

SEQ ID NO: 470861 - RNA, 14 nt, Homo sapiens
ccucagccacugaa

SEQ ID NO: 470862 - RNA, 19 nt, Homo sapiens
ccucauccacuaggugccc

SEQ ID NO: 470863 - RNA, 21 nt, Homo sapiens
ccucauuucuucaaaauauca

SEQ ID NO: 470864 - RNA, 10 nt, Homo sapiens
ccuccagacc

SEQ ID NO: 470865 - RNA, 17 nt, Homo sapiens
ccuccauuaaccaagaa

SEQ ID NO: 470866 - RNA, 15 nt, Homo sapiens
ccucccaaacccagc

SEQ ID NO: 470867 - RNA, 13 nt, Homo sapiens
ccucccccgcaga

SEQ ID NO: 470868 - RNA, 15 nt, Homo sapiens
ccucccugcacucau

SEQ ID NO: 470869 - RNA, 23 nt, Homo sapiens
ccuccuggguuuacuccuugagu

SEQ ID NO: 470870 - RNA, 14 nt, Homo sapiens
ccucuacaggcauu

SEQ ID NO: 470871 - RNA, 17 nt, Homo sapiens
ccucuacaggcauuuaa

SEQ ID NO: 470872 - RNA, 13 nt, Homo sapiens
ccucuagaacagc

SEQ ID NO: 470873 - RNA, 19 nt, Homo sapiens
ccucucucucccuccacuc

SEQ ID NO: 470874 - RNA, 12 nt, Homo sapiens
ccucucuugccg

SEQ ID NO: 470875 - RNA, 14 nt, Homo sapiens
ccucugugcugcac

SEQ ID NO: 470876 - RNA, 16 nt, Homo sapiens
ccucuuucucucugug

SEQ ID NO: 470877 - RNA, 20 nt, Homo sapiens
ccucuuuuaaugucaucucu

SEQ ID NO: 470878 - RNA, 19 nt, Homo sapiens
ccugaauccaccugcaguu

SEQ ID NO: 470879 - RNA, 15 nt, Homo sapiens
ccugagacucccgcc

SEQ ID NO: 470880 - RNA, 13 nt, Homo sapiens
ccugagguaccuu

SEQ ID NO: 470881 - RNA, 24 nt, Homo sapiens
ccugauaaacauuaaacacuguaa

SEQ ID NO: 470882 - RNA, 14 nt, Homo sapiens
ccugcccagucuuu

SEQ ID NO: 470883 - RNA, 15 nt, Homo sapiens
ccugcccucccccac

SEQ ID NO: 470884 - RNA, 22 nt, Homo sapiens
ccuggagcaacuugaggguaau

SEQ ID NO: 470885 - RNA, 14 nt, Homo sapiens
ccuggauguuauau

SEQ ID NO: 470886 - RNA, 23 nt, Homo sapiens
ccugggcugucugucaccagcua

SEQ ID NO: 470887 - RNA, 20 nt, Homo sapiens
ccuggggguggcaggcacac

SEQ ID NO: 470888 - RNA, 14 nt, Homo sapiens
ccuguagugagaaa

SEQ ID NO: 470889 - RNA, 12 nt, Homo sapiens
ccugugaucgug

SEQ ID NO: 470890 - RNA, 21 nt, Homo sapiens
ccugugggaguccacuuuccu

SEQ ID NO: 470891 - RNA, 17 nt, Homo sapiens
ccuguugaauuuacucu

SEQ ID NO: 470892 - RNA, 16 nt, Homo sapiens
ccuuagaauacuguau

SEQ ID NO: 470893 - RNA, 17 nt, Homo sapiens
ccuuagaauacuguauu

SEQ ID NO: 470894 - RNA, 14 nt, Homo sapiens
ccuucugaccccac

SEQ ID NO: 470895 - RNA, 14 nt, Homo sapiens
ccuugcucugccau

SEQ ID NO: 470896 - RNA, 15 nt, Homo sapiens
ccuugcucugccauc

SEQ ID NO: 470897 - RNA, 23 nt, Homo sapiens
ccuuucaaauuuaggauggaaua

SEQ ID NO: 470898 - RNA, 22 nt, Homo sapiens
ccuuucacuuuagaggcuugau

SEQ ID NO: 470899 - RNA, 21 nt, Homo sapiens
ccuuuccaaauaagugcauuu

SEQ ID NO: 470900 - RNA, 13 nt, Homo sapiens
ccuuuccugcaaa

SEQ ID NO: 470901 - RNA, 15 nt, Homo sapiens
ccuuucuuacauuag

SEQ ID NO: 470902 - RNA, 15 nt, Homo sapiens
ccuuugauguggaug

SEQ ID NO: 470903 - RNA, 15 nt, Homo sapiens
ccuuuguacugauga

SEQ ID NO: 470904 - RNA, 13 nt, Homo sapiens
cgagcacuuucca

SEQ ID NO: 470905 - RNA, 11 nt, Homo sapiens
cgcacaguauu

SEQ ID NO: 470906 - RNA, 15 nt, Homo sapiens
cgcauccaccgccac

SEQ ID NO: 470907 - RNA, 19 nt, Homo sapiens
cgcccugggcugucuguca

SEQ ID NO: 470908 - RNA, 21 nt, Homo sapiens
cgcuguauuccaaggccugug

SEQ ID NO: 470909 - RNA, 16 nt, Homo sapiens
cggaacagccaaagaa

SEQ ID NO: 470910 - RNA, 23 nt, Homo sapiens
cggucugagaagauucaauuuaa

SEQ ID NO: 470911 - RNA, 23 nt, Homo sapiens
cggugcauacacccccaccuccu

SEQ ID NO: 470912 - RNA, 23 nt, Homo sapiens
cgucuuucgcacauucuccugau

SEQ ID NO: 470913 - RNA, 14 nt, Homo sapiens
cgugccaugaucug

SEQ ID NO: 470914 - RNA, 15 nt, Homo sapiens
cguugacaugcacag

SEQ ID NO: 470915 - RNA, 21 nt, Homo sapiens
cguuugaauauauuuuaucuu

SEQ ID NO: 470916 - RNA, 18 nt, Homo sapiens
cuaaaauacucaccaaaa

SEQ ID NO: 470917 - RNA, 15 nt, Homo sapiens
cuaaaauucuagucu

SEQ ID NO: 470918 - RNA, 22 nt, Homo sapiens
cuaacaaguagcacacugaguu

SEQ ID NO: 470919 - RNA, 17 nt, Homo sapiens
cuaagcuguuucuugau

SEQ ID NO: 470920 - RNA, 16 nt, Homo sapiens
cuaaucagcauucuca

SEQ ID NO: 470921 - RNA, 17 nt, Homo sapiens
cuaaucagcauucucac

SEQ ID NO: 470922 - RNA, 12 nt, Homo sapiens
cuaauggaauau

SEQ ID NO: 470923 - RNA, 13 nt, Homo sapiens
cuaauguacaaua

SEQ ID NO: 470924 - RNA, 15 nt, Homo sapiens
cuaauguacaauaaa

SEQ ID NO: 470925 - RNA, 21 nt, Homo sapiens
cuaauguacaauaaagcaaug

SEQ ID NO: 470926 - RNA, 20 nt, Homo sapiens
cuacaccguggugagcauac

SEQ ID NO: 470927 - RNA, 24 nt, Homo sapiens
cuacagagagugaauacacuggaa

SEQ ID NO: 470928 - RNA, 14 nt, Homo sapiens
cuacgaaagcacag

SEQ ID NO: 470929 - RNA, 12 nt, Homo sapiens
cuagaacagcca

SEQ ID NO: 470930 - RNA, 17 nt, Homo sapiens
cuagccagaggcucuaa

SEQ ID NO: 470931 - RNA, 16 nt, Homo sapiens
cuagguuucaccuccc

SEQ ID NO: 470932 - RNA, 22 nt, Homo sapiens
cuaguagcuuuccucccaaagg

SEQ ID NO: 470933 - RNA, 23 nt, Homo sapiens
cuaguccccagccugcucccuag

SEQ ID NO: 470934 - RNA, 15 nt, Homo sapiens
cuauaauguuucccu

SEQ ID NO: 470935 - RNA, 18 nt, Homo sapiens
cuauagaauaaagccucu

SEQ ID NO: 470936 - RNA, 20 nt, Homo sapiens
cuaucaccucuuaugcacac

SEQ ID NO: 470937 - RNA, 17 nt, Homo sapiens
cuaugcugcaauacauu

SEQ ID NO: 470938 - RNA, 21 nt, Homo sapiens
cuauuaaaagaauccaaauuc

SEQ ID NO: 470939 - RNA, 18 nt, Homo sapiens
cuauuaacucugcauaga

SEQ ID NO: 470940 - RNA, 15 nt, Homo sapiens
cuauucccaaaugcc

SEQ ID NO: 470941 - RNA, 14 nt, Homo sapiens
cucaaaaguauugu

SEQ ID NO: 470942 - RNA, 18 nt, Homo sapiens
cucaauaaaggucauauu

SEQ ID NO: 470943 - RNA, 17 nt, Homo sapiens
cucaccuugcucugcca

SEQ ID NO: 470944 - RNA, 16 nt, Homo sapiens
cucacuggugcauuua

SEQ ID NO: 470945 - RNA, 19 nt, Homo sapiens
cucagaagucaguugcaaa

SEQ ID NO: 470946 - RNA, 17 nt, Homo sapiens
cucauuuguccaugugc

SEQ ID NO: 470947 - RNA, 15 nt, Homo sapiens
cuccaagguggcaua

SEQ ID NO: 470948 - RNA, 15 nt, Homo sapiens
cuccacucugaaguc

SEQ ID NO: 470949 - RNA, 18 nt, Homo sapiens
cuccagggcgagcacuuu

SEQ ID NO: 470950 - RNA, 15 nt, Homo sapiens
cuccauuaaccaaga

SEQ ID NO: 470951 - RNA, 17 nt, Homo sapiens
cucccuagccagaggcu

SEQ ID NO: 470952 - RNA, 15 nt, Homo sapiens
cucccuuggauuuuu

SEQ ID NO: 470953 - RNA, 14 nt, Homo sapiens
cuccucugcuccaa

SEQ ID NO: 470954 - RNA, 18 nt, Homo sapiens
cuccucugcuccaacaga

SEQ ID NO: 470955 - RNA, 21 nt, Homo sapiens
cuccuucuucaaacaggaauu

SEQ ID NO: 470956 - RNA, 14 nt, Homo sapiens
cuccuuuccugcaa

SEQ ID NO: 470957 - RNA, 11 nt, Homo sapiens
cucgugccaug

SEQ ID NO: 470958 - RNA, 16 nt, Homo sapiens
cucgugccaugaucug

SEQ ID NO: 470959 - RNA, 16 nt, Homo sapiens
cucuaauguacaauaa

SEQ ID NO: 470960 - RNA, 13 nt, Homo sapiens
cucuagaacagcc

SEQ ID NO: 470961 - RNA, 17 nt, Homo sapiens
cucuagaacagccagac

SEQ ID NO: 470962 - RNA, 23 nt, Homo sapiens
cucuagaacagccagacccugca

SEQ ID NO: 470963 - RNA, 18 nt, Homo sapiens
cucuauuuugaaaaacca

SEQ ID NO: 470964 - RNA, 13 nt, Homo sapiens
cucucccaaauaa

SEQ ID NO: 470965 - RNA, 19 nt, Homo sapiens
cucugagcugcuaggaacc

SEQ ID NO: 470966 - RNA, 16 nt, Homo sapiens
cucugcaguugaucuc

SEQ ID NO: 470967 - RNA, 15 nt, Homo sapiens
cucuuaccuguaaua

SEQ ID NO: 470968 - RNA, 13 nt, Homo sapiens
cugaaacuauaga

SEQ ID NO: 470969 - RNA, 21 nt, Homo sapiens
cugaaagacaguaaagaccau

SEQ ID NO: 470970 - RNA, 20 nt, Homo sapiens
cugaagucacguagcacaga

SEQ ID NO: 470971 - RNA, 19 nt, Homo sapiens
cugaauccaccugcaguua

SEQ ID NO: 470972 - RNA, 20 nt, Homo sapiens
cugaaugugauacaugccga

SEQ ID NO: 470973 - RNA, 20 nt, Homo sapiens
cugacagaugaccgcaauaa

SEQ ID NO: 470974 - RNA, 13 nt, Homo sapiens
cugaccaccugca

SEQ ID NO: 470975 - RNA, 13 nt, Homo sapiens
cugagcagugggg

SEQ ID NO: 470976 - RNA, 18 nt, Homo sapiens
cugagcccagaaaaaagg

SEQ ID NO: 470977 - RNA, 17 nt, Homo sapiens
cugaguuugaacacaga

SEQ ID NO: 470978 - RNA, 15 nt, Homo sapiens
cugauaaacauuaaa

SEQ ID NO: 470979 - RNA, 17 nt, Homo sapiens
cugcacagugcaucuca

SEQ ID NO: 470980 - RNA, 18 nt, Homo sapiens
cugcaggguccccaagga

SEQ ID NO: 470981 - RNA, 14 nt, Homo sapiens
cugcauuacuauua

SEQ ID NO: 470982 - RNA, 19 nt, Homo sapiens
cugccccccuccuuuccaa

SEQ ID NO: 470983 - RNA, 21 nt, Homo sapiens
cugccccccuucccaccccua

SEQ ID NO: 470984 - RNA, 19 nt, Homo sapiens
cugcccccucccccgcaga

SEQ ID NO: 470985 - RNA, 16 nt, Homo sapiens
cugccgcugcaccacg

SEQ ID NO: 470986 - RNA, 15 nt, Homo sapiens
cugccugaacaaagg

SEQ ID NO: 470987 - RNA, 15 nt, Homo sapiens
cugccuuacagacag

SEQ ID NO: 470988 - RNA, 16 nt, Homo sapiens
cugccuuggacaccau

SEQ ID NO: 470989 - RNA, 14 nt, Homo sapiens
cugcucccuagcca

SEQ ID NO: 470990 - RNA, 18 nt, Homo sapiens
cugcuucacgauucuuac

SEQ ID NO: 470991 - RNA, 22 nt, Homo sapiens
cugcuuuggggcuuaucagaac

SEQ ID NO: 470992 - RNA, 22 nt, Homo sapiens
cuggcacaccagaagugccaug

SEQ ID NO: 470993 - RNA, 23 nt, Homo sapiens
cugggaaauaagcaaaaaacugc

SEQ ID NO: 470994 - RNA, 13 nt, Homo sapiens
cugggaccaaaac

SEQ ID NO: 470995 - RNA, 14 nt, Homo sapiens
cuguaaaagacugg

SEQ ID NO: 470996 - RNA, 16 nt, Homo sapiens
cuguaguggcaaaaaa

SEQ ID NO: 470997 - RNA, 19 nt, Homo sapiens
cuguauuuugccagacuua

SEQ ID NO: 470998 - RNA, 13 nt, Homo sapiens
cugugaauggcag

SEQ ID NO: 470999 - RNA, 17 nt, Homo sapiens
cugugccuaucaccucu

SEQ ID NO: 471000 - RNA, 14 nt, Homo sapiens
cuguggauucuaua

SEQ ID NO: 471001 - RNA, 15 nt, Homo sapiens
cuguuccugccacau

SEQ ID NO: 471002 - RNA, 18 nt, Homo sapiens
cuguuuuggaauguuggc

SEQ ID NO: 471003 - RNA, 19 nt, Homo sapiens
cuuaaaagaacauaggaau

SEQ ID NO: 471004 - RNA, 14 nt, Homo sapiens
cuuaaacuuuguca

SEQ ID NO: 471005 - RNA, 22 nt, Homo sapiens
cuuaauguucugaauaauuucu

SEQ ID NO: 471006 - RNA, 20 nt, Homo sapiens
cuuaauuaccuaagagccac

SEQ ID NO: 471007 - RNA, 14 nt, Homo sapiens
cuuagauugccacu

SEQ ID NO: 471008 - RNA, 20 nt, Homo sapiens
cuuagcguucuguuucacca

SEQ ID NO: 471009 - RNA, 13 nt, Homo sapiens
cuucaaaacagaa

SEQ ID NO: 471010 - RNA, 18 nt, Homo sapiens
cuucaaaauaucaagugu

SEQ ID NO: 471011 - RNA, 16 nt, Homo sapiens
cuucauccauagacac

SEQ ID NO: 471012 - RNA, 16 nt, Homo sapiens
cuuccacuucaggguu

SEQ ID NO: 471013 - RNA, 17 nt, Homo sapiens
cuuccacuucaggguuc

SEQ ID NO: 471014 - RNA, 12 nt, Homo sapiens
cuuccauggugg

SEQ ID NO: 471015 - RNA, 19 nt, Homo sapiens
cuucccacuuugccacugg

SEQ ID NO: 471016 - RNA, 16 nt, Homo sapiens
cuucccuaguucuuug

SEQ ID NO: 471017 - RNA, 13 nt, Homo sapiens
cuucuaccagaga

SEQ ID NO: 471018 - RNA, 20 nt, Homo sapiens
cuucuauuuauuuauuauua

SEQ ID NO: 471019 - RNA, 14 nt, Homo sapiens
cuucuguuuuccaa

SEQ ID NO: 471020 - RNA, 15 nt, Homo sapiens
cuugacuuugccaca

SEQ ID NO: 471021 - RNA, 15 nt, Homo sapiens
cuugcaugugcugca

SEQ ID NO: 471022 - RNA, 14 nt, Homo sapiens
cuugcccaugcaca

SEQ ID NO: 471023 - RNA, 18 nt, Homo sapiens
cuuggguccaguauuuac

SEQ ID NO: 471024 - RNA, 13 nt, Homo sapiens
cuugucagaauuu

SEQ ID NO: 471025 - RNA, 22 nt, Homo sapiens
cuuguucuuccucuuaccugua

SEQ ID NO: 471026 - RNA, 18 nt, Homo sapiens
cuuguugaugaagcacau

SEQ ID NO: 471027 - RNA, 19 nt, Homo sapiens
cuuuaaguaaaauguuuca

SEQ ID NO: 471028 - RNA, 12 nt, Homo sapiens
cuuucaccucag

SEQ ID NO: 471029 - RNA, 20 nt, Homo sapiens
cuuuccaaauaagugcauuu

SEQ ID NO: 471030 - RNA, 17 nt, Homo sapiens
cuuuccacuuccagagg

SEQ ID NO: 471031 - RNA, 22 nt, Homo sapiens
caauaaaaucagugugcuugcc

SEQ ID NO: 471032 - RNA, 15 nt, Homo sapiens
caauaaugaaugagc

SEQ ID NO: 471033 - RNA, 20 nt, Homo sapiens
caauaugaggggacugcaug

SEQ ID NO: 471034 - RNA, 22 nt, Homo sapiens
caauaugaggggacugcaugca

SEQ ID NO: 471035 - RNA, 13 nt, Homo sapiens
caaugaccuguau

SEQ ID NO: 471036 - RNA, 13 nt, Homo sapiens
caaugcauacaau

SEQ ID NO: 471037 - RNA, 18 nt, Homo sapiens
caaugccugccugaacaa

SEQ ID NO: 471038 - RNA, 16 nt, Homo sapiens
caaugccuuguuguau

SEQ ID NO: 471039 - RNA, 14 nt, Homo sapiens
caauggcuggguuu

SEQ ID NO: 471040 - RNA, 18 nt, Homo sapiens
caauugcuucugugcaau

SEQ ID NO: 471041 - RNA, 14 nt, Homo sapiens
caauuggguuguga

SEQ ID NO: 471042 - RNA, 23 nt, Homo sapiens
caauuuagauuuuucucaucucc

SEQ ID NO: 471043 - RNA, 14 nt, Homo sapiens
cacaaauauaguug

SEQ ID NO: 471044 - RNA, 14 nt, Homo sapiens
cacaacuaacaaug

SEQ ID NO: 471045 - RNA, 22 nt, Homo sapiens
cacagaaccuuugucaacuuca

SEQ ID NO: 471046 - RNA, 18 nt, Homo sapiens
cacaggauucucuucuca

SEQ ID NO: 471047 - RNA, 13 nt, Homo sapiens
cacagugcaucuc

SEQ ID NO: 471048 - RNA, 13 nt, Homo sapiens
cacaguuugcaau

SEQ ID NO: 471049 - RNA, 16 nt, Homo sapiens
cacaguuugcaaucuu

SEQ ID NO: 471050 - RNA, 21 nt, Homo sapiens
caccaaauacuuucugagaug

SEQ ID NO: 471051 - RNA, 16 nt, Homo sapiens
caccagcuaucuguca

SEQ ID NO: 471052 - RNA, 21 nt, Homo sapiens
cacccauaccagcuagaauca

SEQ ID NO: 471053 - RNA, 12 nt, Homo sapiens
cacccauucaca

SEQ ID NO: 471054 - RNA, 21 nt, Homo sapiens
cacccuccacucugaggucuc

SEQ ID NO: 471055 - RNA, 15 nt, Homo sapiens
cacccuucucaggga

SEQ ID NO: 471056 - RNA, 16 nt, Homo sapiens
cacccuucucagggac

SEQ ID NO: 471057 - RNA, 23 nt, Homo sapiens
caccgguguccuguuccugccac

SEQ ID NO: 471058 - RNA, 22 nt, Homo sapiens
caccguggugagcauacagagu

SEQ ID NO: 471059 - RNA, 13 nt, Homo sapiens
caccucuuuguca

SEQ ID NO: 471060 - RNA, 21 nt, Homo sapiens
caccuucccuaguucuuugca

SEQ ID NO: 471061 - RNA, 19 nt, Homo sapiens
caccuucgccuuugcugaa

SEQ ID NO: 471062 - RNA, 16 nt, Homo sapiens
cacgaucguuaugcug

SEQ ID NO: 471063 - RNA, 16 nt, Homo sapiens
cacggcuuauaccagg

SEQ ID NO: 471064 - RNA, 16 nt, Homo sapiens
cacuaaguaaccucua

SEQ ID NO: 471065 - RNA, 14 nt, Homo sapiens
cacuagaagcacag

SEQ ID NO: 471066 - RNA, 13 nt, Homo sapiens
cacuagguuucac

SEQ ID NO: 471067 - RNA, 15 nt, Homo sapiens
cacuccccucaucca

SEQ ID NO: 471068 - RNA, 15 nt, Homo sapiens
cacugaauuaugcca

SEQ ID NO: 471069 - RNA, 18 nt, Homo sapiens
cacugaguuugaacacag

SEQ ID NO: 471070 - RNA, 20 nt, Homo sapiens
cacugcugaaccuuuccucu

SEQ ID NO: 471071 - RNA, 16 nt, Homo sapiens
cacuggaguucacuuu

SEQ ID NO: 471072 - RNA, 15 nt, Homo sapiens
cacuguuucuucuca

SEQ ID NO: 471073 - RNA, 15 nt, Homo sapiens
cacuuaaacuuuguc

SEQ ID NO: 471074 - RNA, 22 nt, Homo sapiens
cacuuaaggggggaugucuuga

SEQ ID NO: 471075 - RNA, 18 nt, Homo sapiens
cacuugacuuugccacau

SEQ ID NO: 471076 - RNA, 14 nt, Homo sapiens
cacuuuuucugucu

SEQ ID NO: 471077 - RNA, 14 nt, Homo sapiens
cagaaaaaaggacu

SEQ ID NO: 471078 - RNA, 19 nt, Homo sapiens
cagaauacaguaagcugcu

SEQ ID NO: 471079 - RNA, 19 nt, Homo sapiens
cagaccuagugcucccuuc

SEQ ID NO: 471080 - RNA, 14 nt, Homo sapiens
cagagacucugaaa

SEQ ID NO: 471081 - RNA, 15 nt, Homo sapiens
cagagagaaagaaga

SEQ ID NO: 471082 - RNA, 17 nt, Homo sapiens
cagaggcucuaauguac

SEQ ID NO: 471083 - RNA, 23 nt, Homo sapiens
cagaguaacacaauuuucacuuu

SEQ ID NO: 471084 - RNA, 17 nt, Homo sapiens
cagauguuuguuuucaa

SEQ ID NO: 471085 - RNA, 17 nt, Homo sapiens
cagcauucucacuccua

SEQ ID NO: 471086 - RNA, 21 nt, Homo sapiens
cagccccauccuucccgcagc

SEQ ID NO: 471087 - RNA, 21 nt, Homo sapiens
cagcccgugcaacggaagcca

SEQ ID NO: 471088 - RNA, 23 nt, Homo sapiens
cagccugcucccuagccagaggc

SEQ ID NO: 471089 - RNA, 19 nt, Homo sapiens
cagcuaacaaguagcacac

SEQ ID NO: 471090 - RNA, 18 nt, Homo sapiens
caggaaagaucccaaguc

SEQ ID NO: 471091 - RNA, 21 nt, Homo sapiens
caggaauuucuguuagcaaua

SEQ ID NO: 471092 - RNA, 22 nt, Homo sapiens
caggaauuucuguuagcaauau

SEQ ID NO: 471093 - RNA, 18 nt, Homo sapiens
caggccaggagacuguua

SEQ ID NO: 471094 - RNA, 18 nt, Homo sapiens
caggcccuuccucuccac

SEQ ID NO: 471095 - RNA, 15 nt, Homo sapiens
caggcucacagagau

SEQ ID NO: 471096 - RNA, 23 nt, Homo sapiens
cagggggguuggguuccagacag

SEQ ID NO: 471097 - RNA, 20 nt, Homo sapiens
caggguucuaaccuuucuaa

SEQ ID NO: 471098 - RNA, 13 nt, Homo sapiens
cagguuaccucac

SEQ ID NO: 471099 - RNA, 15 nt, Homo sapiens
cagguuaccucacuu

SEQ ID NO: 471100 - RNA, 16 nt, Homo sapiens
cagguuaccucacuuu

SEQ ID NO: 471101 - RNA, 17 nt, Homo sapiens
cagguuccuccuaggcg

SEQ ID NO: 471102 - RNA, 12 nt, Homo sapiens
caguacagggca

SEQ ID NO: 471103 - RNA, 17 nt, Homo sapiens
caguagugccugugauc

SEQ ID NO: 471104 - RNA, 16 nt, Homo sapiens
caguagugcuaucuca

SEQ ID NO: 471105 - RNA, 16 nt, Homo sapiens
caguauugacuucuuu

SEQ ID NO: 471106 - RNA, 22 nt, Homo sapiens
cagucuuuggagagcucaguac

SEQ ID NO: 471107 - RNA, 16 nt, Homo sapiens
caguguguacuucuuc

SEQ ID NO: 471108 - RNA, 17 nt, Homo sapiens
caguuauagaaaaucua

SEQ ID NO: 471109 - RNA, 15 nt, Homo sapiens
caguuuuuccuaguc

SEQ ID NO: 471110 - RNA, 13 nt, Homo sapiens
cauaaaucugucu

SEQ ID NO: 471111 - RNA, 17 nt, Homo sapiens
cauaaaucugucugauu

SEQ ID NO: 471112 - RNA, 14 nt, Homo sapiens
cauaaauguuauau

SEQ ID NO: 471113 - RNA, 15 nt, Homo sapiens
cauaacacacuacug

SEQ ID NO: 471114 - RNA, 16 nt, Homo sapiens
cauaagauuauauaca

SEQ ID NO: 471115 - RNA, 19 nt, Homo sapiens
cauaauaaaaggcauucau

SEQ ID NO: 471116 - RNA, 20 nt, Homo sapiens
cauacauacacugcauccug

SEQ ID NO: 471117 - RNA, 22 nt, Homo sapiens
cauacaucuaagucaguuucac

SEQ ID NO: 471118 - RNA, 15 nt, Homo sapiens
cauagagcagcacua

SEQ ID NO: 471119 - RNA, 19 nt, Homo sapiens
cauaggugcucuuccucau

SEQ ID NO: 471120 - RNA, 23 nt, Homo sapiens
cauaggugcucuuccucaucuca

SEQ ID NO: 471121 - RNA, 18 nt, Homo sapiens
cauagucuuuguuuacau

SEQ ID NO: 471122 - RNA, 21 nt, Homo sapiens
cauccaauggauugugcaaau

SEQ ID NO: 471123 - RNA, 16 nt, Homo sapiens
cauccucugcuuguca

SEQ ID NO: 471124 - RNA, 17 nt, Homo sapiens
caucugaggaguccaaa

SEQ ID NO: 471125 - RNA, 13 nt, Homo sapiens
caucuggagucuu

SEQ ID NO: 471126 - RNA, 22 nt, Homo sapiens
caucuuguaaauaaugcuuaac

SEQ ID NO: 471127 - RNA, 21 nt, Homo sapiens
augacucaccuugcucugcca

SEQ ID NO: 471128 - RNA, 13 nt, Homo sapiens
augaguggaauac

SEQ ID NO: 471129 - RNA, 19 nt, Homo sapiens
augauucuccucucccaaa

SEQ ID NO: 471130 - RNA, 14 nt, Homo sapiens
augcauccaaauag

SEQ ID NO: 471131 - RNA, 23 nt, Homo sapiens
augcauccaaauaggagucuucu

SEQ ID NO: 471132 - RNA, 20 nt, Homo sapiens
augcaugauauuguauguac

SEQ ID NO: 471133 - RNA, 18 nt, Homo sapiens
augcauucccuacagauu

SEQ ID NO: 471134 - RNA, 22 nt, Homo sapiens
augccagggcgcacuuuccacu

SEQ ID NO: 471135 - RNA, 22 nt, Homo sapiens
augccuuucuaguccuauucua

SEQ ID NO: 471136 - RNA, 19 nt, Homo sapiens
augcuacagagagugaaua

SEQ ID NO: 471137 - RNA, 13 nt, Homo sapiens
augcugacuguac

SEQ ID NO: 471138 - RNA, 13 nt, Homo sapiens
augcuuaacauaa

SEQ ID NO: 471139 - RNA, 13 nt, Homo sapiens
augcuugagaugu

SEQ ID NO: 471140 - RNA, 14 nt, Homo sapiens
augcuuuucuaauc

SEQ ID NO: 471141 - RNA, 13 nt, Homo sapiens
auggauucacuuc

SEQ ID NO: 471142 - RNA, 19 nt, Homo sapiens
auggcuuaagccuguguau

SEQ ID NO: 471143 - RNA, 18 nt, Homo sapiens
auggcuuuccacaucccc

SEQ ID NO: 471144 - RNA, 14 nt, Homo sapiens
augggaccagggau

SEQ ID NO: 471145 - RNA, 14 nt, Homo sapiens
augggagaaccucg

SEQ ID NO: 471146 - RNA, 21 nt, Homo sapiens
augggagagguucugugcaaa

SEQ ID NO: 471147 - RNA, 14 nt, Homo sapiens
auggugcacuggaa

SEQ ID NO: 471148 - RNA, 17 nt, Homo sapiens
augguuuaaagucacag

SEQ ID NO: 471149 - RNA, 21 nt, Homo sapiens
auguaauaaccaaaugcaaug

SEQ ID NO: 471150 - RNA, 17 nt, Homo sapiens
auguacaauaaagcaau

SEQ ID NO: 471151 - RNA, 19 nt, Homo sapiens
auguacauuuucuaacaaa

SEQ ID NO: 471152 - RNA, 19 nt, Homo sapiens
augucaauuuuuaacuuau

SEQ ID NO: 471153 - RNA, 17 nt, Homo sapiens
auguggaaugcauccaa

SEQ ID NO: 471154 - RNA, 20 nt, Homo sapiens
augugucccaugcauaacac

SEQ ID NO: 471155 - RNA, 18 nt, Homo sapiens
auguguccccucacucug

SEQ ID NO: 471156 - RNA, 21 nt, Homo sapiens
auguguccccucacucuguca

SEQ ID NO: 471157 - RNA, 17 nt, Homo sapiens
augugugcaucaugucu

SEQ ID NO: 471158 - RNA, 17 nt, Homo sapiens
auguuaccuucacaugu

SEQ ID NO: 471159 - RNA, 17 nt, Homo sapiens
auguuuaaaaguauaua

SEQ ID NO: 471160 - RNA, 12 nt, Homo sapiens
auuaaacacugu

SEQ ID NO: 471161 - RNA, 14 nt, Homo sapiens
auuaacaucaaaga

SEQ ID NO: 471162 - RNA, 17 nt, Homo sapiens
auuaacucugcauagac

SEQ ID NO: 471163 - RNA, 18 nt, Homo sapiens
auuaacucugcauagaca

SEQ ID NO: 471164 - RNA, 14 nt, Homo sapiens
auuacaauugucau

SEQ ID NO: 471165 - RNA, 14 nt, Homo sapiens
auuauaaguugacc

SEQ ID NO: 471166 - RNA, 19 nt, Homo sapiens
auuauggcuuugugcuugu

SEQ ID NO: 471167 - RNA, 13 nt, Homo sapiens
auuauuacuguuc

SEQ ID NO: 471168 - RNA, 21 nt, Homo sapiens
auuauuucagucaucaucuca

SEQ ID NO: 471169 - RNA, 12 nt, Homo sapiens
auucaaaugcau

SEQ ID NO: 471170 - RNA, 14 nt, Homo sapiens
auucaaaugcauga

SEQ ID NO: 471171 - RNA, 15 nt, Homo sapiens
auucaagccugugaa

SEQ ID NO: 471172 - RNA, 15 nt, Homo sapiens
auucauaaaaauaac

SEQ ID NO: 471173 - RNA, 22 nt, Homo sapiens
auucauaaaaauaaccaaaaaa

SEQ ID NO: 471174 - RNA, 17 nt, Homo sapiens
auuccaaggccugugaa

SEQ ID NO: 471175 - RNA, 19 nt, Homo sapiens
auucccuuggauguagucu

SEQ ID NO: 471176 - RNA, 22 nt, Homo sapiens
auucguccuuagaauacuguau

SEQ ID NO: 471177 - RNA, 12 nt, Homo sapiens
auugaaagggag

SEQ ID NO: 471178 - RNA, 19 nt, Homo sapiens
auugaaucugauuggacau

SEQ ID NO: 471179 - RNA, 17 nt, Homo sapiens
auugacuucuuuuuggc

SEQ ID NO: 471180 - RNA, 18 nt, Homo sapiens
auugagaucagcauucaa

SEQ ID NO: 471181 - RNA, 21 nt, Homo sapiens
auugcaaaagguuaagccaua

SEQ ID NO: 471182 - RNA, 18 nt, Homo sapiens
auugccucuaugugcaac

SEQ ID NO: 471183 - RNA, 22 nt, Homo sapiens
auuggcaucucuccccauauau

SEQ ID NO: 471184 - RNA, 20 nt, Homo sapiens
auugugccaaagauagcaga

SEQ ID NO: 471185 - RNA, 20 nt, Homo sapiens
auuuaaaaucagacucuuua

SEQ ID NO: 471186 - RNA, 17 nt, Homo sapiens
auuuacaguuacugccu

SEQ ID NO: 471187 - RNA, 21 nt, Homo sapiens
auuuaucuuccauaugcucuu

SEQ ID NO: 471188 - RNA, 16 nt, Homo sapiens
auuucagggcugggcu

SEQ ID NO: 471189 - RNA, 17 nt, Homo sapiens
auuucagggcugggcua

SEQ ID NO: 471190 - RNA, 16 nt, Homo sapiens
auuucuaucugcaaau

SEQ ID NO: 471191 - RNA, 20 nt, Homo sapiens
auuucuuugauugugaaaca

SEQ ID NO: 471192 - RNA, 20 nt, Homo sapiens
auuugagagaagccacgcug

SEQ ID NO: 471193 - RNA, 17 nt, Homo sapiens
auuuguccaugugcaaa

SEQ ID NO: 471194 - RNA, 20 nt, Homo sapiens
auuuuaucuugguaguacau

SEQ ID NO: 471195 - RNA, 19 nt, Homo sapiens
auuuugauaccagugagca

SEQ ID NO: 471196 - RNA, 15 nt, Homo sapiens
auuuuucucaucucc

SEQ ID NO: 471197 - RNA, 18 nt, Homo sapiens
caaaagauaaaacuaauu

SEQ ID NO: 471198 - RNA, 17 nt, Homo sapiens
caaaagguuaagccaua

SEQ ID NO: 471199 - RNA, 13 nt, Homo sapiens
caaaauacuucuu

SEQ ID NO: 471200 - RNA, 21 nt, Homo sapiens
caaaauguggaaugcauccaa

SEQ ID NO: 471201 - RNA, 21 nt, Homo sapiens
caaacaguguggcuuaaacau

SEQ ID NO: 471202 - RNA, 20 nt, Homo sapiens
caaacccauuuccagcuccu

SEQ ID NO: 471203 - RNA, 13 nt, Homo sapiens
caaagacuacuaa

SEQ ID NO: 471204 - RNA, 15 nt, Homo sapiens
caaagcugucacuca

SEQ ID NO: 471205 - RNA, 13 nt, Homo sapiens
caaaggacaguac

SEQ ID NO: 471206 - RNA, 18 nt, Homo sapiens
caaaggcuuucuuuccaa

SEQ ID NO: 471207 - RNA, 14 nt, Homo sapiens
caaauaagugcauu

SEQ ID NO: 471208 - RNA, 13 nt, Homo sapiens
caaauaaucacaa

SEQ ID NO: 471209 - RNA, 20 nt, Homo sapiens
caaauaaucacaaaaucaca

SEQ ID NO: 471210 - RNA, 20 nt, Homo sapiens
caaaugcaugauauuguaug

SEQ ID NO: 471211 - RNA, 22 nt, Homo sapiens
caaaugcaugauauuguaugua

SEQ ID NO: 471212 - RNA, 16 nt, Homo sapiens
caacacaccuugccca

SEQ ID NO: 471213 - RNA, 19 nt, Homo sapiens
caacacuugcacaaucacg

SEQ ID NO: 471214 - RNA, 14 nt, Homo sapiens
caacgggucugugg

SEQ ID NO: 471215 - RNA, 20 nt, Homo sapiens
caacuaauacaugguuuaaa

SEQ ID NO: 471216 - RNA, 19 nt, Homo sapiens
caacuuaaaccugugcuuu

SEQ ID NO: 471217 - RNA, 14 nt, Homo sapiens
caagaccccaaagg

SEQ ID NO: 471218 - RNA, 23 nt, Homo sapiens
caagcuuuggcuuuuuccaucuc

SEQ ID NO: 471219 - RNA, 16 nt, Homo sapiens
caagguccaugucacc

SEQ ID NO: 471220 - RNA, 22 nt, Homo sapiens
caaguguuuauuaaaauacugu

SEQ ID NO: 471221 - RNA, 16 nt, Homo sapiens
caaguuuuugguaaug

SEQ ID NO: 471222 - RNA, 12 nt, Homo sapiens
caauaaaagagc

SEQ ID NO: 471223 - RNA, 21 nt, Homo sapiens
aggggacugcaugcaagcuca

SEQ ID NO: 471224 - RNA, 15 nt, Homo sapiens
aggggcaacugauga

SEQ ID NO: 471225 - RNA, 20 nt, Homo sapiens
aggugcucuuccucaucuca

SEQ ID NO: 471226 - RNA, 12 nt, Homo sapiens
agguuaccucac

SEQ ID NO: 471227 - RNA, 12 nt, Homo sapiens
aguaaagaccau

SEQ ID NO: 471228 - RNA, 20 nt, Homo sapiens
aguaacacaauuuucacuuu

SEQ ID NO: 471229 - RNA, 16 nt, Homo sapiens
aguaagcugcucuauu

SEQ ID NO: 471230 - RNA, 15 nt, Homo sapiens
aguaauaacuguuag

SEQ ID NO: 471231 - RNA, 21 nt, Homo sapiens
aguagagcuucuuauauuaaa

SEQ ID NO: 471232 - RNA, 16 nt, Homo sapiens
aguagcuuuccuccca

SEQ ID NO: 471233 - RNA, 14 nt, Homo sapiens
aguagugcuaucuc

SEQ ID NO: 471234 - RNA, 21 nt, Homo sapiens
aguagugcuaucucaugacaa

SEQ ID NO: 471235 - RNA, 14 nt, Homo sapiens
aguauauagccuua

SEQ ID NO: 471236 - RNA, 15 nt, Homo sapiens
agucaaacagugugg

SEQ ID NO: 471237 - RNA, 18 nt, Homo sapiens
agucaaacuuucaccuca

SEQ ID NO: 471238 - RNA, 16 nt, Homo sapiens
agucacguagcacaga

SEQ ID NO: 471239 - RNA, 21 nt, Homo sapiens
agucaucucaaacacugcuua

SEQ ID NO: 471240 - RNA, 21 nt, Homo sapiens
agucauguuucugcaguauuc

SEQ ID NO: 471241 - RNA, 18 nt, Homo sapiens
agucucauuacagauuua

SEQ ID NO: 471242 - RNA, 19 nt, Homo sapiens
agugaugcaggcaguguaa

SEQ ID NO: 471243 - RNA, 20 nt, Homo sapiens
agugcucccuuccuccucaa

SEQ ID NO: 471244 - RNA, 13 nt, Homo sapiens
aguggaaugggua

SEQ ID NO: 471245 - RNA, 19 nt, Homo sapiens
agugguauagaguacugca

SEQ ID NO: 471246 - RNA, 21 nt, Homo sapiens
aguggucaagcccuugcccag

SEQ ID NO: 471247 - RNA, 15 nt, Homo sapiens
agugucccuuaccug

SEQ ID NO: 471248 - RNA, 20 nt, Homo sapiens
aguguccugauuuguguuaa

SEQ ID NO: 471249 - RNA, 18 nt, Homo sapiens
aguguuagagugucuuaa

SEQ ID NO: 471250 - RNA, 14 nt, Homo sapiens
aguuaaaaagucaa

SEQ ID NO: 471251 - RNA, 14 nt, Homo sapiens
aguuaauucuugcc

SEQ ID NO: 471252 - RNA, 18 nt, Homo sapiens
aguucuauuucuaucugc

SEQ ID NO: 471253 - RNA, 19 nt, Homo sapiens
aguucuccuuguacuugaa

SEQ ID NO: 471254 - RNA, 22 nt, Homo sapiens
aguuuaaaaaaauaacaucuga

SEQ ID NO: 471255 - RNA, 19 nt, Homo sapiens
aguuuaauauuccaauacc

SEQ ID NO: 471256 - RNA, 22 nt, Homo sapiens
aguuuaggacccaagguggucu

SEQ ID NO: 471257 - RNA, 12 nt, Homo sapiens
aguuucacauau

SEQ ID NO: 471258 - RNA, 19 nt, Homo sapiens
aguuuccaaguuuauugcc

SEQ ID NO: 471259 - RNA, 21 nt, Homo sapiens
aguuuccaaguuuauugcccu

SEQ ID NO: 471260 - RNA, 19 nt, Homo sapiens
aguuugcuuuguaugcacu

SEQ ID NO: 471261 - RNA, 21 nt, Homo sapiens
auaaaaacccuguauggcacu

SEQ ID NO: 471262 - RNA, 17 nt, Homo sapiens
auaaaaucagugugcuu

SEQ ID NO: 471263 - RNA, 22 nt, Homo sapiens
auaaacaacuuaauguucugaa

SEQ ID NO: 471264 - RNA, 17 nt, Homo sapiens
auaaagaagaaaauaac

SEQ ID NO: 471265 - RNA, 14 nt, Homo sapiens
auaaagaguucucc

SEQ ID NO: 471266 - RNA, 14 nt, Homo sapiens
auaaagcaaugugg

SEQ ID NO: 471267 - RNA, 12 nt, Homo sapiens
auaaauguggau

SEQ ID NO: 471268 - RNA, 14 nt, Homo sapiens
auaaauuggcuccu

SEQ ID NO: 471269 - RNA, 13 nt, Homo sapiens
auaacaagccaaa

SEQ ID NO: 471270 - RNA, 18 nt, Homo sapiens
auaacaagccaaacauuc

SEQ ID NO: 471271 - RNA, 19 nt, Homo sapiens
auaacaagccaaacauucu

SEQ ID NO: 471272 - RNA, 16 nt, Homo sapiens
auaacaccaucuggag

SEQ ID NO: 471273 - RNA, 18 nt, Homo sapiens
auaaccugugaauccaau

SEQ ID NO: 471274 - RNA, 22 nt, Homo sapiens
auaaggaucuucccacuuugcc

SEQ ID NO: 471275 - RNA, 21 nt, Homo sapiens
auaaguaacacuaguagcugu

SEQ ID NO: 471276 - RNA, 18 nt, Homo sapiens
auaauaaccacgauucca

SEQ ID NO: 471277 - RNA, 16 nt, Homo sapiens
auaauaauggcuaacu

SEQ ID NO: 471278 - RNA, 23 nt, Homo sapiens
auacacuguaucuaaaaaauaac

SEQ ID NO: 471279 - RNA, 20 nt, Homo sapiens
auaccagguuaccucacuuu

SEQ ID NO: 471280 - RNA, 18 nt, Homo sapiens
auacucuguguaaucucu

SEQ ID NO: 471281 - RNA, 18 nt, Homo sapiens
auacugguuauaguugau

SEQ ID NO: 471282 - RNA, 18 nt, Homo sapiens
auacuuuggggacuugua

SEQ ID NO: 471283 - RNA, 12 nt, Homo sapiens
auagaacugucc

SEQ ID NO: 471284 - RNA, 20 nt, Homo sapiens
auagaacugucccacaaaau

SEQ ID NO: 471285 - RNA, 15 nt, Homo sapiens
auagacacaguauug

SEQ ID NO: 471286 - RNA, 18 nt, Homo sapiens
auaggaggacagaaccaa

SEQ ID NO: 471287 - RNA, 12 nt, Homo sapiens
auaggagucuuc

SEQ ID NO: 471288 - RNA, 14 nt, Homo sapiens
auaguaaaugcuuu

SEQ ID NO: 471289 - RNA, 19 nt, Homo sapiens
auauacagaccuccagauu

SEQ ID NO: 471290 - RNA, 19 nt, Homo sapiens
auaugaggggacugcaugc

SEQ ID NO: 471291 - RNA, 14 nt, Homo sapiens
auaugggaggaaca

SEQ ID NO: 471292 - RNA, 20 nt, Homo sapiens
auauugagaucagcauucaa

SEQ ID NO: 471293 - RNA, 12 nt, Homo sapiens
auauuucacuua

SEQ ID NO: 471294 - RNA, 12 nt, Homo sapiens
aucaaagcacau

SEQ ID NO: 471295 - RNA, 22 nt, Homo sapiens
aucacugcaccucuuugucaca

SEQ ID NO: 471296 - RNA, 16 nt, Homo sapiens
aucagcucuaaagcag

SEQ ID NO: 471297 - RNA, 14 nt, Homo sapiens
aucaguagugcuau

SEQ ID NO: 471298 - RNA, 22 nt, Homo sapiens
aucauugagaaauaaagcacau

SEQ ID NO: 471299 - RNA, 23 nt, Homo sapiens
auccugauuauugaauguuauau

SEQ ID NO: 471300 - RNA, 16 nt, Homo sapiens
auccugcuagcuguag

SEQ ID NO: 471301 - RNA, 16 nt, Homo sapiens
auccuuuauagcuuug

SEQ ID NO: 471302 - RNA, 16 nt, Homo sapiens
aucgcuggaaaacagc

SEQ ID NO: 471303 - RNA, 20 nt, Homo sapiens
aucuaaggaccccaguuugg

SEQ ID NO: 471304 - RNA, 13 nt, Homo sapiens
aucucacaaauaa

SEQ ID NO: 471305 - RNA, 18 nt, Homo sapiens
aucucuccccauauauaa

SEQ ID NO: 471306 - RNA, 14 nt, Homo sapiens
aucucugcaggaug

SEQ ID NO: 471307 - RNA, 15 nt, Homo sapiens
aucugaggaguccaa

SEQ ID NO: 471308 - RNA, 15 nt, Homo sapiens
aucuggagucuuccu

SEQ ID NO: 471309 - RNA, 13 nt, Homo sapiens
aucuggugcgugu

SEQ ID NO: 471310 - RNA, 22 nt, Homo sapiens
aucuguaaauuuaacugcauau

SEQ ID NO: 471311 - RNA, 14 nt, Homo sapiens
aucuguauaucagc

SEQ ID NO: 471312 - RNA, 16 nt, Homo sapiens
aucuguauaucagcuc

SEQ ID NO: 471313 - RNA, 19 nt, Homo sapiens
aucuucuaucaaagcacau

SEQ ID NO: 471314 - RNA, 20 nt, Homo sapiens
aucuucuaucaaagcacaua

SEQ ID NO: 471315 - RNA, 14 nt, Homo sapiens
aucuuugugacagg

SEQ ID NO: 471316 - RNA, 14 nt, Homo sapiens
augaaaccacugga

SEQ ID NO: 471317 - RNA, 15 nt, Homo sapiens
augaaaccacuggaa

SEQ ID NO: 471318 - RNA, 14 nt, Homo sapiens
augaacccauccaa

SEQ ID NO: 471319 - RNA, 11 nt, Homo sapiens
agauugccacu

SEQ ID NO: 471320 - RNA, 20 nt, Homo sapiens
agcaacccuacaguauauaa

SEQ ID NO: 471321 - RNA, 13 nt, Homo sapiens
agcaacuugaggg

SEQ ID NO: 471322 - RNA, 23 nt, Homo sapiens
agcacaaggagugcccgccuuga

SEQ ID NO: 471323 - RNA, 13 nt, Homo sapiens
agcacacugaguu

SEQ ID NO: 471324 - RNA, 11 nt, Homo sapiens
agcacuuucca

SEQ ID NO: 471325 - RNA, 22 nt, Homo sapiens
agcagagcccucaugugacaug

SEQ ID NO: 471326 - RNA, 20 nt, Homo sapiens
agcaguguguacuucuucau

SEQ ID NO: 471327 - RNA, 20 nt, Homo sapiens
agcaguuagaaauacauuau

SEQ ID NO: 471328 - RNA, 13 nt, Homo sapiens
agcauaacacagc

SEQ ID NO: 471329 - RNA, 14 nt, Homo sapiens
agcauacagagugu

SEQ ID NO: 471330 - RNA, 17 nt, Homo sapiens
agcaucuauagcacaua

SEQ ID NO: 471331 - RNA, 19 nt, Homo sapiens
agcaugaagauaaauccaa

SEQ ID NO: 471332 - RNA, 13 nt, Homo sapiens
agcauuucuugau

SEQ ID NO: 471333 - RNA, 18 nt, Homo sapiens
agccagaggcucuaaugu

SEQ ID NO: 471334 - RNA, 18 nt, Homo sapiens
agccaggguuccagacag

SEQ ID NO: 471335 - RNA, 17 nt, Homo sapiens
agccccccguguucaca

SEQ ID NO: 471336 - RNA, 17 nt, Homo sapiens
agcccucuuucucucug

SEQ ID NO: 471337 - RNA, 13 nt, Homo sapiens
agccuccuaggcu

SEQ ID NO: 471338 - RNA, 18 nt, Homo sapiens
agccucuagaacagccag

SEQ ID NO: 471339 - RNA, 22 nt, Homo sapiens
agccucuagaacagccagaccc

SEQ ID NO: 471340 - RNA, 19 nt, Homo sapiens
agccucuccccgcucugga

SEQ ID NO: 471341 - RNA, 14 nt, Homo sapiens
agccucugugcugc

SEQ ID NO: 471342 - RNA, 21 nt, Homo sapiens
agccuggcacagggcaguggg

SEQ ID NO: 471343 - RNA, 18 nt, Homo sapiens
agccugguggcaauaagg

SEQ ID NO: 471344 - RNA, 22 nt, Homo sapiens
agccugguuuuuaaguacucac

SEQ ID NO: 471345 - RNA, 13 nt, Homo sapiens
agcuccuacaugg

SEQ ID NO: 471346 - RNA, 16 nt, Homo sapiens
agcucucaucuaguuu

SEQ ID NO: 471347 - RNA, 13 nt, Homo sapiens
agcugaaugugau

SEQ ID NO: 471348 - RNA, 23 nt, Homo sapiens
agcugaaugugauacaugccgaa

SEQ ID NO: 471349 - RNA, 19 nt, Homo sapiens
agcugcuguuagauguccu

SEQ ID NO: 471350 - RNA, 15 nt, Homo sapiens
agcuggagaucuuaa

SEQ ID NO: 471351 - RNA, 16 nt, Homo sapiens
agcuggggauguuuag

SEQ ID NO: 471352 - RNA, 19 nt, Homo sapiens
agcuuguuguuuuuugcua

SEQ ID NO: 471353 - RNA, 23 nt, Homo sapiens
agcuuuggcuuuuuccaucucaa

SEQ ID NO: 471354 - RNA, 22 nt, Homo sapiens
aggaacauccggaacagccaaa

SEQ ID NO: 471355 - RNA, 23 nt, Homo sapiens
aggaaguggaauggguaacucuu

SEQ ID NO: 471356 - RNA, 22 nt, Homo sapiens
aggaauuucuguuagcaauaug

SEQ ID NO: 471357 - RNA, 22 nt, Homo sapiens
aggacaguacacacuuggguaa

SEQ ID NO: 471358 - RNA, 17 nt, Homo sapiens
aggcagaauggugggcu

SEQ ID NO: 471359 - RNA, 19 nt, Homo sapiens
aggcaguaugccaaggguc

SEQ ID NO: 471360 - RNA, 21 nt, Homo sapiens
aggcaguugagaaaauuugaa

SEQ ID NO: 471361 - RNA, 18 nt, Homo sapiens
aggccaagggacaguggu

SEQ ID NO: 471362 - RNA, 15 nt, Homo sapiens
aggcgucucuucaaa

SEQ ID NO: 471363 - RNA, 12 nt, Homo sapiens
aggcucuaaugu

SEQ ID NO: 471364 - RNA, 16 nt, Homo sapiens
aggcucuaauguacaa

SEQ ID NO: 471365 - RNA, 17 nt, Homo sapiens
aggcucuaauguacaau

SEQ ID NO: 471366 - RNA, 18 nt, Homo sapiens
aggcucuaauguacaaua

SEQ ID NO: 471367 - RNA, 14 nt, Homo sapiens
agggagcaccagau

SEQ ID NO: 471368 - RNA, 16 nt, Homo sapiens
agggagccaugcucuu

SEQ ID NO: 471369 - RNA, 16 nt, Homo sapiens
agggcgcacuuuccac

SEQ ID NO: 471370 - RNA, 21 nt, Homo sapiens
uagcccucuuucucucugugu

SEQ ID NO: 471371 - RNA, 20 nt, Homo sapiens
uagcuguuuugaauaacaua

SEQ ID NO: 471372 - RNA, 16 nt, Homo sapiens
uagguagaugagaaaa

SEQ ID NO: 471373 - RNA, 13 nt, Homo sapiens
uagguuucaccuc

SEQ ID NO: 471374 - RNA, 14 nt, Homo sapiens
uagguuucaccucc

SEQ ID NO: 471375 - RNA, 23 nt, Homo sapiens
uaguaaauaaugauucaauguga

SEQ ID NO: 471376 - RNA, 16 nt, Homo sapiens
uagugaugcaggcagu

SEQ ID NO: 471377 - RNA, 18 nt, Homo sapiens
uaguuaaauuggcuuguu

SEQ ID NO: 471378 - RNA, 20 nt, Homo sapiens
uaguugauauguaacaguug

SEQ ID NO: 471379 - RNA, 13 nt, Homo sapiens
uauaaaaacugcc

SEQ ID NO: 471380 - RNA, 19 nt, Homo sapiens
uaucaccucuuaugcacac

SEQ ID NO: 471381 - RNA, 22 nt, Homo sapiens
uaucagcagacacuccaguuug

SEQ ID NO: 471382 - RNA, 19 nt, Homo sapiens
uauccacagaaccuuuguc

SEQ ID NO: 471383 - RNA, 20 nt, Homo sapiens
uaucccaguuuaauauucca

SEQ ID NO: 471384 - RNA, 18 nt, Homo sapiens
uaucccuuccuacaguaa

SEQ ID NO: 471385 - RNA, 15 nt, Homo sapiens
uauccuauacugguu

SEQ ID NO: 471386 - RNA, 22 nt, Homo sapiens
uauccugauaaacauuaaacac

SEQ ID NO: 471387 - RNA, 22 nt, Homo sapiens
uauccuuuuaucucacaaauaa

SEQ ID NO: 471388 - RNA, 22 nt, Homo sapiens
uaugacucaccuugcucugcca

SEQ ID NO: 471389 - RNA, 22 nt, Homo sapiens
uaugacuguuuuuguaguggua

SEQ ID NO: 471390 - RNA, 14 nt, Homo sapiens
uaugauagcuuaug

SEQ ID NO: 471391 - RNA, 18 nt, Homo sapiens
uaugccagggcgcacuuu

SEQ ID NO: 471392 - RNA, 22 nt, Homo sapiens
uaugccagggcgcacuuuccac

SEQ ID NO: 471393 - RNA, 17 nt, Homo sapiens
uaugcgcaauguggcau

SEQ ID NO: 471394 - RNA, 18 nt, Homo sapiens
uauggaaccuucccucca

SEQ ID NO: 471395 - RNA, 16 nt, Homo sapiens
uauguagaacuguuca

SEQ ID NO: 471396 - RNA, 13 nt, Homo sapiens
uaugucauacucu

SEQ ID NO: 471397 - RNA, 19 nt, Homo sapiens
uaugugaauugagcacaua

SEQ ID NO: 471398 - RNA, 16 nt, Homo sapiens
uauuaaacuugucaga

SEQ ID NO: 471399 - RNA, 12 nt, Homo sapiens
uauuacugaugu

SEQ ID NO: 471400 - RNA, 16 nt, Homo sapiens
uauuacugaugugugc

SEQ ID NO: 471401 - RNA, 14 nt, Homo sapiens
ucucauuacagauu

SEQ ID NO: 471402 - RNA, 17 nt, Homo sapiens
ucucauuagcucucauc

SEQ ID NO: 471403 - RNA, 17 nt, Homo sapiens
ucucuaaaauucuaguc

SEQ ID NO: 471404 - RNA, 14 nt, Homo sapiens
ucucucccuacccu

SEQ ID NO: 471405 - RNA, 19 nt, Homo sapiens
ucugaaaucuacaacauaa

SEQ ID NO: 471406 - RNA, 15 nt, Homo sapiens
ucugaagucacugca

SEQ ID NO: 471407 - RNA, 21 nt, Homo sapiens
ucugagccagucccucagcca

SEQ ID NO: 471408 - RNA, 22 nt, Homo sapiens
ucugagcugcuaggaaccucau

SEQ ID NO: 471409 - RNA, 23 nt, Homo sapiens
ucugcaggaugggugaaaccaca

SEQ ID NO: 471410 - RNA, 13 nt, Homo sapiens
ucugcauaagauu

SEQ ID NO: 471411 - RNA, 17 nt, Homo sapiens
ucugcuaugucugugau

SEQ ID NO: 471412 - RNA, 16 nt, Homo sapiens
ucuggcuucugcauua

SEQ ID NO: 471413 - RNA, 19 nt, Homo sapiens
ucugggaccaaaacaucaa

SEQ ID NO: 471414 - RNA, 20 nt, Homo sapiens
ucugggggguugccucgagu

SEQ ID NO: 471415 - RNA, 12 nt, Homo sapiens
ucugucaccagc

SEQ ID NO: 471416 - RNA, 20 nt, Homo sapiens
ucugugcaaaacuaccacau

SEQ ID NO: 471417 - RNA, 14 nt, Homo sapiens
ucuguuccaagugu

SEQ ID NO: 471418 - RNA, 17 nt, Homo sapiens
ucuucaaacaguuccau

SEQ ID NO: 471419 - RNA, 13 nt, Homo sapiens
ucuucaacuaauu

SEQ ID NO: 471420 - RNA, 21 nt, Homo sapiens
ucuucguagguugugaugaua

SEQ ID NO: 471421 - RNA, 22 nt, Homo sapiens
ucuucucagcuccacucugaag

SEQ ID NO: 471422 - RNA, 15 nt, Homo sapiens
ucuugccaccguccc

SEQ ID NO: 471423 - RNA, 22 nt, Homo sapiens
ucuuuaaacacucuucagagaa

SEQ ID NO: 471424 - RNA, 18 nt, Homo sapiens
ucuuuaacauacaucuaa

SEQ ID NO: 471425 - RNA, 16 nt, Homo sapiens
ucuuuaguugauuuaa

SEQ ID NO: 471426 - RNA, 14 nt, Homo sapiens
ucuuuccuguaaag

SEQ ID NO: 471427 - RNA, 15 nt, Homo sapiens
ucuuugccaagggag

SEQ ID NO: 471428 - RNA, 19 nt, Homo sapiens
ucuuuguuuacaugaguuc

SEQ ID NO: 471429 - RNA, 20 nt, Homo sapiens
ucuuuuuuuuuucgucuucc

SEQ ID NO: 471430 - RNA, 14 nt, Homo sapiens
ugaaaaaggaucau

SEQ ID NO: 471431 - RNA, 14 nt, Homo sapiens
ugaaacauuuggaa

SEQ ID NO: 471432 - RNA, 15 nt, Homo sapiens
ugaaauacucuucca

SEQ ID NO: 471433 - RNA, 13 nt, Homo sapiens
ugaaauuggaaag

SEQ ID NO: 471434 - RNA, 17 nt, Homo sapiens
ugaaauuggaaaggacu

SEQ ID NO: 471435 - RNA, 23 nt, Homo sapiens
ugaagacccucaaugccaagaaa

SEQ ID NO: 471436 - RNA, 16 nt, Homo sapiens
ugaauaggaguucucc

SEQ ID NO: 471437 - RNA, 11 nt, Homo sapiens
ugacaguauua

SEQ ID NO: 471438 - RNA, 21 nt, Homo sapiens
ugacucggucugagaagauuc

SEQ ID NO: 471439 - RNA, 17 nt, Homo sapiens
ugacuucuuuuuggcau

SEQ ID NO: 471440 - RNA, 22 nt, Homo sapiens
ugagaaaacaggcucacagaga

SEQ ID NO: 471441 - RNA, 15 nt, Homo sapiens
ugagaaacugauuua

SEQ ID NO: 471442 - RNA, 16 nt, Homo sapiens
ugagaaacugauuuau

SEQ ID NO: 471443 - RNA, 17 nt, Homo sapiens
ugagaaauaaagcacau

SEQ ID NO: 471444 - RNA, 18 nt, Homo sapiens
ugagaaauugugccaaag

SEQ ID NO: 471445 - RNA, 23 nt, Homo sapiens
ugagaagauucaauuuaaaauca

SEQ ID NO: 471446 - RNA, 21 nt, Homo sapiens
ugagacagugggggugccugg

SEQ ID NO: 471447 - RNA, 17 nt, Homo sapiens
ugagacucccgccuuug

SEQ ID NO: 471448 - RNA, 17 nt, Homo sapiens
ugagagaccucagggau

SEQ ID NO: 471449 - RNA, 19 nt, Homo sapiens
ugagccagucccucagcca

SEQ ID NO: 471450 - RNA, 21 nt, Homo sapiens
ugagcuauaauguuucccuca

SEQ ID NO: 471451 - RNA, 18 nt, Homo sapiens
ugaggagggcagcuggag

SEQ ID NO: 471452 - RNA, 20 nt, Homo sapiens
ugaggcggggagcaugaaga

SEQ ID NO: 471453 - RNA, 14 nt, Homo sapiens
ugagggcaggguuc

SEQ ID NO: 471454 - RNA, 21 nt, Homo sapiens
ugaguuuaaaaaaauaacauc

SEQ ID NO: 471455 - RNA, 20 nt, Homo sapiens
ugaucgauguuaaacgucac

SEQ ID NO: 471456 - RNA, 13 nt, Homo sapiens
ugaugaagcacau

SEQ ID NO: 471457 - RNA, 22 nt, Homo sapiens
ugaugggagagguucugugcaa

SEQ ID NO: 471458 - RNA, 13 nt, Homo sapiens
ugauucaccaaac

SEQ ID NO: 471459 - RNA, 21 nt, Homo sapiens
ugauuggacauuuucuucaga

SEQ ID NO: 471460 - RNA, 16 nt, Homo sapiens
ugcaaccucacuaugg

SEQ ID NO: 471461 - RNA, 21 nt, Homo sapiens
ugcaauguuccguucaucuga

SEQ ID NO: 471462 - RNA, 21 nt, Homo sapiens
ugcagaauacaguaagcugcu

SEQ ID NO: 471463 - RNA, 22 nt, Homo sapiens
ugcagcccagaacgggccuccc

SEQ ID NO: 471464 - RNA, 21 nt, Homo sapiens
ugcaguaaaguuccaugaaga

SEQ ID NO: 471465 - RNA, 17 nt, Homo sapiens
cuaaggagcacuagaau

SEQ ID NO: 471466 - RNA, 17 nt, Homo sapiens
cuaagucaguuucacau

SEQ ID NO: 471467 - RNA, 20 nt, Homo sapiens
cuaauggaauaugcguaguu

SEQ ID NO: 471468 - RNA, 20 nt, Homo sapiens
cuaauguacaauaaagcaau

SEQ ID NO: 471469 - RNA, 22 nt, Homo sapiens
cuaauguacaauaaagcaaugu

SEQ ID NO: 471470 - RNA, 17 nt, Homo sapiens
cuaccauuauggcuuug

SEQ ID NO: 471471 - RNA, 13 nt, Homo sapiens
cuagaacagccag

SEQ ID NO: 471472 - RNA, 12 nt, Homo sapiens
cuagaagcacag

SEQ ID NO: 471473 - RNA, 14 nt, Homo sapiens
cuagaaucacuuga

SEQ ID NO: 471474 - RNA, 19 nt, Homo sapiens
cuagagaaggacccggagg

SEQ ID NO: 471475 - RNA, 16 nt, Homo sapiens
cuagccagaggcucua

SEQ ID NO: 471476 - RNA, 14 nt, Homo sapiens
cuaggaaccucauu

SEQ ID NO: 471477 - RNA, 21 nt, Homo sapiens
cuaggaaccucauuuguccau

SEQ ID NO: 471478 - RNA, 18 nt, Homo sapiens
cuaggugcccagucuuga

SEQ ID NO: 471479 - RNA, 23 nt, Homo sapiens
cuagguuucaccucccaaaccca

SEQ ID NO: 471480 - RNA, 23 nt, Homo sapiens
cuaguagcuuuccucccaaaggc

SEQ ID NO: 471481 - RNA, 18 nt, Homo sapiens
cuauacugguuauaguug

SEQ ID NO: 471482 - RNA, 14 nt, Homo sapiens
cuaucaaagcacau

SEQ ID NO: 471483 - RNA, 15 nt, Homo sapiens
cuaucaaagcacaua

SEQ ID NO: 471484 - RNA, 16 nt, Homo sapiens
cuauggauucacuucu

SEQ ID NO: 471485 - RNA, 21 nt, Homo sapiens
cuaugggagauuaaaaccaga

SEQ ID NO: 471486 - RNA, 19 nt, Homo sapiens
cuaugugccuuucacuuua

SEQ ID NO: 471487 - RNA, 13 nt, Homo sapiens
cuauucuauugca

SEQ ID NO: 471488 - RNA, 21 nt, Homo sapiens
cuauuucaccauguugccaau

SEQ ID NO: 471489 - RNA, 12 nt, Homo sapiens
cucacucuguca

SEQ ID NO: 471490 - RNA, 16 nt, Homo sapiens
cucaggagaaggccug

SEQ ID NO: 471491 - RNA, 21 nt, Homo sapiens
cucaggaugggaagaaaaagg

SEQ ID NO: 471492 - RNA, 21 nt, Homo sapiens
cucaggcugagcucccucccc

SEQ ID NO: 471493 - RNA, 13 nt, Homo sapiens
cucagggaucuca

SEQ ID NO: 471494 - RNA, 12 nt, Homo sapiens
cucauucuugcc

SEQ ID NO: 471495 - RNA, 22 nt, Homo sapiens
cuccaaaguuuuaaaccuguua

SEQ ID NO: 471496 - RNA, 19 nt, Homo sapiens
cuccacgguagcacuugac

SEQ ID NO: 471497 - RNA, 19 nt, Homo sapiens
cuccagggcgagcacuuuc

SEQ ID NO: 471498 - RNA, 19 nt, Homo sapiens
cucccaaauaaacuccuua

SEQ ID NO: 471499 - RNA, 20 nt, Homo sapiens
cucccacccuucucagggac

SEQ ID NO: 471500 - RNA, 13 nt, Homo sapiens
cucccagacugca

SEQ ID NO: 471501 - RNA, 14 nt, Homo sapiens
cuccccauggugca

SEQ ID NO: 471502 - RNA, 18 nt, Homo sapiens
cuccccuccagaccccua

SEQ ID NO: 471503 - RNA, 14 nt, Homo sapiens
cucccuagccagag

SEQ ID NO: 471504 - RNA, 16 nt, Homo sapiens
cuccgugcguccuccc

SEQ ID NO: 471505 - RNA, 14 nt, Homo sapiens
cuccuuuccaaaua

SEQ ID NO: 471506 - RNA, 14 nt, Homo sapiens
cucggucugagaag

SEQ ID NO: 471507 - RNA, 21 nt, Homo sapiens
cucuaagaaauggcuuuccac

SEQ ID NO: 471508 - RNA, 15 nt, Homo sapiens
cucuaauguacaaua

SEQ ID NO: 471509 - RNA, 14 nt, Homo sapiens
cucuagaacagcca

SEQ ID NO: 471510 - RNA, 17 nt, Homo sapiens
cucuauuuuuuacuaca

SEQ ID NO: 471511 - RNA, 20 nt, Homo sapiens
cucucgagggaagcagugug

SEQ ID NO: 471512 - RNA, 14 nt, Homo sapiens
cucugcauagacaa

SEQ ID NO: 471513 - RNA, 21 nt, Homo sapiens
cucuggcuacgacuugggacg

SEQ ID NO: 471514 - RNA, 12 nt, Homo sapiens
cucugucagcca

SEQ ID NO: 471515 - RNA, 13 nt, Homo sapiens
cucuuaugcacac

SEQ ID NO: 471516 - RNA, 14 nt, Homo sapiens
cucuucaaggccaa

SEQ ID NO: 471517 - RNA, 23 nt, Homo sapiens
cucuuccuugcuuucucuucuaa

SEQ ID NO: 471518 - RNA, 14 nt, Homo sapiens
cucuucuccacugg

SEQ ID NO: 471519 - RNA, 15 nt, Homo sapiens
cucuucuuacuguau

SEQ ID NO: 471520 - RNA, 23 nt, Homo sapiens
cucuuuaguugauuuaaacucuu

SEQ ID NO: 471521 - RNA, 13 nt, Homo sapiens
cucuuuaugacug

SEQ ID NO: 471522 - RNA, 16 nt, Homo sapiens
cugacagccuccuagg

SEQ ID NO: 471523 - RNA, 21 nt, Homo sapiens
cugaccccacuuaugcugcug

SEQ ID NO: 471524 - RNA, 15 nt, Homo sapiens
cugagggcaggguuc

SEQ ID NO: 471525 - RNA, 11 nt, Homo sapiens
cugaggucuca

SEQ ID NO: 471526 - RNA, 21 nt, Homo sapiens
cugauaaacauuaaacacugu

SEQ ID NO: 471527 - RNA, 14 nt, Homo sapiens
cugauuugcaaaug

SEQ ID NO: 471528 - RNA, 16 nt, Homo sapiens
cugauuuugagcucaa

SEQ ID NO: 471529 - RNA, 22 nt, Homo sapiens
cugcaauacauuaaaauaacua

SEQ ID NO: 471530 - RNA, 16 nt, Homo sapiens
cugcagccccccagag

SEQ ID NO: 471531 - RNA, 15 nt, Homo sapiens
cugcaugucucaggc

SEQ ID NO: 471532 - RNA, 14 nt, Homo sapiens
cugcgaugcaaugc

SEQ ID NO: 471533 - RNA, 15 nt, Homo sapiens
cugcucccuagccag

SEQ ID NO: 471534 - RNA, 18 nt, Homo sapiens
cugcucgggaaggccuga

SEQ ID NO: 471535 - RNA, 22 nt, Homo sapiens
cugcuuagugucccuuaccugg

SEQ ID NO: 471536 - RNA, 20 nt, Homo sapiens
cugcuucacgauucuuaccc

SEQ ID NO: 471537 - RNA, 16 nt, Homo sapiens
cuggaaaacagcugcu

SEQ ID NO: 471538 - RNA, 20 nt, Homo sapiens
cuggaaggcuuuauucuucc

SEQ ID NO: 471539 - RNA, 21 nt, Homo sapiens
cuggcacaccagaagugccau

SEQ ID NO: 471540 - RNA, 20 nt, Homo sapiens
cugguaauuuaagauuccag

SEQ ID NO: 471541 - RNA, 20 nt, Homo sapiens
cugguccuucugaccccacu

SEQ ID NO: 471542 - RNA, 19 nt, Homo sapiens
cugguggcccgacagccug

SEQ ID NO: 471543 - RNA, 21 nt, Homo sapiens
cugguuuuuaaguacucacua

SEQ ID NO: 471544 - RNA, 15 nt, Homo sapiens
cuguaaaauacaugg

SEQ ID NO: 471545 - RNA, 22 nt, Homo sapiens
cuguaauagccucaccuucccu

SEQ ID NO: 471546 - RNA, 14 nt, Homo sapiens
cuguaguggcaaaa

SEQ ID NO: 471547 - RNA, 14 nt, Homo sapiens
cuguauggcacuua

SEQ ID NO: 471548 - RNA, 16 nt, Homo sapiens
cuguccugcucacguc

SEQ ID NO: 471549 - RNA, 23 nt, Homo sapiens
cuguccuugucgcugugcccugg

SEQ ID NO: 471550 - RNA, 17 nt, Homo sapiens
cugucugucaccagcua

SEQ ID NO: 471551 - RNA, 23 nt, Homo sapiens
cugugaaacuguuuaggauuuuc

SEQ ID NO: 471552 - RNA, 21 nt, Homo sapiens
cugugaauaaaaacccuguau

SEQ ID NO: 471553 - RNA, 21 nt, Homo sapiens
cugugguguucccuuggcaaa

SEQ ID NO: 471554 - RNA, 13 nt, Homo sapiens
cuguuagcaauau

SEQ ID NO: 471555 - RNA, 11 nt, Homo sapiens
cuguuccugcc

SEQ ID NO: 471556 - RNA, 20 nt, Homo sapiens
cuuaaacuuugucacuucug

SEQ ID NO: 471557 - RNA, 18 nt, Homo sapiens
cuuaaccuauucccaaau

SEQ ID NO: 471558 - RNA, 23 nt, Homo sapiens
cuuaacuuaaaagaacauaggaa

SEQ ID NO: 471559 - RNA, 22 nt, Homo sapiens
cuuagagcacuagaagcacagg

SEQ ID NO: 471560 - RNA, 17 nt, Homo sapiens
cuuagucacuuauuuca

SEQ ID NO: 471561 - RNA, 20 nt, Homo sapiens
cuuagugaaaggucaucuca

SEQ ID NO: 471562 - RNA, 18 nt, Homo sapiens
gugucucugaggacguca

SEQ ID NO: 471563 - RNA, 17 nt, Homo sapiens
guguguagaaacacagc

SEQ ID NO: 471564 - RNA, 15 nt, Homo sapiens
guuaauggucaaugc

SEQ ID NO: 471565 - RNA, 17 nt, Homo sapiens
guuacaugaaugaauga

SEQ ID NO: 471566 - RNA, 11 nt, Homo sapiens
guuccaagugu

SEQ ID NO: 471567 - RNA, 22 nt, Homo sapiens
guucccacucccucucuugccg

SEQ ID NO: 471568 - RNA, 14 nt, Homo sapiens
guucccuuggcaaa

SEQ ID NO: 471569 - RNA, 14 nt, Homo sapiens
guugcagaaaaaga

SEQ ID NO: 471570 - RNA, 22 nt, Homo sapiens
guuguaguuuauaaaagacugu

SEQ ID NO: 471571 - RNA, 14 nt, Homo sapiens
guugugugugcuuu

SEQ ID NO: 471572 - RNA, 16 nt, Homo sapiens
guuuaagguucuugcu

SEQ ID NO: 471573 - RNA, 20 nt, Homo sapiens
guuuacaaccuugugagcaa

SEQ ID NO: 471574 - RNA, 21 nt, Homo sapiens
guuuaccucacuggugcauuu

SEQ ID NO: 471575 - RNA, 18 nt, Homo sapiens
guuuaguaauacagccug

SEQ ID NO: 471576 - RNA, 13 nt, Homo sapiens
guuucacauauuu

SEQ ID NO: 471577 - RNA, 21 nt, Homo sapiens
guuuugugcggugugucucca

SEQ ID NO: 471578 - RNA, 14 nt, Homo sapiens
guuuugugugguau

SEQ ID NO: 471579 - RNA, 18 nt, Homo sapiens
guuuugugugguauucaa

SEQ ID NO: 471580 - RNA, 16 nt, Homo sapiens
guuuuuaaguacucac

SEQ ID NO: 471581 - RNA, 17 nt, Homo sapiens
guuuuuaaguacucacu

SEQ ID NO: 471582 - RNA, 22 nt, Homo sapiens
guuuuuuaaaaaaaaauugaac

SEQ ID NO: 471583 - RNA, 18 nt, Homo sapiens
guuuuuuuacaacauuca

SEQ ID NO: 471584 - RNA, 17 nt, Homo sapiens
uaaaaaauaacugugca

SEQ ID NO: 471585 - RNA, 17 nt, Homo sapiens
uaaaaauaaccaaaaaa

SEQ ID NO: 471586 - RNA, 22 nt, Homo sapiens
uaaaaccaucaaaaauauucca

SEQ ID NO: 471587 - RNA, 19 nt, Homo sapiens
uaaaagccuaugugccuuu

SEQ ID NO: 471588 - RNA, 14 nt, Homo sapiens
uaaaaggcauucau

SEQ ID NO: 471589 - RNA, 15 nt, Homo sapiens
uaaaauaacuaagca

SEQ ID NO: 471590 - RNA, 17 nt, Homo sapiens
uaaaaucagacucuuua

SEQ ID NO: 471591 - RNA, 16 nt, Homo sapiens
uaaaauucauagcauc

SEQ ID NO: 471592 - RNA, 15 nt, Homo sapiens
uaaaauucuagucuc

SEQ ID NO: 471593 - RNA, 15 nt, Homo sapiens
uaaauccaacucuga

SEQ ID NO: 471594 - RNA, 15 nt, Homo sapiens
uaaauccauuuucua

SEQ ID NO: 471595 - RNA, 21 nt, Homo sapiens
uaaaucugucugauucuaugc

SEQ ID NO: 471596 - RNA, 16 nt, Homo sapiens
uaaauuuaacugcaua

SEQ ID NO: 471597 - RNA, 15 nt, Homo sapiens
uaacaagccaaacau

SEQ ID NO: 471598 - RNA, 17 nt, Homo sapiens
uaacaccaucuggaguc

SEQ ID NO: 471599 - RNA, 14 nt, Homo sapiens
uaacaucaaagacu

SEQ ID NO: 471600 - RNA, 13 nt, Homo sapiens
uaaccuauuccca

SEQ ID NO: 471601 - RNA, 20 nt, Homo sapiens
uaacugguggacauggcugu

SEQ ID NO: 471602 - RNA, 17 nt, Homo sapiens
uaagcaaaaaacugcau

SEQ ID NO: 471603 - RNA, 21 nt, Homo sapiens
uaagcccugagacucccgccu

SEQ ID NO: 471604 - RNA, 17 nt, Homo sapiens
uaagcucuuuaugacug

SEQ ID NO: 471605 - RNA, 18 nt, Homo sapiens
uaaguaaccucuacaggc

SEQ ID NO: 471606 - RNA, 11 nt, Homo sapiens
uaagugcauuu

SEQ ID NO: 471607 - RNA, 16 nt, Homo sapiens
uaauaucuuucaguua

SEQ ID NO: 471608 - RNA, 16 nt, Homo sapiens
uaaugauucaauguga

SEQ ID NO: 471609 - RNA, 20 nt, Homo sapiens
uaauguacaauaaagcaaug

SEQ ID NO: 471610 - RNA, 21 nt, Homo sapiens
uaauguacaauaaagcaaugu

SEQ ID NO: 471611 - RNA, 23 nt, Homo sapiens
uaauguacaauaaagcaaugugg

SEQ ID NO: 471612 - RNA, 21 nt, Homo sapiens
uaauugugugacuuuuucaga

SEQ ID NO: 471613 - RNA, 16 nt, Homo sapiens
uacaaauuuuuacuca

SEQ ID NO: 471614 - RNA, 16 nt, Homo sapiens
uacaauaaagcaaugu

SEQ ID NO: 471615 - RNA, 13 nt, Homo sapiens
uacaauugucauu

SEQ ID NO: 471616 - RNA, 14 nt, Homo sapiens
uacagacagaauau

SEQ ID NO: 471617 - RNA, 17 nt, Homo sapiens
uacaugccgaaugccac

SEQ ID NO: 471618 - RNA, 18 nt, Homo sapiens
uacaugccgaaugccaca

SEQ ID NO: 471619 - RNA, 17 nt, Homo sapiens
uacaugguuuaaaguca

SEQ ID NO: 471620 - RNA, 14 nt, Homo sapiens
uacauuaugcuuga

SEQ ID NO: 471621 - RNA, 22 nt, Homo sapiens
uaccagguuaccucacuuuuaa

SEQ ID NO: 471622 - RNA, 15 nt, Homo sapiens
uacccuuucccaaac

SEQ ID NO: 471623 - RNA, 17 nt, Homo sapiens
uaccgggcuggccugug

SEQ ID NO: 471624 - RNA, 16 nt, Homo sapiens
uaccuguagugagaaa

SEQ ID NO: 471625 - RNA, 11 nt, Homo sapiens
uacucuuccaa

SEQ ID NO: 471626 - RNA, 22 nt, Homo sapiens
uacugaugugugcaaccuuuua

SEQ ID NO: 471627 - RNA, 13 nt, Homo sapiens
uagaauacuguau

SEQ ID NO: 471628 - RNA, 13 nt, Homo sapiens
uagagcuucuuau

SEQ ID NO: 471629 - RNA, 20 nt, Homo sapiens
uagauaagugcucaguauug

SEQ ID NO: 471630 - RNA, 21 nt, Homo sapiens
uagauguccucagaagucagu

SEQ ID NO: 471631 - RNA, 18 nt, Homo sapiens
uagauuuuucucaucucc

SEQ ID NO: 471632 - RNA, 17 nt, Homo sapiens
uagccugaaaauccaaa

SEQ ID NO: 471633 - RNA, 22 nt, Homo sapiens
uagcuagaauauccuauacugg

SEQ ID NO: 471634 - RNA, 14 nt, Homo sapiens
uagcuauaacaacu

SEQ ID NO: 471635 - RNA, 13 nt, Homo sapiens
uaggagcuuccag

SEQ ID NO: 471636 - RNA, 13 nt, Homo sapiens
uaggugcucuucc

SEQ ID NO: 471637 - RNA, 18 nt, Homo sapiens
uagguuucaccucccaaa

SEQ ID NO: 471638 - RNA, 17 nt, Homo sapiens
uaguaaagcuugcacau

SEQ ID NO: 471639 - RNA, 17 nt, Homo sapiens
uaguccuggaugacucg

SEQ ID NO: 471640 - RNA, 19 nt, Homo sapiens
uagugagaaacugauuuau

SEQ ID NO: 471641 - RNA, 23 nt, Homo sapiens
uaguggcaaaaaagaacaguguu

SEQ ID NO: 471642 - RNA, 23 nt, Homo sapiens
uaguggccacacucugccuuccu

SEQ ID NO: 471643 - RNA, 16 nt, Homo sapiens
uagugucccuuaccug

SEQ ID NO: 471644 - RNA, 14 nt, Homo sapiens
uaguugaacaagau

SEQ ID NO: 471645 - RNA, 20 nt, Homo sapiens
uaguuuuauaaaacucaguu

SEQ ID NO: 471646 - RNA, 22 nt, Homo sapiens
uauaagcuuuuuucucaauaaa

SEQ ID NO: 471647 - RNA, 16 nt, Homo sapiens
uauaccagguuaccuc

SEQ ID NO: 471648 - RNA, 18 nt, Homo sapiens
uauaccagguuaccucac

SEQ ID NO: 471649 - RNA, 22 nt, Homo sapiens
uauaucuguaaauuuaacugca

SEQ ID NO: 471650 - RNA, 23 nt, Homo sapiens
uaucagcagacacuccaguuugc

SEQ ID NO: 471651 - RNA, 22 nt, Homo sapiens
uauccuggugucuaguuugcau

SEQ ID NO: 471652 - RNA, 19 nt, Homo sapiens
uaucgagaguuucuaugga

SEQ ID NO: 471653 - RNA, 23 nt, Homo sapiens
uaugaaagagaaaaugcuuucuc

SEQ ID NO: 471654 - RNA, 21 nt, Homo sapiens
uaugacaauuucaaaaugcau

SEQ ID NO: 471655 - RNA, 22 nt, Homo sapiens
uaugacaauuucaaaaugcaug

SEQ ID NO: 471656 - RNA, 17 nt, Homo sapiens
uaugaccuaaauccauu

SEQ ID NO: 471657 - RNA, 20 nt, Homo sapiens
uaugaggggacugcaugcaa

SEQ ID NO: 471658 - RNA, 13 nt, Homo sapiens
uaugcacaccucc

SEQ ID NO: 471659 - RNA, 16 nt, Homo sapiens
uuccaaguuuauugcc

SEQ ID NO: 471660 - RNA, 17 nt, Homo sapiens
uuccaaguuuauugccc

SEQ ID NO: 471661 - RNA, 23 nt, Homo sapiens
uuccacuuagaaauugcauuucc

SEQ ID NO: 471662 - RNA, 20 nt, Homo sapiens
uuccagacaggguggggcuu

SEQ ID NO: 471663 - RNA, 14 nt, Homo sapiens
uuccauaugcucuu

SEQ ID NO: 471664 - RNA, 12 nt, Homo sapiens
uuccaugguggu

SEQ ID NO: 471665 - RNA, 21 nt, Homo sapiens
uucccaucuuaaauuucuaaa

SEQ ID NO: 471666 - RNA, 13 nt, Homo sapiens
uuccccacucccg

SEQ ID NO: 471667 - RNA, 21 nt, Homo sapiens
uucccgcagcaccagccugag

SEQ ID NO: 471668 - RNA, 22 nt, Homo sapiens
uucccuccucgggcuucucgcc

SEQ ID NO: 471669 - RNA, 18 nt, Homo sapiens
uuccuaugcugcaauaca

SEQ ID NO: 471670 - RNA, 12 nt, Homo sapiens
uuccucacauuc

SEQ ID NO: 471671 - RNA, 23 nt, Homo sapiens
uuccucccaaaggcuuucuuucc

SEQ ID NO: 471672 - RNA, 11 nt, Homo sapiens
uuccuguaaag

SEQ ID NO: 471673 - RNA, 14 nt, Homo sapiens
uuccuuuaauccca

SEQ ID NO: 471674 - RNA, 20 nt, Homo sapiens
uucuaaaacauucuuuaaca

SEQ ID NO: 471675 - RNA, 18 nt, Homo sapiens
uucuaaggagcacuagaa

SEQ ID NO: 471676 - RNA, 17 nt, Homo sapiens
uucuaguccuggaugac

SEQ ID NO: 471677 - RNA, 14 nt, Homo sapiens
uucuagucucugau

SEQ ID NO: 471678 - RNA, 11 nt, Homo sapiens
uucuauacugu

SEQ ID NO: 471679 - RNA, 12 nt, Homo sapiens
uucuauggauuc

SEQ ID NO: 471680 - RNA, 18 nt, Homo sapiens
uucuauggauucacuucu

SEQ ID NO: 471681 - RNA, 11 nt, Homo sapiens
uucuccacugg

SEQ ID NO: 471682 - RNA, 13 nt, Homo sapiens
uucugaauucaua

SEQ ID NO: 471683 - RNA, 12 nt, Homo sapiens
uucuguggcuca

SEQ ID NO: 471684 - RNA, 23 nt, Homo sapiens
uucuuuaacauacaucuaaguca

SEQ ID NO: 471685 - RNA, 20 nt, Homo sapiens
uugaaggacuacagguauuu

SEQ ID NO: 471686 - RNA, 21 nt, Homo sapiens
uugaauaggaguucuccugga

SEQ ID NO: 471687 - RNA, 11 nt, Homo sapiens
uugauaccagu

SEQ ID NO: 471688 - RNA, 20 nt, Homo sapiens
uugcaaauuauucuagucaa

SEQ ID NO: 471689 - RNA, 21 nt, Homo sapiens
uugcaaauuauucuagucaac

SEQ ID NO: 471690 - RNA, 18 nt, Homo sapiens
uugcaaucuuauguugau

SEQ ID NO: 471691 - RNA, 20 nt, Homo sapiens
uugcaggaagagaugcucua

SEQ ID NO: 471692 - RNA, 21 nt, Homo sapiens
uugcaugugcugcagguguaa

SEQ ID NO: 471693 - RNA, 14 nt, Homo sapiens
uugcccaaccaaug

SEQ ID NO: 471694 - RNA, 19 nt, Homo sapiens
uugcccaaccaaugcacac

SEQ ID NO: 471695 - RNA, 12 nt, Homo sapiens
uugccucuaugu

SEQ ID NO: 471696 - RNA, 18 nt, Homo sapiens
uugccugaauccaccugc

SEQ ID NO: 471697 - RNA, 14 nt, Homo sapiens
uuggguuccagaca

SEQ ID NO: 471698 - RNA, 18 nt, Homo sapiens
uuguauccuccauuguau

SEQ ID NO: 471699 - RNA, 20 nt, Homo sapiens
uuguauuccucacauucaca

SEQ ID NO: 471700 - RNA, 21 nt, Homo sapiens
uuguauuuuacuuugugcaau

SEQ ID NO: 471701 - RNA, 20 nt, Homo sapiens
uugucagaauuucuuuguca

SEQ ID NO: 471702 - RNA, 14 nt, Homo sapiens
uuguccaugugcaa

SEQ ID NO: 471703 - RNA, 14 nt, Homo sapiens
uugucuggcugugg

SEQ ID NO: 471704 - RNA, 20 nt, Homo sapiens
uugugaugauagcacugguu

SEQ ID NO: 471705 - RNA, 21 nt, Homo sapiens
uuguugcaguuaauucuugcc

SEQ ID NO: 471706 - RNA, 14 nt, Homo sapiens
uuguuuaacccaaa

SEQ ID NO: 471707 - RNA, 19 nt, Homo sapiens
uuuaaaaaaaauauucugu

SEQ ID NO: 471708 - RNA, 19 nt, Homo sapiens
uuuaaaaaagcauuauccu

SEQ ID NO: 471709 - RNA, 21 nt, Homo sapiens
uuuaaaaaauaacauauucuu

SEQ ID NO: 471710 - RNA, 13 nt, Homo sapiens
uuuaaguacucac

SEQ ID NO: 471711 - RNA, 14 nt, Homo sapiens
uuuacaugaguuca

SEQ ID NO: 471712 - RNA, 17 nt, Homo sapiens
uuuacuuugugcaauau

SEQ ID NO: 471713 - RNA, 13 nt, Homo sapiens
uuuagcguguaaa

SEQ ID NO: 471714 - RNA, 12 nt, Homo sapiens
uuuaguccucac

SEQ ID NO: 471715 - RNA, 22 nt, Homo sapiens
uuuaucucacaaauaaguaaua

SEQ ID NO: 471716 - RNA, 15 nt, Homo sapiens
uuuaugaaguuaaca

SEQ ID NO: 471717 - RNA, 13 nt, Homo sapiens
uuuauuucucggg

SEQ ID NO: 471718 - RNA, 18 nt, Homo sapiens
uuucaaaaugcaugugau

SEQ ID NO: 471719 - RNA, 20 nt, Homo sapiens
uuucaccucccaaacccagc

SEQ ID NO: 471720 - RNA, 22 nt, Homo sapiens
uuucacuuaaacuuugucacuu

SEQ ID NO: 471721 - RNA, 13 nt, Homo sapiens
uuuccacuggagu

SEQ ID NO: 471722 - RNA, 18 nt, Homo sapiens
uuuccacuggaguucacu

SEQ ID NO: 471723 - RNA, 12 nt, Homo sapiens
uuuccucuccaa

SEQ ID NO: 471724 - RNA, 16 nt, Homo sapiens
uuucgcauccaccgcc

SEQ ID NO: 471725 - RNA, 20 nt, Homo sapiens
uuucuaagcuguuucuugau

SEQ ID NO: 471726 - RNA, 15 nt, Homo sapiens
uuucucauucuugcc

SEQ ID NO: 471727 - RNA, 22 nt, Homo sapiens
uuucuccuuuuuuaugaugaca

SEQ ID NO: 471728 - RNA, 18 nt, Homo sapiens
uuucucgggugcauuuga

SEQ ID NO: 471729 - RNA, 14 nt, Homo sapiens
uuucuuacauuagc

SEQ ID NO: 471730 - RNA, 19 nt, Homo sapiens
uuucuugacuauuucacca

SEQ ID NO: 471731 - RNA, 19 nt, Homo sapiens
uuugaauuauccacaugaa

SEQ ID NO: 471732 - RNA, 12 nt, Homo sapiens
uuugccacugga

SEQ ID NO: 471733 - RNA, 20 nt, Homo sapiens
uuugggauguuaccuucaca

SEQ ID NO: 471734 - RNA, 12 nt, Homo sapiens
uuuguaaccaua

SEQ ID NO: 471735 - RNA, 14 nt, Homo sapiens
uuuguaccgaaaca

SEQ ID NO: 471736 - RNA, 14 nt, Homo sapiens
uuugucaacuucag

SEQ ID NO: 471737 - RNA, 12 nt, Homo sapiens
uuugucacugaa

SEQ ID NO: 471738 - RNA, 18 nt, Homo sapiens
uuugucauucaagccugu

SEQ ID NO: 471739 - RNA, 13 nt, Homo sapiens
uuugugugauuga

SEQ ID NO: 471740 - RNA, 21 nt, Homo sapiens
uuuguucuccggguguggccu

SEQ ID NO: 471741 - RNA, 16 nt, Homo sapiens
uuuuaaugucaucucu

SEQ ID NO: 471742 - RNA, 18 nt, Homo sapiens
uuuuagcguuaaagucag

SEQ ID NO: 471743 - RNA, 19 nt, Homo sapiens
uuuucaauguacuguauug

SEQ ID NO: 471744 - RNA, 17 nt, Homo sapiens
uuuucagaguugcuuua

SEQ ID NO: 471745 - RNA, 15 nt, Homo sapiens
uuuucugaauucaua

SEQ ID NO: 471746 - RNA, 14 nt, Homo sapiens
uuuuuaacuuaucu

SEQ ID NO: 471747 - RNA, 15 nt, Homo sapiens
aauaaagcaaugugg

SEQ ID NO: 471748 - RNA, 16 nt, Homo sapiens
aauguacaauaaagca

SEQ ID NO: 471749 - RNA, 18 nt, Homo sapiens
aauguacaauaaagcaau

SEQ ID NO: 471750 - RNA, 19 nt, Homo sapiens
aauguacaauaaagcaaug

SEQ ID NO: 471751 - RNA, 20 nt, Homo sapiens
aauguacaauaaagcaaugu

SEQ ID NO: 471752 - RNA, 14 nt, Homo sapiens
acaauaaagcaaug

SEQ ID NO: 471753 - RNA, 16 nt, Homo sapiens
acaauaaagcaaugug

SEQ ID NO: 471754 - RNA, 18 nt, Homo sapiens
agaggcucuaauguacaa

SEQ ID NO: 471755 - RNA, 15 nt, Homo sapiens
agccagaggcucuaa

SEQ ID NO: 471756 - RNA, 19 nt, Homo sapiens
agccagaggcucuaaugua

SEQ ID NO: 471757 - RNA, 14 nt, Homo sapiens
agccugcucccuag

SEQ ID NO: 471758 - RNA, 16 nt, Homo sapiens
aggcucuaauguacaa

SEQ ID NO: 471759 - RNA, 18 nt, Homo sapiens
aggcucuaauguacaaua

SEQ ID NO: 471760 - RNA, 22 nt, Homo sapiens
aggcucuaauguacaauaaagc

SEQ ID NO: 471761 - RNA, 14 nt, Homo sapiens
auaaagcaaugugg

SEQ ID NO: 471762 - RNA, 17 nt, Homo sapiens
auguacaauaaagcaau

SEQ ID NO: 471763 - RNA, 21 nt, Homo sapiens
ccccagccugcucccuagcca

SEQ ID NO: 471764 - RNA, 23 nt, Homo sapiens
ccccagccugcucccuagccaga

SEQ ID NO: 471765 - RNA, 18 nt, Homo sapiens
ccuagccagaggcucuaa

SEQ ID NO: 471766 - RNA, 22 nt, Homo sapiens
ccuaguccccagccugcucccu

SEQ ID NO: 471767 - RNA, 13 nt, Homo sapiens
cuaauguacaaua

SEQ ID NO: 471768 - RNA, 19 nt, Homo sapiens
cuaauguacaauaaagcaa

SEQ ID NO: 471769 - RNA, 20 nt, Homo sapiens
cuaauguacaauaaagcaau

SEQ ID NO: 471770 - RNA, 17 nt, Homo sapiens
cuagccagaggcucuaa

SEQ ID NO: 471771 - RNA, 22 nt, Homo sapiens
cuaguccccagccugcucccua

SEQ ID NO: 471772 - RNA, 16 nt, Homo sapiens
cucuaauguacaauaa

SEQ ID NO: 471773 - RNA, 23 nt, Homo sapiens
cucuaauguacaauaaagcaaug

SEQ ID NO: 471774 - RNA, 21 nt, Homo sapiens
gccagaggcucuaauguacaa

SEQ ID NO: 471775 - RNA, 22 nt, Homo sapiens
gccagaggcucuaauguacaau

SEQ ID NO: 471776 - RNA, 23 nt, Homo sapiens
gccagaggcucuaauguacaaua

SEQ ID NO: 471777 - RNA, 16 nt, Homo sapiens
gccugcucccuagcca

SEQ ID NO: 471778 - RNA, 23 nt, Homo sapiens
gcucuaauguacaauaaagcaau

SEQ ID NO: 471779 - RNA, 17 nt, Homo sapiens
ggcucuaauguacaaua

SEQ ID NO: 471780 - RNA, 23 nt, Homo sapiens
ggguaccuaguccccagccugcu

SEQ ID NO: 471781 - RNA, 17 nt, Homo sapiens
guacaauaaagcaaugu

SEQ ID NO: 471782 - RNA, 15 nt, Homo sapiens
uaaagcaauguggua

SEQ ID NO: 471783 - RNA, 20 nt, Homo sapiens
uaguccccagccugcucccu

SEQ ID NO: 471784 - RNA, 21 nt, Homo sapiens
ugcucccuagccagaggcucu

SEQ ID NO: 471785 - RNA, 16 nt, Homo sapiens
aaagcaaugugguagu

SEQ ID NO: 471786 - RNA, 11 nt, Homo sapiens
aagcaaugugg

SEQ ID NO: 471787 - RNA, 13 nt, Homo sapiens
agcaaugugguag

SEQ ID NO: 471788 - RNA, 17 nt, Homo sapiens
aggcucuaauguacaau

SEQ ID NO: 471789 - RNA, 17 nt, Homo sapiens
auaaagcaaugugguag

SEQ ID NO: 471790 - RNA, 13 nt, Homo sapiens
caauaaagcaaug

SEQ ID NO: 471791 - RNA, 19 nt, Homo sapiens
caauaaagcaaugugguag

SEQ ID NO: 471792 - RNA, 20 nt, Homo sapiens
cagaggcucuaauguacaau

SEQ ID NO: 471793 - RNA, 22 nt, Homo sapiens
cagaggcucuaauguacaauaa

SEQ ID NO: 471794 - RNA, 23 nt, Homo sapiens
cagccugcucccuagccagaggc

SEQ ID NO: 471795 - RNA, 14 nt, Homo sapiens
ccagaggcucuaau

SEQ ID NO: 471796 - RNA, 18 nt, Homo sapiens
ccagaggcucuaauguac

SEQ ID NO: 471797 - RNA, 15 nt, Homo sapiens
ccagccugcucccua

SEQ ID NO: 471798 - RNA, 14 nt, Homo sapiens
ccccagccugcucc

SEQ ID NO: 471799 - RNA, 17 nt, Homo sapiens
cccuagccagaggcucu

SEQ ID NO: 471800 - RNA, 21 nt, Homo sapiens
cuaauguacaauaaagcaaug

SEQ ID NO: 471801 - RNA, 23 nt, Homo sapiens
cuaguccccagccugcucccuag

SEQ ID NO: 471802 - RNA, 12 nt, Homo sapiens
cucccuagccag

SEQ ID NO: 471803 - RNA, 17 nt, Homo sapiens
cucccuagccagaggcu

SEQ ID NO: 471804 - RNA, 22 nt, Homo sapiens
cucccuagccagaggcucuaau

SEQ ID NO: 471805 - RNA, 15 nt, Homo sapiens
cucuaauguacaaua

SEQ ID NO: 471806 - RNA, 15 nt, Homo sapiens
cugcucccuagccag

SEQ ID NO: 471807 - RNA, 23 nt, Homo sapiens
gccugcucccuagccagaggcuc

SEQ ID NO: 471808 - RNA, 14 nt, Homo sapiens
gcucuaauguacaa

SEQ ID NO: 471809 - RNA, 15 nt, Homo sapiens
ggcucuaauguacaa

SEQ ID NO: 471810 - RNA, 21 nt, Homo sapiens
ggcucuaauguacaauaaagc

SEQ ID NO: 471811 - RNA, 21 nt, Homo sapiens
guacaauaaagcaauguggua

SEQ ID NO: 471812 - RNA, 14 nt, Homo sapiens
guccccagccugcu

SEQ ID NO: 471813 - RNA, 14 nt, Homo sapiens
uaauguacaauaaa

SEQ ID NO: 471814 - RNA, 19 nt, Homo sapiens
uagccagaggcucuaaugu

SEQ ID NO: 471815 - RNA, 23 nt, Homo sapiens
uagccagaggcucuaauguacaa

SEQ ID NO: 471816 - RNA, 18 nt, Homo sapiens
uccccagccugcucccua

SEQ ID NO: 471817 - RNA, 13 nt, Homo sapiens
uguacaauaaagc

SEQ ID NO: 471818 - RNA, 20 nt, Homo sapiens
uguacaauaaagcaaugugg

SEQ ID NO: 471819 - RNA, 18 nt, Homo sapiens
aauaaagcaaugugguag

SEQ ID NO: 471820 - RNA, 17 nt, Homo sapiens
aauguacaauaaagcaa

SEQ ID NO: 471821 - RNA, 17 nt, Homo sapiens
acaauaaagcaaugugg

SEQ ID NO: 471822 - RNA, 19 nt, Homo sapiens
agaggcucuaauguacaau

SEQ ID NO: 471823 - RNA, 20 nt, Homo sapiens
agaggcucuaauguacaaua

SEQ ID NO: 471824 - RNA, 16 nt, Homo sapiens
agccagaggcucuaau

SEQ ID NO: 471825 - RNA, 18 nt, Homo sapiens
agccagaggcucuaaugu

SEQ ID NO: 471826 - RNA, 23 nt, Homo sapiens
agccagaggcucuaauguacaau

SEQ ID NO: 471827 - RNA, 17 nt, Homo sapiens
agccugcucccuagcca

SEQ ID NO: 471828 - RNA, 18 nt, Homo sapiens
agccugcucccuagccag

SEQ ID NO: 471829 - RNA, 20 nt, Homo sapiens
aguccccagccugcucccua

SEQ ID NO: 471830 - RNA, 23 nt, Homo sapiens
auguacaauaaagcaauguggua

SEQ ID NO: 471831 - RNA, 17 nt, Homo sapiens
caauaaagcaauguggu

SEQ ID NO: 471832 - RNA, 18 nt, Homo sapiens
caauaaagcaauguggua

SEQ ID NO: 471833 - RNA, 14 nt, Homo sapiens
cagaggcucuaaug

SEQ ID NO: 471834 - RNA, 17 nt, Homo sapiens
cagaggcucuaauguac

SEQ ID NO: 471835 - RNA, 19 nt, Homo sapiens
cagaggcucuaauguacaa

SEQ ID NO: 471836 - RNA, 14 nt, Homo sapiens
cagccugcucccua

SEQ ID NO: 471837 - RNA, 21 nt, Homo sapiens
ccagaggcucuaauguacaau

SEQ ID NO: 471838 - RNA, 22 nt, Homo sapiens
ccagaggcucuaauguacaaua

SEQ ID NO: 471839 - RNA, 20 nt, Homo sapiens
ccagccugcucccuagccag

SEQ ID NO: 471840 - RNA, 22 nt, Homo sapiens
cccagccugcucccuagccaga

SEQ ID NO: 471841 - RNA, 22 nt, Homo sapiens
ccccagccugcucccuagccag

SEQ ID NO: 471842 - RNA, 15 nt, Homo sapiens
cuaauguacaauaaa

SEQ ID NO: 471843 - RNA, 16 nt, Homo sapiens
cuagccagaggcucua

SEQ ID NO: 471844 - RNA, 19 nt, Homo sapiens
cuagccagaggcucuaaug

SEQ ID NO: 471845 - RNA, 14 nt, Homo sapiens
cucccuagccagag

SEQ ID NO: 471846 - RNA, 19 nt, Homo sapiens
gccugcucccuagccagag

SEQ ID NO: 471847 - RNA, 13 nt, Homo sapiens
gcucccuagccag

SEQ ID NO: 471848 - RNA, 20 nt, Homo sapiens
gcucccuagccagaggcucu

SEQ ID NO: 471849 - RNA, 19 nt, Homo sapiens
ggcucuaauguacaauaaa

SEQ ID NO: 471850 - RNA, 16 nt, Homo sapiens
guacaauaaagcaaug

SEQ ID NO: 471851 - RNA, 19 nt, Homo sapiens
guacaauaaagcaaugugg

SEQ ID NO: 471852 - RNA, 22 nt, Homo sapiens
guccccagccugcucccuagcc

SEQ ID NO: 471853 - RNA, 17 nt, Homo sapiens
uaaagcaaugugguagu

SEQ ID NO: 471854 - RNA, 20 nt, Homo sapiens
uaauguacaauaaagcaaug

SEQ ID NO: 471855 - RNA, 15 nt, Homo sapiens
uacaauaaagcaaug

SEQ ID NO: 471856 - RNA, 16 nt, Homo sapiens
uacaauaaagcaaugu

SEQ ID NO: 471857 - RNA, 18 nt, Homo sapiens
uacaauaaagcaaugugg

SEQ ID NO: 471858 - RNA, 21 nt, Homo sapiens
uacaauaaagcaaugugguag

SEQ ID NO: 471859 - RNA, 17 nt, Homo sapiens
uagccagaggcucuaau

SEQ ID NO: 471860 - RNA, 20 nt, Homo sapiens
ucccuagccagaggcucuaa

SEQ ID NO: 471861 - RNA, 13 nt, Homo sapiens
ucuaauguacaau

SEQ ID NO: 471862 - RNA, 16 nt, Homo sapiens
ugcucccuagccagag

SEQ ID NO: 471863 - RNA, 20 nt, Homo sapiens
ugcucccuagccagaggcuc

SEQ ID NO: 471864 - RNA, 12 nt, Homo sapiens
aagcaauguggu

SEQ ID NO: 471865 - RNA, 13 nt, Homo sapiens
acaauaaagcaau

SEQ ID NO: 471866 - RNA, 19 nt, Homo sapiens
accuaguccccagccugcu

SEQ ID NO: 471867 - RNA, 12 nt, Homo sapiens
agccugcucccu

SEQ ID NO: 471868 - RNA, 20 nt, Homo sapiens
agccugcucccuagccagag

SEQ ID NO: 471869 - RNA, 12 nt, Homo sapiens
aggcucuaaugu

SEQ ID NO: 471870 - RNA, 14 nt, Homo sapiens
aggcucuaauguac

SEQ ID NO: 471871 - RNA, 15 nt, Homo sapiens
aggcucuaauguaca

SEQ ID NO: 471872 - RNA, 19 nt, Homo sapiens
aggcucuaauguacaauaa

SEQ ID NO: 471873 - RNA, 15 nt, Homo sapiens
auaaagcaauguggu

SEQ ID NO: 471874 - RNA, 18 nt, Homo sapiens
auguacaauaaagcaaug

SEQ ID NO: 471875 - RNA, 20 nt, Homo sapiens
auguacaauaaagcaaugug

SEQ ID NO: 471876 - RNA, 14 nt, Homo sapiens
caauaaagcaaugu

SEQ ID NO: 471877 - RNA, 15 nt, Homo sapiens
caauaaagcaaugug

SEQ ID NO: 471878 - RNA, 18 nt, Homo sapiens
cagaggcucuaauguaca

SEQ ID NO: 471879 - RNA, 23 nt, Homo sapiens
ccagaggcucuaauguacaauaa

SEQ ID NO: 471880 - RNA, 16 nt, Homo sapiens
ccuagccagaggcucu

SEQ ID NO: 471881 - RNA, 16 nt, Homo sapiens
ccugcucccuagccag

SEQ ID NO: 471882 - RNA, 17 nt, Homo sapiens
ccugcucccuagccaga

SEQ ID NO: 471883 - RNA, 22 nt, Homo sapiens
ccugcucccuagccagaggcuc

SEQ ID NO: 471884 - RNA, 22 nt, Homo sapiens
cuaauguacaauaaagcaaugu

SEQ ID NO: 471885 - RNA, 22 nt, Homo sapiens
cucuaauguacaauaaagcaau

SEQ ID NO: 471886 - RNA, 14 nt, Homo sapiens
cugcucccuagcca

SEQ ID NO: 471887 - RNA, 21 nt, Homo sapiens
gaggcucuaauguacaauaaa

SEQ ID NO: 471888 - RNA, 15 nt, Homo sapiens
gccagaggcucuaau

SEQ ID NO: 471889 - RNA, 18 nt, Homo sapiens
gccagaggcucuaaugua

SEQ ID NO: 471890 - RNA, 20 nt, Homo sapiens
gccagaggcucuaauguaca

SEQ ID NO: 471891 - RNA, 15 nt, Homo sapiens
gcucuaauguacaau

SEQ ID NO: 471892 - RNA, 17 nt, Homo sapiens
gcucuaauguacaauaa

SEQ ID NO: 471893 - RNA, 18 nt, Homo sapiens
guacaauaaagcaaugug

SEQ ID NO: 471894 - RNA, 20 nt, Homo sapiens
guccccagccugcucccuag

SEQ ID NO: 471895 - RNA, 21 nt, Homo sapiens
uaauguacaauaaagcaaugu

SEQ ID NO: 471896 - RNA, 23 nt, Homo sapiens
uaauguacaauaaagcaaugugg

SEQ ID NO: 471897 - RNA, 13 nt, Homo sapiens
uccccagccugcu

SEQ ID NO: 471898 - RNA, 19 nt, Homo sapiens
uccccagccugcucccuag

SEQ ID NO: 471899 - RNA, 13 nt, Homo sapiens
ucccuagccagag

SEQ ID NO: 471900 - RNA, 23 nt, Homo sapiens
ucccuagccagaggcucuaaugu

SEQ ID NO: 471901 - RNA, 14 nt, Homo sapiens
ucuaauguacaaua

SEQ ID NO: 471902 - RNA, 21 nt, Homo sapiens
ucuaauguacaauaaagcaau

SEQ ID NO: 471903 - RNA, 15 nt, Homo sapiens
ugcucccuagccaga

SEQ ID NO: 471904 - RNA, 14 nt, Homo sapiens
uguacaauaaagca

SEQ ID NO: 471905 - RNA, 18 nt, Homo sapiens
uguacaauaaagcaaugu

SEQ ID NO: 471906 - RNA, 23 nt, Homo sapiens
uguacaauaaagcaaugugguag

SEQ ID NO: 471907 - RNA, 14 nt, Homo sapiens
aaaauaauuguucc

SEQ ID NO: 471908 - RNA, 13 nt, Homo sapiens
aaaauagcaaaag

SEQ ID NO: 471909 - RNA, 14 nt, Homo sapiens
aaaauagcuauaaa

SEQ ID NO: 471910 - RNA, 23 nt, Homo sapiens
aaaauuauuuaaaccgcuaaaag

SEQ ID NO: 471911 - RNA, 14 nt, Homo sapiens
aaacaaaauccuug

SEQ ID NO: 471912 - RNA, 14 nt, Homo sapiens
aaacaaguauuugu

SEQ ID NO: 471913 - RNA, 23 nt, Homo sapiens
aaagaggagagaggaagcucucu

SEQ ID NO: 471914 - RNA, 20 nt, Homo sapiens
aaagcaagcauucagaagaa

SEQ ID NO: 471915 - RNA, 18 nt, Homo sapiens
aaagguuuaugaaaaaga

SEQ ID NO: 471916 - RNA, 17 nt, Homo sapiens
aaauaaaaauagcuaua

SEQ ID NO: 471917 - RNA, 14 nt, Homo sapiens
aaaugaauguuguc

SEQ ID NO: 471918 - RNA, 16 nt, Homo sapiens
aaauuaucugauccuu

SEQ ID NO: 471919 - RNA, 12 nt, Homo sapiens
aacaaguagcua

SEQ ID NO: 471920 - RNA, 20 nt, Homo sapiens
aacauuucuauagccaaaaa

SEQ ID NO: 471921 - RNA, 23 nt, Homo sapiens
aaccucaguaauuuagaaaucau

SEQ ID NO: 471922 - RNA, 15 nt, Homo sapiens
aacuagcaaaaggau

SEQ ID NO: 471923 - RNA, 13 nt, Homo sapiens
aacuauaagcaag

SEQ ID NO: 471924 - RNA, 14 nt, Homo sapiens
aacuauaagcaaga

SEQ ID NO: 471925 - RNA, 16 nt, Homo sapiens
aacucgaauaaaggau

SEQ ID NO: 471926 - RNA, 18 nt, Homo sapiens
aacucgaauaaaggaugg

SEQ ID NO: 471927 - RNA, 20 nt, Homo sapiens
aagcaauuauugugccucag

SEQ ID NO: 471928 - RNA, 15 nt, Homo sapiens
aagccuaccaaugua

SEQ ID NO: 471929 - RNA, 12 nt, Homo sapiens
aaggaucacuug

SEQ ID NO: 471930 - RNA, 13 nt, Homo sapiens
aaggaucacuuga

SEQ ID NO: 471931 - RNA, 22 nt, Homo sapiens
aaggucacacaguauuaaguga

SEQ ID NO: 471932 - RNA, 16 nt, Homo sapiens
aaggucccuuguuucc

SEQ ID NO: 471933 - RNA, 22 nt, Homo sapiens
aaguuuucaccuaucuggaaaa

SEQ ID NO: 471934 - RNA, 15 nt, Homo sapiens
aauaagguacaagaa

SEQ ID NO: 471935 - RNA, 17 nt, Homo sapiens
ccucagggaccaaggag

SEQ ID NO: 471936 - RNA, 23 nt, Homo sapiens
ccugauggccaggccucagggac

SEQ ID NO: 471937 - RNA, 13 nt, Homo sapiens
ccugcacuacucu

SEQ ID NO: 471938 - RNA, 18 nt, Homo sapiens
ccuggguaacaaagugag

SEQ ID NO: 471939 - RNA, 23 nt, Homo sapiens
ccugugaugcuuugaaguacaau

SEQ ID NO: 471940 - RNA, 16 nt, Homo sapiens
ccuuacucaccucucu

SEQ ID NO: 471941 - RNA, 11 nt, Homo sapiens
ccuugcugcua

SEQ ID NO: 471942 - RNA, 18 nt, Homo sapiens
cggggcuaggguaggggc

SEQ ID NO: 471943 - RNA, 22 nt, Homo sapiens
cgucagggucggggcuagggua

SEQ ID NO: 471944 - RNA, 23 nt, Homo sapiens
cgucagggucggggcuaggguag

SEQ ID NO: 471945 - RNA, 16 nt, Homo sapiens
cuaaauaccucaauca

SEQ ID NO: 471946 - RNA, 17 nt, Homo sapiens
cuaauuuuuuguuguuu

SEQ ID NO: 471947 - RNA, 14 nt, Homo sapiens
cuaccaauguagac

SEQ ID NO: 471948 - RNA, 23 nt, Homo sapiens
cuaggguaggggcaaggaaacuc

SEQ ID NO: 471949 - RNA, 20 nt, Homo sapiens
cucaaggcugcagugagcca

SEQ ID NO: 471950 - RNA, 21 nt, Homo sapiens
cucaaggcugcagugagccaa

SEQ ID NO: 471951 - RNA, 19 nt, Homo sapiens
cucaaguuuuuguuuugua

SEQ ID NO: 471952 - RNA, 20 nt, Homo sapiens
cucagccucccaaguagcug

SEQ ID NO: 471953 - RNA, 13 nt, Homo sapiens
cucaggagacaau

SEQ ID NO: 471954 - RNA, 12 nt, Homo sapiens
cucagggaccaa

SEQ ID NO: 471955 - RNA, 19 nt, Homo sapiens
cucccaaagugcugggauu

SEQ ID NO: 471956 - RNA, 22 nt, Homo sapiens
cucgaauaaaggaugggaccaa

SEQ ID NO: 471957 - RNA, 17 nt, Homo sapiens
cucggccucccaaagug

SEQ ID NO: 471958 - RNA, 14 nt, Homo sapiens
cucuaaguuuagaa

SEQ ID NO: 471959 - RNA, 13 nt, Homo sapiens
cucuucuacuucu

SEQ ID NO: 471960 - RNA, 13 nt, Homo sapiens
cugaagaaaccuu

SEQ ID NO: 471961 - RNA, 22 nt, Homo sapiens
cugagacgcaaggaucacuuga

SEQ ID NO: 471962 - RNA, 10 nt, Homo sapiens
cugcauuuca

SEQ ID NO: 471963 - RNA, 22 nt, Homo sapiens
cugggauuacaggcaugagcca

SEQ ID NO: 471964 - RNA, 17 nt, Homo sapiens
cuggugaugcccaaaga

SEQ ID NO: 471965 - RNA, 13 nt, Homo sapiens
cugugcaucuggc

SEQ ID NO: 471966 - RNA, 16 nt, Homo sapiens
cuucagauuuguguua

SEQ ID NO: 471967 - RNA, 16 nt, Homo sapiens
cuugauaaaugccuca

SEQ ID NO: 471968 - RNA, 15 nt, Homo sapiens
cuugcugugaaauga

SEQ ID NO: 471969 - RNA, 15 nt, Homo sapiens
cuuguguguuuugag

SEQ ID NO: 471970 - RNA, 21 nt, Homo sapiens
gaaaagaaaccagagucaaau

SEQ ID NO: 471971 - RNA, 17 nt, Homo sapiens
gaaaauaauuguuccaa

SEQ ID NO: 471972 - RNA, 15 nt, Homo sapiens
gaaacaagguuuuca

SEQ ID NO: 471973 - RNA, 23 nt, Homo sapiens
gaaaccuucagauuuguguuaua

SEQ ID NO: 471974 - RNA, 17 nt, Homo sapiens
gaaagugguucuaugau

SEQ ID NO: 471975 - RNA, 18 nt, Homo sapiens
gaaauaagcccaacagac

SEQ ID NO: 471976 - RNA, 14 nt, Homo sapiens
gaaauacuugacaa

SEQ ID NO: 471977 - RNA, 22 nt, Homo sapiens
gaaauuuaaacuauaagcaaga

SEQ ID NO: 471978 - RNA, 21 nt, Homo sapiens
gaagaggugagaguaagccuu

SEQ ID NO: 471979 - RNA, 14 nt, Homo sapiens
gaaguaaaagcaaa

SEQ ID NO: 471980 - RNA, 11 nt, Homo sapiens
gaaguuucauc

SEQ ID NO: 471981 - RNA, 17 nt, Homo sapiens
gaaugcaaaccauagca

SEQ ID NO: 471982 - RNA, 13 nt, Homo sapiens
gaccucccaaagu

SEQ ID NO: 471983 - RNA, 19 nt, Homo sapiens
gaccucccugucucuacaa

SEQ ID NO: 471984 - RNA, 17 nt, Homo sapiens
gacuguaggauuugaag

SEQ ID NO: 471985 - RNA, 17 nt, Homo sapiens
aaaaagaagcaaccuca

SEQ ID NO: 471986 - RNA, 11 nt, Homo sapiens
aaaacugacuc

SEQ ID NO: 471987 - RNA, 23 nt, Homo sapiens
uuauucaauaacuauugcugcuu

SEQ ID NO: 471988 - RNA, 14 nt, Homo sapiens
uuauugugccucag

SEQ ID NO: 471989 - RNA, 22 nt, Homo sapiens
uuauuuaguuggaggccuuuag

SEQ ID NO: 471990 - RNA, 17 nt, Homo sapiens
uucaaacgaaauggcuc

SEQ ID NO: 471991 - RNA, 16 nt, Homo sapiens
uucaccacauucguca

SEQ ID NO: 471992 - RNA, 18 nt, Homo sapiens
uucaucuauuucugagaa

SEQ ID NO: 471993 - RNA, 23 nt, Homo sapiens
uuccucucugaguggacuggccu

SEQ ID NO: 471994 - RNA, 13 nt, Homo sapiens
uucuucugccuca

SEQ ID NO: 471995 - RNA, 19 nt, Homo sapiens
uugaaguaggacuuuccua

SEQ ID NO: 471996 - RNA, 17 nt, Homo sapiens
uugagaaagccuucaua

SEQ ID NO: 471997 - RNA, 15 nt, Homo sapiens
uugauguaacugugu

SEQ ID NO: 471998 - RNA, 13 nt, Homo sapiens
uugcugcauuuca

SEQ ID NO: 471999 - RNA, 18 nt, Homo sapiens
uugguuaccuauugcugu

SEQ ID NO: 472000 - RNA, 15 nt, Homo sapiens
uuguucugucuuuag

SEQ ID NO: 472001 - RNA, 14 nt, Homo sapiens
uuuaaaauagcaaa

SEQ ID NO: 472002 - RNA, 15 nt, Homo sapiens
uuuaaaccgcuaaaa

SEQ ID NO: 472003 - RNA, 12 nt, Homo sapiens
uuuaaauucucu

SEQ ID NO: 472004 - RNA, 14 nt, Homo sapiens
uuuaauagcaaaga

SEQ ID NO: 472005 - RNA, 13 nt, Homo sapiens
uuuaggaagcaag

SEQ ID NO: 472006 - RNA, 15 nt, Homo sapiens
uuucuauagccaaaa

SEQ ID NO: 472007 - RNA, 16 nt, Homo sapiens
uuugaaaaagcgaaaa

SEQ ID NO: 472008 - RNA, 16 nt, Homo sapiens
aaaagaagcaaccuca

SEQ ID NO: 472009 - RNA, 13 nt, Homo sapiens
aaacaaauuccuu

SEQ ID NO: 472010 - RNA, 11 nt, Homo sapiens
aaacauucucu

SEQ ID NO: 472011 - RNA, 14 nt, Homo sapiens
aaaccagagucaaa

SEQ ID NO: 472012 - RNA, 22 nt, Homo sapiens
aaaccucccccaagcagagcuu

SEQ ID NO: 472013 - RNA, 17 nt, Homo sapiens
aaacuccugacuuugug

SEQ ID NO: 472014 - RNA, 15 nt, Homo sapiens
aaacucgaauaaagg

SEQ ID NO: 472015 - RNA, 14 nt, Homo sapiens
aaagaaguaaaagc

SEQ ID NO: 472016 - RNA, 19 nt, Homo sapiens
aaagcccuuuuauaccucc

SEQ ID NO: 472017 - RNA, 21 nt, Homo sapiens
aaagcuguguguuuggaagac

SEQ ID NO: 472018 - RNA, 15 nt, Homo sapiens
aaaggaugggaccaa

SEQ ID NO: 472019 - RNA, 11 nt, Homo sapiens
aaaugccucau

SEQ ID NO: 472020 - RNA, 14 nt, Homo sapiens
aaauuaucuuuaaa

SEQ ID NO: 472021 - RNA, 14 nt, Homo sapiens
aacaauucucucuu

SEQ ID NO: 472022 - RNA, 12 nt, Homo sapiens
aacagaguaaau

SEQ ID NO: 472023 - RNA, 16 nt, Homo sapiens
aacagccugacaacau

SEQ ID NO: 472024 - RNA, 16 nt, Homo sapiens
aacauagacagaagaa

SEQ ID NO: 472025 - RNA, 16 nt, Homo sapiens
aacaucauucuugaga

SEQ ID NO: 472026 - RNA, 14 nt, Homo sapiens
aaccauagcacagg

SEQ ID NO: 472027 - RNA, 14 nt, Homo sapiens
aagaagaaucucau

SEQ ID NO: 472028 - RNA, 20 nt, Homo sapiens
aagcgauucuucugccucag

SEQ ID NO: 472029 - RNA, 16 nt, Homo sapiens
aaggaaacucgaauaa

SEQ ID NO: 472030 - RNA, 13 nt, Homo sapiens
aauaaaaacugac

SEQ ID NO: 472031 - RNA, 14 nt, Homo sapiens
aauaaaaacugacu

SEQ ID NO: 472032 - RNA, 15 nt, Homo sapiens
aaugaaauacuugac

SEQ ID NO: 472033 - RNA, 12 nt, Homo sapiens
aaugucauucac

SEQ ID NO: 472034 - RNA, 23 nt, Homo sapiens
aauguccuucuuuaucugugaua

SEQ ID NO: 472035 - RNA, 19 nt, Homo sapiens
aauuaaacaaauuccuucc

SEQ ID NO: 472036 - RNA, 17 nt, Homo sapiens
aauucucucucuugcag

SEQ ID NO: 472037 - RNA, 21 nt, Homo sapiens
acaaaaaauuugagaaagccu

SEQ ID NO: 472038 - RNA, 12 nt, Homo sapiens
acacgcuuucac

SEQ ID NO: 472039 - RNA, 21 nt, Homo sapiens
acagccuauaaccagacacau

SEQ ID NO: 472040 - RNA, 17 nt, Homo sapiens
accuaugucccuucuca

SEQ ID NO: 472041 - RNA, 12 nt, Homo sapiens
accuauugcugu

SEQ ID NO: 472042 - RNA, 13 nt, Homo sapiens
accucccaaagug

SEQ ID NO: 472043 - RNA, 19 nt, Homo sapiens
accuggguaacaaagugag

SEQ ID NO: 472044 - RNA, 21 nt, Homo sapiens
accuucagauuuguguuauaa

SEQ ID NO: 472045 - RNA, 14 nt, Homo sapiens
caagucuaguggaa

SEQ ID NO: 472046 - RNA, 17 nt, Homo sapiens
caaucaucuauugagug

SEQ ID NO: 472047 - RNA, 16 nt, Homo sapiens
caauucuccugccuca

SEQ ID NO: 472048 - RNA, 17 nt, Homo sapiens
caauucuccugccucag

SEQ ID NO: 472049 - RNA, 16 nt, Homo sapiens
cacagaaacauuuuca

SEQ ID NO: 472050 - RNA, 15 nt, Homo sapiens
caccuaucuggaaaa

SEQ ID NO: 472051 - RNA, 20 nt, Homo sapiens
cacgacuguuguacaagcuc

SEQ ID NO: 472052 - RNA, 18 nt, Homo sapiens
cagacuguaggauuugaa

SEQ ID NO: 472053 - RNA, 14 nt, Homo sapiens
cagagcuuccucag

SEQ ID NO: 472054 - RNA, 20 nt, Homo sapiens
cagaggcacagagagaguca

SEQ ID NO: 472055 - RNA, 20 nt, Homo sapiens
cagaguaaauagcauucucu

SEQ ID NO: 472056 - RNA, 16 nt, Homo sapiens
cagagucaaauuugaa

SEQ ID NO: 472057 - RNA, 19 nt, Homo sapiens
cagcuagaaauaagcccaa

SEQ ID NO: 472058 - RNA, 16 nt, Homo sapiens
caggaaggacuaugaa

SEQ ID NO: 472059 - RNA, 15 nt, Homo sapiens
caggaaggacugugc

SEQ ID NO: 472060 - RNA, 13 nt, Homo sapiens
cagggaccaagga

SEQ ID NO: 472061 - RNA, 21 nt, Homo sapiens
caggguuucaccauauuggcc

SEQ ID NO: 472062 - RNA, 19 nt, Homo sapiens
cagguguaagccaccgugc

SEQ ID NO: 472063 - RNA, 17 nt, Homo sapiens
cagugcuauuuugugcc

SEQ ID NO: 472064 - RNA, 15 nt, Homo sapiens
caucucuguaaaaag

SEQ ID NO: 472065 - RNA, 21 nt, Homo sapiens
cauguuugucugugugcugua

SEQ ID NO: 472066 - RNA, 15 nt, Homo sapiens
cauugaauuugccuu

SEQ ID NO: 472067 - RNA, 13 nt, Homo sapiens
cauuuauguguga

SEQ ID NO: 472068 - RNA, 19 nt, Homo sapiens
cauuuuucauagauaccau

SEQ ID NO: 472069 - RNA, 19 nt, Homo sapiens
ccaacuugguuuugcuaca

SEQ ID NO: 472070 - RNA, 19 nt, Homo sapiens
ccagagcuguggacuuugu

SEQ ID NO: 472071 - RNA, 16 nt, Homo sapiens
ccaggaaggacugugc

SEQ ID NO: 472072 - RNA, 14 nt, Homo sapiens
ccaggcuagaggca

SEQ ID NO: 472073 - RNA, 11 nt, Homo sapiens
ccauucugcuu

SEQ ID NO: 472074 - RNA, 20 nt, Homo sapiens
cccagaagcucaaggcugca

SEQ ID NO: 472075 - RNA, 11 nt, Homo sapiens
cccagcucucg

SEQ ID NO: 472076 - RNA, 17 nt, Homo sapiens
ccuaaacaucauucauu

SEQ ID NO: 472077 - RNA, 16 nt, Homo sapiens
ccuauugcuguaaaua

SEQ ID NO: 472078 - RNA, 18 nt, Homo sapiens
ccucuguugccaggcuag

SEQ ID NO: 472079 - RNA, 16 nt, Homo sapiens
ccugaccuugugaucu

SEQ ID NO: 472080 - RNA, 22 nt, Homo sapiens
ccuuacagaacacgcuuucaca

SEQ ID NO: 472081 - RNA, 19 nt, Homo sapiens
ccuuguguguuuugagagu

SEQ ID NO: 472082 - RNA, 16 nt, Homo sapiens
ccuuucuucaccaaau

SEQ ID NO: 472083 - RNA, 22 nt, Homo sapiens
cgaacucaucccuguuccucaa

SEQ ID NO: 472084 - RNA, 21 nt, Homo sapiens
cgcaaggaucacuugagccca

SEQ ID NO: 472085 - RNA, 18 nt, Homo sapiens
cgccccccggccugaugg

SEQ ID NO: 472086 - RNA, 14 nt, Homo sapiens
cggccugauggcca

SEQ ID NO: 472087 - RNA, 14 nt, Homo sapiens
cguggcaacugugg

SEQ ID NO: 472088 - RNA, 21 nt, Homo sapiens
cuaagauaauuaaaugaaaua

SEQ ID NO: 472089 - RNA, 23 nt, Homo sapiens
cuacaggggaggcugagacgcaa

SEQ ID NO: 472090 - RNA, 15 nt, Homo sapiens
cuaggguaggggcaa

SEQ ID NO: 472091 - RNA, 15 nt, Homo sapiens
cuaucuuuuugcuua

SEQ ID NO: 472092 - RNA, 13 nt, Homo sapiens
cucacucugucac

SEQ ID NO: 472093 - RNA, 20 nt, Homo sapiens
cucagccucccgaguagcug

SEQ ID NO: 472094 - RNA, 17 nt, Homo sapiens
cucaucccuguuccuca

SEQ ID NO: 472095 - RNA, 11 nt, Homo sapiens
cucaugccacu

SEQ ID NO: 472096 - RNA, 21 nt, Homo sapiens
cucgaauaaaggaugggacca

SEQ ID NO: 472097 - RNA, 15 nt, Homo sapiens
cucuuuccuuccuuc

SEQ ID NO: 472098 - RNA, 15 nt, Homo sapiens
cugaccuugugaucu

SEQ ID NO: 472099 - RNA, 15 nt, Homo sapiens
cuggcauuugcugca

SEQ ID NO: 472100 - RNA, 23 nt, Homo sapiens
cugggauuacagguguaagccac

SEQ ID NO: 472101 - RNA, 22 nt, Homo sapiens
cuguaguuuuuguucaccuucu

SEQ ID NO: 472102 - RNA, 21 nt, Homo sapiens
cuuacugcaaccuuugccucc

SEQ ID NO: 472103 - RNA, 16 nt, Homo sapiens
cuucuuuaucugugau

SEQ ID NO: 472104 - RNA, 20 nt, Homo sapiens
cuuuaaagcguuugcacaga

SEQ ID NO: 472105 - RNA, 18 nt, Homo sapiens
cuuucaugaguuucccag

SEQ ID NO: 472106 - RNA, 21 nt, Homo sapiens
cuuucaugaguuucccagaga

SEQ ID NO: 472107 - RNA, 16 nt, Homo sapiens
cuuucuucaccaaauc

SEQ ID NO: 472108 - RNA, 15 nt, Homo sapiens
gaaaagaaaccagag

SEQ ID NO: 472109 - RNA, 16 nt, Homo sapiens
gaaaauugaaugcaaa

SEQ ID NO: 472110 - RNA, 22 nt, Homo sapiens
gaaaccagagucaaauuugaaa

SEQ ID NO: 472111 - RNA, 15 nt, Homo sapiens
gaaauacuugacaac

SEQ ID NO: 472112 - RNA, 13 nt, Homo sapiens
gaaauauucacaa

SEQ ID NO: 472113 - RNA, 16 nt, Homo sapiens
gaacaauucucucuua

SEQ ID NO: 472114 - RNA, 14 nt, Homo sapiens
gaacacgcuuucac

SEQ ID NO: 472115 - RNA, 21 nt, Homo sapiens
gaacucaucccuguuccucaa

SEQ ID NO: 472116 - RNA, 12 nt, Homo sapiens
gaaggacugugc

SEQ ID NO: 472117 - RNA, 15 nt, Homo sapiens
gaagucuacuuuguc

SEQ ID NO: 472118 - RNA, 12 nt, Homo sapiens
gaauccaugcuu

SEQ ID NO: 472119 - RNA, 20 nt, Homo sapiens
gacaacauuuuucauagaua

SEQ ID NO: 472120 - RNA, 22 nt, Homo sapiens
gacauagcuggaaaauuccuau

SEQ ID NO: 472121 - RNA, 18 nt, Homo sapiens
gaccacaggugccuacca

SEQ ID NO: 472122 - RNA, 20 nt, Homo sapiens
gacuaucuuacuauuucaca

SEQ ID NO: 472123 - RNA, 14 nt, Homo sapiens
gacuaugaaaagcu

SEQ ID NO: 472124 - RNA, 18 nt, Homo sapiens
gagauaagaucuauagcc

SEQ ID NO: 472125 - RNA, 21 nt, Homo sapiens
gagccaaguucacaccacugc

SEQ ID NO: 472126 - RNA, 19 nt, Homo sapiens
gagcccagaagcucaaggc

SEQ ID NO: 472127 - RNA, 18 nt, Homo sapiens
gaggucaagauuucagga

SEQ ID NO: 472128 - RNA, 18 nt, Homo sapiens
gaguguuuaaaguucaac

SEQ ID NO: 472129 - RNA, 16 nt, Homo sapiens
gauucuucugccucag

SEQ ID NO: 472130 - RNA, 13 nt, Homo sapiens
gauuuguguuaua

SEQ ID NO: 472131 - RNA, 14 nt, Homo sapiens
gcaaggaucacuug

SEQ ID NO: 472132 - RNA, 22 nt, Homo sapiens
gcaauaacguuuaagccaaaac

SEQ ID NO: 472133 - RNA, 13 nt, Homo sapiens
gcaauugcuucuc

SEQ ID NO: 472134 - RNA, 14 nt, Homo sapiens
gcagcaacucccac

SEQ ID NO: 472135 - RNA, 16 nt, Homo sapiens
gcaguguaggcuuuac

SEQ ID NO: 472136 - RNA, 19 nt, Homo sapiens
gccaggagcuucucugaug

SEQ ID NO: 472137 - RNA, 13 nt, Homo sapiens
gccccccggccug

SEQ ID NO: 472138 - RNA, 14 nt, Homo sapiens
gccucaaagcaagc

SEQ ID NO: 472139 - RNA, 20 nt, Homo sapiens
gcuaaucauuaagguauuau

SEQ ID NO: 472140 - RNA, 15 nt, Homo sapiens
gcuagaaauaagccc

SEQ ID NO: 472141 - RNA, 17 nt, Homo sapiens
gcuaggguaggggcaag

SEQ ID NO: 472142 - RNA, 19 nt, Homo sapiens
gcuguguuugagcuuucau

SEQ ID NO: 472143 - RNA, 20 nt, Homo sapiens
gcuucucuaaaacagcacua

SEQ ID NO: 472144 - RNA, 22 nt, Homo sapiens
ggaaaaaaaaaaauaugagauu

SEQ ID NO: 472145 - RNA, 17 nt, Homo sapiens
ggaaaaaauuagacaag

SEQ ID NO: 472146 - RNA, 16 nt, Homo sapiens
ggacuaugaaaagcua

SEQ ID NO: 472147 - RNA, 20 nt, Homo sapiens
ggauuaaugguccugugaug

SEQ ID NO: 472148 - RNA, 23 nt, Homo sapiens
ggcaaggaaacucgaauaaagga

SEQ ID NO: 472149 - RNA, 15 nt, Homo sapiens
ggccucagggaccaa

SEQ ID NO: 472150 - RNA, 22 nt, Homo sapiens
ggcuaggguaggggcaaggaaa

SEQ ID NO: 472151 - RNA, 19 nt, Homo sapiens
ggggcuaggguaggggcaa

SEQ ID NO: 472152 - RNA, 18 nt, Homo sapiens
gguaauauaaaguguaau

SEQ ID NO: 472153 - RNA, 18 nt, Homo sapiens
ggugacuuuccuaugaca

SEQ ID NO: 472154 - RNA, 14 nt, Homo sapiens
guaacauagacaaa

SEQ ID NO: 472155 - RNA, 20 nt, Homo sapiens
guacguuaauuaaacaaauu

SEQ ID NO: 472156 - RNA, 20 nt, Homo sapiens
guaucucuuuugaauccaug

SEQ ID NO: 472157 - RNA, 15 nt, Homo sapiens
gucucgaacuccuga

SEQ ID NO: 472158 - RNA, 19 nt, Homo sapiens
guuagggaugacugugauu

SEQ ID NO: 472159 - RNA, 16 nt, Homo sapiens
guuauucaauaacuau

SEQ ID NO: 472160 - RNA, 22 nt, Homo sapiens
guuccucuagguaaacuagcaa

SEQ ID NO: 472161 - RNA, 18 nt, Homo sapiens
guugugaaugucauucac

SEQ ID NO: 472162 - RNA, 21 nt, Homo sapiens
aaaauguucugacagcauuuc

SEQ ID NO: 472163 - RNA, 14 nt, Homo sapiens
aaauagcaaaagaa

SEQ ID NO: 472164 - RNA, 20 nt, Homo sapiens
aaaucuguauugcuaagaua

SEQ ID NO: 472165 - RNA, 16 nt, Homo sapiens
aaaugaaauacuugac

SEQ ID NO: 472166 - RNA, 21 nt, Homo sapiens
aacaaguauuuguuaauuuag

SEQ ID NO: 472167 - RNA, 20 nt, Homo sapiens
aacagaacauagacagaaga

SEQ ID NO: 472168 - RNA, 15 nt, Homo sapiens
aacagccccaaaguc

SEQ ID NO: 472169 - RNA, 12 nt, Homo sapiens
aacauagacaga

SEQ ID NO: 472170 - RNA, 12 nt, Homo sapiens
aaccuugcugcu

SEQ ID NO: 472171 - RNA, 14 nt, Homo sapiens
aacuaucuuuuugc

SEQ ID NO: 472172 - RNA, 22 nt, Homo sapiens
aacuuaccaggcaccaaaagaa

SEQ ID NO: 472173 - RNA, 15 nt, Homo sapiens
aacuucuauuuucaa

SEQ ID NO: 472174 - RNA, 23 nt, Homo sapiens
aagaaaaccuuucuucaccaaau

SEQ ID NO: 472175 - RNA, 22 nt, Homo sapiens
aagaaaccuucagauuuguguu

SEQ ID NO: 472176 - RNA, 23 nt, Homo sapiens
aagaagcaaccucaguaauuuag

SEQ ID NO: 472177 - RNA, 15 nt, Homo sapiens
aagaauacuucucau

SEQ ID NO: 472178 - RNA, 19 nt, Homo sapiens
aagacuguggccugcccag

SEQ ID NO: 472179 - RNA, 15 nt, Homo sapiens
aagcagagcuuccuc

SEQ ID NO: 472180 - RNA, 16 nt, Homo sapiens
aagccauuauucacua

SEQ ID NO: 472181 - RNA, 17 nt, Homo sapiens
aagcgauucuucugccu

SEQ ID NO: 472182 - RNA, 15 nt, Homo sapiens
aagcguuugcacaga

SEQ ID NO: 472183 - RNA, 20 nt, Homo sapiens
aagcucaggaggcgaauaaa

SEQ ID NO: 472184 - RNA, 11 nt, Homo sapiens
aagcucucuuu

SEQ ID NO: 472185 - RNA, 14 nt, Homo sapiens
aaguuaauucucag

SEQ ID NO: 472186 - RNA, 15 nt, Homo sapiens
aauaauuguuccaaa

SEQ ID NO: 472187 - RNA, 17 nt, Homo sapiens
aauauccuaaacaucau

SEQ ID NO: 472188 - RNA, 21 nt, Homo sapiens
aaucaagacccuuuucuguau

SEQ ID NO: 472189 - RNA, 16 nt, Homo sapiens
aaucucaucucaguga

SEQ ID NO: 472190 - RNA, 17 nt, Homo sapiens
aaugauaugucuuuaaa

SEQ ID NO: 472191 - RNA, 23 nt, Homo sapiens
aauguauauugauguaacugugu

SEQ ID NO: 472192 - RNA, 22 nt, Homo sapiens
aauguccuucuuuaucugugau

SEQ ID NO: 472193 - RNA, 20 nt, Homo sapiens
aauguucugacagcauuuca

SEQ ID NO: 472194 - RNA, 19 nt, Homo sapiens
acacaguauuaagugacag

SEQ ID NO: 472195 - RNA, 15 nt, Homo sapiens
acagaaacauuuuca

SEQ ID NO: 472196 - RNA, 23 nt, Homo sapiens
acagacaccaucuuuugugagau

SEQ ID NO: 472197 - RNA, 20 nt, Homo sapiens
acagggaacaagcauucucc

SEQ ID NO: 472198 - RNA, 19 nt, Homo sapiens
acauagacaaaaaauuuga

SEQ ID NO: 472199 - RNA, 15 nt, Homo sapiens
acauagacagaagaa

SEQ ID NO: 472200 - RNA, 23 nt, Homo sapiens
accaaaucuugguugaugccaaa

SEQ ID NO: 472201 - RNA, 22 nt, Homo sapiens
accaaaugccuuucuagcaauu

SEQ ID NO: 472202 - RNA, 21 nt, Homo sapiens
accauuuugaaauauucacaa

SEQ ID NO: 472203 - RNA, 21 nt, Homo sapiens
accuaugucccuucucaugcc

SEQ ID NO: 472204 - RNA, 22 nt, Homo sapiens
accucggcucacugcagccucc

SEQ ID NO: 472205 - RNA, 19 nt, Homo sapiens
accuucagauuuguguuau

SEQ ID NO: 472206 - RNA, 16 nt, Homo sapiens
acuacaggcucaugcc

SEQ ID NO: 472207 - RNA, 17 nt, Homo sapiens
acuacaggcucaugcca

SEQ ID NO: 472208 - RNA, 18 nt, Homo sapiens
acucaucccuguuccuca

SEQ ID NO: 472209 - RNA, 20 nt, Homo sapiens
acucuacuuccucuuaccua

SEQ ID NO: 472210 - RNA, 15 nt, Homo sapiens
acucugaauuuccag

SEQ ID NO: 472211 - RNA, 16 nt, Homo sapiens
acuguuguacaagcuc

SEQ ID NO: 472212 - RNA, 17 nt, Homo sapiens
acuucaaauguuauuca

SEQ ID NO: 472213 - RNA, 16 nt, Homo sapiens
agaaaccagagucaaa

SEQ ID NO: 472214 - RNA, 15 nt, Homo sapiens
agaaagccuucauaa

SEQ ID NO: 472215 - RNA, 15 nt, Homo sapiens
agagaaaagaaacca

SEQ ID NO: 472216 - RNA, 17 nt, Homo sapiens
agauauuauucauucau

SEQ ID NO: 472217 - RNA, 18 nt, Homo sapiens
agaugggaggaucacuug

SEQ ID NO: 472218 - RNA, 19 nt, Homo sapiens
agcaauuauugugccucag

SEQ ID NO: 472219 - RNA, 23 nt, Homo sapiens
agccaaguucacaccacugccau

SEQ ID NO: 472220 - RNA, 23 nt, Homo sapiens
agcuacguauuuaauagcaaaga

SEQ ID NO: 472221 - RNA, 18 nt, Homo sapiens
agcuucucugaugugaua

SEQ ID NO: 472222 - RNA, 19 nt, Homo sapiens
agcuuucaugaguuuccca

SEQ ID NO: 472223 - RNA, 14 nt, Homo sapiens
aggaaggacugugc

SEQ ID NO: 472224 - RNA, 12 nt, Homo sapiens
aggaucacuuga

SEQ ID NO: 472225 - RNA, 11 nt, Homo sapiens
agggaccaagg

SEQ ID NO: 472226 - RNA, 13 nt, Homo sapiens
aggguaggggcaa

SEQ ID NO: 472227 - RNA, 14 nt, Homo sapiens
aggguaggggcaag

SEQ ID NO: 472228 - RNA, 23 nt, Homo sapiens
aggugacuuuccuaugacacuca

SEQ ID NO: 472229 - RNA, 17 nt, Homo sapiens
aguaaauagcauucucu

SEQ ID NO: 472230 - RNA, 16 nt, Homo sapiens
aguaggacuuuccuaa

SEQ ID NO: 472231 - RNA, 13 nt, Homo sapiens
auaaaugccucau

SEQ ID NO: 472232 - RNA, 20 nt, Homo sapiens
auaauuaaaugaaauacuug

SEQ ID NO: 472233 - RNA, 21 nt, Homo sapiens
auagauuuucugcuacuuugc

SEQ ID NO: 472234 - RNA, 15 nt, Homo sapiens
auauaaaguguaaua

SEQ ID NO: 472235 - RNA, 16 nt, Homo sapiens
aucuauuucugagaag

SEQ ID NO: 472236 - RNA, 14 nt, Homo sapiens
aucuuuugugagau

SEQ ID NO: 472237 - RNA, 16 nt, Homo sapiens
augaaauacuugacaa

SEQ ID NO: 472238 - RNA, 22 nt, Homo sapiens
augagcaauucuccugccucag

SEQ ID NO: 472239 - RNA, 19 nt, Homo sapiens
auggccaggccucagggac

SEQ ID NO: 472240 - RNA, 21 nt, Homo sapiens
augguuuucuccaagagcuac

SEQ ID NO: 472241 - RNA, 20 nt, Homo sapiens
augucauuuugguacuuugg

SEQ ID NO: 472242 - RNA, 19 nt, Homo sapiens
augucuuuaaaaugauuca

SEQ ID NO: 472243 - RNA, 15 nt, Homo sapiens
auguucugacagcau

SEQ ID NO: 472244 - RNA, 17 nt, Homo sapiens
auuaaacaaauuccuuc

SEQ ID NO: 472245 - RNA, 22 nt, Homo sapiens
auucugcuugguuccacaauca

SEQ ID NO: 472246 - RNA, 15 nt, Homo sapiens
auucuucugccucag

SEQ ID NO: 472247 - RNA, 18 nt, Homo sapiens
auuguauaauuaugaagc

SEQ ID NO: 472248 - RNA, 15 nt, Homo sapiens
auuuccuccugggca

SEQ ID NO: 472249 - RNA, 19 nt, Homo sapiens
auuuuauucccaagcucua

SEQ ID NO: 472250 - RNA, 13 nt, Homo sapiens
caaaaaauuugag

SEQ ID NO: 472251 - RNA, 15 nt, Homo sapiens
caaagcaagcauuca

SEQ ID NO: 472252 - RNA, 22 nt, Homo sapiens
caaaugccuuucuagcaauugc

SEQ ID NO: 472253 - RNA, 20 nt, Homo sapiens
caaccuggguaacaaaguga

SEQ ID NO: 472254 - RNA, 18 nt, Homo sapiens
guuuuguaccaacacaca

SEQ ID NO: 472255 - RNA, 17 nt, Homo sapiens
uaaaacuuacuauggua

SEQ ID NO: 472256 - RNA, 12 nt, Homo sapiens
uaaacauucucu

SEQ ID NO: 472257 - RNA, 22 nt, Homo sapiens
uaaagauuuuuuaauaauuuag

SEQ ID NO: 472258 - RNA, 18 nt, Homo sapiens
uaacaggucuccucuuaa

SEQ ID NO: 472259 - RNA, 15 nt, Homo sapiens
uaacuauugcugcuu

SEQ ID NO: 472260 - RNA, 21 nt, Homo sapiens
uaauauccuaaacaucauuca

SEQ ID NO: 472261 - RNA, 18 nt, Homo sapiens
uaaucaguuuuauccaca

SEQ ID NO: 472262 - RNA, 20 nt, Homo sapiens
uaauuaaaugaaauacuuga

SEQ ID NO: 472263 - RNA, 14 nt, Homo sapiens
uacuuaagugcugc

SEQ ID NO: 472264 - RNA, 16 nt, Homo sapiens
uacuucuugugcuuua

SEQ ID NO: 472265 - RNA, 17 nt, Homo sapiens
uagggaugacugugauu

SEQ ID NO: 472266 - RNA, 17 nt, Homo sapiens
uaggggcaaggaaacuc

SEQ ID NO: 472267 - RNA, 16 nt, Homo sapiens
uaguaacauagacaaa

SEQ ID NO: 472268 - RNA, 21 nt, Homo sapiens
uaguugccguggcaacugugg

SEQ ID NO: 472269 - RNA, 21 nt, Homo sapiens
uauaaccagacacauacucau

SEQ ID NO: 472270 - RNA, 11 nt, Homo sapiens
uaucugugaua

SEQ ID NO: 472271 - RNA, 23 nt, Homo sapiens
uauucauucauuuacucauucau

SEQ ID NO: 472272 - RNA, 14 nt, Homo sapiens
uauuuauaacauug

SEQ ID NO: 472273 - RNA, 21 nt, Homo sapiens
ucaacuuaccaggcaccaaaa

SEQ ID NO: 472274 - RNA, 21 nt, Homo sapiens
ucaagcgauucuucugccuca

SEQ ID NO: 472275 - RNA, 16 nt, Homo sapiens
ucaauaacuauugcug

SEQ ID NO: 472276 - RNA, 19 nt, Homo sapiens
ucaauaacuauugcugcuu

SEQ ID NO: 472277 - RNA, 18 nt, Homo sapiens
ucaauuaaaggcuuucag

SEQ ID NO: 472278 - RNA, 18 nt, Homo sapiens
ucacuuuuuauuuugcca

SEQ ID NO: 472279 - RNA, 22 nt, Homo sapiens
ucagaacucuguguugugaaug

SEQ ID NO: 472280 - RNA, 18 nt, Homo sapiens
ucagagggcguguuguuu

SEQ ID NO: 472281 - RNA, 14 nt, Homo sapiens
ucagggaccaagga

SEQ ID NO: 472282 - RNA, 21 nt, Homo sapiens
ucagugaagaauacuucucau

SEQ ID NO: 472283 - RNA, 22 nt, Homo sapiens
ucaguguagaaccuaauucaau

SEQ ID NO: 472284 - RNA, 17 nt, Homo sapiens
ucauaucuguaugccuc

SEQ ID NO: 472285 - RNA, 18 nt, Homo sapiens
ucccagaugccccagcaa

SEQ ID NO: 472286 - RNA, 20 nt, Homo sapiens
ucgaauaaaggaugggacca

SEQ ID NO: 472287 - RNA, 18 nt, Homo sapiens
ucguauccccaagccaca

SEQ ID NO: 472288 - RNA, 16 nt, Homo sapiens
ucuacuucuugugcuu

SEQ ID NO: 472289 - RNA, 13 nt, Homo sapiens
ucuucugccucag

SEQ ID NO: 472290 - RNA, 22 nt, Homo sapiens
ugaaaauaauuguuccaaauga

SEQ ID NO: 472291 - RNA, 17 nt, Homo sapiens
ugaacaauucucucuua

SEQ ID NO: 472292 - RNA, 15 nt, Homo sapiens
ugaagucaaaccuua

SEQ ID NO: 472293 - RNA, 23 nt, Homo sapiens
ugaaguuagggaugacugugauu

SEQ ID NO: 472294 - RNA, 19 nt, Homo sapiens
ugaaucccauaucuaccca

SEQ ID NO: 472295 - RNA, 20 nt, Homo sapiens
ugaccaagauacuuaagugc

SEQ ID NO: 472296 - RNA, 21 nt, Homo sapiens
ugacuuuccuaugacacucau

SEQ ID NO: 472297 - RNA, 12 nt, Homo sapiens
ugagaaagccuu

SEQ ID NO: 472298 - RNA, 20 nt, Homo sapiens
ugagaaagccuucauaagcc

SEQ ID NO: 472299 - RNA, 20 nt, Homo sapiens
ugauggccaggccucaggga

SEQ ID NO: 472300 - RNA, 18 nt, Homo sapiens
ugcaaaccauagcacagg

SEQ ID NO: 472301 - RNA, 19 nt, Homo sapiens
ugcaucaugcaugcacucu

SEQ ID NO: 472302 - RNA, 17 nt, Homo sapiens
ugcauguaauccuagca

SEQ ID NO: 472303 - RNA, 12 nt, Homo sapiens
ugccuuccucau

SEQ ID NO: 472304 - RNA, 23 nt, Homo sapiens
ugcuaugguuuucuccaagagcu

SEQ ID NO: 472305 - RNA, 22 nt, Homo sapiens
ugcuucucuaaaacagcacuau

SEQ ID NO: 472306 - RNA, 22 nt, Homo sapiens
uggaaccaacgaucauaucugu

SEQ ID NO: 472307 - RNA, 17 nt, Homo sapiens
uggaagacuaucuuacu

SEQ ID NO: 472308 - RNA, 22 nt, Homo sapiens
uggacaauaugaaucuuuucca

SEQ ID NO: 472309 - RNA, 24 nt, Homo sapiens
uggacaucauguuuucuggugaug

SEQ ID NO: 472310 - RNA, 22 nt, Homo sapiens
uggccaggccucagggaccaag

SEQ ID NO: 472311 - RNA, 22 nt, Homo sapiens
ugggcaacagagugagacccua

SEQ ID NO: 472312 - RNA, 17 nt, Homo sapiens
ugguauaucuuuuucca

SEQ ID NO: 472313 - RNA, 16 nt, Homo sapiens
ugguugaugccaaaaa

SEQ ID NO: 472314 - RNA, 21 nt, Homo sapiens
ugugaaaugacugcaucaugc

SEQ ID NO: 472315 - RNA, 18 nt, Homo sapiens
uguggcacacaacugugg

SEQ ID NO: 472316 - RNA, 17 nt, Homo sapiens
uguguuuggaagacuau

SEQ ID NO: 472317 - RNA, 18 nt, Homo sapiens
uguucagcuggacaauau

SEQ ID NO: 472318 - RNA, 19 nt, Homo sapiens
uuaaaaaauaaaaacugac

SEQ ID NO: 472319 - RNA, 16 nt, Homo sapiens
uuaaaacuuacuaugg

SEQ ID NO: 472320 - RNA, 18 nt, Homo sapiens
uuaauuaaacaaauuccu

SEQ ID NO: 472321 - RNA, 20 nt, Homo sapiens
uuaccaggcaccaaaagaag

SEQ ID NO: 472322 - RNA, 18 nt, Homo sapiens
uuacuauuucacaacagc

SEQ ID NO: 472323 - RNA, 15 nt, Homo sapiens
uuaugaaaaagaaga

SEQ ID NO: 472324 - RNA, 15 nt, Homo sapiens
uuauuccuuugcaua

SEQ ID NO: 472325 - RNA, 13 nt, Homo sapiens
uuauugugccuca

SEQ ID NO: 472326 - RNA, 18 nt, Homo sapiens
uucaaguuaauucucaga

SEQ ID NO: 472327 - RNA, 22 nt, Homo sapiens
uucaccaaaucuugguugaugc

SEQ ID NO: 472328 - RNA, 15 nt, Homo sapiens
uucacuagacugugc

SEQ ID NO: 472329 - RNA, 22 nt, Homo sapiens
uucagagggcguguuguuuuac

SEQ ID NO: 472330 - RNA, 18 nt, Homo sapiens
uucuuacagacugcaugu

SEQ ID NO: 472331 - RNA, 17 nt, Homo sapiens
uugaaaauaauuguucc

SEQ ID NO: 472332 - RNA, 19 nt, Homo sapiens
uugaauuugccuuccucau

SEQ ID NO: 472333 - RNA, 16 nt, Homo sapiens
uugauaaaugccucau

SEQ ID NO: 472334 - RNA, 15 nt, Homo sapiens
uuuaaaaaacuaaaa

SEQ ID NO: 472335 - RNA, 12 nt, Homo sapiens
uuuaauagcaaa

SEQ ID NO: 472336 - RNA, 19 nt, Homo sapiens
uuuaggaagcaagcuuaau

SEQ ID NO: 472337 - RNA, 23 nt, Homo sapiens
uuucaaguggaaaccuugcugcu

SEQ ID NO: 472338 - RNA, 14 nt, Homo sapiens
uuucuucaccaaau

SEQ ID NO: 472339 - RNA, 18 nt, Homo sapiens
uuuuuuaaaaaagcuuaa

SEQ ID NO: 472340 - RNA, 21 nt, Homo sapiens
uuuuuuaggaagcaagcuuaa

SEQ ID NO: 472341 - RNA, 20 nt, Homo sapiens
agcagagacgggguuucacc

SEQ ID NO: 472342 - RNA, 20 nt, Homo sapiens
agccaaguucacaccacugc

SEQ ID NO: 472343 - RNA, 18 nt, Homo sapiens
agccucccgaguagcugg

SEQ ID NO: 472344 - RNA, 14 nt, Homo sapiens
agcuuuugcuucau

SEQ ID NO: 472345 - RNA, 22 nt, Homo sapiens
aggaaacucgaauaaaggaugg

SEQ ID NO: 472346 - RNA, 19 nt, Homo sapiens
aggcacgcaccaccaugcc

SEQ ID NO: 472347 - RNA, 13 nt, Homo sapiens
aggccucagggac

SEQ ID NO: 472348 - RNA, 15 nt, Homo sapiens
agguaaacuagcaaa

SEQ ID NO: 472349 - RNA, 17 nt, Homo sapiens
aguaguugacagugcua

SEQ ID NO: 472350 - RNA, 19 nt, Homo sapiens
aguggaaaccuugcugcua

SEQ ID NO: 472351 - RNA, 15 nt, Homo sapiens
aguuuuuguuucaca

SEQ ID NO: 472352 - RNA, 16 nt, Homo sapiens
auaacuauugcugcuu

SEQ ID NO: 472353 - RNA, 18 nt, Homo sapiens
auagauaccauuuugaaa

SEQ ID NO: 472354 - RNA, 14 nt, Homo sapiens
aucaugcaugcacu

SEQ ID NO: 472355 - RNA, 17 nt, Homo sapiens
aucaugcaugcacucuu

SEQ ID NO: 472356 - RNA, 20 nt, Homo sapiens
auccuugauaaaugccucau

SEQ ID NO: 472357 - RNA, 21 nt, Homo sapiens
aucucuuuugaauccaugcuu

SEQ ID NO: 472358 - RNA, 18 nt, Homo sapiens
augagccaccaugcccag

SEQ ID NO: 472359 - RNA, 21 nt, Homo sapiens
auggugagagauaagaucuau

SEQ ID NO: 472360 - RNA, 18 nt, Homo sapiens
augucccuucucaugccu

SEQ ID NO: 472361 - RNA, 16 nt, Homo sapiens
auuccagucucugcau

SEQ ID NO: 472362 - RNA, 15 nt, Homo sapiens
auucuccugccucag

SEQ ID NO: 472363 - RNA, 16 nt, Homo sapiens
auugaggaugaacuca

SEQ ID NO: 472364 - RNA, 13 nt, Homo sapiens
auuuaguuucaua

SEQ ID NO: 472365 - RNA, 15 nt, Homo sapiens
auuugcugcauuuca

SEQ ID NO: 472366 - RNA, 12 nt, Homo sapiens
auuuuuuccaca

SEQ ID NO: 472367 - RNA, 14 nt, Homo sapiens
caaaaagacugugg

SEQ ID NO: 472368 - RNA, 14 nt, Homo sapiens
caaaauccuugccu

SEQ ID NO: 472369 - RNA, 15 nt, Homo sapiens
caacauguuauuugu

SEQ ID NO: 472370 - RNA, 13 nt, Homo sapiens
caaggaaacucga

SEQ ID NO: 472371 - RNA, 14 nt, Homo sapiens
caaggcugcaguga

SEQ ID NO: 472372 - RNA, 17 nt, Homo sapiens
caaggcugcagugagcc

SEQ ID NO: 472373 - RNA, 23 nt, Homo sapiens
caaguucacaccacugccauuuc

SEQ ID NO: 472374 - RNA, 20 nt, Homo sapiens
caaugcaccuaaagaaaaac

SEQ ID NO: 472375 - RNA, 21 nt, Homo sapiens
cacaagguugcuggcauuugc

SEQ ID NO: 472376 - RNA, 13 nt, Homo sapiens
cacacugagcaag

SEQ ID NO: 472377 - RNA, 21 nt, Homo sapiens
cacucuuuugagcaguaaaug

SEQ ID NO: 472378 - RNA, 19 nt, Homo sapiens
cagaauuaacuccauucca

SEQ ID NO: 472379 - RNA, 20 nt, Homo sapiens
cagagggcguguuguuuuac

SEQ ID NO: 472380 - RNA, 14 nt, Homo sapiens
cagauuuguguuau

SEQ ID NO: 472381 - RNA, 18 nt, Homo sapiens
cagccucccaaguagcug

SEQ ID NO: 472382 - RNA, 19 nt, Homo sapiens
cagccucccaaguagcugg

SEQ ID NO: 472383 - RNA, 20 nt, Homo sapiens
cagccucccaaguagcugga

SEQ ID NO: 472384 - RNA, 13 nt, Homo sapiens
caggccucaggga

SEQ ID NO: 472385 - RNA, 14 nt, Homo sapiens
caggccucagggac

SEQ ID NO: 472386 - RNA, 16 nt, Homo sapiens
cagggaccaaggagau

SEQ ID NO: 472387 - RNA, 21 nt, Homo sapiens
caggugacuuuccuaugacac

SEQ ID NO: 472388 - RNA, 15 nt, Homo sapiens
caguggugugaucuu

SEQ ID NO: 472389 - RNA, 16 nt, Homo sapiens
caucucagugaagaau

SEQ ID NO: 472390 - RNA, 13 nt, Homo sapiens
caucucuguaaaa

SEQ ID NO: 472391 - RNA, 17 nt, Homo sapiens
cauuauguaauguccuu

SEQ ID NO: 472392 - RNA, 19 nt, Homo sapiens
cauucauuuauucauucau

SEQ ID NO: 472393 - RNA, 16 nt, Homo sapiens
cauuucuauagccaaa

SEQ ID NO: 472394 - RNA, 16 nt, Homo sapiens
cauuugcugcauuuca

SEQ ID NO: 472395 - RNA, 21 nt, Homo sapiens
cauuuuguaaguugaagcaaa

SEQ ID NO: 472396 - RNA, 23 nt, Homo sapiens
ccaaaaaaaaauacaugcuaaga

SEQ ID NO: 472397 - RNA, 12 nt, Homo sapiens
ccaccaggcuag

SEQ ID NO: 472398 - RNA, 20 nt, Homo sapiens
ccacgacuguuguacaagcu

SEQ ID NO: 472399 - RNA, 22 nt, Homo sapiens
ccagaagcucaaggcugcagug

SEQ ID NO: 472400 - RNA, 14 nt, Homo sapiens
ccaggccucaggga

SEQ ID NO: 472401 - RNA, 15 nt, Homo sapiens
ccaggccucagggac

SEQ ID NO: 472402 - RNA, 22 nt, Homo sapiens
ccaucuuuugugagauguaauu

SEQ ID NO: 472403 - RNA, 13 nt, Homo sapiens
ccauuuugaaaua

SEQ ID NO: 472404 - RNA, 19 nt, Homo sapiens
cccaggcuggaguacagug

SEQ ID NO: 472405 - RNA, 12 nt, Homo sapiens
ccucagggacca

SEQ ID NO: 472406 - RNA, 15 nt, Homo sapiens
ucucucuugcaggaa

SEQ ID NO: 472407 - RNA, 16 nt, Homo sapiens
ucuguuucccaccuca

SEQ ID NO: 472408 - RNA, 21 nt, Homo sapiens
ugaaaagcuagaauugagugu

SEQ ID NO: 472409 - RNA, 22 nt, Homo sapiens
ugagagcauugggauaucuccu

SEQ ID NO: 472410 - RNA, 21 nt, Homo sapiens
ugagaugggaggaucacuuga

SEQ ID NO: 472411 - RNA, 22 nt, Homo sapiens
ugaggccaagaguuugagacca

SEQ ID NO: 472412 - RNA, 16 nt, Homo sapiens
ugauccguuccauugc

SEQ ID NO: 472413 - RNA, 18 nt, Homo sapiens
ugguaaacauucucucag

SEQ ID NO: 472414 - RNA, 21 nt, Homo sapiens
uguccuucuuuaucugugaua

SEQ ID NO: 472415 - RNA, 20 nt, Homo sapiens
ugugagcuuucugauacuua

SEQ ID NO: 472416 - RNA, 16 nt, Homo sapiens
uguguacugcaguugg

SEQ ID NO: 472417 - RNA, 15 nt, Homo sapiens
ugugugaagcaaauu

SEQ ID NO: 472418 - RNA, 14 nt, Homo sapiens
uguuucccaccuca

SEQ ID NO: 472419 - RNA, 22 nt, Homo sapiens
uuaaauucugaacaauucucuc

SEQ ID NO: 472420 - RNA, 21 nt, Homo sapiens
uuaccaggcaccaaaagaagu

SEQ ID NO: 472421 - RNA, 15 nt, Homo sapiens
uuaccuauugcugua

SEQ ID NO: 472422 - RNA, 19 nt, Homo sapiens
uuagacaagucuaguggaa

SEQ ID NO: 472423 - RNA, 16 nt, Homo sapiens
uuauauuacacuacac

SEQ ID NO: 472424 - RNA, 19 nt, Homo sapiens
uuaucugauccuuguggca

SEQ ID NO: 472425 - RNA, 18 nt, Homo sapiens
uuauuauuguucuuuaag

SEQ ID NO: 472426 - RNA, 16 nt, Homo sapiens
uucacacugaccaaga

SEQ ID NO: 472427 - RNA, 18 nt, Homo sapiens
uucagaagaaaaagaagc

SEQ ID NO: 472428 - RNA, 23 nt, Homo sapiens
uucaguggugugaucuuggcuca

SEQ ID NO: 472429 - RNA, 20 nt, Homo sapiens
uucccaagcucuagugggaa

SEQ ID NO: 472430 - RNA, 11 nt, Homo sapiens
uucgcuugcuu

SEQ ID NO: 472431 - RNA, 14 nt, Homo sapiens
uucuccugccucag

SEQ ID NO: 472432 - RNA, 16 nt, Homo sapiens
uucugacagcauuuca

SEQ ID NO: 472433 - RNA, 17 nt, Homo sapiens
uugaauauaauggccuc

SEQ ID NO: 472434 - RNA, 21 nt, Homo sapiens
uugcugugaaaugacugcauc

SEQ ID NO: 472435 - RNA, 17 nt, Homo sapiens
uuguaaguugaagcaaa

SEQ ID NO: 472436 - RNA, 19 nt, Homo sapiens
uuguggcacacaacugugg

SEQ ID NO: 472437 - RNA, 17 nt, Homo sapiens
uugugucuggcaguuua

SEQ ID NO: 472438 - RNA, 18 nt, Homo sapiens
uuguucacuagacugugc

SEQ ID NO: 472439 - RNA, 16 nt, Homo sapiens
uuuaaaaaagcuuaaa

SEQ ID NO: 472440 - RNA, 16 nt, Homo sapiens
uuuaaacuauaagcaa

SEQ ID NO: 472441 - RNA, 18 nt, Homo sapiens
uuuaaacuauaagcaaga

SEQ ID NO: 472442 - RNA, 21 nt, Homo sapiens
uuucaugauaaugaacagaac

SEQ ID NO: 472443 - RNA, 19 nt, Homo sapiens
uuucccaccucaccugaga

SEQ ID NO: 472444 - RNA, 18 nt, Homo sapiens
uuuccuaugacacucauc

SEQ ID NO: 472445 - RNA, 20 nt, Homo sapiens
uuucuggugaugcccaaaga

SEQ ID NO: 472446 - RNA, 17 nt, Homo sapiens
uuucuuucucacuaaau

SEQ ID NO: 472447 - RNA, 14 nt, Homo sapiens
uuuugagaguauau

SEQ ID NO: 472448 - RNA, 20 nt, Homo sapiens
aaaauagcuaaauaccucaa

SEQ ID NO: 472449 - RNA, 22 nt, Homo sapiens
aaaauguucugacagcauuuca

SEQ ID NO: 472450 - RNA, 21 nt, Homo sapiens
aaagucuggcuaugcucacag

SEQ ID NO: 472451 - RNA, 17 nt, Homo sapiens
aaauagcaaaagaagaa

SEQ ID NO: 472452 - RNA, 14 nt, Homo sapiens
aaauagcauucucu

SEQ ID NO: 472453 - RNA, 22 nt, Homo sapiens
aaaucuugguugaugccaaaaa

SEQ ID NO: 472454 - RNA, 14 nt, Homo sapiens
aaaugauucacuuu

SEQ ID NO: 472455 - RNA, 18 nt, Homo sapiens
aaauucucucucuugcag

SEQ ID NO: 472456 - RNA, 18 nt, Homo sapiens
aacagccccaaagucaau

SEQ ID NO: 472457 - RNA, 12 nt, Homo sapiens
aaccauucugcu

SEQ ID NO: 472458 - RNA, 23 nt, Homo sapiens
aaccauucugcuugguuccacaa

SEQ ID NO: 472459 - RNA, 11 nt, Homo sapiens
aacgucagggu

SEQ ID NO: 472460 - RNA, 13 nt, Homo sapiens
aacuauugcugcu

SEQ ID NO: 472461 - RNA, 14 nt, Homo sapiens
aacucagagccucc

SEQ ID NO: 472462 - RNA, 22 nt, Homo sapiens
aacuguggaaggcacacugagc

SEQ ID NO: 472463 - RNA, 16 nt, Homo sapiens
aaggacuaugaaaagc

SEQ ID NO: 472464 - RNA, 14 nt, Homo sapiens
aaggaugggaccaa

SEQ ID NO: 472465 - RNA, 15 nt, Homo sapiens
aaggcacacugagca

SEQ ID NO: 472466 - RNA, 17 nt, Homo sapiens
aaggucccuuguuucca

SEQ ID NO: 472467 - RNA, 20 nt, Homo sapiens
aagugcugggauuacaggca

SEQ ID NO: 472468 - RNA, 22 nt, Homo sapiens
aagugcugggauuacaggugua

SEQ ID NO: 472469 - RNA, 14 nt, Homo sapiens
aaguguaauagauu

SEQ ID NO: 472470 - RNA, 19 nt, Homo sapiens
aaguuagggaugacuguga

SEQ ID NO: 472471 - RNA, 21 nt, Homo sapiens
aaguuagggaugacugugauu

SEQ ID NO: 472472 - RNA, 15 nt, Homo sapiens
aauaagcccaacaga

SEQ ID NO: 472473 - RNA, 22 nt, Homo sapiens
aauaauuuagacuucaagcaug

SEQ ID NO: 472474 - RNA, 20 nt, Homo sapiens
aaugauccguuccauugcaa

SEQ ID NO: 472475 - RNA, 19 nt, Homo sapiens
aauguuuaagauaaacaga

SEQ ID NO: 472476 - RNA, 19 nt, Homo sapiens
aauuauugugccucagccu

SEQ ID NO: 472477 - RNA, 19 nt, Homo sapiens
aauucuccugccucagccu

SEQ ID NO: 472478 - RNA, 21 nt, Homo sapiens
aauucuccugccucagccucc

SEQ ID NO: 472479 - RNA, 21 nt, Homo sapiens
aauucucuuuaguucugucag

SEQ ID NO: 472480 - RNA, 22 nt, Homo sapiens
acaauucucucuuauaugugua

SEQ ID NO: 472481 - RNA, 12 nt, Homo sapiens
acacaacugugg

SEQ ID NO: 472482 - RNA, 23 nt, Homo sapiens
acacugagcaaguuuucaccuau

SEQ ID NO: 472483 - RNA, 21 nt, Homo sapiens
acagaguaaauagcauucucu

SEQ ID NO: 472484 - RNA, 18 nt, Homo sapiens
acauuucuauagccaaaa

SEQ ID NO: 472485 - RNA, 20 nt, Homo sapiens
acauuuuucauagauaccau

SEQ ID NO: 472486 - RNA, 17 nt, Homo sapiens
accagagucaaauuuga

SEQ ID NO: 472487 - RNA, 17 nt, Homo sapiens
accauagcacaggcuaa

SEQ ID NO: 472488 - RNA, 15 nt, Homo sapiens
accaugccaggcuaa

SEQ ID NO: 472489 - RNA, 12 nt, Homo sapiens
accuugcugcua

SEQ ID NO: 472490 - RNA, 19 nt, Homo sapiens
acgccccccggccugaugg

SEQ ID NO: 472491 - RNA, 16 nt, Homo sapiens
acuacucuacuuccuc

SEQ ID NO: 472492 - RNA, 15 nt, Homo sapiens
acucaccucucucua

SEQ ID NO: 472493 - RNA, 17 nt, Homo sapiens
acuguuguacaagcuca

SEQ ID NO: 472494 - RNA, 23 nt, Homo sapiens
acuucucauuuuuuaaaaaagcu

SEQ ID NO: 472495 - RNA, 20 nt, Homo sapiens
agaaagccuucauaagccua

SEQ ID NO: 472496 - RNA, 12 nt, Homo sapiens
agaaauaagccc

SEQ ID NO: 472497 - RNA, 15 nt, Homo sapiens
agacacgcucuucua

SEQ ID NO: 472498 - RNA, 18 nt, Homo sapiens
agacgcaaggaucacuug

SEQ ID NO: 472499 - RNA, 19 nt, Homo sapiens
agaguaaauagcauucucu

SEQ ID NO: 472500 - RNA, 22 nt, Homo sapiens
gacuuuguucacuagacugugc

SEQ ID NO: 472501 - RNA, 17 nt, Homo sapiens
gagaaaagaaaccagag

SEQ ID NO: 472502 - RNA, 22 nt, Homo sapiens
gagaaaagaaaccagagucaaa

SEQ ID NO: 472503 - RNA, 20 nt, Homo sapiens
gagcaauucuccugccucag

SEQ ID NO: 472504 - RNA, 12 nt, Homo sapiens
gagcuuccucag

SEQ ID NO: 472505 - RNA, 18 nt, Homo sapiens
gaggcugagacgcaagga

SEQ ID NO: 472506 - RNA, 22 nt, Homo sapiens
gagguauuugguaacuugcugu

SEQ ID NO: 472507 - RNA, 23 nt, Homo sapiens
gauauauacauguuuaguauuau

SEQ ID NO: 472508 - RNA, 21 nt, Homo sapiens
gauccuugauaaaugccucau

SEQ ID NO: 472509 - RNA, 12 nt, Homo sapiens
gaugggaccaac

SEQ ID NO: 472510 - RNA, 17 nt, Homo sapiens
gcaauucuccugccuca

SEQ ID NO: 472511 - RNA, 18 nt, Homo sapiens
gcacagggaacaagcauu

SEQ ID NO: 472512 - RNA, 15 nt, Homo sapiens
gcauuuacucucuua

SEQ ID NO: 472513 - RNA, 16 nt, Homo sapiens
gcauuugcugcauuuc

SEQ ID NO: 472514 - RNA, 18 nt, Homo sapiens
gccaaacagccccaaagu

SEQ ID NO: 472515 - RNA, 17 nt, Homo sapiens
gcccagucgauaucuca

SEQ ID NO: 472516 - RNA, 20 nt, Homo sapiens
gcccuggcuggaguucagug

SEQ ID NO: 472517 - RNA, 15 nt, Homo sapiens
gccucagggaccaag

SEQ ID NO: 472518 - RNA, 14 nt, Homo sapiens
gccuucauaagccu

SEQ ID NO: 472519 - RNA, 20 nt, Homo sapiens
gccuucauaagccuaccaau

SEQ ID NO: 472520 - RNA, 19 nt, Homo sapiens
gcuagagugcaguggcaug

SEQ ID NO: 472521 - RNA, 21 nt, Homo sapiens
gcugagagaguuaagugaaug

SEQ ID NO: 472522 - RNA, 19 nt, Homo sapiens
gcuggaguacagugacacg

SEQ ID NO: 472523 - RNA, 21 nt, Homo sapiens
gcuggcauuugcugcauuuca

SEQ ID NO: 472524 - RNA, 23 nt, Homo sapiens
ggaaaauguucugacagcauuuc

SEQ ID NO: 472525 - RNA, 19 nt, Homo sapiens
ggaaacucgaauaaaggau

SEQ ID NO: 472526 - RNA, 19 nt, Homo sapiens
ggaaggucccuuguuucca

SEQ ID NO: 472527 - RNA, 22 nt, Homo sapiens
ggagacaauaacuccagugaug

SEQ ID NO: 472528 - RNA, 12 nt, Homo sapiens
ggaugggaccaa

SEQ ID NO: 472529 - RNA, 17 nt, Homo sapiens
gggaacaagcauucucc

SEQ ID NO: 472530 - RNA, 17 nt, Homo sapiens
gguauaauuuuuaucca

SEQ ID NO: 472531 - RNA, 16 nt, Homo sapiens
guaauccuagcacuuu

SEQ ID NO: 472532 - RNA, 14 nt, Homo sapiens
guaaugaaacaaag

SEQ ID NO: 472533 - RNA, 15 nt, Homo sapiens
gucacacaguauuaa

SEQ ID NO: 472534 - RNA, 22 nt, Homo sapiens
gucuccucuuaaaaaauaaaaa

SEQ ID NO: 472535 - RNA, 15 nt, Homo sapiens
gucuggcuaugcuca

SEQ ID NO: 472536 - RNA, 14 nt, Homo sapiens
gugaugcccaaaga

SEQ ID NO: 472537 - RNA, 20 nt, Homo sapiens
gugcugggauuacaggugua

SEQ ID NO: 472538 - RNA, 18 nt, Homo sapiens
guguguuuggaagacuau

SEQ ID NO: 472539 - RNA, 21 nt, Homo sapiens
guucucucuuaguaacauaga

SEQ ID NO: 472540 - RNA, 15 nt, Homo sapiens
guuucaaacuccuga

SEQ ID NO: 472541 - RNA, 13 nt, Homo sapiens
uaaaauuucaaca

SEQ ID NO: 472542 - RNA, 16 nt, Homo sapiens
uaaaggaugggaccaa

SEQ ID NO: 472543 - RNA, 15 nt, Homo sapiens
uaauaccuguccaca

SEQ ID NO: 472544 - RNA, 17 nt, Homo sapiens
uaauauaaaguguaaua

SEQ ID NO: 472545 - RNA, 22 nt, Homo sapiens
uaaucaguuuuauccacagaaa

SEQ ID NO: 472546 - RNA, 14 nt, Homo sapiens
uaaugaaacaaaga

SEQ ID NO: 472547 - RNA, 23 nt, Homo sapiens
uacuucuugugcuuuacucugaa

SEQ ID NO: 472548 - RNA, 13 nt, Homo sapiens
uagcaaaagaaga

SEQ ID NO: 472549 - RNA, 16 nt, Homo sapiens
uagcugggacuacagg

SEQ ID NO: 472550 - RNA, 17 nt, Homo sapiens
uaggugucuguuuccca

SEQ ID NO: 472551 - RNA, 23 nt, Homo sapiens
uaguugccguggcaacuguggaa

SEQ ID NO: 472552 - RNA, 20 nt, Homo sapiens
uaucagacuguaggauuuga

SEQ ID NO: 472553 - RNA, 17 nt, Homo sapiens
uaucuuuuugcuuacag

SEQ ID NO: 472554 - RNA, 21 nt, Homo sapiens
uaugaaaaagaagaaucucau

SEQ ID NO: 472555 - RNA, 15 nt, Homo sapiens
uauucauucauucau

SEQ ID NO: 472556 - RNA, 13 nt, Homo sapiens
uauugugccucag

SEQ ID NO: 472557 - RNA, 15 nt, Homo sapiens
ucaaaaagacugugg

SEQ ID NO: 472558 - RNA, 15 nt, Homo sapiens
ucaaggcugcaguga

SEQ ID NO: 472559 - RNA, 14 nt, Homo sapiens
ucacuagacugugc

SEQ ID NO: 472560 - RNA, 22 nt, Homo sapiens
ucacugaagaaaccuucagauu

SEQ ID NO: 472561 - RNA, 14 nt, Homo sapiens
ucacugcuaccucu

SEQ ID NO: 472562 - RNA, 12 nt, Homo sapiens
ucagggaccaag

SEQ ID NO: 472563 - RNA, 19 nt, Homo sapiens
ucaggugcauuccaccaca

SEQ ID NO: 472564 - RNA, 15 nt, Homo sapiens
ucccacgacuguugu

SEQ ID NO: 472565 - RNA, 22 nt, Homo sapiens
uccuggggagcuucacaaacau

SEQ ID NO: 472566 - RNA, 22 nt, Homo sapiens
uccugucuuggaaggacuacua

SEQ ID NO: 472567 - RNA, 18 nt, Homo sapiens
acgacuguuguacaagcu

SEQ ID NO: 472568 - RNA, 18 nt, Homo sapiens
acgcacucaacuuccuuu

SEQ ID NO: 472569 - RNA, 23 nt, Homo sapiens
acgggguuucaccacauucguca

SEQ ID NO: 472570 - RNA, 13 nt, Homo sapiens
acguuuaagccaa

SEQ ID NO: 472571 - RNA, 17 nt, Homo sapiens
acuccuuagagacauca

SEQ ID NO: 472572 - RNA, 22 nt, Homo sapiens
acuuugguggccacauaagcca

SEQ ID NO: 472573 - RNA, 19 nt, Homo sapiens
agaaagccuucauaagccu

SEQ ID NO: 472574 - RNA, 14 nt, Homo sapiens
agaagguccuuaau

SEQ ID NO: 472575 - RNA, 21 nt, Homo sapiens
agacgcaaggaucacuugagc

SEQ ID NO: 472576 - RNA, 12 nt, Homo sapiens
agagacaucaaa

SEQ ID NO: 472577 - RNA, 16 nt, Homo sapiens
agaggcaacugcccag

SEQ ID NO: 472578 - RNA, 19 nt, Homo sapiens
agaguuaagugaaugucua

SEQ ID NO: 472579 - RNA, 23 nt, Homo sapiens
agauagauauuccuauugugcaa

SEQ ID NO: 472580 - RNA, 21 nt, Homo sapiens
agaugggaggaucacuugagg

SEQ ID NO: 472581 - RNA, 17 nt, Homo sapiens
agccucccaaguagcug

SEQ ID NO: 472582 - RNA, 18 nt, Homo sapiens
agccucccaaguagcugg

SEQ ID NO: 472583 - RNA, 19 nt, Homo sapiens
agccucccgaguagcugag

SEQ ID NO: 472584 - RNA, 17 nt, Homo sapiens
agcuuucugauacuuau

SEQ ID NO: 472585 - RNA, 11 nt, Homo sapiens
aggaagcaagc

SEQ ID NO: 472586 - RNA, 13 nt, Homo sapiens
aggaugggaccaa

SEQ ID NO: 472587 - RNA, 21 nt, Homo sapiens
aggauuaaugguccugugaug

SEQ ID NO: 472588 - RNA, 12 nt, Homo sapiens
aggccucaggga

SEQ ID NO: 472589 - RNA, 17 nt, Homo sapiens
aggcuggaguacaguga

SEQ ID NO: 472590 - RNA, 16 nt, Homo sapiens
agggaugacugugauu

SEQ ID NO: 472591 - RNA, 20 nt, Homo sapiens
aguauuaagugacagugcua

SEQ ID NO: 472592 - RNA, 17 nt, Homo sapiens
agucagaacucuguguu

SEQ ID NO: 472593 - RNA, 16 nt, Homo sapiens
agucucacucugucac

SEQ ID NO: 472594 - RNA, 20 nt, Homo sapiens
agugaaaauuuuauugaaua

SEQ ID NO: 472595 - RNA, 19 nt, Homo sapiens
aguguaaccuugcaucuca

SEQ ID NO: 472596 - RNA, 21 nt, Homo sapiens
aguugguuaccuauugcugua

SEQ ID NO: 472597 - RNA, 13 nt, Homo sapiens
auagagguacaug

SEQ ID NO: 472598 - RNA, 23 nt, Homo sapiens
auagauauuccuauugugcaaug

SEQ ID NO: 472599 - RNA, 13 nt, Homo sapiens
auccuagcacuuu

SEQ ID NO: 472600 - RNA, 12 nt, Homo sapiens
aucuuuuccacu

SEQ ID NO: 472601 - RNA, 14 nt, Homo sapiens
augagauuggaaaa

SEQ ID NO: 472602 - RNA, 13 nt, Homo sapiens
auggaguuucccu

SEQ ID NO: 472603 - RNA, 15 nt, Homo sapiens
auggccaggccucag

SEQ ID NO: 472604 - RNA, 14 nt, Homo sapiens
augguccugugaug

SEQ ID NO: 472605 - RNA, 22 nt, Homo sapiens
auguccuucuuuaucugugaua

SEQ ID NO: 472606 - RNA, 22 nt, Homo sapiens
augugugaagcaaauuucuaga

SEQ ID NO: 472607 - RNA, 16 nt, Homo sapiens
augugugcuuggaaaa

SEQ ID NO: 472608 - RNA, 13 nt, Homo sapiens
auguucugacagc

SEQ ID NO: 472609 - RNA, 13 nt, Homo sapiens
auguuguguuguu

SEQ ID NO: 472610 - RNA, 15 nt, Homo sapiens
auuauugugccucag

SEQ ID NO: 472611 - RNA, 23 nt, Homo sapiens
auucugcuugguuccacaaucau

SEQ ID NO: 472612 - RNA, 14 nt, Homo sapiens
auugaggaugaacu

SEQ ID NO: 472613 - RNA, 12 nt, Homo sapiens
auuggugcauuu

SEQ ID NO: 472614 - RNA, 21 nt, Homo sapiens
auuguuccaaaugaauguugu

SEQ ID NO: 472615 - RNA, 14 nt, Homo sapiens
auuuuauucccaag

SEQ ID NO: 472616 - RNA, 20 nt, Homo sapiens
auuuucaaguggaaaccuug

SEQ ID NO: 472617 - RNA, 17 nt, Homo sapiens
caaaauaaagaauagca

SEQ ID NO: 472618 - RNA, 23 nt, Homo sapiens
caaagucaauuaaaggcuuucag

SEQ ID NO: 472619 - RNA, 21 nt, Homo sapiens
caaauguuauucaauaacuau

SEQ ID NO: 472620 - RNA, 23 nt, Homo sapiens
caacugcccaggaaggacugugc

SEQ ID NO: 472621 - RNA, 14 nt, Homo sapiens
caagccuuacucac

SEQ ID NO: 472622 - RNA, 15 nt, Homo sapiens
caaggaaacucgaau

SEQ ID NO: 472623 - RNA, 17 nt, Homo sapiens
caaggaucacuugagcc

SEQ ID NO: 472624 - RNA, 20 nt, Homo sapiens
caaguguaaccuugcaucuc

SEQ ID NO: 472625 - RNA, 23 nt, Homo sapiens
cacaagguugcuggcauuugcug

SEQ ID NO: 472626 - RNA, 12 nt, Homo sapiens
cacacaacugug

SEQ ID NO: 472627 - RNA, 13 nt, Homo sapiens
cacacaacugugg

SEQ ID NO: 472628 - RNA, 23 nt, Homo sapiens
cacauucuuaacacauguccuug

SEQ ID NO: 472629 - RNA, 14 nt, Homo sapiens
cacuagacugugcc

SEQ ID NO: 472630 - RNA, 18 nt, Homo sapiens
cacucaucagguaaacug

SEQ ID NO: 472631 - RNA, 19 nt, Homo sapiens
cagccucccgaguagcuga

SEQ ID NO: 472632 - RNA, 22 nt, Homo sapiens
caggauuaaugguccugugaug

SEQ ID NO: 472633 - RNA, 20 nt, Homo sapiens
caggauugaggaugaacuca

SEQ ID NO: 472634 - RNA, 17 nt, Homo sapiens
uauaucuuuuuccauca

SEQ ID NO: 472635 - RNA, 18 nt, Homo sapiens
uaugcuguucauugauga

SEQ ID NO: 472636 - RNA, 16 nt, Homo sapiens
uauuauuuuuuccaca

SEQ ID NO: 472637 - RNA, 20 nt, Homo sapiens
ucaagacccuuuucuguaug

SEQ ID NO: 472638 - RNA, 22 nt, Homo sapiens
ucaagcgauucuucugccucag

SEQ ID NO: 472639 - RNA, 18 nt, Homo sapiens
ucaauaacuauugcugcu

SEQ ID NO: 472640 - RNA, 15 nt, Homo sapiens
ucagauuuguguuau

SEQ ID NO: 472641 - RNA, 23 nt, Homo sapiens
ucaggauuaaugguccugugaug

SEQ ID NO: 472642 - RNA, 21 nt, Homo sapiens
ucaggauugaggaugaacuca

SEQ ID NO: 472643 - RNA, 23 nt, Homo sapiens
ucauaagccuaccaauguagaca

SEQ ID NO: 472644 - RNA, 20 nt, Homo sapiens
ucccacgacuguuguacaag

SEQ ID NO: 472645 - RNA, 14 nt, Homo sapiens
ucccagcuacaggg

SEQ ID NO: 472646 - RNA, 23 nt, Homo sapiens
ucccgauaucaaaaagacugugg

SEQ ID NO: 472647 - RNA, 16 nt, Homo sapiens
uccuuagagacaucaa

SEQ ID NO: 472648 - RNA, 23 nt, Homo sapiens
ucgaguaacuuuaaaaaaaucau

SEQ ID NO: 472649 - RNA, 17 nt, Homo sapiens
ucggacaccaucuuggg

SEQ ID NO: 472650 - RNA, 13 nt, Homo sapiens
ucuacuuugucua

SEQ ID NO: 472651 - RNA, 18 nt, Homo sapiens
ucuauugaguguacauuu

SEQ ID NO: 472652 - RNA, 11 nt, Homo sapiens
ucucucucuuu

SEQ ID NO: 472653 - RNA, 9 nt, Homo sapiens
ucucucuuu

SEQ ID NO: 472654 - RNA, 14 nt, Homo sapiens
ucugugcaucuggc

SEQ ID NO: 472655 - RNA, 16 nt, Homo sapiens
ucuuuaguucugucag

SEQ ID NO: 472656 - RNA, 21 nt, Homo sapiens
ugaaguuagggaugacuguga

SEQ ID NO: 472657 - RNA, 15 nt, Homo sapiens
ugaaucuuuuccacu

SEQ ID NO: 472658 - RNA, 17 nt, Homo sapiens
ugaauuugccuuccuca

SEQ ID NO: 472659 - RNA, 18 nt, Homo sapiens
ugagaaauuuaaacuaua

SEQ ID NO: 472660 - RNA, 21 nt, Homo sapiens
ugagacgcaaggaucacuuga

SEQ ID NO: 472661 - RNA, 23 nt, Homo sapiens
ugauggccaggccucagggacca

SEQ ID NO: 472662 - RNA, 14 nt, Homo sapiens
ugauguaacugugu

SEQ ID NO: 472663 - RNA, 17 nt, Homo sapiens
ugccguggcaacugugg

SEQ ID NO: 472664 - RNA, 20 nt, Homo sapiens
ugcuuucucuucuacuucuu

SEQ ID NO: 472665 - RNA, 23 nt, Homo sapiens
uggaaaccuugcugcuaugcugu

SEQ ID NO: 472666 - RNA, 16 nt, Homo sapiens
ugggaggaucacuuga

SEQ ID NO: 472667 - RNA, 18 nt, Homo sapiens
ugguuucccaagagcuac

SEQ ID NO: 472668 - RNA, 19 nt, Homo sapiens
uguaauccuagcacuuugg

SEQ ID NO: 472669 - RNA, 12 nt, Homo sapiens
ugugauuuucag

SEQ ID NO: 472670 - RNA, 20 nt, Homo sapiens
uuaaaacuuacuaugguaua

SEQ ID NO: 472671 - RNA, 14 nt, Homo sapiens
uuaaaauagcaaaa

SEQ ID NO: 472672 - RNA, 19 nt, Homo sapiens
uuaaaauagcaaaagaaga

SEQ ID NO: 472673 - RNA, 18 nt, Homo sapiens
uuaaacuauaagcaagaa

SEQ ID NO: 472674 - RNA, 19 nt, Homo sapiens
uuaauuuuugauacuaagc

SEQ ID NO: 472675 - RNA, 16 nt, Homo sapiens
uuagggaugacuguga

SEQ ID NO: 472676 - RNA, 14 nt, Homo sapiens
uuaugaaaaagaag

SEQ ID NO: 472677 - RNA, 21 nt, Homo sapiens
uuauucaauaacuauugcugc

SEQ ID NO: 472678 - RNA, 15 nt, Homo sapiens
caggugccuaccacc

SEQ ID NO: 472679 - RNA, 20 nt, Homo sapiens
cagguguaagccaccgugcc

SEQ ID NO: 472680 - RNA, 21 nt, Homo sapiens
caguaaauguauauugaugua

SEQ ID NO: 472681 - RNA, 11 nt, Homo sapiens
cauaagccuac

SEQ ID NO: 472682 - RNA, 17 nt, Homo sapiens
cauaucuguaugccuca

SEQ ID NO: 472683 - RNA, 20 nt, Homo sapiens
caugcacucuuuugagcagu

SEQ ID NO: 472684 - RNA, 23 nt, Homo sapiens
cauucagaagaaaaagaagcaac

SEQ ID NO: 472685 - RNA, 13 nt, Homo sapiens
cauugaauuugcc

SEQ ID NO: 472686 - RNA, 23 nt, Homo sapiens
cauugaugacaugggauugaguu

SEQ ID NO: 472687 - RNA, 17 nt, Homo sapiens
ccaagaguuugagacca

SEQ ID NO: 472688 - RNA, 17 nt, Homo sapiens
ccagagucaaauuugaa

SEQ ID NO: 472689 - RNA, 17 nt, Homo sapiens
ccaggcuggaguacagu

SEQ ID NO: 472690 - RNA, 15 nt, Homo sapiens
ccaucuuuugugaga

SEQ ID NO: 472691 - RNA, 21 nt, Homo sapiens
ccauugaauuugccuuccuca

SEQ ID NO: 472692 - RNA, 19 nt, Homo sapiens
cccuuuucuguauguccuu

SEQ ID NO: 472693 - RNA, 12 nt, Homo sapiens
ccggccugaugg

SEQ ID NO: 472694 - RNA, 23 nt, Homo sapiens
ccucuuaaaaaauaaaaacugac

SEQ ID NO: 472695 - RNA, 17 nt, Homo sapiens
ccucuuaccuauguccc

SEQ ID NO: 472696 - RNA, 16 nt, Homo sapiens
ccugacuuugugaucc

SEQ ID NO: 472697 - RNA, 15 nt, Homo sapiens
ccugucucuacaaaa

SEQ ID NO: 472698 - RNA, 12 nt, Homo sapiens
ccuguuccucaa

SEQ ID NO: 472699 - RNA, 14 nt, Homo sapiens
ccuuacucaccucu

SEQ ID NO: 472700 - RNA, 17 nt, Homo sapiens
ccuuucuuucuuccuuc

SEQ ID NO: 472701 - RNA, 18 nt, Homo sapiens
cuagcaauugcuucucua

SEQ ID NO: 472702 - RNA, 23 nt, Homo sapiens
cuaguugccguggcaacugugga

SEQ ID NO: 472703 - RNA, 11 nt, Homo sapiens
cucaccucucu

SEQ ID NO: 472704 - RNA, 13 nt, Homo sapiens
cucagggaccaag

SEQ ID NO: 472705 - RNA, 15 nt, Homo sapiens
cucagggaccaagga

SEQ ID NO: 472706 - RNA, 13 nt, Homo sapiens
cucauaucaaucc

SEQ ID NO: 472707 - RNA, 16 nt, Homo sapiens
cuccuuagagacauca

SEQ ID NO: 472708 - RNA, 16 nt, Homo sapiens
cucgaccucccaaagu

SEQ ID NO: 472709 - RNA, 16 nt, Homo sapiens
cucggccucccaaagu

SEQ ID NO: 472710 - RNA, 18 nt, Homo sapiens
cucuaaaacagcacuauc

SEQ ID NO: 472711 - RNA, 13 nt, Homo sapiens
cucucucucucuu

SEQ ID NO: 472712 - RNA, 23 nt, Homo sapiens
cucucuugcaggaaggacuauga

SEQ ID NO: 472713 - RNA, 17 nt, Homo sapiens
cucugucgccaggcuag

SEQ ID NO: 472714 - RNA, 22 nt, Homo sapiens
cugaaguuagggaugacuguga

SEQ ID NO: 472715 - RNA, 17 nt, Homo sapiens
cugaccaagauacuuaa

SEQ ID NO: 472716 - RNA, 22 nt, Homo sapiens
cugacuccuuagagacaucaaa

SEQ ID NO: 472717 - RNA, 22 nt, Homo sapiens
cugagacuucaggugcauucca

SEQ ID NO: 472718 - RNA, 15 nt, Homo sapiens
cugauccuuguggca

SEQ ID NO: 472719 - RNA, 20 nt, Homo sapiens
cugcauuucaaguuaauucu

SEQ ID NO: 472720 - RNA, 19 nt, Homo sapiens
cuuccuuucuuucucucuc

SEQ ID NO: 472721 - RNA, 20 nt, Homo sapiens
cuucuuuuaguuguaucucu

SEQ ID NO: 472722 - RNA, 15 nt, Homo sapiens
cuuucugauacuuau

SEQ ID NO: 472723 - RNA, 16 nt, Homo sapiens
cuuuuaguuguaucuc

SEQ ID NO: 472724 - RNA, 20 nt, Homo sapiens
gaaaagaaaccagagucaaa

SEQ ID NO: 472725 - RNA, 15 nt, Homo sapiens
gaaaccagagucaaa

SEQ ID NO: 472726 - RNA, 14 nt, Homo sapiens
gaaauauucacaag

SEQ ID NO: 472727 - RNA, 19 nt, Homo sapiens
gaauaaaggaugggaccaa

SEQ ID NO: 472728 - RNA, 18 nt, Homo sapiens
gacaacauuucuauagcc

SEQ ID NO: 472729 - RNA, 13 nt, Homo sapiens
gacaggguuucac

SEQ ID NO: 472730 - RNA, 22 nt, Homo sapiens
gaccuuuuuuaggaagcaagcu

SEQ ID NO: 472731 - RNA, 19 nt, Homo sapiens
gacuggccucaaagcaagc

SEQ ID NO: 472732 - RNA, 17 nt, Homo sapiens
gagaggaagcucucuuu

SEQ ID NO: 472733 - RNA, 18 nt, Homo sapiens
gagaguauauuauguauu

SEQ ID NO: 472734 - RNA, 13 nt, Homo sapiens
gagcuuucugaua

SEQ ID NO: 472735 - RNA, 12 nt, Homo sapiens
gaggaucacuug

SEQ ID NO: 472736 - RNA, 19 nt, Homo sapiens
gauaucaaaaagacugugg

SEQ ID NO: 472737 - RNA, 18 nt, Homo sapiens
gcaauucuccugccucag

SEQ ID NO: 472738 - RNA, 15 nt, Homo sapiens
gcagagcuuccucag

SEQ ID NO: 472739 - RNA, 18 nt, Homo sapiens
gccaggccucagggacca

SEQ ID NO: 472740 - RNA, 23 nt, Homo sapiens
gccauugaauuugccuuccucau

SEQ ID NO: 472741 - RNA, 11 nt, Homo sapiens
gccugauggcc

SEQ ID NO: 472742 - RNA, 13 nt, Homo sapiens
gccugauggccag

SEQ ID NO: 472743 - RNA, 20 nt, Homo sapiens
gcuagaaauaagcccaacag

SEQ ID NO: 472744 - RNA, 23 nt, Homo sapiens
gcuaucagacuguaggauuugaa

SEQ ID NO: 472745 - RNA, 23 nt, Homo sapiens
gcuaugguuuucuccaagagcua

SEQ ID NO: 472746 - RNA, 18 nt, Homo sapiens
gcugugagcuuucugaua

SEQ ID NO: 472747 - RNA, 17 nt, Homo sapiens
gcuuuacucugaauuuc

SEQ ID NO: 472748 - RNA, 15 nt, Homo sapiens
gcuuuuguacguuaa

SEQ ID NO: 472749 - RNA, 15 nt, Homo sapiens
ggaaacucgaauaaa

SEQ ID NO: 472750 - RNA, 14 nt, Homo sapiens
ggaugacugugauu

SEQ ID NO: 472751 - RNA, 14 nt, Homo sapiens
gguaaacauucucu

SEQ ID NO: 472752 - RNA, 20 nt, Homo sapiens
gguaauauaaaguguaauag

SEQ ID NO: 472753 - RNA, 22 nt, Homo sapiens
gguaggggcaaggaaacucgaa

SEQ ID NO: 472754 - RNA, 18 nt, Homo sapiens
ggucggggcuaggguagg

SEQ ID NO: 472755 - RNA, 14 nt, Homo sapiens
guaaaagcaaaaaa

SEQ ID NO: 472756 - RNA, 14 nt, Homo sapiens
guaaacauucucuc

SEQ ID NO: 472757 - RNA, 17 nt, Homo sapiens
guaaauagcauucucua

SEQ ID NO: 472758 - RNA, 17 nt, Homo sapiens
guaauagauguuugaua

SEQ ID NO: 472759 - RNA, 22 nt, Homo sapiens
guaaugaaacaaagaguucaag

SEQ ID NO: 472760 - RNA, 15 nt, Homo sapiens
guaggggcaaggaaa

SEQ ID NO: 472761 - RNA, 20 nt, Homo sapiens
guauauugauguaacugugu

SEQ ID NO: 472762 - RNA, 18 nt, Homo sapiens
guauugcuaaucauuaag

SEQ ID NO: 472763 - RNA, 15 nt, Homo sapiens
gugcugggauuacag

SEQ ID NO: 472764 - RNA, 21 nt, Homo sapiens
gugggaaggucccuuguuucc

SEQ ID NO: 472765 - RNA, 15 nt, Homo sapiens
gugggcuccuuacag

SEQ ID NO: 472766 - RNA, 14 nt, Homo sapiens
guguaacaggucuc

SEQ ID NO: 472767 - RNA, 17 nt, Homo sapiens
gugucuggcaguuuaua

SEQ ID NO: 472768 - RNA, 17 nt, Homo sapiens
guuagggaugacuguga

SEQ ID NO: 472769 - RNA, 17 nt, Homo sapiens
guucaguggugugaucu

SEQ ID NO: 472770 - RNA, 13 nt, Homo sapiens
guuguuguuguug

SEQ ID NO: 472771 - RNA, 18 nt, Homo sapiens
guuucacagccuauaacc

SEQ ID NO: 472772 - RNA, 14 nt, Homo sapiens
guuugagcuuucau

SEQ ID NO: 472773 - RNA, 15 nt, Homo sapiens
guuuuguaccaacac

SEQ ID NO: 472774 - RNA, 21 nt, Homo sapiens
uaaaaugauuguaguaaucug

SEQ ID NO: 472775 - RNA, 13 nt, Homo sapiens
uaaacugaugcuu

SEQ ID NO: 472776 - RNA, 19 nt, Homo sapiens
uaaagcuuugucuuuuugu

SEQ ID NO: 472777 - RNA, 15 nt, Homo sapiens
uaaaggaugggacca

SEQ ID NO: 472778 - RNA, 17 nt, Homo sapiens
uaaaggaugggaccaac

SEQ ID NO: 472779 - RNA, 15 nt, Homo sapiens
uaaaguugauaaaga

SEQ ID NO: 472780 - RNA, 15 nt, Homo sapiens
uaaauagcauucucu

SEQ ID NO: 472781 - RNA, 19 nt, Homo sapiens
uaaccagacacauacucau

SEQ ID NO: 472782 - RNA, 22 nt, Homo sapiens
uaacuggguaaugaaacaaaga

SEQ ID NO: 472783 - RNA, 14 nt, Homo sapiens
uaauccuagcacuu

SEQ ID NO: 472784 - RNA, 18 nt, Homo sapiens
uaaugaacagaacauaga

SEQ ID NO: 472785 - RNA, 15 nt, Homo sapiens
uaauuuaguuucaua

SEQ ID NO: 472786 - RNA, 13 nt, Homo sapiens
uaccaaaugccuu

SEQ ID NO: 472787 - RNA, 20 nt, Homo sapiens
uaccaaaugccuuucuagca

SEQ ID NO: 472788 - RNA, 10 nt, Homo sapiens
uacucucuua

SEQ ID NO: 472789 - RNA, 21 nt, Homo sapiens
uagaaauaagcccaacagaca

SEQ ID NO: 472790 - RNA, 16 nt, Homo sapiens
uagauauuauucauuc

SEQ ID NO: 472791 - RNA, 18 nt, Homo sapiens
uagcugguucacacugac

SEQ ID NO: 472792 - RNA, 23 nt, Homo sapiens
uagcugguucacacugaccaaga

SEQ ID NO: 472793 - RNA, 14 nt, Homo sapiens
uaggggcaaggaaa

SEQ ID NO: 472794 - RNA, 14 nt, Homo sapiens
uaguaacauagaca

SEQ ID NO: 472795 - RNA, 17 nt, Homo sapiens
aauagcuaaauaccuca

SEQ ID NO: 472796 - RNA, 16 nt, Homo sapiens
aauauaaaguguaaua

SEQ ID NO: 472797 - RNA, 16 nt, Homo sapiens
aaugaaauacuugaca

SEQ ID NO: 472798 - RNA, 22 nt, Homo sapiens
aauuaccagaguuguucugucu

SEQ ID NO: 472799 - RNA, 20 nt, Homo sapiens
acaaaugauuucgugacugu

SEQ ID NO: 472800 - RNA, 13 nt, Homo sapiens
acaagcauucucc

SEQ ID NO: 472801 - RNA, 17 nt, Homo sapiens
acacauucuuaacacau

SEQ ID NO: 472802 - RNA, 20 nt, Homo sapiens
acacauucuuaacacauguc

SEQ ID NO: 472803 - RNA, 21 nt, Homo sapiens
acacauucuuaacacaugucc

SEQ ID NO: 472804 - RNA, 21 nt, Homo sapiens
acacucaucagguaaacugau

SEQ ID NO: 472805 - RNA, 11 nt, Homo sapiens
acagcauuuca

SEQ ID NO: 472806 - RNA, 15 nt, Homo sapiens
acaggaaaaugacuu

SEQ ID NO: 472807 - RNA, 14 nt, Homo sapiens
acauuguaaaugau

SEQ ID NO: 472808 - RNA, 13 nt, Homo sapiens
accuauugcugua

SEQ ID NO: 472809 - RNA, 22 nt, Homo sapiens
accucccccaagcagagcuucc

SEQ ID NO: 472810 - RNA, 13 nt, Homo sapiens
accuugcaucuca

SEQ ID NO: 472811 - RNA, 23 nt, Homo sapiens
acgccccccggccugauggccag

SEQ ID NO: 472812 - RNA, 21 nt, Homo sapiens
acuacacacuguguacugcag

SEQ ID NO: 472813 - RNA, 16 nt, Homo sapiens
acuacuacucaauggc

SEQ ID NO: 472814 - RNA, 13 nt, Homo sapiens
acuauugcugcuu

SEQ ID NO: 472815 - RNA, 19 nt, Homo sapiens
acucaucccuguuccucaa

SEQ ID NO: 472816 - RNA, 23 nt, Homo sapiens
acucaucccuguuccucaaggcc

SEQ ID NO: 472817 - RNA, 23 nt, Homo sapiens
acucgaauaaaggaugggaccaa

SEQ ID NO: 472818 - RNA, 12 nt, Homo sapiens
acugacuccuua

SEQ ID NO: 472819 - RNA, 13 nt, Homo sapiens
acugacuccuuag

SEQ ID NO: 472820 - RNA, 22 nt, Homo sapiens
acuguggucccagcuacagggg

SEQ ID NO: 472821 - RNA, 22 nt, Homo sapiens
acuuuaaaaaaaucauaugcua

SEQ ID NO: 472822 - RNA, 19 nt, Homo sapiens
acuuuaaagcguuugcaca

SEQ ID NO: 472823 - RNA, 21 nt, Homo sapiens
agacuaucuuacuauuucaca

SEQ ID NO: 472824 - RNA, 14 nt, Homo sapiens
agagaguuaaguga

SEQ ID NO: 472825 - RNA, 17 nt, Homo sapiens
agagaguuaagugaaug

SEQ ID NO: 472826 - RNA, 14 nt, Homo sapiens
agagccuccuccag

SEQ ID NO: 472827 - RNA, 16 nt, Homo sapiens
agcagagcuuccucag

SEQ ID NO: 472828 - RNA, 20 nt, Homo sapiens
agcccaacagacaccaucuu

SEQ ID NO: 472829 - RNA, 16 nt, Homo sapiens
agccuaccaauguaga

SEQ ID NO: 472830 - RNA, 17 nt, Homo sapiens
agccucccgaguagcug

SEQ ID NO: 472831 - RNA, 14 nt, Homo sapiens
agcucucuuuccca

SEQ ID NO: 472832 - RNA, 21 nt, Homo sapiens
aggccaccuggccaggagcuu

SEQ ID NO: 472833 - RNA, 20 nt, Homo sapiens
aggccucagggaccaaggag

SEQ ID NO: 472834 - RNA, 18 nt, Homo sapiens
agggaacaagcauucucc

SEQ ID NO: 472835 - RNA, 20 nt, Homo sapiens
aggggcaaggaaacucgaau

SEQ ID NO: 472836 - RNA, 23 nt, Homo sapiens
agggucggggcuaggguaggggc

SEQ ID NO: 472837 - RNA, 21 nt, Homo sapiens
aggugacuuuccuaugacacu

SEQ ID NO: 472838 - RNA, 20 nt, Homo sapiens
agucaauuaaaggcuuucag

SEQ ID NO: 472839 - RNA, 20 nt, Homo sapiens
aguugccguggcaacugugg

SEQ ID NO: 472840 - RNA, 16 nt, Homo sapiens
auaaaggaugggacca

SEQ ID NO: 472841 - RNA, 17 nt, Homo sapiens
auaaaggaugggaccaa

SEQ ID NO: 472842 - RNA, 12 nt, Homo sapiens
aucagacuguag

SEQ ID NO: 472843 - RNA, 20 nt, Homo sapiens
auccaugcuuggguguaaca

SEQ ID NO: 472844 - RNA, 16 nt, Homo sapiens
auccuugauaaaugcc

SEQ ID NO: 472845 - RNA, 22 nt, Homo sapiens
augccuuuucccaaaauguuga

SEQ ID NO: 472846 - RNA, 18 nt, Homo sapiens
auggccaggccucaggga

SEQ ID NO: 472847 - RNA, 22 nt, Homo sapiens
auggccaggccucagggaccaa

SEQ ID NO: 472848 - RNA, 16 nt, Homo sapiens
auggcucggccaggca

SEQ ID NO: 472849 - RNA, 16 nt, Homo sapiens
augggaggaucacuug

SEQ ID NO: 472850 - RNA, 18 nt, Homo sapiens
augguauauauuuugaaa

SEQ ID NO: 472851 - RNA, 19 nt, Homo sapiens
auggugguaaacauucucu

SEQ ID NO: 472852 - RNA, 21 nt, Homo sapiens
auguauuuauauuuugugcua

SEQ ID NO: 472853 - RNA, 14 nt, Homo sapiens
augucuuuaaaaug

SEQ ID NO: 472854 - RNA, 22 nt, Homo sapiens
auguuaaaaaaauaagaagaau

SEQ ID NO: 472855 - RNA, 18 nt, Homo sapiens
auucauuuauucauucau

SEQ ID NO: 472856 - RNA, 20 nt, Homo sapiens
auugaauuugccuuccucau

SEQ ID NO: 472857 - RNA, 16 nt, Homo sapiens
auugauguaacugugu

SEQ ID NO: 472858 - RNA, 16 nt, Homo sapiens
auuucuauagccaaaa

SEQ ID NO: 472859 - RNA, 21 nt, Homo sapiens
auuuucucuaaaauuucaaca

SEQ ID NO: 472860 - RNA, 14 nt, Homo sapiens
caaaaugugugcuu

SEQ ID NO: 472861 - RNA, 16 nt, Homo sapiens
caaacagccccaaagu

SEQ ID NO: 472862 - RNA, 21 nt, Homo sapiens
caaaucuugguugaugccaaa

SEQ ID NO: 472863 - RNA, 19 nt, Homo sapiens
caaaugccuuucuagcaau

SEQ ID NO: 472864 - RNA, 20 nt, Homo sapiens
caacagccugacaacauuuc

SEQ ID NO: 472865 - RNA, 17 nt, Homo sapiens
caagcaauuauugugcc

SEQ ID NO: 472866 - RNA, 21 nt, Homo sapiens
caagcauucagaagaaaaaga

SEQ ID NO: 472867 - RNA, 22 nt, Homo sapiens
caaggaaacucgaauaaaggau

SEQ ID NO: 472868 - RNA, 15 nt, Homo sapiens
caaggcugcagugag

SEQ ID NO: 472869 - RNA, 22 nt, Homo sapiens
caccaucuuuugugagauguaa

SEQ ID NO: 472870 - RNA, 18 nt, Homo sapiens
cacgcuuuuugaaaaagc

SEQ ID NO: 472871 - RNA, 13 nt, Homo sapiens
cacuagacugugc

SEQ ID NO: 472872 - RNA, 16 nt, Homo sapiens
cagacuguaggauuug

SEQ ID NO: 472873 - RNA, 17 nt, Homo sapiens
cagcauuucagcuguga

SEQ ID NO: 472874 - RNA, 18 nt, Homo sapiens
cagccucccgaguagcug

SEQ ID NO: 472875 - RNA, 20 nt, Homo sapiens
cagccucccgaguagcugag

SEQ ID NO: 472876 - RNA, 19 nt, Homo sapiens
cagccucccgaguagcugg

SEQ ID NO: 472877 - RNA, 21 nt, Homo sapiens
cagcuggacaauaugaaucuu

SEQ ID NO: 472878 - RNA, 19 nt, Homo sapiens
cagggaacaagcauucucc

SEQ ID NO: 472879 - RNA, 21 nt, Homo sapiens
cauaagccuaccaauguagac

SEQ ID NO: 472880 - RNA, 22 nt, Homo sapiens
cauauugacuuaauugcagcuu

SEQ ID NO: 472881 - RNA, 21 nt, Homo sapiens
caucauucauuuuuguuguug

SEQ ID NO: 472882 - RNA, 16 nt, Homo sapiens
caucgguuuauacuau

SEQ ID NO: 472883 - RNA, 17 nt, Homo sapiens
cauucauuuauucauuc

SEQ ID NO: 472884 - RNA, 22 nt, Homo sapiens
cauugcaagcuucuuuuaguug

SEQ ID NO: 472885 - RNA, 14 nt, Homo sapiens
cauuucagcuguga

SEQ ID NO: 472886 - RNA, 11 nt, Homo sapiens
cauuugcugca

SEQ ID NO: 472887 - RNA, 10 nt, Homo sapiens
ccaagagcua

SEQ ID NO: 472888 - RNA, 15 nt, Homo sapiens
ccaggcuagagugca

SEQ ID NO: 472889 - RNA, 20 nt, Homo sapiens
ccaguccuggggagcuucac

SEQ ID NO: 472890 - RNA, 16 nt, Homo sapiens
ccauaucuacccagaa

SEQ ID NO: 472891 - RNA, 23 nt, Homo sapiens
ccaucuuuugugagauguaauug

SEQ ID NO: 472892 - RNA, 23 nt, Homo sapiens
cccagaagcucaaggcugcagug

SEQ ID NO: 472893 - RNA, 17 nt, Homo sapiens
cccaggaaggacugugc

SEQ ID NO: 472894 - RNA, 21 nt, Homo sapiens
ccgauaucaaaaagacugugg

SEQ ID NO: 472895 - RNA, 13 nt, Homo sapiens
ccucagggaccaa

SEQ ID NO: 472896 - RNA, 20 nt, Homo sapiens
ccuccuuuucuuucucucuc

SEQ ID NO: 472897 - RNA, 21 nt, Homo sapiens
ccucuagguaaacuagcaaaa

SEQ ID NO: 472898 - RNA, 12 nt, Homo sapiens
ccugauggccag

SEQ ID NO: 472899 - RNA, 18 nt, Homo sapiens
ccugggcaacagagugag

SEQ ID NO: 472900 - RNA, 23 nt, Homo sapiens
ccuuaaugauccguuccauugca

SEQ ID NO: 472901 - RNA, 18 nt, Homo sapiens
ccuucugugcaucuggcc

SEQ ID NO: 472902 - RNA, 22 nt, Homo sapiens
ccuuuagauauuauucauucau

SEQ ID NO: 472903 - RNA, 21 nt, Homo sapiens
cgaauaaaggaugggaccaac

SEQ ID NO: 472904 - RNA, 12 nt, Homo sapiens
cgcuuuuguacg

SEQ ID NO: 472905 - RNA, 16 nt, Homo sapiens
cggacaccaucuuggg

SEQ ID NO: 472906 - RNA, 16 nt, Homo sapiens
cggacgccccccggcc

SEQ ID NO: 472907 - RNA, 14 nt, Homo sapiens
cggccucccaaagu

SEQ ID NO: 472908 - RNA, 20 nt, Homo sapiens
cuagaaauaagcccaacaga

SEQ ID NO: 472909 - RNA, 20 nt, Homo sapiens
cuagagugcgguggcgcgau

SEQ ID NO: 472910 - RNA, 13 nt, Homo sapiens
cuaggguaggggc

SEQ ID NO: 472911 - RNA, 16 nt, Homo sapiens
cuaggguaggggcaag

SEQ ID NO: 472912 - RNA, 14 nt, Homo sapiens
cucaucccuguucc

SEQ ID NO: 472913 - RNA, 21 nt, Homo sapiens
cucauucauuuauucauucau

SEQ ID NO: 472914 - RNA, 20 nt, Homo sapiens
cucgaauaaaggaugggacc

SEQ ID NO: 472915 - RNA, 14 nt, Homo sapiens
cucggacaccaucu

SEQ ID NO: 472916 - RNA, 16 nt, Homo sapiens
cucuuaaugcuguguu

SEQ ID NO: 472917 - RNA, 16 nt, Homo sapiens
cucuuaguaacauaga

SEQ ID NO: 472918 - RNA, 17 nt, Homo sapiens
cucuuuugaauccaugc

SEQ ID NO: 472919 - RNA, 18 nt, Homo sapiens
cucuuuugaauccaugcu

SEQ ID NO: 472920 - RNA, 19 nt, Homo sapiens
cucuuuugaauccaugcuu

SEQ ID NO: 472921 - RNA, 21 nt, Homo sapiens
cugaagaaaccuucagauuug

SEQ ID NO: 472922 - RNA, 17 nt, Homo sapiens
cugaccucgugauccac

SEQ ID NO: 472923 - RNA, 15 nt, Homo sapiens
cugacuuugugaucc

SEQ ID NO: 472924 - RNA, 16 nt, Homo sapiens
cugagagaaacugagg

SEQ ID NO: 472925 - RNA, 22 nt, Homo sapiens
cugauggccaggccucagggac

SEQ ID NO: 472926 - RNA, 20 nt, Homo sapiens
cugcccaggaaggacugugc

SEQ ID NO: 472927 - RNA, 21 nt, Homo sapiens
cuggaaaaaaaaaaauaugag

SEQ ID NO: 472928 - RNA, 15 nt, Homo sapiens
cugugaaaugacugc

SEQ ID NO: 472929 - RNA, 11 nt, Homo sapiens
cuguuccucaa

SEQ ID NO: 472930 - RNA, 18 nt, Homo sapiens
cuguucugccuuccgcag

SEQ ID NO: 472931 - RNA, 21 nt, Homo sapiens
cuuaaugauccguuccauugc

SEQ ID NO: 472932 - RNA, 17 nt, Homo sapiens
cuuaccaggcaccaaaa

SEQ ID NO: 472933 - RNA, 15 nt, Homo sapiens
cuucaaacgaaaugg

SEQ ID NO: 472934 - RNA, 20 nt, Homo sapiens
cuugcugugaaaugacugca

SEQ ID NO: 472935 - RNA, 15 nt, Homo sapiens
cuuuaaaaugauuca

SEQ ID NO: 472936 - RNA, 14 nt, Homo sapiens
cuuuaucugugaua

SEQ ID NO: 472937 - RNA, 19 nt, Homo sapiens
cuuugggaggcugagaugg

SEQ ID NO: 472938 - RNA, 19 nt, Homo sapiens
cuuuguucacuagacugug

SEQ ID NO: 472939 - RNA, 14 nt, Homo sapiens
gaaacucgaauaaa

SEQ ID NO: 472940 - RNA, 19 nt, Homo sapiens
gaaauaaguuuuuguuuca

SEQ ID NO: 472941 - RNA, 21 nt, Homo sapiens
gaaggacuaugaaaagcuaga

SEQ ID NO: 472942 - RNA, 21 nt, Homo sapiens
gaaguuagggaugacugugau

SEQ ID NO: 472943 - RNA, 16 nt, Homo sapiens
gaauuuuuaaacaagu

SEQ ID NO: 472944 - RNA, 21 nt, Homo sapiens
gaccuuuuuuaggaagcaagc

SEQ ID NO: 472945 - RNA, 22 nt, Homo sapiens
gacuccuuagagacaucaaaau

SEQ ID NO: 472946 - RNA, 21 nt, Homo sapiens
gagaaauuuaaacuauaagca

SEQ ID NO: 472947 - RNA, 17 nt, Homo sapiens
gagcuguggacuuuguu

SEQ ID NO: 472948 - RNA, 19 nt, Homo sapiens
gaggaauucugaagccauu

SEQ ID NO: 472949 - RNA, 14 nt, Homo sapiens
gauaaaugccucau

SEQ ID NO: 472950 - RNA, 17 nt, Homo sapiens
gauaauuaaaugaaaua

SEQ ID NO: 472951 - RNA, 20 nt, Homo sapiens
gauggugguaaacauucucu

SEQ ID NO: 472952 - RNA, 15 nt, Homo sapiens
gauucuucugccuca

SEQ ID NO: 472953 - RNA, 14 nt, Homo sapiens
gcacacaacugugg

SEQ ID NO: 472954 - RNA, 21 nt, Homo sapiens
gcauuccaccacacauggcua

SEQ ID NO: 472955 - RNA, 18 nt, Homo sapiens
gcauuugcugcauuucaa

SEQ ID NO: 472956 - RNA, 14 nt, Homo sapiens
gccaaaaauagcua

SEQ ID NO: 472957 - RNA, 15 nt, Homo sapiens
gccaggccucaggga

SEQ ID NO: 472958 - RNA, 19 nt, Homo sapiens
gccaggccucagggaccaa

SEQ ID NO: 472959 - RNA, 22 nt, Homo sapiens
gccaggccucagggaccaagga

SEQ ID NO: 472960 - RNA, 19 nt, Homo sapiens
gccaggcuagagugcagug

SEQ ID NO: 472961 - RNA, 14 nt, Homo sapiens
gccucagggaccaa

SEQ ID NO: 472962 - RNA, 17 nt, Homo sapiens
gccucagggaccaagga

SEQ ID NO: 472963 - RNA, 12 nt, Homo sapiens
gccucccaaagu

SEQ ID NO: 472964 - RNA, 19 nt, Homo sapiens
gcuuuacccucaggugcua

SEQ ID NO: 472965 - RNA, 20 nt, Homo sapiens
ggauuacagguguaagccac

SEQ ID NO: 472966 - RNA, 13 nt, Homo sapiens
ggccucagggacc

SEQ ID NO: 472967 - RNA, 16 nt, Homo sapiens
ggcuggaguucagugg

SEQ ID NO: 472968 - RNA, 22 nt, Homo sapiens
gggcuaggguaggggcaaggaa

SEQ ID NO: 472969 - RNA, 17 nt, Homo sapiens
gguagaguccuaggaca

SEQ ID NO: 472970 - RNA, 21 nt, Homo sapiens
guaucucuuuugaauccaugc

SEQ ID NO: 472971 - RNA, 23 nt, Homo sapiens
guaugccucauuuuauucuguca

SEQ ID NO: 472972 - RNA, 17 nt, Homo sapiens
gucagaacucuguguug

SEQ ID NO: 472973 - RNA, 20 nt, Homo sapiens
guccuucuuuaucugugaua

SEQ ID NO: 472974 - RNA, 15 nt, Homo sapiens
gucuaguggaaccaa

SEQ ID NO: 472975 - RNA, 15 nt, Homo sapiens
gucucgaacuccugg

SEQ ID NO: 472976 - RNA, 17 nt, Homo sapiens
gucucuccugaugcuca

SEQ ID NO: 472977 - RNA, 13 nt, Homo sapiens
gugagauguaauu

SEQ ID NO: 472978 - RNA, 22 nt, Homo sapiens
gugcuuggaaaauguucugaca

SEQ ID NO: 472979 - RNA, 18 nt, Homo sapiens
guggaaaccuugcugcua

SEQ ID NO: 472980 - RNA, 13 nt, Homo sapiens
guguuucuuacag

SEQ ID NO: 472981 - RNA, 16 nt, Homo sapiens
guuaagugaaugucua

SEQ ID NO: 472982 - RNA, 18 nt, Homo sapiens
guucuuuaagaauuacag

SEQ ID NO: 472983 - RNA, 19 nt, Homo sapiens
guugguuaccuauugcugu

SEQ ID NO: 472984 - RNA, 15 nt, Homo sapiens
guuguacaagcucag

SEQ ID NO: 472985 - RNA, 18 nt, Homo sapiens
guuuaguauuaugucuua

SEQ ID NO: 472986 - RNA, 22 nt, Homo sapiens
uaaaaucuguauugcuaagaua

SEQ ID NO: 472987 - RNA, 13 nt, Homo sapiens
uaaacaaauuccu

SEQ ID NO: 472988 - RNA, 17 nt, Homo sapiens
uaacaaagugagaccuc

SEQ ID NO: 472989 - RNA, 20 nt, Homo sapiens
uaagaagaaugcuuaaucag

SEQ ID NO: 472990 - RNA, 20 nt, Homo sapiens
uaauauuuguuccucuaggu

SEQ ID NO: 472991 - RNA, 14 nt, Homo sapiens
uaccuauugcugua

SEQ ID NO: 472992 - RNA, 12 nt, Homo sapiens
uagaaauaagcc

SEQ ID NO: 472993 - RNA, 17 nt, Homo sapiens
uagagugcaguggcaug

SEQ ID NO: 472994 - RNA, 13 nt, Homo sapiens
uagcaacuacagu

SEQ ID NO: 472995 - RNA, 15 nt, Homo sapiens
uagggaugacuguga

SEQ ID NO: 472996 - RNA, 22 nt, Homo sapiens
uaguaaagacaggguuucacca

SEQ ID NO: 472997 - RNA, 18 nt, Homo sapiens
uaguucuaggguuucccu

SEQ ID NO: 472998 - RNA, 20 nt, Homo sapiens
uaguugccguggcaacugug

SEQ ID NO: 472999 - RNA, 15 nt, Homo sapiens
uaguuguaucucuuu

SEQ ID NO: 473000 - RNA, 21 nt, Homo sapiens
uauaagcaagaaggcaaaaau

SEQ ID NO: 473001 - RNA, 20 nt, Homo sapiens
uauauuuugugcuaucagac

SEQ ID NO: 473002 - RNA, 17 nt, Homo sapiens
uaucaaaaagacugugg

SEQ ID NO: 473003 - RNA, 13 nt, Homo sapiens
ucaaaacaaucaa

SEQ ID NO: 473004 - RNA, 10 nt, Homo sapiens
ucaacugagg

SEQ ID NO: 473005 - RNA, 14 nt, Homo sapiens
ucaaguuaauucuc

SEQ ID NO: 473006 - RNA, 20 nt, Homo sapiens
ucacaacagaaaacccaaaa

SEQ ID NO: 473007 - RNA, 13 nt, Homo sapiens
ucaccuaucugga

SEQ ID NO: 473008 - RNA, 16 nt, Homo sapiens
ucagggucggggcuag

SEQ ID NO: 473009 - RNA, 14 nt, Homo sapiens
ucaggugcuacaca

SEQ ID NO: 473010 - RNA, 20 nt, Homo sapiens
ucaguguuauaaaaucugua

SEQ ID NO: 473011 - RNA, 18 nt, Homo sapiens
ucaugaguuucccagaga

SEQ ID NO: 473012 - RNA, 16 nt, Homo sapiens
ucccacgacuguugua

SEQ ID NO: 473013 - RNA, 14 nt, Homo sapiens
ucccuguuccucaa

SEQ ID NO: 473014 - RNA, 18 nt, Homo sapiens
uccuugauaaaugccuca

SEQ ID NO: 473015 - RNA, 21 nt, Homo sapiens
ucgaauaaaggaugggaccaa

SEQ ID NO: 473016 - RNA, 22 nt, Homo sapiens
ucguagagacgggguuucacca

SEQ ID NO: 473017 - RNA, 18 nt, Homo sapiens
ucucuaaaacagcacuau

SEQ ID NO: 473018 - RNA, 20 nt, Homo sapiens
ucuggcuaaauggacaucau

SEQ ID NO: 473019 - RNA, 16 nt, Homo sapiens
ucuguucugccuuccg

SEQ ID NO: 473020 - RNA, 18 nt, Homo sapiens
ucuuucccagaugcccca

SEQ ID NO: 473021 - RNA, 18 nt, Homo sapiens
ugaaaauaauuguuccaa

SEQ ID NO: 473022 - RNA, 19 nt, Homo sapiens
ugaagcaaauuucuagaua

SEQ ID NO: 473023 - RNA, 15 nt, Homo sapiens
ugaaugcaaaccaua

SEQ ID NO: 473024 - RNA, 18 nt, Homo sapiens
ugaauuugccuuccucau

SEQ ID NO: 473025 - RNA, 19 nt, Homo sapiens
ugacaacauuucuauagcc

SEQ ID NO: 473026 - RNA, 23 nt, Homo sapiens
ugagcaaguuuucaccuaucugg

SEQ ID NO: 473027 - RNA, 17 nt, Homo sapiens
ugauccguuccauugca

SEQ ID NO: 473028 - RNA, 21 nt, Homo sapiens
ugauggccaggccucagggac

SEQ ID NO: 473029 - RNA, 17 nt, Homo sapiens
ugcaaccuuugccuccc

SEQ ID NO: 473030 - RNA, 23 nt, Homo sapiens
ugcaagcuucuuuuaguuguauc

SEQ ID NO: 473031 - RNA, 23 nt, Homo sapiens
ugcagcaacucccacgacuguug

SEQ ID NO: 473032 - RNA, 14 nt, Homo sapiens
ugccucagccuccc

SEQ ID NO: 473033 - RNA, 14 nt, Homo sapiens
ugcuuggguguaac

SEQ ID NO: 473034 - RNA, 16 nt, Homo sapiens
ugcuuucagauccauc

SEQ ID NO: 473035 - RNA, 17 nt, Homo sapiens
uggaaaaaauuagacaa

SEQ ID NO: 473036 - RNA, 15 nt, Homo sapiens
ugguaaacauucucu

SEQ ID NO: 473037 - RNA, 18 nt, Homo sapiens
uguaaucaguuuuaucca

SEQ ID NO: 473038 - RNA, 21 nt, Homo sapiens
uguauauugauguaacugugu

SEQ ID NO: 473039 - RNA, 19 nt, Homo sapiens
ugucgccaggcuagagugc

SEQ ID NO: 473040 - RNA, 14 nt, Homo sapiens
uguguuucuuacag

SEQ ID NO: 473041 - RNA, 17 nt, Homo sapiens
uuaaaaaaauaagaaga

SEQ ID NO: 473042 - RNA, 19 nt, Homo sapiens
uuacugcaaccuuugccuc

SEQ ID NO: 473043 - RNA, 14 nt, Homo sapiens
uuagagacaucaaa

SEQ ID NO: 473044 - RNA, 18 nt, Homo sapiens
uuagggaugacugugauu

SEQ ID NO: 473045 - RNA, 17 nt, Homo sapiens
uuaguaacauagacaaa

SEQ ID NO: 473046 - RNA, 18 nt, Homo sapiens
uuauauuuugugcuauca

SEQ ID NO: 473047 - RNA, 16 nt, Homo sapiens
uucaguggugugaucu

SEQ ID NO: 473048 - RNA, 17 nt, Homo sapiens
uucucucuuaguaacau

SEQ ID NO: 473049 - RNA, 15 nt, Homo sapiens
uucuuaaauaagaaa

SEQ ID NO: 473050 - RNA, 23 nt, Homo sapiens
uugaaaggagaaaaaaaaagcca

SEQ ID NO: 473051 - RNA, 23 nt, Homo sapiens
uugagaguauauuauguauuuau

SEQ ID NO: 473052 - RNA, 22 nt, Homo sapiens
uugagcuuucaugaguuuccca

SEQ ID NO: 473053 - RNA, 16 nt, Homo sapiens
uugcagauccuugaua

SEQ ID NO: 473054 - RNA, 16 nt, Homo sapiens
uuuaagauaaacagaa

SEQ ID NO: 473055 - RNA, 22 nt, Homo sapiens
uuuauccacagaaacauuuuca

SEQ ID NO: 473056 - RNA, 12 nt, Homo sapiens
uuugaaguagga

SEQ ID NO: 473057 - RNA, 18 nt, Homo sapiens
uuugauacuaagcauuga

SEQ ID NO: 473058 - RNA, 13 nt, Homo sapiens
uuuuccaucaugu

SEQ ID NO: 473059 - RNA, 17 nt, Homo sapiens
uuuucuggugaugccca

SEQ ID NO: 473060 - RNA, 18 nt, Homo sapiens
uuuugaaaaagcgaaaaa

SEQ ID NO: 473061 - RNA, 13 nt, Homo sapiens
aaaaacaugucau

SEQ ID NO: 473062 - RNA, 16 nt, Homo sapiens
aaaaacaugucaugua

SEQ ID NO: 473063 - RNA, 23 nt, Homo sapiens
aaaaaguucagcaugaaggaugc

SEQ ID NO: 473064 - RNA, 21 nt, Homo sapiens
aaaaauggacaaaauccauga

SEQ ID NO: 473065 - RNA, 13 nt, Homo sapiens
aaaaauucaugca

SEQ ID NO: 473066 - RNA, 19 nt, Homo sapiens
aaaaauucaugcaucucaa

SEQ ID NO: 473067 - RNA, 13 nt, Homo sapiens
aaaacaagccaug

SEQ ID NO: 473068 - RNA, 17 nt, Homo sapiens
aaaacaaggaugaauua

SEQ ID NO: 473069 - RNA, 20 nt, Homo sapiens
aaaacaguccuucaaacuuc

SEQ ID NO: 473070 - RNA, 14 nt, Homo sapiens
aaaacguauugcau

SEQ ID NO: 473071 - RNA, 19 nt, Homo sapiens
aaaagcccauucauuccau

SEQ ID NO: 473072 - RNA, 14 nt, Homo sapiens
aaaauacauacuau

SEQ ID NO: 473073 - RNA, 22 nt, Homo sapiens
aaaauagggaaguaacaguaac

SEQ ID NO: 473074 - RNA, 22 nt, Homo sapiens
aaaauauuuuuaugugcaauaa

SEQ ID NO: 473075 - RNA, 19 nt, Homo sapiens
aaaaucacaaacucaucca

SEQ ID NO: 473076 - RNA, 19 nt, Homo sapiens
aaaauccaugaacaauuua

SEQ ID NO: 473077 - RNA, 14 nt, Homo sapiens
aaaaucucccaaag

SEQ ID NO: 473078 - RNA, 19 nt, Homo sapiens
aaaaugaauaauacauuga

SEQ ID NO: 473079 - RNA, 15 nt, Homo sapiens
aaaaugcaacaacau

SEQ ID NO: 473080 - RNA, 18 nt, Homo sapiens
aaaaugcaacaacaugua

SEQ ID NO: 473081 - RNA, 13 nt, Homo sapiens
aaaaugugcaaua

SEQ ID NO: 473082 - RNA, 15 nt, Homo sapiens
aaaaugugcaauaug

SEQ ID NO: 473083 - RNA, 14 nt, Homo sapiens
aaaauucauuccau

SEQ ID NO: 473084 - RNA, 15 nt, Homo sapiens
aaaauuuaaaucaua

SEQ ID NO: 473085 - RNA, 22 nt, Homo sapiens
aaacacuauauggcagugucuu

SEQ ID NO: 473086 - RNA, 20 nt, Homo sapiens
aaacaugugguuaaugccau

SEQ ID NO: 473087 - RNA, 15 nt, Homo sapiens
aaacauguucacuua

SEQ ID NO: 473088 - RNA, 14 nt, Homo sapiens
aaacauuaguucua

SEQ ID NO: 473089 - RNA, 11 nt, Homo sapiens
aaacauuccau

SEQ ID NO: 473090 - RNA, 16 nt, Homo sapiens
aaacauuccauccuug

SEQ ID NO: 473091 - RNA, 23 nt, Homo sapiens
aaacauuuaucuuuguacguucu

SEQ ID NO: 473092 - RNA, 23 nt, Homo sapiens
aaacauuuucuugaauggcaugc

SEQ ID NO: 473093 - RNA, 14 nt, Homo sapiens
aaaccacagucuua

SEQ ID NO: 473094 - RNA, 22 nt, Homo sapiens
aaaccugcaguuuuguuuguac

SEQ ID NO: 473095 - RNA, 19 nt, Homo sapiens
aaacgguacacagacuauu

SEQ ID NO: 473096 - RNA, 15 nt, Homo sapiens
aaacucauaacaguc

SEQ ID NO: 473097 - RNA, 17 nt, Homo sapiens
aaagacauccucaaaag

SEQ ID NO: 473098 - RNA, 19 nt, Homo sapiens
aaagagcacuucacacaga

SEQ ID NO: 473099 - RNA, 13 nt, Homo sapiens
aaagauaguuuau

SEQ ID NO: 473100 - RNA, 23 nt, Homo sapiens
aaagauccccaaaacaggccagg

SEQ ID NO: 473101 - RNA, 15 nt, Homo sapiens
aaagccaucaaacac

SEQ ID NO: 473102 - RNA, 14 nt, Homo sapiens
aaagcuuugugcag

SEQ ID NO: 473103 - RNA, 19 nt, Homo sapiens
aaaggaaagauuugccaau

SEQ ID NO: 473104 - RNA, 20 nt, Homo sapiens
aaaggcaaaugcccaaggga

SEQ ID NO: 473105 - RNA, 16 nt, Homo sapiens
aaaggcuaaaagggaa

SEQ ID NO: 473106 - RNA, 13 nt, Homo sapiens
aaaguucauucaa

SEQ ID NO: 473107 - RNA, 14 nt, Homo sapiens
aaaguucuagugac

SEQ ID NO: 473108 - RNA, 22 nt, Homo sapiens
aaauaaagcuguucucauuccu

SEQ ID NO: 473109 - RNA, 16 nt, Homo sapiens
aaauaaaucaguucau

SEQ ID NO: 473110 - RNA, 19 nt, Homo sapiens
aaauaaguggaaaccgugu

SEQ ID NO: 473111 - RNA, 22 nt, Homo sapiens
aaauacaguuugucacaugaaa

SEQ ID NO: 473112 - RNA, 21 nt, Homo sapiens
aaauaccugucaauacuaugg

SEQ ID NO: 473113 - RNA, 11 nt, Homo sapiens
aaauacucuga

SEQ ID NO: 473114 - RNA, 13 nt, Homo sapiens
aaauagagaucuu

SEQ ID NO: 473115 - RNA, 19 nt, Homo sapiens
aaauagagaucuuauguca

SEQ ID NO: 473116 - RNA, 20 nt, Homo sapiens
aaauagagaucuuaugucaa

SEQ ID NO: 473117 - RNA, 18 nt, Homo sapiens
aaauauuugacaggcuua

SEQ ID NO: 473118 - RNA, 12 nt, Homo sapiens
aaaucaaaaagg

SEQ ID NO: 473119 - RNA, 15 nt, Homo sapiens
aaaucauuaagacaa

SEQ ID NO: 473120 - RNA, 16 nt, Homo sapiens
aaaucucaauucuucc

SEQ ID NO: 473121 - RNA, 18 nt, Homo sapiens
aaaugaguaaacccagcu

SEQ ID NO: 473122 - RNA, 15 nt, Homo sapiens
aaaugcaaauucuca

SEQ ID NO: 473123 - RNA, 20 nt, Homo sapiens
aaaugcuguauuagucacag

SEQ ID NO: 473124 - RNA, 14 nt, Homo sapiens
aaauggcuuaucca

SEQ ID NO: 473125 - RNA, 17 nt, Homo sapiens
aaauggcuuccuggcaa

SEQ ID NO: 473126 - RNA, 21 nt, Homo sapiens
aaauguucaauaugagucuca

SEQ ID NO: 473127 - RNA, 15 nt, Homo sapiens
aaauguuuagugaaa

SEQ ID NO: 473128 - RNA, 18 nt, Homo sapiens
aaauuauauuuugaacaa

SEQ ID NO: 473129 - RNA, 17 nt, Homo sapiens
aaauucaugcaucucaa

SEQ ID NO: 473130 - RNA, 19 nt, Homo sapiens
aaauugauuaaaggggcug

SEQ ID NO: 473131 - RNA, 21 nt, Homo sapiens
aaauuucacuuaauaaugugu

SEQ ID NO: 473132 - RNA, 16 nt, Homo sapiens
aaauuugcuauuccca

SEQ ID NO: 473133 - RNA, 16 nt, Homo sapiens
aaauuuuuguuuauaa

SEQ ID NO: 473134 - RNA, 22 nt, Homo sapiens
aacaaaccuugugcucuuuuca

SEQ ID NO: 473135 - RNA, 14 nt, Homo sapiens
aacaaauaauuugu

SEQ ID NO: 473136 - RNA, 17 nt, Homo sapiens
aacaauuacauggcucu

SEQ ID NO: 473137 - RNA, 21 nt, Homo sapiens
aacaauuacauggcucuaaaa

SEQ ID NO: 473138 - RNA, 14 nt, Homo sapiens
aacaccccacagga

SEQ ID NO: 473139 - RNA, 18 nt, Homo sapiens
aacagagacuucuagaca

SEQ ID NO: 473140 - RNA, 22 nt, Homo sapiens
aacagagcaagacucugucuca

SEQ ID NO: 473141 - RNA, 20 nt, Homo sapiens
aacaucaucaaggcacugcc

SEQ ID NO: 473142 - RNA, 21 nt, Homo sapiens
aacaucaucaaggcacugccu

SEQ ID NO: 473143 - RNA, 14 nt, Homo sapiens
aacauguucacuua

SEQ ID NO: 473144 - RNA, 14 nt, Homo sapiens
aacauuaguucuau

SEQ ID NO: 473145 - RNA, 21 nt, Homo sapiens
aacauuugcaaagaccuuuag

SEQ ID NO: 473146 - RNA, 19 nt, Homo sapiens
aaccagcaucccuugacca

SEQ ID NO: 473147 - RNA, 20 nt, Homo sapiens
aaccaggaauccacucucca

SEQ ID NO: 473148 - RNA, 15 nt, Homo sapiens
aacccaaagagacag

SEQ ID NO: 473149 - RNA, 19 nt, Homo sapiens
aaccuacuuucauacugaa

SEQ ID NO: 473150 - RNA, 20 nt, Homo sapiens
aaccuacuuucauacugaag

SEQ ID NO: 473151 - RNA, 14 nt, Homo sapiens
aaccugaugcaguc

SEQ ID NO: 473152 - RNA, 13 nt, Homo sapiens
aacuaacucuccu

SEQ ID NO: 473153 - RNA, 23 nt, Homo sapiens
aacuaacucuccuccauguugcc

SEQ ID NO: 473154 - RNA, 19 nt, Homo sapiens
aacuaagcuaugugaaaua

SEQ ID NO: 473155 - RNA, 14 nt, Homo sapiens
aacuagaaccugga

SEQ ID NO: 473156 - RNA, 21 nt, Homo sapiens
aacucaaggaaaucuguguca

SEQ ID NO: 473157 - RNA, 11 nt, Homo sapiens
aacucaauauu

SEQ ID NO: 473158 - RNA, 20 nt, Homo sapiens
aacucaauauuuuccaugaa

SEQ ID NO: 473159 - RNA, 14 nt, Homo sapiens
aacugaagccagaa

SEQ ID NO: 473160 - RNA, 16 nt, Homo sapiens
aacuggaugaggucau

SEQ ID NO: 473161 - RNA, 20 nt, Homo sapiens
aacuggcuucugcuugucau

SEQ ID NO: 473162 - RNA, 21 nt, Homo sapiens
aacugucaaagaaucaaucca

SEQ ID NO: 473163 - RNA, 21 nt, Homo sapiens
aacugugcagagacuuuaucc

SEQ ID NO: 473164 - RNA, 19 nt, Homo sapiens
aacuuccagauccuggaaa

SEQ ID NO: 473165 - RNA, 18 nt, Homo sapiens
aagaaacugcucuaauau

SEQ ID NO: 473166 - RNA, 23 nt, Homo sapiens
aagaacaaacacuuagcauccca

SEQ ID NO: 473167 - RNA, 14 nt, Homo sapiens
aagaagugccaguu

SEQ ID NO: 473168 - RNA, 16 nt, Homo sapiens
aagaaugauuaugaau

SEQ ID NO: 473169 - RNA, 15 nt, Homo sapiens
aagacagcuucucau

SEQ ID NO: 473170 - RNA, 19 nt, Homo sapiens
aagacauaggaacauguag

SEQ ID NO: 473171 - RNA, 16 nt, Homo sapiens
aagacauccucaaaag

SEQ ID NO: 473172 - RNA, 15 nt, Homo sapiens
aagacaucuccacca

SEQ ID NO: 473173 - RNA, 16 nt, Homo sapiens
aagaccacugaaugaa

SEQ ID NO: 473174 - RNA, 20 nt, Homo sapiens
aagacccucaaugccaagaa

SEQ ID NO: 473175 - RNA, 18 nt, Homo sapiens
aagaccuauaaaucauua

SEQ ID NO: 473176 - RNA, 15 nt, Homo sapiens
aagaccugagcugaa

SEQ ID NO: 473177 - RNA, 13 nt, Homo sapiens
aagagauuccuga

SEQ ID NO: 473178 - RNA, 19 nt, Homo sapiens
aagaggaugaagugauaug

SEQ ID NO: 473179 - RNA, 20 nt, Homo sapiens
aagaggcauucccagaauuu

SEQ ID NO: 473180 - RNA, 19 nt, Homo sapiens
aagagggcacacacugugu

SEQ ID NO: 473181 - RNA, 13 nt, Homo sapiens
aagagucauguca

SEQ ID NO: 473182 - RNA, 18 nt, Homo sapiens
aagagugguggcagcuca

SEQ ID NO: 473183 - RNA, 23 nt, Homo sapiens
aagaucacgccauugcacuccag

SEQ ID NO: 473184 - RNA, 14 nt, Homo sapiens
aagaugaugcuccu

SEQ ID NO: 473185 - RNA, 15 nt, Homo sapiens
aagaugcagcaaaau

SEQ ID NO: 473186 - RNA, 20 nt, Homo sapiens
aagaugcauuaucuaugaua

SEQ ID NO: 473187 - RNA, 12 nt, Homo sapiens
aagcaagcuccc

SEQ ID NO: 473188 - RNA, 14 nt, Homo sapiens
aagcaccaagcuca

SEQ ID NO: 473189 - RNA, 16 nt, Homo sapiens
aagcagcaacagcaaa

SEQ ID NO: 473190 - RNA, 22 nt, Homo sapiens
aagccaucaaacacaaugccuc

SEQ ID NO: 473191 - RNA, 17 nt, Homo sapiens
aagcccauucauuccau

SEQ ID NO: 473192 - RNA, 13 nt, Homo sapiens
aagcucaucucag

SEQ ID NO: 473193 - RNA, 16 nt, Homo sapiens
aagcucccaagggaug

SEQ ID NO: 473194 - RNA, 23 nt, Homo sapiens
aagcuggaggacuagaaccugga

SEQ ID NO: 473195 - RNA, 21 nt, Homo sapiens
aagcuuggugcuaaaccacaa

SEQ ID NO: 473196 - RNA, 15 nt, Homo sapiens
aaggaagccacagcu

SEQ ID NO: 473197 - RNA, 21 nt, Homo sapiens
aaggaucuuaggcaugacugu

SEQ ID NO: 473198 - RNA, 15 nt, Homo sapiens
aaggauucuguaugc

SEQ ID NO: 473199 - RNA, 16 nt, Homo sapiens
aaggcaggacagagaa

SEQ ID NO: 473200 - RNA, 20 nt, Homo sapiens
aaggcguggagcugccugau

SEQ ID NO: 473201 - RNA, 23 nt, Homo sapiens
aaggcuuacacccacaguggaaa

SEQ ID NO: 473202 - RNA, 16 nt, Homo sapiens
aagggaugcugcaaug

SEQ ID NO: 473203 - RNA, 16 nt, Homo sapiens
aagggauggugcccug

SEQ ID NO: 473204 - RNA, 22 nt, Homo sapiens
aagggcaacucacgggugcaug

SEQ ID NO: 473205 - RNA, 22 nt, Homo sapiens
aaggguaccuugaacacugggg

SEQ ID NO: 473206 - RNA, 21 nt, Homo sapiens
aagguacuucaaauccuugaa

SEQ ID NO: 473207 - RNA, 19 nt, Homo sapiens
aagguggggacagggauga

SEQ ID NO: 473208 - RNA, 15 nt, Homo sapiens
aaguacuguaacugu

SEQ ID NO: 473209 - RNA, 13 nt, Homo sapiens
aaguagcugcuac

SEQ ID NO: 473210 - RNA, 14 nt, Homo sapiens
aaguagcugcuacc

SEQ ID NO: 473211 - RNA, 19 nt, Homo sapiens
aaguaugcacuaaucaaua

SEQ ID NO: 473212 - RNA, 14 nt, Homo sapiens
aaguaugugcauau

SEQ ID NO: 473213 - RNA, 16 nt, Homo sapiens
aagucgucuuaacuca

SEQ ID NO: 473214 - RNA, 18 nt, Homo sapiens
aagugaguggaaauggaa

SEQ ID NO: 473215 - RNA, 19 nt, Homo sapiens
aaguuuugacaucaaugau

SEQ ID NO: 473216 - RNA, 19 nt, Homo sapiens
aauaaaccacaagcaucuc

SEQ ID NO: 473217 - RNA, 21 nt, Homo sapiens
aauaaagcuguucucauuccu

SEQ ID NO: 473218 - RNA, 15 nt, Homo sapiens
aauaaauaugcucag

SEQ ID NO: 473219 - RNA, 16 nt, Homo sapiens
aauaaggaucuuccca

SEQ ID NO: 473220 - RNA, 22 nt, Homo sapiens
aauacuucuaccauaauuuuca

SEQ ID NO: 473221 - RNA, 14 nt, Homo sapiens
aauauaaacacuau

SEQ ID NO: 473222 - RNA, 15 nt, Homo sapiens
aauaucaugcuccau

SEQ ID NO: 473223 - RNA, 15 nt, Homo sapiens
aauauuuuccaugaa

SEQ ID NO: 473224 - RNA, 19 nt, Homo sapiens
aauauuuuuaugugcaaua

SEQ ID NO: 473225 - RNA, 14 nt, Homo sapiens
aaucaagauuuaau

SEQ ID NO: 473226 - RNA, 20 nt, Homo sapiens
aaucacacgucuggcuucac

SEQ ID NO: 473227 - RNA, 23 nt, Homo sapiens
aaucacacgucuggcuucacaga

SEQ ID NO: 473228 - RNA, 14 nt, Homo sapiens
aaucacucagugau

SEQ ID NO: 473229 - RNA, 18 nt, Homo sapiens
aaucacuucugagaacuc

SEQ ID NO: 473230 - RNA, 14 nt, Homo sapiens
aaucagacuaugaa

SEQ ID NO: 473231 - RNA, 18 nt, Homo sapiens
aaucagcaagaagauccu

SEQ ID NO: 473232 - RNA, 15 nt, Homo sapiens
aauccaaaccacagu

SEQ ID NO: 473233 - RNA, 20 nt, Homo sapiens
aauccacucuccauuucuau

SEQ ID NO: 473234 - RNA, 17 nt, Homo sapiens
aauccuuuauagcuuug

SEQ ID NO: 473235 - RNA, 15 nt, Homo sapiens
aaucuaugccacuca

SEQ ID NO: 473236 - RNA, 17 nt, Homo sapiens
aaucucaauucuucccu

SEQ ID NO: 473237 - RNA, 21 nt, Homo sapiens
aaucuccuucuuuccuggacu

SEQ ID NO: 473238 - RNA, 13 nt, Homo sapiens
aaucugcacugug

SEQ ID NO: 473239 - RNA, 17 nt, Homo sapiens
aaucuuauggggccgga

SEQ ID NO: 473240 - RNA, 18 nt, Homo sapiens
aaugaccaguaauuguga

SEQ ID NO: 473241 - RNA, 17 nt, Homo sapiens
aaugacccccaucccau

SEQ ID NO: 473242 - RNA, 21 nt, Homo sapiens
aaugaugucguuugaaucaca

SEQ ID NO: 473243 - RNA, 19 nt, Homo sapiens
aaugcauauccaacaugug

SEQ ID NO: 473244 - RNA, 21 nt, Homo sapiens
aaugcauuuaaacucauuuga

SEQ ID NO: 473245 - RNA, 21 nt, Homo sapiens
aaugccauccucaaacacugc

SEQ ID NO: 473246 - RNA, 20 nt, Homo sapiens
aaugccugagugccuggcca

SEQ ID NO: 473247 - RNA, 10 nt, Homo sapiens
aauggcaaca

SEQ ID NO: 473248 - RNA, 17 nt, Homo sapiens
aauggcaacaucuugca

SEQ ID NO: 473249 - RNA, 13 nt, Homo sapiens
aauggcagggaua

SEQ ID NO: 473250 - RNA, 22 nt, Homo sapiens
aaugggacugaugucaucuuga

SEQ ID NO: 473251 - RNA, 18 nt, Homo sapiens
aaugggcagcucaucucu

SEQ ID NO: 473252 - RNA, 23 nt, Homo sapiens
aaugguuauaucuaaaacaugua

SEQ ID NO: 473253 - RNA, 20 nt, Homo sapiens
aauguaggaaggagagcucu

SEQ ID NO: 473254 - RNA, 14 nt, Homo sapiens
aaugugagguguug

SEQ ID NO: 473255 - RNA, 15 nt, Homo sapiens
aaugugcucaugcau

SEQ ID NO: 473256 - RNA, 23 nt, Homo sapiens
aauguuaaguugauggugaugaa

SEQ ID NO: 473257 - RNA, 19 nt, Homo sapiens
aauguuauucaauggaauc

SEQ ID NO: 473258 - RNA, 18 nt, Homo sapiens
aauuaagcucauuuuuag

SEQ ID NO: 473259 - RNA, 16 nt, Homo sapiens
aauuacaggcacauac

SEQ ID NO: 473260 - RNA, 15 nt, Homo sapiens
aauuagaaacauaaa

SEQ ID NO: 473261 - RNA, 21 nt, Homo sapiens
aauuaucuaaaguaugaagca

SEQ ID NO: 473262 - RNA, 15 nt, Homo sapiens
aauuaugcuuucuau

SEQ ID NO: 473263 - RNA, 20 nt, Homo sapiens
aauucagcucuugagagcau

SEQ ID NO: 473264 - RNA, 22 nt, Homo sapiens
aauucaugcaucucaacaaagg

SEQ ID NO: 473265 - RNA, 21 nt, Homo sapiens
aauucccuucaucuggaacca

SEQ ID NO: 473266 - RNA, 15 nt, Homo sapiens
aauuccuugcacaua

SEQ ID NO: 473267 - RNA, 20 nt, Homo sapiens
aauucuagcuuugagcuuaa

SEQ ID NO: 473268 - RNA, 14 nt, Homo sapiens
aauugcucaugcau

SEQ ID NO: 473269 - RNA, 20 nt, Homo sapiens
aauuguaaaauuuaaaucau

SEQ ID NO: 473270 - RNA, 23 nt, Homo sapiens
aauugugaagucgucuuaacuca

SEQ ID NO: 473271 - RNA, 15 nt, Homo sapiens
aauuugauacagguu

SEQ ID NO: 473272 - RNA, 14 nt, Homo sapiens
aauuuggagucuga

SEQ ID NO: 473273 - RNA, 11 nt, Homo sapiens
acaaaacagaa

SEQ ID NO: 473274 - RNA, 19 nt, Homo sapiens
acaaaauaaagcuguucuc

SEQ ID NO: 473275 - RNA, 21 nt, Homo sapiens
acaaacucaccaucugugcac

SEQ ID NO: 473276 - RNA, 23 nt, Homo sapiens
acaaauuugggagggugagacac

SEQ ID NO: 473277 - RNA, 21 nt, Homo sapiens
acaacacacaauuuaugaauu

SEQ ID NO: 473278 - RNA, 14 nt, Homo sapiens
acaacagugagaaa

SEQ ID NO: 473279 - RNA, 20 nt, Homo sapiens
acaagacccaaguagcugcu

SEQ ID NO: 473280 - RNA, 22 nt, Homo sapiens
acaagacccaaguagcugcuac

SEQ ID NO: 473281 - RNA, 11 nt, Homo sapiens
acaaguccagc

SEQ ID NO: 473282 - RNA, 23 nt, Homo sapiens
acaauaguaauucucaggccauc

SEQ ID NO: 473283 - RNA, 19 nt, Homo sapiens
acaaucacacaacaaauaa

SEQ ID NO: 473284 - RNA, 16 nt, Homo sapiens
acaaugacuaaagaca

SEQ ID NO: 473285 - RNA, 11 nt, Homo sapiens
acaaugcauuc

SEQ ID NO: 473286 - RNA, 13 nt, Homo sapiens
acaaugcuguauu

SEQ ID NO: 473287 - RNA, 21 nt, Homo sapiens
acacaaagcuguugaaauauu

SEQ ID NO: 473288 - RNA, 12 nt, Homo sapiens
acacaaggucau

SEQ ID NO: 473289 - RNA, 14 nt, Homo sapiens
acacagcucccaua

SEQ ID NO: 473290 - RNA, 17 nt, Homo sapiens
acacauacagagcucuc

SEQ ID NO: 473291 - RNA, 14 nt, Homo sapiens
acacauuaagccuu

SEQ ID NO: 473292 - RNA, 23 nt, Homo sapiens
acacauuaagccuuccacacuca

SEQ ID NO: 473293 - RNA, 22 nt, Homo sapiens
acacauuuacacuagaggccag

SEQ ID NO: 473294 - RNA, 18 nt, Homo sapiens
acaccaagugucugcaag

SEQ ID NO: 473295 - RNA, 21 nt, Homo sapiens
acaccaucuuuccaucccagg

SEQ ID NO: 473296 - RNA, 19 nt, Homo sapiens
acaccuccaaugcugccug

SEQ ID NO: 473297 - RNA, 15 nt, Homo sapiens
acaccuguaauccca

SEQ ID NO: 473298 - RNA, 20 nt, Homo sapiens
acacucaagaagcaggcuac

SEQ ID NO: 473299 - RNA, 22 nt, Homo sapiens
acacugaaauauacacacagca

SEQ ID NO: 473300 - RNA, 15 nt, Homo sapiens
cgugacaacacaaau

SEQ ID NO: 473301 - RNA, 22 nt, Homo sapiens
cgugauguggagggcacauucc

SEQ ID NO: 473302 - RNA, 18 nt, Homo sapiens
cguggccccaaauuugcu

SEQ ID NO: 473303 - RNA, 20 nt, Homo sapiens
cguugauguuggcugggaac

SEQ ID NO: 473304 - RNA, 19 nt, Homo sapiens
cguuggccuaacacugggc

SEQ ID NO: 473305 - RNA, 13 nt, Homo sapiens
cguuuaaucacau

SEQ ID NO: 473306 - RNA, 16 nt, Homo sapiens
cuaaaaugaguuaccu

SEQ ID NO: 473307 - RNA, 22 nt, Homo sapiens
cuaaagaagguuucagaaagaa

SEQ ID NO: 473308 - RNA, 13 nt, Homo sapiens
cuaaagagcuuua

SEQ ID NO: 473309 - RNA, 21 nt, Homo sapiens
cuaaagaggaaggaccaagga

SEQ ID NO: 473310 - RNA, 21 nt, Homo sapiens
cuaaaugaguaaacccagcug

SEQ ID NO: 473311 - RNA, 21 nt, Homo sapiens
cuaaccucugagucaccaucu

SEQ ID NO: 473312 - RNA, 21 nt, Homo sapiens
cuaacuuuuuugcuauccagc

SEQ ID NO: 473313 - RNA, 20 nt, Homo sapiens
cuaaggaauaugagcuuuau

SEQ ID NO: 473314 - RNA, 21 nt, Homo sapiens
cuaaggaauaugagcuuuaug

SEQ ID NO: 473315 - RNA, 22 nt, Homo sapiens
cuaauuuguuuucccuucuuac

SEQ ID NO: 473316 - RNA, 20 nt, Homo sapiens
cuacacccuuggacuugagg

SEQ ID NO: 473317 - RNA, 15 nt, Homo sapiens
cuacacugacacugg

SEQ ID NO: 473318 - RNA, 15 nt, Homo sapiens
cuacauuuuaaugca

SEQ ID NO: 473319 - RNA, 20 nt, Homo sapiens
cuaccaacgaaagacgugau

SEQ ID NO: 473320 - RNA, 20 nt, Homo sapiens
cuaccuucuuuggccccuug

SEQ ID NO: 473321 - RNA, 19 nt, Homo sapiens
cuacuagcucuuugagaua

SEQ ID NO: 473322 - RNA, 19 nt, Homo sapiens
cuacucaggaggcugaggc

SEQ ID NO: 473323 - RNA, 16 nt, Homo sapiens
cuacuuucauacugaa

SEQ ID NO: 473324 - RNA, 19 nt, Homo sapiens
cuagaaccuggaagggcua

SEQ ID NO: 473325 - RNA, 13 nt, Homo sapiens
cuagaagggcuag

SEQ ID NO: 473326 - RNA, 17 nt, Homo sapiens
cuagaguucuccagaca

SEQ ID NO: 473327 - RNA, 22 nt, Homo sapiens
cuagaguucuccagacaggguu

SEQ ID NO: 473328 - RNA, 14 nt, Homo sapiens
cuagccgaccucag

SEQ ID NO: 473329 - RNA, 16 nt, Homo sapiens
cuagcucuuugagaua

SEQ ID NO: 473330 - RNA, 14 nt, Homo sapiens
cuagucucuaucau

SEQ ID NO: 473331 - RNA, 23 nt, Homo sapiens
cuaguuguaauuuuuuuguggga

SEQ ID NO: 473332 - RNA, 22 nt, Homo sapiens
cuauaugccgcuacaaaaaggu

SEQ ID NO: 473333 - RNA, 18 nt, Homo sapiens
cuaucccuuuccaaaggc

SEQ ID NO: 473334 - RNA, 13 nt, Homo sapiens
cuaugaaauauca

SEQ ID NO: 473335 - RNA, 20 nt, Homo sapiens
cuaugaaauaucaugcucca

SEQ ID NO: 473336 - RNA, 15 nt, Homo sapiens
cuaugauaugcuaau

SEQ ID NO: 473337 - RNA, 14 nt, Homo sapiens
cuauggaagcauau

SEQ ID NO: 473338 - RNA, 16 nt, Homo sapiens
cuauggcacccaugca

SEQ ID NO: 473339 - RNA, 17 nt, Homo sapiens
cuauggcucuacuuuca

SEQ ID NO: 473340 - RNA, 13 nt, Homo sapiens
cuauguugauaaa

SEQ ID NO: 473341 - RNA, 22 nt, Homo sapiens
cuauuaguaguuaauucuguca

SEQ ID NO: 473342 - RNA, 20 nt, Homo sapiens
cuauuauuugacuuguugcu

SEQ ID NO: 473343 - RNA, 21 nt, Homo sapiens
cuauucccuucuaaccugaac

SEQ ID NO: 473344 - RNA, 15 nt, Homo sapiens
cuauuucuaucccaa

SEQ ID NO: 473345 - RNA, 23 nt, Homo sapiens
cuauuuuuauuuguuugugcauu

SEQ ID NO: 473346 - RNA, 14 nt, Homo sapiens
cucaaaaccagaga

SEQ ID NO: 473347 - RNA, 18 nt, Homo sapiens
cucaaaccaaaucacuga

SEQ ID NO: 473348 - RNA, 14 nt, Homo sapiens
cucacagcuguaau

SEQ ID NO: 473349 - RNA, 22 nt, Homo sapiens
cucacgggugcaugaaaccacu

SEQ ID NO: 473350 - RNA, 22 nt, Homo sapiens
cucagaaaacaaggaugaauua

SEQ ID NO: 473351 - RNA, 15 nt, Homo sapiens
cucaggagaagggau

SEQ ID NO: 473352 - RNA, 13 nt, Homo sapiens
cucaggugaucca

SEQ ID NO: 473353 - RNA, 15 nt, Homo sapiens
cucagugauugcaau

SEQ ID NO: 473354 - RNA, 17 nt, Homo sapiens
cucaucaccacagggau

SEQ ID NO: 473355 - RNA, 17 nt, Homo sapiens
cucaucaucaacccuaa

SEQ ID NO: 473356 - RNA, 20 nt, Homo sapiens
cucauccuuccucauuugca

SEQ ID NO: 473357 - RNA, 20 nt, Homo sapiens
cuccacaccuccaaugcugc

SEQ ID NO: 473358 - RNA, 19 nt, Homo sapiens
cuccagaaagcucaucuca

SEQ ID NO: 473359 - RNA, 18 nt, Homo sapiens
cucccucucuugccgaca

SEQ ID NO: 473360 - RNA, 19 nt, Homo sapiens
cucccugaaguaagcaaag

SEQ ID NO: 473361 - RNA, 13 nt, Homo sapiens
cuccgaggccagu

SEQ ID NO: 473362 - RNA, 14 nt, Homo sapiens
cuccgaggccagua

SEQ ID NO: 473363 - RNA, 14 nt, Homo sapiens
cuccgcuacuucca

SEQ ID NO: 473364 - RNA, 15 nt, Homo sapiens
cuccgcuacuuccag

SEQ ID NO: 473365 - RNA, 18 nt, Homo sapiens
cuccuagacucugugauc

SEQ ID NO: 473366 - RNA, 17 nt, Homo sapiens
cuccugaccucagguga

SEQ ID NO: 473367 - RNA, 20 nt, Homo sapiens
cuccugaccucaggugaucc

SEQ ID NO: 473368 - RNA, 17 nt, Homo sapiens
cuccuuccagcacugac

SEQ ID NO: 473369 - RNA, 23 nt, Homo sapiens
cuccuugaguuuuccugcugcga

SEQ ID NO: 473370 - RNA, 15 nt, Homo sapiens
cucgacucacugcaa

SEQ ID NO: 473371 - RNA, 15 nt, Homo sapiens
cucgcccacuuccuc

SEQ ID NO: 473372 - RNA, 20 nt, Homo sapiens
cucgcuuccgcauccuaguc

SEQ ID NO: 473373 - RNA, 21 nt, Homo sapiens
cucguuucugauuaaugcuaa

SEQ ID NO: 473374 - RNA, 23 nt, Homo sapiens
cucuaauucuagagucucuguua

SEQ ID NO: 473375 - RNA, 22 nt, Homo sapiens
cucuaucauuaaaguucuagug

SEQ ID NO: 473376 - RNA, 17 nt, Homo sapiens
cucuccuccauguugcc

SEQ ID NO: 473377 - RNA, 20 nt, Homo sapiens
cucucuucaauaaaccacaa

SEQ ID NO: 473378 - RNA, 21 nt, Homo sapiens
cucugagcagugcuugaauga

SEQ ID NO: 473379 - RNA, 13 nt, Homo sapiens
cucugagggugau

SEQ ID NO: 473380 - RNA, 14 nt, Homo sapiens
cucugccgcugcca

SEQ ID NO: 473381 - RNA, 24 nt, Homo sapiens
cucugcugccgccccacccagaug

SEQ ID NO: 473382 - RNA, 20 nt, Homo sapiens
cucuuaagugugcacagaua

SEQ ID NO: 473383 - RNA, 15 nt, Homo sapiens
cucuuacaaaacucu

SEQ ID NO: 473384 - RNA, 23 nt, Homo sapiens
cucuuagaugcaguucugaagaa

SEQ ID NO: 473385 - RNA, 16 nt, Homo sapiens
cucuuaggcaaucaca

SEQ ID NO: 473386 - RNA, 15 nt, Homo sapiens
cucuuauuugcucac

SEQ ID NO: 473387 - RNA, 22 nt, Homo sapiens
cucuucaauaaaccacaagcau

SEQ ID NO: 473388 - RNA, 16 nt, Homo sapiens
cucuugaagacacuga

SEQ ID NO: 473389 - RNA, 20 nt, Homo sapiens
cucuuggguucaagugauuc

SEQ ID NO: 473390 - RNA, 12 nt, Homo sapiens
cucuuucgccaa

SEQ ID NO: 473391 - RNA, 22 nt, Homo sapiens
cugaaaccuguucuaccaauua

SEQ ID NO: 473392 - RNA, 16 nt, Homo sapiens
cugaagccaaagccaa

SEQ ID NO: 473393 - RNA, 17 nt, Homo sapiens
cugaaggagauuuuccu

SEQ ID NO: 473394 - RNA, 19 nt, Homo sapiens
cugaauguuagauaguuac

SEQ ID NO: 473395 - RNA, 21 nt, Homo sapiens
cugacuauugaaguugcagau

SEQ ID NO: 473396 - RNA, 22 nt, Homo sapiens
cugaggcaggagaauugcuuga

SEQ ID NO: 473397 - RNA, 20 nt, Homo sapiens
cugagugccuggccaaaggg

SEQ ID NO: 473398 - RNA, 13 nt, Homo sapiens
cugaugcaagcaa

SEQ ID NO: 473399 - RNA, 22 nt, Homo sapiens
cugauuaaaaaaucucccaaag

SEQ ID NO: 473400 - RNA, 22 nt, Homo sapiens
cugauucugucaaugucuugaa

SEQ ID NO: 473401 - RNA, 22 nt, Homo sapiens
cugcaaccuucgccucccagga

SEQ ID NO: 473402 - RNA, 19 nt, Homo sapiens
cugcacaaacucaccaucu

SEQ ID NO: 473403 - RNA, 20 nt, Homo sapiens
cugcacauaaguuaugguuu

SEQ ID NO: 473404 - RNA, 11 nt, Homo sapiens
cugccaccacc

SEQ ID NO: 473405 - RNA, 19 nt, Homo sapiens
cugccuaaaauaugauguu

SEQ ID NO: 473406 - RNA, 19 nt, Homo sapiens
cugccucugucucacugaa

SEQ ID NO: 473407 - RNA, 16 nt, Homo sapiens
cugcuaccucacuggg

SEQ ID NO: 473408 - RNA, 14 nt, Homo sapiens
cugcuccagccucu

SEQ ID NO: 473409 - RNA, 14 nt, Homo sapiens
cugcucuaauauca

SEQ ID NO: 473410 - RNA, 11 nt, Homo sapiens
cugcuugccau

SEQ ID NO: 473411 - RNA, 13 nt, Homo sapiens
cugcuugccaucc

SEQ ID NO: 473412 - RNA, 21 nt, Homo sapiens
cuggaggcagaaucccggcug

SEQ ID NO: 473413 - RNA, 20 nt, Homo sapiens
cuggagggagaacccaaaga

SEQ ID NO: 473414 - RNA, 17 nt, Homo sapiens
cuggaguccugcucugu

SEQ ID NO: 473415 - RNA, 20 nt, Homo sapiens
cuggagugcaguggcacgau

SEQ ID NO: 473416 - RNA, 22 nt, Homo sapiens
cuggcaacagagcgagauucca

SEQ ID NO: 473417 - RNA, 22 nt, Homo sapiens
cuggcaucucccacacaagacc

SEQ ID NO: 473418 - RNA, 21 nt, Homo sapiens
cugggauauuuccauauggca

SEQ ID NO: 473419 - RNA, 20 nt, Homo sapiens
cuggguaaaugcagcgugaa

SEQ ID NO: 473420 - RNA, 15 nt, Homo sapiens
cuggguucaaaaaga

SEQ ID NO: 473421 - RNA, 17 nt, Homo sapiens
cugguaauuuguaucug

SEQ ID NO: 473422 - RNA, 22 nt, Homo sapiens
cuggucccagccagcaguucag

SEQ ID NO: 473423 - RNA, 23 nt, Homo sapiens
cuggugggcuagccaauagaguu

SEQ ID NO: 473424 - RNA, 17 nt, Homo sapiens
cuguacuaaaaauacaa

SEQ ID NO: 473425 - RNA, 12 nt, Homo sapiens
cuguaugauucc

SEQ ID NO: 473426 - RNA, 19 nt, Homo sapiens
cugucaauacuauggagua

SEQ ID NO: 473427 - RNA, 23 nt, Homo sapiens
cugugauucgguggagacuauca

SEQ ID NO: 473428 - RNA, 15 nt, Homo sapiens
cuguggcugcuagca

SEQ ID NO: 473429 - RNA, 21 nt, Homo sapiens
cuguggcugcuagcacuugga

SEQ ID NO: 473430 - RNA, 22 nt, Homo sapiens
cuguggguagacacacaugaag

SEQ ID NO: 473431 - RNA, 21 nt, Homo sapiens
cuguguacagaauucugcuac

SEQ ID NO: 473432 - RNA, 16 nt, Homo sapiens
cugugugaacguguau

SEQ ID NO: 473433 - RNA, 11 nt, Homo sapiens
cuguuccugcc

SEQ ID NO: 473434 - RNA, 22 nt, Homo sapiens
cuguucuauucaucucaaggaa

SEQ ID NO: 473435 - RNA, 13 nt, Homo sapiens
cuuaaaauuguau

SEQ ID NO: 473436 - RNA, 15 nt, Homo sapiens
cuuaacucaccauaa

SEQ ID NO: 473437 - RNA, 14 nt, Homo sapiens
cuuaauaaugugua

SEQ ID NO: 473438 - RNA, 17 nt, Homo sapiens
cuuaaucuuauggggcc

SEQ ID NO: 473439 - RNA, 20 nt, Homo sapiens
cuuaaugaaugaaugaauuc

SEQ ID NO: 473440 - RNA, 15 nt, Homo sapiens
cuuacauaugcaaaa

SEQ ID NO: 473441 - RNA, 18 nt, Homo sapiens
cuuaccuaccacaugcca

SEQ ID NO: 473442 - RNA, 14 nt, Homo sapiens
cuuacugcaggcaa

SEQ ID NO: 473443 - RNA, 18 nt, Homo sapiens
cuuagguuguagcagaaa

SEQ ID NO: 473444 - RNA, 23 nt, Homo sapiens
cuuaguccaauuccuugcacaua

SEQ ID NO: 473445 - RNA, 20 nt, Homo sapiens
cuuaguugcaugaccacaua

SEQ ID NO: 473446 - RNA, 14 nt, Homo sapiens
cuuauaaaaucaaa

SEQ ID NO: 473447 - RNA, 22 nt, Homo sapiens
cuuaucaguaguaucaaugauu

SEQ ID NO: 473448 - RNA, 15 nt, Homo sapiens
cuuauccuguucucu

SEQ ID NO: 473449 - RNA, 14 nt, Homo sapiens
cuuauucucaagaa

SEQ ID NO: 473450 - RNA, 14 nt, Homo sapiens
cuuauugacuauua

SEQ ID NO: 473451 - RNA, 23 nt, Homo sapiens
cuuauuugagugauuauuuguua

SEQ ID NO: 473452 - RNA, 17 nt, Homo sapiens
cuucagggaacugcaua

SEQ ID NO: 473453 - RNA, 16 nt, Homo sapiens
cuucaugcauuugcac

SEQ ID NO: 473454 - RNA, 19 nt, Homo sapiens
cuuccaaacagaacuaugg

SEQ ID NO: 473455 - RNA, 21 nt, Homo sapiens
cuuccacacucaccucuaaaa

SEQ ID NO: 473456 - RNA, 18 nt, Homo sapiens
cuuccagugcaacacuga

SEQ ID NO: 473457 - RNA, 20 nt, Homo sapiens
cuucccaggaguacacccca

SEQ ID NO: 473458 - RNA, 13 nt, Homo sapiens
cuuccucacacca

SEQ ID NO: 473459 - RNA, 15 nt, Homo sapiens
cuucugauacgugua

SEQ ID NO: 473460 - RNA, 19 nt, Homo sapiens
cuucuuaggguuaugauua

SEQ ID NO: 473461 - RNA, 14 nt, Homo sapiens
cuugaacacugggg

SEQ ID NO: 473462 - RNA, 18 nt, Homo sapiens
cuugaagacaauggcuua

SEQ ID NO: 473463 - RNA, 15 nt, Homo sapiens
cuugaagacacugaa

SEQ ID NO: 473464 - RNA, 16 nt, Homo sapiens
cuugaagacacugaaa

SEQ ID NO: 473465 - RNA, 22 nt, Homo sapiens
cuugaggguaauaaacuuagaa

SEQ ID NO: 473466 - RNA, 21 nt, Homo sapiens
cuugauaagaccaccaccuca

SEQ ID NO: 473467 - RNA, 14 nt, Homo sapiens
cuugccaucccucc

SEQ ID NO: 473468 - RNA, 16 nt, Homo sapiens
cuuggccucccaaagu

SEQ ID NO: 473469 - RNA, 20 nt, Homo sapiens
cuugggcaugggggagccuu

SEQ ID NO: 473470 - RNA, 18 nt, Homo sapiens
cuuggugcuaaaccacaa

SEQ ID NO: 473471 - RNA, 20 nt, Homo sapiens
cuugguuugaguuucucuca

SEQ ID NO: 473472 - RNA, 23 nt, Homo sapiens
cuuguaaaugugguaaagaguua

SEQ ID NO: 473473 - RNA, 12 nt, Homo sapiens
cuugucauccac

SEQ ID NO: 473474 - RNA, 14 nt, Homo sapiens
cuuguguuuuuaac

SEQ ID NO: 473475 - RNA, 24 nt, Homo sapiens
cuuucaggccacauggcuaaagaa

SEQ ID NO: 473476 - RNA, 14 nt, Homo sapiens
cuuuccacauucag

SEQ ID NO: 473477 - RNA, 21 nt, Homo sapiens
cuuuccuggacuuaacucuaa

SEQ ID NO: 473478 - RNA, 15 nt, Homo sapiens
cuuucugcacauaag

SEQ ID NO: 473479 - RNA, 17 nt, Homo sapiens
cuuugaucuucagggaa

SEQ ID NO: 473480 - RNA, 21 nt, Homo sapiens
cuuugcauagcagcugcuacu

SEQ ID NO: 473481 - RNA, 18 nt, Homo sapiens
cuuugcuucucucucuaa

SEQ ID NO: 473482 - RNA, 15 nt, Homo sapiens
cuuuggaaaucacac

SEQ ID NO: 473483 - RNA, 20 nt, Homo sapiens
cuuuggaauacuucuaccau

SEQ ID NO: 473484 - RNA, 19 nt, Homo sapiens
cuuuggaugggucacuugu

SEQ ID NO: 473485 - RNA, 18 nt, Homo sapiens
cuuuugggaauggacuca

SEQ ID NO: 473486 - RNA, 22 nt, Homo sapiens
gaaaaacuaaggauaaaaucua

SEQ ID NO: 473487 - RNA, 17 nt, Homo sapiens
gaaaacaguauuuucca

SEQ ID NO: 473488 - RNA, 13 nt, Homo sapiens
gaaaacauuccau

SEQ ID NO: 473489 - RNA, 19 nt, Homo sapiens
gaaaaggaaggcucuucuc

SEQ ID NO: 473490 - RNA, 23 nt, Homo sapiens
gaaaaugauugcuuaucaguagu

SEQ ID NO: 473491 - RNA, 19 nt, Homo sapiens
gaaacauuuggaagcccca

SEQ ID NO: 473492 - RNA, 13 nt, Homo sapiens
gaaaccacagcug

SEQ ID NO: 473493 - RNA, 20 nt, Homo sapiens
gaaacccguguaucugggau

SEQ ID NO: 473494 - RNA, 17 nt, Homo sapiens
gaaacuaacacagccau

SEQ ID NO: 473495 - RNA, 14 nt, Homo sapiens
gaaagaagugggga

SEQ ID NO: 473496 - RNA, 17 nt, Homo sapiens
gaaagaggaagcuuucu

SEQ ID NO: 473497 - RNA, 18 nt, Homo sapiens
gaaagcaucacuugggau

SEQ ID NO: 473498 - RNA, 22 nt, Homo sapiens
gaaaggcaaaugcccaagggaa

SEQ ID NO: 473499 - RNA, 22 nt, Homo sapiens
gaaaggguucagggcaugggga

SEQ ID NO: 473500 - RNA, 19 nt, Homo sapiens
gaaagucaacauguaguaa

SEQ ID NO: 473501 - RNA, 19 nt, Homo sapiens
gaaauaaaguuggugacag

SEQ ID NO: 473502 - RNA, 15 nt, Homo sapiens
gaaaucgaugagaaa

SEQ ID NO: 473503 - RNA, 19 nt, Homo sapiens
gaaaucuaugaaauaucau

SEQ ID NO: 473504 - RNA, 16 nt, Homo sapiens
gaacaaucaaggcaac

SEQ ID NO: 473505 - RNA, 14 nt, Homo sapiens
gaacacaaggucau

SEQ ID NO: 473506 - RNA, 19 nt, Homo sapiens
gaacagaagggcuaacuca

SEQ ID NO: 473507 - RNA, 23 nt, Homo sapiens
gaacagccgcuccugucugccag

SEQ ID NO: 473508 - RNA, 15 nt, Homo sapiens
gaaccaggcaacuug

SEQ ID NO: 473509 - RNA, 17 nt, Homo sapiens
gaaccuagaagggcuag

SEQ ID NO: 473510 - RNA, 15 nt, Homo sapiens
gaacgaguuguuggc

SEQ ID NO: 473511 - RNA, 13 nt, Homo sapiens
gaacuagaaccug

SEQ ID NO: 473512 - RNA, 12 nt, Homo sapiens
gaacucugagca

SEQ ID NO: 473513 - RNA, 19 nt, Homo sapiens
gaagaaauuccaggaaaau

SEQ ID NO: 473514 - RNA, 20 nt, Homo sapiens
gaagaacuugucccucaggc

SEQ ID NO: 473515 - RNA, 17 nt, Homo sapiens
gaagaaucuguuuccca

SEQ ID NO: 473516 - RNA, 19 nt, Homo sapiens
gaagacuauauuguacaca

SEQ ID NO: 473517 - RNA, 12 nt, Homo sapiens
gaagacuguggc

SEQ ID NO: 473518 - RNA, 20 nt, Homo sapiens
gaagacuuuaaaccaccuag

SEQ ID NO: 473519 - RNA, 17 nt, Homo sapiens
gaagagaaugugacagg

SEQ ID NO: 473520 - RNA, 17 nt, Homo sapiens
gaagagauugagcuacu

SEQ ID NO: 473521 - RNA, 15 nt, Homo sapiens
gaagaugaugcuauu

SEQ ID NO: 473522 - RNA, 17 nt, Homo sapiens
gaagauguuuugaaaug

SEQ ID NO: 473523 - RNA, 18 nt, Homo sapiens
gaagauuuaccacuugug

SEQ ID NO: 473524 - RNA, 17 nt, Homo sapiens
gaagcaccaaucaugaa

SEQ ID NO: 473525 - RNA, 16 nt, Homo sapiens
gaagcagcucaaggga

SEQ ID NO: 473526 - RNA, 22 nt, Homo sapiens
gaaggagagcucuuugugaaug

SEQ ID NO: 473527 - RNA, 12 nt, Homo sapiens
gaaggagggaga

SEQ ID NO: 473528 - RNA, 14 nt, Homo sapiens
gaaggcaaugccau

SEQ ID NO: 473529 - RNA, 17 nt, Homo sapiens
gaaggggacgcuuugaa

SEQ ID NO: 473530 - RNA, 20 nt, Homo sapiens
gaagucuucuccuccaugaa

SEQ ID NO: 473531 - RNA, 12 nt, Homo sapiens
gaagugccaguu

SEQ ID NO: 473532 - RNA, 16 nt, Homo sapiens
gaagugugugaucugu

SEQ ID NO: 473533 - RNA, 14 nt, Homo sapiens
gaaguuaaagggca

SEQ ID NO: 473534 - RNA, 20 nt, Homo sapiens
gaaguuuugacaucaaugau

SEQ ID NO: 473535 - RNA, 13 nt, Homo sapiens
gaauaauccagaa

SEQ ID NO: 473536 - RNA, 22 nt, Homo sapiens
gaauaguguuggaaaaugugca

SEQ ID NO: 473537 - RNA, 20 nt, Homo sapiens
gaaucaaggugauugugauu

SEQ ID NO: 473538 - RNA, 14 nt, Homo sapiens
gaaucacuugacuu

SEQ ID NO: 473539 - RNA, 17 nt, Homo sapiens
gaaugagaagaaugacu

SEQ ID NO: 473540 - RNA, 15 nt, Homo sapiens
gaaugagagacacac

SEQ ID NO: 473541 - RNA, 21 nt, Homo sapiens
gaaugcauuauuuauugcugu

SEQ ID NO: 473542 - RNA, 22 nt, Homo sapiens
gaaugggagcauaugugagaaa

SEQ ID NO: 473543 - RNA, 17 nt, Homo sapiens
gaauuacaggcacauac

SEQ ID NO: 473544 - RNA, 22 nt, Homo sapiens
gaauucugcuaccucacugggg

SEQ ID NO: 473545 - RNA, 13 nt, Homo sapiens
gaauugcagagua

SEQ ID NO: 473546 - RNA, 14 nt, Homo sapiens
gaauuuucuuccaa

SEQ ID NO: 473547 - RNA, 13 nt, Homo sapiens
gacaaagggaaau

SEQ ID NO: 473548 - RNA, 14 nt, Homo sapiens
gacaaaucaaagca

SEQ ID NO: 473549 - RNA, 22 nt, Homo sapiens
gacaaaucuaugccacucagaa

SEQ ID NO: 473550 - RNA, 15 nt, Homo sapiens
gacacugauaugggu

SEQ ID NO: 473551 - RNA, 18 nt, Homo sapiens
gacacugcugaaccuuuc

SEQ ID NO: 473552 - RNA, 17 nt, Homo sapiens
gacagagaccuccugcc

SEQ ID NO: 473553 - RNA, 15 nt, Homo sapiens
gacaggguucauuga

SEQ ID NO: 473554 - RNA, 19 nt, Homo sapiens
gacaugaagggaugcugca

SEQ ID NO: 473555 - RNA, 23 nt, Homo sapiens
gacaugaagggaugcugcaaugu

SEQ ID NO: 473556 - RNA, 16 nt, Homo sapiens
gacauucucaucacca

SEQ ID NO: 473557 - RNA, 21 nt, Homo sapiens
gacauuuauuuuucucaugaa

SEQ ID NO: 473558 - RNA, 19 nt, Homo sapiens
gacauuugcucauggaauu

SEQ ID NO: 473559 - RNA, 19 nt, Homo sapiens
gacauuuugaucacucuuu

SEQ ID NO: 473560 - RNA, 16 nt, Homo sapiens
gaccaggcaaugugac

SEQ ID NO: 473561 - RNA, 20 nt, Homo sapiens
gaccaguuuaaccugaugca

SEQ ID NO: 473562 - RNA, 13 nt, Homo sapiens
gaccccaauccaa

SEQ ID NO: 473563 - RNA, 17 nt, Homo sapiens
gaccucaggugcuaggg

SEQ ID NO: 473564 - RNA, 17 nt, Homo sapiens
gaccuuucagcugugaa

SEQ ID NO: 473565 - RNA, 15 nt, Homo sapiens
gacgcugcugccgug

SEQ ID NO: 473566 - RNA, 22 nt, Homo sapiens
gacgugcacugagagugaagug

SEQ ID NO: 473567 - RNA, 20 nt, Homo sapiens
gacuauggcucuacuuucag

SEQ ID NO: 473568 - RNA, 23 nt, Homo sapiens
gacuauucccuucuaaccugaac

SEQ ID NO: 473569 - RNA, 16 nt, Homo sapiens
gacuauuuaacuugag

SEQ ID NO: 473570 - RNA, 16 nt, Homo sapiens
gacucaaaacccaucu

SEQ ID NO: 473571 - RNA, 19 nt, Homo sapiens
gacucaccuugcucugcca

SEQ ID NO: 473572 - RNA, 21 nt, Homo sapiens
gacucagggccccagcacuaa

SEQ ID NO: 473573 - RNA, 21 nt, Homo sapiens
gacuccuaggcaggacaugcu

SEQ ID NO: 473574 - RNA, 23 nt, Homo sapiens
gacucuccagaaagcucaucuca

SEQ ID NO: 473575 - RNA, 16 nt, Homo sapiens
gacucugucucaaaaa

SEQ ID NO: 473576 - RNA, 22 nt, Homo sapiens
gacugaucgauuugcacccacc

SEQ ID NO: 473577 - RNA, 18 nt, Homo sapiens
gacugcugacauuuugca

SEQ ID NO: 473578 - RNA, 19 nt, Homo sapiens
gacugucaguaggcuggaa

SEQ ID NO: 473579 - RNA, 20 nt, Homo sapiens
gacugucaguaggcuggaag

SEQ ID NO: 473580 - RNA, 13 nt, Homo sapiens
gacuuaacucuaa

SEQ ID NO: 473581 - RNA, 20 nt, Homo sapiens
gacuucaaaaacugucaaag

SEQ ID NO: 473582 - RNA, 14 nt, Homo sapiens
gagaaaagacauaa

SEQ ID NO: 473583 - RNA, 23 nt, Homo sapiens
gagaaaucauuauuaaaugaagc

SEQ ID NO: 473584 - RNA, 13 nt, Homo sapiens
gagaacacuguga

SEQ ID NO: 473585 - RNA, 21 nt, Homo sapiens
gagaaugagagacacacugaa

SEQ ID NO: 473586 - RNA, 23 nt, Homo sapiens
gagacaaaucuaugccacucaga

SEQ ID NO: 473587 - RNA, 23 nt, Homo sapiens
gagacaagaaauccuaguggccu

SEQ ID NO: 473588 - RNA, 19 nt, Homo sapiens
gagacaugagcauggcuga

SEQ ID NO: 473589 - RNA, 22 nt, Homo sapiens
gagaccaggcaaagcaagugau

SEQ ID NO: 473590 - RNA, 22 nt, Homo sapiens
gagacuccuaggcaggacaugc

SEQ ID NO: 473591 - RNA, 15 nt, Homo sapiens
gagacugcugaguca

SEQ ID NO: 473592 - RNA, 21 nt, Homo sapiens
gagagcucuuugugaauguga

SEQ ID NO: 473593 - RNA, 22 nt, Homo sapiens
gagaggcaaaggcucucacucc

SEQ ID NO: 473594 - RNA, 14 nt, Homo sapiens
gagauggccugaga

SEQ ID NO: 473595 - RNA, 20 nt, Homo sapiens
gagaugggguuucacugugu

SEQ ID NO: 473596 - RNA, 17 nt, Homo sapiens
gagauugagcuacuuca

SEQ ID NO: 473597 - RNA, 21 nt, Homo sapiens
gagcaaagucuaaaguuuaca

SEQ ID NO: 473598 - RNA, 15 nt, Homo sapiens
gagcagaacuuucac

SEQ ID NO: 473599 - RNA, 11 nt, Homo sapiens
gagcagggauu

SEQ ID NO: 473600 - RNA, 23 nt, Homo sapiens
gagcaguagcagcagcaucucug

SEQ ID NO: 473601 - RNA, 20 nt, Homo sapiens
gagcagugcuugaaugaagu

SEQ ID NO: 473602 - RNA, 19 nt, Homo sapiens
gagcauuuauaaauggaca

SEQ ID NO: 473603 - RNA, 13 nt, Homo sapiens
gagccaaggguuc

SEQ ID NO: 473604 - RNA, 16 nt, Homo sapiens
gagccacguauguuuu

SEQ ID NO: 473605 - RNA, 15 nt, Homo sapiens
gagccagucccucag

SEQ ID NO: 473606 - RNA, 16 nt, Homo sapiens
gagccagucccucagc

SEQ ID NO: 473607 - RNA, 18 nt, Homo sapiens
gagccauguuaauguaau

SEQ ID NO: 473608 - RNA, 13 nt, Homo sapiens
gagcccaguuuca

SEQ ID NO: 473609 - RNA, 16 nt, Homo sapiens
gagccuuuggccagaa

SEQ ID NO: 473610 - RNA, 13 nt, Homo sapiens
gagcgagauucca

SEQ ID NO: 473611 - RNA, 14 nt, Homo sapiens
gagcgguaugcucu

SEQ ID NO: 473612 - RNA, 13 nt, Homo sapiens
gagcuagaaccug

SEQ ID NO: 473613 - RNA, 16 nt, Homo sapiens
gagcucuuugugaaug

SEQ ID NO: 473614 - RNA, 16 nt, Homo sapiens
gagcugggauguuucu

SEQ ID NO: 473615 - RNA, 17 nt, Homo sapiens
gagcuguguucuugcca

SEQ ID NO: 473616 - RNA, 18 nt, Homo sapiens
gagcuugacuucaugcca

SEQ ID NO: 473617 - RNA, 20 nt, Homo sapiens
gaggaagugcacuggcccuc

SEQ ID NO: 473618 - RNA, 20 nt, Homo sapiens
gaggcagagguugcagugag

SEQ ID NO: 473619 - RNA, 18 nt, Homo sapiens
gaggcagcuguugcagug

SEQ ID NO: 473620 - RNA, 19 nt, Homo sapiens
gaggcagcuguugcaguga

SEQ ID NO: 473621 - RNA, 20 nt, Homo sapiens
gaggcagcuguugcagugag

SEQ ID NO: 473622 - RNA, 20 nt, Homo sapiens
gaggcaggagaaucacuuga

SEQ ID NO: 473623 - RNA, 18 nt, Homo sapiens
gaggcaggagaauugcuu

SEQ ID NO: 473624 - RNA, 20 nt, Homo sapiens
gaggcaggagaauugcuuga

SEQ ID NO: 473625 - RNA, 22 nt, Homo sapiens
gaggccccuucuagguggcaag

SEQ ID NO: 473626 - RNA, 19 nt, Homo sapiens
gaggccuuccagggacgaa

SEQ ID NO: 473627 - RNA, 16 nt, Homo sapiens
gaggcuaccucaccug

SEQ ID NO: 473628 - RNA, 23 nt, Homo sapiens
gaggcuuagcuuugcucugccaa

SEQ ID NO: 473629 - RNA, 22 nt, Homo sapiens
gagggauaguggggucagggcu

SEQ ID NO: 473630 - RNA, 17 nt, Homo sapiens
gagggugagacacugca

SEQ ID NO: 473631 - RNA, 18 nt, Homo sapiens
gaguagagggcacugggu

SEQ ID NO: 473632 - RNA, 16 nt, Homo sapiens
gagucuggguccaggc

SEQ ID NO: 473633 - RNA, 20 nt, Homo sapiens
gagugcaguggcacgaucuc

SEQ ID NO: 473634 - RNA, 14 nt, Homo sapiens
gagugcccccaaca

SEQ ID NO: 473635 - RNA, 20 nt, Homo sapiens
gagugccuggccaaagggau

SEQ ID NO: 473636 - RNA, 19 nt, Homo sapiens
gaguggaacagaaggggug

SEQ ID NO: 473637 - RNA, 18 nt, Homo sapiens
gagugguggcagcucaaa

SEQ ID NO: 473638 - RNA, 13 nt, Homo sapiens
gaguucuccagac

SEQ ID NO: 473639 - RNA, 18 nt, Homo sapiens
gaguugggacaauugcuu

SEQ ID NO: 473640 - RNA, 13 nt, Homo sapiens
gauaaagcacugu

SEQ ID NO: 473641 - RNA, 22 nt, Homo sapiens
gauaagaccaccaccucagagu

SEQ ID NO: 473642 - RNA, 21 nt, Homo sapiens
gauaagagggcacacacugug

SEQ ID NO: 473643 - RNA, 20 nt, Homo sapiens
gauaaucacaauacaucccu

SEQ ID NO: 473644 - RNA, 22 nt, Homo sapiens
gauacaaauugcagacugugua

SEQ ID NO: 473645 - RNA, 17 nt, Homo sapiens
gauaguggggucagggc

SEQ ID NO: 473646 - RNA, 20 nt, Homo sapiens
gaucaaaguguaaacaccau

SEQ ID NO: 473647 - RNA, 19 nt, Homo sapiens
gaucacgccauugcacucc

SEQ ID NO: 473648 - RNA, 24 nt, Homo sapiens
gaucacucuuugcacacucuugug

SEQ ID NO: 473649 - RNA, 16 nt, Homo sapiens
gaucccaucuugauaa

SEQ ID NO: 473650 - RNA, 20 nt, Homo sapiens
gauccccaaaacaggccagg

SEQ ID NO: 473651 - RNA, 22 nt, Homo sapiens
gauccuaaaacaaaagcucauc

SEQ ID NO: 473652 - RNA, 15 nt, Homo sapiens
gaucgauuugcaccc

SEQ ID NO: 473653 - RNA, 20 nt, Homo sapiens
gaucgcaccagugcacucca

SEQ ID NO: 473654 - RNA, 22 nt, Homo sapiens
gaucucugcuuuggaaaucaca

SEQ ID NO: 473655 - RNA, 15 nt, Homo sapiens
gaugagacuacuuca

SEQ ID NO: 473656 - RNA, 21 nt, Homo sapiens
gaugagaguacaccccaacag

SEQ ID NO: 473657 - RNA, 13 nt, Homo sapiens
gaugcaagcaaga

SEQ ID NO: 473658 - RNA, 14 nt, Homo sapiens
gaugcccacuuccc

SEQ ID NO: 473659 - RNA, 14 nt, Homo sapiens
gaugcuacugcugc

SEQ ID NO: 473660 - RNA, 14 nt, Homo sapiens
gauggggcaucggu

SEQ ID NO: 473661 - RNA, 21 nt, Homo sapiens
gaugggggaaagcacaggugg

SEQ ID NO: 473662 - RNA, 14 nt, Homo sapiens
gauguccucaccac

SEQ ID NO: 473663 - RNA, 18 nt, Homo sapiens
gaugucguuugaaucaca

SEQ ID NO: 473664 - RNA, 23 nt, Homo sapiens
gauguggcugaaccgagcuggag

SEQ ID NO: 473665 - RNA, 23 nt, Homo sapiens
gauguuuugugaccagguuugug

SEQ ID NO: 473666 - RNA, 22 nt, Homo sapiens
gauuaaguaaugauaacuggaa

SEQ ID NO: 473667 - RNA, 14 nt, Homo sapiens
gauuaaugcuaaau

SEQ ID NO: 473668 - RNA, 20 nt, Homo sapiens
gauuagguguucaggccagu

SEQ ID NO: 473669 - RNA, 16 nt, Homo sapiens
gauucucgcuuaaaaa

SEQ ID NO: 473670 - RNA, 22 nt, Homo sapiens
gauugaguuuucuucugugauu

SEQ ID NO: 473671 - RNA, 15 nt, Homo sapiens
gauugcaauuugcac

SEQ ID NO: 473672 - RNA, 22 nt, Homo sapiens
gauuguugaaagccaugaggga

SEQ ID NO: 473673 - RNA, 23 nt, Homo sapiens
gauuuauauuuuaaagcuuggug

SEQ ID NO: 473674 - RNA, 23 nt, Homo sapiens
gauuuuggggagacaaagggaaa

SEQ ID NO: 473675 - RNA, 15 nt, Homo sapiens
gcaaaaauauaccuu

SEQ ID NO: 473676 - RNA, 18 nt, Homo sapiens
gcaaagauccccaaaaca

SEQ ID NO: 473677 - RNA, 16 nt, Homo sapiens
gcaaagauuugcuuua

SEQ ID NO: 473678 - RNA, 18 nt, Homo sapiens
gcaaagauuugcuuuaau

SEQ ID NO: 473679 - RNA, 22 nt, Homo sapiens
gcaacagcaaaucacgaccacu

SEQ ID NO: 473680 - RNA, 19 nt, Homo sapiens
gcaaccuuuggaugcacuu

SEQ ID NO: 473681 - RNA, 16 nt, Homo sapiens
gcaagcucccaaggga

SEQ ID NO: 473682 - RNA, 17 nt, Homo sapiens
gcaauugcucaugcaua

SEQ ID NO: 473683 - RNA, 22 nt, Homo sapiens
gcacacugccagucucacugug

SEQ ID NO: 473684 - RNA, 15 nt, Homo sapiens
gcacagaagacagca

SEQ ID NO: 473685 - RNA, 17 nt, Homo sapiens
gcacauaccacugcacc

SEQ ID NO: 473686 - RNA, 18 nt, Homo sapiens
gcacaucaaaauaugccc

SEQ ID NO: 473687 - RNA, 15 nt, Homo sapiens
gcacgaacaccaagu

SEQ ID NO: 473688 - RNA, 13 nt, Homo sapiens
gcacuuauucuca

SEQ ID NO: 473689 - RNA, 16 nt, Homo sapiens
gcagaaaauugccuaa

SEQ ID NO: 473690 - RNA, 22 nt, Homo sapiens
gcagaaaggaaaagauuccugu

SEQ ID NO: 473691 - RNA, 20 nt, Homo sapiens
uaaacacaaagcuguugaaa

SEQ ID NO: 473692 - RNA, 15 nt, Homo sapiens
uaaagcaaggccuug

SEQ ID NO: 473693 - RNA, 20 nt, Homo sapiens
uaaagcaaggccuugagcaa

SEQ ID NO: 473694 - RNA, 17 nt, Homo sapiens
uaaagcuuugugcagau

SEQ ID NO: 473695 - RNA, 17 nt, Homo sapiens
uaaaggcuaaaagggaa

SEQ ID NO: 473696 - RNA, 14 nt, Homo sapiens
uaaaguaugugcau

SEQ ID NO: 473697 - RNA, 12 nt, Homo sapiens
uaaauacuguuu

SEQ ID NO: 473698 - RNA, 16 nt, Homo sapiens
uaaaucauuaagacaa

SEQ ID NO: 473699 - RNA, 19 nt, Homo sapiens
uaaaugaauaaaacauuug

SEQ ID NO: 473700 - RNA, 23 nt, Homo sapiens
uaaauuaugcuuucuauuuugag

SEQ ID NO: 473701 - RNA, 17 nt, Homo sapiens
uaaauuguuugaccaug

SEQ ID NO: 473702 - RNA, 18 nt, Homo sapiens
uaaauuuuauuccaaaau

SEQ ID NO: 473703 - RNA, 15 nt, Homo sapiens
uaacaauugugaagu

SEQ ID NO: 473704 - RNA, 14 nt, Homo sapiens
uaacuauguugaua

SEQ ID NO: 473705 - RNA, 17 nt, Homo sapiens
uaacucaauauuuucca

SEQ ID NO: 473706 - RNA, 19 nt, Homo sapiens
uaacucuccuccauguugc

SEQ ID NO: 473707 - RNA, 12 nt, Homo sapiens
uaagaagacugc

SEQ ID NO: 473708 - RNA, 18 nt, Homo sapiens
uaagagaagcuacuuugu

SEQ ID NO: 473709 - RNA, 19 nt, Homo sapiens
uaagagggcacacacugug

SEQ ID NO: 473710 - RNA, 22 nt, Homo sapiens
uaagagggcacacacuguguac

SEQ ID NO: 473711 - RNA, 16 nt, Homo sapiens
uaagaugaaaggagaa

SEQ ID NO: 473712 - RNA, 17 nt, Homo sapiens
uaagccuuccacacuca

SEQ ID NO: 473713 - RNA, 15 nt, Homo sapiens
uaaguaaugaugucg

SEQ ID NO: 473714 - RNA, 14 nt, Homo sapiens
uaagugcaugacau

SEQ ID NO: 473715 - RNA, 14 nt, Homo sapiens
uaauaaguacugug

SEQ ID NO: 473716 - RNA, 13 nt, Homo sapiens
uaaucccagcacu

SEQ ID NO: 473717 - RNA, 15 nt, Homo sapiens
uaaugauaacuggaa

SEQ ID NO: 473718 - RNA, 23 nt, Homo sapiens
uaaugaugucguuugaaucacag

SEQ ID NO: 473719 - RNA, 13 nt, Homo sapiens
uaaugcaccugaa

SEQ ID NO: 473720 - RNA, 14 nt, Homo sapiens
uaauucuagagucu

SEQ ID NO: 473721 - RNA, 14 nt, Homo sapiens
uaauucugucacuc

SEQ ID NO: 473722 - RNA, 12 nt, Homo sapiens
uaauuuaaucuu

SEQ ID NO: 473723 - RNA, 17 nt, Homo sapiens
uaauuuccauaguguga

SEQ ID NO: 473724 - RNA, 23 nt, Homo sapiens
uaauuuuuuugugggaaauccac

SEQ ID NO: 473725 - RNA, 20 nt, Homo sapiens
uacaaaaauuagccgggcau

SEQ ID NO: 473726 - RNA, 21 nt, Homo sapiens
uacaagucaucauaauucagc

SEQ ID NO: 473727 - RNA, 14 nt, Homo sapiens
uacacacagcagua

SEQ ID NO: 473728 - RNA, 22 nt, Homo sapiens
uacacugccuucucaacuccaa

SEQ ID NO: 473729 - RNA, 18 nt, Homo sapiens
uacagagaaaagacauaa

SEQ ID NO: 473730 - RNA, 20 nt, Homo sapiens
uacagcccaugauagccucu

SEQ ID NO: 473731 - RNA, 16 nt, Homo sapiens
uacaggugaagcacca

SEQ ID NO: 473732 - RNA, 17 nt, Homo sapiens
uacaguaaauaaauugu

SEQ ID NO: 473733 - RNA, 19 nt, Homo sapiens
uacaguuugucacaugaaa

SEQ ID NO: 473734 - RNA, 19 nt, Homo sapiens
uacauaaaguaugugcaua

SEQ ID NO: 473735 - RNA, 20 nt, Homo sapiens
uacauaaaguaugugcauau

SEQ ID NO: 473736 - RNA, 19 nt, Homo sapiens
uacauuagucauucaauaa

SEQ ID NO: 473737 - RNA, 22 nt, Homo sapiens
uaccacaugccaagcacugugc

SEQ ID NO: 473738 - RNA, 13 nt, Homo sapiens
uaccauguggcaa

SEQ ID NO: 473739 - RNA, 13 nt, Homo sapiens
uaccucaccuggg

SEQ ID NO: 473740 - RNA, 14 nt, Homo sapiens
uaccucacuggggu

SEQ ID NO: 473741 - RNA, 17 nt, Homo sapiens
uaccuccugucucuggc

SEQ ID NO: 473742 - RNA, 11 nt, Homo sapiens
uaccugucaau

SEQ ID NO: 473743 - RNA, 18 nt, Homo sapiens
uaccuucaccaucuguau

SEQ ID NO: 473744 - RNA, 12 nt, Homo sapiens
uacuaguacagg

SEQ ID NO: 473745 - RNA, 20 nt, Homo sapiens
uacucauuaaaaauaauaga

SEQ ID NO: 473746 - RNA, 17 nt, Homo sapiens
uacuccccaacugaguu

SEQ ID NO: 473747 - RNA, 16 nt, Homo sapiens
uacucuuccaucuuuc

SEQ ID NO: 473748 - RNA, 18 nt, Homo sapiens
uacuguagacucuggaag

SEQ ID NO: 473749 - RNA, 22 nt, Homo sapiens
uacuucuuaggguuaugauuaa

SEQ ID NO: 473750 - RNA, 14 nt, Homo sapiens
uacuuucauacuga

SEQ ID NO: 473751 - RNA, 18 nt, Homo sapiens
uagaaagaaacugcucua

SEQ ID NO: 473752 - RNA, 20 nt, Homo sapiens
uagaaagaaacugcucuaau

SEQ ID NO: 473753 - RNA, 19 nt, Homo sapiens
uagaaauauagccaaaaau

SEQ ID NO: 473754 - RNA, 19 nt, Homo sapiens
uagaaccaccaacaagcaa

SEQ ID NO: 473755 - RNA, 21 nt, Homo sapiens
uagaagcugaagauccccaac

SEQ ID NO: 473756 - RNA, 20 nt, Homo sapiens
uagaagggcuagaaccugga

SEQ ID NO: 473757 - RNA, 22 nt, Homo sapiens
uagaagguucucuccuccccaa

SEQ ID NO: 473758 - RNA, 16 nt, Homo sapiens
uagaauaccacaggaa

SEQ ID NO: 473759 - RNA, 22 nt, Homo sapiens
uagaauacuaauaaaauacaua

SEQ ID NO: 473760 - RNA, 14 nt, Homo sapiens
uagacaaaaaccau

SEQ ID NO: 473761 - RNA, 19 nt, Homo sapiens
uagagaaauuugccaauuu

SEQ ID NO: 473762 - RNA, 19 nt, Homo sapiens
uagagagggaaggucucag

SEQ ID NO: 473763 - RNA, 18 nt, Homo sapiens
uagagauaugcagaagga

SEQ ID NO: 473764 - RNA, 22 nt, Homo sapiens
uagagcaggcguucagcucacu

SEQ ID NO: 473765 - RNA, 22 nt, Homo sapiens
uagaguucuccagacaggguuc

SEQ ID NO: 473766 - RNA, 16 nt, Homo sapiens
uagccgaaaugaucuu

SEQ ID NO: 473767 - RNA, 14 nt, Homo sapiens
uagccgaccucagc

SEQ ID NO: 473768 - RNA, 17 nt, Homo sapiens
uagccgaccucagccuu

SEQ ID NO: 473769 - RNA, 18 nt, Homo sapiens
uagguuaaaaacagggaa

SEQ ID NO: 473770 - RNA, 13 nt, Homo sapiens
uaguaauucucag

SEQ ID NO: 473771 - RNA, 20 nt, Homo sapiens
uaguacagguuuugcccuga

SEQ ID NO: 473772 - RNA, 20 nt, Homo sapiens
uagucccacuuacuugggag

SEQ ID NO: 473773 - RNA, 16 nt, Homo sapiens
uaguggggucagggcu

SEQ ID NO: 473774 - RNA, 19 nt, Homo sapiens
uaguguuggaaaaugugca

SEQ ID NO: 473775 - RNA, 22 nt, Homo sapiens
uaguguuggaaaaugugcaaua

SEQ ID NO: 473776 - RNA, 20 nt, Homo sapiens
uaguucuccccgauggggca

SEQ ID NO: 473777 - RNA, 16 nt, Homo sapiens
uauaacuauguugaua

SEQ ID NO: 473778 - RNA, 18 nt, Homo sapiens
uauaacuauguugauaaa

SEQ ID NO: 473779 - RNA, 20 nt, Homo sapiens
uauaauuuccauagugugag

SEQ ID NO: 473780 - RNA, 17 nt, Homo sapiens
uauaccugggcauacua

SEQ ID NO: 473781 - RNA, 18 nt, Homo sapiens
uauaccugggcauacuaa

SEQ ID NO: 473782 - RNA, 23 nt, Homo sapiens
uauacuuugccuuuccauaauca

SEQ ID NO: 473783 - RNA, 13 nt, Homo sapiens
uauauggccucaa

SEQ ID NO: 473784 - RNA, 15 nt, Homo sapiens
uauauugcugcuggu

SEQ ID NO: 473785 - RNA, 21 nt, Homo sapiens
uauccaacaugugcucaggga

SEQ ID NO: 473786 - RNA, 12 nt, Homo sapiens
uauccuguucuc

SEQ ID NO: 473787 - RNA, 21 nt, Homo sapiens
uaucuauggcacccaugcacc

SEQ ID NO: 473788 - RNA, 22 nt, Homo sapiens
uaugacucaccuugcucugcca

SEQ ID NO: 473789 - RNA, 15 nt, Homo sapiens
uaugcaggacugauc

SEQ ID NO: 473790 - RNA, 20 nt, Homo sapiens
uauggaguaccauguggcaa

SEQ ID NO: 473791 - RNA, 16 nt, Homo sapiens
uauggcacccaugcac

SEQ ID NO: 473792 - RNA, 18 nt, Homo sapiens
uauggcacccaugcaccu

SEQ ID NO: 473793 - RNA, 17 nt, Homo sapiens
uauggcucuacuuucag

SEQ ID NO: 473794 - RNA, 13 nt, Homo sapiens
uaugggcuuucuc

SEQ ID NO: 473795 - RNA, 14 nt, Homo sapiens
uaugugauguggca

SEQ ID NO: 473796 - RNA, 12 nt, Homo sapiens
uauguugcaauc

SEQ ID NO: 473797 - RNA, 20 nt, Homo sapiens
uauuaacagcugauacaggu

SEQ ID NO: 473798 - RNA, 20 nt, Homo sapiens
uauuacaguuuaucuauggc

SEQ ID NO: 473799 - RNA, 22 nt, Homo sapiens
uauuacaguuuaucuauggcac

SEQ ID NO: 473800 - RNA, 19 nt, Homo sapiens
uauuagugaaguaugcacu

SEQ ID NO: 473801 - RNA, 20 nt, Homo sapiens
uauuagugaaguaugcacua

SEQ ID NO: 473802 - RNA, 18 nt, Homo sapiens
uauuauuucuuacucaaa

SEQ ID NO: 473803 - RNA, 15 nt, Homo sapiens
uauucccaugcauuu

SEQ ID NO: 473804 - RNA, 19 nt, Homo sapiens
uauucccuucuaaccugaa

SEQ ID NO: 473805 - RNA, 15 nt, Homo sapiens
uauugcugcugguaa

SEQ ID NO: 473806 - RNA, 13 nt, Homo sapiens
uauugugcauaga

SEQ ID NO: 473807 - RNA, 14 nt, Homo sapiens
uauuguggugccac

SEQ ID NO: 473808 - RNA, 15 nt, Homo sapiens
uauuuauugcugaau

SEQ ID NO: 473809 - RNA, 22 nt, Homo sapiens
uauuuuaaucuaauucuaagga

SEQ ID NO: 473810 - RNA, 20 nt, Homo sapiens
uauuuuaauuuaaucuucca

SEQ ID NO: 473811 - RNA, 22 nt, Homo sapiens
uauuuugccagugggaacuccu

SEQ ID NO: 473812 - RNA, 14 nt, Homo sapiens
uauuuuuaugugca

SEQ ID NO: 473813 - RNA, 20 nt, Homo sapiens
gcauguuggcccagaccuca

SEQ ID NO: 473814 - RNA, 15 nt, Homo sapiens
gcauucauaacagaa

SEQ ID NO: 473815 - RNA, 20 nt, Homo sapiens
gcauugccuuuagugaucac

SEQ ID NO: 473816 - RNA, 13 nt, Homo sapiens
gccaaaagccuuu

SEQ ID NO: 473817 - RNA, 17 nt, Homo sapiens
gccaaacacccaugccc

SEQ ID NO: 473818 - RNA, 11 nt, Homo sapiens
gccaacaagca

SEQ ID NO: 473819 - RNA, 16 nt, Homo sapiens
gccaacauagugaaac

SEQ ID NO: 473820 - RNA, 21 nt, Homo sapiens
gccaaggcuggagugcagugg

SEQ ID NO: 473821 - RNA, 12 nt, Homo sapiens
gccaagggauga

SEQ ID NO: 473822 - RNA, 13 nt, Homo sapiens
gccaagugaaaaa

SEQ ID NO: 473823 - RNA, 18 nt, Homo sapiens
gccaauaacacacagcua

SEQ ID NO: 473824 - RNA, 21 nt, Homo sapiens
gccacagcuggugguaucuga

SEQ ID NO: 473825 - RNA, 22 nt, Homo sapiens
gccaggauugaccuuugcacga

SEQ ID NO: 473826 - RNA, 18 nt, Homo sapiens
gccauccucaaacacugc

SEQ ID NO: 473827 - RNA, 21 nt, Homo sapiens
gccaugacuugagaaacaaau

SEQ ID NO: 473828 - RNA, 15 nt, Homo sapiens
gccauugcacuccag

SEQ ID NO: 473829 - RNA, 20 nt, Homo sapiens
gcccauucuaaacuccuuuc

SEQ ID NO: 473830 - RNA, 13 nt, Homo sapiens
gccccaauucgau

SEQ ID NO: 473831 - RNA, 20 nt, Homo sapiens
gccccccuugccagacaugu

SEQ ID NO: 473832 - RNA, 20 nt, Homo sapiens
gccccucagugguuuccucg

SEQ ID NO: 473833 - RNA, 12 nt, Homo sapiens
gccccuucaucc

SEQ ID NO: 473834 - RNA, 17 nt, Homo sapiens
gcccggaguggacugau

SEQ ID NO: 473835 - RNA, 19 nt, Homo sapiens
gcccucuccugggcagcug

SEQ ID NO: 473836 - RNA, 21 nt, Homo sapiens
gccgagaucacgccacugcac

SEQ ID NO: 473837 - RNA, 23 nt, Homo sapiens
gccucacuuaugagaugccugaa

SEQ ID NO: 473838 - RNA, 20 nt, Homo sapiens
gccucccaggagaaucacuu

SEQ ID NO: 473839 - RNA, 22 nt, Homo sapiens
gccuccccuccucugcuugcca

SEQ ID NO: 473840 - RNA, 16 nt, Homo sapiens
gccuccgcuacuucca

SEQ ID NO: 473841 - RNA, 16 nt, Homo sapiens
gccugccuggcaggcu

SEQ ID NO: 473842 - RNA, 20 nt, Homo sapiens
gcgcgccuccgcuacuucca

SEQ ID NO: 473843 - RNA, 15 nt, Homo sapiens
gcgcgcucaucccac

SEQ ID NO: 473844 - RNA, 21 nt, Homo sapiens
gcuaaagaggaagugcacugg

SEQ ID NO: 473845 - RNA, 15 nt, Homo sapiens
gcuaacccccaaaua

SEQ ID NO: 473846 - RNA, 16 nt, Homo sapiens
gcuaccucacuggggu

SEQ ID NO: 473847 - RNA, 21 nt, Homo sapiens
gcuacucaggaggcugaggca

SEQ ID NO: 473848 - RNA, 11 nt, Homo sapiens
gcuagaaccug

SEQ ID NO: 473849 - RNA, 18 nt, Homo sapiens
gcuauagaaaacaauaca

SEQ ID NO: 473850 - RNA, 21 nt, Homo sapiens
gcucaaagcguggacaggugu

SEQ ID NO: 473851 - RNA, 13 nt, Homo sapiens
gcucacugucaca

SEQ ID NO: 473852 - RNA, 19 nt, Homo sapiens
gcucagggaauaauccaga

SEQ ID NO: 473853 - RNA, 22 nt, Homo sapiens
gcuccacaccuccaaugcugcc

SEQ ID NO: 473854 - RNA, 22 nt, Homo sapiens
gcuccacuuucagugaaagcau

SEQ ID NO: 473855 - RNA, 21 nt, Homo sapiens
gcuccaucgcugucaucucag

SEQ ID NO: 473856 - RNA, 15 nt, Homo sapiens
gcucccaagggaugg

SEQ ID NO: 473857 - RNA, 23 nt, Homo sapiens
gcucccaagggauggugcccugu

SEQ ID NO: 473858 - RNA, 16 nt, Homo sapiens
gcuccuaguagcuuuc

SEQ ID NO: 473859 - RNA, 20 nt, Homo sapiens
gcuccuaguagcuuuccucc

SEQ ID NO: 473860 - RNA, 15 nt, Homo sapiens
gcucuaaaugucaau

SEQ ID NO: 473861 - RNA, 18 nt, Homo sapiens
gcucucacuccaggacag

SEQ ID NO: 473862 - RNA, 16 nt, Homo sapiens
gcucuggaguccugcu

SEQ ID NO: 473863 - RNA, 15 nt, Homo sapiens
gcucugucucaaaag

SEQ ID NO: 473864 - RNA, 18 nt, Homo sapiens
gcucuuaggcaaucacau

SEQ ID NO: 473865 - RNA, 13 nt, Homo sapiens
gcugcuagcacuu

SEQ ID NO: 473866 - RNA, 19 nt, Homo sapiens
gcuggaggacuagaaccug

SEQ ID NO: 473867 - RNA, 21 nt, Homo sapiens
gcuggagggagaacccaaaga

SEQ ID NO: 473868 - RNA, 14 nt, Homo sapiens
gcuggagugcagug

SEQ ID NO: 473869 - RNA, 21 nt, Homo sapiens
gcuggcaccuuaguugcauga

SEQ ID NO: 473870 - RNA, 21 nt, Homo sapiens
gcuggcgucaugcaaagucau

SEQ ID NO: 473871 - RNA, 15 nt, Homo sapiens
gcugggcucgccaca

SEQ ID NO: 473872 - RNA, 17 nt, Homo sapiens
gcuggguggcacugcca

SEQ ID NO: 473873 - RNA, 22 nt, Homo sapiens
gcugguuuuacauuagauuuau

SEQ ID NO: 473874 - RNA, 19 nt, Homo sapiens
gcuguuuuuauauauguga

SEQ ID NO: 473875 - RNA, 22 nt, Homo sapiens
gcuuaguccaauuccuugcaca

SEQ ID NO: 473876 - RNA, 23 nt, Homo sapiens
gcuuaguccaauuccuugcacau

SEQ ID NO: 473877 - RNA, 18 nt, Homo sapiens
gcuuauccaugccuggga

SEQ ID NO: 473878 - RNA, 23 nt, Homo sapiens
gcuuggaaacuggaugaggucau

SEQ ID NO: 473879 - RNA, 21 nt, Homo sapiens
gcuuguaaaauuucacuuaau

SEQ ID NO: 473880 - RNA, 19 nt, Homo sapiens
gcuuuaaaacuuauccucc

SEQ ID NO: 473881 - RNA, 20 nt, Homo sapiens
gcuuuaguccuagaggaccu

SEQ ID NO: 473882 - RNA, 12 nt, Homo sapiens
gcuuuccuccca

SEQ ID NO: 473883 - RNA, 23 nt, Homo sapiens
gcuuugaaggaaccaagugcauu

SEQ ID NO: 473884 - RNA, 22 nt, Homo sapiens
ggaaaaugugcaauaugugaug

SEQ ID NO: 473885 - RNA, 19 nt, Homo sapiens
ggaaacuguuguguccaau

SEQ ID NO: 473886 - RNA, 17 nt, Homo sapiens
ggaaagugauaugcauu

SEQ ID NO: 473887 - RNA, 11 nt, Homo sapiens
ggaaaucacac

SEQ ID NO: 473888 - RNA, 19 nt, Homo sapiens
ggaacauguaguuuuacuu

SEQ ID NO: 473889 - RNA, 13 nt, Homo sapiens
ggaacugcaauaa

SEQ ID NO: 473890 - RNA, 13 nt, Homo sapiens
ggaaguauacuuu

SEQ ID NO: 473891 - RNA, 20 nt, Homo sapiens
ggaauauuugcaagacauag

SEQ ID NO: 473892 - RNA, 22 nt, Homo sapiens
ggaauauuugcaagacauagaa

SEQ ID NO: 473893 - RNA, 15 nt, Homo sapiens
ggaauggagcuguau

SEQ ID NO: 473894 - RNA, 19 nt, Homo sapiens
ggaaugggcagcucaucuc

SEQ ID NO: 473895 - RNA, 15 nt, Homo sapiens
ggaauuuucuuccaa

SEQ ID NO: 473896 - RNA, 15 nt, Homo sapiens
ggacaugaaacucca

SEQ ID NO: 473897 - RNA, 19 nt, Homo sapiens
ggacauggccccugugagu

SEQ ID NO: 473898 - RNA, 20 nt, Homo sapiens
ggaccacgugagaucauuca

SEQ ID NO: 473899 - RNA, 18 nt, Homo sapiens
ggacugagcugggggaag

SEQ ID NO: 473900 - RNA, 19 nt, Homo sapiens
ggacugaucgauuugcacc

SEQ ID NO: 473901 - RNA, 21 nt, Homo sapiens
ggacuuaaaacaaaccuugug

SEQ ID NO: 473902 - RNA, 13 nt, Homo sapiens
ggagaaugcacag

SEQ ID NO: 473903 - RNA, 16 nt, Homo sapiens
ggagcucgugggacag

SEQ ID NO: 473904 - RNA, 13 nt, Homo sapiens
ggaggcuucugau

SEQ ID NO: 473905 - RNA, 14 nt, Homo sapiens
ggaguacaccccaa

SEQ ID NO: 473906 - RNA, 16 nt, Homo sapiens
ggaguacgugaaauga

SEQ ID NO: 473907 - RNA, 17 nt, Homo sapiens
ggagugcccccaacagc

SEQ ID NO: 473908 - RNA, 21 nt, Homo sapiens
ggagugcccccaacagcaccc

SEQ ID NO: 473909 - RNA, 16 nt, Homo sapiens
ggagugggcgcagugg

SEQ ID NO: 473910 - RNA, 22 nt, Homo sapiens
ggauauguuaaauguauagcug

SEQ ID NO: 473911 - RNA, 17 nt, Homo sapiens
ggauauugggucucagc

SEQ ID NO: 473912 - RNA, 20 nt, Homo sapiens
ggauauuugguuuggccauc

SEQ ID NO: 473913 - RNA, 15 nt, Homo sapiens
ggaucccucucugga

SEQ ID NO: 473914 - RNA, 18 nt, Homo sapiens
ggaucuaucaccugucau

SEQ ID NO: 473915 - RNA, 20 nt, Homo sapiens
ggaucuucccacuuugccac

SEQ ID NO: 473916 - RNA, 13 nt, Homo sapiens
ggauguugcucag

SEQ ID NO: 473917 - RNA, 17 nt, Homo sapiens
ggcaacaucuugcaaaa

SEQ ID NO: 473918 - RNA, 19 nt, Homo sapiens
ggcaaucacauagugaaag

SEQ ID NO: 473919 - RNA, 15 nt, Homo sapiens
ggcacauuccuugcc

SEQ ID NO: 473920 - RNA, 23 nt, Homo sapiens
ggcacccacaaauaaaugacaag

SEQ ID NO: 473921 - RNA, 19 nt, Homo sapiens
ggcacgaucucgacucacu

SEQ ID NO: 473922 - RNA, 13 nt, Homo sapiens
ggcacugccugau

SEQ ID NO: 473923 - RNA, 11 nt, Homo sapiens
ggcacuggguc

SEQ ID NO: 473924 - RNA, 16 nt, Homo sapiens
ggcacuggugggccau

SEQ ID NO: 473925 - RNA, 18 nt, Homo sapiens
ggcagccaggcuggcaga

SEQ ID NO: 473926 - RNA, 17 nt, Homo sapiens
ggcagcuguugcaguga

SEQ ID NO: 473927 - RNA, 12 nt, Homo sapiens
ggcauacuaaua

SEQ ID NO: 473928 - RNA, 20 nt, Homo sapiens
ggcauaucuuguuguucagu

SEQ ID NO: 473929 - RNA, 14 nt, Homo sapiens
ggcaugguggcaca

SEQ ID NO: 473930 - RNA, 23 nt, Homo sapiens
ggcauguuuugcccaccagauca

SEQ ID NO: 473931 - RNA, 15 nt, Homo sapiens
ggcccugagcucggu

SEQ ID NO: 473932 - RNA, 23 nt, Homo sapiens
ggccuaacacugggcugcagaga

SEQ ID NO: 473933 - RNA, 20 nt, Homo sapiens
ggccugcucgcccacuuccu

SEQ ID NO: 473934 - RNA, 14 nt, Homo sapiens
ggcgcaguggcuca

SEQ ID NO: 473935 - RNA, 20 nt, Homo sapiens
ggcggguccgggucgcagga

SEQ ID NO: 473936 - RNA, 15 nt, Homo sapiens
ggcguggagcugccu

SEQ ID NO: 473937 - RNA, 17 nt, Homo sapiens
ggcuagaaccuggagag

SEQ ID NO: 473938 - RNA, 16 nt, Homo sapiens
ggcuagaacuggagag

SEQ ID NO: 473939 - RNA, 17 nt, Homo sapiens
ggcucuuaggcaaucac

SEQ ID NO: 473940 - RNA, 23 nt, Homo sapiens
ggcuuguugcccucugcaguuga

SEQ ID NO: 473941 - RNA, 14 nt, Homo sapiens
gggaagaagggaua

SEQ ID NO: 473942 - RNA, 19 nt, Homo sapiens
gggaauugaggacacugau

SEQ ID NO: 473943 - RNA, 17 nt, Homo sapiens
agcuccuaguagcuuuc

SEQ ID NO: 473944 - RNA, 15 nt, Homo sapiens
agcucgguggaccca

SEQ ID NO: 473945 - RNA, 17 nt, Homo sapiens
agcucuuugugaaugug

SEQ ID NO: 473946 - RNA, 18 nt, Homo sapiens
agcugacacaggaugaag

SEQ ID NO: 473947 - RNA, 14 nt, Homo sapiens
agcugccccgggga

SEQ ID NO: 473948 - RNA, 17 nt, Homo sapiens
agcugcuggcagugggu

SEQ ID NO: 473949 - RNA, 21 nt, Homo sapiens
agcuggaauuacaggcacaua

SEQ ID NO: 473950 - RNA, 20 nt, Homo sapiens
agcuggagcccgugcccuac

SEQ ID NO: 473951 - RNA, 19 nt, Homo sapiens
agcuggaguacgugaaaug

SEQ ID NO: 473952 - RNA, 15 nt, Homo sapiens
agcuggugagugaug

SEQ ID NO: 473953 - RNA, 16 nt, Homo sapiens
agcuggugguaucuga

SEQ ID NO: 473954 - RNA, 17 nt, Homo sapiens
agcuguucucauuccug

SEQ ID NO: 473955 - RNA, 19 nt, Homo sapiens
agcuuauugucuagugaaa

SEQ ID NO: 473956 - RNA, 14 nt, Homo sapiens
agcuugaaucuacu

SEQ ID NO: 473957 - RNA, 17 nt, Homo sapiens
agcuugacuucaugcca

SEQ ID NO: 473958 - RNA, 14 nt, Homo sapiens
agcuuggaaacugg

SEQ ID NO: 473959 - RNA, 22 nt, Homo sapiens
agcuuggaaacuggaugagguc

SEQ ID NO: 473960 - RNA, 20 nt, Homo sapiens
aggaaaacugaggcccuugg

SEQ ID NO: 473961 - RNA, 17 nt, Homo sapiens
aggaaaagauuccuguc

SEQ ID NO: 473962 - RNA, 20 nt, Homo sapiens
aggaaauauucuguaaucuu

SEQ ID NO: 473963 - RNA, 15 nt, Homo sapiens
aggaagggcauccuu

SEQ ID NO: 473964 - RNA, 18 nt, Homo sapiens
aggaaguaugguuuuauu

SEQ ID NO: 473965 - RNA, 13 nt, Homo sapiens
aggaauauuugca

SEQ ID NO: 473966 - RNA, 17 nt, Homo sapiens
aggacuaauccaauacc

SEQ ID NO: 473967 - RNA, 20 nt, Homo sapiens
aggacugaucgauuugcacc

SEQ ID NO: 473968 - RNA, 21 nt, Homo sapiens
aggagaaucacuugaacccag

SEQ ID NO: 473969 - RNA, 22 nt, Homo sapiens
aggagaggggcagaacagccgc

SEQ ID NO: 473970 - RNA, 19 nt, Homo sapiens
aggagauuuuccuuccuac

SEQ ID NO: 473971 - RNA, 13 nt, Homo sapiens
aggagcagcuuca

SEQ ID NO: 473972 - RNA, 13 nt, Homo sapiens
aggagcagugcag

SEQ ID NO: 473973 - RNA, 14 nt, Homo sapiens
aggaguacagguga

SEQ ID NO: 473974 - RNA, 12 nt, Homo sapiens
aggauaacacaa

SEQ ID NO: 473975 - RNA, 23 nt, Homo sapiens
aggauauugacauugauacagug

SEQ ID NO: 473976 - RNA, 20 nt, Homo sapiens
aggauauugggucucagccc

SEQ ID NO: 473977 - RNA, 18 nt, Homo sapiens
aggaucacuugagcccag

SEQ ID NO: 473978 - RNA, 19 nt, Homo sapiens
aggcaaaugcccaagggaa

SEQ ID NO: 473979 - RNA, 14 nt, Homo sapiens
aggcaaucacauag

SEQ ID NO: 473980 - RNA, 17 nt, Homo sapiens
aggcacauaccacugca

SEQ ID NO: 473981 - RNA, 22 nt, Homo sapiens
aggcaccaguuacccugcaugu

SEQ ID NO: 473982 - RNA, 13 nt, Homo sapiens
aggcacuaaaaag

SEQ ID NO: 473983 - RNA, 17 nt, Homo sapiens
aggcacugccugaugga

SEQ ID NO: 473984 - RNA, 23 nt, Homo sapiens
aggcagcuguugcagugagccaa

SEQ ID NO: 473985 - RNA, 21 nt, Homo sapiens
aggcagcuuuuucucucccac

SEQ ID NO: 473986 - RNA, 20 nt, Homo sapiens
aggcauccuuccucacacca

SEQ ID NO: 473987 - RNA, 15 nt, Homo sapiens
aggcaugacuguaga

SEQ ID NO: 473988 - RNA, 18 nt, Homo sapiens
aggcaugagccaccacgc

SEQ ID NO: 473989 - RNA, 18 nt, Homo sapiens
aggcaugagucagucuga

SEQ ID NO: 473990 - RNA, 11 nt, Homo sapiens
aggccuuccag

SEQ ID NO: 473991 - RNA, 20 nt, Homo sapiens
aggcgugagccaccgcgccu

SEQ ID NO: 473992 - RNA, 19 nt, Homo sapiens
aggcuaagguggguggauc

SEQ ID NO: 473993 - RNA, 20 nt, Homo sapiens
aggcuggagugcaguggcac

SEQ ID NO: 473994 - RNA, 21 nt, Homo sapiens
aggcuggcagauuuccaaaag

SEQ ID NO: 473995 - RNA, 18 nt, Homo sapiens
aggcuggggaaguccucu

SEQ ID NO: 473996 - RNA, 18 nt, Homo sapiens
aggcuucuccgcccauuc

SEQ ID NO: 473997 - RNA, 14 nt, Homo sapiens
aggcuuucaagaag

SEQ ID NO: 473998 - RNA, 16 nt, Homo sapiens
agggaaaacauuccau

SEQ ID NO: 473999 - RNA, 17 nt, Homo sapiens
agggaauaauccagaaa

SEQ ID NO: 474000 - RNA, 20 nt, Homo sapiens
agggacccugggugggagca

SEQ ID NO: 474001 - RNA, 18 nt, Homo sapiens
agggaggcucugucucaa

SEQ ID NO: 474002 - RNA, 18 nt, Homo sapiens
agggauaucuacuguggu

SEQ ID NO: 474003 - RNA, 20 nt, Homo sapiens
agggauggugcccuguucuc

SEQ ID NO: 474004 - RNA, 21 nt, Homo sapiens
agggauuuuagucacacgugg

SEQ ID NO: 474005 - RNA, 17 nt, Homo sapiens
agggcauuuccaaguua

SEQ ID NO: 474006 - RNA, 23 nt, Homo sapiens
agggcuagaaccuguagagcuag

SEQ ID NO: 474007 - RNA, 14 nt, Homo sapiens
aggguuaugauuaa

SEQ ID NO: 474008 - RNA, 22 nt, Homo sapiens
aggguucaccaggucagggaga

SEQ ID NO: 474009 - RNA, 15 nt, Homo sapiens
aggguucagggcaug

SEQ ID NO: 474010 - RNA, 16 nt, Homo sapiens
agguaguuaagggaug

SEQ ID NO: 474011 - RNA, 23 nt, Homo sapiens
agguccuggcaaagaugaucagu

SEQ ID NO: 474012 - RNA, 20 nt, Homo sapiens
aggucucaggagaagggaua

SEQ ID NO: 474013 - RNA, 22 nt, Homo sapiens
aggugcccaggaaccucagggc

SEQ ID NO: 474014 - RNA, 16 nt, Homo sapiens
agguggggacagggau

SEQ ID NO: 474015 - RNA, 15 nt, Homo sapiens
aguaaacaccuggag

SEQ ID NO: 474016 - RNA, 22 nt, Homo sapiens
aguaaaugaauaaaacauuugc

SEQ ID NO: 474017 - RNA, 12 nt, Homo sapiens
aguacaggugaa

SEQ ID NO: 474018 - RNA, 13 nt, Homo sapiens
aguacaggugaag

SEQ ID NO: 474019 - RNA, 22 nt, Homo sapiens
aguacuguaacugugucaugau

SEQ ID NO: 474020 - RNA, 15 nt, Homo sapiens
aguagacaagcaauu

SEQ ID NO: 474021 - RNA, 18 nt, Homo sapiens
aguagagggcacuggguc

SEQ ID NO: 474022 - RNA, 14 nt, Homo sapiens
aguaggacugcuga

SEQ ID NO: 474023 - RNA, 13 nt, Homo sapiens
aguaugugcauau

SEQ ID NO: 474024 - RNA, 14 nt, Homo sapiens
agucaccucaugga

SEQ ID NO: 474025 - RNA, 14 nt, Homo sapiens
aguccaauuccuug

SEQ ID NO: 474026 - RNA, 20 nt, Homo sapiens
aguccaauuccuugcacaua

SEQ ID NO: 474027 - RNA, 20 nt, Homo sapiens
aguccagccuggagaugaaa

SEQ ID NO: 474028 - RNA, 20 nt, Homo sapiens
aguccgacaaagcuacuuga

SEQ ID NO: 474029 - RNA, 16 nt, Homo sapiens
aguccuucaaacuucc

SEQ ID NO: 474030 - RNA, 22 nt, Homo sapiens
agucgucuggcaucucccacac

SEQ ID NO: 474031 - RNA, 14 nt, Homo sapiens
agucuaaaguuuac

SEQ ID NO: 474032 - RNA, 20 nt, Homo sapiens
agucuaagaugaaaggagaa

SEQ ID NO: 474033 - RNA, 20 nt, Homo sapiens
agucugaauagucuucagag

SEQ ID NO: 474034 - RNA, 14 nt, Homo sapiens
agucugacugugcc

SEQ ID NO: 474035 - RNA, 19 nt, Homo sapiens
agucugaugagaacucuga

SEQ ID NO: 474036 - RNA, 13 nt, Homo sapiens
agucuggcucugu

SEQ ID NO: 474037 - RNA, 22 nt, Homo sapiens
agucuucauaauuucuucacuc

SEQ ID NO: 474038 - RNA, 14 nt, Homo sapiens
agucuucuccucca

SEQ ID NO: 474039 - RNA, 21 nt, Homo sapiens
agucuugcucuuucgccaagg

SEQ ID NO: 474040 - RNA, 17 nt, Homo sapiens
agugaagugaagagagg

SEQ ID NO: 474041 - RNA, 16 nt, Homo sapiens
agugauaugcauuucc

SEQ ID NO: 474042 - RNA, 14 nt, Homo sapiens
agugauggucagag

SEQ ID NO: 474043 - RNA, 16 nt, Homo sapiens
agugauucuugugccu

SEQ ID NO: 474044 - RNA, 20 nt, Homo sapiens
agugccuggccaaagggaua

SEQ ID NO: 474045 - RNA, 21 nt, Homo sapiens
agugcugagauuauaggcaug

SEQ ID NO: 474046 - RNA, 21 nt, Homo sapiens
agugcuugauugcguggaauu

SEQ ID NO: 474047 - RNA, 22 nt, Homo sapiens
aguggaaagacagcuucucauc

SEQ ID NO: 474048 - RNA, 13 nt, Homo sapiens
aguggaggcauug

SEQ ID NO: 474049 - RNA, 20 nt, Homo sapiens
aguggcacgaucucgacuca

SEQ ID NO: 474050 - RNA, 14 nt, Homo sapiens
agugguggcaaaag

SEQ ID NO: 474051 - RNA, 19 nt, Homo sapiens
agugguggcagcucaaaau

SEQ ID NO: 474052 - RNA, 21 nt, Homo sapiens
gaugcauucgguuuugugauu

SEQ ID NO: 474053 - RNA, 22 nt, Homo sapiens
gaugggucacuuguccucaguu

SEQ ID NO: 474054 - RNA, 17 nt, Homo sapiens
gauggugcccuguucuc

SEQ ID NO: 474055 - RNA, 22 nt, Homo sapiens
gaugucaucuugagcucuucau

SEQ ID NO: 474056 - RNA, 12 nt, Homo sapiens
gauguugcucag

SEQ ID NO: 474057 - RNA, 20 nt, Homo sapiens
gauuaaaaaaucucccaaag

SEQ ID NO: 474058 - RNA, 18 nt, Homo sapiens
gauuauagugacaaugaa

SEQ ID NO: 474059 - RNA, 23 nt, Homo sapiens
gauuauuuguuauuuguacaguu

SEQ ID NO: 474060 - RNA, 17 nt, Homo sapiens
gauucaauucaacacuc

SEQ ID NO: 474061 - RNA, 13 nt, Homo sapiens
gauucacacuguc

SEQ ID NO: 474062 - RNA, 21 nt, Homo sapiens
gauucacccccaaacagugac

SEQ ID NO: 474063 - RNA, 11 nt, Homo sapiens
gauucucaggg

SEQ ID NO: 474064 - RNA, 16 nt, Homo sapiens
gauugaccuuugcacg

SEQ ID NO: 474065 - RNA, 16 nt, Homo sapiens
gauugagcuacuucag

SEQ ID NO: 474066 - RNA, 21 nt, Homo sapiens
gauugagcuacuucaggacuu

SEQ ID NO: 474067 - RNA, 16 nt, Homo sapiens
gauugcuuaucaguag

SEQ ID NO: 474068 - RNA, 18 nt, Homo sapiens
gcaaaggcucucacucca

SEQ ID NO: 474069 - RNA, 19 nt, Homo sapiens
gcaaaggcucucacuccag

SEQ ID NO: 474070 - RNA, 23 nt, Homo sapiens
gcaaaggcugggaccacgugaga

SEQ ID NO: 474071 - RNA, 16 nt, Homo sapiens
gcaaauuccaauacau

SEQ ID NO: 474072 - RNA, 14 nt, Homo sapiens
gcaagggcacuuaa

SEQ ID NO: 474073 - RNA, 14 nt, Homo sapiens
gcaaguagguugcu

SEQ ID NO: 474074 - RNA, 16 nt, Homo sapiens
gcaauaaaauguauuu

SEQ ID NO: 474075 - RNA, 13 nt, Homo sapiens
gcaaucacauagu

SEQ ID NO: 474076 - RNA, 17 nt, Homo sapiens
gcaauuagacaagaacu

SEQ ID NO: 474077 - RNA, 13 nt, Homo sapiens
gcacaauaguaac

SEQ ID NO: 474078 - RNA, 18 nt, Homo sapiens
gcacaauaguaaccuggg

SEQ ID NO: 474079 - RNA, 13 nt, Homo sapiens
gcacacacugugu

SEQ ID NO: 474080 - RNA, 19 nt, Homo sapiens
gcacacacuguguacagua

SEQ ID NO: 474081 - RNA, 23 nt, Homo sapiens
gcacagaagacagcagcaagugu

SEQ ID NO: 474082 - RNA, 20 nt, Homo sapiens
gcacagccauacggcacuga

SEQ ID NO: 474083 - RNA, 23 nt, Homo sapiens
gcacagccucuuagaugcaguuc

SEQ ID NO: 474084 - RNA, 17 nt, Homo sapiens
gcacagguuagggcaug

SEQ ID NO: 474085 - RNA, 21 nt, Homo sapiens
gcacauuuaagagacagucac

SEQ ID NO: 474086 - RNA, 18 nt, Homo sapiens
gcaccaagaccccaaagg

SEQ ID NO: 474087 - RNA, 22 nt, Homo sapiens
gcacuaaucaauacuuugaaca

SEQ ID NO: 474088 - RNA, 16 nt, Homo sapiens
gcacugagagugaagu

SEQ ID NO: 474089 - RNA, 21 nt, Homo sapiens
gcacugccugauggaccuguc

SEQ ID NO: 474090 - RNA, 15 nt, Homo sapiens
gcacuggugggccau

SEQ ID NO: 474091 - RNA, 21 nt, Homo sapiens
gcagagcccucaugugacaug

SEQ ID NO: 474092 - RNA, 20 nt, Homo sapiens
gcagaguacuggcugaugga

SEQ ID NO: 474093 - RNA, 23 nt, Homo sapiens
gcagaguacuggcugauggagua

SEQ ID NO: 474094 - RNA, 18 nt, Homo sapiens
gcagcugcuacuagcucu

SEQ ID NO: 474095 - RNA, 18 nt, Homo sapiens
gcagggacaauuugcugc

SEQ ID NO: 474096 - RNA, 15 nt, Homo sapiens
gcagggaugauggca

SEQ ID NO: 474097 - RNA, 13 nt, Homo sapiens
gcaguagacaagc

SEQ ID NO: 474098 - RNA, 19 nt, Homo sapiens
gcagugcuugaaugaaguu

SEQ ID NO: 474099 - RNA, 16 nt, Homo sapiens
gcaguucugaagaaga

SEQ ID NO: 474100 - RNA, 21 nt, Homo sapiens
gcaguuuugugauaaguucua

SEQ ID NO: 474101 - RNA, 18 nt, Homo sapiens
gcauagaguucagacuuu

SEQ ID NO: 474102 - RNA, 17 nt, Homo sapiens
gcaucucccacacaaga

SEQ ID NO: 474103 - RNA, 21 nt, Homo sapiens
gcaucucccacacaagaccca

SEQ ID NO: 474104 - RNA, 17 nt, Homo sapiens
gcaugaagguuucugaa

SEQ ID NO: 474105 - RNA, 15 nt, Homo sapiens
gcaugacagcuguuc

SEQ ID NO: 474106 - RNA, 22 nt, Homo sapiens
gcauguuuugcccaccagauca

SEQ ID NO: 474107 - RNA, 16 nt, Homo sapiens
gcauucagccaggaga

SEQ ID NO: 474108 - RNA, 22 nt, Homo sapiens
gccaaagccaauaacacacagc

SEQ ID NO: 474109 - RNA, 20 nt, Homo sapiens
gccaagaucacgccacugca

SEQ ID NO: 474110 - RNA, 21 nt, Homo sapiens
gccaagaucacgccauugcac

SEQ ID NO: 474111 - RNA, 12 nt, Homo sapiens
gccaauuuacuu

SEQ ID NO: 474112 - RNA, 11 nt, Homo sapiens
gccacccagca

SEQ ID NO: 474113 - RNA, 22 nt, Homo sapiens
gccacccugugggccgggcaau

SEQ ID NO: 474114 - RNA, 21 nt, Homo sapiens
gccacguauguuuuuguguau

SEQ ID NO: 474115 - RNA, 22 nt, Homo sapiens
gccagauuuuccugaaaacccu

SEQ ID NO: 474116 - RNA, 13 nt, Homo sapiens
gccagcacagccu

SEQ ID NO: 474117 - RNA, 22 nt, Homo sapiens
gccauaaaaauaaaucaguuca

SEQ ID NO: 474118 - RNA, 23 nt, Homo sapiens
gccauaccugguaagcaaaaacu

SEQ ID NO: 474119 - RNA, 14 nt, Homo sapiens
gcccaccuccuucc

SEQ ID NO: 474120 - RNA, 18 nt, Homo sapiens
gcccacuuccucccggcc

SEQ ID NO: 474121 - RNA, 20 nt, Homo sapiens
gcccaguuucacugccauau

SEQ ID NO: 474122 - RNA, 15 nt, Homo sapiens
gccccaauucgaucc

SEQ ID NO: 474123 - RNA, 13 nt, Homo sapiens
gcccgugcccuac

SEQ ID NO: 474124 - RNA, 16 nt, Homo sapiens
gcccuacuucuuugcu

SEQ ID NO: 474125 - RNA, 18 nt, Homo sapiens
gcccucaaaauguccuga

SEQ ID NO: 474126 - RNA, 16 nt, Homo sapiens
gcccuccaguguauga

SEQ ID NO: 474127 - RNA, 23 nt, Homo sapiens
gccgcugccaugcuuugagucca

SEQ ID NO: 474128 - RNA, 18 nt, Homo sapiens
gccgggcaugguggcaca

SEQ ID NO: 474129 - RNA, 17 nt, Homo sapiens
gccuacucuuccaucuu

SEQ ID NO: 474130 - RNA, 14 nt, Homo sapiens
gccuaugugcaugc

SEQ ID NO: 474131 - RNA, 18 nt, Homo sapiens
gccucccaaagugcugag

SEQ ID NO: 474132 - RNA, 17 nt, Homo sapiens
gccucccuucaugcaug

SEQ ID NO: 474133 - RNA, 21 nt, Homo sapiens
gccuccgccucaguaagacga

SEQ ID NO: 474134 - RNA, 16 nt, Homo sapiens
gccuccucacaacaug

SEQ ID NO: 474135 - RNA, 13 nt, Homo sapiens
gccucucugacau

SEQ ID NO: 474136 - RNA, 17 nt, Homo sapiens
gccuggccagaugcaug

SEQ ID NO: 474137 - RNA, 16 nt, Homo sapiens
gccugggagccagggu

SEQ ID NO: 474138 - RNA, 14 nt, Homo sapiens
gccugggugacaga

SEQ ID NO: 474139 - RNA, 14 nt, Homo sapiens
gccuguaaucccag

SEQ ID NO: 474140 - RNA, 13 nt, Homo sapiens
gccuguaguccca

SEQ ID NO: 474141 - RNA, 16 nt, Homo sapiens
gccugugggagucaug

SEQ ID NO: 474142 - RNA, 20 nt, Homo sapiens
gccugugggcgcauacuaca

SEQ ID NO: 474143 - RNA, 23 nt, Homo sapiens
gccuuccacuuggcuacacaggg

SEQ ID NO: 474144 - RNA, 18 nt, Homo sapiens
gccuucccaggaguacac

SEQ ID NO: 474145 - RNA, 19 nt, Homo sapiens
gccuucccaggaguacacc

SEQ ID NO: 474146 - RNA, 16 nt, Homo sapiens
gcgagugcucauuuca

SEQ ID NO: 474147 - RNA, 19 nt, Homo sapiens
gcuaacacacagcucccau

SEQ ID NO: 474148 - RNA, 14 nt, Homo sapiens
gcuacacugacacu

SEQ ID NO: 474149 - RNA, 11 nt, Homo sapiens
gcuagaaccua

SEQ ID NO: 474150 - RNA, 19 nt, Homo sapiens
gcuauacagaaaaaccaca

SEQ ID NO: 474151 - RNA, 23 nt, Homo sapiens
gcuauaccugggcauacuaauaa

SEQ ID NO: 474152 - RNA, 20 nt, Homo sapiens
gcucacgccuguaaucccag

SEQ ID NO: 474153 - RNA, 13 nt, Homo sapiens
gcucacuguucua

SEQ ID NO: 474154 - RNA, 16 nt, Homo sapiens
gcucaggaccaggcaa

SEQ ID NO: 474155 - RNA, 22 nt, Homo sapiens
gcucagggcuaaacgggcauug

SEQ ID NO: 474156 - RNA, 14 nt, Homo sapiens
gcucaguucugccu

SEQ ID NO: 474157 - RNA, 20 nt, Homo sapiens
gcucauucauuuaacagagc

SEQ ID NO: 474158 - RNA, 20 nt, Homo sapiens
gcuccaucgcugucaucuca

SEQ ID NO: 474159 - RNA, 19 nt, Homo sapiens
gcucccugguucugaugau

SEQ ID NO: 474160 - RNA, 12 nt, Homo sapiens
gcuccucaucca

SEQ ID NO: 474161 - RNA, 15 nt, Homo sapiens
gcucgcccacuuccu

SEQ ID NO: 474162 - RNA, 21 nt, Homo sapiens
gcucgcuuccgcauccuaguc

SEQ ID NO: 474163 - RNA, 22 nt, Homo sapiens
gcucgcuuccgcauccuagucu

SEQ ID NO: 474164 - RNA, 21 nt, Homo sapiens
gcucuaaaaaguuuugcccuu

SEQ ID NO: 474165 - RNA, 14 nt, Homo sapiens
gcucuuuucaagaa

SEQ ID NO: 474166 - RNA, 15 nt, Homo sapiens
gcugaacucaugaga

SEQ ID NO: 474167 - RNA, 14 nt, Homo sapiens
gcugagaacacugu

SEQ ID NO: 474168 - RNA, 19 nt, Homo sapiens
gcugagauuauaggcauga

SEQ ID NO: 474169 - RNA, 14 nt, Homo sapiens
gcugagucugcaga

SEQ ID NO: 474170 - RNA, 18 nt, Homo sapiens
gcugaguugguguugaca

SEQ ID NO: 474171 - RNA, 22 nt, Homo sapiens
gcugaguuucucuuggguauaa

SEQ ID NO: 474172 - RNA, 12 nt, Homo sapiens
gcugaugcaguu

SEQ ID NO: 474173 - RNA, 20 nt, Homo sapiens
gcugccuaguuaccaugaac

SEQ ID NO: 474174 - RNA, 14 nt, Homo sapiens
gcugcuacuagcuc

SEQ ID NO: 474175 - RNA, 23 nt, Homo sapiens
gcuggaaaaguauguuagugcaa

SEQ ID NO: 474176 - RNA, 19 nt, Homo sapiens
gcuggagccuggugcccua

SEQ ID NO: 474177 - RNA, 20 nt, Homo sapiens
gcuggagccuggugcccuaa

SEQ ID NO: 474178 - RNA, 18 nt, Homo sapiens
gcuggaguacgugaaaug

SEQ ID NO: 474179 - RNA, 20 nt, Homo sapiens
gcuggagugcaguggcacga

SEQ ID NO: 474180 - RNA, 22 nt, Homo sapiens
gcuggcaccuuaguugcaugac

SEQ ID NO: 474181 - RNA, 17 nt, Homo sapiens
gcuggccucucugacau

SEQ ID NO: 474182 - RNA, 23 nt, Homo sapiens
gcuggccucucugacauaugcua

SEQ ID NO: 474183 - RNA, 17 nt, Homo sapiens
gcuguaguaccccaaga

SEQ ID NO: 474184 - RNA, 13 nt, Homo sapiens
gcugucaucucag

SEQ ID NO: 474185 - RNA, 16 nt, Homo sapiens
gcugugaacauggacu

SEQ ID NO: 474186 - RNA, 19 nt, Homo sapiens
gcuucacagaugugugauu

SEQ ID NO: 474187 - RNA, 17 nt, Homo sapiens
gcuucuagaaccaggca

SEQ ID NO: 474188 - RNA, 22 nt, Homo sapiens
gcuucuccaggguccacaggaa

SEQ ID NO: 474189 - RNA, 19 nt, Homo sapiens
gcuucuccgcccauucuga

SEQ ID NO: 474190 - RNA, 14 nt, Homo sapiens
gcuuuggugccugg

SEQ ID NO: 474191 - RNA, 20 nt, Homo sapiens
gcuuuucuaaucugcagugg

SEQ ID NO: 474192 - RNA, 18 nt, Homo sapiens
gcuuuugaaaaacaaaca

SEQ ID NO: 474193 - RNA, 19 nt, Homo sapiens
gcuuuugguuauaaugugu

SEQ ID NO: 474194 - RNA, 18 nt, Homo sapiens
ggaaaaugaauaauacau

SEQ ID NO: 474195 - RNA, 14 nt, Homo sapiens
ggaaaccacagcug

SEQ ID NO: 474196 - RNA, 17 nt, Homo sapiens
ggaagcagcucaaggga

SEQ ID NO: 474197 - RNA, 13 nt, Homo sapiens
ggaaggagagcuc

SEQ ID NO: 474198 - RNA, 14 nt, Homo sapiens
ggaagucagacuuu

SEQ ID NO: 474199 - RNA, 19 nt, Homo sapiens
ggaaguuauguuguucaaa

SEQ ID NO: 474200 - RNA, 21 nt, Homo sapiens
ggaaguuuuguggaggagcuc

SEQ ID NO: 474201 - RNA, 14 nt, Homo sapiens
ggaauaauccagaa

SEQ ID NO: 474202 - RNA, 21 nt, Homo sapiens
ggaauuacaggcacauaccac

SEQ ID NO: 474203 - RNA, 13 nt, Homo sapiens
ggaauucaucucu

SEQ ID NO: 474204 - RNA, 16 nt, Homo sapiens
ggacaugaaaaauugc

SEQ ID NO: 474205 - RNA, 18 nt, Homo sapiens
ggacauuugcucauggaa

SEQ ID NO: 474206 - RNA, 18 nt, Homo sapiens
ggacuaagaagauguuuu

SEQ ID NO: 474207 - RNA, 18 nt, Homo sapiens
ggacuuucugaagccuca

SEQ ID NO: 474208 - RNA, 19 nt, Homo sapiens
ggagaaaggacccucaaga

SEQ ID NO: 474209 - RNA, 20 nt, Homo sapiens
ggagaaguaauccuagggaa

SEQ ID NO: 474210 - RNA, 13 nt, Homo sapiens
ggagacugcugag

SEQ ID NO: 474211 - RNA, 12 nt, Homo sapiens
ggagcucagaga

SEQ ID NO: 474212 - RNA, 20 nt, Homo sapiens
ggaggcagagguugcaguga

SEQ ID NO: 474213 - RNA, 22 nt, Homo sapiens
ggaggcagagguugcagugaac

SEQ ID NO: 474214 - RNA, 20 nt, Homo sapiens
ggaggcagcuguugcaguga

SEQ ID NO: 474215 - RNA, 14 nt, Homo sapiens
ggaguacaggugaa

SEQ ID NO: 474216 - RNA, 12 nt, Homo sapiens
ggauaugagaug

SEQ ID NO: 474217 - RNA, 17 nt, Homo sapiens
ggaucgcaagagccaug

SEQ ID NO: 474218 - RNA, 17 nt, Homo sapiens
ggaucucucuagugaug

SEQ ID NO: 474219 - RNA, 17 nt, Homo sapiens
ggauugaccuuugcacg

SEQ ID NO: 474220 - RNA, 20 nt, Homo sapiens
ggcaaaggcucucacuccag

SEQ ID NO: 474221 - RNA, 23 nt, Homo sapiens
ggcaacagagcgagauuccaucu

SEQ ID NO: 474222 - RNA, 15 nt, Homo sapiens
ggcacacacugugua

SEQ ID NO: 474223 - RNA, 16 nt, Homo sapiens
ggcacugccaugcagg

SEQ ID NO: 474224 - RNA, 14 nt, Homo sapiens
ggcagcucaucucu

SEQ ID NO: 474225 - RNA, 20 nt, Homo sapiens
ggcaggagaaucgcuugaac

SEQ ID NO: 474226 - RNA, 21 nt, Homo sapiens
ggcaggcaccugggcuuucug

SEQ ID NO: 474227 - RNA, 24 nt, Homo sapiens
ggcauagaugcaggugagcccaug

SEQ ID NO: 474228 - RNA, 18 nt, Homo sapiens
ggcaucucccacacaaga

SEQ ID NO: 474229 - RNA, 20 nt, Homo sapiens
ggccaucucuggaugccuga

SEQ ID NO: 474230 - RNA, 18 nt, Homo sapiens
ggccaucugggcuucaca

SEQ ID NO: 474231 - RNA, 11 nt, Homo sapiens
ggcccagaccu

SEQ ID NO: 474232 - RNA, 15 nt, Homo sapiens
ggcccagaccucagg

SEQ ID NO: 474233 - RNA, 17 nt, Homo sapiens
ggccuaacacugggcug

SEQ ID NO: 474234 - RNA, 12 nt, Homo sapiens
ggccucucugac

SEQ ID NO: 474235 - RNA, 13 nt, Homo sapiens
ggccuggccaugu

SEQ ID NO: 474236 - RNA, 23 nt, Homo sapiens
ggcuaaguguccauuauuuaccu

SEQ ID NO: 474237 - RNA, 14 nt, Homo sapiens
ggcuacacagggau

SEQ ID NO: 474238 - RNA, 15 nt, Homo sapiens
ggcuacacagggaug

SEQ ID NO: 474239 - RNA, 17 nt, Homo sapiens
ggcuagaaucuggagag

SEQ ID NO: 474240 - RNA, 21 nt, Homo sapiens
ggcuauaccugggcauacuaa

SEQ ID NO: 474241 - RNA, 23 nt, Homo sapiens
ggcuccacaccuccaaugcugcc

SEQ ID NO: 474242 - RNA, 16 nt, Homo sapiens
ggcugcugguggcgcu

SEQ ID NO: 474243 - RNA, 17 nt, Homo sapiens
ggcuggaaucuggagag

SEQ ID NO: 474244 - RNA, 19 nt, Homo sapiens
ggcugggaacucaccuggg

SEQ ID NO: 474245 - RNA, 18 nt, Homo sapiens
ggcuuaggaaagugauau

SEQ ID NO: 474246 - RNA, 19 nt, Homo sapiens
ggcuuuaaaacuuauccuc

SEQ ID NO: 474247 - RNA, 14 nt, Homo sapiens
ggcuuuaccuuuau

SEQ ID NO: 474248 - RNA, 20 nt, Homo sapiens
gggaagacuuuaaaccaccu

SEQ ID NO: 474249 - RNA, 20 nt, Homo sapiens
gggaagggugguggagccag

SEQ ID NO: 474250 - RNA, 15 nt, Homo sapiens
gggaauugcagagua

SEQ ID NO: 474251 - RNA, 13 nt, Homo sapiens
gggacagggauga

SEQ ID NO: 474252 - RNA, 16 nt, Homo sapiens
gggagccagggugaga

SEQ ID NO: 474253 - RNA, 12 nt, Homo sapiens
gggagggugaga

SEQ ID NO: 474254 - RNA, 16 nt, Homo sapiens
gggagugggcgcagug

SEQ ID NO: 474255 - RNA, 16 nt, Homo sapiens
gggauacccagugaug

SEQ ID NO: 474256 - RNA, 13 nt, Homo sapiens
gggcacacacugu

SEQ ID NO: 474257 - RNA, 15 nt, Homo sapiens
gggcagaucauuuga

SEQ ID NO: 474258 - RNA, 16 nt, Homo sapiens
gggcaugguagcucaa

SEQ ID NO: 474259 - RNA, 18 nt, Homo sapiens
gggcgcauacuacaguaa

SEQ ID NO: 474260 - RNA, 23 nt, Homo sapiens
gggcgcucgcuuccgcauccuag

SEQ ID NO: 474261 - RNA, 17 nt, Homo sapiens
gggcuaucccuuuccaa

SEQ ID NO: 474262 - RNA, 19 nt, Homo sapiens
gggcuucuagaaccaggca

SEQ ID NO: 474263 - RNA, 13 nt, Homo sapiens
ggggaaaggcuug

SEQ ID NO: 474264 - RNA, 24 nt, Homo sapiens
ggggcugggcagcguacucaucau

SEQ ID NO: 474265 - RNA, 20 nt, Homo sapiens
ggggcuggguaagagcacag

SEQ ID NO: 474266 - RNA, 22 nt, Homo sapiens
gggggcuggguaagagcacagg

SEQ ID NO: 474267 - RNA, 21 nt, Homo sapiens
gggguauuuuaggcagggauu

SEQ ID NO: 474268 - RNA, 17 nt, Homo sapiens
ggguagacacacaugaa

SEQ ID NO: 474269 - RNA, 22 nt, Homo sapiens
ggguccaggccuggccaugugg

SEQ ID NO: 474270 - RNA, 21 nt, Homo sapiens
gggugacagaacgagacucca

SEQ ID NO: 474271 - RNA, 17 nt, Homo sapiens
gggugcuggauggacag

SEQ ID NO: 474272 - RNA, 14 nt, Homo sapiens
gggugucugcuaaa

SEQ ID NO: 474273 - RNA, 19 nt, Homo sapiens
gggugugaaagguuuccaa

SEQ ID NO: 474274 - RNA, 16 nt, Homo sapiens
ggguuuugaacauaaa

SEQ ID NO: 474275 - RNA, 19 nt, Homo sapiens
gguaauaaguacuguguac

SEQ ID NO: 474276 - RNA, 19 nt, Homo sapiens
gguagagacuuugacucuc

SEQ ID NO: 474277 - RNA, 17 nt, Homo sapiens
gguccgaagucuuccau

SEQ ID NO: 474278 - RNA, 19 nt, Homo sapiens
ggucugggcaccaccucug

SEQ ID NO: 474279 - RNA, 23 nt, Homo sapiens
ggugcucauucauuuaacagagc

SEQ ID NO: 474280 - RNA, 20 nt, Homo sapiens
gguggguuuugaacauaaag

SEQ ID NO: 474281 - RNA, 15 nt, Homo sapiens
ggugugaacagggaa

SEQ ID NO: 474282 - RNA, 19 nt, Homo sapiens
gguucaccaggucagggag

SEQ ID NO: 474283 - RNA, 17 nt, Homo sapiens
gguuucuccagagggaa

SEQ ID NO: 474284 - RNA, 16 nt, Homo sapiens
guaaaucuauuggcca

SEQ ID NO: 474285 - RNA, 20 nt, Homo sapiens
guaaucccagcuacuuggga

SEQ ID NO: 474286 - RNA, 13 nt, Homo sapiens
guacaagcugaug

SEQ ID NO: 474287 - RNA, 14 nt, Homo sapiens
guacccuucaccca

SEQ ID NO: 474288 - RNA, 18 nt, Homo sapiens
guaccuugaacacugggg

SEQ ID NO: 474289 - RNA, 21 nt, Homo sapiens
guacgugaaaugacuuuucca

SEQ ID NO: 474290 - RNA, 16 nt, Homo sapiens
guacugauggacuuaa

SEQ ID NO: 474291 - RNA, 15 nt, Homo sapiens
guagauaggccaugg

SEQ ID NO: 474292 - RNA, 14 nt, Homo sapiens
guaguaucaaugau

SEQ ID NO: 474293 - RNA, 21 nt, Homo sapiens
guauaaaggcuaaaagggaaa

SEQ ID NO: 474294 - RNA, 16 nt, Homo sapiens
guauaaguccuugcaa

SEQ ID NO: 474295 - RNA, 17 nt, Homo sapiens
guauagcuggcaccuua

SEQ ID NO: 474296 - RNA, 15 nt, Homo sapiens
guauguuugggagac

SEQ ID NO: 474297 - RNA, 21 nt, Homo sapiens
guauguuugggagacugcuga

SEQ ID NO: 474298 - RNA, 20 nt, Homo sapiens
guauuagaauaccacaggaa

SEQ ID NO: 474299 - RNA, 18 nt, Homo sapiens
guauucccaagaguggug

SEQ ID NO: 474300 - RNA, 13 nt, Homo sapiens
guauugugcauag

SEQ ID NO: 474301 - RNA, 10 nt, Homo sapiens
gucaaaaagu

SEQ ID NO: 474302 - RNA, 22 nt, Homo sapiens
gucacucaccacuacaucacuu

SEQ ID NO: 474303 - RNA, 20 nt, Homo sapiens
gucauggccaaauguucaau

SEQ ID NO: 474304 - RNA, 16 nt, Homo sapiens
gucauuauaagagaaa

SEQ ID NO: 474305 - RNA, 14 nt, Homo sapiens
guccccuuccuucc

SEQ ID NO: 474306 - RNA, 17 nt, Homo sapiens
guccgacaaagcuacuu

SEQ ID NO: 474307 - RNA, 23 nt, Homo sapiens
guccucuggguaggaaucagcaa

SEQ ID NO: 474308 - RNA, 23 nt, Homo sapiens
guccugauuacaaugcugucugu

SEQ ID NO: 474309 - RNA, 18 nt, Homo sapiens
gucuaaagcuuuggggga

SEQ ID NO: 474310 - RNA, 17 nt, Homo sapiens
gucuacguuaccaggca

SEQ ID NO: 474311 - RNA, 23 nt, Homo sapiens
gucuccucuuggccucagcagcu

SEQ ID NO: 474312 - RNA, 22 nt, Homo sapiens
gucuucauaauuucuucacuca

SEQ ID NO: 474313 - RNA, 20 nt, Homo sapiens
gugaaauaaaaguagaauaa

SEQ ID NO: 474314 - RNA, 23 nt, Homo sapiens
gugaacugcagcgaguacuuccc

SEQ ID NO: 474315 - RNA, 22 nt, Homo sapiens
gugacccgugaaaaggacaaau

SEQ ID NO: 474316 - RNA, 16 nt, Homo sapiens
gugagacacugcacag

SEQ ID NO: 474317 - RNA, 18 nt, Homo sapiens
gugagaccuuggcgcuac

SEQ ID NO: 474318 - RNA, 17 nt, Homo sapiens
gugagcagcggacuuca

SEQ ID NO: 474319 - RNA, 13 nt, Homo sapiens
gugauccacccac

SEQ ID NO: 474320 - RNA, 19 nt, Homo sapiens
gugcaaauugucacaggac

SEQ ID NO: 474321 - RNA, 20 nt, Homo sapiens
gugcacaacauuacagggaa

SEQ ID NO: 474322 - RNA, 18 nt, Homo sapiens
agcugugugaacguguau

SEQ ID NO: 474323 - RNA, 22 nt, Homo sapiens
agcuuauaaaaucaaacagaga

SEQ ID NO: 474324 - RNA, 17 nt, Homo sapiens
aggaaaaucugcacugu

SEQ ID NO: 474325 - RNA, 14 nt, Homo sapiens
aggaaaccacagcu

SEQ ID NO: 474326 - RNA, 22 nt, Homo sapiens
aggaaaccacagcugcuggaga

SEQ ID NO: 474327 - RNA, 17 nt, Homo sapiens
aggaagcuuucugucuc

SEQ ID NO: 474328 - RNA, 19 nt, Homo sapiens
aggaauacauaaaguaugu

SEQ ID NO: 474329 - RNA, 15 nt, Homo sapiens
aggacacagaugaaa

SEQ ID NO: 474330 - RNA, 14 nt, Homo sapiens
aggaccaaggagau

SEQ ID NO: 474331 - RNA, 15 nt, Homo sapiens
aggacccacuuccug

SEQ ID NO: 474332 - RNA, 18 nt, Homo sapiens
aggagcagugcaggcaca

SEQ ID NO: 474333 - RNA, 20 nt, Homo sapiens
aggaggcagcuguugcagug

SEQ ID NO: 474334 - RNA, 20 nt, Homo sapiens
aggaguacaccccaacagca

SEQ ID NO: 474335 - RNA, 21 nt, Homo sapiens
aggaguacaccccaacagcac

SEQ ID NO: 474336 - RNA, 21 nt, Homo sapiens
aggauauugggucagugucca

SEQ ID NO: 474337 - RNA, 20 nt, Homo sapiens
aggaucuucccacuuugcca

SEQ ID NO: 474338 - RNA, 17 nt, Homo sapiens
aggauugaccuuugcac

SEQ ID NO: 474339 - RNA, 22 nt, Homo sapiens
aggauuuacuuuuuguaaaaag

SEQ ID NO: 474340 - RNA, 16 nt, Homo sapiens
aggcaaaggcucucac

SEQ ID NO: 474341 - RNA, 13 nt, Homo sapiens
aggcacagaugaa

SEQ ID NO: 474342 - RNA, 16 nt, Homo sapiens
aggcacauaccacugc

SEQ ID NO: 474343 - RNA, 13 nt, Homo sapiens
aggcacucauggg

SEQ ID NO: 474344 - RNA, 19 nt, Homo sapiens
aggcagagaggagccagga

SEQ ID NO: 474345 - RNA, 16 nt, Homo sapiens
aggcaugaaguuuccu

SEQ ID NO: 474346 - RNA, 15 nt, Homo sapiens
aggccaggaguucaa

SEQ ID NO: 474347 - RNA, 15 nt, Homo sapiens
aggccaucaucagug

SEQ ID NO: 474348 - RNA, 16 nt, Homo sapiens
aggccgaggugggcag

SEQ ID NO: 474349 - RNA, 19 nt, Homo sapiens
aggcguggagcugccugau

SEQ ID NO: 474350 - RNA, 18 nt, Homo sapiens
aggcugagagcaguggcu

SEQ ID NO: 474351 - RNA, 14 nt, Homo sapiens
aggcuggagugcag

SEQ ID NO: 474352 - RNA, 22 nt, Homo sapiens
aggcuuucaagaagugccaguu

SEQ ID NO: 474353 - RNA, 15 nt, Homo sapiens
agggaauaauccaga

SEQ ID NO: 474354 - RNA, 20 nt, Homo sapiens
agggaauggcacagcccaaa

SEQ ID NO: 474355 - RNA, 20 nt, Homo sapiens
agggaugaaagagaaggugg

SEQ ID NO: 474356 - RNA, 15 nt, Homo sapiens
agggaugcugcaaug

SEQ ID NO: 474357 - RNA, 13 nt, Homo sapiens
agggccaggugca

SEQ ID NO: 474358 - RNA, 17 nt, Homo sapiens
agggcuagaaccuggaa

SEQ ID NO: 474359 - RNA, 23 nt, Homo sapiens
agggcuggaaucuggagagcuag

SEQ ID NO: 474360 - RNA, 20 nt, Homo sapiens
aggggcugucucccaaugaa

SEQ ID NO: 474361 - RNA, 18 nt, Homo sapiens
aggggucuggacaugugg

SEQ ID NO: 474362 - RNA, 18 nt, Homo sapiens
agggguugagagcaugcc

SEQ ID NO: 474363 - RNA, 20 nt, Homo sapiens
agggugagacacugcacaga

SEQ ID NO: 474364 - RNA, 21 nt, Homo sapiens
aggguucaccaggucagggag

SEQ ID NO: 474365 - RNA, 13 nt, Homo sapiens
agguacccaaggu

SEQ ID NO: 474366 - RNA, 18 nt, Homo sapiens
agguacccaaggucacau

SEQ ID NO: 474367 - RNA, 19 nt, Homo sapiens
agguauucugcugaugcua

SEQ ID NO: 474368 - RNA, 23 nt, Homo sapiens
aggucagaaaccauuguucagaa

SEQ ID NO: 474369 - RNA, 17 nt, Homo sapiens
aggucauagcagugcuu

SEQ ID NO: 474370 - RNA, 19 nt, Homo sapiens
agguccuuuccacccugag

SEQ ID NO: 474371 - RNA, 23 nt, Homo sapiens
aggugcugagaaauuccacacau

SEQ ID NO: 474372 - RNA, 15 nt, Homo sapiens
aggugggcagaucau

SEQ ID NO: 474373 - RNA, 17 nt, Homo sapiens
agguuaaaaacagggaa

SEQ ID NO: 474374 - RNA, 22 nt, Homo sapiens
aguaaacccagcugugagacaa

SEQ ID NO: 474375 - RNA, 20 nt, Homo sapiens
aguaaccuuucaaucaaaac

SEQ ID NO: 474376 - RNA, 18 nt, Homo sapiens
aguacaccccaacagcac

SEQ ID NO: 474377 - RNA, 23 nt, Homo sapiens
aguacaccccaacagcacccucu

SEQ ID NO: 474378 - RNA, 21 nt, Homo sapiens
aguagauuuuaaaaguuauua

SEQ ID NO: 474379 - RNA, 12 nt, Homo sapiens
aguagcugcuac

SEQ ID NO: 474380 - RNA, 16 nt, Homo sapiens
aguagcuuuccuccca

SEQ ID NO: 474381 - RNA, 22 nt, Homo sapiens
aguauacuuuuugcauauguaa

SEQ ID NO: 474382 - RNA, 16 nt, Homo sapiens
aguaugaaaaugucau

SEQ ID NO: 474383 - RNA, 22 nt, Homo sapiens
aguaugcacuaaucaauacuuu

SEQ ID NO: 474384 - RNA, 12 nt, Homo sapiens
aguauugugcau

SEQ ID NO: 474385 - RNA, 21 nt, Homo sapiens
agucacacgggggcagcugau

SEQ ID NO: 474386 - RNA, 16 nt, Homo sapiens
agucacagucacacac

SEQ ID NO: 474387 - RNA, 15 nt, Homo sapiens
agucaccucauggaa

SEQ ID NO: 474388 - RNA, 16 nt, Homo sapiens
agucauggacaugaag

SEQ ID NO: 474389 - RNA, 21 nt, Homo sapiens
aguccagccuggcaaggguuc

SEQ ID NO: 474390 - RNA, 16 nt, Homo sapiens
agucccagcuacucag

SEQ ID NO: 474391 - RNA, 16 nt, Homo sapiens
agucucuaucauuaaa

SEQ ID NO: 474392 - RNA, 18 nt, Homo sapiens
agucuucuccuccaugaa

SEQ ID NO: 474393 - RNA, 19 nt, Homo sapiens
agucuugcagcaggaucua

SEQ ID NO: 474394 - RNA, 14 nt, Homo sapiens
agugaaacauuugu

SEQ ID NO: 474395 - RNA, 19 nt, Homo sapiens
agugagaaaccauauuucc

SEQ ID NO: 474396 - RNA, 16 nt, Homo sapiens
agugagaugcauucuu

SEQ ID NO: 474397 - RNA, 16 nt, Homo sapiens
agugcccccaacagca

SEQ ID NO: 474398 - RNA, 12 nt, Homo sapiens
aguggagccaug

SEQ ID NO: 474399 - RNA, 21 nt, Homo sapiens
agugggcaucagcagcagggu

SEQ ID NO: 474400 - RNA, 14 nt, Homo sapiens
aguggggucagggc

SEQ ID NO: 474401 - RNA, 15 nt, Homo sapiens
aguguaaacaccaua

SEQ ID NO: 474402 - RNA, 21 nt, Homo sapiens
aguguuggaaaaugugcaaua

SEQ ID NO: 474403 - RNA, 13 nt, Homo sapiens
aguuaaacuuuga

SEQ ID NO: 474404 - RNA, 23 nt, Homo sapiens
aguuacccugcauguuggcccag

SEQ ID NO: 474405 - RNA, 13 nt, Homo sapiens
aguucagacuuuu

SEQ ID NO: 474406 - RNA, 14 nt, Homo sapiens
aguucagagcugcc

SEQ ID NO: 474407 - RNA, 16 nt, Homo sapiens
aguuccuuucaauggu

SEQ ID NO: 474408 - RNA, 22 nt, Homo sapiens
aguucggaaaccguccugugua

SEQ ID NO: 474409 - RNA, 22 nt, Homo sapiens
aguucuguuguguuugucaaaa

SEQ ID NO: 474410 - RNA, 14 nt, Homo sapiens
aguugucuauucau

SEQ ID NO: 474411 - RNA, 19 nt, Homo sapiens
aguuguuuucccgagcaaa

SEQ ID NO: 474412 - RNA, 16 nt, Homo sapiens
aguuuaaccugaugca

SEQ ID NO: 474413 - RNA, 18 nt, Homo sapiens
aguuugggugucugcuaa

SEQ ID NO: 474414 - RNA, 12 nt, Homo sapiens
aguuuguuucau

SEQ ID NO: 474415 - RNA, 16 nt, Homo sapiens
aguuuuauaugcuucu

SEQ ID NO: 474416 - RNA, 20 nt, Homo sapiens
aguuuugcccuuuuuaagga

SEQ ID NO: 474417 - RNA, 15 nt, Homo sapiens
auaaaaauaaaucag

SEQ ID NO: 474418 - RNA, 20 nt, Homo sapiens
auaaaaauaaaucaguucau

SEQ ID NO: 474419 - RNA, 18 nt, Homo sapiens
auaaaaucaaacagagac

SEQ ID NO: 474420 - RNA, 13 nt, Homo sapiens
auaaaaugcauuu

SEQ ID NO: 474421 - RNA, 11 nt, Homo sapiens
auaaaccacaa

SEQ ID NO: 474422 - RNA, 18 nt, Homo sapiens
auaaaccacaagcaucuc

SEQ ID NO: 474423 - RNA, 14 nt, Homo sapiens
auaaagacaucucc

SEQ ID NO: 474424 - RNA, 22 nt, Homo sapiens
auaaaggcccagacuccauggu

SEQ ID NO: 474425 - RNA, 21 nt, Homo sapiens
auaaaguaugguauugaaacu

SEQ ID NO: 474426 - RNA, 17 nt, Homo sapiens
auaaaguuggugacaga

SEQ ID NO: 474427 - RNA, 15 nt, Homo sapiens
auaaauaaaacauuu

SEQ ID NO: 474428 - RNA, 21 nt, Homo sapiens
auaaaucauuaagacaacuga

SEQ ID NO: 474429 - RNA, 14 nt, Homo sapiens
auaacaaugcugua

SEQ ID NO: 474430 - RNA, 21 nt, Homo sapiens
auuaaaggggcugucucccaa

SEQ ID NO: 474431 - RNA, 13 nt, Homo sapiens
auuaaugcuaaau

SEQ ID NO: 474432 - RNA, 13 nt, Homo sapiens
auuacaggcacau

SEQ ID NO: 474433 - RNA, 19 nt, Homo sapiens
auuacagggaaugccugag

SEQ ID NO: 474434 - RNA, 22 nt, Homo sapiens
auuaccuguauuugugcaauaa

SEQ ID NO: 474435 - RNA, 13 nt, Homo sapiens
auuacgugcaaua

SEQ ID NO: 474436 - RNA, 16 nt, Homo sapiens
auuacuguauauacuu

SEQ ID NO: 474437 - RNA, 16 nt, Homo sapiens
auuagaauaccacagg

SEQ ID NO: 474438 - RNA, 22 nt, Homo sapiens
auuagauuuggaggcuaccuca

SEQ ID NO: 474439 - RNA, 23 nt, Homo sapiens
auuagauuuggaggcuaccucac

SEQ ID NO: 474440 - RNA, 17 nt, Homo sapiens
auuagccgggcauggug

SEQ ID NO: 474441 - RNA, 17 nt, Homo sapiens
auuauaagugcagagau

SEQ ID NO: 474442 - RNA, 22 nt, Homo sapiens
auuauaggcaugagccaccacg

SEQ ID NO: 474443 - RNA, 18 nt, Homo sapiens
auuaucuaugauaugcua

SEQ ID NO: 474444 - RNA, 14 nt, Homo sapiens
auuauuuuaaucua

SEQ ID NO: 474445 - RNA, 22 nt, Homo sapiens
auucaaaauguacuauguguua

SEQ ID NO: 474446 - RNA, 16 nt, Homo sapiens
auucaucucaaggaau

SEQ ID NO: 474447 - RNA, 15 nt, Homo sapiens
auucaugcaucucaa

SEQ ID NO: 474448 - RNA, 17 nt, Homo sapiens
auucaugcaucucaaca

SEQ ID NO: 474449 - RNA, 14 nt, Homo sapiens
auucauuccauuug

SEQ ID NO: 474450 - RNA, 23 nt, Homo sapiens
auucccuucaucuggaaccauca

SEQ ID NO: 474451 - RNA, 22 nt, Homo sapiens
auaacuaggcguggacuuacua

SEQ ID NO: 474452 - RNA, 22 nt, Homo sapiens
auaacuggcuucugcuugucau

SEQ ID NO: 474453 - RNA, 17 nt, Homo sapiens
auaagugcagagauuaa

SEQ ID NO: 474454 - RNA, 19 nt, Homo sapiens
auaaguucuaguugcuugu

SEQ ID NO: 474455 - RNA, 19 nt, Homo sapiens
auaauaaaauucauuccau

SEQ ID NO: 474456 - RNA, 23 nt, Homo sapiens
auaauagguuugugacuuuccua

SEQ ID NO: 474457 - RNA, 20 nt, Homo sapiens
auaaugucauuaaacaugac

SEQ ID NO: 474458 - RNA, 13 nt, Homo sapiens
auaauucagcucu

SEQ ID NO: 474459 - RNA, 17 nt, Homo sapiens
auacagaaaaaccacau

SEQ ID NO: 474460 - RNA, 17 nt, Homo sapiens
auacaggacauucucau

SEQ ID NO: 474461 - RNA, 19 nt, Homo sapiens
auacauuaucucacuugug

SEQ ID NO: 474462 - RNA, 20 nt, Homo sapiens
auacauuauuggacuuccau

SEQ ID NO: 474463 - RNA, 18 nt, Homo sapiens
auacccacacagucacag

SEQ ID NO: 474464 - RNA, 19 nt, Homo sapiens
auaccugguaagcaaaaac

SEQ ID NO: 474465 - RNA, 22 nt, Homo sapiens
auacuuuuugcauauguaagga

SEQ ID NO: 474466 - RNA, 17 nt, Homo sapiens
auagagaucuuauguca

SEQ ID NO: 474467 - RNA, 20 nt, Homo sapiens
auagcugugugaacguguau

SEQ ID NO: 474468 - RNA, 15 nt, Homo sapiens
auaggcaugagccac

SEQ ID NO: 474469 - RNA, 17 nt, Homo sapiens
auaguaggacugcugac

SEQ ID NO: 474470 - RNA, 19 nt, Homo sapiens
auaguaggacugcugacau

SEQ ID NO: 474471 - RNA, 23 nt, Homo sapiens
auaguguuggaaaaugugcaaua

SEQ ID NO: 474472 - RNA, 21 nt, Homo sapiens
auauaauuuccauagugugag

SEQ ID NO: 474473 - RNA, 14 nt, Homo sapiens
auauauuaagugac

SEQ ID NO: 474474 - RNA, 14 nt, Homo sapiens
auauauugcugcug

SEQ ID NO: 474475 - RNA, 19 nt, Homo sapiens
auaucaagagacaugguau

SEQ ID NO: 474476 - RNA, 13 nt, Homo sapiens
auaucaugcucca

SEQ ID NO: 474477 - RNA, 12 nt, Homo sapiens
auaugauguuua

SEQ ID NO: 474478 - RNA, 18 nt, Homo sapiens
auauguaaggaagucaga

SEQ ID NO: 474479 - RNA, 15 nt, Homo sapiens
auauguuaaauguau

SEQ ID NO: 474480 - RNA, 15 nt, Homo sapiens
auauuaaaaucacaa

SEQ ID NO: 474481 - RNA, 15 nt, Homo sapiens
auauuauuugcagau

SEQ ID NO: 474482 - RNA, 22 nt, Homo sapiens
auauuuguaugauccuaaugaa

SEQ ID NO: 474483 - RNA, 19 nt, Homo sapiens
auauuuuuaugugcaauaa

SEQ ID NO: 474484 - RNA, 22 nt, Homo sapiens
aucaaauggaagacacauugaa

SEQ ID NO: 474485 - RNA, 14 nt, Homo sapiens
aucaagcagccaag

SEQ ID NO: 474486 - RNA, 19 nt, Homo sapiens
aucaauccagcgguucuca

SEQ ID NO: 474487 - RNA, 18 nt, Homo sapiens
aucaaugaaaugauguca

SEQ ID NO: 474488 - RNA, 22 nt, Homo sapiens
aucaauucuauuacgugcaaua

SEQ ID NO: 474489 - RNA, 23 nt, Homo sapiens
aucaauucuauuacgugcaauac

SEQ ID NO: 474490 - RNA, 17 nt, Homo sapiens
aucacacaacaaauaau

SEQ ID NO: 474491 - RNA, 21 nt, Homo sapiens
aucacagcuaacaauugugaa

SEQ ID NO: 474492 - RNA, 20 nt, Homo sapiens
aucaccagagaccaaacaag

SEQ ID NO: 474493 - RNA, 22 nt, Homo sapiens
aucaccuagaaacuuguuagaa

SEQ ID NO: 474494 - RNA, 15 nt, Homo sapiens
aucacgacaaucaca

SEQ ID NO: 474495 - RNA, 16 nt, Homo sapiens
aucacgccauugcacu

SEQ ID NO: 474496 - RNA, 14 nt, Homo sapiens
aucacucauuuauu

SEQ ID NO: 474497 - RNA, 13 nt, Homo sapiens
aucacucuuugca

SEQ ID NO: 474498 - RNA, 20 nt, Homo sapiens
aucagagacaguaucucuag

SEQ ID NO: 474499 - RNA, 17 nt, Homo sapiens
aucaggagaaaaagccu

SEQ ID NO: 474500 - RNA, 16 nt, Homo sapiens
aucauaauucagcucu

SEQ ID NO: 474501 - RNA, 14 nt, Homo sapiens
aucauaugggauac

SEQ ID NO: 474502 - RNA, 17 nt, Homo sapiens
aucaucaguggagccau

SEQ ID NO: 474503 - RNA, 15 nt, Homo sapiens
aucauggacugagcu

SEQ ID NO: 474504 - RNA, 21 nt, Homo sapiens
aucaugguuuuucuuaguaga

SEQ ID NO: 474505 - RNA, 15 nt, Homo sapiens
aucauuaugaaguca

SEQ ID NO: 474506 - RNA, 17 nt, Homo sapiens
auccaacaugugcucag

SEQ ID NO: 474507 - RNA, 20 nt, Homo sapiens
auccaacaugugcucaggga

SEQ ID NO: 474508 - RNA, 13 nt, Homo sapiens
auccaacccgggg

SEQ ID NO: 474509 - RNA, 13 nt, Homo sapiens
auccaauaccucu

SEQ ID NO: 474510 - RNA, 15 nt, Homo sapiens
auccaauaccucuug

SEQ ID NO: 474511 - RNA, 12 nt, Homo sapiens
auccaauggauu

SEQ ID NO: 474512 - RNA, 16 nt, Homo sapiens
auccacacugagcuga

SEQ ID NO: 474513 - RNA, 12 nt, Homo sapiens
auccaccugccu

SEQ ID NO: 474514 - RNA, 16 nt, Homo sapiens
auccagcgguucucaa

SEQ ID NO: 474515 - RNA, 15 nt, Homo sapiens
auccgaggcaggguc

SEQ ID NO: 474516 - RNA, 22 nt, Homo sapiens
auccgaggcagggucaggagag

SEQ ID NO: 474517 - RNA, 23 nt, Homo sapiens
auccuaaaugaguaaacccagcu

SEQ ID NO: 474518 - RNA, 21 nt, Homo sapiens
auccuggcucuuuggagauca

SEQ ID NO: 474519 - RNA, 23 nt, Homo sapiens
aucgcugcgauacuggcauuucc

SEQ ID NO: 474520 - RNA, 16 nt, Homo sapiens
aucgcugucaucucag

SEQ ID NO: 474521 - RNA, 15 nt, Homo sapiens
aucgggagugcacuu

SEQ ID NO: 474522 - RNA, 15 nt, Homo sapiens
aucuacauacacagu

SEQ ID NO: 474523 - RNA, 22 nt, Homo sapiens
aucuaugaaauaucaugcucca

SEQ ID NO: 474524 - RNA, 23 nt, Homo sapiens
aucucagcuccugaaaaaugccu

SEQ ID NO: 474525 - RNA, 15 nt, Homo sapiens
aucuccucagcaccc

SEQ ID NO: 474526 - RNA, 22 nt, Homo sapiens
aucucugucccacuuggcauca

SEQ ID NO: 474527 - RNA, 20 nt, Homo sapiens
aucugaggguauaaagacau

SEQ ID NO: 474528 - RNA, 15 nt, Homo sapiens
aucugccacguguau

SEQ ID NO: 474529 - RNA, 19 nt, Homo sapiens
aucugccuguucugaggau

SEQ ID NO: 474530 - RNA, 23 nt, Homo sapiens
aucugggcauagaugcaggugag

SEQ ID NO: 474531 - RNA, 21 nt, Homo sapiens
aucuucagggaacugcauaga

SEQ ID NO: 474532 - RNA, 22 nt, Homo sapiens
aucuucagggaacugcauagau

SEQ ID NO: 474533 - RNA, 15 nt, Homo sapiens
aucuuccauggauuu

SEQ ID NO: 474534 - RNA, 17 nt, Homo sapiens
aucuucccacuuugcca

SEQ ID NO: 474535 - RNA, 15 nt, Homo sapiens
aucuuucacagggga

SEQ ID NO: 474536 - RNA, 17 nt, Homo sapiens
augaaauaucaugcucc

SEQ ID NO: 474537 - RNA, 17 nt, Homo sapiens
augaagggaugcugcaa

SEQ ID NO: 474538 - RNA, 17 nt, Homo sapiens
augaaugggagugaggg

SEQ ID NO: 474539 - RNA, 20 nt, Homo sapiens
augacagcuguuccacaggg

SEQ ID NO: 474540 - RNA, 19 nt, Homo sapiens
augacauccaauacagagu

SEQ ID NO: 474541 - RNA, 17 nt, Homo sapiens
augacauucaugccugg

SEQ ID NO: 474542 - RNA, 15 nt, Homo sapiens
augacuaaagacaua

SEQ ID NO: 474543 - RNA, 21 nt, Homo sapiens
augacucaccuugcucugcca

SEQ ID NO: 474544 - RNA, 16 nt, Homo sapiens
augagagacacacuga

SEQ ID NO: 474545 - RNA, 20 nt, Homo sapiens
augagcaucccaggaucgca

SEQ ID NO: 474546 - RNA, 15 nt, Homo sapiens
augagcccuagaaga

SEQ ID NO: 474547 - RNA, 14 nt, Homo sapiens
augauaacuggaaa

SEQ ID NO: 474548 - RNA, 19 nt, Homo sapiens
augauaauauuguggugcc

SEQ ID NO: 474549 - RNA, 19 nt, Homo sapiens
augauccuuaugaugucca

SEQ ID NO: 474550 - RNA, 18 nt, Homo sapiens
augaugcuauuaauacug

SEQ ID NO: 474551 - RNA, 22 nt, Homo sapiens
augaugucccuauggaagcaua

SEQ ID NO: 474552 - RNA, 18 nt, Homo sapiens
augaugugggucaaggaa

SEQ ID NO: 474553 - RNA, 18 nt, Homo sapiens
augcaacaacauguauaa

SEQ ID NO: 474554 - RNA, 19 nt, Homo sapiens
augcacuaaucaauacuuu

SEQ ID NO: 474555 - RNA, 23 nt, Homo sapiens
augcauauccaacaugugcucag

SEQ ID NO: 474556 - RNA, 17 nt, Homo sapiens
augcauggaaauucccu

SEQ ID NO: 474557 - RNA, 16 nt, Homo sapiens
augcauguacccuaag

SEQ ID NO: 474558 - RNA, 20 nt, Homo sapiens
augcauguuuuccagcuccu

SEQ ID NO: 474559 - RNA, 16 nt, Homo sapiens
augccaagcacugugc

SEQ ID NO: 474560 - RNA, 13 nt, Homo sapiens
augccagcuauaa

SEQ ID NO: 474561 - RNA, 13 nt, Homo sapiens
augcccagcugua

SEQ ID NO: 474562 - RNA, 16 nt, Homo sapiens
augcguuuaaucacau

SEQ ID NO: 474563 - RNA, 18 nt, Homo sapiens
augcuauaacuauguuga

SEQ ID NO: 474564 - RNA, 21 nt, Homo sapiens
augcugauguccucaccacau

SEQ ID NO: 474565 - RNA, 21 nt, Homo sapiens
augcugucuguccaacugccu

SEQ ID NO: 474566 - RNA, 16 nt, Homo sapiens
auggaccagaagccaa

SEQ ID NO: 474567 - RNA, 14 nt, Homo sapiens
auggacucuucccc

SEQ ID NO: 474568 - RNA, 15 nt, Homo sapiens
auggagugccuguac

SEQ ID NO: 474569 - RNA, 23 nt, Homo sapiens
auggcacuaguauuucuaugaaa

SEQ ID NO: 474570 - RNA, 12 nt, Homo sapiens
auggcagggaua

SEQ ID NO: 474571 - RNA, 14 nt, Homo sapiens
auggugaugaaaug

SEQ ID NO: 474572 - RNA, 15 nt, Homo sapiens
auguacuauguguua

SEQ ID NO: 474573 - RNA, 16 nt, Homo sapiens
auguacuauguguuaa

SEQ ID NO: 474574 - RNA, 17 nt, Homo sapiens
auguagauaaagcacug

SEQ ID NO: 474575 - RNA, 12 nt, Homo sapiens
auguagucucau

SEQ ID NO: 474576 - RNA, 15 nt, Homo sapiens
auguauaugcaauau

SEQ ID NO: 474577 - RNA, 22 nt, Homo sapiens
augucccuauggaagcauauug

SEQ ID NO: 474578 - RNA, 19 nt, Homo sapiens
augucguuugaaucacagu

SEQ ID NO: 474579 - RNA, 16 nt, Homo sapiens
augugaaucaugguuu

SEQ ID NO: 474580 - RNA, 10 nt, Homo sapiens
augugcaaua

SEQ ID NO: 474581 - RNA, 11 nt, Homo sapiens
augugcaauau

SEQ ID NO: 474582 - RNA, 12 nt, Homo sapiens
augugugauuca

SEQ ID NO: 474583 - RNA, 17 nt, Homo sapiens
auguucacauacagacu

SEQ ID NO: 474584 - RNA, 16 nt, Homo sapiens
auguucacuguggcau

SEQ ID NO: 474585 - RNA, 14 nt, Homo sapiens
auguugcccagugu

SEQ ID NO: 474586 - RNA, 16 nt, Homo sapiens
auguugcccagugugu

SEQ ID NO: 474587 - RNA, 20 nt, Homo sapiens
auguugcccaguguguuucu

SEQ ID NO: 474588 - RNA, 12 nt, Homo sapiens
auguugccuguc

SEQ ID NO: 474589 - RNA, 15 nt, Homo sapiens
auguuuaaaagcaua

SEQ ID NO: 474590 - RNA, 13 nt, Homo sapiens
auguuuugcccac

SEQ ID NO: 474591 - RNA, 15 nt, Homo sapiens
cggccuugggaaauc

SEQ ID NO: 474592 - RNA, 19 nt, Homo sapiens
cggcgggagggcgcggggc

SEQ ID NO: 474593 - RNA, 16 nt, Homo sapiens
cggggacccccaacuc

SEQ ID NO: 474594 - RNA, 16 nt, Homo sapiens
cgugaaaaugcuguau

SEQ ID NO: 474595 - RNA, 14 nt, Homo sapiens
cgugacaacacaaa

SEQ ID NO: 474596 - RNA, 9 nt, Homo sapiens
cgugcaaua

SEQ ID NO: 474597 - RNA, 17 nt, Homo sapiens
cgugggccugagaccaa

SEQ ID NO: 474598 - RNA, 15 nt, Homo sapiens
gacaugggacauuug

SEQ ID NO: 474599 - RNA, 16 nt, Homo sapiens
caccuaguaugcucag

SEQ ID NO: 474600 - RNA, 14 nt, Homo sapiens
caccuaguucuccc

SEQ ID NO: 474601 - RNA, 16 nt, Homo sapiens
caccucccugcaauaa

SEQ ID NO: 474602 - RNA, 17 nt, Homo sapiens
caccucccugcaauaaa

SEQ ID NO: 474603 - RNA, 16 nt, Homo sapiens
caccugggcugaggca

SEQ ID NO: 474604 - RNA, 15 nt, Homo sapiens
caccuggggcugcug

SEQ ID NO: 474605 - RNA, 12 nt, Homo sapiens
cacgaagucagu

SEQ ID NO: 474606 - RNA, 18 nt, Homo sapiens
cacgccauugcacuccag

SEQ ID NO: 474607 - RNA, 17 nt, Homo sapiens
cacgcccaccagccuug

SEQ ID NO: 474608 - RNA, 20 nt, Homo sapiens
cacgugagaucauucacuca

SEQ ID NO: 474609 - RNA, 16 nt, Homo sapiens
cacucauacaucuggc

SEQ ID NO: 474610 - RNA, 16 nt, Homo sapiens
cacucauuuauuucca

SEQ ID NO: 474611 - RNA, 19 nt, Homo sapiens
cacuccaggacaguggaga

SEQ ID NO: 474612 - RNA, 14 nt, Homo sapiens
cacucuuugcacac

SEQ ID NO: 474613 - RNA, 19 nt, Homo sapiens
cacugcaggcaucacagcu

SEQ ID NO: 474614 - RNA, 19 nt, Homo sapiens
cacugccagucucacugug

SEQ ID NO: 474615 - RNA, 23 nt, Homo sapiens
aagaguccuacagauggacugaa

SEQ ID NO: 474616 - RNA, 20 nt, Homo sapiens
aagaucacgccauugcacuc

SEQ ID NO: 474617 - RNA, 14 nt, Homo sapiens
aagaugaugcuauu

SEQ ID NO: 474618 - RNA, 16 nt, Homo sapiens
aagaugaugcuauuaa

SEQ ID NO: 474619 - RNA, 19 nt, Homo sapiens
aagaugcagcaaaauguga

SEQ ID NO: 474620 - RNA, 21 nt, Homo sapiens
aagaugguaccaccagucuga

SEQ ID NO: 474621 - RNA, 15 nt, Homo sapiens
aagcaaacacauuaa

SEQ ID NO: 474622 - RNA, 20 nt, Homo sapiens
aagcacaggugggcuuccca

SEQ ID NO: 474623 - RNA, 13 nt, Homo sapiens
aagcaccaaucau

SEQ ID NO: 474624 - RNA, 16 nt, Homo sapiens
aagcauauuguuauua

SEQ ID NO: 474625 - RNA, 20 nt, Homo sapiens
aagcaucauuauuugcagag

SEQ ID NO: 474626 - RNA, 16 nt, Homo sapiens
aagccaaagccaauaa

SEQ ID NO: 474627 - RNA, 18 nt, Homo sapiens
aagccaagagucauguca

SEQ ID NO: 474628 - RNA, 18 nt, Homo sapiens
aagccagauuuuccugaa

SEQ ID NO: 474629 - RNA, 19 nt, Homo sapiens
aagccagauuuuccugaaa

SEQ ID NO: 474630 - RNA, 17 nt, Homo sapiens
aagccgcaucccagacu

SEQ ID NO: 474631 - RNA, 17 nt, Homo sapiens
aagccugguggcaauaa

SEQ ID NO: 474632 - RNA, 22 nt, Homo sapiens
aagccuuggggcugaugcaguu

SEQ ID NO: 474633 - RNA, 13 nt, Homo sapiens
aagcuacuugaag

SEQ ID NO: 474634 - RNA, 15 nt, Homo sapiens
aagcuagaaccugga

SEQ ID NO: 474635 - RNA, 14 nt, Homo sapiens
aagcucauccauuu

SEQ ID NO: 474636 - RNA, 20 nt, Homo sapiens
aagcucuugaagacacugaa

SEQ ID NO: 474637 - RNA, 19 nt, Homo sapiens
aagcugguuaaaguggaug

SEQ ID NO: 474638 - RNA, 23 nt, Homo sapiens
aaggaagaaauuccaggaaaauc

SEQ ID NO: 474639 - RNA, 14 nt, Homo sapiens
aaggaauccacucc

SEQ ID NO: 474640 - RNA, 19 nt, Homo sapiens
aaggaauuaucaauuacaa

SEQ ID NO: 474641 - RNA, 15 nt, Homo sapiens
aaggcaaaaaugugc

SEQ ID NO: 474642 - RNA, 18 nt, Homo sapiens
aaggcuggagugcagugg

SEQ ID NO: 474643 - RNA, 21 nt, Homo sapiens
aaggcuuacacccacagugga

SEQ ID NO: 474644 - RNA, 13 nt, Homo sapiens
aaggcuuggcaca

SEQ ID NO: 474645 - RNA, 20 nt, Homo sapiens
aagggccagcuggaggugaa

SEQ ID NO: 474646 - RNA, 18 nt, Homo sapiens
aagggcucacgcauucag

SEQ ID NO: 474647 - RNA, 14 nt, Homo sapiens
aaggggccuggaag

SEQ ID NO: 474648 - RNA, 16 nt, Homo sapiens
aaggggcugucuccca

SEQ ID NO: 474649 - RNA, 22 nt, Homo sapiens
aaggguucaccaggucagggag

SEQ ID NO: 474650 - RNA, 17 nt, Homo sapiens
aaggugagcaaagggcu

SEQ ID NO: 474651 - RNA, 17 nt, Homo sapiens
aagguggggacagggau

SEQ ID NO: 474652 - RNA, 12 nt, Homo sapiens
aaguagcuggaa

SEQ ID NO: 474653 - RNA, 14 nt, Homo sapiens
aagucuuccauaga

SEQ ID NO: 474654 - RNA, 22 nt, Homo sapiens
aagucuuccauagagacuuugu

SEQ ID NO: 474655 - RNA, 17 nt, Homo sapiens
aagugcauuuuuaucug

SEQ ID NO: 474656 - RNA, 23 nt, Homo sapiens
aagugcauuuuuaucugugaguu

SEQ ID NO: 474657 - RNA, 21 nt, Homo sapiens
aagugugcuggccucucugac

SEQ ID NO: 474658 - RNA, 14 nt, Homo sapiens
aaguuaacacucua

SEQ ID NO: 474659 - RNA, 21 nt, Homo sapiens
aaguugauauagaacagugcu

SEQ ID NO: 474660 - RNA, 15 nt, Homo sapiens
aauaaauaaacgagc

SEQ ID NO: 474661 - RNA, 12 nt, Homo sapiens
aauaaaugacaa

SEQ ID NO: 474662 - RNA, 22 nt, Homo sapiens
aauaaaugacaagugagacaaa

SEQ ID NO: 474663 - RNA, 14 nt, Homo sapiens
aauaacaaucacaa

SEQ ID NO: 474664 - RNA, 15 nt, Homo sapiens
aauaaguacugugua

SEQ ID NO: 474665 - RNA, 16 nt, Homo sapiens
aauaauguguacauua

SEQ ID NO: 474666 - RNA, 22 nt, Homo sapiens
aauacauaaaguaugugcauau

SEQ ID NO: 474667 - RNA, 24 nt, Homo sapiens
aauacauaaaguaugugcauauuu

SEQ ID NO: 474668 - RNA, 15 nt, Homo sapiens
aauagaaacauugaa

SEQ ID NO: 474669 - RNA, 14 nt, Homo sapiens
aauagaacagagaa

SEQ ID NO: 474670 - RNA, 16 nt, Homo sapiens
aauagggaaguaacag

SEQ ID NO: 474671 - RNA, 19 nt, Homo sapiens
aauaggugugaacagggaa

SEQ ID NO: 474672 - RNA, 20 nt, Homo sapiens
aauauauaguggacaguaac

SEQ ID NO: 474673 - RNA, 22 nt, Homo sapiens
aauauuagacaaaguucauuca

SEQ ID NO: 474674 - RNA, 18 nt, Homo sapiens
aauauuugcaagacauag

SEQ ID NO: 474675 - RNA, 23 nt, Homo sapiens
aauauuuuccaugaaaaugcaac

SEQ ID NO: 474676 - RNA, 17 nt, Homo sapiens
aauauuuuuaugugcaa

SEQ ID NO: 474677 - RNA, 13 nt, Homo sapiens
aaucaaauggugu

SEQ ID NO: 474678 - RNA, 21 nt, Homo sapiens
aaucaaggugauugugauuau

SEQ ID NO: 474679 - RNA, 18 nt, Homo sapiens
aaucaccuaccuucacca

SEQ ID NO: 474680 - RNA, 15 nt, Homo sapiens
aaucacucagugauu

SEQ ID NO: 474681 - RNA, 22 nt, Homo sapiens
aaucacucagugauugcaauuu

SEQ ID NO: 474682 - RNA, 16 nt, Homo sapiens
aaucacuucugagaac

SEQ ID NO: 474683 - RNA, 15 nt, Homo sapiens
aaucaggcucaaaac

SEQ ID NO: 474684 - RNA, 13 nt, Homo sapiens
aauccaaaccaca

SEQ ID NO: 474685 - RNA, 15 nt, Homo sapiens
aauccagaacucaaa

SEQ ID NO: 474686 - RNA, 17 nt, Homo sapiens
aaucuucagaccuagaa

SEQ ID NO: 474687 - RNA, 18 nt, Homo sapiens
aaugaauaacagccucau

SEQ ID NO: 474688 - RNA, 12 nt, Homo sapiens
aaugacuuuucc

SEQ ID NO: 474689 - RNA, 21 nt, Homo sapiens
aaugagacugaacugugugaa

SEQ ID NO: 474690 - RNA, 18 nt, Homo sapiens
aaugagagacacacugaa

SEQ ID NO: 474691 - RNA, 15 nt, Homo sapiens
aaugauaacuggaaa

SEQ ID NO: 474692 - RNA, 20 nt, Homo sapiens
aaugaugucaugucagcucc

SEQ ID NO: 474693 - RNA, 13 nt, Homo sapiens
aaugauguugaau

SEQ ID NO: 474694 - RNA, 16 nt, Homo sapiens
aaugcagagucaauga

SEQ ID NO: 474695 - RNA, 19 nt, Homo sapiens
aaugcagcgugaagggauu

SEQ ID NO: 474696 - RNA, 20 nt, Homo sapiens
aaugcauuuaaacucauuug

SEQ ID NO: 474697 - RNA, 21 nt, Homo sapiens
aauggcagggauacccaguga

SEQ ID NO: 474698 - RNA, 22 nt, Homo sapiens
aauggcagggauacccagugau

SEQ ID NO: 474699 - RNA, 15 nt, Homo sapiens
aauggggugcaugaa

SEQ ID NO: 474700 - RNA, 17 nt, Homo sapiens
aauggugaaaugcagag

SEQ ID NO: 474701 - RNA, 14 nt, Homo sapiens
aaugguuugaauau

SEQ ID NO: 474702 - RNA, 15 nt, Homo sapiens
aaugucagggccagg

SEQ ID NO: 474703 - RNA, 11 nt, Homo sapiens
aaugugcaaua

SEQ ID NO: 474704 - RNA, 12 nt, Homo sapiens
aauuaacacugc

SEQ ID NO: 474705 - RNA, 15 nt, Homo sapiens
acuaguaaagacaua

SEQ ID NO: 474706 - RNA, 22 nt, Homo sapiens
acuaucucauuuccaagcaagu

SEQ ID NO: 474707 - RNA, 14 nt, Homo sapiens
acuauucacuaaaa

SEQ ID NO: 474708 - RNA, 10 nt, Homo sapiens
acucaaacau

SEQ ID NO: 474709 - RNA, 12 nt, Homo sapiens
acucaaaccaaa

SEQ ID NO: 474710 - RNA, 21 nt, Homo sapiens
acucagccuggcugauuauca

SEQ ID NO: 474711 - RNA, 21 nt, Homo sapiens
acucagugauugcaauuugca

SEQ ID NO: 474712 - RNA, 14 nt, Homo sapiens
acucauccauuaau

SEQ ID NO: 474713 - RNA, 16 nt, Homo sapiens
acuccuaggcaggaca

SEQ ID NO: 474714 - RNA, 20 nt, Homo sapiens
acuccuaggcaggacaugcu

SEQ ID NO: 474715 - RNA, 18 nt, Homo sapiens
acuccugaccucagguga

SEQ ID NO: 474716 - RNA, 22 nt, Homo sapiens
acucugcuaccccuacugaaau

SEQ ID NO: 474717 - RNA, 15 nt, Homo sapiens
acucugucucaaaaa

SEQ ID NO: 474718 - RNA, 10 nt, Homo sapiens
acucuugagc

SEQ ID NO: 474719 - RNA, 18 nt, Homo sapiens
acugaaaacuugccguua

SEQ ID NO: 474720 - RNA, 13 nt, Homo sapiens
acugaacuuugcu

SEQ ID NO: 474721 - RNA, 15 nt, Homo sapiens
acugacuccugugga

SEQ ID NO: 474722 - RNA, 12 nt, Homo sapiens
acugagcuguca

SEQ ID NO: 474723 - RNA, 21 nt, Homo sapiens
acugauagaugucuauucuug

SEQ ID NO: 474724 - RNA, 21 nt, Homo sapiens
acugauucauacauuaucuca

SEQ ID NO: 474725 - RNA, 21 nt, Homo sapiens
acugcacagaagacagcagca

SEQ ID NO: 474726 - RNA, 20 nt, Homo sapiens
acugcacucuagccugggug

SEQ ID NO: 474727 - RNA, 18 nt, Homo sapiens
acugcaggcaucacagcu

SEQ ID NO: 474728 - RNA, 21 nt, Homo sapiens
acugcauaaaaagugccugua

SEQ ID NO: 474729 - RNA, 15 nt, Homo sapiens
acuggaugaggucau

SEQ ID NO: 474730 - RNA, 18 nt, Homo sapiens
acuggcaaccugcuuuca

SEQ ID NO: 474731 - RNA, 21 nt, Homo sapiens
acuguaaagcuuugugcagau

SEQ ID NO: 474732 - RNA, 17 nt, Homo sapiens
acuguauauacuuugcc

SEQ ID NO: 474733 - RNA, 16 nt, Homo sapiens
acugucuugaagacaa

SEQ ID NO: 474734 - RNA, 18 nt, Homo sapiens
acuguucuauucaucuca

SEQ ID NO: 474735 - RNA, 14 nt, Homo sapiens
acuuaauaaugugu

SEQ ID NO: 474736 - RNA, 14 nt, Homo sapiens
acuuaucaucacac

SEQ ID NO: 474737 - RNA, 13 nt, Homo sapiens
acuucaaggguuu

SEQ ID NO: 474738 - RNA, 15 nt, Homo sapiens
acuucacacagacaa

SEQ ID NO: 474739 - RNA, 20 nt, Homo sapiens
acuucucucaucugggcaaa

SEQ ID NO: 474740 - RNA, 17 nt, Homo sapiens
acuugacagaacacugu

SEQ ID NO: 474741 - RNA, 19 nt, Homo sapiens
acuuggcuacacagggaug

SEQ ID NO: 474742 - RNA, 11 nt, Homo sapiens
acuuguugcug

SEQ ID NO: 474743 - RNA, 20 nt, Homo sapiens
acuuguuuggccuauuccau

SEQ ID NO: 474744 - RNA, 15 nt, Homo sapiens
acuuuccgcuuucac

SEQ ID NO: 474745 - RNA, 16 nt, Homo sapiens
auuaucuaaaguauga

SEQ ID NO: 474746 - RNA, 18 nt, Homo sapiens
auuaucucacuugugcca

SEQ ID NO: 474747 - RNA, 15 nt, Homo sapiens
auuauuuuggaucua

SEQ ID NO: 474748 - RNA, 13 nt, Homo sapiens
auucacaguguga

SEQ ID NO: 474749 - RNA, 16 nt, Homo sapiens
auucacucauacaucu

SEQ ID NO: 474750 - RNA, 14 nt, Homo sapiens
auucaggcuuugga

SEQ ID NO: 474751 - RNA, 19 nt, Homo sapiens
auucaucucucuuuaauau

SEQ ID NO: 474752 - RNA, 13 nt, Homo sapiens
auucaugcaucuc

SEQ ID NO: 474753 - RNA, 11 nt, Homo sapiens
auucauuccau

SEQ ID NO: 474754 - RNA, 12 nt, Homo sapiens
auucauuccauu

SEQ ID NO: 474755 - RNA, 23 nt, Homo sapiens
auucccagcaccuaguaugcuca

SEQ ID NO: 474756 - RNA, 16 nt, Homo sapiens
auuccugagccagugu

SEQ ID NO: 474757 - RNA, 20 nt, Homo sapiens
auuccuuagcuuagaccuca

SEQ ID NO: 474758 - RNA, 22 nt, Homo sapiens
auucuaaggaauaugagcuuua

SEQ ID NO: 474759 - RNA, 18 nt, Homo sapiens
auucuauuacgugcaaua

SEQ ID NO: 474760 - RNA, 19 nt, Homo sapiens
auucuauuacgugcaauac

SEQ ID NO: 474761 - RNA, 22 nt, Homo sapiens
auucucaggccaucaucagugg

SEQ ID NO: 474762 - RNA, 14 nt, Homo sapiens
auucucgcuuaaaa

SEQ ID NO: 474763 - RNA, 16 nt, Homo sapiens
auucugucaaugucuu

SEQ ID NO: 474764 - RNA, 18 nt, Homo sapiens
auucuuuauucuuuuacu

SEQ ID NO: 474765 - RNA, 21 nt, Homo sapiens
auugaaccucuuggguucaag

SEQ ID NO: 474766 - RNA, 17 nt, Homo sapiens
auugaccuuugcacgaa

SEQ ID NO: 474767 - RNA, 16 nt, Homo sapiens
auugacugauggugaa

SEQ ID NO: 474768 - RNA, 20 nt, Homo sapiens
auugaugucaaaaacuucaa

SEQ ID NO: 474769 - RNA, 19 nt, Homo sapiens
auugccuuuagugaucaca

SEQ ID NO: 474770 - RNA, 20 nt, Homo sapiens
auugccuuuagugaucacag

SEQ ID NO: 474771 - RNA, 21 nt, Homo sapiens
auugcuuaucaguaguaucaa

SEQ ID NO: 474772 - RNA, 15 nt, Homo sapiens
auuggaaaggcagcu

SEQ ID NO: 474773 - RNA, 15 nt, Homo sapiens
auuggucuccucuca

SEQ ID NO: 474774 - RNA, 14 nt, Homo sapiens
auuguaaaacccca

SEQ ID NO: 474775 - RNA, 20 nt, Homo sapiens
auuguaaacauuaguucuau

SEQ ID NO: 474776 - RNA, 16 nt, Homo sapiens
auugucuguaaugaca

SEQ ID NO: 474777 - RNA, 15 nt, Homo sapiens
auuguugaaagccau

SEQ ID NO: 474778 - RNA, 13 nt, Homo sapiens
auuuaacuugagg

SEQ ID NO: 474779 - RNA, 17 nt, Homo sapiens
auuuaagagacagucac

SEQ ID NO: 474780 - RNA, 18 nt, Homo sapiens
auuuauugcuguguaaca

SEQ ID NO: 474781 - RNA, 17 nt, Homo sapiens
auuuauuuuuuuacuuc

SEQ ID NO: 474782 - RNA, 20 nt, Homo sapiens
auuucaagaauguuauucaa

SEQ ID NO: 474783 - RNA, 14 nt, Homo sapiens
auuuccacaccaag

SEQ ID NO: 474784 - RNA, 16 nt, Homo sapiens
auuugacuuguugcug

SEQ ID NO: 474785 - RNA, 17 nt, Homo sapiens
auuugaguauugcugau

SEQ ID NO: 474786 - RNA, 14 nt, Homo sapiens
auuugauacagguu

SEQ ID NO: 474787 - RNA, 14 nt, Homo sapiens
auuugcaagacaua

SEQ ID NO: 474788 - RNA, 14 nt, Homo sapiens
auuugcagagacag

SEQ ID NO: 474789 - RNA, 15 nt, Homo sapiens
auuugcauauguaug

SEQ ID NO: 474790 - RNA, 16 nt, Homo sapiens
auuugcucauggaauu

SEQ ID NO: 474791 - RNA, 18 nt, Homo sapiens
auuuggaaaauaaaucaa

SEQ ID NO: 474792 - RNA, 18 nt, Homo sapiens
auuuggaggcuaccucac

SEQ ID NO: 474793 - RNA, 19 nt, Homo sapiens
auuuguaaauuuucaagca

SEQ ID NO: 474794 - RNA, 14 nt, Homo sapiens
auuuuaauuugaua

SEQ ID NO: 474795 - RNA, 21 nt, Homo sapiens
auuuuaggcagggauuugagg

SEQ ID NO: 474796 - RNA, 14 nt, Homo sapiens
auuuuauacauuaa

SEQ ID NO: 474797 - RNA, 16 nt, Homo sapiens
auuuuauuccaaaaua

SEQ ID NO: 474798 - RNA, 22 nt, Homo sapiens
auuuucuccgaaaggcaaaaau

SEQ ID NO: 474799 - RNA, 23 nt, Homo sapiens
auuuuggaucuaucaccugucau

SEQ ID NO: 474800 - RNA, 20 nt, Homo sapiens
auuuuguguucaguacaauu

SEQ ID NO: 474801 - RNA, 15 nt, Homo sapiens
auuuuuaugugcaau

SEQ ID NO: 474802 - RNA, 16 nt, Homo sapiens
auuuuuaugugcaaua

SEQ ID NO: 474803 - RNA, 17 nt, Homo sapiens
auuuuuauuugagacag

SEQ ID NO: 474804 - RNA, 14 nt, Homo sapiens
auuuuugaaaccaa

SEQ ID NO: 474805 - RNA, 19 nt, Homo sapiens
auuuuugaauacaggcaua

SEQ ID NO: 474806 - RNA, 22 nt, Homo sapiens
auuuuuuugugggaaauccaca

SEQ ID NO: 474807 - RNA, 10 nt, Homo sapiens
caaaaacacc

SEQ ID NO: 474808 - RNA, 18 nt, Homo sapiens
caaaaauacucacauggc

SEQ ID NO: 474809 - RNA, 21 nt, Homo sapiens
caaaaauauaccuucagagac

SEQ ID NO: 474810 - RNA, 20 nt, Homo sapiens
caaaaauuauauuuugaaca

SEQ ID NO: 474811 - RNA, 15 nt, Homo sapiens
caaaacccacagaag

SEQ ID NO: 474812 - RNA, 16 nt, Homo sapiens
caaaacccacagaaga

SEQ ID NO: 474813 - RNA, 22 nt, Homo sapiens
caaaagcccauucauuccauuc

SEQ ID NO: 474814 - RNA, 21 nt, Homo sapiens
caaaauaaauaaucuacugua

SEQ ID NO: 474815 - RNA, 18 nt, Homo sapiens
caaaaugaugucauguca

SEQ ID NO: 474816 - RNA, 20 nt, Homo sapiens
caaacaauaguaauucucag

SEQ ID NO: 474817 - RNA, 11 nt, Homo sapiens
caaacagugac

SEQ ID NO: 474818 - RNA, 18 nt, Homo sapiens
caaacccacccauaccag

SEQ ID NO: 474819 - RNA, 16 nt, Homo sapiens
caaacuucuuguucaa

SEQ ID NO: 474820 - RNA, 14 nt, Homo sapiens
caaagacuauuccc

SEQ ID NO: 474821 - RNA, 13 nt, Homo sapiens
caaagacuuuccu

SEQ ID NO: 474822 - RNA, 12 nt, Homo sapiens
caaagagacagc

SEQ ID NO: 474823 - RNA, 22 nt, Homo sapiens
caaagagacagcucuucuacua

SEQ ID NO: 474824 - RNA, 12 nt, Homo sapiens
caaagauuugcu

SEQ ID NO: 474825 - RNA, 17 nt, Homo sapiens
caaagauuugcuuuaau

SEQ ID NO: 474826 - RNA, 23 nt, Homo sapiens
caaagcagggucugggcaggacu

SEQ ID NO: 474827 - RNA, 21 nt, Homo sapiens
caaagccaauaacacacagcu

SEQ ID NO: 474828 - RNA, 17 nt, Homo sapiens
caaaggcucucacucca

SEQ ID NO: 474829 - RNA, 18 nt, Homo sapiens
caaaggcucucacuccag

SEQ ID NO: 474830 - RNA, 20 nt, Homo sapiens
caaaggcugagaacacugug

SEQ ID NO: 474831 - RNA, 18 nt, Homo sapiens
caaaggcuuucuuuccaa

SEQ ID NO: 474832 - RNA, 16 nt, Homo sapiens
caaagucaugcaaagg

SEQ ID NO: 474833 - RNA, 14 nt, Homo sapiens
caaaguucauucaa

SEQ ID NO: 474834 - RNA, 20 nt, Homo sapiens
caaaguuuuaaaccuguuaa

SEQ ID NO: 474835 - RNA, 13 nt, Homo sapiens
caaaucaaagcag

SEQ ID NO: 474836 - RNA, 16 nt, Homo sapiens
caaauccccuccccaa

SEQ ID NO: 474837 - RNA, 13 nt, Homo sapiens
caaaucucuauua

SEQ ID NO: 474838 - RNA, 15 nt, Homo sapiens
caaaugcccaaggga

SEQ ID NO: 474839 - RNA, 15 nt, Homo sapiens
caaauggaagacaca

SEQ ID NO: 474840 - RNA, 16 nt, Homo sapiens
caaaugggacugaugu

SEQ ID NO: 474841 - RNA, 12 nt, Homo sapiens
caaauguucaau

SEQ ID NO: 474842 - RNA, 14 nt, Homo sapiens
caaauugcagacug

SEQ ID NO: 474843 - RNA, 17 nt, Homo sapiens
caacaagcaagcuccca

SEQ ID NO: 474844 - RNA, 12 nt, Homo sapiens
caacaguuucca

SEQ ID NO: 474845 - RNA, 17 nt, Homo sapiens
caacaucaagccuguga

SEQ ID NO: 474846 - RNA, 15 nt, Homo sapiens
caacaucuugcaaaa

SEQ ID NO: 474847 - RNA, 18 nt, Homo sapiens
caacaugugcucagggaa

SEQ ID NO: 474848 - RNA, 15 nt, Homo sapiens
caacauuacagggaa

SEQ ID NO: 474849 - RNA, 15 nt, Homo sapiens
caaccuacuuucaua

SEQ ID NO: 474850 - RNA, 14 nt, Homo sapiens
caaccuucgccucc

SEQ ID NO: 474851 - RNA, 18 nt, Homo sapiens
caacucacgggugcauga

SEQ ID NO: 474852 - RNA, 20 nt, Homo sapiens
caacuugggaacuagacucc

SEQ ID NO: 474853 - RNA, 13 nt, Homo sapiens
caagaagggcuag

SEQ ID NO: 474854 - RNA, 11 nt, Homo sapiens
caagaaugaga

SEQ ID NO: 474855 - RNA, 19 nt, Homo sapiens
caagagagaaaagcucacu

SEQ ID NO: 474856 - RNA, 16 nt, Homo sapiens
caagagcacacuuggc

SEQ ID NO: 474857 - RNA, 14 nt, Homo sapiens
caagagucugauga

SEQ ID NO: 474858 - RNA, 21 nt, Homo sapiens
caagaucacgccauugcacuc

SEQ ID NO: 474859 - RNA, 19 nt, Homo sapiens
caagcaacugguugacuaa

SEQ ID NO: 474860 - RNA, 13 nt, Homo sapiens
caagcagccaagg

SEQ ID NO: 474861 - RNA, 14 nt, Homo sapiens
caagcaguagacaa

SEQ ID NO: 474862 - RNA, 23 nt, Homo sapiens
caagcucaaagcguggacaggug

SEQ ID NO: 474863 - RNA, 21 nt, Homo sapiens
caagcuggaguacgugaaaug

SEQ ID NO: 474864 - RNA, 15 nt, Homo sapiens
caaggaagguggugg

SEQ ID NO: 474865 - RNA, 16 nt, Homo sapiens
ccggaaggaaugucag

SEQ ID NO: 474866 - RNA, 17 nt, Homo sapiens
ccgggcaauccagacag

SEQ ID NO: 474867 - RNA, 22 nt, Homo sapiens
ccguuuccuaagccaagaguca

SEQ ID NO: 474868 - RNA, 22 nt, Homo sapiens
ccuaaaucaaguuggcuucuaa

SEQ ID NO: 474869 - RNA, 17 nt, Homo sapiens
ccuaaggcacccacaaa

SEQ ID NO: 474870 - RNA, 16 nt, Homo sapiens
ccuaaggcaugaauau

SEQ ID NO: 474871 - RNA, 23 nt, Homo sapiens
ccuaaggucauuaccacaggcca

SEQ ID NO: 474872 - RNA, 22 nt, Homo sapiens
ccuacaagucaucauaauucag

SEQ ID NO: 474873 - RNA, 20 nt, Homo sapiens
ccuacggaaggggacgcuuu

SEQ ID NO: 474874 - RNA, 17 nt, Homo sapiens
ccuacgugacaacacaa

SEQ ID NO: 474875 - RNA, 18 nt, Homo sapiens
ccuacucuuccaucuuuc

SEQ ID NO: 474876 - RNA, 13 nt, Homo sapiens
ccucaaacacugc

SEQ ID NO: 474877 - RNA, 14 nt, Homo sapiens
ccucaccugggcag

SEQ ID NO: 474878 - RNA, 23 nt, Homo sapiens
ccucagaaaacaaggaugaauua

SEQ ID NO: 474879 - RNA, 10 nt, Homo sapiens
ccucagggcu

SEQ ID NO: 474880 - RNA, 20 nt, Homo sapiens
ccucauggaauuggagcucg

SEQ ID NO: 474881 - RNA, 20 nt, Homo sapiens
ccucauuaccuugugcuaau

SEQ ID NO: 474882 - RNA, 14 nt, Homo sapiens
ccucauuugcaagg

SEQ ID NO: 474883 - RNA, 20 nt, Homo sapiens
ccucccaaagugcugagauu

SEQ ID NO: 474884 - RNA, 23 nt, Homo sapiens
ccuccccaaggagacacaacaac

SEQ ID NO: 474885 - RNA, 21 nt, Homo sapiens
ccuccccaauuccccagggaa

SEQ ID NO: 474886 - RNA, 17 nt, Homo sapiens
ccuccuagacucuguga

SEQ ID NO: 474887 - RNA, 14 nt, Homo sapiens
ccucguaugcaugg

SEQ ID NO: 474888 - RNA, 16 nt, Homo sapiens
ccucuaaaacaguccu

SEQ ID NO: 474889 - RNA, 13 nt, Homo sapiens
ccucuaugaacua

SEQ ID NO: 474890 - RNA, 12 nt, Homo sapiens
ccucucuugccg

SEQ ID NO: 474891 - RNA, 16 nt, Homo sapiens
ccucuuggccucagca

SEQ ID NO: 474892 - RNA, 15 nt, Homo sapiens
ccucuuuaacagcuu

SEQ ID NO: 474893 - RNA, 17 nt, Homo sapiens
ccugaugacauccaaua

SEQ ID NO: 474894 - RNA, 22 nt, Homo sapiens
ccuggcaaggacacagaugaaa

SEQ ID NO: 474895 - RNA, 18 nt, Homo sapiens
ccugggagccagggugag

SEQ ID NO: 474896 - RNA, 19 nt, Homo sapiens
ccugucaauacuauggagu

SEQ ID NO: 474897 - RNA, 16 nt, Homo sapiens
ccuguccacacccagc

SEQ ID NO: 474898 - RNA, 22 nt, Homo sapiens
ccugucugccagccagcagcca

SEQ ID NO: 474899 - RNA, 15 nt, Homo sapiens
ccuguguuacugauu

SEQ ID NO: 474900 - RNA, 14 nt, Homo sapiens
ccuguucuuucuua

SEQ ID NO: 474901 - RNA, 17 nt, Homo sapiens
ccuguugaauuuacucu

SEQ ID NO: 474902 - RNA, 22 nt, Homo sapiens
ccuuacauuugaaaucuaugaa

SEQ ID NO: 474903 - RNA, 20 nt, Homo sapiens
ccuucacuccccuaucccau

SEQ ID NO: 474904 - RNA, 14 nt, Homo sapiens
ccuuccucauuugc

SEQ ID NO: 474905 - RNA, 13 nt, Homo sapiens
ccuugagucaaaa

SEQ ID NO: 474906 - RNA, 15 nt, Homo sapiens
ccuugcucugccauc

SEQ ID NO: 474907 - RNA, 22 nt, Homo sapiens
ccuuggaaguugcauggcauca

SEQ ID NO: 474908 - RNA, 19 nt, Homo sapiens
ccuuggggcugaugcaguu

SEQ ID NO: 474909 - RNA, 14 nt, Homo sapiens
ccuuuauagcuuug

SEQ ID NO: 474910 - RNA, 12 nt, Homo sapiens
ccuuucacugug

SEQ ID NO: 474911 - RNA, 13 nt, Homo sapiens
ccuuuccauuuau

SEQ ID NO: 474912 - RNA, 18 nt, Homo sapiens
ccuuuggaugcacuuuau

SEQ ID NO: 474913 - RNA, 23 nt, Homo sapiens
ccuuuuuaaggaaggcacuaaaa

SEQ ID NO: 474914 - RNA, 21 nt, Homo sapiens
cgagaucacgccacugcacuc

SEQ ID NO: 474915 - RNA, 20 nt, Homo sapiens
cgcauacuacaguaacugug

SEQ ID NO: 474916 - RNA, 21 nt, Homo sapiens
cgccuccgcuacuuccagggc

SEQ ID NO: 474917 - RNA, 21 nt, Homo sapiens
cgccugugggcgcauacuaca

SEQ ID NO: 474918 - RNA, 20 nt, Homo sapiens
cggggaggggcgcucgcuuc

SEQ ID NO: 474919 - RNA, 21 nt, Homo sapiens
cgguaagcacuuaaugaauga

SEQ ID NO: 474920 - RNA, 19 nt, Homo sapiens
cgugcacugagagugaagu

SEQ ID NO: 474921 - RNA, 15 nt, Homo sapiens
cgugcccuaccacac

SEQ ID NO: 474922 - RNA, 20 nt, Homo sapiens
cguggaauugugcugaguug

SEQ ID NO: 474923 - RNA, 14 nt, Homo sapiens
cguggagcugccug

SEQ ID NO: 474924 - RNA, 16 nt, Homo sapiens
cgugugggcaauguuc

SEQ ID NO: 474925 - RNA, 12 nt, Homo sapiens
cguuuaaucaca

SEQ ID NO: 474926 - RNA, 14 nt, Homo sapiens
cuaaaaucagggaa

SEQ ID NO: 474927 - RNA, 18 nt, Homo sapiens
cuaaacuccuuuccugca

SEQ ID NO: 474928 - RNA, 15 nt, Homo sapiens
cuaaagagcuuuagu

SEQ ID NO: 474929 - RNA, 17 nt, Homo sapiens
cuaaaucaauucuauua

SEQ ID NO: 474930 - RNA, 14 nt, Homo sapiens
cuaaauguaagaau

SEQ ID NO: 474931 - RNA, 14 nt, Homo sapiens
cuaaaugucaauca

SEQ ID NO: 474932 - RNA, 21 nt, Homo sapiens
cuaacacagccaucaagggaa

SEQ ID NO: 474933 - RNA, 21 nt, Homo sapiens
cuaagccaagagucaugucaa

SEQ ID NO: 474934 - RNA, 18 nt, Homo sapiens
cuaaucaauaccuacaag

SEQ ID NO: 474935 - RNA, 22 nt, Homo sapiens
cuaauccugaagggaagcccau

SEQ ID NO: 474936 - RNA, 22 nt, Homo sapiens
cuacaagucaucauaauucagc

SEQ ID NO: 474937 - RNA, 16 nt, Homo sapiens
cuacacugacacuggu

SEQ ID NO: 474938 - RNA, 23 nt, Homo sapiens
cuacagggcgagacucugucuca

SEQ ID NO: 474939 - RNA, 19 nt, Homo sapiens
cuacaguaacugugacuga

SEQ ID NO: 474940 - RNA, 21 nt, Homo sapiens
cuaccaacgaaagacgugauu

SEQ ID NO: 474941 - RNA, 12 nt, Homo sapiens
cuaccacaugcc

SEQ ID NO: 474942 - RNA, 15 nt, Homo sapiens
cuacuaaaacauaca

SEQ ID NO: 474943 - RNA, 19 nt, Homo sapiens
cuagaaccuagaagggcua

SEQ ID NO: 474944 - RNA, 18 nt, Homo sapiens
cuagaaccuggagagcua

SEQ ID NO: 474945 - RNA, 18 nt, Homo sapiens
cuagaaccuguagagcua

SEQ ID NO: 474946 - RNA, 14 nt, Homo sapiens
cuagaauacuaaua

SEQ ID NO: 474947 - RNA, 17 nt, Homo sapiens
cuagacaaaaaccauug

SEQ ID NO: 474948 - RNA, 18 nt, Homo sapiens
cuagagcacacuguagca

SEQ ID NO: 474949 - RNA, 15 nt, Homo sapiens
cuagauacugaaugu

SEQ ID NO: 474950 - RNA, 12 nt, Homo sapiens
cuagauugugaa

SEQ ID NO: 474951 - RNA, 16 nt, Homo sapiens
cuagcacuuggagcca

SEQ ID NO: 474952 - RNA, 17 nt, Homo sapiens
cuagggaaggguggugg

SEQ ID NO: 474953 - RNA, 22 nt, Homo sapiens
cuaguacagguuuugcccugau

SEQ ID NO: 474954 - RNA, 12 nt, Homo sapiens
cuaguagcuuuc

SEQ ID NO: 474955 - RNA, 22 nt, Homo sapiens
cuaguagcuuuccucccaaagg

SEQ ID NO: 474956 - RNA, 17 nt, Homo sapiens
cuaguugaucagcuuau

SEQ ID NO: 474957 - RNA, 22 nt, Homo sapiens
cuauaauguugucauuucaaga

SEQ ID NO: 474958 - RNA, 14 nt, Homo sapiens
cuauaugcacuuau

SEQ ID NO: 474959 - RNA, 15 nt, Homo sapiens
cuaucaccugucauc

SEQ ID NO: 474960 - RNA, 21 nt, Homo sapiens
cuaugaaauaucaugcuccau

SEQ ID NO: 474961 - RNA, 16 nt, Homo sapiens
cuaugauaugcuaaua

SEQ ID NO: 474962 - RNA, 18 nt, Homo sapiens
cuauggcucuacuuucag

SEQ ID NO: 474963 - RNA, 20 nt, Homo sapiens
cuaugucacccaaugcauau

SEQ ID NO: 474964 - RNA, 13 nt, Homo sapiens
cuaugugcaugca

SEQ ID NO: 474965 - RNA, 15 nt, Homo sapiens
cuauuacgugcaaua

SEQ ID NO: 474966 - RNA, 19 nt, Homo sapiens
cuauucaaguauuaggggu

SEQ ID NO: 474967 - RNA, 16 nt, Homo sapiens
cuauucauugacugau

SEQ ID NO: 474968 - RNA, 14 nt, Homo sapiens
cuauugacaucagc

SEQ ID NO: 474969 - RNA, 17 nt, Homo sapiens
cuauuuaacuugagggu

SEQ ID NO: 474970 - RNA, 18 nt, Homo sapiens
cucaacauaacauaagcu

SEQ ID NO: 474971 - RNA, 15 nt, Homo sapiens
cucaagacaaaugac

SEQ ID NO: 474972 - RNA, 15 nt, Homo sapiens
cucaagaucaaugaa

SEQ ID NO: 474973 - RNA, 12 nt, Homo sapiens
cucaaucucuga

SEQ ID NO: 474974 - RNA, 12 nt, Homo sapiens
cucaauucuucc

SEQ ID NO: 474975 - RNA, 21 nt, Homo sapiens
cucacugugggaaggccagcu

SEQ ID NO: 474976 - RNA, 16 nt, Homo sapiens
cucagacucauuguaa

SEQ ID NO: 474977 - RNA, 22 nt, Homo sapiens
cucaggacacuaauacaccagg

SEQ ID NO: 474978 - RNA, 16 nt, Homo sapiens
cucaggagaagggaua

SEQ ID NO: 474979 - RNA, 13 nt, Homo sapiens
cucagugcuguaa

SEQ ID NO: 474980 - RNA, 14 nt, Homo sapiens
cucaucccacccgc

SEQ ID NO: 474981 - RNA, 15 nt, Homo sapiens
cucauccugcaggca

SEQ ID NO: 474982 - RNA, 19 nt, Homo sapiens
cucaugagaaguugauaua

SEQ ID NO: 474983 - RNA, 22 nt, Homo sapiens
cucauggaugagacuacuucag

SEQ ID NO: 474984 - RNA, 16 nt, Homo sapiens
cucauugcuuggaauu

SEQ ID NO: 474985 - RNA, 20 nt, Homo sapiens
cuccaaaguuuuaaaccugu

SEQ ID NO: 474986 - RNA, 22 nt, Homo sapiens
cuccaaaguuuuaaaccuguua

SEQ ID NO: 474987 - RNA, 22 nt, Homo sapiens
cuccagaugagaguacacccca

SEQ ID NO: 474988 - RNA, 21 nt, Homo sapiens
cuccagccuggcuacagggcg

SEQ ID NO: 474989 - RNA, 20 nt, Homo sapiens
cucccaaagugcugggauua

SEQ ID NO: 474990 - RNA, 16 nt, Homo sapiens
cucccuccaccucccu

SEQ ID NO: 474991 - RNA, 17 nt, Homo sapiens
cucccuucucuaccuca

SEQ ID NO: 474992 - RNA, 20 nt, Homo sapiens
uagagcaggcguucagcuca

SEQ ID NO: 474993 - RNA, 23 nt, Homo sapiens
uagaggauauugggucucagccc

SEQ ID NO: 474994 - RNA, 16 nt, Homo sapiens
uagagucucuguuacu

SEQ ID NO: 474995 - RNA, 15 nt, Homo sapiens
uagaguucagacuuu

SEQ ID NO: 474996 - RNA, 16 nt, Homo sapiens
uagaguucagacuuuu

SEQ ID NO: 474997 - RNA, 14 nt, Homo sapiens
uagaguugggacaa

SEQ ID NO: 474998 - RNA, 22 nt, Homo sapiens
uagauaaagcacuguuuggaua

SEQ ID NO: 474999 - RNA, 13 nt, Homo sapiens
uagauucuuuauu

SEQ ID NO: 475000 - RNA, 21 nt, Homo sapiens
uagccuagaagauacaauaau

SEQ ID NO: 475001 - RNA, 11 nt, Homo sapiens
uagcugcuacc

SEQ ID NO: 475002 - RNA, 16 nt, Homo sapiens
uagcuuagaccucagc

SEQ ID NO: 475003 - RNA, 13 nt, Homo sapiens
uaggacugcugac

SEQ ID NO: 475004 - RNA, 15 nt, Homo sapiens
uaggauguugcucag

SEQ ID NO: 475005 - RNA, 15 nt, Homo sapiens
uaggcagggauuuga

SEQ ID NO: 475006 - RNA, 19 nt, Homo sapiens
uagguuaaaaacagggaaa

SEQ ID NO: 475007 - RNA, 16 nt, Homo sapiens
uaguaagagauuccug

SEQ ID NO: 475008 - RNA, 20 nt, Homo sapiens
uaguaguuaauucugucacu

SEQ ID NO: 475009 - RNA, 23 nt, Homo sapiens
uaguaguuaauucugucacucac

SEQ ID NO: 475010 - RNA, 14 nt, Homo sapiens
uaguccaauuccuu

SEQ ID NO: 475011 - RNA, 21 nt, Homo sapiens
uaguguuggaaaaugugcaau

SEQ ID NO: 475012 - RNA, 23 nt, Homo sapiens
uaguguuggaaaaugugcaauau

SEQ ID NO: 475013 - RNA, 22 nt, Homo sapiens
uaguuguaauuuuuuuguggga

SEQ ID NO: 475014 - RNA, 16 nt, Homo sapiens
uauaaagaccuauaaa

SEQ ID NO: 475015 - RNA, 22 nt, Homo sapiens
uauaaauaaaacauuuucacac

SEQ ID NO: 475016 - RNA, 16 nt, Homo sapiens
uauaacugugcaaaua

SEQ ID NO: 475017 - RNA, 15 nt, Homo sapiens
uauacucuucaagga

SEQ ID NO: 475018 - RNA, 16 nt, Homo sapiens
uauacucuucaaggac

SEQ ID NO: 475019 - RNA, 22 nt, Homo sapiens
uauagaacagugcuugccacag

SEQ ID NO: 475020 - RNA, 17 nt, Homo sapiens
uauagaauggaacucaa

SEQ ID NO: 475021 - RNA, 14 nt, Homo sapiens
uauagagauaugca

SEQ ID NO: 475022 - RNA, 21 nt, Homo sapiens
uauagcugugugaacguguau

SEQ ID NO: 475023 - RNA, 17 nt, Homo sapiens
uauagucacuaguugua

SEQ ID NO: 475024 - RNA, 12 nt, Homo sapiens
uauaugcaauau

SEQ ID NO: 475025 - RNA, 20 nt, Homo sapiens
uauaugccgcuacaaaaagg

SEQ ID NO: 475026 - RNA, 15 nt, Homo sapiens
uauauggccucaaga

SEQ ID NO: 475027 - RNA, 16 nt, Homo sapiens
uauauguauaugcaau

SEQ ID NO: 475028 - RNA, 18 nt, Homo sapiens
uaucaauuacaacaguga

SEQ ID NO: 475029 - RNA, 19 nt, Homo sapiens
uaucaguaguaucaaugau

SEQ ID NO: 475030 - RNA, 16 nt, Homo sapiens
uaucccaaacuaagcu

SEQ ID NO: 475031 - RNA, 13 nt, Homo sapiens
uauccuguucucu

SEQ ID NO: 475032 - RNA, 19 nt, Homo sapiens
uauccuguuuuuaaaccau

SEQ ID NO: 475033 - RNA, 18 nt, Homo sapiens
uaucuagacccaucuucu

SEQ ID NO: 475034 - RNA, 19 nt, Homo sapiens
uaucucggaccuuucagcu

SEQ ID NO: 475035 - RNA, 17 nt, Homo sapiens
uaucuguguuugcugag

SEQ ID NO: 475036 - RNA, 11 nt, Homo sapiens
uaugagcugcu

SEQ ID NO: 475037 - RNA, 16 nt, Homo sapiens
uaugaugucccuaugg

SEQ ID NO: 475038 - RNA, 23 nt, Homo sapiens
uaugcaaccuuuggaugcacuuu

SEQ ID NO: 475039 - RNA, 13 nt, Homo sapiens
uauguauucucaa

SEQ ID NO: 475040 - RNA, 20 nt, Homo sapiens
uaugucaucucagugcugua

SEQ ID NO: 475041 - RNA, 10 nt, Homo sapiens
uaugugcaau

SEQ ID NO: 475042 - RNA, 14 nt, Homo sapiens
uauuagaauuucau

SEQ ID NO: 475043 - RNA, 12 nt, Homo sapiens
uauuagucacaa

SEQ ID NO: 475044 - RNA, 23 nt, Homo sapiens
uauugauaauaaaauucauucca

SEQ ID NO: 475045 - RNA, 13 nt, Homo sapiens
uauugucuaguga

SEQ ID NO: 475046 - RNA, 23 nt, Homo sapiens
uauuguggaaagaugaaugcaau

SEQ ID NO: 475047 - RNA, 22 nt, Homo sapiens
uauuucuaucccaaacuaagcu

SEQ ID NO: 475048 - RNA, 12 nt, Homo sapiens
uauuugagacag

SEQ ID NO: 475049 - RNA, 18 nt, Homo sapiens
uauuugaguauugcugau

SEQ ID NO: 475050 - RNA, 18 nt, Homo sapiens
uauuuuaaucuaauucua

SEQ ID NO: 475051 - RNA, 14 nt, Homo sapiens
uauuuuccaugaaa

SEQ ID NO: 475052 - RNA, 21 nt, Homo sapiens
uauuuuuuuaagcuguaaaaa

SEQ ID NO: 475053 - RNA, 21 nt, Homo sapiens
ucaaaaacugucaaagaauca

SEQ ID NO: 475054 - RNA, 18 nt, Homo sapiens
ucaagcuuuccgagucaa

SEQ ID NO: 475055 - RNA, 16 nt, Homo sapiens
ucaaguuggcuucuaa

SEQ ID NO: 475056 - RNA, 22 nt, Homo sapiens
ucaaguuggcuucuaaucaaag

SEQ ID NO: 475057 - RNA, 17 nt, Homo sapiens
ucaauaaaccacaagca

SEQ ID NO: 475058 - RNA, 18 nt, Homo sapiens
ucaauaaaccacaagcau

SEQ ID NO: 475059 - RNA, 16 nt, Homo sapiens
ucaauacuuugaacac

SEQ ID NO: 475060 - RNA, 15 nt, Homo sapiens
ucaauaugagucuca

SEQ ID NO: 475061 - RNA, 18 nt, Homo sapiens
ucaauaugagucucaaua

SEQ ID NO: 475062 - RNA, 19 nt, Homo sapiens
ucaaucaaaacucaguauc

SEQ ID NO: 475063 - RNA, 19 nt, Homo sapiens
ucaaugaaaugaugucaua

SEQ ID NO: 475064 - RNA, 16 nt, Homo sapiens
ucaauuacaacaguga

SEQ ID NO: 475065 - RNA, 23 nt, Homo sapiens
ucaauuccagaaaaacucaugga

SEQ ID NO: 475066 - RNA, 19 nt, Homo sapiens
ucacaaaaguauauucaaa

SEQ ID NO: 475067 - RNA, 16 nt, Homo sapiens
ucacagaugugugauu

SEQ ID NO: 475068 - RNA, 18 nt, Homo sapiens
ucacagcuaacaauugug

SEQ ID NO: 475069 - RNA, 15 nt, Homo sapiens
ucacagguugaccaa

SEQ ID NO: 475070 - RNA, 12 nt, Homo sapiens
ucacaucacuuc

SEQ ID NO: 475071 - RNA, 19 nt, Homo sapiens
ucacauucgaguguuucag

SEQ ID NO: 475072 - RNA, 16 nt, Homo sapiens
ucaccaggucagggag

SEQ ID NO: 475073 - RNA, 18 nt, Homo sapiens
ucaccaucagucaaugaa

SEQ ID NO: 475074 - RNA, 14 nt, Homo sapiens
ucacccaaugcaua

SEQ ID NO: 475075 - RNA, 14 nt, Homo sapiens
ucaccucauggaau

SEQ ID NO: 475076 - RNA, 22 nt, Homo sapiens
ucaccuggggcugcuggccuga

SEQ ID NO: 475077 - RNA, 17 nt, Homo sapiens
ucaccuugcucugccau

SEQ ID NO: 475078 - RNA, 22 nt, Homo sapiens
ucacucaaucucugauucuguc

SEQ ID NO: 475079 - RNA, 14 nt, Homo sapiens
ucagaacaaaguga

SEQ ID NO: 475080 - RNA, 20 nt, Homo sapiens
ucagaaucacuucugagaac

SEQ ID NO: 475081 - RNA, 17 nt, Homo sapiens
ucagaaucagacuauga

SEQ ID NO: 475082 - RNA, 19 nt, Homo sapiens
ucagagagggcaggcauga

SEQ ID NO: 475083 - RNA, 16 nt, Homo sapiens
ucagaguauggagcuc

SEQ ID NO: 475084 - RNA, 15 nt, Homo sapiens
ucagcagcaggguuu

SEQ ID NO: 475085 - RNA, 20 nt, Homo sapiens
ucagccuagccgaccucagc

SEQ ID NO: 475086 - RNA, 19 nt, Homo sapiens
ucagcucuugagagcauuc

SEQ ID NO: 475087 - RNA, 14 nt, Homo sapiens
ucagcuggaucucc

SEQ ID NO: 475088 - RNA, 18 nt, Homo sapiens
ucagcuggaucuccauuc

SEQ ID NO: 475089 - RNA, 21 nt, Homo sapiens
ucagcuggaucuccauucucu

SEQ ID NO: 475090 - RNA, 21 nt, Homo sapiens
ucagcuuauaaaaucaaacag

SEQ ID NO: 475091 - RNA, 21 nt, Homo sapiens
ucaggacacuaauacaccagg

SEQ ID NO: 475092 - RNA, 14 nt, Homo sapiens
ucaggccaucauca

SEQ ID NO: 475093 - RNA, 15 nt, Homo sapiens
ucagggagcauuuau

SEQ ID NO: 475094 - RNA, 15 nt, Homo sapiens
ucaguaaauguuugu

SEQ ID NO: 475095 - RNA, 18 nt, Homo sapiens
ucaguaagacgacaagga

SEQ ID NO: 475096 - RNA, 20 nt, Homo sapiens
ucaguaagacgacaaggaaa

SEQ ID NO: 475097 - RNA, 17 nt, Homo sapiens
ucaguaguaucaaugau

SEQ ID NO: 475098 - RNA, 12 nt, Homo sapiens
ucagucaaugaa

SEQ ID NO: 475099 - RNA, 17 nt, Homo sapiens
ucaguccaaagggcaug

SEQ ID NO: 475100 - RNA, 17 nt, Homo sapiens
ucagucuuuuccaucuc

SEQ ID NO: 475101 - RNA, 20 nt, Homo sapiens
ucauacauuaucucacuugu

SEQ ID NO: 475102 - RNA, 19 nt, Homo sapiens
ucaucaaauggaagacaca

SEQ ID NO: 475103 - RNA, 18 nt, Homo sapiens
ucaucaaggcacugccug

SEQ ID NO: 475104 - RNA, 23 nt, Homo sapiens
ucaucaaggcacugccugaugga

SEQ ID NO: 475105 - RNA, 16 nt, Homo sapiens
ucaucaccacagggau

SEQ ID NO: 475106 - RNA, 13 nt, Homo sapiens
ucauccugcaggc

SEQ ID NO: 475107 - RNA, 24 nt, Homo sapiens
ucaugcaaaggcugggaccacgug

SEQ ID NO: 475108 - RNA, 17 nt, Homo sapiens
ucauggaauuggagcuc

SEQ ID NO: 475109 - RNA, 16 nt, Homo sapiens
ucauguagguugucua

SEQ ID NO: 475110 - RNA, 17 nt, Homo sapiens
ucaugucaaauugcaau

SEQ ID NO: 475111 - RNA, 15 nt, Homo sapiens
ucauuaaaguucuag

SEQ ID NO: 475112 - RNA, 17 nt, Homo sapiens
ucauuaucaguccaaag

SEQ ID NO: 475113 - RNA, 20 nt, Homo sapiens
ucauucaauaaauuguaauu

SEQ ID NO: 475114 - RNA, 19 nt, Homo sapiens
ucauucauuuaacagagcu

SEQ ID NO: 475115 - RNA, 18 nt, Homo sapiens
ucauugacugauggugaa

SEQ ID NO: 475116 - RNA, 17 nt, Homo sapiens
ucauuguucuugugaac

SEQ ID NO: 475117 - RNA, 22 nt, Homo sapiens
ucauuguucuugugaacccaaa

SEQ ID NO: 475118 - RNA, 13 nt, Homo sapiens
ucauuuauuucca

SEQ ID NO: 475119 - RNA, 20 nt, Homo sapiens
uccaauccuuuauagcuuug

SEQ ID NO: 475120 - RNA, 20 nt, Homo sapiens
uccacuaugagcugcuggca

SEQ ID NO: 475121 - RNA, 20 nt, Homo sapiens
uccacuggagaauugaaaag

SEQ ID NO: 475122 - RNA, 17 nt, Homo sapiens
uccagaacucaaaugag

SEQ ID NO: 475123 - RNA, 20 nt, Homo sapiens
uccagaugagaguacacccc

SEQ ID NO: 475124 - RNA, 17 nt, Homo sapiens
uccagccugggcaacag

SEQ ID NO: 475125 - RNA, 20 nt, Homo sapiens
uccagccugggcaacagagc

SEQ ID NO: 475126 - RNA, 15 nt, Homo sapiens
uccaggccugaaguc

SEQ ID NO: 475127 - RNA, 23 nt, Homo sapiens
uccaggggccacaagaccaucua

SEQ ID NO: 475128 - RNA, 12 nt, Homo sapiens
uccauguaucua

SEQ ID NO: 475129 - RNA, 16 nt, Homo sapiens
ucccaaaggcuuucuu

SEQ ID NO: 475130 - RNA, 18 nt, Homo sapiens
ucccaaauuuucacauaa

SEQ ID NO: 475131 - RNA, 13 nt, Homo sapiens
ucccacacaagac

SEQ ID NO: 475132 - RNA, 17 nt, Homo sapiens
ucccagccagcaguuca

SEQ ID NO: 475133 - RNA, 15 nt, Homo sapiens
ucccagcuacuuggg

SEQ ID NO: 475134 - RNA, 14 nt, Homo sapiens
ucccaggaguacac

SEQ ID NO: 475135 - RNA, 20 nt, Homo sapiens
ucccaguggcugcugcccag

SEQ ID NO: 475136 - RNA, 13 nt, Homo sapiens
ugaggcaggagaa

SEQ ID NO: 475137 - RNA, 17 nt, Homo sapiens
ugaggccaggaguucaa

SEQ ID NO: 475138 - RNA, 22 nt, Homo sapiens
ugaggcuuuaaaacuuauccuc

SEQ ID NO: 475139 - RNA, 16 nt, Homo sapiens
ugaggggaugcaacaa

SEQ ID NO: 475140 - RNA, 14 nt, Homo sapiens
ugaguauugcugau

SEQ ID NO: 475141 - RNA, 19 nt, Homo sapiens
ugaguuacuaucaugucaa

SEQ ID NO: 475142 - RNA, 15 nt, Homo sapiens
ugaguuuguacaguc

SEQ ID NO: 475143 - RNA, 23 nt, Homo sapiens
ugauacagugaagauacaggaca

SEQ ID NO: 475144 - RNA, 20 nt, Homo sapiens
ugaucugaggguauaaagac

SEQ ID NO: 475145 - RNA, 23 nt, Homo sapiens
ugaugcugggauuuacacuugag

SEQ ID NO: 475146 - RNA, 17 nt, Homo sapiens
ugaugucguuugaauca

SEQ ID NO: 475147 - RNA, 14 nt, Homo sapiens
gcagaaucuuugca

SEQ ID NO: 475148 - RNA, 16 nt, Homo sapiens
gcagaaucuuugcaag

SEQ ID NO: 475149 - RNA, 13 nt, Homo sapiens
gcagacugucccu

SEQ ID NO: 475150 - RNA, 20 nt, Homo sapiens
gcagagcuuguuuuguuuca

SEQ ID NO: 475151 - RNA, 16 nt, Homo sapiens
gcagagguugcaguga

SEQ ID NO: 475152 - RNA, 16 nt, Homo sapiens
gcagaugagguugcua

SEQ ID NO: 475153 - RNA, 12 nt, Homo sapiens
gcagccaaggga

SEQ ID NO: 475154 - RNA, 23 nt, Homo sapiens
gcagcuguugcagugagccaaga

SEQ ID NO: 475155 - RNA, 19 nt, Homo sapiens
gcaggaacauacagacaca

SEQ ID NO: 475156 - RNA, 23 nt, Homo sapiens
gcaggcaugagucagucugauga

SEQ ID NO: 475157 - RNA, 14 nt, Homo sapiens
gcaggcuacacuga

SEQ ID NO: 475158 - RNA, 16 nt, Homo sapiens
gcaggcuacacugaca

SEQ ID NO: 475159 - RNA, 15 nt, Homo sapiens
gcaggcuagaaccug

SEQ ID NO: 475160 - RNA, 21 nt, Homo sapiens
gcagugagcuguguucuugcc

SEQ ID NO: 475161 - RNA, 14 nt, Homo sapiens
gcaguugaucucca

SEQ ID NO: 475162 - RNA, 16 nt, Homo sapiens
gcauagcagcugcuac

SEQ ID NO: 475163 - RNA, 23 nt, Homo sapiens
gcauauuuucuccgaaaggcaaa

SEQ ID NO: 475164 - RNA, 14 nt, Homo sapiens
gcaucacagcuaac

SEQ ID NO: 475165 - RNA, 17 nt, Homo sapiens
gcaucagcaacaaccag

SEQ ID NO: 475166 - RNA, 22 nt, Homo sapiens
gcaucccaggaucgcaagagcc

SEQ ID NO: 475167 - RNA, 12 nt, Homo sapiens
gcauccuagucu

SEQ ID NO: 475168 - RNA, 19 nt, Homo sapiens
gcaugagucagucugauga

SEQ ID NO: 475169 - RNA, 22 nt, Homo sapiens
gcauuaucuaugauaugcuaau

SEQ ID NO: 475170 - RNA, 16 nt, Homo sapiens
gcauucauaacagaac

SEQ ID NO: 475171 - RNA, 18 nt, Homo sapiens
gcauugucuguaaugaca

SEQ ID NO: 475172 - RNA, 18 nt, Homo sapiens
gccaaauguucaauauga

SEQ ID NO: 475173 - RNA, 24 nt, Homo sapiens
gccaaauguucaauaugagucuca

SEQ ID NO: 475174 - RNA, 22 nt, Homo sapiens
gccaagaucacgccauugcacu

SEQ ID NO: 475175 - RNA, 20 nt, Homo sapiens
gccaagcucaggaccaggca

SEQ ID NO: 475176 - RNA, 20 nt, Homo sapiens
gccaaggcuggagugcagug

SEQ ID NO: 475177 - RNA, 15 nt, Homo sapiens
gccaauccacuccuu

SEQ ID NO: 475178 - RNA, 17 nt, Homo sapiens
gccaauccacuccuucc

SEQ ID NO: 475179 - RNA, 19 nt, Homo sapiens
gccacagggccuuuggcag

SEQ ID NO: 475180 - RNA, 21 nt, Homo sapiens
gccaggccucuuggcagucac

SEQ ID NO: 475181 - RNA, 23 nt, Homo sapiens
gccaggcuguuggaaaauccaga

SEQ ID NO: 475182 - RNA, 22 nt, Homo sapiens
gccaguaaacagaggaguacag

SEQ ID NO: 475183 - RNA, 13 nt, Homo sapiens
gccagucccucag

SEQ ID NO: 475184 - RNA, 19 nt, Homo sapiens
gccauaccugguaagcaaa

SEQ ID NO: 475185 - RNA, 14 nt, Homo sapiens
gccaucaagggaau

SEQ ID NO: 475186 - RNA, 17 nt, Homo sapiens
gccaugcuuugagucca

SEQ ID NO: 475187 - RNA, 18 nt, Homo sapiens
gccaugggcacugugggu

SEQ ID NO: 475188 - RNA, 22 nt, Homo sapiens
gccauucucccucuuguuuuca

SEQ ID NO: 475189 - RNA, 14 nt, Homo sapiens
gccauugcacucca

SEQ ID NO: 475190 - RNA, 17 nt, Homo sapiens
gcccaaauggcagggau

SEQ ID NO: 475191 - RNA, 14 nt, Homo sapiens
gcccacuucccucc

SEQ ID NO: 475192 - RNA, 15 nt, Homo sapiens
gccccaaauuccugu

SEQ ID NO: 475193 - RNA, 17 nt, Homo sapiens
gccccugauccugugaa

SEQ ID NO: 475194 - RNA, 17 nt, Homo sapiens
gcccuagagcacacugu

SEQ ID NO: 475195 - RNA, 15 nt, Homo sapiens
gccgcugccaugcuu

SEQ ID NO: 475196 - RNA, 20 nt, Homo sapiens
gccggaaggaaugucagggc

SEQ ID NO: 475197 - RNA, 15 nt, Homo sapiens
gccucauugauguca

SEQ ID NO: 475198 - RNA, 21 nt, Homo sapiens
gccucauugaugucaaaaacu

SEQ ID NO: 475199 - RNA, 17 nt, Homo sapiens
gccucuuagaugcaguu

SEQ ID NO: 475200 - RNA, 13 nt, Homo sapiens
gccucuuggcagu

SEQ ID NO: 475201 - RNA, 17 nt, Homo sapiens
gccugaagccaggccau

SEQ ID NO: 475202 - RNA, 13 nt, Homo sapiens
gccugaugacauc

SEQ ID NO: 475203 - RNA, 22 nt, Homo sapiens
gccuguagaugacauggugaaa

SEQ ID NO: 475204 - RNA, 22 nt, Homo sapiens
gccuguagucccagcuacucag

SEQ ID NO: 475205 - RNA, 12 nt, Homo sapiens
gccugucuuucc

SEQ ID NO: 475206 - RNA, 14 nt, Homo sapiens
gccugucuuuccca

SEQ ID NO: 475207 - RNA, 22 nt, Homo sapiens
gccuuggagucgucuggcaucu

SEQ ID NO: 475208 - RNA, 20 nt, Homo sapiens
gccuuggggcugaugcaguu

SEQ ID NO: 475209 - RNA, 14 nt, Homo sapiens
gccuuuuguguuuu

SEQ ID NO: 475210 - RNA, 20 nt, Homo sapiens
gcgcaauugcucaugcauag

SEQ ID NO: 475211 - RNA, 16 nt, Homo sapiens
gcggcauuaaagccau

SEQ ID NO: 475212 - RNA, 21 nt, Homo sapiens
gcggggacucgguaagcacuu

SEQ ID NO: 475213 - RNA, 23 nt, Homo sapiens
gcuaaauguaagaaucauuguaa

SEQ ID NO: 475214 - RNA, 18 nt, Homo sapiens
gcuacaaaauaaagcugu

SEQ ID NO: 475215 - RNA, 19 nt, Homo sapiens
gcuacacugacacugguau

SEQ ID NO: 475216 - RNA, 14 nt, Homo sapiens
gcuacuagcucuuu

SEQ ID NO: 475217 - RNA, 15 nt, Homo sapiens
gcuagggaaggcggg

SEQ ID NO: 475218 - RNA, 23 nt, Homo sapiens
gcuaucccuuuccaaaggccaug

SEQ ID NO: 475219 - RNA, 20 nt, Homo sapiens
gcucacuaagaagcuugaau

SEQ ID NO: 475220 - RNA, 13 nt, Homo sapiens
gcucacucuucca

SEQ ID NO: 475221 - RNA, 18 nt, Homo sapiens
gcucacuguucuauucau

SEQ ID NO: 475222 - RNA, 15 nt, Homo sapiens
gcucagcauuuccac

SEQ ID NO: 475223 - RNA, 21 nt, Homo sapiens
gcuccucggacggcuccggac

SEQ ID NO: 475224 - RNA, 16 nt, Homo sapiens
gcucucacuccaggac

SEQ ID NO: 475225 - RNA, 13 nt, Homo sapiens
gcucuucauuuau

SEQ ID NO: 475226 - RNA, 17 nt, Homo sapiens
gcucuuuucaaugaaua

SEQ ID NO: 475227 - RNA, 20 nt, Homo sapiens
gcugaaaacugcaacuugua

SEQ ID NO: 475228 - RNA, 20 nt, Homo sapiens
gcugaggcauccuuccucac

SEQ ID NO: 475229 - RNA, 22 nt, Homo sapiens
gcugauacaaauugcagacugu

SEQ ID NO: 475230 - RNA, 13 nt, Homo sapiens
gcugaugcaguug

SEQ ID NO: 475231 - RNA, 13 nt, Homo sapiens
gcugauguccuca

SEQ ID NO: 475232 - RNA, 18 nt, Homo sapiens
gcugccaaacacccaugc

SEQ ID NO: 475233 - RNA, 12 nt, Homo sapiens
gcugccaugcuu

SEQ ID NO: 475234 - RNA, 22 nt, Homo sapiens
gcugccgugggccugagaccaa

SEQ ID NO: 475235 - RNA, 14 nt, Homo sapiens
gcugcucugugguc

SEQ ID NO: 475236 - RNA, 15 nt, Homo sapiens
gcuggaguacgugaa

SEQ ID NO: 475237 - RNA, 17 nt, Homo sapiens
gcuggagucaugugccu

SEQ ID NO: 475238 - RNA, 13 nt, Homo sapiens
gcuggagugcagu

SEQ ID NO: 475239 - RNA, 21 nt, Homo sapiens
gcugggauguuucugucacau

SEQ ID NO: 475240 - RNA, 19 nt, Homo sapiens
gcugggauuacagguguga

SEQ ID NO: 475241 - RNA, 16 nt, Homo sapiens
gcugggauuuacacuu

SEQ ID NO: 475242 - RNA, 21 nt, Homo sapiens
gcuggguaagagcacagguua

SEQ ID NO: 475243 - RNA, 14 nt, Homo sapiens
gcuguucucauucc

SEQ ID NO: 475244 - RNA, 18 nt, Homo sapiens
gcuguucucauuccuguu

SEQ ID NO: 475245 - RNA, 18 nt, Homo sapiens
gcuuauaaaaucaaacag

SEQ ID NO: 475246 - RNA, 18 nt, Homo sapiens
gcuuccgcauccuagucu

SEQ ID NO: 475247 - RNA, 22 nt, Homo sapiens
gcuuccuuagguugaugcugga

SEQ ID NO: 475248 - RNA, 16 nt, Homo sapiens
gcuucucucucuaaaa

SEQ ID NO: 475249 - RNA, 19 nt, Homo sapiens
gcuucugauacguguauga

SEQ ID NO: 475250 - RNA, 14 nt, Homo sapiens
gcuugaaccuggga

SEQ ID NO: 475251 - RNA, 16 nt, Homo sapiens
gcuuuccucccaaagg

SEQ ID NO: 475252 - RNA, 17 nt, Homo sapiens
gcuuucuuuccaauccu

SEQ ID NO: 475253 - RNA, 20 nt, Homo sapiens
gcuuuggagacgccucccca

SEQ ID NO: 475254 - RNA, 21 nt, Homo sapiens
gcuuuugggaauggacucacu

SEQ ID NO: 475255 - RNA, 13 nt, Homo sapiens
ggaaaacaguauu

SEQ ID NO: 475256 - RNA, 20 nt, Homo sapiens
ggaaaauaaaucaaugcuau

SEQ ID NO: 475257 - RNA, 18 nt, Homo sapiens
ggaaaauauguaacugga

SEQ ID NO: 475258 - RNA, 15 nt, Homo sapiens
ggaaaccacagcugc

SEQ ID NO: 475259 - RNA, 17 nt, Homo sapiens
ggaaacuggaugagguc

SEQ ID NO: 475260 - RNA, 19 nt, Homo sapiens
ggaaacuggaugaggucau

SEQ ID NO: 475261 - RNA, 18 nt, Homo sapiens
ggaaagacagcuucucau

SEQ ID NO: 475262 - RNA, 13 nt, Homo sapiens
ggaaagaugaaug

SEQ ID NO: 475263 - RNA, 22 nt, Homo sapiens
ggaaaggcaaaugcccaaggga

SEQ ID NO: 475264 - RNA, 16 nt, Homo sapiens
ggaaaguucuuaggca

SEQ ID NO: 475265 - RNA, 22 nt, Homo sapiens
ggaacccccagaauaaauaugc

SEQ ID NO: 475266 - RNA, 18 nt, Homo sapiens
ggaagaacuugucccuca

SEQ ID NO: 475267 - RNA, 20 nt, Homo sapiens
ggaagcagaaucuuugcaag

SEQ ID NO: 475268 - RNA, 16 nt, Homo sapiens
ggaaguccucugggua

SEQ ID NO: 475269 - RNA, 16 nt, Homo sapiens
ggaaguuaaagggcau

SEQ ID NO: 475270 - RNA, 16 nt, Homo sapiens
ggaauaugagcuuuau

SEQ ID NO: 475271 - RNA, 12 nt, Homo sapiens
ggaaugccugag

SEQ ID NO: 475272 - RNA, 18 nt, Homo sapiens
ggacacuugcucaugccc

SEQ ID NO: 475273 - RNA, 20 nt, Homo sapiens
ggacacuugcucaugcccug

SEQ ID NO: 475274 - RNA, 23 nt, Homo sapiens
ggacagcccuucuuuccacagaa

SEQ ID NO: 475275 - RNA, 20 nt, Homo sapiens
ggacaugaagggaugcugca

SEQ ID NO: 475276 - RNA, 23 nt, Homo sapiens
ggacaugaagggaugcugcaaug

SEQ ID NO: 475277 - RNA, 21 nt, Homo sapiens
ggacuauggcucuacuuucag

SEQ ID NO: 475278 - RNA, 15 nt, Homo sapiens
ggacucuucucaucc

SEQ ID NO: 475279 - RNA, 19 nt, Homo sapiens
ggacugcugacauuuugca

SEQ ID NO: 475280 - RNA, 16 nt, Homo sapiens
ggacuuacuauuuauu

SEQ ID NO: 475281 - RNA, 19 nt, Homo sapiens
ggacuucaaaaacugucaa

SEQ ID NO: 475282 - RNA, 13 nt, Homo sapiens
ggacuuccauuug

SEQ ID NO: 475283 - RNA, 16 nt, Homo sapiens
ggagagcuggagccug

SEQ ID NO: 475284 - RNA, 16 nt, Homo sapiens
ggagccaauccacucc

SEQ ID NO: 475285 - RNA, 14 nt, Homo sapiens
ggagccuccagcug

SEQ ID NO: 475286 - RNA, 23 nt, Homo sapiens
agaccaggcuggccagcauggug

SEQ ID NO: 475287 - RNA, 19 nt, Homo sapiens
agaccagucuggccaauau

SEQ ID NO: 475288 - RNA, 15 nt, Homo sapiens
agacccucaaugcca

SEQ ID NO: 475289 - RNA, 20 nt, Homo sapiens
agacgugcacugagagugaa

SEQ ID NO: 475290 - RNA, 22 nt, Homo sapiens
agacuaugaggaauauuugcaa

SEQ ID NO: 475291 - RNA, 18 nt, Homo sapiens
agacugcaggguccccaa

SEQ ID NO: 475292 - RNA, 13 nt, Homo sapiens
agacugucaguag

SEQ ID NO: 475293 - RNA, 23 nt, Homo sapiens
agacuuggcuccaccacugauau

SEQ ID NO: 475294 - RNA, 17 nt, Homo sapiens
agacuuuaaaccaccua

SEQ ID NO: 475295 - RNA, 19 nt, Homo sapiens
agagaaagagaaugggagc

SEQ ID NO: 475296 - RNA, 21 nt, Homo sapiens
agagacagcucuucuacuacc

SEQ ID NO: 475297 - RNA, 23 nt, Homo sapiens
agagaccaggcaaagcaagugau

SEQ ID NO: 475298 - RNA, 18 nt, Homo sapiens
agagaccaggcugugaaa

SEQ ID NO: 475299 - RNA, 20 nt, Homo sapiens
agagaccaggcugugaaauc

SEQ ID NO: 475300 - RNA, 16 nt, Homo sapiens
agagauggccugagaa

SEQ ID NO: 475301 - RNA, 16 nt, Homo sapiens
agagauuccugagcca

SEQ ID NO: 475302 - RNA, 18 nt, Homo sapiens
agagauugagcuacuuca

SEQ ID NO: 475303 - RNA, 13 nt, Homo sapiens
agagcacacugua

SEQ ID NO: 475304 - RNA, 15 nt, Homo sapiens
agagcacacuguagc

SEQ ID NO: 475305 - RNA, 19 nt, Homo sapiens
agagcaguuucuguccugc

SEQ ID NO: 475306 - RNA, 17 nt, Homo sapiens
agagccaggcuguugga

SEQ ID NO: 475307 - RNA, 22 nt, Homo sapiens
agagcccuucaugcauuugcac

SEQ ID NO: 475308 - RNA, 21 nt, Homo sapiens
agagccugaguguugccuaau

SEQ ID NO: 475309 - RNA, 22 nt, Homo sapiens
agagcuuugcuucucucucuaa

SEQ ID NO: 475310 - RNA, 15 nt, Homo sapiens
agaggaagugcacug

SEQ ID NO: 475311 - RNA, 19 nt, Homo sapiens
agaggaccugagucugcua

SEQ ID NO: 475312 - RNA, 21 nt, Homo sapiens
agaggagagagacuccagcug

SEQ ID NO: 475313 - RNA, 18 nt, Homo sapiens
agagggcacacacugugu

SEQ ID NO: 475314 - RNA, 14 nt, Homo sapiens
agagggcaggcaug

SEQ ID NO: 475315 - RNA, 21 nt, Homo sapiens
agaguacaccccaacagcacc

SEQ ID NO: 475316 - RNA, 16 nt, Homo sapiens
agaguagagggcacug

SEQ ID NO: 475317 - RNA, 14 nt, Homo sapiens
agagucaugucaaa

SEQ ID NO: 475318 - RNA, 15 nt, Homo sapiens
agaguuuagcuggaa

SEQ ID NO: 475319 - RNA, 16 nt, Homo sapiens
agaguuuagcuggaaa

SEQ ID NO: 475320 - RNA, 17 nt, Homo sapiens
agauaggccaugggcac

SEQ ID NO: 475321 - RNA, 15 nt, Homo sapiens
agauaugaugucccu

SEQ ID NO: 475322 - RNA, 19 nt, Homo sapiens
agaucacgccauugcacuc

SEQ ID NO: 475323 - RNA, 19 nt, Homo sapiens
agaucaugggucaagagau

SEQ ID NO: 475324 - RNA, 14 nt, Homo sapiens
agaucauucacuca

SEQ ID NO: 475325 - RNA, 14 nt, Homo sapiens
agauccucuucuca

SEQ ID NO: 475326 - RNA, 19 nt, Homo sapiens
agauccucuucucaaagcu

SEQ ID NO: 475327 - RNA, 21 nt, Homo sapiens
agaucgaugauaugaccagaa

SEQ ID NO: 475328 - RNA, 13 nt, Homo sapiens
agaucuuauguca

SEQ ID NO: 475329 - RNA, 15 nt, Homo sapiens
agaucuuaugucaag

SEQ ID NO: 475330 - RNA, 20 nt, Homo sapiens
agaugaagcaaacacauuaa

SEQ ID NO: 475331 - RNA, 16 nt, Homo sapiens
agaugacauggugaaa

SEQ ID NO: 475332 - RNA, 22 nt, Homo sapiens
agaugcauguucaaaccaauca

SEQ ID NO: 475333 - RNA, 19 nt, Homo sapiens
agaugcauuaucuaugaua

SEQ ID NO: 475334 - RNA, 20 nt, Homo sapiens
agaugcauuaucuaugauau

SEQ ID NO: 475335 - RNA, 21 nt, Homo sapiens
agaugggguuucacuguguug

SEQ ID NO: 475336 - RNA, 21 nt, Homo sapiens
agauguagcaaauuccaauac

SEQ ID NO: 475337 - RNA, 17 nt, Homo sapiens
agauguucacuguggca

SEQ ID NO: 475338 - RNA, 14 nt, Homo sapiens
agauuaacauuuca

SEQ ID NO: 475339 - RNA, 15 nt, Homo sapiens
agauuaacauuucac

SEQ ID NO: 475340 - RNA, 14 nt, Homo sapiens
agauucacacuguc

SEQ ID NO: 475341 - RNA, 11 nt, Homo sapiens
agauugccacu

SEQ ID NO: 475342 - RNA, 20 nt, Homo sapiens
agauuuggaggcuaccucac

SEQ ID NO: 475343 - RNA, 14 nt, Homo sapiens
agauuuuccugaaa

SEQ ID NO: 475344 - RNA, 16 nt, Homo sapiens
agcaaaggcugagaac

SEQ ID NO: 475345 - RNA, 20 nt, Homo sapiens
agcaaauuccaauacauuau

SEQ ID NO: 475346 - RNA, 20 nt, Homo sapiens
agcaaucucggcucauugaa

SEQ ID NO: 475347 - RNA, 11 nt, Homo sapiens
agcacacugua

SEQ ID NO: 475348 - RNA, 19 nt, Homo sapiens
agcacccucuccagaugag

SEQ ID NO: 475349 - RNA, 15 nt, Homo sapiens
agcagaaucuuugca

SEQ ID NO: 475350 - RNA, 21 nt, Homo sapiens
agcagagagauugaacuuuga

SEQ ID NO: 475351 - RNA, 15 nt, Homo sapiens
agcagccaagggaug

SEQ ID NO: 475352 - RNA, 16 nt, Homo sapiens
agcagccaagggauga

SEQ ID NO: 475353 - RNA, 15 nt, Homo sapiens
agcaggacugcacag

SEQ ID NO: 475354 - RNA, 19 nt, Homo sapiens
agcaggcguucagcucacu

SEQ ID NO: 475355 - RNA, 21 nt, Homo sapiens
agcaguggacucaaaacccau

SEQ ID NO: 475356 - RNA, 13 nt, Homo sapiens
agcaguucagagc

SEQ ID NO: 475357 - RNA, 18 nt, Homo sapiens
agcaugcauucauaacag

SEQ ID NO: 475358 - RNA, 18 nt, Homo sapiens
agcauuaugauguggguc

SEQ ID NO: 475359 - RNA, 17 nt, Homo sapiens
agcauugggcugggcuc

SEQ ID NO: 475360 - RNA, 17 nt, Homo sapiens
agcauuuccacaccaag

SEQ ID NO: 475361 - RNA, 20 nt, Homo sapiens
agccaagaucacgccacugc

SEQ ID NO: 475362 - RNA, 17 nt, Homo sapiens
agccaagaucacgccau

SEQ ID NO: 475363 - RNA, 19 nt, Homo sapiens
agccaagaucacgccauug

SEQ ID NO: 475364 - RNA, 23 nt, Homo sapiens
agccaccgcgccuggccaggcug

SEQ ID NO: 475365 - RNA, 22 nt, Homo sapiens
agccaggauugaccuuugcacg

SEQ ID NO: 475366 - RNA, 22 nt, Homo sapiens
agccagggugagagucuggguc

SEQ ID NO: 475367 - RNA, 20 nt, Homo sapiens
agccauaccugguaagcaaa

SEQ ID NO: 475368 - RNA, 15 nt, Homo sapiens
agcccauucauucca

SEQ ID NO: 475369 - RNA, 14 nt, Homo sapiens
agccccaauucgau

SEQ ID NO: 475370 - RNA, 20 nt, Homo sapiens
agcccuucaugcauuugcac

SEQ ID NO: 475371 - RNA, 12 nt, Homo sapiens
agccgaccucag

SEQ ID NO: 475372 - RNA, 11 nt, Homo sapiens
agccggagccu

SEQ ID NO: 475373 - RNA, 15 nt, Homo sapiens
agccgggaaagaaga

SEQ ID NO: 475374 - RNA, 17 nt, Homo sapiens
agccgggcaugguggca

SEQ ID NO: 475375 - RNA, 20 nt, Homo sapiens
agccuagaaacuaacacagc

SEQ ID NO: 475376 - RNA, 17 nt, Homo sapiens
agccuagccgaccucag

SEQ ID NO: 475377 - RNA, 22 nt, Homo sapiens
agccucugccgcugccaugcuu

SEQ ID NO: 475378 - RNA, 19 nt, Homo sapiens
agccucuuagaugcaguuc

SEQ ID NO: 475379 - RNA, 22 nt, Homo sapiens
agccugcugguuuuacauuaga

SEQ ID NO: 475380 - RNA, 17 nt, Homo sapiens
agccuggaacaucauca

SEQ ID NO: 475381 - RNA, 15 nt, Homo sapiens
agcgcgcacacgcac

SEQ ID NO: 475382 - RNA, 15 nt, Homo sapiens
agcguggacaggugu

SEQ ID NO: 475383 - RNA, 19 nt, Homo sapiens
agcuacuugaaggacacaa

SEQ ID NO: 475384 - RNA, 17 nt, Homo sapiens
agcuaguuaugugagaa

SEQ ID NO: 475385 - RNA, 22 nt, Homo sapiens
agcucaaagcguggacaggugu

SEQ ID NO: 475386 - RNA, 18 nt, Homo sapiens
agcucagcauuuccacac

SEQ ID NO: 475387 - RNA, 19 nt, Homo sapiens
agcucagcauuuccacacc

SEQ ID NO: 475388 - RNA, 15 nt, Homo sapiens
agcucaggcacacuu

SEQ ID NO: 475389 - RNA, 12 nt, Homo sapiens
agcucaucucag

SEQ ID NO: 475390 - RNA, 22 nt, Homo sapiens
agcucucugagccagucccuca

SEQ ID NO: 475391 - RNA, 19 nt, Homo sapiens
agcucuugaagacacugaa

SEQ ID NO: 475392 - RNA, 23 nt, Homo sapiens
agcugauacaaauugcagacugu

SEQ ID NO: 475393 - RNA, 23 nt, Homo sapiens
agcuggagcccgugcccuaccac

SEQ ID NO: 475394 - RNA, 16 nt, Homo sapiens
agcuggaguacgugaa

SEQ ID NO: 475395 - RNA, 20 nt, Homo sapiens
agcuggcaccuuaguugcau

SEQ ID NO: 475396 - RNA, 20 nt, Homo sapiens
agcuggugguaucugaguug

SEQ ID NO: 475397 - RNA, 19 nt, Homo sapiens
agcugugcgcaauugcuca

SEQ ID NO: 475398 - RNA, 13 nt, Homo sapiens
agcuuagaccuca

SEQ ID NO: 475399 - RNA, 15 nt, Homo sapiens
agcuucucauccugc

SEQ ID NO: 475400 - RNA, 22 nt, Homo sapiens
agcuugcucacaucuuggcaca

SEQ ID NO: 475401 - RNA, 21 nt, Homo sapiens
agcuuugagcuuaagaauuuu

SEQ ID NO: 475402 - RNA, 17 nt, Homo sapiens
agcuuugcuucucucuc

SEQ ID NO: 475403 - RNA, 15 nt, Homo sapiens
aggaaaagauuccug

SEQ ID NO: 475404 - RNA, 22 nt, Homo sapiens
aggaaacuguuguguccaaucc

SEQ ID NO: 475405 - RNA, 14 nt, Homo sapiens
aggaaccucagggc

SEQ ID NO: 475406 - RNA, 23 nt, Homo sapiens
aggaacuauguucacaagaacaa

SEQ ID NO: 475407 - RNA, 14 nt, Homo sapiens
aggaagcuccaguu

SEQ ID NO: 475408 - RNA, 16 nt, Homo sapiens
aggaaguaugguuuua

SEQ ID NO: 475409 - RNA, 21 nt, Homo sapiens
aggaauauuugcaagacauag

SEQ ID NO: 475410 - RNA, 17 nt, Homo sapiens
aggaauuaaguuaggga

SEQ ID NO: 475411 - RNA, 16 nt, Homo sapiens
aggacagcccuucuuu

SEQ ID NO: 475412 - RNA, 20 nt, Homo sapiens
aggaccaggcaaugugacuu

SEQ ID NO: 475413 - RNA, 17 nt, Homo sapiens
aggaccugagucugcua

SEQ ID NO: 475414 - RNA, 17 nt, Homo sapiens
aggacuagaaccuggag

SEQ ID NO: 475415 - RNA, 23 nt, Homo sapiens
aggacuagggcuuauccaugccu

SEQ ID NO: 475416 - RNA, 19 nt, Homo sapiens
aggacugaucgauuugcac

SEQ ID NO: 475417 - RNA, 15 nt, Homo sapiens
aggagaaucacuuga

SEQ ID NO: 475418 - RNA, 22 nt, Homo sapiens
aggaguacaccccaacagcacc

SEQ ID NO: 475419 - RNA, 19 nt, Homo sapiens
aggaugaaggcaaugccau

SEQ ID NO: 475420 - RNA, 15 nt, Homo sapiens
aggaugcccacuucc

SEQ ID NO: 475421 - RNA, 18 nt, Homo sapiens
aggaugguucccuugaug

SEQ ID NO: 475422 - RNA, 14 nt, Homo sapiens
auuuguaaguuuau

SEQ ID NO: 475423 - RNA, 20 nt, Homo sapiens
auuuguuaaugguuugaaua

SEQ ID NO: 475424 - RNA, 14 nt, Homo sapiens
auuuguuugugcau

SEQ ID NO: 475425 - RNA, 13 nt, Homo sapiens
auuuuagucacac

SEQ ID NO: 475426 - RNA, 12 nt, Homo sapiens
auuuuauggcaa

SEQ ID NO: 475427 - RNA, 16 nt, Homo sapiens
auuuucaagcagcaau

SEQ ID NO: 475428 - RNA, 13 nt, Homo sapiens
auuuuccugaaaa

SEQ ID NO: 475429 - RNA, 19 nt, Homo sapiens
auuuuccuuccuacacccu

SEQ ID NO: 475430 - RNA, 17 nt, Homo sapiens
auuuucuaaugugccua

SEQ ID NO: 475431 - RNA, 18 nt, Homo sapiens
auuuucuccgaaaggcaa

SEQ ID NO: 475432 - RNA, 12 nt, Homo sapiens
auuuucuuccaa

SEQ ID NO: 475433 - RNA, 19 nt, Homo sapiens
auuuucuugaauggcaugc

SEQ ID NO: 475434 - RNA, 19 nt, Homo sapiens
auuuugauaccagugagca

SEQ ID NO: 475435 - RNA, 15 nt, Homo sapiens
auuuuuucucaagau

SEQ ID NO: 475436 - RNA, 22 nt, Homo sapiens
caaaaaaucucaauucuucccu

SEQ ID NO: 475437 - RNA, 16 nt, Homo sapiens
caaaaagucauuguaa

SEQ ID NO: 475438 - RNA, 19 nt, Homo sapiens
caaaagcccauucauucca

SEQ ID NO: 475439 - RNA, 21 nt, Homo sapiens
caaaagcccauucauuccauu

SEQ ID NO: 475440 - RNA, 15 nt, Homo sapiens
caaacacccaugccc

SEQ ID NO: 475441 - RNA, 17 nt, Homo sapiens
caaacacccaugcccag

SEQ ID NO: 475442 - RNA, 14 nt, Homo sapiens
caaacuaccuucca

SEQ ID NO: 475443 - RNA, 21 nt, Homo sapiens
caaacuggugugugccucauu

SEQ ID NO: 475444 - RNA, 16 nt, Homo sapiens
caaagacaaaggugag

SEQ ID NO: 475445 - RNA, 16 nt, Homo sapiens
caaagacuauucccuu

SEQ ID NO: 475446 - RNA, 15 nt, Homo sapiens
caaagcuacuugaag

SEQ ID NO: 475447 - RNA, 20 nt, Homo sapiens
caaaggcucucacuccagga

SEQ ID NO: 475448 - RNA, 18 nt, Homo sapiens
caaaggcugagaacacug

SEQ ID NO: 475449 - RNA, 22 nt, Homo sapiens
caaaggcugagaacacugugaa

SEQ ID NO: 475450 - RNA, 17 nt, Homo sapiens
caaagugcugagauuau

SEQ ID NO: 475451 - RNA, 12 nt, Homo sapiens
caacaacaugua

SEQ ID NO: 475452 - RNA, 19 nt, Homo sapiens
caacagagcgagauuccau

SEQ ID NO: 475453 - RNA, 14 nt, Homo sapiens
caacagcacccucu

SEQ ID NO: 475454 - RNA, 17 nt, Homo sapiens
caacaugugcucaggga

SEQ ID NO: 475455 - RNA, 22 nt, Homo sapiens
caacauuacagggaaugccuga

SEQ ID NO: 475456 - RNA, 20 nt, Homo sapiens
caacccaauaguuguugauu

SEQ ID NO: 475457 - RNA, 15 nt, Homo sapiens
caacccuaaaaagca

SEQ ID NO: 475458 - RNA, 20 nt, Homo sapiens
caaccuguugaauuuacucu

SEQ ID NO: 475459 - RNA, 19 nt, Homo sapiens
caacugccauguuuugcca

SEQ ID NO: 475460 - RNA, 12 nt, Homo sapiens
caagaacuugga

SEQ ID NO: 475461 - RNA, 15 nt, Homo sapiens
caagaagugccaguu

SEQ ID NO: 475462 - RNA, 19 nt, Homo sapiens
caagacccaaguagcugcu

SEQ ID NO: 475463 - RNA, 21 nt, Homo sapiens
caagacccaaguagcugcuac

SEQ ID NO: 475464 - RNA, 14 nt, Homo sapiens
caagagucauguca

SEQ ID NO: 475465 - RNA, 15 nt, Homo sapiens
caagagucaugucaa

SEQ ID NO: 475466 - RNA, 21 nt, Homo sapiens
caagcaauucuccugccucag

SEQ ID NO: 475467 - RNA, 14 nt, Homo sapiens
caagcagcaauaga

SEQ ID NO: 475468 - RNA, 16 nt, Homo sapiens
caagcauuuagaugua

SEQ ID NO: 475469 - RNA, 17 nt, Homo sapiens
caagcauuuagauguau

SEQ ID NO: 475470 - RNA, 13 nt, Homo sapiens
caagcucccaagg

SEQ ID NO: 475471 - RNA, 16 nt, Homo sapiens
caagcuggacuauggc

SEQ ID NO: 475472 - RNA, 14 nt, Homo sapiens
caaggagacacaac

SEQ ID NO: 475473 - RNA, 21 nt, Homo sapiens
caaggcaaagacuauucccuu

SEQ ID NO: 475474 - RNA, 13 nt, Homo sapiens
caaggcacugccu

SEQ ID NO: 475475 - RNA, 14 nt, Homo sapiens
caaggcacugccug

SEQ ID NO: 475476 - RNA, 16 nt, Homo sapiens
caaggcacugccugau

SEQ ID NO: 475477 - RNA, 17 nt, Homo sapiens
caaggcuggagugcagu

SEQ ID NO: 475478 - RNA, 15 nt, Homo sapiens
caaggugaacacuuc

SEQ ID NO: 475479 - RNA, 15 nt, Homo sapiens
caaguagcugcuacc

SEQ ID NO: 475480 - RNA, 17 nt, Homo sapiens
caaguagcuggaauuac

SEQ ID NO: 475481 - RNA, 17 nt, Homo sapiens
caagugauucuugugcc

SEQ ID NO: 475482 - RNA, 23 nt, Homo sapiens
caaguggcugugacaucuacgua

SEQ ID NO: 475483 - RNA, 23 nt, Homo sapiens
caaguggguccaaguggcuguga

SEQ ID NO: 475484 - RNA, 20 nt, Homo sapiens
caaguuggcuucuaaucaaa

SEQ ID NO: 475485 - RNA, 14 nt, Homo sapiens
caauaaaccacaag

SEQ ID NO: 475486 - RNA, 12 nt, Homo sapiens
caauaaacugaa

SEQ ID NO: 475487 - RNA, 12 nt, Homo sapiens
caauaugagucu

SEQ ID NO: 475488 - RNA, 10 nt, Homo sapiens
caaucacaaa

SEQ ID NO: 475489 - RNA, 20 nt, Homo sapiens
caaucacaaaaguauauuca

SEQ ID NO: 475490 - RNA, 12 nt, Homo sapiens
caauccaagagu

SEQ ID NO: 475491 - RNA, 18 nt, Homo sapiens
caauccagcgguucucaa

SEQ ID NO: 475492 - RNA, 18 nt, Homo sapiens
caauccuuuauagcuuug

SEQ ID NO: 475493 - RNA, 17 nt, Homo sapiens
caaugauuuacucaaua

SEQ ID NO: 475494 - RNA, 16 nt, Homo sapiens
caaugcauucugaggu

SEQ ID NO: 475495 - RNA, 16 nt, Homo sapiens
caauggcuuacuccag

SEQ ID NO: 475496 - RNA, 20 nt, Homo sapiens
caauucuauuacgugcaaua

SEQ ID NO: 475497 - RNA, 19 nt, Homo sapiens
caauucuuacaaacaugug

SEQ ID NO: 475498 - RNA, 16 nt, Homo sapiens
caauuugcugccaaac

SEQ ID NO: 475499 - RNA, 18 nt, Homo sapiens
cacaaacucauccauuaa

SEQ ID NO: 475500 - RNA, 23 nt, Homo sapiens
cacaaauuugggagggugagaca

SEQ ID NO: 475501 - RNA, 22 nt, Homo sapiens
cacaagacccaaguagcugcua

SEQ ID NO: 475502 - RNA, 16 nt, Homo sapiens
cacaauuaaugaaaua

SEQ ID NO: 475503 - RNA, 13 nt, Homo sapiens
cacacacauacag

SEQ ID NO: 475504 - RNA, 12 nt, Homo sapiens
cacacacugugu

SEQ ID NO: 475505 - RNA, 16 nt, Homo sapiens
cacacagcaguagcag

SEQ ID NO: 475506 - RNA, 12 nt, Homo sapiens
cacacauacaga

SEQ ID NO: 475507 - RNA, 13 nt, Homo sapiens
cacacauauguau

SEQ ID NO: 475508 - RNA, 21 nt, Homo sapiens
cacacuguagcauuacagugg

SEQ ID NO: 475509 - RNA, 12 nt, Homo sapiens
cacagacagggu

SEQ ID NO: 475510 - RNA, 20 nt, Homo sapiens
cacagagcaggacugcacag

SEQ ID NO: 475511 - RNA, 19 nt, Homo sapiens
cacagcaguagcaguagau

SEQ ID NO: 475512 - RNA, 19 nt, Homo sapiens
cacagcguccuguccacac

SEQ ID NO: 475513 - RNA, 22 nt, Homo sapiens
cacaggaugaaggcaaugccau

SEQ ID NO: 475514 - RNA, 16 nt, Homo sapiens
cacagggauguacaag

SEQ ID NO: 475515 - RNA, 20 nt, Homo sapiens
cacauaaaagacacagaaca

SEQ ID NO: 475516 - RNA, 23 nt, Homo sapiens
cacauaguagguacccaauucaa

SEQ ID NO: 475517 - RNA, 16 nt, Homo sapiens
cacaugaguauuguga

SEQ ID NO: 475518 - RNA, 12 nt, Homo sapiens
cacaugccaagc

SEQ ID NO: 475519 - RNA, 23 nt, Homo sapiens
caccaucagucaaugaauaacag

SEQ ID NO: 475520 - RNA, 16 nt, Homo sapiens
caccauuuguauccac

SEQ ID NO: 475521 - RNA, 14 nt, Homo sapiens
cacccaaugcauau

SEQ ID NO: 475522 - RNA, 23 nt, Homo sapiens
cacccagcucagcauuuccacac

SEQ ID NO: 475523 - RNA, 18 nt, Homo sapiens
cacccaggcuggagugca

SEQ ID NO: 475524 - RNA, 23 nt, Homo sapiens
caccgguguccuguuccugccac

SEQ ID NO: 475525 - RNA, 14 nt, Homo sapiens
caccucccugcaau

SEQ ID NO: 475526 - RNA, 20 nt, Homo sapiens
caccuguaaucccagcacuu

SEQ ID NO: 475527 - RNA, 19 nt, Homo sapiens
caccuucagaggcugaggu

SEQ ID NO: 475528 - RNA, 17 nt, Homo sapiens
cacgaucucgacucacu

SEQ ID NO: 475529 - RNA, 19 nt, Homo sapiens
cacuaaacagacuauuuaa

SEQ ID NO: 475530 - RNA, 20 nt, Homo sapiens
cacucagugauugcaauuug

SEQ ID NO: 475531 - RNA, 19 nt, Homo sapiens
cacucauuuauuuccauau

SEQ ID NO: 475532 - RNA, 21 nt, Homo sapiens
cacuggugggccauuagauuu

SEQ ID NO: 475533 - RNA, 16 nt, Homo sapiens
cacugugggcuuuuau

SEQ ID NO: 475534 - RNA, 18 nt, Homo sapiens
cacuguggguagacacac

SEQ ID NO: 475535 - RNA, 22 nt, Homo sapiens
cacuuaaugaaugaaugaauuc

SEQ ID NO: 475536 - RNA, 17 nt, Homo sapiens
cacuuauccuguucucu

SEQ ID NO: 475537 - RNA, 18 nt, Homo sapiens
cacuuccuauaugcacuu

SEQ ID NO: 475538 - RNA, 19 nt, Homo sapiens
cacuucugagaacucaucc

SEQ ID NO: 475539 - RNA, 16 nt, Homo sapiens
cacuugacuuugccac

SEQ ID NO: 475540 - RNA, 19 nt, Homo sapiens
cagaaaucaaaaagggaau

SEQ ID NO: 475541 - RNA, 16 nt, Homo sapiens
cagaacgagacuccac

SEQ ID NO: 475542 - RNA, 18 nt, Homo sapiens
cagaacucaaaugagccc

SEQ ID NO: 475543 - RNA, 24 nt, Homo sapiens
cagaaggaaccagcguguauauga

SEQ ID NO: 475544 - RNA, 12 nt, Homo sapiens
cagaaggggugg

SEQ ID NO: 475545 - RNA, 14 nt, Homo sapiens
cagaaucccggcug

SEQ ID NO: 475546 - RNA, 17 nt, Homo sapiens
cagacauguggugggac

SEQ ID NO: 475547 - RNA, 16 nt, Homo sapiens
cagaccucaggugcua

SEQ ID NO: 475548 - RNA, 12 nt, Homo sapiens
cagacuccaugg

SEQ ID NO: 475549 - RNA, 20 nt, Homo sapiens
cagacuggugggcuagccaa

SEQ ID NO: 475550 - RNA, 17 nt, Homo sapiens
cagagaaaacagcaaua

SEQ ID NO: 475551 - RNA, 23 nt, Homo sapiens
cagagaaaacagcaauagugaau

SEQ ID NO: 475552 - RNA, 17 nt, Homo sapiens
cagagcagaacuuucac

SEQ ID NO: 475553 - RNA, 15 nt, Homo sapiens
cagagcucucugagg

SEQ ID NO: 475554 - RNA, 13 nt, Homo sapiens
cagagcuuccuua

SEQ ID NO: 475555 - RNA, 22 nt, Homo sapiens
cagagcuuggacuggaugcaug

SEQ ID NO: 475556 - RNA, 19 nt, Homo sapiens
cagagucaaugaacuuucc

SEQ ID NO: 475557 - RNA, 14 nt, Homo sapiens
cagaugaaugggag

SEQ ID NO: 475558 - RNA, 14 nt, Homo sapiens
cagaugagaguaca

SEQ ID NO: 475559 - RNA, 20 nt, Homo sapiens
cagaugagaguacaccccaa

SEQ ID NO: 475560 - RNA, 13 nt, Homo sapiens
cuagaaccuggag

SEQ ID NO: 475561 - RNA, 14 nt, Homo sapiens
cuagaaucacuuga

SEQ ID NO: 475562 - RNA, 18 nt, Homo sapiens
cuagaaucuggagagcua

SEQ ID NO: 475563 - RNA, 18 nt, Homo sapiens
cuagaguuuagcuggaaa

SEQ ID NO: 475564 - RNA, 12 nt, Homo sapiens
cuaguugcuugu

SEQ ID NO: 475565 - RNA, 16 nt, Homo sapiens
cuauaacuauguugau

SEQ ID NO: 475566 - RNA, 20 nt, Homo sapiens
cuauaacuauguugauaaaa

SEQ ID NO: 475567 - RNA, 18 nt, Homo sapiens
cuauagaaaacaauacag

SEQ ID NO: 475568 - RNA, 16 nt, Homo sapiens
cuauauggcagugucu

SEQ ID NO: 475569 - RNA, 17 nt, Homo sapiens
cuauauuguacacaccu

SEQ ID NO: 475570 - RNA, 18 nt, Homo sapiens
cuaucauuaaaguucuag

SEQ ID NO: 475571 - RNA, 18 nt, Homo sapiens
cuaucuuugccacccuca

SEQ ID NO: 475572 - RNA, 12 nt, Homo sapiens
cuaugagcugcu

SEQ ID NO: 475573 - RNA, 20 nt, Homo sapiens
cuauggcacccaugcaccuu

SEQ ID NO: 475574 - RNA, 21 nt, Homo sapiens
cuaugugcaugcagcaucuaa

SEQ ID NO: 475575 - RNA, 16 nt, Homo sapiens
cuauuacgugcaauac

SEQ ID NO: 475576 - RNA, 23 nt, Homo sapiens
cuauugacaucagcaucaccuag

SEQ ID NO: 475577 - RNA, 12 nt, Homo sapiens
cucaaacauguu

SEQ ID NO: 475578 - RNA, 18 nt, Homo sapiens
cucaaacgguacacagac

SEQ ID NO: 475579 - RNA, 19 nt, Homo sapiens
cucaagccgcaucccagac

SEQ ID NO: 475580 - RNA, 13 nt, Homo sapiens
cucacaccuguaa

SEQ ID NO: 475581 - RNA, 19 nt, Homo sapiens
cucacaccuguaaucccag

SEQ ID NO: 475582 - RNA, 19 nt, Homo sapiens
cucacacgggguauuuuag

SEQ ID NO: 475583 - RNA, 12 nt, Homo sapiens
cucacaucuugg

SEQ ID NO: 475584 - RNA, 17 nt, Homo sapiens
cucaccuugcucugcca

SEQ ID NO: 475585 - RNA, 21 nt, Homo sapiens
cucacucugcuuugcaucccc

SEQ ID NO: 475586 - RNA, 16 nt, Homo sapiens
cucacucuguugccca

SEQ ID NO: 475587 - RNA, 16 nt, Homo sapiens
cucagaauacagacaa

SEQ ID NO: 475588 - RNA, 15 nt, Homo sapiens
cucagccacccugug

SEQ ID NO: 475589 - RNA, 17 nt, Homo sapiens
cucagcuggaucuccau

SEQ ID NO: 475590 - RNA, 12 nt, Homo sapiens
cucaggaccagg

SEQ ID NO: 475591 - RNA, 21 nt, Homo sapiens
cucaggccaucaucaguggag

SEQ ID NO: 475592 - RNA, 16 nt, Homo sapiens
cucaggcuggcaccgc

SEQ ID NO: 475593 - RNA, 15 nt, Homo sapiens
cucaguucugccuua

SEQ ID NO: 475594 - RNA, 21 nt, Homo sapiens
cucaucacauuuguaaauguc

SEQ ID NO: 475595 - RNA, 23 nt, Homo sapiens
cucauccagggcucugaccaguu

SEQ ID NO: 475596 - RNA, 22 nt, Homo sapiens
cucaugcccugccaagcagcag

SEQ ID NO: 475597 - RNA, 20 nt, Homo sapiens
cucaugcugugugacucaaa

SEQ ID NO: 475598 - RNA, 19 nt, Homo sapiens
cucauggaauuggagcucg

SEQ ID NO: 475599 - RNA, 21 nt, Homo sapiens
cucauggaugagacuacuuca

SEQ ID NO: 475600 - RNA, 18 nt, Homo sapiens
cucauuaccuugugcuaa

SEQ ID NO: 475601 - RNA, 12 nt, Homo sapiens
cucauugcuugg

SEQ ID NO: 475602 - RNA, 19 nt, Homo sapiens
cucauuuauuuccauauua

SEQ ID NO: 475603 - RNA, 18 nt, Homo sapiens
cuccagagggaauugcag

SEQ ID NO: 475604 - RNA, 20 nt, Homo sapiens
cuccagccugggcaacagag

SEQ ID NO: 475605 - RNA, 22 nt, Homo sapiens
cuccagccugggcaacagagca

SEQ ID NO: 475606 - RNA, 20 nt, Homo sapiens
cuccagccugggugacagaa

SEQ ID NO: 475607 - RNA, 21 nt, Homo sapiens
cuccaucaguuagagcugaca

SEQ ID NO: 475608 - RNA, 20 nt, Homo sapiens
cuccauuguucagaugcuuc

SEQ ID NO: 475609 - RNA, 13 nt, Homo sapiens
cucccaagggaug

SEQ ID NO: 475610 - RNA, 21 nt, Homo sapiens
cucccaagggauggugcccug

SEQ ID NO: 475611 - RNA, 13 nt, Homo sapiens
cucccagacugca

SEQ ID NO: 475612 - RNA, 22 nt, Homo sapiens
cucccuccaccucccugcaaua

SEQ ID NO: 475613 - RNA, 19 nt, Homo sapiens
cucccugguucugaugaug

SEQ ID NO: 475614 - RNA, 20 nt, Homo sapiens
cuccuccccaaggagacaca

SEQ ID NO: 475615 - RNA, 17 nt, Homo sapiens
cuccucguaugcaugga

SEQ ID NO: 475616 - RNA, 15 nt, Homo sapiens
cuccucugcuugcca

SEQ ID NO: 475617 - RNA, 18 nt, Homo sapiens
cuccuuccagcacugacu

SEQ ID NO: 475618 - RNA, 20 nt, Homo sapiens
cuccuugagagaccaggcaa

SEQ ID NO: 475619 - RNA, 19 nt, Homo sapiens
cucgaacucccgaccucag

SEQ ID NO: 475620 - RNA, 13 nt, Homo sapiens
cucgaacuccuga

SEQ ID NO: 475621 - RNA, 20 nt, Homo sapiens
cucggacagcccaucugccu

SEQ ID NO: 475622 - RNA, 19 nt, Homo sapiens
cucuagccuggcaacagag

SEQ ID NO: 475623 - RNA, 21 nt, Homo sapiens
cucuagccuggcaacagagcg

SEQ ID NO: 475624 - RNA, 22 nt, Homo sapiens
cucucacuccaggacaguggag

SEQ ID NO: 475625 - RNA, 17 nt, Homo sapiens
cucugagacacacccca

SEQ ID NO: 475626 - RNA, 14 nt, Homo sapiens
cucuggaugccuga

SEQ ID NO: 475627 - RNA, 13 nt, Homo sapiens
cucugucucaaaa

SEQ ID NO: 475628 - RNA, 19 nt, Homo sapiens
cucuucccccacuccucuu

SEQ ID NO: 475629 - RNA, 17 nt, Homo sapiens
cucuucucaaagcuggg

SEQ ID NO: 475630 - RNA, 21 nt, Homo sapiens
cucuugcccagccggcugcaa

SEQ ID NO: 475631 - RNA, 14 nt, Homo sapiens
cucuuggcagucac

SEQ ID NO: 475632 - RNA, 15 nt, Homo sapiens
cucuuuuucuagucu

SEQ ID NO: 475633 - RNA, 15 nt, Homo sapiens
cugaaaacaagccau

SEQ ID NO: 475634 - RNA, 22 nt, Homo sapiens
cugaaacauuuggaagccccau

SEQ ID NO: 475635 - RNA, 21 nt, Homo sapiens
cugaaauauacacacagcagu

SEQ ID NO: 475636 - RNA, 17 nt, Homo sapiens
cugaaaucauacuucuu

SEQ ID NO: 475637 - RNA, 21 nt, Homo sapiens
cugaaaucauacuucuuaggg

SEQ ID NO: 475638 - RNA, 12 nt, Homo sapiens
cugaacugaugg

SEQ ID NO: 475639 - RNA, 22 nt, Homo sapiens
cugaacuggagccaugggcaca

SEQ ID NO: 475640 - RNA, 16 nt, Homo sapiens
cugaaguaagcaaaga

SEQ ID NO: 475641 - RNA, 17 nt, Homo sapiens
cugaaguaagcaaagac

SEQ ID NO: 475642 - RNA, 22 nt, Homo sapiens
cugaagucuucuccuccaugaa

SEQ ID NO: 475643 - RNA, 20 nt, Homo sapiens
cugaauguuagauaguuacu

SEQ ID NO: 475644 - RNA, 22 nt, Homo sapiens
cugaccaguuuaaccugaugca

SEQ ID NO: 475645 - RNA, 19 nt, Homo sapiens
cugaccucaggugauccac

SEQ ID NO: 475646 - RNA, 17 nt, Homo sapiens
cugagacuuggcuccac

SEQ ID NO: 475647 - RNA, 13 nt, Homo sapiens
cugagagugaagu

SEQ ID NO: 475648 - RNA, 14 nt, Homo sapiens
cugagagugaagug

SEQ ID NO: 475649 - RNA, 22 nt, Homo sapiens
cugagauuauaggcaugagcca

SEQ ID NO: 475650 - RNA, 17 nt, Homo sapiens
cugagcucgguggaccc

SEQ ID NO: 475651 - RNA, 14 nt, Homo sapiens
cugagucaccaucu

SEQ ID NO: 475652 - RNA, 13 nt, Homo sapiens
cugauacguguau

SEQ ID NO: 475653 - RNA, 14 nt, Homo sapiens
cugaugcagucacg

SEQ ID NO: 475654 - RNA, 23 nt, Homo sapiens
cugauuaaaaaaucucccaaagc

SEQ ID NO: 475655 - RNA, 15 nt, Homo sapiens
cugauuaaugcuaaa

SEQ ID NO: 475656 - RNA, 16 nt, Homo sapiens
cugcacauaaguuaug

SEQ ID NO: 475657 - RNA, 20 nt, Homo sapiens
cugcacuccagccugggcaa

SEQ ID NO: 475658 - RNA, 15 nt, Homo sapiens
cugccaugcuuugag

SEQ ID NO: 475659 - RNA, 14 nt, Homo sapiens
cugccucagccucc

SEQ ID NO: 475660 - RNA, 12 nt, Homo sapiens
cugcuaccucac

SEQ ID NO: 475661 - RNA, 12 nt, Homo sapiens
cugcuugccauc

SEQ ID NO: 475662 - RNA, 17 nt, Homo sapiens
cugcuuuggaaaucaca

SEQ ID NO: 475663 - RNA, 14 nt, Homo sapiens
cuggaacaucauca

SEQ ID NO: 475664 - RNA, 12 nt, Homo sapiens
cuggagggcuag

SEQ ID NO: 475665 - RNA, 20 nt, Homo sapiens
cuggagggcuagaaucugga

SEQ ID NO: 475666 - RNA, 21 nt, Homo sapiens
cuggcugcgcucggccugcuc

SEQ ID NO: 475667 - RNA, 20 nt, Homo sapiens
cuggcuucacagauguguga

SEQ ID NO: 475668 - RNA, 16 nt, Homo sapiens
cugggauauuuccaua

SEQ ID NO: 475669 - RNA, 22 nt, Homo sapiens
cugggauauuuccauauggcaa

SEQ ID NO: 475670 - RNA, 23 nt, Homo sapiens
cugggcaaggaggccacgugaug

SEQ ID NO: 475671 - RNA, 13 nt, Homo sapiens
cugggcaccaccu

SEQ ID NO: 475672 - RNA, 23 nt, Homo sapiens
cugggcucgccacaucccaugag

SEQ ID NO: 475673 - RNA, 13 nt, Homo sapiens
cugggcugaggca

SEQ ID NO: 475674 - RNA, 15 nt, Homo sapiens
cuggguaagagcaca

SEQ ID NO: 475675 - RNA, 15 nt, Homo sapiens
cugguaacauagguu

SEQ ID NO: 475676 - RNA, 12 nt, Homo sapiens
cuguaaugacaa

SEQ ID NO: 475677 - RNA, 15 nt, Homo sapiens
cuguaaugacaaaua

SEQ ID NO: 475678 - RNA, 15 nt, Homo sapiens
cuguacaagcugaug

SEQ ID NO: 475679 - RNA, 17 nt, Homo sapiens
cuguauuagucacagag

SEQ ID NO: 475680 - RNA, 14 nt, Homo sapiens
cuguauuugugcaa

SEQ ID NO: 475681 - RNA, 19 nt, Homo sapiens
cugucaaagaaucaaucca

SEQ ID NO: 475682 - RNA, 23 nt, Homo sapiens
cugucacaucagcuccacuuuca

SEQ ID NO: 475683 - RNA, 18 nt, Homo sapiens
cugucacgugugggcaau

SEQ ID NO: 475684 - RNA, 14 nt, Homo sapiens
cuguccacacccag

SEQ ID NO: 475685 - RNA, 23 nt, Homo sapiens
cuguccuugucgcugugcccugg

SEQ ID NO: 475686 - RNA, 13 nt, Homo sapiens
cugucuacacuaa

SEQ ID NO: 475687 - RNA, 14 nt, Homo sapiens
cugucuacacuaag

SEQ ID NO: 475688 - RNA, 19 nt, Homo sapiens
cugucuccuuaacacugag

SEQ ID NO: 475689 - RNA, 14 nt, Homo sapiens
cugucuuugcugag

SEQ ID NO: 475690 - RNA, 15 nt, Homo sapiens
cugugagcagggauu

SEQ ID NO: 475691 - RNA, 19 nt, Homo sapiens
cugugggagucauggacau

SEQ ID NO: 475692 - RNA, 22 nt, Homo sapiens
cuguguacagaauucugcuacc

SEQ ID NO: 475693 - RNA, 19 nt, Homo sapiens
cugugugaacguguaugua

SEQ ID NO: 475694 - RNA, 14 nt, Homo sapiens
cugugugacucaaa

SEQ ID NO: 475695 - RNA, 17 nt, Homo sapiens
cuguguguacuaauaca

SEQ ID NO: 475696 - RNA, 20 nt, Homo sapiens
cuguucuuucuuacacaaga

SEQ ID NO: 475697 - RNA, 17 nt, Homo sapiens
agggcuuauccaugccu

SEQ ID NO: 475698 - RNA, 21 nt, Homo sapiens
aggguaccuugaacacugggg

SEQ ID NO: 475699 - RNA, 19 nt, Homo sapiens
aggugaagcaccaagcuca

SEQ ID NO: 475700 - RNA, 16 nt, Homo sapiens
aggugauccacccacc

SEQ ID NO: 475701 - RNA, 14 nt, Homo sapiens
aggugauccaccug

SEQ ID NO: 475702 - RNA, 19 nt, Homo sapiens
aggugggcagaucauuuga

SEQ ID NO: 475703 - RNA, 20 nt, Homo sapiens
aggugguauguuugggagac

SEQ ID NO: 475704 - RNA, 15 nt, Homo sapiens
aguaaaacuguggua

SEQ ID NO: 475705 - RNA, 22 nt, Homo sapiens
aguaaccuggguaaaugcagcg

SEQ ID NO: 475706 - RNA, 15 nt, Homo sapiens
aguaagcaagauuua

SEQ ID NO: 475707 - RNA, 13 nt, Homo sapiens
aguaaugaugucg

SEQ ID NO: 475708 - RNA, 13 nt, Homo sapiens
aguaauugugaaa

SEQ ID NO: 475709 - RNA, 16 nt, Homo sapiens
aguacaccccaacagc

SEQ ID NO: 475710 - RNA, 17 nt, Homo sapiens
aguacaccccaacagca

SEQ ID NO: 475711 - RNA, 21 nt, Homo sapiens
aguacaccccaacagcacccu

SEQ ID NO: 475712 - RNA, 14 nt, Homo sapiens
aguacagacagaag

SEQ ID NO: 475713 - RNA, 22 nt, Homo sapiens
aguaccuuuccauuuauucuuu

SEQ ID NO: 475714 - RNA, 17 nt, Homo sapiens
aguagcugcuaccuucu

SEQ ID NO: 475715 - RNA, 14 nt, Homo sapiens
aguaguaucaauga

SEQ ID NO: 475716 - RNA, 13 nt, Homo sapiens
aguauacaugacu

SEQ ID NO: 475717 - RNA, 19 nt, Homo sapiens
aguaugcacuaaucaauac

SEQ ID NO: 475718 - RNA, 22 nt, Homo sapiens
agucaauccaagagucugauga

SEQ ID NO: 475719 - RNA, 13 nt, Homo sapiens
agucacagagaua

SEQ ID NO: 475720 - RNA, 14 nt, Homo sapiens
agucacaucucuuc

SEQ ID NO: 475721 - RNA, 17 nt, Homo sapiens
agucacaucucuuccuc

SEQ ID NO: 475722 - RNA, 22 nt, Homo sapiens
agucaggaaagagaacuuccag

SEQ ID NO: 475723 - RNA, 14 nt, Homo sapiens
agucauggccaaau

SEQ ID NO: 475724 - RNA, 20 nt, Homo sapiens
aguccaaggaaaccacagcu

SEQ ID NO: 475725 - RNA, 23 nt, Homo sapiens
aguccaaggaaaccacagcugcu

SEQ ID NO: 475726 - RNA, 14 nt, Homo sapiens
aguccauauuucaa

SEQ ID NO: 475727 - RNA, 13 nt, Homo sapiens
agucccucagcca

SEQ ID NO: 475728 - RNA, 18 nt, Homo sapiens
aguccgacaaagcuacuu

SEQ ID NO: 475729 - RNA, 13 nt, Homo sapiens
aguccuacagaug

SEQ ID NO: 475730 - RNA, 23 nt, Homo sapiens
aguccuacagauggacugaaaaa

SEQ ID NO: 475731 - RNA, 20 nt, Homo sapiens
agucgucuggcaucucccac

SEQ ID NO: 475732 - RNA, 23 nt, Homo sapiens
agucucacugugggaaggccagc

SEQ ID NO: 475733 - RNA, 22 nt, Homo sapiens
agucucuaucauuaaaguucua

SEQ ID NO: 475734 - RNA, 20 nt, Homo sapiens
agugaaacauuugugaaaaa

SEQ ID NO: 475735 - RNA, 20 nt, Homo sapiens
agugaaagcaucacuuggga

SEQ ID NO: 475736 - RNA, 17 nt, Homo sapiens
agugaaccuagauugca

SEQ ID NO: 475737 - RNA, 13 nt, Homo sapiens
agugaauucacca

SEQ ID NO: 475738 - RNA, 19 nt, Homo sapiens
agugagcuguguucuugcc

SEQ ID NO: 475739 - RNA, 14 nt, Homo sapiens
agugauaugcauuu

SEQ ID NO: 475740 - RNA, 22 nt, Homo sapiens
agugaucacgacaaucacacaa

SEQ ID NO: 475741 - RNA, 20 nt, Homo sapiens
agugcacaacauuacaggga

SEQ ID NO: 475742 - RNA, 16 nt, Homo sapiens
agugcaggcacaguau

SEQ ID NO: 475743 - RNA, 18 nt, Homo sapiens
agugcaguggcacgaucu

SEQ ID NO: 475744 - RNA, 17 nt, Homo sapiens
agugccuggccaaaggg

SEQ ID NO: 475745 - RNA, 19 nt, Homo sapiens
agugccuggccaaagggau

SEQ ID NO: 475746 - RNA, 20 nt, Homo sapiens
aguggagcaaucucggcuca

SEQ ID NO: 475747 - RNA, 20 nt, Homo sapiens
agugggugccccccuugcca

SEQ ID NO: 475748 - RNA, 20 nt, Homo sapiens
agugucaggaggaaggcuua

SEQ ID NO: 475749 - RNA, 21 nt, Homo sapiens
aguuaaggggagcaacagagg

SEQ ID NO: 475750 - RNA, 19 nt, Homo sapiens
aguucaggcucugagacac

SEQ ID NO: 475751 - RNA, 23 nt, Homo sapiens
aguuccucauuuuugaauacagg

SEQ ID NO: 475752 - RNA, 23 nt, Homo sapiens
aguucuuuucaaccuacuuucau

SEQ ID NO: 475753 - RNA, 15 nt, Homo sapiens
aguugacuugacaga

SEQ ID NO: 475754 - RNA, 22 nt, Homo sapiens
aguugacuugacagaacacugu

SEQ ID NO: 475755 - RNA, 14 nt, Homo sapiens
aguugaggccagga

SEQ ID NO: 475756 - RNA, 17 nt, Homo sapiens
aguugauggugaugaaa

SEQ ID NO: 475757 - RNA, 20 nt, Homo sapiens
aguugcuuguaaaauuucac

SEQ ID NO: 475758 - RNA, 19 nt, Homo sapiens
aguuguagguaauauugca

SEQ ID NO: 475759 - RNA, 23 nt, Homo sapiens
aguuugaguuacuaucaugucaa

SEQ ID NO: 475760 - RNA, 14 nt, Homo sapiens
aguuuuuccuaguc

SEQ ID NO: 475761 - RNA, 15 nt, Homo sapiens
auaaaaguaaacuca

SEQ ID NO: 475762 - RNA, 16 nt, Homo sapiens
auaaaauacauacuau

SEQ ID NO: 475763 - RNA, 17 nt, Homo sapiens
auaaaaucaaacagaga

SEQ ID NO: 475764 - RNA, 16 nt, Homo sapiens
auaaaauucauuccau

SEQ ID NO: 475765 - RNA, 18 nt, Homo sapiens
auaaaauucauuccauuu

SEQ ID NO: 475766 - RNA, 21 nt, Homo sapiens
auaaaccccaguucugaauca

SEQ ID NO: 475767 - RNA, 15 nt, Homo sapiens
auaaaguaugugcau

SEQ ID NO: 475768 - RNA, 19 nt, Homo sapiens
auaaauaaucuacuguaca

SEQ ID NO: 475769 - RNA, 17 nt, Homo sapiens
auaaaucauuaagacaa

SEQ ID NO: 475770 - RNA, 19 nt, Homo sapiens
auaaaugacaagugagaca

SEQ ID NO: 475771 - RNA, 14 nt, Homo sapiens
auaaauucuacucu

SEQ ID NO: 475772 - RNA, 13 nt, Homo sapiens
auaacaaucacaa

SEQ ID NO: 475773 - RNA, 12 nt, Homo sapiens
auaaguccuugc

SEQ ID NO: 475774 - RNA, 16 nt, Homo sapiens
auaauaaaauucauuc

SEQ ID NO: 475775 - RNA, 17 nt, Homo sapiens
auaauaaaauucauucc

SEQ ID NO: 475776 - RNA, 15 nt, Homo sapiens
auaauggggaauuaa

SEQ ID NO: 475777 - RNA, 23 nt, Homo sapiens
auaauucagcucuugagagcauu

SEQ ID NO: 475778 - RNA, 17 nt, Homo sapiens
auacacauacacgguau

SEQ ID NO: 475779 - RNA, 18 nt, Homo sapiens
auacagagcucucugagg

SEQ ID NO: 475780 - RNA, 16 nt, Homo sapiens
auacaggacauucuca

SEQ ID NO: 475781 - RNA, 23 nt, Homo sapiens
auacagguauucugcugaugcua

SEQ ID NO: 475782 - RNA, 17 nt, Homo sapiens
auacauacuauagauuc

SEQ ID NO: 475783 - RNA, 13 nt, Homo sapiens
auaccacugcacc

SEQ ID NO: 475784 - RNA, 14 nt, Homo sapiens
auacccagugaugu

SEQ ID NO: 475785 - RNA, 15 nt, Homo sapiens
auacccuguccuuuc

SEQ ID NO: 475786 - RNA, 12 nt, Homo sapiens
auacguguauga

SEQ ID NO: 475787 - RNA, 19 nt, Homo sapiens
auacuacaaauuaguguca

SEQ ID NO: 475788 - RNA, 16 nt, Homo sapiens
auacucuaugugauuu

SEQ ID NO: 475789 - RNA, 14 nt, Homo sapiens
auacucuucaagga

SEQ ID NO: 475790 - RNA, 13 nt, Homo sapiens
auacugcauaaaa

SEQ ID NO: 475791 - RNA, 17 nt, Homo sapiens
auacuucaauacuucau

SEQ ID NO: 475792 - RNA, 19 nt, Homo sapiens
acaggcacauaccacugca

SEQ ID NO: 475793 - RNA, 22 nt, Homo sapiens
acagggaaugccugagugccug

SEQ ID NO: 475794 - RNA, 22 nt, Homo sapiens
acaguaacugugacugaugacu

SEQ ID NO: 475795 - RNA, 15 nt, Homo sapiens
acaguaugucccaua

SEQ ID NO: 475796 - RNA, 19 nt, Homo sapiens
acauaagcaaagacuauga

SEQ ID NO: 475797 - RNA, 19 nt, Homo sapiens
acauagcuaguuaugugag

SEQ ID NO: 475798 - RNA, 16 nt, Homo sapiens
acauaggaacauguag

SEQ ID NO: 475799 - RNA, 12 nt, Homo sapiens
acauagugagac

SEQ ID NO: 475800 - RNA, 14 nt, Homo sapiens
acaucauggacuga

SEQ ID NO: 475801 - RNA, 17 nt, Homo sapiens
acauccauugacugacc

SEQ ID NO: 475802 - RNA, 20 nt, Homo sapiens
acaugcaaagauccccaaaa

SEQ ID NO: 475803 - RNA, 18 nt, Homo sapiens
acaugcugaagccaaagc

SEQ ID NO: 475804 - RNA, 21 nt, Homo sapiens
acaugcugaagccaaagccaa

SEQ ID NO: 475805 - RNA, 10 nt, Homo sapiens
acaugugcuu

SEQ ID NO: 475806 - RNA, 23 nt, Homo sapiens
acauguggugggacagggaccca

SEQ ID NO: 475807 - RNA, 21 nt, Homo sapiens
acauuacagggaaugccugag

SEQ ID NO: 475808 - RNA, 15 nt, Homo sapiens
acauuagccuaugug

SEQ ID NO: 475809 - RNA, 14 nt, Homo sapiens
acauuagucauuca

SEQ ID NO: 475810 - RNA, 13 nt, Homo sapiens
acauuaucucacu

SEQ ID NO: 475811 - RNA, 15 nt, Homo sapiens
acauucccagcaccu

SEQ ID NO: 475812 - RNA, 16 nt, Homo sapiens
acauucgaguguuuca

SEQ ID NO: 475813 - RNA, 20 nt, Homo sapiens
acauugaauuagaaacauaa

SEQ ID NO: 475814 - RNA, 15 nt, Homo sapiens
acauuuaagagacag

SEQ ID NO: 475815 - RNA, 14 nt, Homo sapiens
accaaaaaucucaa

SEQ ID NO: 475816 - RNA, 14 nt, Homo sapiens
accaaaucacugaa

SEQ ID NO: 475817 - RNA, 15 nt, Homo sapiens
accaaucaugaauua

SEQ ID NO: 475818 - RNA, 16 nt, Homo sapiens
accacagucuuagggg

SEQ ID NO: 475819 - RNA, 16 nt, Homo sapiens
accaccucugugggca

SEQ ID NO: 475820 - RNA, 17 nt, Homo sapiens
accaccucugugggcac

SEQ ID NO: 475821 - RNA, 18 nt, Homo sapiens
accacugcacccagcuaa

SEQ ID NO: 475822 - RNA, 14 nt, Homo sapiens
accaguaauuguga

SEQ ID NO: 475823 - RNA, 22 nt, Homo sapiens
accaguuuaaccugaugcaguc

SEQ ID NO: 475824 - RNA, 12 nt, Homo sapiens
accauguggcaa

SEQ ID NO: 475825 - RNA, 18 nt, Homo sapiens
accauuuuugaaaccaaa

SEQ ID NO: 475826 - RNA, 20 nt, Homo sapiens
acccaggcuggagugcagug

SEQ ID NO: 475827 - RNA, 17 nt, Homo sapiens
acccauucuacacagag

SEQ ID NO: 475828 - RNA, 13 nt, Homo sapiens
accccaacagcac

SEQ ID NO: 475829 - RNA, 21 nt, Homo sapiens
accccaacaugccugcaccug

SEQ ID NO: 475830 - RNA, 20 nt, Homo sapiens
accccccccacacacaccau

SEQ ID NO: 475831 - RNA, 20 nt, Homo sapiens
acccccuccuccagcaauag

SEQ ID NO: 475832 - RNA, 19 nt, Homo sapiens
accccugucucccaaaaau

SEQ ID NO: 475833 - RNA, 22 nt, Homo sapiens
acccuaaaaagcagagcuuugc

SEQ ID NO: 475834 - RNA, 17 nt, Homo sapiens
acccucaagacaaauga

SEQ ID NO: 475835 - RNA, 23 nt, Homo sapiens
acccuguuuguugugucuugcua

SEQ ID NO: 475836 - RNA, 14 nt, Homo sapiens
accgaggacaugaa

SEQ ID NO: 475837 - RNA, 22 nt, Homo sapiens
accuaaagaauaugaauggauu

SEQ ID NO: 475838 - RNA, 23 nt, Homo sapiens
accuagauugcaccauugcacuc

SEQ ID NO: 475839 - RNA, 15 nt, Homo sapiens
accucccugugagag

SEQ ID NO: 475840 - RNA, 19 nt, Homo sapiens
accuccuuauguauucuca

SEQ ID NO: 475841 - RNA, 20 nt, Homo sapiens
accugccucccuucaugcau

SEQ ID NO: 475842 - RNA, 22 nt, Homo sapiens
accuggagagcuagaaccuaga

SEQ ID NO: 475843 - RNA, 16 nt, Homo sapiens
accuggcaaggacaca

SEQ ID NO: 475844 - RNA, 21 nt, Homo sapiens
accuguaaucccagcacuuug

SEQ ID NO: 475845 - RNA, 22 nt, Homo sapiens
accuuacauuugaaaucuauga

SEQ ID NO: 475846 - RNA, 20 nt, Homo sapiens
accuuaguugcaugaccaca

SEQ ID NO: 475847 - RNA, 15 nt, Homo sapiens
accuugaacacuggg

SEQ ID NO: 475848 - RNA, 17 nt, Homo sapiens
accuugggggaagacuu

SEQ ID NO: 475849 - RNA, 18 nt, Homo sapiens
accuuuagagaaagagaa

SEQ ID NO: 475850 - RNA, 20 nt, Homo sapiens
accuuuccauuuauucuuug

SEQ ID NO: 475851 - RNA, 16 nt, Homo sapiens
accuuucugcacauaa

SEQ ID NO: 475852 - RNA, 18 nt, Homo sapiens
acgcacacacacauacag

SEQ ID NO: 475853 - RNA, 14 nt, Homo sapiens
acguauggcuccac

SEQ ID NO: 475854 - RNA, 23 nt, Homo sapiens
acgugauguggagggcacauucc

SEQ ID NO: 475855 - RNA, 19 nt, Homo sapiens
acguguccagaacacucug

SEQ ID NO: 475856 - RNA, 16 nt, Homo sapiens
acuaauacagacuaug

SEQ ID NO: 475857 - RNA, 17 nt, Homo sapiens
acuaaucaauacuuuga

SEQ ID NO: 475858 - RNA, 13 nt, Homo sapiens
acuaugagcugcu

SEQ ID NO: 475859 - RNA, 17 nt, Homo sapiens
acuaugcaaaaguacaa

SEQ ID NO: 475860 - RNA, 18 nt, Homo sapiens
acuauggcucuacuuuca

SEQ ID NO: 475861 - RNA, 18 nt, Homo sapiens
acuauugaaguugcagau

SEQ ID NO: 475862 - RNA, 19 nt, Homo sapiens
acucaacaguuuccaguca

SEQ ID NO: 475863 - RNA, 21 nt, Homo sapiens
acucaagaagcaggcuacacu

SEQ ID NO: 475864 - RNA, 13 nt, Homo sapiens
acucaaucucuga

SEQ ID NO: 475865 - RNA, 17 nt, Homo sapiens
acucaccccuucuaauc

SEQ ID NO: 475866 - RNA, 21 nt, Homo sapiens
acucacugcaaccuucgccuc

SEQ ID NO: 475867 - RNA, 22 nt, Homo sapiens
acucagccuggcugauuaucac

SEQ ID NO: 475868 - RNA, 19 nt, Homo sapiens
acucaucccuaaugcugca

SEQ ID NO: 475869 - RNA, 23 nt, Homo sapiens
acucauggaugagacuacuucag

SEQ ID NO: 475870 - RNA, 18 nt, Homo sapiens
acuccagccugggugaca

SEQ ID NO: 475871 - RNA, 16 nt, Homo sapiens
acucccucucuugccg

SEQ ID NO: 475872 - RNA, 14 nt, Homo sapiens
acuccuagggccac

SEQ ID NO: 475873 - RNA, 18 nt, Homo sapiens
acuccucuuauuugcuca

SEQ ID NO: 475874 - RNA, 14 nt, Homo sapiens
acucugcuuugcau

SEQ ID NO: 475875 - RNA, 18 nt, Homo sapiens
acugaagaugcagcaaaa

SEQ ID NO: 475876 - RNA, 18 nt, Homo sapiens
acugaauguaaacaaagg

SEQ ID NO: 475877 - RNA, 15 nt, Homo sapiens
acugagagugaagug

SEQ ID NO: 475878 - RNA, 12 nt, Homo sapiens
acugaugucauc

SEQ ID NO: 475879 - RNA, 16 nt, Homo sapiens
acugcacagaagacag

SEQ ID NO: 475880 - RNA, 20 nt, Homo sapiens
acugcacuccaaucugggug

SEQ ID NO: 475881 - RNA, 20 nt, Homo sapiens
acugcacuccagccugggca

SEQ ID NO: 475882 - RNA, 18 nt, Homo sapiens
acugcagcuaacuuauca

SEQ ID NO: 475883 - RNA, 20 nt, Homo sapiens
acugccauauacucuucaag

SEQ ID NO: 475884 - RNA, 22 nt, Homo sapiens
acuggagaggcuagaaccaaga

SEQ ID NO: 475885 - RNA, 12 nt, Homo sapiens
acuggaugcaug

SEQ ID NO: 475886 - RNA, 23 nt, Homo sapiens
acuggaugcauguuuuccagcuc

SEQ ID NO: 475887 - RNA, 19 nt, Homo sapiens
acuggcuucugcuugucau

SEQ ID NO: 475888 - RNA, 22 nt, Homo sapiens
acugggacaggggagaaccuag

SEQ ID NO: 475889 - RNA, 21 nt, Homo sapiens
acuguagacucuggaaguaua

SEQ ID NO: 475890 - RNA, 14 nt, Homo sapiens
acugucacauuccc

SEQ ID NO: 475891 - RNA, 21 nt, Homo sapiens
acugugcccaaguggguccaa

SEQ ID NO: 475892 - RNA, 17 nt, Homo sapiens
acuuaauaauguguaca

SEQ ID NO: 475893 - RNA, 14 nt, Homo sapiens
acuucacacacagg

SEQ ID NO: 475894 - RNA, 17 nt, Homo sapiens
acuucaugccagcuaua

SEQ ID NO: 475895 - RNA, 13 nt, Homo sapiens
acuuccagugcaa

SEQ ID NO: 475896 - RNA, 19 nt, Homo sapiens
acuuccuauaugcacuuau

SEQ ID NO: 475897 - RNA, 15 nt, Homo sapiens
acuucuuguucaaaa

SEQ ID NO: 475898 - RNA, 13 nt, Homo sapiens
acuugacuuugcc

SEQ ID NO: 475899 - RNA, 15 nt, Homo sapiens
acuugacuuugccac

SEQ ID NO: 475900 - RNA, 12 nt, Homo sapiens
acuugagacaaa

SEQ ID NO: 475901 - RNA, 19 nt, Homo sapiens
acuuuccauaucaagagac

SEQ ID NO: 475902 - RNA, 21 nt, Homo sapiens
acuuucugaagccucacuuau

SEQ ID NO: 475903 - RNA, 12 nt, Homo sapiens
acuuugugaaaa

SEQ ID NO: 475904 - RNA, 23 nt, Homo sapiens
acuuuuuuuuuuuuuugagacag

SEQ ID NO: 475905 - RNA, 15 nt, Homo sapiens
agaaaaacaugucau

SEQ ID NO: 475906 - RNA, 12 nt, Homo sapiens
agaaaaacucau

SEQ ID NO: 475907 - RNA, 14 nt, Homo sapiens
agaaagcaaacuua

SEQ ID NO: 475908 - RNA, 17 nt, Homo sapiens
agaaagcucaucucagc

SEQ ID NO: 475909 - RNA, 17 nt, Homo sapiens
agaaagugacaagcuca

SEQ ID NO: 475910 - RNA, 23 nt, Homo sapiens
agaaauuccaggaaaaucugcac

SEQ ID NO: 475911 - RNA, 23 nt, Homo sapiens
agaaccuggcagguuagaaccua

SEQ ID NO: 475912 - RNA, 20 nt, Homo sapiens
agaacgagacuccaccucaa

SEQ ID NO: 475913 - RNA, 22 nt, Homo sapiens
agaacuuugcauagcagcugcu

SEQ ID NO: 475914 - RNA, 19 nt, Homo sapiens
agaagacuauauuguacac

SEQ ID NO: 475915 - RNA, 16 nt, Homo sapiens
agaagggauaucuacu

SEQ ID NO: 475916 - RNA, 22 nt, Homo sapiens
agaaguccauggaguuaucuaa

SEQ ID NO: 475917 - RNA, 12 nt, Homo sapiens
agaagugccagu

SEQ ID NO: 475918 - RNA, 18 nt, Homo sapiens
agaauacuaauaaaauac

SEQ ID NO: 475919 - RNA, 22 nt, Homo sapiens
agaaucaauccagcgguucuca

SEQ ID NO: 475920 - RNA, 20 nt, Homo sapiens
agaaucagugcaaagauuug

SEQ ID NO: 475921 - RNA, 21 nt, Homo sapiens
agaaucccggcugucaagggg

SEQ ID NO: 475922 - RNA, 21 nt, Homo sapiens
agaaucuguuucccagcagug

SEQ ID NO: 475923 - RNA, 13 nt, Homo sapiens
agaauggaacuca

SEQ ID NO: 475924 - RNA, 21 nt, Homo sapiens
agacaauggcuuacuccagga

SEQ ID NO: 475925 - RNA, 19 nt, Homo sapiens
agacacaacaacuccuagg

SEQ ID NO: 475926 - RNA, 22 nt, Homo sapiens
agacacacaugaaguccaagca

SEQ ID NO: 475927 - RNA, 18 nt, Homo sapiens
agacaugagugcgugcuc

SEQ ID NO: 475928 - RNA, 19 nt, Homo sapiens
uaaagcuguucucauuccu

SEQ ID NO: 475929 - RNA, 15 nt, Homo sapiens
uaaagcuuugugcag

SEQ ID NO: 475930 - RNA, 18 nt, Homo sapiens
uaaaguaugguauugaaa

SEQ ID NO: 475931 - RNA, 15 nt, Homo sapiens
uaaaguaugugcaua

SEQ ID NO: 475932 - RNA, 16 nt, Homo sapiens
uaaaguaugugcauau

SEQ ID NO: 475933 - RNA, 14 nt, Homo sapiens
uaaaguucuaguga

SEQ ID NO: 475934 - RNA, 15 nt, Homo sapiens
uaaaguucuagugac

SEQ ID NO: 475935 - RNA, 14 nt, Homo sapiens
uaaaucaaugcuau

SEQ ID NO: 475936 - RNA, 15 nt, Homo sapiens
uaaauguaagaauca

SEQ ID NO: 475937 - RNA, 17 nt, Homo sapiens
uaaauguuuguggaaua

SEQ ID NO: 475938 - RNA, 17 nt, Homo sapiens
uaacaaucacaaaggaa

SEQ ID NO: 475939 - RNA, 13 nt, Homo sapiens
uaacacacagcua

SEQ ID NO: 475940 - RNA, 15 nt, Homo sapiens
uaacaugcaaagauc

SEQ ID NO: 475941 - RNA, 19 nt, Homo sapiens
uaacccccaaauacucuga

SEQ ID NO: 475942 - RNA, 15 nt, Homo sapiens
uaaccccuggcaacc

SEQ ID NO: 475943 - RNA, 22 nt, Homo sapiens
uaaccucugagucaccaucuua

SEQ ID NO: 475944 - RNA, 21 nt, Homo sapiens
uaacugugcagagacuuuauc

SEQ ID NO: 475945 - RNA, 16 nt, Homo sapiens
uaagaaacacugacuc

SEQ ID NO: 475946 - RNA, 18 nt, Homo sapiens
uaagauguucacuguggc

SEQ ID NO: 475947 - RNA, 15 nt, Homo sapiens
uaagcaaagacuuuc

SEQ ID NO: 475948 - RNA, 15 nt, Homo sapiens
uaagcuaugugaaau

SEQ ID NO: 475949 - RNA, 23 nt, Homo sapiens
uaaggaucuucccacuuugccac

SEQ ID NO: 475950 - RNA, 20 nt, Homo sapiens
uaagguggguggaucaccug

SEQ ID NO: 475951 - RNA, 19 nt, Homo sapiens
uaaguugauggugaugaaa

SEQ ID NO: 475952 - RNA, 19 nt, Homo sapiens
uaauaaaauacauacuaua

SEQ ID NO: 475953 - RNA, 19 nt, Homo sapiens
uaauaauguguacauuagu

SEQ ID NO: 475954 - RNA, 15 nt, Homo sapiens
uaauagaaacauuga

SEQ ID NO: 475955 - RNA, 16 nt, Homo sapiens
uaauagaaacauugaa

SEQ ID NO: 475956 - RNA, 22 nt, Homo sapiens
uaauauauguauaugcaauaua

SEQ ID NO: 475957 - RNA, 12 nt, Homo sapiens
uaauauauugcu

SEQ ID NO: 475958 - RNA, 15 nt, Homo sapiens
uaauauauugcugcu

SEQ ID NO: 475959 - RNA, 23 nt, Homo sapiens
uaauaucagcaagucucuuuaua

SEQ ID NO: 475960 - RNA, 19 nt, Homo sapiens
uaauauggggaugcagcau

SEQ ID NO: 475961 - RNA, 20 nt, Homo sapiens
uaaucacucagugauugcaa

SEQ ID NO: 475962 - RNA, 13 nt, Homo sapiens
uaaugaaugcaua

SEQ ID NO: 475963 - RNA, 16 nt, Homo sapiens
uaaugcucgucugugu

SEQ ID NO: 475964 - RNA, 22 nt, Homo sapiens
uaauguguacauuagucauuca

SEQ ID NO: 475965 - RNA, 13 nt, Homo sapiens
uaauuagcugugc

SEQ ID NO: 475966 - RNA, 19 nt, Homo sapiens
uaauuaggguccacgccca

SEQ ID NO: 475967 - RNA, 12 nt, Homo sapiens
uaauucuuuauc

SEQ ID NO: 475968 - RNA, 14 nt, Homo sapiens
uaauuggagggaaa

SEQ ID NO: 475969 - RNA, 15 nt, Homo sapiens
uaauuuaaucuucca

SEQ ID NO: 475970 - RNA, 19 nt, Homo sapiens
uaauuuaaucuuccaugga

SEQ ID NO: 475971 - RNA, 20 nt, Homo sapiens
uacaaaaauuagcugggcau

SEQ ID NO: 475972 - RNA, 12 nt, Homo sapiens
uacaaacaugug

SEQ ID NO: 475973 - RNA, 15 nt, Homo sapiens
uacaacagugagaaa

SEQ ID NO: 475974 - RNA, 17 nt, Homo sapiens
uacaagggcugagauuc

SEQ ID NO: 475975 - RNA, 15 nt, Homo sapiens
uacaauaaguuaacu

SEQ ID NO: 475976 - RNA, 22 nt, Homo sapiens
uacacaguggccaagcggccau

SEQ ID NO: 475977 - RNA, 24 nt, Homo sapiens
uacagcagcaugcauucauaacag

SEQ ID NO: 475978 - RNA, 16 nt, Homo sapiens
uacaguaacugugacu

SEQ ID NO: 475979 - RNA, 14 nt, Homo sapiens
uacaguuuaucuau

SEQ ID NO: 475980 - RNA, 15 nt, Homo sapiens
uacauaaaguaugug

SEQ ID NO: 475981 - RNA, 20 nt, Homo sapiens
uacaucccuuaccugggaaa

SEQ ID NO: 475982 - RNA, 11 nt, Homo sapiens
uaccacaggaa

SEQ ID NO: 475983 - RNA, 20 nt, Homo sapiens
uaccacaugccaagcacugu

SEQ ID NO: 475984 - RNA, 16 nt, Homo sapiens
uaccacugcacccagc

SEQ ID NO: 475985 - RNA, 17 nt, Homo sapiens
uaccacugcacccagcu

SEQ ID NO: 475986 - RNA, 20 nt, Homo sapiens
uaccuacauuuuaaugcacc

SEQ ID NO: 475987 - RNA, 16 nt, Homo sapiens
uaccuugaacaaucaa

SEQ ID NO: 475988 - RNA, 20 nt, Homo sapiens
uacgcuccaucgcugucauc

SEQ ID NO: 475989 - RNA, 15 nt, Homo sapiens
uacguuaccaggcag

SEQ ID NO: 475990 - RNA, 21 nt, Homo sapiens
uacuacaguaacugugacuga

SEQ ID NO: 475991 - RNA, 14 nt, Homo sapiens
uacuaucaugucaa

SEQ ID NO: 475992 - RNA, 21 nt, Homo sapiens
uacucaauguuacuaucugcu

SEQ ID NO: 475993 - RNA, 19 nt, Homo sapiens
uacugaaaucaagcuggag

SEQ ID NO: 475994 - RNA, 16 nt, Homo sapiens
uacuguauauacuuug

SEQ ID NO: 475995 - RNA, 23 nt, Homo sapiens
uacuguggucugggcaccaccuc

SEQ ID NO: 475996 - RNA, 17 nt, Homo sapiens
uacuuauuaaucuguau

SEQ ID NO: 475997 - RNA, 23 nt, Homo sapiens
uacuucccgcuguuccucgccac

SEQ ID NO: 475998 - RNA, 21 nt, Homo sapiens
uagaaaaauuagaugacugaa

SEQ ID NO: 475999 - RNA, 20 nt, Homo sapiens
uagaaaagcaaagggugcua

SEQ ID NO: 476000 - RNA, 19 nt, Homo sapiens
uagaaacauugaagaugaa

SEQ ID NO: 476001 - RNA, 15 nt, Homo sapiens
uagaaauauagccaa

SEQ ID NO: 476002 - RNA, 15 nt, Homo sapiens
uagaagguagugaag

SEQ ID NO: 476003 - RNA, 20 nt, Homo sapiens
uagaauaauacuagucuuau

SEQ ID NO: 476004 - RNA, 17 nt, Homo sapiens
uagacaaaguucauuca

SEQ ID NO: 476005 - RNA, 15 nt, Homo sapiens
uagacgaacagcuga

SEQ ID NO: 476006 - RNA, 14 nt, Homo sapiens
uagagauaugcaga

SEQ ID NO: 476007 - RNA, 18 nt, Homo sapiens
uagagauuugguguacaa

SEQ ID NO: 476008 - RNA, 14 nt, Homo sapiens
uagagcacacugua

SEQ ID NO: 476009 - RNA, 20 nt, Homo sapiens
uagaggugcucauucauuua

SEQ ID NO: 476010 - RNA, 13 nt, Homo sapiens
uagauaaagagaa

SEQ ID NO: 476011 - RNA, 14 nt, Homo sapiens
uagauaaagcacug

SEQ ID NO: 476012 - RNA, 16 nt, Homo sapiens
uagaugacauggugaa

SEQ ID NO: 476013 - RNA, 18 nt, Homo sapiens
uagaugcauguacccuaa

SEQ ID NO: 476014 - RNA, 21 nt, Homo sapiens
uagauugcaccauugcacucu

SEQ ID NO: 476015 - RNA, 13 nt, Homo sapiens
uagcagcugcuac

SEQ ID NO: 476016 - RNA, 21 nt, Homo sapiens
uagcauccaaggggccuggaa

SEQ ID NO: 476017 - RNA, 20 nt, Homo sapiens
uagccuagaagauacaauaa

SEQ ID NO: 476018 - RNA, 19 nt, Homo sapiens
uagcugugugaacguguau

SEQ ID NO: 476019 - RNA, 19 nt, Homo sapiens
uagcuuagaccucagccug

SEQ ID NO: 476020 - RNA, 15 nt, Homo sapiens
uagcuuggaaacugg

SEQ ID NO: 476021 - RNA, 12 nt, Homo sapiens
uaguaaagacau

SEQ ID NO: 476022 - RNA, 12 nt, Homo sapiens
uagucgucuccu

SEQ ID NO: 476023 - RNA, 13 nt, Homo sapiens
uagucucuaucau

SEQ ID NO: 476024 - RNA, 18 nt, Homo sapiens
uagucucuaucauuaaag

SEQ ID NO: 476025 - RNA, 18 nt, Homo sapiens
uagugaucacagcagcuu

SEQ ID NO: 476026 - RNA, 15 nt, Homo sapiens
uaguuacuauaugcc

SEQ ID NO: 476027 - RNA, 14 nt, Homo sapiens
uaguuagaaagggu

SEQ ID NO: 476028 - RNA, 22 nt, Homo sapiens
uaguugugcaugccuggcacaa

SEQ ID NO: 476029 - RNA, 15 nt, Homo sapiens
uauaacaaugcugua

SEQ ID NO: 476030 - RNA, 18 nt, Homo sapiens
uauaacugugcaaauaca

SEQ ID NO: 476031 - RNA, 20 nt, Homo sapiens
uauaacuuccuaugcaaaua

SEQ ID NO: 476032 - RNA, 15 nt, Homo sapiens
uauacauuaacuuca

SEQ ID NO: 476033 - RNA, 17 nt, Homo sapiens
uauaugucaucucagug

SEQ ID NO: 476034 - RNA, 13 nt, Homo sapiens
uaucaguccaaag

SEQ ID NO: 476035 - RNA, 14 nt, Homo sapiens
uauccaacaugugc

SEQ ID NO: 476036 - RNA, 18 nt, Homo sapiens
uaucccaaacuaagcuau

SEQ ID NO: 476037 - RNA, 18 nt, Homo sapiens
uauccuccaugaauauca

SEQ ID NO: 476038 - RNA, 15 nt, Homo sapiens
uaugaaaaugucauu

SEQ ID NO: 476039 - RNA, 17 nt, Homo sapiens
uaugaauuuuuucucaa

SEQ ID NO: 476040 - RNA, 15 nt, Homo sapiens
uaugagaugccugaa

SEQ ID NO: 476041 - RNA, 17 nt, Homo sapiens
uaugagaugccugaagc

SEQ ID NO: 476042 - RNA, 22 nt, Homo sapiens
uaugagauguagcaaauuccaa

SEQ ID NO: 476043 - RNA, 16 nt, Homo sapiens
uaugagcugcuggcag

SEQ ID NO: 476044 - RNA, 18 nt, Homo sapiens
uaugaugucccuauggaa

SEQ ID NO: 476045 - RNA, 12 nt, Homo sapiens
uaugccacucag

SEQ ID NO: 476046 - RNA, 22 nt, Homo sapiens
uaugcuuucuauuuugagauca

SEQ ID NO: 476047 - RNA, 18 nt, Homo sapiens
uaugguuuuccaucuuau

SEQ ID NO: 476048 - RNA, 9 nt, Homo sapiens
uaugugcaa

SEQ ID NO: 476049 - RNA, 11 nt, Homo sapiens
uaugugcaaua

SEQ ID NO: 476050 - RNA, 17 nt, Homo sapiens
uauguugcccagugugu

SEQ ID NO: 476051 - RNA, 14 nt, Homo sapiens
uauuacgugcaaua

SEQ ID NO: 476052 - RNA, 15 nt, Homo sapiens
uauuacgugcaauac

SEQ ID NO: 476053 - RNA, 16 nt, Homo sapiens
uauuacgugcaauacu

SEQ ID NO: 476054 - RNA, 15 nt, Homo sapiens
uauuauuugcagauu

SEQ ID NO: 476055 - RNA, 12 nt, Homo sapiens
uauucucaagaa

SEQ ID NO: 476056 - RNA, 20 nt, Homo sapiens
uauugaaguuuugacaucaa

SEQ ID NO: 476057 - RNA, 17 nt, Homo sapiens
uauugcugaaugacuac

SEQ ID NO: 476058 - RNA, 13 nt, Homo sapiens
uauuggacuucca

SEQ ID NO: 476059 - RNA, 21 nt, Homo sapiens
uauuggcuauuauuugacuug

SEQ ID NO: 476060 - RNA, 15 nt, Homo sapiens
uauuuaaaaucuccu

SEQ ID NO: 476061 - RNA, 17 nt, Homo sapiens
uauuuauuuuauggcaa

SEQ ID NO: 476062 - RNA, 16 nt, Homo sapiens
uauuuccauauggcaa

SEQ ID NO: 476063 - RNA, 17 nt, Homo sapiens
uauuugcaagacauaga

SEQ ID NO: 476064 - RNA, 20 nt, Homo sapiens
uauuugcauauguaugacuc

SEQ ID NO: 476065 - RNA, 22 nt, Homo sapiens
uauuuuaaagcuuggugcuaaa

SEQ ID NO: 476066 - RNA, 17 nt, Homo sapiens
aaaaaccugcaguuuug

SEQ ID NO: 476067 - RNA, 16 nt, Homo sapiens
aaaaauaaaaaagauc

SEQ ID NO: 476068 - RNA, 19 nt, Homo sapiens
aaaaauaaaaugcauuuaa

SEQ ID NO: 476069 - RNA, 16 nt, Homo sapiens
aaaacaaaaacaccua

SEQ ID NO: 476070 - RNA, 17 nt, Homo sapiens
aaaacucaguaucauaa

SEQ ID NO: 476071 - RNA, 19 nt, Homo sapiens
augguuuuccaucuuaucu

SEQ ID NO: 476072 - RNA, 19 nt, Homo sapiens
augucauuguucuugugaa

SEQ ID NO: 476073 - RNA, 17 nt, Homo sapiens
augucguuugaaucaca

SEQ ID NO: 476074 - RNA, 21 nt, Homo sapiens
augucguuugaaucacaguau

SEQ ID NO: 476075 - RNA, 17 nt, Homo sapiens
augugagguguugcuaa

SEQ ID NO: 476076 - RNA, 11 nt, Homo sapiens
augugcaauaa

SEQ ID NO: 476077 - RNA, 14 nt, Homo sapiens
augugcucagggaa

SEQ ID NO: 476078 - RNA, 21 nt, Homo sapiens
augugcucagggaauaaucca

SEQ ID NO: 476079 - RNA, 13 nt, Homo sapiens
augugcucaugca

SEQ ID NO: 476080 - RNA, 24 nt, Homo sapiens
augugguuaaugccauggacagaa

SEQ ID NO: 476081 - RNA, 13 nt, Homo sapiens
auguucaauauga

SEQ ID NO: 476082 - RNA, 18 nt, Homo sapiens
auguuggcugggaacuca

SEQ ID NO: 476083 - RNA, 19 nt, Homo sapiens
auguuuagugaaacauuug

SEQ ID NO: 476084 - RNA, 22 nt, Homo sapiens
auguuucugucacaucagcucc

SEQ ID NO: 476085 - RNA, 16 nt, Homo sapiens
auuaagccuuccacac

SEQ ID NO: 476086 - RNA, 20 nt, Homo sapiens
auuaauauggggaugcagca

SEQ ID NO: 476087 - RNA, 20 nt, Homo sapiens
auuagccgggcaugguggca

SEQ ID NO: 476088 - RNA, 19 nt, Homo sapiens
auuagugaaguaugcacua

SEQ ID NO: 476089 - RNA, 15 nt, Homo sapiens
auuauaacugugcaa

SEQ ID NO: 476090 - RNA, 17 nt, Homo sapiens
auuauaacugugcaaau

SEQ ID NO: 476091 - RNA, 13 nt, Homo sapiens
auuauagaaugga

SEQ ID NO: 476092 - RNA, 15 nt, Homo sapiens
agugugacucauuaa

SEQ ID NO: 476093 - RNA, 20 nt, Homo sapiens
aguguuggaaaaugugcaau

SEQ ID NO: 476094 - RNA, 20 nt, Homo sapiens
aguguuggagaagaacugaa

SEQ ID NO: 476095 - RNA, 12 nt, Homo sapiens
aguuaagggaug

SEQ ID NO: 476096 - RNA, 20 nt, Homo sapiens
aguuaaggggagcaacagag

SEQ ID NO: 476097 - RNA, 22 nt, Homo sapiens
aguuagaaaggguucagggcau

SEQ ID NO: 476098 - RNA, 20 nt, Homo sapiens
aguuaugguuuuccaucuua

SEQ ID NO: 476099 - RNA, 22 nt, Homo sapiens
aguucagaaucacuucugagaa

SEQ ID NO: 476100 - RNA, 15 nt, Homo sapiens
aguucccgugcaccu

SEQ ID NO: 476101 - RNA, 13 nt, Homo sapiens
aguucugccuuau

SEQ ID NO: 476102 - RNA, 14 nt, Homo sapiens
aguuuagugugaua

SEQ ID NO: 476103 - RNA, 17 nt, Homo sapiens
aguuuugacaucaauga

SEQ ID NO: 476104 - RNA, 21 nt, Homo sapiens
auaaaauauauugguauguaa

SEQ ID NO: 476105 - RNA, 19 nt, Homo sapiens
auaaaaucuagccuagaag

SEQ ID NO: 476106 - RNA, 20 nt, Homo sapiens
auaaagcacuguuuggauau

SEQ ID NO: 476107 - RNA, 15 nt, Homo sapiens
auaaauaaaguuucu

SEQ ID NO: 476108 - RNA, 19 nt, Homo sapiens
auaaaucagccuaaauguc

SEQ ID NO: 476109 - RNA, 18 nt, Homo sapiens
auaaauuuuauuccaaaa

SEQ ID NO: 476110 - RNA, 15 nt, Homo sapiens
auaacuauguugaua

SEQ ID NO: 476111 - RNA, 17 nt, Homo sapiens
auaagcaaagacuauga

SEQ ID NO: 476112 - RNA, 22 nt, Homo sapiens
auaaggaucuucccacuuugcc

SEQ ID NO: 476113 - RNA, 15 nt, Homo sapiens
auaaguagagacuga

SEQ ID NO: 476114 - RNA, 23 nt, Homo sapiens
auaauacauugaauuagaaacau

SEQ ID NO: 476115 - RNA, 17 nt, Homo sapiens
auaaucuacuguacaca

SEQ ID NO: 476116 - RNA, 13 nt, Homo sapiens
caaggacacagau

SEQ ID NO: 476117 - RNA, 22 nt, Homo sapiens
caaggacuaauccaauaccucu

SEQ ID NO: 476118 - RNA, 22 nt, Homo sapiens
caaggagacacaacaacuccua

SEQ ID NO: 476119 - RNA, 16 nt, Homo sapiens
caaggcugugcucccu

SEQ ID NO: 476120 - RNA, 20 nt, Homo sapiens
caaggcuuaggaaagugaua

SEQ ID NO: 476121 - RNA, 21 nt, Homo sapiens
caagggccagcuggaggugaa

SEQ ID NO: 476122 - RNA, 23 nt, Homo sapiens
caagggcugagauucuucgugua

SEQ ID NO: 476123 - RNA, 16 nt, Homo sapiens
caaggguuuguugaac

SEQ ID NO: 476124 - RNA, 17 nt, Homo sapiens
caaguaaaacuguggua

SEQ ID NO: 476125 - RNA, 16 nt, Homo sapiens
caaguaacaauaugau

SEQ ID NO: 476126 - RNA, 14 nt, Homo sapiens
caaguagcugcuac

SEQ ID NO: 476127 - RNA, 17 nt, Homo sapiens
caaguagguugcugucu

SEQ ID NO: 476128 - RNA, 19 nt, Homo sapiens
caagucugagcccucaaaa

SEQ ID NO: 476129 - RNA, 17 nt, Homo sapiens
caagugagacaaaaagc

SEQ ID NO: 476130 - RNA, 20 nt, Homo sapiens
caaguucuacaucaauauca

SEQ ID NO: 476131 - RNA, 15 nt, Homo sapiens
caauaaaauggguuu

SEQ ID NO: 476132 - RNA, 17 nt, Homo sapiens
caauaaaccacaagcau

SEQ ID NO: 476133 - RNA, 19 nt, Homo sapiens
caauaguaauucucaggcc

SEQ ID NO: 476134 - RNA, 19 nt, Homo sapiens
caauccaagagucugauga

SEQ ID NO: 476135 - RNA, 15 nt, Homo sapiens
caaucucggcucauu

SEQ ID NO: 476136 - RNA, 11 nt, Homo sapiens
caaugaacuuu

SEQ ID NO: 476137 - RNA, 22 nt, Homo sapiens
caaugguuugcaaggaagccac

SEQ ID NO: 476138 - RNA, 14 nt, Homo sapiens
caauguagucucau

SEQ ID NO: 476139 - RNA, 18 nt, Homo sapiens
caauuacaacagugagaa

SEQ ID NO: 476140 - RNA, 20 nt, Homo sapiens
caauuagacaagaacuugga

SEQ ID NO: 476141 - RNA, 14 nt, Homo sapiens
caauugcucaugca

SEQ ID NO: 476142 - RNA, 15 nt, Homo sapiens
cacaaacucauccau

SEQ ID NO: 476143 - RNA, 13 nt, Homo sapiens
cacaagaccaucu

SEQ ID NO: 476144 - RNA, 13 nt, Homo sapiens
cacaagagcugga

SEQ ID NO: 476145 - RNA, 13 nt, Homo sapiens
cacaauacaauaa

SEQ ID NO: 476146 - RNA, 22 nt, Homo sapiens
cacacaacaaauaauuaaguga

SEQ ID NO: 476147 - RNA, 14 nt, Homo sapiens
cacacagacagggu

SEQ ID NO: 476148 - RNA, 16 nt, Homo sapiens
cacacagacaggguuu

SEQ ID NO: 476149 - RNA, 16 nt, Homo sapiens
cacacaucuguggaga

SEQ ID NO: 476150 - RNA, 17 nt, Homo sapiens
cacacugagcugagggg

SEQ ID NO: 476151 - RNA, 16 nt, Homo sapiens
cacagaugugugauuc

SEQ ID NO: 476152 - RNA, 15 nt, Homo sapiens
cacagccaucaaggg

SEQ ID NO: 476153 - RNA, 21 nt, Homo sapiens
cacagccucuuagaugcaguu

SEQ ID NO: 476154 - RNA, 14 nt, Homo sapiens
cacagcguccuguc

SEQ ID NO: 476155 - RNA, 22 nt, Homo sapiens
cacagcuucugcagcagacugu

SEQ ID NO: 476156 - RNA, 23 nt, Homo sapiens
cacagugugaaucuuggugucua

SEQ ID NO: 476157 - RNA, 16 nt, Homo sapiens
cacaugccaagcacug

SEQ ID NO: 476158 - RNA, 13 nt, Homo sapiens
cacauuaagccuu

SEQ ID NO: 476159 - RNA, 20 nt, Homo sapiens
caccaagcagcaacagcaaa

SEQ ID NO: 476160 - RNA, 15 nt, Homo sapiens
caccagagaccaaac

SEQ ID NO: 476161 - RNA, 16 nt, Homo sapiens
caccauaaaaaggaau

SEQ ID NO: 476162 - RNA, 13 nt, Homo sapiens
caccaucuguaua

SEQ ID NO: 476163 - RNA, 12 nt, Homo sapiens
caccccaacagc

SEQ ID NO: 476164 - RNA, 14 nt, Homo sapiens
cacccucuccagau

SEQ ID NO: 476165 - RNA, 16 nt, Homo sapiens
caccuuggccucccaa

SEQ ID NO: 476166 - RNA, 13 nt, Homo sapiens
caccuuucugcac

SEQ ID NO: 476167 - RNA, 22 nt, Homo sapiens
cacgaucucgacucacugcaac

SEQ ID NO: 476168 - RNA, 13 nt, Homo sapiens
cacgggugcauga

SEQ ID NO: 476169 - RNA, 16 nt, Homo sapiens
cacgugagaucauuca

SEQ ID NO: 476170 - RNA, 16 nt, Homo sapiens
cacuaagaagcuugaa

SEQ ID NO: 476171 - RNA, 14 nt, Homo sapiens
cacuaugagcugcu

SEQ ID NO: 476172 - RNA, 19 nt, Homo sapiens
cacuccccuaucccauucu

SEQ ID NO: 476173 - RNA, 16 nt, Homo sapiens
cacucuuugcacacuc

SEQ ID NO: 476174 - RNA, 16 nt, Homo sapiens
cacugacuccugugga

SEQ ID NO: 476175 - RNA, 14 nt, Homo sapiens
cacugagcugaggg

SEQ ID NO: 476176 - RNA, 23 nt, Homo sapiens
cacugccaugcagggccucacac

SEQ ID NO: 476177 - RNA, 21 nt, Homo sapiens
cacugggcugcagagacugga

SEQ ID NO: 476178 - RNA, 23 nt, Homo sapiens
cacugugggaaggccagcugccc

SEQ ID NO: 476179 - RNA, 16 nt, Homo sapiens
cacuuauugacuauua

SEQ ID NO: 476180 - RNA, 22 nt, Homo sapiens
cacuucugagaacucaucccua

SEQ ID NO: 476181 - RNA, 22 nt, Homo sapiens
cacuugcucaugcccugccaag

SEQ ID NO: 476182 - RNA, 14 nt, Homo sapiens
cacuuggaacacaa

SEQ ID NO: 476183 - RNA, 11 nt, Homo sapiens
cacuugucaau

SEQ ID NO: 476184 - RNA, 16 nt, Homo sapiens
cacuuugccacuggau

SEQ ID NO: 476185 - RNA, 19 nt, Homo sapiens
cacuuugggaggccgaggu

SEQ ID NO: 476186 - RNA, 16 nt, Homo sapiens
cagaaaaacucaugga

SEQ ID NO: 476187 - RNA, 14 nt, Homo sapiens
cagaaaaacugugg

SEQ ID NO: 476188 - RNA, 17 nt, Homo sapiens
cagaaaaacugugggua

SEQ ID NO: 476189 - RNA, 16 nt, Homo sapiens
cagaaagcucaucuca

SEQ ID NO: 476190 - RNA, 13 nt, Homo sapiens
cagaacacugucu

SEQ ID NO: 476191 - RNA, 16 nt, Homo sapiens
cagaacacugucuuga

SEQ ID NO: 476192 - RNA, 22 nt, Homo sapiens
cagaacacugucuugaagacaa

SEQ ID NO: 476193 - RNA, 18 nt, Homo sapiens
cagaaucccggcugucaa

SEQ ID NO: 476194 - RNA, 12 nt, Homo sapiens
cagacaggguuu

SEQ ID NO: 476195 - RNA, 23 nt, Homo sapiens
cagaccuugggggaagacuuuaa

SEQ ID NO: 476196 - RNA, 16 nt, Homo sapiens
cagagaaaagacauaa

SEQ ID NO: 476197 - RNA, 19 nt, Homo sapiens
cagagauaauucuagcuuu

SEQ ID NO: 476198 - RNA, 21 nt, Homo sapiens
cagagauaauucuagcuuuga

SEQ ID NO: 476199 - RNA, 17 nt, Homo sapiens
cagagcugacacaggau

SEQ ID NO: 476200 - RNA, 16 nt, Homo sapiens
cagagucuggcucugu

SEQ ID NO: 476201 - RNA, 12 nt, Homo sapiens
cagauaaucaca

SEQ ID NO: 476202 - RNA, 15 nt, Homo sapiens
cagauccucuucuca

SEQ ID NO: 476203 - RNA, 17 nt, Homo sapiens
cagauccucuucucaaa

SEQ ID NO: 476204 - RNA, 20 nt, Homo sapiens
cagaugccucuagaagagac

SEQ ID NO: 476205 - RNA, 17 nt, Homo sapiens
cagauguggcugaaccg

SEQ ID NO: 476206 - RNA, 15 nt, Homo sapiens
cagauucacacuguc

SEQ ID NO: 476207 - RNA, 13 nt, Homo sapiens
cagcaaaauguga

SEQ ID NO: 476208 - RNA, 14 nt, Homo sapiens
cagcaaaucacgac

SEQ ID NO: 476209 - RNA, 13 nt, Homo sapiens
cagcaauagugaa

SEQ ID NO: 476210 - RNA, 14 nt, Homo sapiens
cagcaauuccaugc

SEQ ID NO: 476211 - RNA, 20 nt, Homo sapiens
cagcacauucacugacauga

SEQ ID NO: 476212 - RNA, 21 nt, Homo sapiens
cagcacauucacugacaugau

SEQ ID NO: 476213 - RNA, 21 nt, Homo sapiens
cagcacuaaagcaguggacac

SEQ ID NO: 476214 - RNA, 21 nt, Homo sapiens
cagcagcucaggcacacuucu

SEQ ID NO: 476215 - RNA, 14 nt, Homo sapiens
cagcaguggacuca

SEQ ID NO: 476216 - RNA, 14 nt, Homo sapiens
cagcaucuaaguaa

SEQ ID NO: 476217 - RNA, 22 nt, Homo sapiens
cagccaggauugaccuuugcac

SEQ ID NO: 476218 - RNA, 15 nt, Homo sapiens
cagccaucaagggaa

SEQ ID NO: 476219 - RNA, 17 nt, Homo sapiens
cagcccaagaugcuuua

SEQ ID NO: 476220 - RNA, 20 nt, Homo sapiens
cagccucccaaguagcugga

SEQ ID NO: 476221 - RNA, 19 nt, Homo sapiens
cagccucuuagaugcaguu

SEQ ID NO: 476222 - RNA, 19 nt, Homo sapiens
cagccugggcaacagagca

SEQ ID NO: 476223 - RNA, 17 nt, Homo sapiens
cagccuugcucucuuca

SEQ ID NO: 476224 - RNA, 15 nt, Homo sapiens
cagcgaguacuuccc

SEQ ID NO: 476225 - RNA, 20 nt, Homo sapiens
cagcuaacacacagcuccca

SEQ ID NO: 476226 - RNA, 22 nt, Homo sapiens
cagcuacccaggaggcugaggu

SEQ ID NO: 476227 - RNA, 12 nt, Homo sapiens
cagcucaucucu

SEQ ID NO: 476228 - RNA, 17 nt, Homo sapiens
cagcuccccagaguccu

SEQ ID NO: 476229 - RNA, 19 nt, Homo sapiens
cagcuccccagaguccucu

SEQ ID NO: 476230 - RNA, 12 nt, Homo sapiens
cagcuccuagua

SEQ ID NO: 476231 - RNA, 15 nt, Homo sapiens
cagcugccccgggga

SEQ ID NO: 476232 - RNA, 23 nt, Homo sapiens
cagcuggcgucaugcaaagucau

SEQ ID NO: 476233 - RNA, 16 nt, Homo sapiens
cagcuguugcagugag

SEQ ID NO: 476234 - RNA, 21 nt, Homo sapiens
cagcuuauaaaaucaaacaga

SEQ ID NO: 476235 - RNA, 15 nt, Homo sapiens
cagcuuauugucuag

SEQ ID NO: 476236 - RNA, 18 nt, Homo sapiens
caggaaagagaacuucca

SEQ ID NO: 476237 - RNA, 20 nt, Homo sapiens
caggaaagagaacuuccaga

SEQ ID NO: 476238 - RNA, 16 nt, Homo sapiens
caggacuguggagucc

SEQ ID NO: 476239 - RNA, 20 nt, Homo sapiens
caggaggcagcuguugcagu

SEQ ID NO: 476240 - RNA, 21 nt, Homo sapiens
caggaggcugaggcaggagaa

SEQ ID NO: 476241 - RNA, 21 nt, Homo sapiens
caggauugaccuuugcacgaa

SEQ ID NO: 476242 - RNA, 17 nt, Homo sapiens
caggcaaagcaagugau

SEQ ID NO: 476243 - RNA, 14 nt, Homo sapiens
caggcaacugaggc

SEQ ID NO: 476244 - RNA, 17 nt, Homo sapiens
caggcaguucccagaaa

SEQ ID NO: 476245 - RNA, 15 nt, Homo sapiens
caggcggguccgggu

SEQ ID NO: 476246 - RNA, 15 nt, Homo sapiens
caggcguucagcuca

SEQ ID NO: 476247 - RNA, 13 nt, Homo sapiens
caggcuacacuga

SEQ ID NO: 476248 - RNA, 12 nt, Homo sapiens
caggcucugaga

SEQ ID NO: 476249 - RNA, 18 nt, Homo sapiens
caggcuggucucgaacuc

SEQ ID NO: 476250 - RNA, 19 nt, Homo sapiens
caggcuuucaagaagugcc

SEQ ID NO: 476251 - RNA, 11 nt, Homo sapiens
cagggacccac

SEQ ID NO: 476252 - RNA, 15 nt, Homo sapiens
cagggacccacuuca

SEQ ID NO: 476253 - RNA, 20 nt, Homo sapiens
cagggaugauggcagagcca

SEQ ID NO: 476254 - RNA, 20 nt, Homo sapiens
cagggcccugagcucggugg

SEQ ID NO: 476255 - RNA, 21 nt, Homo sapiens
cagggcucagccuggugggcc

SEQ ID NO: 476256 - RNA, 21 nt, Homo sapiens
caggucuaccaaaaaucucaa

SEQ ID NO: 476257 - RNA, 23 nt, Homo sapiens
gacauugauacagugaagauaca

SEQ ID NO: 476258 - RNA, 15 nt, Homo sapiens
gacauuuugaucacu

SEQ ID NO: 476259 - RNA, 15 nt, Homo sapiens
gaccacacagacagg

SEQ ID NO: 476260 - RNA, 19 nt, Homo sapiens
gaccacauagaacaugugu

SEQ ID NO: 476261 - RNA, 23 nt, Homo sapiens
gaccagccuggccaacauaguga

SEQ ID NO: 476262 - RNA, 19 nt, Homo sapiens
gaccaggcaaagcaaguga

SEQ ID NO: 476263 - RNA, 15 nt, Homo sapiens
gaccaggcaauguga

SEQ ID NO: 476264 - RNA, 14 nt, Homo sapiens
gacccaaguagcug

SEQ ID NO: 476265 - RNA, 18 nt, Homo sapiens
gacccaaguagcugcuac

SEQ ID NO: 476266 - RNA, 18 nt, Homo sapiens
gacccagggaugacaugu

SEQ ID NO: 476267 - RNA, 18 nt, Homo sapiens
gaccccugucucccaaaa

SEQ ID NO: 476268 - RNA, 14 nt, Homo sapiens
gaccucagccugug

SEQ ID NO: 476269 - RNA, 20 nt, Homo sapiens
gaccucaggugauccaccca

SEQ ID NO: 476270 - RNA, 22 nt, Homo sapiens
gaccucaggugauccacccacc

SEQ ID NO: 476271 - RNA, 24 nt, Homo sapiens
gaccugucacgauugucaucagga

SEQ ID NO: 476272 - RNA, 21 nt, Homo sapiens
gaccuugggggaagacuuuaa

SEQ ID NO: 476273 - RNA, 17 nt, Homo sapiens
gacgaagaagagccaca

SEQ ID NO: 476274 - RNA, 20 nt, Homo sapiens
gacggaggccuacucuucca

SEQ ID NO: 476275 - RNA, 19 nt, Homo sapiens
gacuaauccaauaccucuu

SEQ ID NO: 476276 - RNA, 22 nt, Homo sapiens
gacuaugucacccaaugcauau

SEQ ID NO: 476277 - RNA, 20 nt, Homo sapiens
gacuauuauagaauggaacu

SEQ ID NO: 476278 - RNA, 17 nt, Homo sapiens
gacucaaaaauagggaa

SEQ ID NO: 476279 - RNA, 22 nt, Homo sapiens
gacucaaaaauagggaaguaac

SEQ ID NO: 476280 - RNA, 20 nt, Homo sapiens
gacucuucucauccuuccuc

SEQ ID NO: 476281 - RNA, 13 nt, Homo sapiens
gacugauggugaa

SEQ ID NO: 476282 - RNA, 16 nt, Homo sapiens
gacugaugucaucuug

SEQ ID NO: 476283 - RNA, 14 nt, Homo sapiens
gacugcugagucaa

SEQ ID NO: 476284 - RNA, 18 nt, Homo sapiens
gacugugauuuauuugga

SEQ ID NO: 476285 - RNA, 20 nt, Homo sapiens
gacuguggcugcuagcacuu

SEQ ID NO: 476286 - RNA, 22 nt, Homo sapiens
gacuuucugaagccucacuuau

SEQ ID NO: 476287 - RNA, 12 nt, Homo sapiens
gacuuugccaca

SEQ ID NO: 476288 - RNA, 20 nt, Homo sapiens
gagaaaacuuauuugaguga

SEQ ID NO: 476289 - RNA, 22 nt, Homo sapiens
gagaaaacuuauuugagugauu

SEQ ID NO: 476290 - RNA, 19 nt, Homo sapiens
gagaaauaagauaguugau

SEQ ID NO: 476291 - RNA, 14 nt, Homo sapiens
gagaacacugugaa

SEQ ID NO: 476292 - RNA, 21 nt, Homo sapiens
gagaaucacuugaacccagga

SEQ ID NO: 476293 - RNA, 19 nt, Homo sapiens
gagacaagaaauccuagug

SEQ ID NO: 476294 - RNA, 19 nt, Homo sapiens
gagacaugguauugacuca

SEQ ID NO: 476295 - RNA, 20 nt, Homo sapiens
gagacuuugacucuccagaa

SEQ ID NO: 476296 - RNA, 13 nt, Homo sapiens
gagagaccaggca

SEQ ID NO: 476297 - RNA, 19 nt, Homo sapiens
gagaguacaccccaacagc

SEQ ID NO: 476298 - RNA, 15 nt, Homo sapiens
gagaguagagggcac

SEQ ID NO: 476299 - RNA, 16 nt, Homo sapiens
gagaguggaacagaag

SEQ ID NO: 476300 - RNA, 21 nt, Homo sapiens
gagauaggccugugggccaga

SEQ ID NO: 476301 - RNA, 16 nt, Homo sapiens
gagcacacuuggccca

SEQ ID NO: 476302 - RNA, 22 nt, Homo sapiens
gagcagccucagaacaaaguga

SEQ ID NO: 476303 - RNA, 13 nt, Homo sapiens
gagcauucugcuc

SEQ ID NO: 476304 - RNA, 23 nt, Homo sapiens
gagcccggaguggacugauuuuc

SEQ ID NO: 476305 - RNA, 20 nt, Homo sapiens
gagcccuccuggaauggagc

SEQ ID NO: 476306 - RNA, 13 nt, Homo sapiens
gagccuccagcug

SEQ ID NO: 476307 - RNA, 12 nt, Homo sapiens
gagccuggacaa

SEQ ID NO: 476308 - RNA, 13 nt, Homo sapiens
gagcuagaaccua

SEQ ID NO: 476309 - RNA, 16 nt, Homo sapiens
gagcugacacaggaug

SEQ ID NO: 476310 - RNA, 12 nt, Homo sapiens
gagcugucaugu

SEQ ID NO: 476311 - RNA, 13 nt, Homo sapiens
gagcuugacuuca

SEQ ID NO: 476312 - RNA, 17 nt, Homo sapiens
gagcuuuaguccuagag

SEQ ID NO: 476313 - RNA, 18 nt, Homo sapiens
gaggcagacagcagcuca

SEQ ID NO: 476314 - RNA, 20 nt, Homo sapiens
gaggcauucccagaauuugc

SEQ ID NO: 476315 - RNA, 21 nt, Homo sapiens
gaggccccuucuagguggcaa

SEQ ID NO: 476316 - RNA, 16 nt, Homo sapiens
gagggcacacacugug

SEQ ID NO: 476317 - RNA, 22 nt, Homo sapiens
gagggcgcggggcggggagcga

SEQ ID NO: 476318 - RNA, 20 nt, Homo sapiens
gagggcuagaaccuagaagg

SEQ ID NO: 476319 - RNA, 17 nt, Homo sapiens
gaguacaccccaacagc

SEQ ID NO: 476320 - RNA, 23 nt, Homo sapiens
gagucacacgggggcagcugaua

SEQ ID NO: 476321 - RNA, 14 nt, Homo sapiens
gagucaugucaaau

SEQ ID NO: 476322 - RNA, 16 nt, Homo sapiens
gaguccuccuguccag

SEQ ID NO: 476323 - RNA, 11 nt, Homo sapiens
gaguccucuau

SEQ ID NO: 476324 - RNA, 23 nt, Homo sapiens
gagucugaauagucuucagagau

SEQ ID NO: 476325 - RNA, 11 nt, Homo sapiens
gaguuaccuac

SEQ ID NO: 476326 - RNA, 21 nt, Homo sapiens
gaguuuagugugauaaaggca

SEQ ID NO: 476327 - RNA, 17 nt, Homo sapiens
gaguuuauuugaguauu

SEQ ID NO: 476328 - RNA, 14 nt, Homo sapiens
gauaacaaccugga

SEQ ID NO: 476329 - RNA, 13 nt, Homo sapiens
gauagaugucuau

SEQ ID NO: 476330 - RNA, 14 nt, Homo sapiens
gauaggccuguggg

SEQ ID NO: 476331 - RNA, 17 nt, Homo sapiens
gauauauuaagugacug

SEQ ID NO: 476332 - RNA, 19 nt, Homo sapiens
gauaugaugucccuaugga

SEQ ID NO: 476333 - RNA, 22 nt, Homo sapiens
gaucacgccauugcacuccagc

SEQ ID NO: 476334 - RNA, 19 nt, Homo sapiens
gaucacuuccuauaugcac

SEQ ID NO: 476335 - RNA, 14 nt, Homo sapiens
gaucccaucuugau

SEQ ID NO: 476336 - RNA, 17 nt, Homo sapiens
gaucuaucaccugucau

SEQ ID NO: 476337 - RNA, 14 nt, Homo sapiens
gaucucgacucacu

SEQ ID NO: 476338 - RNA, 17 nt, Homo sapiens
gaucugaugcaagcaag

SEQ ID NO: 476339 - RNA, 12 nt, Homo sapiens
gaugaugcuccu

SEQ ID NO: 476340 - RNA, 18 nt, Homo sapiens
gaugcagaaaauugccua

SEQ ID NO: 476341 - RNA, 22 nt, Homo sapiens
gaugcaguucugaagaagaugg

SEQ ID NO: 476342 - RNA, 20 nt, Homo sapiens
gaugucaaaaacuucaauau

SEQ ID NO: 476343 - RNA, 15 nt, Homo sapiens
gauguuucugucaca

SEQ ID NO: 476344 - RNA, 12 nt, Homo sapiens
gauuacaaugcu

SEQ ID NO: 476345 - RNA, 15 nt, Homo sapiens
gauuauuuuaaucua

SEQ ID NO: 476346 - RNA, 14 nt, Homo sapiens
gauucacaguguga

SEQ ID NO: 476347 - RNA, 23 nt, Homo sapiens
gauucacccccaaacagugacau

SEQ ID NO: 476348 - RNA, 16 nt, Homo sapiens
gauuggagauagggaa

SEQ ID NO: 476349 - RNA, 15 nt, Homo sapiens
gauuggccccacuga

SEQ ID NO: 476350 - RNA, 20 nt, Homo sapiens
gauuuccaaaagacuugaag

SEQ ID NO: 476351 - RNA, 15 nt, Homo sapiens
gcaaaacuacaaugu

SEQ ID NO: 476352 - RNA, 15 nt, Homo sapiens
gcaaaacuuaggcau

SEQ ID NO: 476353 - RNA, 16 nt, Homo sapiens
gcaaagacuuuccucu

SEQ ID NO: 476354 - RNA, 17 nt, Homo sapiens
gcaaagaugaucaguau

SEQ ID NO: 476355 - RNA, 20 nt, Homo sapiens
gcaaaggcugagaacacugu

SEQ ID NO: 476356 - RNA, 14 nt, Homo sapiens
gcaaauugucacag

SEQ ID NO: 476357 - RNA, 19 nt, Homo sapiens
gcaaccccaucauccucag

SEQ ID NO: 476358 - RNA, 22 nt, Homo sapiens
gcaacugaggcagacagcagcu

SEQ ID NO: 476359 - RNA, 22 nt, Homo sapiens
gcaacugguugacuaauacauu

SEQ ID NO: 476360 - RNA, 21 nt, Homo sapiens
gcaagcaagaaacacugggcu

SEQ ID NO: 476361 - RNA, 23 nt, Homo sapiens
gcaaggacacagaugaaacacaa

SEQ ID NO: 476362 - RNA, 22 nt, Homo sapiens
gcaagugugcuggccucucuga

SEQ ID NO: 476363 - RNA, 21 nt, Homo sapiens
gcaaguuggaaaauauguaac

SEQ ID NO: 476364 - RNA, 18 nt, Homo sapiens
gcaauaaggaucuuccca

SEQ ID NO: 476365 - RNA, 19 nt, Homo sapiens
gcaauaguaggacugcuga

SEQ ID NO: 476366 - RNA, 15 nt, Homo sapiens
gcaaucuaugacuca

SEQ ID NO: 476367 - RNA, 15 nt, Homo sapiens
gcacacacacauaca

SEQ ID NO: 476368 - RNA, 21 nt, Homo sapiens
gcacacacuguguacaguaaa

SEQ ID NO: 476369 - RNA, 21 nt, Homo sapiens
gcaccuagaauuggcugaacu

SEQ ID NO: 476370 - RNA, 17 nt, Homo sapiens
gcaccuuaguugcauga

SEQ ID NO: 476371 - RNA, 20 nt, Homo sapiens
gcacgaacaccaagugucug

SEQ ID NO: 476372 - RNA, 22 nt, Homo sapiens
gcacgaucucgacucacugcaa

SEQ ID NO: 476373 - RNA, 13 nt, Homo sapiens
gcacugugcucag

SEQ ID NO: 476374 - RNA, 13 nt, Homo sapiens
gcagaacuuucac

SEQ ID NO: 476375 - RNA, 19 nt, Homo sapiens
gcagaggagcaaauugagg

SEQ ID NO: 476376 - RNA, 16 nt, Homo sapiens
gcagaguacuggcuga

SEQ ID NO: 476377 - RNA, 15 nt, Homo sapiens
gcagccaagggauga

SEQ ID NO: 476378 - RNA, 16 nt, Homo sapiens
gcagcgcgcacacgca

SEQ ID NO: 476379 - RNA, 18 nt, Homo sapiens
gcagcucaggcacacuuc

SEQ ID NO: 476380 - RNA, 14 nt, Homo sapiens
gcagcucaucucug

SEQ ID NO: 476381 - RNA, 15 nt, Homo sapiens
gcagcuguugcagug

SEQ ID NO: 476382 - RNA, 16 nt, Homo sapiens
gcagcuguugcaguga

SEQ ID NO: 476383 - RNA, 18 nt, Homo sapiens
gcaggagaaucacuugaa

SEQ ID NO: 476384 - RNA, 17 nt, Homo sapiens
gcaggagaaucgcuuga

SEQ ID NO: 476385 - RNA, 13 nt, Homo sapiens
gcaggcuuucaag

SEQ ID NO: 476386 - RNA, 17 nt, Homo sapiens
gcagggaugauggcaga

SEQ ID NO: 476387 - RNA, 18 nt, Homo sapiens
gcagggauuagguguuca

SEQ ID NO: 476388 - RNA, 17 nt, Homo sapiens
gcagugagcuguguucu

SEQ ID NO: 476389 - RNA, 11 nt, Homo sapiens
gcauacuacag

SEQ ID NO: 476390 - RNA, 21 nt, Homo sapiens
gcauacuacaguaacugugac

SEQ ID NO: 476391 - RNA, 21 nt, Homo sapiens
cuccuagggccacugaagaua

SEQ ID NO: 476392 - RNA, 14 nt, Homo sapiens
cuccuuuccugcaa

SEQ ID NO: 476393 - RNA, 15 nt, Homo sapiens
cucgugggacaguca

SEQ ID NO: 476394 - RNA, 18 nt, Homo sapiens
cucuacuaaaacauacaa

SEQ ID NO: 476395 - RNA, 22 nt, Homo sapiens
cucugccgcugccaugcuuuga

SEQ ID NO: 476396 - RNA, 20 nt, Homo sapiens
cucugcuaccccuacugaaa

SEQ ID NO: 476397 - RNA, 22 nt, Homo sapiens
cucuggaugccugauugccaag

SEQ ID NO: 476398 - RNA, 14 nt, Homo sapiens
cucugucucaaaaa

SEQ ID NO: 476399 - RNA, 12 nt, Homo sapiens
cucuucaaggac

SEQ ID NO: 476400 - RNA, 21 nt, Homo sapiens
cucuucaauaaaccacaagca

SEQ ID NO: 476401 - RNA, 22 nt, Homo sapiens
cccucggacagcccaucugccu

SEQ ID NO: 476402 - RNA, 11 nt, Homo sapiens
cccugcauguu

SEQ ID NO: 476403 - RNA, 18 nt, Homo sapiens
cccugcucacucuuccac

SEQ ID NO: 476404 - RNA, 15 nt, Homo sapiens
cccuggcaaccagga

SEQ ID NO: 476405 - RNA, 14 nt, Homo sapiens
cccuggggacagca

SEQ ID NO: 476406 - RNA, 24 nt, Homo sapiens
cccugugaguuuguacagucuugc

SEQ ID NO: 476407 - RNA, 16 nt, Homo sapiens
cccuucaugcauggaa

SEQ ID NO: 476408 - RNA, 23 nt, Homo sapiens
cccuuccaggggucaccuugaga

SEQ ID NO: 476409 - RNA, 13 nt, Homo sapiens
cccuucucagaaa

SEQ ID NO: 476410 - RNA, 14 nt, Homo sapiens
cccuugaugaagaa

SEQ ID NO: 476411 - RNA, 14 nt, Homo sapiens
ccgaagucuuccau

SEQ ID NO: 476412 - RNA, 13 nt, Homo sapiens
ccgaggacaugaa

SEQ ID NO: 476413 - RNA, 20 nt, Homo sapiens
ccgcagggugaacugcagcg

SEQ ID NO: 476414 - RNA, 19 nt, Homo sapiens
acuuuuuaaaauaauaaca

SEQ ID NO: 476415 - RNA, 21 nt, Homo sapiens
acuuuuuaaaauaauaacaau

SEQ ID NO: 476416 - RNA, 14 nt, Homo sapiens
agaaaaaaauucau

SEQ ID NO: 476417 - RNA, 15 nt, Homo sapiens
agaaaacacaaccug

SEQ ID NO: 476418 - RNA, 22 nt, Homo sapiens
agaaaauagagaucuuauguca

SEQ ID NO: 476419 - RNA, 21 nt, Homo sapiens
agaaaauguuacuucucucau

SEQ ID NO: 476420 - RNA, 21 nt, Homo sapiens
agaaacacugacuccugugga

SEQ ID NO: 476421 - RNA, 12 nt, Homo sapiens
agaaacauuugg

SEQ ID NO: 476422 - RNA, 12 nt, Homo sapiens
agaacacuguga

SEQ ID NO: 476423 - RNA, 19 nt, Homo sapiens
agaaccaugguaugaaggu

SEQ ID NO: 476424 - RNA, 13 nt, Homo sapiens
agaaccuagaagg

SEQ ID NO: 476425 - RNA, 23 nt, Homo sapiens
agaaccuggagagcuagaaccua

SEQ ID NO: 476426 - RNA, 18 nt, Homo sapiens
agaacgagacuccaccuc

SEQ ID NO: 476427 - RNA, 15 nt, Homo sapiens
agaacuugucccuca

SEQ ID NO: 476428 - RNA, 20 nt, Homo sapiens
agaacuuugcauagcagcug

SEQ ID NO: 476429 - RNA, 16 nt, Homo sapiens
agaagaaugacuaugc

SEQ ID NO: 476430 - RNA, 22 nt, Homo sapiens
agaagacagcagcaagugugcu

SEQ ID NO: 476431 - RNA, 18 nt, Homo sapiens
agaagaccucccugugag

SEQ ID NO: 476432 - RNA, 19 nt, Homo sapiens
agaagaccucccugugaga

SEQ ID NO: 476433 - RNA, 23 nt, Homo sapiens
agaagagccggagccuccagcug

SEQ ID NO: 476434 - RNA, 13 nt, Homo sapiens
agaaggagggaga

SEQ ID NO: 476435 - RNA, 20 nt, Homo sapiens
agaagggauaucuacugugg

SEQ ID NO: 476436 - RNA, 15 nt, Homo sapiens
agaagggcuaacuca

SEQ ID NO: 476437 - RNA, 22 nt, Homo sapiens
agaaggguaccuugaacacugg

SEQ ID NO: 476438 - RNA, 20 nt, Homo sapiens
agaaucacuugacuuugcca

SEQ ID NO: 476439 - RNA, 14 nt, Homo sapiens
agaaugagacugaa

SEQ ID NO: 476440 - RNA, 23 nt, Homo sapiens
agaauucugcuaccucacugggg

SEQ ID NO: 476441 - RNA, 20 nt, Homo sapiens
agacacaccccaacaugccu

SEQ ID NO: 476442 - RNA, 12 nt, Homo sapiens
agacacugcaca

SEQ ID NO: 476443 - RNA, 13 nt, Homo sapiens
agacacugcacag

SEQ ID NO: 476444 - RNA, 14 nt, Homo sapiens
agacagagucucac

SEQ ID NO: 476445 - RNA, 20 nt, Homo sapiens
agacagcaggcauaaggcac

SEQ ID NO: 476446 - RNA, 21 nt, Homo sapiens
agacaugagugcgugcucagu

SEQ ID NO: 476447 - RNA, 19 nt, Homo sapiens
agacaugguauugacucaa

SEQ ID NO: 476448 - RNA, 21 nt, Homo sapiens
agaccaucuacauacacagug

SEQ ID NO: 476449 - RNA, 19 nt, Homo sapiens
agaccuugggggaagacuu

SEQ ID NO: 476450 - RNA, 14 nt, Homo sapiens
agacgccuccccaa

SEQ ID NO: 476451 - RNA, 18 nt, Homo sapiens
agacguuuaaaagccauc

SEQ ID NO: 476452 - RNA, 19 nt, Homo sapiens
agacuaugcaaaaguacaa

SEQ ID NO: 476453 - RNA, 15 nt, Homo sapiens
agacuaugucaccca

SEQ ID NO: 476454 - RNA, 19 nt, Homo sapiens
agacuauucccuucuaacc

SEQ ID NO: 476455 - RNA, 16 nt, Homo sapiens
agacucccaagcugga

SEQ ID NO: 476456 - RNA, 17 nt, Homo sapiens
agacucccaagcuggac

SEQ ID NO: 476457 - RNA, 21 nt, Homo sapiens
agacuuaauagaaacauugaa

SEQ ID NO: 476458 - RNA, 19 nt, Homo sapiens
agacuuggcuccaccacug

SEQ ID NO: 476459 - RNA, 21 nt, Homo sapiens
agacuuggcuccaccacugau

SEQ ID NO: 476460 - RNA, 12 nt, Homo sapiens
agacuuugacuc

SEQ ID NO: 476461 - RNA, 13 nt, Homo sapiens
agagaaaacuuau

SEQ ID NO: 476462 - RNA, 15 nt, Homo sapiens
agagaaugugcucau

SEQ ID NO: 476463 - RNA, 17 nt, Homo sapiens
agagacaguaucucuag

SEQ ID NO: 476464 - RNA, 15 nt, Homo sapiens
agagacuccuugaga

SEQ ID NO: 476465 - RNA, 23 nt, Homo sapiens
agagacuuuauccaugccaauag

SEQ ID NO: 476466 - RNA, 16 nt, Homo sapiens
agagagaaaagcucac

SEQ ID NO: 476467 - RNA, 15 nt, Homo sapiens
agagaggagccagga

SEQ ID NO: 476468 - RNA, 20 nt, Homo sapiens
agagaugggguuucacugug

SEQ ID NO: 476469 - RNA, 22 nt, Homo sapiens
agagauuccugagccaguguca

SEQ ID NO: 476470 - RNA, 19 nt, Homo sapiens
agagcacacuguagcauua

SEQ ID NO: 476471 - RNA, 17 nt, Homo sapiens
agagccggagccuccag

SEQ ID NO: 476472 - RNA, 18 nt, Homo sapiens
agagccggagccuccagc

SEQ ID NO: 476473 - RNA, 21 nt, Homo sapiens
agagcuuggacuggaugcaug

SEQ ID NO: 476474 - RNA, 23 nt, Homo sapiens
agaggcugaggugagaggaucag

SEQ ID NO: 476475 - RNA, 19 nt, Homo sapiens
agaguacaccccaacagca

SEQ ID NO: 476476 - RNA, 19 nt, Homo sapiens
agaguagagggcacugggu

SEQ ID NO: 476477 - RNA, 19 nt, Homo sapiens
agaguauuagucacaauua

SEQ ID NO: 476478 - RNA, 20 nt, Homo sapiens
agaguauuggucuccucuca

SEQ ID NO: 476479 - RNA, 20 nt, Homo sapiens
agagucaaugaacuuuccac

SEQ ID NO: 476480 - RNA, 17 nt, Homo sapiens
agaguucuccagacagg

SEQ ID NO: 476481 - RNA, 21 nt, Homo sapiens
agaguucuccagacaggguuc

SEQ ID NO: 476482 - RNA, 17 nt, Homo sapiens
agaguuuagcuggaaaa

SEQ ID NO: 476483 - RNA, 14 nt, Homo sapiens
agauaauacauucc

SEQ ID NO: 476484 - RNA, 18 nt, Homo sapiens
agauacaggacauucuca

SEQ ID NO: 476485 - RNA, 14 nt, Homo sapiens
agaucaaauggaaa

SEQ ID NO: 476486 - RNA, 19 nt, Homo sapiens
agaucaaugaaaugauguc

SEQ ID NO: 476487 - RNA, 17 nt, Homo sapiens
agaucacgccacugcac

SEQ ID NO: 476488 - RNA, 14 nt, Homo sapiens
agaucauggcccac

SEQ ID NO: 476489 - RNA, 14 nt, Homo sapiens
agaugaaugggagu

SEQ ID NO: 476490 - RNA, 15 nt, Homo sapiens
agaugagaguacacc

SEQ ID NO: 476491 - RNA, 20 nt, Homo sapiens
agaugcagaaaauugccuaa

SEQ ID NO: 476492 - RNA, 13 nt, Homo sapiens
agaugcaggugag

SEQ ID NO: 476493 - RNA, 10 nt, Homo sapiens
agaugcaguu

SEQ ID NO: 476494 - RNA, 10 nt, Homo sapiens
agaugcauua

SEQ ID NO: 476495 - RNA, 19 nt, Homo sapiens
agaugcuuuaagugcacaa

SEQ ID NO: 476496 - RNA, 19 nt, Homo sapiens
agauguccuugaugcucau

SEQ ID NO: 476497 - RNA, 17 nt, Homo sapiens
agauguuuaugauguaa

SEQ ID NO: 476498 - RNA, 12 nt, Homo sapiens
agcaaagacuuu

SEQ ID NO: 476499 - RNA, 15 nt, Homo sapiens
agcaaaggcugagaa

SEQ ID NO: 476500 - RNA, 15 nt, Homo sapiens
agcaaaucacgacca

SEQ ID NO: 476501 - RNA, 17 nt, Homo sapiens
agcaagcucccaaggga

SEQ ID NO: 476502 - RNA, 24 nt, Homo sapiens
agcaagucucuuuauauggccuca

SEQ ID NO: 476503 - RNA, 20 nt, Homo sapiens
agcacacuuggcccaagugg

SEQ ID NO: 476504 - RNA, 17 nt, Homo sapiens
agcacagguuagggcau

SEQ ID NO: 476505 - RNA, 13 nt, Homo sapiens
agcaccaagcuca

SEQ ID NO: 476506 - RNA, 20 nt, Homo sapiens
agcacccucuccagaugcag

SEQ ID NO: 476507 - RNA, 17 nt, Homo sapiens
agcacuaaagcagugga

SEQ ID NO: 476508 - RNA, 12 nt, Homo sapiens
agcagcugcuac

SEQ ID NO: 476509 - RNA, 21 nt, Homo sapiens
agcagcuucaguuguuuuccc

SEQ ID NO: 476510 - RNA, 14 nt, Homo sapiens
agcagguggcagaa

SEQ ID NO: 476511 - RNA, 16 nt, Homo sapiens
agcaguagacaagcaa

SEQ ID NO: 476512 - RNA, 20 nt, Homo sapiens
agcauaggaggggucuggac

SEQ ID NO: 476513 - RNA, 22 nt, Homo sapiens
agcauaggaggggucuggacau

SEQ ID NO: 476514 - RNA, 14 nt, Homo sapiens
agcauuacaguggg

SEQ ID NO: 476515 - RNA, 12 nt, Homo sapiens
agccaaagccaa

SEQ ID NO: 476516 - RNA, 18 nt, Homo sapiens
agccaacagaugugucag

SEQ ID NO: 476517 - RNA, 16 nt, Homo sapiens
gggcuuauccaugccu

SEQ ID NO: 476518 - RNA, 15 nt, Homo sapiens
ggggcugaugcaguu

SEQ ID NO: 476519 - RNA, 16 nt, Homo sapiens
ggggcugaugcaguug

SEQ ID NO: 476520 - RNA, 17 nt, Homo sapiens
ggggcuuuuacaccagu

SEQ ID NO: 476521 - RNA, 23 nt, Homo sapiens
gggggagugggcgcaguggcuca

SEQ ID NO: 476522 - RNA, 23 nt, Homo sapiens
gggucccugauaacaaccuggag

SEQ ID NO: 476523 - RNA, 22 nt, Homo sapiens
gggugagagucuggguccaggc

SEQ ID NO: 476524 - RNA, 20 nt, Homo sapiens
ggguucaccaggucagggag

SEQ ID NO: 476525 - RNA, 18 nt, Homo sapiens
gguaauuuguaucugaag

SEQ ID NO: 476526 - RNA, 14 nt, Homo sapiens
gguacauauuucuu

SEQ ID NO: 476527 - RNA, 17 nt, Homo sapiens
gguaccaagagacuccu

SEQ ID NO: 476528 - RNA, 22 nt, Homo sapiens
ggucaggaggaaaagacuaaca

SEQ ID NO: 476529 - RNA, 11 nt, Homo sapiens
ggucauuugcu

SEQ ID NO: 476530 - RNA, 16 nt, Homo sapiens
ggucucgaacuccuga

SEQ ID NO: 476531 - RNA, 17 nt, Homo sapiens
ggugagacacugcacag

SEQ ID NO: 476532 - RNA, 19 nt, Homo sapiens
ggugagacacugcacagaa

SEQ ID NO: 476533 - RNA, 19 nt, Homo sapiens
ggugcaugaagguuucuga

SEQ ID NO: 476534 - RNA, 22 nt, Homo sapiens
gguggccucuccuuguggccug

SEQ ID NO: 476535 - RNA, 19 nt, Homo sapiens
ggugggccuccucugucca

SEQ ID NO: 476536 - RNA, 18 nt, Homo sapiens
gguguaauuccucccuaa

SEQ ID NO: 476537 - RNA, 21 nt, Homo sapiens
gguguccuguuccugccacau

SEQ ID NO: 476538 - RNA, 19 nt, Homo sapiens
ggugucuggauucccagga

SEQ ID NO: 476539 - RNA, 19 nt, Homo sapiens
gguuagggaaaacauucca

SEQ ID NO: 476540 - RNA, 20 nt, Homo sapiens
gguuagggaaaacauuccau

SEQ ID NO: 476541 - RNA, 13 nt, Homo sapiens
gguuauaaugugu

SEQ ID NO: 476542 - RNA, 15 nt, Homo sapiens
gguucucuucacacu

SEQ ID NO: 476543 - RNA, 22 nt, Homo sapiens
guaaacagaggaguacagguga

SEQ ID NO: 476544 - RNA, 16 nt, Homo sapiens
guaaacauuaguucua

SEQ ID NO: 476545 - RNA, 18 nt, Homo sapiens
guaaagaguuaguuugag

SEQ ID NO: 476546 - RNA, 17 nt, Homo sapiens
guaaagcuuugugcaga

SEQ ID NO: 476547 - RNA, 16 nt, Homo sapiens
guaaauaccugucaau

SEQ ID NO: 476548 - RNA, 23 nt, Homo sapiens
guaagaaaauaucacuugucaau

SEQ ID NO: 476549 - RNA, 16 nt, Homo sapiens
guaagaaucauuguaa

SEQ ID NO: 476550 - RNA, 18 nt, Homo sapiens
guaagcaaagacuuuccu

SEQ ID NO: 476551 - RNA, 18 nt, Homo sapiens
guaaucccagaacuuugg

SEQ ID NO: 476552 - RNA, 17 nt, Homo sapiens
guaauucucaggccauc

SEQ ID NO: 476553 - RNA, 17 nt, Homo sapiens
guacaagcugauguuuu

SEQ ID NO: 476554 - RNA, 16 nt, Homo sapiens
guacacagacuauuga

SEQ ID NO: 476555 - RNA, 17 nt, Homo sapiens
guacagaauucugcuac

SEQ ID NO: 476556 - RNA, 22 nt, Homo sapiens
guacagaauucugcuaccucac

SEQ ID NO: 476557 - RNA, 18 nt, Homo sapiens
guacagguuuugcccuga

SEQ ID NO: 476558 - RNA, 14 nt, Homo sapiens
guacuaaaaauaca

SEQ ID NO: 476559 - RNA, 21 nt, Homo sapiens
guacuaauacagacuauguca

SEQ ID NO: 476560 - RNA, 14 nt, Homo sapiens
guagauaugauaga

SEQ ID NO: 476561 - RNA, 22 nt, Homo sapiens
guagugggugccuguaauccca

SEQ ID NO: 476562 - RNA, 14 nt, Homo sapiens
guauauacaaagaa

SEQ ID NO: 476563 - RNA, 15 nt, Homo sapiens
guauaugucaucuca

SEQ ID NO: 476564 - RNA, 11 nt, Homo sapiens
guauauucaaa

SEQ ID NO: 476565 - RNA, 20 nt, Homo sapiens
guaucuaccucacuauucaa

SEQ ID NO: 476566 - RNA, 18 nt, Homo sapiens
guaucucggaccuuucag

SEQ ID NO: 476567 - RNA, 23 nt, Homo sapiens
guaugacucccaaauuuucacau

SEQ ID NO: 476568 - RNA, 23 nt, Homo sapiens
guaugauccuaaugaaugcauaa

SEQ ID NO: 476569 - RNA, 14 nt, Homo sapiens
guaugccaagugaa

SEQ ID NO: 476570 - RNA, 12 nt, Homo sapiens
gucaaauugcaa

SEQ ID NO: 476571 - RNA, 22 nt, Homo sapiens
gucaacccaauaguuguugauu

SEQ ID NO: 476572 - RNA, 18 nt, Homo sapiens
gucaauaaaauccauaca

SEQ ID NO: 476573 - RNA, 12 nt, Homo sapiens
gucaaugaacuu

SEQ ID NO: 476574 - RNA, 19 nt, Homo sapiens
gucaaugaacuuuccacau

SEQ ID NO: 476575 - RNA, 13 nt, Homo sapiens
gucaccucaugga

SEQ ID NO: 476576 - RNA, 22 nt, Homo sapiens
gucacguggaggagcagugcag

SEQ ID NO: 476577 - RNA, 14 nt, Homo sapiens
gucaugucagcucc

SEQ ID NO: 476578 - RNA, 18 nt, Homo sapiens
gucauuaaacaugacauu

SEQ ID NO: 476579 - RNA, 19 nt, Homo sapiens
guccaaggaaaccacagcu

SEQ ID NO: 476580 - RNA, 18 nt, Homo sapiens
guccaaguggcugugaca

SEQ ID NO: 476581 - RNA, 19 nt, Homo sapiens
guccaggucuaccaaaaau

SEQ ID NO: 476582 - RNA, 18 nt, Homo sapiens
gucccagcuacucaggag

SEQ ID NO: 476583 - RNA, 19 nt, Homo sapiens
gucccucaggcuuguugcc

SEQ ID NO: 476584 - RNA, 15 nt, Homo sapiens
guccuguuccugcca

SEQ ID NO: 476585 - RNA, 20 nt, Homo sapiens
guccuuagccccaucugcca

SEQ ID NO: 476586 - RNA, 14 nt, Homo sapiens
gucgcugugcccug

SEQ ID NO: 476587 - RNA, 13 nt, Homo sapiens
gucuaaagcuuug

SEQ ID NO: 476588 - RNA, 22 nt, Homo sapiens
gucucacugugggaaggccagc

SEQ ID NO: 476589 - RNA, 16 nt, Homo sapiens
gucuccuuaacacuga

SEQ ID NO: 476590 - RNA, 18 nt, Homo sapiens
gucugaugagaacucuga

SEQ ID NO: 476591 - RNA, 18 nt, Homo sapiens
gucugccagccagcagcc

SEQ ID NO: 476592 - RNA, 16 nt, Homo sapiens
gucuggcaucucccac

SEQ ID NO: 476593 - RNA, 19 nt, Homo sapiens
gucuggcaucucccacaca

SEQ ID NO: 476594 - RNA, 23 nt, Homo sapiens
gucuguccaacugccuguucaau

SEQ ID NO: 476595 - RNA, 15 nt, Homo sapiens
gucuuaacucaccau

SEQ ID NO: 476596 - RNA, 22 nt, Homo sapiens
gucuuuucaaaaggauuuacuu

SEQ ID NO: 476597 - RNA, 20 nt, Homo sapiens
gugaaagcaucacuugggau

SEQ ID NO: 476598 - RNA, 23 nt, Homo sapiens
gugaaggcagagaggagccagga

SEQ ID NO: 476599 - RNA, 17 nt, Homo sapiens
gugagacacugcacaga

SEQ ID NO: 476600 - RNA, 16 nt, Homo sapiens
gugagcaaagggcuca

SEQ ID NO: 476601 - RNA, 23 nt, Homo sapiens
gugauauuaaccaggggccauga

SEQ ID NO: 476602 - RNA, 19 nt, Homo sapiens
gugauucaaaauguacuau

SEQ ID NO: 476603 - RNA, 20 nt, Homo sapiens
gugcaaagauuugcuuuaau

SEQ ID NO: 476604 - RNA, 18 nt, Homo sapiens
gugcauagagccacguau

SEQ ID NO: 476605 - RNA, 20 nt, Homo sapiens
gugcaugcagcaucuaagua

SEQ ID NO: 476606 - RNA, 16 nt, Homo sapiens
gugcgcaauugcucau

SEQ ID NO: 476607 - RNA, 22 nt, Homo sapiens
guggaaguuaaagggcauuucc

SEQ ID NO: 476608 - RNA, 15 nt, Homo sapiens
guggcacugccaugc

SEQ ID NO: 476609 - RNA, 18 nt, Homo sapiens
guggccccaaauuugcua

SEQ ID NO: 476610 - RNA, 19 nt, Homo sapiens
guggccccaaauuugcuau

SEQ ID NO: 476611 - RNA, 12 nt, Homo sapiens
gugggcacuggu

SEQ ID NO: 476612 - RNA, 13 nt, Homo sapiens
gugggcacuggug

SEQ ID NO: 476613 - RNA, 20 nt, Homo sapiens
gugggcagaucacgagguca

SEQ ID NO: 476614 - RNA, 14 nt, Homo sapiens
guggggacagggau

SEQ ID NO: 476615 - RNA, 20 nt, Homo sapiens
guggucugggcaccaccucu

SEQ ID NO: 476616 - RNA, 17 nt, Homo sapiens
gugguggcaaaagacau

SEQ ID NO: 476617 - RNA, 17 nt, Homo sapiens
guguaauuccucccuaa

SEQ ID NO: 476618 - RNA, 22 nt, Homo sapiens
guguguuaaaugggacuggagu

SEQ ID NO: 476619 - RNA, 17 nt, Homo sapiens
guguugacaugugcuuu

SEQ ID NO: 476620 - RNA, 11 nt, Homo sapiens
guuaaugccau

SEQ ID NO: 476621 - RNA, 13 nt, Homo sapiens
guuacuaguacag

SEQ ID NO: 476622 - RNA, 14 nt, Homo sapiens
guuacuaguacagg

SEQ ID NO: 476623 - RNA, 15 nt, Homo sapiens
guuagaaaugcaaau

SEQ ID NO: 476624 - RNA, 12 nt, Homo sapiens
guuauaaugugu

SEQ ID NO: 476625 - RNA, 16 nt, Homo sapiens
guuauuaacagcugau

SEQ ID NO: 476626 - RNA, 13 nt, Homo sapiens
guuauuguggaaa

SEQ ID NO: 476627 - RNA, 20 nt, Homo sapiens
guuauuguggaaagaugaau

SEQ ID NO: 476628 - RNA, 18 nt, Homo sapiens
guucaagagcacacuugg

SEQ ID NO: 476629 - RNA, 23 nt, Homo sapiens
guucaauaaaaguaaacucagca

SEQ ID NO: 476630 - RNA, 13 nt, Homo sapiens
guucaccagguca

SEQ ID NO: 476631 - RNA, 14 nt, Homo sapiens
guucagaugcuucu

SEQ ID NO: 476632 - RNA, 23 nt, Homo sapiens
guucuaccaauuauagaucaaau

SEQ ID NO: 476633 - RNA, 18 nt, Homo sapiens
guucuuucuuacacaaga

SEQ ID NO: 476634 - RNA, 12 nt, Homo sapiens
guugacauggga

SEQ ID NO: 476635 - RNA, 14 nt, Homo sapiens
guugcccagugugu

SEQ ID NO: 476636 - RNA, 23 nt, Homo sapiens
guuggcccagaccucaggugcua

SEQ ID NO: 476637 - RNA, 18 nt, Homo sapiens
guuguuauuaacagcuga

SEQ ID NO: 476638 - RNA, 22 nt, Homo sapiens
guuuaaaagccaucaaacacaa

SEQ ID NO: 476639 - RNA, 18 nt, Homo sapiens
guuuauaaaagaugcauu

SEQ ID NO: 476640 - RNA, 23 nt, Homo sapiens
guuucucuuggguauaaaggcua

SEQ ID NO: 476641 - RNA, 19 nt, Homo sapiens
guuuucaucaagacuggaa

SEQ ID NO: 476642 - RNA, 15 nt, Homo sapiens
guuuucuucugugau

SEQ ID NO: 476643 - RNA, 19 nt, Homo sapiens
ucaaguacuguaacugugu

SEQ ID NO: 476644 - RNA, 15 nt, Homo sapiens
ucaaguucuacauca

SEQ ID NO: 476645 - RNA, 13 nt, Homo sapiens
ucaauaaaccaca

SEQ ID NO: 476646 - RNA, 18 nt, Homo sapiens
ucaauaaauuguaauugu

SEQ ID NO: 476647 - RNA, 13 nt, Homo sapiens
ucaauccaagagu

SEQ ID NO: 476648 - RNA, 22 nt, Homo sapiens
ucaauccaagagucugaugauu

SEQ ID NO: 476649 - RNA, 16 nt, Homo sapiens
ucaaucucugauucug

SEQ ID NO: 476650 - RNA, 22 nt, Homo sapiens
ucaaugcuauaacuauguugau

SEQ ID NO: 476651 - RNA, 16 nt, Homo sapiens
ucacaaacucauccau

SEQ ID NO: 476652 - RNA, 23 nt, Homo sapiens
ucacaccaggcuugccugcaggc

SEQ ID NO: 476653 - RNA, 18 nt, Homo sapiens
ucacacgggggcagcuga

SEQ ID NO: 476654 - RNA, 23 nt, Homo sapiens
ucacacugggacuugcaaaaagg

SEQ ID NO: 476655 - RNA, 18 nt, Homo sapiens
ucacagaugugugauuca

SEQ ID NO: 476656 - RNA, 14 nt, Homo sapiens
ucaccaucugugca

SEQ ID NO: 476657 - RNA, 19 nt, Homo sapiens
ucacccaggcuggagugca

SEQ ID NO: 476658 - RNA, 16 nt, Homo sapiens
ucaccgaggacaugaa

SEQ ID NO: 476659 - RNA, 21 nt, Homo sapiens
ucacgauugucaucaggagaa

SEQ ID NO: 476660 - RNA, 21 nt, Homo sapiens
ucacuaagaagcuugaaucua

SEQ ID NO: 476661 - RNA, 18 nt, Homo sapiens
ucacucaaucucugauuc

SEQ ID NO: 476662 - RNA, 16 nt, Homo sapiens
ucacugccauauacuc

SEQ ID NO: 476663 - RNA, 16 nt, Homo sapiens
ucagaaacacccucac

SEQ ID NO: 476664 - RNA, 14 nt, Homo sapiens
ucagaauacagaca

SEQ ID NO: 476665 - RNA, 11 nt, Homo sapiens
ucagagcugcc

SEQ ID NO: 476666 - RNA, 20 nt, Homo sapiens
ucagcaugaaggaugccaua

SEQ ID NO: 476667 - RNA, 16 nt, Homo sapiens
ucagcucacuguucua

SEQ ID NO: 476668 - RNA, 17 nt, Homo sapiens
ucagcugugaacaugga

SEQ ID NO: 476669 - RNA, 17 nt, Homo sapiens
ucagcuuauaaaaucaa

SEQ ID NO: 476670 - RNA, 19 nt, Homo sapiens
ucagcuuauuguagcauau

SEQ ID NO: 476671 - RNA, 15 nt, Homo sapiens
ucaggagcagccuca

SEQ ID NO: 476672 - RNA, 21 nt, Homo sapiens
ucaggagcagccucagaacaa

SEQ ID NO: 476673 - RNA, 19 nt, Homo sapiens
ucaggaggaaggcuuacac

SEQ ID NO: 476674 - RNA, 23 nt, Homo sapiens
ucaggccacauggcuaaagaagg

SEQ ID NO: 476675 - RNA, 20 nt, Homo sapiens
ucagggagaguuugggaacu

SEQ ID NO: 476676 - RNA, 22 nt, Homo sapiens
ucagucugaugagaacucugag

SEQ ID NO: 476677 - RNA, 21 nt, Homo sapiens
ucagugcaaagauuugcuuua

SEQ ID NO: 476678 - RNA, 21 nt, Homo sapiens
ucagugcuucgcagauguccu

SEQ ID NO: 476679 - RNA, 17 nt, Homo sapiens
ucaguuccucuuugcau

SEQ ID NO: 476680 - RNA, 16 nt, Homo sapiens
ucaucacacaacucag

SEQ ID NO: 476681 - RNA, 20 nt, Homo sapiens
ucaucaccuguuaucugugu

SEQ ID NO: 476682 - RNA, 19 nt, Homo sapiens
ucaucaggagaaaaagccu

SEQ ID NO: 476683 - RNA, 21 nt, Homo sapiens
ucaucaguggagccauguuaa

SEQ ID NO: 476684 - RNA, 13 nt, Homo sapiens
ucauccauuugcg

SEQ ID NO: 476685 - RNA, 13 nt, Homo sapiens
ucaucugggcaaa

SEQ ID NO: 476686 - RNA, 18 nt, Homo sapiens
ucaugaaucugcaaugug

SEQ ID NO: 476687 - RNA, 22 nt, Homo sapiens
ucaugacuuuuccauguaucua

SEQ ID NO: 476688 - RNA, 19 nt, Homo sapiens
ucaugcauggaaauucccu

SEQ ID NO: 476689 - RNA, 13 nt, Homo sapiens
ucauggaauugga

SEQ ID NO: 476690 - RNA, 13 nt, Homo sapiens
ucauggacaugaa

SEQ ID NO: 476691 - RNA, 21 nt, Homo sapiens
ucauggaugagacuacuucag

SEQ ID NO: 476692 - RNA, 19 nt, Homo sapiens
ucaugugccucuguccuua

SEQ ID NO: 476693 - RNA, 22 nt, Homo sapiens
ucauugaagacccucaaugcca

SEQ ID NO: 476694 - RNA, 14 nt, Homo sapiens
ucauugacuaucaa

SEQ ID NO: 476695 - RNA, 14 nt, Homo sapiens
ucauugacugaugg

SEQ ID NO: 476696 - RNA, 18 nt, Homo sapiens
ucauuguaaacauuaguu

SEQ ID NO: 476697 - RNA, 23 nt, Homo sapiens
ucauuucaggagcagccucagaa

SEQ ID NO: 476698 - RNA, 18 nt, Homo sapiens
uccaacuaucucauuucc

SEQ ID NO: 476699 - RNA, 18 nt, Homo sapiens
uccaauuccuugcacaua

SEQ ID NO: 476700 - RNA, 14 nt, Homo sapiens
uccacacccagcuc

SEQ ID NO: 476701 - RNA, 16 nt, Homo sapiens
uccacaccuggucuga

SEQ ID NO: 476702 - RNA, 16 nt, Homo sapiens
uccacgcccaccagcc

SEQ ID NO: 476703 - RNA, 11 nt, Homo sapiens
uccacuaugag

SEQ ID NO: 476704 - RNA, 14 nt, Homo sapiens
uccacuaugagcug

SEQ ID NO: 476705 - RNA, 16 nt, Homo sapiens
uccacuaugagcugcu

SEQ ID NO: 476706 - RNA, 11 nt, Homo sapiens
uccacucccag

SEQ ID NO: 476707 - RNA, 18 nt, Homo sapiens
uccagaaaaacucaugga

SEQ ID NO: 476708 - RNA, 17 nt, Homo sapiens
uccagagggaauugcag

SEQ ID NO: 476709 - RNA, 17 nt, Homo sapiens
uccagaugagaguacac

SEQ ID NO: 476710 - RNA, 19 nt, Homo sapiens
uccagccuggcuacagggc

SEQ ID NO: 476711 - RNA, 20 nt, Homo sapiens
uccauauggcaauaggugug

SEQ ID NO: 476712 - RNA, 23 nt, Homo sapiens
uccaugguggaaguuaaagggca

SEQ ID NO: 476713 - RNA, 20 nt, Homo sapiens
uccauuuauucuuugaucuu

SEQ ID NO: 476714 - RNA, 20 nt, Homo sapiens
ucccaaguagcuggaauuac

SEQ ID NO: 476715 - RNA, 13 nt, Homo sapiens
ucccagcuacuca

SEQ ID NO: 476716 - RNA, 17 nt, Homo sapiens
ucccaggaguacacccc

SEQ ID NO: 476717 - RNA, 18 nt, Homo sapiens
ucccagguuaucugggca

SEQ ID NO: 476718 - RNA, 19 nt, Homo sapiens
ucccauaccacccaaugcu

SEQ ID NO: 476719 - RNA, 14 nt, Homo sapiens
uccccaacugcucc

SEQ ID NO: 476720 - RNA, 23 nt, Homo sapiens
uccccugucacgugugggcaaug

SEQ ID NO: 476721 - RNA, 15 nt, Homo sapiens
ucccuagauugugaa

SEQ ID NO: 476722 - RNA, 21 nt, Homo sapiens
ucccucaggcuuguugcccuc

SEQ ID NO: 476723 - RNA, 19 nt, Homo sapiens
ucccugauaacaaccugga

SEQ ID NO: 476724 - RNA, 20 nt, Homo sapiens
ucccugauaacaaccuggag

SEQ ID NO: 476725 - RNA, 21 nt, Homo sapiens
ucccuucacuccccuauccca

SEQ ID NO: 476726 - RNA, 16 nt, Homo sapiens
ucccuucuaaccugaa

SEQ ID NO: 476727 - RNA, 15 nt, Homo sapiens
uccgaagucuuccau

SEQ ID NO: 476728 - RNA, 17 nt, Homo sapiens
uccgaugaguaaaaagu

SEQ ID NO: 476729 - RNA, 14 nt, Homo sapiens
uccgcuuucacuuc

SEQ ID NO: 476730 - RNA, 19 nt, Homo sapiens
uccuaaaacaaaagcucau

SEQ ID NO: 476731 - RNA, 19 nt, Homo sapiens
uccuaaugaaugcauaaaa

SEQ ID NO: 476732 - RNA, 18 nt, Homo sapiens
uccuagagauuuggugua

SEQ ID NO: 476733 - RNA, 18 nt, Homo sapiens
uccuaguagcuuuccucc

SEQ ID NO: 476734 - RNA, 15 nt, Homo sapiens
uccucaaacacugca

SEQ ID NO: 476735 - RNA, 13 nt, Homo sapiens
uccucugcuugcc

SEQ ID NO: 476736 - RNA, 22 nt, Homo sapiens
uccucuggguaggaaucagcaa

SEQ ID NO: 476737 - RNA, 15 nt, Homo sapiens
uccucuuugcaugga

SEQ ID NO: 476738 - RNA, 22 nt, Homo sapiens
uccugaccucaggugauccacc

SEQ ID NO: 476739 - RNA, 17 nt, Homo sapiens
uccugggcagcugccuc

SEQ ID NO: 476740 - RNA, 13 nt, Homo sapiens
uccugucugccag

SEQ ID NO: 476741 - RNA, 16 nt, Homo sapiens
uccuguuccugccaca

SEQ ID NO: 476742 - RNA, 20 nt, Homo sapiens
uccuuagcuuagaccucagc

SEQ ID NO: 476743 - RNA, 23 nt, Homo sapiens
uccuuaugauguccaacaaggaa

SEQ ID NO: 476744 - RNA, 16 nt, Homo sapiens
uccuuccagcacugac

SEQ ID NO: 476745 - RNA, 19 nt, Homo sapiens
uccuugaagauuuaccacu

SEQ ID NO: 476746 - RNA, 16 nt, Homo sapiens
uccuugcacauaguag

SEQ ID NO: 476747 - RNA, 23 nt, Homo sapiens
ucgauuugcacccaccuuucugc

SEQ ID NO: 476748 - RNA, 13 nt, Homo sapiens
ucgcaagagccau

SEQ ID NO: 476749 - RNA, 21 nt, Homo sapiens
ucgccaaggcuggagugcagu

SEQ ID NO: 476750 - RNA, 23 nt, Homo sapiens
ucgcuaccuuuugcuguggcaaa

SEQ ID NO: 476751 - RNA, 15 nt, Homo sapiens
ucgcuugaaccuggg

SEQ ID NO: 476752 - RNA, 17 nt, Homo sapiens
ucuaaaaugaguuaccu

SEQ ID NO: 476753 - RNA, 20 nt, Homo sapiens
ucuaaaaugaguuaccuaca

SEQ ID NO: 476754 - RNA, 14 nt, Homo sapiens
ucuacaucaauauc

SEQ ID NO: 476755 - RNA, 15 nt, Homo sapiens
ucuacaucaauauca

SEQ ID NO: 476756 - RNA, 15 nt, Homo sapiens
ucuacuaaaaauaca

SEQ ID NO: 476757 - RNA, 20 nt, Homo sapiens
ucuacuacccccacagaccu

SEQ ID NO: 476758 - RNA, 17 nt, Homo sapiens
ucuacuguacacaaucu

SEQ ID NO: 476759 - RNA, 16 nt, Homo sapiens
ucuagacaaaaaccau

SEQ ID NO: 476760 - RNA, 18 nt, Homo sapiens
ucuagccuagaagauaca

SEQ ID NO: 476761 - RNA, 12 nt, Homo sapiens
gggacuugcaaa

SEQ ID NO: 476762 - RNA, 20 nt, Homo sapiens
gggauauuugguuuggccau

SEQ ID NO: 476763 - RNA, 17 nt, Homo sapiens
gggauuggggaagacug

SEQ ID NO: 476764 - RNA, 15 nt, Homo sapiens
gggcaauccagacag

SEQ ID NO: 476765 - RNA, 12 nt, Homo sapiens
gggcagggauga

SEQ ID NO: 476766 - RNA, 19 nt, Homo sapiens
gggcauagaugcaggugag

SEQ ID NO: 476767 - RNA, 17 nt, Homo sapiens
gggcccugccugcugca

SEQ ID NO: 476768 - RNA, 15 nt, Homo sapiens
gggccggaaggaaug

SEQ ID NO: 476769 - RNA, 16 nt, Homo sapiens
gggccggaaggaaugu

SEQ ID NO: 476770 - RNA, 15 nt, Homo sapiens
accaccagucaauaa

SEQ ID NO: 476771 - RNA, 15 nt, Homo sapiens
accaccuaguucucc

SEQ ID NO: 476772 - RNA, 20 nt, Homo sapiens
accacgugagaucauucacu

SEQ ID NO: 476773 - RNA, 21 nt, Homo sapiens
accacgugagaucauucacuc

SEQ ID NO: 476774 - RNA, 15 nt, Homo sapiens
accagccugggcaac

SEQ ID NO: 476775 - RNA, 17 nt, Homo sapiens
accagccuugcucucuu

SEQ ID NO: 476776 - RNA, 21 nt, Homo sapiens
accagccuugcucucuucaau

SEQ ID NO: 476777 - RNA, 18 nt, Homo sapiens
accaggcaaagcaaguga

SEQ ID NO: 476778 - RNA, 13 nt, Homo sapiens
accaggucaggga

SEQ ID NO: 476779 - RNA, 14 nt, Homo sapiens
accaggucagggag

SEQ ID NO: 476780 - RNA, 15 nt, Homo sapiens
accaguaauugugaa

SEQ ID NO: 476781 - RNA, 19 nt, Homo sapiens
accaguuuaaccugaugca

SEQ ID NO: 476782 - RNA, 20 nt, Homo sapiens
accauaaaaaggaauccacu

SEQ ID NO: 476783 - RNA, 18 nt, Homo sapiens
accauguuggccaggcug

SEQ ID NO: 476784 - RNA, 19 nt, Homo sapiens
accauuuuugaaaccaaac

SEQ ID NO: 476785 - RNA, 16 nt, Homo sapiens
acccaaguagcugcua

SEQ ID NO: 476786 - RNA, 20 nt, Homo sapiens
acccacaguggaaagacagc

SEQ ID NO: 476787 - RNA, 13 nt, Homo sapiens
acccauucuacac

SEQ ID NO: 476788 - RNA, 22 nt, Homo sapiens
accccaacagcacccucuccag

SEQ ID NO: 476789 - RNA, 13 nt, Homo sapiens
acccccaacuccu

SEQ ID NO: 476790 - RNA, 19 nt, Homo sapiens
acccccugugagcagggau

SEQ ID NO: 476791 - RNA, 22 nt, Homo sapiens
acccggcaggcuagaaccuggc

SEQ ID NO: 476792 - RNA, 20 nt, Homo sapiens
acccuaaggucauuaccaca

SEQ ID NO: 476793 - RNA, 19 nt, Homo sapiens
accgcgccuggccaggcug

SEQ ID NO: 476794 - RNA, 23 nt, Homo sapiens
accgcugauucucagggucucug

SEQ ID NO: 476795 - RNA, 21 nt, Homo sapiens
accgguguccuguuccugcca

SEQ ID NO: 476796 - RNA, 18 nt, Homo sapiens
accuacauuuuaaugcac

SEQ ID NO: 476797 - RNA, 21 nt, Homo sapiens
accuaccacaugccaagcacu

SEQ ID NO: 476798 - RNA, 17 nt, Homo sapiens
accuacuuucauacuga

SEQ ID NO: 476799 - RNA, 15 nt, Homo sapiens
accuaguaugcucag

SEQ ID NO: 476800 - RNA, 23 nt, Homo sapiens
accuaguucuccccgauggggca

SEQ ID NO: 476801 - RNA, 21 nt, Homo sapiens
accucaccugggcagggauga

SEQ ID NO: 476802 - RNA, 21 nt, Homo sapiens
accucagaguauggagcucag

SEQ ID NO: 476803 - RNA, 11 nt, Homo sapiens
accucagggcu

SEQ ID NO: 476804 - RNA, 16 nt, Homo sapiens
accucaggugauccac

SEQ ID NO: 476805 - RNA, 12 nt, Homo sapiens
accucauuauca

SEQ ID NO: 476806 - RNA, 15 nt, Homo sapiens
accucccugcaauaa

SEQ ID NO: 476807 - RNA, 14 nt, Homo sapiens
accuccugucucug

SEQ ID NO: 476808 - RNA, 12 nt, Homo sapiens
accuccuuccag

SEQ ID NO: 476809 - RNA, 14 nt, Homo sapiens
accugaacugaugg

SEQ ID NO: 476810 - RNA, 19 nt, Homo sapiens
accugccucccuucaugca

SEQ ID NO: 476811 - RNA, 17 nt, Homo sapiens
accugccuuuuauagua

SEQ ID NO: 476812 - RNA, 21 nt, Homo sapiens
accuggagagcuagaaccuag

SEQ ID NO: 476813 - RNA, 21 nt, Homo sapiens
accuggagggcuagaaccuag

SEQ ID NO: 476814 - RNA, 23 nt, Homo sapiens
accuggagggcuggaaucuggag

SEQ ID NO: 476815 - RNA, 21 nt, Homo sapiens
accuggaggggcuagaaccua

SEQ ID NO: 476816 - RNA, 18 nt, Homo sapiens
accuggguaaaugcagcg

SEQ ID NO: 476817 - RNA, 15 nt, Homo sapiens
accuuaauauucucc

SEQ ID NO: 476818 - RNA, 21 nt, Homo sapiens
accuucuaggaagcuccaguu

SEQ ID NO: 476819 - RNA, 16 nt, Homo sapiens
accuugaacacugggg

SEQ ID NO: 476820 - RNA, 19 nt, Homo sapiens
accuugggggaagacuuua

SEQ ID NO: 476821 - RNA, 17 nt, Homo sapiens
accuuuggaugcacuuu

SEQ ID NO: 476822 - RNA, 19 nt, Homo sapiens
accuuuggaugcacuuuau

SEQ ID NO: 476823 - RNA, 22 nt, Homo sapiens
acgagccuauuucucuuugcac

SEQ ID NO: 476824 - RNA, 12 nt, Homo sapiens
acgccuccccaa

SEQ ID NO: 476825 - RNA, 15 nt, Homo sapiens
acgccuguaauccca

SEQ ID NO: 476826 - RNA, 17 nt, Homo sapiens
acgccuguaaucccaga

SEQ ID NO: 476827 - RNA, 21 nt, Homo sapiens
acguaaaaagaaaaaaaccau

SEQ ID NO: 476828 - RNA, 21 nt, Homo sapiens
acguggucuuucuuacaagga

SEQ ID NO: 476829 - RNA, 17 nt, Homo sapiens
acuaaacagacuauuua

SEQ ID NO: 476830 - RNA, 18 nt, Homo sapiens
acuaaacagacuauuuaa

SEQ ID NO: 476831 - RNA, 14 nt, Homo sapiens
acuacaucacuuga

SEQ ID NO: 476832 - RNA, 15 nt, Homo sapiens
acuagacaaguccag

SEQ ID NO: 476833 - RNA, 14 nt, Homo sapiens
acuagguuuaucuc

SEQ ID NO: 476834 - RNA, 21 nt, Homo sapiens
acuauugaaguugcagauuca

SEQ ID NO: 476835 - RNA, 21 nt, Homo sapiens
acucaaaacccaucugggcuc

SEQ ID NO: 476836 - RNA, 18 nt, Homo sapiens
acucaccuugcucugcca

SEQ ID NO: 476837 - RNA, 19 nt, Homo sapiens
acucagggccccagcacua

SEQ ID NO: 476838 - RNA, 22 nt, Homo sapiens
acucauggaugagacuacuuca

SEQ ID NO: 476839 - RNA, 15 nt, Homo sapiens
acucauuuauuucca

SEQ ID NO: 476840 - RNA, 16 nt, Homo sapiens
acuccccaacugaguu

SEQ ID NO: 476841 - RNA, 13 nt, Homo sapiens
acuccuaaaucaa

SEQ ID NO: 476842 - RNA, 14 nt, Homo sapiens
acuccuaaaucaag

SEQ ID NO: 476843 - RNA, 22 nt, Homo sapiens
acuccuuuccugcaaacccauu

SEQ ID NO: 476844 - RNA, 22 nt, Homo sapiens
acucuccagaaagcucaucuca

SEQ ID NO: 476845 - RNA, 20 nt, Homo sapiens
acucuuaagaagacugcauu

SEQ ID NO: 476846 - RNA, 18 nt, Homo sapiens
acucuugaucaucuguag

SEQ ID NO: 476847 - RNA, 18 nt, Homo sapiens
acugaaaacaagccauga

SEQ ID NO: 476848 - RNA, 16 nt, Homo sapiens
acugaaauauacacac

SEQ ID NO: 476849 - RNA, 20 nt, Homo sapiens
acugaaaucaagcuggagua

SEQ ID NO: 476850 - RNA, 15 nt, Homo sapiens
acugauagaugucua

SEQ ID NO: 476851 - RNA, 12 nt, Homo sapiens
acugaugacuuu

SEQ ID NO: 476852 - RNA, 10 nt, Homo sapiens
acugcaauaa

SEQ ID NO: 476853 - RNA, 15 nt, Homo sapiens
acugcacccagcuaa

SEQ ID NO: 476854 - RNA, 22 nt, Homo sapiens
acugcagcuaacuuaucaucac

SEQ ID NO: 476855 - RNA, 20 nt, Homo sapiens
acugcauaaaaagugccugu

SEQ ID NO: 476856 - RNA, 14 nt, Homo sapiens
acuggcugauggag

SEQ ID NO: 476857 - RNA, 13 nt, Homo sapiens
acugggcuucuag

SEQ ID NO: 476858 - RNA, 19 nt, Homo sapiens
acugggugaggauaacaca

SEQ ID NO: 476859 - RNA, 22 nt, Homo sapiens
acugucuugaagacaauggcuu

SEQ ID NO: 476860 - RNA, 20 nt, Homo sapiens
acuguggcugcuagcacuug

SEQ ID NO: 476861 - RNA, 17 nt, Homo sapiens
acugugggaaggccagc

SEQ ID NO: 476862 - RNA, 22 nt, Homo sapiens
acuguggguagacacacaugaa

SEQ ID NO: 476863 - RNA, 17 nt, Homo sapiens
acugugguacugaugga

SEQ ID NO: 476864 - RNA, 19 nt, Homo sapiens
acuuaauagaaacauugaa

SEQ ID NO: 476865 - RNA, 15 nt, Homo sapiens
acuuauucucaagaa

SEQ ID NO: 476866 - RNA, 18 nt, Homo sapiens
acuuccuauaugcacuua

SEQ ID NO: 476867 - RNA, 14 nt, Homo sapiens
acuugacuuugcca

SEQ ID NO: 476868 - RNA, 17 nt, Homo sapiens
acuuggaacacaaugac

SEQ ID NO: 476869 - RNA, 17 nt, Homo sapiens
acuuggcuacacaggga

SEQ ID NO: 476870 - RNA, 13 nt, Homo sapiens
acuugggaacuag

SEQ ID NO: 476871 - RNA, 18 nt, Homo sapiens
acuugugccaacacucaa

SEQ ID NO: 476872 - RNA, 15 nt, Homo sapiens
acuuucuucuaccag

SEQ ID NO: 476873 - RNA, 21 nt, Homo sapiens
acuuuuuguaaaaagcuucau

SEQ ID NO: 476874 - RNA, 15 nt, Homo sapiens
agaaaaacaaauuca

SEQ ID NO: 476875 - RNA, 16 nt, Homo sapiens
agaaaauuaugcagcu

SEQ ID NO: 476876 - RNA, 14 nt, Homo sapiens
agaaacacccucac

SEQ ID NO: 476877 - RNA, 13 nt, Homo sapiens
agaaacacugggc

SEQ ID NO: 476878 - RNA, 14 nt, Homo sapiens
agaaagcucaucuc

SEQ ID NO: 476879 - RNA, 15 nt, Homo sapiens
agaaagcucaucuca

SEQ ID NO: 476880 - RNA, 12 nt, Homo sapiens
agaaagugacaa

SEQ ID NO: 476881 - RNA, 13 nt, Homo sapiens
agaaauccuagug

SEQ ID NO: 476882 - RNA, 17 nt, Homo sapiens
agaaaugcaaauucuca

SEQ ID NO: 476883 - RNA, 18 nt, Homo sapiens
agaaauuaugucagcuua

SEQ ID NO: 476884 - RNA, 16 nt, Homo sapiens
agaacacaaggucauu

SEQ ID NO: 476885 - RNA, 12 nt, Homo sapiens
agaacagccgcu

SEQ ID NO: 476886 - RNA, 23 nt, Homo sapiens
agaaccuggagggcuagaaccua

SEQ ID NO: 476887 - RNA, 16 nt, Homo sapiens
agaacucugagcagug

SEQ ID NO: 476888 - RNA, 16 nt, Homo sapiens
agaacuugucccucag

SEQ ID NO: 476889 - RNA, 14 nt, Homo sapiens
agaagcaccaauca

SEQ ID NO: 476890 - RNA, 12 nt, Homo sapiens
agaagccaagga

SEQ ID NO: 476891 - RNA, 20 nt, Homo sapiens
agaagguggguuuucaucaa

SEQ ID NO: 476892 - RNA, 20 nt, Homo sapiens
agaauauuaaaaauuaauuc

SEQ ID NO: 476893 - RNA, 17 nt, Homo sapiens
agaaucacuugacuuug

SEQ ID NO: 476894 - RNA, 23 nt, Homo sapiens
agaaucacuugacuuugccacau

SEQ ID NO: 476895 - RNA, 17 nt, Homo sapiens
agaaugauuaugaauua

SEQ ID NO: 476896 - RNA, 15 nt, Homo sapiens
agaauggaaggugga

SEQ ID NO: 476897 - RNA, 15 nt, Homo sapiens
agaaugugcucaugc

SEQ ID NO: 476898 - RNA, 22 nt, Homo sapiens
agacaaaugggacugaugucau

SEQ ID NO: 476899 - RNA, 22 nt, Homo sapiens
agacaagaaauccuaguggccu

SEQ ID NO: 476900 - RNA, 19 nt, Homo sapiens
agacaagaacuuggaggca

SEQ ID NO: 476901 - RNA, 19 nt, Homo sapiens
agacacaccccaacaugcc

SEQ ID NO: 476902 - RNA, 15 nt, Homo sapiens
agacagagucucacu

SEQ ID NO: 476903 - RNA, 14 nt, Homo sapiens
agacagcuucucau

SEQ ID NO: 476904 - RNA, 18 nt, Homo sapiens
agacaugguauugacuca

SEQ ID NO: 476905 - RNA, 18 nt, Homo sapiens
agacccaaguagcugcua

SEQ ID NO: 476906 - RNA, 22 nt, Homo sapiens
agacgaacagcugacauggagu

SEQ ID NO: 476907 - RNA, 20 nt, Homo sapiens
agacuaacaggagaaugcac

SEQ ID NO: 476908 - RNA, 16 nt, Homo sapiens
agacucauuguaauuc

SEQ ID NO: 476909 - RNA, 14 nt, Homo sapiens
agacuggaaggugg

SEQ ID NO: 476910 - RNA, 23 nt, Homo sapiens
agacuugcuuuucuaacuaagag

SEQ ID NO: 476911 - RNA, 20 nt, Homo sapiens
agagaaaaguccacagugau

SEQ ID NO: 476912 - RNA, 14 nt, Homo sapiens
agagaaauuugcca

SEQ ID NO: 476913 - RNA, 17 nt, Homo sapiens
agagaacugauugugag

SEQ ID NO: 476914 - RNA, 15 nt, Homo sapiens
agagaacuuccagau

SEQ ID NO: 476915 - RNA, 14 nt, Homo sapiens
agagaccacaagca

SEQ ID NO: 476916 - RNA, 19 nt, Homo sapiens
agagacugaaaacuugccg

SEQ ID NO: 476917 - RNA, 19 nt, Homo sapiens
agagacuuugacucuccag

SEQ ID NO: 476918 - RNA, 23 nt, Homo sapiens
agagaggcaaaggcucucacucc

SEQ ID NO: 476919 - RNA, 19 nt, Homo sapiens
agagcaagacucugucuca

SEQ ID NO: 476920 - RNA, 19 nt, Homo sapiens
agagcaggcguucagcuca

SEQ ID NO: 476921 - RNA, 19 nt, Homo sapiens
agagcuagaaccuagaagg

SEQ ID NO: 476922 - RNA, 16 nt, Homo sapiens
agagcugacacaggau

SEQ ID NO: 476923 - RNA, 17 nt, Homo sapiens
agagcuggagccuggug

SEQ ID NO: 476924 - RNA, 23 nt, Homo sapiens
agagcugggauguuucugucaca

SEQ ID NO: 476925 - RNA, 15 nt, Homo sapiens
agaggagaaggaggg

SEQ ID NO: 476926 - RNA, 16 nt, Homo sapiens
agaggcaaccuguuga

SEQ ID NO: 476927 - RNA, 16 nt, Homo sapiens
agagggccugaugaca

SEQ ID NO: 476928 - RNA, 13 nt, Homo sapiens
agaguacacccca

SEQ ID NO: 476929 - RNA, 20 nt, Homo sapiens
agaguacaccccaacagcac

SEQ ID NO: 476930 - RNA, 23 nt, Homo sapiens
agagugaagugaagagaggcaaa

SEQ ID NO: 476931 - RNA, 19 nt, Homo sapiens
agaguucuccagacagggu

SEQ ID NO: 476932 - RNA, 15 nt, Homo sapiens
agauaauacauuccg

SEQ ID NO: 476933 - RNA, 13 nt, Homo sapiens
agauaaucacaau

SEQ ID NO: 476934 - RNA, 17 nt, Homo sapiens
agauaauucuagcuuug

SEQ ID NO: 476935 - RNA, 14 nt, Homo sapiens
agaucaaaugcccu

SEQ ID NO: 476936 - RNA, 22 nt, Homo sapiens
agaucaaugaaaugaugucaua

SEQ ID NO: 476937 - RNA, 13 nt, Homo sapiens
agauccuggaaau

SEQ ID NO: 476938 - RNA, 20 nt, Homo sapiens
agaucgagaccauccuggcc

SEQ ID NO: 476939 - RNA, 14 nt, Homo sapiens
agaugaaugcaaua

SEQ ID NO: 476940 - RNA, 17 nt, Homo sapiens
agaugcaggugagccca

SEQ ID NO: 476941 - RNA, 20 nt, Homo sapiens
agaugggagcccaguuucac

SEQ ID NO: 476942 - RNA, 22 nt, Homo sapiens
agaugugugauucacaguguga

SEQ ID NO: 476943 - RNA, 17 nt, Homo sapiens
agauuguugaaagccau

SEQ ID NO: 476944 - RNA, 18 nt, Homo sapiens
agauuuccaaaagacuug

SEQ ID NO: 476945 - RNA, 21 nt, Homo sapiens
agauuuuccugaaaacccuug

SEQ ID NO: 476946 - RNA, 15 nt, Homo sapiens
agcaaacacauuaag

SEQ ID NO: 476947 - RNA, 23 nt, Homo sapiens
agcaaaggcugagaacacuguga

SEQ ID NO: 476948 - RNA, 13 nt, Homo sapiens
agcacacuguagc

SEQ ID NO: 476949 - RNA, 11 nt, Homo sapiens
agcacaggugg

SEQ ID NO: 476950 - RNA, 14 nt, Homo sapiens
agcacccucuccag

SEQ ID NO: 476951 - RNA, 15 nt, Homo sapiens
agcacuaaagcagug

SEQ ID NO: 476952 - RNA, 23 nt, Homo sapiens
agcagaaaggaaaagauuccugu

SEQ ID NO: 476953 - RNA, 22 nt, Homo sapiens
agcagagcccucaugugacaug

SEQ ID NO: 476954 - RNA, 21 nt, Homo sapiens
agcagauauauuaagugacug

SEQ ID NO: 476955 - RNA, 24 nt, Homo sapiens
agcaggcuuucaagaagugccagu

SEQ ID NO: 476956 - RNA, 22 nt, Homo sapiens
agcaguucagagcugcccucuc

SEQ ID NO: 476957 - RNA, 13 nt, Homo sapiens
agcaguuuuguga

SEQ ID NO: 476958 - RNA, 20 nt, Homo sapiens
agcauacucuaugugauuua

SEQ ID NO: 476959 - RNA, 12 nt, Homo sapiens
agcauauggagu

SEQ ID NO: 476960 - RNA, 15 nt, Homo sapiens
agcauaugugagaaa

SEQ ID NO: 476961 - RNA, 15 nt, Homo sapiens
agcaugccuguggga

SEQ ID NO: 476962 - RNA, 15 nt, Homo sapiens
agcauuacagugggu

SEQ ID NO: 476963 - RNA, 24 nt, Homo sapiens
agccaaagccaauaacacacagcu

SEQ ID NO: 476964 - RNA, 18 nt, Homo sapiens
agccaagagucaugucaa

SEQ ID NO: 476965 - RNA, 19 nt, Homo sapiens
agccaagagucaugucaaa

SEQ ID NO: 476966 - RNA, 11 nt, Homo sapiens
agccaagggau

SEQ ID NO: 476967 - RNA, 15 nt, Homo sapiens
agccaaguuaagaau

SEQ ID NO: 476968 - RNA, 19 nt, Homo sapiens
agccagcagccagcucuca

SEQ ID NO: 476969 - RNA, 14 nt, Homo sapiens
agccagcaguucag

SEQ ID NO: 476970 - RNA, 22 nt, Homo sapiens
agccagcaguucagagcugccc

SEQ ID NO: 476971 - RNA, 19 nt, Homo sapiens
agcccgugcccuaccacac

SEQ ID NO: 476972 - RNA, 20 nt, Homo sapiens
agcccuccuggaauggagcu

SEQ ID NO: 476973 - RNA, 15 nt, Homo sapiens
agccuccagcugccc

SEQ ID NO: 476974 - RNA, 18 nt, Homo sapiens
agccucggcagauguggc

SEQ ID NO: 476975 - RNA, 17 nt, Homo sapiens
agccucugccgcugcca

SEQ ID NO: 476976 - RNA, 14 nt, Homo sapiens
agccuugcucucuu

SEQ ID NO: 476977 - RNA, 15 nt, Homo sapiens
agccuugcucucuuc

SEQ ID NO: 476978 - RNA, 17 nt, Homo sapiens
agccuugcucucuucaa

SEQ ID NO: 476979 - RNA, 21 nt, Homo sapiens
agccuuggggcugaugcaguu

SEQ ID NO: 476980 - RNA, 14 nt, Homo sapiens
agcgugaagggauu

SEQ ID NO: 476981 - RNA, 15 nt, Homo sapiens
agcuagaaccuggag

SEQ ID NO: 476982 - RNA, 18 nt, Homo sapiens
agcucuugaagacacuga

SEQ ID NO: 476983 - RNA, 22 nt, Homo sapiens
agcuggagccaacagauguguc

SEQ ID NO: 476984 - RNA, 23 nt, Homo sapiens
agcuggaggacuagaaccuggag

SEQ ID NO: 476985 - RNA, 23 nt, Homo sapiens
agcugggaccacacagacagggu

SEQ ID NO: 476986 - RNA, 22 nt, Homo sapiens
agcuggguuggaaaacaguauu

SEQ ID NO: 476987 - RNA, 18 nt, Homo sapiens
agcugguuggagagcuag

SEQ ID NO: 476988 - RNA, 21 nt, Homo sapiens
agcuguuucaccaucagucaa

SEQ ID NO: 476989 - RNA, 13 nt, Homo sapiens
agcuuaagaauuu

SEQ ID NO: 476990 - RNA, 15 nt, Homo sapiens
aggaaaaugaauaau

SEQ ID NO: 476991 - RNA, 15 nt, Homo sapiens
aggaaaccacagcug

SEQ ID NO: 476992 - RNA, 13 nt, Homo sapiens
aggaacauacaga

SEQ ID NO: 476993 - RNA, 22 nt, Homo sapiens
aggaagagauugagcuacuuca

SEQ ID NO: 476994 - RNA, 15 nt, Homo sapiens
aggaaggcucuucuc

SEQ ID NO: 476995 - RNA, 20 nt, Homo sapiens
aggaaggcucuucuccccag

SEQ ID NO: 476996 - RNA, 15 nt, Homo sapiens
aggaagucagacuuu

SEQ ID NO: 476997 - RNA, 16 nt, Homo sapiens
aggaauccacucccag

SEQ ID NO: 476998 - RNA, 15 nt, Homo sapiens
aggaauccacucucc

SEQ ID NO: 476999 - RNA, 22 nt, Homo sapiens
aucaccagcacauucacugaca

SEQ ID NO: 477000 - RNA, 12 nt, Homo sapiens
aucacgaccacu

SEQ ID NO: 477001 - RNA, 18 nt, Homo sapiens
aucacucauuuauuucca

SEQ ID NO: 477002 - RNA, 20 nt, Homo sapiens
aucacuuccuauaugcacuu

SEQ ID NO: 477003 - RNA, 19 nt, Homo sapiens
aucacuucugagaacucau

SEQ ID NO: 477004 - RNA, 19 nt, Homo sapiens
aucacuugacuuugccaca

SEQ ID NO: 477005 - RNA, 21 nt, Homo sapiens
aucaguuagagcugacacaaa

SEQ ID NO: 477006 - RNA, 21 nt, Homo sapiens
aucauauccuaugacccagca

SEQ ID NO: 477007 - RNA, 13 nt, Homo sapiens
aucauguauuuau

SEQ ID NO: 477008 - RNA, 22 nt, Homo sapiens
aucauuccccugcccaccuccu

SEQ ID NO: 477009 - RNA, 14 nt, Homo sapiens
auccaauaccucuu

SEQ ID NO: 477010 - RNA, 17 nt, Homo sapiens
auccaauggauugugca

SEQ ID NO: 477011 - RNA, 15 nt, Homo sapiens
auccacuucuuucag

SEQ ID NO: 477012 - RNA, 16 nt, Homo sapiens
auccagaaauaaugaa

SEQ ID NO: 477013 - RNA, 22 nt, Homo sapiens
auccaugccugggaaaugccac

SEQ ID NO: 477014 - RNA, 17 nt, Homo sapiens
aucccagacuugcugaa

SEQ ID NO: 477015 - RNA, 13 nt, Homo sapiens
auccccaccuacu

SEQ ID NO: 477016 - RNA, 21 nt, Homo sapiens
auccccuugucugaacuggag

SEQ ID NO: 477017 - RNA, 12 nt, Homo sapiens
auccuguucucu

SEQ ID NO: 477018 - RNA, 13 nt, Homo sapiens
aucgagaccaucc

SEQ ID NO: 477019 - RNA, 13 nt, Homo sapiens
aucgcaagagcca

SEQ ID NO: 477020 - RNA, 16 nt, Homo sapiens
aucgcuugaaccuggg

SEQ ID NO: 477021 - RNA, 14 nt, Homo sapiens
aucuaccaacgaaa

SEQ ID NO: 477022 - RNA, 17 nt, Homo sapiens
aucuaccucacuauuca

SEQ ID NO: 477023 - RNA, 17 nt, Homo sapiens
aucuaucaccugucauc

SEQ ID NO: 477024 - RNA, 16 nt, Homo sapiens
aucuaugauaugcuaa

SEQ ID NO: 477025 - RNA, 16 nt, Homo sapiens
aucucccacacaagac

SEQ ID NO: 477026 - RNA, 17 nt, Homo sapiens
aucucggcucauugaac

SEQ ID NO: 477027 - RNA, 22 nt, Homo sapiens
aucucugauucugucaaugucu

SEQ ID NO: 477028 - RNA, 19 nt, Homo sapiens
aucucugucccacuuggca

SEQ ID NO: 477029 - RNA, 13 nt, Homo sapiens
aucugcaaugugg

SEQ ID NO: 477030 - RNA, 17 nt, Homo sapiens
aucugcuuuugguuaua

SEQ ID NO: 477031 - RNA, 14 nt, Homo sapiens
aucuggaaccauca

SEQ ID NO: 477032 - RNA, 16 nt, Homo sapiens
aucugggauauuucca

SEQ ID NO: 477033 - RNA, 16 nt, Homo sapiens
aucuucuuucaugaag

SEQ ID NO: 477034 - RNA, 14 nt, Homo sapiens
augaaaccacugga

SEQ ID NO: 477035 - RNA, 17 nt, Homo sapiens
augaaagaggcauuccc

SEQ ID NO: 477036 - RNA, 22 nt, Homo sapiens
augaacauaaucuaccaacgaa

SEQ ID NO: 477037 - RNA, 15 nt, Homo sapiens
augaagggaugcugc

SEQ ID NO: 477038 - RNA, 13 nt, Homo sapiens
augacauucaugc

SEQ ID NO: 477039 - RNA, 21 nt, Homo sapiens
augaccacauagaacaugugu

SEQ ID NO: 477040 - RNA, 18 nt, Homo sapiens
augaccaguaauugugaa

SEQ ID NO: 477041 - RNA, 10 nt, Homo sapiens
augacuaugc

SEQ ID NO: 477042 - RNA, 18 nt, Homo sapiens
augagacuacuucagaau

SEQ ID NO: 477043 - RNA, 17 nt, Homo sapiens
augaggaauauuugcaa

SEQ ID NO: 477044 - RNA, 22 nt, Homo sapiens
augauccuaaugaaugcauaaa

SEQ ID NO: 477045 - RNA, 18 nt, Homo sapiens
augauugcuuaucaguag

SEQ ID NO: 477046 - RNA, 21 nt, Homo sapiens
augauuuacucaauaucugaa

SEQ ID NO: 477047 - RNA, 16 nt, Homo sapiens
augcaaagucaugcaa

SEQ ID NO: 477048 - RNA, 14 nt, Homo sapiens
augcaaauucucaa

SEQ ID NO: 477049 - RNA, 21 nt, Homo sapiens
augcaagcaagaaacacuggg

SEQ ID NO: 477050 - RNA, 12 nt, Homo sapiens
augcacaguggg

SEQ ID NO: 477051 - RNA, 14 nt, Homo sapiens
augcagcaucuaag

SEQ ID NO: 477052 - RNA, 21 nt, Homo sapiens
augcaguauuguaucauuaau

SEQ ID NO: 477053 - RNA, 23 nt, Homo sapiens
augcauuauuuauugcuguguaa

SEQ ID NO: 477054 - RNA, 16 nt, Homo sapiens
augcauuugcacuauu

SEQ ID NO: 477055 - RNA, 17 nt, Homo sapiens
augccaagcacugugcu

SEQ ID NO: 477056 - RNA, 21 nt, Homo sapiens
augccaagcacugugcucagg

SEQ ID NO: 477057 - RNA, 14 nt, Homo sapiens
augccgcuacaaaa

SEQ ID NO: 477058 - RNA, 14 nt, Homo sapiens
augcuuuucuaauc

SEQ ID NO: 477059 - RNA, 17 nt, Homo sapiens
auggaaaggagaggaaa

SEQ ID NO: 477060 - RNA, 17 nt, Homo sapiens
auggaaauucccuucau

SEQ ID NO: 477061 - RNA, 13 nt, Homo sapiens
auggacagugggc

SEQ ID NO: 477062 - RNA, 17 nt, Homo sapiens
auggacucuucccccac

SEQ ID NO: 477063 - RNA, 22 nt, Homo sapiens
auggacucuucccccacuccuc

SEQ ID NO: 477064 - RNA, 21 nt, Homo sapiens
auggagcuugacuucaugcca

SEQ ID NO: 477065 - RNA, 17 nt, Homo sapiens
auggccaaauguucaau

SEQ ID NO: 477066 - RNA, 19 nt, Homo sapiens
auggccccugccuucccag

SEQ ID NO: 477067 - RNA, 20 nt, Homo sapiens
auggccucaagaucaaugaa

SEQ ID NO: 477068 - RNA, 20 nt, Homo sapiens
auggcuauaaacaauuacau

SEQ ID NO: 477069 - RNA, 16 nt, Homo sapiens
auggcucuacuuucag

SEQ ID NO: 477070 - RNA, 13 nt, Homo sapiens
augggacugaugu

SEQ ID NO: 477071 - RNA, 21 nt, Homo sapiens
augggacugaugucaucuuga

SEQ ID NO: 477072 - RNA, 17 nt, Homo sapiens
augggcagcucaucucu

SEQ ID NO: 477073 - RNA, 19 nt, Homo sapiens
augggguugguguucucau

SEQ ID NO: 477074 - RNA, 23 nt, Homo sapiens
auggguuagggaaaacauuccau

SEQ ID NO: 477075 - RNA, 19 nt, Homo sapiens
auggugaaaauauuugaca

SEQ ID NO: 477076 - RNA, 20 nt, Homo sapiens
augguggggcaugccuguag

SEQ ID NO: 477077 - RNA, 14 nt, Homo sapiens
augguuauaucuaa

SEQ ID NO: 477078 - RNA, 13 nt, Homo sapiens
auguaaauacugu

SEQ ID NO: 477079 - RNA, 14 nt, Homo sapiens
auguaacuggaauc

SEQ ID NO: 477080 - RNA, 17 nt, Homo sapiens
auguaauaaugugaauc

SEQ ID NO: 477081 - RNA, 16 nt, Homo sapiens
auguagauaaagcacu

SEQ ID NO: 477082 - RNA, 23 nt, Homo sapiens
auguagcaaauuccaauacauua

SEQ ID NO: 477083 - RNA, 22 nt, Homo sapiens
auguaguuuuacuugguguuua

SEQ ID NO: 477084 - RNA, 14 nt, Homo sapiens
auguauaugucauc

SEQ ID NO: 477085 - RNA, 22 nt, Homo sapiens
auguaucuaccucacuauucaa

SEQ ID NO: 477086 - RNA, 15 nt, Homo sapiens
auguauguacuucau

SEQ ID NO: 477087 - RNA, 16 nt, Homo sapiens
augucaugucagcucc

SEQ ID NO: 477088 - RNA, 19 nt, Homo sapiens
auguccucuuguugcugag

SEQ ID NO: 477089 - RNA, 19 nt, Homo sapiens
auguccugauuacaaugcu

SEQ ID NO: 477090 - RNA, 16 nt, Homo sapiens
augugagguguugcua

SEQ ID NO: 477091 - RNA, 17 nt, Homo sapiens
augugccucuguccuua

SEQ ID NO: 477092 - RNA, 16 nt, Homo sapiens
augugcucaugcauug

SEQ ID NO: 477093 - RNA, 13 nt, Homo sapiens
augugugauucac

SEQ ID NO: 477094 - RNA, 16 nt, Homo sapiens
augugugauucacagu

SEQ ID NO: 477095 - RNA, 22 nt, Homo sapiens
auguucacuuauugacuauuau

SEQ ID NO: 477096 - RNA, 17 nt, Homo sapiens
auguugacaugggacau

SEQ ID NO: 477097 - RNA, 18 nt, Homo sapiens
auguuuugaaauguacca

SEQ ID NO: 477098 - RNA, 16 nt, Homo sapiens
auuguucgaagacaca

SEQ ID NO: 477099 - RNA, 13 nt, Homo sapiens
auuuaacagagcu

SEQ ID NO: 477100 - RNA, 18 nt, Homo sapiens
auuucauuuuuacccuua

SEQ ID NO: 477101 - RNA, 21 nt, Homo sapiens
auuucuaucccaaacuaagcu

SEQ ID NO: 477102 - RNA, 13 nt, Homo sapiens
auuucuucacuca

SEQ ID NO: 477103 - RNA, 14 nt, Homo sapiens
auuucuucacucaa

SEQ ID NO: 477104 - RNA, 14 nt, Homo sapiens
auuugagacagagu

SEQ ID NO: 477105 - RNA, 15 nt, Homo sapiens
auuugagacagaguc

SEQ ID NO: 477106 - RNA, 15 nt, Homo sapiens
auuugauaguauugu

SEQ ID NO: 477107 - RNA, 23 nt, Homo sapiens
auuugcaaggugaacacuuccuu

SEQ ID NO: 477108 - RNA, 14 nt, Homo sapiens
auuugcucauggaa

SEQ ID NO: 477109 - RNA, 19 nt, Homo sapiens
auuuuaaaagaaugauuau

SEQ ID NO: 477110 - RNA, 21 nt, Homo sapiens
auuuuaguaagagauuccuga

SEQ ID NO: 477111 - RNA, 15 nt, Homo sapiens
auuuuauacauuaac

SEQ ID NO: 477112 - RNA, 21 nt, Homo sapiens
auuuuggggagacaaagggaa

SEQ ID NO: 477113 - RNA, 23 nt, Homo sapiens
auuuuuccccaaaaagaauggga

SEQ ID NO: 477114 - RNA, 16 nt, Homo sapiens
caaaacucaguaucau

SEQ ID NO: 477115 - RNA, 13 nt, Homo sapiens
caaaacuuaggca

SEQ ID NO: 477116 - RNA, 20 nt, Homo sapiens
caaaaugauauguuugagua

SEQ ID NO: 477117 - RNA, 21 nt, Homo sapiens
caaacacauuaagccuuccac

SEQ ID NO: 477118 - RNA, 12 nt, Homo sapiens
caaacacccaug

SEQ ID NO: 477119 - RNA, 20 nt, Homo sapiens
caaacacugcaggcaucaca

SEQ ID NO: 477120 - RNA, 17 nt, Homo sapiens
caaacagaacuauggaa

SEQ ID NO: 477121 - RNA, 21 nt, Homo sapiens
caaaccuugugcucuuuucaa

SEQ ID NO: 477122 - RNA, 17 nt, Homo sapiens
caaacuaagcuauguga

SEQ ID NO: 477123 - RNA, 18 nt, Homo sapiens
caaacuaagcuaugugaa

SEQ ID NO: 477124 - RNA, 23 nt, Homo sapiens
caaacuaccuuccaguuccucau

SEQ ID NO: 477125 - RNA, 21 nt, Homo sapiens
caaacuuaagaaacacugacu

SEQ ID NO: 477126 - RNA, 14 nt, Homo sapiens
caaacuucaagggu

SEQ ID NO: 477127 - RNA, 16 nt, Homo sapiens
caaacuuccagugcaa

SEQ ID NO: 477128 - RNA, 17 nt, Homo sapiens
caaagauccccaaaaca

SEQ ID NO: 477129 - RNA, 13 nt, Homo sapiens
caaagcguggaca

SEQ ID NO: 477130 - RNA, 17 nt, Homo sapiens
caaagcuacuugaagga

SEQ ID NO: 477131 - RNA, 21 nt, Homo sapiens
caaaggcugagaacacuguga

SEQ ID NO: 477132 - RNA, 21 nt, Homo sapiens
caaaggcuuucuuuccaaucc

SEQ ID NO: 477133 - RNA, 18 nt, Homo sapiens
caaagugagacaguccag

SEQ ID NO: 477134 - RNA, 15 nt, Homo sapiens
caaauaaguuacccu

SEQ ID NO: 477135 - RNA, 14 nt, Homo sapiens
caaauaauuuguau

SEQ ID NO: 477136 - RNA, 17 nt, Homo sapiens
caaauaauuuguauacc

SEQ ID NO: 477137 - RNA, 16 nt, Homo sapiens
caaaugcccaagggaa

SEQ ID NO: 477138 - RNA, 20 nt, Homo sapiens
caaauggaagacacauugaa

SEQ ID NO: 477139 - RNA, 17 nt, Homo sapiens
caaauuuucacauaaaa

SEQ ID NO: 477140 - RNA, 22 nt, Homo sapiens
caacaagcaagcucccaaggga

SEQ ID NO: 477141 - RNA, 12 nt, Homo sapiens
caacagaugugu

SEQ ID NO: 477142 - RNA, 14 nt, Homo sapiens
caacagauguguca

SEQ ID NO: 477143 - RNA, 16 nt, Homo sapiens
caacaguuuccaguca

SEQ ID NO: 477144 - RNA, 12 nt, Homo sapiens
caacauagugaa

SEQ ID NO: 477145 - RNA, 15 nt, Homo sapiens
caacauuaaacacaa

SEQ ID NO: 477146 - RNA, 17 nt, Homo sapiens
caacauuaaacacaaag

SEQ ID NO: 477147 - RNA, 22 nt, Homo sapiens
caagacagugccuauacugccu

SEQ ID NO: 477148 - RNA, 10 nt, Homo sapiens
caagacauag

SEQ ID NO: 477149 - RNA, 14 nt, Homo sapiens
caagaccccaaagg

SEQ ID NO: 477150 - RNA, 14 nt, Homo sapiens
caagagcacacuug

SEQ ID NO: 477151 - RNA, 20 nt, Homo sapiens
caagaucacgccacugcacu

SEQ ID NO: 477152 - RNA, 20 nt, Homo sapiens
caagaucacgccauugcacu

SEQ ID NO: 477153 - RNA, 19 nt, Homo sapiens
caagcaagcucccaaggga

SEQ ID NO: 477154 - RNA, 21 nt, Homo sapiens
caagcaagcucccaagggaug

SEQ ID NO: 477155 - RNA, 15 nt, Homo sapiens
caagcagccaaggga

SEQ ID NO: 477156 - RNA, 17 nt, Homo sapiens
caagcagccaagggaug

SEQ ID NO: 477157 - RNA, 18 nt, Homo sapiens
caagccugugauuguguu

SEQ ID NO: 477158 - RNA, 16 nt, Homo sapiens
caaggaaaccacagcu

SEQ ID NO: 477159 - RNA, 14 nt, Homo sapiens
caaggaaauagagg

SEQ ID NO: 477160 - RNA, 18 nt, Homo sapiens
caaggcaaagacuauucc

SEQ ID NO: 477161 - RNA, 19 nt, Homo sapiens
caaggcuggagugcagugg

SEQ ID NO: 477162 - RNA, 18 nt, Homo sapiens
caauaacacacagcuaac

SEQ ID NO: 477163 - RNA, 18 nt, Homo sapiens
caauagaguugggacaau

SEQ ID NO: 477164 - RNA, 13 nt, Homo sapiens
caauagcauccaa

SEQ ID NO: 477165 - RNA, 13 nt, Homo sapiens
caauagugaauga

SEQ ID NO: 477166 - RNA, 16 nt, Homo sapiens
caauaugagucucaau

SEQ ID NO: 477167 - RNA, 18 nt, Homo sapiens
caauaugagucucaauaa

SEQ ID NO: 477168 - RNA, 22 nt, Homo sapiens
caauauguauagcauauggagu

SEQ ID NO: 477169 - RNA, 19 nt, Homo sapiens
caaucaaaugguguuuucu

SEQ ID NO: 477170 - RNA, 22 nt, Homo sapiens
caaucaggcucaaaaccagaga

SEQ ID NO: 477171 - RNA, 18 nt, Homo sapiens
caaucucugauucuguca

SEQ ID NO: 477172 - RNA, 16 nt, Homo sapiens
caaugaaaugauguca

SEQ ID NO: 477173 - RNA, 20 nt, Homo sapiens
caaugaauaacagccucauu

SEQ ID NO: 477174 - RNA, 22 nt, Homo sapiens
caaugcuauaacuauguugaua

SEQ ID NO: 477175 - RNA, 23 nt, Homo sapiens
caaugcuauaacuauguugauaa

SEQ ID NO: 477176 - RNA, 22 nt, Homo sapiens
caauguagucucauaaccagga

SEQ ID NO: 477177 - RNA, 15 nt, Homo sapiens
caauguuacuaucug

SEQ ID NO: 477178 - RNA, 20 nt, Homo sapiens
caauucuaacuuuuuugcua

SEQ ID NO: 477179 - RNA, 13 nt, Homo sapiens
caauuugcugcca

SEQ ID NO: 477180 - RNA, 20 nt, Homo sapiens
cacaaauuugggagggugag

SEQ ID NO: 477181 - RNA, 15 nt, Homo sapiens
cacacagacaggguu

SEQ ID NO: 477182 - RNA, 13 nt, Homo sapiens
cacacagcuaaca

SEQ ID NO: 477183 - RNA, 19 nt, Homo sapiens
cacacaugaguauugugau

SEQ ID NO: 477184 - RNA, 15 nt, Homo sapiens
cacaccaucuuucca

SEQ ID NO: 477185 - RNA, 22 nt, Homo sapiens
cacaccuuauauuuacguauga

SEQ ID NO: 477186 - RNA, 18 nt, Homo sapiens
cacacucaccucuaaaac

SEQ ID NO: 477187 - RNA, 12 nt, Homo sapiens
cacacugaagaa

SEQ ID NO: 477188 - RNA, 20 nt, Homo sapiens
cacagacgccuuacuggcaa

SEQ ID NO: 477189 - RNA, 21 nt, Homo sapiens
cacagagauaauucuagcuuu

SEQ ID NO: 477190 - RNA, 20 nt, Homo sapiens
cacagcaggcuuucaagaag

SEQ ID NO: 477191 - RNA, 22 nt, Homo sapiens
cacagcuguaguaccccaagaa

SEQ ID NO: 477192 - RNA, 13 nt, Homo sapiens
cacagucacaguc

SEQ ID NO: 477193 - RNA, 12 nt, Homo sapiens
cacagugugaau

SEQ ID NO: 477194 - RNA, 22 nt, Homo sapiens
cacauaguagguacccaauuca

SEQ ID NO: 477195 - RNA, 17 nt, Homo sapiens
cacaugccaagcacugu

SEQ ID NO: 477196 - RNA, 18 nt, Homo sapiens
cacaugccaagcacugug

SEQ ID NO: 477197 - RNA, 22 nt, Homo sapiens
cacaugggaguuuagugugaua

SEQ ID NO: 477198 - RNA, 17 nt, Homo sapiens
cacauucgaguguuuca

SEQ ID NO: 477199 - RNA, 24 nt, Homo sapiens
cacauucuuauuaggauuccaccu

SEQ ID NO: 477200 - RNA, 13 nt, Homo sapiens
caucccaggaucg

SEQ ID NO: 477201 - RNA, 17 nt, Homo sapiens
cauccuagucucuauca

SEQ ID NO: 477202 - RNA, 15 nt, Homo sapiens
cauccucaaacacug

SEQ ID NO: 477203 - RNA, 16 nt, Homo sapiens
cauccucaaacacugc

SEQ ID NO: 477204 - RNA, 19 nt, Homo sapiens
cauccuugagucaaaaaau

SEQ ID NO: 477205 - RNA, 18 nt, Homo sapiens
caucgucuuuaaccccaa

SEQ ID NO: 477206 - RNA, 18 nt, Homo sapiens
caucucuggaugccugau

SEQ ID NO: 477207 - RNA, 17 nt, Homo sapiens
caucuugcaaaacuaca

SEQ ID NO: 477208 - RNA, 12 nt, Homo sapiens
caucuuuccauc

SEQ ID NO: 477209 - RNA, 22 nt, Homo sapiens
caugaacaucauggacugagcu

SEQ ID NO: 477210 - RNA, 15 nt, Homo sapiens
caugaccacauagaa

SEQ ID NO: 477211 - RNA, 20 nt, Homo sapiens
caugagugcgugcucaguuc

SEQ ID NO: 477212 - RNA, 15 nt, Homo sapiens
caugccaagcacugu

SEQ ID NO: 477213 - RNA, 22 nt, Homo sapiens
caugcugugugacucaaaccaa

SEQ ID NO: 477214 - RNA, 20 nt, Homo sapiens
caugucaaauugcaaucagg

SEQ ID NO: 477215 - RNA, 12 nt, Homo sapiens
caugucagcucc

SEQ ID NO: 477216 - RNA, 18 nt, Homo sapiens
cauguggcccuccagugu

SEQ ID NO: 477217 - RNA, 22 nt, Homo sapiens
cauguggcccuccaguguauga

SEQ ID NO: 477218 - RNA, 18 nt, Homo sapiens
caugugguuacuaguaca

SEQ ID NO: 477219 - RNA, 15 nt, Homo sapiens
cauuaaacaugacau

SEQ ID NO: 477220 - RNA, 20 nt, Homo sapiens
cauuacagggaaugccugag

SEQ ID NO: 477221 - RNA, 16 nt, Homo sapiens
cauuaccuugugcuaa

SEQ ID NO: 477222 - RNA, 23 nt, Homo sapiens
cauuagauuuggaggcuaccuca

SEQ ID NO: 477223 - RNA, 21 nt, Homo sapiens
cauucaugacugaacugaaaa

SEQ ID NO: 477224 - RNA, 12 nt, Homo sapiens
cauucauuccau

SEQ ID NO: 477225 - RNA, 19 nt, Homo sapiens
cauucauuccauucuggaa

SEQ ID NO: 477226 - RNA, 16 nt, Homo sapiens
cauuccauucuggaag

SEQ ID NO: 477227 - RNA, 18 nt, Homo sapiens
cauugacugauggugaaa

SEQ ID NO: 477228 - RNA, 22 nt, Homo sapiens
ggaugauuauuuucuguucuau

SEQ ID NO: 477229 - RNA, 14 nt, Homo sapiens
ggaugcugcaaugu

SEQ ID NO: 477230 - RNA, 23 nt, Homo sapiens
ggcaacuugggaacuagacuccc

SEQ ID NO: 477231 - RNA, 18 nt, Homo sapiens
ggcaauccagacagcagg

SEQ ID NO: 477232 - RNA, 21 nt, Homo sapiens
ggcaauguucccccucuccuc

SEQ ID NO: 477233 - RNA, 15 nt, Homo sapiens
ggcacaacaucaagc

SEQ ID NO: 477234 - RNA, 23 nt, Homo sapiens
ggcaccacucuccuuucacagag

SEQ ID NO: 477235 - RNA, 22 nt, Homo sapiens
ggcacuaguauuucuaugaaau

SEQ ID NO: 477236 - RNA, 18 nt, Homo sapiens
ggcagagguugcagugaa

SEQ ID NO: 477237 - RNA, 17 nt, Homo sapiens
ggcagauguggcugaac

SEQ ID NO: 477238 - RNA, 16 nt, Homo sapiens
ggcagggaugauggca

SEQ ID NO: 477239 - RNA, 23 nt, Homo sapiens
ggcaucaccuccaccauacucca

SEQ ID NO: 477240 - RNA, 11 nt, Homo sapiens
ggcaugaauau

SEQ ID NO: 477241 - RNA, 15 nt, Homo sapiens
ggcaugacagcuguu

SEQ ID NO: 477242 - RNA, 15 nt, Homo sapiens
ggccaaauguucaau

SEQ ID NO: 477243 - RNA, 18 nt, Homo sapiens
ggccgggcaauccagaca

SEQ ID NO: 477244 - RNA, 20 nt, Homo sapiens
ggccuccucuucuaugcuuu

SEQ ID NO: 477245 - RNA, 22 nt, Homo sapiens
ggccugagaagagagaucaaau

SEQ ID NO: 477246 - RNA, 14 nt, Homo sapiens
ggccuuagaacuuu

SEQ ID NO: 477247 - RNA, 13 nt, Homo sapiens
ggcuacacaggga

SEQ ID NO: 477248 - RNA, 17 nt, Homo sapiens
ggcuaccucaccugggc

SEQ ID NO: 477249 - RNA, 17 nt, Homo sapiens
ggcuagaaccuggagaa

SEQ ID NO: 477250 - RNA, 23 nt, Homo sapiens
ggcuauuauuugacuuguugcug

SEQ ID NO: 477251 - RNA, 18 nt, Homo sapiens
ggcugaaccgagcuggag

SEQ ID NO: 477252 - RNA, 16 nt, Homo sapiens
ggcugagaacacugug

SEQ ID NO: 477253 - RNA, 13 nt, Homo sapiens
ggcugaugcaguu

SEQ ID NO: 477254 - RNA, 20 nt, Homo sapiens
ggcuuacacccacaguggaa

SEQ ID NO: 477255 - RNA, 13 nt, Homo sapiens
ggcuugcugccaa

SEQ ID NO: 477256 - RNA, 24 nt, Homo sapiens
ggcuuuaaaacuuauccuccauga

SEQ ID NO: 477257 - RNA, 19 nt, Homo sapiens
gggaagacuuuaaaccacc

SEQ ID NO: 477258 - RNA, 13 nt, Homo sapiens
gggaaguucaggc

SEQ ID NO: 477259 - RNA, 12 nt, Homo sapiens
gggaaugccuga

SEQ ID NO: 477260 - RNA, 20 nt, Homo sapiens
gggacagagcagaacuuuca

SEQ ID NO: 477261 - RNA, 15 nt, Homo sapiens
gggacugaugucauc

SEQ ID NO: 477262 - RNA, 20 nt, Homo sapiens
gggaggcagagguugcagug

SEQ ID NO: 477263 - RNA, 18 nt, Homo sapiens
gggagucauggacaugaa

SEQ ID NO: 477264 - RNA, 20 nt, Homo sapiens
gggagugcccccaacagcac

SEQ ID NO: 477265 - RNA, 16 nt, Homo sapiens
gggauaucuacugugg

SEQ ID NO: 477266 - RNA, 21 nt, Homo sapiens
gggcaccaagaccccaaaggg

SEQ ID NO: 477267 - RNA, 16 nt, Homo sapiens
gggcuuuuacaccagu

SEQ ID NO: 477268 - RNA, 12 nt, Homo sapiens
ggggacagggau

SEQ ID NO: 477269 - RNA, 13 nt, Homo sapiens
ggggaggggcgcu

SEQ ID NO: 477270 - RNA, 23 nt, Homo sapiens
gggggaagacuuuaaaccaccua

SEQ ID NO: 477271 - RNA, 17 nt, Homo sapiens
ggggucuggacaugugg

SEQ ID NO: 477272 - RNA, 16 nt, Homo sapiens
gggguugguguucuca

SEQ ID NO: 477273 - RNA, 12 nt, Homo sapiens
ggguccaagugg

SEQ ID NO: 477274 - RNA, 13 nt, Homo sapiens
ggguccccaagga

SEQ ID NO: 477275 - RNA, 20 nt, Homo sapiens
ggucucaggagaagggauag

SEQ ID NO: 477276 - RNA, 17 nt, Homo sapiens
ggugauggggcugagca

SEQ ID NO: 477277 - RNA, 18 nt, Homo sapiens
ggugcagaccuuggggga

SEQ ID NO: 477278 - RNA, 15 nt, Homo sapiens
ggugcccuccuaucc

SEQ ID NO: 477279 - RNA, 14 nt, Homo sapiens
ggugggacagggac

SEQ ID NO: 477280 - RNA, 20 nt, Homo sapiens
ggugggcuucccaguggcug

SEQ ID NO: 477281 - RNA, 13 nt, Homo sapiens
gguguugacaugu

SEQ ID NO: 477282 - RNA, 15 nt, Homo sapiens
gguuaucugggcaua

SEQ ID NO: 477283 - RNA, 21 nt, Homo sapiens
gguuggaaagaguugccauaa

SEQ ID NO: 477284 - RNA, 14 nt, Homo sapiens
gguugguguucuca

SEQ ID NO: 477285 - RNA, 22 nt, Homo sapiens
gguuuuccaucuuaucugucuu

SEQ ID NO: 477286 - RNA, 17 nt, Homo sapiens
guaaacauuaguucuau

SEQ ID NO: 477287 - RNA, 16 nt, Homo sapiens
guaaagcuuugugcag

SEQ ID NO: 477288 - RNA, 18 nt, Homo sapiens
guaaauuuucaagcagca

SEQ ID NO: 477289 - RNA, 19 nt, Homo sapiens
guaacuggaaucucaaaag

SEQ ID NO: 477290 - RNA, 14 nt, Homo sapiens
guaaguaaugauac

SEQ ID NO: 477291 - RNA, 13 nt, Homo sapiens
guaauucucaggc

SEQ ID NO: 477292 - RNA, 21 nt, Homo sapiens
guacacagacuauugacauca

SEQ ID NO: 477293 - RNA, 16 nt, Homo sapiens
guacacugccuucuca

SEQ ID NO: 477294 - RNA, 13 nt, Homo sapiens
guacagucuugca

SEQ ID NO: 477295 - RNA, 18 nt, Homo sapiens
guacauuagucauucaau

SEQ ID NO: 477296 - RNA, 23 nt, Homo sapiens
guacccuaaggucauuaccacag

SEQ ID NO: 477297 - RNA, 14 nt, Homo sapiens
guagagaugugauu

SEQ ID NO: 477298 - RNA, 16 nt, Homo sapiens
guagagggcacugggu

SEQ ID NO: 477299 - RNA, 14 nt, Homo sapiens
guagcaaauuccaa

SEQ ID NO: 477300 - RNA, 11 nt, Homo sapiens
guagcugcuac

SEQ ID NO: 477301 - RNA, 14 nt, Homo sapiens
guagcugcuaccuu

SEQ ID NO: 477302 - RNA, 13 nt, Homo sapiens
guaggacugcuga

SEQ ID NO: 477303 - RNA, 19 nt, Homo sapiens
guagguaauauugcaaggc

SEQ ID NO: 477304 - RNA, 15 nt, Homo sapiens
guaguaccccaagaa

SEQ ID NO: 477305 - RNA, 19 nt, Homo sapiens
guaucuaccucacuauuca

SEQ ID NO: 477306 - RNA, 20 nt, Homo sapiens
guaugcacuaaucaauacuu

SEQ ID NO: 477307 - RNA, 16 nt, Homo sapiens
guauggagcucagaga

SEQ ID NO: 477308 - RNA, 17 nt, Homo sapiens
guauguaacuacaggaa

SEQ ID NO: 477309 - RNA, 23 nt, Homo sapiens
guauguuugggagacugcugagu

SEQ ID NO: 477310 - RNA, 21 nt, Homo sapiens
guauuuuaggcagggauuuga

SEQ ID NO: 477311 - RNA, 21 nt, Homo sapiens
gucaauccaagagucugauga

SEQ ID NO: 477312 - RNA, 17 nt, Homo sapiens
gucacaauuaaugaaau

SEQ ID NO: 477313 - RNA, 22 nt, Homo sapiens
gucacccaggcuggagugcagu

SEQ ID NO: 477314 - RNA, 23 nt, Homo sapiens
gucaucaggagaaaaagccucca

SEQ ID NO: 477315 - RNA, 14 nt, Homo sapiens
gucaugcaaaggcu

SEQ ID NO: 477316 - RNA, 18 nt, Homo sapiens
gucaugcguuuaaucaca

SEQ ID NO: 477317 - RNA, 17 nt, Homo sapiens
guccacaggaagugaag

SEQ ID NO: 477318 - RNA, 15 nt, Homo sapiens
gucccagcuacucag

SEQ ID NO: 477319 - RNA, 14 nt, Homo sapiens
guccuugaugcuca

SEQ ID NO: 477320 - RNA, 15 nt, Homo sapiens
guccuugucgcugug

SEQ ID NO: 477321 - RNA, 16 nt, Homo sapiens
gucgucuuaacucacc

SEQ ID NO: 477322 - RNA, 23 nt, Homo sapiens
gucuaaaaauaaaaugcauuuaa

SEQ ID NO: 477323 - RNA, 16 nt, Homo sapiens
gucuaaagagcuuuag

SEQ ID NO: 477324 - RNA, 15 nt, Homo sapiens
gucuggcaucuccca

SEQ ID NO: 477325 - RNA, 15 nt, Homo sapiens
gucugggcaccaccu

SEQ ID NO: 477326 - RNA, 16 nt, Homo sapiens
gucugggcaccaccuc

SEQ ID NO: 477327 - RNA, 23 nt, Homo sapiens
gucuuaucaagcagccaagggau

SEQ ID NO: 477328 - RNA, 12 nt, Homo sapiens
gugaacagggaa

SEQ ID NO: 477329 - RNA, 23 nt, Homo sapiens
gugacaugaacccauccaaugga

SEQ ID NO: 477330 - RNA, 17 nt, Homo sapiens
gugaguggaaauggaaa

SEQ ID NO: 477331 - RNA, 14 nt, Homo sapiens
gugaguuaauuuaa

SEQ ID NO: 477332 - RNA, 14 nt, Homo sapiens
gugaucacagcagc

SEQ ID NO: 477333 - RNA, 18 nt, Homo sapiens
gugcaaagauuugcuuua

SEQ ID NO: 477334 - RNA, 17 nt, Homo sapiens
gugcagaccuuggggga

SEQ ID NO: 477335 - RNA, 22 nt, Homo sapiens
gugcaugccuggcacaacauca

SEQ ID NO: 477336 - RNA, 20 nt, Homo sapiens
gugccacaaauaaaauggau

SEQ ID NO: 477337 - RNA, 18 nt, Homo sapiens
gugcuggccucucugaca

SEQ ID NO: 477338 - RNA, 20 nt, Homo sapiens
guggagccaauccacuccuu

SEQ ID NO: 477339 - RNA, 23 nt, Homo sapiens
guggcaaaagacauccucaaaag

SEQ ID NO: 477340 - RNA, 22 nt, Homo sapiens
guggcagaauggggugcaugaa

SEQ ID NO: 477341 - RNA, 19 nt, Homo sapiens
gugguguuaaucauuucau

SEQ ID NO: 477342 - RNA, 23 nt, Homo sapiens
guguauuuaaccuugaaggguuc

SEQ ID NO: 477343 - RNA, 21 nt, Homo sapiens
gugugaacagggaacucagaa

SEQ ID NO: 477344 - RNA, 22 nt, Homo sapiens
gugugguugcucacagcuguaa

SEQ ID NO: 477345 - RNA, 20 nt, Homo sapiens
guguuggaaaaugugcaaua

SEQ ID NO: 477346 - RNA, 13 nt, Homo sapiens
guuagaaaugcaa

SEQ ID NO: 477347 - RNA, 11 nt, Homo sapiens
guucaaaaaga

SEQ ID NO: 477348 - RNA, 23 nt, Homo sapiens
guucaaaccaaucaaaugguguu

SEQ ID NO: 477349 - RNA, 21 nt, Homo sapiens
guucagaaucacuucugagaa

SEQ ID NO: 477350 - RNA, 21 nt, Homo sapiens
guucccacucccucucuugcc

SEQ ID NO: 477351 - RNA, 22 nt, Homo sapiens
guucccacucccucucuugccg

SEQ ID NO: 477352 - RNA, 13 nt, Homo sapiens
guuccccuggaaa

SEQ ID NO: 477353 - RNA, 13 nt, Homo sapiens
guuccucuuugca

SEQ ID NO: 477354 - RNA, 22 nt, Homo sapiens
guucugagauuauuuuaaucua

SEQ ID NO: 477355 - RNA, 18 nt, Homo sapiens
guugauguuggcugggaa

SEQ ID NO: 477356 - RNA, 17 nt, Homo sapiens
guugcacggcugcugag

SEQ ID NO: 477357 - RNA, 19 nt, Homo sapiens
uuacaguuuaucuauggca

SEQ ID NO: 477358 - RNA, 16 nt, Homo sapiens
uuaccuugugcuaauc

SEQ ID NO: 477359 - RNA, 23 nt, Homo sapiens
uuacuaguacagguuuugcccug

SEQ ID NO: 477360 - RNA, 14 nt, Homo sapiens
uuacuaucauguca

SEQ ID NO: 477361 - RNA, 23 nt, Homo sapiens
uuacuauuuauugcugaaugacu

SEQ ID NO: 477362 - RNA, 13 nt, Homo sapiens
uuagaaaugcaaa

SEQ ID NO: 477363 - RNA, 21 nt, Homo sapiens
uuagacuuaauagaaacauug

SEQ ID NO: 477364 - RNA, 20 nt, Homo sapiens
uuagaggaucccucucugga

SEQ ID NO: 477365 - RNA, 20 nt, Homo sapiens
uuagauauaauaaauuugga

SEQ ID NO: 477366 - RNA, 12 nt, Homo sapiens
uuagaugcaguu

SEQ ID NO: 477367 - RNA, 22 nt, Homo sapiens
uuagcaguuuugugauaaguuc

SEQ ID NO: 477368 - RNA, 17 nt, Homo sapiens
uuaguccaauuccuugc

SEQ ID NO: 477369 - RNA, 15 nt, Homo sapiens
uuagucgagccaagu

SEQ ID NO: 477370 - RNA, 13 nt, Homo sapiens
uuauaaaaucaaa

SEQ ID NO: 477371 - RNA, 23 nt, Homo sapiens
uuauaaagggagauaacaaucug

SEQ ID NO: 477372 - RNA, 12 nt, Homo sapiens
uuauaaucuuuc

SEQ ID NO: 477373 - RNA, 12 nt, Homo sapiens
uuauaaucuuuu

SEQ ID NO: 477374 - RNA, 18 nt, Homo sapiens
uuauagccgaaaugaucu

SEQ ID NO: 477375 - RNA, 12 nt, Homo sapiens
uuaucaguccaa

SEQ ID NO: 477376 - RNA, 17 nt, Homo sapiens
uuaucuaaaucaccaga

SEQ ID NO: 477377 - RNA, 13 nt, Homo sapiens
uuaucuauggcac

SEQ ID NO: 477378 - RNA, 18 nt, Homo sapiens
uuaucucacuugugccaa

SEQ ID NO: 477379 - RNA, 20 nt, Homo sapiens
uuaugagaugccugaagcca

SEQ ID NO: 477380 - RNA, 11 nt, Homo sapiens
uuaugugcaau

SEQ ID NO: 477381 - RNA, 14 nt, Homo sapiens
uuauucucaagaag

SEQ ID NO: 477382 - RNA, 17 nt, Homo sapiens
uuauuuuuuuacuuccu

SEQ ID NO: 477383 - RNA, 17 nt, Homo sapiens
uucaaaauguacuaugu

SEQ ID NO: 477384 - RNA, 22 nt, Homo sapiens
uucaaaccaaucaaaugguguu

SEQ ID NO: 477385 - RNA, 18 nt, Homo sapiens
uucaaacuuccagugcaa

SEQ ID NO: 477386 - RNA, 15 nt, Homo sapiens
uucaacaucuaguga

SEQ ID NO: 477387 - RNA, 15 nt, Homo sapiens
uucaaccuacuuuca

SEQ ID NO: 477388 - RNA, 22 nt, Homo sapiens
uucaacugccauguuuugccac

SEQ ID NO: 477389 - RNA, 15 nt, Homo sapiens
uucaaguacuguaac

SEQ ID NO: 477390 - RNA, 19 nt, Homo sapiens
uucaauaaaaguaaacuca

SEQ ID NO: 477391 - RNA, 15 nt, Homo sapiens
uucaauaaaccacaa

SEQ ID NO: 477392 - RNA, 20 nt, Homo sapiens
uucaauaaaccacaagcauc

SEQ ID NO: 477393 - RNA, 14 nt, Homo sapiens
uucacacaauacaa

SEQ ID NO: 477394 - RNA, 16 nt, Homo sapiens
uucacagaugugugau

SEQ ID NO: 477395 - RNA, 17 nt, Homo sapiens
uucacagaugugugauu

SEQ ID NO: 477396 - RNA, 16 nt, Homo sapiens
uucacaugccuauaau

SEQ ID NO: 477397 - RNA, 21 nt, Homo sapiens
uucaccugggcugaggcaucc

SEQ ID NO: 477398 - RNA, 16 nt, Homo sapiens
uucacuuauugacuau

SEQ ID NO: 477399 - RNA, 13 nt, Homo sapiens
uucagcaagguga

SEQ ID NO: 477400 - RNA, 19 nt, Homo sapiens
uucaggcucugagacacac

SEQ ID NO: 477401 - RNA, 17 nt, Homo sapiens
uucauaacagaacaaga

SEQ ID NO: 477402 - RNA, 19 nt, Homo sapiens
uucauaauuucuucacuca

SEQ ID NO: 477403 - RNA, 23 nt, Homo sapiens
uucauucucacucugcuuugcau

SEQ ID NO: 477404 - RNA, 16 nt, Homo sapiens
uuccaagcaaguauua

SEQ ID NO: 477405 - RNA, 21 nt, Homo sapiens
uuccaggggucaccuugagag

SEQ ID NO: 477406 - RNA, 22 nt, Homo sapiens
uucccaaaagcccauucauucc

SEQ ID NO: 477407 - RNA, 13 nt, Homo sapiens
uucccaacuccag

SEQ ID NO: 477408 - RNA, 11 nt, Homo sapiens
uucccaccacc

SEQ ID NO: 477409 - RNA, 24 nt, Homo sapiens
uucccacucccucucuugccgaca

SEQ ID NO: 477410 - RNA, 15 nt, Homo sapiens
uucccacuuugccac

SEQ ID NO: 477411 - RNA, 12 nt, Homo sapiens
uucccaugcauu

SEQ ID NO: 477412 - RNA, 21 nt, Homo sapiens
uuccccugcucacucuuccac

SEQ ID NO: 477413 - RNA, 20 nt, Homo sapiens
uucccuauuuugccaguggg

SEQ ID NO: 477414 - RNA, 22 nt, Homo sapiens
uucccuccucgggcuucucgcc

SEQ ID NO: 477415 - RNA, 22 nt, Homo sapiens
uucccuucaucuggaaccauca

SEQ ID NO: 477416 - RNA, 23 nt, Homo sapiens
uuccucccaaaggcuuucuuucc

SEQ ID NO: 477417 - RNA, 14 nt, Homo sapiens
uuccuuuaauccca

SEQ ID NO: 477418 - RNA, 13 nt, Homo sapiens
uucuaaucaaagc

SEQ ID NO: 477419 - RNA, 20 nt, Homo sapiens
uucuacaucaauaucauccc

SEQ ID NO: 477420 - RNA, 16 nt, Homo sapiens
uucuaguugcuuguaa

SEQ ID NO: 477421 - RNA, 15 nt, Homo sapiens
uucucaagaagaaca

SEQ ID NO: 477422 - RNA, 22 nt, Homo sapiens
uucucauccuuccucauuugca

SEQ ID NO: 477423 - RNA, 17 nt, Homo sapiens
uucuccagacaggguuc

SEQ ID NO: 477424 - RNA, 15 nt, Homo sapiens
uucucccucauuuca

SEQ ID NO: 477425 - RNA, 16 nt, Homo sapiens
uucucuaccucauggg

SEQ ID NO: 477426 - RNA, 19 nt, Homo sapiens
uucugauacguguaugaga

SEQ ID NO: 477427 - RNA, 22 nt, Homo sapiens
uucugcacauaaguuaugguuu

SEQ ID NO: 477428 - RNA, 19 nt, Homo sapiens
uucugcuaccucacugggg

SEQ ID NO: 477429 - RNA, 17 nt, Homo sapiens
uucugucacucaccacu

SEQ ID NO: 477430 - RNA, 16 nt, Homo sapiens
uucuuacaaacaugug

SEQ ID NO: 477431 - RNA, 17 nt, Homo sapiens
uucuucacucaaucucu

SEQ ID NO: 477432 - RNA, 13 nt, Homo sapiens
uucuucuaccaga

SEQ ID NO: 477433 - RNA, 22 nt, Homo sapiens
uucuugugccucagccucccaa

SEQ ID NO: 477434 - RNA, 16 nt, Homo sapiens
uugacagaacacuguc

SEQ ID NO: 477435 - RNA, 20 nt, Homo sapiens
uugacaucagcaucaccuag

SEQ ID NO: 477436 - RNA, 20 nt, Homo sapiens
uugacuauuauagaauggaa

SEQ ID NO: 477437 - RNA, 15 nt, Homo sapiens
uugacucuccagaaa

SEQ ID NO: 477438 - RNA, 15 nt, Homo sapiens
uugacugugauuuau

SEQ ID NO: 477439 - RNA, 14 nt, Homo sapiens
uugacuucaugcca

SEQ ID NO: 477440 - RNA, 20 nt, Homo sapiens
uugacuuugccacauccauu

SEQ ID NO: 477441 - RNA, 14 nt, Homo sapiens
uugaggacacugau

SEQ ID NO: 477442 - RNA, 15 nt, Homo sapiens
uugaguauugcugau

SEQ ID NO: 477443 - RNA, 21 nt, Homo sapiens
uugaguccacgcccaccagcc

SEQ ID NO: 477444 - RNA, 11 nt, Homo sapiens
uugauaccagu

SEQ ID NO: 477445 - RNA, 16 nt, Homo sapiens
uugauaguauugugca

SEQ ID NO: 477446 - RNA, 18 nt, Homo sapiens
uugaucacucuuugcaca

SEQ ID NO: 477447 - RNA, 17 nt, Homo sapiens
uugauuguuguuauuaa

SEQ ID NO: 477448 - RNA, 21 nt, Homo sapiens
uugcaaggcaaagacuauucc

SEQ ID NO: 477449 - RNA, 22 nt, Homo sapiens
uugcacauaguagguacccaau

SEQ ID NO: 477450 - RNA, 15 nt, Homo sapiens
uugcaccauugcacu

SEQ ID NO: 477451 - RNA, 17 nt, Homo sapiens
uugcauauguaugacuc

SEQ ID NO: 477452 - RNA, 21 nt, Homo sapiens
uugcaucagcaacaaccagca

SEQ ID NO: 477453 - RNA, 17 nt, Homo sapiens
uugcccacagcuguaug

SEQ ID NO: 477454 - RNA, 19 nt, Homo sapiens
uuggaagugugugaucugu

SEQ ID NO: 477455 - RNA, 16 nt, Homo sapiens
uuggacuuccauuugg

SEQ ID NO: 477456 - RNA, 16 nt, Homo sapiens
uuggacuugaggauuu

SEQ ID NO: 477457 - RNA, 23 nt, Homo sapiens
uuggaggagcaaaggcugagaac

SEQ ID NO: 477458 - RNA, 13 nt, Homo sapiens
uuggcacacagca

SEQ ID NO: 477459 - RNA, 23 nt, Homo sapiens
uuggcacagccauacggcacuga

SEQ ID NO: 477460 - RNA, 21 nt, Homo sapiens
uuggccuauuccauucuggau

SEQ ID NO: 477461 - RNA, 13 nt, Homo sapiens
uuggggcuuuuac

SEQ ID NO: 477462 - RNA, 16 nt, Homo sapiens
uuggugcuaaaccaca

SEQ ID NO: 477463 - RNA, 14 nt, Homo sapiens
uugguggguuuuga

SEQ ID NO: 477464 - RNA, 13 nt, Homo sapiens
uugguguucucau

SEQ ID NO: 477465 - RNA, 12 nt, Homo sapiens
uugucacaggac

SEQ ID NO: 477466 - RNA, 18 nt, Homo sapiens
uugugaaugugagguguu

SEQ ID NO: 477467 - RNA, 15 nt, Homo sapiens
uuguuauuuguacag

SEQ ID NO: 477468 - RNA, 15 nt, Homo sapiens
uuguucagaugcuuc

SEQ ID NO: 477469 - RNA, 17 nt, Homo sapiens
uuuaaagcuugcucaca

SEQ ID NO: 477470 - RNA, 15 nt, Homo sapiens
uuuaaaugauguuga

SEQ ID NO: 477471 - RNA, 14 nt, Homo sapiens
uuuaaucacauucg

SEQ ID NO: 477472 - RNA, 13 nt, Homo sapiens
uuuacuuccucag

SEQ ID NO: 477473 - RNA, 22 nt, Homo sapiens
uuuagauggcuguaaaucuauu

SEQ ID NO: 477474 - RNA, 22 nt, Homo sapiens
uuuauaaaagaaggaaaagaua

SEQ ID NO: 477475 - RNA, 13 nt, Homo sapiens
uuuauccaugcca

SEQ ID NO: 477476 - RNA, 21 nt, Homo sapiens
uuuaucuauggcacccaugca

SEQ ID NO: 477477 - RNA, 13 nt, Homo sapiens
uuuauuauauaua

SEQ ID NO: 477478 - RNA, 13 nt, Homo sapiens
uuuauuccaaaau

SEQ ID NO: 477479 - RNA, 21 nt, Homo sapiens
uuuauucgccugauaagaaua

SEQ ID NO: 477480 - RNA, 16 nt, Homo sapiens
uuuauuugagacagag

SEQ ID NO: 477481 - RNA, 14 nt, Homo sapiens
uuucaccuucauau

SEQ ID NO: 477482 - RNA, 19 nt, Homo sapiens
uuucacuuaauaaugugua

SEQ ID NO: 477483 - RNA, 18 nt, Homo sapiens
uuucagcuguuucaccau

SEQ ID NO: 477484 - RNA, 22 nt, Homo sapiens
uuuccaauccuuuauagcuuug

SEQ ID NO: 477485 - RNA, 16 nt, Homo sapiens
uuuccauaaucacuca

SEQ ID NO: 477486 - RNA, 20 nt, Homo sapiens
uuuccuggacuuaacucuaa

SEQ ID NO: 477487 - RNA, 18 nt, Homo sapiens
uuugagacagagucucac

SEQ ID NO: 477488 - RNA, 18 nt, Homo sapiens
uuugaggagcagcuucag

SEQ ID NO: 477489 - RNA, 13 nt, Homo sapiens
uuugaguauugcu

SEQ ID NO: 477490 - RNA, 18 nt, Homo sapiens
uuugccagugggaacucc

SEQ ID NO: 477491 - RNA, 16 nt, Homo sapiens
uuugcccaccagauca

SEQ ID NO: 477492 - RNA, 22 nt, Homo sapiens
uuugccuuuccauaaucacuca

SEQ ID NO: 477493 - RNA, 12 nt, Homo sapiens
uuugcucaugga

SEQ ID NO: 477494 - RNA, 22 nt, Homo sapiens
uuuggaaaucacacgucuggcu

SEQ ID NO: 477495 - RNA, 20 nt, Homo sapiens
uuugggaacugcaauaaccu

SEQ ID NO: 477496 - RNA, 17 nt, Homo sapiens
uuugggacaaaacagaa

SEQ ID NO: 477497 - RNA, 22 nt, Homo sapiens
uuugugaaugugagguguugcu

SEQ ID NO: 477498 - RNA, 19 nt, Homo sapiens
uuuguugugucuugcuaua

SEQ ID NO: 477499 - RNA, 18 nt, Homo sapiens
uuuuaaaagaaugauuau

SEQ ID NO: 477500 - RNA, 17 nt, Homo sapiens
uuuuaacaacuaugauu

SEQ ID NO: 477501 - RNA, 22 nt, Homo sapiens
uuuuauuugagacagagucuca

SEQ ID NO: 477502 - RNA, 19 nt, Homo sapiens
uuuucaaauaggaugcauu

SEQ ID NO: 477503 - RNA, 19 nt, Homo sapiens
uuuuccagcuccucaucca

SEQ ID NO: 477504 - RNA, 13 nt, Homo sapiens
uuuucccaccacc

SEQ ID NO: 477505 - RNA, 12 nt, Homo sapiens
uuuugacaucaa

SEQ ID NO: 477506 - RNA, 13 nt, Homo sapiens
uuuugacugugau

SEQ ID NO: 477507 - RNA, 16 nt, Homo sapiens
uuuuuaugugcaauaa

SEQ ID NO: 477508 - RNA, 19 nt, Homo sapiens
uaugucacccaaugcauau

SEQ ID NO: 477509 - RNA, 20 nt, Homo sapiens
uaugucacccaaugcauauc

SEQ ID NO: 477510 - RNA, 16 nt, Homo sapiens
uauuaaaaaaguggug

SEQ ID NO: 477511 - RNA, 20 nt, Homo sapiens
aucuaaaacauguagaaaaa

SEQ ID NO: 477512 - RNA, 23 nt, Homo sapiens
aucuacauacacaguggccaagc

SEQ ID NO: 477513 - RNA, 18 nt, Homo sapiens
aucuaucaccugucauca

SEQ ID NO: 477514 - RNA, 14 nt, Homo sapiens
aucucaauucuucc

SEQ ID NO: 477515 - RNA, 19 nt, Homo sapiens
aucucagcuggaucuccau

SEQ ID NO: 477516 - RNA, 19 nt, Homo sapiens
aucucauuuccaagcaagu

SEQ ID NO: 477517 - RNA, 15 nt, Homo sapiens
aucuccauucucuca

SEQ ID NO: 477518 - RNA, 14 nt, Homo sapiens
aucucgacucacug

SEQ ID NO: 477519 - RNA, 21 nt, Homo sapiens
aucucuuccuccgaggccagu

SEQ ID NO: 477520 - RNA, 20 nt, Homo sapiens
aucugaguugacuugacaga

SEQ ID NO: 477521 - RNA, 20 nt, Homo sapiens
aucuuugcaagaaagucaga

SEQ ID NO: 477522 - RNA, 15 nt, Homo sapiens
augaaaccacuggaa

SEQ ID NO: 477523 - RNA, 20 nt, Homo sapiens
augaaaccccguuucuacua

SEQ ID NO: 477524 - RNA, 16 nt, Homo sapiens
augaaauguaaauacu

SEQ ID NO: 477525 - RNA, 14 nt, Homo sapiens
augaacccauccaa

SEQ ID NO: 477526 - RNA, 18 nt, Homo sapiens
augaacccauccaaugga

SEQ ID NO: 477527 - RNA, 20 nt, Homo sapiens
augaacccauccaauggauu

SEQ ID NO: 477528 - RNA, 14 nt, Homo sapiens
augaacuuuccaca

SEQ ID NO: 477529 - RNA, 16 nt, Homo sapiens
augaagcaaacacauu

SEQ ID NO: 477530 - RNA, 16 nt, Homo sapiens
augaauaaaacauuug

SEQ ID NO: 477531 - RNA, 16 nt, Homo sapiens
augaauaauacauuga

SEQ ID NO: 477532 - RNA, 18 nt, Homo sapiens
augaauaauacauugaau

SEQ ID NO: 477533 - RNA, 15 nt, Homo sapiens
augaaugcaauagua

SEQ ID NO: 477534 - RNA, 19 nt, Homo sapiens
augacuuuauccugagucc

SEQ ID NO: 477535 - RNA, 14 nt, Homo sapiens
augagacuacuuca

SEQ ID NO: 477536 - RNA, 23 nt, Homo sapiens
augagcuuuauguaauaauguga

SEQ ID NO: 477537 - RNA, 15 nt, Homo sapiens
augauaacuggaaac

SEQ ID NO: 477538 - RNA, 15 nt, Homo sapiens
augauacagagggau

SEQ ID NO: 477539 - RNA, 13 nt, Homo sapiens
augauaugaccag

SEQ ID NO: 477540 - RNA, 14 nt, Homo sapiens
augaucaguaugaa

SEQ ID NO: 477541 - RNA, 16 nt, Homo sapiens
augauccuaaugaaug

SEQ ID NO: 477542 - RNA, 18 nt, Homo sapiens
augauccuaaugaaugca

SEQ ID NO: 477543 - RNA, 13 nt, Homo sapiens
augaucugucaaa

SEQ ID NO: 477544 - RNA, 13 nt, Homo sapiens
augaucuuuucaa

SEQ ID NO: 477545 - RNA, 20 nt, Homo sapiens
augauggcuuuaccuuuauu

SEQ ID NO: 477546 - RNA, 19 nt, Homo sapiens
augaugucguuugaaucac

SEQ ID NO: 477547 - RNA, 23 nt, Homo sapiens
augauucacccccaaacagugac

SEQ ID NO: 477548 - RNA, 17 nt, Homo sapiens
augcaacaacauguaua

SEQ ID NO: 477549 - RNA, 18 nt, Homo sapiens
augcaaccuuuggaugca

SEQ ID NO: 477550 - RNA, 22 nt, Homo sapiens
augcaaccuuuggaugcacuuu

SEQ ID NO: 477551 - RNA, 24 nt, Homo sapiens
augcaaccuuuggaugcacuuuau

SEQ ID NO: 477552 - RNA, 13 nt, Homo sapiens
augcaagauuuag

SEQ ID NO: 477553 - RNA, 16 nt, Homo sapiens
augcagcaaaauguga

SEQ ID NO: 477554 - RNA, 17 nt, Homo sapiens
augcagcaaaaugugaa

SEQ ID NO: 477555 - RNA, 13 nt, Homo sapiens
augcagcaucuaa

SEQ ID NO: 477556 - RNA, 18 nt, Homo sapiens
augcaguauugagcacug

SEQ ID NO: 477557 - RNA, 15 nt, Homo sapiens
augcauaaaauguua

SEQ ID NO: 477558 - RNA, 18 nt, Homo sapiens
augcauggaaauucccuu

SEQ ID NO: 477559 - RNA, 12 nt, Homo sapiens
augcauucugag

SEQ ID NO: 477560 - RNA, 18 nt, Homo sapiens
augccaagcacugugcuc

SEQ ID NO: 477561 - RNA, 17 nt, Homo sapiens
augccacucagaaucuc

SEQ ID NO: 477562 - RNA, 22 nt, Homo sapiens
augccucauuaccuugugcuaa

SEQ ID NO: 477563 - RNA, 20 nt, Homo sapiens
augccuuuucccaacuccag

SEQ ID NO: 477564 - RNA, 20 nt, Homo sapiens
augcuacugcugccuaguua

SEQ ID NO: 477565 - RNA, 14 nt, Homo sapiens
augcuuauaggugg

SEQ ID NO: 477566 - RNA, 13 nt, Homo sapiens
auggaagcauauu

SEQ ID NO: 477567 - RNA, 23 nt, Homo sapiens
auggagcuguauaacugugcaga

SEQ ID NO: 477568 - RNA, 14 nt, Homo sapiens
auggagugccugua

SEQ ID NO: 477569 - RNA, 18 nt, Homo sapiens
auggaugagacuacuuca

SEQ ID NO: 477570 - RNA, 16 nt, Homo sapiens
auggcacccaugcacc

SEQ ID NO: 477571 - RNA, 17 nt, Homo sapiens
auggcacccaugcaccu

SEQ ID NO: 477572 - RNA, 18 nt, Homo sapiens
auggcuggagugauucug

SEQ ID NO: 477573 - RNA, 19 nt, Homo sapiens
augggagacuccaucucaa

SEQ ID NO: 477574 - RNA, 18 nt, Homo sapiens
augggagccucagacuca

SEQ ID NO: 477575 - RNA, 15 nt, Homo sapiens
augggcagcucaucu

SEQ ID NO: 477576 - RNA, 20 nt, Homo sapiens
auggguuagggaaaacauuc

SEQ ID NO: 477577 - RNA, 21 nt, Homo sapiens
auggguuucuccagagggaau

SEQ ID NO: 477578 - RNA, 18 nt, Homo sapiens
auggugaaaauauuugac

SEQ ID NO: 477579 - RNA, 14 nt, Homo sapiens
auggugaaaugcag

SEQ ID NO: 477580 - RNA, 14 nt, Homo sapiens
auguaacuacagga

SEQ ID NO: 477581 - RNA, 18 nt, Homo sapiens
auguaagaaucauuguaa

SEQ ID NO: 477582 - RNA, 16 nt, Homo sapiens
auguaauaaugugaau

SEQ ID NO: 477583 - RNA, 22 nt, Homo sapiens
auguacccuaaggucauuacca

SEQ ID NO: 477584 - RNA, 15 nt, Homo sapiens
auguaucuaccucac

SEQ ID NO: 477585 - RNA, 12 nt, Homo sapiens
augucagcuuau

SEQ ID NO: 477586 - RNA, 19 nt, Homo sapiens
augugagguguugcuaaau

SEQ ID NO: 477587 - RNA, 19 nt, Homo sapiens
augugggucaaggaauuaa

SEQ ID NO: 477588 - RNA, 12 nt, Homo sapiens
auguuagugcaa

SEQ ID NO: 477589 - RNA, 15 nt, Homo sapiens
auguucacuguggca

SEQ ID NO: 477590 - RNA, 17 nt, Homo sapiens
auguuuuagccagugau

SEQ ID NO: 477591 - RNA, 22 nt, Homo sapiens
auguuuugaaauguaccaucaa

SEQ ID NO: 477592 - RNA, 20 nt, Homo sapiens
auuaagaauugguugccaua

SEQ ID NO: 477593 - RNA, 19 nt, Homo sapiens
auuacauauuugcauaugu

SEQ ID NO: 477594 - RNA, 17 nt, Homo sapiens
auuacauggcucuaaaa

SEQ ID NO: 477595 - RNA, 14 nt, Homo sapiens
auuaccuugugcua

SEQ ID NO: 477596 - RNA, 17 nt, Homo sapiens
auuagaauuucauauga

SEQ ID NO: 477597 - RNA, 20 nt, Homo sapiens
auuagacaaaguucauucaa

SEQ ID NO: 477598 - RNA, 23 nt, Homo sapiens
auuagauuuauucgccugauaag

SEQ ID NO: 477599 - RNA, 19 nt, Homo sapiens
auuagccuaugugcaugca

SEQ ID NO: 477600 - RNA, 19 nt, Homo sapiens
auuagguguucaggccagu

SEQ ID NO: 477601 - RNA, 14 nt, Homo sapiens
auuauagugacaau

SEQ ID NO: 477602 - RNA, 22 nt, Homo sapiens
auuaugaauagaagguagugaa

SEQ ID NO: 477603 - RNA, 18 nt, Homo sapiens
auuaugaauuacauuugu

SEQ ID NO: 477604 - RNA, 17 nt, Homo sapiens
auucaaagagacauaua

SEQ ID NO: 477605 - RNA, 22 nt, Homo sapiens
auucaacugccauguuuugcca

SEQ ID NO: 477606 - RNA, 20 nt, Homo sapiens
auucacccccaaacagugac

SEQ ID NO: 477607 - RNA, 17 nt, Homo sapiens
auucauaacagaacaag

SEQ ID NO: 477608 - RNA, 17 nt, Homo sapiens
auucauacauuaucuca

SEQ ID NO: 477609 - RNA, 15 nt, Homo sapiens
auucauuuaacagag

SEQ ID NO: 477610 - RNA, 16 nt, Homo sapiens
auucauuuaacagagc

SEQ ID NO: 477611 - RNA, 23 nt, Homo sapiens
auucauuuuucuuucugauguca

SEQ ID NO: 477612 - RNA, 14 nt, Homo sapiens
auucccagccagca

SEQ ID NO: 477613 - RNA, 22 nt, Homo sapiens
auuccccugcccaccuccuucc

SEQ ID NO: 477614 - RNA, 14 nt, Homo sapiens
auuccugagccagu

SEQ ID NO: 477615 - RNA, 14 nt, Homo sapiens
auuccuguccuuca

SEQ ID NO: 477616 - RNA, 19 nt, Homo sapiens
auuccuguuagccaggugg

SEQ ID NO: 477617 - RNA, 12 nt, Homo sapiens
auuccuugcaca

SEQ ID NO: 477618 - RNA, 18 nt, Homo sapiens
auucuaagucaauccaag

SEQ ID NO: 477619 - RNA, 16 nt, Homo sapiens
auucuacacagagcag

SEQ ID NO: 477620 - RNA, 13 nt, Homo sapiens
auucuagagucuc

SEQ ID NO: 477621 - RNA, 21 nt, Homo sapiens
auucugagguaaccucauuau

SEQ ID NO: 477622 - RNA, 23 nt, Homo sapiens
auucugagguaaccucauuauca

SEQ ID NO: 477623 - RNA, 20 nt, Homo sapiens
auucugcuaccucacugggg

SEQ ID NO: 477624 - RNA, 12 nt, Homo sapiens
auucugcugaug

SEQ ID NO: 477625 - RNA, 15 nt, Homo sapiens
auucugcugaugcua

SEQ ID NO: 477626 - RNA, 19 nt, Homo sapiens
auucuguaugccaagugaa

SEQ ID NO: 477627 - RNA, 20 nt, Homo sapiens
auucuuacaaacaugugguu

SEQ ID NO: 477628 - RNA, 18 nt, Homo sapiens
auucuuuacccccuggga

SEQ ID NO: 477629 - RNA, 14 nt, Homo sapiens
auucuuuaucacau

SEQ ID NO: 477630 - RNA, 15 nt, Homo sapiens
auugaagacccucaa

SEQ ID NO: 477631 - RNA, 23 nt, Homo sapiens
auugaaguuuugacaucaaugau

SEQ ID NO: 477632 - RNA, 14 nt, Homo sapiens
auugaauaggauca

SEQ ID NO: 477633 - RNA, 14 nt, Homo sapiens
auugacuacauauu

SEQ ID NO: 477634 - RNA, 18 nt, Homo sapiens
auugacugauggugaaau

SEQ ID NO: 477635 - RNA, 15 nt, Homo sapiens
auugauauaauuucc

SEQ ID NO: 477636 - RNA, 16 nt, Homo sapiens
auuggacuuccauuug

SEQ ID NO: 477637 - RNA, 21 nt, Homo sapiens
auuguggaaagaugaaugcaa

SEQ ID NO: 477638 - RNA, 22 nt, Homo sapiens
auuguggaaagaugaaugcaau

SEQ ID NO: 477639 - RNA, 12 nt, Homo sapiens
auuuaacuugag

SEQ ID NO: 477640 - RNA, 14 nt, Homo sapiens
auuuaaucuuccau

SEQ ID NO: 477641 - RNA, 17 nt, Homo sapiens
auuuauuacuguaagaa

SEQ ID NO: 477642 - RNA, 20 nt, Homo sapiens
auuuauuuuuuuacuuccuc

SEQ ID NO: 477643 - RNA, 13 nt, Homo sapiens
auuucauaugaca

SEQ ID NO: 477644 - RNA, 15 nt, Homo sapiens
auuugcaagacauag

SEQ ID NO: 477645 - RNA, 21 nt, Homo sapiens
auuugcuauagaaaacaauac

SEQ ID NO: 477646 - RNA, 13 nt, Homo sapiens
auuugcucaugga

SEQ ID NO: 477647 - RNA, 15 nt, Homo sapiens
auuugguguacaauu

SEQ ID NO: 477648 - RNA, 12 nt, Homo sapiens
aaaaaaacguau

SEQ ID NO: 477649 - RNA, 21 nt, Homo sapiens
aaaaaaauuuuauagugucuu

SEQ ID NO: 477650 - RNA, 20 nt, Homo sapiens
aaaaaacguauugcauuuaa

SEQ ID NO: 477651 - RNA, 18 nt, Homo sapiens
aaaaaccauaggcugcuc

SEQ ID NO: 477652 - RNA, 14 nt, Homo sapiens
aaaaacguauugca

SEQ ID NO: 477653 - RNA, 22 nt, Homo sapiens
aaaaagccuccaguccaaggaa

SEQ ID NO: 477654 - RNA, 13 nt, Homo sapiens
aaaacaggccagg

SEQ ID NO: 477655 - RNA, 12 nt, Homo sapiens
aaaacauuccau

SEQ ID NO: 477656 - RNA, 14 nt, Homo sapiens
aaaacccacagaag

SEQ ID NO: 477657 - RNA, 14 nt, Homo sapiens
aaaacuucaauauc

SEQ ID NO: 477658 - RNA, 11 nt, Homo sapiens
aaaagacauaa

SEQ ID NO: 477659 - RNA, 18 nt, Homo sapiens
aaaagcccauucauucca

SEQ ID NO: 477660 - RNA, 23 nt, Homo sapiens
aaaagcuucauucucacucugcu

SEQ ID NO: 477661 - RNA, 22 nt, Homo sapiens
aaaauaaaaaagaucuccaagc

SEQ ID NO: 477662 - RNA, 17 nt, Homo sapiens
aaaauaaagcuguucuc

SEQ ID NO: 477663 - RNA, 23 nt, Homo sapiens
aaaauauaccuucagagacuguc

SEQ ID NO: 477664 - RNA, 12 nt, Homo sapiens
aaaauaucacuu

SEQ ID NO: 477665 - RNA, 18 nt, Homo sapiens
aaaauaucacuugucaau

SEQ ID NO: 477666 - RNA, 19 nt, Homo sapiens
aaaauauuuuuaugugcaa

SEQ ID NO: 477667 - RNA, 16 nt, Homo sapiens
aaaaucacaaacucau

SEQ ID NO: 477668 - RNA, 17 nt, Homo sapiens
aaaauccagaacucaaa

SEQ ID NO: 477669 - RNA, 16 nt, Homo sapiens
aaaauccauacauuug

SEQ ID NO: 477670 - RNA, 15 nt, Homo sapiens
aaaaugaguuaccua

SEQ ID NO: 477671 - RNA, 23 nt, Homo sapiens
aaaauggacaaaauccaugaaca

SEQ ID NO: 477672 - RNA, 23 nt, Homo sapiens
aaaaugucauuguucuugugaac

SEQ ID NO: 477673 - RNA, 15 nt, Homo sapiens
aaacaaauucaucaa

SEQ ID NO: 477674 - RNA, 22 nt, Homo sapiens
aaacaccaaacucauaacaguc

SEQ ID NO: 477675 - RNA, 14 nt, Homo sapiens
aaacacccaugccc

SEQ ID NO: 477676 - RNA, 17 nt, Homo sapiens
aaacauucaaagagaca

SEQ ID NO: 477677 - RNA, 18 nt, Homo sapiens
aaaccaccuaguucuccc

SEQ ID NO: 477678 - RNA, 23 nt, Homo sapiens
aaacccauuuccagcuccuagua

SEQ ID NO: 477679 - RNA, 20 nt, Homo sapiens
aaaccccaucucuacuaaaa

SEQ ID NO: 477680 - RNA, 17 nt, Homo sapiens
aaacguauugcauuuaa

SEQ ID NO: 477681 - RNA, 20 nt, Homo sapiens
gacagucaccucauggaauu

SEQ ID NO: 477682 - RNA, 20 nt, Homo sapiens
gacagugggcaucagcagca

SEQ ID NO: 477683 - RNA, 19 nt, Homo sapiens
gacauaagcaaagacuaug

SEQ ID NO: 477684 - RNA, 22 nt, Homo sapiens
gacauauacuaagauguucacu

SEQ ID NO: 477685 - RNA, 21 nt, Homo sapiens
gacaugcugaagccaaagcca

SEQ ID NO: 477686 - RNA, 16 nt, Homo sapiens
gacauugauacaguga

SEQ ID NO: 477687 - RNA, 22 nt, Homo sapiens
gaccaauaaccaugcccaagaa

SEQ ID NO: 477688 - RNA, 17 nt, Homo sapiens
gaccccgcccagcauug

SEQ ID NO: 477689 - RNA, 20 nt, Homo sapiens
gaccuccuuauguauucuca

SEQ ID NO: 477690 - RNA, 23 nt, Homo sapiens
gaccuggcaaggacacagaugaa

SEQ ID NO: 477691 - RNA, 13 nt, Homo sapiens
gaccuucuaggaa

SEQ ID NO: 477692 - RNA, 22 nt, Homo sapiens
gaccuucuaggaagcuccaguu

SEQ ID NO: 477693 - RNA, 12 nt, Homo sapiens
gaccuuugcacg

SEQ ID NO: 477694 - RNA, 21 nt, Homo sapiens
gacguuggccuaacacugggc

SEQ ID NO: 477695 - RNA, 19 nt, Homo sapiens
gacuagggcuuauccaugc

SEQ ID NO: 477696 - RNA, 19 nt, Homo sapiens
gacuaugaggaauauuugc

SEQ ID NO: 477697 - RNA, 13 nt, Homo sapiens
gacuaugcaaaag

SEQ ID NO: 477698 - RNA, 19 nt, Homo sapiens
gacucagggccccagcacu

SEQ ID NO: 477699 - RNA, 18 nt, Homo sapiens
gacucuucccccacuccu

SEQ ID NO: 477700 - RNA, 14 nt, Homo sapiens
gacugauggugaaa

SEQ ID NO: 477701 - RNA, 19 nt, Homo sapiens
gacuggaccccgcccagca

SEQ ID NO: 477702 - RNA, 14 nt, Homo sapiens
gacuuaaaacaaac

SEQ ID NO: 477703 - RNA, 18 nt, Homo sapiens
gacuugacagaacacugu

SEQ ID NO: 477704 - RNA, 20 nt, Homo sapiens
gacuugacagaacacugucu

SEQ ID NO: 477705 - RNA, 14 nt, Homo sapiens
gacuugcaaaaagg

SEQ ID NO: 477706 - RNA, 22 nt, Homo sapiens
gacuugcugaaucggaaucucu

SEQ ID NO: 477707 - RNA, 21 nt, Homo sapiens
gagaaacaaauaauuuguaua

SEQ ID NO: 477708 - RNA, 14 nt, Homo sapiens
gagaaauugaggau

SEQ ID NO: 477709 - RNA, 14 nt, Homo sapiens
gagaacucugagca

SEQ ID NO: 477710 - RNA, 18 nt, Homo sapiens
gagaacucugagcagugc

SEQ ID NO: 477711 - RNA, 23 nt, Homo sapiens
gagaauguuagaggaucccucuc

SEQ ID NO: 477712 - RNA, 23 nt, Homo sapiens
gagacucagggccccagcacuaa

SEQ ID NO: 477713 - RNA, 14 nt, Homo sapiens
gagacugucaguag

SEQ ID NO: 477714 - RNA, 18 nt, Homo sapiens
gagagacacacugaagaa

SEQ ID NO: 477715 - RNA, 16 nt, Homo sapiens
gagagcauucugcucu

SEQ ID NO: 477716 - RNA, 23 nt, Homo sapiens
gagaggagaaggagggagacaug

SEQ ID NO: 477717 - RNA, 18 nt, Homo sapiens
gagaggagccaggacugu

SEQ ID NO: 477718 - RNA, 16 nt, Homo sapiens
gagagugaagugaaga

SEQ ID NO: 477719 - RNA, 20 nt, Homo sapiens
gagaucauugcaaacucaac

SEQ ID NO: 477720 - RNA, 14 nt, Homo sapiens
gagaucgagaccau

SEQ ID NO: 477721 - RNA, 17 nt, Homo sapiens
gagaucuuaugucaagu

SEQ ID NO: 477722 - RNA, 22 nt, Homo sapiens
gagauuauuuuaaucuaauucu

SEQ ID NO: 477723 - RNA, 19 nt, Homo sapiens
gagauuccugagccagugu

SEQ ID NO: 477724 - RNA, 11 nt, Homo sapiens
gagcaaaggcu

SEQ ID NO: 477725 - RNA, 16 nt, Homo sapiens
gagcaaaggcugagaa

SEQ ID NO: 477726 - RNA, 21 nt, Homo sapiens
gagcaaaggcugagaacacug

SEQ ID NO: 477727 - RNA, 11 nt, Homo sapiens
gagcacacugu

SEQ ID NO: 477728 - RNA, 21 nt, Homo sapiens
gagcagugcuugaaugaaguu

SEQ ID NO: 477729 - RNA, 16 nt, Homo sapiens
gagccaggacugugga

SEQ ID NO: 477730 - RNA, 13 nt, Homo sapiens
gagccuggugccc

SEQ ID NO: 477731 - RNA, 16 nt, Homo sapiens
gagcuagaaccuggag

SEQ ID NO: 477732 - RNA, 18 nt, Homo sapiens
gagcuagaaccuggagag

SEQ ID NO: 477733 - RNA, 21 nt, Homo sapiens
gagcucgguggacccagggau

SEQ ID NO: 477734 - RNA, 15 nt, Homo sapiens
gagcucuucauuuau

SEQ ID NO: 477735 - RNA, 18 nt, Homo sapiens
gagcugacacaaaccugc

SEQ ID NO: 477736 - RNA, 20 nt, Homo sapiens
gagcugggggaagaagggau

SEQ ID NO: 477737 - RNA, 15 nt, Homo sapiens
gagcuuuauguaaua

SEQ ID NO: 477738 - RNA, 16 nt, Homo sapiens
gaggaguacaggugaa

SEQ ID NO: 477739 - RNA, 20 nt, Homo sapiens
gaggcaaccuguugaauuua

SEQ ID NO: 477740 - RNA, 20 nt, Homo sapiens
gaggcacgagaauugcuuga

SEQ ID NO: 477741 - RNA, 20 nt, Homo sapiens
gaggcagagguugcagugaa

SEQ ID NO: 477742 - RNA, 20 nt, Homo sapiens
gaggcaggagaaucgcuuga

SEQ ID NO: 477743 - RNA, 21 nt, Homo sapiens
gagggagaacccaaagagaca

SEQ ID NO: 477744 - RNA, 15 nt, Homo sapiens
gagggcacacacugu

SEQ ID NO: 477745 - RNA, 18 nt, Homo sapiens
gagggcuagaaccuggag

SEQ ID NO: 477746 - RNA, 18 nt, Homo sapiens
gaguacaccccaacagca

SEQ ID NO: 477747 - RNA, 19 nt, Homo sapiens
gaguacaccccaacagcac

SEQ ID NO: 477748 - RNA, 14 nt, Homo sapiens
gaguauugcugauc

SEQ ID NO: 477749 - RNA, 16 nt, Homo sapiens
gagucauggacaugaa

SEQ ID NO: 477750 - RNA, 20 nt, Homo sapiens
gagucucacucuguugccca

SEQ ID NO: 477751 - RNA, 21 nt, Homo sapiens
gagucuggcucugucacccag

SEQ ID NO: 477752 - RNA, 17 nt, Homo sapiens
gagugcccccaacagca

SEQ ID NO: 477753 - RNA, 14 nt, Homo sapiens
gagugcgugcucag

SEQ ID NO: 477754 - RNA, 14 nt, Homo sapiens
gaguuuagugugau

SEQ ID NO: 477755 - RNA, 23 nt, Homo sapiens
gauaacacaaguaaaacuguggu

SEQ ID NO: 477756 - RNA, 20 nt, Homo sapiens
gauaaguucuaguugcuugu

SEQ ID NO: 477757 - RNA, 15 nt, Homo sapiens
gauauagaacagugc

SEQ ID NO: 477758 - RNA, 12 nt, Homo sapiens
gauaucuacugu

SEQ ID NO: 477759 - RNA, 22 nt, Homo sapiens
gauauuaaccaggggccaugaa

SEQ ID NO: 477760 - RNA, 13 nt, Homo sapiens
gaucauugcaaac

SEQ ID NO: 477761 - RNA, 22 nt, Homo sapiens
gauccccaacugcuccagccuc

SEQ ID NO: 477762 - RNA, 15 nt, Homo sapiens
gaucccucucuggau

SEQ ID NO: 477763 - RNA, 16 nt, Homo sapiens
gauccuaaaacaaaag

SEQ ID NO: 477764 - RNA, 14 nt, Homo sapiens
gaucgauuugcacc

SEQ ID NO: 477765 - RNA, 22 nt, Homo sapiens
gaucuuaggcaugacuguagaa

SEQ ID NO: 477766 - RNA, 19 nt, Homo sapiens
gaucuucagggaacugcau

SEQ ID NO: 477767 - RNA, 13 nt, Homo sapiens
gaugagaguacac

SEQ ID NO: 477768 - RNA, 16 nt, Homo sapiens
gaugaggcagaugccu

SEQ ID NO: 477769 - RNA, 21 nt, Homo sapiens
gaugaggucauagcagugcuu

SEQ ID NO: 477770 - RNA, 19 nt, Homo sapiens
gauggcuuuaccuuuauua

SEQ ID NO: 477771 - RNA, 20 nt, Homo sapiens
gaugggagugcccccaacag

SEQ ID NO: 477772 - RNA, 14 nt, Homo sapiens
gaugucccuaugga

SEQ ID NO: 477773 - RNA, 20 nt, Homo sapiens
gaugugccuggguggacaug

SEQ ID NO: 477774 - RNA, 15 nt, Homo sapiens
gauguucacuguggc

SEQ ID NO: 477775 - RNA, 21 nt, Homo sapiens
gauuauaggcaugagccacca

SEQ ID NO: 477776 - RNA, 17 nt, Homo sapiens
gauuauagugacaauga

SEQ ID NO: 477777 - RNA, 15 nt, Homo sapiens
gauugagcuacuuca

SEQ ID NO: 477778 - RNA, 18 nt, Homo sapiens
gauuggcaggaguuggaa

SEQ ID NO: 477779 - RNA, 22 nt, Homo sapiens
gauuggccccacugacguuggc

SEQ ID NO: 477780 - RNA, 20 nt, Homo sapiens
gauuuaauccuagagauuug

SEQ ID NO: 477781 - RNA, 18 nt, Homo sapiens
gauuuggaggcuaccuca

SEQ ID NO: 477782 - RNA, 13 nt, Homo sapiens
gauuuuccuuccu

SEQ ID NO: 477783 - RNA, 19 nt, Homo sapiens
gcaaaacuuaggcaugcac

SEQ ID NO: 477784 - RNA, 22 nt, Homo sapiens
gcaaaauguuucaaguacugua

SEQ ID NO: 477785 - RNA, 14 nt, Homo sapiens
gcaaaggcucucac

SEQ ID NO: 477786 - RNA, 23 nt, Homo sapiens
gcaaaggcugagaacacugugaa

SEQ ID NO: 477787 - RNA, 12 nt, Homo sapiens
gcaaagucuaaa

SEQ ID NO: 477788 - RNA, 22 nt, Homo sapiens
gcaaagucuaaaguuuacagua

SEQ ID NO: 477789 - RNA, 14 nt, Homo sapiens
gcaacaaccagcau

SEQ ID NO: 477790 - RNA, 15 nt, Homo sapiens
gcaacugaggcagac

SEQ ID NO: 477791 - RNA, 14 nt, Homo sapiens
gcaagaaacacugg

SEQ ID NO: 477792 - RNA, 20 nt, Homo sapiens
gcaagacucugucucaaaaa

SEQ ID NO: 477793 - RNA, 17 nt, Homo sapiens
gcaaggacacagaugaa

SEQ ID NO: 477794 - RNA, 16 nt, Homo sapiens
gcaauagugaaugaau

SEQ ID NO: 477795 - RNA, 15 nt, Homo sapiens
gcaaucacauaguga

SEQ ID NO: 477796 - RNA, 22 nt, Homo sapiens
gcaauucuaacuuuuuugcuau

SEQ ID NO: 477797 - RNA, 12 nt, Homo sapiens
gcaauugcucau

SEQ ID NO: 477798 - RNA, 17 nt, Homo sapiens
gcacaauaguaaccugg

SEQ ID NO: 477799 - RNA, 19 nt, Homo sapiens
gcacacagcaggcuuucaa

SEQ ID NO: 477800 - RNA, 22 nt, Homo sapiens
gcacagccucuuagaugcaguu

SEQ ID NO: 477801 - RNA, 20 nt, Homo sapiens
gcacagcguccuguccacac

SEQ ID NO: 477802 - RNA, 22 nt, Homo sapiens
gcacauuagccuaugugcaugc

SEQ ID NO: 477803 - RNA, 10 nt, Homo sapiens
gcaccaccuc

SEQ ID NO: 477804 - RNA, 13 nt, Homo sapiens
gcacccucuccag

SEQ ID NO: 477805 - RNA, 14 nt, Homo sapiens
gcacccucuccaga

SEQ ID NO: 477806 - RNA, 15 nt, Homo sapiens
gcacccucuccagau

SEQ ID NO: 477807 - RNA, 19 nt, Homo sapiens
gcacuaguauuucuaugaa

SEQ ID NO: 477808 - RNA, 15 nt, Homo sapiens
gcacucauggguaau

SEQ ID NO: 477809 - RNA, 22 nt, Homo sapiens
gcagaaucccggcugucaaggg

SEQ ID NO: 477810 - RNA, 18 nt, Homo sapiens
gcagcaagugugcuggcc

SEQ ID NO: 477811 - RNA, 12 nt, Homo sapiens
gcagcucaaaau

SEQ ID NO: 477812 - RNA, 13 nt, Homo sapiens
gcaggacugcaca

SEQ ID NO: 477813 - RNA, 17 nt, Homo sapiens
gcaggagaauugcuuga

SEQ ID NO: 477814 - RNA, 23 nt, Homo sapiens
gcaggcaagugggauaaaggccc

SEQ ID NO: 477815 - RNA, 20 nt, Homo sapiens
gcaguggacucaaaacccau

SEQ ID NO: 477816 - RNA, 22 nt, Homo sapiens
gcaguggcacgaucucgacuca

SEQ ID NO: 477817 - RNA, 18 nt, Homo sapiens
uauuuuaacaaugugccc

SEQ ID NO: 477818 - RNA, 14 nt, Homo sapiens
uauuuugacuguga

SEQ ID NO: 477819 - RNA, 15 nt, Homo sapiens
uauuuuuaccugccu

SEQ ID NO: 477820 - RNA, 15 nt, Homo sapiens
uauuuuuaugugcaa

SEQ ID NO: 477821 - RNA, 17 nt, Homo sapiens
uauuuuuuuaagcugua

SEQ ID NO: 477822 - RNA, 13 nt, Homo sapiens
ucaaaaauacuca

SEQ ID NO: 477823 - RNA, 20 nt, Homo sapiens
ucaaaaauacucacauggcu

SEQ ID NO: 477824 - RNA, 21 nt, Homo sapiens
ucaaaugagccccuucauccg

SEQ ID NO: 477825 - RNA, 18 nt, Homo sapiens
ucaagagaucgagaccau

SEQ ID NO: 477826 - RNA, 18 nt, Homo sapiens
ucaaggaauaaugggcuu

SEQ ID NO: 477827 - RNA, 18 nt, Homo sapiens
ucaaggacuuucugaagc

SEQ ID NO: 477828 - RNA, 12 nt, Homo sapiens
ucaaggcacugc

SEQ ID NO: 477829 - RNA, 18 nt, Homo sapiens
ucaaguacuguaacugug

SEQ ID NO: 477830 - RNA, 23 nt, Homo sapiens
ucaaguacuguaacugugucaug

SEQ ID NO: 477831 - RNA, 20 nt, Homo sapiens
ucaaguauuagggguaauau

SEQ ID NO: 477832 - RNA, 19 nt, Homo sapiens
ucaaguucuacaucaauau

SEQ ID NO: 477833 - RNA, 20 nt, Homo sapiens
ucaauacuauggaguaccau

SEQ ID NO: 477834 - RNA, 18 nt, Homo sapiens
ucaaucucugauucuguc

SEQ ID NO: 477835 - RNA, 21 nt, Homo sapiens
ucaauucuauuacgugcaaua

SEQ ID NO: 477836 - RNA, 20 nt, Homo sapiens
ucacaaacucauccauuaau

SEQ ID NO: 477837 - RNA, 18 nt, Homo sapiens
ucacacaauacaauaagu

SEQ ID NO: 477838 - RNA, 19 nt, Homo sapiens
ucacacgguuugaagccug

SEQ ID NO: 477839 - RNA, 21 nt, Homo sapiens
ucacagagauaauucuagcuu

SEQ ID NO: 477840 - RNA, 18 nt, Homo sapiens
ucacagcuguaauaacaa

SEQ ID NO: 477841 - RNA, 13 nt, Homo sapiens
ucacaucuuggca

SEQ ID NO: 477842 - RNA, 15 nt, Homo sapiens
ucacauuuguaaaug

SEQ ID NO: 477843 - RNA, 14 nt, Homo sapiens
ucaccacuacauca

SEQ ID NO: 477844 - RNA, 15 nt, Homo sapiens
ucaccccagacuccu

SEQ ID NO: 477845 - RNA, 17 nt, Homo sapiens
ucacccccaaacaguga

SEQ ID NO: 477846 - RNA, 17 nt, Homo sapiens
ucaccgaggacaugaaa

SEQ ID NO: 477847 - RNA, 18 nt, Homo sapiens
ucaccugggcugaggcau

SEQ ID NO: 477848 - RNA, 15 nt, Homo sapiens
ucacgccauugcacu

SEQ ID NO: 477849 - RNA, 19 nt, Homo sapiens
ucacgccauugcacuccag

SEQ ID NO: 477850 - RNA, 17 nt, Homo sapiens
ucacuaaaauuaaucug

SEQ ID NO: 477851 - RNA, 16 nt, Homo sapiens
ucacucugcuuugcau

SEQ ID NO: 477852 - RNA, 13 nt, Homo sapiens
ucacugauuuuca

SEQ ID NO: 477853 - RNA, 21 nt, Homo sapiens
ucacuuaauaauguguacauu

SEQ ID NO: 477854 - RNA, 18 nt, Homo sapiens
ucacuuauccuguucucu

SEQ ID NO: 477855 - RNA, 19 nt, Homo sapiens
ucacuuccuauaugcacuu

SEQ ID NO: 477856 - RNA, 21 nt, Homo sapiens
ucacuugucaauaaaauccau

SEQ ID NO: 477857 - RNA, 19 nt, Homo sapiens
ucacuugugccaacacuca

SEQ ID NO: 477858 - RNA, 21 nt, Homo sapiens
ucagaaacacccucacacugg

SEQ ID NO: 477859 - RNA, 18 nt, Homo sapiens
ucagaaaccauuguucag

SEQ ID NO: 477860 - RNA, 17 nt, Homo sapiens
ucagagcugacacagga

SEQ ID NO: 477861 - RNA, 16 nt, Homo sapiens
ucaggagaaaaagccu

SEQ ID NO: 477862 - RNA, 23 nt, Homo sapiens
ucaggagaggggcagaacagccg

SEQ ID NO: 477863 - RNA, 16 nt, Homo sapiens
ucaggcuuuggauguu

SEQ ID NO: 477864 - RNA, 15 nt, Homo sapiens
ucagggccaggugca

SEQ ID NO: 477865 - RNA, 22 nt, Homo sapiens
ucagggccaggugcagaccuug

SEQ ID NO: 477866 - RNA, 18 nt, Homo sapiens
ucagggcugagaggagaa

SEQ ID NO: 477867 - RNA, 18 nt, Homo sapiens
ucaguaguaucaaugauu

SEQ ID NO: 477868 - RNA, 22 nt, Homo sapiens
ucagugauugcaauuugcacaa

SEQ ID NO: 477869 - RNA, 19 nt, Homo sapiens
ucagugcaaagauuugcuu

SEQ ID NO: 477870 - RNA, 17 nt, Homo sapiens
ucauaagcgaucacuuc

SEQ ID NO: 477871 - RNA, 18 nt, Homo sapiens
ucauaauuucuucacuca

SEQ ID NO: 477872 - RNA, 18 nt, Homo sapiens
ucaucucagugcuguaaa

SEQ ID NO: 477873 - RNA, 13 nt, Homo sapiens
ucaugcauuugca

SEQ ID NO: 477874 - RNA, 14 nt, Homo sapiens
ucaugcauuugcac

SEQ ID NO: 477875 - RNA, 17 nt, Homo sapiens
ucauuaaaguucuagug

SEQ ID NO: 477876 - RNA, 11 nt, Homo sapiens
uccaaaccaca

SEQ ID NO: 477877 - RNA, 19 nt, Homo sapiens
uccaaacuaccuuccaguu

SEQ ID NO: 477878 - RNA, 14 nt, Homo sapiens
uccaaaggccaugg

SEQ ID NO: 477879 - RNA, 14 nt, Homo sapiens
uccaacaugugcuc

SEQ ID NO: 477880 - RNA, 15 nt, Homo sapiens
uccaacaugugcuca

SEQ ID NO: 477881 - RNA, 20 nt, Homo sapiens
uccaacaugugcucagggaa

SEQ ID NO: 477882 - RNA, 13 nt, Homo sapiens
uccaacccgggga

SEQ ID NO: 477883 - RNA, 11 nt, Homo sapiens
uccaagcauuu

SEQ ID NO: 477884 - RNA, 18 nt, Homo sapiens
uccaaggaaaccacagcu

SEQ ID NO: 477885 - RNA, 17 nt, Homo sapiens
uccaauuccuugcacau

SEQ ID NO: 477886 - RNA, 12 nt, Homo sapiens
uccacaccaagc

SEQ ID NO: 477887 - RNA, 17 nt, Homo sapiens
uccacaccuccaaugcu

SEQ ID NO: 477888 - RNA, 17 nt, Homo sapiens
uccaccucccugcaaua

SEQ ID NO: 477889 - RNA, 15 nt, Homo sapiens
uccacucccaggcag

SEQ ID NO: 477890 - RNA, 13 nt, Homo sapiens
uccacuucuuuca

SEQ ID NO: 477891 - RNA, 14 nt, Homo sapiens
uccagaaagugaca

SEQ ID NO: 477892 - RNA, 12 nt, Homo sapiens
uccaggggccac

SEQ ID NO: 477893 - RNA, 15 nt, Homo sapiens
uccaguccaaggaaa

SEQ ID NO: 477894 - RNA, 16 nt, Homo sapiens
uccaguugucuauuca

SEQ ID NO: 477895 - RNA, 13 nt, Homo sapiens
uccaucccaggcu

SEQ ID NO: 477896 - RNA, 18 nt, Homo sapiens
uccaucgcugucaucuca

SEQ ID NO: 477897 - RNA, 15 nt, Homo sapiens
uccaugaacaucaug

SEQ ID NO: 477898 - RNA, 14 nt, Homo sapiens
uccaugccugggaa

SEQ ID NO: 477899 - RNA, 17 nt, Homo sapiens
ucccaaaagcccauuca

SEQ ID NO: 477900 - RNA, 22 nt, Homo sapiens
ucccaaaagcccauucauucca

SEQ ID NO: 477901 - RNA, 23 nt, Homo sapiens
ucccaaaagcccauucauuccau

SEQ ID NO: 477902 - RNA, 19 nt, Homo sapiens
ucccaaagugcugagauua

SEQ ID NO: 477903 - RNA, 12 nt, Homo sapiens
ucccaauuuccc

SEQ ID NO: 477904 - RNA, 14 nt, Homo sapiens
ucccagcaguggac

SEQ ID NO: 477905 - RNA, 14 nt, Homo sapiens
ucccagcuacucag

SEQ ID NO: 477906 - RNA, 15 nt, Homo sapiens
ucccaggagaaucac

SEQ ID NO: 477907 - RNA, 23 nt, Homo sapiens
ucccaggaguacaccccaacagc

SEQ ID NO: 477908 - RNA, 16 nt, Homo sapiens
ucccaugacccaggcu

SEQ ID NO: 477909 - RNA, 14 nt, Homo sapiens
uccccaccacacuu

SEQ ID NO: 477910 - RNA, 21 nt, Homo sapiens
ucccuccaccucccugcaaua

SEQ ID NO: 477911 - RNA, 14 nt, Homo sapiens
ucccucucuugccg

SEQ ID NO: 477912 - RNA, 15 nt, Homo sapiens
ucccuucaucuggaa

SEQ ID NO: 477913 - RNA, 21 nt, Homo sapiens
ucccuucaucuggaaccauca

SEQ ID NO: 477914 - RNA, 15 nt, Homo sapiens
uccgaggccaguacc

SEQ ID NO: 477915 - RNA, 15 nt, Homo sapiens
uccgcauccuagucu

SEQ ID NO: 477916 - RNA, 13 nt, Homo sapiens
uccgcuacuucca

SEQ ID NO: 477917 - RNA, 16 nt, Homo sapiens
uccuaaaacaaaagcu

SEQ ID NO: 477918 - RNA, 22 nt, Homo sapiens
uccuaagccaagagucauguca

SEQ ID NO: 477919 - RNA, 17 nt, Homo sapiens
uccuagacucugugauc

SEQ ID NO: 477920 - RNA, 15 nt, Homo sapiens
uccuagggccacuga

SEQ ID NO: 477921 - RNA, 22 nt, Homo sapiens
uccucauuuuugaauacaggca

SEQ ID NO: 477922 - RNA, 21 nt, Homo sapiens
uccucuccccaugauguuuag

SEQ ID NO: 477923 - RNA, 12 nt, Homo sapiens
uccucuucccug

SEQ ID NO: 477924 - RNA, 18 nt, Homo sapiens
uccugaccucaggugauc

SEQ ID NO: 477925 - RNA, 19 nt, Homo sapiens
uccuuagcuuagaccucag

SEQ ID NO: 477926 - RNA, 20 nt, Homo sapiens
uccuuguauuuaaauauuaa

SEQ ID NO: 477927 - RNA, 12 nt, Homo sapiens
ucgaaucacuca

SEQ ID NO: 477928 - RNA, 12 nt, Homo sapiens
ucgaguguuuca

SEQ ID NO: 477929 - RNA, 18 nt, Homo sapiens
ucgaugagaaauugaacu

SEQ ID NO: 477930 - RNA, 17 nt, Homo sapiens
ucggcucauugaaccuc

SEQ ID NO: 477931 - RNA, 16 nt, Homo sapiens
ucgucuggcaucuccc

SEQ ID NO: 477932 - RNA, 19 nt, Homo sapiens
ucuaaggaauaugagcuuu

SEQ ID NO: 477933 - RNA, 19 nt, Homo sapiens
ucuaaugugccuaguucuu

SEQ ID NO: 477934 - RNA, 23 nt, Homo sapiens
ucuaccaaaaaucucaauauuuc

SEQ ID NO: 477935 - RNA, 21 nt, Homo sapiens
ucuacguauggcuccacaccu

SEQ ID NO: 477936 - RNA, 15 nt, Homo sapiens
ucuagaauacuaaua

SEQ ID NO: 477937 - RNA, 14 nt, Homo sapiens
ucuaucaccuguca

SEQ ID NO: 477938 - RNA, 18 nt, Homo sapiens
ucuaucugcuuuugccua

SEQ ID NO: 477939 - RNA, 17 nt, Homo sapiens
ucuaugaaauaucaugc

SEQ ID NO: 477940 - RNA, 18 nt, Homo sapiens
ucuauggcacccaugcac

SEQ ID NO: 477941 - RNA, 14 nt, Homo sapiens
ucucaauucuuccc

SEQ ID NO: 477942 - RNA, 15 nt, Homo sapiens
ucucaauucuucccu

SEQ ID NO: 477943 - RNA, 20 nt, Homo sapiens
ucucaucacauuuguaaaug

SEQ ID NO: 477944 - RNA, 12 nt, Homo sapiens
ucuccagaugag

SEQ ID NO: 477945 - RNA, 19 nt, Homo sapiens
ucuccagaugagaguacac

SEQ ID NO: 477946 - RNA, 23 nt, Homo sapiens
ucuccagaugagaguacacccca

SEQ ID NO: 477947 - RNA, 14 nt, Homo sapiens
ucucccacacaaga

SEQ ID NO: 477948 - RNA, 19 nt, Homo sapiens
ucucgaacuccugaccuca

SEQ ID NO: 477949 - RNA, 12 nt, Homo sapiens
ucucuaucauua

SEQ ID NO: 477950 - RNA, 19 nt, Homo sapiens
ucucuucaauaaaccacaa

SEQ ID NO: 477951 - RNA, 19 nt, Homo sapiens
ucugaaaauuaacacugcu

SEQ ID NO: 477952 - RNA, 23 nt, Homo sapiens
ucugagcagugcuugaaugaagu

SEQ ID NO: 477953 - RNA, 14 nt, Homo sapiens
ucugauacguguau

SEQ ID NO: 477954 - RNA, 16 nt, Homo sapiens
ucugaucugaugcaag

SEQ ID NO: 477955 - RNA, 24 nt, Homo sapiens
aaacuaacacagccaucaagggaa

SEQ ID NO: 477956 - RNA, 22 nt, Homo sapiens
aaacuuccagugcaacacugaa

SEQ ID NO: 477957 - RNA, 13 nt, Homo sapiens
aaagaagguuuca

SEQ ID NO: 477958 - RNA, 17 nt, Homo sapiens
aaagacuaugaggaaua

SEQ ID NO: 477959 - RNA, 19 nt, Homo sapiens
aaagaugaaugcaauagua

SEQ ID NO: 477960 - RNA, 16 nt, Homo sapiens
aaagauuugcuuuaau

SEQ ID NO: 477961 - RNA, 19 nt, Homo sapiens
aaagcaaacuuaagaaaca

SEQ ID NO: 477962 - RNA, 13 nt, Homo sapiens
aaagcacaggugg

SEQ ID NO: 477963 - RNA, 20 nt, Homo sapiens
aaagcuacuugaaggacaca

SEQ ID NO: 477964 - RNA, 22 nt, Homo sapiens
aaagcucacuaagaagcuugaa

SEQ ID NO: 477965 - RNA, 23 nt, Homo sapiens
aaagcucacuaagaagcuugaau

SEQ ID NO: 477966 - RNA, 13 nt, Homo sapiens
aaagcucaucuca

SEQ ID NO: 477967 - RNA, 22 nt, Homo sapiens
aaagcuugcucacaucuuggca

SEQ ID NO: 477968 - RNA, 16 nt, Homo sapiens
aaagcuuugugcagau

SEQ ID NO: 477969 - RNA, 22 nt, Homo sapiens
aaaggaauccacucccaggcag

SEQ ID NO: 477970 - RNA, 19 nt, Homo sapiens
aaaggacucuugagcccuc

SEQ ID NO: 477971 - RNA, 18 nt, Homo sapiens
aaaggagaacacugguua

SEQ ID NO: 477972 - RNA, 20 nt, Homo sapiens
aaaggcugagaacacuguga

SEQ ID NO: 477973 - RNA, 17 nt, Homo sapiens
aaaguaugguauugaaa

SEQ ID NO: 477974 - RNA, 17 nt, Homo sapiens
aaauaaagcuguucuca

SEQ ID NO: 477975 - RNA, 13 nt, Homo sapiens
aaauaaaugacaa

SEQ ID NO: 477976 - RNA, 21 nt, Homo sapiens
aaauaacuaggcguggacuua

SEQ ID NO: 477977 - RNA, 17 nt, Homo sapiens
aaauaaucuacuguaca

SEQ ID NO: 477978 - RNA, 14 nt, Homo sapiens
aaauacauacuaua

SEQ ID NO: 477979 - RNA, 19 nt, Homo sapiens
aaauauacacacagcagua

SEQ ID NO: 477980 - RNA, 18 nt, Homo sapiens
aaauauuuuuaugugcaa

SEQ ID NO: 477981 - RNA, 20 nt, Homo sapiens
aaauauuuuuaugugcaaua

SEQ ID NO: 477982 - RNA, 22 nt, Homo sapiens
aaaucaaaaagggaaugcauua

SEQ ID NO: 477983 - RNA, 22 nt, Homo sapiens
aaaucaggguuaguauugucca

SEQ ID NO: 477984 - RNA, 14 nt, Homo sapiens
aaauccagaacuca

SEQ ID NO: 477985 - RNA, 16 nt, Homo sapiens
aaauccagaacucaaa

SEQ ID NO: 477986 - RNA, 12 nt, Homo sapiens
aaaucuaugaaa

SEQ ID NO: 477987 - RNA, 13 nt, Homo sapiens
aaaucucccaaag

SEQ ID NO: 477988 - RNA, 21 nt, Homo sapiens
aaaugaugucaugucagcucc

SEQ ID NO: 477989 - RNA, 17 nt, Homo sapiens
aaaugcaacaacaugua

SEQ ID NO: 477990 - RNA, 21 nt, Homo sapiens
aaauggcagggauacccagug

SEQ ID NO: 477991 - RNA, 17 nt, Homo sapiens
aaauguucuuaaccuuu

SEQ ID NO: 477992 - RNA, 19 nt, Homo sapiens
aaauuaacugggcauggua

SEQ ID NO: 477993 - RNA, 20 nt, Homo sapiens
aaauucaucaaauggaagac

SEQ ID NO: 477994 - RNA, 23 nt, Homo sapiens
aaauucaugcaucucaacaaagg

SEQ ID NO: 477995 - RNA, 15 nt, Homo sapiens
aaauucuacaacuuu

SEQ ID NO: 477996 - RNA, 15 nt, Homo sapiens
aaauugccuaaagag

SEQ ID NO: 477997 - RNA, 14 nt, Homo sapiens
aaauuuaaauggag

SEQ ID NO: 477998 - RNA, 13 nt, Homo sapiens
aaauuucacuuaa

SEQ ID NO: 477999 - RNA, 15 nt, Homo sapiens
aaauuucuauucucu

SEQ ID NO: 478000 - RNA, 19 nt, Homo sapiens
aaauuucuauucucuccac

SEQ ID NO: 478001 - RNA, 22 nt, Homo sapiens
aaauuugcuauucccaugcauu

SEQ ID NO: 478002 - RNA, 13 nt, Homo sapiens
aaauuuucaagca

SEQ ID NO: 478003 - RNA, 22 nt, Homo sapiens
aacaaacacuuagcaucccaca

SEQ ID NO: 478004 - RNA, 22 nt, Homo sapiens
aacaacuccuagggccacugaa

SEQ ID NO: 478005 - RNA, 18 nt, Homo sapiens
aacaacucgaaucacuca

SEQ ID NO: 478006 - RNA, 19 nt, Homo sapiens
aacaacucgaaucacucau

SEQ ID NO: 478007 - RNA, 16 nt, Homo sapiens
aacaagcaagcuccca

SEQ ID NO: 478008 - RNA, 13 nt, Homo sapiens
aacaaggaugaau

SEQ ID NO: 478009 - RNA, 13 nt, Homo sapiens
aacaaucacaaag

SEQ ID NO: 478010 - RNA, 15 nt, Homo sapiens
aacacacagcuccca

SEQ ID NO: 478011 - RNA, 11 nt, Homo sapiens
aacacauuaag

SEQ ID NO: 478012 - RNA, 16 nt, Homo sapiens
aacaccaagugucugc

SEQ ID NO: 478013 - RNA, 13 nt, Homo sapiens
aacacccaugccc

SEQ ID NO: 478014 - RNA, 19 nt, Homo sapiens
aacacccucacacugggac

SEQ ID NO: 478015 - RNA, 18 nt, Homo sapiens
aacacugacuccugugga

SEQ ID NO: 478016 - RNA, 19 nt, Homo sapiens
aacacugcaggcaucacag

SEQ ID NO: 478017 - RNA, 18 nt, Homo sapiens
aacagaaguccauggagu

SEQ ID NO: 478018 - RNA, 11 nt, Homo sapiens
aacagcaauag

SEQ ID NO: 478019 - RNA, 22 nt, Homo sapiens
aacagcacccucuccagaugag

SEQ ID NO: 478020 - RNA, 16 nt, Homo sapiens
aacagugagaaaccau

SEQ ID NO: 478021 - RNA, 12 nt, Homo sapiens
aacauaaagccu

SEQ ID NO: 478022 - RNA, 13 nt, Homo sapiens
aacauaaagccuu

SEQ ID NO: 478023 - RNA, 14 nt, Homo sapiens
aacaugugcucagg

SEQ ID NO: 478024 - RNA, 23 nt, Homo sapiens
aacauuaguucuauuucuauccc

SEQ ID NO: 478025 - RNA, 18 nt, Homo sapiens
aacauuuggaagccccau

SEQ ID NO: 478026 - RNA, 11 nt, Homo sapiens
aaccacaagca

SEQ ID NO: 478027 - RNA, 21 nt, Homo sapiens
aaccagagccugaguguugcc

SEQ ID NO: 478028 - RNA, 17 nt, Homo sapiens
aaccaggauauugacau

SEQ ID NO: 478029 - RNA, 20 nt, Homo sapiens
aaccauuucagcuguuucac

SEQ ID NO: 478030 - RNA, 19 nt, Homo sapiens
aacccaaagugugacucau

SEQ ID NO: 478031 - RNA, 20 nt, Homo sapiens
aacccaggaggcagcuguug

SEQ ID NO: 478032 - RNA, 20 nt, Homo sapiens
aaccuagauugcaccauugc

SEQ ID NO: 478033 - RNA, 11 nt, Homo sapiens
aaccucagggc

SEQ ID NO: 478034 - RNA, 15 nt, Homo sapiens
aaccucauuaucagu

SEQ ID NO: 478035 - RNA, 19 nt, Homo sapiens
aaccucugagucaccaucu

SEQ ID NO: 478036 - RNA, 21 nt, Homo sapiens
aaccuggagagcuagaaccua

SEQ ID NO: 478037 - RNA, 23 nt, Homo sapiens
aaccuggagggcuagaaccugga

SEQ ID NO: 478038 - RNA, 22 nt, Homo sapiens
aaccuggaggggcuagaaccua

SEQ ID NO: 478039 - RNA, 15 nt, Homo sapiens
aacgguacacagacu

SEQ ID NO: 478040 - RNA, 11 nt, Homo sapiens
aacguguaugu

SEQ ID NO: 478041 - RNA, 14 nt, Homo sapiens
aacuacaauguagu

SEQ ID NO: 478042 - RNA, 19 nt, Homo sapiens
aacuacaauguagucucau

SEQ ID NO: 478043 - RNA, 22 nt, Homo sapiens
aacuagucgucuccucuuggcc

SEQ ID NO: 478044 - RNA, 23 nt, Homo sapiens
aacucugagcagugcuugaauga

SEQ ID NO: 478045 - RNA, 17 nt, Homo sapiens
aacugaaaacaagccau

SEQ ID NO: 478046 - RNA, 17 nt, Homo sapiens
aacugucaaagaaucaa

SEQ ID NO: 478047 - RNA, 22 nt, Homo sapiens
aacugucaaagaaucaauccag

SEQ ID NO: 478048 - RNA, 14 nt, Homo sapiens
aacuuaucaucaca

SEQ ID NO: 478049 - RNA, 21 nt, Homo sapiens
aacuuugaggaggaagcagaa

SEQ ID NO: 478050 - RNA, 22 nt, Homo sapiens
aacuuugcauagcagcugcuac

SEQ ID NO: 478051 - RNA, 15 nt, Homo sapiens
aagaaaaaaaccaua

SEQ ID NO: 478052 - RNA, 16 nt, Homo sapiens
aagaaauuaugucagc

SEQ ID NO: 478053 - RNA, 14 nt, Homo sapiens
aagaaggaaugggg

SEQ ID NO: 478054 - RNA, 21 nt, Homo sapiens
aagaagggauaucuacugugg

SEQ ID NO: 478055 - RNA, 16 nt, Homo sapiens
aagaaugacuaugcaa

SEQ ID NO: 478056 - RNA, 17 nt, Homo sapiens
aagaaugagacugaacu

SEQ ID NO: 478057 - RNA, 23 nt, Homo sapiens
aagaaugagacugaacuguguga

SEQ ID NO: 478058 - RNA, 13 nt, Homo sapiens
aagacuaaauuaa

SEQ ID NO: 478059 - RNA, 17 nt, Homo sapiens
aagacuauauuguacac

SEQ ID NO: 478060 - RNA, 14 nt, Homo sapiens
aagacucugucuca

SEQ ID NO: 478061 - RNA, 18 nt, Homo sapiens
aagagacauauacuaaga

SEQ ID NO: 478062 - RNA, 13 nt, Homo sapiens
aagagagaucaaa

SEQ ID NO: 478063 - RNA, 23 nt, Homo sapiens
aagagauuccugagccaguguca

SEQ ID NO: 478064 - RNA, 15 nt, Homo sapiens
aagagccacagugag

SEQ ID NO: 478065 - RNA, 14 nt, Homo sapiens
aagaggcauuccca

SEQ ID NO: 478066 - RNA, 15 nt, Homo sapiens
aagaguaacugguag

SEQ ID NO: 478067 - RNA, 18 nt, Homo sapiens
aagauaaaauuugauaca

SEQ ID NO: 478068 - RNA, 20 nt, Homo sapiens
aagauacaggacauucucau

SEQ ID NO: 478069 - RNA, 20 nt, Homo sapiens
aagauaguugauuaugaaua

SEQ ID NO: 478070 - RNA, 20 nt, Homo sapiens
aagaucacgccacugcacuc

SEQ ID NO: 478071 - RNA, 16 nt, Homo sapiens
aagaucauucugagag

SEQ ID NO: 478072 - RNA, 22 nt, Homo sapiens
aagaugaugcuccuauccuccc

SEQ ID NO: 478073 - RNA, 17 nt, Homo sapiens
aagauguucacuguggc

SEQ ID NO: 478074 - RNA, 21 nt, Homo sapiens
aagcaaagacuaugaggaaua

SEQ ID NO: 478075 - RNA, 16 nt, Homo sapiens
aagcaucacuugggau

SEQ ID NO: 478076 - RNA, 20 nt, Homo sapiens
aagccacagcuggugguauc

SEQ ID NO: 478077 - RNA, 14 nt, Homo sapiens
aagcccauucauuc

SEQ ID NO: 478078 - RNA, 18 nt, Homo sapiens
aagcccauucauuccauu

SEQ ID NO: 478079 - RNA, 21 nt, Homo sapiens
aagccuuggggcugaugcagu

SEQ ID NO: 478080 - RNA, 18 nt, Homo sapiens
aagcucacuaagaagcuu

SEQ ID NO: 478081 - RNA, 22 nt, Homo sapiens
aagcucaucucagcuccugaaa

SEQ ID NO: 478082 - RNA, 17 nt, Homo sapiens
aagcucccaagggaugg

SEQ ID NO: 478083 - RNA, 18 nt, Homo sapiens
aagcuguucucauuccug

SEQ ID NO: 478084 - RNA, 20 nt, Homo sapiens
aagcuuggugcuaaaccaca

SEQ ID NO: 478085 - RNA, 18 nt, Homo sapiens
aaggaagucagacuuuuu

SEQ ID NO: 478086 - RNA, 15 nt, Homo sapiens
aaggacacagaugaa

SEQ ID NO: 478087 - RNA, 23 nt, Homo sapiens
aaggaccauaaauuuaaauggag

SEQ ID NO: 478088 - RNA, 21 nt, Homo sapiens
aaggacuuucugaagccucac

SEQ ID NO: 478089 - RNA, 20 nt, Homo sapiens
aaggagacacaacaacuccu

SEQ ID NO: 478090 - RNA, 16 nt, Homo sapiens
aaggaggccacgugau

SEQ ID NO: 478091 - RNA, 14 nt, Homo sapiens
gcauagauugauca

SEQ ID NO: 478092 - RNA, 15 nt, Homo sapiens
gcauauauacauaua

SEQ ID NO: 478093 - RNA, 22 nt, Homo sapiens
gcaucauuauuugcagagacag

SEQ ID NO: 478094 - RNA, 19 nt, Homo sapiens
gcauccaaggggccuggaa

SEQ ID NO: 478095 - RNA, 11 nt, Homo sapiens
gcauccuaguc

SEQ ID NO: 478096 - RNA, 16 nt, Homo sapiens
gcauccuagucucuau

SEQ ID NO: 478097 - RNA, 19 nt, Homo sapiens
gcauccuagucucuaucau

SEQ ID NO: 478098 - RNA, 21 nt, Homo sapiens
gcaucuuuucuguugccccau

SEQ ID NO: 478099 - RNA, 17 nt, Homo sapiens
gcaugaaaccacuggaa

SEQ ID NO: 478100 - RNA, 14 nt, Homo sapiens
gcaugacagcuguu

SEQ ID NO: 478101 - RNA, 16 nt, Homo sapiens
gcaugaccacauagaa

SEQ ID NO: 478102 - RNA, 16 nt, Homo sapiens
gcauguuuuccagcuc

SEQ ID NO: 478103 - RNA, 17 nt, Homo sapiens
gcauuccaacuaucuca

SEQ ID NO: 478104 - RNA, 19 nt, Homo sapiens
gcauuuaaacucauuugag

SEQ ID NO: 478105 - RNA, 22 nt, Homo sapiens
gcauuuuguuuguuucuucacu

SEQ ID NO: 478106 - RNA, 19 nt, Homo sapiens
gccaaggcuggagugcagu

SEQ ID NO: 478107 - RNA, 17 nt, Homo sapiens
gccaauaacacacagcu

SEQ ID NO: 478108 - RNA, 19 nt, Homo sapiens
gccacauggagcuugacuu

SEQ ID NO: 478109 - RNA, 22 nt, Homo sapiens
gccagaguauuggucuccucuc

SEQ ID NO: 478110 - RNA, 17 nt, Homo sapiens
gccagauggacuccagc

SEQ ID NO: 478111 - RNA, 22 nt, Homo sapiens
gccauagagggccugaugacau

SEQ ID NO: 478112 - RNA, 12 nt, Homo sapiens
gccauugcacuc

SEQ ID NO: 478113 - RNA, 23 nt, Homo sapiens
gcccacguggaggcccaccugcc

SEQ ID NO: 478114 - RNA, 15 nt, Homo sapiens
gcccaguguguuucu

SEQ ID NO: 478115 - RNA, 18 nt, Homo sapiens
gcccaguuucacugccau

SEQ ID NO: 478116 - RNA, 23 nt, Homo sapiens
gccccagcacuaaagcaguggac

SEQ ID NO: 478117 - RNA, 13 nt, Homo sapiens
gcccccaacagca

SEQ ID NO: 478118 - RNA, 19 nt, Homo sapiens
gcccgugcccuaccacaca

SEQ ID NO: 478119 - RNA, 19 nt, Homo sapiens
gcccugccugcugcaucuu

SEQ ID NO: 478120 - RNA, 15 nt, Homo sapiens
gcccuucaugcauuu

SEQ ID NO: 478121 - RNA, 13 nt, Homo sapiens
gccgacggagccg

SEQ ID NO: 478122 - RNA, 13 nt, Homo sapiens
gccuaacacuggg

SEQ ID NO: 478123 - RNA, 16 nt, Homo sapiens
gccuagccgaccucag

SEQ ID NO: 478124 - RNA, 21 nt, Homo sapiens
gccuauaauuggagggaaaaa

SEQ ID NO: 478125 - RNA, 17 nt, Homo sapiens
gccuauuucucuuugca

SEQ ID NO: 478126 - RNA, 14 nt, Homo sapiens
gccucaagaucaau

SEQ ID NO: 478127 - RNA, 19 nt, Homo sapiens
gccucaguaagacgacaag

SEQ ID NO: 478128 - RNA, 14 nt, Homo sapiens
gccucauugcuugg

SEQ ID NO: 478129 - RNA, 17 nt, Homo sapiens
gccucccaaagugcuga

SEQ ID NO: 478130 - RNA, 19 nt, Homo sapiens
gccucccaggagaaucacu

SEQ ID NO: 478131 - RNA, 17 nt, Homo sapiens
gccucccccaauggcaa

SEQ ID NO: 478132 - RNA, 23 nt, Homo sapiens
gccuccccuccucugcuugccau

SEQ ID NO: 478133 - RNA, 21 nt, Homo sapiens
gccuccucuguccagggcccu

SEQ ID NO: 478134 - RNA, 19 nt, Homo sapiens
gccugcucgcccacuuccu

SEQ ID NO: 478135 - RNA, 13 nt, Homo sapiens
gccuguaauccca

SEQ ID NO: 478136 - RNA, 21 nt, Homo sapiens
gccuucccuaaaaucagggaa

SEQ ID NO: 478137 - RNA, 13 nt, Homo sapiens
gcuaaaagggaaa

SEQ ID NO: 478138 - RNA, 13 nt, Homo sapiens
gcuaacacacagc

SEQ ID NO: 478139 - RNA, 13 nt, Homo sapiens
gcuagaaccugga

SEQ ID NO: 478140 - RNA, 17 nt, Homo sapiens
gcuagaguucuccagac

SEQ ID NO: 478141 - RNA, 17 nt, Homo sapiens
gcuauaacuauguugau

SEQ ID NO: 478142 - RNA, 18 nt, Homo sapiens
gcuaucccuucucagaaa

SEQ ID NO: 478143 - RNA, 22 nt, Homo sapiens
gcucacuguucuauucaucuca

SEQ ID NO: 478144 - RNA, 18 nt, Homo sapiens
gcucaggaccaggcaaug

SEQ ID NO: 478145 - RNA, 17 nt, Homo sapiens
gcucaguucugccuuau

SEQ ID NO: 478146 - RNA, 18 nt, Homo sapiens
gcucauauuguucccuau

SEQ ID NO: 478147 - RNA, 11 nt, Homo sapiens
gcucauuucag

SEQ ID NO: 478148 - RNA, 19 nt, Homo sapiens
gcuccaguugucuauucau

SEQ ID NO: 478149 - RNA, 15 nt, Homo sapiens
gcuccugucugccag

SEQ ID NO: 478150 - RNA, 16 nt, Homo sapiens
gcucugccuguggagu

SEQ ID NO: 478151 - RNA, 18 nt, Homo sapiens
gcucugugugguccaggu

SEQ ID NO: 478152 - RNA, 16 nt, Homo sapiens
gcugagucugcagaug

SEQ ID NO: 478153 - RNA, 14 nt, Homo sapiens
gcugcaugcgagug

SEQ ID NO: 478154 - RNA, 21 nt, Homo sapiens
gcuggaacagauucacacugu

SEQ ID NO: 478155 - RNA, 23 nt, Homo sapiens
gcuggcaccuuaguugcaugacc

SEQ ID NO: 478156 - RNA, 14 nt, Homo sapiens
gcuuauaaaaucaa

SEQ ID NO: 478157 - RNA, 21 nt, Homo sapiens
gcuuaucaguaguaucaauga

SEQ ID NO: 478158 - RNA, 18 nt, Homo sapiens
gcuucgcaaaauguuuca

SEQ ID NO: 478159 - RNA, 23 nt, Homo sapiens
gcuugauugcguggaauugugcu

SEQ ID NO: 478160 - RNA, 11 nt, Homo sapiens
gcuugccaucc

SEQ ID NO: 478161 - RNA, 14 nt, Homo sapiens
gcuuguguuuuuaa

SEQ ID NO: 478162 - RNA, 23 nt, Homo sapiens
gcuuuaauuguuaagauaugaug

SEQ ID NO: 478163 - RNA, 13 nt, Homo sapiens
gcuuuaccuuuau

SEQ ID NO: 478164 - RNA, 13 nt, Homo sapiens
gcuuucacuuccu

SEQ ID NO: 478165 - RNA, 17 nt, Homo sapiens
gcuuuccucccaaaggc

SEQ ID NO: 478166 - RNA, 23 nt, Homo sapiens
gcuuucugucuccuuaacacuga

SEQ ID NO: 478167 - RNA, 17 nt, Homo sapiens
gcuuuucuaacuaagag

SEQ ID NO: 478168 - RNA, 15 nt, Homo sapiens
ggaaaaugugcaaua

SEQ ID NO: 478169 - RNA, 14 nt, Homo sapiens
ggaaacaauaucaa

SEQ ID NO: 478170 - RNA, 20 nt, Homo sapiens
ggaaacuggaugaggucaua

SEQ ID NO: 478171 - RNA, 13 nt, Homo sapiens
ggaacacaaugac

SEQ ID NO: 478172 - RNA, 20 nt, Homo sapiens
ggaacagauucacacugucu

SEQ ID NO: 478173 - RNA, 23 nt, Homo sapiens
ggaaccacaagacugcacaucaa

SEQ ID NO: 478174 - RNA, 21 nt, Homo sapiens
ggaagcuuucugucuccuuaa

SEQ ID NO: 478175 - RNA, 22 nt, Homo sapiens
ggaaggucucaggagaagggau

SEQ ID NO: 478176 - RNA, 17 nt, Homo sapiens
ggaagugugugaucugu

SEQ ID NO: 478177 - RNA, 18 nt, Homo sapiens
ggacacuaauacaccagg

SEQ ID NO: 478178 - RNA, 19 nt, Homo sapiens
ggacagucaccucauggaa

SEQ ID NO: 478179 - RNA, 20 nt, Homo sapiens
ggacuaauccaauaccucuu

SEQ ID NO: 478180 - RNA, 22 nt, Homo sapiens
ggacugaucgauuugcacccac

SEQ ID NO: 478181 - RNA, 13 nt, Homo sapiens
ggacugaugucau

SEQ ID NO: 478182 - RNA, 14 nt, Homo sapiens
ggagaauugaaaag

SEQ ID NO: 478183 - RNA, 14 nt, Homo sapiens
ggagagagacucca

SEQ ID NO: 478184 - RNA, 23 nt, Homo sapiens
ggagcaaaggcugagaacacugu

SEQ ID NO: 478185 - RNA, 13 nt, Homo sapiens
ggagcaacagagg

SEQ ID NO: 478186 - RNA, 20 nt, Homo sapiens
ggagccaacagaugugucag

SEQ ID NO: 478187 - RNA, 12 nt, Homo sapiens
ggaggagcagug

SEQ ID NO: 478188 - RNA, 18 nt, Homo sapiens
ggaguacaccccaacagc

SEQ ID NO: 478189 - RNA, 22 nt, Homo sapiens
ggaguacaccccaacagcaccc

SEQ ID NO: 478190 - RNA, 16 nt, Homo sapiens
ggagucccuuuggcaa

SEQ ID NO: 478191 - RNA, 19 nt, Homo sapiens
ggaucuucccacuuugcca

SEQ ID NO: 478192 - RNA, 13 nt, Homo sapiens
ggaugaggucaua

SEQ ID NO: 478193 - RNA, 21 nt, Homo sapiens
ggaugcaacaaaaugauccuu

SEQ ID NO: 478194 - RNA, 13 nt, Homo sapiens
ggauggaaaggga

SEQ ID NO: 478195 - RNA, 22 nt, Homo sapiens
ggauuagguguucaggccagua

SEQ ID NO: 478196 - RNA, 14 nt, Homo sapiens
ggauucccaggaug

SEQ ID NO: 478197 - RNA, 16 nt, Homo sapiens
ggauucuguaugccaa

SEQ ID NO: 478198 - RNA, 19 nt, Homo sapiens
ggauuuccagccagggcug

SEQ ID NO: 478199 - RNA, 20 nt, Homo sapiens
ggcaacagagcgagauucca

SEQ ID NO: 478200 - RNA, 15 nt, Homo sapiens
ggcaaccuguugaau

SEQ ID NO: 478201 - RNA, 20 nt, Homo sapiens
ggcaacucacgggugcauga

SEQ ID NO: 478202 - RNA, 22 nt, Homo sapiens
ggcaauaggugugaacagggaa

SEQ ID NO: 478203 - RNA, 14 nt, Homo sapiens
ggcaauagucaaau

SEQ ID NO: 478204 - RNA, 22 nt, Homo sapiens
ggcacccacaaauaaaugacaa

SEQ ID NO: 478205 - RNA, 16 nt, Homo sapiens
ggcagcuguugcagug

SEQ ID NO: 478206 - RNA, 19 nt, Homo sapiens
ggcagcuguugcagugagc

SEQ ID NO: 478207 - RNA, 20 nt, Homo sapiens
ggcaggagaaucacuugaac

SEQ ID NO: 478208 - RNA, 19 nt, Homo sapiens
ggcaggagaaucgcuugaa

SEQ ID NO: 478209 - RNA, 20 nt, Homo sapiens
ggcaggagaauugcuugaac

SEQ ID NO: 478210 - RNA, 14 nt, Homo sapiens
ggcauagaugcagg

SEQ ID NO: 478211 - RNA, 13 nt, Homo sapiens
ggcaucacagcua

SEQ ID NO: 478212 - RNA, 20 nt, Homo sapiens
ggcauugucuguaaugacaa

SEQ ID NO: 478213 - RNA, 17 nt, Homo sapiens
ggccaguaccuuuccau

SEQ ID NO: 478214 - RNA, 15 nt, Homo sapiens
ggccuaacacugggc

SEQ ID NO: 478215 - RNA, 16 nt, Homo sapiens
ggcuacacagggaugu

SEQ ID NO: 478216 - RNA, 17 nt, Homo sapiens
ggcuacacugacacugg

SEQ ID NO: 478217 - RNA, 23 nt, Homo sapiens
ggcuaccucaccugggcagggau

SEQ ID NO: 478218 - RNA, 14 nt, Homo sapiens
ggcucucacuccag

SEQ ID NO: 478219 - RNA, 14 nt, Homo sapiens
ggcuggagugcagu

SEQ ID NO: 478220 - RNA, 15 nt, Homo sapiens
ggcuggagugcagug

SEQ ID NO: 478221 - RNA, 16 nt, Homo sapiens
ggcuggagugcagugg

SEQ ID NO: 478222 - RNA, 14 nt, Homo sapiens
ggcuuuuauugcca

SEQ ID NO: 478223 - RNA, 14 nt, Homo sapiens
gggaaaacauucca

SEQ ID NO: 478224 - RNA, 13 nt, Homo sapiens
gggaacucaccug

SEQ ID NO: 478225 - RNA, 14 nt, Homo sapiens
gggaagacuguggc

SEQ ID NO: 478226 - RNA, 16 nt, Homo sapiens
gggacagucaccucau

SEQ ID NO: 478227 - RNA, 22 nt, Homo sapiens
gggaggcagagguugcagugaa

SEQ ID NO: 478228 - RNA, 13 nt, Homo sapiens
ucugaugcaagca

SEQ ID NO: 478229 - RNA, 21 nt, Homo sapiens
ucugaugcaagcaagaaacac

SEQ ID NO: 478230 - RNA, 14 nt, Homo sapiens
ucugccgcugccau

SEQ ID NO: 478231 - RNA, 16 nt, Homo sapiens
ucugcuauauuuucau

SEQ ID NO: 478232 - RNA, 19 nt, Homo sapiens
ucuggccguugauguuggc

SEQ ID NO: 478233 - RNA, 22 nt, Homo sapiens
ucuggugguguuaaucauuuca

SEQ ID NO: 478234 - RNA, 12 nt, Homo sapiens
ucugucucaaaa

SEQ ID NO: 478235 - RNA, 11 nt, Homo sapiens
ucuuaacucac

SEQ ID NO: 478236 - RNA, 19 nt, Homo sapiens
ucuuacaaugcauucugag

SEQ ID NO: 478237 - RNA, 12 nt, Homo sapiens
ucuuacacaaga

SEQ ID NO: 478238 - RNA, 22 nt, Homo sapiens
ucuuacugcaggcaagugggau

SEQ ID NO: 478239 - RNA, 16 nt, Homo sapiens
ucuuaugcaggacuga

SEQ ID NO: 478240 - RNA, 16 nt, Homo sapiens
ucuucaauaaaccaca

SEQ ID NO: 478241 - RNA, 22 nt, Homo sapiens
ucuucagagauaggccuguggg

SEQ ID NO: 478242 - RNA, 16 nt, Homo sapiens
ucuucagagcugacac

SEQ ID NO: 478243 - RNA, 19 nt, Homo sapiens
ucuucccacuuugccacug

SEQ ID NO: 478244 - RNA, 17 nt, Homo sapiens
ucuuccuucauuguucu

SEQ ID NO: 478245 - RNA, 16 nt, Homo sapiens
ucuucuacuaccccca

SEQ ID NO: 478246 - RNA, 13 nt, Homo sapiens
ucuucuaugcuuu

SEQ ID NO: 478247 - RNA, 20 nt, Homo sapiens
ucuugggaauuuucuuccaa

SEQ ID NO: 478248 - RNA, 22 nt, Homo sapiens
ucuuguaaagguccuggcaaag

SEQ ID NO: 478249 - RNA, 14 nt, Homo sapiens
ucuuugaaagggcu

SEQ ID NO: 478250 - RNA, 21 nt, Homo sapiens
ucuuugagauaauacauuccg

SEQ ID NO: 478251 - RNA, 15 nt, Homo sapiens
ucuuuucaaccuacu

SEQ ID NO: 478252 - RNA, 16 nt, Homo sapiens
ugaaaacccuugccau

SEQ ID NO: 478253 - RNA, 15 nt, Homo sapiens
ugaaaaggacaaaua

SEQ ID NO: 478254 - RNA, 22 nt, Homo sapiens
ugaaaaugcuguauuagucaca

SEQ ID NO: 478255 - RNA, 16 nt, Homo sapiens
ugaaacauuugcaaaa

SEQ ID NO: 478256 - RNA, 21 nt, Homo sapiens
ugaaaccuguucuaccaauua

SEQ ID NO: 478257 - RNA, 16 nt, Homo sapiens
ugaaauaucaugcucc

SEQ ID NO: 478258 - RNA, 16 nt, Homo sapiens
ugaaaugacuuuucca

SEQ ID NO: 478259 - RNA, 21 nt, Homo sapiens
ugaaaugcagagucaaugaac

SEQ ID NO: 478260 - RNA, 13 nt, Homo sapiens
ugaacacuggggg

SEQ ID NO: 478261 - RNA, 17 nt, Homo sapiens
ugaacaucauggacuga

SEQ ID NO: 478262 - RNA, 15 nt, Homo sapiens
ugaaccuagauugca

SEQ ID NO: 478263 - RNA, 14 nt, Homo sapiens
ugaacuucagggag

SEQ ID NO: 478264 - RNA, 21 nt, Homo sapiens
ugaagaaaucgggagugcacu

SEQ ID NO: 478265 - RNA, 19 nt, Homo sapiens
ugaagaagagaaugugaca

SEQ ID NO: 478266 - RNA, 15 nt, Homo sapiens
ugaagccucacuuau

SEQ ID NO: 478267 - RNA, 13 nt, Homo sapiens
ugaaggaugccau

SEQ ID NO: 478268 - RNA, 23 nt, Homo sapiens
ugaauaugggguugguguucuca

SEQ ID NO: 478269 - RNA, 12 nt, Homo sapiens
ugaaucacagua

SEQ ID NO: 478270 - RNA, 22 nt, Homo sapiens
ugaaucacaguauacgcuccau

SEQ ID NO: 478271 - RNA, 17 nt, Homo sapiens
ugaaugcaauaguagga

SEQ ID NO: 478272 - RNA, 15 nt, Homo sapiens
ugacaagugagacaa

SEQ ID NO: 478273 - RNA, 14 nt, Homo sapiens
ugacagaacacugu

SEQ ID NO: 478274 - RNA, 12 nt, Homo sapiens
ugacagaucucu

SEQ ID NO: 478275 - RNA, 14 nt, Homo sapiens
ugacaugugcuuug

SEQ ID NO: 478276 - RNA, 19 nt, Homo sapiens
ugaccagaaaucaaaaagg

SEQ ID NO: 478277 - RNA, 21 nt, Homo sapiens
ugaccaguuuaaccugaugca

SEQ ID NO: 478278 - RNA, 22 nt, Homo sapiens
ugacucaacaguuuccagucau

SEQ ID NO: 478279 - RNA, 20 nt, Homo sapiens
ugacucaccuugcucugcca

SEQ ID NO: 478280 - RNA, 15 nt, Homo sapiens
ugacucgggccuuag

SEQ ID NO: 478281 - RNA, 16 nt, Homo sapiens
ugacucgggccuuaga

SEQ ID NO: 478282 - RNA, 23 nt, Homo sapiens
ugacucuccagaaagcucaucuc

SEQ ID NO: 478283 - RNA, 20 nt, Homo sapiens
ugacuugagaaacaaauaau

SEQ ID NO: 478284 - RNA, 14 nt, Homo sapiens
ugagaagaaugacu

SEQ ID NO: 478285 - RNA, 14 nt, Homo sapiens
ugagacuacuucag

SEQ ID NO: 478286 - RNA, 15 nt, Homo sapiens
ugagagacacacuga

SEQ ID NO: 478287 - RNA, 19 nt, Homo sapiens
ugagagacacacugaagaa

SEQ ID NO: 478288 - RNA, 11 nt, Homo sapiens
ugagaguacac

SEQ ID NO: 478289 - RNA, 16 nt, Homo sapiens
ugagaguacaccccaa

SEQ ID NO: 478290 - RNA, 14 nt, Homo sapiens
ugagcauggagcug

SEQ ID NO: 478291 - RNA, 19 nt, Homo sapiens
ugagccagucccucagcca

SEQ ID NO: 478292 - RNA, 15 nt, Homo sapiens
ugagcuacuucagga

SEQ ID NO: 478293 - RNA, 16 nt, Homo sapiens
ugagcugggggaagaa

SEQ ID NO: 478294 - RNA, 22 nt, Homo sapiens
ugaggcagacagcagcucaggc

SEQ ID NO: 478295 - RNA, 18 nt, Homo sapiens
ugaggguauaaagacauc

SEQ ID NO: 478296 - RNA, 12 nt, Homo sapiens
ugagguaaccuc

SEQ ID NO: 478297 - RNA, 14 nt, Homo sapiens
ugagguguugcuaa

SEQ ID NO: 478298 - RNA, 15 nt, Homo sapiens
ugaguaaaugaauaa

SEQ ID NO: 478299 - RNA, 18 nt, Homo sapiens
ugagucugcagaugagga

SEQ ID NO: 478300 - RNA, 21 nt, Homo sapiens
ugaguugguguugacaugugc

SEQ ID NO: 478301 - RNA, 21 nt, Homo sapiens
ugauaagagggcacacacugu

SEQ ID NO: 478302 - RNA, 15 nt, Homo sapiens
ugauaagcaacucca

SEQ ID NO: 478303 - RNA, 21 nt, Homo sapiens
ugauacaaauugcagacugug

SEQ ID NO: 478304 - RNA, 12 nt, Homo sapiens
ugauacguguau

SEQ ID NO: 478305 - RNA, 13 nt, Homo sapiens
ugauacguguaug

SEQ ID NO: 478306 - RNA, 17 nt, Homo sapiens
ugauaugggucuugaua

SEQ ID NO: 478307 - RNA, 13 nt, Homo sapiens
ugauccacccacc

SEQ ID NO: 478308 - RNA, 13 nt, Homo sapiens
ugaugcugggauu

SEQ ID NO: 478309 - RNA, 15 nt, Homo sapiens
ugauggcagagccag

SEQ ID NO: 478310 - RNA, 17 nt, Homo sapiens
ugauguuggcugggaac

SEQ ID NO: 478311 - RNA, 18 nt, Homo sapiens
ugauuggccccacugacg

SEQ ID NO: 478312 - RNA, 13 nt, Homo sapiens
ugauugugauuau

SEQ ID NO: 478313 - RNA, 19 nt, Homo sapiens
ugauuguguuuauugauga

SEQ ID NO: 478314 - RNA, 19 nt, Homo sapiens
ugcaaagauuugcuuuaau

SEQ ID NO: 478315 - RNA, 17 nt, Homo sapiens
ugcaaagucaugcaaag

SEQ ID NO: 478316 - RNA, 13 nt, Homo sapiens
ugcaacaacaugu

SEQ ID NO: 478317 - RNA, 21 nt, Homo sapiens
ugcaagacauagaauaguguu

SEQ ID NO: 478318 - RNA, 15 nt, Homo sapiens
ugcaauaaaaugggu

SEQ ID NO: 478319 - RNA, 16 nt, Homo sapiens
ugcaaucaggcucaaa

SEQ ID NO: 478320 - RNA, 20 nt, Homo sapiens
ugcaaucugguugugauuua

SEQ ID NO: 478321 - RNA, 18 nt, Homo sapiens
ugcacaaacucaccaucu

SEQ ID NO: 478322 - RNA, 19 nt, Homo sapiens
ugcacacccaucgucuuua

SEQ ID NO: 478323 - RNA, 15 nt, Homo sapiens
ugcacagaagacagc

SEQ ID NO: 478324 - RNA, 15 nt, Homo sapiens
ugcaccauugcacuc

SEQ ID NO: 478325 - RNA, 19 nt, Homo sapiens
ugcacucuagccuggcaac

SEQ ID NO: 478326 - RNA, 14 nt, Homo sapiens
ugcacuuauucuca

SEQ ID NO: 478327 - RNA, 16 nt, Homo sapiens
ugcagaaaauugccua

SEQ ID NO: 478328 - RNA, 18 nt, Homo sapiens
ugcagaaaauugccuaaa

SEQ ID NO: 478329 - RNA, 15 nt, Homo sapiens
ugcagaugaggacua

SEQ ID NO: 478330 - RNA, 17 nt, Homo sapiens
ugcaggcaagugggaua

SEQ ID NO: 478331 - RNA, 13 nt, Homo sapiens
ugcaggcacagua

SEQ ID NO: 478332 - RNA, 17 nt, Homo sapiens
ugcaggcaucacagcua

SEQ ID NO: 478333 - RNA, 15 nt, Homo sapiens
ugcauagcagcugcu

SEQ ID NO: 478334 - RNA, 20 nt, Homo sapiens
ugcauauccaacaugugcuc

SEQ ID NO: 478335 - RNA, 15 nt, Homo sapiens
ugcauauguaugacu

SEQ ID NO: 478336 - RNA, 16 nt, Homo sapiens
ugcaugcagcaucuaa

SEQ ID NO: 478337 - RNA, 23 nt, Homo sapiens
ugcaugccuggcacaacaucaag

SEQ ID NO: 478338 - RNA, 14 nt, Homo sapiens
ugcauuaucuauga

SEQ ID NO: 478339 - RNA, 17 nt, Homo sapiens
ugccaagcucaggacca

SEQ ID NO: 478340 - RNA, 18 nt, Homo sapiens
ugccacccucaugcugug

SEQ ID NO: 478341 - RNA, 14 nt, Homo sapiens
ugccagacaugugg

SEQ ID NO: 478342 - RNA, 12 nt, Homo sapiens
ugcccagugugu

SEQ ID NO: 478343 - RNA, 13 nt, Homo sapiens
ugcccccaacagc

SEQ ID NO: 478344 - RNA, 16 nt, Homo sapiens
ugcccuccuaucccca

SEQ ID NO: 478345 - RNA, 16 nt, Homo sapiens
ugccgcuacaaaaagg

SEQ ID NO: 478346 - RNA, 21 nt, Homo sapiens
ugccucauuaccuugugcuaa

SEQ ID NO: 478347 - RNA, 22 nt, Homo sapiens
ugccucauuaccuugugcuaau

SEQ ID NO: 478348 - RNA, 19 nt, Homo sapiens
ugccugcaggcaugaguca

SEQ ID NO: 478349 - RNA, 16 nt, Homo sapiens
ugccuguaaucccagc

SEQ ID NO: 478350 - RNA, 22 nt, Homo sapiens
ugcuaacccccaaauacucuga

SEQ ID NO: 478351 - RNA, 22 nt, Homo sapiens
ugcuaacuagcuuggaaacugg

SEQ ID NO: 478352 - RNA, 12 nt, Homo sapiens
ugcugaagccaa

SEQ ID NO: 478353 - RNA, 20 nt, Homo sapiens
ugcugagaccccccaccacc

SEQ ID NO: 478354 - RNA, 12 nt, Homo sapiens
ugcugccaaaca

SEQ ID NO: 478355 - RNA, 17 nt, Homo sapiens
ugcugccaaacacccau

SEQ ID NO: 478356 - RNA, 21 nt, Homo sapiens
ugcugccaaacacccaugccc

SEQ ID NO: 478357 - RNA, 21 nt, Homo sapiens
ugcuggagucaugugccucug

SEQ ID NO: 478358 - RNA, 18 nt, Homo sapiens
ugcuugggcuauaccugg

SEQ ID NO: 478359 - RNA, 13 nt, Homo sapiens
ugcuugucaucca

SEQ ID NO: 478360 - RNA, 17 nt, Homo sapiens
ugcuuuucuaaucugca

SEQ ID NO: 478361 - RNA, 16 nt, Homo sapiens
uggaaaaaaaggaaga

SEQ ID NO: 478362 - RNA, 15 nt, Homo sapiens
uggaaaaugugcaau

SEQ ID NO: 478363 - RNA, 16 nt, Homo sapiens
uggaaaaugugcaaua

SEQ ID NO: 478364 - RNA, 21 nt, Homo sapiens
uggaaagacagcuucucaucc

SEQ ID NO: 478365 - RNA, 15 nt, Homo sapiens
uggaaauucccuuca

SEQ ID NO: 478366 - RNA, 20 nt, Homo sapiens
uggaaauucccuucaucugg

SEQ ID NO: 478367 - RNA, 19 nt, Homo sapiens
uggaacagauucacacugu

SEQ ID NO: 478368 - RNA, 16 nt, Homo sapiens
uggaacccccagaaua

SEQ ID NO: 478369 - RNA, 18 nt, Homo sapiens
uggaagacacauugaaag

SEQ ID NO: 478370 - RNA, 19 nt, Homo sapiens
uggaagguggggacaggga

SEQ ID NO: 478371 - RNA, 19 nt, Homo sapiens
uggaaguugcauggcauca

SEQ ID NO: 478372 - RNA, 23 nt, Homo sapiens
uggaaguugcauggcaucaccuc

SEQ ID NO: 478373 - RNA, 16 nt, Homo sapiens
uggaauacuucuacca

SEQ ID NO: 478374 - RNA, 18 nt, Homo sapiens
uggaauuacaggcacaua

SEQ ID NO: 478375 - RNA, 20 nt, Homo sapiens
uggacacuugcucaugcccu

SEQ ID NO: 478376 - RNA, 13 nt, Homo sapiens
uggagauagggaa

SEQ ID NO: 478377 - RNA, 17 nt, Homo sapiens
uggagcucgugggacag

SEQ ID NO: 478378 - RNA, 16 nt, Homo sapiens
uggaggcaccauuugu

SEQ ID NO: 478379 - RNA, 20 nt, Homo sapiens
uggagggcacauuccuugcc

SEQ ID NO: 478380 - RNA, 20 nt, Homo sapiens
uggagggcuagaaccuggca

SEQ ID NO: 478381 - RNA, 21 nt, Homo sapiens
uggaucuaucaccugucauca

SEQ ID NO: 478382 - RNA, 17 nt, Homo sapiens
uggcaacaucuugcaaa

SEQ ID NO: 478383 - RNA, 22 nt, Homo sapiens
uggcaaccugcuuucaagaccc

SEQ ID NO: 478384 - RNA, 14 nt, Homo sapiens
uggcaauagucaaa

SEQ ID NO: 478385 - RNA, 16 nt, Homo sapiens
uggcacccaugcaccu

SEQ ID NO: 478386 - RNA, 23 nt, Homo sapiens
uggcacuaguauuucuaugaaau

SEQ ID NO: 478387 - RNA, 15 nt, Homo sapiens
uggcacugccaugca

SEQ ID NO: 478388 - RNA, 22 nt, Homo sapiens
uggcaucucccacacaagaccc

SEQ ID NO: 478389 - RNA, 14 nt, Homo sapiens
uggccgucgcugug

SEQ ID NO: 478390 - RNA, 17 nt, Homo sapiens
uggccuccucuucuaug

SEQ ID NO: 478391 - RNA, 15 nt, Homo sapiens
uggcuacacagggau

SEQ ID NO: 478392 - RNA, 15 nt, Homo sapiens
uggcucacaccugua

SEQ ID NO: 478393 - RNA, 17 nt, Homo sapiens
uggcugauggaguaaau

SEQ ID NO: 478394 - RNA, 19 nt, Homo sapiens
uggcuucugcuugucaucc

SEQ ID NO: 478395 - RNA, 17 nt, Homo sapiens
ugggaacuccuaaauca

SEQ ID NO: 478396 - RNA, 17 nt, Homo sapiens
ugggacugaugucaucu

SEQ ID NO: 478397 - RNA, 18 nt, Homo sapiens
ugggagacugcugaguca

SEQ ID NO: 478398 - RNA, 16 nt, Homo sapiens
ugggcagcucaucucu

SEQ ID NO: 478399 - RNA, 13 nt, Homo sapiens
ugggccuccucac

SEQ ID NO: 478400 - RNA, 21 nt, Homo sapiens
ugggcucgccacaucccauga

SEQ ID NO: 478401 - RNA, 19 nt, Homo sapiens
ugggcugggcucgccacau

SEQ ID NO: 478402 - RNA, 14 nt, Homo sapiens
uggggaagacugug

SEQ ID NO: 478403 - RNA, 16 nt, Homo sapiens
uggggcugaugcaguu

SEQ ID NO: 478404 - RNA, 22 nt, Homo sapiens
ugggggaagacuuuaaaccacc

SEQ ID NO: 478405 - RNA, 23 nt, Homo sapiens
ugggggaagacuuuaaaccaccu

SEQ ID NO: 478406 - RNA, 21 nt, Homo sapiens
uggguuagggaaaacauucca

SEQ ID NO: 478407 - RNA, 23 nt, Homo sapiens
uggguuuugaacauaaagccuug

SEQ ID NO: 478408 - RNA, 16 nt, Homo sapiens
ugguaauuuguaucug

SEQ ID NO: 478409 - RNA, 15 nt, Homo sapiens
ugguaguuuggaaag

SEQ ID NO: 478410 - RNA, 18 nt, Homo sapiens
uggucugggcaccaccuc

SEQ ID NO: 478411 - RNA, 18 nt, Homo sapiens
uggugcccuguucucuac

SEQ ID NO: 478412 - RNA, 15 nt, Homo sapiens
uggugugugccucau

SEQ ID NO: 478413 - RNA, 14 nt, Homo sapiens
ugguucugugccaa

SEQ ID NO: 478414 - RNA, 20 nt, Homo sapiens
ugguuuggaguuuauuugag

SEQ ID NO: 478415 - RNA, 17 nt, Homo sapiens
uguaaaauuucacuuaa

SEQ ID NO: 478416 - RNA, 15 nt, Homo sapiens
uguaaagcaggugcc

SEQ ID NO: 478417 - RNA, 20 nt, Homo sapiens
uguaaauacuguuuuuaaca

SEQ ID NO: 478418 - RNA, 20 nt, Homo sapiens
uguaacuggguucaaaaaga

SEQ ID NO: 478419 - RNA, 19 nt, Homo sapiens
uguaaggaauuaucaauua

SEQ ID NO: 478420 - RNA, 16 nt, Homo sapiens
uguaaguaaugauaca

SEQ ID NO: 478421 - RNA, 18 nt, Homo sapiens
uguaaguuuaugucuaaa

SEQ ID NO: 478422 - RNA, 18 nt, Homo sapiens
uguaauuccucccuaaga

SEQ ID NO: 478423 - RNA, 19 nt, Homo sapiens
uguaccuaggauauguuaa

SEQ ID NO: 478424 - RNA, 18 nt, Homo sapiens
uguagaugacauggugaa

SEQ ID NO: 478425 - RNA, 20 nt, Homo sapiens
uguaucuaccucacuauuca

SEQ ID NO: 478426 - RNA, 17 nt, Homo sapiens
uguauuagucacagaga

SEQ ID NO: 478427 - RNA, 12 nt, Homo sapiens
ugucaaugucuu

SEQ ID NO: 478428 - RNA, 22 nt, Homo sapiens
ugucauaagcgaucacuuccua

SEQ ID NO: 478429 - RNA, 16 nt, Homo sapiens
uguccucaccacaugc

SEQ ID NO: 478430 - RNA, 19 nt, Homo sapiens
ugucuaaaaauaaaaugca

SEQ ID NO: 478431 - RNA, 14 nt, Homo sapiens
ugucucccaaaaau

SEQ ID NO: 478432 - RNA, 17 nt, Homo sapiens
ugugaacguguauguac

SEQ ID NO: 478433 - RNA, 20 nt, Homo sapiens
ugugacaugaacccauccaa

SEQ ID NO: 478434 - RNA, 17 nt, Homo sapiens
uguggcugcuagcacuu

SEQ ID NO: 478435 - RNA, 21 nt, Homo sapiens
uguggcugcuagcacuuggag

SEQ ID NO: 478436 - RNA, 22 nt, Homo sapiens
ugugguuaaugccauggacaga

SEQ ID NO: 478437 - RNA, 18 nt, Homo sapiens
ugugugaacuaacaugca

SEQ ID NO: 478438 - RNA, 18 nt, Homo sapiens
ugugugaucugugggcac

SEQ ID NO: 478439 - RNA, 14 nt, Homo sapiens
uguuaaaacuggga

SEQ ID NO: 478440 - RNA, 14 nt, Homo sapiens
uguuauuauauaau

SEQ ID NO: 478441 - RNA, 13 nt, Homo sapiens
uguuauuguggaa

SEQ ID NO: 478442 - RNA, 16 nt, Homo sapiens
uguuauuuguacaguu

SEQ ID NO: 478443 - RNA, 18 nt, Homo sapiens
uguucacuuauugacuau

SEQ ID NO: 478444 - RNA, 14 nt, Homo sapiens
uguucccacucccu

SEQ ID NO: 478445 - RNA, 23 nt, Homo sapiens
uguucccacucccucucuugccg

SEQ ID NO: 478446 - RNA, 15 nt, Homo sapiens
uguucccuauuuugc

SEQ ID NO: 478447 - RNA, 14 nt, Homo sapiens
uguuccugccacau

SEQ ID NO: 478448 - RNA, 19 nt, Homo sapiens
uguucugaggauucagggg

SEQ ID NO: 478449 - RNA, 14 nt, Homo sapiens
uguugacaugugcu

SEQ ID NO: 478450 - RNA, 19 nt, Homo sapiens
uguuggaaaaugugcaaua

SEQ ID NO: 478451 - RNA, 15 nt, Homo sapiens
uguuguguccaaucc

SEQ ID NO: 478452 - RNA, 16 nt, Homo sapiens
uguuguguuugucaaa

SEQ ID NO: 478453 - RNA, 13 nt, Homo sapiens
uguuuaaaagcau

SEQ ID NO: 478454 - RNA, 18 nt, Homo sapiens
uguuucugaucugaugca

SEQ ID NO: 478455 - RNA, 17 nt, Homo sapiens
uguuuugcccaccagau

SEQ ID NO: 478456 - RNA, 23 nt, Homo sapiens
uuaaaaaagugguggcaaaagac

SEQ ID NO: 478457 - RNA, 12 nt, Homo sapiens
uuaaaccaccua

SEQ ID NO: 478458 - RNA, 14 nt, Homo sapiens
uuaaauacuacaaa

SEQ ID NO: 478459 - RNA, 19 nt, Homo sapiens
uuaaauggagaaaggaccc

SEQ ID NO: 478460 - RNA, 14 nt, Homo sapiens
uuaaauuaugggaa

SEQ ID NO: 478461 - RNA, 17 nt, Homo sapiens
uuaacacucuaagagaa

SEQ ID NO: 478462 - RNA, 19 nt, Homo sapiens
uuaaggggagcaacagagg

SEQ ID NO: 478463 - RNA, 21 nt, Homo sapiens
uuaagucuuaucaagcagcca

SEQ ID NO: 478464 - RNA, 18 nt, Homo sapiens
uuaauaggaaaaacggaa

SEQ ID NO: 478465 - RNA, 20 nt, Homo sapiens
uuacaaugcauucugaggua

SEQ ID NO: 478466 - RNA, 18 nt, Homo sapiens
uuacagagaaaagacaua

SEQ ID NO: 478467 - RNA, 16 nt, Homo sapiens
uuacagggaaugccug

SEQ ID NO: 478468 - RNA, 17 nt, Homo sapiens
uuacauuugaaaucuau

SEQ ID NO: 478469 - RNA, 15 nt, Homo sapiens
uuaccuaccacaugc

SEQ ID NO: 478470 - RNA, 22 nt, Homo sapiens
uuaccugggaaagggcuguuau

SEQ ID NO: 478471 - RNA, 22 nt, Homo sapiens
uuacuauuuauugcugaaugac

SEQ ID NO: 478472 - RNA, 17 nt, Homo sapiens
uuagggaaaacauucca

SEQ ID NO: 478473 - RNA, 21 nt, Homo sapiens
uuaguagagaugggguuucac

SEQ ID NO: 478474 - RNA, 17 nt, Homo sapiens
uuauagugacaaugaag

SEQ ID NO: 478475 - RNA, 16 nt, Homo sapiens
uuauauaauuacauau

SEQ ID NO: 478476 - RNA, 13 nt, Homo sapiens
uuaucaguaguau

SEQ ID NO: 478477 - RNA, 12 nt, Homo sapiens
uuauccaugccu

SEQ ID NO: 478478 - RNA, 23 nt, Homo sapiens
uuaucugucccagguuaucuggg

SEQ ID NO: 478479 - RNA, 20 nt, Homo sapiens
uuauguuaaaacugggacag

SEQ ID NO: 478480 - RNA, 12 nt, Homo sapiens
uuauucucaaga

SEQ ID NO: 478481 - RNA, 14 nt, Homo sapiens
uuauuuuggaucua

SEQ ID NO: 478482 - RNA, 21 nt, Homo sapiens
uucaaaaauacucacauggcu

SEQ ID NO: 478483 - RNA, 17 nt, Homo sapiens
uucaaagagacauauac

SEQ ID NO: 478484 - RNA, 22 nt, Homo sapiens
uucaacaucuagugagcaguca

SEQ ID NO: 478485 - RNA, 18 nt, Homo sapiens
uucaaguauuagggguaa

SEQ ID NO: 478486 - RNA, 15 nt, Homo sapiens
uucaauaaauuguaa

SEQ ID NO: 478487 - RNA, 14 nt, Homo sapiens
uucacucaaucucu

SEQ ID NO: 478488 - RNA, 21 nt, Homo sapiens
uucacuuaauaauguguacau

SEQ ID NO: 478489 - RNA, 19 nt, Homo sapiens
uucacuuauccuguucucu

SEQ ID NO: 478490 - RNA, 21 nt, Homo sapiens
uucagccuagccgaccucagc

SEQ ID NO: 478491 - RNA, 15 nt, Homo sapiens
uucagggaacugcau

SEQ ID NO: 478492 - RNA, 23 nt, Homo sapiens
uucauacugaagaugcagcaaaa

SEQ ID NO: 478493 - RNA, 18 nt, Homo sapiens
uucauauauuuguaugau

SEQ ID NO: 478494 - RNA, 21 nt, Homo sapiens
uucauaugacauucaugccug

SEQ ID NO: 478495 - RNA, 15 nt, Homo sapiens
uucaucauugacuac

SEQ ID NO: 478496 - RNA, 13 nt, Homo sapiens
uuccaaaggccau

SEQ ID NO: 478497 - RNA, 20 nt, Homo sapiens
uuccacacucaccucuaaaa

SEQ ID NO: 478498 - RNA, 12 nt, Homo sapiens
uuccacuaugag

SEQ ID NO: 478499 - RNA, 17 nt, Homo sapiens
uuccacuaugagcugcu

SEQ ID NO: 478500 - RNA, 19 nt, Homo sapiens
uuccaggaaaaucugcacu

SEQ ID NO: 478501 - RNA, 16 nt, Homo sapiens
uuccaugaaaaugcaa

SEQ ID NO: 478502 - RNA, 14 nt, Homo sapiens
auuccuugcacaua

SEQ ID NO: 478503 - RNA, 16 nt, Homo sapiens
auucgauccccuguca

SEQ ID NO: 478504 - RNA, 19 nt, Homo sapiens
auucucaagccgcauccca

SEQ ID NO: 478505 - RNA, 18 nt, Homo sapiens
auucucaggccaucauca

SEQ ID NO: 478506 - RNA, 17 nt, Homo sapiens
auucugaaucaagguga

SEQ ID NO: 478507 - RNA, 18 nt, Homo sapiens
auucugcugaugcuacug

SEQ ID NO: 478508 - RNA, 22 nt, Homo sapiens
auucugucacucaccacuacau

SEQ ID NO: 478509 - RNA, 19 nt, Homo sapiens
auucuuauuaggauuccac

SEQ ID NO: 478510 - RNA, 20 nt, Homo sapiens
auugaagacccucaaugcca

SEQ ID NO: 478511 - RNA, 13 nt, Homo sapiens
auugaagaugaac

SEQ ID NO: 478512 - RNA, 21 nt, Homo sapiens
auugaaucccuuaaacucagg

SEQ ID NO: 478513 - RNA, 15 nt, Homo sapiens
auugaauuagaaaca

SEQ ID NO: 478514 - RNA, 17 nt, Homo sapiens
auugacuaucaaacuga

SEQ ID NO: 478515 - RNA, 20 nt, Homo sapiens
auugacucaacaguuuccag

SEQ ID NO: 478516 - RNA, 15 nt, Homo sapiens
auugaggacacugau

SEQ ID NO: 478517 - RNA, 15 nt, Homo sapiens
auugcagaguacugg

SEQ ID NO: 478518 - RNA, 18 nt, Homo sapiens
auuguaaaaccccaucuc

SEQ ID NO: 478519 - RNA, 19 nt, Homo sapiens
auuguaaacauuaguucua

SEQ ID NO: 478520 - RNA, 18 nt, Homo sapiens
auugucuguaaugacaaa

SEQ ID NO: 478521 - RNA, 14 nt, Homo sapiens
auuuacucaauauc

SEQ ID NO: 478522 - RNA, 17 nt, Homo sapiens
auuuccagccagggcug

SEQ ID NO: 478523 - RNA, 19 nt, Homo sapiens
auuucuucacucaaucucu

SEQ ID NO: 478524 - RNA, 11 nt, Homo sapiens
auuugagacag

SEQ ID NO: 478525 - RNA, 17 nt, Homo sapiens
auuugagacagagucuc

SEQ ID NO: 478526 - RNA, 16 nt, Homo sapiens
auuugaguauugcuga

SEQ ID NO: 478527 - RNA, 23 nt, Homo sapiens
auuugcacccaccuuucugcaca

SEQ ID NO: 478528 - RNA, 11 nt, Homo sapiens
auuugcacuau

SEQ ID NO: 478529 - RNA, 17 nt, Homo sapiens
auuugccaauuuacuuu

SEQ ID NO: 478530 - RNA, 22 nt, Homo sapiens
auuugcuauagaaaacaauaca

SEQ ID NO: 478531 - RNA, 12 nt, Homo sapiens
auuugguguaca

SEQ ID NO: 478532 - RNA, 18 nt, Homo sapiens
auuugucgauauuuccau

SEQ ID NO: 478533 - RNA, 22 nt, Homo sapiens
auuugucgauauuuccaucauu

SEQ ID NO: 478534 - RNA, 17 nt, Homo sapiens
auuuucacacaauacaa

SEQ ID NO: 478535 - RNA, 21 nt, Homo sapiens
auuuugcggcauuaaagccau

SEQ ID NO: 478536 - RNA, 16 nt, Homo sapiens
auuuuggaucuaucac

SEQ ID NO: 478537 - RNA, 23 nt, Homo sapiens
auuuugguggguuuugaacauaa

SEQ ID NO: 478538 - RNA, 16 nt, Homo sapiens
auuuuuaccugccuaa

SEQ ID NO: 478539 - RNA, 13 nt, Homo sapiens
auuuuugaauaca

SEQ ID NO: 478540 - RNA, 21 nt, Homo sapiens
caaaaaaaguucagcaugaag

SEQ ID NO: 478541 - RNA, 16 nt, Homo sapiens
caaaaaugggcagcca

SEQ ID NO: 478542 - RNA, 14 nt, Homo sapiens
caaaacuuaggcau

SEQ ID NO: 478543 - RNA, 15 nt, Homo sapiens
caaaagcccauucau

SEQ ID NO: 478544 - RNA, 18 nt, Homo sapiens
caaaagcccauucauucc

SEQ ID NO: 478545 - RNA, 20 nt, Homo sapiens
caaaagcccauucauuccau

SEQ ID NO: 478546 - RNA, 16 nt, Homo sapiens
caaaagcucauccauu

SEQ ID NO: 478547 - RNA, 23 nt, Homo sapiens
caaaaguucuuugggacaaaaca

SEQ ID NO: 478548 - RNA, 19 nt, Homo sapiens
caaaauaaagcuguucuca

SEQ ID NO: 478549 - RNA, 23 nt, Homo sapiens
caaaauguccugauuacaaugcu

SEQ ID NO: 478550 - RNA, 15 nt, Homo sapiens
caaacacugcaggca

SEQ ID NO: 478551 - RNA, 12 nt, Homo sapiens
caaacagaacua

SEQ ID NO: 478552 - RNA, 20 nt, Homo sapiens
caaacccauuuccagcuccu

SEQ ID NO: 478553 - RNA, 19 nt, Homo sapiens
caaagaugaucaguaugaa

SEQ ID NO: 478554 - RNA, 13 nt, Homo sapiens
caaaggcugagaa

SEQ ID NO: 478555 - RNA, 11 nt, Homo sapiens
caaagugugac

SEQ ID NO: 478556 - RNA, 14 nt, Homo sapiens
caaauaaaugacaa

SEQ ID NO: 478557 - RNA, 13 nt, Homo sapiens
caaauaaguggaa

SEQ ID NO: 478558 - RNA, 18 nt, Homo sapiens
caaauaaguuacccucaa

SEQ ID NO: 478559 - RNA, 17 nt, Homo sapiens
caaaucacgaccacuga

SEQ ID NO: 478560 - RNA, 14 nt, Homo sapiens
caaauguuuaguga

SEQ ID NO: 478561 - RNA, 23 nt, Homo sapiens
caaauucucaagccgcaucccag

SEQ ID NO: 478562 - RNA, 16 nt, Homo sapiens
caaauugcagacugug

SEQ ID NO: 478563 - RNA, 19 nt, Homo sapiens
caacaaacuucaaggguuu

SEQ ID NO: 478564 - RNA, 17 nt, Homo sapiens
caacagagcgagauucc

SEQ ID NO: 478565 - RNA, 17 nt, Homo sapiens
caacagcaaaucacgac

SEQ ID NO: 478566 - RNA, 13 nt, Homo sapiens
caacaucuaguga

SEQ ID NO: 478567 - RNA, 17 nt, Homo sapiens
caacuaucucauuucca

SEQ ID NO: 478568 - RNA, 17 nt, Homo sapiens
caacuugggaacuagac

SEQ ID NO: 478569 - RNA, 15 nt, Homo sapiens
caagaaucagugcaa

SEQ ID NO: 478570 - RNA, 16 nt, Homo sapiens
caagaaucagugcaaa

SEQ ID NO: 478571 - RNA, 13 nt, Homo sapiens
caagacaaaugac

SEQ ID NO: 478572 - RNA, 18 nt, Homo sapiens
caagacaugaaguuuuau

SEQ ID NO: 478573 - RNA, 18 nt, Homo sapiens
caagaccaucuacauaca

SEQ ID NO: 478574 - RNA, 15 nt, Homo sapiens
caagaccccaaaggg

SEQ ID NO: 478575 - RNA, 22 nt, Homo sapiens
caagagacaugguauugacuca

SEQ ID NO: 478576 - RNA, 16 nt, Homo sapiens
caagagccauguagaa

SEQ ID NO: 478577 - RNA, 18 nt, Homo sapiens
caagaucacgccauugca

SEQ ID NO: 478578 - RNA, 19 nt, Homo sapiens
caagauuuaacuguuugau

SEQ ID NO: 478579 - RNA, 15 nt, Homo sapiens
caagcucccaaggga

SEQ ID NO: 478580 - RNA, 23 nt, Homo sapiens
caaggaagccucggcagaugugg

SEQ ID NO: 478581 - RNA, 15 nt, Homo sapiens
caaggacacagauga

SEQ ID NO: 478582 - RNA, 16 nt, Homo sapiens
caaggaggccacguga

SEQ ID NO: 478583 - RNA, 15 nt, Homo sapiens
caaggucauuugcua

SEQ ID NO: 478584 - RNA, 17 nt, Homo sapiens
caaguacuguaacugug

SEQ ID NO: 478585 - RNA, 16 nt, Homo sapiens
caagugagacaaaaag

SEQ ID NO: 478586 - RNA, 13 nt, Homo sapiens
caauaaaccacaa

SEQ ID NO: 478587 - RNA, 22 nt, Homo sapiens
caauacauuauuggacuuccau

SEQ ID NO: 478588 - RNA, 16 nt, Homo sapiens
caauaccuacaaguca

SEQ ID NO: 478589 - RNA, 14 nt, Homo sapiens
caauagaacagaga

SEQ ID NO: 478590 - RNA, 15 nt, Homo sapiens
caauaguuguugauu

SEQ ID NO: 478591 - RNA, 17 nt, Homo sapiens
caauaucaucccugucu

SEQ ID NO: 478592 - RNA, 15 nt, Homo sapiens
caauaugagucucaa

SEQ ID NO: 478593 - RNA, 15 nt, Homo sapiens
caaucacauagugaa

SEQ ID NO: 478594 - RNA, 16 nt, Homo sapiens
caauccaacccgggga

SEQ ID NO: 478595 - RNA, 23 nt, Homo sapiens
caaugcugccugggagccagggu

SEQ ID NO: 478596 - RNA, 20 nt, Homo sapiens
caaugugggcagagauugga

SEQ ID NO: 478597 - RNA, 21 nt, Homo sapiens
caauucuauuacgugcaauac

SEQ ID NO: 478598 - RNA, 17 nt, Homo sapiens
cacaacauuacagggaa

SEQ ID NO: 478599 - RNA, 17 nt, Homo sapiens
cacaagaccaucuacau

SEQ ID NO: 478600 - RNA, 16 nt, Homo sapiens
cacaagacugcacauc

SEQ ID NO: 478601 - RNA, 14 nt, Homo sapiens
cacaaugccucauc

SEQ ID NO: 478602 - RNA, 21 nt, Homo sapiens
cacacgucuggcuucacagau

SEQ ID NO: 478603 - RNA, 18 nt, Homo sapiens
cacacuuuccgcuuucac

SEQ ID NO: 478604 - RNA, 19 nt, Homo sapiens
cacagaccugcucuggaca

SEQ ID NO: 478605 - RNA, 20 nt, Homo sapiens
cacagcucccauaaccgcug

SEQ ID NO: 478606 - RNA, 20 nt, Homo sapiens
cacagcugcuggagacuccu

SEQ ID NO: 478607 - RNA, 23 nt, Homo sapiens
cacagcuucugcagcagacuguc

SEQ ID NO: 478608 - RNA, 19 nt, Homo sapiens
cacaggaaccacaagacug

SEQ ID NO: 478609 - RNA, 23 nt, Homo sapiens
cacaggaugaaggcaaugccauc

SEQ ID NO: 478610 - RNA, 13 nt, Homo sapiens
cacauucacugac

SEQ ID NO: 478611 - RNA, 22 nt, Homo sapiens
caccacgccuggccagaugcau

SEQ ID NO: 478612 - RNA, 15 nt, Homo sapiens
caccaggucagggag

SEQ ID NO: 478613 - RNA, 12 nt, Homo sapiens
caccagucugac

SEQ ID NO: 478614 - RNA, 18 nt, Homo sapiens
caccaucagucaaugaau

SEQ ID NO: 478615 - RNA, 19 nt, Homo sapiens
caccauguuggccaggcug

SEQ ID NO: 478616 - RNA, 22 nt, Homo sapiens
cacccagaugggggaaagcaca

SEQ ID NO: 478617 - RNA, 20 nt, Homo sapiens
cacccaggcuggagugcagu

SEQ ID NO: 478618 - RNA, 15 nt, Homo sapiens
cacccauaccagcua

SEQ ID NO: 478619 - RNA, 16 nt, Homo sapiens
cacccaugcccagcug

SEQ ID NO: 478620 - RNA, 11 nt, Homo sapiens
caccuacuccu

SEQ ID NO: 478621 - RNA, 17 nt, Homo sapiens
ccaauggcaacaucuug

SEQ ID NO: 478622 - RNA, 22 nt, Homo sapiens
ccaauggcaacaucuugcaaaa

SEQ ID NO: 478623 - RNA, 22 nt, Homo sapiens
ccaauuauagaucaaaugcccu

SEQ ID NO: 478624 - RNA, 19 nt, Homo sapiens
ccaauucaauuacuauuga

SEQ ID NO: 478625 - RNA, 14 nt, Homo sapiens
ccacaagaccaucu

SEQ ID NO: 478626 - RNA, 17 nt, Homo sapiens
ccacacagacaggguuu

SEQ ID NO: 478627 - RNA, 14 nt, Homo sapiens
ccacaccaagcagc

SEQ ID NO: 478628 - RNA, 19 nt, Homo sapiens
ccacagaccugcucuggac

SEQ ID NO: 478629 - RNA, 15 nt, Homo sapiens
ccacaggaaccacaa

SEQ ID NO: 478630 - RNA, 20 nt, Homo sapiens
ccacaguggaaagacagcuu

SEQ ID NO: 478631 - RNA, 21 nt, Homo sapiens
ccacaguggaaagacagcuuc

SEQ ID NO: 478632 - RNA, 18 nt, Homo sapiens
cacugccaugcagggccu

SEQ ID NO: 478633 - RNA, 13 nt, Homo sapiens
cacugccugaugg

SEQ ID NO: 478634 - RNA, 17 nt, Homo sapiens
cacugggacuugcaaaa

SEQ ID NO: 478635 - RNA, 14 nt, Homo sapiens
cacugggcuucuag

SEQ ID NO: 478636 - RNA, 22 nt, Homo sapiens
cacugggcuucuagaaccaggc

SEQ ID NO: 478637 - RNA, 22 nt, Homo sapiens
cacuggugggccauuagauuug

SEQ ID NO: 478638 - RNA, 20 nt, Homo sapiens
cacuguggcauugucuguaa

SEQ ID NO: 478639 - RNA, 21 nt, Homo sapiens
cacuguggcauugucuguaau

SEQ ID NO: 478640 - RNA, 18 nt, Homo sapiens
cacuuauccuguucucug

SEQ ID NO: 478641 - RNA, 16 nt, Homo sapiens
cacuuauucucaagaa

SEQ ID NO: 478642 - RNA, 15 nt, Homo sapiens
cacuugacuuugcca

SEQ ID NO: 478643 - RNA, 17 nt, Homo sapiens
cacuuguguuuugcaag

SEQ ID NO: 478644 - RNA, 17 nt, Homo sapiens
cagaaaccauuguucag

SEQ ID NO: 478645 - RNA, 22 nt, Homo sapiens
cagaaagugacaagcucacaga

SEQ ID NO: 478646 - RNA, 17 nt, Homo sapiens
cagaacucaaaugagcc

SEQ ID NO: 478647 - RNA, 16 nt, Homo sapiens
cagacagaaggugcua

SEQ ID NO: 478648 - RNA, 21 nt, Homo sapiens
cagacuauuuaacuugagggu

SEQ ID NO: 478649 - RNA, 22 nt, Homo sapiens
cagacuugucccuccuuuucca

SEQ ID NO: 478650 - RNA, 20 nt, Homo sapiens
cagagcaagacucugucuca

SEQ ID NO: 478651 - RNA, 20 nt, Homo sapiens
cagagguugcagugagccga

SEQ ID NO: 478652 - RNA, 21 nt, Homo sapiens
cagaguauuggucuccucuca

SEQ ID NO: 478653 - RNA, 17 nt, Homo sapiens
cagaguccucuaugaac

SEQ ID NO: 478654 - RNA, 17 nt, Homo sapiens
cagaugagaguacaccc

SEQ ID NO: 478655 - RNA, 21 nt, Homo sapiens
cagaugcagaaaauugccuaa

SEQ ID NO: 478656 - RNA, 22 nt, Homo sapiens
cagaugggagugcccccaacag

SEQ ID NO: 478657 - RNA, 17 nt, Homo sapiens
cagauuugggcuggaac

SEQ ID NO: 478658 - RNA, 15 nt, Homo sapiens
cagcacugacuggaa

SEQ ID NO: 478659 - RNA, 14 nt, Homo sapiens
cagcauuuccacac

SEQ ID NO: 478660 - RNA, 13 nt, Homo sapiens
cagccaacaagca

SEQ ID NO: 478661 - RNA, 14 nt, Homo sapiens
cagccuggcaaggg

SEQ ID NO: 478662 - RNA, 16 nt, Homo sapiens
cagcuaacaauuguga

SEQ ID NO: 478663 - RNA, 12 nt, Homo sapiens
cagcuaacacac

SEQ ID NO: 478664 - RNA, 14 nt, Homo sapiens
cagcugacacaucu

SEQ ID NO: 478665 - RNA, 15 nt, Homo sapiens
cagcuggaucuccau

SEQ ID NO: 478666 - RNA, 19 nt, Homo sapiens
cagcuggcgucaugcaaag

SEQ ID NO: 478667 - RNA, 23 nt, Homo sapiens
cagcugugaacauggacucuucc

SEQ ID NO: 478668 - RNA, 14 nt, Homo sapiens
cagcuguugcagug

SEQ ID NO: 478669 - RNA, 15 nt, Homo sapiens
caggaaccucagggc

SEQ ID NO: 478670 - RNA, 23 nt, Homo sapiens
caggaaccucagggcugugugua

SEQ ID NO: 478671 - RNA, 14 nt, Homo sapiens
caggacauucucau

SEQ ID NO: 478672 - RNA, 17 nt, Homo sapiens
caggaccaucccggccg

SEQ ID NO: 478673 - RNA, 18 nt, Homo sapiens
caggaggaaggcuuacac

SEQ ID NO: 478674 - RNA, 22 nt, Homo sapiens
caggaggcagcuguugcaguga

SEQ ID NO: 478675 - RNA, 19 nt, Homo sapiens
caggcuacacugacacugg

SEQ ID NO: 478676 - RNA, 16 nt, Homo sapiens
caggcucaacauaaca

SEQ ID NO: 478677 - RNA, 11 nt, Homo sapiens
caggcucugag

SEQ ID NO: 478678 - RNA, 21 nt, Homo sapiens
cagggaaauuauaagugcaga

SEQ ID NO: 478679 - RNA, 19 nt, Homo sapiens
caggugugccgacagaagg

SEQ ID NO: 478680 - RNA, 23 nt, Homo sapiens
caguaaacagaggaguacaggug

SEQ ID NO: 478681 - RNA, 16 nt, Homo sapiens
caguaacugugacuga

SEQ ID NO: 478682 - RNA, 19 nt, Homo sapiens
caguaacugugacugauga

SEQ ID NO: 478683 - RNA, 12 nt, Homo sapiens
caguccaaggaa

SEQ ID NO: 478684 - RNA, 21 nt, Homo sapiens
cagugagccaagaucacgcca

SEQ ID NO: 478685 - RNA, 20 nt, Homo sapiens
cagugagcuguguucuugcc

SEQ ID NO: 478686 - RNA, 15 nt, Homo sapiens
caguggcacgaucuc

SEQ ID NO: 478687 - RNA, 18 nt, Homo sapiens
caguggguggagccaauc

SEQ ID NO: 478688 - RNA, 15 nt, Homo sapiens
caguguccaaagcag

SEQ ID NO: 478689 - RNA, 20 nt, Homo sapiens
caguuaccucugccucagaa

SEQ ID NO: 478690 - RNA, 16 nt, Homo sapiens
caguucagaaucacuu

SEQ ID NO: 478691 - RNA, 20 nt, Homo sapiens
caguuuaaccugaugcaguc

SEQ ID NO: 478692 - RNA, 21 nt, Homo sapiens
caguuugauuguuguuuauaa

SEQ ID NO: 478693 - RNA, 18 nt, Homo sapiens
cauaaaaaggaauccacu

SEQ ID NO: 478694 - RNA, 21 nt, Homo sapiens
cauaaaaauaaaucaguucau

SEQ ID NO: 478695 - RNA, 18 nt, Homo sapiens
cauaaagccuuggaugua

SEQ ID NO: 478696 - RNA, 21 nt, Homo sapiens
cauaaagccuuggauguauau

SEQ ID NO: 478697 - RNA, 16 nt, Homo sapiens
cauaaaguaugugcau

SEQ ID NO: 478698 - RNA, 18 nt, Homo sapiens
cauaagcaaagacuauga

SEQ ID NO: 478699 - RNA, 13 nt, Homo sapiens
cauacggcacuga

SEQ ID NO: 478700 - RNA, 14 nt, Homo sapiens
cauacggcacugaa

SEQ ID NO: 478701 - RNA, 21 nt, Homo sapiens
cauacugaagaugcagcaaaa

SEQ ID NO: 478702 - RNA, 20 nt, Homo sapiens
cauagauccuaagccauaaa

SEQ ID NO: 478703 - RNA, 18 nt, Homo sapiens
cauagcagcugcuacuag

SEQ ID NO: 478704 - RNA, 23 nt, Homo sapiens
cauaggcccagugagaugcauuc

SEQ ID NO: 478705 - RNA, 22 nt, Homo sapiens
cauaucuuguuguucaguuugg

SEQ ID NO: 478706 - RNA, 24 nt, Homo sapiens
caucaaauggaagacacauugaaa

SEQ ID NO: 478707 - RNA, 20 nt, Homo sapiens
caucaaggguacacugccuu

SEQ ID NO: 478708 - RNA, 16 nt, Homo sapiens
caucacacaacucagc

SEQ ID NO: 478709 - RNA, 15 nt, Homo sapiens
caucaccacagggau

SEQ ID NO: 478710 - RNA, 15 nt, Homo sapiens
caucagucaaugaau

SEQ ID NO: 478711 - RNA, 17 nt, Homo sapiens
caucaucaguggagcca

SEQ ID NO: 478712 - RNA, 15 nt, Homo sapiens
caucccuaaugcugc

SEQ ID NO: 478713 - RNA, 17 nt, Homo sapiens
cauccuggccaacauug

SEQ ID NO: 478714 - RNA, 14 nt, Homo sapiens
caucuacauacaca

SEQ ID NO: 478715 - RNA, 13 nt, Homo sapiens
caucucaaggaau

SEQ ID NO: 478716 - RNA, 15 nt, Homo sapiens
caucucagugcugua

SEQ ID NO: 478717 - RNA, 18 nt, Homo sapiens
caucucagugcuguaaaa

SEQ ID NO: 478718 - RNA, 17 nt, Homo sapiens
caucucuggaugccuga

SEQ ID NO: 478719 - RNA, 18 nt, Homo sapiens
caucuggaaccaucagaa

SEQ ID NO: 478720 - RNA, 23 nt, Homo sapiens
caucugggcaaaacccacagaag

SEQ ID NO: 478721 - RNA, 19 nt, Homo sapiens
caucuuaagagaugccuca

SEQ ID NO: 478722 - RNA, 12 nt, Homo sapiens
caucuucuuuca

SEQ ID NO: 478723 - RNA, 21 nt, Homo sapiens
caugaaaaauugcuaugacua

SEQ ID NO: 478724 - RNA, 19 nt, Homo sapiens
caugaacaucauggacuga

SEQ ID NO: 478725 - RNA, 19 nt, Homo sapiens
caugaagaccacugaauga

SEQ ID NO: 478726 - RNA, 17 nt, Homo sapiens
caugaagggaugcugca

SEQ ID NO: 478727 - RNA, 15 nt, Homo sapiens
caugagucagucuga

SEQ ID NO: 478728 - RNA, 18 nt, Homo sapiens
caugagucagucugauga

SEQ ID NO: 478729 - RNA, 15 nt, Homo sapiens
caugccugcaccugc

SEQ ID NO: 478730 - RNA, 18 nt, Homo sapiens
caugcugaagccaaagcc

SEQ ID NO: 478731 - RNA, 13 nt, Homo sapiens
cauguaccugaaa

SEQ ID NO: 478732 - RNA, 20 nt, Homo sapiens
cauguaccugaaacauuugg

SEQ ID NO: 478733 - RNA, 17 nt, Homo sapiens
cauguaguaagcaagau

SEQ ID NO: 478734 - RNA, 22 nt, Homo sapiens
cauguaucuaccucacuauuca

SEQ ID NO: 478735 - RNA, 12 nt, Homo sapiens
cauuaaagccau

SEQ ID NO: 478736 - RNA, 13 nt, Homo sapiens
cauuaucagucca

SEQ ID NO: 478737 - RNA, 20 nt, Homo sapiens
cauucacucauacaucuggc

SEQ ID NO: 478738 - RNA, 18 nt, Homo sapiens
cauucauuccauucugga

SEQ ID NO: 478739 - RNA, 12 nt, Homo sapiens
cauuccauuugc

SEQ ID NO: 478740 - RNA, 24 nt, Homo sapiens
cauugcacucuagccuggcaacag

SEQ ID NO: 478741 - RNA, 19 nt, Homo sapiens
cauuguucagaugcuucuu

SEQ ID NO: 478742 - RNA, 20 nt, Homo sapiens
cauuguucuugugaacccaa

SEQ ID NO: 478743 - RNA, 23 nt, Homo sapiens
cauuuagauuuugauaccaguga

SEQ ID NO: 478744 - RNA, 18 nt, Homo sapiens
cauuuauuuugacuguga

SEQ ID NO: 478745 - RNA, 16 nt, Homo sapiens
cauuuuugaaaccaaa

SEQ ID NO: 478746 - RNA, 15 nt, Homo sapiens
ccaaaaaaaguucag

SEQ ID NO: 478747 - RNA, 22 nt, Homo sapiens
ccaaaagcccauucauuccauu

SEQ ID NO: 478748 - RNA, 18 nt, Homo sapiens
ccaaacucauaacagucu

SEQ ID NO: 478749 - RNA, 12 nt, Homo sapiens
ccaaagggccca

SEQ ID NO: 478750 - RNA, 16 nt, Homo sapiens
ccaaauggcagggaua

SEQ ID NO: 478751 - RNA, 10 nt, Homo sapiens
ccaacagcac

SEQ ID NO: 478752 - RNA, 18 nt, Homo sapiens
ccaacaugugcucaggga

SEQ ID NO: 478753 - RNA, 13 nt, Homo sapiens
ccaacugcuccag

SEQ ID NO: 478754 - RNA, 18 nt, Homo sapiens
ccaaggcuggagugcagu

SEQ ID NO: 478755 - RNA, 13 nt, Homo sapiens
ccaaguagcugcu

SEQ ID NO: 478756 - RNA, 17 nt, Homo sapiens
uuagcuuagaccucagc

SEQ ID NO: 478757 - RNA, 22 nt, Homo sapiens
uuagucauucaauaaauuguaa

SEQ ID NO: 478758 - RNA, 22 nt, Homo sapiens
uuaguucuauuucuaucccaaa

SEQ ID NO: 478759 - RNA, 13 nt, Homo sapiens
uuaguugcaugac

SEQ ID NO: 478760 - RNA, 17 nt, Homo sapiens
uuauaaaagaugcauua

SEQ ID NO: 478761 - RNA, 24 nt, Homo sapiens
uuauaaaagaugcauuaucuauga

SEQ ID NO: 478762 - RNA, 17 nt, Homo sapiens
uuauaaaaucaaacaga

SEQ ID NO: 478763 - RNA, 14 nt, Homo sapiens
uuauccuguucucu

SEQ ID NO: 478764 - RNA, 16 nt, Homo sapiens
uuauguaauaauguga

SEQ ID NO: 478765 - RNA, 14 nt, Homo sapiens
uuauuggacuucca

SEQ ID NO: 478766 - RNA, 19 nt, Homo sapiens
uuauuugaguauugcugau

SEQ ID NO: 478767 - RNA, 23 nt, Homo sapiens
uucaagaagugccaguugaucaa

SEQ ID NO: 478768 - RNA, 16 nt, Homo sapiens
uucaagagcacacuug

SEQ ID NO: 478769 - RNA, 19 nt, Homo sapiens
uucaaguacuguaacugug

SEQ ID NO: 478770 - RNA, 18 nt, Homo sapiens
uucaauaaaccacaagca

SEQ ID NO: 478771 - RNA, 12 nt, Homo sapiens
uucacaguguga

SEQ ID NO: 478772 - RNA, 20 nt, Homo sapiens
uucaccaucuguauauacaa

SEQ ID NO: 478773 - RNA, 19 nt, Homo sapiens
uucaccauguuggccaggc

SEQ ID NO: 478774 - RNA, 15 nt, Homo sapiens
uucacucauacaucu

SEQ ID NO: 478775 - RNA, 14 nt, Homo sapiens
uucacuuauugacu

SEQ ID NO: 478776 - RNA, 13 nt, Homo sapiens
uucagaaagaagu

SEQ ID NO: 478777 - RNA, 21 nt, Homo sapiens
uucagaaucacuucugagaac

SEQ ID NO: 478778 - RNA, 18 nt, Homo sapiens
uucagagcugacacagga

SEQ ID NO: 478779 - RNA, 12 nt, Homo sapiens
uucagagcugcc

SEQ ID NO: 478780 - RNA, 14 nt, Homo sapiens
uucagccaggagau

SEQ ID NO: 478781 - RNA, 22 nt, Homo sapiens
uucaguuccucuuugcauggaa

SEQ ID NO: 478782 - RNA, 17 nt, Homo sapiens
uucauacauuaucucac

SEQ ID NO: 478783 - RNA, 18 nt, Homo sapiens
uucauacauuaucucacu

SEQ ID NO: 478784 - RNA, 21 nt, Homo sapiens
uucaugccagcuauaaucucc

SEQ ID NO: 478785 - RNA, 10 nt, Homo sapiens
uucauuccau

SEQ ID NO: 478786 - RNA, 14 nt, Homo sapiens
uucauuccauuugc

SEQ ID NO: 478787 - RNA, 13 nt, Homo sapiens
uucauugacugau

SEQ ID NO: 478788 - RNA, 21 nt, Homo sapiens
uucauuuuuacccuuacuugg

SEQ ID NO: 478789 - RNA, 14 nt, Homo sapiens
uuccaagcaaguau

SEQ ID NO: 478790 - RNA, 17 nt, Homo sapiens
uuccaagcaaguauuag

SEQ ID NO: 478791 - RNA, 21 nt, Homo sapiens
uuccauuuauucuuugaucuu

SEQ ID NO: 478792 - RNA, 19 nt, Homo sapiens
uucccaaaagcccauucau

SEQ ID NO: 478793 - RNA, 16 nt, Homo sapiens
uucccacuuugccacu

SEQ ID NO: 478794 - RNA, 22 nt, Homo sapiens
uucccagcaccuaguaugcuca

SEQ ID NO: 478795 - RNA, 15 nt, Homo sapiens
uucccugcuuaauga

SEQ ID NO: 478796 - RNA, 18 nt, Homo sapiens
uuccuagucauaauguca

SEQ ID NO: 478797 - RNA, 16 nt, Homo sapiens
uuccuauaugcacuua

SEQ ID NO: 478798 - RNA, 22 nt, Homo sapiens
uuccucgcuagaguucuccaga

SEQ ID NO: 478799 - RNA, 23 nt, Homo sapiens
uucgcgcgccuccgcuacuucca

SEQ ID NO: 478800 - RNA, 19 nt, Homo sapiens
uucuauucaucucaaggaa

SEQ ID NO: 478801 - RNA, 17 nt, Homo sapiens
uucuauuucuaucccaa

SEQ ID NO: 478802 - RNA, 20 nt, Homo sapiens
uucucaacuccaaacugacu

SEQ ID NO: 478803 - RNA, 18 nt, Homo sapiens
uucucagagugguucuga

SEQ ID NO: 478804 - RNA, 13 nt, Homo sapiens
uucuccagacagg

SEQ ID NO: 478805 - RNA, 16 nt, Homo sapiens
uucugauacguguaug

SEQ ID NO: 478806 - RNA, 15 nt, Homo sapiens
uucugauuaaugcua

SEQ ID NO: 478807 - RNA, 17 nt, Homo sapiens
uucugcugaugcuacug

SEQ ID NO: 478808 - RNA, 21 nt, Homo sapiens
uucuuaaacaaauguaugauu

SEQ ID NO: 478809 - RNA, 13 nt, Homo sapiens
uucuuacaaacau

SEQ ID NO: 478810 - RNA, 13 nt, Homo sapiens
uucuucguguaua

SEQ ID NO: 478811 - RNA, 13 nt, Homo sapiens
uucuugugccuca

SEQ ID NO: 478812 - RNA, 19 nt, Homo sapiens
uugacacuauucacuaaaa

SEQ ID NO: 478813 - RNA, 15 nt, Homo sapiens
uugacaguuugauaa

SEQ ID NO: 478814 - RNA, 14 nt, Homo sapiens
uugacaucaaugau

SEQ ID NO: 478815 - RNA, 16 nt, Homo sapiens
uugacauuuugaucac

SEQ ID NO: 478816 - RNA, 13 nt, Homo sapiens
uugagacagaguc

SEQ ID NO: 478817 - RNA, 14 nt, Homo sapiens
uugagcuacuucag

SEQ ID NO: 478818 - RNA, 19 nt, Homo sapiens
uugagcuuaagaauuuuga

SEQ ID NO: 478819 - RNA, 22 nt, Homo sapiens
uugauaagagggcacacacugu

SEQ ID NO: 478820 - RNA, 21 nt, Homo sapiens
uugaucuucagggaacugcau

SEQ ID NO: 478821 - RNA, 14 nt, Homo sapiens
uugauggugaugaa

SEQ ID NO: 478822 - RNA, 19 nt, Homo sapiens
uugaugucaaaaacuucaa

SEQ ID NO: 478823 - RNA, 15 nt, Homo sapiens
uugcaagacauagaa

SEQ ID NO: 478824 - RNA, 13 nt, Homo sapiens
uugcacauaguag

SEQ ID NO: 478825 - RNA, 20 nt, Homo sapiens
uugcagugagccaagaucac

SEQ ID NO: 478826 - RNA, 20 nt, Homo sapiens
uugcagugagccgagaucac

SEQ ID NO: 478827 - RNA, 18 nt, Homo sapiens
uugcauagcagcugcuac

SEQ ID NO: 478828 - RNA, 18 nt, Homo sapiens
uugcaugaccacauagaa

SEQ ID NO: 478829 - RNA, 23 nt, Homo sapiens
uugccaagcucaggaccaggcaa

SEQ ID NO: 478830 - RNA, 23 nt, Homo sapiens
uugccugcacaaacucaccaucu

SEQ ID NO: 478831 - RNA, 13 nt, Homo sapiens
uugcucacuguca

SEQ ID NO: 478832 - RNA, 17 nt, Homo sapiens
uugcugaucuuuucuaa

SEQ ID NO: 478833 - RNA, 21 nt, Homo sapiens
uugcuuguaaaauuucacuua

SEQ ID NO: 478834 - RNA, 13 nt, Homo sapiens
uugcuuugcccag

SEQ ID NO: 478835 - RNA, 12 nt, Homo sapiens
uuggaaaucaca

SEQ ID NO: 478836 - RNA, 15 nt, Homo sapiens
uuggaagccccauaa

SEQ ID NO: 478837 - RNA, 20 nt, Homo sapiens
uuggagucugacugugccca

SEQ ID NO: 478838 - RNA, 21 nt, Homo sapiens
uugguacuagauacugaaugu

SEQ ID NO: 478839 - RNA, 19 nt, Homo sapiens
uuguaaguuuaugucuaaa

SEQ ID NO: 478840 - RNA, 23 nt, Homo sapiens
uugugcuuaguccaauuccuugc

SEQ ID NO: 478841 - RNA, 13 nt, Homo sapiens
uuguucuugugaa

SEQ ID NO: 478842 - RNA, 15 nt, Homo sapiens
uuguugaaagccaug

SEQ ID NO: 478843 - RNA, 15 nt, Homo sapiens
uuuaacaacuaugau

SEQ ID NO: 478844 - RNA, 16 nt, Homo sapiens
uuuaacuugaggguaa

SEQ ID NO: 478845 - RNA, 19 nt, Homo sapiens
uuuaaggcaggacagagaa

SEQ ID NO: 478846 - RNA, 16 nt, Homo sapiens
uuuaauuugauaguau

SEQ ID NO: 478847 - RNA, 12 nt, Homo sapiens
uuuacaccaguu

SEQ ID NO: 478848 - RNA, 23 nt, Homo sapiens
uuuaguaagagauuccugagcca

SEQ ID NO: 478849 - RNA, 19 nt, Homo sapiens
uuuauccugagucccuuaa

SEQ ID NO: 478850 - RNA, 11 nt, Homo sapiens
uuuaugugcaa

SEQ ID NO: 478851 - RNA, 15 nt, Homo sapiens
uuuauucccccaaag

SEQ ID NO: 478852 - RNA, 16 nt, Homo sapiens
uuuauucccccaaagc

SEQ ID NO: 478853 - RNA, 13 nt, Homo sapiens
uuuauugccauga

SEQ ID NO: 478854 - RNA, 23 nt, Homo sapiens
uuuauuugagacagagucucacu

SEQ ID NO: 478855 - RNA, 17 nt, Homo sapiens
uuucaaucaaaacucag

SEQ ID NO: 478856 - RNA, 19 nt, Homo sapiens
uuucacuguguuggccagg

SEQ ID NO: 478857 - RNA, 17 nt, Homo sapiens
uuuccaaaggccaugga

SEQ ID NO: 478858 - RNA, 22 nt, Homo sapiens
uuuccagcuccuaguagcuuuc

SEQ ID NO: 478859 - RNA, 21 nt, Homo sapiens
uuuccauaaucacucagugau

SEQ ID NO: 478860 - RNA, 18 nt, Homo sapiens
uuuccgggauagagucuu

SEQ ID NO: 478861 - RNA, 22 nt, Homo sapiens
uuucuacuaaaaauacaaaaau

SEQ ID NO: 478862 - RNA, 22 nt, Homo sapiens
uuucuauaauguugucauuuca

SEQ ID NO: 478863 - RNA, 14 nt, Homo sapiens
uuucuguugcccca

SEQ ID NO: 478864 - RNA, 16 nt, Homo sapiens
uuucuuacacaagagc

SEQ ID NO: 478865 - RNA, 18 nt, Homo sapiens
uuugaaaaacaaacagaa

SEQ ID NO: 478866 - RNA, 22 nt, Homo sapiens
uuugaacaacucgaaucacuca

SEQ ID NO: 478867 - RNA, 17 nt, Homo sapiens
uuugaacuagaguuuag

SEQ ID NO: 478868 - RNA, 16 nt, Homo sapiens
uuugagacagagucug

SEQ ID NO: 478869 - RNA, 23 nt, Homo sapiens
uuugaguccacgcccaccagccu

SEQ ID NO: 478870 - RNA, 15 nt, Homo sapiens
uuugaguuucucuca

SEQ ID NO: 478871 - RNA, 12 nt, Homo sapiens
uuugauaccagu

SEQ ID NO: 478872 - RNA, 19 nt, Homo sapiens
uuugcauaagugcaugaca

SEQ ID NO: 478873 - RNA, 19 nt, Homo sapiens
uuugccacccucaugcugu

SEQ ID NO: 478874 - RNA, 14 nt, Homo sapiens
uuugcugccaaaca

SEQ ID NO: 478875 - RNA, 20 nt, Homo sapiens
uuugcugccaaacacccaug

SEQ ID NO: 478876 - RNA, 21 nt, Homo sapiens
uuuggggaaaggcuuggcaca

SEQ ID NO: 478877 - RNA, 23 nt, Homo sapiens
uuuguaaaaagcuucauucucac

SEQ ID NO: 478878 - RNA, 17 nt, Homo sapiens
uuugugggaaauccaca

SEQ ID NO: 478879 - RNA, 20 nt, Homo sapiens
uuuguuuuguaucauuauga

SEQ ID NO: 478880 - RNA, 12 nt, Homo sapiens
uuuuacaccagu

SEQ ID NO: 478881 - RNA, 19 nt, Homo sapiens
uuuuaguagagaugggguu

SEQ ID NO: 478882 - RNA, 19 nt, Homo sapiens
uuuugaacauaaagccuug

SEQ ID NO: 478883 - RNA, 15 nt, Homo sapiens
uuuuguguuccucuu

SEQ ID NO: 478884 - RNA, 21 nt, Homo sapiens
uuuuugaaaucagcauacuca

SEQ ID NO: 478885 - RNA, 18 nt, Homo sapiens
uguucaagagcacacuug

SEQ ID NO: 478886 - RNA, 15 nt, Homo sapiens
uguuccccaucaucu

SEQ ID NO: 478887 - RNA, 20 nt, Homo sapiens
uguucuauucaucucaagga

SEQ ID NO: 478888 - RNA, 18 nt, Homo sapiens
uguuggaaaaugugcaau

SEQ ID NO: 478889 - RNA, 21 nt, Homo sapiens
uguuguuuuaggaauacauaa

SEQ ID NO: 478890 - RNA, 14 nt, Homo sapiens
uuaaaaaaguggug

SEQ ID NO: 478891 - RNA, 21 nt, Homo sapiens
uuaaaacaaaccuugugcucu

SEQ ID NO: 478892 - RNA, 20 nt, Homo sapiens
uuaaaagccaucaaacacaa

SEQ ID NO: 478893 - RNA, 23 nt, Homo sapiens
uuaaaauauuuuuaugugcaaua

SEQ ID NO: 478894 - RNA, 19 nt, Homo sapiens
uuaaagcuugcucacaucu

SEQ ID NO: 478895 - RNA, 12 nt, Homo sapiens
uuaaauaguaaa

SEQ ID NO: 478896 - RNA, 15 nt, Homo sapiens
uuaaauguauagcug

SEQ ID NO: 478897 - RNA, 18 nt, Homo sapiens
uuaacaaauuaaagaaua

SEQ ID NO: 478898 - RNA, 15 nt, Homo sapiens
uuaaccugaugcagu

SEQ ID NO: 478899 - RNA, 23 nt, Homo sapiens
uuaacuauuuuauuuucuaaugu

SEQ ID NO: 478900 - RNA, 17 nt, Homo sapiens
uuaagaaaaacauguca

SEQ ID NO: 478901 - RNA, 20 nt, Homo sapiens
uuaagaauguucuuauguug

SEQ ID NO: 478902 - RNA, 17 nt, Homo sapiens
uuaaggaaggcacuaaa

SEQ ID NO: 478903 - RNA, 17 nt, Homo sapiens
uuaaguugauggugaug

SEQ ID NO: 478904 - RNA, 20 nt, Homo sapiens
uuaaguugauggugaugaaa

SEQ ID NO: 478905 - RNA, 16 nt, Homo sapiens
uuaauuguuaagauau

SEQ ID NO: 478906 - RNA, 11 nt, Homo sapiens
uuacacaagag

SEQ ID NO: 478907 - RNA, 20 nt, Homo sapiens
uuacccccugggagccccaa

SEQ ID NO: 478908 - RNA, 12 nt, Homo sapiens
uuacgugcaaua

SEQ ID NO: 478909 - RNA, 16 nt, Homo sapiens
uuacuaucaugucaaa

SEQ ID NO: 478910 - RNA, 17 nt, Homo sapiens
uuacuaucaugucaaac

SEQ ID NO: 478911 - RNA, 21 nt, Homo sapiens
uuacuauuuauugcugaauga

SEQ ID NO: 478912 - RNA, 17 nt, Homo sapiens
uuacugauucauacauu

SEQ ID NO: 478913 - RNA, 14 nt, Homo sapiens
uuacugguugacau

SEQ ID NO: 478914 - RNA, 23 nt, Homo sapiens
uuagaguggauagaaaauuaugc

SEQ ID NO: 478915 - RNA, 13 nt, Homo sapiens
uuagauugccacu

SEQ ID NO: 478916 - RNA, 17 nt, Homo sapiens
ugcauagcagcugcuac

SEQ ID NO: 478917 - RNA, 13 nt, Homo sapiens
ugcauauauacau

SEQ ID NO: 478918 - RNA, 21 nt, Homo sapiens
ugcauauccaacaugugcuca

SEQ ID NO: 478919 - RNA, 19 nt, Homo sapiens
ugcauauguaaggaaguca

SEQ ID NO: 478920 - RNA, 15 nt, Homo sapiens
ugcaugaucugucaa

SEQ ID NO: 478921 - RNA, 14 nt, Homo sapiens
ugcauggaauuugu

SEQ ID NO: 478922 - RNA, 19 nt, Homo sapiens
ugcauguacccuaagguca

SEQ ID NO: 478923 - RNA, 14 nt, Homo sapiens
ugcauuugcacuau

SEQ ID NO: 478924 - RNA, 23 nt, Homo sapiens
ugccacauggagcuugacuucau

SEQ ID NO: 478925 - RNA, 19 nt, Homo sapiens
ugccacugcuuucauugaa

SEQ ID NO: 478926 - RNA, 11 nt, Homo sapiens
ugccacuggau

SEQ ID NO: 478927 - RNA, 17 nt, Homo sapiens
ugccagugggaacuccu

SEQ ID NO: 478928 - RNA, 14 nt, Homo sapiens
ugcccccaacagca

SEQ ID NO: 478929 - RNA, 17 nt, Homo sapiens
ugccccccuugccagac

SEQ ID NO: 478930 - RNA, 17 nt, Homo sapiens
ugccuagaggugcucau

SEQ ID NO: 478931 - RNA, 18 nt, Homo sapiens
ugccucccuucaugcaug

SEQ ID NO: 478932 - RNA, 19 nt, Homo sapiens
ugccucccuucaugcaugg

SEQ ID NO: 478933 - RNA, 14 nt, Homo sapiens
ugccucuguccuua

SEQ ID NO: 478934 - RNA, 14 nt, Homo sapiens
ugccucugucucac

SEQ ID NO: 478935 - RNA, 19 nt, Homo sapiens
ugccuucccaggaguacac

SEQ ID NO: 478936 - RNA, 20 nt, Homo sapiens
ugcgcucggccugcucgccc

SEQ ID NO: 478937 - RNA, 22 nt, Homo sapiens
ugcuaauccucuuuuucuaguc

SEQ ID NO: 478938 - RNA, 16 nt, Homo sapiens
ugcuaccucacugggg

SEQ ID NO: 478939 - RNA, 19 nt, Homo sapiens
ugcuauagaaaacaauaca

SEQ ID NO: 478940 - RNA, 22 nt, Homo sapiens
ugcucagggaauaauccagaaa

SEQ ID NO: 478941 - RNA, 21 nt, Homo sapiens
ugcucauucauuuaacagagc

SEQ ID NO: 478942 - RNA, 13 nt, Homo sapiens
ugcucucuucaau

SEQ ID NO: 478943 - RNA, 17 nt, Homo sapiens
cuuaaaauaaaaugcag

SEQ ID NO: 478944 - RNA, 14 nt, Homo sapiens
cuuacaaacaugug

SEQ ID NO: 478945 - RNA, 21 nt, Homo sapiens
gcauacucuaugugauuuauu

SEQ ID NO: 478946 - RNA, 19 nt, Homo sapiens
gcauagaguucagacuuuu

SEQ ID NO: 478947 - RNA, 19 nt, Homo sapiens
gcauagauugaucaaagug

SEQ ID NO: 478948 - RNA, 23 nt, Homo sapiens
gcauaggaggggucuggacaugu

SEQ ID NO: 478949 - RNA, 23 nt, Homo sapiens
gcaugacagcuguuccacagggg

SEQ ID NO: 478950 - RNA, 17 nt, Homo sapiens
cguguacuacaauuuaa

SEQ ID NO: 478951 - RNA, 17 nt, Homo sapiens
cuaaaacaaaagcucau

SEQ ID NO: 478952 - RNA, 22 nt, Homo sapiens
cuaaaauaagggcagagucaca

SEQ ID NO: 478953 - RNA, 14 nt, Homo sapiens
cuaaaaugaguuac

SEQ ID NO: 478954 - RNA, 19 nt, Homo sapiens
cuaaaaugaguuaccuaca

SEQ ID NO: 478955 - RNA, 15 nt, Homo sapiens
cuaaagaagguuuca

SEQ ID NO: 478956 - RNA, 18 nt, Homo sapiens
cuaaaugaguaaacccag

SEQ ID NO: 478957 - RNA, 13 nt, Homo sapiens
cuaacaauuguga

SEQ ID NO: 478958 - RNA, 15 nt, Homo sapiens
cuaacacagccauca

SEQ ID NO: 478959 - RNA, 20 nt, Homo sapiens
cuaacacagccaucaaggga

SEQ ID NO: 478960 - RNA, 17 nt, Homo sapiens
cuaacaggagaaugcac

SEQ ID NO: 478961 - RNA, 14 nt, Homo sapiens
cuaacccccaaaua

SEQ ID NO: 478962 - RNA, 17 nt, Homo sapiens
cuaacuuaucaucacac

SEQ ID NO: 478963 - RNA, 13 nt, Homo sapiens
cuaagccaagagu

SEQ ID NO: 478964 - RNA, 19 nt, Homo sapiens
cuaaggaauaugagcuuua

SEQ ID NO: 478965 - RNA, 22 nt, Homo sapiens
cuaaggucauuaccacaggcca

SEQ ID NO: 478966 - RNA, 13 nt, Homo sapiens
cuaaucugcagug

SEQ ID NO: 478967 - RNA, 20 nt, Homo sapiens
cuacaacuuuuccuaaggca

SEQ ID NO: 478968 - RNA, 21 nt, Homo sapiens
cuacacagagcaggacugcac

SEQ ID NO: 478969 - RNA, 15 nt, Homo sapiens
cuacuaaaaacacaa

SEQ ID NO: 478970 - RNA, 16 nt, Homo sapiens
cuacuacccccacaga

SEQ ID NO: 478971 - RNA, 14 nt, Homo sapiens
cuacuugaaggaca

SEQ ID NO: 478972 - RNA, 18 nt, Homo sapiens
cuagaaccuggagggcua

SEQ ID NO: 478973 - RNA, 19 nt, Homo sapiens
cuagaaccuggagggcuag

SEQ ID NO: 478974 - RNA, 19 nt, Homo sapiens
cuagagauuugguguacaa

SEQ ID NO: 478975 - RNA, 12 nt, Homo sapiens
cuagaggugcuc

SEQ ID NO: 478976 - RNA, 23 nt, Homo sapiens
cuaguagcuuuccucccaaaggc

SEQ ID NO: 478977 - RNA, 18 nt, Homo sapiens
cuagugagcagucaggaa

SEQ ID NO: 478978 - RNA, 21 nt, Homo sapiens
cuaguucuccccgauggggca

SEQ ID NO: 478979 - RNA, 11 nt, Homo sapiens
cuauccagcua

SEQ ID NO: 478980 - RNA, 13 nt, Homo sapiens
cuaugcuuuggaa

SEQ ID NO: 478981 - RNA, 16 nt, Homo sapiens
cuaugcuuuggaauac

SEQ ID NO: 478982 - RNA, 14 nt, Homo sapiens
cuaugugcaugcag

SEQ ID NO: 478983 - RNA, 23 nt, Homo sapiens
cuauuauagaauggaacucaagg

SEQ ID NO: 478984 - RNA, 12 nt, Homo sapiens
cuauucaucuca

SEQ ID NO: 478985 - RNA, 21 nt, Homo sapiens
cuauugugcuuucuaucuaau

SEQ ID NO: 478986 - RNA, 15 nt, Homo sapiens
cuauuuaacuugagg

SEQ ID NO: 478987 - RNA, 22 nt, Homo sapiens
cuauuuuuauuuguuugugcau

SEQ ID NO: 478988 - RNA, 15 nt, Homo sapiens
cucaaaaauagggaa

SEQ ID NO: 478989 - RNA, 20 nt, Homo sapiens
cucacacugggacuugcaaa

SEQ ID NO: 478990 - RNA, 13 nt, Homo sapiens
cucaccacaugcg

SEQ ID NO: 478991 - RNA, 14 nt, Homo sapiens
cucacgccuguaau

SEQ ID NO: 478992 - RNA, 19 nt, Homo sapiens
cucacuauucaaguauuag

SEQ ID NO: 478993 - RNA, 23 nt, Homo sapiens
cucacuauucaaguauuaggggu

SEQ ID NO: 478994 - RNA, 19 nt, Homo sapiens
cucagagagggcaggcaug

SEQ ID NO: 478995 - RNA, 14 nt, Homo sapiens
cucagcauuuccac

SEQ ID NO: 478996 - RNA, 16 nt, Homo sapiens
cucagcuggaucucca

SEQ ID NO: 478997 - RNA, 16 nt, Homo sapiens
cucaggugauccaccu

SEQ ID NO: 478998 - RNA, 15 nt, Homo sapiens
cucaguucagaauca

SEQ ID NO: 478999 - RNA, 13 nt, Homo sapiens
cucaucugggcaa

SEQ ID NO: 479000 - RNA, 20 nt, Homo sapiens
cucaugcccugccaagcagc

SEQ ID NO: 479001 - RNA, 19 nt, Homo sapiens
cucaugcugugugacucaa

SEQ ID NO: 479002 - RNA, 15 nt, Homo sapiens
cucauugaugucaaa

SEQ ID NO: 479003 - RNA, 21 nt, Homo sapiens
cucauuuauuuccauauuaaa

SEQ ID NO: 479004 - RNA, 15 nt, Homo sapiens
cucauuucaggagca

SEQ ID NO: 479005 - RNA, 19 nt, Homo sapiens
cucauuuuagaaccaccaa

SEQ ID NO: 479006 - RNA, 13 nt, Homo sapiens
cuccagacagggu

SEQ ID NO: 479007 - RNA, 15 nt, Homo sapiens
cuccagacaggguuc

SEQ ID NO: 479008 - RNA, 19 nt, Homo sapiens
cuccagagggaauugcaga

SEQ ID NO: 479009 - RNA, 15 nt, Homo sapiens
cuccagaugagagua

SEQ ID NO: 479010 - RNA, 23 nt, Homo sapiens
cuccaucaguuagagcugacaca

SEQ ID NO: 479011 - RNA, 13 nt, Homo sapiens
cucccacacaaga

SEQ ID NO: 479012 - RNA, 18 nt, Homo sapiens
cuccccuggggacagcaa

SEQ ID NO: 479013 - RNA, 17 nt, Homo sapiens
cucccugaaguaagcaa

SEQ ID NO: 479014 - RNA, 18 nt, Homo sapiens
cucgaacuccugaccuca

SEQ ID NO: 479015 - RNA, 14 nt, Homo sapiens
cucgaaucacucau

SEQ ID NO: 479016 - RNA, 15 nt, Homo sapiens
cucguggaacaguua

SEQ ID NO: 479017 - RNA, 19 nt, Homo sapiens
cucuaaaaugaguuaccua

SEQ ID NO: 479018 - RNA, 12 nt, Homo sapiens
cucucacuccag

SEQ ID NO: 479019 - RNA, 21 nt, Homo sapiens
cucucuucaauaaaccacaag

SEQ ID NO: 479020 - RNA, 16 nt, Homo sapiens
cucugcaguugaucuc

SEQ ID NO: 479021 - RNA, 19 nt, Homo sapiens
cucugccgcugccaugcuu

SEQ ID NO: 479022 - RNA, 13 nt, Homo sapiens
cucugcuugccau

SEQ ID NO: 479023 - RNA, 14 nt, Homo sapiens
cucuucaaggacuu

SEQ ID NO: 479024 - RNA, 16 nt, Homo sapiens
cucuucaauaaaccac

SEQ ID NO: 479025 - RNA, 18 nt, Homo sapiens
cucuucaauaaaccacaa

SEQ ID NO: 479026 - RNA, 20 nt, Homo sapiens
cucuucaauaaaccacaagc

SEQ ID NO: 479027 - RNA, 12 nt, Homo sapiens
cucuuggcaguc

SEQ ID NO: 479028 - RNA, 20 nt, Homo sapiens
cucuuguguuuuuugcucac

SEQ ID NO: 479029 - RNA, 16 nt, Homo sapiens
cugaaaacaagccaug

SEQ ID NO: 479030 - RNA, 17 nt, Homo sapiens
cugaaaauuaacacugc

SEQ ID NO: 479031 - RNA, 16 nt, Homo sapiens
cugaagccucacuuau

SEQ ID NO: 479032 - RNA, 17 nt, Homo sapiens
cugacauuuugcagaaa

SEQ ID NO: 479033 - RNA, 21 nt, Homo sapiens
cugaccuccuuacauaugcaa

SEQ ID NO: 479034 - RNA, 21 nt, Homo sapiens
cugacuguuuccaucaagggu

SEQ ID NO: 479035 - RNA, 16 nt, Homo sapiens
cugagaacacugugaa

SEQ ID NO: 479036 - RNA, 17 nt, Homo sapiens
cugagaacacugugaaa

SEQ ID NO: 479037 - RNA, 22 nt, Homo sapiens
cugagcagugcuugaaugaagu

SEQ ID NO: 479038 - RNA, 23 nt, Homo sapiens
cugagcagugcuugaaugaaguu

SEQ ID NO: 479039 - RNA, 17 nt, Homo sapiens
cugaggcagacagcagc

SEQ ID NO: 479040 - RNA, 15 nt, Homo sapiens
cugagucugcagaug

SEQ ID NO: 479041 - RNA, 21 nt, Homo sapiens
cugauacaaauugcagacugu

SEQ ID NO: 479042 - RNA, 14 nt, Homo sapiens
cugauccugugaag

SEQ ID NO: 479043 - RNA, 14 nt, Homo sapiens
cugaucgauuugca

SEQ ID NO: 479044 - RNA, 13 nt, Homo sapiens
cugaucugaugca

SEQ ID NO: 479045 - RNA, 13 nt, Homo sapiens
cugaugacuuuau

SEQ ID NO: 479046 - RNA, 19 nt, Homo sapiens
cugaugacuuuauccugag

SEQ ID NO: 479047 - RNA, 18 nt, Homo sapiens
cugauguccucaccacau

SEQ ID NO: 479048 - RNA, 17 nt, Homo sapiens
cugauuaaugcuaaaug

SEQ ID NO: 479049 - RNA, 18 nt, Homo sapiens
cugcaggguccccaagga

SEQ ID NO: 479050 - RNA, 22 nt, Homo sapiens
cugcauuauauuuauuacugua

SEQ ID NO: 479051 - RNA, 12 nt, Homo sapiens
cugccuguggag

SEQ ID NO: 479052 - RNA, 22 nt, Homo sapiens
cugccuguucugaggauucagg

SEQ ID NO: 479053 - RNA, 20 nt, Homo sapiens
cugcugguaauuuguaucug

SEQ ID NO: 479054 - RNA, 14 nt, Homo sapiens
cuggaacagauuca

SEQ ID NO: 479055 - RNA, 20 nt, Homo sapiens
cuggaacagauucacacugu

SEQ ID NO: 479056 - RNA, 15 nt, Homo sapiens
cuggaaucucaaaag

SEQ ID NO: 479057 - RNA, 20 nt, Homo sapiens
cuggagggcuggaaucugga

SEQ ID NO: 479058 - RNA, 12 nt, Homo sapiens
cuggagugcagu

SEQ ID NO: 479059 - RNA, 13 nt, Homo sapiens
cuggaugccugau

SEQ ID NO: 479060 - RNA, 23 nt, Homo sapiens
cuggccagggccuggaagacaga

SEQ ID NO: 479061 - RNA, 14 nt, Homo sapiens
cuggcugauuauca

SEQ ID NO: 479062 - RNA, 16 nt, Homo sapiens
cugggaccacacagac

SEQ ID NO: 479063 - RNA, 23 nt, Homo sapiens
cugggauuacaggcgugagccac

SEQ ID NO: 479064 - RNA, 22 nt, Homo sapiens
cugggcaaggaggccacgugau

SEQ ID NO: 479065 - RNA, 14 nt, Homo sapiens
cugggcaccaccuc

SEQ ID NO: 479066 - RNA, 19 nt, Homo sapiens
cugggcugcagagacugga

SEQ ID NO: 479067 - RNA, 21 nt, Homo sapiens
cugguauuccugccuccauau

SEQ ID NO: 479068 - RNA, 23 nt, Homo sapiens
cuggugugugccucauugcuugg

SEQ ID NO: 479069 - RNA, 18 nt, Homo sapiens
cuguaaaaacugugggau

SEQ ID NO: 479070 - RNA, 20 nt, Homo sapiens
cuguaaagcuuugugcagau

SEQ ID NO: 479071 - RNA, 18 nt, Homo sapiens
cuguagcauuacaguggg

SEQ ID NO: 479072 - RNA, 12 nt, Homo sapiens
cuguagucccag

SEQ ID NO: 479073 - RNA, 17 nt, Homo sapiens
cuguaugccaagugaaa

SEQ ID NO: 479074 - RNA, 13 nt, Homo sapiens
cugucaaagugag

SEQ ID NO: 479075 - RNA, 13 nt, Homo sapiens
cuguccuuucuca

SEQ ID NO: 479076 - RNA, 16 nt, Homo sapiens
cugucucccgggacua

SEQ ID NO: 479077 - RNA, 20 nt, Homo sapiens
cugucuccuuaacacugagc

SEQ ID NO: 479078 - RNA, 14 nt, Homo sapiens
cugugcacgcagug

SEQ ID NO: 479079 - RNA, 19 nt, Homo sapiens
cugugucaguggaugcugc

SEQ ID NO: 479080 - RNA, 15 nt, Homo sapiens
cuguguuugcugagg

SEQ ID NO: 479081 - RNA, 20 nt, Homo sapiens
cuguucaagagcacacuugg

SEQ ID NO: 479082 - RNA, 15 nt, Homo sapiens
cuguuccugccacau

SEQ ID NO: 479083 - RNA, 20 nt, Homo sapiens
cuguucuuacugguugacau

SEQ ID NO: 479084 - RNA, 20 nt, Homo sapiens
ugugaacagggaacucagaa

SEQ ID NO: 479085 - RNA, 18 nt, Homo sapiens
ugugaacccaaaguguga

SEQ ID NO: 479086 - RNA, 14 nt, Homo sapiens
ugugaacguguaug

SEQ ID NO: 479087 - RNA, 24 nt, Homo sapiens
ugugaccuccuuauguauucucaa

SEQ ID NO: 479088 - RNA, 16 nt, Homo sapiens
ugugagguguugcuaa

SEQ ID NO: 479089 - RNA, 21 nt, Homo sapiens
ugugcaaauccccuccccaaa

SEQ ID NO: 479090 - RNA, 13 nt, Homo sapiens
ugugcucagggaa

SEQ ID NO: 479091 - RNA, 23 nt, Homo sapiens
uguggguagacacacaugaaguc

SEQ ID NO: 479092 - RNA, 22 nt, Homo sapiens
uguguacauuagucauucaaua

SEQ ID NO: 479093 - RNA, 22 nt, Homo sapiens
ugugucuaucugcuuuugccua

SEQ ID NO: 479094 - RNA, 22 nt, Homo sapiens
ugugugaacguguauguaccua

SEQ ID NO: 479095 - RNA, 12 nt, Homo sapiens
ugugugaucugu

SEQ ID NO: 479096 - RNA, 22 nt, Homo sapiens
uguguuaaguaauauuggcuau

SEQ ID NO: 479097 - RNA, 13 nt, Homo sapiens
uguguuugcugag

SEQ ID NO: 479098 - RNA, 15 nt, Homo sapiens
uguguuuuuugcuca

SEQ ID NO: 479099 - RNA, 21 nt, Homo sapiens
uguuaaaacugggacagggga

SEQ ID NO: 479100 - RNA, 17 nt, Homo sapiens
uguuauucaauggaauc

SEQ ID NO: 479101 - RNA, 18 nt, Homo sapiens
uguuauuuguacaguuca

SEQ ID NO: 479102 - RNA, 16 nt, Homo sapiens
uguucaauaugagucu

SEQ ID NO: 479103 - RNA, 13 nt, Homo sapiens
uguucagaugcuu

SEQ ID NO: 479104 - RNA, 19 nt, Homo sapiens
uguucuuucuuacacaaga

SEQ ID NO: 479105 - RNA, 13 nt, Homo sapiens
uguugaacaauag

SEQ ID NO: 479106 - RNA, 16 nt, Homo sapiens
uguugacaugggacau

SEQ ID NO: 479107 - RNA, 13 nt, Homo sapiens
uguugacaugugc

SEQ ID NO: 479108 - RNA, 23 nt, Homo sapiens
uguugaugaggcagaugccucua

SEQ ID NO: 479109 - RNA, 14 nt, Homo sapiens
uguugcaaucuggu

SEQ ID NO: 479110 - RNA, 17 nt, Homo sapiens
uguuggaaaaugugcaa

SEQ ID NO: 479111 - RNA, 16 nt, Homo sapiens
uguuggcaugcaagau

SEQ ID NO: 479112 - RNA, 20 nt, Homo sapiens
uguuguuuuaggaauacaua

SEQ ID NO: 479113 - RNA, 17 nt, Homo sapiens
uguuuccaucaagggua

SEQ ID NO: 479114 - RNA, 14 nt, Homo sapiens
uguuucugaucuga

SEQ ID NO: 479115 - RNA, 15 nt, Homo sapiens
uguuugucaaaaagu

SEQ ID NO: 479116 - RNA, 19 nt, Homo sapiens
uguuugucaaaaagucauu

SEQ ID NO: 479117 - RNA, 16 nt, Homo sapiens
uguuuugagcuuaaaa

SEQ ID NO: 479118 - RNA, 15 nt, Homo sapiens
uuaaaagccaucaaa

SEQ ID NO: 479119 - RNA, 21 nt, Homo sapiens
uuaaaaucacaaacucaucca

SEQ ID NO: 479120 - RNA, 17 nt, Homo sapiens
uuaaacaaauguaugau

SEQ ID NO: 479121 - RNA, 21 nt, Homo sapiens
uuaaacccuauugguaaagaa

SEQ ID NO: 479122 - RNA, 21 nt, Homo sapiens
uuaaacucagggagcauuuau

SEQ ID NO: 479123 - RNA, 17 nt, Homo sapiens
uuaaagcuuggugcuaa

SEQ ID NO: 479124 - RNA, 16 nt, Homo sapiens
uuaaauuuuuccuuag

SEQ ID NO: 479125 - RNA, 14 nt, Homo sapiens
uuaacagcuuucuc

SEQ ID NO: 479126 - RNA, 15 nt, Homo sapiens
uuaacuugaggguaa

SEQ ID NO: 479127 - RNA, 15 nt, Homo sapiens
uuaagauaugauguc

SEQ ID NO: 479128 - RNA, 16 nt, Homo sapiens
uuaaguugauggugau

SEQ ID NO: 479129 - RNA, 14 nt, Homo sapiens
uuaauaauguuuca

SEQ ID NO: 479130 - RNA, 13 nt, Homo sapiens
uuaaugauaauau

SEQ ID NO: 479131 - RNA, 18 nt, Homo sapiens
uuaauuugauaguauugu

SEQ ID NO: 479132 - RNA, 15 nt, Homo sapiens
uuacaacagugagaa

SEQ ID NO: 479133 - RNA, 17 nt, Homo sapiens
uuacaggcgugagccac

SEQ ID NO: 479134 - RNA, 19 nt, Homo sapiens
uuacauuugaaaucuauga

SEQ ID NO: 479135 - RNA, 15 nt, Homo sapiens
uuacuaucaugucaa

SEQ ID NO: 479136 - RNA, 13 nt, Homo sapiens
uuagaacuagucg

SEQ ID NO: 479137 - RNA, 15 nt, Homo sapiens
uuagaguacagaucc

SEQ ID NO: 479138 - RNA, 15 nt, Homo sapiens
uuagccagugaugcu

SEQ ID NO: 479139 - RNA, 22 nt, Homo sapiens
uuagcugugcgcaauugcucau

SEQ ID NO: 479140 - RNA, 14 nt, Homo sapiens
uuaggcagggauuu

SEQ ID NO: 479141 - RNA, 18 nt, Homo sapiens
uuagggaaaacauuccau

SEQ ID NO: 479142 - RNA, 17 nt, Homo sapiens
uuagucauaaacaugca

SEQ ID NO: 479143 - RNA, 15 nt, Homo sapiens
uuauaaaagaugcau

SEQ ID NO: 479144 - RNA, 18 nt, Homo sapiens
uuauacauuaacuucagc

SEQ ID NO: 479145 - RNA, 23 nt, Homo sapiens
uuauggaaggacuacagcagcau

SEQ ID NO: 479146 - RNA, 12 nt, Homo sapiens
uuaugugcaaua

SEQ ID NO: 479147 - RNA, 19 nt, Homo sapiens
uuauuaggaaguaugguuu

SEQ ID NO: 479148 - RNA, 18 nt, Homo sapiens
uuauuaggauuccaccuu

SEQ ID NO: 479149 - RNA, 22 nt, Homo sapiens
uuauuagggauuaccguuuccu

SEQ ID NO: 479150 - RNA, 21 nt, Homo sapiens
uuauuccaaaauaacaaaaua

SEQ ID NO: 479151 - RNA, 15 nt, Homo sapiens
uuauucccccaaagc

SEQ ID NO: 479152 - RNA, 17 nt, Homo sapiens
uuauuuguacaguucag

SEQ ID NO: 479153 - RNA, 23 nt, Homo sapiens
uucaaaaauuauauuuugaacaa

SEQ ID NO: 479154 - RNA, 22 nt, Homo sapiens
uucaaagagacauauacuaaga

SEQ ID NO: 479155 - RNA, 13 nt, Homo sapiens
uucaagcaauucu

SEQ ID NO: 479156 - RNA, 14 nt, Homo sapiens
uucaaguacuguaa

SEQ ID NO: 479157 - RNA, 18 nt, Homo sapiens
uucacuccccuaucccau

SEQ ID NO: 479158 - RNA, 20 nt, Homo sapiens
uucagccuagccgaccucag

SEQ ID NO: 479159 - RNA, 18 nt, Homo sapiens
uucagcugugaacaugga

SEQ ID NO: 479160 - RNA, 16 nt, Homo sapiens
uucagugcuucgcaga

SEQ ID NO: 479161 - RNA, 23 nt, Homo sapiens
uucaguuccucuuugcauggaau

SEQ ID NO: 479162 - RNA, 20 nt, Homo sapiens
uucauauauuuguaugaucc

SEQ ID NO: 479163 - RNA, 20 nt, Homo sapiens
uucaugacuuuuccauguau

SEQ ID NO: 479164 - RNA, 14 nt, Homo sapiens
uucaugcauggaaa

SEQ ID NO: 479165 - RNA, 16 nt, Homo sapiens
uucaugcauuugcacu

SEQ ID NO: 479166 - RNA, 19 nt, Homo sapiens
uucauugacugauggugaa

SEQ ID NO: 479167 - RNA, 22 nt, Homo sapiens
uuccaucccaggcuuuugaaaa

SEQ ID NO: 479168 - RNA, 22 nt, Homo sapiens
uucccaacuccagaaagugaca

SEQ ID NO: 479169 - RNA, 22 nt, Homo sapiens
uucccagcuucugccacauaaa

SEQ ID NO: 479170 - RNA, 15 nt, Homo sapiens
uucccaggaguacac

SEQ ID NO: 479171 - RNA, 21 nt, Homo sapiens
uucccauaccacccaaugcug

SEQ ID NO: 479172 - RNA, 21 nt, Homo sapiens
uuccccuugcccagggcucag

SEQ ID NO: 479173 - RNA, 21 nt, Homo sapiens
uucccuauuuugccaguggga

SEQ ID NO: 479174 - RNA, 16 nt, Homo sapiens
uuccgcauccuagucu

SEQ ID NO: 479175 - RNA, 22 nt, Homo sapiens
uuccuaaggcacccacaaauaa

SEQ ID NO: 479176 - RNA, 18 nt, Homo sapiens
uuccuuugaagaggaaaa

SEQ ID NO: 479177 - RNA, 19 nt, Homo sapiens
uucguguauagcuguguga

SEQ ID NO: 479178 - RNA, 14 nt, Homo sapiens
uucuaaugugccua

SEQ ID NO: 479179 - RNA, 20 nt, Homo sapiens
uucucauccugcaggcagcu

SEQ ID NO: 479180 - RNA, 15 nt, Homo sapiens
uucuccagacagggu

SEQ ID NO: 479181 - RNA, 17 nt, Homo sapiens
uucugaaucaaggugau

SEQ ID NO: 479182 - RNA, 18 nt, Homo sapiens
uucugaaucaccuaccuu

SEQ ID NO: 479183 - RNA, 16 nt, Homo sapiens
uucugagguaaccuca

SEQ ID NO: 479184 - RNA, 13 nt, Homo sapiens
uucuuccuucauu

SEQ ID NO: 479185 - RNA, 19 nt, Homo sapiens
uugaagacccucaaugcca

SEQ ID NO: 479186 - RNA, 19 nt, Homo sapiens
uugaaucccuuaaacucag

SEQ ID NO: 479187 - RNA, 22 nt, Homo sapiens
uugaauggcaugcuaguagcag

SEQ ID NO: 479188 - RNA, 20 nt, Homo sapiens
uugacacuauucacuaaaau

SEQ ID NO: 479189 - RNA, 15 nt, Homo sapiens
uugacagaacacugu

SEQ ID NO: 479190 - RNA, 20 nt, Homo sapiens
uugacaucaaugaugaggcu

SEQ ID NO: 479191 - RNA, 22 nt, Homo sapiens
uugacaugggacauuugcucau

SEQ ID NO: 479192 - RNA, 15 nt, Homo sapiens
uugaccuuugcacga

SEQ ID NO: 479193 - RNA, 17 nt, Homo sapiens
uugagaucauugcaaac

SEQ ID NO: 479194 - RNA, 13 nt, Homo sapiens
uugagcuacuuca

SEQ ID NO: 479195 - RNA, 19 nt, Homo sapiens
uugauauaaauaaaacauu

SEQ ID NO: 479196 - RNA, 17 nt, Homo sapiens
uugcauagcagcugcua

SEQ ID NO: 479197 - RNA, 17 nt, Homo sapiens
uugcauauguaaggaag

SEQ ID NO: 479198 - RNA, 14 nt, Homo sapiens
uugcaucagcaaca

SEQ ID NO: 479199 - RNA, 23 nt, Homo sapiens
uugcauuuaauuuauugaggcuu

SEQ ID NO: 479200 - RNA, 22 nt, Homo sapiens
uugccaucccucccuccaccuc

SEQ ID NO: 479201 - RNA, 16 nt, Homo sapiens
uugcccaccagaucau

SEQ ID NO: 479202 - RNA, 17 nt, Homo sapiens
uugcggggauaaagaga

SEQ ID NO: 479203 - RNA, 18 nt, Homo sapiens
uugcuauucccaugcauu

SEQ ID NO: 479204 - RNA, 22 nt, Homo sapiens
uugcugccaaacacccaugccc

SEQ ID NO: 479205 - RNA, 16 nt, Homo sapiens
uugcuucucucucuaa

SEQ ID NO: 479206 - RNA, 15 nt, Homo sapiens
uuggaaaaugugcaa

SEQ ID NO: 479207 - RNA, 16 nt, Homo sapiens
uuggaugcacuuuaua

SEQ ID NO: 479208 - RNA, 16 nt, Homo sapiens
uuggccaucucuggau

SEQ ID NO: 479209 - RNA, 16 nt, Homo sapiens
uuggcuacacagggau

SEQ ID NO: 479210 - RNA, 15 nt, Homo sapiens
uugggaacugcaaua

SEQ ID NO: 479211 - RNA, 18 nt, Homo sapiens
uuguaaacauuaguucua

SEQ ID NO: 479212 - RNA, 15 nt, Homo sapiens
uuguauugcauauau

SEQ ID NO: 479213 - RNA, 15 nt, Homo sapiens
uugucaaaaagucau

SEQ ID NO: 479214 - RNA, 16 nt, Homo sapiens
uugucaaaaagucauu

SEQ ID NO: 479215 - RNA, 22 nt, Homo sapiens
uugucaagcaguagacaagcaa

SEQ ID NO: 479216 - RNA, 14 nt, Homo sapiens
uugugaagaaacau

SEQ ID NO: 479217 - RNA, 21 nt, Homo sapiens
uuguggaaagaugaaugcaau

SEQ ID NO: 479218 - RNA, 20 nt, Homo sapiens
uuguguuuuguuuuguauca

SEQ ID NO: 479219 - RNA, 23 nt, Homo sapiens
uuguuuucccgagcaaagucuaa

SEQ ID NO: 479220 - RNA, 16 nt, Homo sapiens
uuuaaaagaaugauua

SEQ ID NO: 479221 - RNA, 16 nt, Homo sapiens
uuuaaaagcauacucu

SEQ ID NO: 479222 - RNA, 21 nt, Homo sapiens
uuuaaaccaccuaguucuccc

SEQ ID NO: 479223 - RNA, 13 nt, Homo sapiens
aacagcacccucu

SEQ ID NO: 479224 - RNA, 15 nt, Homo sapiens
aacagcacccucucc

SEQ ID NO: 479225 - RNA, 17 nt, Homo sapiens
aacagcacccucuccag

SEQ ID NO: 479226 - RNA, 17 nt, Homo sapiens
aacaucauggacugagc

SEQ ID NO: 479227 - RNA, 18 nt, Homo sapiens
aacaucauggacugagcu

SEQ ID NO: 479228 - RNA, 14 nt, Homo sapiens
aacaugcaaagauc

SEQ ID NO: 479229 - RNA, 18 nt, Homo sapiens
aacaugccugcaccugca

SEQ ID NO: 479230 - RNA, 13 nt, Homo sapiens
aacaugugcucag

SEQ ID NO: 479231 - RNA, 16 nt, Homo sapiens
aacaugugcucaggga

SEQ ID NO: 479232 - RNA, 21 nt, Homo sapiens
aacaugugguuaaugccaugg

SEQ ID NO: 479233 - RNA, 14 nt, Homo sapiens
aacauuuucuugaa

SEQ ID NO: 479234 - RNA, 15 nt, Homo sapiens
aaccacaauauguau

SEQ ID NO: 479235 - RNA, 17 nt, Homo sapiens
aaccaggggccaugaau

SEQ ID NO: 479236 - RNA, 20 nt, Homo sapiens
aaccagugucugaaccaccc

SEQ ID NO: 479237 - RNA, 15 nt, Homo sapiens
aaccaugcccaagaa

SEQ ID NO: 479238 - RNA, 11 nt, Homo sapiens
aacccaaagug

SEQ ID NO: 479239 - RNA, 19 nt, Homo sapiens
aacccuauugguaaagaau

SEQ ID NO: 479240 - RNA, 21 nt, Homo sapiens
aaccuggagggcuagaaccua

SEQ ID NO: 479241 - RNA, 23 nt, Homo sapiens
aaccuguaaagcaggugcccagg

SEQ ID NO: 479242 - RNA, 15 nt, Homo sapiens
aacgaguuguuggcu

SEQ ID NO: 479243 - RNA, 19 nt, Homo sapiens
aacuauguucacaagaaca

SEQ ID NO: 479244 - RNA, 19 nt, Homo sapiens
aacucaauauuuuccauga

SEQ ID NO: 479245 - RNA, 13 nt, Homo sapiens
aacucuccuccau

SEQ ID NO: 479246 - RNA, 18 nt, Homo sapiens
aacugaaaacaagccaug

SEQ ID NO: 479247 - RNA, 20 nt, Homo sapiens
aacugcagcgaguacuuccc

SEQ ID NO: 479248 - RNA, 18 nt, Homo sapiens
aacugccuguucaauaaa

SEQ ID NO: 479249 - RNA, 16 nt, Homo sapiens
aacugggcaugguagu

SEQ ID NO: 479250 - RNA, 17 nt, Homo sapiens
aacuggguucaaaaaga

SEQ ID NO: 479251 - RNA, 19 nt, Homo sapiens
aacuguuguguccaauccc

SEQ ID NO: 479252 - RNA, 16 nt, Homo sapiens
aacuuaggcaugcaca

SEQ ID NO: 479253 - RNA, 21 nt, Homo sapiens
aacuucaauauccacuucuuu

SEQ ID NO: 479254 - RNA, 15 nt, Homo sapiens
aagaaaauaucacuu

SEQ ID NO: 479255 - RNA, 14 nt, Homo sapiens
aagaaaaugauugc

SEQ ID NO: 479256 - RNA, 21 nt, Homo sapiens
aagaaaauguuacuucucuca

SEQ ID NO: 479257 - RNA, 23 nt, Homo sapiens
aagaaauauuagacaaaguucau

SEQ ID NO: 479258 - RNA, 16 nt, Homo sapiens
aagaacaucuuuaugg

SEQ ID NO: 479259 - RNA, 13 nt, Homo sapiens
aagaagcuugaau

SEQ ID NO: 479260 - RNA, 13 nt, Homo sapiens
aagaaucuguuuc

SEQ ID NO: 479261 - RNA, 21 nt, Homo sapiens
aagacaaauugaucagugcuu

SEQ ID NO: 479262 - RNA, 13 nt, Homo sapiens
aagacaauggcuu

SEQ ID NO: 479263 - RNA, 16 nt, Homo sapiens
aagacagagcugggau

SEQ ID NO: 479264 - RNA, 22 nt, Homo sapiens
aagacagugccuauacugccuc

SEQ ID NO: 479265 - RNA, 19 nt, Homo sapiens
aagacauaguugugcaugc

SEQ ID NO: 479266 - RNA, 16 nt, Homo sapiens
aagaccaccaccucag

SEQ ID NO: 479267 - RNA, 23 nt, Homo sapiens
aagacuauucccuucuaaccuga

SEQ ID NO: 479268 - RNA, 18 nt, Homo sapiens
aagacugggugaggauaa

SEQ ID NO: 479269 - RNA, 22 nt, Homo sapiens
aagagaaaaguccacagugaua

SEQ ID NO: 479270 - RNA, 18 nt, Homo sapiens
aagagccggagccuccag

SEQ ID NO: 479271 - RNA, 15 nt, Homo sapiens
aagaggaagugcacu

SEQ ID NO: 479272 - RNA, 16 nt, Homo sapiens
aagagucaugucaaau

SEQ ID NO: 479273 - RNA, 17 nt, Homo sapiens
acacuuagcaucccaca

SEQ ID NO: 479274 - RNA, 14 nt, Homo sapiens
acagaacacugucu

SEQ ID NO: 479275 - RNA, 21 nt, Homo sapiens
acagaacgagacuccaccuca

SEQ ID NO: 479276 - RNA, 13 nt, Homo sapiens
acagaacuaugga

SEQ ID NO: 479277 - RNA, 23 nt, Homo sapiens
acagaagacagcagcaagugugc

SEQ ID NO: 479278 - RNA, 16 nt, Homo sapiens
acagaccugcucugga

SEQ ID NO: 479279 - RNA, 16 nt, Homo sapiens
acagaccuuugaacua

SEQ ID NO: 479280 - RNA, 24 nt, Homo sapiens
acagacuaugucacccaaugcaua

SEQ ID NO: 479281 - RNA, 17 nt, Homo sapiens
acagagaaaagacauaa

SEQ ID NO: 479282 - RNA, 15 nt, Homo sapiens
acagagcagaacuuu

SEQ ID NO: 479283 - RNA, 17 nt, Homo sapiens
acagagcagaacuuuca

SEQ ID NO: 479284 - RNA, 12 nt, Homo sapiens
acagagcgagau

SEQ ID NO: 479285 - RNA, 17 nt, Homo sapiens
acagagucuggcucugu

SEQ ID NO: 479286 - RNA, 23 nt, Homo sapiens
acagagucuggcucugucaccca

SEQ ID NO: 479287 - RNA, 13 nt, Homo sapiens
acagaugugucag

SEQ ID NO: 479288 - RNA, 19 nt, Homo sapiens
acagaugugucagccagga

SEQ ID NO: 479289 - RNA, 22 nt, Homo sapiens
acagaugugugauucacagugu

SEQ ID NO: 479290 - RNA, 16 nt, Homo sapiens
acagcacccucuccag

SEQ ID NO: 479291 - RNA, 20 nt, Homo sapiens
acagccucuuagaugcaguu

SEQ ID NO: 479292 - RNA, 20 nt, Homo sapiens
acagcugcuggagacuccua

SEQ ID NO: 479293 - RNA, 22 nt, Homo sapiens
acagcuguaguaccccaagaag

SEQ ID NO: 479294 - RNA, 19 nt, Homo sapiens
acaggagaaugcacagugg

SEQ ID NO: 479295 - RNA, 20 nt, Homo sapiens
acaggaugaaggcaaugcca

SEQ ID NO: 479296 - RNA, 19 nt, Homo sapiens
acaguaaauggcuuaucca

SEQ ID NO: 479297 - RNA, 17 nt, Homo sapiens
acaguauacgcuccauc

SEQ ID NO: 479298 - RNA, 11 nt, Homo sapiens
acagugacauu

SEQ ID NO: 479299 - RNA, 14 nt, Homo sapiens
acauaaagccuugg

SEQ ID NO: 479300 - RNA, 22 nt, Homo sapiens
acauaguagguacccaauucaa

SEQ ID NO: 479301 - RNA, 15 nt, Homo sapiens
acauauugagcacuu

SEQ ID NO: 479302 - RNA, 18 nt, Homo sapiens
acaucaagccugugauug

SEQ ID NO: 479303 - RNA, 12 nt, Homo sapiens
acaucaaugaug

SEQ ID NO: 479304 - RNA, 13 nt, Homo sapiens
acaucacuugaga

SEQ ID NO: 479305 - RNA, 20 nt, Homo sapiens
acaucaucaaggcacugccu

SEQ ID NO: 479306 - RNA, 12 nt, Homo sapiens
acaucauggacu

SEQ ID NO: 479307 - RNA, 16 nt, Homo sapiens
acaucuuggcacauuu

SEQ ID NO: 479308 - RNA, 13 nt, Homo sapiens
acaugaacccauc

SEQ ID NO: 479309 - RNA, 19 nt, Homo sapiens
acaugaagggaugcugcaa

SEQ ID NO: 479310 - RNA, 18 nt, Homo sapiens
acaugccaagcacugugc

SEQ ID NO: 479311 - RNA, 23 nt, Homo sapiens
acauggagcuugacuucaugcca

SEQ ID NO: 479312 - RNA, 23 nt, Homo sapiens
acauuaaacacaaagcuguugaa

SEQ ID NO: 479313 - RNA, 13 nt, Homo sapiens
acauuaacuucag

SEQ ID NO: 479314 - RNA, 17 nt, Homo sapiens
acauuauuggacuucca

SEQ ID NO: 479315 - RNA, 13 nt, Homo sapiens
acauucaugccug

SEQ ID NO: 479316 - RNA, 22 nt, Homo sapiens
acauucucaucaccacagggau

SEQ ID NO: 479317 - RNA, 23 nt, Homo sapiens
accaagaagggcuagaaccugga

SEQ ID NO: 479318 - RNA, 17 nt, Homo sapiens
accaaggagaugaagca

SEQ ID NO: 479319 - RNA, 15 nt, Homo sapiens
accacagucuuaggg

SEQ ID NO: 479320 - RNA, 18 nt, Homo sapiens
accacauagaacaugugu

SEQ ID NO: 479321 - RNA, 22 nt, Homo sapiens
accaggcuggccagcaugguga

SEQ ID NO: 479322 - RNA, 18 nt, Homo sapiens
accauaaauuuaaaugga

SEQ ID NO: 479323 - RNA, 20 nt, Homo sapiens
accauccuggccaacauugu

SEQ ID NO: 479324 - RNA, 18 nt, Homo sapiens
acccaauaguuguugauu

SEQ ID NO: 479325 - RNA, 20 nt, Homo sapiens
acccacaaauaaaugacaag

SEQ ID NO: 479326 - RNA, 17 nt, Homo sapiens
acccaccuuucugcaca

SEQ ID NO: 479327 - RNA, 14 nt, Homo sapiens
acccacuuccugau

SEQ ID NO: 479328 - RNA, 19 nt, Homo sapiens
acccagcaagggcacuuaa

SEQ ID NO: 479329 - RNA, 17 nt, Homo sapiens
acccaugcccagcugua

SEQ ID NO: 479330 - RNA, 18 nt, Homo sapiens
acccauucuacacagagc

SEQ ID NO: 479331 - RNA, 20 nt, Homo sapiens
acccccacagaccugcucug

SEQ ID NO: 479332 - RNA, 18 nt, Homo sapiens
acccucaaugccaagaaa

SEQ ID NO: 479333 - RNA, 12 nt, Homo sapiens
acccucaugcug

SEQ ID NO: 479334 - RNA, 16 nt, Homo sapiens
acccugagacuuggcu

SEQ ID NO: 479335 - RNA, 16 nt, Homo sapiens
acccuuggacuugagg

SEQ ID NO: 479336 - RNA, 23 nt, Homo sapiens
accuacauuuuaaugcaccugaa

SEQ ID NO: 479337 - RNA, 12 nt, Homo sapiens
accuacuccugg

SEQ ID NO: 479338 - RNA, 23 nt, Homo sapiens
accuagaagggcuagaaccugga

SEQ ID NO: 479339 - RNA, 13 nt, Homo sapiens
accuauaaaucau

SEQ ID NO: 479340 - RNA, 18 nt, Homo sapiens
accucaccugggcaggga

SEQ ID NO: 479341 - RNA, 13 nt, Homo sapiens
accucacuauuca

SEQ ID NO: 479342 - RNA, 22 nt, Homo sapiens
accucagggcuguguguacuaa

SEQ ID NO: 479343 - RNA, 15 nt, Homo sapiens
accucaggugaucca

SEQ ID NO: 479344 - RNA, 16 nt, Homo sapiens
accucccugcaauaaa

SEQ ID NO: 479345 - RNA, 16 nt, Homo sapiens
accuccuggaaggcag

SEQ ID NO: 479346 - RNA, 21 nt, Homo sapiens
accugagcugaaauaaaguga

SEQ ID NO: 479347 - RNA, 22 nt, Homo sapiens
accuggagaacuagaaccugga

SEQ ID NO: 479348 - RNA, 22 nt, Homo sapiens
accuggagggcuagaaccugga

SEQ ID NO: 479349 - RNA, 22 nt, Homo sapiens
accuggaggggcuagaaccuag

SEQ ID NO: 479350 - RNA, 22 nt, Homo sapiens
accugggcugaggcauccuucc

SEQ ID NO: 479351 - RNA, 23 nt, Homo sapiens
accuguuaucuguguuugcugag

SEQ ID NO: 479352 - RNA, 23 nt, Homo sapiens
accuuacauuugaaaucuaugaa

SEQ ID NO: 479353 - RNA, 19 nt, Homo sapiens
accuucaccaucuguauau

SEQ ID NO: 479354 - RNA, 18 nt, Homo sapiens
accuugggggaagacuuu

SEQ ID NO: 479355 - RNA, 14 nt, Homo sapiens
accuuuccauuuau

SEQ ID NO: 479356 - RNA, 20 nt, Homo sapiens
accuuugcacgaacaccaag

SEQ ID NO: 479357 - RNA, 21 nt, Homo sapiens
acgaacagcugacauggaguu

SEQ ID NO: 479358 - RNA, 17 nt, Homo sapiens
acgaaggccuguguguu

SEQ ID NO: 479359 - RNA, 12 nt, Homo sapiens
acgagacuccac

SEQ ID NO: 479360 - RNA, 17 nt, Homo sapiens
acgccauugcacuccag

SEQ ID NO: 479361 - RNA, 13 nt, Homo sapiens
acgccuccccaau

SEQ ID NO: 479362 - RNA, 20 nt, Homo sapiens
acgugagaucauucacucau

SEQ ID NO: 479363 - RNA, 20 nt, Homo sapiens
acguuggccuaacacugggc

SEQ ID NO: 479364 - RNA, 13 nt, Homo sapiens
acuaagauguuca

SEQ ID NO: 479365 - RNA, 18 nt, Homo sapiens
acuacaauuuaaagcaaa

SEQ ID NO: 479366 - RNA, 17 nt, Homo sapiens
acuacaguaacugugac

SEQ ID NO: 479367 - RNA, 13 nt, Homo sapiens
acuagauacugaa

SEQ ID NO: 479368 - RNA, 15 nt, Homo sapiens
acuuugccacuggau

SEQ ID NO: 479369 - RNA, 22 nt, Homo sapiens
agaaaaaaauucaugcaucuca

SEQ ID NO: 479370 - RNA, 23 nt, Homo sapiens
agaaaaaaauucaugcaucucaa

SEQ ID NO: 479371 - RNA, 16 nt, Homo sapiens
agaaaauacauuuuau

SEQ ID NO: 479372 - RNA, 16 nt, Homo sapiens
agaaaaugauugcuua

SEQ ID NO: 479373 - RNA, 17 nt, Homo sapiens
agaaacacaacuauauu

SEQ ID NO: 479374 - RNA, 13 nt, Homo sapiens
agaaacugcucua

SEQ ID NO: 479375 - RNA, 19 nt, Homo sapiens
agaaacugcucuaauauca

SEQ ID NO: 479376 - RNA, 21 nt, Homo sapiens
agaaaggacccucaagacaaa

SEQ ID NO: 479377 - RNA, 14 nt, Homo sapiens
agaaaucugaaaag

SEQ ID NO: 479378 - RNA, 22 nt, Homo sapiens
agaaauuccaggaaaaucugca

SEQ ID NO: 479379 - RNA, 19 nt, Homo sapiens
agaaauuugccaauuuacu

SEQ ID NO: 479380 - RNA, 12 nt, Homo sapiens
agaacuuugcau

SEQ ID NO: 479381 - RNA, 23 nt, Homo sapiens
agaacuuugcauagcagcugcua

SEQ ID NO: 479382 - RNA, 13 nt, Homo sapiens
agaagaacugaaa

SEQ ID NO: 479383 - RNA, 18 nt, Homo sapiens
agaagaugguaccaccag

SEQ ID NO: 479384 - RNA, 15 nt, Homo sapiens
agaagcugaagaucc

SEQ ID NO: 479385 - RNA, 18 nt, Homo sapiens
agaaggagggagacauga

SEQ ID NO: 479386 - RNA, 22 nt, Homo sapiens
agaagggauaucuacugugguc

SEQ ID NO: 479387 - RNA, 16 nt, Homo sapiens
agaagugccaguugau

SEQ ID NO: 479388 - RNA, 21 nt, Homo sapiens
agaaucacuugacuuugccac

SEQ ID NO: 479389 - RNA, 17 nt, Homo sapiens
agaaucagacuaugaag

SEQ ID NO: 479390 - RNA, 22 nt, Homo sapiens
agaaucuguuucccagcagugg

SEQ ID NO: 479391 - RNA, 15 nt, Homo sapiens
agaaugugacaggca

SEQ ID NO: 479392 - RNA, 23 nt, Homo sapiens
agaauguucuuauguugcccagu

SEQ ID NO: 479393 - RNA, 16 nt, Homo sapiens
agaauugguugccaua

SEQ ID NO: 479394 - RNA, 19 nt, Homo sapiens
agacaaagggaaaugcagc

SEQ ID NO: 479395 - RNA, 17 nt, Homo sapiens
agacaaaguucauucaa

SEQ ID NO: 479396 - RNA, 13 nt, Homo sapiens
agacaaauugauc

SEQ ID NO: 479397 - RNA, 19 nt, Homo sapiens
agacaagagggacaagugg

SEQ ID NO: 479398 - RNA, 17 nt, Homo sapiens
agacacauuuacacuag

SEQ ID NO: 479399 - RNA, 18 nt, Homo sapiens
agacacugaaauauacac

SEQ ID NO: 479400 - RNA, 17 nt, Homo sapiens
agacagagaccuccugc

SEQ ID NO: 479401 - RNA, 15 nt, Homo sapiens
agacagcuucucauc

SEQ ID NO: 479402 - RNA, 19 nt, Homo sapiens
agacaggguuucaccaugu

SEQ ID NO: 479403 - RNA, 21 nt, Homo sapiens
agacauaguugugcaugccug

SEQ ID NO: 479404 - RNA, 18 nt, Homo sapiens
agacaugagcauggcuga

SEQ ID NO: 479405 - RNA, 15 nt, Homo sapiens
agacaugagugcgug

SEQ ID NO: 479406 - RNA, 18 nt, Homo sapiens
agaccaucuacauacaca

SEQ ID NO: 479407 - RNA, 15 nt, Homo sapiens
agaccugcucuggac

SEQ ID NO: 479408 - RNA, 22 nt, Homo sapiens
agaccugcucuggacacuugcu

SEQ ID NO: 479409 - RNA, 15 nt, Homo sapiens
agaccuuggcgcuac

SEQ ID NO: 479410 - RNA, 18 nt, Homo sapiens
agacuauucccuucuaac

SEQ ID NO: 479411 - RNA, 20 nt, Homo sapiens
agacucagggccccagcacu

SEQ ID NO: 479412 - RNA, 21 nt, Homo sapiens
agacucagggccccagcacua

SEQ ID NO: 479413 - RNA, 20 nt, Homo sapiens
agacucuggaaguauacuuu

SEQ ID NO: 479414 - RNA, 22 nt, Homo sapiens
agacuguggcugcuagcacuug

SEQ ID NO: 479415 - RNA, 22 nt, Homo sapiens
agacuuggcuccaccacugaua

SEQ ID NO: 479416 - RNA, 20 nt, Homo sapiens
agacuuugacucuccagaaa

SEQ ID NO: 479417 - RNA, 15 nt, Homo sapiens
agagaaaagacauaa

SEQ ID NO: 479418 - RNA, 23 nt, Homo sapiens
agagaggagguaguuaagggaug

SEQ ID NO: 479419 - RNA, 19 nt, Homo sapiens
agagaucgagaccauccug

SEQ ID NO: 479420 - RNA, 16 nt, Homo sapiens
agagaugggguuucac

SEQ ID NO: 479421 - RNA, 23 nt, Homo sapiens
agagauuggaaugggcagcucau

SEQ ID NO: 479422 - RNA, 20 nt, Homo sapiens
agagcaagacucugucucaa

SEQ ID NO: 479423 - RNA, 22 nt, Homo sapiens
agagcacacuuggcccaagugg

SEQ ID NO: 479424 - RNA, 16 nt, Homo sapiens
agagcaggacugcaca

SEQ ID NO: 479425 - RNA, 18 nt, Homo sapiens
agagccccacuugacacu

SEQ ID NO: 479426 - RNA, 23 nt, Homo sapiens
agagcccuucaugcauuugcacu

SEQ ID NO: 479427 - RNA, 21 nt, Homo sapiens
agaggagugggaaauugauua

SEQ ID NO: 479428 - RNA, 14 nt, Homo sapiens
agaggcaaaggcuc

SEQ ID NO: 479429 - RNA, 21 nt, Homo sapiens
agaggcaaaggcucucacucc

SEQ ID NO: 479430 - RNA, 18 nt, Homo sapiens
agagggaaggucucagga

SEQ ID NO: 479431 - RNA, 19 nt, Homo sapiens
agagggcacacacugugua

SEQ ID NO: 479432 - RNA, 15 nt, Homo sapiens
agaguauggagcuca

SEQ ID NO: 479433 - RNA, 15 nt, Homo sapiens
agagucucacucugu

SEQ ID NO: 479434 - RNA, 20 nt, Homo sapiens
agagucucacucuguugccc

SEQ ID NO: 479435 - RNA, 16 nt, Homo sapiens
agaguggguacuagaa

SEQ ID NO: 479436 - RNA, 20 nt, Homo sapiens
agauaacaaucuguauauaa

SEQ ID NO: 479437 - RNA, 13 nt, Homo sapiens
agauagaagugaa

SEQ ID NO: 479438 - RNA, 19 nt, Homo sapiens
agauauauuaagugacugu

SEQ ID NO: 479439 - RNA, 20 nt, Homo sapiens
agaucacgccauugcacucc

SEQ ID NO: 479440 - RNA, 22 nt, Homo sapiens
agaucacgccauugcacuccag

SEQ ID NO: 479441 - RNA, 15 nt, Homo sapiens
agaucaugggucaag

SEQ ID NO: 479442 - RNA, 19 nt, Homo sapiens
agauccccaacugcuccag

SEQ ID NO: 479443 - RNA, 15 nt, Homo sapiens
agaugacauggugaa

SEQ ID NO: 479444 - RNA, 18 nt, Homo sapiens
agaugacauggugaaaau

SEQ ID NO: 479445 - RNA, 16 nt, Homo sapiens
agaugagaguacaccc

SEQ ID NO: 479446 - RNA, 16 nt, Homo sapiens
agaugcagccccaucu

SEQ ID NO: 479447 - RNA, 19 nt, Homo sapiens
agaugcccaggauuugacu

SEQ ID NO: 479448 - RNA, 16 nt, Homo sapiens
agauggacuccagccu

SEQ ID NO: 479449 - RNA, 22 nt, Homo sapiens
agaugggggaaagcacaggugg

SEQ ID NO: 479450 - RNA, 22 nt, Homo sapiens
agauguauguacuucaugcugu

SEQ ID NO: 479451 - RNA, 23 nt, Homo sapiens
agauugaucaaaguguaaacacc

SEQ ID NO: 479452 - RNA, 22 nt, Homo sapiens
agauuuaauccuagagauuugg

SEQ ID NO: 479453 - RNA, 14 nt, Homo sapiens
agauuuaccacuug

SEQ ID NO: 479454 - RNA, 19 nt, Homo sapiens
agauuuggaggcuaccuca

SEQ ID NO: 479455 - RNA, 13 nt, Homo sapiens
agcaaagggcuca

SEQ ID NO: 479456 - RNA, 15 nt, Homo sapiens
agcaaauuccaauac

SEQ ID NO: 479457 - RNA, 21 nt, Homo sapiens
agcaaauuccaauacauuauu

SEQ ID NO: 479458 - RNA, 15 nt, Homo sapiens
agcaagggcacuuaa

SEQ ID NO: 479459 - RNA, 18 nt, Homo sapiens
agcaauucuccugccuca

SEQ ID NO: 479460 - RNA, 23 nt, Homo sapiens
agcacaggugggcuucccagugg

SEQ ID NO: 479461 - RNA, 14 nt, Homo sapiens
agcagaacuuucac

SEQ ID NO: 479462 - RNA, 15 nt, Homo sapiens
agcagccaacaagca

SEQ ID NO: 479463 - RNA, 21 nt, Homo sapiens
agcagccucagaacaaaguga

SEQ ID NO: 479464 - RNA, 15 nt, Homo sapiens
agcaggcuacacuga

SEQ ID NO: 479465 - RNA, 16 nt, Homo sapiens
agcaggcuacacugac

SEQ ID NO: 479466 - RNA, 19 nt, Homo sapiens
agcagggauuagguguuca

SEQ ID NO: 479467 - RNA, 17 nt, Homo sapiens
caggugaagcaccaagc

SEQ ID NO: 479468 - RNA, 20 nt, Homo sapiens
cagguucaagcaauucuccu

SEQ ID NO: 479469 - RNA, 17 nt, Homo sapiens
caguaacugugacugau

SEQ ID NO: 479470 - RNA, 21 nt, Homo sapiens
caguaacugugacugaugacu

SEQ ID NO: 479471 - RNA, 12 nt, Homo sapiens
caguaguaucaa

SEQ ID NO: 479472 - RNA, 14 nt, Homo sapiens
cagucauggccaaa

SEQ ID NO: 479473 - RNA, 23 nt, Homo sapiens
cagucauggccaaauguucaaua

SEQ ID NO: 479474 - RNA, 14 nt, Homo sapiens
cagucccucagcca

SEQ ID NO: 479475 - RNA, 14 nt, Homo sapiens
cagugagaugcauu

SEQ ID NO: 479476 - RNA, 14 nt, Homo sapiens
cagugcaacacuga

SEQ ID NO: 479477 - RNA, 17 nt, Homo sapiens
cagugcaggcacaguau

SEQ ID NO: 479478 - RNA, 16 nt, Homo sapiens
cagugcuugaaugaag

SEQ ID NO: 479479 - RNA, 13 nt, Homo sapiens
caguggguuugua

SEQ ID NO: 479480 - RNA, 17 nt, Homo sapiens
cagugucuuuccaccuu

SEQ ID NO: 479481 - RNA, 12 nt, Homo sapiens
caguguguuucu

SEQ ID NO: 479482 - RNA, 19 nt, Homo sapiens
caguguguuucugaucuga

SEQ ID NO: 479483 - RNA, 20 nt, Homo sapiens
caguguguuucugaucugau

SEQ ID NO: 479484 - RNA, 16 nt, Homo sapiens
caguucaguuccucuu

SEQ ID NO: 479485 - RNA, 16 nt, Homo sapiens
caguuccuuucaaugg

SEQ ID NO: 479486 - RNA, 19 nt, Homo sapiens
caguucugccuuaucuaaa

SEQ ID NO: 479487 - RNA, 22 nt, Homo sapiens
caguucuuuucaaccuacuuuc

SEQ ID NO: 479488 - RNA, 15 nt, Homo sapiens
caguugucuauucau

SEQ ID NO: 479489 - RNA, 16 nt, Homo sapiens
caguuugucacaugaa

SEQ ID NO: 479490 - RNA, 20 nt, Homo sapiens
cauaaaaauaaaucaguuca

SEQ ID NO: 479491 - RNA, 14 nt, Homo sapiens
cauaaaauguuaag

SEQ ID NO: 479492 - RNA, 15 nt, Homo sapiens
cauaacagaacaaga

SEQ ID NO: 479493 - RNA, 22 nt, Homo sapiens
cauaacagucuuacugcaggca

SEQ ID NO: 479494 - RNA, 19 nt, Homo sapiens
cauaaccgcugauucucag

SEQ ID NO: 479495 - RNA, 13 nt, Homo sapiens
cauagagacuuug

SEQ ID NO: 479496 - RNA, 17 nt, Homo sapiens
cauagaguucagacuuu

SEQ ID NO: 479497 - RNA, 15 nt, Homo sapiens
cauagcagcugcuac

SEQ ID NO: 479498 - RNA, 17 nt, Homo sapiens
cauagcagcugcuacua

SEQ ID NO: 479499 - RNA, 15 nt, Homo sapiens
cauagcagugcuuga

SEQ ID NO: 479500 - RNA, 18 nt, Homo sapiens
cauauauaacaaugcugu

SEQ ID NO: 479501 - RNA, 20 nt, Homo sapiens
cauauccaacaugugcucag

SEQ ID NO: 479502 - RNA, 14 nt, Homo sapiens
cauauguaugacuc

SEQ ID NO: 479503 - RNA, 20 nt, Homo sapiens
caucaaacacaaugccucau

SEQ ID NO: 479504 - RNA, 19 nt, Homo sapiens
caucaaauggaagacacau

SEQ ID NO: 479505 - RNA, 18 nt, Homo sapiens
caucaaggcacugccuga

SEQ ID NO: 479506 - RNA, 22 nt, Homo sapiens
caucaaggcacugccugaugga

SEQ ID NO: 479507 - RNA, 15 nt, Homo sapiens
caucagagacaguau

SEQ ID NO: 479508 - RNA, 21 nt, Homo sapiens
cauccaauggauugugcaaau

SEQ ID NO: 479509 - RNA, 19 nt, Homo sapiens
caucccagacuugcugaau

SEQ ID NO: 479510 - RNA, 23 nt, Homo sapiens
caucccaggaucgcaagagccau

SEQ ID NO: 479511 - RNA, 23 nt, Homo sapiens
cauccuaaaugaguaaacccagc

SEQ ID NO: 479512 - RNA, 18 nt, Homo sapiens
cauccugcaggcagcuuu

SEQ ID NO: 479513 - RNA, 18 nt, Homo sapiens
caucggucuaaagcuuug

SEQ ID NO: 479514 - RNA, 16 nt, Homo sapiens
caugaauaucaguuau

SEQ ID NO: 479515 - RNA, 20 nt, Homo sapiens
caugacauauuuuugcuuua

SEQ ID NO: 479516 - RNA, 17 nt, Homo sapiens
caugagaaguugauaua

SEQ ID NO: 479517 - RNA, 14 nt, Homo sapiens
caugccaagcacug

SEQ ID NO: 479518 - RNA, 18 nt, Homo sapiens
caugccaagcacugugcu

SEQ ID NO: 479519 - RNA, 15 nt, Homo sapiens
caugccugggaaaug

SEQ ID NO: 479520 - RNA, 15 nt, Homo sapiens
caugcgagugcucau

SEQ ID NO: 479521 - RNA, 12 nt, Homo sapiens
cauggaaauucc

SEQ ID NO: 479522 - RNA, 23 nt, Homo sapiens
cauggaaauucccuucaucugga

SEQ ID NO: 479523 - RNA, 16 nt, Homo sapiens
cauggaauuggagcuc

SEQ ID NO: 479524 - RNA, 18 nt, Homo sapiens
cauggagagcuggagccu

SEQ ID NO: 479525 - RNA, 23 nt, Homo sapiens
cauggagcuugacuucaugccag

SEQ ID NO: 479526 - RNA, 15 nt, Homo sapiens
cauggcaucaccucc

SEQ ID NO: 479527 - RNA, 14 nt, Homo sapiens
caugggacauuugc

SEQ ID NO: 479528 - RNA, 15 nt, Homo sapiens
cauggggguauugua

SEQ ID NO: 479529 - RNA, 15 nt, Homo sapiens
caugguauugacuca

SEQ ID NO: 479530 - RNA, 13 nt, Homo sapiens
caugguggcacac

SEQ ID NO: 479531 - RNA, 19 nt, Homo sapiens
cauguaguuuuacuuggug

SEQ ID NO: 479532 - RNA, 22 nt, Homo sapiens
caugugacaugaacccauccaa

SEQ ID NO: 479533 - RNA, 19 nt, Homo sapiens
cauguggugggacagggac

SEQ ID NO: 479534 - RNA, 22 nt, Homo sapiens
cauguuuuccagcuccucaucc

SEQ ID NO: 479535 - RNA, 12 nt, Homo sapiens
cauuacagggaa

SEQ ID NO: 479536 - RNA, 23 nt, Homo sapiens
cauuagagcaggcguucagcuca

SEQ ID NO: 479537 - RNA, 20 nt, Homo sapiens
cauuagccuaugugcaugca

SEQ ID NO: 479538 - RNA, 12 nt, Homo sapiens
cauuaucuauga

SEQ ID NO: 479539 - RNA, 13 nt, Homo sapiens
cauuaucuaugau

SEQ ID NO: 479540 - RNA, 17 nt, Homo sapiens
cauuauuggacuuccau

SEQ ID NO: 479541 - RNA, 12 nt, Homo sapiens
cauucacucaua

SEQ ID NO: 479542 - RNA, 19 nt, Homo sapiens
cauucauaacagaacaaga

SEQ ID NO: 479543 - RNA, 17 nt, Homo sapiens
cauucauuuaacagagc

SEQ ID NO: 479544 - RNA, 15 nt, Homo sapiens
cauuccaacuaucuc

SEQ ID NO: 479545 - RNA, 21 nt, Homo sapiens
cauucccagaauuugcugcau

SEQ ID NO: 479546 - RNA, 21 nt, Homo sapiens
cauuguucuugugaacccaaa

SEQ ID NO: 479547 - RNA, 16 nt, Homo sapiens
cauuuauuuuucucau

SEQ ID NO: 479548 - RNA, 23 nt, Homo sapiens
cauuugaaaucuaugaaauauca

SEQ ID NO: 479549 - RNA, 13 nt, Homo sapiens
cauuugcacuauu

SEQ ID NO: 479550 - RNA, 14 nt, Homo sapiens
cauuugcucaugga

SEQ ID NO: 479551 - RNA, 21 nt, Homo sapiens
cauuuguaaaugucuuuucaa

SEQ ID NO: 479552 - RNA, 17 nt, Homo sapiens
cauuuuaaugcaccuga

SEQ ID NO: 479553 - RNA, 20 nt, Homo sapiens
ccaaaagcccauucauucca

SEQ ID NO: 479554 - RNA, 20 nt, Homo sapiens
ccaaagccaauaacacacag

SEQ ID NO: 479555 - RNA, 22 nt, Homo sapiens
ccaaagccaauaacacacagcu

SEQ ID NO: 479556 - RNA, 16 nt, Homo sapiens
ccaacagcacccucuc

SEQ ID NO: 479557 - RNA, 21 nt, Homo sapiens
ccaacuucuucagagcugaca

SEQ ID NO: 479558 - RNA, 12 nt, Homo sapiens
ccaauacauuau

SEQ ID NO: 479559 - RNA, 15 nt, Homo sapiens
ccacacccagcucag

SEQ ID NO: 479560 - RNA, 16 nt, Homo sapiens
ccacacucaccucuaa

SEQ ID NO: 479561 - RNA, 15 nt, Homo sapiens
ccacaugccaagcac

SEQ ID NO: 479562 - RNA, 19 nt, Homo sapiens
ccacugcacccagcuaauu

SEQ ID NO: 479563 - RNA, 18 nt, Homo sapiens
ccagaaagugacaagcuc

SEQ ID NO: 479564 - RNA, 14 nt, Homo sapiens
ccagaagagguaua

SEQ ID NO: 479565 - RNA, 15 nt, Homo sapiens
ccagauggacuccag

SEQ ID NO: 479566 - RNA, 23 nt, Homo sapiens
ccagaugggggaaagcacaggug

SEQ ID NO: 479567 - RNA, 23 nt, Homo sapiens
ccagcaguggacucaaaacccau

SEQ ID NO: 479568 - RNA, 19 nt, Homo sapiens
ccagcaucccuugaccagg

SEQ ID NO: 479569 - RNA, 21 nt, Homo sapiens
ccagccucugccgcugccaug

SEQ ID NO: 479570 - RNA, 16 nt, Homo sapiens
ccagccugccuggcag

SEQ ID NO: 479571 - RNA, 20 nt, Homo sapiens
ccagcuauugauauaaauaa

SEQ ID NO: 479572 - RNA, 19 nt, Homo sapiens
ccagcuccuaguagcuuuc

SEQ ID NO: 479573 - RNA, 22 nt, Homo sapiens
ccaggaggcagcuguugcagug

SEQ ID NO: 479574 - RNA, 23 nt, Homo sapiens
ccaggaggcagcuguugcaguga

SEQ ID NO: 479575 - RNA, 16 nt, Homo sapiens
ccaggaguacacccca

SEQ ID NO: 479576 - RNA, 23 nt, Homo sapiens
ccaggaguacaccccaacagcac

SEQ ID NO: 479577 - RNA, 18 nt, Homo sapiens
ccagggaugacauguccc

SEQ ID NO: 479578 - RNA, 16 nt, Homo sapiens
ccaggguccacaggaa

SEQ ID NO: 479579 - RNA, 19 nt, Homo sapiens
ccaguugaucaaugaauaa

SEQ ID NO: 479580 - RNA, 22 nt, Homo sapiens
ccauaaaaauaaaucaguucau

SEQ ID NO: 479581 - RNA, 12 nt, Homo sapiens
ccauaauuguuc

SEQ ID NO: 479582 - RNA, 19 nt, Homo sapiens
ccauaccacccaaugcuga

SEQ ID NO: 479583 - RNA, 17 nt, Homo sapiens
ccaucaaggguacacug

SEQ ID NO: 479584 - RNA, 17 nt, Homo sapiens
ccauccucaaacacugc

SEQ ID NO: 479585 - RNA, 14 nt, Homo sapiens
ccaucuuuccaucc

SEQ ID NO: 479586 - RNA, 15 nt, Homo sapiens
ccaugaaaaugcaac

SEQ ID NO: 479587 - RNA, 17 nt, Homo sapiens
ccaugaaaaugcaacaa

SEQ ID NO: 479588 - RNA, 23 nt, Homo sapiens
ccaugaaaaugcaacaacaugua

SEQ ID NO: 479589 - RNA, 17 nt, Homo sapiens
ccauguaucuaccucac

SEQ ID NO: 479590 - RNA, 13 nt, Homo sapiens
ccauucauuccau

SEQ ID NO: 479591 - RNA, 18 nt, Homo sapiens
ccauuucagcuguuucac

SEQ ID NO: 479592 - RNA, 17 nt, Homo sapiens
ccauuuuugaaaccaaa

SEQ ID NO: 479593 - RNA, 17 nt, Homo sapiens
cccaaauggcagggaua

SEQ ID NO: 479594 - RNA, 22 nt, Homo sapiens
cccaauggcaacaucuugcaaa

SEQ ID NO: 479595 - RNA, 14 nt, Homo sapiens
cccacagcuguaug

SEQ ID NO: 479596 - RNA, 18 nt, Homo sapiens
cccagaguccucuaugaa

SEQ ID NO: 479597 - RNA, 14 nt, Homo sapiens
cccagcauguugag

SEQ ID NO: 479598 - RNA, 12 nt, Homo sapiens
cccaggaguaca

SEQ ID NO: 479599 - RNA, 22 nt, Homo sapiens
cccaggcuuuugaaaaacaaac

SEQ ID NO: 479600 - RNA, 23 nt, Homo sapiens
cccagguuucuggucucuaggcu

SEQ ID NO: 479601 - RNA, 21 nt, Homo sapiens
cccaugagaguagagggcacu

SEQ ID NO: 479602 - RNA, 18 nt, Homo sapiens
cccaugcagacaugagug

SEQ ID NO: 479603 - RNA, 14 nt, Homo sapiens
cccauucauuccau

SEQ ID NO: 479604 - RNA, 15 nt, Homo sapiens
cccauucuacacaga

SEQ ID NO: 479605 - RNA, 21 nt, Homo sapiens
cccauucucccucucaaggca

SEQ ID NO: 479606 - RNA, 21 nt, Homo sapiens
cucuucccauaccacccaaug

SEQ ID NO: 479607 - RNA, 13 nt, Homo sapiens
cucuucucaaagc

SEQ ID NO: 479608 - RNA, 17 nt, Homo sapiens
cucuugaagacacugaa

SEQ ID NO: 479609 - RNA, 17 nt, Homo sapiens
cucuuggguucaaguga

SEQ ID NO: 479610 - RNA, 14 nt, Homo sapiens
cucuuguugcugag

SEQ ID NO: 479611 - RNA, 16 nt, Homo sapiens
cugaaauauacacaca

SEQ ID NO: 479612 - RNA, 22 nt, Homo sapiens
cugaaaucauacuucuuagggu

SEQ ID NO: 479613 - RNA, 20 nt, Homo sapiens
cugaacugaaaacaagccau

SEQ ID NO: 479614 - RNA, 17 nt, Homo sapiens
cugaaucaccagcacau

SEQ ID NO: 479615 - RNA, 23 nt, Homo sapiens
cugaauuuggagucugacugugc

SEQ ID NO: 479616 - RNA, 15 nt, Homo sapiens
cugacauaugcuaac

SEQ ID NO: 479617 - RNA, 16 nt, Homo sapiens
cugacauaugcuaacc

SEQ ID NO: 479618 - RNA, 23 nt, Homo sapiens
cugacauaugcuaacccccaaau

SEQ ID NO: 479619 - RNA, 15 nt, Homo sapiens
cugacugugcccaag

SEQ ID NO: 479620 - RNA, 18 nt, Homo sapiens
cugagauucuucguguau

SEQ ID NO: 479621 - RNA, 16 nt, Homo sapiens
cugaggauucaggggc

SEQ ID NO: 479622 - RNA, 15 nt, Homo sapiens
cugauacguguauga

SEQ ID NO: 479623 - RNA, 21 nt, Homo sapiens
cugaugacuuuauccugaguc

SEQ ID NO: 479624 - RNA, 22 nt, Homo sapiens
cugaugacuuuauccugagucc

SEQ ID NO: 479625 - RNA, 14 nt, Homo sapiens
cugcaauguaggaa

SEQ ID NO: 479626 - RNA, 18 nt, Homo sapiens
cugcagcgaguacuuccc

SEQ ID NO: 479627 - RNA, 23 nt, Homo sapiens
cugcaucuuuucuguugccccau

SEQ ID NO: 479628 - RNA, 18 nt, Homo sapiens
cugcaugcgagugcucau

SEQ ID NO: 479629 - RNA, 16 nt, Homo sapiens
cugcccuagagcacac

SEQ ID NO: 479630 - RNA, 16 nt, Homo sapiens
cugccuaaaauaugau

SEQ ID NO: 479631 - RNA, 20 nt, Homo sapiens
cugccuauuaguaguuaauu

SEQ ID NO: 479632 - RNA, 14 nt, Homo sapiens
cugcgaugcaaugc

SEQ ID NO: 479633 - RNA, 17 nt, Homo sapiens
cugcuaccucacugggg

SEQ ID NO: 479634 - RNA, 17 nt, Homo sapiens
cugcucugccuguggag

SEQ ID NO: 479635 - RNA, 23 nt, Homo sapiens
cuggaacagauucacacugucug

SEQ ID NO: 479636 - RNA, 15 nt, Homo sapiens
cuggaacaucaucaa

SEQ ID NO: 479637 - RNA, 19 nt, Homo sapiens
cuggagggagaacccaaag

SEQ ID NO: 479638 - RNA, 23 nt, Homo sapiens
cuggccauguggcccuccagugu

SEQ ID NO: 479639 - RNA, 17 nt, Homo sapiens
cugggcauagaugcagg

SEQ ID NO: 479640 - RNA, 12 nt, Homo sapiens
cugggcuuucug

SEQ ID NO: 479641 - RNA, 22 nt, Homo sapiens
cugggggaggggacauugaaca

SEQ ID NO: 479642 - RNA, 12 nt, Homo sapiens
cuggguggacau

SEQ ID NO: 479643 - RNA, 18 nt, Homo sapiens
cuggguggcacugccaug

SEQ ID NO: 479644 - RNA, 22 nt, Homo sapiens
cuggguggcacugccaugcagg

SEQ ID NO: 479645 - RNA, 19 nt, Homo sapiens
cugguaauuuguaucugaa

SEQ ID NO: 479646 - RNA, 15 nt, Homo sapiens
cuggucaaguuguaa

SEQ ID NO: 479647 - RNA, 14 nt, Homo sapiens
cugguucugaugau

SEQ ID NO: 479648 - RNA, 14 nt, Homo sapiens
cugguuuggaguuu

SEQ ID NO: 479649 - RNA, 24 nt, Homo sapiens
cuguaagaaaauaucacuugucaa

SEQ ID NO: 479650 - RNA, 17 nt, Homo sapiens
cuguaaucccagaacuu

SEQ ID NO: 479651 - RNA, 18 nt, Homo sapiens
cuguaaucccagcuacuu

SEQ ID NO: 479652 - RNA, 21 nt, Homo sapiens
cuguagaugacauggugaaaa

SEQ ID NO: 479653 - RNA, 18 nt, Homo sapiens
cuguagguucaugcccaa

SEQ ID NO: 479654 - RNA, 19 nt, Homo sapiens
cuguagucccagcuacuca

SEQ ID NO: 479655 - RNA, 12 nt, Homo sapiens
cuguaugccaag

SEQ ID NO: 479656 - RNA, 18 nt, Homo sapiens
cuguaugccaagugaaaa

SEQ ID NO: 479657 - RNA, 14 nt, Homo sapiens
cuguauuagucaca

SEQ ID NO: 479658 - RNA, 16 nt, Homo sapiens
cugugaucugagggua

SEQ ID NO: 479659 - RNA, 17 nt, Homo sapiens
cugugauucgguggaga

SEQ ID NO: 479660 - RNA, 19 nt, Homo sapiens
cugugguacugauggacuu

SEQ ID NO: 479661 - RNA, 19 nt, Homo sapiens
cuguguacacaugggaguu

SEQ ID NO: 479662 - RNA, 15 nt, Homo sapiens
cugugugaacgugua

SEQ ID NO: 479663 - RNA, 21 nt, Homo sapiens
cugugugaacuaacaugcaaa

SEQ ID NO: 479664 - RNA, 19 nt, Homo sapiens
cuguguguuuuaguuucau

SEQ ID NO: 479665 - RNA, 22 nt, Homo sapiens
cuguuacugcuugggcuauacc

SEQ ID NO: 479666 - RNA, 18 nt, Homo sapiens
cuguuguaacugcccaag

SEQ ID NO: 479667 - RNA, 21 nt, Homo sapiens
cuuaaccuuugauucuacuua

SEQ ID NO: 479668 - RNA, 17 nt, Homo sapiens
cuuaauaauguguacau

SEQ ID NO: 479669 - RNA, 13 nt, Homo sapiens
cuuagaugcaguu

SEQ ID NO: 479670 - RNA, 17 nt, Homo sapiens
cuuagcuuagaccucag

SEQ ID NO: 479671 - RNA, 14 nt, Homo sapiens
cuuaggcaugacug

SEQ ID NO: 479672 - RNA, 15 nt, Homo sapiens
cuuaggcaugcacag

SEQ ID NO: 479673 - RNA, 15 nt, Homo sapiens
cuuaguugcaugacc

SEQ ID NO: 479674 - RNA, 16 nt, Homo sapiens
cuuauccagcugguga

SEQ ID NO: 479675 - RNA, 15 nt, Homo sapiens
cuuaugaaacuaaga

SEQ ID NO: 479676 - RNA, 23 nt, Homo sapiens
cuucacagaugugugauucacag

SEQ ID NO: 479677 - RNA, 15 nt, Homo sapiens
cuucaccaucuguau

SEQ ID NO: 479678 - RNA, 23 nt, Homo sapiens
cuucaccuuucccacuuucuucu

SEQ ID NO: 479679 - RNA, 15 nt, Homo sapiens
cuucacucaaucucu

SEQ ID NO: 479680 - RNA, 23 nt, Homo sapiens
cuucacuccccuaucccauucuc

SEQ ID NO: 479681 - RNA, 20 nt, Homo sapiens
cuucacuuauccuguucucu

SEQ ID NO: 479682 - RNA, 21 nt, Homo sapiens
cuucagccuagccgaccucag

SEQ ID NO: 479683 - RNA, 14 nt, Homo sapiens
cuucaugcauggaa

SEQ ID NO: 479684 - RNA, 15 nt, Homo sapiens
cuucauuguucuucu

SEQ ID NO: 479685 - RNA, 17 nt, Homo sapiens
cuucccacuuugccacu

SEQ ID NO: 479686 - RNA, 17 nt, Homo sapiens
cuucuaaucaaagcuuu

SEQ ID NO: 479687 - RNA, 17 nt, Homo sapiens
cuucucgccccucagug

SEQ ID NO: 479688 - RNA, 16 nt, Homo sapiens
cuucugauacguguau

SEQ ID NO: 479689 - RNA, 11 nt, Homo sapiens
cuucuguccac

SEQ ID NO: 479690 - RNA, 19 nt, Homo sapiens
cuucuucagagcugacaca

SEQ ID NO: 479691 - RNA, 15 nt, Homo sapiens
cuugaaaucaagggc

SEQ ID NO: 479692 - RNA, 18 nt, Homo sapiens
cuugacuucaugccagcu

SEQ ID NO: 479693 - RNA, 15 nt, Homo sapiens
cuugacuuugccaca

SEQ ID NO: 479694 - RNA, 12 nt, Homo sapiens
cuugccagacau

SEQ ID NO: 479695 - RNA, 17 nt, Homo sapiens
cuugcucacaucuuggc

SEQ ID NO: 479696 - RNA, 12 nt, Homo sapiens
cuugcugccaaa

SEQ ID NO: 479697 - RNA, 13 nt, Homo sapiens
cuuggauguauau

SEQ ID NO: 479698 - RNA, 14 nt, Homo sapiens
cuuggccucagcag

SEQ ID NO: 479699 - RNA, 18 nt, Homo sapiens
cuuguaaaauuucacuua

SEQ ID NO: 479700 - RNA, 20 nt, Homo sapiens
cuugucaauaaaauccauac

SEQ ID NO: 479701 - RNA, 15 nt, Homo sapiens
cuugugaacccaaag

SEQ ID NO: 479702 - RNA, 20 nt, Homo sapiens
cuugugccaacacucaagaa

SEQ ID NO: 479703 - RNA, 17 nt, Homo sapiens
cuuguuagaaaugcaaa

SEQ ID NO: 479704 - RNA, 23 nt, Homo sapiens
cuuguuagaaaugcaaauucuca

SEQ ID NO: 479705 - RNA, 24 nt, Homo sapiens
cuuguuccccaucaucuguggaac

SEQ ID NO: 479706 - RNA, 19 nt, Homo sapiens
cuuguugcccucugcaguu

SEQ ID NO: 479707 - RNA, 15 nt, Homo sapiens
cuuuaaaacuuaucc

SEQ ID NO: 479708 - RNA, 19 nt, Homo sapiens
cuuuauauggccucaagau

SEQ ID NO: 479709 - RNA, 22 nt, Homo sapiens
cuuuauuacaguuuaucuaugg

SEQ ID NO: 479710 - RNA, 19 nt, Homo sapiens
cuuucaagaagugccaguu

SEQ ID NO: 479711 - RNA, 22 nt, Homo sapiens
cuuucaagaagugccaguugau

SEQ ID NO: 479712 - RNA, 21 nt, Homo sapiens
cuuucaggccacauggcuaaa

SEQ ID NO: 479713 - RNA, 15 nt, Homo sapiens
cuuuccucccaaagg

SEQ ID NO: 479714 - RNA, 19 nt, Homo sapiens
cuuugcacgaacaccaagu

SEQ ID NO: 479715 - RNA, 19 nt, Homo sapiens
cuuugccacauccauugac

SEQ ID NO: 479716 - RNA, 19 nt, Homo sapiens
cuuugugcagauucuuuac

SEQ ID NO: 479717 - RNA, 15 nt, Homo sapiens
cuuuuauugccauga

SEQ ID NO: 479718 - RNA, 21 nt, Homo sapiens
cuuuugcauaagugcaugaca

SEQ ID NO: 479719 - RNA, 15 nt, Homo sapiens
gaaaacugcaacuug

SEQ ID NO: 479720 - RNA, 17 nt, Homo sapiens
gaaaagcucacuaagaa

SEQ ID NO: 479721 - RNA, 23 nt, Homo sapiens
gaaaaggaaggcucuucucccca

SEQ ID NO: 479722 - RNA, 21 nt, Homo sapiens
gaaaaugcuguauuagucaca

SEQ ID NO: 479723 - RNA, 14 nt, Homo sapiens
gaaaaugugcaaua

SEQ ID NO: 479724 - RNA, 19 nt, Homo sapiens
gaaacccguguaucuggga

SEQ ID NO: 479725 - RNA, 19 nt, Homo sapiens
gaaacuaacacagccauca

SEQ ID NO: 479726 - RNA, 15 nt, Homo sapiens
gaaagaugaaugcaa

SEQ ID NO: 479727 - RNA, 21 nt, Homo sapiens
gaaagauuagauaaagagaaa

SEQ ID NO: 479728 - RNA, 22 nt, Homo sapiens
gaaagcacaggugggcuuccca

SEQ ID NO: 479729 - RNA, 22 nt, Homo sapiens
gaaagugaucacgacaaucaca

SEQ ID NO: 479730 - RNA, 18 nt, Homo sapiens
gaaauaaaguuggugaca

SEQ ID NO: 479731 - RNA, 16 nt, Homo sapiens
gaaaucaaaaagggaa

SEQ ID NO: 479732 - RNA, 15 nt, Homo sapiens
gaaaugacuuuucca

SEQ ID NO: 479733 - RNA, 22 nt, Homo sapiens
gaaaugcaaauucucaagccgc

SEQ ID NO: 479734 - RNA, 14 nt, Homo sapiens
gaaaugcagaguca

SEQ ID NO: 479735 - RNA, 20 nt, Homo sapiens
ucccaucuugauaagaccac

SEQ ID NO: 479736 - RNA, 21 nt, Homo sapiens
ucccccaaacuucuuguucaa

SEQ ID NO: 479737 - RNA, 21 nt, Homo sapiens
uccccugccuuccuuuaaucc

SEQ ID NO: 479738 - RNA, 22 nt, Homo sapiens
uccccuugcccagggcucagcc

SEQ ID NO: 479739 - RNA, 14 nt, Homo sapiens
ucccgggacuaccu

SEQ ID NO: 479740 - RNA, 23 nt, Homo sapiens
ucccugaaguaagcaaagacuuu

SEQ ID NO: 479741 - RNA, 17 nt, Homo sapiens
ucccuucaugcauggaa

SEQ ID NO: 479742 - RNA, 16 nt, Homo sapiens
uccgagucaagugauu

SEQ ID NO: 479743 - RNA, 19 nt, Homo sapiens
uccuaaccuuccuguaaac

SEQ ID NO: 479744 - RNA, 15 nt, Homo sapiens
uccuaagccauaaaa

SEQ ID NO: 479745 - RNA, 14 nt, Homo sapiens
uccucaaacacugc

SEQ ID NO: 479746 - RNA, 20 nt, Homo sapiens
uccucaccccagacuccuga

SEQ ID NO: 479747 - RNA, 22 nt, Homo sapiens
uccuccaugaauaucaguuauu

SEQ ID NO: 479748 - RNA, 18 nt, Homo sapiens
uccuccuagacucuguga

SEQ ID NO: 479749 - RNA, 16 nt, Homo sapiens
uccucuuguugcugag

SEQ ID NO: 479750 - RNA, 22 nt, Homo sapiens
uccugcaaacccauuuccagcu

SEQ ID NO: 479751 - RNA, 16 nt, Homo sapiens
uccugcuccucaggaa

SEQ ID NO: 479752 - RNA, 18 nt, Homo sapiens
uccuggaauggagcugua

SEQ ID NO: 479753 - RNA, 23 nt, Homo sapiens
uccuggcaaagaugaucaguaug

SEQ ID NO: 479754 - RNA, 16 nt, Homo sapiens
uccuggcaauagucaa

SEQ ID NO: 479755 - RNA, 21 nt, Homo sapiens
uccuuaacacugagcugucau

SEQ ID NO: 479756 - RNA, 19 nt, Homo sapiens
uccuuacauaugcaaaaau

SEQ ID NO: 479757 - RNA, 18 nt, Homo sapiens
uccuuagcuuagaccuca

SEQ ID NO: 479758 - RNA, 19 nt, Homo sapiens
uccuugagagaccaggcaa

SEQ ID NO: 479759 - RNA, 13 nt, Homo sapiens
uccuuuaauccca

SEQ ID NO: 479760 - RNA, 19 nt, Homo sapiens
ucgaacuccugaccucagg

SEQ ID NO: 479761 - RNA, 15 nt, Homo sapiens
ucguuugaaucacag

SEQ ID NO: 479762 - RNA, 16 nt, Homo sapiens
ucuaagcccccuuccc

SEQ ID NO: 479763 - RNA, 22 nt, Homo sapiens
ucuaaggaauaugagcuuuaug

SEQ ID NO: 479764 - RNA, 17 nt, Homo sapiens
ucuaaguaaugaugucg

SEQ ID NO: 479765 - RNA, 18 nt, Homo sapiens
ucuacaucaauaucaucc

SEQ ID NO: 479766 - RNA, 12 nt, Homo sapiens
ucuacugugguc

SEQ ID NO: 479767 - RNA, 20 nt, Homo sapiens
ucuaggcuggggaaguccuc

SEQ ID NO: 479768 - RNA, 12 nt, Homo sapiens
ucuaugacucac

SEQ ID NO: 479769 - RNA, 17 nt, Homo sapiens
ucuauggcauauugaua

SEQ ID NO: 479770 - RNA, 16 nt, Homo sapiens
ucuauuacgugcaaua

SEQ ID NO: 479771 - RNA, 20 nt, Homo sapiens
ucucaaaaaaaaaaauacaa

SEQ ID NO: 479772 - RNA, 12 nt, Homo sapiens
ucucacuccagg

SEQ ID NO: 479773 - RNA, 15 nt, Homo sapiens
ucucacuccaggaca

SEQ ID NO: 479774 - RNA, 22 nt, Homo sapiens
ucucagagugguucugagauua

SEQ ID NO: 479775 - RNA, 23 nt, Homo sapiens
ucucagccccugauccugugaag

SEQ ID NO: 479776 - RNA, 20 nt, Homo sapiens
ucucauccugcaggcagcuu

SEQ ID NO: 479777 - RNA, 16 nt, Homo sapiens
ucuccagaaagcucau

SEQ ID NO: 479778 - RNA, 20 nt, Homo sapiens
ucuccagaaagcucaucuca

SEQ ID NO: 479779 - RNA, 23 nt, Homo sapiens
ucuccagagggaauugcagagua

SEQ ID NO: 479780 - RNA, 22 nt, Homo sapiens
ucuccaggggccacaagaccau

SEQ ID NO: 479781 - RNA, 14 nt, Homo sapiens
ucuccugggcagcu

SEQ ID NO: 479782 - RNA, 21 nt, Homo sapiens
ucucggaccuuucagcuguga

SEQ ID NO: 479783 - RNA, 15 nt, Homo sapiens
ucucuacuaaaacau

SEQ ID NO: 479784 - RNA, 15 nt, Homo sapiens
ucucugacauaugcu

SEQ ID NO: 479785 - RNA, 21 nt, Homo sapiens
ucucugcuuuggaaaucacac

SEQ ID NO: 479786 - RNA, 18 nt, Homo sapiens
ucucuucaauaaaccaca

SEQ ID NO: 479787 - RNA, 18 nt, Homo sapiens
ucugaaaauuaacacugc

SEQ ID NO: 479788 - RNA, 19 nt, Homo sapiens
ucugagacacaccccaaca

SEQ ID NO: 479789 - RNA, 17 nt, Homo sapiens
ucugaggauucaggggc

SEQ ID NO: 479790 - RNA, 15 nt, Homo sapiens
ucugauacguguaug

SEQ ID NO: 479791 - RNA, 12 nt, Homo sapiens
ucugccugugga

SEQ ID NO: 479792 - RNA, 18 nt, Homo sapiens
ucugcuaccucacugggg

SEQ ID NO: 479793 - RNA, 17 nt, Homo sapiens
ucuggugccagauccuc

SEQ ID NO: 479794 - RNA, 19 nt, Homo sapiens
ucuggugccagauccucuu

SEQ ID NO: 479795 - RNA, 21 nt, Homo sapiens
ucugucccagguuaucugggc

SEQ ID NO: 479796 - RNA, 19 nt, Homo sapiens
ucugucuccuuaacacuga

SEQ ID NO: 479797 - RNA, 22 nt, Homo sapiens
ucuguuguguuugucaaaaagu

SEQ ID NO: 479798 - RNA, 14 nt, Homo sapiens
ucuuaggcaaucac

SEQ ID NO: 479799 - RNA, 16 nt, Homo sapiens
ucuuagucgagccaag

SEQ ID NO: 479800 - RNA, 18 nt, Homo sapiens
ucuuauacacaacacaca

SEQ ID NO: 479801 - RNA, 12 nt, Homo sapiens
ucuuauggggcc

SEQ ID NO: 479802 - RNA, 23 nt, Homo sapiens
ucuuaugucaaguucuacaucaa

SEQ ID NO: 479803 - RNA, 18 nt, Homo sapiens
ucuucaauaaaccacaag

SEQ ID NO: 479804 - RNA, 17 nt, Homo sapiens
ucuucccacuuugccac

SEQ ID NO: 479805 - RNA, 16 nt, Homo sapiens
ucuuccucccuggaau

SEQ ID NO: 479806 - RNA, 23 nt, Homo sapiens
ucuuccuccgaggccaguaccuu

SEQ ID NO: 479807 - RNA, 17 nt, Homo sapiens
ucuucucaaagcuggga

SEQ ID NO: 479808 - RNA, 22 nt, Homo sapiens
ucuuguaacuggguucaaaaag

SEQ ID NO: 479809 - RNA, 24 nt, Homo sapiens
ucuuguguuuuuugcucacuguca

SEQ ID NO: 479810 - RNA, 16 nt, Homo sapiens
ucuuuaacagcuuucu

SEQ ID NO: 479811 - RNA, 15 nt, Homo sapiens
ucuuuagcaguuuug

SEQ ID NO: 479812 - RNA, 14 nt, Homo sapiens
ucuuucccagacuu

SEQ ID NO: 479813 - RNA, 17 nt, Homo sapiens
ucuuucuuacaaggaag

SEQ ID NO: 479814 - RNA, 19 nt, Homo sapiens
ucuuucuuacacaagagcu

SEQ ID NO: 479815 - RNA, 20 nt, Homo sapiens
ucuuugagauaauacauucc

SEQ ID NO: 479816 - RNA, 22 nt, Homo sapiens
ugaaaaaaaauuuuauaguguc

SEQ ID NO: 479817 - RNA, 13 nt, Homo sapiens
ugaaaaaugccuc

SEQ ID NO: 479818 - RNA, 14 nt, Homo sapiens
ugaaaacaagccau

SEQ ID NO: 479819 - RNA, 16 nt, Homo sapiens
ugaaaauuaacacugc

SEQ ID NO: 479820 - RNA, 14 nt, Homo sapiens
ugaaaccacuggaa

SEQ ID NO: 479821 - RNA, 15 nt, Homo sapiens
ugaaauccacacauc

SEQ ID NO: 479822 - RNA, 19 nt, Homo sapiens
ugaaauggugaaaugcaga

SEQ ID NO: 479823 - RNA, 16 nt, Homo sapiens
ugaacacaaagccugu

SEQ ID NO: 479824 - RNA, 12 nt, Homo sapiens
ugaacacugggg

SEQ ID NO: 479825 - RNA, 14 nt, Homo sapiens
ugaacauaaagccu

SEQ ID NO: 479826 - RNA, 19 nt, Homo sapiens
ugaacguguauguaccuag

SEQ ID NO: 479827 - RNA, 22 nt, Homo sapiens
ugaacugcagcgaguacuuccc

SEQ ID NO: 479828 - RNA, 14 nt, Homo sapiens
ugaagaaacauuua

SEQ ID NO: 479829 - RNA, 15 nt, Homo sapiens
ugaagauacaggaca

SEQ ID NO: 479830 - RNA, 15 nt, Homo sapiens
ugaagcaaacacauu

SEQ ID NO: 479831 - RNA, 16 nt, Homo sapiens
ugaagcaaacacauua

SEQ ID NO: 479832 - RNA, 15 nt, Homo sapiens
ugaagccaaagccaa

SEQ ID NO: 479833 - RNA, 17 nt, Homo sapiens
ugaaggcaaugccaucc

SEQ ID NO: 479834 - RNA, 21 nt, Homo sapiens
ugaagggaugcugcaauguag

SEQ ID NO: 479835 - RNA, 14 nt, Homo sapiens
ugaaucacaguaua

SEQ ID NO: 479836 - RNA, 22 nt, Homo sapiens
ugaaucaugguuuuucuuagua

SEQ ID NO: 479837 - RNA, 17 nt, Homo sapiens
ugaaucuuggugucuac

SEQ ID NO: 479838 - RNA, 15 nt, Homo sapiens
ugaaugcaauaguag

SEQ ID NO: 479839 - RNA, 14 nt, Homo sapiens
ugaauucaccaagu

SEQ ID NO: 479840 - RNA, 13 nt, Homo sapiens
ugacaagugagac

SEQ ID NO: 479841 - RNA, 20 nt, Homo sapiens
ugacaagugagacaaaaagc

SEQ ID NO: 479842 - RNA, 19 nt, Homo sapiens
ugacacugguauuccugcc

SEQ ID NO: 479843 - RNA, 15 nt, Homo sapiens
ugacagaacacuguc

SEQ ID NO: 479844 - RNA, 15 nt, Homo sapiens
ugacauuuugcagaa

SEQ ID NO: 479845 - RNA, 22 nt, Homo sapiens
ugaccacauagaacaugugucu

SEQ ID NO: 479846 - RNA, 22 nt, Homo sapiens
ugacugugcccaagugggucca

SEQ ID NO: 479847 - RNA, 13 nt, Homo sapiens
ugacuucaugcca

SEQ ID NO: 479848 - RNA, 19 nt, Homo sapiens
ugacuugacagaacacugu

SEQ ID NO: 479849 - RNA, 13 nt, Homo sapiens
ugacuuugcauca

SEQ ID NO: 479850 - RNA, 21 nt, Homo sapiens
ugacuuugccacauccauuga

SEQ ID NO: 479851 - RNA, 13 nt, Homo sapiens
ugagaacacugug

SEQ ID NO: 479852 - RNA, 16 nt, Homo sapiens
ugagacugaacugugu

SEQ ID NO: 479853 - RNA, 16 nt, Homo sapiens
ugagagacacacugaa

SEQ ID NO: 479854 - RNA, 22 nt, Homo sapiens
ugagaguauuagucacaauuaa

SEQ ID NO: 479855 - RNA, 16 nt, Homo sapiens
ugagauaauacauucc

SEQ ID NO: 479856 - RNA, 17 nt, Homo sapiens
ugagauaauacauuccg

SEQ ID NO: 479857 - RNA, 16 nt, Homo sapiens
ugagaucauucacuca

SEQ ID NO: 479858 - RNA, 22 nt, Homo sapiens
ugagauucuucguguauagcug

SEQ ID NO: 479859 - RNA, 16 nt, Homo sapiens
ugagcagcggacuuca

SEQ ID NO: 479860 - RNA, 21 nt, Homo sapiens
ugagcuuaagaauuuugagca

SEQ ID NO: 479861 - RNA, 22 nt, Homo sapiens
ugagcuuuauguaauaauguga

SEQ ID NO: 479862 - RNA, 17 nt, Homo sapiens
ugaggaauauuugcaag

SEQ ID NO: 479863 - RNA, 13 nt, Homo sapiens
ugauuaugaauua

SEQ ID NO: 479864 - RNA, 17 nt, Homo sapiens
ugauucaaaauguacua

SEQ ID NO: 479865 - RNA, 13 nt, Homo sapiens
ugauucacagugu

SEQ ID NO: 479866 - RNA, 19 nt, Homo sapiens
ugauucauacauuaucuca

SEQ ID NO: 479867 - RNA, 16 nt, Homo sapiens
ugauucugucaauguc

SEQ ID NO: 479868 - RNA, 16 nt, Homo sapiens
ugcaaagauuugcuuu

SEQ ID NO: 479869 - RNA, 13 nt, Homo sapiens
ugcaaauucucaa

SEQ ID NO: 479870 - RNA, 22 nt, Homo sapiens
ugcaauaguaggacugcugaca

SEQ ID NO: 479871 - RNA, 22 nt, Homo sapiens
ugcaaucugguugugauuuaua

SEQ ID NO: 479872 - RNA, 14 nt, Homo sapiens
ugcaauuugcacaa

SEQ ID NO: 479873 - RNA, 19 nt, Homo sapiens
ugcacaacauuacagggaa

SEQ ID NO: 479874 - RNA, 19 nt, Homo sapiens
ugcacagauacacauacac

SEQ ID NO: 479875 - RNA, 23 nt, Homo sapiens
ugcacauaguagguacccaauuc

SEQ ID NO: 479876 - RNA, 23 nt, Homo sapiens
ugcacccaccuuucugcacauaa

SEQ ID NO: 479877 - RNA, 17 nt, Homo sapiens
ugcacugagagugaagu

SEQ ID NO: 479878 - RNA, 15 nt, Homo sapiens
ugcacuuauucucaa

SEQ ID NO: 479879 - RNA, 17 nt, Homo sapiens
ugcagcgaguacuuccc

SEQ ID NO: 479880 - RNA, 16 nt, Homo sapiens
ugcagcuaacuuauca

SEQ ID NO: 479881 - RNA, 15 nt, Homo sapiens
ugcaggguccccaag

SEQ ID NO: 479882 - RNA, 13 nt, Homo sapiens
ugcagugagccaa

SEQ ID NO: 479883 - RNA, 16 nt, Homo sapiens
ugcauaagugcaugac

SEQ ID NO: 479884 - RNA, 20 nt, Homo sapiens
ugcauaagugcaugacauau

SEQ ID NO: 479885 - RNA, 16 nt, Homo sapiens
ugcauauuuuauuaua

SEQ ID NO: 479886 - RNA, 17 nt, Homo sapiens
ugcaugaaaccacugga

SEQ ID NO: 479887 - RNA, 22 nt, Homo sapiens
ugcaugaccacauagaacaugu

SEQ ID NO: 479888 - RNA, 21 nt, Homo sapiens
ugcaugcgagugcucauuuca

SEQ ID NO: 479889 - RNA, 15 nt, Homo sapiens
ugcauggaaauuccc

SEQ ID NO: 479890 - RNA, 22 nt, Homo sapiens
ugcauguccucuuguugcugag

SEQ ID NO: 479891 - RNA, 19 nt, Homo sapiens
ugcauguuggcccagaccu

SEQ ID NO: 479892 - RNA, 12 nt, Homo sapiens
ugcauuaucuau

SEQ ID NO: 479893 - RNA, 13 nt, Homo sapiens
ugcauuugcacua

SEQ ID NO: 479894 - RNA, 19 nt, Homo sapiens
ugccaacuucuucagagcu

SEQ ID NO: 479895 - RNA, 21 nt, Homo sapiens
ugccaagacaugaaguuuuau

SEQ ID NO: 479896 - RNA, 23 nt, Homo sapiens
ugccaauugaauaggaucaaauu

SEQ ID NO: 479897 - RNA, 12 nt, Homo sapiens
ugccagacaugu

SEQ ID NO: 479898 - RNA, 14 nt, Homo sapiens
ugccagauccucuu

SEQ ID NO: 479899 - RNA, 18 nt, Homo sapiens
ugccagauccucuucuca

SEQ ID NO: 479900 - RNA, 14 nt, Homo sapiens
ugccaguugaucaa

SEQ ID NO: 479901 - RNA, 16 nt, Homo sapiens
ugccauauacucuuca

SEQ ID NO: 479902 - RNA, 19 nt, Homo sapiens
ugccauccucaaacacugc

SEQ ID NO: 479903 - RNA, 20 nt, Homo sapiens
ugccauccucaaacacugca

SEQ ID NO: 479904 - RNA, 22 nt, Homo sapiens
ugccaugugcuaguaauuggaa

SEQ ID NO: 479905 - RNA, 16 nt, Homo sapiens
ugccauguuuugccac

SEQ ID NO: 479906 - RNA, 12 nt, Homo sapiens
ugcccaccuccu

SEQ ID NO: 479907 - RNA, 19 nt, Homo sapiens
ugcccaggaaccucagggc

SEQ ID NO: 479908 - RNA, 15 nt, Homo sapiens
ugcccagggcucagc

SEQ ID NO: 479909 - RNA, 16 nt, Homo sapiens
ugcccaguguguuucu

SEQ ID NO: 479910 - RNA, 16 nt, Homo sapiens
ugccccccuugccaga

SEQ ID NO: 479911 - RNA, 20 nt, Homo sapiens
ugcccucuccugggcagcug

SEQ ID NO: 479912 - RNA, 12 nt, Homo sapiens
ugccgcugccau

SEQ ID NO: 479913 - RNA, 15 nt, Homo sapiens
ugccuagaggugcuc

SEQ ID NO: 479914 - RNA, 12 nt, Homo sapiens
ugccucauuuua

SEQ ID NO: 479915 - RNA, 18 nt, Homo sapiens
ugccugaagccaggccau

SEQ ID NO: 479916 - RNA, 16 nt, Homo sapiens
ugccuuuagugaucac

SEQ ID NO: 479917 - RNA, 17 nt, Homo sapiens
ugcgagugcucauuuca

SEQ ID NO: 479918 - RNA, 17 nt, Homo sapiens
ugcggcauuaaagccau

SEQ ID NO: 479919 - RNA, 17 nt, Homo sapiens
ugcuauaacuauguuga

SEQ ID NO: 479920 - RNA, 15 nt, Homo sapiens
ugcucacugucacau

SEQ ID NO: 479921 - RNA, 16 nt, Homo sapiens
ugcucccuccacagcu

SEQ ID NO: 479922 - RNA, 19 nt, Homo sapiens
ugcucccugguucugauga

SEQ ID NO: 479923 - RNA, 15 nt, Homo sapiens
ugcugugugacucaa

SEQ ID NO: 479924 - RNA, 21 nt, Homo sapiens
ugcugugugacucaaaccaaa

SEQ ID NO: 479925 - RNA, 14 nt, Homo sapiens
ugcuugaaugaagu

SEQ ID NO: 479926 - RNA, 16 nt, Homo sapiens
ugcuuucuauuuugag

SEQ ID NO: 479927 - RNA, 10 nt, Homo sapiens
ugcuuugcau

SEQ ID NO: 479928 - RNA, 15 nt, Homo sapiens
uggaaaccguguaaa

SEQ ID NO: 479929 - RNA, 17 nt, Homo sapiens
uggaaaggcagcucuaa

SEQ ID NO: 479930 - RNA, 22 nt, Homo sapiens
uggaacaucaucaaggcacugc

SEQ ID NO: 479931 - RNA, 17 nt, Homo sapiens
uggaagcauauuguuau

SEQ ID NO: 479932 - RNA, 20 nt, Homo sapiens
uggaagguggggacagggau

SEQ ID NO: 479933 - RNA, 15 nt, Homo sapiens
uggaagugugugauc

SEQ ID NO: 479934 - RNA, 23 nt, Homo sapiens
uggaaguuaaagggcauuuccaa

SEQ ID NO: 479935 - RNA, 21 nt, Homo sapiens
uggacaugaagggaugcugca

SEQ ID NO: 479936 - RNA, 23 nt, Homo sapiens
uggaccugucacgauugucauca

SEQ ID NO: 479937 - RNA, 21 nt, Homo sapiens
uggacuauggcucuacuuuca

SEQ ID NO: 479938 - RNA, 15 nt, Homo sapiens
uggagccaacagaug

SEQ ID NO: 479939 - RNA, 14 nt, Homo sapiens
uggagcugccugau

SEQ ID NO: 479940 - RNA, 19 nt, Homo sapiens
uggaggacuagaaccugga

SEQ ID NO: 479941 - RNA, 19 nt, Homo sapiens
uggagggcuagaaccugga

SEQ ID NO: 479942 - RNA, 19 nt, Homo sapiens
uggagggcuagaaucugga

SEQ ID NO: 479943 - RNA, 18 nt, Homo sapiens
uggaguccgacaaagcua

SEQ ID NO: 479944 - RNA, 18 nt, Homo sapiens
uggaguccgaugauucuc

SEQ ID NO: 479945 - RNA, 13 nt, Homo sapiens
uggaguuaucuaa

SEQ ID NO: 479946 - RNA, 18 nt, Homo sapiens
uggaugccugauugccaa

SEQ ID NO: 479947 - RNA, 13 nt, Homo sapiens
uggcaaaagacau

SEQ ID NO: 479948 - RNA, 22 nt, Homo sapiens
uggcaaaagacauccucaaaag

SEQ ID NO: 479949 - RNA, 19 nt, Homo sapiens
uggcaaagaugaucaguau

SEQ ID NO: 479950 - RNA, 22 nt, Homo sapiens
uggcaaaucucuauuaggaaau

SEQ ID NO: 479951 - RNA, 19 nt, Homo sapiens
uggcaacggaagaaugaga

SEQ ID NO: 479952 - RNA, 19 nt, Homo sapiens
uggcaauaaggaucuuccc

SEQ ID NO: 479953 - RNA, 15 nt, Homo sapiens
uggcacccaugcacc

SEQ ID NO: 479954 - RNA, 11 nt, Homo sapiens
uggcagggaua

SEQ ID NO: 479955 - RNA, 15 nt, Homo sapiens
uggcagucacaucuc

SEQ ID NO: 479956 - RNA, 20 nt, Homo sapiens
uggcauugucuguaaugaca

SEQ ID NO: 479957 - RNA, 21 nt, Homo sapiens
uggcauugucuguaaugacaa

SEQ ID NO: 479958 - RNA, 21 nt, Homo sapiens
uggccaggcugcacacauucu

SEQ ID NO: 479959 - RNA, 19 nt, Homo sapiens
uggcugaaccgagcuggag

SEQ ID NO: 479960 - RNA, 18 nt, Homo sapiens
uggcuucugcuugucauc

SEQ ID NO: 479961 - RNA, 13 nt, Homo sapiens
ugggaacuccuaa

SEQ ID NO: 479962 - RNA, 21 nt, Homo sapiens
ugggaagggaucccuuuguau

SEQ ID NO: 479963 - RNA, 17 nt, Homo sapiens
ugggaauuuucuuccaa

SEQ ID NO: 479964 - RNA, 21 nt, Homo sapiens
ugggacauuugcucauggaau

SEQ ID NO: 479965 - RNA, 19 nt, Homo sapiens
ugggagcccaguuucacug

SEQ ID NO: 479966 - RNA, 21 nt, Homo sapiens
ugggaggcagagguugcagug

SEQ ID NO: 479967 - RNA, 14 nt, Homo sapiens
ugggagugagggau

SEQ ID NO: 479968 - RNA, 19 nt, Homo sapiens
ugggaguuuagugugauaa

SEQ ID NO: 479969 - RNA, 18 nt, Homo sapiens
ugggcaacagagcaagac

SEQ ID NO: 479970 - RNA, 14 nt, Homo sapiens
ugggcagggaugau

SEQ ID NO: 479971 - RNA, 20 nt, Homo sapiens
ugggccuccucacaacaugg

SEQ ID NO: 479972 - RNA, 13 nt, Homo sapiens
ugggcuucuagaa

SEQ ID NO: 479973 - RNA, 22 nt, Homo sapiens
uggggacagagcagaacuuuca

SEQ ID NO: 479974 - RNA, 22 nt, Homo sapiens
ugggggcaccaagaccccaaag

SEQ ID NO: 479975 - RNA, 16 nt, Homo sapiens
ugggguuccccuggaa

SEQ ID NO: 479976 - RNA, 19 nt, Homo sapiens
uggguuggaaaacaguauu

SEQ ID NO: 479977 - RNA, 19 nt, Homo sapiens
ugguaauaaguacugugua

SEQ ID NO: 479978 - RNA, 13 nt, Homo sapiens
uggucuccucuca

SEQ ID NO: 479979 - RNA, 21 nt, Homo sapiens
uggugacaaugggagacucca

SEQ ID NO: 479980 - RNA, 13 nt, Homo sapiens
uggugccuggaaa

SEQ ID NO: 479981 - RNA, 19 nt, Homo sapiens
uggugggggugcagaugag

SEQ ID NO: 479982 - RNA, 17 nt, Homo sapiens
ugguguugacaugugcu

SEQ ID NO: 479983 - RNA, 20 nt, Homo sapiens
ugguucugaugaugugccug

SEQ ID NO: 479984 - RNA, 21 nt, Homo sapiens
uguaaagcaggugcccaggaa

SEQ ID NO: 479985 - RNA, 13 nt, Homo sapiens
uguacuauguguu

SEQ ID NO: 479986 - RNA, 19 nt, Homo sapiens
uguauagcuggcaccuuag

SEQ ID NO: 479987 - RNA, 18 nt, Homo sapiens
uguaucauuaugaaguca

SEQ ID NO: 479988 - RNA, 17 nt, Homo sapiens
uguaugagacuaugcaa

SEQ ID NO: 479989 - RNA, 20 nt, Homo sapiens
uguaugagagggcccugccu

SEQ ID NO: 479990 - RNA, 15 nt, Homo sapiens
ugucacccaaugcau

SEQ ID NO: 479991 - RNA, 19 nt, Homo sapiens
ugucacucaccacuacauc

SEQ ID NO: 479992 - RNA, 11 nt, Homo sapiens
ugucaucucag

SEQ ID NO: 479993 - RNA, 21 nt, Homo sapiens
ugucaucucagcuggaucucc

SEQ ID NO: 479994 - RNA, 16 nt, Homo sapiens
uguccguccucuuccc

SEQ ID NO: 479995 - RNA, 13 nt, Homo sapiens
ugucuauucuugu

SEQ ID NO: 479996 - RNA, 18 nt, Homo sapiens
ugucuccuuaacacugag

SEQ ID NO: 479997 - RNA, 19 nt, Homo sapiens
ugucugccagccagcagcc

SEQ ID NO: 479998 - RNA, 19 nt, Homo sapiens
ugucuggauucccaggaug

SEQ ID NO: 479999 - RNA, 14 nt, Homo sapiens
ugucuuauuaggga

SEQ ID NO: 480000 - RNA, 22 nt, Homo sapiens
ugucuugggaauuuucuuccaa

SEQ ID NO: 480001 - RNA, 16 nt, Homo sapiens
ugucuuuucaaaagga

SEQ ID NO: 480002 - RNA, 18 nt, Homo sapiens
ugucuuuucaaaaggauu

SEQ ID NO: 480003 - RNA, 22 nt, Homo sapiens
ggaggaaaagacuaacaggaga

SEQ ID NO: 480004 - RNA, 17 nt, Homo sapiens
ggagguaguuaagggau

SEQ ID NO: 480005 - RNA, 17 nt, Homo sapiens
ggaguaccauguggcaa

SEQ ID NO: 480006 - RNA, 16 nt, Homo sapiens
ggagucaugugccucu

SEQ ID NO: 480007 - RNA, 20 nt, Homo sapiens
ggagugcccccaacagcacc

SEQ ID NO: 480008 - RNA, 24 nt, Homo sapiens
ggaguuuauuugaguauugcugau

SEQ ID NO: 480009 - RNA, 19 nt, Homo sapiens
ggauaggcaggaacauaca

SEQ ID NO: 480010 - RNA, 21 nt, Homo sapiens
ggauauuuccauauggcaaua

SEQ ID NO: 480011 - RNA, 14 nt, Homo sapiens
ggaugaagugauau

SEQ ID NO: 480012 - RNA, 20 nt, Homo sapiens
ggaugauuauuuucuguucu

SEQ ID NO: 480013 - RNA, 15 nt, Homo sapiens
aaaaacguauugcau

SEQ ID NO: 480014 - RNA, 12 nt, Homo sapiens
aaaaagccucca

SEQ ID NO: 480015 - RNA, 16 nt, Homo sapiens
aaaaaguucagcauga

SEQ ID NO: 480016 - RNA, 19 nt, Homo sapiens
aaaaauaaaaaagaucucc

SEQ ID NO: 480017 - RNA, 17 nt, Homo sapiens
aaaaauacucacauggc

SEQ ID NO: 480018 - RNA, 11 nt, Homo sapiens
aaaacauucca

SEQ ID NO: 480019 - RNA, 20 nt, Homo sapiens
aaaaccccaucucuacuaaa

SEQ ID NO: 480020 - RNA, 13 nt, Homo sapiens
aaaacugggacag

SEQ ID NO: 480021 - RNA, 15 nt, Homo sapiens
aaaagacacagaaca

SEQ ID NO: 480022 - RNA, 14 nt, Homo sapiens
aaaagacauccuca

SEQ ID NO: 480023 - RNA, 12 nt, Homo sapiens
aaaaucaaacag

SEQ ID NO: 480024 - RNA, 19 nt, Homo sapiens
aaaaucucaauucuucccu

SEQ ID NO: 480025 - RNA, 21 nt, Homo sapiens
aaaaugaugucaugucagcuc

SEQ ID NO: 480026 - RNA, 14 nt, Homo sapiens
aaacaaaagcucau

SEQ ID NO: 480027 - RNA, 12 nt, Homo sapiens
aaacaagccaug

SEQ ID NO: 480028 - RNA, 15 nt, Homo sapiens
aaacacaaccugccu

SEQ ID NO: 480029 - RNA, 17 nt, Homo sapiens
aaacagcaauagugaau

SEQ ID NO: 480030 - RNA, 18 nt, Homo sapiens
aaacagcaauagugaaug

SEQ ID NO: 480031 - RNA, 14 nt, Homo sapiens
aaacagugacauuu

SEQ ID NO: 480032 - RNA, 20 nt, Homo sapiens
aaacauuuucacacaauaca

SEQ ID NO: 480033 - RNA, 19 nt, Homo sapiens
aaaccuguucuaccaauua

SEQ ID NO: 480034 - RNA, 14 nt, Homo sapiens
aaacuaagcuaugu

SEQ ID NO: 480035 - RNA, 13 nt, Homo sapiens
aaacucaccaucu

SEQ ID NO: 480036 - RNA, 14 nt, Homo sapiens
aaacucaguaucau

SEQ ID NO: 480037 - RNA, 18 nt, Homo sapiens
aaagaacucagugcugcc

SEQ ID NO: 480038 - RNA, 12 nt, Homo sapiens
aaagaagagccg

SEQ ID NO: 480039 - RNA, 14 nt, Homo sapiens
aaagaaguggggac

SEQ ID NO: 480040 - RNA, 22 nt, Homo sapiens
aaagacauaggaacauguaguu

SEQ ID NO: 480041 - RNA, 16 nt, Homo sapiens
aaagacaucuccacca

SEQ ID NO: 480042 - RNA, 23 nt, Homo sapiens
aaagacuaacaggagaaugcaca

SEQ ID NO: 480043 - RNA, 19 nt, Homo sapiens
aaagacuuuccucuuaguc

SEQ ID NO: 480044 - RNA, 14 nt, Homo sapiens
aaagagaacuucca

SEQ ID NO: 480045 - RNA, 19 nt, Homo sapiens
aaagagacauauacuaaga

SEQ ID NO: 480046 - RNA, 19 nt, Homo sapiens
aaagauuugcuuuaauugu

SEQ ID NO: 480047 - RNA, 15 nt, Homo sapiens
aaagcaggugcccag

SEQ ID NO: 480048 - RNA, 19 nt, Homo sapiens
aaagcaguggacaccagga

SEQ ID NO: 480049 - RNA, 22 nt, Homo sapiens
aaagccaucaaacacaaugccu

SEQ ID NO: 480050 - RNA, 18 nt, Homo sapiens
aaagcccauucauuccau

SEQ ID NO: 480051 - RNA, 14 nt, Homo sapiens
aaagcuacuugaag

SEQ ID NO: 480052 - RNA, 13 nt, Homo sapiens
aaagcuguucuca

SEQ ID NO: 480053 - RNA, 15 nt, Homo sapiens
aaagcuucauucuca

SEQ ID NO: 480054 - RNA, 22 nt, Homo sapiens
aaagcuuggugcuaaaccacaa

SEQ ID NO: 480055 - RNA, 24 nt, Homo sapiens
aaagcuuugggggagugggcgcag

SEQ ID NO: 480056 - RNA, 16 nt, Homo sapiens
aaaggaaagauuugcc

SEQ ID NO: 480057 - RNA, 22 nt, Homo sapiens
aaaggaaagauuugccaauuga

SEQ ID NO: 480058 - RNA, 22 nt, Homo sapiens
aaaggaacuauguucacaagaa

SEQ ID NO: 480059 - RNA, 14 nt, Homo sapiens
aaaggacucuugag

SEQ ID NO: 480060 - RNA, 19 nt, Homo sapiens
aaaggcugggaccacguga

SEQ ID NO: 480061 - RNA, 22 nt, Homo sapiens
aaaggcuuccccaccacacuuu

SEQ ID NO: 480062 - RNA, 16 nt, Homo sapiens
aaauaaaccccaguuc

SEQ ID NO: 480063 - RNA, 14 nt, Homo sapiens
aaauaauaacaauc

SEQ ID NO: 480064 - RNA, 13 nt, Homo sapiens
aaauauagccaaa

SEQ ID NO: 480065 - RNA, 12 nt, Homo sapiens
aaauauuugaca

SEQ ID NO: 480066 - RNA, 20 nt, Homo sapiens
aaauauuuugcggcauuaaa

SEQ ID NO: 480067 - RNA, 21 nt, Homo sapiens
aaaucaaguuggcuucuaauc

SEQ ID NO: 480068 - RNA, 18 nt, Homo sapiens
aaaucuaugaaauaucau

SEQ ID NO: 480069 - RNA, 18 nt, Homo sapiens
aaaugauccuuaugaugu

SEQ ID NO: 480070 - RNA, 20 nt, Homo sapiens
aaaugaugucaugucagcuc

SEQ ID NO: 480071 - RNA, 17 nt, Homo sapiens
aaaugauguugaauauu

SEQ ID NO: 480072 - RNA, 18 nt, Homo sapiens
aaaugggacugaugucau

SEQ ID NO: 480073 - RNA, 22 nt, Homo sapiens
aaaugucauuguucuugugaac

SEQ ID NO: 480074 - RNA, 12 nt, Homo sapiens
aaaugugcaaua

SEQ ID NO: 480075 - RNA, 17 nt, Homo sapiens
aaauguuacuucucuca

SEQ ID NO: 480076 - RNA, 14 nt, Homo sapiens
aauucaagcuuucc

SEQ ID NO: 480077 - RNA, 15 nt, Homo sapiens
aauucaugcaucuca

SEQ ID NO: 480078 - RNA, 15 nt, Homo sapiens
aauucauuccauuug

SEQ ID NO: 480079 - RNA, 22 nt, Homo sapiens
aauuccuuagcuuagaccucag

SEQ ID NO: 480080 - RNA, 21 nt, Homo sapiens
aauucuagagucucuguuacu

SEQ ID NO: 480081 - RNA, 13 nt, Homo sapiens
aauucucaagccg

SEQ ID NO: 480082 - RNA, 20 nt, Homo sapiens
aauucucaagccgcauccca

SEQ ID NO: 480083 - RNA, 21 nt, Homo sapiens
aauucucaagccgcaucccag

SEQ ID NO: 480084 - RNA, 18 nt, Homo sapiens
aauucuuacaaacaugug

SEQ ID NO: 480085 - RNA, 17 nt, Homo sapiens
aauugaggacacugaua

SEQ ID NO: 480086 - RNA, 12 nt, Homo sapiens
aauuguuugacc

SEQ ID NO: 480087 - RNA, 20 nt, Homo sapiens
aauuucacuuaauaaugugu

SEQ ID NO: 480088 - RNA, 15 nt, Homo sapiens
aauuucuauucucuc

SEQ ID NO: 480089 - RNA, 13 nt, Homo sapiens
acaaacucaccau

SEQ ID NO: 480090 - RNA, 16 nt, Homo sapiens
acaaagcuacuugaag

SEQ ID NO: 480091 - RNA, 14 nt, Homo sapiens
acaaaguucauuca

SEQ ID NO: 480092 - RNA, 16 nt, Homo sapiens
acaaauaaagcaauga

SEQ ID NO: 480093 - RNA, 23 nt, Homo sapiens
acaaauguuuagugaaacauuug

SEQ ID NO: 480094 - RNA, 16 nt, Homo sapiens
acaacaccccacagga

SEQ ID NO: 480095 - RNA, 13 nt, Homo sapiens
acaacaugguguc

SEQ ID NO: 480096 - RNA, 17 nt, Homo sapiens
acaaguaaaacuguggu

SEQ ID NO: 480097 - RNA, 14 nt, Homo sapiens
acaagugagacaaa

SEQ ID NO: 480098 - RNA, 17 nt, Homo sapiens
acaagugagacaaaaag

SEQ ID NO: 480099 - RNA, 16 nt, Homo sapiens
acaauaguaauucuca

SEQ ID NO: 480100 - RNA, 15 nt, Homo sapiens
acaaucuguauauaa

SEQ ID NO: 480101 - RNA, 22 nt, Homo sapiens
acaaugaagaugaugcuauuaa

SEQ ID NO: 480102 - RNA, 13 nt, Homo sapiens
acaaugugcccuc

SEQ ID NO: 480103 - RNA, 17 nt, Homo sapiens
acacaacacacaauuua

SEQ ID NO: 480104 - RNA, 12 nt, Homo sapiens
acacacauacag

SEQ ID NO: 480105 - RNA, 15 nt, Homo sapiens
acacaggaugaaggc

SEQ ID NO: 480106 - RNA, 19 nt, Homo sapiens
acacauuaagccuuccaca

SEQ ID NO: 480107 - RNA, 13 nt, Homo sapiens
acacccacagugg

SEQ ID NO: 480108 - RNA, 20 nt, Homo sapiens
acacccagcucagcauuucc

SEQ ID NO: 480109 - RNA, 15 nt, Homo sapiens
acacuaauacaccag

SEQ ID NO: 480110 - RNA, 17 nt, Homo sapiens
acacuaauacaccaggu

SEQ ID NO: 480111 - RNA, 22 nt, Homo sapiens
acacugcacagaagacagcagc

SEQ ID NO: 480112 - RNA, 18 nt, Homo sapiens
acagaagggcuaacucag

SEQ ID NO: 480113 - RNA, 15 nt, Homo sapiens
acagagucucacucu

SEQ ID NO: 480114 - RNA, 15 nt, Homo sapiens
acagcaauagugaau

SEQ ID NO: 480115 - RNA, 12 nt, Homo sapiens
acagcagaauaa

SEQ ID NO: 480116 - RNA, 15 nt, Homo sapiens
acagcaggcuuucaa

SEQ ID NO: 480117 - RNA, 12 nt, Homo sapiens
acagcaguagca

SEQ ID NO: 480118 - RNA, 19 nt, Homo sapiens
acagcuaacacacagcucc

SEQ ID NO: 480119 - RNA, 16 nt, Homo sapiens
aaauuugggaggguga

SEQ ID NO: 480120 - RNA, 20 nt, Homo sapiens
aaauuuuuccuuagcauugu

SEQ ID NO: 480121 - RNA, 21 nt, Homo sapiens
aacaaccagcaucccuugacc

SEQ ID NO: 480122 - RNA, 15 nt, Homo sapiens
aacacaaugccucau

SEQ ID NO: 480123 - RNA, 15 nt, Homo sapiens
aacacugaagcucuu

SEQ ID NO: 480124 - RNA, 12 nt, Homo sapiens
aacacugggcug

SEQ ID NO: 480125 - RNA, 11 nt, Homo sapiens
aacacugugaa

SEQ ID NO: 480126 - RNA, 14 nt, Homo sapiens
aacagaacuaugga

SEQ ID NO: 480127 - RNA, 21 nt, Homo sapiens
aacagaagggcuaacucaguu

SEQ ID NO: 480128 - RNA, 20 nt, Homo sapiens
aacagaguuugauaugggcu

SEQ ID NO: 480129 - RNA, 20 nt, Homo sapiens
aacagaugugucagccagga

SEQ ID NO: 480130 - RNA, 17 nt, Homo sapiens
aacaggagaaugcacag

SEQ ID NO: 480131 - RNA, 14 nt, Homo sapiens
aacaguccuucaaa

SEQ ID NO: 480132 - RNA, 15 nt, Homo sapiens
aacaguuuccaguca

SEQ ID NO: 480133 - RNA, 22 nt, Homo sapiens
aacaguuuccagucauggccaa

SEQ ID NO: 480134 - RNA, 12 nt, Homo sapiens
aacaugaugaaa

SEQ ID NO: 480135 - RNA, 19 nt, Homo sapiens
aacaugugguuaaugccau

SEQ ID NO: 480136 - RNA, 10 nt, Homo sapiens
aacauuccau

SEQ ID NO: 480137 - RNA, 20 nt, Homo sapiens
aacauuucacaaauguuuag

SEQ ID NO: 480138 - RNA, 17 nt, Homo sapiens
aaccagagccugagugu

SEQ ID NO: 480139 - RNA, 14 nt, Homo sapiens
aaccaugguaugaa

SEQ ID NO: 480140 - RNA, 23 nt, Homo sapiens
aacccaaagugugacucauuaaa

SEQ ID NO: 480141 - RNA, 21 nt, Homo sapiens
aaccuggcagguuagaaccua

SEQ ID NO: 480142 - RNA, 20 nt, Homo sapiens
aaccuucgccucccagguuc

SEQ ID NO: 480143 - RNA, 13 nt, Homo sapiens
aacuaacacagcc

SEQ ID NO: 480144 - RNA, 18 nt, Homo sapiens
aacuagcuuggaaacugg

SEQ ID NO: 480145 - RNA, 14 nt, Homo sapiens
aacucaaaugagcc

SEQ ID NO: 480146 - RNA, 17 nt, Homo sapiens
aacugcccaaggcaugu

SEQ ID NO: 480147 - RNA, 15 nt, Homo sapiens
aacuucagccagcua

SEQ ID NO: 480148 - RNA, 20 nt, Homo sapiens
aacuuccagugcaacacuga

SEQ ID NO: 480149 - RNA, 21 nt, Homo sapiens
aacuuccagugcaacacugaa

SEQ ID NO: 480150 - RNA, 15 nt, Homo sapiens
aagaaaaugauugcu

SEQ ID NO: 480151 - RNA, 19 nt, Homo sapiens
aagaaauuaugucagcuua

SEQ ID NO: 480152 - RNA, 23 nt, Homo sapiens
aagaacugaaaucauacuucuua

SEQ ID NO: 480153 - RNA, 20 nt, Homo sapiens
aagaacuuggaggcaccauu

SEQ ID NO: 480154 - RNA, 16 nt, Homo sapiens
aagaacuugucccuca

SEQ ID NO: 480155 - RNA, 20 nt, Homo sapiens
aagacacugaaauauacaca

SEQ ID NO: 480156 - RNA, 17 nt, Homo sapiens
aagaccucccugugaga

SEQ ID NO: 480157 - RNA, 14 nt, Homo sapiens
aagacgugauucaa

SEQ ID NO: 480158 - RNA, 18 nt, Homo sapiens
aagacuauucccuucuaa

SEQ ID NO: 480159 - RNA, 22 nt, Homo sapiens
aagacuguggcugcuagcacuu

SEQ ID NO: 480160 - RNA, 18 nt, Homo sapiens
aagacuuuaaaccaccua

SEQ ID NO: 480161 - RNA, 19 nt, Homo sapiens
aagagaacuuccagauccu

SEQ ID NO: 480162 - RNA, 11 nt, Homo sapiens
aagagaauuau

SEQ ID NO: 480163 - RNA, 17 nt, Homo sapiens
aagagcacacuuggccc

SEQ ID NO: 480164 - RNA, 21 nt, Homo sapiens
aagagccggagccuccagcug

SEQ ID NO: 480165 - RNA, 13 nt, Homo sapiens
aagaggaugaagu

SEQ ID NO: 480166 - RNA, 16 nt, Homo sapiens
ucuaucauuaaaguuc

SEQ ID NO: 480167 - RNA, 22 nt, Homo sapiens
ucuaucauuaaaguucuaguga

SEQ ID NO: 480168 - RNA, 13 nt, Homo sapiens
ucuauuugugcuu

SEQ ID NO: 480169 - RNA, 23 nt, Homo sapiens
ucucaacuccaaacugacucuua

SEQ ID NO: 480170 - RNA, 23 nt, Homo sapiens
ucucaagaagaacaucuuuaugg

SEQ ID NO: 480171 - RNA, 19 nt, Homo sapiens
ucucacucuguugcccagg

SEQ ID NO: 480172 - RNA, 22 nt, Homo sapiens
ucucacugugggaaggccagcu

SEQ ID NO: 480173 - RNA, 21 nt, Homo sapiens
ucucagcuggaucuccauucu

SEQ ID NO: 480174 - RNA, 12 nt, Homo sapiens
ucucauccugca

SEQ ID NO: 480175 - RNA, 20 nt, Homo sapiens
ucuccagagggaauugcaga

SEQ ID NO: 480176 - RNA, 18 nt, Homo sapiens
ucucccaaagccccaaau

SEQ ID NO: 480177 - RNA, 18 nt, Homo sapiens
ucucccgggacuaccugg

SEQ ID NO: 480178 - RNA, 15 nt, Homo sapiens
ucuccugggcagcug

SEQ ID NO: 480179 - RNA, 14 nt, Homo sapiens
ucuccuuaacacug

SEQ ID NO: 480180 - RNA, 15 nt, Homo sapiens
ucucgacucacugca

SEQ ID NO: 480181 - RNA, 19 nt, Homo sapiens
ucucuugccgacaagggca

SEQ ID NO: 480182 - RNA, 14 nt, Homo sapiens
ucugaaggagauuu

SEQ ID NO: 480183 - RNA, 22 nt, Homo sapiens
ucugaccaguuuaaccugaugc

SEQ ID NO: 480184 - RNA, 20 nt, Homo sapiens
ucugagaguauuagucacaa

SEQ ID NO: 480185 - RNA, 16 nt, Homo sapiens
ucugaggauucagggg

SEQ ID NO: 480186 - RNA, 23 nt, Homo sapiens
ucugaggggaugcaacaaaauga

SEQ ID NO: 480187 - RNA, 21 nt, Homo sapiens
acucaaucucugauucuguca

SEQ ID NO: 480188 - RNA, 20 nt, Homo sapiens
acucagaucaaaaaugggca

SEQ ID NO: 480189 - RNA, 16 nt, Homo sapiens
acucagugauugcaau

SEQ ID NO: 480190 - RNA, 16 nt, Homo sapiens
acuccaggacagugga

SEQ ID NO: 480191 - RNA, 14 nt, Homo sapiens
acucccgaccucag

SEQ ID NO: 480192 - RNA, 20 nt, Homo sapiens
acucuuguguuuuuugcuca

SEQ ID NO: 480193 - RNA, 21 nt, Homo sapiens
acucuuguguuuuuugcucac

SEQ ID NO: 480194 - RNA, 17 nt, Homo sapiens
acugaaaacaagccaug

SEQ ID NO: 480195 - RNA, 13 nt, Homo sapiens
acugacacuggua

SEQ ID NO: 480196 - RNA, 16 nt, Homo sapiens
acugacuccuguggag

SEQ ID NO: 480197 - RNA, 14 nt, Homo sapiens
acugagagugaagu

SEQ ID NO: 480198 - RNA, 14 nt, Homo sapiens
acugaggcagacag

SEQ ID NO: 480199 - RNA, 20 nt, Homo sapiens
acugaggcagacagcagcuc

SEQ ID NO: 480200 - RNA, 14 nt, Homo sapiens
acugauauccuccu

SEQ ID NO: 480201 - RNA, 16 nt, Homo sapiens
acugaucgauuugcac

SEQ ID NO: 480202 - RNA, 19 nt, Homo sapiens
acugccuucucaacuccaa

SEQ ID NO: 480203 - RNA, 14 nt, Homo sapiens
acuggaaacuucag

SEQ ID NO: 480204 - RNA, 23 nt, Homo sapiens
acuggaagguggggacagggaug

SEQ ID NO: 480205 - RNA, 13 nt, Homo sapiens
acugggacuugca

SEQ ID NO: 480206 - RNA, 13 nt, Homo sapiens
acuggugggccau

SEQ ID NO: 480207 - RNA, 21 nt, Homo sapiens
acugucuugaagacaauggcu

SEQ ID NO: 480208 - RNA, 22 nt, Homo sapiens
acuguggcugcuagcacuugga

SEQ ID NO: 480209 - RNA, 13 nt, Homo sapiens
acuguguuggcca

SEQ ID NO: 480210 - RNA, 20 nt, Homo sapiens
acuuaauaauguguacauua

SEQ ID NO: 480211 - RNA, 14 nt, Homo sapiens
acuuaccuaccaca

SEQ ID NO: 480212 - RNA, 18 nt, Homo sapiens
acuuaucaucacacaacu

SEQ ID NO: 480213 - RNA, 16 nt, Homo sapiens
acuuauccuguucucu

SEQ ID NO: 480214 - RNA, 18 nt, Homo sapiens
acuucaaaaacugucaaa

SEQ ID NO: 480215 - RNA, 20 nt, Homo sapiens
acuucaaaaacugucaaaga

SEQ ID NO: 480216 - RNA, 22 nt, Homo sapiens
acuucaaggguuuguugaacaa

SEQ ID NO: 480217 - RNA, 23 nt, Homo sapiens
acuuccagugcaacacugaagcu

SEQ ID NO: 480218 - RNA, 18 nt, Homo sapiens
acuuccucgcuagaguuc

SEQ ID NO: 480219 - RNA, 14 nt, Homo sapiens
acuugaacccagga

SEQ ID NO: 480220 - RNA, 14 nt, Homo sapiens
acuuggaacacaau

SEQ ID NO: 480221 - RNA, 20 nt, Homo sapiens
acuuggcuacacagggaugu

SEQ ID NO: 480222 - RNA, 15 nt, Homo sapiens
acuuuggaggacaau

SEQ ID NO: 480223 - RNA, 15 nt, Homo sapiens
acuuuuaaguacuua

SEQ ID NO: 480224 - RNA, 13 nt, Homo sapiens
guuuugacaucaa

SEQ ID NO: 480225 - RNA, 19 nt, Homo sapiens
guuuuguggaggagcucag

SEQ ID NO: 480226 - RNA, 22 nt, Homo sapiens
uaaaaaaaaaacguauugcauu

SEQ ID NO: 480227 - RNA, 16 nt, Homo sapiens
uaaaaaagaucuccaa

SEQ ID NO: 480228 - RNA, 15 nt, Homo sapiens
uaaaaauacaaaaau

SEQ ID NO: 480229 - RNA, 20 nt, Homo sapiens
uaaaacaaaccuugugcucu

SEQ ID NO: 480230 - RNA, 18 nt, Homo sapiens
uaaaacauuuucacacaa

SEQ ID NO: 480231 - RNA, 21 nt, Homo sapiens
uaaaaccccaucucuacuaaa

SEQ ID NO: 480232 - RNA, 16 nt, Homo sapiens
uaaaagaaugauuaug

SEQ ID NO: 480233 - RNA, 16 nt, Homo sapiens
uaaaauaauaacaauc

SEQ ID NO: 480234 - RNA, 11 nt, Homo sapiens
uaaaaugcaga

SEQ ID NO: 480235 - RNA, 14 nt, Homo sapiens
uaaaauuucacuua

SEQ ID NO: 480236 - RNA, 17 nt, Homo sapiens
uaaacaaaggaauuaug

SEQ ID NO: 480237 - RNA, 15 nt, Homo sapiens
agcaggggcucuuag

SEQ ID NO: 480238 - RNA, 15 nt, Homo sapiens
agcagugcaggcaca

SEQ ID NO: 480239 - RNA, 17 nt, Homo sapiens
agcauauuguuauuaua

SEQ ID NO: 480240 - RNA, 21 nt, Homo sapiens
agcaucacuugggauuaauau

SEQ ID NO: 480241 - RNA, 19 nt, Homo sapiens
agcaucccuugaccaggcc

SEQ ID NO: 480242 - RNA, 20 nt, Homo sapiens
agccaagagucaugucaaau

SEQ ID NO: 480243 - RNA, 18 nt, Homo sapiens
agccaauaacacacagcu

SEQ ID NO: 480244 - RNA, 22 nt, Homo sapiens
agccaauagaguugggacaauu

SEQ ID NO: 480245 - RNA, 18 nt, Homo sapiens
agccagcagccagcucuc

SEQ ID NO: 480246 - RNA, 21 nt, Homo sapiens
agccagcaguucagagcugcc

SEQ ID NO: 480247 - RNA, 14 nt, Homo sapiens
agccagucccucag

SEQ ID NO: 480248 - RNA, 19 nt, Homo sapiens
agccgggaaagaagagccg

SEQ ID NO: 480249 - RNA, 18 nt, Homo sapiens
agccuagccgaccucagc

SEQ ID NO: 480250 - RNA, 18 nt, Homo sapiens
agccucugccgcugccau

SEQ ID NO: 480251 - RNA, 22 nt, Homo sapiens
agccugccuggcaggcugucug

SEQ ID NO: 480252 - RNA, 12 nt, Homo sapiens
agccuggugggc

SEQ ID NO: 480253 - RNA, 21 nt, Homo sapiens
agccuuggauguauaugucau

SEQ ID NO: 480254 - RNA, 23 nt, Homo sapiens
agcgcgcgcgcccucuggcugcu

SEQ ID NO: 480255 - RNA, 15 nt, Homo sapiens
agcuaacacacagcu

SEQ ID NO: 480256 - RNA, 18 nt, Homo sapiens
agcuacucaggaggcuga

SEQ ID NO: 480257 - RNA, 14 nt, Homo sapiens
agcuacuucaggac

SEQ ID NO: 480258 - RNA, 15 nt, Homo sapiens
agcuacuugaaggac

SEQ ID NO: 480259 - RNA, 20 nt, Homo sapiens
agcuacuugaaggacacaag

SEQ ID NO: 480260 - RNA, 14 nt, Homo sapiens
agcuagaaccugga

SEQ ID NO: 480261 - RNA, 21 nt, Homo sapiens
agcucacuaagaagcuugaau

SEQ ID NO: 480262 - RNA, 20 nt, Homo sapiens
agcucagcauuuccacacca

SEQ ID NO: 480263 - RNA, 16 nt, Homo sapiens
agcucaggcacacuuc

SEQ ID NO: 480264 - RNA, 14 nt, Homo sapiens
agcucccaagggau

SEQ ID NO: 480265 - RNA, 21 nt, Homo sapiens
agcucccaagggauggugccc

SEQ ID NO: 480266 - RNA, 20 nt, Homo sapiens
agcuccgccccuugaacaug

SEQ ID NO: 480267 - RNA, 17 nt, Homo sapiens
gaaccaagaagggcuag

SEQ ID NO: 480268 - RNA, 18 nt, Homo sapiens
gaaccaggcaacuuggga

SEQ ID NO: 480269 - RNA, 17 nt, Homo sapiens
gaaccaugguaugaagg

SEQ ID NO: 480270 - RNA, 13 nt, Homo sapiens
gaaccuuuccucu

SEQ ID NO: 480271 - RNA, 13 nt, Homo sapiens
gaacuaacaugca

SEQ ID NO: 480272 - RNA, 21 nt, Homo sapiens
gaacucaaggaaaucuguguc

SEQ ID NO: 480273 - RNA, 21 nt, Homo sapiens
gaacucaugagaaguugauau

SEQ ID NO: 480274 - RNA, 13 nt, Homo sapiens
gaacucugagcag

SEQ ID NO: 480275 - RNA, 13 nt, Homo sapiens
gaacuggagccau

SEQ ID NO: 480276 - RNA, 14 nt, Homo sapiens
gaacuggagccaug

SEQ ID NO: 480277 - RNA, 22 nt, Homo sapiens
gaacuggagccaugggcacaaa

SEQ ID NO: 480278 - RNA, 20 nt, Homo sapiens
gaacuuugcugagccuguaa

SEQ ID NO: 480279 - RNA, 16 nt, Homo sapiens
gaagaacuugucccuc

SEQ ID NO: 480280 - RNA, 13 nt, Homo sapiens
gaagaagagccac

SEQ ID NO: 480281 - RNA, 12 nt, Homo sapiens
gaagacacugaa

SEQ ID NO: 480282 - RNA, 17 nt, Homo sapiens
gaagacuauauuguaca

SEQ ID NO: 480283 - RNA, 19 nt, Homo sapiens
gaagacuuuaaaccaccua

SEQ ID NO: 480284 - RNA, 20 nt, Homo sapiens
gaagauccccaacugcucca

SEQ ID NO: 480285 - RNA, 20 nt, Homo sapiens
gaagauccuaaaacaaaagc

SEQ ID NO: 480286 - RNA, 15 nt, Homo sapiens
gaagggauaucuacu

SEQ ID NO: 480287 - RNA, 22 nt, Homo sapiens
gaaggucucaggagaagggaua

SEQ ID NO: 480288 - RNA, 20 nt, Homo sapiens
gaagguggggacagggauga

SEQ ID NO: 480289 - RNA, 19 nt, Homo sapiens
gaaguaagcaaagacuuuc

SEQ ID NO: 480290 - RNA, 15 nt, Homo sapiens
gaagucaugcguuua

SEQ ID NO: 480291 - RNA, 16 nt, Homo sapiens
gaagucuuccauagag

SEQ ID NO: 480292 - RNA, 13 nt, Homo sapiens
gaagugugugauc

SEQ ID NO: 480293 - RNA, 15 nt, Homo sapiens
gaaguugauaugccu

SEQ ID NO: 480294 - RNA, 18 nt, Homo sapiens
gaauaaaauuguaaaauu

SEQ ID NO: 480295 - RNA, 14 nt, Homo sapiens
gaauaauccagaaa

SEQ ID NO: 480296 - RNA, 15 nt, Homo sapiens
gaauacauaaaguau

SEQ ID NO: 480297 - RNA, 14 nt, Homo sapiens
gaauaguacagaca

SEQ ID NO: 480298 - RNA, 23 nt, Homo sapiens
gaauaguguuggaaaaugugcaa

SEQ ID NO: 480299 - RNA, 15 nt, Homo sapiens
gaauaugaauggauu

SEQ ID NO: 480300 - RNA, 13 nt, Homo sapiens
gaaucaauccagc

SEQ ID NO: 480301 - RNA, 16 nt, Homo sapiens
gaaucacuugaaccca

SEQ ID NO: 480302 - RNA, 19 nt, Homo sapiens
gaaucauauaguauguaac

SEQ ID NO: 480303 - RNA, 17 nt, Homo sapiens
gaaucccggcugucaag

SEQ ID NO: 480304 - RNA, 22 nt, Homo sapiens
gaaugauuaugaauuacauuug

SEQ ID NO: 480305 - RNA, 13 nt, Homo sapiens
gaauggagcugua

SEQ ID NO: 480306 - RNA, 19 nt, Homo sapiens
gaauggggugcaugaaggu

SEQ ID NO: 480307 - RNA, 17 nt, Homo sapiens
gaaugugagguguugcu

SEQ ID NO: 480308 - RNA, 13 nt, Homo sapiens
gaauguucugcug

SEQ ID NO: 480309 - RNA, 21 nt, Homo sapiens
gaauuaguuuuauaugcuucu

SEQ ID NO: 480310 - RNA, 15 nt, Homo sapiens
gaauuuaaggcccaa

SEQ ID NO: 480311 - RNA, 18 nt, Homo sapiens
gacaaaauccaugaacaa

SEQ ID NO: 480312 - RNA, 17 nt, Homo sapiens
gacaaguggggacugca

SEQ ID NO: 480313 - RNA, 20 nt, Homo sapiens
gacaaugaagaugaugcuau

SEQ ID NO: 480314 - RNA, 22 nt, Homo sapiens
gacaaugggagacuccaucuca

SEQ ID NO: 480315 - RNA, 20 nt, Homo sapiens
gacacaggaugaaggcaaug

SEQ ID NO: 480316 - RNA, 20 nt, Homo sapiens
gacacauuuguaaauuuuca

SEQ ID NO: 480317 - RNA, 19 nt, Homo sapiens
gacagagcagaacuuucac

SEQ ID NO: 480318 - RNA, 14 nt, Homo sapiens
gacagagcugggau

SEQ ID NO: 480319 - RNA, 13 nt, Homo sapiens
gacaggguuucac

SEQ ID NO: 480320 - RNA, 13 nt, Homo sapiens
gacagucaccuca

SEQ ID NO: 480321 - RNA, 21 nt, Homo sapiens
gacaugugguuacuaguacag

SEQ ID NO: 480322 - RNA, 13 nt, Homo sapiens
gacauucaugccu

SEQ ID NO: 480323 - RNA, 23 nt, Homo sapiens
gacauucucaucaccacagggau

SEQ ID NO: 480324 - RNA, 19 nt, Homo sapiens
gaccacgugagaucauuca

SEQ ID NO: 480325 - RNA, 16 nt, Homo sapiens
gaccagccugggcaac

SEQ ID NO: 480326 - RNA, 20 nt, Homo sapiens
gaccaggcaaagcaagugau

SEQ ID NO: 480327 - RNA, 22 nt, Homo sapiens
gaccaggcaaugugacuuugca

SEQ ID NO: 480328 - RNA, 17 nt, Homo sapiens
gaccaggccugggccag

SEQ ID NO: 480329 - RNA, 13 nt, Homo sapiens
gaccaucccggcc

SEQ ID NO: 480330 - RNA, 15 nt, Homo sapiens
gaccaucuacauaca

SEQ ID NO: 480331 - RNA, 16 nt, Homo sapiens
gacccagggaugacau

SEQ ID NO: 480332 - RNA, 15 nt, Homo sapiens
gacccucaaugccaa

SEQ ID NO: 480333 - RNA, 18 nt, Homo sapiens
gaccuccuuacauaugca

SEQ ID NO: 480334 - RNA, 12 nt, Homo sapiens
gaccuucuagga

SEQ ID NO: 480335 - RNA, 20 nt, Homo sapiens
gaccuugggggaagacuuua

SEQ ID NO: 480336 - RNA, 19 nt, Homo sapiens
gacggaggccuacucuucc

SEQ ID NO: 480337 - RNA, 22 nt, Homo sapiens
gacgugauucaauucaacacuc

SEQ ID NO: 480338 - RNA, 14 nt, Homo sapiens
gacuagaaccugga

SEQ ID NO: 480339 - RNA, 21 nt, Homo sapiens
gacuauugacaucagcaucac

SEQ ID NO: 480340 - RNA, 14 nt, Homo sapiens
gacucgggccuuag

SEQ ID NO: 480341 - RNA, 19 nt, Homo sapiens
gacucuccagaaagcucau

SEQ ID NO: 480342 - RNA, 14 nt, Homo sapiens
gacucuuaagaaga

SEQ ID NO: 480343 - RNA, 15 nt, Homo sapiens
gacugaugacuuuau

SEQ ID NO: 480344 - RNA, 14 nt, Homo sapiens
gacugaugucaucu

SEQ ID NO: 480345 - RNA, 17 nt, Homo sapiens
gacugaugucaucuuga

SEQ ID NO: 480346 - RNA, 22 nt, Homo sapiens
gacugcacagcguccuguccac

SEQ ID NO: 480347 - RNA, 11 nt, Homo sapiens
gacugcugaca

SEQ ID NO: 480348 - RNA, 22 nt, Homo sapiens
gacuguucaagagcacacuugg

SEQ ID NO: 480349 - RNA, 16 nt, Homo sapiens
gacuugaggauuuuga

SEQ ID NO: 480350 - RNA, 15 nt, Homo sapiens
gacuuuaaaccaccu

SEQ ID NO: 480351 - RNA, 16 nt, Homo sapiens
gacuuuaaaccaccua

SEQ ID NO: 480352 - RNA, 16 nt, Homo sapiens
gacuuugccacaucca

SEQ ID NO: 480353 - RNA, 20 nt, Homo sapiens
gacuuuuuuuaaauaguaaa

SEQ ID NO: 480354 - RNA, 14 nt, Homo sapiens
gagaaaaaaauuca

SEQ ID NO: 480355 - RNA, 20 nt, Homo sapiens
gagaaaaagccuccagucca

SEQ ID NO: 480356 - RNA, 19 nt, Homo sapiens
gagaaaaguccacagugau

SEQ ID NO: 480357 - RNA, 20 nt, Homo sapiens
gagaaauugaacuucaggga

SEQ ID NO: 480358 - RNA, 18 nt, Homo sapiens
gagaagaaugacuaugca

SEQ ID NO: 480359 - RNA, 12 nt, Homo sapiens
gagaaucacuug

SEQ ID NO: 480360 - RNA, 12 nt, Homo sapiens
gagacagucacc

SEQ ID NO: 480361 - RNA, 22 nt, Homo sapiens
gagaccaaggcccccgggccga

SEQ ID NO: 480362 - RNA, 16 nt, Homo sapiens
gagaccaggcaaagca

SEQ ID NO: 480363 - RNA, 19 nt, Homo sapiens
gagacuccuaggcaggaca

SEQ ID NO: 480364 - RNA, 18 nt, Homo sapiens
gagagagguacccaaggu

SEQ ID NO: 480365 - RNA, 14 nt, Homo sapiens
gagagcaugccugu

SEQ ID NO: 480366 - RNA, 18 nt, Homo sapiens
gagagcucuuugugaaug

SEQ ID NO: 480367 - RNA, 15 nt, Homo sapiens
gagagucugggucca

SEQ ID NO: 480368 - RNA, 18 nt, Homo sapiens
gagauaauucuagcuuug

SEQ ID NO: 480369 - RNA, 16 nt, Homo sapiens
gagaucgagaccaucc

SEQ ID NO: 480370 - RNA, 15 nt, Homo sapiens
gagauuccugagcca

SEQ ID NO: 480371 - RNA, 16 nt, Homo sapiens
gagauuugguguacaa

SEQ ID NO: 480372 - RNA, 15 nt, Homo sapiens
gagcaacagaggaca

SEQ ID NO: 480373 - RNA, 15 nt, Homo sapiens
gagcacuucacacag

SEQ ID NO: 480374 - RNA, 11 nt, Homo sapiens
gagcuagaagc

SEQ ID NO: 480375 - RNA, 22 nt, Homo sapiens
gagcucagagagggcaggcaug

SEQ ID NO: 480376 - RNA, 12 nt, Homo sapiens
gagcucucugag

SEQ ID NO: 480377 - RNA, 15 nt, Homo sapiens
gagcugacacaggau

SEQ ID NO: 480378 - RNA, 11 nt, Homo sapiens
gagcuugacuu

SEQ ID NO: 480379 - RNA, 14 nt, Homo sapiens
gaggagcagugcag

SEQ ID NO: 480380 - RNA, 18 nt, Homo sapiens
gaggcagagguugcagug

SEQ ID NO: 480381 - RNA, 22 nt, Homo sapiens
gaggcaggagaaucgcuugaac

SEQ ID NO: 480382 - RNA, 13 nt, Homo sapiens
gaggccacgugau

SEQ ID NO: 480383 - RNA, 19 nt, Homo sapiens
gaggccaguaccuuuccau

SEQ ID NO: 480384 - RNA, 13 nt, Homo sapiens
gaggcuaccucac

SEQ ID NO: 480385 - RNA, 20 nt, Homo sapiens
gaggcuucugauacguguau

SEQ ID NO: 480386 - RNA, 22 nt, Homo sapiens
gaggcuucugauacguguauga

SEQ ID NO: 480387 - RNA, 13 nt, Homo sapiens
gaggugaaggcag

SEQ ID NO: 480388 - RNA, 12 nt, Homo sapiens
gagguguugcua

SEQ ID NO: 480389 - RNA, 13 nt, Homo sapiens
gagguugcaguga

SEQ ID NO: 480390 - RNA, 21 nt, Homo sapiens
gaguaaguguaagaaaaugau

SEQ ID NO: 480391 - RNA, 15 nt, Homo sapiens
gaguacaccccaaca

SEQ ID NO: 480392 - RNA, 19 nt, Homo sapiens
gaguacuggcugauggagu

SEQ ID NO: 480393 - RNA, 18 nt, Homo sapiens
gagugcccccaacagcac

SEQ ID NO: 480394 - RNA, 21 nt, Homo sapiens
gaguuaauauauagaagggua

SEQ ID NO: 480395 - RNA, 16 nt, Homo sapiens
gaguuaguuugaguua

SEQ ID NO: 480396 - RNA, 21 nt, Homo sapiens
gaguuugggaacugcaauaac

SEQ ID NO: 480397 - RNA, 18 nt, Homo sapiens
gauaauauuguggugcca

SEQ ID NO: 480398 - RNA, 20 nt, Homo sapiens
gauacagguauucugcugau

SEQ ID NO: 480399 - RNA, 13 nt, Homo sapiens
gauagagucuugc

SEQ ID NO: 480400 - RNA, 20 nt, Homo sapiens
gaucacgccauugcacucca

SEQ ID NO: 480401 - RNA, 14 nt, Homo sapiens
gugcccuguucucu

SEQ ID NO: 480402 - RNA, 17 nt, Homo sapiens
auuaaaaucacaaacuc

SEQ ID NO: 480403 - RNA, 16 nt, Homo sapiens
auuaacagcugauaca

SEQ ID NO: 480404 - RNA, 17 nt, Homo sapiens
auuaagacaacugaguu

SEQ ID NO: 480405 - RNA, 22 nt, Homo sapiens
auuaagugacuguucaagagca

SEQ ID NO: 480406 - RNA, 18 nt, Homo sapiens
auuacaggcgugagccac

SEQ ID NO: 480407 - RNA, 22 nt, Homo sapiens
auuaccuugugcuaauccucuu

SEQ ID NO: 480408 - RNA, 19 nt, Homo sapiens
auuacgugcaauacuucaa

SEQ ID NO: 480409 - RNA, 12 nt, Homo sapiens
auuagaugacug

SEQ ID NO: 480410 - RNA, 18 nt, Homo sapiens
auuauagugacaaugaag

SEQ ID NO: 480411 - RNA, 20 nt, Homo sapiens
auuaucuaaaguaugaagca

SEQ ID NO: 480412 - RNA, 13 nt, Homo sapiens
auuaugaagucau

SEQ ID NO: 480413 - RNA, 18 nt, Homo sapiens
auuauuggacuuccauuu

SEQ ID NO: 480414 - RNA, 19 nt, Homo sapiens
auuauuuauugcuguguaa

SEQ ID NO: 480415 - RNA, 21 nt, Homo sapiens
auucacccccaaacagugaca

SEQ ID NO: 480416 - RNA, 16 nt, Homo sapiens
auucagccaggagaug

SEQ ID NO: 480417 - RNA, 22 nt, Homo sapiens
auucaggggcugggggugcugg

SEQ ID NO: 480418 - RNA, 13 nt, Homo sapiens
auucauacauuau

SEQ ID NO: 480419 - RNA, 15 nt, Homo sapiens
auucauacauuaucu

SEQ ID NO: 480420 - RNA, 15 nt, Homo sapiens
auucaucaaauggaa

SEQ ID NO: 480421 - RNA, 17 nt, Homo sapiens
auucaucucaaggaaua

SEQ ID NO: 480422 - RNA, 10 nt, Homo sapiens
auucauucca

SEQ ID NO: 480423 - RNA, 22 nt, Homo sapiens
auuccauucuggaagugacuuu

SEQ ID NO: 480424 - RNA, 18 nt, Homo sapiens
auucuaacuuuuuugcua

SEQ ID NO: 480425 - RNA, 21 nt, Homo sapiens
auucucucaggcuugcugcca

SEQ ID NO: 480426 - RNA, 15 nt, Homo sapiens
auucugucacucacc

SEQ ID NO: 480427 - RNA, 22 nt, Homo sapiens
auucuuguuggagacaugggau

SEQ ID NO: 480428 - RNA, 16 nt, Homo sapiens
auugaaguuuugacau

SEQ ID NO: 480429 - RNA, 19 nt, Homo sapiens
auugaaguuuugacaucaa

SEQ ID NO: 480430 - RNA, 19 nt, Homo sapiens
auugacaucagcaucaccu

SEQ ID NO: 480431 - RNA, 15 nt, Homo sapiens
auugagcuacuucag

SEQ ID NO: 480432 - RNA, 14 nt, Homo sapiens
auugaggacacuga

SEQ ID NO: 480433 - RNA, 19 nt, Homo sapiens
auugaggcuuuaaaacuua

SEQ ID NO: 480434 - RNA, 19 nt, Homo sapiens
auugcacucuagccuggca

SEQ ID NO: 480435 - RNA, 15 nt, Homo sapiens
auugcagacugugua

SEQ ID NO: 480436 - RNA, 17 nt, Homo sapiens
auugccuagaggugcuc

SEQ ID NO: 480437 - RNA, 18 nt, Homo sapiens
auuggggaagacuguggc

SEQ ID NO: 480438 - RNA, 23 nt, Homo sapiens
auugugauuauagugacaaugaa

SEQ ID NO: 480439 - RNA, 21 nt, Homo sapiens
auugugugaaagguacuucaa

SEQ ID NO: 480440 - RNA, 22 nt, Homo sapiens
cagaaucccggcugucaagggg

SEQ ID NO: 480441 - RNA, 14 nt, Homo sapiens
cagaaucuuugcaa

SEQ ID NO: 480442 - RNA, 18 nt, Homo sapiens
cagacaggguucauugaa

SEQ ID NO: 480443 - RNA, 18 nt, Homo sapiens
cagaccuguuucuuguaa

SEQ ID NO: 480444 - RNA, 23 nt, Homo sapiens
cagacuaugucacccaaugcaua

SEQ ID NO: 480445 - RNA, 19 nt, Homo sapiens
cagacuauugacaucagca

SEQ ID NO: 480446 - RNA, 20 nt, Homo sapiens
cagagaccaggcugugaaau

SEQ ID NO: 480447 - RNA, 22 nt, Homo sapiens
cagagagggcaggcaugaaguu

SEQ ID NO: 480448 - RNA, 16 nt, Homo sapiens
cagagcagaacuuuca

SEQ ID NO: 480449 - RNA, 16 nt, Homo sapiens
cagagcagagucugaa

SEQ ID NO: 480450 - RNA, 18 nt, Homo sapiens
cagaggaguacaggugaa

SEQ ID NO: 480451 - RNA, 18 nt, Homo sapiens
cagagggaucuuguguac

SEQ ID NO: 480452 - RNA, 18 nt, Homo sapiens
cagaguacuggcugaugg

SEQ ID NO: 480453 - RNA, 16 nt, Homo sapiens
cagagucaaugaacuu

SEQ ID NO: 480454 - RNA, 17 nt, Homo sapiens
cagagucucacucuguu

SEQ ID NO: 480455 - RNA, 17 nt, Homo sapiens
cagaguuccccaugcag

SEQ ID NO: 480456 - RNA, 23 nt, Homo sapiens
cagaguuugauaugggcuuucuc

SEQ ID NO: 480457 - RNA, 23 nt, Homo sapiens
cagaugagaguacaccccaacag

SEQ ID NO: 480458 - RNA, 20 nt, Homo sapiens
cagauguccuugaugcucau

SEQ ID NO: 480459 - RNA, 13 nt, Homo sapiens
cagaugugugauu

SEQ ID NO: 480460 - RNA, 14 nt, Homo sapiens
cagcaaaaugugaa

SEQ ID NO: 480461 - RNA, 20 nt, Homo sapiens
cagcaaaaugugaaugggaa

SEQ ID NO: 480462 - RNA, 17 nt, Homo sapiens
cagcaacagcaaaucac

SEQ ID NO: 480463 - RNA, 13 nt, Homo sapiens
cagcaagucucuu

SEQ ID NO: 480464 - RNA, 14 nt, Homo sapiens
cagcaauagcaucc

SEQ ID NO: 480465 - RNA, 17 nt, Homo sapiens
cagcacccucuccagau

SEQ ID NO: 480466 - RNA, 19 nt, Homo sapiens
cagcacccucuccagauga

SEQ ID NO: 480467 - RNA, 19 nt, Homo sapiens
cagcaugcauucauaacag

SEQ ID NO: 480468 - RNA, 13 nt, Homo sapiens
cagccaagggaug

SEQ ID NO: 480469 - RNA, 20 nt, Homo sapiens
cagccauacggcacugaaca

SEQ ID NO: 480470 - RNA, 13 nt, Homo sapiens
cagccaucaaggg

SEQ ID NO: 480471 - RNA, 19 nt, Homo sapiens
cagccccugauccugugaa

SEQ ID NO: 480472 - RNA, 18 nt, Homo sapiens
cagccucugccgcugcca

SEQ ID NO: 480473 - RNA, 19 nt, Homo sapiens
cagccucugccgcugccau

SEQ ID NO: 480474 - RNA, 20 nt, Homo sapiens
cagccuggccaacauaguga

SEQ ID NO: 480475 - RNA, 19 nt, Homo sapiens
cagcgaguacuucccgcug

SEQ ID NO: 480476 - RNA, 17 nt, Homo sapiens
cagcgggacucuucuca

SEQ ID NO: 480477 - RNA, 18 nt, Homo sapiens
cagcgggacucuucucau

SEQ ID NO: 480478 - RNA, 14 nt, Homo sapiens
cagcguacucauca

SEQ ID NO: 480479 - RNA, 14 nt, Homo sapiens
cagcgugaagggau

SEQ ID NO: 480480 - RNA, 17 nt, Homo sapiens
cagcuaacaauugugaa

SEQ ID NO: 480481 - RNA, 24 nt, Homo sapiens
cagcuacucaggaggcugaggcag

SEQ ID NO: 480482 - RNA, 17 nt, Homo sapiens
cagcuggguggcacugc

SEQ ID NO: 480483 - RNA, 23 nt, Homo sapiens
cagcuggguuggaaaacaguauu

SEQ ID NO: 480484 - RNA, 18 nt, Homo sapiens
cagcuuauugucuaguga

SEQ ID NO: 480485 - RNA, 14 nt, Homo sapiens
cagcuucuacggug

SEQ ID NO: 480486 - RNA, 20 nt, Homo sapiens
cagcuuuucccaaaagccca

SEQ ID NO: 480487 - RNA, 13 nt, Homo sapiens
caggaacauacag

SEQ ID NO: 480488 - RNA, 18 nt, Homo sapiens
caggaacauacagacaca

SEQ ID NO: 480489 - RNA, 20 nt, Homo sapiens
caggacugaucgauuugcac

SEQ ID NO: 480490 - RNA, 14 nt, Homo sapiens
caggagaagggaua

SEQ ID NO: 480491 - RNA, 18 nt, Homo sapiens
caggagaaucacuugaac

SEQ ID NO: 480492 - RNA, 22 nt, Homo sapiens
caggagaggggcagaacagccg

SEQ ID NO: 480493 - RNA, 19 nt, Homo sapiens
caggaguacaccccaacag

SEQ ID NO: 480494 - RNA, 23 nt, Homo sapiens
caggaguuggaagugugugaucu

SEQ ID NO: 480495 - RNA, 23 nt, Homo sapiens
caggcaaugugacuuugcaucag

SEQ ID NO: 480496 - RNA, 19 nt, Homo sapiens
caggcacauaccacugcac

SEQ ID NO: 480497 - RNA, 20 nt, Homo sapiens
caggcagcuuuuucucuccc

SEQ ID NO: 480498 - RNA, 19 nt, Homo sapiens
caggccaggagacuguuaa

SEQ ID NO: 480499 - RNA, 22 nt, Homo sapiens
caggccucuuggcagucacauc

SEQ ID NO: 480500 - RNA, 20 nt, Homo sapiens
caggcgugagccaccgcgcc

SEQ ID NO: 480501 - RNA, 14 nt, Homo sapiens
caggcuagauguau

SEQ ID NO: 480502 - RNA, 20 nt, Homo sapiens
caggcuuucaagaagugcca

SEQ ID NO: 480503 - RNA, 17 nt, Homo sapiens
cagggacccacuucaca

SEQ ID NO: 480504 - RNA, 17 nt, Homo sapiens
cagggauacccagugau

SEQ ID NO: 480505 - RNA, 15 nt, Homo sapiens
cagggcuguguguac

SEQ ID NO: 480506 - RNA, 22 nt, Homo sapiens
caggggcucuuaggcaaucaca

SEQ ID NO: 480507 - RNA, 14 nt, Homo sapiens
cagguccuuuccac

SEQ ID NO: 480508 - RNA, 20 nt, Homo sapiens
cagguccuuuccacccugag

SEQ ID NO: 480509 - RNA, 17 nt, Homo sapiens
caggugugguugcucac

SEQ ID NO: 480510 - RNA, 21 nt, Homo sapiens
caguaaauggcuuauccagcu

SEQ ID NO: 480511 - RNA, 16 nt, Homo sapiens
caguaacgcaggggaa

SEQ ID NO: 480512 - RNA, 18 nt, Homo sapiens
caguaagacgacaaggaa

SEQ ID NO: 480513 - RNA, 22 nt, Homo sapiens
caguauuuuccaaacuaccuuc

SEQ ID NO: 480514 - RNA, 16 nt, Homo sapiens
cagucaccucauggaa

SEQ ID NO: 480515 - RNA, 18 nt, Homo sapiens
caguccaaggaaaccaca

SEQ ID NO: 480516 - RNA, 17 nt, Homo sapiens
cagugagccaagaucac

SEQ ID NO: 480517 - RNA, 15 nt, Homo sapiens
cagugcaaagauuug

SEQ ID NO: 480518 - RNA, 21 nt, Homo sapiens
cagugcaacacugaagcucuu

SEQ ID NO: 480519 - RNA, 14 nt, Homo sapiens
caguggacaccagg

SEQ ID NO: 480520 - RNA, 21 nt, Homo sapiens
cagugggugccccccuugcca

SEQ ID NO: 480521 - RNA, 20 nt, Homo sapiens
caguuauuuuuaaacuguaa

SEQ ID NO: 480522 - RNA, 20 nt, Homo sapiens
caguucagaaucacuucuga

SEQ ID NO: 480523 - RNA, 18 nt, Homo sapiens
caguucugccuuaucuaa

SEQ ID NO: 480524 - RNA, 16 nt, Homo sapiens
caguugaucaaugaau

SEQ ID NO: 480525 - RNA, 18 nt, Homo sapiens
caguuguauaguauauga

SEQ ID NO: 480526 - RNA, 16 nt, Homo sapiens
cauaaauguugacaug

SEQ ID NO: 480527 - RNA, 18 nt, Homo sapiens
cauaagugcaugacauau

SEQ ID NO: 480528 - RNA, 16 nt, Homo sapiens
cauaaugucauacgaa

SEQ ID NO: 480529 - RNA, 19 nt, Homo sapiens
cauaccacccaaugcugau

SEQ ID NO: 480530 - RNA, 19 nt, Homo sapiens
cauacccacacagucacag

SEQ ID NO: 480531 - RNA, 23 nt, Homo sapiens
cauacgaaccuaaagaauaugaa

SEQ ID NO: 480532 - RNA, 22 nt, Homo sapiens
cauacuacaguaacugugacug

SEQ ID NO: 480533 - RNA, 17 nt, Homo sapiens
cauagccauaccuggua

SEQ ID NO: 480534 - RNA, 15 nt, Homo sapiens
cauaggcccagugag

SEQ ID NO: 480535 - RNA, 18 nt, Homo sapiens
cauaguugugcaugccug

SEQ ID NO: 480536 - RNA, 18 nt, Homo sapiens
cauauacucuucaaggac

SEQ ID NO: 480537 - RNA, 15 nt, Homo sapiens
cauauauuuguauga

SEQ ID NO: 480538 - RNA, 14 nt, Homo sapiens
cauauccaacaugu

SEQ ID NO: 480539 - RNA, 18 nt, Homo sapiens
cauauccaacaugugcuc

SEQ ID NO: 480540 - RNA, 15 nt, Homo sapiens
cauauuaaucccucg

SEQ ID NO: 480541 - RNA, 14 nt, Homo sapiens
cauauuguuauuau

SEQ ID NO: 480542 - RNA, 19 nt, Homo sapiens
cauauuuuauuauagucac

SEQ ID NO: 480543 - RNA, 21 nt, Homo sapiens
cauauuuucuuuaaaagacaa

SEQ ID NO: 480544 - RNA, 11 nt, Homo sapiens
caucaaugaug

SEQ ID NO: 480545 - RNA, 17 nt, Homo sapiens
caucauaauucagcucu

SEQ ID NO: 480546 - RNA, 18 nt, Homo sapiens
ccuuagcuuagaccucag

SEQ ID NO: 480547 - RNA, 15 nt, Homo sapiens
ccuucaaacuuccag

SEQ ID NO: 480548 - RNA, 17 nt, Homo sapiens
ccuucccaugacccagg

SEQ ID NO: 480549 - RNA, 16 nt, Homo sapiens
ccuucuuacaaugcau

SEQ ID NO: 480550 - RNA, 11 nt, Homo sapiens
ccuugaugaag

SEQ ID NO: 480551 - RNA, 14 nt, Homo sapiens
ccuugaugcucaua

SEQ ID NO: 480552 - RNA, 15 nt, Homo sapiens
ccuugcucucuucaa

SEQ ID NO: 480553 - RNA, 19 nt, Homo sapiens
ccuugcucucuucaauaaa

SEQ ID NO: 480554 - RNA, 14 nt, Homo sapiens
ccuugcucugccau

SEQ ID NO: 480555 - RNA, 16 nt, Homo sapiens
ccuugggggaagacuu

SEQ ID NO: 480556 - RNA, 13 nt, Homo sapiens
ccuuuccugcaaa

SEQ ID NO: 480557 - RNA, 13 nt, Homo sapiens
ccuuuuuaaggaa

SEQ ID NO: 480558 - RNA, 13 nt, Homo sapiens
cgaagucuuccau

SEQ ID NO: 480559 - RNA, 16 nt, Homo sapiens
cgacaaagcuacuuga

SEQ ID NO: 480560 - RNA, 14 nt, Homo sapiens
cgagucaagugauu

SEQ ID NO: 480561 - RNA, 14 nt, Homo sapiens
cgaucccaucuuga

SEQ ID NO: 480562 - RNA, 19 nt, Homo sapiens
cgcacaauaguaaccuggg

SEQ ID NO: 480563 - RNA, 18 nt, Homo sapiens
cgcagauguccuugaugc

SEQ ID NO: 480564 - RNA, 11 nt, Homo sapiens
cgcaggaccau

SEQ ID NO: 480565 - RNA, 18 nt, Homo sapiens
cgcaguggcucacaccug

SEQ ID NO: 480566 - RNA, 14 nt, Homo sapiens
cgccuuacuggcaa

SEQ ID NO: 480567 - RNA, 11 nt, Homo sapiens
cgcuacuucca

SEQ ID NO: 480568 - RNA, 17 nt, Homo sapiens
cggagaacaaaugugaa

SEQ ID NO: 480569 - RNA, 14 nt, Homo sapiens
cggcucauugaacc

SEQ ID NO: 480570 - RNA, 12 nt, Homo sapiens
cgguaagcacuu

SEQ ID NO: 480571 - RNA, 16 nt, Homo sapiens
cgguggacccagggau

SEQ ID NO: 480572 - RNA, 18 nt, Homo sapiens
guuggaaaaugugcaaua

SEQ ID NO: 480573 - RNA, 19 nt, Homo sapiens
guuggaugcggaacccaaa

SEQ ID NO: 480574 - RNA, 18 nt, Homo sapiens
guuggcugggaacucacc

SEQ ID NO: 480575 - RNA, 13 nt, Homo sapiens
guugguguucuca

SEQ ID NO: 480576 - RNA, 14 nt, Homo sapiens
guuguauugcauau

SEQ ID NO: 480577 - RNA, 20 nt, Homo sapiens
guuuauuugaguauugcuga

SEQ ID NO: 480578 - RNA, 16 nt, Homo sapiens
guuucaaguacuguaa

SEQ ID NO: 480579 - RNA, 20 nt, Homo sapiens
guuucaaguacuguaacugu

SEQ ID NO: 480580 - RNA, 17 nt, Homo sapiens
guuucuccagagggaau

SEQ ID NO: 480581 - RNA, 22 nt, Homo sapiens
guuucucucacauuacuguaua

SEQ ID NO: 480582 - RNA, 20 nt, Homo sapiens
guuucugaucugaugcaagc

SEQ ID NO: 480583 - RNA, 23 nt, Homo sapiens
guuucuuuagcaguuuugugaua

SEQ ID NO: 480584 - RNA, 17 nt, Homo sapiens
guuugaaucacaguaua

SEQ ID NO: 480585 - RNA, 14 nt, Homo sapiens
guuugaguuacuau

SEQ ID NO: 480586 - RNA, 15 nt, Homo sapiens
guuuggccuauucca

SEQ ID NO: 480587 - RNA, 18 nt, Homo sapiens
guuuuaaagcuugcucac

SEQ ID NO: 480588 - RNA, 18 nt, Homo sapiens
guuuuagcacccccaugg

SEQ ID NO: 480589 - RNA, 17 nt, Homo sapiens
guuuucaucaagacugg

SEQ ID NO: 480590 - RNA, 15 nt, Homo sapiens
guuuugcuuaggcac

SEQ ID NO: 480591 - RNA, 19 nt, Homo sapiens
uaaaaaguuucuaaagugu

SEQ ID NO: 480592 - RNA, 20 nt, Homo sapiens
uaaaacauuuucacacaaua

SEQ ID NO: 480593 - RNA, 22 nt, Homo sapiens
uaaaaccccaucucuacuaaaa

SEQ ID NO: 480594 - RNA, 21 nt, Homo sapiens
uaaaagaugcauuaucuauga

SEQ ID NO: 480595 - RNA, 14 nt, Homo sapiens
uaaaauaauaacaa

SEQ ID NO: 480596 - RNA, 20 nt, Homo sapiens
uaaaauauuuuuaugugcaa

SEQ ID NO: 480597 - RNA, 23 nt, Homo sapiens
uaaaaugaccaguaauugugaaa

SEQ ID NO: 480598 - RNA, 22 nt, Homo sapiens
uaaacagaggaguacaggugaa

SEQ ID NO: 480599 - RNA, 12 nt, Homo sapiens
uaaacaugcauu

SEQ ID NO: 480600 - RNA, 17 nt, Homo sapiens
uaaagauaaaauuugau

SEQ ID NO: 480601 - RNA, 22 nt, Homo sapiens
uaaagggagauaacaaucugua

SEQ ID NO: 480602 - RNA, 20 nt, Homo sapiens
uaaaggggcugucucccaau

SEQ ID NO: 480603 - RNA, 15 nt, Homo sapiens
uaaaucaaugcuaua

SEQ ID NO: 480604 - RNA, 23 nt, Homo sapiens
uaaaucauuaagacaacugaguu

SEQ ID NO: 480605 - RNA, 15 nt, Homo sapiens
uaaaugggacuggag

SEQ ID NO: 480606 - RNA, 12 nt, Homo sapiens
uaaauguuaaag

SEQ ID NO: 480607 - RNA, 17 nt, Homo sapiens
uaaauguugacauggga

SEQ ID NO: 480608 - RNA, 20 nt, Homo sapiens
uaaauuaugggaaucaagau

SEQ ID NO: 480609 - RNA, 15 nt, Homo sapiens
uaaauuuuauuccaa

SEQ ID NO: 480610 - RNA, 21 nt, Homo sapiens
uaacagccucauugaugucaa

SEQ ID NO: 480611 - RNA, 21 nt, Homo sapiens
uaaccccuggcaaccaggaau

SEQ ID NO: 480612 - RNA, 24 nt, Homo sapiens
uaaccuggguaaaugcagcgugaa

SEQ ID NO: 480613 - RNA, 14 nt, Homo sapiens
uaacuauugcccag

SEQ ID NO: 480614 - RNA, 19 nt, Homo sapiens
uaacugugacugaugacuu

SEQ ID NO: 480615 - RNA, 22 nt, Homo sapiens
uaacuguuugauuauaacugug

SEQ ID NO: 480616 - RNA, 18 nt, Homo sapiens
uaagaagacugcauuaua

SEQ ID NO: 480617 - RNA, 19 nt, Homo sapiens
uaagaggaugaagugauau

SEQ ID NO: 480618 - RNA, 16 nt, Homo sapiens
uaagcaaagacuauga

SEQ ID NO: 480619 - RNA, 17 nt, Homo sapiens
uaagcauuccaacuauc

SEQ ID NO: 480620 - RNA, 14 nt, Homo sapiens
uaaggcguggagcu

SEQ ID NO: 480621 - RNA, 18 nt, Homo sapiens
uaauacagacuaugucac

SEQ ID NO: 480622 - RNA, 15 nt, Homo sapiens
uaaucaauacuuuga

SEQ ID NO: 480623 - RNA, 18 nt, Homo sapiens
uaaucccaauuuccccug

SEQ ID NO: 480624 - RNA, 19 nt, Homo sapiens
uaauccucuuuuucuaguc

SEQ ID NO: 480625 - RNA, 21 nt, Homo sapiens
uaaucuuucauagccauaccu

SEQ ID NO: 480626 - RNA, 19 nt, Homo sapiens
uaauguagauaaagcacug

SEQ ID NO: 480627 - RNA, 20 nt, Homo sapiens
uaauguagauaaagcacugu

SEQ ID NO: 480628 - RNA, 21 nt, Homo sapiens
uaauguguuuuuaauuaucua

SEQ ID NO: 480629 - RNA, 16 nt, Homo sapiens
uaauuacauauuugca

SEQ ID NO: 480630 - RNA, 23 nt, Homo sapiens
uaauucuagagucucuguuacug

SEQ ID NO: 480631 - RNA, 16 nt, Homo sapiens
uaauucuuuaucacau

SEQ ID NO: 480632 - RNA, 21 nt, Homo sapiens
uaauuugauaguauugugcau

SEQ ID NO: 480633 - RNA, 14 nt, Homo sapiens
uaauuuguaucuga

SEQ ID NO: 480634 - RNA, 18 nt, Homo sapiens
uaauuuguaucugaagga

SEQ ID NO: 480635 - RNA, 21 nt, Homo sapiens
uacaaaauaaagcuguucuca

SEQ ID NO: 480636 - RNA, 19 nt, Homo sapiens
uacaaugcauucugaggua

SEQ ID NO: 480637 - RNA, 15 nt, Homo sapiens
uacacagacuauuga

SEQ ID NO: 480638 - RNA, 15 nt, Homo sapiens
uacaccccaacagca

SEQ ID NO: 480639 - RNA, 19 nt, Homo sapiens
uacaccccaacagcacccu

SEQ ID NO: 480640 - RNA, 20 nt, Homo sapiens
uacagcuggguggcacugcc

SEQ ID NO: 480641 - RNA, 21 nt, Homo sapiens
uacagcuggguggcacugcca

SEQ ID NO: 480642 - RNA, 20 nt, Homo sapiens
uacaggcauagaguucagac

SEQ ID NO: 480643 - RNA, 21 nt, Homo sapiens
uacauaugcaaaaauauaccu

SEQ ID NO: 480644 - RNA, 21 nt, Homo sapiens
uacauauuucuuugccuuuau

SEQ ID NO: 480645 - RNA, 16 nt, Homo sapiens
uacauauuugcauaug

SEQ ID NO: 480646 - RNA, 14 nt, Homo sapiens
uacauuaacuucag

SEQ ID NO: 480647 - RNA, 19 nt, Homo sapiens
uacauuauuggacuuccau

SEQ ID NO: 480648 - RNA, 22 nt, Homo sapiens
uaccaaaaaucucaauauuuca

SEQ ID NO: 480649 - RNA, 17 nt, Homo sapiens
uaccaccagucaauaau

SEQ ID NO: 480650 - RNA, 23 nt, Homo sapiens
uaccuaggauauguuaaauguau

SEQ ID NO: 480651 - RNA, 14 nt, Homo sapiens
uaccugccuuuuau

SEQ ID NO: 480652 - RNA, 16 nt, Homo sapiens
uaccugggaccuccac

SEQ ID NO: 480653 - RNA, 16 nt, Homo sapiens
uaccugggcauacuaa

SEQ ID NO: 480654 - RNA, 18 nt, Homo sapiens
uaccuuuugcuguggcaa

SEQ ID NO: 480655 - RNA, 14 nt, Homo sapiens
uacgugacaacaca

SEQ ID NO: 480656 - RNA, 11 nt, Homo sapiens
uacgugcaaua

SEQ ID NO: 480657 - RNA, 14 nt, Homo sapiens
uacuaaaacauaca

SEQ ID NO: 480658 - RNA, 15 nt, Homo sapiens
uacuaucaugucaaa

SEQ ID NO: 480659 - RNA, 14 nt, Homo sapiens
uacucaaacauguu

SEQ ID NO: 480660 - RNA, 13 nt, Homo sapiens
uacucaucaucaa

SEQ ID NO: 480661 - RNA, 17 nt, Homo sapiens
uacuccaggagacccac

SEQ ID NO: 480662 - RNA, 18 nt, Homo sapiens
uacucuaugugauuuauu

SEQ ID NO: 480663 - RNA, 18 nt, Homo sapiens
uacugguugacauuuuga

SEQ ID NO: 480664 - RNA, 13 nt, Homo sapiens
uacuuacguguga

SEQ ID NO: 480665 - RNA, 21 nt, Homo sapiens
uacuuuuuguaaaaagcuuca

SEQ ID NO: 480666 - RNA, 16 nt, Homo sapiens
uagaaaagaaagcaaa

SEQ ID NO: 480667 - RNA, 16 nt, Homo sapiens
uagaaacacaacuaua

SEQ ID NO: 480668 - RNA, 13 nt, Homo sapiens
uagaaccaggcaa

SEQ ID NO: 480669 - RNA, 11 nt, Homo sapiens
uagaaccugga

SEQ ID NO: 480670 - RNA, 20 nt, Homo sapiens
uagaaggguaccuugaacac

SEQ ID NO: 480671 - RNA, 12 nt, Homo sapiens
uagaaucuggag

SEQ ID NO: 480672 - RNA, 17 nt, Homo sapiens
uagagaucuuaugucaa

SEQ ID NO: 480673 - RNA, 20 nt, Homo sapiens
uagaggauauugggucucag

SEQ ID NO: 480674 - RNA, 23 nt, Homo sapiens
uagaggugcucauucauuuaaca

SEQ ID NO: 480675 - RNA, 20 nt, Homo sapiens
uagauuuggaggcuaccuca

SEQ ID NO: 480676 - RNA, 18 nt, Homo sapiens
uagcaaauuccaauacau

SEQ ID NO: 480677 - RNA, 22 nt, Homo sapiens
uagcagaaaggaaaagauuccu

SEQ ID NO: 480678 - RNA, 14 nt, Homo sapiens
uagcugcuaccuuc

SEQ ID NO: 480679 - RNA, 14 nt, Homo sapiens
uagcuuagaccuca

SEQ ID NO: 480680 - RNA, 15 nt, Homo sapiens
uagcuuagaccucag

SEQ ID NO: 480681 - RNA, 15 nt, Homo sapiens
uaggcaggacaugcu

SEQ ID NO: 480682 - RNA, 17 nt, Homo sapiens
uagggaaaacauuccau

SEQ ID NO: 480683 - RNA, 18 nt, Homo sapiens
uagggcuuauccaugccu

SEQ ID NO: 480684 - RNA, 22 nt, Homo sapiens
uagucacagagauaauucuagc

SEQ ID NO: 480685 - RNA, 14 nt, Homo sapiens
uagugaaacauuug

SEQ ID NO: 480686 - RNA, 19 nt, Homo sapiens
uagugaaguaugcacuaau

SEQ ID NO: 480687 - RNA, 19 nt, Homo sapiens
uaguucuauuucuauccca

SEQ ID NO: 480688 - RNA, 14 nt, Homo sapiens
uauaagugcagaga

SEQ ID NO: 480689 - RNA, 12 nt, Homo sapiens
uauacaugacuu

SEQ ID NO: 480690 - RNA, 20 nt, Homo sapiens
uauaccugggcauacuaaua

SEQ ID NO: 480691 - RNA, 21 nt, Homo sapiens
uauagaaggguaccuugaaca

SEQ ID NO: 480692 - RNA, 21 nt, Homo sapiens
uauagauucuuuauuagugaa

SEQ ID NO: 480693 - RNA, 14 nt, Homo sapiens
uauagcugugugaa

SEQ ID NO: 480694 - RNA, 15 nt, Homo sapiens
uauagugacaaugaa

SEQ ID NO: 480695 - RNA, 21 nt, Homo sapiens
uauagugucuugggaauuuuc

SEQ ID NO: 480696 - RNA, 16 nt, Homo sapiens
uauauaacaacaaacu

SEQ ID NO: 480697 - RNA, 13 nt, Homo sapiens
uauauacaaagaa

SEQ ID NO: 480698 - RNA, 17 nt, Homo sapiens
uauauacaaagaauucu

SEQ ID NO: 480699 - RNA, 13 nt, Homo sapiens
uauaugcacuuau

SEQ ID NO: 480700 - RNA, 11 nt, Homo sapiens
uauccaugccu

SEQ ID NO: 480701 - RNA, 18 nt, Homo sapiens
uauccccaccuacuccug

SEQ ID NO: 480702 - RNA, 15 nt, Homo sapiens
uaucuaaaacaugua

SEQ ID NO: 480703 - RNA, 18 nt, Homo sapiens
uaucuaccucacuauuca

SEQ ID NO: 480704 - RNA, 12 nt, Homo sapiens
uaucuacugugg

SEQ ID NO: 480705 - RNA, 14 nt, Homo sapiens
uaucucacuugugc

SEQ ID NO: 480706 - RNA, 16 nt, Homo sapiens
uaucucggaccuuuca

SEQ ID NO: 480707 - RNA, 14 nt, Homo sapiens
uaucugaguugacu

SEQ ID NO: 480708 - RNA, 18 nt, Homo sapiens
uaucuuugccacccucau

SEQ ID NO: 480709 - RNA, 12 nt, Homo sapiens
uaugcacuaauc

SEQ ID NO: 480710 - RNA, 19 nt, Homo sapiens
uauggcagugucuuuccac

SEQ ID NO: 480711 - RNA, 16 nt, Homo sapiens
uauggccucaagauca

SEQ ID NO: 480712 - RNA, 17 nt, Homo sapiens
ugcuaccucacuggggu

SEQ ID NO: 480713 - RNA, 15 nt, Homo sapiens
ugcuacuagcucuuu

SEQ ID NO: 480714 - RNA, 23 nt, Homo sapiens
ugcuaguaauuggaaaggcagcu

SEQ ID NO: 480715 - RNA, 21 nt, Homo sapiens
uuaagcuaggauguugcucag

SEQ ID NO: 480716 - RNA, 18 nt, Homo sapiens
uuaaggaaaaauaaauau

SEQ ID NO: 480717 - RNA, 19 nt, Homo sapiens
uuaaguugauggugaugaa

SEQ ID NO: 480718 - RNA, 13 nt, Homo sapiens
uuaauaaugugua

SEQ ID NO: 480719 - RNA, 17 nt, Homo sapiens
uuaauuguuaagauaug

SEQ ID NO: 480720 - RNA, 20 nt, Homo sapiens
uuaauuuauugaggcuuuaa

SEQ ID NO: 480721 - RNA, 20 nt, Homo sapiens
uuacagcuggguggcacugc

SEQ ID NO: 480722 - RNA, 22 nt, Homo sapiens
aaaacuguggguagagacuuug

SEQ ID NO: 480723 - RNA, 21 nt, Homo sapiens
aaaagaaagcaaacuuaagaa

SEQ ID NO: 480724 - RNA, 16 nt, Homo sapiens
aaaagaaugauuauga

SEQ ID NO: 480725 - RNA, 20 nt, Homo sapiens
aaaagaaugauuaugaauua

SEQ ID NO: 480726 - RNA, 19 nt, Homo sapiens
aaaagagauggccugagaa

SEQ ID NO: 480727 - RNA, 22 nt, Homo sapiens
aaaagaugcauuaucuaugaua

SEQ ID NO: 480728 - RNA, 17 nt, Homo sapiens
aaaagcccauucauucc

SEQ ID NO: 480729 - RNA, 16 nt, Homo sapiens
aaaagcuucauucuca

SEQ ID NO: 480730 - RNA, 18 nt, Homo sapiens
aaaaggaaggcucuucuc

SEQ ID NO: 480731 - RNA, 12 nt, Homo sapiens
aaaauaaagcug

SEQ ID NO: 480732 - RNA, 20 nt, Homo sapiens
aaaauagaaauauagccaaa

SEQ ID NO: 480733 - RNA, 21 nt, Homo sapiens
aaaauagagaucuuaugucaa

SEQ ID NO: 480734 - RNA, 16 nt, Homo sapiens
aaaaucaaacagagac

SEQ ID NO: 480735 - RNA, 19 nt, Homo sapiens
aaaauggacaaaauccaug

SEQ ID NO: 480736 - RNA, 12 nt, Homo sapiens
aaaaugugcaau

SEQ ID NO: 480737 - RNA, 21 nt, Homo sapiens
aaaauuucacuuaauaaugug

SEQ ID NO: 480738 - RNA, 21 nt, Homo sapiens
aaacacauuaagccuuccaca

SEQ ID NO: 480739 - RNA, 19 nt, Homo sapiens
aaacacccucacacuggga

SEQ ID NO: 480740 - RNA, 20 nt, Homo sapiens
aaacaccuggaggugaaggc

SEQ ID NO: 480741 - RNA, 15 nt, Homo sapiens
aaacagacuauuuaa

SEQ ID NO: 480742 - RNA, 22 nt, Homo sapiens
aaacagacuauuuaacuugagg

SEQ ID NO: 480743 - RNA, 12 nt, Homo sapiens
aaacaggccagg

SEQ ID NO: 480744 - RNA, 21 nt, Homo sapiens
aaacaguccuucaaacuucca

SEQ ID NO: 480745 - RNA, 13 nt, Homo sapiens
aaacauguagaaa

SEQ ID NO: 480746 - RNA, 23 nt, Homo sapiens
aaacaugugguuaaugccaugga

SEQ ID NO: 480747 - RNA, 16 nt, Homo sapiens
aaacauuuaucuuugu

SEQ ID NO: 480748 - RNA, 14 nt, Homo sapiens
aaaccaaaucacug

SEQ ID NO: 480749 - RNA, 19 nt, Homo sapiens
aaaccuugugcucuuuuca

SEQ ID NO: 480750 - RNA, 17 nt, Homo sapiens
aaacuaccuuccaguuc

SEQ ID NO: 480751 - RNA, 12 nt, Homo sapiens
aaacucauccau

SEQ ID NO: 480752 - RNA, 19 nt, Homo sapiens
aaacugaggcccuugggca

SEQ ID NO: 480753 - RNA, 22 nt, Homo sapiens
aaacugucaaagaaucaaucca

SEQ ID NO: 480754 - RNA, 17 nt, Homo sapiens
aaacuuaggcaugcaca

SEQ ID NO: 480755 - RNA, 20 nt, Homo sapiens
aaacuuauccuccaugaaua

SEQ ID NO: 480756 - RNA, 19 nt, Homo sapiens
aaacuuauuugagugauua

SEQ ID NO: 480757 - RNA, 13 nt, Homo sapiens
aaacuucaagggu

SEQ ID NO: 480758 - RNA, 13 nt, Homo sapiens
aaacuucaauauc

SEQ ID NO: 480759 - RNA, 19 nt, Homo sapiens
aaagaaggcuggcugaaag

SEQ ID NO: 480760 - RNA, 22 nt, Homo sapiens
aaagaugcauuaucuaugauau

SEQ ID NO: 480761 - RNA, 15 nt, Homo sapiens
aaagcccauucauuc

SEQ ID NO: 480762 - RNA, 19 nt, Homo sapiens
aaagccuccaguccaagga

SEQ ID NO: 480763 - RNA, 17 nt, Homo sapiens
aaagcguggacaggugu

SEQ ID NO: 480764 - RNA, 21 nt, Homo sapiens
aaagcuguucucauuccuguu

SEQ ID NO: 480765 - RNA, 20 nt, Homo sapiens
aaagcuuuggugccuggaaa

SEQ ID NO: 480766 - RNA, 14 nt, Homo sapiens
aaaggaauccacuc

SEQ ID NO: 480767 - RNA, 14 nt, Homo sapiens
aaagguccuggcaa

SEQ ID NO: 480768 - RNA, 15 nt, Homo sapiens
aaaggugcugagaaa

SEQ ID NO: 480769 - RNA, 14 nt, Homo sapiens
aaagucaacaugua

SEQ ID NO: 480770 - RNA, 16 nt, Homo sapiens
aaagugauaugcauuu

SEQ ID NO: 480771 - RNA, 13 nt, Homo sapiens
aaaguucuaguga

SEQ ID NO: 480772 - RNA, 21 nt, Homo sapiens
aaaguucuuaggcaccauaga

SEQ ID NO: 480773 - RNA, 19 nt, Homo sapiens
aaauaauaacaaucacaaa

SEQ ID NO: 480774 - RNA, 18 nt, Homo sapiens
aaauaugccccauucaac

SEQ ID NO: 480775 - RNA, 22 nt, Homo sapiens
aaauaugcucagccacccugug

SEQ ID NO: 480776 - RNA, 11 nt, Homo sapiens
aaauauguaac

SEQ ID NO: 480777 - RNA, 19 nt, Homo sapiens
aaaucacgaccacugauag

SEQ ID NO: 480778 - RNA, 21 nt, Homo sapiens
aaaucauauccuaugacccag

SEQ ID NO: 480779 - RNA, 15 nt, Homo sapiens
aaauccccuccccaa

SEQ ID NO: 480780 - RNA, 16 nt, Homo sapiens
aaauccccuccccaaa

SEQ ID NO: 480781 - RNA, 19 nt, Homo sapiens
aaaugacaagugagacaaa

SEQ ID NO: 480782 - RNA, 19 nt, Homo sapiens
aaaugagccccuucauccg

SEQ ID NO: 480783 - RNA, 22 nt, Homo sapiens
aaaugcuguauuagucacagag

SEQ ID NO: 480784 - RNA, 19 nt, Homo sapiens
aaauggaagacacauugaa

SEQ ID NO: 480785 - RNA, 21 nt, Homo sapiens
aaaugggacugaugucaucuu

SEQ ID NO: 480786 - RNA, 19 nt, Homo sapiens
aaauguuaacagaguuuga

SEQ ID NO: 480787 - RNA, 19 nt, Homo sapiens
aaauguuguuuuaggaaua

SEQ ID NO: 480788 - RNA, 13 nt, Homo sapiens
aaauuaaagcuga

SEQ ID NO: 480789 - RNA, 15 nt, Homo sapiens
aaauuagcugggcau

SEQ ID NO: 480790 - RNA, 22 nt, Homo sapiens
aaauuaguauagcuacuuugga

SEQ ID NO: 480791 - RNA, 17 nt, Homo sapiens
aaauucccuucaucugg

SEQ ID NO: 480792 - RNA, 23 nt, Homo sapiens
aaauuccuuagcuuagaccucag

SEQ ID NO: 480793 - RNA, 17 nt, Homo sapiens
aaauugaacuucaggga

SEQ ID NO: 480794 - RNA, 13 nt, Homo sapiens
aaauuguauagag

SEQ ID NO: 480795 - RNA, 16 nt, Homo sapiens
aacaaaagcucaucca

SEQ ID NO: 480796 - RNA, 12 nt, Homo sapiens
aacaaaaugauc

SEQ ID NO: 480797 - RNA, 16 nt, Homo sapiens
aacaacucgaaucacu

SEQ ID NO: 480798 - RNA, 23 nt, Homo sapiens
aacacaaugccucaucuucccug

SEQ ID NO: 480799 - RNA, 18 nt, Homo sapiens
aacacaauuguaaguaau

SEQ ID NO: 480800 - RNA, 15 nt, Homo sapiens
aacacauuaagccuu

SEQ ID NO: 480801 - RNA, 19 nt, Homo sapiens
aacacguuuuuucacuauu

SEQ ID NO: 480802 - RNA, 19 nt, Homo sapiens
aacagaggaguacagguga

SEQ ID NO: 480803 - RNA, 15 nt, Homo sapiens
aacagaugugucagc

SEQ ID NO: 480804 - RNA, 13 nt, Homo sapiens
aacagcaaaucac

SEQ ID NO: 480805 - RNA, 19 nt, Homo sapiens
aacagcaauagugaaugaa

SEQ ID NO: 480806 - RNA, 15 nt, Homo sapiens
auaaucuuucacagg

SEQ ID NO: 480807 - RNA, 15 nt, Homo sapiens
auacagagcucucug

SEQ ID NO: 480808 - RNA, 22 nt, Homo sapiens
auacaggacauucucaucacca

SEQ ID NO: 480809 - RNA, 12 nt, Homo sapiens
auacagugucuu

SEQ ID NO: 480810 - RNA, 17 nt, Homo sapiens
auacaguuugucacaug

SEQ ID NO: 480811 - RNA, 13 nt, Homo sapiens
auacggcacugaa

SEQ ID NO: 480812 - RNA, 17 nt, Homo sapiens
auacucuucaaggacuu

SEQ ID NO: 480813 - RNA, 21 nt, Homo sapiens
auagagaaaaaaauucaugca

SEQ ID NO: 480814 - RNA, 18 nt, Homo sapiens
auagagaucuuaugucaa

SEQ ID NO: 480815 - RNA, 16 nt, Homo sapiens
auagaucaaaugcccu

SEQ ID NO: 480816 - RNA, 18 nt, Homo sapiens
auaggcaggaacauacag

SEQ ID NO: 480817 - RNA, 15 nt, Homo sapiens
auauagaacagugcu

SEQ ID NO: 480818 - RNA, 17 nt, Homo sapiens
auauaguggacaguaac

SEQ ID NO: 480819 - RNA, 18 nt, Homo sapiens
auaucaagagacauggua

SEQ ID NO: 480820 - RNA, 17 nt, Homo sapiens
auauccaacaugugcuc

SEQ ID NO: 480821 - RNA, 22 nt, Homo sapiens
auauccaacaugugcucaggga

SEQ ID NO: 480822 - RNA, 14 nt, Homo sapiens
auaucuacuguggu

SEQ ID NO: 480823 - RNA, 18 nt, Homo sapiens
auaucucuuuuauuucac

SEQ ID NO: 480824 - RNA, 22 nt, Homo sapiens
auaucucuuuuauuucacucaa

SEQ ID NO: 480825 - RNA, 13 nt, Homo sapiens
auaugagcuuuau

SEQ ID NO: 480826 - RNA, 19 nt, Homo sapiens
auaugcacuuauucucaag

SEQ ID NO: 480827 - RNA, 18 nt, Homo sapiens
auaugcuaacccccaaau

SEQ ID NO: 480828 - RNA, 14 nt, Homo sapiens
auaugggguuggug

SEQ ID NO: 480829 - RNA, 20 nt, Homo sapiens
auaugggguugguguucuca

SEQ ID NO: 480830 - RNA, 21 nt, Homo sapiens
auauguauuacuuacacuaua

SEQ ID NO: 480831 - RNA, 22 nt, Homo sapiens
auauuagacaaaguucauucaa

SEQ ID NO: 480832 - RNA, 18 nt, Homo sapiens
auauuaugaccacacaca

SEQ ID NO: 480833 - RNA, 23 nt, Homo sapiens
auauuguuugcuaagcauuccaa

SEQ ID NO: 480834 - RNA, 16 nt, Homo sapiens
auauuugguuuggcca

SEQ ID NO: 480835 - RNA, 13 nt, Homo sapiens
auauuuuauacau

SEQ ID NO: 480836 - RNA, 15 nt, Homo sapiens
aucaacccuaaaaag

SEQ ID NO: 480837 - RNA, 22 nt, Homo sapiens
aucaagauuuaauccuagagau

SEQ ID NO: 480838 - RNA, 23 nt, Homo sapiens
aucaagcuggaguacgugaaaug

SEQ ID NO: 480839 - RNA, 16 nt, Homo sapiens
aucacaaacucaucca

SEQ ID NO: 480840 - RNA, 13 nt, Homo sapiens
aucacacaacuca

SEQ ID NO: 480841 - RNA, 17 nt, Homo sapiens
aucaccuccaccauacu

SEQ ID NO: 480842 - RNA, 21 nt, Homo sapiens
aucacgccauugcacuccagc

SEQ ID NO: 480843 - RNA, 19 nt, Homo sapiens
aucacucauuuauuuccau

SEQ ID NO: 480844 - RNA, 17 nt, Homo sapiens
aucacuuccuauaugca

SEQ ID NO: 480845 - RNA, 19 nt, Homo sapiens
aucagagacaguaucucua

SEQ ID NO: 480846 - RNA, 17 nt, Homo sapiens
aucaguccaaagggcau

SEQ ID NO: 480847 - RNA, 15 nt, Homo sapiens
aucaucaacccuaaa

SEQ ID NO: 480848 - RNA, 11 nt, Homo sapiens
auccacccacc

SEQ ID NO: 480849 - RNA, 13 nt, Homo sapiens
auccacuccuucc

SEQ ID NO: 480850 - RNA, 14 nt, Homo sapiens
auccacuccuuccu

SEQ ID NO: 480851 - RNA, 21 nt, Homo sapiens
aucccggcugucaaggggugu

SEQ ID NO: 480852 - RNA, 17 nt, Homo sapiens
auccuagucucuaucau

SEQ ID NO: 480853 - RNA, 22 nt, Homo sapiens
auccuagucucuaucauuaaag

SEQ ID NO: 480854 - RNA, 19 nt, Homo sapiens
auccuguucucugaagaug

SEQ ID NO: 480855 - RNA, 18 nt, Homo sapiens
auccuguuuuuaaaccau

SEQ ID NO: 480856 - RNA, 16 nt, Homo sapiens
auccuuuauagcuuug

SEQ ID NO: 480857 - RNA, 13 nt, Homo sapiens
aucgauuugcacc

SEQ ID NO: 480858 - RNA, 17 nt, Homo sapiens
aucgauuugcacccacc

SEQ ID NO: 480859 - RNA, 15 nt, Homo sapiens
aucgcugucaucuca

SEQ ID NO: 480860 - RNA, 22 nt, Homo sapiens
aucgcugucaucucagcuggau

SEQ ID NO: 480861 - RNA, 16 nt, Homo sapiens
aucuaugccacucaga

SEQ ID NO: 480862 - RNA, 14 nt, Homo sapiens
aucucccacacaag

SEQ ID NO: 480863 - RNA, 16 nt, Homo sapiens
aucucucuagugaugg

SEQ ID NO: 480864 - RNA, 22 nt, Homo sapiens
aucucugcuuuggaaaucacac

SEQ ID NO: 480865 - RNA, 17 nt, Homo sapiens
aucucuggaugccugau

SEQ ID NO: 480866 - RNA, 15 nt, Homo sapiens
aucucuuuccuccua

SEQ ID NO: 480867 - RNA, 22 nt, Homo sapiens
aucugcuuuugguuauaaugug

SEQ ID NO: 480868 - RNA, 23 nt, Homo sapiens
aucugcuuuugguuauaaugugu

SEQ ID NO: 480869 - RNA, 17 nt, Homo sapiens
aucugggugacugagca

SEQ ID NO: 480870 - RNA, 15 nt, Homo sapiens
aucugguugugauuu

SEQ ID NO: 480871 - RNA, 19 nt, Homo sapiens
aucuuugcaagaaagucag

SEQ ID NO: 480872 - RNA, 13 nt, Homo sapiens
augaaaaugucau

SEQ ID NO: 480873 - RNA, 13 nt, Homo sapiens
augaaagaggcau

SEQ ID NO: 480874 - RNA, 16 nt, Homo sapiens
augaaauaucaugcuc

SEQ ID NO: 480875 - RNA, 20 nt, Homo sapiens
augaacuauggacggugcuc

SEQ ID NO: 480876 - RNA, 15 nt, Homo sapiens
augaagaugaugcua

SEQ ID NO: 480877 - RNA, 19 nt, Homo sapiens
augaagggaugcugcaaug

SEQ ID NO: 480878 - RNA, 21 nt, Homo sapiens
augaagggaugcugcaaugua

SEQ ID NO: 480879 - RNA, 21 nt, Homo sapiens
augaagguuucugaaaauuaa

SEQ ID NO: 480880 - RNA, 16 nt, Homo sapiens
augaaguccaagcauu

SEQ ID NO: 480881 - RNA, 20 nt, Homo sapiens
augacauccaauacagaguu

SEQ ID NO: 480882 - RNA, 16 nt, Homo sapiens
augacauggugaaaau

SEQ ID NO: 480883 - RNA, 19 nt, Homo sapiens
augacuaaagcagggacaa

SEQ ID NO: 480884 - RNA, 13 nt, Homo sapiens
augacuuuuccau

SEQ ID NO: 480885 - RNA, 15 nt, Homo sapiens
augagacuacuucag

SEQ ID NO: 480886 - RNA, 22 nt, Homo sapiens
augagacuacuucagaaucaga

SEQ ID NO: 480887 - RNA, 22 nt, Homo sapiens
augagacuaugcaaaaguacaa

SEQ ID NO: 480888 - RNA, 20 nt, Homo sapiens
augagaguagagggcacugg

SEQ ID NO: 480889 - RNA, 22 nt, Homo sapiens
augaggucauagcagugcuuga

SEQ ID NO: 480890 - RNA, 22 nt, Homo sapiens
augagguuggaaagaguugcca

SEQ ID NO: 480891 - RNA, 15 nt, Homo sapiens
augcaacaacaugua

SEQ ID NO: 480892 - RNA, 16 nt, Homo sapiens
augcaacaacauguau

SEQ ID NO: 480893 - RNA, 13 nt, Homo sapiens
augcagacaugag

SEQ ID NO: 480894 - RNA, 16 nt, Homo sapiens
augcagcaucuaagua

SEQ ID NO: 480895 - RNA, 18 nt, Homo sapiens
augcagccccaucuccuc

SEQ ID NO: 480896 - RNA, 13 nt, Homo sapiens
augcagcgugaag

SEQ ID NO: 480897 - RNA, 13 nt, Homo sapiens
augcauguucaaa

SEQ ID NO: 480898 - RNA, 17 nt, Homo sapiens
augccaccuccuggaag

SEQ ID NO: 480899 - RNA, 19 nt, Homo sapiens
augccucauuaccuugugc

SEQ ID NO: 480900 - RNA, 16 nt, Homo sapiens
augccugauugccaag

SEQ ID NO: 480901 - RNA, 17 nt, Homo sapiens
augccugauugccaagc

SEQ ID NO: 480902 - RNA, 18 nt, Homo sapiens
augcgagugcucauuuca

SEQ ID NO: 480903 - RNA, 15 nt, Homo sapiens
augcguuuaaucaca

SEQ ID NO: 480904 - RNA, 23 nt, Homo sapiens
augcuaacccccaaauacucuga

SEQ ID NO: 480905 - RNA, 20 nt, Homo sapiens
augcuaguagcagugagcaa

SEQ ID NO: 480906 - RNA, 18 nt, Homo sapiens
augcuuuaagugcacaac

SEQ ID NO: 480907 - RNA, 21 nt, Homo sapiens
auggacaugaagggaugcugc

SEQ ID NO: 480908 - RNA, 21 nt, Homo sapiens
auggagcuguauaacugugca

SEQ ID NO: 480909 - RNA, 22 nt, Homo sapiens
auggcacagcccaaagaaggaa

SEQ ID NO: 480910 - RNA, 22 nt, Homo sapiens
auggcacuaguauuucuaugaa

SEQ ID NO: 480911 - RNA, 13 nt, Homo sapiens
auggccucaagau

SEQ ID NO: 480912 - RNA, 14 nt, Homo sapiens
auggcucuaaaaag

SEQ ID NO: 480913 - RNA, 22 nt, Homo sapiens
auggcuguaaaucuauuggcca

SEQ ID NO: 480914 - RNA, 17 nt, Homo sapiens
augggacugaugucauc

SEQ ID NO: 480915 - RNA, 23 nt, Homo sapiens
augggagcauaugugagaaauaa

SEQ ID NO: 480916 - RNA, 22 nt, Homo sapiens
auggguuagggaaaacauucca

SEQ ID NO: 480917 - RNA, 20 nt, Homo sapiens
augguagugggugccuguaa

SEQ ID NO: 480918 - RNA, 21 nt, Homo sapiens
auggugaaaccccgucuguac

SEQ ID NO: 480919 - RNA, 19 nt, Homo sapiens
augguggggcaugccugua

SEQ ID NO: 480920 - RNA, 21 nt, Homo sapiens
augguuugcaaggaagccaca

SEQ ID NO: 480921 - RNA, 20 nt, Homo sapiens
aauuauauuuugaacaacuc

SEQ ID NO: 480922 - RNA, 17 nt, Homo sapiens
aauucaucucucuuuaa

SEQ ID NO: 480923 - RNA, 19 nt, Homo sapiens
aauucaugcaucucaacaa

SEQ ID NO: 480924 - RNA, 13 nt, Homo sapiens
aauuccaauacau

SEQ ID NO: 480925 - RNA, 16 nt, Homo sapiens
aauuccaauacauuau

SEQ ID NO: 480926 - RNA, 19 nt, Homo sapiens
aauucuauuacgugcaaua

SEQ ID NO: 480927 - RNA, 16 nt, Homo sapiens
aauucuccugccucag

SEQ ID NO: 480928 - RNA, 22 nt, Homo sapiens
aauucugucacucaccacuaca

SEQ ID NO: 480929 - RNA, 19 nt, Homo sapiens
aauucuuacaaacaugugg

SEQ ID NO: 480930 - RNA, 19 nt, Homo sapiens
aauuuaaucuuccauggau

SEQ ID NO: 480931 - RNA, 12 nt, Homo sapiens
aauuucacuuaa

SEQ ID NO: 480932 - RNA, 13 nt, Homo sapiens
aauuuucuuccaa

SEQ ID NO: 480933 - RNA, 17 nt, Homo sapiens
acaaaauccaugaacaa

SEQ ID NO: 480934 - RNA, 19 nt, Homo sapiens
acaaacacuuagcauccca

SEQ ID NO: 480935 - RNA, 14 nt, Homo sapiens
acaaacaugugguu

SEQ ID NO: 480936 - RNA, 13 nt, Homo sapiens
acaaacucaucca

SEQ ID NO: 480937 - RNA, 21 nt, Homo sapiens
acaaauaaguggaaaccgugu

SEQ ID NO: 480938 - RNA, 18 nt, Homo sapiens
acaaauaaguuacccuca

SEQ ID NO: 480939 - RNA, 13 nt, Homo sapiens
acaaauguaugau

SEQ ID NO: 480940 - RNA, 18 nt, Homo sapiens
acaaauguuuagugaaac

SEQ ID NO: 480941 - RNA, 19 nt, Homo sapiens
acaacaucaagccugugau

SEQ ID NO: 480942 - RNA, 17 nt, Homo sapiens
acaacauguauaauauu

SEQ ID NO: 480943 - RNA, 22 nt, Homo sapiens
acaagaccaucuacauacacag

SEQ ID NO: 480944 - RNA, 20 nt, Homo sapiens
acaagcaauuagacaagaac

SEQ ID NO: 480945 - RNA, 22 nt, Homo sapiens
acaagcaggcucaacauaacau

SEQ ID NO: 480946 - RNA, 16 nt, Homo sapiens
acaaggcgaucccauc

SEQ ID NO: 480947 - RNA, 15 nt, Homo sapiens
acaauagaaaccugu

SEQ ID NO: 480948 - RNA, 18 nt, Homo sapiens
acaaugacuaaagacaua

SEQ ID NO: 480949 - RNA, 19 nt, Homo sapiens
acaauuaaugaaauaauua

SEQ ID NO: 480950 - RNA, 22 nt, Homo sapiens
acaauuguaaaauuuaaaucau

SEQ ID NO: 480951 - RNA, 14 nt, Homo sapiens
acaauugugaaguc

SEQ ID NO: 480952 - RNA, 13 nt, Homo sapiens
acaauuuaugaau

SEQ ID NO: 480953 - RNA, 13 nt, Homo sapiens
acacaacaacucc

SEQ ID NO: 480954 - RNA, 15 nt, Homo sapiens
acacaccaucuuucc

SEQ ID NO: 480955 - RNA, 19 nt, Homo sapiens
acacagagcaggacugcac

SEQ ID NO: 480956 - RNA, 13 nt, Homo sapiens
acacauacagagc

SEQ ID NO: 480957 - RNA, 19 nt, Homo sapiens
acacaugaaguccaagcau

SEQ ID NO: 480958 - RNA, 17 nt, Homo sapiens
acacauuaagccuucca

SEQ ID NO: 480959 - RNA, 16 nt, Homo sapiens
acaccagguagaacac

SEQ ID NO: 480960 - RNA, 21 nt, Homo sapiens
acaccuggaggugaaggcaga

SEQ ID NO: 480961 - RNA, 21 nt, Homo sapiens
acaccuguaaucccagcacuu

SEQ ID NO: 480962 - RNA, 23 nt, Homo sapiens
acacgggggcagcugauacaaau

SEQ ID NO: 480963 - RNA, 14 nt, Homo sapiens
acacugaagcucuu

SEQ ID NO: 480964 - RNA, 15 nt, Homo sapiens
acacugcaggcauca

SEQ ID NO: 480965 - RNA, 21 nt, Homo sapiens
ugcucucuucaauaaaccaca

SEQ ID NO: 480966 - RNA, 19 nt, Homo sapiens
ugcuguccccuuccagggg

SEQ ID NO: 480967 - RNA, 21 nt, Homo sapiens
ugcuuaggcacucauggguaa

SEQ ID NO: 480968 - RNA, 16 nt, Homo sapiens
ugcuucgcagaugucc

SEQ ID NO: 480969 - RNA, 10 nt, Homo sapiens
ugcuugccau

SEQ ID NO: 480970 - RNA, 12 nt, Homo sapiens
ugcuugccaucc

SEQ ID NO: 480971 - RNA, 20 nt, Homo sapiens
ugcuuguaaaauuucacuua

SEQ ID NO: 480972 - RNA, 15 nt, Homo sapiens
ugcuuucuaucuaau

SEQ ID NO: 480973 - RNA, 22 nt, Homo sapiens
uggaaaaguauguuagugcaaa

SEQ ID NO: 480974 - RNA, 14 nt, Homo sapiens
uggaaaauauguaa

SEQ ID NO: 480975 - RNA, 18 nt, Homo sapiens
uggaaagaugaaugcaau

SEQ ID NO: 480976 - RNA, 16 nt, Homo sapiens
uggaacucaaggaaau

SEQ ID NO: 480977 - RNA, 22 nt, Homo sapiens
uggaagacagagaccuccugcc

SEQ ID NO: 480978 - RNA, 13 nt, Homo sapiens
uggaaucuuguaa

SEQ ID NO: 480979 - RNA, 14 nt, Homo sapiens
uggaauuggagcuc

SEQ ID NO: 480980 - RNA, 22 nt, Homo sapiens
uggacagugggcaucagcagca

SEQ ID NO: 480981 - RNA, 17 nt, Homo sapiens
uggacuuaacucuaauu

SEQ ID NO: 480982 - RNA, 15 nt, Homo sapiens
uggacuuccauuugg

SEQ ID NO: 480983 - RNA, 18 nt, Homo sapiens
uggacuugaggauuuuga

SEQ ID NO: 480984 - RNA, 13 nt, Homo sapiens
uggagaagcuccc

SEQ ID NO: 480985 - RNA, 15 nt, Homo sapiens
uggagaauugaaaag

SEQ ID NO: 480986 - RNA, 18 nt, Homo sapiens
uggagcagccaacaagca

SEQ ID NO: 480987 - RNA, 22 nt, Homo sapiens
uggaggcuucugauacguguau

SEQ ID NO: 480988 - RNA, 15 nt, Homo sapiens
uggagugccuguaca

SEQ ID NO: 480989 - RNA, 19 nt, Homo sapiens
uggaucuccauucucucag

SEQ ID NO: 480990 - RNA, 13 nt, Homo sapiens
uggauuuugucaa

SEQ ID NO: 480991 - RNA, 18 nt, Homo sapiens
uggcaacaucuugcaaaa

SEQ ID NO: 480992 - RNA, 18 nt, Homo sapiens
uggcaaggacacagauga

SEQ ID NO: 480993 - RNA, 23 nt, Homo sapiens
uggcaauaggugugaacagggaa

SEQ ID NO: 480994 - RNA, 19 nt, Homo sapiens
uggcaccuuaguugcauga

SEQ ID NO: 480995 - RNA, 16 nt, Homo sapiens
uggccaacaugaugaa

SEQ ID NO: 480996 - RNA, 18 nt, Homo sapiens
uggcccucgcucugccuc

SEQ ID NO: 480997 - RNA, 15 nt, Homo sapiens
uggcccucuuugaaa

SEQ ID NO: 480998 - RNA, 19 nt, Homo sapiens
uggcccucuuugaaagggc

SEQ ID NO: 480999 - RNA, 14 nt, Homo sapiens
uggcgcuggcugcg

SEQ ID NO: 481000 - RNA, 14 nt, Homo sapiens
uggcuauuauuuga

SEQ ID NO: 481001 - RNA, 16 nt, Homo sapiens
uggcucacgccuguaa

SEQ ID NO: 481002 - RNA, 15 nt, Homo sapiens
uggcucuacuuucag

SEQ ID NO: 481003 - RNA, 19 nt, Homo sapiens
uggcugauuaucaccaucc

SEQ ID NO: 481004 - RNA, 14 nt, Homo sapiens
uggcuuacuccagg

SEQ ID NO: 481005 - RNA, 21 nt, Homo sapiens
uggcuucacagaugugugauu

SEQ ID NO: 481006 - RNA, 23 nt, Homo sapiens
uggcuucacagaugugugauuca

SEQ ID NO: 481007 - RNA, 16 nt, Homo sapiens
ugggaaagggcuguua

SEQ ID NO: 481008 - RNA, 15 nt, Homo sapiens
ugggaacugcaauaa

SEQ ID NO: 481009 - RNA, 21 nt, Homo sapiens
ugggacaaaacagaaguccau

SEQ ID NO: 481010 - RNA, 21 nt, Homo sapiens
ugggacagucaccucauggaa

SEQ ID NO: 481011 - RNA, 22 nt, Homo sapiens
ugggacagucaccucauggaau

SEQ ID NO: 481012 - RNA, 20 nt, Homo sapiens
ugggacauuugcucauggaa

SEQ ID NO: 481013 - RNA, 16 nt, Homo sapiens
ugggacugaugucauc

SEQ ID NO: 481014 - RNA, 20 nt, Homo sapiens
ugggaggcagagguugcagu

SEQ ID NO: 481015 - RNA, 12 nt, Homo sapiens
ugggcagcugcc

SEQ ID NO: 481016 - RNA, 21 nt, Homo sapiens
ugggccgggcaauccagacag

SEQ ID NO: 481017 - RNA, 23 nt, Homo sapiens
uggggacagagcagaacuuucac

SEQ ID NO: 481018 - RNA, 18 nt, Homo sapiens
uggggcuuuuacaccagu

SEQ ID NO: 481019 - RNA, 15 nt, Homo sapiens
ugggggaaagcacag

SEQ ID NO: 481020 - RNA, 23 nt, Homo sapiens
ugggggaagaccuggcaaggaca

SEQ ID NO: 481021 - RNA, 15 nt, Homo sapiens
ugggggaagacuuua

SEQ ID NO: 481022 - RNA, 22 nt, Homo sapiens
uggguauaaaggcuaaaaggga

SEQ ID NO: 481023 - RNA, 22 nt, Homo sapiens
ugggucaggaggaaaagacuaa

SEQ ID NO: 481024 - RNA, 14 nt, Homo sapiens
ugggugucugcuaa

SEQ ID NO: 481025 - RNA, 12 nt, Homo sapiens
ugguaugaaggu

SEQ ID NO: 481026 - RNA, 14 nt, Homo sapiens
uggugaaaugcaga

SEQ ID NO: 481027 - RNA, 17 nt, Homo sapiens
uggugaaaugcagaguc

SEQ ID NO: 481028 - RNA, 17 nt, Homo sapiens
ugguguuaaucauuuca

SEQ ID NO: 481029 - RNA, 15 nt, Homo sapiens
ugguguucucaucua

SEQ ID NO: 481030 - RNA, 19 nt, Homo sapiens
ugguuuggaguuuauuuga

SEQ ID NO: 481031 - RNA, 23 nt, Homo sapiens
uguaaaauuuaaaucauauccua

SEQ ID NO: 481032 - RNA, 17 nt, Homo sapiens
uguacauuagucauuca

SEQ ID NO: 481033 - RNA, 15 nt, Homo sapiens
uguagacucuggaag

SEQ ID NO: 481034 - RNA, 15 nt, Homo sapiens
uguagauaaagcacu

SEQ ID NO: 481035 - RNA, 17 nt, Homo sapiens
uguagauaaagcacugu

SEQ ID NO: 481036 - RNA, 18 nt, Homo sapiens
uguagucccagcuacuca

SEQ ID NO: 481037 - RNA, 23 nt, Homo sapiens
uguauagcugugugaacguguau

SEQ ID NO: 481038 - RNA, 19 nt, Homo sapiens
uguaucuaccucacuauuc

SEQ ID NO: 481039 - RNA, 23 nt, Homo sapiens
uguaugacucccaaauuuucaca

SEQ ID NO: 481040 - RNA, 20 nt, Homo sapiens
uguaugauuacaucaaggcu

SEQ ID NO: 481041 - RNA, 19 nt, Homo sapiens
uguaugccaagugaaaaaa

SEQ ID NO: 481042 - RNA, 15 nt, Homo sapiens
ugucaugucagcucc

SEQ ID NO: 481043 - RNA, 18 nt, Homo sapiens
ugucuacguuaccaggca

SEQ ID NO: 481044 - RNA, 16 nt, Homo sapiens
ugucuccuuaacacug

SEQ ID NO: 481045 - RNA, 19 nt, Homo sapiens
ugucuguaaugacaaauaa

SEQ ID NO: 481046 - RNA, 21 nt, Homo sapiens
ugucuguaaugacaaauaagu

SEQ ID NO: 481047 - RNA, 23 nt, Homo sapiens
ugucuuacagagaaaagacauaa

SEQ ID NO: 481048 - RNA, 15 nt, Homo sapiens
ugucuuauuugcuau

SEQ ID NO: 481049 - RNA, 19 nt, Homo sapiens
ugugaacauggacucuucc

SEQ ID NO: 481050 - RNA, 16 nt, Homo sapiens
ugugaacccaaagugu

SEQ ID NO: 481051 - RNA, 13 nt, Homo sapiens
ugugacuuuccua

SEQ ID NO: 481052 - RNA, 14 nt, Homo sapiens
ugugagcagggauu

SEQ ID NO: 481053 - RNA, 17 nt, Homo sapiens
ugugauucacaguguga

SEQ ID NO: 481054 - RNA, 22 nt, Homo sapiens
ugugauuccuuugaagaggaaa

SEQ ID NO: 481055 - RNA, 9 nt, Homo sapiens
ugugcaaua

SEQ ID NO: 481056 - RNA, 21 nt, Homo sapiens
ugugcggccuggucuaccugu

SEQ ID NO: 481057 - RNA, 17 nt, Homo sapiens
ugugcuggccucucuga

SEQ ID NO: 481058 - RNA, 22 nt, Homo sapiens
uguggagaugcccaggauuuga

SEQ ID NO: 481059 - RNA, 20 nt, Homo sapiens
uguggagcagccaacaagca

SEQ ID NO: 481060 - RNA, 18 nt, Homo sapiens
uguggaggagcucaggac

SEQ ID NO: 481061 - RNA, 20 nt, Homo sapiens
uguggccugggccuccucac

SEQ ID NO: 481062 - RNA, 15 nt, Homo sapiens
ugugggaaauccaca

SEQ ID NO: 481063 - RNA, 18 nt, Homo sapiens
ugugggcgcauacuacag

SEQ ID NO: 481064 - RNA, 21 nt, Homo sapiens
ugugguccgaagucuuccaua

SEQ ID NO: 481065 - RNA, 19 nt, Homo sapiens
uguggucugggcaccaccu

SEQ ID NO: 481066 - RNA, 19 nt, Homo sapiens
ugugguuaaugccauggac

SEQ ID NO: 481067 - RNA, 19 nt, Homo sapiens
uguguacauuagucauuca

SEQ ID NO: 481068 - RNA, 15 nt, Homo sapiens
ugugugaacguguau

SEQ ID NO: 481069 - RNA, 15 nt, Homo sapiens
uguguucaguacaau

SEQ ID NO: 481070 - RNA, 13 nt, Homo sapiens
uguuaaguugaug

SEQ ID NO: 481071 - RNA, 23 nt, Homo sapiens
uguuagaaaugcaaauucucaag

SEQ ID NO: 481072 - RNA, 12 nt, Homo sapiens
uguucaagagca

SEQ ID NO: 481073 - RNA, 13 nt, Homo sapiens
ucugauacgugua

SEQ ID NO: 481074 - RNA, 18 nt, Homo sapiens
ucugccagccagcagcca

SEQ ID NO: 481075 - RNA, 12 nt, Homo sapiens
ucugcuugccau

SEQ ID NO: 481076 - RNA, 21 nt, Homo sapiens
ucuggcaucucccacacaaga

SEQ ID NO: 481077 - RNA, 19 nt, Homo sapiens
ucuggcucugucacccagg

SEQ ID NO: 481078 - RNA, 23 nt, Homo sapiens
ucugggauauuuccauauggcaa

SEQ ID NO: 481079 - RNA, 15 nt, Homo sapiens
ucugggcaccaccuc

SEQ ID NO: 481080 - RNA, 12 nt, Homo sapiens
ucuguaaucuuc

SEQ ID NO: 481081 - RNA, 20 nt, Homo sapiens
ucuguagguauuaaucacau

SEQ ID NO: 481082 - RNA, 14 nt, Homo sapiens
ucugugggcacugg

SEQ ID NO: 481083 - RNA, 17 nt, Homo sapiens
ucugugggcacuggugg

SEQ ID NO: 481084 - RNA, 20 nt, Homo sapiens
ucuguuuccaggucagaaac

SEQ ID NO: 481085 - RNA, 13 nt, Homo sapiens
ucuuacacaagag

SEQ ID NO: 481086 - RNA, 22 nt, Homo sapiens
ucuuagaugcaguucugaagaa

SEQ ID NO: 481087 - RNA, 20 nt, Homo sapiens
ucuuaggcaaucacauagug

SEQ ID NO: 481088 - RNA, 21 nt, Homo sapiens
ucuucagggaacugcauagau

SEQ ID NO: 481089 - RNA, 16 nt, Homo sapiens
ucuucauaauuucuuc

SEQ ID NO: 481090 - RNA, 21 nt, Homo sapiens
ucuucauaauuucuucacuca

SEQ ID NO: 481091 - RNA, 22 nt, Homo sapiens
ucuucauuuauuuugacuguga

SEQ ID NO: 481092 - RNA, 16 nt, Homo sapiens
ucuucccacuuugcca

SEQ ID NO: 481093 - RNA, 14 nt, Homo sapiens
ucuuccucccugga

SEQ ID NO: 481094 - RNA, 22 nt, Homo sapiens
ucuucguguauagcugugugaa

SEQ ID NO: 481095 - RNA, 16 nt, Homo sapiens
ucuucuccuccaugaa

SEQ ID NO: 481096 - RNA, 18 nt, Homo sapiens
ucuuggguucaagugauu

SEQ ID NO: 481097 - RNA, 20 nt, Homo sapiens
ucuuuauauggccucaagau

SEQ ID NO: 481098 - RNA, 16 nt, Homo sapiens
ucuuucuuacaaggaa

SEQ ID NO: 481099 - RNA, 22 nt, Homo sapiens
ucuuucuuacacaagagcugga

SEQ ID NO: 481100 - RNA, 18 nt, Homo sapiens
ucuuugcaagaaagucag

SEQ ID NO: 481101 - RNA, 21 nt, Homo sapiens
ucuuuuuagagaaauuugcca

SEQ ID NO: 481102 - RNA, 14 nt, Homo sapiens
ucuuuuugaaauca

SEQ ID NO: 481103 - RNA, 20 nt, Homo sapiens
ugaaaaugcuguauuaguca

SEQ ID NO: 481104 - RNA, 13 nt, Homo sapiens
ugaaacauuugca

SEQ ID NO: 481105 - RNA, 21 nt, Homo sapiens
ugaaauauacacacagcagua

SEQ ID NO: 481106 - RNA, 13 nt, Homo sapiens
ugaaaucuaugaa

SEQ ID NO: 481107 - RNA, 21 nt, Homo sapiens
ugaaaugacuuuuccauucuc

SEQ ID NO: 481108 - RNA, 23 nt, Homo sapiens
ugaaaugacuuuuccauucuccu

SEQ ID NO: 481109 - RNA, 20 nt, Homo sapiens
ugaacaacucgaaucacuca

SEQ ID NO: 481110 - RNA, 15 nt, Homo sapiens
ugaacacaaagccug

SEQ ID NO: 481111 - RNA, 21 nt, Homo sapiens
ugaacacguuuuuucacuauu

SEQ ID NO: 481112 - RNA, 15 nt, Homo sapiens
ugaagaaucuguuuc

SEQ ID NO: 481113 - RNA, 15 nt, Homo sapiens
ugaagacacugaaau

SEQ ID NO: 481114 - RNA, 23 nt, Homo sapiens
ugaagacccucaaugccaagaaa

SEQ ID NO: 481115 - RNA, 12 nt, Homo sapiens
ugaagacugggu

SEQ ID NO: 481116 - RNA, 15 nt, Homo sapiens
ugaaggcaaugccau

SEQ ID NO: 481117 - RNA, 21 nt, Homo sapiens
ugaaggcaaugccauccucaa

SEQ ID NO: 481118 - RNA, 15 nt, Homo sapiens
ugaagggaugcugca

SEQ ID NO: 481119 - RNA, 14 nt, Homo sapiens
ugaaguaagcaaag

SEQ ID NO: 481120 - RNA, 22 nt, Homo sapiens
ugaagucaugcguuuaaucaca

SEQ ID NO: 481121 - RNA, 23 nt, Homo sapiens
ugaagucaugcguuuaaucacau

SEQ ID NO: 481122 - RNA, 17 nt, Homo sapiens
ugaagucuucuccucca

SEQ ID NO: 481123 - RNA, 17 nt, Homo sapiens
ugaauauaaacacuaua

SEQ ID NO: 481124 - RNA, 16 nt, Homo sapiens
ugaaugugagguguug

SEQ ID NO: 481125 - RNA, 18 nt, Homo sapiens
ugacagaacgagacucca

SEQ ID NO: 481126 - RNA, 22 nt, Homo sapiens
ugacagaacgagacuccaccuc

SEQ ID NO: 481127 - RNA, 19 nt, Homo sapiens
ugacauccaauacagaguu

SEQ ID NO: 481128 - RNA, 18 nt, Homo sapiens
ugacauuagcauuguggu

SEQ ID NO: 481129 - RNA, 13 nt, Homo sapiens
ugacauugauaca

SEQ ID NO: 481130 - RNA, 17 nt, Homo sapiens
ugaccaguuuaaccuga

SEQ ID NO: 481131 - RNA, 22 nt, Homo sapiens
ugacguuggccuaacacugggc

SEQ ID NO: 481132 - RNA, 18 nt, Homo sapiens
ugacuaaagcagggacaa

SEQ ID NO: 481133 - RNA, 20 nt, Homo sapiens
ugacucuccagaaagcucau

SEQ ID NO: 481134 - RNA, 16 nt, Homo sapiens
ugacugauggugaaau

SEQ ID NO: 481135 - RNA, 18 nt, Homo sapiens
ugacuugguaugcuuuau

SEQ ID NO: 481136 - RNA, 15 nt, Homo sapiens
ugacuuuuccauucu

SEQ ID NO: 481137 - RNA, 13 nt, Homo sapiens
ugagacuaugcaa

SEQ ID NO: 481138 - RNA, 16 nt, Homo sapiens
ugagagcaugccugug

SEQ ID NO: 481139 - RNA, 14 nt, Homo sapiens
ugagagcauucugc

SEQ ID NO: 481140 - RNA, 20 nt, Homo sapiens
ugagagcccuucaugcauuu

SEQ ID NO: 481141 - RNA, 19 nt, Homo sapiens
ugagaggagagagacucca

SEQ ID NO: 481142 - RNA, 13 nt, Homo sapiens
ugagaucauucac

SEQ ID NO: 481143 - RNA, 16 nt, Homo sapiens
ugagaucauugcaaac

SEQ ID NO: 481144 - RNA, 20 nt, Homo sapiens
ugagcaaguagguugcuguc

SEQ ID NO: 481145 - RNA, 15 nt, Homo sapiens
ugagcaucccaggau

SEQ ID NO: 481146 - RNA, 13 nt, Homo sapiens
ugagcuacuucag

SEQ ID NO: 481147 - RNA, 22 nt, Homo sapiens
ugagcuuaaaaaaaaaguauac

SEQ ID NO: 481148 - RNA, 12 nt, Homo sapiens
ugaggacacuga

SEQ ID NO: 481149 - RNA, 18 nt, Homo sapiens
ugaggaugccaagauuaa

SEQ ID NO: 481150 - RNA, 20 nt, Homo sapiens
ugaggcaggagaaucacuug

SEQ ID NO: 481151 - RNA, 20 nt, Homo sapiens
ugaggcauccuuccucacac

SEQ ID NO: 481152 - RNA, 13 nt, Homo sapiens
ugagguguugcua

SEQ ID NO: 481153 - RNA, 13 nt, Homo sapiens
ugaguauugcuga

SEQ ID NO: 481154 - RNA, 18 nt, Homo sapiens
ugagucaaaaaaucucaa

SEQ ID NO: 481155 - RNA, 19 nt, Homo sapiens
ugagucaaaaaaucucaau

SEQ ID NO: 481156 - RNA, 22 nt, Homo sapiens
ugauaagagggcacacacugug

SEQ ID NO: 481157 - RNA, 20 nt, Homo sapiens
ugauacaaauugcagacugu

SEQ ID NO: 481158 - RNA, 21 nt, Homo sapiens
ugauauagaacagugcuugcc

SEQ ID NO: 481159 - RNA, 22 nt, Homo sapiens
ugaucacucuuugcacacucuu

SEQ ID NO: 481160 - RNA, 18 nt, Homo sapiens
ugauccuaaugaaugcau

SEQ ID NO: 481161 - RNA, 20 nt, Homo sapiens
ugauccuaaugaaugcauaa

SEQ ID NO: 481162 - RNA, 14 nt, Homo sapiens
ugauccugugaagu

SEQ ID NO: 481163 - RNA, 12 nt, Homo sapiens
ugaucugaugca

SEQ ID NO: 481164 - RNA, 17 nt, Homo sapiens
ugaugaggcagaugccu

SEQ ID NO: 481165 - RNA, 23 nt, Homo sapiens
ugaugucauaagcgaucacuucc

SEQ ID NO: 481166 - RNA, 13 nt, Homo sapiens
ugaugucauguca

SEQ ID NO: 481167 - RNA, 13 nt, Homo sapiens
ugauuaaugcuaa

SEQ ID NO: 481168 - RNA, 14 nt, Homo sapiens
ugauuaaugcuaaa

SEQ ID NO: 481169 - RNA, 15 nt, Homo sapiens
ugauuauagugacaa

SEQ ID NO: 481170 - RNA, 16 nt, Homo sapiens
ugcaaaaguacaaggg

SEQ ID NO: 481171 - RNA, 13 nt, Homo sapiens
ugcaacuuguaaa

SEQ ID NO: 481172 - RNA, 12 nt, Homo sapiens
ugcaagacauag

SEQ ID NO: 481173 - RNA, 17 nt, Homo sapiens
ugcaauagaacagagaa

SEQ ID NO: 481174 - RNA, 21 nt, Homo sapiens
ugcaauaguaggacugcugac

SEQ ID NO: 481175 - RNA, 17 nt, Homo sapiens
ugcaccauugcacucua

SEQ ID NO: 481176 - RNA, 22 nt, Homo sapiens
ugcacccaccuuucugcacaua

SEQ ID NO: 481177 - RNA, 12 nt, Homo sapiens
ugcagacaugag

SEQ ID NO: 481178 - RNA, 18 nt, Homo sapiens
ugcagagauuaacauuuc

SEQ ID NO: 481179 - RNA, 13 nt, Homo sapiens
ugcagaguacugg

SEQ ID NO: 481180 - RNA, 12 nt, Homo sapiens
ugcagagucaau

SEQ ID NO: 481181 - RNA, 16 nt, Homo sapiens
ugcaggcaucacagcu

SEQ ID NO: 481182 - RNA, 17 nt, Homo sapiens
ugcaggguccccaagga

SEQ ID NO: 481183 - RNA, 20 nt, Homo sapiens
ugcauaaaauguuaaguuga

SEQ ID NO: 481184 - RNA, 18 nt, Homo sapiens
ugcauaagugcaugacau

SEQ ID NO: 481185 - RNA, 19 nt, Homo sapiens
ugcauagagccacguaugu

SEQ ID NO: 481186 - RNA, 18 nt, Homo sapiens
cuuacaaacaugugguua

SEQ ID NO: 481187 - RNA, 18 nt, Homo sapiens
cuuagaauaaaauuguaa

SEQ ID NO: 481188 - RNA, 13 nt, Homo sapiens
cuuagaccucagc

SEQ ID NO: 481189 - RNA, 14 nt, Homo sapiens
cuuaggcaaucaca

SEQ ID NO: 481190 - RNA, 16 nt, Homo sapiens
cuuaggcaaucacaua

SEQ ID NO: 481191 - RNA, 17 nt, Homo sapiens
cuuaggcaaucacauag

SEQ ID NO: 481192 - RNA, 20 nt, Homo sapiens
cuuaucaagcagccaaggga

SEQ ID NO: 481193 - RNA, 17 nt, Homo sapiens
cuuaucaguaguaucaa

SEQ ID NO: 481194 - RNA, 17 nt, Homo sapiens
cuuauccaugccuggga

SEQ ID NO: 481195 - RNA, 21 nt, Homo sapiens
cuuaugucaaguucuacauca

SEQ ID NO: 481196 - RNA, 22 nt, Homo sapiens
cuucagccuagccgaccucagc

SEQ ID NO: 481197 - RNA, 20 nt, Homo sapiens
cuucauaauuucuucacuca

SEQ ID NO: 481198 - RNA, 13 nt, Homo sapiens
cuuccacuaugag

SEQ ID NO: 481199 - RNA, 21 nt, Homo sapiens
cuuccacuuggcuacacaggg

SEQ ID NO: 481200 - RNA, 15 nt, Homo sapiens
cuuccagcacugacu

SEQ ID NO: 481201 - RNA, 19 nt, Homo sapiens
cuuccagugcaacacugaa

SEQ ID NO: 481202 - RNA, 20 nt, Homo sapiens
cuuccagugcaacacugaag

SEQ ID NO: 481203 - RNA, 21 nt, Homo sapiens
cuucccaguggcugcugccca

SEQ ID NO: 481204 - RNA, 13 nt, Homo sapiens
cuuccccuugccc

SEQ ID NO: 481205 - RNA, 16 nt, Homo sapiens
cuuccucagcuguaga

SEQ ID NO: 481206 - RNA, 15 nt, Homo sapiens
cuucguguauagcug

SEQ ID NO: 481207 - RNA, 20 nt, Homo sapiens
cuucuaaccugaacugaugg

SEQ ID NO: 481208 - RNA, 14 nt, Homo sapiens
cuucuaaucaaagc

SEQ ID NO: 481209 - RNA, 21 nt, Homo sapiens
cuucuacuacccccacagacc

SEQ ID NO: 481210 - RNA, 13 nt, Homo sapiens
cuucuagaaccag

SEQ ID NO: 481211 - RNA, 22 nt, Homo sapiens
cuucuaggacgccacccagcaa

SEQ ID NO: 481212 - RNA, 17 nt, Homo sapiens
cuucuccgcccauucug

SEQ ID NO: 481213 - RNA, 13 nt, Homo sapiens
cuugaacacuggg

SEQ ID NO: 481214 - RNA, 19 nt, Homo sapiens
cuugagacaaaucuaugcc

SEQ ID NO: 481215 - RNA, 16 nt, Homo sapiens
cuugaguuuuccugcu

SEQ ID NO: 481216 - RNA, 18 nt, Homo sapiens
cuugauucagaaccauuu

SEQ ID NO: 481217 - RNA, 14 nt, Homo sapiens
cuugccacugcacu

SEQ ID NO: 481218 - RNA, 19 nt, Homo sapiens
cuugccaucccucccucca

SEQ ID NO: 481219 - RNA, 22 nt, Homo sapiens
cuugcucucuucaauaaaccac

SEQ ID NO: 481220 - RNA, 17 nt, Homo sapiens
cuuggcuacacagggau

SEQ ID NO: 481221 - RNA, 18 nt, Homo sapiens
cuuggggcugaugcaguu

SEQ ID NO: 481222 - RNA, 17 nt, Homo sapiens
cuuggguucaagugauu

SEQ ID NO: 481223 - RNA, 19 nt, Homo sapiens
cuugucaauaaaauccaua

SEQ ID NO: 481224 - RNA, 17 nt, Homo sapiens
cuugucuuauuugcuau

SEQ ID NO: 481225 - RNA, 23 nt, Homo sapiens
cuuguguuuuuugcucacuguca

SEQ ID NO: 481226 - RNA, 16 nt, Homo sapiens
cuuguuagaaaugcaa

SEQ ID NO: 481227 - RNA, 13 nt, Homo sapiens
cuuguugcugagu

SEQ ID NO: 481228 - RNA, 11 nt, Homo sapiens
cuuuaaaccac

SEQ ID NO: 481229 - RNA, 13 nt, Homo sapiens
cuuucagcuguga

SEQ ID NO: 481230 - RNA, 13 nt, Homo sapiens
cuuuccaucccag

SEQ ID NO: 481231 - RNA, 22 nt, Homo sapiens
cuuuccuuguuccccaucaucu

SEQ ID NO: 481232 - RNA, 22 nt, Homo sapiens
cuuucuggaauccaaaccacag

SEQ ID NO: 481233 - RNA, 20 nt, Homo sapiens
cuuugcugagccuguaaaau

SEQ ID NO: 481234 - RNA, 17 nt, Homo sapiens
cuuuggagaucaaggag

SEQ ID NO: 481235 - RNA, 14 nt, Homo sapiens
cuuuuacaccaguu

SEQ ID NO: 481236 - RNA, 16 nt, Homo sapiens
cuuuuccauguaucua

SEQ ID NO: 481237 - RNA, 15 nt, Homo sapiens
cuuuugccuacguga

SEQ ID NO: 481238 - RNA, 22 nt, Homo sapiens
cuuuuugaaaucagcauacuca

SEQ ID NO: 481239 - RNA, 14 nt, Homo sapiens
gaaaaacaugucau

SEQ ID NO: 481240 - RNA, 20 nt, Homo sapiens
gaaaauaaguauccaucaga

SEQ ID NO: 481241 - RNA, 22 nt, Homo sapiens
gaaaauagagaucuuaugucaa

SEQ ID NO: 481242 - RNA, 19 nt, Homo sapiens
gaaaaucugcacugugggc

SEQ ID NO: 481243 - RNA, 15 nt, Homo sapiens
gaaaaugugcaauau

SEQ ID NO: 481244 - RNA, 11 nt, Homo sapiens
gaaaauuacag

SEQ ID NO: 481245 - RNA, 14 nt, Homo sapiens
gaaacuaacacagc

SEQ ID NO: 481246 - RNA, 18 nt, Homo sapiens
gaaacuggaugaggucau

SEQ ID NO: 481247 - RNA, 19 nt, Homo sapiens
gaaacuggaugaggucaua

SEQ ID NO: 481248 - RNA, 23 nt, Homo sapiens
gaaagaaaguugcacggcugcug

SEQ ID NO: 481249 - RNA, 18 nt, Homo sapiens
gaaagacagagcugggau

SEQ ID NO: 481250 - RNA, 24 nt, Homo sapiens
gaaagagaaugggagcauauguga

SEQ ID NO: 481251 - RNA, 23 nt, Homo sapiens
gaaagcaucauuauuugcagaga

SEQ ID NO: 481252 - RNA, 21 nt, Homo sapiens
gaaaggcaaaaaugugcccuu

SEQ ID NO: 481253 - RNA, 22 nt, Homo sapiens
gaaaggcuuggcacacagcagg

SEQ ID NO: 481254 - RNA, 14 nt, Homo sapiens
gaaauauagccaaa

SEQ ID NO: 481255 - RNA, 12 nt, Homo sapiens
gaaaucaagggc

SEQ ID NO: 481256 - RNA, 22 nt, Homo sapiens
gaaaucgggagugcacuuuuug

SEQ ID NO: 481257 - RNA, 13 nt, Homo sapiens
gaaaucuaugaaa

SEQ ID NO: 481258 - RNA, 17 nt, Homo sapiens
gaaaugcaaauucucaa

SEQ ID NO: 481259 - RNA, 20 nt, Homo sapiens
gaacaaagugagacagucca

SEQ ID NO: 481260 - RNA, 19 nt, Homo sapiens
gaacaaguuguuucauuga

SEQ ID NO: 481261 - RNA, 15 nt, Homo sapiens
gaacacaaggucauu

SEQ ID NO: 481262 - RNA, 22 nt, Homo sapiens
gaacacuaaacagacuauuuaa

SEQ ID NO: 481263 - RNA, 20 nt, Homo sapiens
gaacacugggggaggggaca

SEQ ID NO: 481264 - RNA, 16 nt, Homo sapiens
gaacaucaucaaggca

SEQ ID NO: 481265 - RNA, 16 nt, Homo sapiens
gaaccaggcaacuugg

SEQ ID NO: 481266 - RNA, 12 nt, Homo sapiens
gaaccucagggc

SEQ ID NO: 481267 - RNA, 16 nt, Homo sapiens
gaaccuggagggcuag

SEQ ID NO: 481268 - RNA, 23 nt, Homo sapiens
gaacgaguuguuggcugcucccu

SEQ ID NO: 481269 - RNA, 15 nt, Homo sapiens
gaacuaacaugcaaa

SEQ ID NO: 481270 - RNA, 16 nt, Homo sapiens
gaacuagaaccuggag

SEQ ID NO: 481271 - RNA, 13 nt, Homo sapiens
gaacuagacuccc

SEQ ID NO: 481272 - RNA, 18 nt, Homo sapiens
gaacugaaaacaagccau

SEQ ID NO: 481273 - RNA, 16 nt, Homo sapiens
gaacuuucaccuucau

SEQ ID NO: 481274 - RNA, 23 nt, Homo sapiens
gaacuuugcauagcagcugcuac

SEQ ID NO: 481275 - RNA, 22 nt, Homo sapiens
gaagaacugaaaucauacuucu

SEQ ID NO: 481276 - RNA, 14 nt, Homo sapiens
gaagaaucuguuuc

SEQ ID NO: 481277 - RNA, 21 nt, Homo sapiens
gaagagacguuuaaaagccau

SEQ ID NO: 481278 - RNA, 18 nt, Homo sapiens
gaagauauaacuauugcc

SEQ ID NO: 481279 - RNA, 18 nt, Homo sapiens
gaagauccccaacugcuc

SEQ ID NO: 481280 - RNA, 18 nt, Homo sapiens
gaagcaggcuacacugac

SEQ ID NO: 481281 - RNA, 23 nt, Homo sapiens
gaagccuuggggcugaugcaguu

SEQ ID NO: 481282 - RNA, 22 nt, Homo sapiens
gaagcugaagauccccaacugc

SEQ ID NO: 481283 - RNA, 17 nt, Homo sapiens
gaagcugcagcuggucu

SEQ ID NO: 481284 - RNA, 19 nt, Homo sapiens
gaagggaugcugcaaugua

SEQ ID NO: 481285 - RNA, 23 nt, Homo sapiens
gaaggguaccuugaacacugggg

SEQ ID NO: 481286 - RNA, 22 nt, Homo sapiens
gaaggguucaccaggucaggga

SEQ ID NO: 481287 - RNA, 21 nt, Homo sapiens
gaagucuucuccuccaugaac

SEQ ID NO: 481288 - RNA, 22 nt, Homo sapiens
gaauaaauaugcucagccaccc

SEQ ID NO: 481289 - RNA, 17 nt, Homo sapiens
gaauacauaaaguaugu

SEQ ID NO: 481290 - RNA, 23 nt, Homo sapiens
gaauacuaauaaaauacauacua

SEQ ID NO: 481291 - RNA, 21 nt, Homo sapiens
gaauagaagguagugaagaaa

SEQ ID NO: 481292 - RNA, 17 nt, Homo sapiens
gaauauaaacacuauau

SEQ ID NO: 481293 - RNA, 22 nt, Homo sapiens
gaauaugggguugguguucuca

SEQ ID NO: 481294 - RNA, 22 nt, Homo sapiens
gaaucaauccagcgguucucaa

SEQ ID NO: 481295 - RNA, 16 nt, Homo sapiens
gaaucaccuugauuca

SEQ ID NO: 481296 - RNA, 20 nt, Homo sapiens
gaaucacucauuuauuucca

SEQ ID NO: 481297 - RNA, 16 nt, Homo sapiens
gaaucacuucugagaa

SEQ ID NO: 481298 - RNA, 17 nt, Homo sapiens
gaaucacuugaacccag

SEQ ID NO: 481299 - RNA, 16 nt, Homo sapiens
gaaucccuuaaacuca

SEQ ID NO: 481300 - RNA, 16 nt, Homo sapiens
gaaugggcagcucauc

SEQ ID NO: 481301 - RNA, 20 nt, Homo sapiens
gaauuacaggcacauaccac

SEQ ID NO: 481302 - RNA, 14 nt, Homo sapiens
gaauugguugccau

SEQ ID NO: 481303 - RNA, 21 nt, Homo sapiens
gacaaaaagcacuaguauaaa

SEQ ID NO: 481304 - RNA, 16 nt, Homo sapiens
gacaaagcuacuugaa

SEQ ID NO: 481305 - RNA, 20 nt, Homo sapiens
gacaaauaaguuacccucaa

SEQ ID NO: 481306 - RNA, 22 nt, Homo sapiens
gacaagaaauccuaguggccuc

SEQ ID NO: 481307 - RNA, 15 nt, Homo sapiens
gacaaggaaaggcaa

SEQ ID NO: 481308 - RNA, 19 nt, Homo sapiens
gacaaugaagaugaugcua

SEQ ID NO: 481309 - RNA, 13 nt, Homo sapiens
gacacaaaccugc

SEQ ID NO: 481310 - RNA, 15 nt, Homo sapiens
gacacaaaccugccu

SEQ ID NO: 481311 - RNA, 13 nt, Homo sapiens
gacagaacacugu

SEQ ID NO: 481312 - RNA, 16 nt, Homo sapiens
gacagaacgagacucc

SEQ ID NO: 481313 - RNA, 16 nt, Homo sapiens
gacagacacugcugaa

SEQ ID NO: 481314 - RNA, 17 nt, Homo sapiens
gacagacacugcugaac

SEQ ID NO: 481315 - RNA, 20 nt, Homo sapiens
gacagagguuaucuguccca

SEQ ID NO: 481316 - RNA, 20 nt, Homo sapiens
gacagagucuggcucuguca

SEQ ID NO: 481317 - RNA, 18 nt, Homo sapiens
gacagcuguuccacaggg

SEQ ID NO: 481318 - RNA, 14 nt, Homo sapiens
gacaguuugauaau

SEQ ID NO: 481319 - RNA, 15 nt, Homo sapiens
gacauauacuaagau

SEQ ID NO: 481320 - RNA, 18 nt, Homo sapiens
gacaucagcaucaccuag

SEQ ID NO: 481321 - RNA, 14 nt, Homo sapiens
gacauccucaaaag

SEQ ID NO: 481322 - RNA, 24 nt, Homo sapiens
ccacccucaugcugugugacucaa

SEQ ID NO: 481323 - RNA, 23 nt, Homo sapiens
ccaccgguguccuguuccugcca

SEQ ID NO: 481324 - RNA, 16 nt, Homo sapiens
ccaccucccugcaaua

SEQ ID NO: 481325 - RNA, 19 nt, Homo sapiens
ccacuaugagcugcuggca

SEQ ID NO: 481326 - RNA, 14 nt, Homo sapiens
ccacucccaggcag

SEQ ID NO: 481327 - RNA, 12 nt, Homo sapiens
ccacugauaucc

SEQ ID NO: 481328 - RNA, 16 nt, Homo sapiens
ccagagggaauugcag

SEQ ID NO: 481329 - RNA, 21 nt, Homo sapiens
ccagaguuccccaugcagaca

SEQ ID NO: 481330 - RNA, 22 nt, Homo sapiens
ccagcaguucagagcugcccuc

SEQ ID NO: 481331 - RNA, 19 nt, Homo sapiens
ccagccagauggacuccag

SEQ ID NO: 481332 - RNA, 14 nt, Homo sapiens
ccagccagcaguuc

SEQ ID NO: 481333 - RNA, 15 nt, Homo sapiens
ccagccagcaguuca

SEQ ID NO: 481334 - RNA, 16 nt, Homo sapiens
ccagccagggcugcua

SEQ ID NO: 481335 - RNA, 20 nt, Homo sapiens
ccagccucugccgcugccau

SEQ ID NO: 481336 - RNA, 15 nt, Homo sapiens
ccagcuccucaucca

SEQ ID NO: 481337 - RNA, 15 nt, Homo sapiens
ccaggacaguggaga

SEQ ID NO: 481338 - RNA, 14 nt, Homo sapiens
ccaggcaggcaccu

SEQ ID NO: 481339 - RNA, 20 nt, Homo sapiens
ccaggcuggagugcagugga

SEQ ID NO: 481340 - RNA, 15 nt, Homo sapiens
ccaggggccaugaau

SEQ ID NO: 481341 - RNA, 20 nt, Homo sapiens
ccagguagagagaccacaag

SEQ ID NO: 481342 - RNA, 22 nt, Homo sapiens
ccagguagagagaccacaagca

SEQ ID NO: 481343 - RNA, 13 nt, Homo sapiens
ccaggucagggag

SEQ ID NO: 481344 - RNA, 15 nt, Homo sapiens
ccaguaaacagagga

SEQ ID NO: 481345 - RNA, 16 nt, Homo sapiens
ccagucccucagccac

SEQ ID NO: 481346 - RNA, 17 nt, Homo sapiens
ccagucccucagccacu

SEQ ID NO: 481347 - RNA, 13 nt, Homo sapiens
ccaguggcugcug

SEQ ID NO: 481348 - RNA, 20 nt, Homo sapiens
ccaguguguuucugaucuga

SEQ ID NO: 481349 - RNA, 12 nt, Homo sapiens
ccauacauuugu

SEQ ID NO: 481350 - RNA, 19 nt, Homo sapiens
ccauagggacccauucuac

SEQ ID NO: 481351 - RNA, 21 nt, Homo sapiens
ccauauacucuucaaggacuu

SEQ ID NO: 481352 - RNA, 18 nt, Homo sapiens
ccaucagaaacacccuca

SEQ ID NO: 481353 - RNA, 21 nt, Homo sapiens
ccaucaguuagagcugacaca

SEQ ID NO: 481354 - RNA, 20 nt, Homo sapiens
ccauccaauggauugugcaa

SEQ ID NO: 481355 - RNA, 22 nt, Homo sapiens
ccauccaauggauugugcaaau

SEQ ID NO: 481356 - RNA, 17 nt, Homo sapiens
ccaucuccucagcaccc

SEQ ID NO: 481357 - RNA, 18 nt, Homo sapiens
ccaucugugcacgcagug

SEQ ID NO: 481358 - RNA, 15 nt, Homo sapiens
ccaugacccaggcug

SEQ ID NO: 481359 - RNA, 22 nt, Homo sapiens
ccauucuggaagugacuuuggc

SEQ ID NO: 481360 - RNA, 17 nt, Homo sapiens
cccaaagugugacucau

SEQ ID NO: 481361 - RNA, 22 nt, Homo sapiens
cccaacagcacccucuccagau

SEQ ID NO: 481362 - RNA, 11 nt, Homo sapiens
cccaagggaaa

SEQ ID NO: 481363 - RNA, 19 nt, Homo sapiens
cccaauggcaacaucuugc

SEQ ID NO: 481364 - RNA, 12 nt, Homo sapiens
cccacuuugcca

SEQ ID NO: 481365 - RNA, 13 nt, Homo sapiens
cccacuuugccac

SEQ ID NO: 481366 - RNA, 17 nt, Homo sapiens
cccagccagcaguucag

SEQ ID NO: 481367 - RNA, 19 nt, Homo sapiens
cccaggcuggagugcagug

SEQ ID NO: 481368 - RNA, 14 nt, Homo sapiens
cccaguguguuucu

SEQ ID NO: 481369 - RNA, 21 nt, Homo sapiens
cccaguguguuucugaucuga

SEQ ID NO: 481370 - RNA, 21 nt, Homo sapiens
cccauccaauggauugugcaa

SEQ ID NO: 481371 - RNA, 23 nt, Homo sapiens
ccccauggguuuugcuuaggcac

SEQ ID NO: 481372 - RNA, 17 nt, Homo sapiens
ccccucagugguuuccu

SEQ ID NO: 481373 - RNA, 18 nt, Homo sapiens
ccccuugccagacaugug

SEQ ID NO: 481374 - RNA, 17 nt, Homo sapiens
cccggcugucaaggggu

SEQ ID NO: 481375 - RNA, 22 nt, Homo sapiens
cccuauggaagcauauuguuau

SEQ ID NO: 481376 - RNA, 22 nt, Homo sapiens
cccugaaguaagcaaagacuuu

SEQ ID NO: 481377 - RNA, 17 nt, Homo sapiens
cccugcaggaaaacuga

SEQ ID NO: 481378 - RNA, 19 nt, Homo sapiens
cccugcucacucuuccaca

SEQ ID NO: 481379 - RNA, 17 nt, Homo sapiens
cccugucuaaaaauuca

SEQ ID NO: 481380 - RNA, 20 nt, Homo sapiens
cccuucauccgccugugggc

SEQ ID NO: 481381 - RNA, 19 nt, Homo sapiens
cccuucuaaccugaacuga

SEQ ID NO: 481382 - RNA, 18 nt, Homo sapiens
ccgggaacaaaaugaugu

SEQ ID NO: 481383 - RNA, 14 nt, Homo sapiens
ccgggacuaccugg

SEQ ID NO: 481384 - RNA, 22 nt, Homo sapiens
ccguuuugugaagaaacauuua

SEQ ID NO: 481385 - RNA, 18 nt, Homo sapiens
ccuaaugaaugcauaaaa

SEQ ID NO: 481386 - RNA, 16 nt, Homo sapiens
ccuagaagauacaaua

SEQ ID NO: 481387 - RNA, 13 nt, Homo sapiens
ccuagaggugcuc

SEQ ID NO: 481388 - RNA, 15 nt, Homo sapiens
ccuagccgaccucag

SEQ ID NO: 481389 - RNA, 21 nt, Homo sapiens
ccuaguagcuuuccucccaaa

SEQ ID NO: 481390 - RNA, 13 nt, Homo sapiens
ccuauaugcacuu

SEQ ID NO: 481391 - RNA, 15 nt, Homo sapiens
ccuauaugcacuuau

SEQ ID NO: 481392 - RNA, 16 nt, Homo sapiens
ccucaggugcuaggga

SEQ ID NO: 481393 - RNA, 21 nt, Homo sapiens
ccucaguaagacgacaaggaa

SEQ ID NO: 481394 - RNA, 16 nt, Homo sapiens
ccuccaugaacaucau

SEQ ID NO: 481395 - RNA, 23 nt, Homo sapiens
ccuccaugaacaucauggacuga

SEQ ID NO: 481396 - RNA, 19 nt, Homo sapiens
ccuccaugaauaucaguua

SEQ ID NO: 481397 - RNA, 22 nt, Homo sapiens
ccuccuagacucugugaucuga

SEQ ID NO: 481398 - RNA, 16 nt, Homo sapiens
ccuccuggguuuacuc

SEQ ID NO: 481399 - RNA, 18 nt, Homo sapiens
ccuccuuacauaugcaaa

SEQ ID NO: 481400 - RNA, 21 nt, Homo sapiens
ccucuccagaugagaguacac

SEQ ID NO: 481401 - RNA, 14 nt, Homo sapiens
ccucugcuugccau

SEQ ID NO: 481402 - RNA, 17 nt, Homo sapiens
ccucuggguaggaauca

SEQ ID NO: 481403 - RNA, 21 nt, Homo sapiens
ccucuuagaugcaguucugaa

SEQ ID NO: 481404 - RNA, 14 nt, Homo sapiens
ccucuuauuugcuc

SEQ ID NO: 481405 - RNA, 16 nt, Homo sapiens
ccucuuuaacagcuuu

SEQ ID NO: 481406 - RNA, 20 nt, Homo sapiens
ccucuuuuucuagucuucau

SEQ ID NO: 481407 - RNA, 21 nt, Homo sapiens
ccugaaguaagcaaagacuuu

SEQ ID NO: 481408 - RNA, 13 nt, Homo sapiens
ccugagagugggu

SEQ ID NO: 481409 - RNA, 20 nt, Homo sapiens
ccugagcucgguggacccag

SEQ ID NO: 481410 - RNA, 22 nt, Homo sapiens
ccugagcugaaauaaagugagu

SEQ ID NO: 481411 - RNA, 20 nt, Homo sapiens
ccugauaacaaccuggagac

SEQ ID NO: 481412 - RNA, 14 nt, Homo sapiens
ccugcaggcagcuu

SEQ ID NO: 481413 - RNA, 13 nt, Homo sapiens
ccuggaagacaga

SEQ ID NO: 481414 - RNA, 20 nt, Homo sapiens
ccuggaaggcagccaggcug

SEQ ID NO: 481415 - RNA, 16 nt, Homo sapiens
ccuggccaaagggaua

SEQ ID NO: 481416 - RNA, 16 nt, Homo sapiens
ccugggcagcugccuc

SEQ ID NO: 481417 - RNA, 22 nt, Homo sapiens
ccugggcauacuaauaaaguau

SEQ ID NO: 481418 - RNA, 12 nt, Homo sapiens
ccuggugcccua

SEQ ID NO: 481419 - RNA, 22 nt, Homo sapiens
ccuggugggccuccucugucca

SEQ ID NO: 481420 - RNA, 21 nt, Homo sapiens
ccuguagaugacauggugaaa

SEQ ID NO: 481421 - RNA, 15 nt, Homo sapiens
ccugucucccaaaaa

SEQ ID NO: 481422 - RNA, 16 nt, Homo sapiens
ccugugagcagggauu

SEQ ID NO: 481423 - RNA, 22 nt, Homo sapiens
ccuguggcccucgcucugccuc

SEQ ID NO: 481424 - RNA, 10 nt, Homo sapiens
ccuguuaaau

SEQ ID NO: 481425 - RNA, 22 nt, Homo sapiens
ccuguuaucuguguuugcugag

SEQ ID NO: 481426 - RNA, 15 nt, Homo sapiens
ccuguuccugccaca

SEQ ID NO: 481427 - RNA, 12 nt, Homo sapiens
ccuuaacacuga

SEQ ID NO: 481428 - RNA, 20 nt, Homo sapiens
ccuuaucuaaaucaccagag

SEQ ID NO: 481429 - RNA, 15 nt, Homo sapiens
ccuucaccaucugua

SEQ ID NO: 481430 - RNA, 14 nt, Homo sapiens
ccuucaucuggaac

SEQ ID NO: 481431 - RNA, 18 nt, Homo sapiens
ccuucgccucccaggaga

SEQ ID NO: 481432 - RNA, 22 nt, Homo sapiens
ccuucuggugccagauccucuu

SEQ ID NO: 481433 - RNA, 22 nt, Homo sapiens
ccuugagaggcaugacagcugu

SEQ ID NO: 481434 - RNA, 18 nt, Homo sapiens
ccuugucucuacuaaaaa

SEQ ID NO: 481435 - RNA, 15 nt, Homo sapiens
ccuuuagugaucaca

SEQ ID NO: 481436 - RNA, 16 nt, Homo sapiens
ccuuuaguggcuucau

SEQ ID NO: 481437 - RNA, 12 nt, Homo sapiens
ccuuugccuugg

SEQ ID NO: 481438 - RNA, 19 nt, Homo sapiens
ccuuuggaugcacuuuaua

SEQ ID NO: 481439 - RNA, 17 nt, Homo sapiens
ccuuuuauuucuuaaac

SEQ ID NO: 481440 - RNA, 21 nt, Homo sapiens
cgaaagacgugauucaauuca

SEQ ID NO: 481441 - RNA, 16 nt, Homo sapiens
cgagugcucauuucag

SEQ ID NO: 481442 - RNA, 14 nt, Homo sapiens
cgauccccugucac

SEQ ID NO: 481443 - RNA, 20 nt, Homo sapiens
cgcaucccagacuugcugaa

SEQ ID NO: 481444 - RNA, 18 nt, Homo sapiens
cgccaaggcuggagugca

SEQ ID NO: 481445 - RNA, 20 nt, Homo sapiens
cgccaaggcuggagugcagu

SEQ ID NO: 481446 - RNA, 23 nt, Homo sapiens
cgcuacaaaauaaagcuguucuc

SEQ ID NO: 481447 - RNA, 19 nt, Homo sapiens
cgcucaucccacccgccca

SEQ ID NO: 481448 - RNA, 15 nt, Homo sapiens
cggagccuccagcug

SEQ ID NO: 481449 - RNA, 15 nt, Homo sapiens
cggcauuaaagccau

SEQ ID NO: 481450 - RNA, 19 nt, Homo sapiens
uuuaagaaaaacaugucau

SEQ ID NO: 481451 - RNA, 13 nt, Homo sapiens
uuuaagcuguaaa

SEQ ID NO: 481452 - RNA, 20 nt, Homo sapiens
uuuagaaccaccaacaagca

SEQ ID NO: 481453 - RNA, 15 nt, Homo sapiens
uuuagagaaagagaa

SEQ ID NO: 481454 - RNA, 21 nt, Homo sapiens
uuuaguagagaugggguuuca

SEQ ID NO: 481455 - RNA, 18 nt, Homo sapiens
uuuaucuauggcacccau

SEQ ID NO: 481456 - RNA, 21 nt, Homo sapiens
uuuauuacaguuuaucuaugg

SEQ ID NO: 481457 - RNA, 15 nt, Homo sapiens
uuuauugcugaauga

SEQ ID NO: 481458 - RNA, 23 nt, Homo sapiens
uuucaaucaaaacucaguaucau

SEQ ID NO: 481459 - RNA, 20 nt, Homo sapiens
uuucacacaauacaauaagu

SEQ ID NO: 481460 - RNA, 13 nt, Homo sapiens
uuucacugccaua

SEQ ID NO: 481461 - RNA, 16 nt, Homo sapiens
uuucaggccacauggc

SEQ ID NO: 481462 - RNA, 21 nt, Homo sapiens
uuucaggccacauggcuaaag

SEQ ID NO: 481463 - RNA, 19 nt, Homo sapiens
uuucagugaaagcaucacu

SEQ ID NO: 481464 - RNA, 21 nt, Homo sapiens
uuuccagcgggacucuucuca

SEQ ID NO: 481465 - RNA, 20 nt, Homo sapiens
uuuccauguaucuaccucac

SEQ ID NO: 481466 - RNA, 19 nt, Homo sapiens
uuucccuucuuacaaugca

SEQ ID NO: 481467 - RNA, 23 nt, Homo sapiens
uuuccuuuggcuauuaaaaaagu

SEQ ID NO: 481468 - RNA, 19 nt, Homo sapiens
uuugaauacaggcauagag

SEQ ID NO: 481469 - RNA, 10 nt, Homo sapiens
uuugagacag

SEQ ID NO: 481470 - RNA, 13 nt, Homo sapiens
uuugcaagacaua

SEQ ID NO: 481471 - RNA, 13 nt, Homo sapiens
uuugcucauggaa

SEQ ID NO: 481472 - RNA, 11 nt, Homo sapiens
uuugcuuuaau

SEQ ID NO: 481473 - RNA, 20 nt, Homo sapiens
uuuguaucauuaugaaguca

SEQ ID NO: 481474 - RNA, 19 nt, Homo sapiens
uuuguauuuuuaguagaga

SEQ ID NO: 481475 - RNA, 18 nt, Homo sapiens
uuuguuauuuuuccccaa

SEQ ID NO: 481476 - RNA, 14 nt, Homo sapiens
uuuuaagcuguaaa

SEQ ID NO: 481477 - RNA, 22 nt, Homo sapiens
uuuuaauuuaaucuuccaugga

SEQ ID NO: 481478 - RNA, 20 nt, Homo sapiens
uuuuagucuaauugaauccc

SEQ ID NO: 481479 - RNA, 18 nt, Homo sapiens
uuuucaaauaggaugcau

SEQ ID NO: 481480 - RNA, 21 nt, Homo sapiens
uuuucccgagcaaagucuaaa

SEQ ID NO: 481481 - RNA, 22 nt, Homo sapiens
uuuuccgggaacaaaaugaugu

SEQ ID NO: 481482 - RNA, 15 nt, Homo sapiens
uuuucuagucuucau

SEQ ID NO: 481483 - RNA, 23 nt, Homo sapiens
uuuugacaucaaugaugaggcuc

SEQ ID NO: 481484 - RNA, 13 nt, Homo sapiens
uuuugagacagag

SEQ ID NO: 481485 - RNA, 14 nt, Homo sapiens
uuuugaguaucucg

SEQ ID NO: 481486 - RNA, 22 nt, Homo sapiens
uuuuggaucuaucaccugucau

SEQ ID NO: 481487 - RNA, 12 nt, Homo sapiens
uuuuucucauga

SEQ ID NO: 481488 - RNA, 22 nt, Homo sapiens
acagcugcuggagacuccuagg

SEQ ID NO: 481489 - RNA, 20 nt, Homo sapiens
acagcuggguggcacugcca

SEQ ID NO: 481490 - RNA, 22 nt, Homo sapiens
acaggacagcccuucuuuccac

SEQ ID NO: 481491 - RNA, 12 nt, Homo sapiens
acaggugugagc

SEQ ID NO: 481492 - RNA, 23 nt, Homo sapiens
acaguaaauaaauuguuugacca

SEQ ID NO: 481493 - RNA, 15 nt, Homo sapiens
acaguaaccuuucaa

SEQ ID NO: 481494 - RNA, 20 nt, Homo sapiens
acagucuugcagcaggaucu

SEQ ID NO: 481495 - RNA, 15 nt, Homo sapiens
acagugagaaaccau

SEQ ID NO: 481496 - RNA, 22 nt, Homo sapiens
acaguggagagagaaaggcuuc

SEQ ID NO: 481497 - RNA, 15 nt, Homo sapiens
acagugggggcacca

SEQ ID NO: 481498 - RNA, 22 nt, Homo sapiens
acaguuaccucugccucagaaa

SEQ ID NO: 481499 - RNA, 14 nt, Homo sapiens
acaguuuccaguca

SEQ ID NO: 481500 - RNA, 15 nt, Homo sapiens
acaguuuccagucau

SEQ ID NO: 481501 - RNA, 15 nt, Homo sapiens
acauaaaauagauuu

SEQ ID NO: 481502 - RNA, 16 nt, Homo sapiens
acauaaguuaugguuu

SEQ ID NO: 481503 - RNA, 13 nt, Homo sapiens
acauacagacaca

SEQ ID NO: 481504 - RNA, 21 nt, Homo sapiens
acauacuauagauucuuuauu

SEQ ID NO: 481505 - RNA, 14 nt, Homo sapiens
acauagaacaugug

SEQ ID NO: 481506 - RNA, 12 nt, Homo sapiens
acauauuugcau

SEQ ID NO: 481507 - RNA, 17 nt, Homo sapiens
acaucaaugaugaggcu

SEQ ID NO: 481508 - RNA, 17 nt, Homo sapiens
acaugaagggaugcugc

SEQ ID NO: 481509 - RNA, 16 nt, Homo sapiens
acaugccaagcacugu

SEQ ID NO: 481510 - RNA, 21 nt, Homo sapiens
acauggaguucccgugcaccu

SEQ ID NO: 481511 - RNA, 21 nt, Homo sapiens
acauggcuaaagaagguuuca

SEQ ID NO: 481512 - RNA, 21 nt, Homo sapiens
acaugucauguagguugucua

SEQ ID NO: 481513 - RNA, 13 nt, Homo sapiens
acaugugguggga

SEQ ID NO: 481514 - RNA, 20 nt, Homo sapiens
acauuacuguauauacuuug

SEQ ID NO: 481515 - RNA, 13 nt, Homo sapiens
acauuaguucuau

SEQ ID NO: 481516 - RNA, 16 nt, Homo sapiens
acauuuauuuuucuca

SEQ ID NO: 481517 - RNA, 14 nt, Homo sapiens
acauuuugaucacu

SEQ ID NO: 481518 - RNA, 16 nt, Homo sapiens
acauuuugaucacucu

SEQ ID NO: 481519 - RNA, 13 nt, Homo sapiens
accaaaucacuga

SEQ ID NO: 481520 - RNA, 19 nt, Homo sapiens
accaagaccccaaagggcc

SEQ ID NO: 481521 - RNA, 18 nt, Homo sapiens
accacacagacaggguuu

SEQ ID NO: 481522 - RNA, 20 nt, Homo sapiens
accacacuuuccgcuuucac

SEQ ID NO: 481523 - RNA, 11 nt, Homo sapiens
accacaugcca

SEQ ID NO: 481524 - RNA, 13 nt, Homo sapiens
accacaugccaag

SEQ ID NO: 481525 - RNA, 19 nt, Homo sapiens
accagcaucccuugaccag

SEQ ID NO: 481526 - RNA, 22 nt, Homo sapiens
accagguagaacacaaggucau

SEQ ID NO: 481527 - RNA, 20 nt, Homo sapiens
accauagggacccauucuac

SEQ ID NO: 481528 - RNA, 12 nt, Homo sapiens
accaucuguaua

SEQ ID NO: 481529 - RNA, 23 nt, Homo sapiens
accaucugugcacgcaguggccu

SEQ ID NO: 481530 - RNA, 21 nt, Homo sapiens
accaugaacacguuuuuucac

SEQ ID NO: 481531 - RNA, 16 nt, Homo sapiens
accauuuguauccacu

SEQ ID NO: 481532 - RNA, 20 nt, Homo sapiens
acccaccuuucugcacauaa

SEQ ID NO: 481533 - RNA, 20 nt, Homo sapiens
acccacuuccugaucccuca

SEQ ID NO: 481534 - RNA, 22 nt, Homo sapiens
acccagaugggggaaagcacag

SEQ ID NO: 481535 - RNA, 20 nt, Homo sapiens
acccaucgucuuuaacccca

SEQ ID NO: 481536 - RNA, 12 nt, Homo sapiens
accccaacagca

SEQ ID NO: 481537 - RNA, 15 nt, Homo sapiens
accccaacagcaccc

SEQ ID NO: 481538 - RNA, 18 nt, Homo sapiens
accccaacagcacccucu

SEQ ID NO: 481539 - RNA, 15 nt, Homo sapiens
accccaucucuacua

SEQ ID NO: 481540 - RNA, 20 nt, Homo sapiens
acccuaaaaagcagagcuuu

SEQ ID NO: 481541 - RNA, 14 nt, Homo sapiens
acccucaugcugug

SEQ ID NO: 481542 - RNA, 16 nt, Homo sapiens
acccugcauguuggcc

SEQ ID NO: 481543 - RNA, 21 nt, Homo sapiens
accguggccccaaauuugcua

SEQ ID NO: 481544 - RNA, 20 nt, Homo sapiens
accuagaauuggcugaacuc

SEQ ID NO: 481545 - RNA, 14 nt, Homo sapiens
accuaguaugcuca

SEQ ID NO: 481546 - RNA, 17 nt, Homo sapiens
accuaguaugcucagua

SEQ ID NO: 481547 - RNA, 18 nt, Homo sapiens
accuaguaugcucaguaa

SEQ ID NO: 481548 - RNA, 14 nt, Homo sapiens
accucacuauucaa

SEQ ID NO: 481549 - RNA, 12 nt, Homo sapiens
accucacugggg

SEQ ID NO: 481550 - RNA, 22 nt, Homo sapiens
accucagaguauggagcucaga

SEQ ID NO: 481551 - RNA, 13 nt, Homo sapiens
accucauggaauu

SEQ ID NO: 481552 - RNA, 22 nt, Homo sapiens
accucauggggguauuguauaa

SEQ ID NO: 481553 - RNA, 14 nt, Homo sapiens
accucccugcaaua

SEQ ID NO: 481554 - RNA, 18 nt, Homo sapiens
accucugugggcacuggu

SEQ ID NO: 481555 - RNA, 16 nt, Homo sapiens
accugaacugaugggu

SEQ ID NO: 481556 - RNA, 13 nt, Homo sapiens
accugaugcaguc

SEQ ID NO: 481557 - RNA, 22 nt, Homo sapiens
accuggagggaaugaaccugga

SEQ ID NO: 481558 - RNA, 22 nt, Homo sapiens
accuggagggcuagaaccuaga

SEQ ID NO: 481559 - RNA, 21 nt, Homo sapiens
accuggcagguuagaaccuag

SEQ ID NO: 481560 - RNA, 13 nt, Homo sapiens
accugggcaggga

SEQ ID NO: 481561 - RNA, 19 nt, Homo sapiens
accugggcagggaugaugg

SEQ ID NO: 481562 - RNA, 19 nt, Homo sapiens
accuguaaucccagcacuu

SEQ ID NO: 481563 - RNA, 20 nt, Homo sapiens
accuguaaucccagcacuuu

SEQ ID NO: 481564 - RNA, 14 nt, Homo sapiens
accuugcucugcca

SEQ ID NO: 481565 - RNA, 14 nt, Homo sapiens
acgaucucgacuca

SEQ ID NO: 481566 - RNA, 15 nt, Homo sapiens
acgggggcagcugau

SEQ ID NO: 481567 - RNA, 22 nt, Homo sapiens
acgugauucaauucaacacucc

SEQ ID NO: 481568 - RNA, 10 nt, Homo sapiens
acgugcaaua

SEQ ID NO: 481569 - RNA, 16 nt, Homo sapiens
acguuuauagccgaaa

SEQ ID NO: 481570 - RNA, 12 nt, Homo sapiens
acuaacacagcc

SEQ ID NO: 481571 - RNA, 20 nt, Homo sapiens
acuaacaggagaaugcacag

SEQ ID NO: 481572 - RNA, 18 nt, Homo sapiens
acuaagagaaugugcuca

SEQ ID NO: 481573 - RNA, 16 nt, Homo sapiens
acuaauaaaauacaua

SEQ ID NO: 481574 - RNA, 13 nt, Homo sapiens
acuaauacauuaa

SEQ ID NO: 481575 - RNA, 17 nt, Homo sapiens
acuacaauguagucuca

SEQ ID NO: 481576 - RNA, 16 nt, Homo sapiens
acuacaguaacuguga

SEQ ID NO: 481577 - RNA, 18 nt, Homo sapiens
acuacaguaacugugacu

SEQ ID NO: 481578 - RNA, 22 nt, Homo sapiens
acuacaguaacugugacugaug

SEQ ID NO: 481579 - RNA, 13 nt, Homo sapiens
acuagaaccugga

SEQ ID NO: 481580 - RNA, 20 nt, Homo sapiens
acuagggcuuauccaugccu

SEQ ID NO: 481581 - RNA, 22 nt, Homo sapiens
acuauauuguuugcuaagcauu

SEQ ID NO: 481582 - RNA, 18 nt, Homo sapiens
acuaucaaacugaagcca

SEQ ID NO: 481583 - RNA, 23 nt, Homo sapiens
acuauggacggugcuccaggcag

SEQ ID NO: 481584 - RNA, 19 nt, Homo sapiens
acuauggcucuacuuucag

SEQ ID NO: 481585 - RNA, 20 nt, Homo sapiens
acuauugacaucagcaucac

SEQ ID NO: 481586 - RNA, 18 nt, Homo sapiens
aagagggcacacacugug

SEQ ID NO: 481587 - RNA, 15 nt, Homo sapiens
aagagucaugucaaa

SEQ ID NO: 481588 - RNA, 12 nt, Homo sapiens
aagauacaauaa

SEQ ID NO: 481589 - RNA, 20 nt, Homo sapiens
aagauccccaacugcuccag

SEQ ID NO: 481590 - RNA, 20 nt, Homo sapiens
aagaugggagcccaguuuca

SEQ ID NO: 481591 - RNA, 18 nt, Homo sapiens
aagauuagauaaagagaa

SEQ ID NO: 481592 - RNA, 18 nt, Homo sapiens
aagauuguugaaagccau

SEQ ID NO: 481593 - RNA, 19 nt, Homo sapiens
aagcaaguuaacacucuaa

SEQ ID NO: 481594 - RNA, 19 nt, Homo sapiens
aagcaccuuuagaauauua

SEQ ID NO: 481595 - RNA, 11 nt, Homo sapiens
aagcacugugc

SEQ ID NO: 481596 - RNA, 16 nt, Homo sapiens
aagcagaaucuuugca

SEQ ID NO: 481597 - RNA, 19 nt, Homo sapiens
aagccaagagucaugucaa

SEQ ID NO: 481598 - RNA, 19 nt, Homo sapiens
aagccaauaacacacagcu

SEQ ID NO: 481599 - RNA, 16 nt, Homo sapiens
aagccuuggauguaua

SEQ ID NO: 481600 - RNA, 18 nt, Homo sapiens
aagcucaggaccaggcaa

SEQ ID NO: 481601 - RNA, 18 nt, Homo sapiens
aagcucaucucagcuccu

SEQ ID NO: 481602 - RNA, 15 nt, Homo sapiens
aagcugcaucucuac

SEQ ID NO: 481603 - RNA, 21 nt, Homo sapiens
aaggagagcucuuugugaaug

SEQ ID NO: 481604 - RNA, 18 nt, Homo sapiens
aaggaggccacgugaugu

SEQ ID NO: 481605 - RNA, 22 nt, Homo sapiens
aaggaucuucccacuuugccac

SEQ ID NO: 481606 - RNA, 14 nt, Homo sapiens
aaggcaaaugccca

SEQ ID NO: 481607 - RNA, 19 nt, Homo sapiens
aaggcaaugccauccucaa

SEQ ID NO: 481608 - RNA, 15 nt, Homo sapiens
aaggcacugccugau

SEQ ID NO: 481609 - RNA, 14 nt, Homo sapiens
aaggcaguauuuca

SEQ ID NO: 481610 - RNA, 16 nt, Homo sapiens
aaggcucucacuccag

SEQ ID NO: 481611 - RNA, 12 nt, Homo sapiens
aaggcugcagga

SEQ ID NO: 481612 - RNA, 22 nt, Homo sapiens
aaggcuucuccgcccauucuga

SEQ ID NO: 481613 - RNA, 17 nt, Homo sapiens
aagggcuagaaccugga

SEQ ID NO: 481614 - RNA, 18 nt, Homo sapiens
aaggguucaccaggucag

SEQ ID NO: 481615 - RNA, 16 nt, Homo sapiens
aaggguucagggcaug

SEQ ID NO: 481616 - RNA, 14 nt, Homo sapiens
aaguaaacucagca

SEQ ID NO: 481617 - RNA, 17 nt, Homo sapiens
aaguacuguaacugugu

SEQ ID NO: 481618 - RNA, 22 nt, Homo sapiens
aaguacuguaacugugucauga

SEQ ID NO: 481619 - RNA, 20 nt, Homo sapiens
aagucaucauaauucagcuc

SEQ ID NO: 481620 - RNA, 14 nt, Homo sapiens
aagucucuuuauau

SEQ ID NO: 481621 - RNA, 11 nt, Homo sapiens
aagucuuccau

SEQ ID NO: 481622 - RNA, 19 nt, Homo sapiens
aagugacaagcucacagac

SEQ ID NO: 481623 - RNA, 22 nt, Homo sapiens
aagugcauuuuuaucugugagu

SEQ ID NO: 481624 - RNA, 14 nt, Homo sapiens
aaguggcugugaca

SEQ ID NO: 481625 - RNA, 22 nt, Homo sapiens
aaguuagggaauggcacagccc

SEQ ID NO: 481626 - RNA, 17 nt, Homo sapiens
aaguucagcaugaagga

SEQ ID NO: 481627 - RNA, 18 nt, Homo sapiens
aaguucaggcucugagac

SEQ ID NO: 481628 - RNA, 20 nt, Homo sapiens
aaguucaggcucugagacac

SEQ ID NO: 481629 - RNA, 17 nt, Homo sapiens
aaguucauucaauucca

SEQ ID NO: 481630 - RNA, 23 nt, Homo sapiens
aaguugauauagaacagugcuug

SEQ ID NO: 481631 - RNA, 14 nt, Homo sapiens
aaguuggcuucuaa

SEQ ID NO: 481632 - RNA, 21 nt, Homo sapiens
aaguuuuguggaggagcucag

SEQ ID NO: 481633 - RNA, 17 nt, Homo sapiens
aauaaaaggucggacca

SEQ ID NO: 481634 - RNA, 18 nt, Homo sapiens
aauaaaaugcagagacau

SEQ ID NO: 481635 - RNA, 16 nt, Homo sapiens
aauaaaaugcauuuaa

SEQ ID NO: 481636 - RNA, 11 nt, Homo sapiens
aauaaaccaca

SEQ ID NO: 481637 - RNA, 16 nt, Homo sapiens
aauaaagcuguucuca

SEQ ID NO: 481638 - RNA, 15 nt, Homo sapiens
aauaacagccucauu

SEQ ID NO: 481639 - RNA, 13 nt, Homo sapiens
aauaagagaagcu

SEQ ID NO: 481640 - RNA, 19 nt, Homo sapiens
aauaagggcagagucacac

SEQ ID NO: 481641 - RNA, 19 nt, Homo sapiens
aauaaguacuguguacaga

SEQ ID NO: 481642 - RNA, 17 nt, Homo sapiens
aauaauaacaaucacaa

SEQ ID NO: 481643 - RNA, 20 nt, Homo sapiens
aauaauccagaaaaacugug

SEQ ID NO: 481644 - RNA, 20 nt, Homo sapiens
aauacauaaaguaugugcau

SEQ ID NO: 481645 - RNA, 14 nt, Homo sapiens
aauacuuugaacac

SEQ ID NO: 481646 - RNA, 14 nt, Homo sapiens
aauaggaugcauuc

SEQ ID NO: 481647 - RNA, 19 nt, Homo sapiens
aauagggaaguaacaguaa

SEQ ID NO: 481648 - RNA, 22 nt, Homo sapiens
aauaguacagacagaaggugcu

SEQ ID NO: 481649 - RNA, 18 nt, Homo sapiens
aauaguaggacugcugac

SEQ ID NO: 481650 - RNA, 17 nt, Homo sapiens
aauauaccuucagagac

SEQ ID NO: 481651 - RNA, 13 nt, Homo sapiens
aaucaaagcagau

SEQ ID NO: 481652 - RNA, 20 nt, Homo sapiens
aaucaaagcagauauauuaa

SEQ ID NO: 481653 - RNA, 20 nt, Homo sapiens
aaucaaggugauugugauua

SEQ ID NO: 481654 - RNA, 18 nt, Homo sapiens
aaucaaguuggcuucuaa

SEQ ID NO: 481655 - RNA, 12 nt, Homo sapiens
aaucacaguaua

SEQ ID NO: 481656 - RNA, 19 nt, Homo sapiens
aaucacucauuuauuucca

SEQ ID NO: 481657 - RNA, 18 nt, Homo sapiens
aauccagcgguucucaaa

SEQ ID NO: 481658 - RNA, 14 nt, Homo sapiens
aaucccggcuguca

SEQ ID NO: 481659 - RNA, 22 nt, Homo sapiens
aauccuugaagauuuaccacuu

SEQ ID NO: 481660 - RNA, 17 nt, Homo sapiens
aaucuccuucuuuccug

SEQ ID NO: 481661 - RNA, 23 nt, Homo sapiens
aaucuggagagcuagaaccugga

SEQ ID NO: 481662 - RNA, 20 nt, Homo sapiens
aaugaagaugaugcuauuaa

SEQ ID NO: 481663 - RNA, 17 nt, Homo sapiens
aaugagagacacacuga

SEQ ID NO: 481664 - RNA, 13 nt, Homo sapiens
aaugaugaggcuc

SEQ ID NO: 481665 - RNA, 19 nt, Homo sapiens
aaugaugucguuugaauca

SEQ ID NO: 481666 - RNA, 16 nt, Homo sapiens
aaugcaacaacaugua

SEQ ID NO: 481667 - RNA, 20 nt, Homo sapiens
aaugcaauaguaggacugcu

SEQ ID NO: 481668 - RNA, 23 nt, Homo sapiens
aaugcuuuucuaaucugcagugg

SEQ ID NO: 481669 - RNA, 16 nt, Homo sapiens
aauggacaaaauccau

SEQ ID NO: 481670 - RNA, 19 nt, Homo sapiens
aauggacaaaauccaugaa

SEQ ID NO: 481671 - RNA, 15 nt, Homo sapiens
aaugggaaaagagau

SEQ ID NO: 481672 - RNA, 17 nt, Homo sapiens
aauggggugcaugaagg

SEQ ID NO: 481673 - RNA, 14 nt, Homo sapiens
aauguaagaaucau

SEQ ID NO: 481674 - RNA, 19 nt, Homo sapiens
aaugucauuaaacaugaca

SEQ ID NO: 481675 - RNA, 19 nt, Homo sapiens
aauguccugauuacaaugc

SEQ ID NO: 481676 - RNA, 18 nt, Homo sapiens
aauguuagauaguuacua

SEQ ID NO: 481677 - RNA, 11 nt, Homo sapiens
aauuaacuggg

SEQ ID NO: 481678 - RNA, 13 nt, Homo sapiens
aauuagaugacug

SEQ ID NO: 481679 - RNA, 17 nt, Homo sapiens
agccaagagucauguca

SEQ ID NO: 481680 - RNA, 15 nt, Homo sapiens
agccagcagccagcu

SEQ ID NO: 481681 - RNA, 16 nt, Homo sapiens
agccaucaaacacaau

SEQ ID NO: 481682 - RNA, 16 nt, Homo sapiens
agcccauucauuccau

SEQ ID NO: 481683 - RNA, 13 nt, Homo sapiens
agccgaccucagc

SEQ ID NO: 481684 - RNA, 20 nt, Homo sapiens
agccggagccuccagcugcc

SEQ ID NO: 481685 - RNA, 16 nt, Homo sapiens
agccuagccgaccuca

SEQ ID NO: 481686 - RNA, 12 nt, Homo sapiens
agccucacuuau

SEQ ID NO: 481687 - RNA, 20 nt, Homo sapiens
agccucauugaugucaaaaa

SEQ ID NO: 481688 - RNA, 13 nt, Homo sapiens
agccuccagcugc

SEQ ID NO: 481689 - RNA, 18 nt, Homo sapiens
agccucccaaguagcugg

SEQ ID NO: 481690 - RNA, 20 nt, Homo sapiens
agccucugccgcugccaugc

SEQ ID NO: 481691 - RNA, 18 nt, Homo sapiens
agccucuuagaugcaguu

SEQ ID NO: 481692 - RNA, 16 nt, Homo sapiens
agccucuuuaacagcu

SEQ ID NO: 481693 - RNA, 20 nt, Homo sapiens
agccucuuuaacagcuuucu

SEQ ID NO: 481694 - RNA, 14 nt, Homo sapiens
agccuggaacauca

SEQ ID NO: 481695 - RNA, 21 nt, Homo sapiens
agccuggccaacauagugaaa

SEQ ID NO: 481696 - RNA, 18 nt, Homo sapiens
agccugguggcaauaagg

SEQ ID NO: 481697 - RNA, 21 nt, Homo sapiens
agccuuccacacucaccucua

SEQ ID NO: 481698 - RNA, 13 nt, Homo sapiens
agcuaacuuauca

SEQ ID NO: 481699 - RNA, 12 nt, Homo sapiens
agcuagaaccua

SEQ ID NO: 481700 - RNA, 19 nt, Homo sapiens
agcuagaaucacuugacuu

SEQ ID NO: 481701 - RNA, 14 nt, Homo sapiens
agcucacuguucua

SEQ ID NO: 481702 - RNA, 16 nt, Homo sapiens
agcucagcauuuccac

SEQ ID NO: 481703 - RNA, 13 nt, Homo sapiens
agcucaucucagc

SEQ ID NO: 481704 - RNA, 18 nt, Homo sapiens
agcuccacuuucagugaa

SEQ ID NO: 481705 - RNA, 23 nt, Homo sapiens
agcugcccucuccugggcagcug

SEQ ID NO: 481706 - RNA, 17 nt, Homo sapiens
agcugcuacuagcucuu

SEQ ID NO: 481707 - RNA, 22 nt, Homo sapiens
agcuggcgucaugcaaagucau

SEQ ID NO: 481708 - RNA, 16 nt, Homo sapiens
agcugggggaagaagg

SEQ ID NO: 481709 - RNA, 21 nt, Homo sapiens
agcuggguuggaaaacaguau

SEQ ID NO: 481710 - RNA, 20 nt, Homo sapiens
agcuguaaaaagagagaaaa

SEQ ID NO: 481711 - RNA, 18 nt, Homo sapiens
uauuuuuuuaagcuguaa

SEQ ID NO: 481712 - RNA, 12 nt, Homo sapiens
ucaaaaagggaa

SEQ ID NO: 481713 - RNA, 18 nt, Homo sapiens
ucaaaaagggaaugcauu

SEQ ID NO: 481714 - RNA, 17 nt, Homo sapiens
ucaaaacucaguaucau

SEQ ID NO: 481715 - RNA, 22 nt, Homo sapiens
ucaaacgugaaaaugcuguauu

SEQ ID NO: 481716 - RNA, 20 nt, Homo sapiens
ucaaaguguaaacaccauag

SEQ ID NO: 481717 - RNA, 13 nt, Homo sapiens
ucaaauccuugaa

SEQ ID NO: 481718 - RNA, 15 nt, Homo sapiens
ucaaaugagccccuu

SEQ ID NO: 481719 - RNA, 20 nt, Homo sapiens
ucaaauggaagacacauuga

SEQ ID NO: 481720 - RNA, 21 nt, Homo sapiens
ucaaauggaagacacauugaa

SEQ ID NO: 481721 - RNA, 18 nt, Homo sapiens
ucaacaguuuccagucau

SEQ ID NO: 481722 - RNA, 15 nt, Homo sapiens
ucaacaucuagugag

SEQ ID NO: 481723 - RNA, 23 nt, Homo sapiens
ucaagagacaugguauugacuca

SEQ ID NO: 481724 - RNA, 22 nt, Homo sapiens
ucaagcaauucuccugccucag

SEQ ID NO: 481725 - RNA, 20 nt, Homo sapiens
ucaagcagccaagggaugaa

SEQ ID NO: 481726 - RNA, 19 nt, Homo sapiens
ucaagcuggaguacgugaa

SEQ ID NO: 481727 - RNA, 18 nt, Homo sapiens
ucaagggguguucaguua

SEQ ID NO: 481728 - RNA, 23 nt, Homo sapiens
gaaauuugccaauuuacuuuguu

SEQ ID NO: 481729 - RNA, 16 nt, Homo sapiens
gaacaccaagugucug

SEQ ID NO: 481730 - RNA, 22 nt, Homo sapiens
gaacacguuuuuucacuauuaa

SEQ ID NO: 481731 - RNA, 12 nt, Homo sapiens
gaacacuggggg

SEQ ID NO: 481732 - RNA, 24 nt, Homo sapiens
gaacacugguuauguugauagaau

SEQ ID NO: 481733 - RNA, 11 nt, Homo sapiens
gaacacuguga

SEQ ID NO: 481734 - RNA, 14 nt, Homo sapiens
gaacauaaagccuu

SEQ ID NO: 481735 - RNA, 17 nt, Homo sapiens
gaucaguugaggccagg

SEQ ID NO: 481736 - RNA, 16 nt, Homo sapiens
gaucucgacucacugc

SEQ ID NO: 481737 - RNA, 19 nt, Homo sapiens
gaucugaggguauaaagac

SEQ ID NO: 481738 - RNA, 16 nt, Homo sapiens
gaugagacuacuucag

SEQ ID NO: 481739 - RNA, 18 nt, Homo sapiens
gaugcauguucaaaccaa

SEQ ID NO: 481740 - RNA, 18 nt, Homo sapiens
gugccuggccaaagggau

SEQ ID NO: 481741 - RNA, 18 nt, Homo sapiens
gugccuguacaagcugau

SEQ ID NO: 481742 - RNA, 13 nt, Homo sapiens
gugcuaaaccaca

SEQ ID NO: 481743 - RNA, 22 nt, Homo sapiens
gugcucauucauuuaacagagc

SEQ ID NO: 481744 - RNA, 15 nt, Homo sapiens
guggaauugugcuga

SEQ ID NO: 481745 - RNA, 19 nt, Homo sapiens
guggagcagccaacaagca

SEQ ID NO: 481746 - RNA, 20 nt, Homo sapiens
guggcccuccaguguaugag

SEQ ID NO: 481747 - RNA, 15 nt, Homo sapiens
guggguuuugaacau

SEQ ID NO: 481748 - RNA, 18 nt, Homo sapiens
gugguggcgugagccugu

SEQ ID NO: 481749 - RNA, 19 nt, Homo sapiens
guguaugagagggcccugc

SEQ ID NO: 481750 - RNA, 19 nt, Homo sapiens
guguccagcugaguuucuc

SEQ ID NO: 481751 - RNA, 14 nt, Homo sapiens
gugugacucauuaa

SEQ ID NO: 481752 - RNA, 14 nt, Homo sapiens
gugugguugcucac

SEQ ID NO: 481753 - RNA, 14 nt, Homo sapiens
guuaaucauuucau

SEQ ID NO: 481754 - RNA, 14 nt, Homo sapiens
guuaaugguuugaa

SEQ ID NO: 481755 - RNA, 16 nt, Homo sapiens
guuagaaaugcaaauu

SEQ ID NO: 481756 - RNA, 18 nt, Homo sapiens
guuagcuaaaggaucuua

SEQ ID NO: 481757 - RNA, 19 nt, Homo sapiens
guuaucugucccagguuau

SEQ ID NO: 481758 - RNA, 19 nt, Homo sapiens
guuauuaacagcugauaca

SEQ ID NO: 481759 - RNA, 14 nt, Homo sapiens
guucagcaugaagg

SEQ ID NO: 481760 - RNA, 12 nt, Homo sapiens
guucaggccagu

SEQ ID NO: 481761 - RNA, 17 nt, Homo sapiens
guuccucuuugcaugga

SEQ ID NO: 481762 - RNA, 21 nt, Homo sapiens
guucuuucuuacacaagagcu

SEQ ID NO: 481763 - RNA, 19 nt, Homo sapiens
guugcucacagcuguaaua

SEQ ID NO: 481764 - RNA, 16 nt, Homo sapiens
guuggaaaaugugcaa

SEQ ID NO: 481765 - RNA, 21 nt, Homo sapiens
guuggagagcuagaaccugga

SEQ ID NO: 481766 - RNA, 11 nt, Homo sapiens
guuguugccaa

SEQ ID NO: 481767 - RNA, 20 nt, Homo sapiens
guuucaccaucagucaauga

SEQ ID NO: 481768 - RNA, 22 nt, Homo sapiens
guuucagaagcugcagcugguc

SEQ ID NO: 481769 - RNA, 19 nt, Homo sapiens
guuucuaaaguguuggcaa

SEQ ID NO: 481770 - RNA, 18 nt, Homo sapiens
guuucugauuaaugcuaa

SEQ ID NO: 481771 - RNA, 23 nt, Homo sapiens
guuucuuguaacuggguucaaaa

SEQ ID NO: 481772 - RNA, 15 nt, Homo sapiens
guuuggccaucucug

SEQ ID NO: 481773 - RNA, 17 nt, Homo sapiens
guuugggugucugcuaa

SEQ ID NO: 481774 - RNA, 13 nt, Homo sapiens
guuugucaaaaag

SEQ ID NO: 481775 - RNA, 14 nt, Homo sapiens
guuugucaaaaagu

SEQ ID NO: 481776 - RNA, 16 nt, Homo sapiens
guuuugacaucaauga

SEQ ID NO: 481777 - RNA, 19 nt, Homo sapiens
uaaaaaaauaaaaaagauc

SEQ ID NO: 481778 - RNA, 20 nt, Homo sapiens
uaaaaaggaauccacuccca

SEQ ID NO: 481779 - RNA, 16 nt, Homo sapiens
uaaaacaaaagcucau

SEQ ID NO: 481780 - RNA, 19 nt, Homo sapiens
uaaaacaaaagcucaucca

SEQ ID NO: 481781 - RNA, 15 nt, Homo sapiens
uaaaacauuuucaca

SEQ ID NO: 481782 - RNA, 15 nt, Homo sapiens
uaaaaccccaucucu

SEQ ID NO: 481783 - RNA, 19 nt, Homo sapiens
uaaaaccccaucucuacua

SEQ ID NO: 481784 - RNA, 15 nt, Homo sapiens
uaaaagacacagaac

SEQ ID NO: 481785 - RNA, 23 nt, Homo sapiens
uaaaagaugcauuaucuaugaua

SEQ ID NO: 481786 - RNA, 21 nt, Homo sapiens
uaaaagauguuuaugauguaa

SEQ ID NO: 481787 - RNA, 22 nt, Homo sapiens
uaaaauauuuuuaugugcaaua

SEQ ID NO: 481788 - RNA, 23 nt, Homo sapiens
uaaaauauuuuuaugugcaauaa

SEQ ID NO: 481789 - RNA, 20 nt, Homo sapiens
uaaaaucacaaacucaucca

SEQ ID NO: 481790 - RNA, 21 nt, Homo sapiens
uaaaaucacaaacucauccau

SEQ ID NO: 481791 - RNA, 14 nt, Homo sapiens
uaaaaugcauuuaa

SEQ ID NO: 481792 - RNA, 14 nt, Homo sapiens
uaaaauuguaaaau

SEQ ID NO: 481793 - RNA, 18 nt, Homo sapiens
uaaaauuucacuuaauaa

SEQ ID NO: 481794 - RNA, 18 nt, Homo sapiens
uaaaauuugauacagguu

SEQ ID NO: 481795 - RNA, 14 nt, Homo sapiens
uaaacaaauguaug

SEQ ID NO: 481796 - RNA, 23 nt, Homo sapiens
uaaacaaauguaugauuacauca

SEQ ID NO: 481797 - RNA, 15 nt, Homo sapiens
uaaacauuaguucua

SEQ ID NO: 481798 - RNA, 19 nt, Homo sapiens
uaaacuuugacaguuugau

SEQ ID NO: 481799 - RNA, 20 nt, Homo sapiens
uaaagacauaggaacaugua

SEQ ID NO: 481800 - RNA, 16 nt, Homo sapiens
uaaagcaggugcccag

SEQ ID NO: 481801 - RNA, 16 nt, Homo sapiens
uaaagcuuugugcaga

SEQ ID NO: 481802 - RNA, 21 nt, Homo sapiens
uaaaggauucuguaugccaag

SEQ ID NO: 481803 - RNA, 17 nt, Homo sapiens
uaaagguccuggcaaag

SEQ ID NO: 481804 - RNA, 14 nt, Homo sapiens
uaaaucgcuaccuu

SEQ ID NO: 481805 - RNA, 20 nt, Homo sapiens
uaaauggacaaaugcuuaug

SEQ ID NO: 481806 - RNA, 17 nt, Homo sapiens
uaaaugggacuggaguc

SEQ ID NO: 481807 - RNA, 15 nt, Homo sapiens
uaaaugucuuuucaa

SEQ ID NO: 481808 - RNA, 12 nt, Homo sapiens
uaacaaccugga

SEQ ID NO: 481809 - RNA, 14 nt, Homo sapiens
uaacaacuaugauu

SEQ ID NO: 481810 - RNA, 15 nt, Homo sapiens
uaacaaugcuguauu

SEQ ID NO: 481811 - RNA, 12 nt, Homo sapiens
uaacacacagcu

SEQ ID NO: 481812 - RNA, 17 nt, Homo sapiens
uaacacuguuaagagag

SEQ ID NO: 481813 - RNA, 22 nt, Homo sapiens
uaacuggcuucugcuugucauc

SEQ ID NO: 481814 - RNA, 12 nt, Homo sapiens
uaacuugagggu

SEQ ID NO: 481815 - RNA, 16 nt, Homo sapiens
uaagaaaaacauguca

SEQ ID NO: 481816 - RNA, 13 nt, Homo sapiens
uaagaaucauugu

SEQ ID NO: 481817 - RNA, 16 nt, Homo sapiens
uaagagggcacacacu

SEQ ID NO: 481818 - RNA, 20 nt, Homo sapiens
uaagagggcacacacugugu

SEQ ID NO: 481819 - RNA, 13 nt, Homo sapiens
uaagauaguugau

SEQ ID NO: 481820 - RNA, 17 nt, Homo sapiens
uaagauguucacugugg

SEQ ID NO: 481821 - RNA, 18 nt, Homo sapiens
uaagccaagagucauguc

SEQ ID NO: 481822 - RNA, 19 nt, Homo sapiens
uaagccaagagucauguca

SEQ ID NO: 481823 - RNA, 20 nt, Homo sapiens
uaagccaagagucaugucaa

SEQ ID NO: 481824 - RNA, 18 nt, Homo sapiens
uaagcccccuucccuucc

SEQ ID NO: 481825 - RNA, 13 nt, Homo sapiens
uaagcuguaaaaa

SEQ ID NO: 481826 - RNA, 20 nt, Homo sapiens
uaaggaauaugagcuuuaug

SEQ ID NO: 481827 - RNA, 16 nt, Homo sapiens
uaagguggguggauca

SEQ ID NO: 481828 - RNA, 19 nt, Homo sapiens
uaaguuagggaauggcaca

SEQ ID NO: 481829 - RNA, 18 nt, Homo sapiens
uaauaaaauucauuccau

SEQ ID NO: 481830 - RNA, 12 nt, Homo sapiens
uaauauugcaag

SEQ ID NO: 481831 - RNA, 17 nt, Homo sapiens
uaaucacucagugauug

SEQ ID NO: 481832 - RNA, 16 nt, Homo sapiens
uaauccaauaccucuu

SEQ ID NO: 481833 - RNA, 18 nt, Homo sapiens
uaauccagaaaaacugug

SEQ ID NO: 481834 - RNA, 14 nt, Homo sapiens
uaaucccagcacuu

SEQ ID NO: 481835 - RNA, 15 nt, Homo sapiens
uaaucccagcacuuu

SEQ ID NO: 481836 - RNA, 20 nt, Homo sapiens
uaaucccagcauguugagag

SEQ ID NO: 481837 - RNA, 20 nt, Homo sapiens
uaaucccagcuacuugggag

SEQ ID NO: 481838 - RNA, 17 nt, Homo sapiens
uaaucuuucacagggga

SEQ ID NO: 481839 - RNA, 17 nt, Homo sapiens
uaaugauaacuggaaac

SEQ ID NO: 481840 - RNA, 18 nt, Homo sapiens
uaauguagauaaagcacu

SEQ ID NO: 481841 - RNA, 15 nt, Homo sapiens
uaauucagcucuuga

SEQ ID NO: 481842 - RNA, 16 nt, Homo sapiens
uaauucuagcuuugag

SEQ ID NO: 481843 - RNA, 20 nt, Homo sapiens
uaauugugaaaauuacaguu

SEQ ID NO: 481844 - RNA, 17 nt, Homo sapiens
uacaauucaggcuuugg

SEQ ID NO: 481845 - RNA, 12 nt, Homo sapiens
uacacagacuau

SEQ ID NO: 481846 - RNA, 17 nt, Homo sapiens
uacacccacaguggaaa

SEQ ID NO: 481847 - RNA, 20 nt, Homo sapiens
uacagacagaaggugcuaag

SEQ ID NO: 481848 - RNA, 15 nt, Homo sapiens
uacaggacauucuca

SEQ ID NO: 481849 - RNA, 18 nt, Homo sapiens
uacaucccuuaccuggga

SEQ ID NO: 481850 - RNA, 14 nt, Homo sapiens
uacauggcucuaaa

SEQ ID NO: 481851 - RNA, 18 nt, Homo sapiens
uacauuauuggacuucca

SEQ ID NO: 481852 - RNA, 18 nt, Homo sapiens
uaccacaugccaagcacu

SEQ ID NO: 481853 - RNA, 15 nt, Homo sapiens
uaccuucaccaucug

SEQ ID NO: 481854 - RNA, 17 nt, Homo sapiens
uaccuucaccaucugua

SEQ ID NO: 481855 - RNA, 17 nt, Homo sapiens
uaccuugaacacugggg

SEQ ID NO: 481856 - RNA, 13 nt, Homo sapiens
uaccuugugcuaa

SEQ ID NO: 481857 - RNA, 23 nt, Homo sapiens
uacuaagauguucacuguggcau

SEQ ID NO: 481858 - RNA, 13 nt, Homo sapiens
uacuagguuuauc

SEQ ID NO: 481859 - RNA, 18 nt, Homo sapiens
uacuauagauucuuuauu

SEQ ID NO: 481860 - RNA, 19 nt, Homo sapiens
uacucaggaggcugaggca

SEQ ID NO: 481861 - RNA, 20 nt, Homo sapiens
uacucaggaggcugaggcag

SEQ ID NO: 481862 - RNA, 21 nt, Homo sapiens
uacuuugaacacaaagccugu

SEQ ID NO: 481863 - RNA, 15 nt, Homo sapiens
uacuuuuuguaaaaa

SEQ ID NO: 481864 - RNA, 21 nt, Homo sapiens
uagaaacuuguuagaaaugca

SEQ ID NO: 481865 - RNA, 19 nt, Homo sapiens
uagaacagugcuugccaca

SEQ ID NO: 481866 - RNA, 20 nt, Homo sapiens
uagaacaugugucuaucugc

SEQ ID NO: 481867 - RNA, 23 nt, Homo sapiens
uagaagagacguuuaaaagccau

SEQ ID NO: 481868 - RNA, 15 nt, Homo sapiens
uagaagcaucacagg

SEQ ID NO: 481869 - RNA, 19 nt, Homo sapiens
uagaauaaaauuguaaaau

SEQ ID NO: 481870 - RNA, 14 nt, Homo sapiens
uagacgaacagcug

SEQ ID NO: 481871 - RNA, 17 nt, Homo sapiens
uagagaaauuugccaau

SEQ ID NO: 481872 - RNA, 17 nt, Homo sapiens
uagagacuuugugaaaa

SEQ ID NO: 481873 - RNA, 22 nt, Homo sapiens
uagagaugggguuucacugugu

SEQ ID NO: 481874 - RNA, 15 nt, Homo sapiens
uagagauuuggugua

SEQ ID NO: 481875 - RNA, 21 nt, Homo sapiens
uagagauuugguguacaauuc

SEQ ID NO: 481876 - RNA, 18 nt, Homo sapiens
aggacaaauaaagcaaug

SEQ ID NO: 481877 - RNA, 14 nt, Homo sapiens
aggacacagaugaa

SEQ ID NO: 481878 - RNA, 21 nt, Homo sapiens
aggacaugaaaaauugcuaug

SEQ ID NO: 481879 - RNA, 16 nt, Homo sapiens
aggagacacaacaacu

SEQ ID NO: 481880 - RNA, 15 nt, Homo sapiens
aggagacccacaggu

SEQ ID NO: 481881 - RNA, 18 nt, Homo sapiens
aggagacccacagguaug

SEQ ID NO: 481882 - RNA, 20 nt, Homo sapiens
aggagagcucuuugugaaug

SEQ ID NO: 481883 - RNA, 14 nt, Homo sapiens
aggaggccacguga

SEQ ID NO: 481884 - RNA, 13 nt, Homo sapiens
aggaguacaggug

SEQ ID NO: 481885 - RNA, 15 nt, Homo sapiens
aggaguacaggugaa

SEQ ID NO: 481886 - RNA, 19 nt, Homo sapiens
aggaucaguugaggccagg

SEQ ID NO: 481887 - RNA, 22 nt, Homo sapiens
aggaucuucccacuuugccacu

SEQ ID NO: 481888 - RNA, 16 nt, Homo sapiens
aggaugccaagauuaa

SEQ ID NO: 481889 - RNA, 13 nt, Homo sapiens
aggauuccaccuu

SEQ ID NO: 481890 - RNA, 16 nt, Homo sapiens
aggcaaaaaugugccc

SEQ ID NO: 481891 - RNA, 21 nt, Homo sapiens
aggcaaaggcucucacuccag

SEQ ID NO: 481892 - RNA, 16 nt, Homo sapiens
aggcagacuugcagag

SEQ ID NO: 481893 - RNA, 19 nt, Homo sapiens
aggcagagguugcagugaa

SEQ ID NO: 481894 - RNA, 17 nt, Homo sapiens
aggcagcugacacaucu

SEQ ID NO: 481895 - RNA, 18 nt, Homo sapiens
aggcagcuguugcaguga

SEQ ID NO: 481896 - RNA, 20 nt, Homo sapiens
aggcagcuuuuucucuccca

SEQ ID NO: 481897 - RNA, 23 nt, Homo sapiens
aggcagcuuuuucucucccacua

SEQ ID NO: 481898 - RNA, 15 nt, Homo sapiens
aggcaggaacauaca

SEQ ID NO: 481899 - RNA, 16 nt, Homo sapiens
aggcauccuuccucac

SEQ ID NO: 481900 - RNA, 16 nt, Homo sapiens
aggccuggccaugugg

SEQ ID NO: 481901 - RNA, 13 nt, Homo sapiens
aggcuacacugac

SEQ ID NO: 481902 - RNA, 17 nt, Homo sapiens
aggcuaccucaccuggg

SEQ ID NO: 481903 - RNA, 15 nt, Homo sapiens
aggcucucacuccag

SEQ ID NO: 481904 - RNA, 14 nt, Homo sapiens
aggcucugucucaa

SEQ ID NO: 481905 - RNA, 16 nt, Homo sapiens
aggcugagaacacugu

SEQ ID NO: 481906 - RNA, 17 nt, Homo sapiens
aggcugagaacacugug

SEQ ID NO: 481907 - RNA, 18 nt, Homo sapiens
aggcugagaacacuguga

SEQ ID NO: 481908 - RNA, 19 nt, Homo sapiens
aggcugagaacacugugaa

SEQ ID NO: 481909 - RNA, 14 nt, Homo sapiens
aggcuggcagauuu

SEQ ID NO: 481910 - RNA, 19 nt, Homo sapiens
agggaaggucucaggagaa

SEQ ID NO: 481911 - RNA, 21 nt, Homo sapiens
agggaaguucaggcucugaga

SEQ ID NO: 481912 - RNA, 14 nt, Homo sapiens
agggacccacuuca

SEQ ID NO: 481913 - RNA, 19 nt, Homo sapiens
agggauuuuagucacacgu

SEQ ID NO: 481914 - RNA, 15 nt, Homo sapiens
agggcacacacugug

SEQ ID NO: 481915 - RNA, 12 nt, Homo sapiens
agggcacugggu

SEQ ID NO: 481916 - RNA, 16 nt, Homo sapiens
agggccccagcacuaa

SEQ ID NO: 481917 - RNA, 14 nt, Homo sapiens
agggccuggaagac

SEQ ID NO: 481918 - RNA, 14 nt, Homo sapiens
agggcuagaaccua

SEQ ID NO: 481919 - RNA, 17 nt, Homo sapiens
agggcuagaaccuggag

SEQ ID NO: 481920 - RNA, 23 nt, Homo sapiens
agggcuagaaucuggagagcuag

SEQ ID NO: 481921 - RNA, 21 nt, Homo sapiens
acacugggacuugcaaaaagg

SEQ ID NO: 481922 - RNA, 21 nt, Homo sapiens
acacugggcuucuagaaccag

SEQ ID NO: 481923 - RNA, 20 nt, Homo sapiens
acacuuggaacacaaugacu

SEQ ID NO: 481924 - RNA, 17 nt, Homo sapiens
acagaagggcuaacuca

SEQ ID NO: 481925 - RNA, 13 nt, Homo sapiens
acagaaggggugg

SEQ ID NO: 481926 - RNA, 20 nt, Homo sapiens
acagagauaauucuagcuuu

SEQ ID NO: 481927 - RNA, 18 nt, Homo sapiens
acagagcaggacugcaca

SEQ ID NO: 481928 - RNA, 20 nt, Homo sapiens
acagagcgagauuccaucuc

SEQ ID NO: 481929 - RNA, 16 nt, Homo sapiens
acagagcucucugagg

SEQ ID NO: 481930 - RNA, 21 nt, Homo sapiens
acagagucucacucuguugcc

SEQ ID NO: 481931 - RNA, 20 nt, Homo sapiens
acagagucuggcucugucac

SEQ ID NO: 481932 - RNA, 21 nt, Homo sapiens
acagagucuggcucugucacc

SEQ ID NO: 481933 - RNA, 19 nt, Homo sapiens
acagcacccucuccagaug

SEQ ID NO: 481934 - RNA, 18 nt, Homo sapiens
acagcagcucaggcacac

SEQ ID NO: 481935 - RNA, 20 nt, Homo sapiens
acagccgcuccugucugcca

SEQ ID NO: 481936 - RNA, 15 nt, Homo sapiens
acagcugacauggag

SEQ ID NO: 481937 - RNA, 21 nt, Homo sapiens
acaggcaacugaggcagacag

SEQ ID NO: 481938 - RNA, 22 nt, Homo sapiens
acagggaacucagaauacagac

SEQ ID NO: 481939 - RNA, 20 nt, Homo sapiens
acagggcgagacucugucuc

SEQ ID NO: 481940 - RNA, 14 nt, Homo sapiens
acaggguucauuga

SEQ ID NO: 481941 - RNA, 22 nt, Homo sapiens
acagguauucugcugaugcuac

SEQ ID NO: 481942 - RNA, 23 nt, Homo sapiens
acaguaaauggcuuauccagcug

SEQ ID NO: 481943 - RNA, 13 nt, Homo sapiens
acaguaacuguga

SEQ ID NO: 481944 - RNA, 19 nt, Homo sapiens
acagucaccccaggacuca

SEQ ID NO: 481945 - RNA, 19 nt, Homo sapiens
acaguccuucaaacuucca

SEQ ID NO: 481946 - RNA, 22 nt, Homo sapiens
acagugacauuuauuuuucuca

SEQ ID NO: 481947 - RNA, 16 nt, Homo sapiens
acagugagaaaccaua

SEQ ID NO: 481948 - RNA, 16 nt, Homo sapiens
acaguggagagagaaa

SEQ ID NO: 481949 - RNA, 14 nt, Homo sapiens
acauaaaagacaca

SEQ ID NO: 481950 - RNA, 14 nt, Homo sapiens
acauaacauaagcu

SEQ ID NO: 481951 - RNA, 13 nt, Homo sapiens
acauagugaaagu

SEQ ID NO: 481952 - RNA, 13 nt, Homo sapiens
acaucaaugauga

SEQ ID NO: 481953 - RNA, 22 nt, Homo sapiens
acaucacuugagacaaaucuau

SEQ ID NO: 481954 - RNA, 13 nt, Homo sapiens
acaucauggacug

SEQ ID NO: 481955 - RNA, 23 nt, Homo sapiens
acaucucuuccuccgaggccagu

SEQ ID NO: 481956 - RNA, 19 nt, Homo sapiens
acaugaacccauccaaugg

SEQ ID NO: 481957 - RNA, 23 nt, Homo sapiens
acaugcaaagauccccaaaacag

SEQ ID NO: 481958 - RNA, 14 nt, Homo sapiens
acaugccaagcacu

SEQ ID NO: 481959 - RNA, 15 nt, Homo sapiens
acaugggacauuugc

SEQ ID NO: 481960 - RNA, 14 nt, Homo sapiens
acauuaaacacaaa

SEQ ID NO: 481961 - RNA, 15 nt, Homo sapiens
acauuagucauucaa

SEQ ID NO: 481962 - RNA, 17 nt, Homo sapiens
acauucagagcuuacuu

SEQ ID NO: 481963 - RNA, 11 nt, Homo sapiens
acauugaacaa

SEQ ID NO: 481964 - RNA, 22 nt, Homo sapiens
acauuuauuuuucucaugaauc

SEQ ID NO: 481965 - RNA, 22 nt, Homo sapiens
acauuugaaaucuaugaaauau

SEQ ID NO: 481966 - RNA, 15 nt, Homo sapiens
acauuugcucaugga

SEQ ID NO: 481967 - RNA, 18 nt, Homo sapiens
acauuuguaaauuuucaa

SEQ ID NO: 481968 - RNA, 13 nt, Homo sapiens
accaaucaugaau

SEQ ID NO: 481969 - RNA, 14 nt, Homo sapiens
accacaauauguau

SEQ ID NO: 481970 - RNA, 21 nt, Homo sapiens
accacaggaaccacaagacug

SEQ ID NO: 481971 - RNA, 14 nt, Homo sapiens
auagaaaauuaugc

SEQ ID NO: 481972 - RNA, 15 nt, Homo sapiens
auagagccacguaug

SEQ ID NO: 481973 - RNA, 14 nt, Homo sapiens
auagcagcugcuac

SEQ ID NO: 481974 - RNA, 22 nt, Homo sapiens
auagcagcugcuacuagcucuu

SEQ ID NO: 481975 - RNA, 12 nt, Homo sapiens
auagccaaaaau

SEQ ID NO: 481976 - RNA, 18 nt, Homo sapiens
auagcuaguuaugugaga

SEQ ID NO: 481977 - RNA, 13 nt, Homo sapiens
auaggagccacaa

SEQ ID NO: 481978 - RNA, 17 nt, Homo sapiens
auaggcccagugagaug

SEQ ID NO: 481979 - RNA, 14 nt, Homo sapiens
auaguauugugcau

SEQ ID NO: 481980 - RNA, 15 nt, Homo sapiens
auaguauugugcaua

SEQ ID NO: 481981 - RNA, 22 nt, Homo sapiens
auaguauugugcauagagccac

SEQ ID NO: 481982 - RNA, 18 nt, Homo sapiens
auagucccagcuacccag

SEQ ID NO: 481983 - RNA, 17 nt, Homo sapiens
auagucccagcuacuca

SEQ ID NO: 481984 - RNA, 21 nt, Homo sapiens
auagugagaccuuggcgcuac

SEQ ID NO: 481985 - RNA, 22 nt, Homo sapiens
auaguggacaguaaccuuucaa

SEQ ID NO: 481986 - RNA, 17 nt, Homo sapiens
auaguggggucagggcu

SEQ ID NO: 481987 - RNA, 10 nt, Homo sapiens
auagugucuu

SEQ ID NO: 481988 - RNA, 14 nt, Homo sapiens
auaguugugcaugc

SEQ ID NO: 481989 - RNA, 15 nt, Homo sapiens
auauaaacacuauau

SEQ ID NO: 481990 - RNA, 16 nt, Homo sapiens
auauacucuucaagga

SEQ ID NO: 481991 - RNA, 17 nt, Homo sapiens
auauagccaaaaauguc

SEQ ID NO: 481992 - RNA, 17 nt, Homo sapiens
auauauaacaaugcugu

SEQ ID NO: 481993 - RNA, 20 nt, Homo sapiens
auauauaacuuccuaugcaa

SEQ ID NO: 481994 - RNA, 14 nt, Homo sapiens
auaucaucccuguc

SEQ ID NO: 481995 - RNA, 17 nt, Homo sapiens
auaucuaaaacauguag

SEQ ID NO: 481996 - RNA, 11 nt, Homo sapiens
auaugcaauau

SEQ ID NO: 481997 - RNA, 16 nt, Homo sapiens
auauggagugccugua

SEQ ID NO: 481998 - RNA, 16 nt, Homo sapiens
auauggcagugucuuu

SEQ ID NO: 481999 - RNA, 24 nt, Homo sapiens
auauuaaaaucacaaacucaucca

SEQ ID NO: 482000 - RNA, 18 nt, Homo sapiens
auauuuuuaugugcaaua

SEQ ID NO: 482001 - RNA, 18 nt, Homo sapiens
aucaaacacaaugccuca

SEQ ID NO: 482002 - RNA, 23 nt, Homo sapiens
aucaaauggaagacacauugaaa

SEQ ID NO: 482003 - RNA, 16 nt, Homo sapiens
aucaagagacauggua

SEQ ID NO: 482004 - RNA, 13 nt, Homo sapiens
aucaagccuguga

SEQ ID NO: 482005 - RNA, 15 nt, Homo sapiens
aucaagcuggaguac

SEQ ID NO: 482006 - RNA, 16 nt, Homo sapiens
aucaaugaaaugaugu

SEQ ID NO: 482007 - RNA, 21 nt, Homo sapiens
aucaauucuauuacgugcaau

SEQ ID NO: 482008 - RNA, 22 nt, Homo sapiens
aucacaaaggaaagauuugcca

SEQ ID NO: 482009 - RNA, 23 nt, Homo sapiens
aucacacgucuggcuucacagau

SEQ ID NO: 482010 - RNA, 19 nt, Homo sapiens
aucacauucgaguguuuca

SEQ ID NO: 482011 - RNA, 14 nt, Homo sapiens
aucaccacagggau

SEQ ID NO: 482012 - RNA, 13 nt, Homo sapiens
uauucaaguauua

SEQ ID NO: 482013 - RNA, 14 nt, Homo sapiens
uauucccccaaagc

SEQ ID NO: 482014 - RNA, 19 nt, Homo sapiens
uauugaugauguugaacaa

SEQ ID NO: 482015 - RNA, 14 nt, Homo sapiens
uauugcugaucuuu

SEQ ID NO: 482016 - RNA, 23 nt, Homo sapiens
uauuuauugcuguguaacacugu

SEQ ID NO: 482017 - RNA, 22 nt, Homo sapiens
uauuuccauauuaaaaucacaa

SEQ ID NO: 482018 - RNA, 15 nt, Homo sapiens
uauuucucuuugcac

SEQ ID NO: 482019 - RNA, 15 nt, Homo sapiens
uauuuguuugugcau

SEQ ID NO: 482020 - RNA, 12 nt, Homo sapiens
uauuuugaacaa

SEQ ID NO: 482021 - RNA, 16 nt, Homo sapiens
uauuuuggaucuauca

SEQ ID NO: 482022 - RNA, 16 nt, Homo sapiens
ucaaaaauacucacau

SEQ ID NO: 482023 - RNA, 23 nt, Homo sapiens
ucaaaaauagggaaguaacagua

SEQ ID NO: 482024 - RNA, 14 nt, Homo sapiens
ucaaaacucaguau

SEQ ID NO: 482025 - RNA, 19 nt, Homo sapiens
ucaaaauguccugauuaca

SEQ ID NO: 482026 - RNA, 19 nt, Homo sapiens
ucaaaccaaaucacugaac

SEQ ID NO: 482027 - RNA, 15 nt, Homo sapiens
ucaaagcugggauua

SEQ ID NO: 482028 - RNA, 23 nt, Homo sapiens
ucaacaagagacuggaaggacca

SEQ ID NO: 482029 - RNA, 18 nt, Homo sapiens
ucaagcaguagacaagca

SEQ ID NO: 482030 - RNA, 23 nt, Homo sapiens
ucaagccgcaucccagacuugcu

SEQ ID NO: 482031 - RNA, 20 nt, Homo sapiens
ucaaguuggcuucuaaucaa

SEQ ID NO: 482032 - RNA, 16 nt, Homo sapiens
ucaauaaaccacaagc

SEQ ID NO: 482033 - RNA, 12 nt, Homo sapiens
ucaauacuaugg

SEQ ID NO: 482034 - RNA, 21 nt, Homo sapiens
ucaauaucugaaucaccuuga

SEQ ID NO: 482035 - RNA, 20 nt, Homo sapiens
ucaauccaagagucugauga

SEQ ID NO: 482036 - RNA, 20 nt, Homo sapiens
ucaaugauuuacucaauauc

SEQ ID NO: 482037 - RNA, 12 nt, Homo sapiens
ucaaugcuauaa

SEQ ID NO: 482038 - RNA, 15 nt, Homo sapiens
ucacaaacucaucca

SEQ ID NO: 482039 - RNA, 11 nt, Homo sapiens
ucacacacagg

SEQ ID NO: 482040 - RNA, 19 nt, Homo sapiens
ucacacgggggcagcugau

SEQ ID NO: 482041 - RNA, 15 nt, Homo sapiens
ucacacgggguauuu

SEQ ID NO: 482042 - RNA, 15 nt, Homo sapiens
ucacacuaucacugc

SEQ ID NO: 482043 - RNA, 18 nt, Homo sapiens
ucacauucgaguguuuca

SEQ ID NO: 482044 - RNA, 22 nt, Homo sapiens
ucaccacagggauccccaggau

SEQ ID NO: 482045 - RNA, 16 nt, Homo sapiens
ucaccauaaaaaggaa

SEQ ID NO: 482046 - RNA, 12 nt, Homo sapiens
ucaccucaugga

SEQ ID NO: 482047 - RNA, 21 nt, Homo sapiens
ucacgaagucaguaguuugag

SEQ ID NO: 482048 - RNA, 14 nt, Homo sapiens
ucacgccacugcac

SEQ ID NO: 482049 - RNA, 19 nt, Homo sapiens
ucacucagugauugcaauu

SEQ ID NO: 482050 - RNA, 15 nt, Homo sapiens
ucacugaacuuugcu

SEQ ID NO: 482051 - RNA, 21 nt, Homo sapiens
ucacugccauauacucuucaa

SEQ ID NO: 482052 - RNA, 15 nt, Homo sapiens
ucacuuccuauaugc

SEQ ID NO: 482053 - RNA, 16 nt, Homo sapiens
ucacuugacuuugcca

SEQ ID NO: 482054 - RNA, 17 nt, Homo sapiens
ucagcaacaaccagcau

SEQ ID NO: 482055 - RNA, 17 nt, Homo sapiens
ucagcaagaagauccua

SEQ ID NO: 482056 - RNA, 19 nt, Homo sapiens
ucagcauuuccacaccaag

SEQ ID NO: 482057 - RNA, 21 nt, Homo sapiens
ucagccccugauccugugaag

SEQ ID NO: 482058 - RNA, 18 nt, Homo sapiens
ucagccuagccgaccuca

SEQ ID NO: 482059 - RNA, 18 nt, Homo sapiens
ucagccuggcugauuauc

SEQ ID NO: 482060 - RNA, 15 nt, Homo sapiens
ucagcuggaucucca

SEQ ID NO: 482061 - RNA, 18 nt, Homo sapiens
ucaggaccaggcaaugug

SEQ ID NO: 482062 - RNA, 19 nt, Homo sapiens
ucaggaccaggcaauguga

SEQ ID NO: 482063 - RNA, 20 nt, Homo sapiens
ucaggccaucaucaguggag

SEQ ID NO: 482064 - RNA, 13 nt, Homo sapiens
ucaggcucugaga

SEQ ID NO: 482065 - RNA, 21 nt, Homo sapiens
ucaggugauccaccugccucg

SEQ ID NO: 482066 - RNA, 18 nt, Homo sapiens
ucaguaaauguuugugga

SEQ ID NO: 482067 - RNA, 17 nt, Homo sapiens
ucaguaaguaucuggag

SEQ ID NO: 482068 - RNA, 10 nt, Homo sapiens
ucagugucca

SEQ ID NO: 482069 - RNA, 14 nt, Homo sapiens
ucaguuguuuuccc

SEQ ID NO: 482070 - RNA, 14 nt, Homo sapiens
ucauaacagucuua

SEQ ID NO: 482071 - RNA, 19 nt, Homo sapiens
ucauaauuucuucacucaa

SEQ ID NO: 482072 - RNA, 20 nt, Homo sapiens
ucaucaaauggaagacacau

SEQ ID NO: 482073 - RNA, 13 nt, Homo sapiens
ucaucucaaggaa

SEQ ID NO: 482074 - RNA, 13 nt, Homo sapiens
ucaucucagugcu

SEQ ID NO: 482075 - RNA, 14 nt, Homo sapiens
ucaugacuuuucca

SEQ ID NO: 482076 - RNA, 18 nt, Homo sapiens
ucaugcugugugacucaa

SEQ ID NO: 482077 - RNA, 15 nt, Homo sapiens
ucauuauuugcagag

SEQ ID NO: 482078 - RNA, 16 nt, Homo sapiens
ucauuccauucuggaa

SEQ ID NO: 482079 - RNA, 21 nt, Homo sapiens
ucauugaaccucuuggguuca

SEQ ID NO: 482080 - RNA, 17 nt, Homo sapiens
ucauugaagacccucaa

SEQ ID NO: 482081 - RNA, 17 nt, Homo sapiens
ucauuguaaucuuucau

SEQ ID NO: 482082 - RNA, 21 nt, Homo sapiens
uccaaagggcauggguuuuau

SEQ ID NO: 482083 - RNA, 21 nt, Homo sapiens
uccaaaguuuuaaaccuguua

SEQ ID NO: 482084 - RNA, 16 nt, Homo sapiens
uccaacaugugcucag

SEQ ID NO: 482085 - RNA, 21 nt, Homo sapiens
uccaaggaaaccacagcugcu

SEQ ID NO: 482086 - RNA, 19 nt, Homo sapiens
uccaauuccuugcacauag

SEQ ID NO: 482087 - RNA, 21 nt, Homo sapiens
uccacacaugaguauugugau

SEQ ID NO: 482088 - RNA, 16 nt, Homo sapiens
uccagcgguucucaaa

SEQ ID NO: 482089 - RNA, 17 nt, Homo sapiens
uccagcugccccgggga

SEQ ID NO: 482090 - RNA, 18 nt, Homo sapiens
uccaggguccacaggaag

SEQ ID NO: 482091 - RNA, 21 nt, Homo sapiens
uccaucaguuagagcugacac

SEQ ID NO: 482092 - RNA, 16 nt, Homo sapiens
uccauccuugagucaa

SEQ ID NO: 482093 - RNA, 21 nt, Homo sapiens
uccauccuugagucaaaaaau

SEQ ID NO: 482094 - RNA, 17 nt, Homo sapiens
uccaucuuuccugaugg

SEQ ID NO: 482095 - RNA, 21 nt, Homo sapiens
uccaugaacaucauggacuga

SEQ ID NO: 482096 - RNA, 20 nt, Homo sapiens
ucccaaagugcugagauuau

SEQ ID NO: 482097 - RNA, 16 nt, Homo sapiens
ucccagcauguugaga

SEQ ID NO: 482098 - RNA, 21 nt, Homo sapiens
ucccaggagaaucacuugaac

SEQ ID NO: 482099 - RNA, 18 nt, Homo sapiens
uccccaaacccacccaua

SEQ ID NO: 482100 - RNA, 17 nt, Homo sapiens
uccccaacugaguucaa

SEQ ID NO: 482101 - RNA, 13 nt, Homo sapiens
ucccccuuucucc

SEQ ID NO: 482102 - RNA, 15 nt, Homo sapiens
ucccggccauucucc

SEQ ID NO: 482103 - RNA, 22 nt, Homo sapiens
ucccuaucuuugccacccucau

SEQ ID NO: 482104 - RNA, 17 nt, Homo sapiens
ucccuauggaagcauau

SEQ ID NO: 482105 - RNA, 17 nt, Homo sapiens
ucccugcuuaaugaaaa

SEQ ID NO: 482106 - RNA, 16 nt, Homo sapiens
ucccugguucugauga

SEQ ID NO: 482107 - RNA, 16 nt, Homo sapiens
ucccuuccacuaugag

SEQ ID NO: 482108 - RNA, 15 nt, Homo sapiens
ucccuucucagaaaa

SEQ ID NO: 482109 - RNA, 13 nt, Homo sapiens
uccgaggccagua

SEQ ID NO: 482110 - RNA, 13 nt, Homo sapiens
uccgcauccuagu

SEQ ID NO: 482111 - RNA, 21 nt, Homo sapiens
uccuacacccuuggacuugag

SEQ ID NO: 482112 - RNA, 17 nt, Homo sapiens
uccuagggccacugaag

SEQ ID NO: 482113 - RNA, 14 nt, Homo sapiens
uccuaguagcuuuc

SEQ ID NO: 482114 - RNA, 15 nt, Homo sapiens
uccuauaugcacuua

SEQ ID NO: 482115 - RNA, 20 nt, Homo sapiens
uccuauuuuucuuguuuuau

SEQ ID NO: 482116 - RNA, 16 nt, Homo sapiens
uccucaguuuuuccua

SEQ ID NO: 482117 - RNA, 14 nt, Homo sapiens
uccuccagcaauag

SEQ ID NO: 482118 - RNA, 21 nt, Homo sapiens
uccuccuagacucugugaucu

SEQ ID NO: 482119 - RNA, 18 nt, Homo sapiens
uccucuaugaacuaugga

SEQ ID NO: 482120 - RNA, 14 nt, Homo sapiens
uccucugcuugcca

SEQ ID NO: 482121 - RNA, 15 nt, Homo sapiens
uccucugcuugccau

SEQ ID NO: 482122 - RNA, 16 nt, Homo sapiens
uccucuucucaaagcu

SEQ ID NO: 482123 - RNA, 22 nt, Homo sapiens
uccucuuggccucagcagcucu

SEQ ID NO: 482124 - RNA, 13 nt, Homo sapiens
uccugggcagcug

SEQ ID NO: 482125 - RNA, 16 nt, Homo sapiens
uccugggcagcugccu

SEQ ID NO: 482126 - RNA, 11 nt, Homo sapiens
uccuguucucu

SEQ ID NO: 482127 - RNA, 17 nt, Homo sapiens
uccuguucuuucuuaca

SEQ ID NO: 482128 - RNA, 13 nt, Homo sapiens
uccuuaacacuga

SEQ ID NO: 482129 - RNA, 21 nt, Homo sapiens
ucgauccccugucacgugugg

SEQ ID NO: 482130 - RNA, 20 nt, Homo sapiens
ucgcuagaguucuccagaca

SEQ ID NO: 482131 - RNA, 15 nt, Homo sapiens
ucgcugucaucucag

SEQ ID NO: 482132 - RNA, 19 nt, Homo sapiens
ucguuugaaucacaguaua

SEQ ID NO: 482133 - RNA, 16 nt, Homo sapiens
ucuaaaucaccagaga

SEQ ID NO: 482134 - RNA, 23 nt, Homo sapiens
ucuaaaucaccagagaccaaaca

SEQ ID NO: 482135 - RNA, 18 nt, Homo sapiens
ucuaaggaauaugagcuu

SEQ ID NO: 482136 - RNA, 20 nt, Homo sapiens
ucuagaaccaggcaacuugg

SEQ ID NO: 482137 - RNA, 18 nt, Homo sapiens
ucuaucauuaaaguucua

SEQ ID NO: 482138 - RNA, 20 nt, Homo sapiens
ucuaucccaaacuaagcuau

SEQ ID NO: 482139 - RNA, 19 nt, Homo sapiens
ucuaugaaauaucaugcuc

SEQ ID NO: 482140 - RNA, 15 nt, Homo sapiens
ucuaugcuuuggaau

SEQ ID NO: 482141 - RNA, 16 nt, Homo sapiens
ucuauggcacccaugc

SEQ ID NO: 482142 - RNA, 20 nt, Homo sapiens
ucuauggcacccaugcaccu

SEQ ID NO: 482143 - RNA, 20 nt, Homo sapiens
ucuauuuugagaucauugca

SEQ ID NO: 482144 - RNA, 22 nt, Homo sapiens
ucucaaacgguacacagacuau

SEQ ID NO: 482145 - RNA, 22 nt, Homo sapiens
ucucaagaagaacaucuuuaug

SEQ ID NO: 482146 - RNA, 22 nt, Homo sapiens
ucucaagccgcaucccagacuu

SEQ ID NO: 482147 - RNA, 13 nt, Homo sapiens
ucucagugcugua

SEQ ID NO: 482148 - RNA, 12 nt, Homo sapiens
ucucauuccugu

SEQ ID NO: 482149 - RNA, 20 nt, Homo sapiens
ucucauuuuucuaaaauaca

SEQ ID NO: 482150 - RNA, 16 nt, Homo sapiens
ucuccccgauggggca

SEQ ID NO: 482151 - RNA, 19 nt, Homo sapiens
ucucgaacucccgaccuca

SEQ ID NO: 482152 - RNA, 17 nt, Homo sapiens
ucucuucaauaaaccac

SEQ ID NO: 482153 - RNA, 21 nt, Homo sapiens
ucucuuuauauggccucaaga

SEQ ID NO: 482154 - RNA, 23 nt, Homo sapiens
ucucuuuuuagagaaauuugcca

SEQ ID NO: 482155 - RNA, 17 nt, Homo sapiens
ucugaagccucacuuau

SEQ ID NO: 482156 - RNA, 16 nt, Homo sapiens
ucugaaucaaggugau

SEQ ID NO: 482157 - RNA, 21 nt, Homo sapiens
ucugagccagucccucagcca

SEQ ID NO: 482158 - RNA, 16 nt, Homo sapiens
ucugaugcaagcaaga

SEQ ID NO: 482159 - RNA, 20 nt, Homo sapiens
ucugccuguggaguagccau

SEQ ID NO: 482160 - RNA, 19 nt, Homo sapiens
ucugcuggaaagucaacau

SEQ ID NO: 482161 - RNA, 18 nt, Homo sapiens
ucuggaauccaaaccaca

SEQ ID NO: 482162 - RNA, 15 nt, Homo sapiens
ucugucaaugucuug

SEQ ID NO: 482163 - RNA, 15 nt, Homo sapiens
ucugucccacuuggc

SEQ ID NO: 482164 - RNA, 21 nt, Homo sapiens
ucuguuguguuugucaaaaag

SEQ ID NO: 482165 - RNA, 19 nt, Homo sapiens
ucuguuuccaggucagaaa

SEQ ID NO: 482166 - RNA, 14 nt, Homo sapiens
ucuuagaugcaguu

SEQ ID NO: 482167 - RNA, 21 nt, Homo sapiens
ucuuauccugucccuccucca

SEQ ID NO: 482168 - RNA, 17 nt, Homo sapiens
ucuuauuugcuauagaa

SEQ ID NO: 482169 - RNA, 13 nt, Homo sapiens
ucuuauuugcuca

SEQ ID NO: 482170 - RNA, 18 nt, Homo sapiens
ucuucacucaaucucuga

SEQ ID NO: 482171 - RNA, 12 nt, Homo sapiens
ucuucagccuag

SEQ ID NO: 482172 - RNA, 20 nt, Homo sapiens
ucuucccuaucuuugccacc

SEQ ID NO: 482173 - RNA, 15 nt, Homo sapiens
ucuucuaccagaccc

SEQ ID NO: 482174 - RNA, 14 nt, Homo sapiens
ucuugccacugcac

SEQ ID NO: 482175 - RNA, 12 nt, Homo sapiens
ucuuuccaaucc

SEQ ID NO: 482176 - RNA, 23 nt, Homo sapiens
ucuuuccuggacuuaacucuaau

SEQ ID NO: 482177 - RNA, 14 nt, Homo sapiens
ucuuucuuacacaa

SEQ ID NO: 482178 - RNA, 12 nt, Homo sapiens
ucuuugcaugga

SEQ ID NO: 482179 - RNA, 12 nt, Homo sapiens
ucuuuucaaaag

SEQ ID NO: 482180 - RNA, 12 nt, Homo sapiens
ugaaaaaugccu

SEQ ID NO: 482181 - RNA, 16 nt, Homo sapiens
ugaaaacuuagucugu

SEQ ID NO: 482182 - RNA, 23 nt, Homo sapiens
ugaaaaggguguuagcuaaagga

SEQ ID NO: 482183 - RNA, 14 nt, Homo sapiens
ugaaacauuuggaa

SEQ ID NO: 482184 - RNA, 17 nt, Homo sapiens
ugaaagaggcauuccca

SEQ ID NO: 482185 - RNA, 17 nt, Homo sapiens
ugaaauauacacacagc

SEQ ID NO: 482186 - RNA, 17 nt, Homo sapiens
ugaaauauuuuugaaug

SEQ ID NO: 482187 - RNA, 20 nt, Homo sapiens
ugaaauccacacaucuuuag

SEQ ID NO: 482188 - RNA, 22 nt, Homo sapiens
ugaaccacccuggaaauucugc

SEQ ID NO: 482189 - RNA, 21 nt, Homo sapiens
ugaacccaggaggcagcuguu

SEQ ID NO: 482190 - RNA, 17 nt, Homo sapiens
ugaacccauccaaugga

SEQ ID NO: 482191 - RNA, 20 nt, Homo sapiens
ugaacugaaaacaagccaug

SEQ ID NO: 482192 - RNA, 20 nt, Homo sapiens
ugaagacugggugaggauaa

SEQ ID NO: 482193 - RNA, 20 nt, Homo sapiens
ugaagauccccaacugcucc

SEQ ID NO: 482194 - RNA, 15 nt, Homo sapiens
ugaagaugaugcuau

SEQ ID NO: 482195 - RNA, 20 nt, Homo sapiens
ugaagcaaguuaacacucua

SEQ ID NO: 482196 - RNA, 21 nt, Homo sapiens
ugaagcucuugaagacacuga

SEQ ID NO: 482197 - RNA, 23 nt, Homo sapiens
ugaagggaugcugcaauguagga

SEQ ID NO: 482198 - RNA, 23 nt, Homo sapiens
ugaaggguucaccaggucaggga

SEQ ID NO: 482199 - RNA, 15 nt, Homo sapiens
ugaaguuuccuuggc

SEQ ID NO: 482200 - RNA, 14 nt, Homo sapiens
ugaauacaggcaua

SEQ ID NO: 482201 - RNA, 15 nt, Homo sapiens
ugaauaucaguuauu

SEQ ID NO: 482202 - RNA, 19 nt, Homo sapiens
ugaaugugagguguugcua

SEQ ID NO: 482203 - RNA, 22 nt, Homo sapiens
ugaaugugagguguugcuaaau

SEQ ID NO: 482204 - RNA, 13 nt, Homo sapiens
ugacaacacaaau

SEQ ID NO: 482205 - RNA, 22 nt, Homo sapiens
ugacacaggaugaaggcaaugc

SEQ ID NO: 482206 - RNA, 22 nt, Homo sapiens
ugacauaugcuaacccccaaau

SEQ ID NO: 482207 - RNA, 12 nt, Homo sapiens
ugacaugugcuu

SEQ ID NO: 482208 - RNA, 16 nt, Homo sapiens
ugacauucaugccugg

SEQ ID NO: 482209 - RNA, 22 nt, Homo sapiens
ugacauuuauuuuucucaugaa

SEQ ID NO: 482210 - RNA, 16 nt, Homo sapiens
ugaccaguaauuguga

SEQ ID NO: 482211 - RNA, 19 nt, Homo sapiens
ugaccaucccaacuuuggu

SEQ ID NO: 482212 - RNA, 17 nt, Homo sapiens
ugaccugccucccuuca

SEQ ID NO: 482213 - RNA, 14 nt, Homo sapiens
ugacucuccagaaa

SEQ ID NO: 482214 - RNA, 13 nt, Homo sapiens
ugacuuguugcug

SEQ ID NO: 482215 - RNA, 12 nt, Homo sapiens
ugagaacacugu

SEQ ID NO: 482216 - RNA, 14 nt, Homo sapiens
ugagaacacuguga

SEQ ID NO: 482217 - RNA, 15 nt, Homo sapiens
ugagaacacugugaa

SEQ ID NO: 482218 - RNA, 16 nt, Homo sapiens
ugagacacugcacaga

SEQ ID NO: 482219 - RNA, 19 nt, Homo sapiens
ugagaccuuggcgcuacaa

SEQ ID NO: 482220 - RNA, 16 nt, Homo sapiens
ugagacuaugcaaaag

SEQ ID NO: 482221 - RNA, 15 nt, Homo sapiens
ugagagaccaggcaa

SEQ ID NO: 482222 - RNA, 23 nt, Homo sapiens
ugagaggagagagacuccagcug

SEQ ID NO: 482223 - RNA, 18 nt, Homo sapiens
ugagaggcaugacagcug

SEQ ID NO: 482224 - RNA, 15 nt, Homo sapiens
ugagaucauugcaaa

SEQ ID NO: 482225 - RNA, 21 nt, Homo sapiens
ugagcagugcuugaaugaagu

SEQ ID NO: 482226 - RNA, 23 nt, Homo sapiens
ugagccaccgcgccuggccaggc

SEQ ID NO: 482227 - RNA, 13 nt, Homo sapiens
ugagccaguguca

SEQ ID NO: 482228 - RNA, 19 nt, Homo sapiens
ugagccucuuuaacagcuu

SEQ ID NO: 482229 - RNA, 13 nt, Homo sapiens
ugaggacacugau

SEQ ID NO: 482230 - RNA, 17 nt, Homo sapiens
ugaggcuuagcuuugcu

SEQ ID NO: 482231 - RNA, 20 nt, Homo sapiens
ugaguccacgcccaccagcc

SEQ ID NO: 482232 - RNA, 15 nt, Homo sapiens
ugagugcgugcucag

SEQ ID NO: 482233 - RNA, 15 nt, Homo sapiens
ugaguggaaauggaa

SEQ ID NO: 482234 - RNA, 13 nt, Homo sapiens
ugaguuucucuca

SEQ ID NO: 482235 - RNA, 22 nt, Homo sapiens
ugauacaaauugcagacugugu

SEQ ID NO: 482236 - RNA, 14 nt, Homo sapiens
ugauacagagggau

SEQ ID NO: 482237 - RNA, 15 nt, Homo sapiens
ugauaucucuuuuau

SEQ ID NO: 482238 - RNA, 23 nt, Homo sapiens
ugauauuucccuccccuggggac

SEQ ID NO: 482239 - RNA, 14 nt, Homo sapiens
ugaucaaugaauaa

SEQ ID NO: 482240 - RNA, 18 nt, Homo sapiens
ugaucacucuuugcacac

SEQ ID NO: 482241 - RNA, 23 nt, Homo sapiens
ugaucagcuuauugucuagugaa

SEQ ID NO: 482242 - RNA, 18 nt, Homo sapiens
ugaucaguaugaaaaugu

SEQ ID NO: 482243 - RNA, 12 nt, Homo sapiens
ugauccugugaa

SEQ ID NO: 482244 - RNA, 22 nt, Homo sapiens
ugaucuucagggaacugcauag

SEQ ID NO: 482245 - RNA, 18 nt, Homo sapiens
ugaugaaauguaaauacu

SEQ ID NO: 482246 - RNA, 12 nt, Homo sapiens
ugaugacaucca

SEQ ID NO: 482247 - RNA, 20 nt, Homo sapiens
ugaugcaagcaagaaacacu

SEQ ID NO: 482248 - RNA, 21 nt, Homo sapiens
ugaugcugggauuuacacuug

SEQ ID NO: 482249 - RNA, 22 nt, Homo sapiens
ugaugucccuauggaagcauau

SEQ ID NO: 482250 - RNA, 13 nt, Homo sapiens
ugauuaugaauag

SEQ ID NO: 482251 - RNA, 15 nt, Homo sapiens
ugauucacaguguga

SEQ ID NO: 482252 - RNA, 14 nt, Homo sapiens
ugauucugaaucaa

SEQ ID NO: 482253 - RNA, 20 nt, Homo sapiens
ugauugcuuaucaguaguau

SEQ ID NO: 482254 - RNA, 22 nt, Homo sapiens
ugauuuuggggagacaaaggga

SEQ ID NO: 482255 - RNA, 17 nt, Homo sapiens
ugcaaauccccucccca

SEQ ID NO: 482256 - RNA, 14 nt, Homo sapiens
ugcaacaacaugua

SEQ ID NO: 482257 - RNA, 20 nt, Homo sapiens
ugcaaccccaucauccucag

SEQ ID NO: 482258 - RNA, 19 nt, Homo sapiens
ugcaagcaagaaacacugg

SEQ ID NO: 482259 - RNA, 16 nt, Homo sapiens
ugcaaguaaacaccug

SEQ ID NO: 482260 - RNA, 20 nt, Homo sapiens
ugcacuccagccugggcaac

SEQ ID NO: 482261 - RNA, 18 nt, Homo sapiens
ugcacucuagccuggcaa

SEQ ID NO: 482262 - RNA, 17 nt, Homo sapiens
ugcacuuauucucaaga

SEQ ID NO: 482263 - RNA, 14 nt, Homo sapiens
ugcaggaaaacuga

SEQ ID NO: 482264 - RNA, 15 nt, Homo sapiens
ugcagugagcugugu

SEQ ID NO: 482265 - RNA, 20 nt, Homo sapiens
ugcauauuuuauuauaguca

SEQ ID NO: 482266 - RNA, 20 nt, Homo sapiens
ugcauggaacccccagaaua

SEQ ID NO: 482267 - RNA, 22 nt, Homo sapiens
ugcauguuuuccagcuccucau

SEQ ID NO: 482268 - RNA, 17 nt, Homo sapiens
ugcauuaucuaugauau

SEQ ID NO: 482269 - RNA, 20 nt, Homo sapiens
ugcauucugagguaaccuca

SEQ ID NO: 482270 - RNA, 23 nt, Homo sapiens
ugcauucugagguaaccucauua

SEQ ID NO: 482271 - RNA, 17 nt, Homo sapiens
ugcauuuaauuuauuga

SEQ ID NO: 482272 - RNA, 19 nt, Homo sapiens
ugccaagcacugugcucag

SEQ ID NO: 482273 - RNA, 22 nt, Homo sapiens
ugccacauggagcuugacuuca

SEQ ID NO: 482274 - RNA, 17 nt, Homo sapiens
ugccaccuccuggaagg

SEQ ID NO: 482275 - RNA, 18 nt, Homo sapiens
ugccagcuauaaucuccc

SEQ ID NO: 482276 - RNA, 13 nt, Homo sapiens
ugcccaccagauc

SEQ ID NO: 482277 - RNA, 23 nt, Homo sapiens
ugcccaccuccuuccagcacuga

SEQ ID NO: 482278 - RNA, 20 nt, Homo sapiens
ugcccagggcucagccuggu

SEQ ID NO: 482279 - RNA, 21 nt, Homo sapiens
ugcccucuuaagugugcacag

SEQ ID NO: 482280 - RNA, 18 nt, Homo sapiens
ugccugcaggcaugaguc

SEQ ID NO: 482281 - RNA, 23 nt, Homo sapiens
ugccuuaucuaaaucaccagaga

SEQ ID NO: 482282 - RNA, 20 nt, Homo sapiens
ugccuuuccauaaucacuca

SEQ ID NO: 482283 - RNA, 15 nt, Homo sapiens
ugcuaacccccaaau

SEQ ID NO: 482284 - RNA, 23 nt, Homo sapiens
ugcuaauauauguauaugcaaua

SEQ ID NO: 482285 - RNA, 21 nt, Homo sapiens
ugcuauaacuauguugauaaa

SEQ ID NO: 482286 - RNA, 23 nt, Homo sapiens
ugcucaugcccugccaagcagca

SEQ ID NO: 482287 - RNA, 12 nt, Homo sapiens
ugcuccucaggg

SEQ ID NO: 482288 - RNA, 14 nt, Homo sapiens
ugcucuucuuuaga

SEQ ID NO: 482289 - RNA, 20 nt, Homo sapiens
ugcugaaucggaaucucugg

SEQ ID NO: 482290 - RNA, 22 nt, Homo sapiens
ugcugaggagaguggaacagaa

SEQ ID NO: 482291 - RNA, 15 nt, Homo sapiens
ugcugauguccucac

SEQ ID NO: 482292 - RNA, 17 nt, Homo sapiens
ugcuggagucaugugcc

SEQ ID NO: 482293 - RNA, 19 nt, Homo sapiens
ugcuggagucaugugccuc

SEQ ID NO: 482294 - RNA, 17 nt, Homo sapiens
ugcuguaaaaacugugg

SEQ ID NO: 482295 - RNA, 19 nt, Homo sapiens
ugcuuugcccagcauuuua

SEQ ID NO: 482296 - RNA, 16 nt, Homo sapiens
ugcuuuggaaaucaca

SEQ ID NO: 482297 - RNA, 19 nt, Homo sapiens
uggaaaacaguauuuucca

SEQ ID NO: 482298 - RNA, 14 nt, Homo sapiens
uggaaaauaaauca

SEQ ID NO: 482299 - RNA, 14 nt, Homo sapiens
uggaaaaugugcaa

SEQ ID NO: 482300 - RNA, 23 nt, Homo sapiens
uggaacacaaugacuaaagacau

SEQ ID NO: 482301 - RNA, 20 nt, Homo sapiens
uggaacagauucacacuguc

SEQ ID NO: 482302 - RNA, 15 nt, Homo sapiens
uggaacucaaggaaa

SEQ ID NO: 482303 - RNA, 18 nt, Homo sapiens
uggaaggcuucuccgccc

SEQ ID NO: 482304 - RNA, 23 nt, Homo sapiens
uggaagguggggacagggaugag

SEQ ID NO: 482305 - RNA, 20 nt, Homo sapiens
uggaaucauauaguauguaa

SEQ ID NO: 482306 - RNA, 17 nt, Homo sapiens
uggaaucauaugggaua

SEQ ID NO: 482307 - RNA, 12 nt, Homo sapiens
uggaaucuggag

SEQ ID NO: 482308 - RNA, 20 nt, Homo sapiens
uggaaugggcagcucaucuc

SEQ ID NO: 482309 - RNA, 21 nt, Homo sapiens
uggaaugggcagcucaucucu

SEQ ID NO: 482310 - RNA, 13 nt, Homo sapiens
uggaauugugcug

SEQ ID NO: 482311 - RNA, 17 nt, Homo sapiens
uggaauuuguaaguuua

SEQ ID NO: 482312 - RNA, 22 nt, Homo sapiens
uggacaugaagggaugcugcaa

SEQ ID NO: 482313 - RNA, 15 nt, Homo sapiens
uggacuggaugcaug

SEQ ID NO: 482314 - RNA, 16 nt, Homo sapiens
uggagacgccucccca

SEQ ID NO: 482315 - RNA, 21 nt, Homo sapiens
uggagacuccuaggcaggaca

SEQ ID NO: 482316 - RNA, 19 nt, Homo sapiens
uggagagcuagaaccugga

SEQ ID NO: 482317 - RNA, 23 nt, Homo sapiens
uggagcccgugcccuaccacaca

SEQ ID NO: 482318 - RNA, 19 nt, Homo sapiens
uggagggcuggaaucugga

SEQ ID NO: 482319 - RNA, 20 nt, Homo sapiens
uggaguagccauucuuuauu

SEQ ID NO: 482320 - RNA, 21 nt, Homo sapiens
uggagugccuguacaagcuga

SEQ ID NO: 482321 - RNA, 22 nt, Homo sapiens
uggauaggcacauagagaggga

SEQ ID NO: 482322 - RNA, 20 nt, Homo sapiens
uggaucuaucaccugucauc

SEQ ID NO: 482323 - RNA, 18 nt, Homo sapiens
uggaucuccauucucuca

SEQ ID NO: 482324 - RNA, 21 nt, Homo sapiens
uggcaacagagcgagauucca

SEQ ID NO: 482325 - RNA, 21 nt, Homo sapiens
uggcaaggcuuaggaaaguga

SEQ ID NO: 482326 - RNA, 15 nt, Homo sapiens
uggcacacgccugua

SEQ ID NO: 482327 - RNA, 20 nt, Homo sapiens
uggcaccuuaguugcaugac

SEQ ID NO: 482328 - RNA, 22 nt, Homo sapiens
uggcaccuuaguugcaugacca

SEQ ID NO: 482329 - RNA, 14 nt, Homo sapiens
uggcagcucaaaau

SEQ ID NO: 482330 - RNA, 17 nt, Homo sapiens
uggccaacauagugaaa

SEQ ID NO: 482331 - RNA, 21 nt, Homo sapiens
uggccaggccucuuggcaguc

SEQ ID NO: 482332 - RNA, 17 nt, Homo sapiens
uggccucagcagcucuu

SEQ ID NO: 482333 - RNA, 15 nt, Homo sapiens
uggcgugagccuguc

SEQ ID NO: 482334 - RNA, 15 nt, Homo sapiens
uggcuccaccacuga

SEQ ID NO: 482335 - RNA, 14 nt, Homo sapiens
uggcugauggagua

SEQ ID NO: 482336 - RNA, 15 nt, Homo sapiens
uggcugcuagcacuu

SEQ ID NO: 482337 - RNA, 18 nt, Homo sapiens
ugggaacuagacucccaa

SEQ ID NO: 482338 - RNA, 20 nt, Homo sapiens
ugggaccacacagacagggu

SEQ ID NO: 482339 - RNA, 21 nt, Homo sapiens
ugggaccacacagacaggguu

SEQ ID NO: 482340 - RNA, 22 nt, Homo sapiens
ugggaccacacagacaggguuu

SEQ ID NO: 482341 - RNA, 21 nt, Homo sapiens
ugggaccacgugagaucauuc

SEQ ID NO: 482342 - RNA, 16 nt, Homo sapiens
ugggagucauggacau

SEQ ID NO: 482343 - RNA, 19 nt, Homo sapiens
ugggagucauggacaugaa

SEQ ID NO: 482344 - RNA, 21 nt, Homo sapiens
ugggagugcccccaacagcac

SEQ ID NO: 482345 - RNA, 23 nt, Homo sapiens
ugggauauuuccauauggcaaua

SEQ ID NO: 482346 - RNA, 21 nt, Homo sapiens
ugggcaaaacccacagaagac

SEQ ID NO: 482347 - RNA, 21 nt, Homo sapiens
ugggcaacagagcaagacucu

SEQ ID NO: 482348 - RNA, 17 nt, Homo sapiens
ugggcaacauagugaga

SEQ ID NO: 482349 - RNA, 12 nt, Homo sapiens
ugggcagggaug

SEQ ID NO: 482350 - RNA, 11 nt, Homo sapiens
ugggcuucuag

SEQ ID NO: 482351 - RNA, 23 nt, Homo sapiens
uggggagaggagugggaaauuga

SEQ ID NO: 482352 - RNA, 14 nt, Homo sapiens
uggggguauuguau

SEQ ID NO: 482353 - RNA, 14 nt, Homo sapiens
ugggggugcagaug

SEQ ID NO: 482354 - RNA, 17 nt, Homo sapiens
ugggguuccccuggaaa

SEQ ID NO: 482355 - RNA, 22 nt, Homo sapiens
uggguaauaaccaagauggagu

SEQ ID NO: 482356 - RNA, 23 nt, Homo sapiens
ugguaccaccagucugacuguuu

SEQ ID NO: 482357 - RNA, 18 nt, Homo sapiens
ugguccgaagucuuccau

SEQ ID NO: 482358 - RNA, 20 nt, Homo sapiens
ugguccuuagccccaucugc

SEQ ID NO: 482359 - RNA, 17 nt, Homo sapiens
uggugaaauggcuggag

SEQ ID NO: 482360 - RNA, 22 nt, Homo sapiens
ugguggagccaguaaacagagg

SEQ ID NO: 482361 - RNA, 22 nt, Homo sapiens
ugguguuaccuuagcuaacuaa

SEQ ID NO: 482362 - RNA, 17 nt, Homo sapiens
ugguguuuucuuaugca

SEQ ID NO: 482363 - RNA, 17 nt, Homo sapiens
ugguuacuaguacaggu

SEQ ID NO: 482364 - RNA, 15 nt, Homo sapiens
ugguuauaauguguu

SEQ ID NO: 482365 - RNA, 23 nt, Homo sapiens
uguaagaaaauaucacuugucaa

SEQ ID NO: 482366 - RNA, 16 nt, Homo sapiens
uguaaucccagcacuu

SEQ ID NO: 482367 - RNA, 19 nt, Homo sapiens
uguaaucccagcuacuugg

SEQ ID NO: 482368 - RNA, 17 nt, Homo sapiens
uguauaaguccuugcaa

SEQ ID NO: 482369 - RNA, 12 nt, Homo sapiens
uguauagcauau

SEQ ID NO: 482370 - RNA, 21 nt, Homo sapiens
uguaugauccuaaugaaugca

SEQ ID NO: 482371 - RNA, 18 nt, Homo sapiens
ugucacaugaaacauuug

SEQ ID NO: 482372 - RNA, 19 nt, Homo sapiens
uguccaacugccuguucaa

SEQ ID NO: 482373 - RNA, 14 nt, Homo sapiens
uguccugauuacaa

SEQ ID NO: 482374 - RNA, 18 nt, Homo sapiens
uguccugauuacaaugcu

SEQ ID NO: 482375 - RNA, 16 nt, Homo sapiens
uguccuguuccugcca

SEQ ID NO: 482376 - RNA, 17 nt, Homo sapiens
uguccuguuccugccac

SEQ ID NO: 482377 - RNA, 18 nt, Homo sapiens
uguccuucaccuuuccca

SEQ ID NO: 482378 - RNA, 16 nt, Homo sapiens
ugucuaaagagcuuua

SEQ ID NO: 482379 - RNA, 15 nt, Homo sapiens
ugucuggccaggccu

SEQ ID NO: 482380 - RNA, 22 nt, Homo sapiens
ugucuuacagagaaaagacaua

SEQ ID NO: 482381 - RNA, 20 nt, Homo sapiens
ugugauuuauuuauuucuac

SEQ ID NO: 482382 - RNA, 23 nt, Homo sapiens
ugugcccucuuaagugugcacag

SEQ ID NO: 482383 - RNA, 12 nt, Homo sapiens
ugugcucaggga

SEQ ID NO: 482384 - RNA, 22 nt, Homo sapiens
ugugcugaguugguguugacau

SEQ ID NO: 482385 - RNA, 18 nt, Homo sapiens
uguggaguccgacaaagc

SEQ ID NO: 482386 - RNA, 18 nt, Homo sapiens
uguggcccuccaguguau

SEQ ID NO: 482387 - RNA, 21 nt, Homo sapiens
ugugguccagguccuuuccac

SEQ ID NO: 482388 - RNA, 19 nt, Homo sapiens
ugugguuacuaguacaggu

SEQ ID NO: 482389 - RNA, 13 nt, Homo sapiens
ugugguugcucac

SEQ ID NO: 482390 - RNA, 16 nt, Homo sapiens
ugugucaguggaugcu

SEQ ID NO: 482391 - RNA, 14 nt, Homo sapiens
ugugugaacgugua

SEQ ID NO: 482392 - RNA, 21 nt, Homo sapiens
ugugugaucugugggcacauu

SEQ ID NO: 482393 - RNA, 12 nt, Homo sapiens
uguguuacugau

SEQ ID NO: 482394 - RNA, 19 nt, Homo sapiens
uguguuuuguuuuguauca

SEQ ID NO: 482395 - RNA, 14 nt, Homo sapiens
uguguuuuuaauua

SEQ ID NO: 482396 - RNA, 14 nt, Homo sapiens
uguuaaucauuuca

SEQ ID NO: 482397 - RNA, 13 nt, Homo sapiens
uguuagaaaugca

SEQ ID NO: 482398 - RNA, 22 nt, Homo sapiens
uguuauaaucuuucacagggga

SEQ ID NO: 482399 - RNA, 15 nt, Homo sapiens
uguucacuguggcau

SEQ ID NO: 482400 - RNA, 16 nt, Homo sapiens
uguuccccaucaucug

SEQ ID NO: 482401 - RNA, 23 nt, Homo sapiens
uguucccuauuuugccaguggga

SEQ ID NO: 482402 - RNA, 16 nt, Homo sapiens
uguucuauucaucuca

SEQ ID NO: 482403 - RNA, 16 nt, Homo sapiens
uguucuauuugugcuu

SEQ ID NO: 482404 - RNA, 12 nt, Homo sapiens
uguucuugugaa

SEQ ID NO: 482405 - RNA, 18 nt, Homo sapiens
uguugcccacagcuguau

SEQ ID NO: 482406 - RNA, 22 nt, Homo sapiens
uguugcugagucugcagaugag

SEQ ID NO: 482407 - RNA, 16 nt, Homo sapiens
uguugugucuugcuau

SEQ ID NO: 482408 - RNA, 12 nt, Homo sapiens
uguuucuuuagc

SEQ ID NO: 482409 - RNA, 13 nt, Homo sapiens
uguuuucuuaugc

SEQ ID NO: 482410 - RNA, 11 nt, Homo sapiens
uuaaaaucaca

SEQ ID NO: 482411 - RNA, 14 nt, Homo sapiens
uuaaagacguaaaa

SEQ ID NO: 482412 - RNA, 19 nt, Homo sapiens
uuaaagcugaaaacugcaa

SEQ ID NO: 482413 - RNA, 23 nt, Homo sapiens
uuaaagcuuggugcuaaaccaca

SEQ ID NO: 482414 - RNA, 16 nt, Homo sapiens
uuaaaguucuagugac

SEQ ID NO: 482415 - RNA, 15 nt, Homo sapiens
uuaacuucagccagc

SEQ ID NO: 482416 - RNA, 19 nt, Homo sapiens
uuaagaaaaacaugucaug

SEQ ID NO: 482417 - RNA, 22 nt, Homo sapiens
uuucuccuuuuuuaugaugaca

SEQ ID NO: 482418 - RNA, 16 nt, Homo sapiens
uuucugaucugaugca

SEQ ID NO: 482419 - RNA, 16 nt, Homo sapiens
uuucugucacaucagc

SEQ ID NO: 482420 - RNA, 22 nt, Homo sapiens
uuucugucacaucagcuccacu

SEQ ID NO: 482421 - RNA, 15 nt, Homo sapiens
uuucuucuaccagac

SEQ ID NO: 482422 - RNA, 14 nt, Homo sapiens
uuugaaaucuauga

SEQ ID NO: 482423 - RNA, 11 nt, Homo sapiens
uuugaacacaa

SEQ ID NO: 482424 - RNA, 19 nt, Homo sapiens
uuugaagcugcagugagcu

SEQ ID NO: 482425 - RNA, 16 nt, Homo sapiens
uuugaaucacaguaua

SEQ ID NO: 482426 - RNA, 13 nt, Homo sapiens
uuugagacagagu

SEQ ID NO: 482427 - RNA, 23 nt, Homo sapiens
caccacacuuuccgcuuucacuu

SEQ ID NO: 482428 - RNA, 21 nt, Homo sapiens
caccaccucugugggcacugg

SEQ ID NO: 482429 - RNA, 16 nt, Homo sapiens
caccaguuccuuucaa

SEQ ID NO: 482430 - RNA, 21 nt, Homo sapiens
cacccauaccagcuagaauca

SEQ ID NO: 482431 - RNA, 13 nt, Homo sapiens
cacccaugcaccu

SEQ ID NO: 482432 - RNA, 17 nt, Homo sapiens
cacccaugcccagcugu

SEQ ID NO: 482433 - RNA, 21 nt, Homo sapiens
caccucagaguauggagcuca

SEQ ID NO: 482434 - RNA, 15 nt, Homo sapiens
caccucccugcaaua

SEQ ID NO: 482435 - RNA, 21 nt, Homo sapiens
caccucugugggcacuggugg

SEQ ID NO: 482436 - RNA, 23 nt, Homo sapiens
caccuugcggggauaaagagaga

SEQ ID NO: 482437 - RNA, 14 nt, Homo sapiens
caccuuucccacuu

SEQ ID NO: 482438 - RNA, 11 nt, Homo sapiens
cacggcugcug

SEQ ID NO: 482439 - RNA, 20 nt, Homo sapiens
cacgggguauuuuaggcagg

SEQ ID NO: 482440 - RNA, 18 nt, Homo sapiens
cacgucuggcuucacaga

SEQ ID NO: 482441 - RNA, 17 nt, Homo sapiens
cacucagaaucuccuuc

SEQ ID NO: 482442 - RNA, 21 nt, Homo sapiens
cacuccagccugggugacaga

SEQ ID NO: 482443 - RNA, 10 nt, Homo sapiens
cacugaagaa

SEQ ID NO: 482444 - RNA, 13 nt, Homo sapiens
cacugagagugaa

SEQ ID NO: 482445 - RNA, 15 nt, Homo sapiens
cacugagagugaagu

SEQ ID NO: 482446 - RNA, 13 nt, Homo sapiens
cacugauauccuc

SEQ ID NO: 482447 - RNA, 14 nt, Homo sapiens
cacugcaggcauca

SEQ ID NO: 482448 - RNA, 19 nt, Homo sapiens
cacugccuucucaacucca

SEQ ID NO: 482449 - RNA, 20 nt, Homo sapiens
cacugcugaaccuuuccucu

SEQ ID NO: 482450 - RNA, 17 nt, Homo sapiens
cacuggcccucuuugaa

SEQ ID NO: 482451 - RNA, 18 nt, Homo sapiens
cacugggacuugcaaaaa

SEQ ID NO: 482452 - RNA, 18 nt, Homo sapiens
cacugugggaaggccagc

SEQ ID NO: 482453 - RNA, 23 nt, Homo sapiens
cacuuaugagaugccugaagcca

SEQ ID NO: 482454 - RNA, 15 nt, Homo sapiens
cacuugaacccagga

SEQ ID NO: 482455 - RNA, 18 nt, Homo sapiens
cacuugacuuugccacau

SEQ ID NO: 482456 - RNA, 15 nt, Homo sapiens
cacuuggcaucagcu

SEQ ID NO: 482457 - RNA, 19 nt, Homo sapiens
cacuuugggaggcugaggu

SEQ ID NO: 482458 - RNA, 20 nt, Homo sapiens
cagaagaccucccugugaga

SEQ ID NO: 482459 - RNA, 17 nt, Homo sapiens
cagaauaaauaugcuca

SEQ ID NO: 482460 - RNA, 13 nt, Homo sapiens
cauugcacuccag

SEQ ID NO: 482461 - RNA, 16 nt, Homo sapiens
cauuugaaaucuauga

SEQ ID NO: 482462 - RNA, 21 nt, Homo sapiens
cauuuugcagaaaauacauuu

SEQ ID NO: 482463 - RNA, 11 nt, Homo sapiens
ccaaagggaua

SEQ ID NO: 482464 - RNA, 18 nt, Homo sapiens
ccaaagugcugagauuau

SEQ ID NO: 482465 - RNA, 14 nt, Homo sapiens
ccaaauuacgugua

SEQ ID NO: 482466 - RNA, 15 nt, Homo sapiens
ccaacagcacccucu

SEQ ID NO: 482467 - RNA, 21 nt, Homo sapiens
ccaacagcacccucuccagau

SEQ ID NO: 482468 - RNA, 14 nt, Homo sapiens
ccaacaugugcuca

SEQ ID NO: 482469 - RNA, 19 nt, Homo sapiens
ccaacugccuguucaauaa

SEQ ID NO: 482470 - RNA, 15 nt, Homo sapiens
ccaaggaaaccacag

SEQ ID NO: 482471 - RNA, 19 nt, Homo sapiens
ccaaggcuggagugcagug

SEQ ID NO: 482472 - RNA, 23 nt, Homo sapiens
ccaauacauuauuggacuuccau

SEQ ID NO: 482473 - RNA, 19 nt, Homo sapiens
ccaauccuuuauagcuuug

SEQ ID NO: 482474 - RNA, 20 nt, Homo sapiens
ccaauggcaacaucuugcaa

SEQ ID NO: 482475 - RNA, 14 nt, Homo sapiens
ccaauuuacuuugu

SEQ ID NO: 482476 - RNA, 20 nt, Homo sapiens
ccacccaaugcugauguccu

SEQ ID NO: 482477 - RNA, 17 nt, Homo sapiens
ccaccucccugcaauaa

SEQ ID NO: 482478 - RNA, 21 nt, Homo sapiens
ccaccuccuuccagcacugac

SEQ ID NO: 482479 - RNA, 12 nt, Homo sapiens
ccacgaugcagu

SEQ ID NO: 482480 - RNA, 18 nt, Homo sapiens
ccacuagacaaguccagc

SEQ ID NO: 482481 - RNA, 15 nt, Homo sapiens
ccacuaugagcugcu

SEQ ID NO: 482482 - RNA, 13 nt, Homo sapiens
ccacuucuuucag

SEQ ID NO: 482483 - RNA, 19 nt, Homo sapiens
ccacuuucuucuaccagac

SEQ ID NO: 482484 - RNA, 15 nt, Homo sapiens
ccagaaaucaaaaag

SEQ ID NO: 482485 - RNA, 13 nt, Homo sapiens
ccagaaccuggag

SEQ ID NO: 482486 - RNA, 18 nt, Homo sapiens
ccagaauuugcugcauuu

SEQ ID NO: 482487 - RNA, 17 nt, Homo sapiens
ccagaccucaggugcua

SEQ ID NO: 482488 - RNA, 19 nt, Homo sapiens
ccagagaccaaacaaggac

SEQ ID NO: 482489 - RNA, 16 nt, Homo sapiens
ccagcacuuugggagg

SEQ ID NO: 482490 - RNA, 16 nt, Homo sapiens
ccaggaaccucagggc

SEQ ID NO: 482491 - RNA, 18 nt, Homo sapiens
ccaggcaacuugggaacu

SEQ ID NO: 482492 - RNA, 16 nt, Homo sapiens
ccaggccucuuggcag

SEQ ID NO: 482493 - RNA, 18 nt, Homo sapiens
ccaggcuggagugcagug

SEQ ID NO: 482494 - RNA, 19 nt, Homo sapiens
ccaggcuggccagcauggu

SEQ ID NO: 482495 - RNA, 21 nt, Homo sapiens
ccaggcuguuggaaaauccag

SEQ ID NO: 482496 - RNA, 15 nt, Homo sapiens
ccagggaugacaugu

SEQ ID NO: 482497 - RNA, 11 nt, Homo sapiens
ccagguccuuu

SEQ ID NO: 482498 - RNA, 20 nt, Homo sapiens
ccagugcaacacugaagcuc

SEQ ID NO: 482499 - RNA, 15 nt, Homo sapiens
ccauagagacuuugu

SEQ ID NO: 482500 - RNA, 22 nt, Homo sapiens
ccauaggcccagugagaugcau

SEQ ID NO: 482501 - RNA, 21 nt, Homo sapiens
ccauagggacccauucuacac

SEQ ID NO: 482502 - RNA, 11 nt, Homo sapiens
ccaucaaacac

SEQ ID NO: 482503 - RNA, 10 nt, Homo sapiens
ccaucccucc

SEQ ID NO: 482504 - RNA, 23 nt, Homo sapiens
ccaugagaguagagggcacuggg

SEQ ID NO: 482505 - RNA, 22 nt, Homo sapiens
ccauguagaagcugcaucuugu

SEQ ID NO: 482506 - RNA, 19 nt, Homo sapiens
ccauuugcguuccaugaug

SEQ ID NO: 482507 - RNA, 22 nt, Homo sapiens
cccaaaagcccauucauuccau

SEQ ID NO: 482508 - RNA, 19 nt, Homo sapiens
cccaaagugcugagauuau

SEQ ID NO: 482509 - RNA, 16 nt, Homo sapiens
cccaaguagcugcuac

SEQ ID NO: 482510 - RNA, 20 nt, Homo sapiens
cccaaguagcugcuaccuuc

SEQ ID NO: 482511 - RNA, 17 nt, Homo sapiens
cccacacaagacccaag

SEQ ID NO: 482512 - RNA, 16 nt, Homo sapiens
cccagaauuugcugca

SEQ ID NO: 482513 - RNA, 13 nt, Homo sapiens
cccagacuccuga

SEQ ID NO: 482514 - RNA, 15 nt, Homo sapiens
cccagccagcaguuc

SEQ ID NO: 482515 - RNA, 23 nt, Homo sapiens
cccaggaggcagcuguugcagug

SEQ ID NO: 482516 - RNA, 13 nt, Homo sapiens
cccaggaguacac

SEQ ID NO: 482517 - RNA, 16 nt, Homo sapiens
cccaggauuugacucg

SEQ ID NO: 482518 - RNA, 10 nt, Homo sapiens
cccagugugu

SEQ ID NO: 482519 - RNA, 12 nt, Homo sapiens
cccaucuugaua

SEQ ID NO: 482520 - RNA, 14 nt, Homo sapiens
cccaugcccagcug

SEQ ID NO: 482521 - RNA, 20 nt, Homo sapiens
ccccaucugccacguguauu

SEQ ID NO: 482522 - RNA, 15 nt, Homo sapiens
cccucaggaccaaag

SEQ ID NO: 482523 - RNA, 15 nt, Homo sapiens
cccuccaguguauga

SEQ ID NO: 482524 - RNA, 20 nt, Homo sapiens
cccuccucugcuugccaucc

SEQ ID NO: 482525 - RNA, 19 nt, Homo sapiens
cccucuccucucuuccucc

SEQ ID NO: 482526 - RNA, 15 nt, Homo sapiens
cccuguccuuucuca

SEQ ID NO: 482527 - RNA, 16 nt, Homo sapiens
cccugucucccaaaaa

SEQ ID NO: 482528 - RNA, 15 nt, Homo sapiens
cccuucucuaccuca

SEQ ID NO: 482529 - RNA, 19 nt, Homo sapiens
cccuucuuacaaugcauuc

SEQ ID NO: 482530 - RNA, 14 nt, Homo sapiens
cccuugcuggaguc

SEQ ID NO: 482531 - RNA, 15 nt, Homo sapiens
cccuuuccaaaggcc

SEQ ID NO: 482532 - RNA, 21 nt, Homo sapiens
ccgagaucgcaccagugcacu

SEQ ID NO: 482533 - RNA, 19 nt, Homo sapiens
ccggaaggaaugucagggc

SEQ ID NO: 482534 - RNA, 16 nt, Homo sapiens
ccggagccuccagcug

SEQ ID NO: 482535 - RNA, 19 nt, Homo sapiens
ccgggcaauccagacagca

SEQ ID NO: 482536 - RNA, 18 nt, Homo sapiens
ccgggcaugguagcucaa

SEQ ID NO: 482537 - RNA, 21 nt, Homo sapiens
ccgguguccuguuccugccac

SEQ ID NO: 482538 - RNA, 16 nt, Homo sapiens
ccgucuguacuaaaaa

SEQ ID NO: 482539 - RNA, 21 nt, Homo sapiens
ccuaacacugggcugcagaga

SEQ ID NO: 482540 - RNA, 19 nt, Homo sapiens
ccuaaggcacccacaaaua

SEQ ID NO: 482541 - RNA, 15 nt, Homo sapiens
ccuaaggcaugaaua

SEQ ID NO: 482542 - RNA, 16 nt, Homo sapiens
ccuaaugcugcagauu

SEQ ID NO: 482543 - RNA, 19 nt, Homo sapiens
ccuagacucugugaucuga

SEQ ID NO: 482544 - RNA, 19 nt, Homo sapiens
ccuagggccacugaagaua

SEQ ID NO: 482545 - RNA, 13 nt, Homo sapiens
ccuaguagcuuuc

SEQ ID NO: 482546 - RNA, 20 nt, Homo sapiens
ccuauagucccagcuacuca

SEQ ID NO: 482547 - RNA, 14 nt, Homo sapiens
ccuaucuuugccac

SEQ ID NO: 482548 - RNA, 19 nt, Homo sapiens
ccucacacugggacuugca

SEQ ID NO: 482549 - RNA, 12 nt, Homo sapiens
ccucaggugcua

SEQ ID NO: 482550 - RNA, 19 nt, Homo sapiens
ccucaguuuuuccuaguca

SEQ ID NO: 482551 - RNA, 12 nt, Homo sapiens
ccucauggaauu

SEQ ID NO: 482552 - RNA, 20 nt, Homo sapiens
ccuccccuggggacagcaag

SEQ ID NO: 482553 - RNA, 11 nt, Homo sapiens
ccuccucacaa

SEQ ID NO: 482554 - RNA, 22 nt, Homo sapiens
ccucugccgcugccaugcuuug

SEQ ID NO: 482555 - RNA, 15 nt, Homo sapiens
ccucugcuugccauc

SEQ ID NO: 482556 - RNA, 15 nt, Homo sapiens
ccucuucuaugcuuu

SEQ ID NO: 482557 - RNA, 23 nt, Homo sapiens
ccugaagucuucuccuccaugaa

SEQ ID NO: 482558 - RNA, 23 nt, Homo sapiens
ccugagaagagagaucaaaugga

SEQ ID NO: 482559 - RNA, 12 nt, Homo sapiens
ccugauuacaau

SEQ ID NO: 482560 - RNA, 21 nt, Homo sapiens
ccugauuacaaugcugucugu

SEQ ID NO: 482561 - RNA, 15 nt, Homo sapiens
ccugcuuaaugaaaa

SEQ ID NO: 482562 - RNA, 15 nt, Homo sapiens
ccuggaaaucagggu

SEQ ID NO: 482563 - RNA, 21 nt, Homo sapiens
ccuggccaggcugcacacauu

SEQ ID NO: 482564 - RNA, 17 nt, Homo sapiens
ccugucaauacuaugga

SEQ ID NO: 482565 - RNA, 20 nt, Homo sapiens
ccugucgucccagcuacuca

SEQ ID NO: 482566 - RNA, 16 nt, Homo sapiens
ccugucuaaaaauuca

SEQ ID NO: 482567 - RNA, 17 nt, Homo sapiens
ccuguucaauaaaagua

SEQ ID NO: 482568 - RNA, 14 nt, Homo sapiens
ccuguuccugccac

SEQ ID NO: 482569 - RNA, 11 nt, Homo sapiens
ccuguucucua

SEQ ID NO: 482570 - RNA, 18 nt, Homo sapiens
ccuguucucugaagaugu

SEQ ID NO: 482571 - RNA, 13 nt, Homo sapiens
ccuuaaacucagg

SEQ ID NO: 482572 - RNA, 20 nt, Homo sapiens
ccuuaacacugagcugucau

SEQ ID NO: 482573 - RNA, 23 nt, Homo sapiens
aggcaacugaggcagacagcagc

SEQ ID NO: 482574 - RNA, 18 nt, Homo sapiens
aggcagaugccucuagaa

SEQ ID NO: 482575 - RNA, 14 nt, Homo sapiens
aggcccaacauuaa

SEQ ID NO: 482576 - RNA, 16 nt, Homo sapiens
aggcccuugggcaccu

SEQ ID NO: 482577 - RNA, 14 nt, Homo sapiens
aggcucucacucca

SEQ ID NO: 482578 - RNA, 15 nt, Homo sapiens
aggcuggagugcagu

SEQ ID NO: 482579 - RNA, 18 nt, Homo sapiens
aggcuucugauacgugua

SEQ ID NO: 482580 - RNA, 11 nt, Homo sapiens
aggcuuggcac

SEQ ID NO: 482581 - RNA, 17 nt, Homo sapiens
agggaaaacauuccauc

SEQ ID NO: 482582 - RNA, 18 nt, Homo sapiens
agggaaaacauuccaucc

SEQ ID NO: 482583 - RNA, 23 nt, Homo sapiens
agggaaguucaggcucugagaca

SEQ ID NO: 482584 - RNA, 14 nt, Homo sapiens
agggaaugacuugg

SEQ ID NO: 482585 - RNA, 13 nt, Homo sapiens
agggaaugcauua

SEQ ID NO: 482586 - RNA, 21 nt, Homo sapiens
agggaugcugcaauguaggaa

SEQ ID NO: 482587 - RNA, 17 nt, Homo sapiens
agggauuagguguucag

SEQ ID NO: 482588 - RNA, 14 nt, Homo sapiens
agggcacacacugu

SEQ ID NO: 482589 - RNA, 20 nt, Homo sapiens
agggcgagacucugucucaa

SEQ ID NO: 482590 - RNA, 23 nt, Homo sapiens
agggcuagaaccuggagagcuag

SEQ ID NO: 482591 - RNA, 18 nt, Homo sapiens
aggggaaugggaagcagc

SEQ ID NO: 482592 - RNA, 20 nt, Homo sapiens
aggggagcaacagaggacau

SEQ ID NO: 482593 - RNA, 12 nt, Homo sapiens
aggggccuggaa

SEQ ID NO: 482594 - RNA, 21 nt, Homo sapiens
agggguaauauauugcugcug

SEQ ID NO: 482595 - RNA, 16 nt, Homo sapiens
aggggucaccuugaga

SEQ ID NO: 482596 - RNA, 19 nt, Homo sapiens
agggguggaguuuuguaua

SEQ ID NO: 482597 - RNA, 16 nt, Homo sapiens
aggguaccuugaacac

SEQ ID NO: 482598 - RNA, 12 nt, Homo sapiens
agggugagacac

SEQ ID NO: 482599 - RNA, 18 nt, Homo sapiens
agguaaauagguuaaaaa

SEQ ID NO: 482600 - RNA, 23 nt, Homo sapiens
aggucggaccagcuuuucccaaa

SEQ ID NO: 482601 - RNA, 14 nt, Homo sapiens
aggugaacacuucc

SEQ ID NO: 482602 - RNA, 17 nt, Homo sapiens
aggugauccaccugccu

SEQ ID NO: 482603 - RNA, 21 nt, Homo sapiens
aggugcagaccuugggggaag

SEQ ID NO: 482604 - RNA, 15 nt, Homo sapiens
aggugggaggaucac

SEQ ID NO: 482605 - RNA, 16 nt, Homo sapiens
aggugugaacagggaa

SEQ ID NO: 482606 - RNA, 13 nt, Homo sapiens
agguuagaaccua

SEQ ID NO: 482607 - RNA, 12 nt, Homo sapiens
agguuagggcau

SEQ ID NO: 482608 - RNA, 12 nt, Homo sapiens
aguaacugugac

SEQ ID NO: 482609 - RNA, 17 nt, Homo sapiens
aguaagcaaagacuuuc

SEQ ID NO: 482610 - RNA, 15 nt, Homo sapiens
aguaaguaucuggag

SEQ ID NO: 482611 - RNA, 13 nt, Homo sapiens
aguagacaagcaa

SEQ ID NO: 482612 - RNA, 17 nt, Homo sapiens
aguagagggcacugggu

SEQ ID NO: 482613 - RNA, 21 nt, Homo sapiens
aguaggacugcugacauuuug

SEQ ID NO: 482614 - RNA, 18 nt, Homo sapiens
aguaugaaaaugucauug

SEQ ID NO: 482615 - RNA, 23 nt, Homo sapiens
aguauguuagugcaaauugucac

SEQ ID NO: 482616 - RNA, 20 nt, Homo sapiens
agucacagagauaauucuag

SEQ ID NO: 482617 - RNA, 18 nt, Homo sapiens
agucacuaguuguaauuu

SEQ ID NO: 482618 - RNA, 20 nt, Homo sapiens
agucaugcaaaggcugggac

SEQ ID NO: 482619 - RNA, 20 nt, Homo sapiens
agucaugcguuuaaucacau

SEQ ID NO: 482620 - RNA, 19 nt, Homo sapiens
agucauuguaaucuuucau

SEQ ID NO: 482621 - RNA, 12 nt, Homo sapiens
agucccugugaa

SEQ ID NO: 482622 - RNA, 13 nt, Homo sapiens
agucuaaaguuua

SEQ ID NO: 482623 - RNA, 19 nt, Homo sapiens
agucuggcucugucaccca

SEQ ID NO: 482624 - RNA, 17 nt, Homo sapiens
agucuggguccaggccu

SEQ ID NO: 482625 - RNA, 20 nt, Homo sapiens
agugacuguucaagagcaca

SEQ ID NO: 482626 - RNA, 21 nt, Homo sapiens
agugacuguucaagagcacac

SEQ ID NO: 482627 - RNA, 22 nt, Homo sapiens
agugagacaaaaagcacuagua

SEQ ID NO: 482628 - RNA, 12 nt, Homo sapiens
agugaugucagg

SEQ ID NO: 482629 - RNA, 19 nt, Homo sapiens
agugauucugaaucaaggu

SEQ ID NO: 482630 - RNA, 14 nt, Homo sapiens
agugcaacacugaa

SEQ ID NO: 482631 - RNA, 21 nt, Homo sapiens
agugcacaacauuacagggaa

SEQ ID NO: 482632 - RNA, 14 nt, Homo sapiens
agugcagagauuaa

SEQ ID NO: 482633 - RNA, 21 nt, Homo sapiens
agugcauuuuuaucugugagu

SEQ ID NO: 482634 - RNA, 17 nt, Homo sapiens
aguggguccaaguggcu

SEQ ID NO: 482635 - RNA, 16 nt, Homo sapiens
aguuagagcugacaca

SEQ ID NO: 482636 - RNA, 16 nt, Homo sapiens
aguucaggcucugaga

SEQ ID NO: 482637 - RNA, 18 nt, Homo sapiens
aguucuauuucuauccca

SEQ ID NO: 482638 - RNA, 17 nt, Homo sapiens
aguucuccagacagggu

SEQ ID NO: 482639 - RNA, 18 nt, Homo sapiens
aguucuccagacaggguu

SEQ ID NO: 482640 - RNA, 11 nt, Homo sapiens
aguucuuaggc

SEQ ID NO: 482641 - RNA, 18 nt, Homo sapiens
aguuggaagugugugauc

SEQ ID NO: 482642 - RNA, 20 nt, Homo sapiens
aguuguuuucccgagcaaag

SEQ ID NO: 482643 - RNA, 18 nt, Homo sapiens
aguuucucucacauuacu

SEQ ID NO: 482644 - RNA, 19 nt, Homo sapiens
aguuugauaugggcuuucu

SEQ ID NO: 482645 - RNA, 19 nt, Homo sapiens
auaaaaacucauccauggc

SEQ ID NO: 482646 - RNA, 20 nt, Homo sapiens
auaaaaugcauuuaaacuca

SEQ ID NO: 482647 - RNA, 21 nt, Homo sapiens
auaaaauuaaagcugaaaacu

SEQ ID NO: 482648 - RNA, 20 nt, Homo sapiens
auaaaauuguaaaauuguau

SEQ ID NO: 482649 - RNA, 19 nt, Homo sapiens
auaaagcuguucucauucc

SEQ ID NO: 482650 - RNA, 14 nt, Homo sapiens
auaaauaugcucag

SEQ ID NO: 482651 - RNA, 14 nt, Homo sapiens
auaaauggacaaau

SEQ ID NO: 482652 - RNA, 18 nt, Homo sapiens
auaaauuggaauaaugua

SEQ ID NO: 482653 - RNA, 13 nt, Homo sapiens
auaacagccucau

SEQ ID NO: 482654 - RNA, 22 nt, Homo sapiens
auaacuauugauauaauuucca

SEQ ID NO: 482655 - RNA, 16 nt, Homo sapiens
auaacuggaaacuuca

SEQ ID NO: 482656 - RNA, 21 nt, Homo sapiens
auaagagggcacacacugugu

SEQ ID NO: 482657 - RNA, 15 nt, Homo sapiens
auaagcuguuuuuau

SEQ ID NO: 482658 - RNA, 15 nt, Homo sapiens
auaagugcaugacau

SEQ ID NO: 482659 - RNA, 16 nt, Homo sapiens
auaauacuagucuuau

SEQ ID NO: 482660 - RNA, 21 nt, Homo sapiens
auaaugucauuaaacaugaca

SEQ ID NO: 482661 - RNA, 17 nt, Homo sapiens
auaauuacauauuugca

SEQ ID NO: 482662 - RNA, 21 nt, Homo sapiens
auaauuuguauacccuguccu

SEQ ID NO: 482663 - RNA, 22 nt, Homo sapiens
auacaauauuuuaacaaugugc

SEQ ID NO: 482664 - RNA, 20 nt, Homo sapiens
auacaguuugucacaugaaa

SEQ ID NO: 482665 - RNA, 19 nt, Homo sapiens
auacauuauuggacuucca

SEQ ID NO: 482666 - RNA, 23 nt, Homo sapiens
auaccagcuagaaucacuugacu

SEQ ID NO: 482667 - RNA, 17 nt, Homo sapiens
auacccacacagucaca

SEQ ID NO: 482668 - RNA, 20 nt, Homo sapiens
auaccugguaagcaaaaacu

SEQ ID NO: 482669 - RNA, 19 nt, Homo sapiens
auacuacaguaacugugac

SEQ ID NO: 482670 - RNA, 22 nt, Homo sapiens
auacuacaguaacugugacuga

SEQ ID NO: 482671 - RNA, 16 nt, Homo sapiens
auacucugaauuugga

SEQ ID NO: 482672 - RNA, 15 nt, Homo sapiens
auacucuucaaggac

SEQ ID NO: 482673 - RNA, 13 nt, Homo sapiens
auagaacagagaa

SEQ ID NO: 482674 - RNA, 20 nt, Homo sapiens
auagauccuaagccauaaaa

SEQ ID NO: 482675 - RNA, 20 nt, Homo sapiens
auagcuacuuuggaggacaa

SEQ ID NO: 482676 - RNA, 14 nt, Homo sapiens
auaggcccagugag

SEQ ID NO: 482677 - RNA, 17 nt, Homo sapiens
auaguacagacagaagg

SEQ ID NO: 482678 - RNA, 16 nt, Homo sapiens
auaguaggacugcuga

SEQ ID NO: 482679 - RNA, 16 nt, Homo sapiens
auaguguuggaaaaug

SEQ ID NO: 482680 - RNA, 14 nt, Homo sapiens
auauagaacagugc

SEQ ID NO: 482681 - RNA, 14 nt, Homo sapiens
auaucaugcuccau

SEQ ID NO: 482682 - RNA, 21 nt, Homo sapiens
auaugcacuuauucucaagaa

SEQ ID NO: 482683 - RNA, 21 nt, Homo sapiens
auaugccuuuucccaacucca

SEQ ID NO: 482684 - RNA, 18 nt, Homo sapiens
auaugcuaauauauguau

SEQ ID NO: 482685 - RNA, 18 nt, Homo sapiens
auauggaggaggcucugg

SEQ ID NO: 482686 - RNA, 21 nt, Homo sapiens
auaugggguugguguucucau

SEQ ID NO: 482687 - RNA, 20 nt, Homo sapiens
auauguaacuggaaucucaa

SEQ ID NO: 482688 - RNA, 20 nt, Homo sapiens
auauuuuaccaccagucaau

SEQ ID NO: 482689 - RNA, 19 nt, Homo sapiens
auauuuuauuauagucacu

SEQ ID NO: 482690 - RNA, 19 nt, Homo sapiens
aucaaacacaaugccucau

SEQ ID NO: 482691 - RNA, 13 nt, Homo sapiens
aucaagacuggaa

SEQ ID NO: 482692 - RNA, 20 nt, Homo sapiens
aucaauccagcgguucucaa

SEQ ID NO: 482693 - RNA, 13 nt, Homo sapiens
aucacauagugaa

SEQ ID NO: 482694 - RNA, 22 nt, Homo sapiens
aucaccuaccuucaccaucugu

SEQ ID NO: 482695 - RNA, 22 nt, Homo sapiens
aucacuuccuauaugcacuuau

SEQ ID NO: 482696 - RNA, 17 nt, Homo sapiens
aucacuugacuuugcca

SEQ ID NO: 482697 - RNA, 23 nt, Homo sapiens
aucagcaacaaccagcaucccuu

SEQ ID NO: 482698 - RNA, 21 nt, Homo sapiens
aucagcuggcgucaugcaaag

SEQ ID NO: 482699 - RNA, 13 nt, Homo sapiens
aucaguccaaagg

SEQ ID NO: 482700 - RNA, 13 nt, Homo sapiens
aucagucugagag

SEQ ID NO: 482701 - RNA, 16 nt, Homo sapiens
aucaguugaggccagg

SEQ ID NO: 482702 - RNA, 14 nt, Homo sapiens
aucaucuguggaac

SEQ ID NO: 482703 - RNA, 20 nt, Homo sapiens
auccagaacucaaaugagcc

SEQ ID NO: 482704 - RNA, 14 nt, Homo sapiens
auccauacauuugu

SEQ ID NO: 482705 - RNA, 20 nt, Homo sapiens
auccauuugcguuccaugau

SEQ ID NO: 482706 - RNA, 17 nt, Homo sapiens
auccccaccuacuccug

SEQ ID NO: 482707 - RNA, 17 nt, Homo sapiens
aucccuaaugcugcaga

SEQ ID NO: 482708 - RNA, 16 nt, Homo sapiens
aucccuuuccaaaggc

SEQ ID NO: 482709 - RNA, 17 nt, Homo sapiens
auccuuccucauuugca

SEQ ID NO: 482710 - RNA, 21 nt, Homo sapiens
cagauggacuccagccugccu

SEQ ID NO: 482711 - RNA, 19 nt, Homo sapiens
cagaugggggaaagcacag

SEQ ID NO: 482712 - RNA, 15 nt, Homo sapiens
cagcacccucuccag

SEQ ID NO: 482713 - RNA, 17 nt, Homo sapiens
cagcagccagcucucag

SEQ ID NO: 482714 - RNA, 20 nt, Homo sapiens
cagcagccagcucucagcca

SEQ ID NO: 482715 - RNA, 23 nt, Homo sapiens
cagcaggcauaaggcaccaguua

SEQ ID NO: 482716 - RNA, 22 nt, Homo sapiens
cagcaguggacucaaaacccau

SEQ ID NO: 482717 - RNA, 13 nt, Homo sapiens
cagcaucccuuga

SEQ ID NO: 482718 - RNA, 19 nt, Homo sapiens
cagcaugaaggaugccaua

SEQ ID NO: 482719 - RNA, 17 nt, Homo sapiens
cagcauuuccacaccaa

SEQ ID NO: 482720 - RNA, 14 nt, Homo sapiens
cagccggcugcaag

SEQ ID NO: 482721 - RNA, 16 nt, Homo sapiens
cagccucauugauguc

SEQ ID NO: 482722 - RNA, 19 nt, Homo sapiens
cagccucauugaugucaaa

SEQ ID NO: 482723 - RNA, 15 nt, Homo sapiens
cagcgugaagggauu

SEQ ID NO: 482724 - RNA, 17 nt, Homo sapiens
cagcuaacuuaucauca

SEQ ID NO: 482725 - RNA, 15 nt, Homo sapiens
caggaaaaucugcac

SEQ ID NO: 482726 - RNA, 13 nt, Homo sapiens
caggacauucuca

SEQ ID NO: 482727 - RNA, 13 nt, Homo sapiens
caggaguacaccc

SEQ ID NO: 482728 - RNA, 18 nt, Homo sapiens
caggaguuggaagugugu

SEQ ID NO: 482729 - RNA, 19 nt, Homo sapiens
caggcagcuuuuucucucc

SEQ ID NO: 482730 - RNA, 16 nt, Homo sapiens
caggcaggcaccuggg

SEQ ID NO: 482731 - RNA, 19 nt, Homo sapiens
caggcaugagucagucuga

SEQ ID NO: 482732 - RNA, 15 nt, Homo sapiens
caggccacauggcua

SEQ ID NO: 482733 - RNA, 18 nt, Homo sapiens
caggccaggagacuguua

SEQ ID NO: 482734 - RNA, 21 nt, Homo sapiens
caggccaggagacuguuaaag

SEQ ID NO: 482735 - RNA, 14 nt, Homo sapiens
caggccaucaucag

SEQ ID NO: 482736 - RNA, 16 nt, Homo sapiens
caggcucugagacaca

SEQ ID NO: 482737 - RNA, 23 nt, Homo sapiens
caggcuguuggaaaauccagaac

SEQ ID NO: 482738 - RNA, 21 nt, Homo sapiens
cagggaaugccugagugccug

SEQ ID NO: 482739 - RNA, 18 nt, Homo sapiens
cagggcucagccuggugg

SEQ ID NO: 482740 - RNA, 22 nt, Homo sapiens
cagggcucagccuggugggccu

SEQ ID NO: 482741 - RNA, 20 nt, Homo sapiens
cagguagaacacaaggucau

SEQ ID NO: 482742 - RNA, 21 nt, Homo sapiens
cagguagaacacaaggucauu

SEQ ID NO: 482743 - RNA, 13 nt, Homo sapiens
caggugaagcacc

SEQ ID NO: 482744 - RNA, 16 nt, Homo sapiens
caggugauccacccac

SEQ ID NO: 482745 - RNA, 17 nt, Homo sapiens
caggugauccaccugcc

SEQ ID NO: 482746 - RNA, 17 nt, Homo sapiens
cagguuuguguuuucuu

SEQ ID NO: 482747 - RNA, 15 nt, Homo sapiens
caguaucuugggcau

SEQ ID NO: 482748 - RNA, 17 nt, Homo sapiens
caguaugaaaaugucau

SEQ ID NO: 482749 - RNA, 15 nt, Homo sapiens
cagucaccucaugga

SEQ ID NO: 482750 - RNA, 12 nt, Homo sapiens
cagugacauuua

SEQ ID NO: 482751 - RNA, 19 nt, Homo sapiens
caguggacucaaaacccau

SEQ ID NO: 482752 - RNA, 18 nt, Homo sapiens
caguggcugcugcccagg

SEQ ID NO: 482753 - RNA, 13 nt, Homo sapiens
caguuaaggggag

SEQ ID NO: 482754 - RNA, 22 nt, Homo sapiens
caguuaaggggagcaacagagg

SEQ ID NO: 482755 - RNA, 13 nt, Homo sapiens
caguucugaagaa

SEQ ID NO: 482756 - RNA, 15 nt, Homo sapiens
caguuuuuccuaguc

SEQ ID NO: 482757 - RNA, 18 nt, Homo sapiens
cauaaacaugcauuguga

SEQ ID NO: 482758 - RNA, 17 nt, Homo sapiens
cauaaaguaugugcaua

SEQ ID NO: 482759 - RNA, 17 nt, Homo sapiens
cauaagcgaucacuucc

SEQ ID NO: 482760 - RNA, 17 nt, Homo sapiens
cauaaguagagacugaa

SEQ ID NO: 482761 - RNA, 18 nt, Homo sapiens
cauaauuucuucacucaa

SEQ ID NO: 482762 - RNA, 23 nt, Homo sapiens
cauaauuucuucacucaaucucu

SEQ ID NO: 482763 - RNA, 14 nt, Homo sapiens
cauacauuaucuca

SEQ ID NO: 482764 - RNA, 23 nt, Homo sapiens
cauacuacaguaacugugacuga

SEQ ID NO: 482765 - RNA, 19 nt, Homo sapiens
cauaggaggggucuggaca

SEQ ID NO: 482766 - RNA, 22 nt, Homo sapiens
cauaguagguacccaauucaau

SEQ ID NO: 482767 - RNA, 13 nt, Homo sapiens
cauaucaagagac

SEQ ID NO: 482768 - RNA, 23 nt, Homo sapiens
cauauggaggaggcucuggaguc

SEQ ID NO: 482769 - RNA, 19 nt, Homo sapiens
cauauguaaggaagucaga

SEQ ID NO: 482770 - RNA, 17 nt, Homo sapiens
caucaccuccaccauac

SEQ ID NO: 482771 - RNA, 16 nt, Homo sapiens
caucagucaaugaaua

SEQ ID NO: 482772 - RNA, 22 nt, Homo sapiens
cauccuagucucuaucauuaaa

SEQ ID NO: 482773 - RNA, 12 nt, Homo sapiens
cauccucaaaag

SEQ ID NO: 482774 - RNA, 12 nt, Homo sapiens
caucucuacuaa

SEQ ID NO: 482775 - RNA, 14 nt, Homo sapiens
caucucucuuuaau

SEQ ID NO: 482776 - RNA, 18 nt, Homo sapiens
caucuguauauacaaaga

SEQ ID NO: 482777 - RNA, 22 nt, Homo sapiens
caucuuuucuguugccccaucc

SEQ ID NO: 482778 - RNA, 20 nt, Homo sapiens
caugaagggaugcugcaaug

SEQ ID NO: 482779 - RNA, 17 nt, Homo sapiens
caugacuuuuccaugua

SEQ ID NO: 482780 - RNA, 20 nt, Homo sapiens
caugauguuuagaaacacaa

SEQ ID NO: 482781 - RNA, 15 nt, Homo sapiens
caugcccugccaagc

SEQ ID NO: 482782 - RNA, 17 nt, Homo sapiens
caugcguuuaaucacau

SEQ ID NO: 482783 - RNA, 20 nt, Homo sapiens
caugcugaagccaaagccaa

SEQ ID NO: 482784 - RNA, 15 nt, Homo sapiens
cauggaaauucccuu

SEQ ID NO: 482785 - RNA, 23 nt, Homo sapiens
cauggccaaauguucaauaugag

SEQ ID NO: 482786 - RNA, 21 nt, Homo sapiens
cauggcuauaaacaauuacau

SEQ ID NO: 482787 - RNA, 16 nt, Homo sapiens
cauggcucuaaaaagu

SEQ ID NO: 482788 - RNA, 20 nt, Homo sapiens
caugguggggcaugccugua

SEQ ID NO: 482789 - RNA, 15 nt, Homo sapiens
caugugcucagggaa

SEQ ID NO: 482790 - RNA, 15 nt, Homo sapiens
cauguuggcccagac

SEQ ID NO: 482791 - RNA, 23 nt, Homo sapiens
cauguuuugccacccccugugag

SEQ ID NO: 482792 - RNA, 17 nt, Homo sapiens
cauuaccuucucccuca

SEQ ID NO: 482793 - RNA, 22 nt, Homo sapiens
cauuccauccuugagucaaaaa

SEQ ID NO: 482794 - RNA, 20 nt, Homo sapiens
cauucccagaauuugcugca

SEQ ID NO: 482795 - RNA, 14 nt, Homo sapiens
cauuccuguucuuu

SEQ ID NO: 482796 - RNA, 15 nt, Homo sapiens
cauucgaguguuuca

SEQ ID NO: 482797 - RNA, 10 nt, Homo sapiens
cauugaacaa

SEQ ID NO: 482798 - RNA, 18 nt, Homo sapiens
cauugcacucuagccugg

SEQ ID NO: 482799 - RNA, 20 nt, Homo sapiens
cauugcacucuagccuggca

SEQ ID NO: 482800 - RNA, 22 nt, Homo sapiens
cauuuaagagacagucacccca

SEQ ID NO: 482801 - RNA, 13 nt, Homo sapiens
cauuuagauuuug

SEQ ID NO: 482802 - RNA, 22 nt, Homo sapiens
cauuucacaaauguuuagugaa

SEQ ID NO: 482803 - RNA, 16 nt, Homo sapiens
cauuugcucauggaau

SEQ ID NO: 482804 - RNA, 17 nt, Homo sapiens
cauuuucugccacccaa

SEQ ID NO: 482805 - RNA, 17 nt, Homo sapiens
ccaaacagaacuaugga

SEQ ID NO: 482806 - RNA, 12 nt, Homo sapiens
ccaaacagugac

SEQ ID NO: 482807 - RNA, 17 nt, Homo sapiens
ccaaacugacucuuaag

SEQ ID NO: 482808 - RNA, 20 nt, Homo sapiens
ccaaauuacguguacuacaa

SEQ ID NO: 482809 - RNA, 13 nt, Homo sapiens
ccaacagaugugu

SEQ ID NO: 482810 - RNA, 12 nt, Homo sapiens
ccaacagcaccc

SEQ ID NO: 482811 - RNA, 14 nt, Homo sapiens
ccaacagcacccuc

SEQ ID NO: 482812 - RNA, 18 nt, Homo sapiens
ccaagaaugagaagaaug

SEQ ID NO: 482813 - RNA, 18 nt, Homo sapiens
ccaagagucugaugauuu

SEQ ID NO: 482814 - RNA, 16 nt, Homo sapiens
ccaaggagaugaagca

SEQ ID NO: 482815 - RNA, 14 nt, Homo sapiens
ccaaucaugaauua

SEQ ID NO: 482816 - RNA, 16 nt, Homo sapiens
ccaauuccuugcacau

SEQ ID NO: 482817 - RNA, 17 nt, Homo sapiens
ccacagcuucugcagca

SEQ ID NO: 482818 - RNA, 19 nt, Homo sapiens
ccaccacugauauccuccu

SEQ ID NO: 482819 - RNA, 22 nt, Homo sapiens
ccacccagaugggggaaagcac

SEQ ID NO: 482820 - RNA, 14 nt, Homo sapiens
ccacccauaccagc

SEQ ID NO: 482821 - RNA, 15 nt, Homo sapiens
ccacccucaugcugu

SEQ ID NO: 482822 - RNA, 21 nt, Homo sapiens
ccacggcaggccccugcagga

SEQ ID NO: 482823 - RNA, 14 nt, Homo sapiens
ccacugccuuugac

SEQ ID NO: 482824 - RNA, 17 nt, Homo sapiens
ccagaaagcucaucuca

SEQ ID NO: 482825 - RNA, 11 nt, Homo sapiens
ccagacagggu

SEQ ID NO: 482826 - RNA, 15 nt, Homo sapiens
ccagaugcauguuca

SEQ ID NO: 482827 - RNA, 13 nt, Homo sapiens
ccagcaauuccau

SEQ ID NO: 482828 - RNA, 19 nt, Homo sapiens
ccagcacagccucuuagau

SEQ ID NO: 482829 - RNA, 16 nt, Homo sapiens
ccagccagcaguucag

SEQ ID NO: 482830 - RNA, 20 nt, Homo sapiens
ccagccugggcaacagagca

SEQ ID NO: 482831 - RNA, 18 nt, Homo sapiens
ccaggauugaccuuugca

SEQ ID NO: 482832 - RNA, 13 nt, Homo sapiens
ccaggcaaagcaa

SEQ ID NO: 482833 - RNA, 13 nt, Homo sapiens
ccaggcaggcuaa

SEQ ID NO: 482834 - RNA, 23 nt, Homo sapiens
ccaggcuggcagauuuccaaaag

SEQ ID NO: 482835 - RNA, 15 nt, Homo sapiens
ccagucauggccaaa

SEQ ID NO: 482836 - RNA, 12 nt, Homo sapiens
ccagucccucag

SEQ ID NO: 482837 - RNA, 22 nt, Homo sapiens
ccaguugucuauucauugacug

SEQ ID NO: 482838 - RNA, 21 nt, Homo sapiens
ccaguuuaaccugaugcaguc

SEQ ID NO: 482839 - RNA, 13 nt, Homo sapiens
ccauaaucacuca

SEQ ID NO: 482840 - RNA, 11 nt, Homo sapiens
ccauaccagcu

SEQ ID NO: 482841 - RNA, 16 nt, Homo sapiens
ccauagagacuuugug

SEQ ID NO: 482842 - RNA, 18 nt, Homo sapiens
ccauauacucuucaagga

SEQ ID NO: 482843 - RNA, 14 nt, Homo sapiens
ccauccucaaacac

SEQ ID NO: 482844 - RNA, 21 nt, Homo sapiens
ccauccuggccaacauuguaa

SEQ ID NO: 482845 - RNA, 15 nt, Homo sapiens
ccauccuugagucaa

SEQ ID NO: 482846 - RNA, 16 nt, Homo sapiens
ccauccuugagucaaa

SEQ ID NO: 482847 - RNA, 14 nt, Homo sapiens
ccaucgucuuuaac

SEQ ID NO: 482848 - RNA, 17 nt, Homo sapiens
ccaucugggcuucacag

SEQ ID NO: 482849 - RNA, 17 nt, Homo sapiens
ccaucuguauauacaaa

SEQ ID NO: 482850 - RNA, 20 nt, Homo sapiens
ccaugaacacguuuuuucac

SEQ ID NO: 482851 - RNA, 12 nt, Homo sapiens
ccaugaacauca

SEQ ID NO: 482852 - RNA, 17 nt, Homo sapiens
ccaugaacaucauggac

SEQ ID NO: 482853 - RNA, 14 nt, Homo sapiens
ccaugcagacauga

SEQ ID NO: 482854 - RNA, 21 nt, Homo sapiens
ccauggacagaagaaggcagc

SEQ ID NO: 482855 - RNA, 19 nt, Homo sapiens
ccaugguaugaaggugauu

SEQ ID NO: 482856 - RNA, 15 nt, Homo sapiens
ccauguagaagcugc

SEQ ID NO: 482857 - RNA, 17 nt, Homo sapiens
ccauguagaagcugcau

SEQ ID NO: 482858 - RNA, 16 nt, Homo sapiens
ccauuuuugaaaccaa

SEQ ID NO: 482859 - RNA, 17 nt, Homo sapiens
cccaaaagcccauucau

SEQ ID NO: 482860 - RNA, 13 nt, Homo sapiens
cccaaacagugac

SEQ ID NO: 482861 - RNA, 10 nt, Homo sapiens
cccaacagca

SEQ ID NO: 482862 - RNA, 13 nt, Homo sapiens
cccacagguauga

SEQ ID NO: 482863 - RNA, 13 nt, Homo sapiens
cccacaguggaaa

SEQ ID NO: 482864 - RNA, 16 nt, Homo sapiens
cccacuugacacuauu

SEQ ID NO: 482865 - RNA, 17 nt, Homo sapiens
cccacuuucuucuacca

SEQ ID NO: 482866 - RNA, 22 nt, Homo sapiens
cccaggcccagaccuucuagga

SEQ ID NO: 482867 - RNA, 15 nt, Homo sapiens
cccaggcugggcaag

SEQ ID NO: 482868 - RNA, 19 nt, Homo sapiens
cccaggcuuuugaaaaaca

SEQ ID NO: 482869 - RNA, 19 nt, Homo sapiens
cccauucuacacagagcag

SEQ ID NO: 482870 - RNA, 11 nt, Homo sapiens
ccccaacagca

SEQ ID NO: 482871 - RNA, 23 nt, Homo sapiens
ccccaacagcacccucuccagau

SEQ ID NO: 482872 - RNA, 13 nt, Homo sapiens
ccccaacugcucc

SEQ ID NO: 482873 - RNA, 11 nt, Homo sapiens
ccccaauccaa

SEQ ID NO: 482874 - RNA, 24 nt, Homo sapiens
ccccacccugagcgccugggucca

SEQ ID NO: 482875 - RNA, 11 nt, Homo sapiens
cccccaacagc

SEQ ID NO: 482876 - RNA, 12 nt, Homo sapiens
ccccuucauccg

SEQ ID NO: 482877 - RNA, 19 nt, Homo sapiens
cccggcugucaaggggugu

SEQ ID NO: 482878 - RNA, 19 nt, Homo sapiens
cccuaaccucugagucacc

SEQ ID NO: 482879 - RNA, 19 nt, Homo sapiens
cccuauugguaaagaaugg

SEQ ID NO: 482880 - RNA, 19 nt, Homo sapiens
cccucaacugugucugaug

SEQ ID NO: 482881 - RNA, 21 nt, Homo sapiens
cccucaugcugugugacucaa

SEQ ID NO: 482882 - RNA, 23 nt, Homo sapiens
cccucuuguuuucacuucacuuu

SEQ ID NO: 482883 - RNA, 16 nt, Homo sapiens
cccugguucugaugau

SEQ ID NO: 482884 - RNA, 16 nt, Homo sapiens
cccugucucuuaaaaa

SEQ ID NO: 482885 - RNA, 18 nt, Homo sapiens
ccgaggggcucaguucug

SEQ ID NO: 482886 - RNA, 16 nt, Homo sapiens
ccgcauccuagucucu

SEQ ID NO: 482887 - RNA, 12 nt, Homo sapiens
ccgcuacuucca

SEQ ID NO: 482888 - RNA, 13 nt, Homo sapiens
ccggccauucucc

SEQ ID NO: 482889 - RNA, 18 nt, Homo sapiens
ccuaaaacaaaagcucau

SEQ ID NO: 482890 - RNA, 22 nt, Homo sapiens
ccuacauuuuaaugcaccugaa

SEQ ID NO: 482891 - RNA, 23 nt, Homo sapiens
ccuagaagggcuagaaccuggag

SEQ ID NO: 482892 - RNA, 15 nt, Homo sapiens
ccuagagcacacugu

SEQ ID NO: 482893 - RNA, 23 nt, Homo sapiens
ccuauggaagcauauuguuauua

SEQ ID NO: 482894 - RNA, 11 nt, Homo sapiens
ccucaaaagaa

SEQ ID NO: 482895 - RNA, 23 nt, Homo sapiens
ccucacacugggacuugcaaaaa

SEQ ID NO: 482896 - RNA, 13 nt, Homo sapiens
ccucacuauucaa

SEQ ID NO: 482897 - RNA, 14 nt, Homo sapiens
ccucagccacugaa

SEQ ID NO: 482898 - RNA, 20 nt, Homo sapiens
ccucaugcugugugacucaa

SEQ ID NO: 482899 - RNA, 20 nt, Homo sapiens
ccuccaccucccugcaauaa

SEQ ID NO: 482900 - RNA, 20 nt, Homo sapiens
ccuccaugaacaucauggac

SEQ ID NO: 482901 - RNA, 18 nt, Homo sapiens
ccucccaaguagcuggaa

SEQ ID NO: 482902 - RNA, 17 nt, Homo sapiens
ccucccuucaugcaugg

SEQ ID NO: 482903 - RNA, 15 nt, Homo sapiens
ccuccgcuacuucca

SEQ ID NO: 482904 - RNA, 18 nt, Homo sapiens
ccuccucugcuugccauc

SEQ ID NO: 482905 - RNA, 21 nt, Homo sapiens
ccuccugaguagcugggacca

SEQ ID NO: 482906 - RNA, 23 nt, Homo sapiens
ccuccuggguuuacuccuugagu

SEQ ID NO: 482907 - RNA, 21 nt, Homo sapiens
ccuccuuacauaugcaaaaau

SEQ ID NO: 482908 - RNA, 20 nt, Homo sapiens
ccucuccugggcagcugccu

SEQ ID NO: 482909 - RNA, 14 nt, Homo sapiens
ccucucuugccgac

SEQ ID NO: 482910 - RNA, 16 nt, Homo sapiens
ccucuuguugcugagu

SEQ ID NO: 482911 - RNA, 16 nt, Homo sapiens
ccucuuuuucuagucu

SEQ ID NO: 482912 - RNA, 22 nt, Homo sapiens
ccugaaguaagcaaagacuuuc

SEQ ID NO: 482913 - RNA, 14 nt, Homo sapiens
ccugagucccuuaa

SEQ ID NO: 482914 - RNA, 23 nt, Homo sapiens
ccugcauguuggcccagaccuca

SEQ ID NO: 482915 - RNA, 16 nt, Homo sapiens
ccugcucacucuucca

SEQ ID NO: 482916 - RNA, 20 nt, Homo sapiens
ccuggaacaucaucaaggca

SEQ ID NO: 482917 - RNA, 21 nt, Homo sapiens
ccuggcaaagaugaucaguau

SEQ ID NO: 482918 - RNA, 20 nt, Homo sapiens
ccuggccaacaugaugaaac

SEQ ID NO: 482919 - RNA, 17 nt, Homo sapiens
ccugggguaccaagaga

SEQ ID NO: 482920 - RNA, 15 nt, Homo sapiens
ccugguucugaugau

SEQ ID NO: 482921 - RNA, 21 nt, Homo sapiens
ccuguucuuucuuacacaaga

SEQ ID NO: 482922 - RNA, 18 nt, Homo sapiens
ccuguuguaacugcccaa

SEQ ID NO: 482923 - RNA, 19 nt, Homo sapiens
ccuguuuugagcuuaaaaa

SEQ ID NO: 482924 - RNA, 23 nt, Homo sapiens
ccuuaaacucagggagcauuuau

SEQ ID NO: 482925 - RNA, 23 nt, Homo sapiens
ccuuagaacuuugcauagcagcu

SEQ ID NO: 482926 - RNA, 13 nt, Homo sapiens
ccuucaaacuucc

SEQ ID NO: 482927 - RNA, 20 nt, Homo sapiens
ccuuccacacucaccucuaa

SEQ ID NO: 482928 - RNA, 13 nt, Homo sapiens
ccuucccaugacc

SEQ ID NO: 482929 - RNA, 15 nt, Homo sapiens
ccuucccaugaccca

SEQ ID NO: 482930 - RNA, 16 nt, Homo sapiens
ccuucgccucccagga

SEQ ID NO: 482931 - RNA, 13 nt, Homo sapiens
ccuugaaggguuc

SEQ ID NO: 482932 - RNA, 21 nt, Homo sapiens
ccuugagucaaaaaaucucaa

SEQ ID NO: 482933 - RNA, 15 nt, Homo sapiens
ccuugccagacaugu

SEQ ID NO: 482934 - RNA, 15 nt, Homo sapiens
ccuugccugcacaaa

SEQ ID NO: 482935 - RNA, 14 nt, Homo sapiens
ccuuuagaauauua

SEQ ID NO: 482936 - RNA, 14 nt, Homo sapiens
ccuuuuuuaaggaa

SEQ ID NO: 482937 - RNA, 20 nt, Homo sapiens
cgagaucacgccacugcacu

SEQ ID NO: 482938 - RNA, 19 nt, Homo sapiens
cgagccaaguuaagaaugu

SEQ ID NO: 482939 - RNA, 17 nt, Homo sapiens
cgaggggcucaguucug

SEQ ID NO: 482940 - RNA, 17 nt, Homo sapiens
cgaguuguuggcugcuc

SEQ ID NO: 482941 - RNA, 18 nt, Homo sapiens
cgaucuuagauugccacu

SEQ ID NO: 482942 - RNA, 15 nt, Homo sapiens
cgcaauugcucaugc

SEQ ID NO: 482943 - RNA, 16 nt, Homo sapiens
cgccaaggcuggagug

SEQ ID NO: 482944 - RNA, 21 nt, Homo sapiens
cgccaaggcuggagugcagug

SEQ ID NO: 482945 - RNA, 16 nt, Homo sapiens
cgccauugcacuccag

SEQ ID NO: 482946 - RNA, 17 nt, Homo sapiens
cgccuccgcuacuucca

SEQ ID NO: 482947 - RNA, 13 nt, Homo sapiens
cgcgcuccgcgca

SEQ ID NO: 482948 - RNA, 16 nt, Homo sapiens
cgcuagaguucuccag

SEQ ID NO: 482949 - RNA, 15 nt, Homo sapiens
cggagaacaaaugug

SEQ ID NO: 482950 - RNA, 17 nt, Homo sapiens
cggagccuccagcugcc

SEQ ID NO: 482951 - RNA, 15 nt, Homo sapiens
cggccugcucgccca

SEQ ID NO: 482952 - RNA, 17 nt, Homo sapiens
cgggaacaaaaugaugu

SEQ ID NO: 482953 - RNA, 18 nt, Homo sapiens
cgguuugaagccuggaac

SEQ ID NO: 482954 - RNA, 17 nt, Homo sapiens
cgugaaaaggacaaaua

SEQ ID NO: 482955 - RNA, 21 nt, Homo sapiens
cgugaagggauuuuagucaca

SEQ ID NO: 482956 - RNA, 22 nt, Homo sapiens
cgugaagggauuuuagucacac

SEQ ID NO: 482957 - RNA, 13 nt, Homo sapiens
cgugauggucuga

SEQ ID NO: 482958 - RNA, 14 nt, Homo sapiens
cguuugaaucacag

SEQ ID NO: 482959 - RNA, 13 nt, Homo sapiens
cuaaaacaguccu

SEQ ID NO: 482960 - RNA, 15 nt, Homo sapiens
cuaaaaccugagcua

SEQ ID NO: 482961 - RNA, 23 nt, Homo sapiens
cuaaaauaagggcagagucacac

SEQ ID NO: 482962 - RNA, 14 nt, Homo sapiens
cuaaaauaugaugu

SEQ ID NO: 482963 - RNA, 20 nt, Homo sapiens
cuaaacagacuauuuaacuu

SEQ ID NO: 482964 - RNA, 16 nt, Homo sapiens
cuaaagguuguauugc

SEQ ID NO: 482965 - RNA, 19 nt, Homo sapiens
cuaaagguuguauugcaua

SEQ ID NO: 482966 - RNA, 20 nt, Homo sapiens
cuaacaggagaaugcacagu

SEQ ID NO: 482967 - RNA, 16 nt, Homo sapiens
cuaaccugaacugaug

SEQ ID NO: 482968 - RNA, 13 nt, Homo sapiens
cuaacuagcuugg

SEQ ID NO: 482969 - RNA, 15 nt, Homo sapiens
cuaagaagcuugaau

SEQ ID NO: 482970 - RNA, 21 nt, Homo sapiens
cuaagagaaugugcucaugca

SEQ ID NO: 482971 - RNA, 20 nt, Homo sapiens
cuaagccaagagucauguca

SEQ ID NO: 482972 - RNA, 18 nt, Homo sapiens
cuaauaaaauacauacua

SEQ ID NO: 482973 - RNA, 19 nt, Homo sapiens
cuaauacagacuaugucac

SEQ ID NO: 482974 - RNA, 20 nt, Homo sapiens
cuaaucaauacuuugaacac

SEQ ID NO: 482975 - RNA, 21 nt, Homo sapiens
cuaauccucuuuuucuagucu

SEQ ID NO: 482976 - RNA, 15 nt, Homo sapiens
cuacaguaacuguga

SEQ ID NO: 482977 - RNA, 14 nt, Homo sapiens
cuacauacacagug

SEQ ID NO: 482978 - RNA, 21 nt, Homo sapiens
cuaccacaugccaagcacugu

SEQ ID NO: 482979 - RNA, 16 nt, Homo sapiens
cuaccucaccugggca

SEQ ID NO: 482980 - RNA, 22 nt, Homo sapiens
cuaccucauggggguauuguau

SEQ ID NO: 482981 - RNA, 18 nt, Homo sapiens
cuaccuuuugcuguggca

SEQ ID NO: 482982 - RNA, 20 nt, Homo sapiens
cuacucaggaggcugaggca

SEQ ID NO: 482983 - RNA, 19 nt, Homo sapiens
cuagaaccaagaagggcua

SEQ ID NO: 482984 - RNA, 13 nt, Homo sapiens
cuuaacacugagc

SEQ ID NO: 482985 - RNA, 17 nt, Homo sapiens
cuuaagagaugccucau

SEQ ID NO: 482986 - RNA, 20 nt, Homo sapiens
cuuacauuugaaaucuauga

SEQ ID NO: 482987 - RNA, 14 nt, Homo sapiens
cuuagauugccacu

SEQ ID NO: 482988 - RNA, 22 nt, Homo sapiens
cuuaggcaugacuguagaauuu

SEQ ID NO: 482989 - RNA, 21 nt, Homo sapiens
cuuagucuguggagaacagaa

SEQ ID NO: 482990 - RNA, 15 nt, Homo sapiens
cuuauccuccaugaa

SEQ ID NO: 482991 - RNA, 13 nt, Homo sapiens
cuuauuaggauuc

SEQ ID NO: 482992 - RNA, 12 nt, Homo sapiens
cuucaaacuucc

SEQ ID NO: 482993 - RNA, 17 nt, Homo sapiens
cuucacucaaucucuga

SEQ ID NO: 482994 - RNA, 19 nt, Homo sapiens
cuucacuccccuaucccau

SEQ ID NO: 482995 - RNA, 19 nt, Homo sapiens
cuucagaaucagacuauga

SEQ ID NO: 482996 - RNA, 16 nt, Homo sapiens
cuucagagcugacaca

SEQ ID NO: 482997 - RNA, 21 nt, Homo sapiens
cuucagagcugacacaggaug

SEQ ID NO: 482998 - RNA, 16 nt, Homo sapiens
cuucaguuguuuuccc

SEQ ID NO: 482999 - RNA, 21 nt, Homo sapiens
cuuccaaacagaacuauggaa

SEQ ID NO: 483000 - RNA, 15 nt, Homo sapiens
cuuccagggcuacgc

SEQ ID NO: 483001 - RNA, 19 nt, Homo sapiens
cuucccacuuugccacugg

SEQ ID NO: 483002 - RNA, 20 nt, Homo sapiens
cuucccuaaaaucagggaau

SEQ ID NO: 483003 - RNA, 17 nt, Homo sapiens
cuuccgcauccuagucu

SEQ ID NO: 483004 - RNA, 14 nt, Homo sapiens
cuuccucacaccag

SEQ ID NO: 483005 - RNA, 17 nt, Homo sapiens
cuuccuucuagggagca

SEQ ID NO: 483006 - RNA, 19 nt, Homo sapiens
cuucucaaagcugggauua

SEQ ID NO: 483007 - RNA, 11 nt, Homo sapiens
cuucucagaaa

SEQ ID NO: 483008 - RNA, 16 nt, Homo sapiens
cuucuccuccaugaac

SEQ ID NO: 483009 - RNA, 18 nt, Homo sapiens
cuucugagccucuuuaac

SEQ ID NO: 483010 - RNA, 23 nt, Homo sapiens
cuucugauacguguaugagacua

SEQ ID NO: 483011 - RNA, 16 nt, Homo sapiens
cuucuuacaaugcauu

SEQ ID NO: 483012 - RNA, 23 nt, Homo sapiens
cuugaauggcaugcuaguagcag

SEQ ID NO: 483013 - RNA, 17 nt, Homo sapiens
cuugacagaacacuguc

SEQ ID NO: 483014 - RNA, 14 nt, Homo sapiens
cuugacuuugccac

SEQ ID NO: 483015 - RNA, 20 nt, Homo sapiens
cuugagacaaaucuaugcca

SEQ ID NO: 483016 - RNA, 23 nt, Homo sapiens
cuugagcaaguagguugcugucu

SEQ ID NO: 483017 - RNA, 21 nt, Homo sapiens
cuugaggauuuugaguaucuc

SEQ ID NO: 483018 - RNA, 17 nt, Homo sapiens
cuugaguuaaccuugcu

SEQ ID NO: 483019 - RNA, 15 nt, Homo sapiens
cuugcaaaacuacaa

SEQ ID NO: 483020 - RNA, 14 nt, Homo sapiens
cuugccugcaggca

SEQ ID NO: 483021 - RNA, 20 nt, Homo sapiens
cuugcucaugcccugccaag

SEQ ID NO: 483022 - RNA, 18 nt, Homo sapiens
cuugcugccaaaagccuu

SEQ ID NO: 483023 - RNA, 13 nt, Homo sapiens
cuuggacuugagg

SEQ ID NO: 483024 - RNA, 23 nt, Homo sapiens
cuuggcacacagcaggcuuucaa

SEQ ID NO: 483025 - RNA, 24 nt, Homo sapiens
cuuggcacauuuaagagacaguca

SEQ ID NO: 483026 - RNA, 13 nt, Homo sapiens
cuuggccucccaa

SEQ ID NO: 483027 - RNA, 18 nt, Homo sapiens
cuuggcuccaccacugau

SEQ ID NO: 483028 - RNA, 19 nt, Homo sapiens
cuuguaaaauuucacuuaa

SEQ ID NO: 483029 - RNA, 17 nt, Homo sapiens
cuuguaaaugugguaaa

SEQ ID NO: 483030 - RNA, 20 nt, Homo sapiens
cuugugccucagccucccaa

SEQ ID NO: 483031 - RNA, 19 nt, Homo sapiens
cuugugcucuuuucaagaa

SEQ ID NO: 483032 - RNA, 18 nt, Homo sapiens
cuuguguuuuuugcucac

SEQ ID NO: 483033 - RNA, 19 nt, Homo sapiens
cuuuaaaacuuauccucca

SEQ ID NO: 483034 - RNA, 14 nt, Homo sapiens
cuuuaaaccaccua

SEQ ID NO: 483035 - RNA, 16 nt, Homo sapiens
cuuuaacagcuuucuc

SEQ ID NO: 483036 - RNA, 21 nt, Homo sapiens
cuuuaagugcacaacauuaca

SEQ ID NO: 483037 - RNA, 22 nt, Homo sapiens
cuuuaauuguuaagauaugaug

SEQ ID NO: 483038 - RNA, 19 nt, Homo sapiens
cuuuagcaguuuugugaua

SEQ ID NO: 483039 - RNA, 13 nt, Homo sapiens
cuuuauagcuuug

SEQ ID NO: 483040 - RNA, 14 nt, Homo sapiens
cuuuauagcuuugg

SEQ ID NO: 483041 - RNA, 22 nt, Homo sapiens
cuuuauauggccucaagaucaa

SEQ ID NO: 483042 - RNA, 16 nt, Homo sapiens
cuuucagcugugaaca

SEQ ID NO: 483043 - RNA, 15 nt, Homo sapiens
cuuuccaaaggccau

SEQ ID NO: 483044 - RNA, 14 nt, Homo sapiens
cuuuccaauccuuu

SEQ ID NO: 483045 - RNA, 13 nt, Homo sapiens
cuuuccacauuca

SEQ ID NO: 483046 - RNA, 16 nt, Homo sapiens
cuuucugcacauaagu

SEQ ID NO: 483047 - RNA, 17 nt, Homo sapiens
cuuucuuacacaagagc

SEQ ID NO: 483048 - RNA, 19 nt, Homo sapiens
cuuugccuuuccauaauca

SEQ ID NO: 483049 - RNA, 23 nt, Homo sapiens
cuuugccuuuccauaaucacuca

SEQ ID NO: 483050 - RNA, 16 nt, Homo sapiens
cuuuggagaucaagga

SEQ ID NO: 483051 - RNA, 20 nt, Homo sapiens
cuuuggcaaaacuuaggcau

SEQ ID NO: 483052 - RNA, 21 nt, Homo sapiens
cuuuuaaacccuauugguaaa

SEQ ID NO: 483053 - RNA, 13 nt, Homo sapiens
cuuuugaaaaaca

SEQ ID NO: 483054 - RNA, 19 nt, Homo sapiens
cuuuugcauaagugcauga

SEQ ID NO: 483055 - RNA, 15 nt, Homo sapiens
gaaaacuuauuugag

SEQ ID NO: 483056 - RNA, 20 nt, Homo sapiens
gaaaagagauggccugagaa

SEQ ID NO: 483057 - RNA, 17 nt, Homo sapiens
gaaaagagcacuucaca

SEQ ID NO: 483058 - RNA, 15 nt, Homo sapiens
gaaaagauuccuguc

SEQ ID NO: 483059 - RNA, 16 nt, Homo sapiens
gaaaaguccacaguga

SEQ ID NO: 483060 - RNA, 20 nt, Homo sapiens
gaaaauauguaacuggaauc

SEQ ID NO: 483061 - RNA, 12 nt, Homo sapiens
gaaaauccagaa

SEQ ID NO: 483062 - RNA, 12 nt, Homo sapiens
gaaaaugugcaa

SEQ ID NO: 483063 - RNA, 14 nt, Homo sapiens
gaaaauuaacacug

SEQ ID NO: 483064 - RNA, 15 nt, Homo sapiens
gaaaauuaacacugc

SEQ ID NO: 483065 - RNA, 18 nt, Homo sapiens
gaaacacugggcuucuag

SEQ ID NO: 483066 - RNA, 15 nt, Homo sapiens
gaaacauuugugaaa

SEQ ID NO: 483067 - RNA, 13 nt, Homo sapiens
gaaacuguagaga

SEQ ID NO: 483068 - RNA, 20 nt, Homo sapiens
gaaacuuguuagaaaugcaa

SEQ ID NO: 483069 - RNA, 19 nt, Homo sapiens
gaaagaguugccauaauga

SEQ ID NO: 483070 - RNA, 23 nt, Homo sapiens
gaaagguacuucaaauccuugaa

SEQ ID NO: 483071 - RNA, 19 nt, Homo sapiens
gaaauaaugguuauaucua

SEQ ID NO: 483072 - RNA, 17 nt, Homo sapiens
gaaauaucaugcuccau

SEQ ID NO: 483073 - RNA, 17 nt, Homo sapiens
gaaaucaaaaagggaau

SEQ ID NO: 483074 - RNA, 20 nt, Homo sapiens
gaaauccuaguggccuccca

SEQ ID NO: 483075 - RNA, 16 nt, Homo sapiens
gaaaugcaaauucuca

SEQ ID NO: 483076 - RNA, 15 nt, Homo sapiens
gaacaaaugugaagg

SEQ ID NO: 483077 - RNA, 15 nt, Homo sapiens
gaacagugcuugcca

SEQ ID NO: 483078 - RNA, 23 nt, Homo sapiens
gaacauaaagccuuggauguaua

SEQ ID NO: 483079 - RNA, 20 nt, Homo sapiens
gaaccgagcuggagccaaca

SEQ ID NO: 483080 - RNA, 20 nt, Homo sapiens
gaaccuagauugcaccauug

SEQ ID NO: 483081 - RNA, 23 nt, Homo sapiens
gaacguguauguaccuaggauau

SEQ ID NO: 483082 - RNA, 19 nt, Homo sapiens
gaacugaaaacaagccaug

SEQ ID NO: 483083 - RNA, 21 nt, Homo sapiens
gaacuuugcauagcagcugcu

SEQ ID NO: 483084 - RNA, 12 nt, Homo sapiens
gaagaacugaaa

SEQ ID NO: 483085 - RNA, 20 nt, Homo sapiens
gaagaagaugguaccaccag

SEQ ID NO: 483086 - RNA, 18 nt, Homo sapiens
gaagaaguugauaugccu

SEQ ID NO: 483087 - RNA, 23 nt, Homo sapiens
gaagacaauggcuuacuccagga

SEQ ID NO: 483088 - RNA, 16 nt, Homo sapiens
gaagagaaugugacag

SEQ ID NO: 483089 - RNA, 18 nt, Homo sapiens
gaagagccggagccucca

SEQ ID NO: 483090 - RNA, 16 nt, Homo sapiens
gaagauacaauaauua

SEQ ID NO: 483091 - RNA, 20 nt, Homo sapiens
gaagauauaacuauugccca

SEQ ID NO: 483092 - RNA, 24 nt, Homo sapiens
gaagauccuaaaacaaaagcucau

SEQ ID NO: 483093 - RNA, 14 nt, Homo sapiens
gaagccaaagccaa

SEQ ID NO: 483094 - RNA, 22 nt, Homo sapiens
gaagcucccugaaguaagcaaa

SEQ ID NO: 483095 - RNA, 10 nt, Homo sapiens
gaaggccagc

SEQ ID NO: 483096 - RNA, 17 nt, Homo sapiens
gaagggaugcugcaaug

SEQ ID NO: 483097 - RNA, 15 nt, Homo sapiens
gaagggcuaacucag

SEQ ID NO: 483098 - RNA, 19 nt, Homo sapiens
gaagggcuagaaccuggag

SEQ ID NO: 483099 - RNA, 19 nt, Homo sapiens
gaagguggggacagggaug

SEQ ID NO: 483100 - RNA, 21 nt, Homo sapiens
gaaguaagcaaagacuuuccu

SEQ ID NO: 483101 - RNA, 12 nt, Homo sapiens
gaagucuuccau

SEQ ID NO: 483102 - RNA, 21 nt, Homo sapiens
gaauaugggguugguguucuc

SEQ ID NO: 483103 - RNA, 19 nt, Homo sapiens
gaaucacuugacuuugcca

SEQ ID NO: 483104 - RNA, 15 nt, Homo sapiens
gaaucauaugggaua

SEQ ID NO: 483105 - RNA, 14 nt, Homo sapiens
gaaugagaagaaug

SEQ ID NO: 483106 - RNA, 20 nt, Homo sapiens
gaaugagacugaacugugug

SEQ ID NO: 483107 - RNA, 22 nt, Homo sapiens
gaaugcaaaaggugcugagaaa

SEQ ID NO: 483108 - RNA, 15 nt, Homo sapiens
gaaugucagggccag

SEQ ID NO: 483109 - RNA, 21 nt, Homo sapiens
gaaugugcucaugcauugcuu

SEQ ID NO: 483110 - RNA, 21 nt, Homo sapiens
gaauuaagaauugguugccau

SEQ ID NO: 483111 - RNA, 23 nt, Homo sapiens
gaauuaaguuagggaauggcaca

SEQ ID NO: 483112 - RNA, 19 nt, Homo sapiens
gaauugcucgaacuuggag

SEQ ID NO: 483113 - RNA, 18 nt, Homo sapiens
gaauuucauaugacauuc

SEQ ID NO: 483114 - RNA, 21 nt, Homo sapiens
gacaaaugacccccaucccau

SEQ ID NO: 483115 - RNA, 20 nt, Homo sapiens
gacaauggcuuacuccagga

SEQ ID NO: 483116 - RNA, 20 nt, Homo sapiens
gacaauuugcugccaaacac

SEQ ID NO: 483117 - RNA, 15 nt, Homo sapiens
gacagaacgagacuc

SEQ ID NO: 483118 - RNA, 13 nt, Homo sapiens
gacagcuucucau

SEQ ID NO: 483119 - RNA, 23 nt, Homo sapiens
gacaggcacagaugaaugggagu

SEQ ID NO: 483120 - RNA, 13 nt, Homo sapiens
gcuuagaccucag

SEQ ID NO: 483121 - RNA, 19 nt, Homo sapiens
gcuuauugucuagugaaac

SEQ ID NO: 483122 - RNA, 23 nt, Homo sapiens
aaggauauguggagaaucaucaa

SEQ ID NO: 483123 - RNA, 18 nt, Homo sapiens
aaggauggaaagggaaug

SEQ ID NO: 483124 - RNA, 18 nt, Homo sapiens
aaggaugugggggaagac

SEQ ID NO: 483125 - RNA, 18 nt, Homo sapiens
aaggcacuaaaaagagcu

SEQ ID NO: 483126 - RNA, 15 nt, Homo sapiens
aaggcagccaggcug

SEQ ID NO: 483127 - RNA, 14 nt, Homo sapiens
aaggccuugagcaa

SEQ ID NO: 483128 - RNA, 18 nt, Homo sapiens
aaggcugagaacacugug

SEQ ID NO: 483129 - RNA, 17 nt, Homo sapiens
aaggcuuggcacacagc

SEQ ID NO: 483130 - RNA, 12 nt, Homo sapiens
aagggcauuucc

SEQ ID NO: 483131 - RNA, 22 nt, Homo sapiens
aagggccagcuggaggugaaga

SEQ ID NO: 483132 - RNA, 16 nt, Homo sapiens
aaggggacgcuuugaa

SEQ ID NO: 483133 - RNA, 20 nt, Homo sapiens
aaggggcugucucccaauga

SEQ ID NO: 483134 - RNA, 23 nt, Homo sapiens
aaggguaccuugaacacuggggg

SEQ ID NO: 483135 - RNA, 20 nt, Homo sapiens
aaggguucagagacucaggg

SEQ ID NO: 483136 - RNA, 22 nt, Homo sapiens
aaggucggaccagcuuuuccca

SEQ ID NO: 483137 - RNA, 11 nt, Homo sapiens
aagguucucuc

SEQ ID NO: 483138 - RNA, 16 nt, Homo sapiens
aaguaauauuggcuau

SEQ ID NO: 483139 - RNA, 16 nt, Homo sapiens
aaguagcugcuaccuu

SEQ ID NO: 483140 - RNA, 13 nt, Homo sapiens
aagucaacaugua

SEQ ID NO: 483141 - RNA, 14 nt, Homo sapiens
aagucaacauguag

SEQ ID NO: 483142 - RNA, 21 nt, Homo sapiens
aagucaucauaauucagcucu

SEQ ID NO: 483143 - RNA, 23 nt, Homo sapiens
aagucuaaaguuuacaguaaaua

SEQ ID NO: 483144 - RNA, 23 nt, Homo sapiens
aagucuuccauagagacuuugug

SEQ ID NO: 483145 - RNA, 17 nt, Homo sapiens
aagugauaugcauuucc

SEQ ID NO: 483146 - RNA, 22 nt, Homo sapiens
aagugcacaacauuacagggaa

SEQ ID NO: 483147 - RNA, 21 nt, Homo sapiens
aagugcauuuuuaucugugag

SEQ ID NO: 483148 - RNA, 12 nt, Homo sapiens
aagugugcacag

SEQ ID NO: 483149 - RNA, 20 nt, Homo sapiens
aagugugcuggccucucuga

SEQ ID NO: 483150 - RNA, 12 nt, Homo sapiens
aagugugugauc

SEQ ID NO: 483151 - RNA, 15 nt, Homo sapiens
aagugugugaucugu

SEQ ID NO: 483152 - RNA, 17 nt, Homo sapiens
aaguucaggcucugaga

SEQ ID NO: 483153 - RNA, 16 nt, Homo sapiens
aaguucuuaggcacca

SEQ ID NO: 483154 - RNA, 14 nt, Homo sapiens
aaguugacaccuuu

SEQ ID NO: 483155 - RNA, 15 nt, Homo sapiens
aauaaaauacauacu

SEQ ID NO: 483156 - RNA, 12 nt, Homo sapiens
aauaaaccacaa

SEQ ID NO: 483157 - RNA, 18 nt, Homo sapiens
aauaauaacaaucacaaa

SEQ ID NO: 483158 - RNA, 13 nt, Homo sapiens
aauaauccagaaa

SEQ ID NO: 483159 - RNA, 18 nt, Homo sapiens
aauacaauaaguuaacua

SEQ ID NO: 483160 - RNA, 20 nt, Homo sapiens
aauacauuauuggacuucca

SEQ ID NO: 483161 - RNA, 22 nt, Homo sapiens
aauaguguuggaaaaugugcaa

SEQ ID NO: 483162 - RNA, 19 nt, Homo sapiens
aauauauaguggacaguaa

SEQ ID NO: 483163 - RNA, 21 nt, Homo sapiens
aauaugggguugguguucuca

SEQ ID NO: 483164 - RNA, 21 nt, Homo sapiens
aauauugacuuuuuauggcac

SEQ ID NO: 483165 - RNA, 14 nt, Homo sapiens
aauauuucagauaa

SEQ ID NO: 483166 - RNA, 18 nt, Homo sapiens
aauauuugacaggcuuau

SEQ ID NO: 483167 - RNA, 17 nt, Homo sapiens
aauauuugcaagacaua

SEQ ID NO: 483168 - RNA, 24 nt, Homo sapiens
aaucaaaugguguuuucuuaugca

SEQ ID NO: 483169 - RNA, 22 nt, Homo sapiens
aaucaaguuggcuucuaaucaa

SEQ ID NO: 483170 - RNA, 15 nt, Homo sapiens
aaucaaugcuauaac

SEQ ID NO: 483171 - RNA, 16 nt, Homo sapiens
aaucaccagagaccaa

SEQ ID NO: 483172 - RNA, 14 nt, Homo sapiens
aauccaacccgggg

SEQ ID NO: 483173 - RNA, 15 nt, Homo sapiens
aauccaauaccucuu

SEQ ID NO: 483174 - RNA, 14 nt, Homo sapiens
aauccacacaucuu

SEQ ID NO: 483175 - RNA, 14 nt, Homo sapiens
aauccacucuccau

SEQ ID NO: 483176 - RNA, 14 nt, Homo sapiens
aaucccagcacuuu

SEQ ID NO: 483177 - RNA, 23 nt, Homo sapiens
aaucuaccaacgaaagacgugau

SEQ ID NO: 483178 - RNA, 15 nt, Homo sapiens
aaucuauaucuuuac

SEQ ID NO: 483179 - RNA, 15 nt, Homo sapiens
aaucucaauauuuca

SEQ ID NO: 483180 - RNA, 21 nt, Homo sapiens
aaucucaauauuucagauaau

SEQ ID NO: 483181 - RNA, 13 nt, Homo sapiens
aaucucggcucau

SEQ ID NO: 483182 - RNA, 16 nt, Homo sapiens
aaucucggcucauuga

SEQ ID NO: 483183 - RNA, 15 nt, Homo sapiens
aaucugcaguggcuc

SEQ ID NO: 483184 - RNA, 14 nt, Homo sapiens
aaugaagaugaugc

SEQ ID NO: 483185 - RNA, 15 nt, Homo sapiens
aaugaagaugaugcu

SEQ ID NO: 483186 - RNA, 16 nt, Homo sapiens
aaugaagaugaugcua

SEQ ID NO: 483187 - RNA, 13 nt, Homo sapiens
aaugacuaaagac

SEQ ID NO: 483188 - RNA, 21 nt, Homo sapiens
aaugagaagaaugacuaugca

SEQ ID NO: 483189 - RNA, 21 nt, Homo sapiens
aaugagagacacacugaagaa

SEQ ID NO: 483190 - RNA, 18 nt, Homo sapiens
aaugauuuacucaauauc

SEQ ID NO: 483191 - RNA, 20 nt, Homo sapiens
aaugcauauccaacaugugc

SEQ ID NO: 483192 - RNA, 23 nt, Homo sapiens
aaugcauauccaacaugugcuca

SEQ ID NO: 483193 - RNA, 13 nt, Homo sapiens
aaugccauccuca

SEQ ID NO: 483194 - RNA, 17 nt, Homo sapiens
aaugcuauaacuauguu

SEQ ID NO: 483195 - RNA, 16 nt, Homo sapiens
aaugcugauguccuca

SEQ ID NO: 483196 - RNA, 15 nt, Homo sapiens
aaugcugucugucca

SEQ ID NO: 483197 - RNA, 14 nt, Homo sapiens
aaugggacugaugu

SEQ ID NO: 483198 - RNA, 16 nt, Homo sapiens
aaugugaaucaugguu

SEQ ID NO: 483199 - RNA, 15 nt, Homo sapiens
aaugugaaugggaaa

SEQ ID NO: 483200 - RNA, 17 nt, Homo sapiens
aaugugagguguugcua

SEQ ID NO: 483201 - RNA, 21 nt, Homo sapiens
aauguuagauaguuacuauau

SEQ ID NO: 483202 - RNA, 22 nt, Homo sapiens
aauguucuuaaccuuugauucu

SEQ ID NO: 483203 - RNA, 22 nt, Homo sapiens
aauguuguuuuaggaauacaua

SEQ ID NO: 483204 - RNA, 15 nt, Homo sapiens
aauuacaacagugag

SEQ ID NO: 483205 - RNA, 16 nt, Homo sapiens
aauucaugcaucucaa

SEQ ID NO: 483206 - RNA, 15 nt, Homo sapiens
aauucccuucaucug

SEQ ID NO: 483207 - RNA, 23 nt, Homo sapiens
aauuccuuagcuuagaccucagc

SEQ ID NO: 483208 - RNA, 21 nt, Homo sapiens
aauucuauuacgugcaauacu

SEQ ID NO: 483209 - RNA, 15 nt, Homo sapiens
aauugaggacacuga

SEQ ID NO: 483210 - RNA, 20 nt, Homo sapiens
aauugcagaguacuggcuga

SEQ ID NO: 483211 - RNA, 14 nt, Homo sapiens
aauugccuaaagag

SEQ ID NO: 483212 - RNA, 12 nt, Homo sapiens
aauuuacuuugu

SEQ ID NO: 483213 - RNA, 20 nt, Homo sapiens
aauuuggagucugacugugc

SEQ ID NO: 483214 - RNA, 12 nt, Homo sapiens
acaaacaugugg

SEQ ID NO: 483215 - RNA, 17 nt, Homo sapiens
acaaaccuugugcucuu

SEQ ID NO: 483216 - RNA, 15 nt, Homo sapiens
acaaagcuacuugaa

SEQ ID NO: 483217 - RNA, 19 nt, Homo sapiens
acaaauagaccuaaauuaa

SEQ ID NO: 483218 - RNA, 21 nt, Homo sapiens
acaaaucuaugccacucagaa

SEQ ID NO: 483219 - RNA, 20 nt, Homo sapiens
acaaaugggacugaugucau

SEQ ID NO: 483220 - RNA, 17 nt, Homo sapiens
acaacaucaagccugug

SEQ ID NO: 483221 - RNA, 16 nt, Homo sapiens
acaacuaugauuugga

SEQ ID NO: 483222 - RNA, 16 nt, Homo sapiens
acaacucgaaucacuc

SEQ ID NO: 483223 - RNA, 17 nt, Homo sapiens
acaacucgaaucacuca

SEQ ID NO: 483224 - RNA, 15 nt, Homo sapiens
acaagagggacaagu

SEQ ID NO: 483225 - RNA, 14 nt, Homo sapiens
acaaggaugaauua

SEQ ID NO: 483226 - RNA, 16 nt, Homo sapiens
acaaguaaaacugugg

SEQ ID NO: 483227 - RNA, 18 nt, Homo sapiens
acaaguaaaacuguggua

SEQ ID NO: 483228 - RNA, 22 nt, Homo sapiens
acaagucaucauaauucagcuc

SEQ ID NO: 483229 - RNA, 22 nt, Homo sapiens
acaaucacacaacaaauaauua

SEQ ID NO: 483230 - RNA, 18 nt, Homo sapiens
acaaugaagaugaugcua

SEQ ID NO: 483231 - RNA, 17 nt, Homo sapiens
acaauggcuuacuccag

SEQ ID NO: 483232 - RNA, 16 nt, Homo sapiens
acacaagagcuggagc

SEQ ID NO: 483233 - RNA, 14 nt, Homo sapiens
acacacacauacag

SEQ ID NO: 483234 - RNA, 17 nt, Homo sapiens
acacacaugaaguccaa

SEQ ID NO: 483235 - RNA, 19 nt, Homo sapiens
acacaccccaacaugccug

SEQ ID NO: 483236 - RNA, 22 nt, Homo sapiens
acacagagcaggacugcacagc

SEQ ID NO: 483237 - RNA, 18 nt, Homo sapiens
acacagaugaaacacaaa

SEQ ID NO: 483238 - RNA, 17 nt, Homo sapiens
acacagcucccauaacc

SEQ ID NO: 483239 - RNA, 16 nt, Homo sapiens
acacauuaagccuucc

SEQ ID NO: 483240 - RNA, 19 nt, Homo sapiens
acacucccuucccaugacc

SEQ ID NO: 483241 - RNA, 15 nt, Homo sapiens
acacugaaauauaca

SEQ ID NO: 483242 - RNA, 22 nt, Homo sapiens
acacugaagaagcaccaaucau

SEQ ID NO: 483243 - RNA, 22 nt, Homo sapiens
acacugggcugcagagacugga

SEQ ID NO: 483244 - RNA, 15 nt, Homo sapiens
acacugucuugaaga

SEQ ID NO: 483245 - RNA, 21 nt, Homo sapiens
acagaacacugucuugaagac

SEQ ID NO: 483246 - RNA, 15 nt, Homo sapiens
acagaagacagcagc

SEQ ID NO: 483247 - RNA, 22 nt, Homo sapiens
acagaagacagcagcaagugug

SEQ ID NO: 483248 - RNA, 17 nt, Homo sapiens
acagaaguccauggagu

SEQ ID NO: 483249 - RNA, 17 nt, Homo sapiens
acagacuaugucaccca

SEQ ID NO: 483250 - RNA, 16 nt, Homo sapiens
acagagaaaagacaua

SEQ ID NO: 483251 - RNA, 20 nt, Homo sapiens
acagagcaagacucugucuc

SEQ ID NO: 483252 - RNA, 18 nt, Homo sapiens
acagagcagaacuuucac

SEQ ID NO: 483253 - RNA, 16 nt, Homo sapiens
acagaugugucagcca

SEQ ID NO: 483254 - RNA, 15 nt, Homo sapiens
acagauucacacugu

SEQ ID NO: 483255 - RNA, 18 nt, Homo sapiens
acagcacccucuccagau

SEQ ID NO: 483256 - RNA, 15 nt, Homo sapiens
acagccaucaaggga

SEQ ID NO: 483257 - RNA, 15 nt, Homo sapiens
acagcuguaauaaca

SEQ ID NO: 483258 - RNA, 15 nt, Homo sapiens
acaggacauucucau

SEQ ID NO: 483259 - RNA, 13 nt, Homo sapiens
gggauagaaagga

SEQ ID NO: 483260 - RNA, 13 nt, Homo sapiens
gggauagaggaua

SEQ ID NO: 483261 - RNA, 12 nt, Homo sapiens
gggaugagcaug

SEQ ID NO: 483262 - RNA, 17 nt, Homo sapiens
gggauguuucugucaca

SEQ ID NO: 483263 - RNA, 14 nt, Homo sapiens
gggcucagccuggu

SEQ ID NO: 483264 - RNA, 14 nt, Homo sapiens
gggcugaugcaguu

SEQ ID NO: 483265 - RNA, 20 nt, Homo sapiens
gggcuucucgccccucagug

SEQ ID NO: 483266 - RNA, 19 nt, Homo sapiens
ggggacucgguaagcacuu

SEQ ID NO: 483267 - RNA, 17 nt, Homo sapiens
ggggagugggcgcagug

SEQ ID NO: 483268 - RNA, 22 nt, Homo sapiens
ggguaggcgggaaggaggguua

SEQ ID NO: 483269 - RNA, 16 nt, Homo sapiens
gggugaacugcagcga

SEQ ID NO: 483270 - RNA, 14 nt, Homo sapiens
gguacacagacuau

SEQ ID NO: 483271 - RNA, 17 nt, Homo sapiens
gguccgggucgcaggac

SEQ ID NO: 483272 - RNA, 18 nt, Homo sapiens
ggugagagucugggucca

SEQ ID NO: 483273 - RNA, 17 nt, Homo sapiens
ggugcaugaagguuucu

SEQ ID NO: 483274 - RNA, 15 nt, Homo sapiens
gguggcagcucaaaa

SEQ ID NO: 483275 - RNA, 15 nt, Homo sapiens
gguggggacagggau

SEQ ID NO: 483276 - RNA, 18 nt, Homo sapiens
gguguccuguuccugcca

SEQ ID NO: 483277 - RNA, 22 nt, Homo sapiens
gguguuaaucauuucauuuuua

SEQ ID NO: 483278 - RNA, 12 nt, Homo sapiens
gguucugaugau

SEQ ID NO: 483279 - RNA, 15 nt, Homo sapiens
gguugcacguuaaaa

SEQ ID NO: 483280 - RNA, 18 nt, Homo sapiens
gguugcagugaaccuaga

SEQ ID NO: 483281 - RNA, 22 nt, Homo sapiens
gguuggaaaacaguauuuucca

SEQ ID NO: 483282 - RNA, 21 nt, Homo sapiens
guaaaaccccaucucuacuaa

SEQ ID NO: 483283 - RNA, 18 nt, Homo sapiens
guaaaauuuaaaucauau

SEQ ID NO: 483284 - RNA, 15 nt, Homo sapiens
guaaacaaaggaauu

SEQ ID NO: 483285 - RNA, 17 nt, Homo sapiens
guaacugugacugauga

SEQ ID NO: 483286 - RNA, 21 nt, Homo sapiens
guaaugacaaauaaguggaaa

SEQ ID NO: 483287 - RNA, 17 nt, Homo sapiens
guaauuccucccuaaga

SEQ ID NO: 483288 - RNA, 19 nt, Homo sapiens
guacaccccaacagcaccc

SEQ ID NO: 483289 - RNA, 17 nt, Homo sapiens
guagaugacauggugaa

SEQ ID NO: 483290 - RNA, 11 nt, Homo sapiens
guagcuggaau

SEQ ID NO: 483291 - RNA, 20 nt, Homo sapiens
guauacccuguccuuucuca

SEQ ID NO: 483292 - RNA, 20 nt, Homo sapiens
guauacuuuuugcauaugua

SEQ ID NO: 483293 - RNA, 13 nt, Homo sapiens
guauaugcaauau

SEQ ID NO: 483294 - RNA, 19 nt, Homo sapiens
guaugauccuaaugaaugc

SEQ ID NO: 483295 - RNA, 21 nt, Homo sapiens
guaugauucccagccagcaca

SEQ ID NO: 483296 - RNA, 23 nt, Homo sapiens
guauguuagugcaaauugucaca

SEQ ID NO: 483297 - RNA, 12 nt, Homo sapiens
guauuagucaca

SEQ ID NO: 483298 - RNA, 18 nt, Homo sapiens
guauucugcugaugcuac

SEQ ID NO: 483299 - RNA, 20 nt, Homo sapiens
guauuguauaaguccuugca

SEQ ID NO: 483300 - RNA, 22 nt, Homo sapiens
guauuuuaggcagggauuugag

SEQ ID NO: 483301 - RNA, 20 nt, Homo sapiens
gucaagcaguagacaagcaa

SEQ ID NO: 483302 - RNA, 17 nt, Homo sapiens
gucaagugauugacaac

SEQ ID NO: 483303 - RNA, 14 nt, Homo sapiens
gucaauaauacauu

SEQ ID NO: 483304 - RNA, 20 nt, Homo sapiens
gucacaugaaacauuugcaa

SEQ ID NO: 483305 - RNA, 22 nt, Homo sapiens
gucagucugaugagaacucuga

SEQ ID NO: 483306 - RNA, 13 nt, Homo sapiens
gucauaaugucau

SEQ ID NO: 483307 - RNA, 18 nt, Homo sapiens
gucauacgaaccuaaaga

SEQ ID NO: 483308 - RNA, 19 nt, Homo sapiens
gucaucucagugcuguaaa

SEQ ID NO: 483309 - RNA, 21 nt, Homo sapiens
guccaacugccuguucaauaa

SEQ ID NO: 483310 - RNA, 19 nt, Homo sapiens
guccaaguggcugugacau

SEQ ID NO: 483311 - RNA, 13 nt, Homo sapiens
guccacacccagc

SEQ ID NO: 483312 - RNA, 16 nt, Homo sapiens
guccacgcccaccagc

SEQ ID NO: 483313 - RNA, 17 nt, Homo sapiens
gucccagccagcaguuc

SEQ ID NO: 483314 - RNA, 17 nt, Homo sapiens
gucccuauggaagcaua

SEQ ID NO: 483315 - RNA, 18 nt, Homo sapiens
gucccuguuguaacugcc

SEQ ID NO: 483316 - RNA, 15 nt, Homo sapiens
gucucaauaaacuga

SEQ ID NO: 483317 - RNA, 18 nt, Homo sapiens
gucucacugaacuagaag

SEQ ID NO: 483318 - RNA, 11 nt, Homo sapiens
gucucuuuaua

SEQ ID NO: 483319 - RNA, 20 nt, Homo sapiens
gucucuuuauauggccucaa

SEQ ID NO: 483320 - RNA, 19 nt, Homo sapiens
gucugacuguuuccaucaa

SEQ ID NO: 483321 - RNA, 23 nt, Homo sapiens
gucuucagccuagccgaccucag

SEQ ID NO: 483322 - RNA, 22 nt, Homo sapiens
gucuucuccuccaugaacauca

SEQ ID NO: 483323 - RNA, 17 nt, Homo sapiens
gucuuucuuacaaggaa

SEQ ID NO: 483324 - RNA, 20 nt, Homo sapiens
gugaaaccccgucuguacua

SEQ ID NO: 483325 - RNA, 15 nt, Homo sapiens
gugaaaugcagaguc

SEQ ID NO: 483326 - RNA, 15 nt, Homo sapiens
gugaagcaccaagcu

SEQ ID NO: 483327 - RNA, 23 nt, Homo sapiens
gugaagucgucuuaacucaccau

SEQ ID NO: 483328 - RNA, 17 nt, Homo sapiens
gugacaagcucacagac

SEQ ID NO: 483329 - RNA, 19 nt, Homo sapiens
gugacauuuauuuuucuca

SEQ ID NO: 483330 - RNA, 22 nt, Homo sapiens
gugagacaguccagccuggaga

SEQ ID NO: 483331 - RNA, 23 nt, Homo sapiens
gugagggauaguggggucagggc

SEQ ID NO: 483332 - RNA, 13 nt, Homo sapiens
gugcaauauguga

SEQ ID NO: 483333 - RNA, 17 nt, Homo sapiens
gugcacugagagugaag

SEQ ID NO: 483334 - RNA, 20 nt, Homo sapiens
gugcaguggcacgaucucga

SEQ ID NO: 483335 - RNA, 17 nt, Homo sapiens
gugcaugcagcaucuaa

SEQ ID NO: 483336 - RNA, 12 nt, Homo sapiens
gugccaauguau

SEQ ID NO: 483337 - RNA, 19 nt, Homo sapiens
gugccagauccucuucuca

SEQ ID NO: 483338 - RNA, 20 nt, Homo sapiens
gugcccaaguggguccaagu

SEQ ID NO: 483339 - RNA, 21 nt, Homo sapiens
gugccuguacaagcugauguu

SEQ ID NO: 483340 - RNA, 21 nt, Homo sapiens
gugcucauucauuuaacagag

SEQ ID NO: 483341 - RNA, 12 nt, Homo sapiens
guggacaggugu

SEQ ID NO: 483342 - RNA, 15 nt, Homo sapiens
guggcagcucaaaau

SEQ ID NO: 483343 - RNA, 16 nt, Homo sapiens
guggcugugacaucua

SEQ ID NO: 483344 - RNA, 21 nt, Homo sapiens
gugggaagaacuugucccuca

SEQ ID NO: 483345 - RNA, 20 nt, Homo sapiens
gugggagucauggacaugaa

SEQ ID NO: 483346 - RNA, 22 nt, Homo sapiens
gugggugccccccuugccagac

SEQ ID NO: 483347 - RNA, 19 nt, Homo sapiens
guguaugguucugugccaa

SEQ ID NO: 483348 - RNA, 15 nt, Homo sapiens
gugucaugauucacc

SEQ ID NO: 483349 - RNA, 15 nt, Homo sapiens
gugugaacguguaug

SEQ ID NO: 483350 - RNA, 17 nt, Homo sapiens
gugugaacguguaugua

SEQ ID NO: 483351 - RNA, 22 nt, Homo sapiens
gugugguccagguccuuuccac

SEQ ID NO: 483352 - RNA, 13 nt, Homo sapiens
gugugugccucau

SEQ ID NO: 483353 - RNA, 16 nt, Homo sapiens
guguuccucuuugcau

SEQ ID NO: 483354 - RNA, 13 nt, Homo sapiens
guguuugcugagg

SEQ ID NO: 483355 - RNA, 19 nt, Homo sapiens
guguuugucaaaaagucau

SEQ ID NO: 483356 - RNA, 14 nt, Homo sapiens
guguuuuuugcuca

SEQ ID NO: 483357 - RNA, 22 nt, Homo sapiens
guuaaagcuuuggugccuggaa

SEQ ID NO: 483358 - RNA, 19 nt, Homo sapiens
guuaaggggagcaacagag

SEQ ID NO: 483359 - RNA, 19 nt, Homo sapiens
guuaaguaauauuggcuau

SEQ ID NO: 483360 - RNA, 18 nt, Homo sapiens
guuacccugcauguuggc

SEQ ID NO: 483361 - RNA, 23 nt, Homo sapiens
guuacuauaugccgcuacaaaaa

SEQ ID NO: 483362 - RNA, 17 nt, Homo sapiens
guuauuauauaauuaca

SEQ ID NO: 483363 - RNA, 22 nt, Homo sapiens
guuauuguggaaagaugaaugc

SEQ ID NO: 483364 - RNA, 18 nt, Homo sapiens
guucaauaugagucucaa

SEQ ID NO: 483365 - RNA, 14 nt, Homo sapiens
guucagcucacugu

SEQ ID NO: 483366 - RNA, 16 nt, Homo sapiens
guucccuauuuugcca

SEQ ID NO: 483367 - RNA, 17 nt, Homo sapiens
guucucauuccuguucu

SEQ ID NO: 483368 - RNA, 19 nt, Homo sapiens
guugaggccaggaguuuaa

SEQ ID NO: 483369 - RNA, 19 nt, Homo sapiens
guugcaauagaacagagaa

SEQ ID NO: 483370 - RNA, 18 nt, Homo sapiens
guuggccuaacacugggc

SEQ ID NO: 483371 - RNA, 12 nt, Homo sapiens
guuggcuucuaa

SEQ ID NO: 483372 - RNA, 17 nt, Homo sapiens
guugugucuugcuauac

SEQ ID NO: 483373 - RNA, 20 nt, Homo sapiens
guuuaaaagccaucaaacac

SEQ ID NO: 483374 - RNA, 21 nt, Homo sapiens
guuucaccaucagucaaugaa

SEQ ID NO: 483375 - RNA, 21 nt, Homo sapiens
guuucuccagagggaauugca

SEQ ID NO: 483376 - RNA, 20 nt, Homo sapiens
guuuuaaagcuugcucacau

SEQ ID NO: 483377 - RNA, 15 nt, Homo sapiens
guuuuccauucucau

SEQ ID NO: 483378 - RNA, 16 nt, Homo sapiens
guuuucuucugugauu

SEQ ID NO: 483379 - RNA, 22 nt, Homo sapiens
guuuuggguugaccccaaucca

SEQ ID NO: 483380 - RNA, 13 nt, Homo sapiens
guuuuguuucauc

SEQ ID NO: 483381 - RNA, 13 nt, Homo sapiens
guuuuuucacuau

SEQ ID NO: 483382 - RNA, 23 nt, Homo sapiens
uaaaaaaaaaacguauugcauuu

SEQ ID NO: 483383 - RNA, 22 nt, Homo sapiens
uaaaaagagcuguccugguauc

SEQ ID NO: 483384 - RNA, 14 nt, Homo sapiens
uaaaaagcagagcu

SEQ ID NO: 483385 - RNA, 23 nt, Homo sapiens
uaaaaagugccuguagaugacau

SEQ ID NO: 483386 - RNA, 13 nt, Homo sapiens
uaaaacaguccuu

SEQ ID NO: 483387 - RNA, 21 nt, Homo sapiens
uaaaauauuuuuaugugcaau

SEQ ID NO: 483388 - RNA, 15 nt, Homo sapiens
uaaaauuucacuuaa

SEQ ID NO: 483389 - RNA, 18 nt, Homo sapiens
uaaacaaauguaugauua

SEQ ID NO: 483390 - RNA, 21 nt, Homo sapiens
uaaacaccauagggacccauu

SEQ ID NO: 483391 - RNA, 17 nt, Homo sapiens
uaaacaugcauugugaa

SEQ ID NO: 483392 - RNA, 21 nt, Homo sapiens
uaaagacauaggaacauguag

SEQ ID NO: 483393 - RNA, 22 nt, Homo sapiens
uaaagccuuggauguauauguc

SEQ ID NO: 483394 - RNA, 16 nt, Homo sapiens
uaaagcugaaaacugc

SEQ ID NO: 483395 - RNA, 13 nt, Homo sapiens
uuccauucuggaa

SEQ ID NO: 483396 - RNA, 16 nt, Homo sapiens
uucccggccauucucc

SEQ ID NO: 483397 - RNA, 18 nt, Homo sapiens
uucccuaaaaucagggaa

SEQ ID NO: 483398 - RNA, 22 nt, Homo sapiens
uucccuucacuccccuauccca

SEQ ID NO: 483399 - RNA, 21 nt, Homo sapiens
uuccuacacccuuggacuuga

SEQ ID NO: 483400 - RNA, 23 nt, Homo sapiens
uuccuacacccuuggacuugagg

SEQ ID NO: 483401 - RNA, 23 nt, Homo sapiens
uuccuauaugcacuuauucucaa

SEQ ID NO: 483402 - RNA, 21 nt, Homo sapiens
uuccuccgaggccaguaccuu

SEQ ID NO: 483403 - RNA, 13 nt, Homo sapiens
uuccucgccacgc

SEQ ID NO: 483404 - RNA, 13 nt, Homo sapiens
uuccucuuugcau

SEQ ID NO: 483405 - RNA, 17 nt, Homo sapiens
uuccugauggcaggaug

SEQ ID NO: 483406 - RNA, 22 nt, Homo sapiens
uuccuuagcuuagaccucagcc

SEQ ID NO: 483407 - RNA, 18 nt, Homo sapiens
uucuaaggaauaugagcu

SEQ ID NO: 483408 - RNA, 23 nt, Homo sapiens
uucuacacagagcaggacugcac

SEQ ID NO: 483409 - RNA, 16 nt, Homo sapiens
uucuaggaagcuccag

SEQ ID NO: 483410 - RNA, 17 nt, Homo sapiens
uucuaggaagcuccagu

SEQ ID NO: 483411 - RNA, 17 nt, Homo sapiens
uucuauuacgugcaaua

SEQ ID NO: 483412 - RNA, 22 nt, Homo sapiens
uucuauuacgugcaauacuuca

SEQ ID NO: 483413 - RNA, 17 nt, Homo sapiens
uucugaagccucacuua

SEQ ID NO: 483414 - RNA, 17 nt, Homo sapiens
uucugauacguguauga

SEQ ID NO: 483415 - RNA, 16 nt, Homo sapiens
uucugaucugaugcaa

SEQ ID NO: 483416 - RNA, 14 nt, Homo sapiens
uucuuaggccacau

SEQ ID NO: 483417 - RNA, 17 nt, Homo sapiens
uucuuauguugcccagu

SEQ ID NO: 483418 - RNA, 14 nt, Homo sapiens
uugaaaaggacucu

SEQ ID NO: 483419 - RNA, 19 nt, Homo sapiens
uugaaaucagcauacucaa

SEQ ID NO: 483420 - RNA, 13 nt, Homo sapiens
uugaaaucuauga

SEQ ID NO: 483421 - RNA, 22 nt, Homo sapiens
uugaacaacucgaaucacucau

SEQ ID NO: 483422 - RNA, 15 nt, Homo sapiens
uugaaggacacaaga

SEQ ID NO: 483423 - RNA, 16 nt, Homo sapiens
uugaauauaaacacua

SEQ ID NO: 483424 - RNA, 18 nt, Homo sapiens
uugacaggcuuauggaag

SEQ ID NO: 483425 - RNA, 17 nt, Homo sapiens
uugacuugacagaacac

SEQ ID NO: 483426 - RNA, 13 nt, Homo sapiens
uugacuuugccac

SEQ ID NO: 483427 - RNA, 11 nt, Homo sapiens
uugagacagag

SEQ ID NO: 483428 - RNA, 23 nt, Homo sapiens
uugauaagagggcacacacugug

SEQ ID NO: 483429 - RNA, 17 nt, Homo sapiens
uugauaugggcuuucuc

SEQ ID NO: 483430 - RNA, 12 nt, Homo sapiens
uugaucaaugaa

SEQ ID NO: 483431 - RNA, 14 nt, Homo sapiens
uugauuaugaauag

SEQ ID NO: 483432 - RNA, 20 nt, Homo sapiens
uugauugcguggaauugugc

SEQ ID NO: 483433 - RNA, 13 nt, Homo sapiens
uugcaagccagau

SEQ ID NO: 483434 - RNA, 12 nt, Homo sapiens
uugcacuccagc

SEQ ID NO: 483435 - RNA, 21 nt, Homo sapiens
uugcagugaaccuagauugca

SEQ ID NO: 483436 - RNA, 19 nt, Homo sapiens
uugcauagcagcugcuacu

SEQ ID NO: 483437 - RNA, 21 nt, Homo sapiens
uugcaugaucugucaaaguga

SEQ ID NO: 483438 - RNA, 13 nt, Homo sapiens
uugcccagugugu

SEQ ID NO: 483439 - RNA, 21 nt, Homo sapiens
uugccuuuccauaaucacuca

SEQ ID NO: 483440 - RNA, 13 nt, Homo sapiens
uugcuaagcauuc

SEQ ID NO: 483441 - RNA, 14 nt, Homo sapiens
uugcucauggaauu

SEQ ID NO: 483442 - RNA, 17 nt, Homo sapiens
uuggaaaauaaaucaau

SEQ ID NO: 483443 - RNA, 17 nt, Homo sapiens
uuggaaaaugugcaaua

SEQ ID NO: 483444 - RNA, 17 nt, Homo sapiens
uuggaaugggcagcuca

SEQ ID NO: 483445 - RNA, 15 nt, Homo sapiens
uuggccaucucugga

SEQ ID NO: 483446 - RNA, 16 nt, Homo sapiens
uuggcuucuaaucaaa

SEQ ID NO: 483447 - RNA, 21 nt, Homo sapiens
uugggcaccucgacuugugaa

SEQ ID NO: 483448 - RNA, 19 nt, Homo sapiens
uugguuugaguuucucuca

SEQ ID NO: 483449 - RNA, 19 nt, Homo sapiens
uuguaaaauuucacuuaau

SEQ ID NO: 483450 - RNA, 16 nt, Homo sapiens
uuguagcagaaaggaa

SEQ ID NO: 483451 - RNA, 23 nt, Homo sapiens
uuguaguugcaauagaacagaga

SEQ ID NO: 483452 - RNA, 18 nt, Homo sapiens
uuguaugauccuaaugaa

SEQ ID NO: 483453 - RNA, 14 nt, Homo sapiens
uugucacaugaaac

SEQ ID NO: 483454 - RNA, 17 nt, Homo sapiens
uuguuaagauaugaugu

SEQ ID NO: 483455 - RNA, 19 nt, Homo sapiens
uuguuguuuauaaagggag

SEQ ID NO: 483456 - RNA, 21 nt, Homo sapiens
uuuaaaagccaucaaacacaa

SEQ ID NO: 483457 - RNA, 15 nt, Homo sapiens
uuuaauccuagagau

SEQ ID NO: 483458 - RNA, 15 nt, Homo sapiens
uuuaaucuuccaugg

SEQ ID NO: 483459 - RNA, 13 nt, Homo sapiens
uuuaauuaucuaa

SEQ ID NO: 483460 - RNA, 14 nt, Homo sapiens
uuuaauuuaaucuu

SEQ ID NO: 483461 - RNA, 11 nt, Homo sapiens
uuuacuuuguu

SEQ ID NO: 483462 - RNA, 23 nt, Homo sapiens
uuuagaaaagaaagcaaacuuaa

SEQ ID NO: 483463 - RNA, 16 nt, Homo sapiens
uuuagugaucacagca

SEQ ID NO: 483464 - RNA, 23 nt, Homo sapiens
uuuauaaagggagauaacaaucu

SEQ ID NO: 483465 - RNA, 16 nt, Homo sapiens
uuuauaaauggacaaa

SEQ ID NO: 483466 - RNA, 13 nt, Homo sapiens
uuuaugugcaaua

SEQ ID NO: 483467 - RNA, 15 nt, Homo sapiens
uuuauuugagacaga

SEQ ID NO: 483468 - RNA, 20 nt, Homo sapiens
uuuauuuugacugugauuua

SEQ ID NO: 483469 - RNA, 19 nt, Homo sapiens
uuucaaauaggaugcauuc

SEQ ID NO: 483470 - RNA, 15 nt, Homo sapiens
uuuccagucauggcc

SEQ ID NO: 483471 - RNA, 21 nt, Homo sapiens
uuucuaccuuucugagucucu

SEQ ID NO: 483472 - RNA, 20 nt, Homo sapiens
uuucuccgaaaggcaaaaau

SEQ ID NO: 483473 - RNA, 13 nt, Homo sapiens
uuucugcacauaa

SEQ ID NO: 483474 - RNA, 17 nt, Homo sapiens
uuugaaaccaaaccaga

SEQ ID NO: 483475 - RNA, 15 nt, Homo sapiens
uuugaaaucuaugaa

SEQ ID NO: 483476 - RNA, 20 nt, Homo sapiens
uuugaacaacucgaaucacu

SEQ ID NO: 483477 - RNA, 15 nt, Homo sapiens
uuugaguauugcuga

SEQ ID NO: 483478 - RNA, 22 nt, Homo sapiens
uuugcaucagcaacaaccagca

SEQ ID NO: 483479 - RNA, 12 nt, Homo sapiens
uuugccacugga

SEQ ID NO: 483480 - RNA, 18 nt, Homo sapiens
uuugcccuuuuuaaggaa

SEQ ID NO: 483481 - RNA, 16 nt, Homo sapiens
uuuguaucauuaugaa

SEQ ID NO: 483482 - RNA, 16 nt, Homo sapiens
uuugugacuuuccuaa

SEQ ID NO: 483483 - RNA, 20 nt, Homo sapiens
uuugugauucaaaauguacu

SEQ ID NO: 483484 - RNA, 16 nt, Homo sapiens
uuuuaaaaguuauuaa

SEQ ID NO: 483485 - RNA, 21 nt, Homo sapiens
uuuucaaauaggaugcauucg

SEQ ID NO: 483486 - RNA, 19 nt, Homo sapiens
uuuucccgagcaaagucua

SEQ ID NO: 483487 - RNA, 21 nt, Homo sapiens
uuuucuguugccccauccacc

SEQ ID NO: 483488 - RNA, 18 nt, Homo sapiens
uuuugacaucaaugauga

SEQ ID NO: 483489 - RNA, 12 nt, Homo sapiens
uuuugugauuca

SEQ ID NO: 483490 - RNA, 23 nt, Homo sapiens
uuuugugauucaaaauguacuau

SEQ ID NO: 483491 - RNA, 12 nt, Homo sapiens
aaaaaacugcau

SEQ ID NO: 483492 - RNA, 15 nt, Homo sapiens
aaaaacguauugcau

SEQ ID NO: 483493 - RNA, 13 nt, Homo sapiens
aaaacaagccaug

SEQ ID NO: 483494 - RNA, 20 nt, Homo sapiens
aaaacaguccuucaaacuuc

SEQ ID NO: 483495 - RNA, 14 nt, Homo sapiens
aaacaagucaaaga

SEQ ID NO: 483496 - RNA, 21 nt, Homo sapiens
aaacacauuaagccuuccaca

SEQ ID NO: 483497 - RNA, 19 nt, Homo sapiens
aaacagguuuuuaguuugu

SEQ ID NO: 483498 - RNA, 10 nt, Homo sapiens
aaacaucagc

SEQ ID NO: 483499 - RNA, 14 nt, Homo sapiens
aaacaucagcaaaa

SEQ ID NO: 483500 - RNA, 22 nt, Homo sapiens
aaacuuacauuuaaaagacaga

SEQ ID NO: 483501 - RNA, 19 nt, Homo sapiens
aaagauuugcuuuaauugu

SEQ ID NO: 483502 - RNA, 16 nt, Homo sapiens
aaagcuuugugcagau

SEQ ID NO: 483503 - RNA, 15 nt, Homo sapiens
aaaguauugugaaag

SEQ ID NO: 483504 - RNA, 13 nt, Homo sapiens
aaauaauucucaa

SEQ ID NO: 483505 - RNA, 19 nt, Homo sapiens
aaauauacacacagcagua

SEQ ID NO: 483506 - RNA, 18 nt, Homo sapiens
aaauauuuuugcuguaga

SEQ ID NO: 483507 - RNA, 13 nt, Homo sapiens
aaaugacagaucu

SEQ ID NO: 483508 - RNA, 15 nt, Homo sapiens
aaauugccuaaagag

SEQ ID NO: 483509 - RNA, 11 nt, Homo sapiens
aacacauuaag

SEQ ID NO: 483510 - RNA, 10 nt, Homo sapiens
aacacugaga

SEQ ID NO: 483511 - RNA, 11 nt, Homo sapiens
aacacugagaa

SEQ ID NO: 483512 - RNA, 17 nt, Homo sapiens
aacagcacccucuccag

SEQ ID NO: 483513 - RNA, 19 nt, Homo sapiens
aaccauggugaacuccacc

SEQ ID NO: 483514 - RNA, 20 nt, Homo sapiens
aaccucaagugauccuccca

SEQ ID NO: 483515 - RNA, 16 nt, Homo sapiens
aaccuggggcuaauca

SEQ ID NO: 483516 - RNA, 20 nt, Homo sapiens
aacuaaaaauuuacaagaga

SEQ ID NO: 483517 - RNA, 17 nt, Homo sapiens
aacugaaaacaagccau

SEQ ID NO: 483518 - RNA, 18 nt, Homo sapiens
aacugaaaacaagccaug

SEQ ID NO: 483519 - RNA, 18 nt, Homo sapiens
aacugccuguucaauaaa

SEQ ID NO: 483520 - RNA, 20 nt, Homo sapiens
aacugugaaauguacgucau

SEQ ID NO: 483521 - RNA, 18 nt, Homo sapiens
aacuuacauuuaaaagac

SEQ ID NO: 483522 - RNA, 15 nt, Homo sapiens
aacuucagccagcua

SEQ ID NO: 483523 - RNA, 19 nt, Homo sapiens
aacuuugauaggaugugga

SEQ ID NO: 483524 - RNA, 15 nt, Homo sapiens
aagacagcuucucau

SEQ ID NO: 483525 - RNA, 15 nt, Homo sapiens
aagacaucuccacca

SEQ ID NO: 483526 - RNA, 17 nt, Homo sapiens
uauauacaaagaauucu

SEQ ID NO: 483527 - RNA, 20 nt, Homo sapiens
uauaugccgcuacaaaaagg

SEQ ID NO: 483528 - RNA, 13 nt, Homo sapiens
uaucaguccaaag

SEQ ID NO: 483529 - RNA, 21 nt, Homo sapiens
uaucauuaucuuugcuguuau

SEQ ID NO: 483530 - RNA, 16 nt, Homo sapiens
uaucuuugcuguuauu

SEQ ID NO: 483531 - RNA, 17 nt, Homo sapiens
uaugugucaguggggcu

SEQ ID NO: 483532 - RNA, 20 nt, Homo sapiens
uauguuacuguauuuuucag

SEQ ID NO: 483533 - RNA, 16 nt, Homo sapiens
uauuucuguaccaaag

SEQ ID NO: 483534 - RNA, 20 nt, Homo sapiens
uauuugcauauguaugacuc

SEQ ID NO: 483535 - RNA, 19 nt, Homo sapiens
ucaaaauguccugauuaca

SEQ ID NO: 483536 - RNA, 15 nt, Homo sapiens
ucaagugauccuccc

SEQ ID NO: 483537 - RNA, 14 nt, Homo sapiens
ucaaguguauuuga

SEQ ID NO: 483538 - RNA, 23 nt, Homo sapiens
ucacaccaggcuugccugcaggc

SEQ ID NO: 483539 - RNA, 15 nt, Homo sapiens
ucacagcaccaaaau

SEQ ID NO: 483540 - RNA, 12 nt, Homo sapiens
ucacaguugugu

SEQ ID NO: 483541 - RNA, 15 nt, Homo sapiens
ucaccccagacuccu

SEQ ID NO: 483542 - RNA, 18 nt, Homo sapiens
ucacuucuaccuacauau

SEQ ID NO: 483543 - RNA, 19 nt, Homo sapiens
ucagcaaaaaaguacuuaa

SEQ ID NO: 483544 - RNA, 20 nt, Homo sapiens
ucaggaacacccccaugaca

SEQ ID NO: 483545 - RNA, 21 nt, Homo sapiens
ucaguggaagaagcagaugag

SEQ ID NO: 483546 - RNA, 15 nt, Homo sapiens
ucaguuuuucacuuc

SEQ ID NO: 483547 - RNA, 21 nt, Homo sapiens
uccaaagggcauggguuuuau

SEQ ID NO: 483548 - RNA, 12 nt, Homo sapiens
ucccaagaucug

SEQ ID NO: 483549 - RNA, 23 nt, Homo sapiens
ucccaggaguacaccccaacagc

SEQ ID NO: 483550 - RNA, 17 nt, Homo sapiens
ucccauucgcaauaagu

SEQ ID NO: 483551 - RNA, 23 nt, Homo sapiens
uccccugucacgugugggcaaug

SEQ ID NO: 483552 - RNA, 14 nt, Homo sapiens
uccccuugaaggag

SEQ ID NO: 483553 - RNA, 18 nt, Homo sapiens
uccuaaccucaagugauc

SEQ ID NO: 483554 - RNA, 19 nt, Homo sapiens
uccucgagggcagggacuu

SEQ ID NO: 483555 - RNA, 23 nt, Homo sapiens
uccugaagguguuuuucauucac

SEQ ID NO: 483556 - RNA, 20 nt, Homo sapiens
uccuucuacauguaaugaca

SEQ ID NO: 483557 - RNA, 16 nt, Homo sapiens
uccuuuguaauugaca

SEQ ID NO: 483558 - RNA, 14 nt, Homo sapiens
uccuuuucugucuc

SEQ ID NO: 483559 - RNA, 18 nt, Homo sapiens
ucgugggaaaggggagua

SEQ ID NO: 483560 - RNA, 20 nt, Homo sapiens
ucuaaaaugaguuaccuaca

SEQ ID NO: 483561 - RNA, 14 nt, Homo sapiens
ucuaacugcuguua

SEQ ID NO: 483562 - RNA, 19 nt, Homo sapiens
ucuaaugugccuaguucuu

SEQ ID NO: 483563 - RNA, 16 nt, Homo sapiens
ucuagggcaguggagu

SEQ ID NO: 483564 - RNA, 19 nt, Homo sapiens
ucucauaaguagcauucau

SEQ ID NO: 483565 - RNA, 20 nt, Homo sapiens
ucucauccugcaggcagcuu

SEQ ID NO: 483566 - RNA, 23 nt, Homo sapiens
ucuccagaugagaguacacccca

SEQ ID NO: 483567 - RNA, 16 nt, Homo sapiens
ucuccaucagaaugaa

SEQ ID NO: 483568 - RNA, 18 nt, Homo sapiens
ucucccgggacuaccugg

SEQ ID NO: 483569 - RNA, 22 nt, Homo sapiens
ucuccugcuuuaaccaccccau

SEQ ID NO: 483570 - RNA, 17 nt, Homo sapiens
ucucggcucagugcaac

SEQ ID NO: 483571 - RNA, 16 nt, Homo sapiens
ucucuuugagucaaua

SEQ ID NO: 483572 - RNA, 15 nt, Homo sapiens
ucugaucaaguauuu

SEQ ID NO: 483573 - RNA, 19 nt, Homo sapiens
ucuuacaaugcauucugag

SEQ ID NO: 483574 - RNA, 16 nt, Homo sapiens
ucuuccucccuggaau

SEQ ID NO: 483575 - RNA, 20 nt, Homo sapiens
ucuuuuucagaaacagugag

SEQ ID NO: 483576 - RNA, 19 nt, Homo sapiens
ugaaaauguacauguuccu

SEQ ID NO: 483577 - RNA, 19 nt, Homo sapiens
ugaaauggugaaaugcaga

SEQ ID NO: 483578 - RNA, 21 nt, Homo sapiens
ugaacacuuuugaaaauguac

SEQ ID NO: 483579 - RNA, 14 nt, Homo sapiens
ugaacauaaagccu

SEQ ID NO: 483580 - RNA, 20 nt, Homo sapiens
ugacaaagaagaccacaaau

SEQ ID NO: 483581 - RNA, 20 nt, Homo sapiens
ugacuugagaaacaaauaau

SEQ ID NO: 483582 - RNA, 13 nt, Homo sapiens
ugagaagcacugu

SEQ ID NO: 483583 - RNA, 11 nt, Homo sapiens
ugagaguacac

SEQ ID NO: 483584 - RNA, 21 nt, Homo sapiens
ugagaucuugguccuguguuu

SEQ ID NO: 483585 - RNA, 20 nt, Homo sapiens
ugagcacauucuggcucagg

SEQ ID NO: 483586 - RNA, 13 nt, Homo sapiens
ugagccaguguca

SEQ ID NO: 483587 - RNA, 14 nt, Homo sapiens
ugagcgaggacauu

SEQ ID NO: 483588 - RNA, 12 nt, Homo sapiens
ugagcuaacuua

SEQ ID NO: 483589 - RNA, 12 nt, Homo sapiens
ugagcugcccac

SEQ ID NO: 483590 - RNA, 22 nt, Homo sapiens
ugaggcuuuaaaacuuauccuc

SEQ ID NO: 483591 - RNA, 22 nt, Homo sapiens
ugaucucgaacuccuaaccuca

SEQ ID NO: 483592 - RNA, 14 nt, Homo sapiens
ugcaacaggcacuc

SEQ ID NO: 483593 - RNA, 23 nt, Homo sapiens
ugcaggggaaguacuacuccuca

SEQ ID NO: 483594 - RNA, 17 nt, Homo sapiens
ugcauaagcauugcuca

SEQ ID NO: 483595 - RNA, 20 nt, Homo sapiens
ugcaucccacguucuguuaa

SEQ ID NO: 483596 - RNA, 23 nt, Homo sapiens
ugcauucugagguaaccucauua

SEQ ID NO: 483597 - RNA, 13 nt, Homo sapiens
ugcccccaacagc

SEQ ID NO: 483598 - RNA, 14 nt, Homo sapiens
ugcccccaacagca

SEQ ID NO: 483599 - RNA, 18 nt, Homo sapiens
ugccgcagugaucaaagu

SEQ ID NO: 483600 - RNA, 18 nt, Homo sapiens
ugccucuaaauagcacuu

SEQ ID NO: 483601 - RNA, 16 nt, Homo sapiens
ugccuugccacauuaa

SEQ ID NO: 483602 - RNA, 23 nt, Homo sapiens
ugcucaagaggaaaauccaaaag

SEQ ID NO: 483603 - RNA, 18 nt, Homo sapiens
ugcuucccagguucaagc

SEQ ID NO: 483604 - RNA, 20 nt, Homo sapiens
uggacacguggugcauuuug

SEQ ID NO: 483605 - RNA, 20 nt, Homo sapiens
uggagaccccaccagccuca

SEQ ID NO: 483606 - RNA, 19 nt, Homo sapiens
uggcaaagaugaucaguau

SEQ ID NO: 483607 - RNA, 12 nt, Homo sapiens
uggcucagggag

SEQ ID NO: 483608 - RNA, 22 nt, Homo sapiens
uggcucagggagguuaagugac

SEQ ID NO: 483609 - RNA, 23 nt, Homo sapiens
uggggucagagacugcuguguuu

SEQ ID NO: 483610 - RNA, 17 nt, Homo sapiens
uggugagcgaggacauu

SEQ ID NO: 483611 - RNA, 19 nt, Homo sapiens
ugguucuaacugcuguuaa

SEQ ID NO: 483612 - RNA, 17 nt, Homo sapiens
uguauaaguccuugcaa

SEQ ID NO: 483613 - RNA, 15 nt, Homo sapiens
ugucuuauuugcuau

SEQ ID NO: 483614 - RNA, 22 nt, Homo sapiens
ugugacaaagaagaccacaaau

SEQ ID NO: 483615 - RNA, 21 nt, Homo sapiens
uguuguuuuaggaauacauaa

SEQ ID NO: 483616 - RNA, 23 nt, Homo sapiens
uuaacucuaacugugacaaagaa

SEQ ID NO: 483617 - RNA, 16 nt, Homo sapiens
uuaaguuuucaugaau

SEQ ID NO: 483618 - RNA, 17 nt, Homo sapiens
uuaggcccggagcugcc

SEQ ID NO: 483619 - RNA, 21 nt, Homo sapiens
uuaguaaauaaacaagucaaa

SEQ ID NO: 483620 - RNA, 16 nt, Homo sapiens
uuaucuuugcuguuau

SEQ ID NO: 483621 - RNA, 17 nt, Homo sapiens
uuauuuaucaaguguau

SEQ ID NO: 483622 - RNA, 12 nt, Homo sapiens
uucaagacagau

SEQ ID NO: 483623 - RNA, 12 nt, Homo sapiens
uucaccaugaug

SEQ ID NO: 483624 - RNA, 20 nt, Homo sapiens
uucacccugauuuuacacac

SEQ ID NO: 483625 - RNA, 13 nt, Homo sapiens
uucaccuguauau

SEQ ID NO: 483626 - RNA, 14 nt, Homo sapiens
uucaucccacaauc

SEQ ID NO: 483627 - RNA, 15 nt, Homo sapiens
uucauucacuuuaau

SEQ ID NO: 483628 - RNA, 20 nt, Homo sapiens
uuccacacucaccucuaaaa

SEQ ID NO: 483629 - RNA, 18 nt, Homo sapiens
uucccccuuuacucauag

SEQ ID NO: 483630 - RNA, 13 nt, Homo sapiens
uuccugacacuca

SEQ ID NO: 483631 - RNA, 20 nt, Homo sapiens
uuccugacacucaauaaaca

SEQ ID NO: 483632 - RNA, 20 nt, Homo sapiens
uucuaaaaauaaaaguauug

SEQ ID NO: 483633 - RNA, 20 nt, Homo sapiens
uucucauccugcaggcagcu

SEQ ID NO: 483634 - RNA, 13 nt, Homo sapiens
uugaaguguuccc

SEQ ID NO: 483635 - RNA, 14 nt, Homo sapiens
uugagaagcacugu

SEQ ID NO: 483636 - RNA, 20 nt, Homo sapiens
uuguauguuuuucuguauaa

SEQ ID NO: 483637 - RNA, 18 nt, Homo sapiens
uuguuaagugcagucuga

SEQ ID NO: 483638 - RNA, 16 nt, Homo sapiens
uuguuacagcuacuau

SEQ ID NO: 483639 - RNA, 14 nt, Homo sapiens
uuuaaaagacagac

SEQ ID NO: 483640 - RNA, 18 nt, Homo sapiens
accuugaugugccuguga

SEQ ID NO: 483641 - RNA, 19 nt, Homo sapiens
accuugugacccagcacug

SEQ ID NO: 483642 - RNA, 17 nt, Homo sapiens
acgucauuugugcaaga

SEQ ID NO: 483643 - RNA, 14 nt, Homo sapiens
acuauaaauauaca

SEQ ID NO: 483644 - RNA, 16 nt, Homo sapiens
acucuaacccuaggca

SEQ ID NO: 483645 - RNA, 15 nt, Homo sapiens
acucuaagacuacag

SEQ ID NO: 483646 - RNA, 17 nt, Homo sapiens
acugaaaacaagccaug

SEQ ID NO: 483647 - RNA, 19 nt, Homo sapiens
acugagagucugcacuuaa

SEQ ID NO: 483648 - RNA, 14 nt, Homo sapiens
acuggcugauggag

SEQ ID NO: 483649 - RNA, 15 nt, Homo sapiens
acuuaaaaaacugca

SEQ ID NO: 483650 - RNA, 23 nt, Homo sapiens
acuuccagugcaacacugaagcu

SEQ ID NO: 483651 - RNA, 16 nt, Homo sapiens
aucagaaugaaagcuc

SEQ ID NO: 483652 - RNA, 19 nt, Homo sapiens
aucagcaaaaaaguacuua

SEQ ID NO: 483653 - RNA, 21 nt, Homo sapiens
aucagcaaaaaaguacuuaaa

SEQ ID NO: 483654 - RNA, 13 nt, Homo sapiens
aucauauuucaaa

SEQ ID NO: 483655 - RNA, 16 nt, Homo sapiens
auccacacugagcuga

SEQ ID NO: 483656 - RNA, 14 nt, Homo sapiens
aucccacaaucuua

SEQ ID NO: 483657 - RNA, 18 nt, Homo sapiens
aucccucugggcacuggu

SEQ ID NO: 483658 - RNA, 15 nt, Homo sapiens
aucucggcucagugc

SEQ ID NO: 483659 - RNA, 18 nt, Homo sapiens
aucucggcucagugcaac

SEQ ID NO: 483660 - RNA, 14 nt, Homo sapiens
augaacuuuccaca

SEQ ID NO: 483661 - RNA, 14 nt, Homo sapiens
augacuggcuucau

SEQ ID NO: 483662 - RNA, 16 nt, Homo sapiens
augagaaacucuugag

SEQ ID NO: 483663 - RNA, 13 nt, Homo sapiens
augaggaaacuuu

SEQ ID NO: 483664 - RNA, 14 nt, Homo sapiens
augaucaguaugaa

SEQ ID NO: 483665 - RNA, 22 nt, Homo sapiens
augaugucccuauggaagcaua

SEQ ID NO: 483666 - RNA, 14 nt, Homo sapiens
augauuagagggau

SEQ ID NO: 483667 - RNA, 16 nt, Homo sapiens
augcauguacccuaag

SEQ ID NO: 483668 - RNA, 18 nt, Homo sapiens
augcggccucugagacau

SEQ ID NO: 483669 - RNA, 22 nt, Homo sapiens
augcuaccuugugacccagcac

SEQ ID NO: 483670 - RNA, 20 nt, Homo sapiens
augggcacagcaacucuaag

SEQ ID NO: 483671 - RNA, 15 nt, Homo sapiens
augggguuucacaaa

SEQ ID NO: 483672 - RNA, 17 nt, Homo sapiens
auguaauaaugugaauc

SEQ ID NO: 483673 - RNA, 14 nt, Homo sapiens
auguauaugucauc

SEQ ID NO: 483674 - RNA, 15 nt, Homo sapiens
augucaguggaagaa

SEQ ID NO: 483675 - RNA, 16 nt, Homo sapiens
augugaaucaugguuu

SEQ ID NO: 483676 - RNA, 20 nt, Homo sapiens
auguugagggaagcuuccau

SEQ ID NO: 483677 - RNA, 16 nt, Homo sapiens
auuaagccuuccacac

SEQ ID NO: 483678 - RNA, 18 nt, Homo sapiens
auuagagggaugagacag

SEQ ID NO: 483679 - RNA, 17 nt, Homo sapiens
auuaggucucuguugac

SEQ ID NO: 483680 - RNA, 18 nt, Homo sapiens
auuauagaaucuacuuua

SEQ ID NO: 483681 - RNA, 15 nt, Homo sapiens
auuaugagacuguac

SEQ ID NO: 483682 - RNA, 16 nt, Homo sapiens
auuauuuaaacaucag

SEQ ID NO: 483683 - RNA, 14 nt, Homo sapiens
auuauuuuaaucua

SEQ ID NO: 483684 - RNA, 14 nt, Homo sapiens
auuccugagccagu

SEQ ID NO: 483685 - RNA, 15 nt, Homo sapiens
auuccuucuacaugu

SEQ ID NO: 483686 - RNA, 16 nt, Homo sapiens
auucgauccccuguca

SEQ ID NO: 483687 - RNA, 20 nt, Homo sapiens
auucucauaaguagcauuca

SEQ ID NO: 483688 - RNA, 21 nt, Homo sapiens
auuuaaaagacagacauuccu

SEQ ID NO: 483689 - RNA, 13 nt, Homo sapiens
auuuaaacaucag

SEQ ID NO: 483690 - RNA, 14 nt, Homo sapiens
auuuaaucuuccau

SEQ ID NO: 483691 - RNA, 14 nt, Homo sapiens
auuucacagcacca

SEQ ID NO: 483692 - RNA, 15 nt, Homo sapiens
auuuuauacauuaac

SEQ ID NO: 483693 - RNA, 17 nt, Homo sapiens
auuuucacacaauacaa

SEQ ID NO: 483694 - RNA, 17 nt, Homo sapiens
auuuucuaaugugccua

SEQ ID NO: 483695 - RNA, 22 nt, Homo sapiens
auuuuuuugugggaaauccaca

SEQ ID NO: 483696 - RNA, 21 nt, Homo sapiens
caaacauguaagcauaacuua

SEQ ID NO: 483697 - RNA, 16 nt, Homo sapiens
caaacuuccagugcaa

SEQ ID NO: 483698 - RNA, 16 nt, Homo sapiens
caaagacuauucccuu

SEQ ID NO: 483699 - RNA, 14 nt, Homo sapiens
caaauaauuuguau

SEQ ID NO: 483700 - RNA, 17 nt, Homo sapiens
caaauauuuauaagcua

SEQ ID NO: 483701 - RNA, 21 nt, Homo sapiens
caaaugauuuucaaauuugau

SEQ ID NO: 483702 - RNA, 17 nt, Homo sapiens
caagaaguaaucaguau

SEQ ID NO: 483703 - RNA, 15 nt, Homo sapiens
caagaaucagugcaa

SEQ ID NO: 483704 - RNA, 13 nt, Homo sapiens
caagcgauucucc

SEQ ID NO: 483705 - RNA, 21 nt, Homo sapiens
caaggcaaagacuauucccuu

SEQ ID NO: 483706 - RNA, 20 nt, Homo sapiens
caaguauuuuugacauuuac

SEQ ID NO: 483707 - RNA, 21 nt, Homo sapiens
caauaaauauuuuugcuguag

SEQ ID NO: 483708 - RNA, 18 nt, Homo sapiens
caaucuuaaggggcagcu

SEQ ID NO: 483709 - RNA, 19 nt, Homo sapiens
caauuuguuaagguucaag

SEQ ID NO: 483710 - RNA, 19 nt, Homo sapiens
cacacucuuucuccugcuu

SEQ ID NO: 483711 - RNA, 17 nt, Homo sapiens
cacacugagcugagggg

SEQ ID NO: 483712 - RNA, 21 nt, Homo sapiens
cacaugauaccucugaucaag

SEQ ID NO: 483713 - RNA, 18 nt, Homo sapiens
cacauucuggcucaggga

SEQ ID NO: 483714 - RNA, 15 nt, Homo sapiens
caccagcgcuugaag

SEQ ID NO: 483715 - RNA, 19 nt, Homo sapiens
caccaugauggccaggcug

SEQ ID NO: 483716 - RNA, 16 nt, Homo sapiens
caccugggcugaggca

SEQ ID NO: 483717 - RNA, 14 nt, Homo sapiens
cacgauuaacugug

SEQ ID NO: 483718 - RNA, 20 nt, Homo sapiens
cacguagggcggcacucaca

SEQ ID NO: 483719 - RNA, 14 nt, Homo sapiens
cacguggugcauuu

SEQ ID NO: 483720 - RNA, 13 nt, Homo sapiens
cagaaacagugag

SEQ ID NO: 483721 - RNA, 17 nt, Homo sapiens
cagaaaucaaacugcuu

SEQ ID NO: 483722 - RNA, 17 nt, Homo sapiens
cagagacugcuguguuu

SEQ ID NO: 483723 - RNA, 20 nt, Homo sapiens
cagaugagaguacaccccaa

SEQ ID NO: 483724 - RNA, 23 nt, Homo sapiens
cagaugagaguacaccccaacag

SEQ ID NO: 483725 - RNA, 15 nt, Homo sapiens
cagcacacgucauuu

SEQ ID NO: 483726 - RNA, 13 nt, Homo sapiens
cagcagucaugca

SEQ ID NO: 483727 - RNA, 14 nt, Homo sapiens
cagcguacucauca

SEQ ID NO: 483728 - RNA, 20 nt, Homo sapiens
cagcguggguguugaaucca

SEQ ID NO: 483729 - RNA, 19 nt, Homo sapiens
caggcaugagucagucuga

SEQ ID NO: 483730 - RNA, 18 nt, Homo sapiens
caggcgaggccuggagua

SEQ ID NO: 483731 - RNA, 16 nt, Homo sapiens
caggguggagugcagu

SEQ ID NO: 483732 - RNA, 13 nt, Homo sapiens
caggugugcacca

SEQ ID NO: 483733 - RNA, 20 nt, Homo sapiens
cagguucucuuugagucaau

SEQ ID NO: 483734 - RNA, 16 nt, Homo sapiens
caguaaacacuccaca

SEQ ID NO: 483735 - RNA, 13 nt, Homo sapiens
cagucacuggaaa

SEQ ID NO: 483736 - RNA, 16 nt, Homo sapiens
cagucugauccaggag

SEQ ID NO: 483737 - RNA, 16 nt, Homo sapiens
cagugcggcagguuca

SEQ ID NO: 483738 - RNA, 17 nt, Homo sapiens
caguuguguuccugaca

SEQ ID NO: 483739 - RNA, 14 nt, Homo sapiens
cauauguaugacuc

SEQ ID NO: 483740 - RNA, 18 nt, Homo sapiens
cauccugcaggcagcuuu

SEQ ID NO: 483741 - RNA, 17 nt, Homo sapiens
caucuagaauucacuga

SEQ ID NO: 483742 - RNA, 21 nt, Homo sapiens
caucuguugacaaaugacaga

SEQ ID NO: 483743 - RNA, 16 nt, Homo sapiens
caugaauaucaguuau

SEQ ID NO: 483744 - RNA, 15 nt, Homo sapiens
caugagaggaggcag

SEQ ID NO: 483745 - RNA, 15 nt, Homo sapiens
caugagucagucuga

SEQ ID NO: 483746 - RNA, 13 nt, Homo sapiens
cauuaucagucca

SEQ ID NO: 483747 - RNA, 19 nt, Homo sapiens
cauucgcaauaaguaccaa

SEQ ID NO: 483748 - RNA, 18 nt, Homo sapiens
cauuuaaaagacagacau

SEQ ID NO: 483749 - RNA, 16 nt, Homo sapiens
cauuuuugaaaccaaa

SEQ ID NO: 483750 - RNA, 15 nt, Homo sapiens
ccaacagcacccucu

SEQ ID NO: 483751 - RNA, 17 nt, Homo sapiens
ccaaugcuuacugcgcu

SEQ ID NO: 483752 - RNA, 22 nt, Homo sapiens
ccacaaucuuaaggggcagcuu

SEQ ID NO: 483753 - RNA, 16 nt, Homo sapiens
ccacacucaccucuaa

SEQ ID NO: 483754 - RNA, 21 nt, Homo sapiens
ccacacucuuucuccugcuuu

SEQ ID NO: 483755 - RNA, 18 nt, Homo sapiens
ccacagggucugcacucu

SEQ ID NO: 483756 - RNA, 20 nt, Homo sapiens
ccacaguggaaagacagcuu

SEQ ID NO: 483757 - RNA, 21 nt, Homo sapiens
ccacaguggaaagacagcuuc

SEQ ID NO: 483758 - RNA, 17 nt, Homo sapiens
ccaccccaucugcauuc

SEQ ID NO: 483759 - RNA, 16 nt, Homo sapiens
ccagagggaauugcag

SEQ ID NO: 483760 - RNA, 16 nt, Homo sapiens
ccagcacugcccaaag

SEQ ID NO: 483761 - RNA, 19 nt, Homo sapiens
ccagcacugcccaaagugc

SEQ ID NO: 483762 - RNA, 16 nt, Homo sapiens
ccaggaguacacccca

SEQ ID NO: 483763 - RNA, 13 nt, Homo sapiens
ccaguuucagggc

SEQ ID NO: 483764 - RNA, 22 nt, Homo sapiens
ccaugauggccaggcugaucuc

SEQ ID NO: 483765 - RNA, 22 nt, Homo sapiens
ccaugugaccgaacacugcagc

SEQ ID NO: 483766 - RNA, 20 nt, Homo sapiens
aaaaaacguauugcauuuaa

SEQ ID NO: 483767 - RNA, 14 nt, Homo sapiens
aaaacguauugcau

SEQ ID NO: 483768 - RNA, 15 nt, Homo sapiens
aaaaugaguuaccua

SEQ ID NO: 483769 - RNA, 12 nt, Homo sapiens
aaacaagccaug

SEQ ID NO: 483770 - RNA, 16 nt, Homo sapiens
aaacagucaucuagaa

SEQ ID NO: 483771 - RNA, 13 nt, Homo sapiens
aaacauuaacucu

SEQ ID NO: 483772 - RNA, 20 nt, Homo sapiens
aaacauuuucacacaauaca

SEQ ID NO: 483773 - RNA, 16 nt, Homo sapiens
aaacuaaaaauuuaca

SEQ ID NO: 483774 - RNA, 12 nt, Homo sapiens
aaacucuugaga

SEQ ID NO: 483775 - RNA, 16 nt, Homo sapiens
aaagacaucuccacca

SEQ ID NO: 483776 - RNA, 20 nt, Homo sapiens
aaagcaaaugggguuucaca

SEQ ID NO: 483777 - RNA, 21 nt, Homo sapiens
aaagcaucugagcuaacuuau

SEQ ID NO: 483778 - RNA, 13 nt, Homo sapiens
aaagggacuaccu

SEQ ID NO: 483779 - RNA, 15 nt, Homo sapiens
aaagggacuaccucu

SEQ ID NO: 483780 - RNA, 14 nt, Homo sapiens
aaagguccuggcaa

SEQ ID NO: 483781 - RNA, 15 nt, Homo sapiens
aaagugaaagcaaau

SEQ ID NO: 483782 - RNA, 17 nt, Homo sapiens
aaagugcagcaggagaa

SEQ ID NO: 483783 - RNA, 16 nt, Homo sapiens
aaauaauuuucaagca

SEQ ID NO: 483784 - RNA, 23 nt, Homo sapiens
aaauauugaacucaaugauagca

SEQ ID NO: 483785 - RNA, 23 nt, Homo sapiens
aaaucaucuuuauuaaguagaug

SEQ ID NO: 483786 - RNA, 20 nt, Homo sapiens
aaaugacuaaaagucuucgg

SEQ ID NO: 483787 - RNA, 15 nt, Homo sapiens
aaauuauuuaucaag

SEQ ID NO: 483788 - RNA, 14 nt, Homo sapiens
aaauuuacaagaga

SEQ ID NO: 483789 - RNA, 18 nt, Homo sapiens
aaauuuacaagagaagaa

SEQ ID NO: 483790 - RNA, 21 nt, Homo sapiens
aaauuuuaguaguuacuaaaa

SEQ ID NO: 483791 - RNA, 14 nt, Homo sapiens
aacaaauaauuugu

SEQ ID NO: 483792 - RNA, 15 nt, Homo sapiens
aacacugaagcucuu

SEQ ID NO: 483793 - RNA, 13 nt, Homo sapiens
aacagcacccucu

SEQ ID NO: 483794 - RNA, 14 nt, Homo sapiens
aacaguccuucaaa

SEQ ID NO: 483795 - RNA, 12 nt, Homo sapiens
aacauaaagccu

SEQ ID NO: 483796 - RNA, 13 nt, Homo sapiens
aacauaaagccuu

SEQ ID NO: 483797 - RNA, 20 nt, Homo sapiens
aacauguaagcauaacuuau

SEQ ID NO: 483798 - RNA, 17 nt, Homo sapiens
aaccagagccugagugu

SEQ ID NO: 483799 - RNA, 21 nt, Homo sapiens
aaccagagccugaguguugcc

SEQ ID NO: 483800 - RNA, 19 nt, Homo sapiens
aacccaaagugugacucau

SEQ ID NO: 483801 - RNA, 21 nt, Homo sapiens
aacccuaggcaucacaugcuc

SEQ ID NO: 483802 - RNA, 23 nt, Homo sapiens
aacccuaggcaucacaugcucaa

SEQ ID NO: 483803 - RNA, 15 nt, Homo sapiens
aaccucauuaucagu

SEQ ID NO: 483804 - RNA, 15 nt, Homo sapiens
aacucuugagaucuu

SEQ ID NO: 483805 - RNA, 20 nt, Homo sapiens
aacuuccagugcaacacuga

SEQ ID NO: 483806 - RNA, 21 nt, Homo sapiens
aacuuccagugcaacacugaa

SEQ ID NO: 483807 - RNA, 13 nt, Homo sapiens
aacuugcaccucu

SEQ ID NO: 483808 - RNA, 15 nt, Homo sapiens
aagacuacagcacac

SEQ ID NO: 483809 - RNA, 15 nt, Homo sapiens
aagagccacagugag

SEQ ID NO: 483810 - RNA, 16 nt, Homo sapiens
aagauaucagcccaaa

SEQ ID NO: 483811 - RNA, 19 nt, Homo sapiens
aagcaucugagcuaacuua

SEQ ID NO: 483812 - RNA, 20 nt, Homo sapiens
aagcaucugagcuaacuuau

SEQ ID NO: 483813 - RNA, 17 nt, Homo sapiens
aaggagaaucaucagga

SEQ ID NO: 483814 - RNA, 18 nt, Homo sapiens
aagguuugagaagcacug

SEQ ID NO: 483815 - RNA, 15 nt, Homo sapiens
aaguaaaacagucau

SEQ ID NO: 483816 - RNA, 14 nt, Homo sapiens
aagugacuugccca

SEQ ID NO: 483817 - RNA, 18 nt, Homo sapiens
aagugcagucugauccag

SEQ ID NO: 483818 - RNA, 19 nt, Homo sapiens
aaguugaaugggcacagca

SEQ ID NO: 483819 - RNA, 23 nt, Homo sapiens
aaguugcuaacuuaaaaaacugc

SEQ ID NO: 483820 - RNA, 13 nt, Homo sapiens
aauaaacagucac

SEQ ID NO: 483821 - RNA, 20 nt, Homo sapiens
aauacauaaaguaugugcau

SEQ ID NO: 483822 - RNA, 15 nt, Homo sapiens
aauauuuauaagcua

SEQ ID NO: 483823 - RNA, 15 nt, Homo sapiens
aaugcugucugucca

SEQ ID NO: 483824 - RNA, 21 nt, Homo sapiens
aauguuagauaguuacuauau

SEQ ID NO: 483825 - RNA, 22 nt, Homo sapiens
aauguuguuuuaggaauacaua

SEQ ID NO: 483826 - RNA, 17 nt, Homo sapiens
aauuauagaaucuacuu

SEQ ID NO: 483827 - RNA, 21 nt, Homo sapiens
aauuauuauuuaaacaucagc

SEQ ID NO: 483828 - RNA, 17 nt, Homo sapiens
aauucucauaaguagca

SEQ ID NO: 483829 - RNA, 20 nt, Homo sapiens
aauugcagaguacuggcuga

SEQ ID NO: 483830 - RNA, 18 nt, Homo sapiens
aauugcuaagaagggaaa

SEQ ID NO: 483831 - RNA, 15 nt, Homo sapiens
aauuugaugaaauca

SEQ ID NO: 483832 - RNA, 17 nt, Homo sapiens
acacauuaaaauguuag

SEQ ID NO: 483833 - RNA, 18 nt, Homo sapiens
uaccuucaccaucuguau

SEQ ID NO: 483834 - RNA, 16 nt, Homo sapiens
uacgucauuugugcaa

SEQ ID NO: 483835 - RNA, 20 nt, Homo sapiens
uacuauaaauauacauauaa

SEQ ID NO: 483836 - RNA, 23 nt, Homo sapiens
uagaauagccuguggccuuugca

SEQ ID NO: 483837 - RNA, 15 nt, Homo sapiens
uagaaucuacuuuaa

SEQ ID NO: 483838 - RNA, 22 nt, Homo sapiens
uagagaugagguuucaccauga

SEQ ID NO: 483839 - RNA, 18 nt, Homo sapiens
uagaugcauguacccuaa

SEQ ID NO: 483840 - RNA, 11 nt, Homo sapiens
uagcacuuccc

SEQ ID NO: 483841 - RNA, 17 nt, Homo sapiens
uaggaagugaacccaua

SEQ ID NO: 483842 - RNA, 12 nt, Homo sapiens
uaggauugugcc

SEQ ID NO: 483843 - RNA, 19 nt, Homo sapiens
uaggugggggaacacugag

SEQ ID NO: 483844 - RNA, 22 nt, Homo sapiens
uauaaauaaaacauuuucacac

SEQ ID NO: 483845 - RNA, 15 nt, Homo sapiens
uauagugaagcaauu

SEQ ID NO: 483846 - RNA, 16 nt, Homo sapiens
uauauacaaguagauc

SEQ ID NO: 483847 - RNA, 17 nt, Homo sapiens
uauaugucaucucagug

SEQ ID NO: 483848 - RNA, 16 nt, Homo sapiens
uaucaaguguauuuga

SEQ ID NO: 483849 - RNA, 21 nt, Homo sapiens
uaucaguugauuuuucuuauu

SEQ ID NO: 483850 - RNA, 15 nt, Homo sapiens
uaucuaacagacaag

SEQ ID NO: 483851 - RNA, 15 nt, Homo sapiens
uaugaaaaugucauu

SEQ ID NO: 483852 - RNA, 16 nt, Homo sapiens
uaugaugucccuaugg

SEQ ID NO: 483853 - RNA, 18 nt, Homo sapiens
uaugaugucccuauggaa

SEQ ID NO: 483854 - RNA, 18 nt, Homo sapiens
uauggucauauuucacag

SEQ ID NO: 483855 - RNA, 20 nt, Homo sapiens
uaugucaucucagugcugua

SEQ ID NO: 483856 - RNA, 14 nt, Homo sapiens
uauuacauaugauu

SEQ ID NO: 483857 - RNA, 22 nt, Homo sapiens
uauuuacagauaacuucuuuag

SEQ ID NO: 483858 - RNA, 17 nt, Homo sapiens
uauuuaucaaguguauu

SEQ ID NO: 483859 - RNA, 22 nt, Homo sapiens
uauuuuaaucuaauucuaagga

SEQ ID NO: 483860 - RNA, 20 nt, Homo sapiens
uauuuuaauuuaaucuucca

SEQ ID NO: 483861 - RNA, 22 nt, Homo sapiens
ucaagcgauucuccugccucag

SEQ ID NO: 483862 - RNA, 13 nt, Homo sapiens
ucacugauuuuca

SEQ ID NO: 483863 - RNA, 13 nt, Homo sapiens
ucaggaacacccc

SEQ ID NO: 483864 - RNA, 20 nt, Homo sapiens
ucagggcuaacgaccacagg

SEQ ID NO: 483865 - RNA, 23 nt, Homo sapiens
ucaguugauuuuucuuauuuaca

SEQ ID NO: 483866 - RNA, 17 nt, Homo sapiens
ucaguuuuaccagauga

SEQ ID NO: 483867 - RNA, 14 nt, Homo sapiens
ucauaaguagcauu

SEQ ID NO: 483868 - RNA, 21 nt, Homo sapiens
ucauaaguagcauucauguaa

SEQ ID NO: 483869 - RNA, 14 nt, Homo sapiens
ucaucccacaaucu

SEQ ID NO: 483870 - RNA, 18 nt, Homo sapiens
uccaccugccguggacuu

SEQ ID NO: 483871 - RNA, 17 nt, Homo sapiens
uccagaugagaguacac

SEQ ID NO: 483872 - RNA, 20 nt, Homo sapiens
uccagaugagaguacacccc

SEQ ID NO: 483873 - RNA, 16 nt, Homo sapiens
uccagcacgucugugu

SEQ ID NO: 483874 - RNA, 21 nt, Homo sapiens
uccaucuguugacaaaugaca

SEQ ID NO: 483875 - RNA, 21 nt, Homo sapiens
uccaugugaccgaacacugca

SEQ ID NO: 483876 - RNA, 18 nt, Homo sapiens
ucccaaauuuucacauaa

SEQ ID NO: 483877 - RNA, 16 nt, Homo sapiens
ucccacguucuguuaa

SEQ ID NO: 483878 - RNA, 14 nt, Homo sapiens
ucccaggaguacac

SEQ ID NO: 483879 - RNA, 16 nt, Homo sapiens
uccccaguacacccca

SEQ ID NO: 483880 - RNA, 14 nt, Homo sapiens
ucccgggacuaccu

SEQ ID NO: 483881 - RNA, 16 nt, Homo sapiens
ucccuucuaaccugaa

SEQ ID NO: 483882 - RNA, 17 nt, Homo sapiens
uccuagacucugugauc

SEQ ID NO: 483883 - RNA, 20 nt, Homo sapiens
uccucaccccagacuccuga

SEQ ID NO: 483884 - RNA, 22 nt, Homo sapiens
uccuccaugaauaucaguuauu

SEQ ID NO: 483885 - RNA, 21 nt, Homo sapiens
uccucgagggcagggacuuug

SEQ ID NO: 483886 - RNA, 16 nt, Homo sapiens
uccugccgcagugauc

SEQ ID NO: 483887 - RNA, 21 nt, Homo sapiens
uccuuuguaauugacacuaua

SEQ ID NO: 483888 - RNA, 21 nt, Homo sapiens
ucgauccccugucacgugugg

SEQ ID NO: 483889 - RNA, 15 nt, Homo sapiens
ucuaacugcuguuaa

SEQ ID NO: 483890 - RNA, 12 nt, Homo sapiens
ucucauccugca

SEQ ID NO: 483891 - RNA, 19 nt, Homo sapiens
ucuccagaugagaguacac

SEQ ID NO: 483892 - RNA, 19 nt, Homo sapiens
ucucgaacuccuaaccuca

SEQ ID NO: 483893 - RNA, 14 nt, Homo sapiens
ucucuuugagucaa

SEQ ID NO: 483894 - RNA, 21 nt, Homo sapiens
ugaaaauguacauguuccuuu

SEQ ID NO: 483895 - RNA, 14 nt, Homo sapiens
ugaaauaauuuuca

SEQ ID NO: 483896 - RNA, 17 nt, Homo sapiens
ugaaauauacacacagc

SEQ ID NO: 483897 - RNA, 21 nt, Homo sapiens
ugaaaugcagagucaaugaac

SEQ ID NO: 483898 - RNA, 21 nt, Homo sapiens
ugaagcucuugaagacacuga

SEQ ID NO: 483899 - RNA, 23 nt, Homo sapiens
ugaaucuuuuucagaaacaguga

SEQ ID NO: 483900 - RNA, 15 nt, Homo sapiens
ugacauugcauuugg

SEQ ID NO: 483901 - RNA, 16 nt, Homo sapiens
ugaccuuccaaagacu

SEQ ID NO: 483902 - RNA, 16 nt, Homo sapiens
ugagacagacauucac

SEQ ID NO: 483903 - RNA, 19 nt, Homo sapiens
ugagacagacauucaccug

SEQ ID NO: 483904 - RNA, 19 nt, Homo sapiens
ugagcaaagggaacaguga

SEQ ID NO: 483905 - RNA, 20 nt, Homo sapiens
ugagcaaagggaacagugag

SEQ ID NO: 483906 - RNA, 14 nt, Homo sapiens
ugagcuaacuuaua

SEQ ID NO: 483907 - RNA, 17 nt, Homo sapiens
ugagcugcccacagcag

SEQ ID NO: 483908 - RNA, 21 nt, Homo sapiens
ugagggucgugggaaagggga

SEQ ID NO: 483909 - RNA, 22 nt, Homo sapiens
ugaugucccuauggaagcauau

SEQ ID NO: 483910 - RNA, 16 nt, Homo sapiens
ugcaaagauuugcuuu

SEQ ID NO: 483911 - RNA, 17 nt, Homo sapiens
ugcaccaccacacccgg

SEQ ID NO: 483912 - RNA, 19 nt, Homo sapiens
ugcacucuaacccuaggca

SEQ ID NO: 483913 - RNA, 16 nt, Homo sapiens
ugcagaaaauugccua

SEQ ID NO: 483914 - RNA, 18 nt, Homo sapiens
ugcagaaaauugccuaaa

SEQ ID NO: 483915 - RNA, 13 nt, Homo sapiens
ugcagaguacugg

SEQ ID NO: 483916 - RNA, 20 nt, Homo sapiens
ugccccucucugggccucag

SEQ ID NO: 483917 - RNA, 16 nt, Homo sapiens
ugccgcuacaaaaagg

SEQ ID NO: 483918 - RNA, 18 nt, Homo sapiens
ugccugcaggcaugaguc

SEQ ID NO: 483919 - RNA, 19 nt, Homo sapiens
ugccugcaggcaugaguca

SEQ ID NO: 483920 - RNA, 19 nt, Homo sapiens
ugccuucccaggaguacac

SEQ ID NO: 483921 - RNA, 20 nt, Homo sapiens
ugcgaucucggcucagugca

SEQ ID NO: 483922 - RNA, 16 nt, Homo sapiens
cagagucaaugaacuu

SEQ ID NO: 483923 - RNA, 17 nt, Homo sapiens
cagaugagaguacaccc

SEQ ID NO: 483924 - RNA, 19 nt, Homo sapiens
cagcacccucuccagauga

SEQ ID NO: 483925 - RNA, 15 nt, Homo sapiens
cagccucaccagcgc

SEQ ID NO: 483926 - RNA, 24 nt, Homo sapiens
cagccugcccucuucauuuagcca

SEQ ID NO: 483927 - RNA, 14 nt, Homo sapiens
cagcugacacaucu

SEQ ID NO: 483928 - RNA, 16 nt, Homo sapiens
cagcuucuauuagcca

SEQ ID NO: 483929 - RNA, 19 nt, Homo sapiens
caggaguacaccccaacag

SEQ ID NO: 483930 - RNA, 20 nt, Homo sapiens
caggcagcuuuuucucuccc

SEQ ID NO: 483931 - RNA, 17 nt, Homo sapiens
caggguggagugcagug

SEQ ID NO: 483932 - RNA, 18 nt, Homo sapiens
caggguggagugcagugg

SEQ ID NO: 483933 - RNA, 14 nt, Homo sapiens
caguaaacacucca

SEQ ID NO: 483934 - RNA, 17 nt, Homo sapiens
caguaugaaaaugucau

SEQ ID NO: 483935 - RNA, 15 nt, Homo sapiens
cagugcaaagauuug

SEQ ID NO: 483936 - RNA, 14 nt, Homo sapiens
caguuuuucacuuc

SEQ ID NO: 483937 - RNA, 17 nt, Homo sapiens
cauaaaguaugugcaua

SEQ ID NO: 483938 - RNA, 13 nt, Homo sapiens
cauaaguagcauu

SEQ ID NO: 483939 - RNA, 14 nt, Homo sapiens
cauauuguuauuau

SEQ ID NO: 483940 - RNA, 14 nt, Homo sapiens
caucuagaauucac

SEQ ID NO: 483941 - RNA, 14 nt, Homo sapiens
caucuccaugugac

SEQ ID NO: 483942 - RNA, 18 nt, Homo sapiens
caucuguauauacaaaga

SEQ ID NO: 483943 - RNA, 18 nt, Homo sapiens
caucuuuauuaaguagau

SEQ ID NO: 483944 - RNA, 15 nt, Homo sapiens
caugacauugcauuu

SEQ ID NO: 483945 - RNA, 16 nt, Homo sapiens
caugacauugcauuug

SEQ ID NO: 483946 - RNA, 18 nt, Homo sapiens
caugagucagucugauga

SEQ ID NO: 483947 - RNA, 17 nt, Homo sapiens
cauggcaguaauucucg

SEQ ID NO: 483948 - RNA, 15 nt, Homo sapiens
cauggggguauugua

SEQ ID NO: 483949 - RNA, 16 nt, Homo sapiens
cauguaaugacacuuc

SEQ ID NO: 483950 - RNA, 21 nt, Homo sapiens
cauucaugacugaacugaaaa

SEQ ID NO: 483951 - RNA, 21 nt, Homo sapiens
cauuguucuugugaacccaaa

SEQ ID NO: 483952 - RNA, 17 nt, Homo sapiens
cauuuucugccacccaa

SEQ ID NO: 483953 - RNA, 12 nt, Homo sapiens
ccaacagcaccc

SEQ ID NO: 483954 - RNA, 14 nt, Homo sapiens
ccaacagcacccuc

SEQ ID NO: 483955 - RNA, 16 nt, Homo sapiens
ccaacagcacccucuc

SEQ ID NO: 483956 - RNA, 21 nt, Homo sapiens
ccaacagcacccucuccagau

SEQ ID NO: 483957 - RNA, 19 nt, Homo sapiens
ccacagggucugcacucua

SEQ ID NO: 483958 - RNA, 17 nt, Homo sapiens
ccacccuguguugacac

SEQ ID NO: 483959 - RNA, 23 nt, Homo sapiens
ccaggaguacaccccaacagcac

SEQ ID NO: 483960 - RNA, 13 nt, Homo sapiens
ccaggguggagug

SEQ ID NO: 483961 - RNA, 17 nt, Homo sapiens
ccaucuguauauacaaa

SEQ ID NO: 483962 - RNA, 21 nt, Homo sapiens
cccacguagggcggcacucac

SEQ ID NO: 483963 - RNA, 17 nt, Homo sapiens
cccaggcaccugcauuu

SEQ ID NO: 483964 - RNA, 11 nt, Homo sapiens
ccccaacagca

SEQ ID NO: 483965 - RNA, 14 nt, Homo sapiens
ccccggaguucagu

SEQ ID NO: 483966 - RNA, 19 nt, Homo sapiens
ccccuuuacucauagcacu

SEQ ID NO: 483967 - RNA, 15 nt, Homo sapiens
cccuguccuuucuca

SEQ ID NO: 483968 - RNA, 19 nt, Homo sapiens
cccuuuacucauagcacuu

SEQ ID NO: 483969 - RNA, 21 nt, Homo sapiens
ccggacuccugccgcagugau

SEQ ID NO: 483970 - RNA, 13 nt, Homo sapiens
ccuaggcaucaca

SEQ ID NO: 483971 - RNA, 21 nt, Homo sapiens
ccucuccagaugagaguacac

SEQ ID NO: 483972 - RNA, 14 nt, Homo sapiens
ccucugagacauga

SEQ ID NO: 483973 - RNA, 17 nt, Homo sapiens
ccuguggccuuugcaau

SEQ ID NO: 483974 - RNA, 13 nt, Homo sapiens
ccuguguugacac

SEQ ID NO: 483975 - RNA, 15 nt, Homo sapiens
ccuucaccaucugua

SEQ ID NO: 483976 - RNA, 13 nt, Homo sapiens
ccuuccaaagacu

SEQ ID NO: 483977 - RNA, 20 nt, Homo sapiens
ccuucugguucuaacugcug

SEQ ID NO: 483978 - RNA, 16 nt, Homo sapiens
ccuucuuacaaugcau

SEQ ID NO: 483979 - RNA, 15 nt, Homo sapiens
ccuugccacauuaaa

SEQ ID NO: 483980 - RNA, 12 nt, Homo sapiens
ccuugugaccca

SEQ ID NO: 483981 - RNA, 12 nt, Homo sapiens
ccuuuuucauaa

SEQ ID NO: 483982 - RNA, 21 nt, Homo sapiens
cgaggacauucucugaccuac

SEQ ID NO: 483983 - RNA, 20 nt, Homo sapiens
cgaggagggagagucuccca

SEQ ID NO: 483984 - RNA, 14 nt, Homo sapiens
cggcucagugcaac

SEQ ID NO: 483985 - RNA, 15 nt, Homo sapiens
cggcucagugcaacc

SEQ ID NO: 483986 - RNA, 15 nt, Homo sapiens
cguggucaagcacuc

SEQ ID NO: 483987 - RNA, 13 nt, Homo sapiens
cuaaaaauuuaca

SEQ ID NO: 483988 - RNA, 13 nt, Homo sapiens
cuaaacuuacauu

SEQ ID NO: 483989 - RNA, 22 nt, Homo sapiens
cuaacccuaggcaucacaugcu

SEQ ID NO: 483990 - RNA, 18 nt, Homo sapiens
cuaacgaccacagggucu

SEQ ID NO: 483991 - RNA, 13 nt, Homo sapiens
cuaacugcuguua

SEQ ID NO: 483992 - RNA, 19 nt, Homo sapiens
cuaaggaauaugagcuuua

SEQ ID NO: 483993 - RNA, 22 nt, Homo sapiens
cuaaggucauuaccacaggcca

SEQ ID NO: 483994 - RNA, 22 nt, Homo sapiens
cuaauuuguuuucccuucuuac

SEQ ID NO: 483995 - RNA, 18 nt, Homo sapiens
cuaccuuuugcuguggca

SEQ ID NO: 483996 - RNA, 17 nt, Homo sapiens
cuaggauugugccugua

SEQ ID NO: 483997 - RNA, 18 nt, Homo sapiens
cuauagaaaacaauacag

SEQ ID NO: 483998 - RNA, 17 nt, Homo sapiens
cucaagaggaaaaucca

SEQ ID NO: 483999 - RNA, 15 nt, Homo sapiens
cucaauaaacaguca

SEQ ID NO: 484000 - RNA, 16 nt, Homo sapiens
cuccccggaguucagu

SEQ ID NO: 484001 - RNA, 21 nt, Homo sapiens
cuccccggaguucaguuuuac

SEQ ID NO: 484002 - RNA, 18 nt, Homo sapiens
cuccuagacucugugauc

SEQ ID NO: 484003 - RNA, 16 nt, Homo sapiens
cucggcucagugcaac

SEQ ID NO: 484004 - RNA, 15 nt, Homo sapiens
cucuaaauagcacuu

SEQ ID NO: 484005 - RNA, 19 nt, Homo sapiens
cucugaccuaucacuucca

SEQ ID NO: 484006 - RNA, 21 nt, Homo sapiens
cucugagcagugcuugaauga

SEQ ID NO: 484007 - RNA, 16 nt, Homo sapiens
cugaaauauacacaca

SEQ ID NO: 484008 - RNA, 21 nt, Homo sapiens
cugaaauauacacacagcagu

SEQ ID NO: 484009 - RNA, 15 nt, Homo sapiens
cugaccuuccaaaga

SEQ ID NO: 484010 - RNA, 22 nt, Homo sapiens
gguggaugaaaugucaguggaa

SEQ ID NO: 484011 - RNA, 20 nt, Homo sapiens
ggugucaaugaauuuugcuu

SEQ ID NO: 484012 - RNA, 18 nt, Homo sapiens
gguuaagugacuugccca

SEQ ID NO: 484013 - RNA, 17 nt, Homo sapiens
gguuucuccagagggaa

SEQ ID NO: 484014 - RNA, 13 nt, Homo sapiens
guaaaacagucau

SEQ ID NO: 484015 - RNA, 23 nt, Homo sapiens
guaaaacagucaucuagaauuca

SEQ ID NO: 484016 - RNA, 16 nt, Homo sapiens
guaaagcuuugugcag

SEQ ID NO: 484017 - RNA, 17 nt, Homo sapiens
guaaagcuuugugcaga

SEQ ID NO: 484018 - RNA, 15 nt, Homo sapiens
guaagcauaacuuau

SEQ ID NO: 484019 - RNA, 18 nt, Homo sapiens
guaaucccaagaucugug

SEQ ID NO: 484020 - RNA, 23 nt, Homo sapiens
guaccaagaagcccaagauauca

SEQ ID NO: 484021 - RNA, 19 nt, Homo sapiens
guagaugaaacauuaacuc

SEQ ID NO: 484022 - RNA, 19 nt, Homo sapiens
guagguaauauugcaaggc

SEQ ID NO: 484023 - RNA, 14 nt, Homo sapiens
guauauacaaagaa

SEQ ID NO: 484024 - RNA, 21 nt, Homo sapiens
gucaaugaauuuugcuuggug

SEQ ID NO: 484025 - RNA, 22 nt, Homo sapiens
gucauauuucacagcaccaaaa

SEQ ID NO: 484026 - RNA, 19 nt, Homo sapiens
gucaucucagugcuguaaa

SEQ ID NO: 484027 - RNA, 23 nt, Homo sapiens
gucuguccaacugccuguucaau

SEQ ID NO: 484028 - RNA, 20 nt, Homo sapiens
gugacuugcccaguuucagg

SEQ ID NO: 484029 - RNA, 17 nt, Homo sapiens
gugaggugcccagcuag

SEQ ID NO: 484030 - RNA, 21 nt, Homo sapiens
gugauucacccugauuuuaca

SEQ ID NO: 484031 - RNA, 13 nt, Homo sapiens
guggucaagcacu

SEQ ID NO: 484032 - RNA, 15 nt, Homo sapiens
guuauugacagcgau

SEQ ID NO: 484033 - RNA, 14 nt, Homo sapiens
guuccugacacuca

SEQ ID NO: 484034 - RNA, 14 nt, Homo sapiens
guuucaccaugaug

SEQ ID NO: 484035 - RNA, 21 nt, Homo sapiens
guuucuccagagggaauugca

SEQ ID NO: 484036 - RNA, 15 nt, Homo sapiens
ugaauaucaguuauu

SEQ ID NO: 484037 - RNA, 19 nt, Homo sapiens
ugacaaagaagaccacaaa

SEQ ID NO: 484038 - RNA, 20 nt, Homo sapiens
ugaccuaucacuuccacugc

SEQ ID NO: 484039 - RNA, 23 nt, Homo sapiens
ugacucucuggugagcgaggaca

SEQ ID NO: 484040 - RNA, 16 nt, Homo sapiens
ugagaguacaccccaa

SEQ ID NO: 484041 - RNA, 21 nt, Homo sapiens
ugagcagugcuugaaugaagu

SEQ ID NO: 484042 - RNA, 18 nt, Homo sapiens
ugaggguauaaagacauc

SEQ ID NO: 484043 - RNA, 12 nt, Homo sapiens
ugagguaaccuc

SEQ ID NO: 484044 - RNA, 16 nt, Homo sapiens
ugauacggcuccccag

SEQ ID NO: 484045 - RNA, 18 nt, Homo sapiens
ugaucaguaugaaaaugu

SEQ ID NO: 484046 - RNA, 20 nt, Homo sapiens
ugaucugaggguauaaagac

SEQ ID NO: 484047 - RNA, 19 nt, Homo sapiens
ugcaaagauuugcuuuaau

SEQ ID NO: 484048 - RNA, 18 nt, Homo sapiens
ugcaaccucugcuuccca

SEQ ID NO: 484049 - RNA, 21 nt, Homo sapiens
ugcacucuaacccuaggcauc

SEQ ID NO: 484050 - RNA, 12 nt, Homo sapiens
ugcagagucaau

SEQ ID NO: 484051 - RNA, 13 nt, Homo sapiens
ugcagcugucuga

SEQ ID NO: 484052 - RNA, 15 nt, Homo sapiens
ugcauauguaugacu

SEQ ID NO: 484053 - RNA, 19 nt, Homo sapiens
ugcauguacccuaagguca

SEQ ID NO: 484054 - RNA, 20 nt, Homo sapiens
ugcauucugagguaaccuca

SEQ ID NO: 484055 - RNA, 14 nt, Homo sapiens
ugccccucucuggg

SEQ ID NO: 484056 - RNA, 17 nt, Homo sapiens
ugcggccucugagacau

SEQ ID NO: 484057 - RNA, 10 nt, Homo sapiens
ugcugagcaa

SEQ ID NO: 484058 - RNA, 22 nt, Homo sapiens
ugcuguuaaaauuaauauauca

SEQ ID NO: 484059 - RNA, 14 nt, Homo sapiens
ugcuugaaugaagu

SEQ ID NO: 484060 - RNA, 17 nt, Homo sapiens
uggaagcauauuguuau

SEQ ID NO: 484061 - RNA, 14 nt, Homo sapiens
aaaggccaggguca

SEQ ID NO: 484062 - RNA, 15 nt, Homo sapiens
aaagggaacagugag

SEQ ID NO: 484063 - RNA, 14 nt, Homo sapiens
aaaguacuaauaga

SEQ ID NO: 484064 - RNA, 18 nt, Homo sapiens
aaaguaucaccagggugc

SEQ ID NO: 484065 - RNA, 14 nt, Homo sapiens
aaagucaaucuuau

SEQ ID NO: 484066 - RNA, 19 nt, Homo sapiens
aaagugcuuccaaggcaga

SEQ ID NO: 484067 - RNA, 14 nt, Homo sapiens
aaauaaacaaguca

SEQ ID NO: 484068 - RNA, 16 nt, Homo sapiens
aaauaaaccccaguuc

SEQ ID NO: 484069 - RNA, 22 nt, Homo sapiens
aaauaaauuauuauuuaaacau

SEQ ID NO: 484070 - RNA, 13 nt, Homo sapiens
aaauaguuaucuu

SEQ ID NO: 484071 - RNA, 14 nt, Homo sapiens
aaaucaaacugcuu

SEQ ID NO: 484072 - RNA, 22 nt, Homo sapiens
aaaugucauuguucuugugaac

SEQ ID NO: 484073 - RNA, 19 nt, Homo sapiens
aaauguuguuuuaggaaua

SEQ ID NO: 484074 - RNA, 21 nt, Homo sapiens
aaauuaauauaucauuaucuu

SEQ ID NO: 484075 - RNA, 17 nt, Homo sapiens
aaauuauguuacuguau

SEQ ID NO: 484076 - RNA, 17 nt, Homo sapiens
aaauuugaugaaaucag

SEQ ID NO: 484077 - RNA, 13 nt, Homo sapiens
aacacaaagugaa

SEQ ID NO: 484078 - RNA, 15 nt, Homo sapiens
aacagcacccucucc

SEQ ID NO: 484079 - RNA, 22 nt, Homo sapiens
aacagcacccucuccagaugag

SEQ ID NO: 484080 - RNA, 23 nt, Homo sapiens
aacaucagcaaaaaaguacuuaa

SEQ ID NO: 484081 - RNA, 19 nt, Homo sapiens
aacauguaagcauaacuua

SEQ ID NO: 484082 - RNA, 18 nt, Homo sapiens
aacauuaacucuaacugu

SEQ ID NO: 484083 - RNA, 13 nt, Homo sapiens
aaccaccccaucu

SEQ ID NO: 484084 - RNA, 11 nt, Homo sapiens
aacccaaagug

SEQ ID NO: 484085 - RNA, 21 nt, Homo sapiens
aacucauaauagacuucccac

SEQ ID NO: 484086 - RNA, 20 nt, Homo sapiens
aacugcaucccacguucugu

SEQ ID NO: 484087 - RNA, 20 nt, Homo sapiens
aacugugacaaagaagacca

SEQ ID NO: 484088 - RNA, 13 nt, Homo sapiens
aacuuacauuuaa

SEQ ID NO: 484089 - RNA, 20 nt, Homo sapiens
aagaagcccaagauaucagc

SEQ ID NO: 484090 - RNA, 23 nt, Homo sapiens
aagaagcccaagauaucagccca

SEQ ID NO: 484091 - RNA, 20 nt, Homo sapiens
aagacacugaaauauacaca

SEQ ID NO: 484092 - RNA, 18 nt, Homo sapiens
aagacuauucccuucuaa

SEQ ID NO: 484093 - RNA, 23 nt, Homo sapiens
aagacuauucccuucuaaccuga

SEQ ID NO: 484094 - RNA, 20 nt, Homo sapiens
aagacucucgcaucuuccca

SEQ ID NO: 484095 - RNA, 13 nt, Homo sapiens
aagcagcagggga

SEQ ID NO: 484096 - RNA, 22 nt, Homo sapiens
aagccagugcggcagguucaca

SEQ ID NO: 484097 - RNA, 16 nt, Homo sapiens
aagccuuggauguaua

SEQ ID NO: 484098 - RNA, 20 nt, Homo sapiens
aagcucuugaagacacugaa

SEQ ID NO: 484099 - RNA, 21 nt, Homo sapiens
aaggaaaaauauugaacucaa

SEQ ID NO: 484100 - RNA, 21 nt, Homo sapiens
aaggcuuacacccacagugga

SEQ ID NO: 484101 - RNA, 23 nt, Homo sapiens
aaggcuuacacccacaguggaaa

SEQ ID NO: 484102 - RNA, 16 nt, Homo sapiens
aaguaaaacagucauc

SEQ ID NO: 484103 - RNA, 14 nt, Homo sapiens
aaguaaacucagca

SEQ ID NO: 484104 - RNA, 16 nt, Homo sapiens
aaguacuacuccucaa

SEQ ID NO: 484105 - RNA, 17 nt, Homo sapiens
aaguacuacuccucaaa

SEQ ID NO: 484106 - RNA, 19 nt, Homo sapiens
aaguagaugaaacauuaac

SEQ ID NO: 484107 - RNA, 14 nt, Homo sapiens
aaguaugugcauau

SEQ ID NO: 484108 - RNA, 20 nt, Homo sapiens
aagugcagcaggagaacucu

SEQ ID NO: 484109 - RNA, 17 nt, Homo sapiens
aagugcagucugaucca

SEQ ID NO: 484110 - RNA, 14 nt, Homo sapiens
aauaaacagucacu

SEQ ID NO: 484111 - RNA, 19 nt, Homo sapiens
aauaauuuucaagcaaagu

SEQ ID NO: 484112 - RNA, 24 nt, Homo sapiens
aauacauaaaguaugugcauauuu

SEQ ID NO: 484113 - RNA, 15 nt, Homo sapiens
aauaguuguaaauau

SEQ ID NO: 484114 - RNA, 21 nt, Homo sapiens
aaucaguaugcaaagcaaucu

SEQ ID NO: 484115 - RNA, 13 nt, Homo sapiens
aaugaauugcuaa

SEQ ID NO: 484116 - RNA, 17 nt, Homo sapiens
aauggugaaaugcagag

SEQ ID NO: 484117 - RNA, 19 nt, Homo sapiens
aauguccugauuacaaugc

SEQ ID NO: 484118 - RNA, 16 nt, Homo sapiens
aaugugaaucaugguu

SEQ ID NO: 484119 - RNA, 16 nt, Homo sapiens
aauuauguuacuguau

SEQ ID NO: 484120 - RNA, 12 nt, Homo sapiens
aauuuacaagag

SEQ ID NO: 484121 - RNA, 15 nt, Homo sapiens
aauuuuauuacauau

SEQ ID NO: 484122 - RNA, 21 nt, Homo sapiens
acaagagaagaaagugaaagc

SEQ ID NO: 484123 - RNA, 11 nt, Homo sapiens
acaaugcauuc

SEQ ID NO: 484124 - RNA, 13 nt, Homo sapiens
acacccacagugg

SEQ ID NO: 484125 - RNA, 18 nt, Homo sapiens
acaccccaccucuuccuu

SEQ ID NO: 484126 - RNA, 19 nt, Homo sapiens
acacccccaugacauugca

SEQ ID NO: 484127 - RNA, 23 nt, Homo sapiens
acacccccaugacauugcauuug

SEQ ID NO: 484128 - RNA, 16 nt, Homo sapiens
acacucuuucuccugc

SEQ ID NO: 484129 - RNA, 22 nt, Homo sapiens
acagacauuccuucuacaugua

SEQ ID NO: 484130 - RNA, 16 nt, Homo sapiens
acagcacccucuccag

SEQ ID NO: 484131 - RNA, 16 nt, Homo sapiens
acagcugagcacauuc

SEQ ID NO: 484132 - RNA, 12 nt, Homo sapiens
acaggcacucaa

SEQ ID NO: 484133 - RNA, 18 nt, Homo sapiens
acagggucugcacucuaa

SEQ ID NO: 484134 - RNA, 19 nt, Homo sapiens
acaguccuucaaacuucca

SEQ ID NO: 484135 - RNA, 16 nt, Homo sapiens
acagugaggugcccag

SEQ ID NO: 484136 - RNA, 14 nt, Homo sapiens
acauaaagccuugg

SEQ ID NO: 484137 - RNA, 12 nt, Homo sapiens
acauauuugcau

SEQ ID NO: 484138 - RNA, 18 nt, Homo sapiens
acauguaaugacacuucu

SEQ ID NO: 484139 - RNA, 13 nt, Homo sapiens
acauuaacuucag

SEQ ID NO: 484140 - RNA, 17 nt, Homo sapiens
acauucagagcuuacuu

SEQ ID NO: 484141 - RNA, 14 nt, Homo sapiens
acauucucugaccu

SEQ ID NO: 484142 - RNA, 20 nt, Homo sapiens
acauucucugaccuacucga

SEQ ID NO: 484143 - RNA, 23 nt, Homo sapiens
acauucucugaccuacucgaggg

SEQ ID NO: 484144 - RNA, 18 nt, Homo sapiens
acauuuaaaagacagaca

SEQ ID NO: 484145 - RNA, 17 nt, Homo sapiens
accaaaggccaggguca

SEQ ID NO: 484146 - RNA, 15 nt, Homo sapiens
acccaagaugcaaga

SEQ ID NO: 484147 - RNA, 18 nt, Homo sapiens
caaggcaaagacuauucc

SEQ ID NO: 484148 - RNA, 13 nt, Homo sapiens
caagucaaagacu

SEQ ID NO: 484149 - RNA, 18 nt, Homo sapiens
caauaaacagucacugga

SEQ ID NO: 484150 - RNA, 19 nt, Homo sapiens
caauaauugaaguguuccc

SEQ ID NO: 484151 - RNA, 12 nt, Homo sapiens
cacaaagugaaa

SEQ ID NO: 484152 - RNA, 15 nt, Homo sapiens
cacaguuguguuccu

SEQ ID NO: 484153 - RNA, 23 nt, Homo sapiens
cacauuaaauugauaacauggaa

SEQ ID NO: 484154 - RNA, 13 nt, Homo sapiens
cacauuaagccuu

SEQ ID NO: 484155 - RNA, 23 nt, Homo sapiens
cacauucuucaguuuuucacuuc

SEQ ID NO: 484156 - RNA, 13 nt, Homo sapiens
caccaucuguaua

SEQ ID NO: 484157 - RNA, 12 nt, Homo sapiens
caccccaacagc

SEQ ID NO: 484158 - RNA, 19 nt, Homo sapiens
acccaggguggagugcagu

SEQ ID NO: 484159 - RNA, 22 nt, Homo sapiens
accccaacagcacccucuccag

SEQ ID NO: 484160 - RNA, 22 nt, Homo sapiens
accccaugcuggccuugccaca

SEQ ID NO: 484161 - RNA, 22 nt, Homo sapiens
acccuaaaaagcagagcuuugc

SEQ ID NO: 484162 - RNA, 15 nt, Homo sapiens
accuaucacuuccac

SEQ ID NO: 484163 - RNA, 12 nt, Homo sapiens
accucauuauca

SEQ ID NO: 484164 - RNA, 16 nt, Homo sapiens
accugaacugaugggu

SEQ ID NO: 484165 - RNA, 19 nt, Homo sapiens
accuucaccaucuguauau

SEQ ID NO: 484166 - RNA, 16 nt, Homo sapiens
accuugugacccagca

SEQ ID NO: 484167 - RNA, 13 nt, Homo sapiens
acgaccacagggu

SEQ ID NO: 484168 - RNA, 20 nt, Homo sapiens
acgaccacagggucugcacu

SEQ ID NO: 484169 - RNA, 14 nt, Homo sapiens
acgauuaacuguga

SEQ ID NO: 484170 - RNA, 16 nt, Homo sapiens
acgucauuugugcaag

SEQ ID NO: 484171 - RNA, 22 nt, Homo sapiens
acuaccucugugccuugccaca

SEQ ID NO: 484172 - RNA, 17 nt, Homo sapiens
acucaauaaacagucac

SEQ ID NO: 484173 - RNA, 16 nt, Homo sapiens
acuccugccgcaguga

SEQ ID NO: 484174 - RNA, 16 nt, Homo sapiens
acugaaauauacacac

SEQ ID NO: 484175 - RNA, 19 nt, Homo sapiens
acugcuguguuugagcucu

SEQ ID NO: 484176 - RNA, 20 nt, Homo sapiens
acugcuguguuugagcucug

SEQ ID NO: 484177 - RNA, 19 nt, Homo sapiens
acuggcugugugaccuuag

SEQ ID NO: 484178 - RNA, 14 nt, Homo sapiens
acuuaaaacuguaa

SEQ ID NO: 484179 - RNA, 16 nt, Homo sapiens
acuucuaccuacauau

SEQ ID NO: 484180 - RNA, 18 nt, Homo sapiens
acuuugauaggaugugga

SEQ ID NO: 484181 - RNA, 14 nt, Homo sapiens
agaagcacuguucc

SEQ ID NO: 484182 - RNA, 18 nt, Homo sapiens
agaagggcaaauauuuau

SEQ ID NO: 484183 - RNA, 19 nt, Homo sapiens
agaaugaaagcuccucgag

SEQ ID NO: 484184 - RNA, 21 nt, Homo sapiens
agaaugaaagcuccucgaggg

SEQ ID NO: 484185 - RNA, 14 nt, Homo sapiens
agaauucacugagu

SEQ ID NO: 484186 - RNA, 13 nt, Homo sapiens
agacagacauuca

SEQ ID NO: 484187 - RNA, 19 nt, Homo sapiens
agacuauucccuucuaacc

SEQ ID NO: 484188 - RNA, 19 nt, Homo sapiens
agacucucgcaucuuccca

SEQ ID NO: 484189 - RNA, 13 nt, Homo sapiens
agacuguacuaac

SEQ ID NO: 484190 - RNA, 21 nt, Homo sapiens
agagccugaguguugccuaau

SEQ ID NO: 484191 - RNA, 13 nt, Homo sapiens
agaguacacccca

SEQ ID NO: 484192 - RNA, 15 nt, Homo sapiens
agauaugaugucccu

SEQ ID NO: 484193 - RNA, 20 nt, Homo sapiens
agaugaagcaaacacauuaa

SEQ ID NO: 484194 - RNA, 15 nt, Homo sapiens
agaugagaguacacc

SEQ ID NO: 484195 - RNA, 16 nt, Homo sapiens
agaugagaguacaccc

SEQ ID NO: 484196 - RNA, 16 nt, Homo sapiens
agaugcagccccaucu

SEQ ID NO: 484197 - RNA, 17 nt, Homo sapiens
agauuguugaaagccau

SEQ ID NO: 484198 - RNA, 19 nt, Homo sapiens
agcacccucuccagaugag

SEQ ID NO: 484199 - RNA, 20 nt, Homo sapiens
agcacccucuccagaugcag

SEQ ID NO: 484200 - RNA, 14 nt, Homo sapiens
agcaccuaaacuua

SEQ ID NO: 484201 - RNA, 22 nt, Homo sapiens
agcacugcccaaagugcuucca

SEQ ID NO: 484202 - RNA, 15 nt, Homo sapiens
agcacuguuccagcc

SEQ ID NO: 484203 - RNA, 17 nt, Homo sapiens
agcauauuguuauuaua

SEQ ID NO: 484204 - RNA, 20 nt, Homo sapiens
agccaaguuuuaaauauuau

SEQ ID NO: 484205 - RNA, 20 nt, Homo sapiens
agccaccccaugcuggccuu

SEQ ID NO: 484206 - RNA, 18 nt, Homo sapiens
agccacccuguguugaca

SEQ ID NO: 484207 - RNA, 21 nt, Homo sapiens
agcccuggagaccccaccagc

SEQ ID NO: 484208 - RNA, 20 nt, Homo sapiens
agccucccugucggccuggu

SEQ ID NO: 484209 - RNA, 14 nt, Homo sapiens
agccugaacccaag

SEQ ID NO: 484210 - RNA, 16 nt, Homo sapiens
agcgaggacauucucu

SEQ ID NO: 484211 - RNA, 17 nt, Homo sapiens
agcuacuauaaauauac

SEQ ID NO: 484212 - RNA, 17 nt, Homo sapiens
agcuuugcuucucucuc

SEQ ID NO: 484213 - RNA, 23 nt, Homo sapiens
aggaacacccccaugacauugca

SEQ ID NO: 484214 - RNA, 18 nt, Homo sapiens
aggaaccaaauuuaagac

SEQ ID NO: 484215 - RNA, 20 nt, Homo sapiens
aggaguacaccccaacagca

SEQ ID NO: 484216 - RNA, 17 nt, Homo sapiens
aggcagcugacacaucu

SEQ ID NO: 484217 - RNA, 13 nt, Homo sapiens
aggcagggaccua

SEQ ID NO: 484218 - RNA, 17 nt, Homo sapiens
aggccagggucacugaa

SEQ ID NO: 484219 - RNA, 13 nt, Homo sapiens
agggaacagugag

SEQ ID NO: 484220 - RNA, 17 nt, Homo sapiens
agggguaacuugcaccu

SEQ ID NO: 484221 - RNA, 23 nt, Homo sapiens
aggggucuuguuaagugcagucu

SEQ ID NO: 484222 - RNA, 13 nt, Homo sapiens
agggucugcacuc

SEQ ID NO: 484223 - RNA, 14 nt, Homo sapiens
agggucugcacucu

SEQ ID NO: 484224 - RNA, 13 nt, Homo sapiens
aggugcugagcaa

SEQ ID NO: 484225 - RNA, 19 nt, Homo sapiens
aguaaauaaacaagucaaa

SEQ ID NO: 484226 - RNA, 16 nt, Homo sapiens
aguacaccccaacagc

SEQ ID NO: 484227 - RNA, 20 nt, Homo sapiens
aguacaccccaccucuuccu

SEQ ID NO: 484228 - RNA, 12 nt, Homo sapiens
aguacuuaaaac

SEQ ID NO: 484229 - RNA, 21 nt, Homo sapiens
aguagcugggauuacaggugu

SEQ ID NO: 484230 - RNA, 16 nt, Homo sapiens
aguaugaaaaugucau

SEQ ID NO: 484231 - RNA, 14 nt, Homo sapiens
aguauugugaaagu

SEQ ID NO: 484232 - RNA, 18 nt, Homo sapiens
agucacuaguuguaauuu

SEQ ID NO: 484233 - RNA, 23 nt, Homo sapiens
agucgaaccauggugaacuccac

SEQ ID NO: 484234 - RNA, 12 nt, Homo sapiens
agucugcacuua

SEQ ID NO: 484235 - RNA, 21 nt, Homo sapiens
agugcaaccucugcuucccag

SEQ ID NO: 484236 - RNA, 15 nt, Homo sapiens
agugcuuccaaggca

SEQ ID NO: 484237 - RNA, 15 nt, Homo sapiens
agugugacucauuaa

SEQ ID NO: 484238 - RNA, 19 nt, Homo sapiens
aguuguagguaauauugca

SEQ ID NO: 484239 - RNA, 15 nt, Homo sapiens
auaaaaguaaacuca

SEQ ID NO: 484240 - RNA, 13 nt, Homo sapiens
auaaaauaauucu

SEQ ID NO: 484241 - RNA, 21 nt, Homo sapiens
auaaaccccaguucugaauca

SEQ ID NO: 484242 - RNA, 14 nt, Homo sapiens
auaaagacaucucc

SEQ ID NO: 484243 - RNA, 14 nt, Homo sapiens
auaaguagcauuca

SEQ ID NO: 484244 - RNA, 19 nt, Homo sapiens
auaaguagcauucauguaa

SEQ ID NO: 484245 - RNA, 16 nt, Homo sapiens
auaaucacaguugugu

SEQ ID NO: 484246 - RNA, 19 nt, Homo sapiens
auagccuguggccuuugca

SEQ ID NO: 484247 - RNA, 22 nt, Homo sapiens
auaguuaucuuuuaauuacaga

SEQ ID NO: 484248 - RNA, 14 nt, Homo sapiens
auauacaaguagau

SEQ ID NO: 484249 - RNA, 12 nt, Homo sapiens
auaugugucagu

SEQ ID NO: 484250 - RNA, 19 nt, Homo sapiens
auauuuuauuauagucacu

SEQ ID NO: 484251 - RNA, 17 nt, Homo sapiens
aucacaguuguguuccu

SEQ ID NO: 484252 - RNA, 18 nt, Homo sapiens
aucacaugcucaaugacu

SEQ ID NO: 484253 - RNA, 19 nt, Homo sapiens
ccuagacucugugaucuga

SEQ ID NO: 484254 - RNA, 14 nt, Homo sapiens
ccucaagugauccu

SEQ ID NO: 484255 - RNA, 17 nt, Homo sapiens
ccuccuagacucuguga

SEQ ID NO: 484256 - RNA, 16 nt, Homo sapiens
ccucgagggcagggac

SEQ ID NO: 484257 - RNA, 16 nt, Homo sapiens
ccucuaaaacaguccu

SEQ ID NO: 484258 - RNA, 17 nt, Homo sapiens
ccucuaaauagcacuuu

SEQ ID NO: 484259 - RNA, 21 nt, Homo sapiens
ccugauuacaaugcugucugu

SEQ ID NO: 484260 - RNA, 23 nt, Homo sapiens
ccugcauggcugagcugcccaca

SEQ ID NO: 484261 - RNA, 15 nt, Homo sapiens
ccugcuuaaugaaaa

SEQ ID NO: 484262 - RNA, 21 nt, Homo sapiens
ccuggagcagccaccccaugc

SEQ ID NO: 484263 - RNA, 21 nt, Homo sapiens
ccuguaugcaacaggcacuca

SEQ ID NO: 484264 - RNA, 15 nt, Homo sapiens
ccuucaaacuuccag

SEQ ID NO: 484265 - RNA, 21 nt, Homo sapiens
ccuucacgauuaacugugaaa

SEQ ID NO: 484266 - RNA, 14 nt, Homo sapiens
ccuucuacauguaa

SEQ ID NO: 484267 - RNA, 21 nt, Homo sapiens
ccuucugguucuaacugcugu

SEQ ID NO: 484268 - RNA, 19 nt, Homo sapiens
ccuugaugugccugugaau

SEQ ID NO: 484269 - RNA, 22 nt, Homo sapiens
ccuuuguuacagcuacuauaaa

SEQ ID NO: 484270 - RNA, 13 nt, Homo sapiens
ccuuuuucauaau

SEQ ID NO: 484271 - RNA, 21 nt, Homo sapiens
cgauauaauuuuauuacauau

SEQ ID NO: 484272 - RNA, 16 nt, Homo sapiens
cggaguucaguuuuac

SEQ ID NO: 484273 - RNA, 13 nt, Homo sapiens
cgggagacucuga

SEQ ID NO: 484274 - RNA, 21 nt, Homo sapiens
cguggacuuggggucagagac

SEQ ID NO: 484275 - RNA, 13 nt, Homo sapiens
cuaaaacaguccu

SEQ ID NO: 484276 - RNA, 16 nt, Homo sapiens
cuaaaaugaguuaccu

SEQ ID NO: 484277 - RNA, 19 nt, Homo sapiens
cuaaaauuauguuacugua

SEQ ID NO: 484278 - RNA, 16 nt, Homo sapiens
cuaaccugaacugaug

SEQ ID NO: 484279 - RNA, 23 nt, Homo sapiens
cuaaccuucacgauuaacuguga

SEQ ID NO: 484280 - RNA, 21 nt, Homo sapiens
cuaaggaauaugagcuuuaug

SEQ ID NO: 484281 - RNA, 17 nt, Homo sapiens
cuaauagaacuuguuaa

SEQ ID NO: 484282 - RNA, 18 nt, Homo sapiens
cuacauguaaugacacuu

SEQ ID NO: 484283 - RNA, 15 nt, Homo sapiens
cuacauuuuaaugca

SEQ ID NO: 484284 - RNA, 22 nt, Homo sapiens
cuaccucauggggguauuguau

SEQ ID NO: 484285 - RNA, 10 nt, Homo sapiens
cuacuuuaau

SEQ ID NO: 484286 - RNA, 17 nt, Homo sapiens
cuauaaauauacauaua

SEQ ID NO: 484287 - RNA, 22 nt, Homo sapiens
cuauaugccgcuacaaaaaggu

SEQ ID NO: 484288 - RNA, 21 nt, Homo sapiens
cuauucccuucuaaccugaac

SEQ ID NO: 484289 - RNA, 16 nt, Homo sapiens
cucaauaaacagucac

SEQ ID NO: 484290 - RNA, 11 nt, Homo sapiens
cucagugcaac

SEQ ID NO: 484291 - RNA, 15 nt, Homo sapiens
cuccagaugagagua

SEQ ID NO: 484292 - RNA, 22 nt, Homo sapiens
cuccagaugagaguacacccca

SEQ ID NO: 484293 - RNA, 17 nt, Homo sapiens
cucccuucucuaccuca

SEQ ID NO: 484294 - RNA, 19 nt, Homo sapiens
cucuaaaaugaguuaccua

SEQ ID NO: 484295 - RNA, 17 nt, Homo sapiens
cucuagggcaguggagu

SEQ ID NO: 484296 - RNA, 23 nt, Homo sapiens
cucugaccuacucgagggacuua

SEQ ID NO: 484297 - RNA, 16 nt, Homo sapiens
cucuugaagacacuga

SEQ ID NO: 484298 - RNA, 17 nt, Homo sapiens
cucuugaagacacugaa

SEQ ID NO: 484299 - RNA, 15 nt, Homo sapiens
cugaaaacaagccau

SEQ ID NO: 484300 - RNA, 12 nt, Homo sapiens
cugaacugaugg

SEQ ID NO: 484301 - RNA, 22 nt, Homo sapiens
cugaacuggagccaugggcaca

SEQ ID NO: 484302 - RNA, 22 nt, Homo sapiens
cugacacucaauaaacagucac

SEQ ID NO: 484303 - RNA, 21 nt, Homo sapiens
cugaccuuccaaagacuaaga

SEQ ID NO: 484304 - RNA, 23 nt, Homo sapiens
cugagcagugcuugaaugaaguu

SEQ ID NO: 484305 - RNA, 18 nt, Homo sapiens
cugcuucccagguucaag

SEQ ID NO: 484306 - RNA, 18 nt, Homo sapiens
cuggauuaggucucuguu

SEQ ID NO: 484307 - RNA, 21 nt, Homo sapiens
cuggcccacagcaggugcuga

SEQ ID NO: 484308 - RNA, 16 nt, Homo sapiens
cugggauuacaggugu

SEQ ID NO: 484309 - RNA, 20 nt, Homo sapiens
cugggcacugguaaucccaa

SEQ ID NO: 484310 - RNA, 20 nt, Homo sapiens
cuguaaagcuuugugcagau

SEQ ID NO: 484311 - RNA, 18 nt, Homo sapiens
cugucacgugugggcaau

SEQ ID NO: 484312 - RNA, 13 nt, Homo sapiens
cuguccuuucuca

SEQ ID NO: 484313 - RNA, 20 nt, Homo sapiens
cugucugaccuuccaaagac

SEQ ID NO: 484314 - RNA, 23 nt, Homo sapiens
cugugacaaagaagaccacaaau

SEQ ID NO: 484315 - RNA, 15 nt, Homo sapiens
cugugccuugccaca

SEQ ID NO: 484316 - RNA, 15 nt, Homo sapiens
cuguugacaaaugac

SEQ ID NO: 484317 - RNA, 15 nt, Homo sapiens
cuguugacuggcugu

SEQ ID NO: 484318 - RNA, 15 nt, Homo sapiens
cuuauccuccaugaa

SEQ ID NO: 484319 - RNA, 14 nt, Homo sapiens
cuuauuuacagaua

SEQ ID NO: 484320 - RNA, 17 nt, Homo sapiens
cuuccaaggcagaagca

SEQ ID NO: 484321 - RNA, 19 nt, Homo sapiens
cuuccagugcaacacugaa

SEQ ID NO: 484322 - RNA, 15 nt, Homo sapiens
cuugaagacacugaa

SEQ ID NO: 484323 - RNA, 18 nt, Homo sapiens
cuugcaccucugaccuau

SEQ ID NO: 484324 - RNA, 14 nt, Homo sapiens
cuugccugcaggca

SEQ ID NO: 484325 - RNA, 13 nt, Homo sapiens
cuuggauguauau

SEQ ID NO: 484326 - RNA, 19 nt, Homo sapiens
cuuuaaaacuuauccucca

SEQ ID NO: 484327 - RNA, 13 nt, Homo sapiens
cuuuccacauuca

SEQ ID NO: 484328 - RNA, 21 nt, Homo sapiens
cuuugagucaauagcuugucu

SEQ ID NO: 484329 - RNA, 17 nt, Homo sapiens
gaaaaauauugaacuca

SEQ ID NO: 484330 - RNA, 21 nt, Homo sapiens
gaaacucauaauagacuuccc

SEQ ID NO: 484331 - RNA, 20 nt, Homo sapiens
gaaauaauuuucaagcaaag

SEQ ID NO: 484332 - RNA, 11 nt, Homo sapiens
gaacacugaga

SEQ ID NO: 484333 - RNA, 18 nt, Homo sapiens
gaaccauggugaacucca

SEQ ID NO: 484334 - RNA, 12 nt, Homo sapiens
gaacucugagca

SEQ ID NO: 484335 - RNA, 17 nt, Homo sapiens
gaacucuuuucccugaa

SEQ ID NO: 484336 - RNA, 14 nt, Homo sapiens
gaacuggagccaug

SEQ ID NO: 484337 - RNA, 13 nt, Homo sapiens
gaagaagagccac

SEQ ID NO: 484338 - RNA, 17 nt, Homo sapiens
gaagcccaagauaucag

SEQ ID NO: 484339 - RNA, 18 nt, Homo sapiens
gaaggagaaucaucagga

SEQ ID NO: 484340 - RNA, 13 nt, Homo sapiens
gaaggaguuuuau

SEQ ID NO: 484341 - RNA, 13 nt, Homo sapiens
gaaucuacuuuaa

SEQ ID NO: 484342 - RNA, 16 nt, Homo sapiens
gacacguggugcauuu

SEQ ID NO: 484343 - RNA, 17 nt, Homo sapiens
gacagaugggcauaugu

SEQ ID NO: 484344 - RNA, 22 nt, Homo sapiens
ugagcuuuauguaauaauguga

SEQ ID NO: 484345 - RNA, 20 nt, Homo sapiens
ugaggcauccuuccucacac

SEQ ID NO: 484346 - RNA, 14 nt, Homo sapiens
ugaguuaaagcagu

SEQ ID NO: 484347 - RNA, 18 nt, Homo sapiens
ugaguuuuguuucacuuu

SEQ ID NO: 484348 - RNA, 22 nt, Homo sapiens
ugaguuuuguuucacuuugaca

SEQ ID NO: 484349 - RNA, 22 nt, Homo sapiens
ugauuagagggaugagacagac

SEQ ID NO: 484350 - RNA, 20 nt, Homo sapiens
ugcagagccacccuguguug

SEQ ID NO: 484351 - RNA, 16 nt, Homo sapiens
ugcauauuuuauuaua

SEQ ID NO: 484352 - RNA, 20 nt, Homo sapiens
ugcauauuuuauuauaguca

SEQ ID NO: 484353 - RNA, 17 nt, Homo sapiens
ugcauuuaauuuauuga

SEQ ID NO: 484354 - RNA, 15 nt, Homo sapiens
ugcauuuugcuuguu

SEQ ID NO: 484355 - RNA, 22 nt, Homo sapiens
ugcgaucucggcucagugcaac

SEQ ID NO: 484356 - RNA, 20 nt, Homo sapiens
ugcuaacuuaaaaaacugca

SEQ ID NO: 484357 - RNA, 19 nt, Homo sapiens
ugcuauagaaaacaauaca

SEQ ID NO: 484358 - RNA, 17 nt, Homo sapiens
ugcuguaaaaacugugg

SEQ ID NO: 484359 - RNA, 22 nt, Homo sapiens
ugcuucccagguucaagcgauu

SEQ ID NO: 484360 - RNA, 21 nt, Homo sapiens
uggaaagacagcuucucaucc

SEQ ID NO: 484361 - RNA, 19 nt, Homo sapiens
uggagcagccaccccaugc

SEQ ID NO: 484362 - RNA, 12 nt, Homo sapiens
uggagcccugga

SEQ ID NO: 484363 - RNA, 15 nt, Homo sapiens
uggaguaacacaaag

SEQ ID NO: 484364 - RNA, 17 nt, Homo sapiens
uggagugcaguggugcg

SEQ ID NO: 484365 - RNA, 13 nt, Homo sapiens
ugggaaaggggag

SEQ ID NO: 484366 - RNA, 21 nt, Homo sapiens
ugggagugcccccaacagcac

SEQ ID NO: 484367 - RNA, 16 nt, Homo sapiens
ugggggaacacugaga

SEQ ID NO: 484368 - RNA, 14 nt, Homo sapiens
uggggguauuguau

SEQ ID NO: 484369 - RNA, 13 nt, Homo sapiens
uggucaagcacuc

SEQ ID NO: 484370 - RNA, 14 nt, Homo sapiens
uggugaaaugcaga

SEQ ID NO: 484371 - RNA, 17 nt, Homo sapiens
uggugaaaugcagaguc

SEQ ID NO: 484372 - RNA, 17 nt, Homo sapiens
uguaagcauaacuuauu

SEQ ID NO: 484373 - RNA, 16 nt, Homo sapiens
uguaauugacacuaua

SEQ ID NO: 484374 - RNA, 23 nt, Homo sapiens
uguaugacucccaaauuuucaca

SEQ ID NO: 484375 - RNA, 19 nt, Homo sapiens
uguauguuuuucuguauaa

SEQ ID NO: 484376 - RNA, 19 nt, Homo sapiens
uguccaacugccuguucaa

SEQ ID NO: 484377 - RNA, 22 nt, Homo sapiens
ugugcaagaccguuuguccacu

SEQ ID NO: 484378 - RNA, 13 nt, Homo sapiens
uguuaagugcagu

SEQ ID NO: 484379 - RNA, 21 nt, Homo sapiens
uguuacccaggguggagugca

SEQ ID NO: 484380 - RNA, 20 nt, Homo sapiens
uguuccuuuguaauugacac

SEQ ID NO: 484381 - RNA, 22 nt, Homo sapiens
uguucuaaaaauaaaaguauug

SEQ ID NO: 484382 - RNA, 13 nt, Homo sapiens
uguuugagcucug

SEQ ID NO: 484383 - RNA, 23 nt, Homo sapiens
uuaacuauuuuauuuucuaaugu

SEQ ID NO: 484384 - RNA, 18 nt, Homo sapiens
uuaagguucaagacagau

SEQ ID NO: 484385 - RNA, 12 nt, Homo sapiens
uuaagugacuug

SEQ ID NO: 484386 - RNA, 17 nt, Homo sapiens
uuaauuguuaagauaug

SEQ ID NO: 484387 - RNA, 19 nt, Homo sapiens
uuacaagagaagaaaguga

SEQ ID NO: 484388 - RNA, 15 nt, Homo sapiens
uuacagcuacuauaa

SEQ ID NO: 484389 - RNA, 20 nt, Homo sapiens
uuacccccugggagccccaa

SEQ ID NO: 484390 - RNA, 16 nt, Homo sapiens
uuauauaauuacauau

SEQ ID NO: 484391 - RNA, 16 nt, Homo sapiens
uuaugaaaaguacuaa

SEQ ID NO: 484392 - RNA, 13 nt, Homo sapiens
uucaagcaaagua

SEQ ID NO: 484393 - RNA, 15 nt, Homo sapiens
uucacagcaccaaaa

SEQ ID NO: 484394 - RNA, 21 nt, Homo sapiens
uucaccugggcugaggcaucc

SEQ ID NO: 484395 - RNA, 16 nt, Homo sapiens
uucagaaacagugagu

SEQ ID NO: 484396 - RNA, 18 nt, Homo sapiens
uucagaaaucaaacugcu

SEQ ID NO: 484397 - RNA, 13 nt, Homo sapiens
uuccuccaccugc

SEQ ID NO: 484398 - RNA, 19 nt, Homo sapiens
uucuaaaaauaaaaguauu

SEQ ID NO: 484399 - RNA, 14 nt, Homo sapiens
uucuaaugugccua

SEQ ID NO: 484400 - RNA, 18 nt, Homo sapiens
uucucagagugguucuga

SEQ ID NO: 484401 - RNA, 18 nt, Homo sapiens
uucugaaucaccuaccuu

SEQ ID NO: 484402 - RNA, 14 nt, Homo sapiens
uugauaacauggaa

SEQ ID NO: 484403 - RNA, 13 nt, Homo sapiens
uugggggggcucc

SEQ ID NO: 484404 - RNA, 19 nt, Homo sapiens
uuguuaagugcagucugau

SEQ ID NO: 484405 - RNA, 18 nt, Homo sapiens
uuguuacagcuacuauaa

SEQ ID NO: 484406 - RNA, 23 nt, Homo sapiens
uuuaaauauuaucuaacagacaa

SEQ ID NO: 484407 - RNA, 13 nt, Homo sapiens
uuuaccagaugau

SEQ ID NO: 484408 - RNA, 16 nt, Homo sapiens
uuuauaaaacuuugaa

SEQ ID NO: 484409 - RNA, 20 nt, Homo sapiens
uuuauuuugugaacacuuuu

SEQ ID NO: 484410 - RNA, 20 nt, Homo sapiens
uuucacacaauacaauaagu

SEQ ID NO: 484411 - RNA, 19 nt, Homo sapiens
uuucccuucuuacaaugca

SEQ ID NO: 484412 - RNA, 20 nt, Homo sapiens
uuucugccaccaaaggccag

SEQ ID NO: 484413 - RNA, 15 nt, Homo sapiens
uuugggguucaagaa

SEQ ID NO: 484414 - RNA, 17 nt, Homo sapiens
uuugugggaaauccaca

SEQ ID NO: 484415 - RNA, 16 nt, Homo sapiens
uuuuaaaaguuauuaa

SEQ ID NO: 484416 - RNA, 22 nt, Homo sapiens
uuuuaauuuaaucuuccaugga

SEQ ID NO: 484417 - RNA, 18 nt, Homo sapiens
uuuuaguuuguucuucag

SEQ ID NO: 484418 - RNA, 18 nt, Homo sapiens
uuuucacuucuaccuaca

SEQ ID NO: 484419 - RNA, 19 nt, Homo sapiens
uuuugaacauaaagccuug

SEQ ID NO: 484420 - RNA, 14 nt, Homo sapiens
uuuuuaaguguucu

SEQ ID NO: 484421 - RNA, 14 nt, Homo sapiens
cacugagcugaggg

SEQ ID NO: 484422 - RNA, 16 nt, Homo sapiens
cacugcccaaagugcu

SEQ ID NO: 484423 - RNA, 19 nt, Homo sapiens
cacuucccccauuggacac

SEQ ID NO: 484424 - RNA, 17 nt, Homo sapiens
cacuucuaccuacauau

SEQ ID NO: 484425 - RNA, 20 nt, Homo sapiens
cacuuuugaaaauguacaug

SEQ ID NO: 484426 - RNA, 14 nt, Homo sapiens
cagaaacagugagu

SEQ ID NO: 484427 - RNA, 18 nt, Homo sapiens
cagaaacagugaguuaaa

SEQ ID NO: 484428 - RNA, 19 nt, Homo sapiens
cagaaugcggccucugaga

SEQ ID NO: 484429 - RNA, 22 nt, Homo sapiens
cagaaugcggccucugagacau

SEQ ID NO: 484430 - RNA, 11 nt, Homo sapiens
cagacaagagu

SEQ ID NO: 484431 - RNA, 21 nt, Homo sapiens
cagacauuccuucuacaugua

SEQ ID NO: 484432 - RNA, 18 nt, Homo sapiens
cagaguacuggcugaugg

SEQ ID NO: 484433 - RNA, 19 nt, Homo sapiens
cagagucaaugaacuuucc

SEQ ID NO: 484434 - RNA, 17 nt, Homo sapiens
cagauaacuucuuuagg

SEQ ID NO: 484435 - RNA, 22 nt, Homo sapiens
cagaugggagugcccccaacag

SEQ ID NO: 484436 - RNA, 20 nt, Homo sapiens
cagaugggcauaugugucag

SEQ ID NO: 484437 - RNA, 15 nt, Homo sapiens
cagcacccucuccag

SEQ ID NO: 484438 - RNA, 17 nt, Homo sapiens
cagcacccucuccagau

SEQ ID NO: 484439 - RNA, 23 nt, Homo sapiens
cagccucccgaguagcugggauu

SEQ ID NO: 484440 - RNA, 18 nt, Homo sapiens
caggaggaaggcuuacac

SEQ ID NO: 484441 - RNA, 13 nt, Homo sapiens
caggaguacaccc

SEQ ID NO: 484442 - RNA, 19 nt, Homo sapiens
cagguucucuuugagucaa

SEQ ID NO: 484443 - RNA, 16 nt, Homo sapiens
caguaugcaaagcaau

SEQ ID NO: 484444 - RNA, 22 nt, Homo sapiens
cagucaucuagaauucacugag

SEQ ID NO: 484445 - RNA, 14 nt, Homo sapiens
cagugcaacacuga

SEQ ID NO: 484446 - RNA, 16 nt, Homo sapiens
cagugcuugaaugaag

SEQ ID NO: 484447 - RNA, 12 nt, Homo sapiens
caguggggcucu

SEQ ID NO: 484448 - RNA, 20 nt, Homo sapiens
caguuauuuuuaaacuguaa

SEQ ID NO: 484449 - RNA, 22 nt, Homo sapiens
caguuguguuccugacacucaa

SEQ ID NO: 484450 - RNA, 18 nt, Homo sapiens
cauaaagccuuggaugua

SEQ ID NO: 484451 - RNA, 21 nt, Homo sapiens
cauaaagccuuggauguauau

SEQ ID NO: 484452 - RNA, 16 nt, Homo sapiens
cauaaaguaugugcau

SEQ ID NO: 484453 - RNA, 17 nt, Homo sapiens
cauauuucaaaugauuu

SEQ ID NO: 484454 - RNA, 19 nt, Homo sapiens
cauauuuuauuauagucac

SEQ ID NO: 484455 - RNA, 17 nt, Homo sapiens
caucacaugcucaauga

SEQ ID NO: 484456 - RNA, 18 nt, Homo sapiens
caucugcauucccagcuc

SEQ ID NO: 484457 - RNA, 15 nt, Homo sapiens
cauguaaugacacuu

SEQ ID NO: 484458 - RNA, 18 nt, Homo sapiens
cauuaucuuugcuguuau

SEQ ID NO: 484459 - RNA, 17 nt, Homo sapiens
cauuuuaaugcaccuga

SEQ ID NO: 484460 - RNA, 17 nt, Homo sapiens
ccaaaauaaaucaucuu

SEQ ID NO: 484461 - RNA, 14 nt, Homo sapiens
ccacagcaggugcu

SEQ ID NO: 484462 - RNA, 19 nt, Homo sapiens
ccagcuagcugcagagcca

SEQ ID NO: 484463 - RNA, 17 nt, Homo sapiens
ccaggguggagugcagu

SEQ ID NO: 484464 - RNA, 19 nt, Homo sapiens
ccaguacaccccaccucuu

SEQ ID NO: 484465 - RNA, 20 nt, Homo sapiens
ccagugcaacacugaagcuc

SEQ ID NO: 484466 - RNA, 17 nt, Homo sapiens
ccaucuccucagcaccc

SEQ ID NO: 484467 - RNA, 17 nt, Homo sapiens
ccauuuuugaaaccaaa

SEQ ID NO: 484468 - RNA, 13 nt, Homo sapiens
cccacaguggaaa

SEQ ID NO: 484469 - RNA, 13 nt, Homo sapiens
cccagacuccuga

SEQ ID NO: 484470 - RNA, 19 nt, Homo sapiens
cccaggguggagugcagug

SEQ ID NO: 484471 - RNA, 23 nt, Homo sapiens
cccauuggacacguggugcauuu

SEQ ID NO: 484472 - RNA, 23 nt, Homo sapiens
ccccaacagcacccucuccagau

SEQ ID NO: 484473 - RNA, 24 nt, Homo sapiens
ccccacccugagcgccugggucca

SEQ ID NO: 484474 - RNA, 17 nt, Homo sapiens
ccccaugacauugcauu

SEQ ID NO: 484475 - RNA, 14 nt, Homo sapiens
cccuaggcaucaca

SEQ ID NO: 484476 - RNA, 15 nt, Homo sapiens
ccgggagacucugaa

SEQ ID NO: 484477 - RNA, 17 nt, Homo sapiens
ccuaaacuuacauuuaa

SEQ ID NO: 484478 - RNA, 23 nt, Homo sapiens
ccuaaggucauuaccacaggcca

SEQ ID NO: 484479 - RNA, 23 nt, Homo sapiens
ccuauggaagcauauuguuauua

SEQ ID NO: 484480 - RNA, 16 nt, Homo sapiens
ccucaagugauccucc

SEQ ID NO: 484481 - RNA, 19 nt, Homo sapiens
ccuccaugaauaucaguua

SEQ ID NO: 484482 - RNA, 22 nt, Homo sapiens
ccuccuagacucugugaucuga

SEQ ID NO: 484483 - RNA, 18 nt, Homo sapiens
ccucugggcacugguaau

SEQ ID NO: 484484 - RNA, 17 nt, Homo sapiens
ccucugugccuugccac

SEQ ID NO: 484485 - RNA, 22 nt, Homo sapiens
ccugaagguguuuuucauucac

SEQ ID NO: 484486 - RNA, 12 nt, Homo sapiens
ccugauuacaau

SEQ ID NO: 484487 - RNA, 21 nt, Homo sapiens
ccuggcaaagaugaucaguau

SEQ ID NO: 484488 - RNA, 19 nt, Homo sapiens
ccuuuacucauagcacuuc

SEQ ID NO: 484489 - RNA, 19 nt, Homo sapiens
cgcuagacgcuucauccca

SEQ ID NO: 484490 - RNA, 19 nt, Homo sapiens
cgggacaguaaacacucca

SEQ ID NO: 484491 - RNA, 16 nt, Homo sapiens
cgugugggcaauguuc

SEQ ID NO: 484492 - RNA, 21 nt, Homo sapiens
cuaaagaggaaggaccaagga

SEQ ID NO: 484493 - RNA, 12 nt, Homo sapiens
cuaaagggacua

SEQ ID NO: 484494 - RNA, 13 nt, Homo sapiens
cuaaauagcacuu

SEQ ID NO: 484495 - RNA, 16 nt, Homo sapiens
cuaacagugugauuca

SEQ ID NO: 484496 - RNA, 23 nt, Homo sapiens
cuaggggucuuguuaagugcagu

SEQ ID NO: 484497 - RNA, 23 nt, Homo sapiens
cuaguuguaauuuuuuuguggga

SEQ ID NO: 484498 - RNA, 20 nt, Homo sapiens
cucacacgcgaaaguaucac

SEQ ID NO: 484499 - RNA, 22 nt, Homo sapiens
cucaccagcgcuugaagccuga

SEQ ID NO: 484500 - RNA, 20 nt, Homo sapiens
cucagccucccgaguagcug

SEQ ID NO: 484501 - RNA, 19 nt, Homo sapiens
cucaggggcccuggagcag

SEQ ID NO: 484502 - RNA, 12 nt, Homo sapiens
cucauagcacuu

SEQ ID NO: 484503 - RNA, 18 nt, Homo sapiens
cuccagagggaauugcag

SEQ ID NO: 484504 - RNA, 15 nt, Homo sapiens
cucugaucaaguauu

SEQ ID NO: 484505 - RNA, 20 nt, Homo sapiens
cugaacugaaaacaagccau

SEQ ID NO: 484506 - RNA, 19 nt, Homo sapiens
cugaauaaaaagcuguucu

SEQ ID NO: 484507 - RNA, 20 nt, Homo sapiens
cugaauguuagauaguuacu

SEQ ID NO: 484508 - RNA, 21 nt, Homo sapiens
cugaguuuuguuucacuuuga

SEQ ID NO: 484509 - RNA, 12 nt, Homo sapiens
cugcagcugucu

SEQ ID NO: 484510 - RNA, 17 nt, Homo sapiens
cugcccgcagaccucug

SEQ ID NO: 484511 - RNA, 13 nt, Homo sapiens
cugggcugaggca

SEQ ID NO: 484512 - RNA, 12 nt, Homo sapiens
cugguucuaacu

SEQ ID NO: 484513 - RNA, 22 nt, Homo sapiens
cuguauuugccggugccuagga

SEQ ID NO: 484514 - RNA, 16 nt, Homo sapiens
cugugaucugagggua

SEQ ID NO: 484515 - RNA, 22 nt, Homo sapiens
cuguguuuuuucugccaccaaa

SEQ ID NO: 484516 - RNA, 14 nt, Homo sapiens
cuguuauugacagc

SEQ ID NO: 484517 - RNA, 13 nt, Homo sapiens
cuguugacaaaug

SEQ ID NO: 484518 - RNA, 22 nt, Homo sapiens
cuguugacuggcugugugaccu

SEQ ID NO: 484519 - RNA, 17 nt, Homo sapiens
cuuaaggggcagcuucu

SEQ ID NO: 484520 - RNA, 20 nt, Homo sapiens
cuuaauaaaauaauucucaa

SEQ ID NO: 484521 - RNA, 20 nt, Homo sapiens
cuucacgauuaacugugaaa

SEQ ID NO: 484522 - RNA, 13 nt, Homo sapiens
cuucauuuagcca

SEQ ID NO: 484523 - RNA, 14 nt, Homo sapiens
cuucauuuagccaa

SEQ ID NO: 484524 - RNA, 20 nt, Homo sapiens
cuuccagugcaacacugaag

SEQ ID NO: 484525 - RNA, 22 nt, Homo sapiens
cuucccccuuuacucauagcac

SEQ ID NO: 484526 - RNA, 20 nt, Homo sapiens
cuucuaaccugaacugaugg

SEQ ID NO: 484527 - RNA, 13 nt, Homo sapiens
cuucuauuagcca

SEQ ID NO: 484528 - RNA, 16 nt, Homo sapiens
cuucuuacaaugcauu

SEQ ID NO: 484529 - RNA, 16 nt, Homo sapiens
cuugguaaucaugaaa

SEQ ID NO: 484530 - RNA, 17 nt, Homo sapiens
cuugucuuauuugcuau

SEQ ID NO: 484531 - RNA, 15 nt, Homo sapiens
cuugugaacccaaag

SEQ ID NO: 484532 - RNA, 15 nt, Homo sapiens
cuuguuaagugcagu

SEQ ID NO: 484533 - RNA, 23 nt, Homo sapiens
cuuuauuauggucauauuucaca

SEQ ID NO: 484534 - RNA, 18 nt, Homo sapiens
cuuugcuucucucucuaa

SEQ ID NO: 484535 - RNA, 19 nt, Homo sapiens
cuuugugcagauucuuuac

SEQ ID NO: 484536 - RNA, 15 nt, Homo sapiens
cuuuuauacaauaau

SEQ ID NO: 484537 - RNA, 23 nt, Homo sapiens
gaaaaauauugaacucaaugaua

SEQ ID NO: 484538 - RNA, 17 nt, Homo sapiens
gaaaaguacuaauagaa

SEQ ID NO: 484539 - RNA, 23 nt, Homo sapiens
gaaacauuaacucuaacugugac

SEQ ID NO: 484540 - RNA, 22 nt, Homo sapiens
gaaacucauaauagacuuccca

SEQ ID NO: 484541 - RNA, 15 nt, Homo sapiens
gaaagaggcagggac

SEQ ID NO: 484542 - RNA, 22 nt, Homo sapiens
gaaagcaucugagcuaacuuau

SEQ ID NO: 484543 - RNA, 18 nt, Homo sapiens
gaaaguauucuaagccaa

SEQ ID NO: 484544 - RNA, 16 nt, Homo sapiens
gaaagugaaagcaaau

SEQ ID NO: 484545 - RNA, 14 nt, Homo sapiens
gaaaucaaacugcu

SEQ ID NO: 484546 - RNA, 15 nt, Homo sapiens
gaaaucaaacugcuu

SEQ ID NO: 484547 - RNA, 16 nt, Homo sapiens
gaaaucagaguuuuca

SEQ ID NO: 484548 - RNA, 12 nt, Homo sapiens
gaacacugagaa

SEQ ID NO: 484549 - RNA, 20 nt, Homo sapiens
gaacacuuuugaaaauguac

SEQ ID NO: 484550 - RNA, 23 nt, Homo sapiens
gaacauaaagccuuggauguaua

SEQ ID NO: 484551 - RNA, 19 nt, Homo sapiens
gaacugaaaacaagccaug

SEQ ID NO: 484552 - RNA, 13 nt, Homo sapiens
gaacuggagccau

SEQ ID NO: 484553 - RNA, 14 nt, Homo sapiens
gaagaaagugaaag

SEQ ID NO: 484554 - RNA, 12 nt, Homo sapiens
gaagacacugaa

SEQ ID NO: 484555 - RNA, 13 nt, Homo sapiens
gaagcuuccauaa

SEQ ID NO: 484556 - RNA, 15 nt, Homo sapiens
gaagcuuccauaaca

SEQ ID NO: 484557 - RNA, 20 nt, Homo sapiens
gaaggaggcuaugcucaggg

SEQ ID NO: 484558 - RNA, 19 nt, Homo sapiens
gaaucuacuuuaauuuauu

SEQ ID NO: 484559 - RNA, 22 nt, Homo sapiens
gaaucuuuuucagaaacaguga

SEQ ID NO: 484560 - RNA, 23 nt, Homo sapiens
gaaucuuuuucagaaacagugag

SEQ ID NO: 484561 - RNA, 21 nt, Homo sapiens
gaaugaaagcuccucgagggc

SEQ ID NO: 484562 - RNA, 19 nt, Homo sapiens
gaaugcggccucugagaca

SEQ ID NO: 484563 - RNA, 24 nt, Homo sapiens
gacagaugggcauaugugucagug

SEQ ID NO: 484564 - RNA, 16 nt, Homo sapiens
gacccagcacugccca

SEQ ID NO: 484565 - RNA, 15 nt, Homo sapiens
gacccaggcaccugc

SEQ ID NO: 484566 - RNA, 19 nt, Homo sapiens
gacccaggcaccugcauuu

SEQ ID NO: 484567 - RNA, 13 nt, Homo sapiens
gaccuaaagggac

SEQ ID NO: 484568 - RNA, 18 nt, Homo sapiens
gacuaccucugugccuug

SEQ ID NO: 484569 - RNA, 14 nt, Homo sapiens
gacuguccccuuga

SEQ ID NO: 484570 - RNA, 19 nt, Homo sapiens
gagaguacaccccaacagc

SEQ ID NO: 484571 - RNA, 12 nt, Homo sapiens
gagagucuccca

SEQ ID NO: 484572 - RNA, 15 nt, Homo sapiens
gagauuccugagcca

SEQ ID NO: 484573 - RNA, 19 nt, Homo sapiens
gagauuccugagccagugu

SEQ ID NO: 484574 - RNA, 14 nt, Homo sapiens
gaggaaacuuugau

SEQ ID NO: 484575 - RNA, 23 nt, Homo sapiens
gaggaaagguuugagaagcacug

SEQ ID NO: 484576 - RNA, 19 nt, Homo sapiens
gaggacauucucugaccua

SEQ ID NO: 484577 - RNA, 20 nt, Homo sapiens
gagggcagggacuuuggucu

SEQ ID NO: 484578 - RNA, 16 nt, Homo sapiens
gaguaacacaaaguga

SEQ ID NO: 484579 - RNA, 19 nt, Homo sapiens
gaguacaccccaacagcac

SEQ ID NO: 484580 - RNA, 20 nt, Homo sapiens
gagucaauagcuugucuucg

SEQ ID NO: 484581 - RNA, 15 nt, Homo sapiens
gagugcaguggugcg

SEQ ID NO: 484582 - RNA, 17 nt, Homo sapiens
gagugcccccaacagca

SEQ ID NO: 484583 - RNA, 18 nt, Homo sapiens
gagugguauauacaagua

SEQ ID NO: 484584 - RNA, 12 nt, Homo sapiens
gauaacauggaa

SEQ ID NO: 484585 - RNA, 19 nt, Homo sapiens
gauaugaugucccuaugga

SEQ ID NO: 484586 - RNA, 15 nt, Homo sapiens
gaucucggcucagug

SEQ ID NO: 484587 - RNA, 14 nt, Homo sapiens
gaucuugguccugu

SEQ ID NO: 484588 - RNA, 18 nt, Homo sapiens
gaucuugguccuguguuu

SEQ ID NO: 484589 - RNA, 15 nt, Homo sapiens
gaugaaacauuaacu

SEQ ID NO: 484590 - RNA, 17 nt, Homo sapiens
gaugagacagacauuca

SEQ ID NO: 484591 - RNA, 13 nt, Homo sapiens
gaugagaguacac

SEQ ID NO: 484592 - RNA, 19 nt, Homo sapiens
gaugcuaccuugugaccca

SEQ ID NO: 484593 - RNA, 20 nt, Homo sapiens
gaugggcauaugugucagug

SEQ ID NO: 484594 - RNA, 15 nt, Homo sapiens
gauuuauaccuaacu

SEQ ID NO: 484595 - RNA, 15 nt, Homo sapiens
gcaaaaaaguacuua

SEQ ID NO: 484596 - RNA, 16 nt, Homo sapiens
gcacugcccaaagugc

SEQ ID NO: 484597 - RNA, 17 nt, Homo sapiens
gcacugcccaaagugcu

SEQ ID NO: 484598 - RNA, 20 nt, Homo sapiens
gcagagccacccuguguuga

SEQ ID NO: 484599 - RNA, 20 nt, Homo sapiens
gcagaguacuggcugaugga

SEQ ID NO: 484600 - RNA, 23 nt, Homo sapiens
gcagcaggacuguccccuugaag

SEQ ID NO: 484601 - RNA, 17 nt, Homo sapiens
gcagcuucuauuagcca

SEQ ID NO: 484602 - RNA, 20 nt, Homo sapiens
gcaggugcugagcaaaggga

SEQ ID NO: 484603 - RNA, 18 nt, Homo sapiens
gccacauggggcugggca

SEQ ID NO: 484604 - RNA, 17 nt, Homo sapiens
gccacccuguguugaca

SEQ ID NO: 484605 - RNA, 21 nt, Homo sapiens
gccaugacuugagaaacaaau

SEQ ID NO: 484606 - RNA, 15 nt, Homo sapiens
gcccacagcaggugc

SEQ ID NO: 484607 - RNA, 12 nt, Homo sapiens
gccggguacuga

SEQ ID NO: 484608 - RNA, 22 nt, Homo sapiens
gccuggaguaacacaaagugaa

SEQ ID NO: 484609 - RNA, 20 nt, Homo sapiens
gccuguaugcaacaggcacu

SEQ ID NO: 484610 - RNA, 17 nt, Homo sapiens
gccuguggccuuugcaa

SEQ ID NO: 484611 - RNA, 18 nt, Homo sapiens
gcgauucuccugccucag

SEQ ID NO: 484612 - RNA, 18 nt, Homo sapiens
gcuauagaaaacaauaca

SEQ ID NO: 484613 - RNA, 21 nt, Homo sapiens
gcuaugcucaggggcccugga

SEQ ID NO: 484614 - RNA, 19 nt, Homo sapiens
gcuucaucccacaaucuua

SEQ ID NO: 484615 - RNA, 15 nt, Homo sapiens
gcuucuauuagccag

SEQ ID NO: 484616 - RNA, 20 nt, Homo sapiens
gcuucuauuagccagucuuu

SEQ ID NO: 484617 - RNA, 19 nt, Homo sapiens
gcuugucuucguccaucug

SEQ ID NO: 484618 - RNA, 22 nt, Homo sapiens
ggaaaauaggaagugaacccau

SEQ ID NO: 484619 - RNA, 15 nt, Homo sapiens
ggaacacccccauga

SEQ ID NO: 484620 - RNA, 12 nt, Homo sapiens
ggacacguggug

SEQ ID NO: 484621 - RNA, 16 nt, Homo sapiens
ggacaguaaacacucc

SEQ ID NO: 484622 - RNA, 19 nt, Homo sapiens
ggacccaggcaccugcauu

SEQ ID NO: 484623 - RNA, 23 nt, Homo sapiens
ggacuaccucugugccuugccac

SEQ ID NO: 484624 - RNA, 16 nt, Homo sapiens
ggagcagccaccccau

SEQ ID NO: 484625 - RNA, 23 nt, Homo sapiens
ggaguaggugggggaacacugag

SEQ ID NO: 484626 - RNA, 21 nt, Homo sapiens
ggcaauguucccccucuccuc

SEQ ID NO: 484627 - RNA, 19 nt, Homo sapiens
ggcuuuaaaacuuauccuc

SEQ ID NO: 484628 - RNA, 15 nt, Homo sapiens
gggagagucucccag

SEQ ID NO: 484629 - RNA, 21 nt, Homo sapiens
gggcucccguggccuguagaa

SEQ ID NO: 484630 - RNA, 16 nt, Homo sapiens
ggguuuugaacauaaa

SEQ ID NO: 484631 - RNA, 21 nt, Homo sapiens
ggucacugaaggccuggccca

SEQ ID NO: 484632 - RNA, 18 nt, Homo sapiens
ggucuauugucuguauuu

SEQ ID NO: 484633 - RNA, 18 nt, Homo sapiens
ggucuuguuaagugcagu

SEQ ID NO: 484634 - RNA, 16 nt, Homo sapiens
guaaauaaacaaguca

SEQ ID NO: 484635 - RNA, 20 nt, Homo sapiens
guaaauauagugaagcaauu

SEQ ID NO: 484636 - RNA, 19 nt, Homo sapiens
guaacuugcaccucugacc

SEQ ID NO: 484637 - RNA, 19 nt, Homo sapiens
guacaccccaacagcaccc

SEQ ID NO: 484638 - RNA, 24 nt, Homo sapiens
guacauguuccuuuguaauugaca

SEQ ID NO: 484639 - RNA, 23 nt, Homo sapiens
guacccuaaggucauuaccacag

SEQ ID NO: 484640 - RNA, 15 nt, Homo sapiens
guauaugucaucuca

SEQ ID NO: 484641 - RNA, 23 nt, Homo sapiens
guaugacucccaaauuuucacau

SEQ ID NO: 484642 - RNA, 20 nt, Homo sapiens
guauuguauaaguccuugca

SEQ ID NO: 484643 - RNA, 19 nt, Homo sapiens
gucaaugaacuuuccacau

SEQ ID NO: 484644 - RNA, 17 nt, Homo sapiens
gucccuauggaagcaua

SEQ ID NO: 484645 - RNA, 16 nt, Homo sapiens
guccgaggggcgggac

SEQ ID NO: 484646 - RNA, 20 nt, Homo sapiens
guccuguguuuuuucugcca

SEQ ID NO: 484647 - RNA, 18 nt, Homo sapiens
gucugaugagaacucuga

SEQ ID NO: 484648 - RNA, 12 nt, Homo sapiens
gucugcacucua

SEQ ID NO: 484649 - RNA, 13 nt, Homo sapiens
gucugcacucuaa

SEQ ID NO: 484650 - RNA, 23 nt, Homo sapiens
gugaaacucauaauagacuuccc

SEQ ID NO: 484651 - RNA, 22 nt, Homo sapiens
gugaacacuuuugaaaauguac

SEQ ID NO: 484652 - RNA, 19 nt, Homo sapiens
gugcaguggugcgaucucg

SEQ ID NO: 484653 - RNA, 14 nt, Homo sapiens
gugccuugccacau

SEQ ID NO: 484654 - RNA, 15 nt, Homo sapiens
guggguuuugaacau

SEQ ID NO: 484655 - RNA, 17 nt, Homo sapiens
guuauuauauaauuaca

SEQ ID NO: 484656 - RNA, 20 nt, Homo sapiens
guucaagaaguaaucaguau

SEQ ID NO: 484657 - RNA, 23 nt, Homo sapiens
guucaauaaaaguaaacucagca

SEQ ID NO: 484658 - RNA, 23 nt, Homo sapiens
uaaaaaaaaaacguauugcauuu

SEQ ID NO: 484659 - RNA, 14 nt, Homo sapiens
uaaaaagcagagcu

SEQ ID NO: 484660 - RNA, 12 nt, Homo sapiens
uaaaacagucau

SEQ ID NO: 484661 - RNA, 15 nt, Homo sapiens
uaaaacauuuucaca

SEQ ID NO: 484662 - RNA, 20 nt, Homo sapiens
uaaaacauuuucacacaaua

SEQ ID NO: 484663 - RNA, 15 nt, Homo sapiens
uaaaauaaauuauua

SEQ ID NO: 484664 - RNA, 17 nt, Homo sapiens
uaaacaagucaaagacu

SEQ ID NO: 484665 - RNA, 17 nt, Homo sapiens
uaaacacuccacauucu

SEQ ID NO: 484666 - RNA, 20 nt, Homo sapiens
uaaacagguuuuuaguuugu

SEQ ID NO: 484667 - RNA, 14 nt, Homo sapiens
uaaacuuacauuua

SEQ ID NO: 484668 - RNA, 15 nt, Homo sapiens
uaaagcuuugugcag

SEQ ID NO: 484669 - RNA, 16 nt, Homo sapiens
uaaagcuuugugcaga

SEQ ID NO: 484670 - RNA, 15 nt, Homo sapiens
uaaagggacuaccuc

SEQ ID NO: 484671 - RNA, 14 nt, Homo sapiens
uaaaguaugugcau

SEQ ID NO: 484672 - RNA, 22 nt, Homo sapiens
uaaauuauagaaucuacuuuaa

SEQ ID NO: 484673 - RNA, 21 nt, Homo sapiens
uaaauucucauaaguagcauu

SEQ ID NO: 484674 - RNA, 18 nt, Homo sapiens
uaacccuaggcaucacau

SEQ ID NO: 484675 - RNA, 15 nt, Homo sapiens
uaacugugacaaaga

SEQ ID NO: 484676 - RNA, 23 nt, Homo sapiens
uaacugugacaaagaagaccaca

SEQ ID NO: 484677 - RNA, 13 nt, Homo sapiens
uaagcauaacuua

SEQ ID NO: 484678 - RNA, 17 nt, Homo sapiens
uaagccuuccacacuca

SEQ ID NO: 484679 - RNA, 20 nt, Homo sapiens
uaaggaauaugagcuuuaug

SEQ ID NO: 484680 - RNA, 14 nt, Homo sapiens
uaagugacuugccc

SEQ ID NO: 484681 - RNA, 12 nt, Homo sapiens
uaauauugcaag

SEQ ID NO: 484682 - RNA, 19 nt, Homo sapiens
uaaucaugaaagcaucuga

SEQ ID NO: 484683 - RNA, 22 nt, Homo sapiens
uaaucccaagaucugugcagcc

SEQ ID NO: 484684 - RNA, 15 nt, Homo sapiens
uaauuuucaagcaaa

SEQ ID NO: 484685 - RNA, 16 nt, Homo sapiens
uaauuuucaagcaaag

SEQ ID NO: 484686 - RNA, 19 nt, Homo sapiens
uacaaguagauccugagaa

SEQ ID NO: 484687 - RNA, 19 nt, Homo sapiens
uacaaugcauucugaggua

SEQ ID NO: 484688 - RNA, 14 nt, Homo sapiens
uacacacagcagua

SEQ ID NO: 484689 - RNA, 19 nt, Homo sapiens
uacaccccaacagcacccu

SEQ ID NO: 484690 - RNA, 14 nt, Homo sapiens
uacaccccaccucu

SEQ ID NO: 484691 - RNA, 16 nt, Homo sapiens
uaccugggaccuccac

SEQ ID NO: 484692 - RNA, 21 nt, Homo sapiens
uaccuuuguuacagcuacuau

SEQ ID NO: 484693 - RNA, 18 nt, Homo sapiens
uaccuuuugcuguggcaa

SEQ ID NO: 484694 - RNA, 21 nt, Homo sapiens
uagaauagccuguggccuuug

SEQ ID NO: 484695 - RNA, 20 nt, Homo sapiens
uagaauucacugaguuuugu

SEQ ID NO: 484696 - RNA, 17 nt, Homo sapiens
uagacuucccacucuag

SEQ ID NO: 484697 - RNA, 18 nt, Homo sapiens
uaggugggggaacacuga

SEQ ID NO: 484698 - RNA, 20 nt, Homo sapiens
uaggugggggaacacugaga

SEQ ID NO: 484699 - RNA, 16 nt, Homo sapiens
uaguaagagauuccug

SEQ ID NO: 484700 - RNA, 17 nt, Homo sapiens
uauaaauauacauauaa

SEQ ID NO: 484701 - RNA, 23 nt, Homo sapiens
uauacaauaauugaaguguuccc

SEQ ID NO: 484702 - RNA, 15 nt, Homo sapiens
uauacauuaacuuca

SEQ ID NO: 484703 - RNA, 18 nt, Homo sapiens
uauauacaaguagauccu

SEQ ID NO: 484704 - RNA, 18 nt, Homo sapiens
uaucacuuccacugcacc

SEQ ID NO: 484705 - RNA, 22 nt, Homo sapiens
uaucauuaucuuugcuguuauu

SEQ ID NO: 484706 - RNA, 18 nt, Homo sapiens
uauccuccaugaauauca

SEQ ID NO: 484707 - RNA, 13 nt, Homo sapiens
uaucuaacagaca

SEQ ID NO: 484708 - RNA, 22 nt, Homo sapiens
uaugauuagagggaugagacag

SEQ ID NO: 484709 - RNA, 17 nt, Homo sapiens
uauuaucuaacagacaa

SEQ ID NO: 484710 - RNA, 19 nt, Homo sapiens
uauucccuucuaaccugaa

SEQ ID NO: 484711 - RNA, 14 nt, Homo sapiens
uauucuaagccaag

SEQ ID NO: 484712 - RNA, 19 nt, Homo sapiens
uauugacagcgauauaauu

SEQ ID NO: 484713 - RNA, 18 nt, Homo sapiens
uauuuuaaucuaauucua

SEQ ID NO: 484714 - RNA, 10 nt, Homo sapiens
ucaaacugcu

SEQ ID NO: 484715 - RNA, 14 nt, Homo sapiens
ucaauaaacaguca

SEQ ID NO: 484716 - RNA, 18 nt, Homo sapiens
ucacacaauacaauaagu

SEQ ID NO: 484717 - RNA, 14 nt, Homo sapiens
ucacagcaccaaaa

SEQ ID NO: 484718 - RNA, 18 nt, Homo sapiens
ucaccugggcugaggcau

SEQ ID NO: 484719 - RNA, 14 nt, Homo sapiens
ucagaaacagugag

SEQ ID NO: 484720 - RNA, 22 nt, Homo sapiens
ucagauugauagggaguuuuaa

SEQ ID NO: 484721 - RNA, 20 nt, Homo sapiens
ucagcaaaaaaguacuuaaa

SEQ ID NO: 484722 - RNA, 19 nt, Homo sapiens
ucaggaggaaggcuuacac

SEQ ID NO: 484723 - RNA, 22 nt, Homo sapiens
ucagucugaugagaacucugag

SEQ ID NO: 484724 - RNA, 19 nt, Homo sapiens
ucagugcaaagauuugcuu

SEQ ID NO: 484725 - RNA, 16 nt, Homo sapiens
ucaucaggacccugga

SEQ ID NO: 484726 - RNA, 18 nt, Homo sapiens
ucaucccacaaucuuaag

SEQ ID NO: 484727 - RNA, 13 nt, Homo sapiens
ucauccugcaggc

SEQ ID NO: 484728 - RNA, 13 nt, Homo sapiens
ucaucucagugcu

SEQ ID NO: 484729 - RNA, 18 nt, Homo sapiens
ucaucucagugcuguaaa

SEQ ID NO: 484730 - RNA, 14 nt, Homo sapiens
ucauggcaguaauu

SEQ ID NO: 484731 - RNA, 17 nt, Homo sapiens
ucauuaucaguccaaag

SEQ ID NO: 484732 - RNA, 22 nt, Homo sapiens
ucauuguucuugugaacccaaa

SEQ ID NO: 484733 - RNA, 17 nt, Homo sapiens
uccagagggaauugcag

SEQ ID NO: 484734 - RNA, 17 nt, Homo sapiens
ucccacguucuguuaau

SEQ ID NO: 484735 - RNA, 17 nt, Homo sapiens
ucccacucuagggcagu

SEQ ID NO: 484736 - RNA, 21 nt, Homo sapiens
ucccacucuagggcaguggag

SEQ ID NO: 484737 - RNA, 17 nt, Homo sapiens
ucccaggaguacacccc

SEQ ID NO: 484738 - RNA, 15 nt, Homo sapiens
uccccggaguucagu

SEQ ID NO: 484739 - RNA, 17 nt, Homo sapiens
ucccuauggaagcauau

SEQ ID NO: 484740 - RNA, 21 nt, Homo sapiens
uccuccuagacucugugaucu

SEQ ID NO: 484741 - RNA, 15 nt, Homo sapiens
uccugagaaguaccu

SEQ ID NO: 484742 - RNA, 19 nt, Homo sapiens
uccugcuuuaaccacccca

SEQ ID NO: 484743 - RNA, 14 nt, Homo sapiens
uccuucuacaugua

SEQ ID NO: 484744 - RNA, 15 nt, Homo sapiens
ucggcucagugcaac

SEQ ID NO: 484745 - RNA, 17 nt, Homo sapiens
ucuaaaaugaguuaccu

SEQ ID NO: 484746 - RNA, 14 nt, Homo sapiens
ucuaaauagcacuu

SEQ ID NO: 484747 - RNA, 16 nt, Homo sapiens
ucuaaauagcacuuuu

SEQ ID NO: 484748 - RNA, 17 nt, Homo sapiens
ucuaacugugacaaaga

SEQ ID NO: 484749 - RNA, 19 nt, Homo sapiens
ucuaaggaauaugagcuuu

SEQ ID NO: 484750 - RNA, 22 nt, Homo sapiens
ucuaaggaauaugagcuuuaug

SEQ ID NO: 484751 - RNA, 19 nt, Homo sapiens
ucuauugucuguauuugcc

SEQ ID NO: 484752 - RNA, 22 nt, Homo sapiens
ucucagagugguucugagauua

SEQ ID NO: 484753 - RNA, 23 nt, Homo sapiens
ucugagcagugcuugaaugaagu

SEQ ID NO: 484754 - RNA, 14 nt, Homo sapiens
ucugccaccaaagg

SEQ ID NO: 484755 - RNA, 16 nt, Homo sapiens
ucuuaucauauuucaa

SEQ ID NO: 484756 - RNA, 16 nt, Homo sapiens
ucuucaguuuuucacu

SEQ ID NO: 484757 - RNA, 14 nt, Homo sapiens
ugaaaguauucuaa

SEQ ID NO: 484758 - RNA, 15 nt, Homo sapiens
ugaagacacugaaau

SEQ ID NO: 484759 - RNA, 16 nt, Homo sapiens
ugaagcaaacacauua

SEQ ID NO: 484760 - RNA, 22 nt, Homo sapiens
ugaaucaugguuuuucuuagua

SEQ ID NO: 484761 - RNA, 15 nt, Homo sapiens
ugaccgaacacugca

SEQ ID NO: 484762 - RNA, 14 nt, Homo sapiens
ugagaaguaccuuu

SEQ ID NO: 484763 - RNA, 15 nt, Homo sapiens
ugagacagacauuca

SEQ ID NO: 484764 - RNA, 19 nt, Homo sapiens
acacauuaagccuuccaca

SEQ ID NO: 484765 - RNA, 14 nt, Homo sapiens
acacgcgaaaguau

SEQ ID NO: 484766 - RNA, 19 nt, Homo sapiens
acacucaauaaacagucac

SEQ ID NO: 484767 - RNA, 15 nt, Homo sapiens
acacugaaauauaca

SEQ ID NO: 484768 - RNA, 22 nt, Homo sapiens
acacugaaauauacacacagca

SEQ ID NO: 484769 - RNA, 14 nt, Homo sapiens
acacugaagcucuu

SEQ ID NO: 484770 - RNA, 19 nt, Homo sapiens
acagcacccucuccagaug

SEQ ID NO: 484771 - RNA, 12 nt, Homo sapiens
acagcaguagca

SEQ ID NO: 484772 - RNA, 15 nt, Homo sapiens
acaguaaacacucca

SEQ ID NO: 484773 - RNA, 13 nt, Homo sapiens
acagucacuggaa

SEQ ID NO: 484774 - RNA, 17 nt, Homo sapiens
acaugcucaaugacucu

SEQ ID NO: 484775 - RNA, 13 nt, Homo sapiens
acauguaaugaca

SEQ ID NO: 484776 - RNA, 21 nt, Homo sapiens
acauucuucaguuuuucacuu

SEQ ID NO: 484777 - RNA, 20 nt, Homo sapiens
acauugaugacuggcuucau

SEQ ID NO: 484778 - RNA, 19 nt, Homo sapiens
acauuuaaaagacagacau

SEQ ID NO: 484779 - RNA, 19 nt, Homo sapiens
accauuuuugaaaccaaac

SEQ ID NO: 484780 - RNA, 20 nt, Homo sapiens
acccacaguggaaagacagc

SEQ ID NO: 484781 - RNA, 23 nt, Homo sapiens
uuaacugugaaauguacgucauu

SEQ ID NO: 484782 - RNA, 15 nt, Homo sapiens
uuaagauaugauguc

SEQ ID NO: 484783 - RNA, 17 nt, Homo sapiens
uuaagguucaagacaga

SEQ ID NO: 484784 - RNA, 16 nt, Homo sapiens
uuaauuguuaagauau

SEQ ID NO: 484785 - RNA, 15 nt, Homo sapiens
uuacaagagaagaaa

SEQ ID NO: 484786 - RNA, 18 nt, Homo sapiens
uuacagcugagcacauuc

SEQ ID NO: 484787 - RNA, 16 nt, Homo sapiens
uuacauuuaaaagaca

SEQ ID NO: 484788 - RNA, 19 nt, Homo sapiens
uuacccaggguggagugca

SEQ ID NO: 484789 - RNA, 14 nt, Homo sapiens
uuacuguggauaaa

SEQ ID NO: 484790 - RNA, 18 nt, Homo sapiens
uuauacauuaacuucagc

SEQ ID NO: 484791 - RNA, 12 nt, Homo sapiens
uuaucaguccaa

SEQ ID NO: 484792 - RNA, 17 nt, Homo sapiens
uuaugaaaaguacuaau

SEQ ID NO: 484793 - RNA, 16 nt, Homo sapiens
uuauguaauaauguga

SEQ ID NO: 484794 - RNA, 18 nt, Homo sapiens
uuauuauuuaaacaucag

SEQ ID NO: 484795 - RNA, 18 nt, Homo sapiens
uucaaacuuccagugcaa

SEQ ID NO: 484796 - RNA, 19 nt, Homo sapiens
uucaauaaaaguaaacuca

SEQ ID NO: 484797 - RNA, 16 nt, Homo sapiens
uucacagcaccaaaau

SEQ ID NO: 484798 - RNA, 20 nt, Homo sapiens
uucaccaucuguauauacaa

SEQ ID NO: 484799 - RNA, 19 nt, Homo sapiens
uucagaaaucaaacugcuu

SEQ ID NO: 484800 - RNA, 21 nt, Homo sapiens
uucaggaacacccccaugaca

SEQ ID NO: 484801 - RNA, 18 nt, Homo sapiens
uucaguuuuaccagauga

SEQ ID NO: 484802 - RNA, 15 nt, Homo sapiens
uucaucccacaaucu

SEQ ID NO: 484803 - RNA, 15 nt, Homo sapiens
uucauguaauaaaca

SEQ ID NO: 484804 - RNA, 13 nt, Homo sapiens
uucauuuagccaa

SEQ ID NO: 484805 - RNA, 18 nt, Homo sapiens
uucccacucuagggcagu

SEQ ID NO: 484806 - RNA, 15 nt, Homo sapiens
uucccaggaguacac

SEQ ID NO: 484807 - RNA, 15 nt, Homo sapiens
uucccugcuuaauga

SEQ ID NO: 484808 - RNA, 18 nt, Homo sapiens
uucuaaggaauaugagcu

SEQ ID NO: 484809 - RNA, 13 nt, Homo sapiens
uucuacauguaau

SEQ ID NO: 484810 - RNA, 19 nt, Homo sapiens
uucuuuaggggaaguaaaa

SEQ ID NO: 484811 - RNA, 21 nt, Homo sapiens
uugaaauaauuuucaagcaaa

SEQ ID NO: 484812 - RNA, 18 nt, Homo sapiens
uugacaaaugacagaucu

SEQ ID NO: 484813 - RNA, 13 nt, Homo sapiens
uugagaagcacug

SEQ ID NO: 484814 - RNA, 11 nt, Homo sapiens
uugagacagag

SEQ ID NO: 484815 - RNA, 21 nt, Homo sapiens
uugagcucugcagcccaggga

SEQ ID NO: 484816 - RNA, 19 nt, Homo sapiens
uugauaggauguggauuaa

SEQ ID NO: 484817 - RNA, 21 nt, Homo sapiens
uugcaaggcaaagacuauucc

SEQ ID NO: 484818 - RNA, 17 nt, Homo sapiens
uugcauauguaugacuc

SEQ ID NO: 484819 - RNA, 23 nt, Homo sapiens
uugcucaagaggaaaauccaaaa

SEQ ID NO: 484820 - RNA, 24 nt, Homo sapiens
uugcuugguggaugaaaugucagu

SEQ ID NO: 484821 - RNA, 14 nt, Homo sapiens
uugguggguuuuga

SEQ ID NO: 484822 - RNA, 20 nt, Homo sapiens
uuguaaauauagugaagcaa

SEQ ID NO: 484823 - RNA, 14 nt, Homo sapiens
uuguuaagugcagu

SEQ ID NO: 484824 - RNA, 13 nt, Homo sapiens
uuguucuugugaa

SEQ ID NO: 484825 - RNA, 23 nt, Homo sapiens
uuuaagacucucgcaucuuccca

SEQ ID NO: 484826 - RNA, 15 nt, Homo sapiens
uuuaaucuuccaugg

SEQ ID NO: 484827 - RNA, 14 nt, Homo sapiens
uuuaauuuaaucuu

SEQ ID NO: 484828 - RNA, 21 nt, Homo sapiens
uuuacaagagaagaaagugaa

SEQ ID NO: 484829 - RNA, 15 nt, Homo sapiens
uuuacagcugagcac

SEQ ID NO: 484830 - RNA, 23 nt, Homo sapiens
uuuaguaagagauuccugagcca

SEQ ID NO: 484831 - RNA, 17 nt, Homo sapiens
uuuaguaguuacuaaaa

SEQ ID NO: 484832 - RNA, 14 nt, Homo sapiens
uuuauuacauauga

SEQ ID NO: 484833 - RNA, 18 nt, Homo sapiens
uuuauuuuugagacagag

SEQ ID NO: 484834 - RNA, 19 nt, Homo sapiens
uuucucuccaucagaauga

SEQ ID NO: 484835 - RNA, 17 nt, Homo sapiens
uuugaaaccaaaccaga

SEQ ID NO: 484836 - RNA, 15 nt, Homo sapiens
uuugagaagcacugu

SEQ ID NO: 484837 - RNA, 15 nt, Homo sapiens
uuuuaaugggcacaa

SEQ ID NO: 484838 - RNA, 13 nt, Homo sapiens
uuuucauguauuu

SEQ ID NO: 484839 - RNA, 14 nt, Homo sapiens
uuuucccccuauca

SEQ ID NO: 484840 - RNA, 14 nt, Homo sapiens
uuuugcuuggugga

SEQ ID NO: 484841 - RNA, 21 nt, Homo sapiens
uuuuugacauuuacuguggau

SEQ ID NO: 484842 - RNA, 17 nt, Homo sapiens
uaaaaauuuacaagaga

SEQ ID NO: 484843 - RNA, 13 nt, Homo sapiens
uaaaacagucauc

SEQ ID NO: 484844 - RNA, 18 nt, Homo sapiens
uaaaagacagacauuccu

SEQ ID NO: 484845 - RNA, 20 nt, Homo sapiens
uaaacaagucaaagacuugu

SEQ ID NO: 484846 - RNA, 17 nt, Homo sapiens
uaaagguccuggcaaag

SEQ ID NO: 484847 - RNA, 15 nt, Homo sapiens
uaaaguaugugcaua

SEQ ID NO: 484848 - RNA, 14 nt, Homo sapiens
uaaauauuaucuaa

SEQ ID NO: 484849 - RNA, 19 nt, Homo sapiens
uaaauugauaacauggaaa

SEQ ID NO: 484850 - RNA, 21 nt, Homo sapiens
uaaccucaagugauccuccca

SEQ ID NO: 484851 - RNA, 20 nt, Homo sapiens
uaagacucucgcaucuuccc

SEQ ID NO: 484852 - RNA, 12 nt, Homo sapiens
uaagguucaaga

SEQ ID NO: 484853 - RNA, 18 nt, Homo sapiens
uaaguuuuuauuguguaa

SEQ ID NO: 484854 - RNA, 13 nt, Homo sapiens
uaaugcaccugaa

SEQ ID NO: 484855 - RNA, 16 nt, Homo sapiens
uaauuacauauuugca

SEQ ID NO: 484856 - RNA, 19 nt, Homo sapiens
uaauuacucuacuucccag

SEQ ID NO: 484857 - RNA, 15 nt, Homo sapiens
uaauuuaaucuucca

SEQ ID NO: 484858 - RNA, 19 nt, Homo sapiens
uaauuuaaucuuccaugga

SEQ ID NO: 484859 - RNA, 24 nt, Homo sapiens
uaauuuaguaaauaaacaagucaa

SEQ ID NO: 484860 - RNA, 15 nt, Homo sapiens
uacaauaaguuaacu

SEQ ID NO: 484861 - RNA, 17 nt, Homo sapiens
uacacccacaguggaaa

SEQ ID NO: 484862 - RNA, 18 nt, Homo sapiens
uacaggugugcaccacca

SEQ ID NO: 484863 - RNA, 20 nt, Homo sapiens
uacauaaaguaugugcauau

SEQ ID NO: 484864 - RNA, 16 nt, Homo sapiens
uacauauuugcauaug

SEQ ID NO: 484865 - RNA, 19 nt, Homo sapiens
uaccucugaucaaguauuu

SEQ ID NO: 484866 - RNA, 17 nt, Homo sapiens
uaccuucaccaucugua

SEQ ID NO: 484867 - RNA, 14 nt, Homo sapiens
aaaaacguauugca

SEQ ID NO: 484868 - RNA, 16 nt, Homo sapiens
aaaaauauugaacuca

SEQ ID NO: 484869 - RNA, 21 nt, Homo sapiens
aaaagcuguucugucuuccca

SEQ ID NO: 484870 - RNA, 21 nt, Homo sapiens
aaacagugaguuaaagcagug

SEQ ID NO: 484871 - RNA, 23 nt, Homo sapiens
aaacauuaacucuaacugugaca

SEQ ID NO: 484872 - RNA, 17 nt, Homo sapiens
aaacguauugcauuuaa

SEQ ID NO: 484873 - RNA, 20 nt, Homo sapiens
aaacuuauccuccaugaaua

SEQ ID NO: 484874 - RNA, 21 nt, Homo sapiens
aaacuuugauaggauguggau

SEQ ID NO: 484875 - RNA, 14 nt, Homo sapiens
aaagcuuugugcag

SEQ ID NO: 484876 - RNA, 23 nt, Homo sapiens
uaaaaagcuguucugucuuccca

SEQ ID NO: 484877 - RNA, 13 nt, Homo sapiens
uaaaacaguccuu

SEQ ID NO: 484878 - RNA, 18 nt, Homo sapiens
uaaaacauuuucacacaa

SEQ ID NO: 484879 - RNA, 19 nt, Homo sapiens
uaaagaaauuuuaguaguu

SEQ ID NO: 484880 - RNA, 22 nt, Homo sapiens
uaaagccuuggauguauauguc

SEQ ID NO: 484881 - RNA, 17 nt, Homo sapiens
uaaagcuuugugcagau

SEQ ID NO: 484882 - RNA, 16 nt, Homo sapiens
uaaaguaugugcauau

SEQ ID NO: 484883 - RNA, 13 nt, Homo sapiens
uaaauauuaucua

SEQ ID NO: 484884 - RNA, 14 nt, Homo sapiens
uaaaucgcuaccuu

SEQ ID NO: 484885 - RNA, 16 nt, Homo sapiens
uaaauuauagaaucua

SEQ ID NO: 484886 - RNA, 14 nt, Homo sapiens
uaaccaccccaucu

SEQ ID NO: 484887 - RNA, 17 nt, Homo sapiens
uaacgaccacagggucu

SEQ ID NO: 484888 - RNA, 19 nt, Homo sapiens
uaacuugcaccucugaccu

SEQ ID NO: 484889 - RNA, 13 nt, Homo sapiens
uaagaagggaaaa

SEQ ID NO: 484890 - RNA, 22 nt, Homo sapiens
uaaucaguaugcaaagcaaucu

SEQ ID NO: 484891 - RNA, 15 nt, Homo sapiens
uaauugacacuauau

SEQ ID NO: 484892 - RNA, 17 nt, Homo sapiens
uaauuuuauuacauaug

SEQ ID NO: 484893 - RNA, 23 nt, Homo sapiens
uaauuuuuuugugggaaauccac

SEQ ID NO: 484894 - RNA, 15 nt, Homo sapiens
uacaccccaacagca

SEQ ID NO: 484895 - RNA, 18 nt, Homo sapiens
uacagaagaguuucuuaa

SEQ ID NO: 484896 - RNA, 15 nt, Homo sapiens
uacauaaaguaugug

SEQ ID NO: 484897 - RNA, 14 nt, Homo sapiens
uacauuaacuucag

SEQ ID NO: 484898 - RNA, 20 nt, Homo sapiens
uaccuacauuuuaaugcacc

SEQ ID NO: 484899 - RNA, 19 nt, Homo sapiens
uacuauaaauauacauaua

SEQ ID NO: 484900 - RNA, 14 nt, Homo sapiens
uacucauagcacuu

SEQ ID NO: 484901 - RNA, 15 nt, Homo sapiens
uacuuaaaacuguaa

SEQ ID NO: 484902 - RNA, 12 nt, Homo sapiens
uagaagggcaaa

SEQ ID NO: 484903 - RNA, 20 nt, Homo sapiens
uagccaaugcuuacugcgcu

SEQ ID NO: 484904 - RNA, 21 nt, Homo sapiens
uagccuguggccuuugcaauu

SEQ ID NO: 484905 - RNA, 22 nt, Homo sapiens
uagccuguggccuuugcaauuu

SEQ ID NO: 484906 - RNA, 15 nt, Homo sapiens
uagcugcagagccac

SEQ ID NO: 484907 - RNA, 22 nt, Homo sapiens
uaggggucuuguuaagugcagu

SEQ ID NO: 484908 - RNA, 22 nt, Homo sapiens
uaggugggggaacacugagaaa

SEQ ID NO: 484909 - RNA, 15 nt, Homo sapiens
uaguuacuauaugcc

SEQ ID NO: 484910 - RNA, 20 nt, Homo sapiens
uaguuguaaauauagugaag

SEQ ID NO: 484911 - RNA, 22 nt, Homo sapiens
uaguuguaauuuuuuuguggga

SEQ ID NO: 484912 - RNA, 23 nt, Homo sapiens
uauaaauuauagaaucuacuuua

SEQ ID NO: 484913 - RNA, 18 nt, Homo sapiens
uauagaaucuacuuuaau

SEQ ID NO: 484914 - RNA, 17 nt, Homo sapiens
uauagucacuaguugua

SEQ ID NO: 484915 - RNA, 21 nt, Homo sapiens
ucaaguauuuuugacauuuac

SEQ ID NO: 484916 - RNA, 21 nt, Homo sapiens
ucaaucuuaucauauuucaaa

SEQ ID NO: 484917 - RNA, 15 nt, Homo sapiens
ucaccuaggggucuu

SEQ ID NO: 484918 - RNA, 22 nt, Homo sapiens
ucacugaguuuuguuucacuuu

SEQ ID NO: 484919 - RNA, 20 nt, Homo sapiens
ucacuuuaauagaagggcaa

SEQ ID NO: 484920 - RNA, 15 nt, Homo sapiens
ucagaaacagugagu

SEQ ID NO: 484921 - RNA, 11 nt, Homo sapiens
ucagcaaaaaa

SEQ ID NO: 484922 - RNA, 17 nt, Homo sapiens
ucaguccaaagggcaug

SEQ ID NO: 484923 - RNA, 17 nt, Homo sapiens
ucagucuuuuccaucuc

SEQ ID NO: 484924 - RNA, 21 nt, Homo sapiens
ucagugcaaagauuugcuuua

SEQ ID NO: 484925 - RNA, 21 nt, Homo sapiens
ucauauuucacagcaccaaaa

SEQ ID NO: 484926 - RNA, 16 nt, Homo sapiens
ucaugaaagcaucuga

SEQ ID NO: 484927 - RNA, 19 nt, Homo sapiens
ucauuaucuuugcuguuau

SEQ ID NO: 484928 - RNA, 17 nt, Homo sapiens
ucauuguucuugugaac

SEQ ID NO: 484929 - RNA, 13 nt, Homo sapiens
uccaucuguugac

SEQ ID NO: 484930 - RNA, 15 nt, Homo sapiens
uccaucuguugacaa

SEQ ID NO: 484931 - RNA, 21 nt, Homo sapiens
ucccagggagcaugagaggag

SEQ ID NO: 484932 - RNA, 16 nt, Homo sapiens
ucccauucgcaauaag

SEQ ID NO: 484933 - RNA, 20 nt, Homo sapiens
ucccgaguagcugggauuac

SEQ ID NO: 484934 - RNA, 16 nt, Homo sapiens
ucccguggccuguaga

SEQ ID NO: 484935 - RNA, 17 nt, Homo sapiens
ucccugcuuaaugaaaa

SEQ ID NO: 484936 - RNA, 18 nt, Homo sapiens
uccuccuagacucuguga

SEQ ID NO: 484937 - RNA, 15 nt, Homo sapiens
uccugacacucaaua

SEQ ID NO: 484938 - RNA, 23 nt, Homo sapiens
uccuggcaaagaugaucaguaug

SEQ ID NO: 484939 - RNA, 23 nt, Homo sapiens
ucgcuaccuuuugcuguggcaaa

SEQ ID NO: 484940 - RNA, 15 nt, Homo sapiens
ucgugggaaagggga

SEQ ID NO: 484941 - RNA, 16 nt, Homo sapiens
ucuaacugcuguuaaa

SEQ ID NO: 484942 - RNA, 21 nt, Homo sapiens
ucuaacugugacaaagaagac

SEQ ID NO: 484943 - RNA, 18 nt, Homo sapiens
ucuaaggaauaugagcuu

SEQ ID NO: 484944 - RNA, 16 nt, Homo sapiens
ucuacauguaaugaca

SEQ ID NO: 484945 - RNA, 12 nt, Homo sapiens
ucuauuagccag

SEQ ID NO: 484946 - RNA, 13 nt, Homo sapiens
ucucagugcugua

SEQ ID NO: 484947 - RNA, 20 nt, Homo sapiens
ucuccagagggaauugcaga

SEQ ID NO: 484948 - RNA, 23 nt, Homo sapiens
ucuccagagggaauugcagagua

SEQ ID NO: 484949 - RNA, 12 nt, Homo sapiens
ucuccagaugag

SEQ ID NO: 484950 - RNA, 20 nt, Homo sapiens
ucucccagggagcaugagag

SEQ ID NO: 484951 - RNA, 13 nt, Homo sapiens
ucuccugccucag

SEQ ID NO: 484952 - RNA, 20 nt, Homo sapiens
ucucgaacuccuaaccucaa

SEQ ID NO: 484953 - RNA, 21 nt, Homo sapiens
ucucugaguccuggcccaaag

SEQ ID NO: 484954 - RNA, 16 nt, Homo sapiens
ucugagcuaacuuaua

SEQ ID NO: 484955 - RNA, 12 nt, Homo sapiens
ucugcacucuaa

SEQ ID NO: 484956 - RNA, 17 nt, Homo sapiens
ucuuauuugcuauagaa

SEQ ID NO: 484957 - RNA, 14 nt, Homo sapiens
ucuuccucccugga

SEQ ID NO: 484958 - RNA, 22 nt, Homo sapiens
ucuuguaaagguccuggcaaag

SEQ ID NO: 484959 - RNA, 15 nt, Homo sapiens
ucuuguuaagugcag

SEQ ID NO: 484960 - RNA, 16 nt, Homo sapiens
ucuuguuaagugcagu

SEQ ID NO: 484961 - RNA, 14 nt, Homo sapiens
ugaaaacaagccau

SEQ ID NO: 484962 - RNA, 21 nt, Homo sapiens
ugaaauauacacacagcagua

SEQ ID NO: 484963 - RNA, 20 nt, Homo sapiens
ugaacugaaaacaagccaug

SEQ ID NO: 484964 - RNA, 23 nt, Homo sapiens
ugaagacaccaucuccaugugac

SEQ ID NO: 484965 - RNA, 15 nt, Homo sapiens
ugaagcaaacacauu

SEQ ID NO: 484966 - RNA, 20 nt, Homo sapiens
gaaaauaggaagugaaccca

SEQ ID NO: 484967 - RNA, 20 nt, Homo sapiens
gaaagguuugagaagcacug

SEQ ID NO: 484968 - RNA, 19 nt, Homo sapiens
gaaauaauuuucaagcaaa

SEQ ID NO: 484969 - RNA, 18 nt, Homo sapiens
gaacugaaaacaagccau

SEQ ID NO: 484970 - RNA, 22 nt, Homo sapiens
gaacuggagccaugggcacaaa

SEQ ID NO: 484971 - RNA, 23 nt, Homo sapiens
gaagcaauuugaaauaauuuuca

SEQ ID NO: 484972 - RNA, 14 nt, Homo sapiens
gaaggccuggccca

SEQ ID NO: 484973 - RNA, 19 nt, Homo sapiens
gaaguaaaacagucaucua

SEQ ID NO: 484974 - RNA, 21 nt, Homo sapiens
gaaguaccuuuguuacagcua

SEQ ID NO: 484975 - RNA, 18 nt, Homo sapiens
gaauaaauggagauucag

SEQ ID NO: 484976 - RNA, 17 nt, Homo sapiens
gaauacauaaaguaugu

SEQ ID NO: 484977 - RNA, 13 nt, Homo sapiens
gaauucacugagu

SEQ ID NO: 484978 - RNA, 13 nt, Homo sapiens
gaauugcagagua

SEQ ID NO: 484979 - RNA, 17 nt, Homo sapiens
gacacuauauauuucuu

SEQ ID NO: 484980 - RNA, 22 nt, Homo sapiens
gacacuucuuguguuaaacuaa

SEQ ID NO: 484981 - RNA, 13 nt, Homo sapiens
gacagcuucucau

SEQ ID NO: 484982 - RNA, 14 nt, Homo sapiens
gacaguaaacacuc

SEQ ID NO: 484983 - RNA, 19 nt, Homo sapiens
gacauuccuucuacaugua

SEQ ID NO: 484984 - RNA, 20 nt, Homo sapiens
gacauuccuucuacauguaa

SEQ ID NO: 484985 - RNA, 13 nt, Homo sapiens
gacccagcacugc

SEQ ID NO: 484986 - RNA, 14 nt, Homo sapiens
gaccgaacacugca

SEQ ID NO: 484987 - RNA, 20 nt, Homo sapiens
gaccuaaagggacuaccucu

SEQ ID NO: 484988 - RNA, 17 nt, Homo sapiens
gacgaagaagagccaca

SEQ ID NO: 484989 - RNA, 15 nt, Homo sapiens
gacuguccccuugaa

SEQ ID NO: 484990 - RNA, 21 nt, Homo sapiens
gagaaacaaauaauuuguaua

SEQ ID NO: 484991 - RNA, 14 nt, Homo sapiens
gagaacucugagca

SEQ ID NO: 484992 - RNA, 18 nt, Homo sapiens
gagaacucugagcagugc

SEQ ID NO: 484993 - RNA, 20 nt, Homo sapiens
gagaccccaccagccucacc

SEQ ID NO: 484994 - RNA, 21 nt, Homo sapiens
gagaggaggcagcaggacugu

SEQ ID NO: 484995 - RNA, 14 nt, Homo sapiens
gagagucugcacuu

SEQ ID NO: 484996 - RNA, 17 nt, Homo sapiens
gagaugagguuucacca

SEQ ID NO: 484997 - RNA, 20 nt, Homo sapiens
gagcagugcuugaaugaagu

SEQ ID NO: 484998 - RNA, 14 nt, Homo sapiens
gaggcagcaggacu

SEQ ID NO: 484999 - RNA, 15 nt, Homo sapiens
gaguacaccccaaca

SEQ ID NO: 485000 - RNA, 18 nt, Homo sapiens
gaguacaccccaacagca

SEQ ID NO: 485001 - RNA, 21 nt, Homo sapiens
gagugccagucagcagucaug

SEQ ID NO: 485002 - RNA, 18 nt, Homo sapiens
gagugcccccaacagcac

SEQ ID NO: 485003 - RNA, 22 nt, Homo sapiens
gaucucggcucagugcaaccuc

SEQ ID NO: 485004 - RNA, 19 nt, Homo sapiens
gaucugaggguauaaagac

SEQ ID NO: 485005 - RNA, 15 nt, Homo sapiens
gauucuccugccuca

SEQ ID NO: 485006 - RNA, 17 nt, Homo sapiens
gcaaagaugaucaguau

SEQ ID NO: 485007 - RNA, 16 nt, Homo sapiens
gcaaagauuugcuuua

SEQ ID NO: 485008 - RNA, 16 nt, Homo sapiens
gcaaagggaacaguga

SEQ ID NO: 485009 - RNA, 22 nt, Homo sapiens
gcacacgucuggccuacagaau

SEQ ID NO: 485010 - RNA, 15 nt, Homo sapiens
gcagaccucuggauu

SEQ ID NO: 485011 - RNA, 23 nt, Homo sapiens
gcagaguacuggcugauggagua

SEQ ID NO: 485012 - RNA, 18 nt, Homo sapiens
gcagggacuuuggucuau

SEQ ID NO: 485013 - RNA, 18 nt, Homo sapiens
gcaggugcugagcaaagg

SEQ ID NO: 485014 - RNA, 14 nt, Homo sapiens
gcaucacaugcuca

SEQ ID NO: 485015 - RNA, 19 nt, Homo sapiens
gcaugagucagucugauga

SEQ ID NO: 485016 - RNA, 19 nt, Homo sapiens
gcauucccagcucuacccu

SEQ ID NO: 485017 - RNA, 22 nt, Homo sapiens
gccacauggggcugggcagcua

SEQ ID NO: 485018 - RNA, 16 nt, Homo sapiens
gccagucagcagucau

SEQ ID NO: 485019 - RNA, 13 nt, Homo sapiens
gcccaaagugcuu

SEQ ID NO: 485020 - RNA, 15 nt, Homo sapiens
gcccacagcaggcca

SEQ ID NO: 485021 - RNA, 18 nt, Homo sapiens
gcccacagcaggugcuga

SEQ ID NO: 485022 - RNA, 13 nt, Homo sapiens
gcccccaacagca

SEQ ID NO: 485023 - RNA, 18 nt, Homo sapiens
gcccucaaaauguccuga

SEQ ID NO: 485024 - RNA, 16 nt, Homo sapiens
gccucccgaguagcug

SEQ ID NO: 485025 - RNA, 18 nt, Homo sapiens
gccuucccaggaguacac

SEQ ID NO: 485026 - RNA, 19 nt, Homo sapiens
gccuucccaggaguacacc

SEQ ID NO: 485027 - RNA, 19 nt, Homo sapiens
gcgaggacauucucugacc

SEQ ID NO: 485028 - RNA, 22 nt, Homo sapiens
gcucagggagguuaagugacuu

SEQ ID NO: 485029 - RNA, 20 nt, Homo sapiens
gcugaggcauccuuccucac

SEQ ID NO: 485030 - RNA, 21 nt, Homo sapiens
gcuucauggcaguaauucucg

SEQ ID NO: 485031 - RNA, 16 nt, Homo sapiens
ggaauaugagcuuuau

SEQ ID NO: 485032 - RNA, 20 nt, Homo sapiens
ggacacguggugcauuuugc

SEQ ID NO: 485033 - RNA, 14 nt, Homo sapiens
ggaguacaccccaa

SEQ ID NO: 485034 - RNA, 18 nt, Homo sapiens
ggaguacaccccaacagc

SEQ ID NO: 485035 - RNA, 20 nt, Homo sapiens
ggagugcccccaacagcacc

SEQ ID NO: 485036 - RNA, 21 nt, Homo sapiens
ggagugcccccaacagcaccc

SEQ ID NO: 485037 - RNA, 19 nt, Homo sapiens
ggauuacaggugugcacca

SEQ ID NO: 485038 - RNA, 11 nt, Homo sapiens
ggcagaagcag

SEQ ID NO: 485039 - RNA, 19 nt, Homo sapiens
ggcagcuucuauuagccag

SEQ ID NO: 485040 - RNA, 18 nt, Homo sapiens
ggcagggaccuaaaggga

SEQ ID NO: 485041 - RNA, 24 nt, Homo sapiens
ggcccacguagggcggcacucaca

SEQ ID NO: 485042 - RNA, 13 nt, Homo sapiens
ggccgagaagcca

SEQ ID NO: 485043 - RNA, 23 nt, Homo sapiens
ggccuggaguaacacaaagugaa

SEQ ID NO: 485044 - RNA, 20 nt, Homo sapiens
ggcucagugcaaccucugcu

SEQ ID NO: 485045 - RNA, 14 nt, Homo sapiens
ggcugggcagcuac

SEQ ID NO: 485046 - RNA, 24 nt, Homo sapiens
ggcuuuaaaacuuauccuccauga

SEQ ID NO: 485047 - RNA, 15 nt, Homo sapiens
gggaauugcagagua

SEQ ID NO: 485048 - RNA, 22 nt, Homo sapiens
gggauggcguggucaagcacuc

SEQ ID NO: 485049 - RNA, 16 nt, Homo sapiens
ggguaacuugcaccuc

SEQ ID NO: 485050 - RNA, 20 nt, Homo sapiens
ggguggagugcaguggugcg

SEQ ID NO: 485051 - RNA, 18 nt, Homo sapiens
gguauauacaaguagauc

SEQ ID NO: 485052 - RNA, 12 nt, Homo sapiens
ggugaacuccac

SEQ ID NO: 485053 - RNA, 20 nt, Homo sapiens
gguggagugcaguggugcga

SEQ ID NO: 485054 - RNA, 17 nt, Homo sapiens
agagccacccuguguug

SEQ ID NO: 485055 - RNA, 21 nt, Homo sapiens
agagccucgcucuguuaccca

SEQ ID NO: 485056 - RNA, 22 nt, Homo sapiens
agagcuuugcuucucucucuaa

SEQ ID NO: 485057 - RNA, 19 nt, Homo sapiens
agaguacaccccaacagca

SEQ ID NO: 485058 - RNA, 20 nt, Homo sapiens
agagucaaugaacuuuccac

SEQ ID NO: 485059 - RNA, 18 nt, Homo sapiens
agaugaaacauuaacucu

SEQ ID NO: 485060 - RNA, 20 nt, Homo sapiens
agaugcagaaaauugccuaa

SEQ ID NO: 485061 - RNA, 13 nt, Homo sapiens
agcaauuugaaau

SEQ ID NO: 485062 - RNA, 16 nt, Homo sapiens
agcagccaccccaugc

SEQ ID NO: 485063 - RNA, 15 nt, Homo sapiens
agcaggugcugagca

SEQ ID NO: 485064 - RNA, 15 nt, Homo sapiens
agcagugcuucucaa

SEQ ID NO: 485065 - RNA, 22 nt, Homo sapiens
agcaugagaggaggcagcagga

SEQ ID NO: 485066 - RNA, 13 nt, Homo sapiens
agccucaccagcg

SEQ ID NO: 485067 - RNA, 16 nt, Homo sapiens
agccuguggccuuugc

SEQ ID NO: 485068 - RNA, 22 nt, Homo sapiens
agcgaggacauucucugaccua

SEQ ID NO: 485069 - RNA, 20 nt, Homo sapiens
agcgauucuccugccucagc

SEQ ID NO: 485070 - RNA, 19 nt, Homo sapiens
agcuacuauaaauauacau

SEQ ID NO: 485071 - RNA, 19 nt, Homo sapiens
agcuccucgagggcaggga

SEQ ID NO: 485072 - RNA, 19 nt, Homo sapiens
agcucuugaagacacugaa

SEQ ID NO: 485073 - RNA, 17 nt, Homo sapiens
aggaaaaauauugaacu

SEQ ID NO: 485074 - RNA, 12 nt, Homo sapiens
aggaaaauccaa

SEQ ID NO: 485075 - RNA, 15 nt, Homo sapiens
aggaaaauccaaaag

SEQ ID NO: 485076 - RNA, 14 nt, Homo sapiens
aggaccaaggagau

SEQ ID NO: 485077 - RNA, 20 nt, Homo sapiens
aggcauccuuccucacacca

SEQ ID NO: 485078 - RNA, 12 nt, Homo sapiens
aggccaggguca

SEQ ID NO: 485079 - RNA, 20 nt, Homo sapiens
aggugggggaacacugagaa

SEQ ID NO: 485080 - RNA, 23 nt, Homo sapiens
agguuuuuaguuuguucuucaga

SEQ ID NO: 485081 - RNA, 19 nt, Homo sapiens
aguaacgggacaguaaaca

SEQ ID NO: 485082 - RNA, 18 nt, Homo sapiens
aguacaccccaacagcac

SEQ ID NO: 485083 - RNA, 17 nt, Homo sapiens
aguacuuaaaacuguaa

SEQ ID NO: 485084 - RNA, 19 nt, Homo sapiens
aguagaugaaacauuaacu

SEQ ID NO: 485085 - RNA, 18 nt, Homo sapiens
aguauugugaaaguauuc

SEQ ID NO: 485086 - RNA, 16 nt, Homo sapiens
agucaauagcuugucu

SEQ ID NO: 485087 - RNA, 14 nt, Homo sapiens
agucagcagucaug

SEQ ID NO: 485088 - RNA, 21 nt, Homo sapiens
aguccagccuggcaaggguuc

SEQ ID NO: 485089 - RNA, 16 nt, Homo sapiens
aguccuucaaacuucc

SEQ ID NO: 485090 - RNA, 16 nt, Homo sapiens
agugcagucugaucca

SEQ ID NO: 485091 - RNA, 16 nt, Homo sapiens
agugcccccaacagca

SEQ ID NO: 485092 - RNA, 12 nt, Homo sapiens
agugugauucac

SEQ ID NO: 485093 - RNA, 15 nt, Homo sapiens
aguugaaugggcaca

SEQ ID NO: 485094 - RNA, 17 nt, Homo sapiens
aguugcauaagcauugc

SEQ ID NO: 485095 - RNA, 15 nt, Homo sapiens
auaaaguaugugcau

SEQ ID NO: 485096 - RNA, 15 nt, Homo sapiens
auaaauaaaacauuu

SEQ ID NO: 485097 - RNA, 15 nt, Homo sapiens
auaaauauacauaua

SEQ ID NO: 485098 - RNA, 16 nt, Homo sapiens
auaaauauacauauaa

SEQ ID NO: 485099 - RNA, 15 nt, Homo sapiens
auaaauggagauuca

SEQ ID NO: 485100 - RNA, 21 nt, Homo sapiens
auaauagacuucccacucuag

SEQ ID NO: 485101 - RNA, 21 nt, Homo sapiens
auaauuuguauacccuguccu

SEQ ID NO: 485102 - RNA, 16 nt, Homo sapiens
auaauuuucaagcaaa

SEQ ID NO: 485103 - RNA, 15 nt, Homo sapiens
auacccuguccuuuc

SEQ ID NO: 485104 - RNA, 18 nt, Homo sapiens
auagacuucccacucuag

SEQ ID NO: 485105 - RNA, 18 nt, Homo sapiens
auagcaccuaaacuuaca

SEQ ID NO: 485106 - RNA, 23 nt, Homo sapiens
auagccuguggccuuugcaauuu

SEQ ID NO: 485107 - RNA, 18 nt, Homo sapiens
auauuaucuaacagacaa

SEQ ID NO: 485108 - RNA, 17 nt, Homo sapiens
auauugaacucaaugau

SEQ ID NO: 485109 - RNA, 15 nt, Homo sapiens
aucaacccuaaaaag

SEQ ID NO: 485110 - RNA, 22 nt, Homo sapiens
aucagcccaaaagucaaucuua

SEQ ID NO: 485111 - RNA, 13 nt, Homo sapiens
aucaguccaaagg

SEQ ID NO: 485112 - RNA, 10 nt, Homo sapiens
aucaguugau

SEQ ID NO: 485113 - RNA, 21 nt, Homo sapiens
auccccuugucugaacuggag

SEQ ID NO: 485114 - RNA, 22 nt, Homo sapiens
auccggacuccugccgcaguga

SEQ ID NO: 485115 - RNA, 15 nt, Homo sapiens
auccugagaaguacc

SEQ ID NO: 485116 - RNA, 15 nt, Homo sapiens
aucuuccauggauuu

SEQ ID NO: 485117 - RNA, 15 nt, Homo sapiens
augagacuguacuaa

SEQ ID NO: 485118 - RNA, 23 nt, Homo sapiens
augagcuuuauguaauaauguga

SEQ ID NO: 485119 - RNA, 17 nt, Homo sapiens
augauggccaggcugau

SEQ ID NO: 485120 - RNA, 17 nt, Homo sapiens
augcaacaggcacucaa

SEQ ID NO: 485121 - RNA, 12 nt, Homo sapiens
augcauucugag

SEQ ID NO: 485122 - RNA, 16 nt, Homo sapiens
auggucauauuucaca

SEQ ID NO: 485123 - RNA, 14 nt, Homo sapiens
auggugaaaugcag

SEQ ID NO: 485124 - RNA, 13 nt, Homo sapiens
auggugaacucca

SEQ ID NO: 485125 - RNA, 22 nt, Homo sapiens
auguacccuaaggucauuacca

SEQ ID NO: 485126 - RNA, 20 nt, Homo sapiens
augucaguggaagaagcaga

SEQ ID NO: 485127 - RNA, 22 nt, Homo sapiens
augucccuauggaagcauauug

SEQ ID NO: 485128 - RNA, 22 nt, Homo sapiens
augucuccucucccauucgcaa

SEQ ID NO: 485129 - RNA, 19 nt, Homo sapiens
augugaccgaacacugcag

SEQ ID NO: 485130 - RNA, 18 nt, Homo sapiens
auguugagggaagcuucc

SEQ ID NO: 485131 - RNA, 20 nt, Homo sapiens
auguuuuucuguauaacagc

SEQ ID NO: 485132 - RNA, 22 nt, Homo sapiens
auucuaaggaauaugagcuuua

SEQ ID NO: 485133 - RNA, 21 nt, Homo sapiens
auucugagguaaccucauuau

SEQ ID NO: 485134 - RNA, 23 nt, Homo sapiens
auucugagguaaccucauuauca

SEQ ID NO: 485135 - RNA, 18 nt, Homo sapiens
auucuuuacccccuggga

SEQ ID NO: 485136 - RNA, 19 nt, Homo sapiens
auugaggcuuuaaaacuua

SEQ ID NO: 485137 - RNA, 15 nt, Homo sapiens
auugcagaguacugg

SEQ ID NO: 485138 - RNA, 17 nt, Homo sapiens
auugucuguauuugccg

SEQ ID NO: 485139 - RNA, 15 nt, Homo sapiens
auuugcauauguaug

SEQ ID NO: 485140 - RNA, 14 nt, Homo sapiens
cauuuaaaagacag

SEQ ID NO: 485141 - RNA, 17 nt, Homo sapiens
cauuuaaaagacagaca

SEQ ID NO: 485142 - RNA, 13 nt, Homo sapiens
cauuugugcaaga

SEQ ID NO: 485143 - RNA, 10 nt, Homo sapiens
ccaacagcac

SEQ ID NO: 485144 - RNA, 19 nt, Homo sapiens
ccaacugccuguucaauaa

SEQ ID NO: 485145 - RNA, 21 nt, Homo sapiens
ccaagauaucagcccaaaagu

SEQ ID NO: 485146 - RNA, 18 nt, Homo sapiens
ccaagaugcaagaaggag

SEQ ID NO: 485147 - RNA, 16 nt, Homo sapiens
ccaaggagaugaagca

SEQ ID NO: 485148 - RNA, 15 nt, Homo sapiens
ccacagggucugcac

SEQ ID NO: 485149 - RNA, 18 nt, Homo sapiens
ccacuagacaaguccagc

SEQ ID NO: 485150 - RNA, 20 nt, Homo sapiens
ccagcuauugauauaaauaa

SEQ ID NO: 485151 - RNA, 16 nt, Homo sapiens
ccaggcaccugcauuu

SEQ ID NO: 485152 - RNA, 23 nt, Homo sapiens
ccaggguggagugcaguggugcg

SEQ ID NO: 485153 - RNA, 14 nt, Homo sapiens
ccaugacauugcau

SEQ ID NO: 485154 - RNA, 16 nt, Homo sapiens
ccauuuuugaaaccaa

SEQ ID NO: 485155 - RNA, 12 nt, Homo sapiens
cccaggaguaca

SEQ ID NO: 485156 - RNA, 17 nt, Homo sapiens
cccaggccgagaagcca

SEQ ID NO: 485157 - RNA, 14 nt, Homo sapiens
cccaggguggagug

SEQ ID NO: 485158 - RNA, 15 nt, Homo sapiens
cccccugaguuuccu

SEQ ID NO: 485159 - RNA, 20 nt, Homo sapiens
ccccuuuacucauagcacuu

SEQ ID NO: 485160 - RNA, 16 nt, Homo sapiens
ccuaaacuuacauuua

SEQ ID NO: 485161 - RNA, 23 nt, Homo sapiens
ccuaaacuuacauuuaaaagaca

SEQ ID NO: 485162 - RNA, 17 nt, Homo sapiens
ccuaaagggacuaccuc

SEQ ID NO: 485163 - RNA, 17 nt, Homo sapiens
ccuaggauugugccugu

SEQ ID NO: 485164 - RNA, 18 nt, Homo sapiens
ccucaaauguugagggaa

SEQ ID NO: 485165 - RNA, 16 nt, Homo sapiens
ccugacacucaauaaa

SEQ ID NO: 485166 - RNA, 23 nt, Homo sapiens
ccugacacucaauaaacagucac

SEQ ID NO: 485167 - RNA, 19 nt, Homo sapiens
ccugauuuuacacacauua

SEQ ID NO: 485168 - RNA, 14 nt, Homo sapiens
ccugcaggcagcuu

SEQ ID NO: 485169 - RNA, 20 nt, Homo sapiens
ccuggaguaacacaaaguga

SEQ ID NO: 485170 - RNA, 21 nt, Homo sapiens
ccuggaguaacacaaagugaa

SEQ ID NO: 485171 - RNA, 17 nt, Homo sapiens
ccuguucaauaaaagua

SEQ ID NO: 485172 - RNA, 21 nt, Homo sapiens
ccuuaagcccuggcccccuga

SEQ ID NO: 485173 - RNA, 13 nt, Homo sapiens
ccuucaaacuucc

SEQ ID NO: 485174 - RNA, 20 nt, Homo sapiens
ccuuccacacucaccucuaa

SEQ ID NO: 485175 - RNA, 18 nt, Homo sapiens
ccuuucuaaccuucacga

SEQ ID NO: 485176 - RNA, 13 nt, Homo sapiens
ccuuugcaauuug

SEQ ID NO: 485177 - RNA, 15 nt, Homo sapiens
cgaaaaguugguguc

SEQ ID NO: 485178 - RNA, 19 nt, Homo sapiens
cgaaccauggugaacucca

SEQ ID NO: 485179 - RNA, 14 nt, Homo sapiens
cgauccccugucac

SEQ ID NO: 485180 - RNA, 14 nt, Homo sapiens
cgcuugaagccuga

SEQ ID NO: 485181 - RNA, 14 nt, Homo sapiens
cgggagacucugaa

SEQ ID NO: 485182 - RNA, 15 nt, Homo sapiens
cguuagaaguugaau

SEQ ID NO: 485183 - RNA, 14 nt, Homo sapiens
cuaaaaugaguuac

SEQ ID NO: 485184 - RNA, 19 nt, Homo sapiens
cuaaaaugaguuaccuaca

SEQ ID NO: 485185 - RNA, 20 nt, Homo sapiens
cuaaaauuauguuacuguau

SEQ ID NO: 485186 - RNA, 16 nt, Homo sapiens
cuaaacuuacauuuaa

SEQ ID NO: 485187 - RNA, 11 nt, Homo sapiens
cuaacagacaa

SEQ ID NO: 485188 - RNA, 22 nt, Homo sapiens
cuaaccuucacgauuaacugug

SEQ ID NO: 485189 - RNA, 14 nt, Homo sapiens
cuaagaagggaaaa

SEQ ID NO: 485190 - RNA, 20 nt, Homo sapiens
cuaaggaauaugagcuuuau

SEQ ID NO: 485191 - RNA, 14 nt, Homo sapiens
cuacagaaugcggc

SEQ ID NO: 485192 - RNA, 13 nt, Homo sapiens
cuaccuacauauu

SEQ ID NO: 485193 - RNA, 19 nt, Homo sapiens
cuacuucccaguaacccua

SEQ ID NO: 485194 - RNA, 16 nt, Homo sapiens
cuauauauuucuuaau

SEQ ID NO: 485195 - RNA, 14 nt, Homo sapiens
cuauggaagcauau

SEQ ID NO: 485196 - RNA, 11 nt, Homo sapiens
cuauuagccag

SEQ ID NO: 485197 - RNA, 22 nt, Homo sapiens
cucaauaaacagucacuggaaa

SEQ ID NO: 485198 - RNA, 23 nt, Homo sapiens
cucaccagcgcuugaagccugaa

SEQ ID NO: 485199 - RNA, 13 nt, Homo sapiens
cucagugcuguaa

SEQ ID NO: 485200 - RNA, 17 nt, Homo sapiens
cucaucaucaacccuaa

SEQ ID NO: 485201 - RNA, 15 nt, Homo sapiens
cucauccugcaggca

SEQ ID NO: 485202 - RNA, 19 nt, Homo sapiens
cuccagagggaauugcaga

SEQ ID NO: 485203 - RNA, 16 nt, Homo sapiens
cucccagggagcauga

SEQ ID NO: 485204 - RNA, 16 nt, Homo sapiens
cucccguggccuguag

SEQ ID NO: 485205 - RNA, 22 nt, Homo sapiens
cuccuaaccucaagugauccuc

SEQ ID NO: 485206 - RNA, 15 nt, Homo sapiens
cuccugccgcaguga

SEQ ID NO: 485207 - RNA, 21 nt, Homo sapiens
cuccugcuuuaaccaccccau

SEQ ID NO: 485208 - RNA, 16 nt, Homo sapiens
cucgcucuguuaccca

SEQ ID NO: 485209 - RNA, 17 nt, Homo sapiens
cucggcucagugcaacc

SEQ ID NO: 485210 - RNA, 16 nt, Homo sapiens
cucugugccuugccac

SEQ ID NO: 485211 - RNA, 17 nt, Homo sapiens
cucugugccuugccaca

SEQ ID NO: 485212 - RNA, 16 nt, Homo sapiens
cugaaaacaagccaug

SEQ ID NO: 485213 - RNA, 19 nt, Homo sapiens
cugaauguuagauaguuac

SEQ ID NO: 485214 - RNA, 18 nt, Homo sapiens
cugagagucugcacuuaa

SEQ ID NO: 485215 - RNA, 22 nt, Homo sapiens
cugagcagugcuugaaugaagu

SEQ ID NO: 485216 - RNA, 18 nt, Homo sapiens
cugagggucgugggaaag

SEQ ID NO: 485217 - RNA, 19 nt, Homo sapiens
cugaguuuuguuucacuuu

SEQ ID NO: 485218 - RNA, 16 nt, Homo sapiens
cugcacuuaacaagcu

SEQ ID NO: 485219 - RNA, 13 nt, Homo sapiens
cuggccuugccac

SEQ ID NO: 485220 - RNA, 13 nt, Homo sapiens
cuggcucagggag

SEQ ID NO: 485221 - RNA, 13 nt, Homo sapiens
cuggcugugugac

SEQ ID NO: 485222 - RNA, 16 nt, Homo sapiens
cugguucuaacugcug

SEQ ID NO: 485223 - RNA, 18 nt, Homo sapiens
cuguaaaaacugugggau

SEQ ID NO: 485224 - RNA, 21 nt, Homo sapiens
cuguugacaaaugacagaucu

SEQ ID NO: 485225 - RNA, 19 nt, Homo sapiens
cuuaaaacuguaaauuuau

SEQ ID NO: 485226 - RNA, 13 nt, Homo sapiens
cuuaaaauuguau

SEQ ID NO: 485227 - RNA, 19 nt, Homo sapiens
cuuaauaaaauaauucuca

SEQ ID NO: 485228 - RNA, 17 nt, Homo sapiens
cuuacauuuaaaagaca

SEQ ID NO: 485229 - RNA, 12 nt, Homo sapiens
cuucaaacuucc

SEQ ID NO: 485230 - RNA, 19 nt, Homo sapiens
cuucacgauuaacugugaa

SEQ ID NO: 485231 - RNA, 23 nt, Homo sapiens
cuucaguuuuucacuucuaccua

SEQ ID NO: 485232 - RNA, 19 nt, Homo sapiens
cuucauuuuguauaaucac

SEQ ID NO: 485233 - RNA, 18 nt, Homo sapiens
cuuccagugcaacacuga

SEQ ID NO: 485234 - RNA, 21 nt, Homo sapiens
cuucccaguaacccuaaggaa

SEQ ID NO: 485235 - RNA, 18 nt, Homo sapiens
cuucuacauguaaugaca

SEQ ID NO: 485236 - RNA, 19 nt, Homo sapiens
cuucugguucuaacugcug

SEQ ID NO: 485237 - RNA, 17 nt, Homo sapiens
cuugaugugccugugaa

SEQ ID NO: 485238 - RNA, 23 nt, Homo sapiens
cuuguguuaaacuaaaaauuuac

SEQ ID NO: 485239 - RNA, 21 nt, Homo sapiens
cuuuaaccaccccaucugcau

SEQ ID NO: 485240 - RNA, 22 nt, Homo sapiens
cuuuaauuguuaagauaugaug

SEQ ID NO: 485241 - RNA, 14 nt, Homo sapiens
cuuuccacauucag

SEQ ID NO: 485242 - RNA, 17 nt, Homo sapiens
cuuuguaauugacacua

SEQ ID NO: 485243 - RNA, 19 nt, Homo sapiens
cuuuuucagaaacagugag

SEQ ID NO: 485244 - RNA, 22 nt, Homo sapiens
cuuuuucagaaacagugaguua

SEQ ID NO: 485245 - RNA, 19 nt, Homo sapiens
gaaaaaggaaaaauauuga

SEQ ID NO: 485246 - RNA, 15 nt, Homo sapiens
gaaaauguacauguu

SEQ ID NO: 485247 - RNA, 16 nt, Homo sapiens
gaaaguaucaccaggg

SEQ ID NO: 485248 - RNA, 15 nt, Homo sapiens
gaaagugaaagcaaa

SEQ ID NO: 485249 - RNA, 14 nt, Homo sapiens
gaaaugcagaguca

SEQ ID NO: 485250 - RNA, 14 nt, Homo sapiens
gaacauaaagccuu

SEQ ID NO: 485251 - RNA, 19 nt, Homo sapiens
gaacuccuaaccucaagug

SEQ ID NO: 485252 - RNA, 13 nt, Homo sapiens
gaacucugagcag

SEQ ID NO: 485253 - RNA, 13 nt, Homo sapiens
gaagaaagugaaa

SEQ ID NO: 485254 - RNA, 24 nt, Homo sapiens
gaaguugaaugggcacagcaacuc

SEQ ID NO: 485255 - RNA, 23 nt, Homo sapiens
aagagauuccugagccaguguca

SEQ ID NO: 485256 - RNA, 18 nt, Homo sapiens
aagauuguugaaagccau

SEQ ID NO: 485257 - RNA, 13 nt, Homo sapiens
aagcauaacuuau

SEQ ID NO: 485258 - RNA, 16 nt, Homo sapiens
aagcauauuguuauua

SEQ ID NO: 485259 - RNA, 15 nt, Homo sapiens
aagcgauucuccugc

SEQ ID NO: 485260 - RNA, 14 nt, Homo sapiens
aaguaaaacaguca

SEQ ID NO: 485261 - RNA, 16 nt, Homo sapiens
aaguaaucaguaugca

SEQ ID NO: 485262 - RNA, 18 nt, Homo sapiens
aaguugaaugggcacagc

SEQ ID NO: 485263 - RNA, 14 nt, Homo sapiens
aauaaaauaauucu

SEQ ID NO: 485264 - RNA, 12 nt, Homo sapiens
aauaaacaguca

SEQ ID NO: 485265 - RNA, 18 nt, Homo sapiens
aauacaauaaguuaacua

SEQ ID NO: 485266 - RNA, 14 nt, Homo sapiens
aauagaagggcaaa

SEQ ID NO: 485267 - RNA, 18 nt, Homo sapiens
aauauuaucuaacagaca

SEQ ID NO: 485268 - RNA, 13 nt, Homo sapiens
aaucaaacugcuu

SEQ ID NO: 485269 - RNA, 13 nt, Homo sapiens
aaugacacuucuu

SEQ ID NO: 485270 - RNA, 12 nt, Homo sapiens
aaugacagaucu

SEQ ID NO: 485271 - RNA, 16 nt, Homo sapiens
aaugcagagucaauga

SEQ ID NO: 485272 - RNA, 13 nt, Homo sapiens
aauuacagaagag

SEQ ID NO: 485273 - RNA, 16 nt, Homo sapiens
aauugauaacauggaa

SEQ ID NO: 485274 - RNA, 14 nt, Homo sapiens
aauugccuaaagag

SEQ ID NO: 485275 - RNA, 23 nt, Homo sapiens
aauuguuuuuaaguuuucaugaa

SEQ ID NO: 485276 - RNA, 22 nt, Homo sapiens
aauuuauuuugugaacacuuuu

SEQ ID NO: 485277 - RNA, 17 nt, Homo sapiens
aauuuuauuacauauga

SEQ ID NO: 485278 - RNA, 11 nt, Homo sapiens
acaaguccagc

SEQ ID NO: 485279 - RNA, 14 nt, Homo sapiens
acacauuaagccuu

SEQ ID NO: 485280 - RNA, 22 nt, Homo sapiens
acacccccaugacauugcauuu

SEQ ID NO: 485281 - RNA, 21 nt, Homo sapiens
acagaagaguuucuuaacuua

SEQ ID NO: 485282 - RNA, 23 nt, Homo sapiens
acagaaugcggccucugagacau

SEQ ID NO: 485283 - RNA, 18 nt, Homo sapiens
acagacauucaccuguau

SEQ ID NO: 485284 - RNA, 21 nt, Homo sapiens
acagacauuccuucuacaugu

SEQ ID NO: 485285 - RNA, 18 nt, Homo sapiens
acagcacccucuccagau

SEQ ID NO: 485286 - RNA, 15 nt, Homo sapiens
acagcugagcacauu

SEQ ID NO: 485287 - RNA, 14 nt, Homo sapiens
acaggugugcacca

SEQ ID NO: 485288 - RNA, 16 nt, Homo sapiens
acagucacuggaaaga

SEQ ID NO: 485289 - RNA, 21 nt, Homo sapiens
acagucaucuagaauucacug

SEQ ID NO: 485290 - RNA, 22 nt, Homo sapiens
acaguuguguuccugacacuca

SEQ ID NO: 485291 - RNA, 15 nt, Homo sapiens
acauaaaauagauuu

SEQ ID NO: 485292 - RNA, 18 nt, Homo sapiens
acaugaagacaccaucuc

SEQ ID NO: 485293 - RNA, 16 nt, Homo sapiens
acaugcucaaugacuc

SEQ ID NO: 485294 - RNA, 19 nt, Homo sapiens
acauguaagcauaacuuau

SEQ ID NO: 485295 - RNA, 14 nt, Homo sapiens
acauuuacugugga

SEQ ID NO: 485296 - RNA, 15 nt, Homo sapiens
acauuuacuguggau

SEQ ID NO: 485297 - RNA, 17 nt, Homo sapiens
accaaggagaugaagca

SEQ ID NO: 485298 - RNA, 17 nt, Homo sapiens
accaucuccaugugacc

SEQ ID NO: 485299 - RNA, 15 nt, Homo sapiens
accauggugaacucc

SEQ ID NO: 485300 - RNA, 18 nt, Homo sapiens
accauuuuugaaaccaaa

SEQ ID NO: 485301 - RNA, 17 nt, Homo sapiens
acccagcacugcccaaa

SEQ ID NO: 485302 - RNA, 12 nt, Homo sapiens
accccaacagca

SEQ ID NO: 485303 - RNA, 20 nt, Homo sapiens
acccuaggcaucacaugcuc

SEQ ID NO: 485304 - RNA, 22 nt, Homo sapiens
acccugauuuuacacacauuaa

SEQ ID NO: 485305 - RNA, 23 nt, Homo sapiens
acccugauuuuacacacauuaaa

SEQ ID NO: 485306 - RNA, 22 nt, Homo sapiens
accgaaaaguuggugucaauga

SEQ ID NO: 485307 - RNA, 18 nt, Homo sapiens
accuacauuuuaaugcac

SEQ ID NO: 485308 - RNA, 14 nt, Homo sapiens
accuccguggaaua

SEQ ID NO: 485309 - RNA, 14 nt, Homo sapiens
accugaacugaugg

SEQ ID NO: 485310 - RNA, 20 nt, Homo sapiens
accuucacgauuaacuguga

SEQ ID NO: 485311 - RNA, 16 nt, Homo sapiens
accuugaugugccugu

SEQ ID NO: 485312 - RNA, 15 nt, Homo sapiens
acgauuaacugugaa

SEQ ID NO: 485313 - RNA, 11 nt, Homo sapiens
acgucauuugu

SEQ ID NO: 485314 - RNA, 20 nt, Homo sapiens
acguggugcauuuugcuugu

SEQ ID NO: 485315 - RNA, 15 nt, Homo sapiens
acuagacaaguccag

SEQ ID NO: 485316 - RNA, 16 nt, Homo sapiens
acuauaaauauacaua

SEQ ID NO: 485317 - RNA, 21 nt, Homo sapiens
acucaauaaauauuuuugcug

SEQ ID NO: 485318 - RNA, 19 nt, Homo sapiens
acucauaauagacuuccca

SEQ ID NO: 485319 - RNA, 20 nt, Homo sapiens
acucauaauagacuucccac

SEQ ID NO: 485320 - RNA, 13 nt, Homo sapiens
acucauagcacuu

SEQ ID NO: 485321 - RNA, 16 nt, Homo sapiens
acucauagcacuuccc

SEQ ID NO: 485322 - RNA, 17 nt, Homo sapiens
acucauagcacuucccc

SEQ ID NO: 485323 - RNA, 18 nt, Homo sapiens
acuccuaaccucaaguga

SEQ ID NO: 485324 - RNA, 17 nt, Homo sapiens
acucucgcaucuuccca

SEQ ID NO: 485325 - RNA, 20 nt, Homo sapiens
acugaguuuuguuucacuuu

SEQ ID NO: 485326 - RNA, 13 nt, Homo sapiens
acugcagcugucu

SEQ ID NO: 485327 - RNA, 13 nt, Homo sapiens
acuuaacaagcuc

SEQ ID NO: 485328 - RNA, 13 nt, Homo sapiens
acuuccagugcaa

SEQ ID NO: 485329 - RNA, 22 nt, Homo sapiens
acuugcaccucugaccuaucac

SEQ ID NO: 485330 - RNA, 14 nt, Homo sapiens
acuuguggaaaaua

SEQ ID NO: 485331 - RNA, 21 nt, Homo sapiens
agacaagagugguauauacaa

SEQ ID NO: 485332 - RNA, 18 nt, Homo sapiens
agacacugaaauauacac

SEQ ID NO: 485333 - RNA, 15 nt, Homo sapiens
agacgcuucauccca

SEQ ID NO: 485334 - RNA, 20 nt, Homo sapiens
agacucucgcaucuucccaa

SEQ ID NO: 485335 - RNA, 15 nt, Homo sapiens
agacuucccacucua

SEQ ID NO: 485336 - RNA, 16 nt, Homo sapiens
agagauuccugagcca

SEQ ID NO: 485337 - RNA, 15 nt, Homo sapiens
agagggaugagacag

SEQ ID NO: 485338 - RNA, 21 nt, Homo sapiens
agaguacaccccaacagcacc

SEQ ID NO: 485339 - RNA, 13 nt, Homo sapiens
agagucugcacuu

SEQ ID NO: 485340 - RNA, 21 nt, Homo sapiens
agagugccagucagcagucau

SEQ ID NO: 485341 - RNA, 20 nt, Homo sapiens
agaugcuaccuugugaccca

SEQ ID NO: 485342 - RNA, 15 nt, Homo sapiens
agcaaaaaaguacuu

SEQ ID NO: 485343 - RNA, 15 nt, Homo sapiens
agcaaacacauuaag

SEQ ID NO: 485344 - RNA, 19 nt, Homo sapiens
agcacauucuggcucaggg

SEQ ID NO: 485345 - RNA, 21 nt, Homo sapiens
agcaccaaaauaaaucaucuu

SEQ ID NO: 485346 - RNA, 14 nt, Homo sapiens
agcacccucuccag

SEQ ID NO: 485347 - RNA, 21 nt, Homo sapiens
agcacuuuuugggguucaaga

SEQ ID NO: 485348 - RNA, 13 nt, Homo sapiens
agcauaacuuauu

SEQ ID NO: 485349 - RNA, 22 nt, Homo sapiens
agcaucugagcuaacuuauauu

SEQ ID NO: 485350 - RNA, 22 nt, Homo sapiens
agccagucuuuacagcugagca

SEQ ID NO: 485351 - RNA, 21 nt, Homo sapiens
agccagugcggcagguucaca

SEQ ID NO: 485352 - RNA, 19 nt, Homo sapiens
agcccaagauaucagccca

SEQ ID NO: 485353 - RNA, 19 nt, Homo sapiens
agcccuggcccccugaguu

SEQ ID NO: 485354 - RNA, 19 nt, Homo sapiens
agccucaccagcgcuugaa

SEQ ID NO: 485355 - RNA, 21 nt, Homo sapiens
agccuuggauguauaugucau

SEQ ID NO: 485356 - RNA, 18 nt, Homo sapiens
agcucuugaagacacuga

SEQ ID NO: 485357 - RNA, 21 nt, Homo sapiens
agcugggauuacaggugugca

SEQ ID NO: 485358 - RNA, 17 nt, Homo sapiens
agcuguucugucuuccc

SEQ ID NO: 485359 - RNA, 15 nt, Homo sapiens
agcuucucauccugc

SEQ ID NO: 485360 - RNA, 18 nt, Homo sapiens
aggaacacccccaugaca

SEQ ID NO: 485361 - RNA, 13 nt, Homo sapiens
aggagaacucuuu

SEQ ID NO: 485362 - RNA, 22 nt, Homo sapiens
aggaguacaccccaacagcacc

SEQ ID NO: 485363 - RNA, 21 nt, Homo sapiens
aggcagcuuuuucucucccac

SEQ ID NO: 485364 - RNA, 17 nt, Homo sapiens
aggcaucacaugcucaa

SEQ ID NO: 485365 - RNA, 18 nt, Homo sapiens
aggcaugagucagucuga

SEQ ID NO: 485366 - RNA, 16 nt, Homo sapiens
aggccagggucacuga

SEQ ID NO: 485367 - RNA, 11 nt, Homo sapiens
aggccuuccag

SEQ ID NO: 485368 - RNA, 22 nt, Homo sapiens
aggcugaucucgaacuccuaac

SEQ ID NO: 485369 - RNA, 14 nt, Homo sapiens
agggacuaccucug

SEQ ID NO: 485370 - RNA, 15 nt, Homo sapiens
gaauacauaaaguau

SEQ ID NO: 485371 - RNA, 19 nt, Homo sapiens
gacacguggugcauuuugc

SEQ ID NO: 485372 - RNA, 20 nt, Homo sapiens
gacagagccucgcucuguua

SEQ ID NO: 485373 - RNA, 15 nt, Homo sapiens
gaccuaucacuucca

SEQ ID NO: 485374 - RNA, 17 nt, Homo sapiens
gacuccugccgcaguga

SEQ ID NO: 485375 - RNA, 20 nt, Homo sapiens
gacuccugccgcagugauca

SEQ ID NO: 485376 - RNA, 11 nt, Homo sapiens
gagacucugaa

SEQ ID NO: 485377 - RNA, 15 nt, Homo sapiens
gagagucucccaggg

SEQ ID NO: 485378 - RNA, 16 nt, Homo sapiens
gaggaaaauccaaaag

SEQ ID NO: 485379 - RNA, 13 nt, Homo sapiens
gaggaaacuuuga

SEQ ID NO: 485380 - RNA, 17 nt, Homo sapiens
gagggagagucucccag

SEQ ID NO: 485381 - RNA, 18 nt, Homo sapiens
gagggguaacuugcaccu

SEQ ID NO: 485382 - RNA, 19 nt, Homo sapiens
gaguacuggcugauggagu

SEQ ID NO: 485383 - RNA, 22 nt, Homo sapiens
gaguaggugggggaacacugag

SEQ ID NO: 485384 - RNA, 16 nt, Homo sapiens
gaguccuccuguccag

SEQ ID NO: 485385 - RNA, 14 nt, Homo sapiens
gagugcccccaaca

SEQ ID NO: 485386 - RNA, 22 nt, Homo sapiens
gauauaauuuuauuacauauga

SEQ ID NO: 485387 - RNA, 20 nt, Homo sapiens
gaucucggcucagugcaacc

SEQ ID NO: 485388 - RNA, 18 nt, Homo sapiens
gaugagacagacauucac

SEQ ID NO: 485389 - RNA, 21 nt, Homo sapiens
gaugagaguacaccccaacag

SEQ ID NO: 485390 - RNA, 21 nt, Homo sapiens
gaugggcauaugugucagugg

SEQ ID NO: 485391 - RNA, 18 nt, Homo sapiens
gauuacaggugugcacca

SEQ ID NO: 485392 - RNA, 15 nt, Homo sapiens
gauuauuuuaaucua

SEQ ID NO: 485393 - RNA, 20 nt, Homo sapiens
gcaaaguauugugaaaguau

SEQ ID NO: 485394 - RNA, 13 nt, Homo sapiens
gcaauaaguacca

SEQ ID NO: 485395 - RNA, 13 nt, Homo sapiens
gcacccucuccag

SEQ ID NO: 485396 - RNA, 14 nt, Homo sapiens
gcacccucuccaga

SEQ ID NO: 485397 - RNA, 15 nt, Homo sapiens
gcacccucuccagau

SEQ ID NO: 485398 - RNA, 19 nt, Homo sapiens
gcacucuaacccuaggcau

SEQ ID NO: 485399 - RNA, 16 nt, Homo sapiens
gcagaaaauugccuaa

SEQ ID NO: 485400 - RNA, 16 nt, Homo sapiens
gcagaguacuggcuga

SEQ ID NO: 485401 - RNA, 23 nt, Homo sapiens
gcaggcaugagucagucugauga

SEQ ID NO: 485402 - RNA, 12 nt, Homo sapiens
gcauaacuuauu

SEQ ID NO: 485403 - RNA, 20 nt, Homo sapiens
gcauggcugagcugcccaca

SEQ ID NO: 485404 - RNA, 18 nt, Homo sapiens
gccaaguuuuaaauauua

SEQ ID NO: 485405 - RNA, 22 nt, Homo sapiens
gccaaguuuuaaauauuaucua

SEQ ID NO: 485406 - RNA, 15 nt, Homo sapiens
gccccaauucgaucc

SEQ ID NO: 485407 - RNA, 18 nt, Homo sapiens
gcccucuucauuuagcca

SEQ ID NO: 485408 - RNA, 19 nt, Homo sapiens
gccucaccagcgcuugaag

SEQ ID NO: 485409 - RNA, 14 nt, Homo sapiens
gcuaccuugugacc

SEQ ID NO: 485410 - RNA, 19 nt, Homo sapiens
gcuccucgagggcagggac

SEQ ID NO: 485411 - RNA, 17 nt, Homo sapiens
gcugagcugcccacagc

SEQ ID NO: 485412 - RNA, 15 nt, Homo sapiens
gcuggccuugccaca

SEQ ID NO: 485413 - RNA, 12 nt, Homo sapiens
gcugggcagcua

SEQ ID NO: 485414 - RNA, 17 nt, Homo sapiens
gcuucccagguucaagc

SEQ ID NO: 485415 - RNA, 19 nt, Homo sapiens
gcuuuaaaacuuauccucc

SEQ ID NO: 485416 - RNA, 20 nt, Homo sapiens
gcuuuaaccaccccaucugc

SEQ ID NO: 485417 - RNA, 19 nt, Homo sapiens
ggaaagguuugagaagcac

SEQ ID NO: 485418 - RNA, 18 nt, Homo sapiens
ggacuauuacauccacau

SEQ ID NO: 485419 - RNA, 17 nt, Homo sapiens
ggagggagagucuccca

SEQ ID NO: 485420 - RNA, 16 nt, Homo sapiens
ggagguuaagugacuu

SEQ ID NO: 485421 - RNA, 22 nt, Homo sapiens
ggaguacaccccaacagcaccc

SEQ ID NO: 485422 - RNA, 22 nt, Homo sapiens
ggcacucaauaaauauuuuugc

SEQ ID NO: 485423 - RNA, 18 nt, Homo sapiens
ggcucagugcaaccucug

SEQ ID NO: 485424 - RNA, 20 nt, Homo sapiens
ggcuuacacccacaguggaa

SEQ ID NO: 485425 - RNA, 19 nt, Homo sapiens
gggaaguacuacuccucaa

SEQ ID NO: 485426 - RNA, 15 nt, Homo sapiens
gggcaggcugagggu

SEQ ID NO: 485427 - RNA, 24 nt, Homo sapiens
ggggcugggcagcguacucaucau

SEQ ID NO: 485428 - RNA, 23 nt, Homo sapiens
gggggcucccguggccuguagaa

SEQ ID NO: 485429 - RNA, 16 nt, Homo sapiens
gguaacuugcaccucu

SEQ ID NO: 485430 - RNA, 20 nt, Homo sapiens
ggucagagacugcuguguuu

SEQ ID NO: 485431 - RNA, 18 nt, Homo sapiens
ggugucaaugaauuuugc

SEQ ID NO: 485432 - RNA, 18 nt, Homo sapiens
gguucuaacugcuguuaa

SEQ ID NO: 485433 - RNA, 16 nt, Homo sapiens
guaaguuuauaaugca

SEQ ID NO: 485434 - RNA, 16 nt, Homo sapiens
guaauugacacuauau

SEQ ID NO: 485435 - RNA, 15 nt, Homo sapiens
guacaccccaccucu

SEQ ID NO: 485436 - RNA, 22 nt, Homo sapiens
guaggugggggaacacugagaa

SEQ ID NO: 485437 - RNA, 16 nt, Homo sapiens
guauaaguccuugcaa

SEQ ID NO: 485438 - RNA, 20 nt, Homo sapiens
guauacccuguccuuucuca

SEQ ID NO: 485439 - RNA, 17 nt, Homo sapiens
guauuuuucagaaauca

SEQ ID NO: 485440 - RNA, 12 nt, Homo sapiens
gucaaugaacuu

SEQ ID NO: 485441 - RNA, 20 nt, Homo sapiens
gucacuggaaagagugccag

SEQ ID NO: 485442 - RNA, 22 nt, Homo sapiens
gucagucugaugagaacucuga

SEQ ID NO: 485443 - RNA, 17 nt, Homo sapiens
gucaguggaagaagcag

SEQ ID NO: 485444 - RNA, 14 nt, Homo sapiens
gucauuugugcaag

SEQ ID NO: 485445 - RNA, 22 nt, Homo sapiens
gucauuuuuauaaaacuuugaa

SEQ ID NO: 485446 - RNA, 23 nt, Homo sapiens
guccugauuacaaugcugucugu

SEQ ID NO: 485447 - RNA, 12 nt, Homo sapiens
gucucucucuuu

SEQ ID NO: 485448 - RNA, 14 nt, Homo sapiens
gugaacuccaccuc

SEQ ID NO: 485449 - RNA, 18 nt, Homo sapiens
gugcaaagauuugcuuua

SEQ ID NO: 485450 - RNA, 22 nt, Homo sapiens
gugcgaucucggcucagugcaa

SEQ ID NO: 485451 - RNA, 13 nt, Homo sapiens
guggagugcagug

SEQ ID NO: 485452 - RNA, 20 nt, Homo sapiens
guuaaccuuucuaaccuuca

SEQ ID NO: 485453 - RNA, 23 nt, Homo sapiens
guuacuauaugccgcuacaaaaa

SEQ ID NO: 485454 - RNA, 22 nt, Homo sapiens
guucaagaaguaaucaguaugc

SEQ ID NO: 485455 - RNA, 20 nt, Homo sapiens
guucaagacagaugggcaua

SEQ ID NO: 485456 - RNA, 17 nt, Homo sapiens
guucuaacugcuguuaa

SEQ ID NO: 485457 - RNA, 21 nt, Homo sapiens
guuucagggcuaacgaccaca

SEQ ID NO: 485458 - RNA, 18 nt, Homo sapiens
guuuuucauucacuuuaa

SEQ ID NO: 485459 - RNA, 14 nt, Homo sapiens
uaaauauagugaag

SEQ ID NO: 485460 - RNA, 13 nt, Homo sapiens
uaaauugauaaca

SEQ ID NO: 485461 - RNA, 20 nt, Homo sapiens
uaacccuaggcaucacaugc

SEQ ID NO: 485462 - RNA, 14 nt, Homo sapiens
uaaccuuucuaacc

SEQ ID NO: 485463 - RNA, 23 nt, Homo sapiens
uaacuuaaaaaacugcaucccac

SEQ ID NO: 485464 - RNA, 19 nt, Homo sapiens
uaagacucucgcaucuucc

SEQ ID NO: 485465 - RNA, 18 nt, Homo sapiens
uaagugcagucugaucca

SEQ ID NO: 485466 - RNA, 14 nt, Homo sapiens
uaauagacuuccca

SEQ ID NO: 485467 - RNA, 14 nt, Homo sapiens
uaaucaguaugcaa

SEQ ID NO: 485468 - RNA, 13 nt, Homo sapiens
uaauugacacuau

SEQ ID NO: 485469 - RNA, 12 nt, Homo sapiens
uaauuuaaucuu

SEQ ID NO: 485470 - RNA, 20 nt, Homo sapiens
uacaagagaagaaagugaaa

SEQ ID NO: 485471 - RNA, 19 nt, Homo sapiens
uacauaaaguaugugcaua

SEQ ID NO: 485472 - RNA, 16 nt, Homo sapiens
uacauauuuguauguu

SEQ ID NO: 485473 - RNA, 20 nt, Homo sapiens
uacccaggguggagugcagu

SEQ ID NO: 485474 - RNA, 15 nt, Homo sapiens
uaccuucaccaucug

SEQ ID NO: 485475 - RNA, 13 nt, Homo sapiens
uacucaucaucaa

SEQ ID NO: 485476 - RNA, 22 nt, Homo sapiens
uagaauagccuguggccuuugc

SEQ ID NO: 485477 - RNA, 18 nt, Homo sapiens
uaggcaucacaugcucaa

SEQ ID NO: 485478 - RNA, 14 nt, Homo sapiens
uagggcaguggagu

SEQ ID NO: 485479 - RNA, 21 nt, Homo sapiens
uaggugggggaacacugagaa

SEQ ID NO: 485480 - RNA, 16 nt, Homo sapiens
uaguugcauaagcauu

SEQ ID NO: 485481 - RNA, 14 nt, Homo sapiens
uauaaauauacaua

SEQ ID NO: 485482 - RNA, 17 nt, Homo sapiens
uauaaauuauagaaucu

SEQ ID NO: 485483 - RNA, 13 nt, Homo sapiens
uauauacaaagaa

SEQ ID NO: 485484 - RNA, 12 nt, Homo sapiens
aaaaaaacguau

SEQ ID NO: 485485 - RNA, 11 nt, Homo sapiens
aaaacagucau

SEQ ID NO: 485486 - RNA, 21 nt, Homo sapiens
aaaacagucaucuagaauuca

SEQ ID NO: 485487 - RNA, 19 nt, Homo sapiens
aaaaguacuaauagaacuu

SEQ ID NO: 485488 - RNA, 15 nt, Homo sapiens
aaaauauugaacuca

SEQ ID NO: 485489 - RNA, 14 nt, Homo sapiens
aaaauguacauguu

SEQ ID NO: 485490 - RNA, 23 nt, Homo sapiens
aaaaugucauuguucuugugaac

SEQ ID NO: 485491 - RNA, 12 nt, Homo sapiens
aaacacuccaca

SEQ ID NO: 485492 - RNA, 21 nt, Homo sapiens
aaacaguccuucaaacuucca

SEQ ID NO: 485493 - RNA, 21 nt, Homo sapiens
aaaccuugaugugccugugaa

SEQ ID NO: 485494 - RNA, 16 nt, Homo sapiens
aaacucuugagaucuu

SEQ ID NO: 485495 - RNA, 23 nt, Homo sapiens
aaacugcuuaugaaaaguacuaa

SEQ ID NO: 485496 - RNA, 22 nt, Homo sapiens
aaacuuccagugcaacacugaa

SEQ ID NO: 485497 - RNA, 16 nt, Homo sapiens
aaagauuugcuuuaau

SEQ ID NO: 485498 - RNA, 13 nt, Homo sapiens
aaagcgccccggg

SEQ ID NO: 485499 - RNA, 19 nt, Homo sapiens
aaagcuguucugucuuccc

SEQ ID NO: 485500 - RNA, 14 nt, Homo sapiens
aaagggacuaccuc

SEQ ID NO: 485501 - RNA, 16 nt, Homo sapiens
aaaguuggugucaaug

SEQ ID NO: 485502 - RNA, 15 nt, Homo sapiens
aaauauacauauaaa

SEQ ID NO: 485503 - RNA, 16 nt, Homo sapiens
aaauauuuuugcugua

SEQ ID NO: 485504 - RNA, 14 nt, Homo sapiens
aaauuauagaaucu

SEQ ID NO: 485505 - RNA, 15 nt, Homo sapiens
aacacauuaagccuu

SEQ ID NO: 485506 - RNA, 15 nt, Homo sapiens
aacagucacuggaaa

SEQ ID NO: 485507 - RNA, 17 nt, Homo sapiens
aacagugaggugcccag

SEQ ID NO: 485508 - RNA, 14 nt, Homo sapiens
aacagugugauuca

SEQ ID NO: 485509 - RNA, 14 nt, Homo sapiens
aacauuaacucuaa

SEQ ID NO: 485510 - RNA, 17 nt, Homo sapiens
aaccaccccaucugcau

SEQ ID NO: 485511 - RNA, 23 nt, Homo sapiens
aacccaaagugugacucauuaaa

SEQ ID NO: 485512 - RNA, 18 nt, Homo sapiens
aacucuaagacuacagca

SEQ ID NO: 485513 - RNA, 23 nt, Homo sapiens
aacucugagcagugcuugaauga

SEQ ID NO: 485514 - RNA, 13 nt, Homo sapiens
aagagauuccuga

SEQ ID NO: 485515 - RNA, 22 nt, Homo sapiens
aagagugccagucagcagucau

SEQ ID NO: 485516 - RNA, 19 nt, Homo sapiens
aagaguuucuuaacuuacu

SEQ ID NO: 485517 - RNA, 15 nt, Homo sapiens
aagcaaacacauuaa

SEQ ID NO: 485518 - RNA, 13 nt, Homo sapiens
aagcacuguucca

SEQ ID NO: 485519 - RNA, 16 nt, Homo sapiens
aagcagugcuucucaa

SEQ ID NO: 485520 - RNA, 13 nt, Homo sapiens
aagcauugcucaa

SEQ ID NO: 485521 - RNA, 21 nt, Homo sapiens
aagcuguucugucuucccacc

SEQ ID NO: 485522 - RNA, 15 nt, Homo sapiens
aagggacuaccucug

SEQ ID NO: 485523 - RNA, 20 nt, Homo sapiens
aagguuugagaagcacuguu

SEQ ID NO: 485524 - RNA, 13 nt, Homo sapiens
aaguauugaauua

SEQ ID NO: 485525 - RNA, 15 nt, Homo sapiens
aagugacuugcccag

SEQ ID NO: 485526 - RNA, 18 nt, Homo sapiens
aauaaacaagucaaagac

SEQ ID NO: 485527 - RNA, 22 nt, Homo sapiens
aauacauaaaguaugugcauau

SEQ ID NO: 485528 - RNA, 21 nt, Homo sapiens
aauaguuaucuuuuaauuaca

SEQ ID NO: 485529 - RNA, 15 nt, Homo sapiens
aauauccauccugaa

SEQ ID NO: 485530 - RNA, 13 nt, Homo sapiens
aauauugaacuca

SEQ ID NO: 485531 - RNA, 17 nt, Homo sapiens
aaucacaguuguguucc

SEQ ID NO: 485532 - RNA, 18 nt, Homo sapiens
aaucaccuaccuucacca

SEQ ID NO: 485533 - RNA, 21 nt, Homo sapiens
aaucaccuaggggucuuguua

SEQ ID NO: 485534 - RNA, 21 nt, Homo sapiens
aaucuuuuauacaauaauuga

SEQ ID NO: 485535 - RNA, 22 nt, Homo sapiens
aaucuuuuucagaaacagugag

SEQ ID NO: 485536 - RNA, 22 nt, Homo sapiens
aaugauagcaccuaaacuuaca

SEQ ID NO: 485537 - RNA, 16 nt, Homo sapiens
aaugggcacaaaaugg

SEQ ID NO: 485538 - RNA, 12 nt, Homo sapiens
aauguacauguu

SEQ ID NO: 485539 - RNA, 18 nt, Homo sapiens
aauguuagauaguuacua

SEQ ID NO: 485540 - RNA, 14 nt, Homo sapiens
aauuaauauaucau

SEQ ID NO: 485541 - RNA, 21 nt, Homo sapiens
aauucucauaaguagcauuca

SEQ ID NO: 485542 - RNA, 19 nt, Homo sapiens
aauuuaaucuuccauggau

SEQ ID NO: 485543 - RNA, 18 nt, Homo sapiens
aauuuuauuacauaugau

SEQ ID NO: 485544 - RNA, 17 nt, Homo sapiens
acaaacauguaagcaua

SEQ ID NO: 485545 - RNA, 16 nt, Homo sapiens
acacauuaagccuucc

SEQ ID NO: 485546 - RNA, 17 nt, Homo sapiens
acacauuaagccuucca

SEQ ID NO: 485547 - RNA, 23 nt, Homo sapiens
acacauuaagccuuccacacuca

SEQ ID NO: 485548 - RNA, 13 nt, Homo sapiens
acaccccaccucu

SEQ ID NO: 485549 - RNA, 10 nt, Homo sapiens
acacugagaa

SEQ ID NO: 485550 - RNA, 16 nt, Homo sapiens
acacugcagcugucug

SEQ ID NO: 485551 - RNA, 20 nt, Homo sapiens
acagaaugcggccucugaga

SEQ ID NO: 485552 - RNA, 21 nt, Homo sapiens
acagcugagcacauucuggcu

SEQ ID NO: 485553 - RNA, 16 nt, Homo sapiens
acaguaaacacuccac

SEQ ID NO: 485554 - RNA, 19 nt, Homo sapiens
acauccacaugauaccucu

SEQ ID NO: 485555 - RNA, 20 nt, Homo sapiens
acaugauaccucugaucaag

SEQ ID NO: 485556 - RNA, 18 nt, Homo sapiens
acauucucugaccuacuc

SEQ ID NO: 485557 - RNA, 17 nt, Homo sapiens
acauucuggcucaggga

SEQ ID NO: 485558 - RNA, 22 nt, Homo sapiens
accaagaagcccaagauaucag

SEQ ID NO: 485559 - RNA, 18 nt, Homo sapiens
accacagggucugcacuc

SEQ ID NO: 485560 - RNA, 19 nt, Homo sapiens
accagcgcuugaagccuga

SEQ ID NO: 485561 - RNA, 15 nt, Homo sapiens
accauccauguauuu

SEQ ID NO: 485562 - RNA, 12 nt, Homo sapiens
accaucuguaua

SEQ ID NO: 485563 - RNA, 15 nt, Homo sapiens
acccaggcaccugca

SEQ ID NO: 485564 - RNA, 20 nt, Homo sapiens
acccaggguggagugcagug

SEQ ID NO: 485565 - RNA, 20 nt, Homo sapiens
acccuaaaaagcagagcuuu

SEQ ID NO: 485566 - RNA, 22 nt, Homo sapiens
accgaggagggagagucuccca

SEQ ID NO: 485567 - RNA, 23 nt, Homo sapiens
accuacauuuuaaugcaccugaa

SEQ ID NO: 485568 - RNA, 15 nt, Homo sapiens
accuaggggucuugu

SEQ ID NO: 485569 - RNA, 13 nt, Homo sapiens
accucaagugauc

SEQ ID NO: 485570 - RNA, 22 nt, Homo sapiens
accucauggggguauuguauaa

SEQ ID NO: 485571 - RNA, 17 nt, Homo sapiens
cccaaagugugacucau

SEQ ID NO: 485572 - RNA, 10 nt, Homo sapiens
cccaacagca

SEQ ID NO: 485573 - RNA, 22 nt, Homo sapiens
cccaacagcacccucuccagau

SEQ ID NO: 485574 - RNA, 23 nt, Homo sapiens
cccacagcaggugcugagcaaag

SEQ ID NO: 485575 - RNA, 20 nt, Homo sapiens
cccacguagggcggcacuca

SEQ ID NO: 485576 - RNA, 13 nt, Homo sapiens
cccaggaguacac

SEQ ID NO: 485577 - RNA, 18 nt, Homo sapiens
cccaggguggagugcagu

SEQ ID NO: 485578 - RNA, 12 nt, Homo sapiens
cccaucugcauu

SEQ ID NO: 485579 - RNA, 23 nt, Homo sapiens
ccccaucugcauucccagcucua

SEQ ID NO: 485580 - RNA, 11 nt, Homo sapiens
cccccaacagc

SEQ ID NO: 485581 - RNA, 14 nt, Homo sapiens
cccccauuggacac

SEQ ID NO: 485582 - RNA, 13 nt, Homo sapiens
cccggaguucagu

SEQ ID NO: 485583 - RNA, 22 nt, Homo sapiens
cccuauggaagcauauuguuau

SEQ ID NO: 485584 - RNA, 19 nt, Homo sapiens
cccucuccucucuuccucc

SEQ ID NO: 485585 - RNA, 19 nt, Homo sapiens
cccuucuaaccugaacuga

SEQ ID NO: 485586 - RNA, 15 nt, Homo sapiens
cccuucucuaccuca

SEQ ID NO: 485587 - RNA, 19 nt, Homo sapiens
cccuucuuacaaugcauuc

SEQ ID NO: 485588 - RNA, 15 nt, Homo sapiens
ccgagaagccagugc

SEQ ID NO: 485589 - RNA, 15 nt, Homo sapiens
ccgcagugaucaaag

SEQ ID NO: 485590 - RNA, 14 nt, Homo sapiens
ccgggacuaccugg

SEQ ID NO: 485591 - RNA, 22 nt, Homo sapiens
ccuacauuuuaaugcaccugaa

SEQ ID NO: 485592 - RNA, 16 nt, Homo sapiens
gacaguaaacacucca

SEQ ID NO: 485593 - RNA, 19 nt, Homo sapiens
gacaugaagacaccaucuc

SEQ ID NO: 485594 - RNA, 16 nt, Homo sapiens
gacauucucugaccua

SEQ ID NO: 485595 - RNA, 14 nt, Homo sapiens
gacauugcauuugg

SEQ ID NO: 485596 - RNA, 15 nt, Homo sapiens
gaccccaccagccuc

SEQ ID NO: 485597 - RNA, 16 nt, Homo sapiens
gaccuacucgagggac

SEQ ID NO: 485598 - RNA, 18 nt, Homo sapiens
gacuacagcacacgucau

SEQ ID NO: 485599 - RNA, 22 nt, Homo sapiens
gacuaccucugugccuugccac

SEQ ID NO: 485600 - RNA, 23 nt, Homo sapiens
gacuauucccuucuaaccugaac

SEQ ID NO: 485601 - RNA, 20 nt, Homo sapiens
gagaagaaagugaaagcaaa

SEQ ID NO: 485602 - RNA, 21 nt, Homo sapiens
gagaagaaagugaaagcaaau

SEQ ID NO: 485603 - RNA, 16 nt, Homo sapiens
gagaagccagugcggc

SEQ ID NO: 485604 - RNA, 22 nt, Homo sapiens
gagaccccaccagccucaccag

SEQ ID NO: 485605 - RNA, 21 nt, Homo sapiens
gagagucucccagggagcaug

SEQ ID NO: 485606 - RNA, 22 nt, Homo sapiens
gagauuauuuuaaucuaauucu

SEQ ID NO: 485607 - RNA, 19 nt, Homo sapiens
gagcaaagggaacagugag

SEQ ID NO: 485608 - RNA, 16 nt, Homo sapiens
gagcagccaccccaug

SEQ ID NO: 485609 - RNA, 21 nt, Homo sapiens
gagcagugcuugaaugaaguu

SEQ ID NO: 485610 - RNA, 15 nt, Homo sapiens
gagcuuuauguaaua

SEQ ID NO: 485611 - RNA, 19 nt, Homo sapiens
gaggccuuccagggacgaa

SEQ ID NO: 485612 - RNA, 17 nt, Homo sapiens
gaguacaccccaacagc

SEQ ID NO: 485613 - RNA, 23 nt, Homo sapiens
gaguaggugggggaacacugaga

SEQ ID NO: 485614 - RNA, 24 nt, Homo sapiens
gaguaggugggggaacacugagaa

SEQ ID NO: 485615 - RNA, 13 nt, Homo sapiens
accccaacagcac

SEQ ID NO: 485616 - RNA, 15 nt, Homo sapiens
accccaacagcaccc

SEQ ID NO: 485617 - RNA, 18 nt, Homo sapiens
accccaacagcacccucu

SEQ ID NO: 485618 - RNA, 20 nt, Homo sapiens
acccuaaggucauuaccaca

SEQ ID NO: 485619 - RNA, 18 nt, Homo sapiens
acccuaggcaucacaugc

SEQ ID NO: 485620 - RNA, 15 nt, Homo sapiens
accuaaacuuacauu

SEQ ID NO: 485621 - RNA, 18 nt, Homo sapiens
accuaaacuuacauuuaa

SEQ ID NO: 485622 - RNA, 22 nt, Homo sapiens
accugggcugaggcauccuucc

SEQ ID NO: 485623 - RNA, 23 nt, Homo sapiens
accuucacgauuaacugugaaau

SEQ ID NO: 485624 - RNA, 17 nt, Homo sapiens
accuugaugugccugug

SEQ ID NO: 485625 - RNA, 19 nt, Homo sapiens
accuugaugugccugugaa

SEQ ID NO: 485626 - RNA, 20 nt, Homo sapiens
accuugugacccagcacugc

SEQ ID NO: 485627 - RNA, 18 nt, Homo sapiens
acguggugcauuuugcuu

SEQ ID NO: 485628 - RNA, 21 nt, Homo sapiens
acucuacuucccaguaacccu

SEQ ID NO: 485629 - RNA, 23 nt, Homo sapiens
acucucuggugagcgaggacauu

SEQ ID NO: 485630 - RNA, 14 nt, Homo sapiens
acucuugagaucuu

SEQ ID NO: 485631 - RNA, 18 nt, Homo sapiens
acugaaaacaagccauga

SEQ ID NO: 485632 - RNA, 18 nt, Homo sapiens
acugaaggccuggcccac

SEQ ID NO: 485633 - RNA, 15 nt, Homo sapiens
acugagagucugcac

SEQ ID NO: 485634 - RNA, 18 nt, Homo sapiens
acugagagucugcacuua

SEQ ID NO: 485635 - RNA, 17 nt, Homo sapiens
acuggaaagagugccag

SEQ ID NO: 485636 - RNA, 21 nt, Homo sapiens
acuguaaagcuuugugcagau

SEQ ID NO: 485637 - RNA, 18 nt, Homo sapiens
acuugcaccucugaccua

SEQ ID NO: 485638 - RNA, 10 nt, Homo sapiens
agaagccagu

SEQ ID NO: 485639 - RNA, 20 nt, Homo sapiens
agaaucagugcaaagauuug

SEQ ID NO: 485640 - RNA, 15 nt, Homo sapiens
agacagcuucucauc

SEQ ID NO: 485641 - RNA, 13 nt, Homo sapiens
agaccacaaauag

SEQ ID NO: 485642 - RNA, 18 nt, Homo sapiens
agacuauucccuucuaac

SEQ ID NO: 485643 - RNA, 22 nt, Homo sapiens
agagauuccugagccaguguca

SEQ ID NO: 485644 - RNA, 16 nt, Homo sapiens
cugagaaguaccuuug

SEQ ID NO: 485645 - RNA, 14 nt, Homo sapiens
cugagagucugcac

SEQ ID NO: 485646 - RNA, 21 nt, Homo sapiens
cugagcaaagggaacagugag

SEQ ID NO: 485647 - RNA, 14 nt, Homo sapiens
cugauuuuacacac

SEQ ID NO: 485648 - RNA, 11 nt, Homo sapiens
cugcacucuaa

SEQ ID NO: 485649 - RNA, 20 nt, Homo sapiens
cugcacucuaacccuaggca

SEQ ID NO: 485650 - RNA, 18 nt, Homo sapiens
cuggagcagccaccccau

SEQ ID NO: 485651 - RNA, 19 nt, Homo sapiens
cugggauuacaggugugca

SEQ ID NO: 485652 - RNA, 20 nt, Homo sapiens
cugggauuacaggugugcac

SEQ ID NO: 485653 - RNA, 16 nt, Homo sapiens
cugucucccgggacua

SEQ ID NO: 485654 - RNA, 15 nt, Homo sapiens
cugugaaucaccuag

SEQ ID NO: 485655 - RNA, 18 nt, Homo sapiens
cugugacaaagaagacca

SEQ ID NO: 485656 - RNA, 15 nt, Homo sapiens
cuucaccaucuguau

SEQ ID NO: 485657 - RNA, 21 nt, Homo sapiens
cuuccacacucaccucuaaaa

SEQ ID NO: 485658 - RNA, 13 nt, Homo sapiens
cuucccacucuag

SEQ ID NO: 485659 - RNA, 20 nt, Homo sapiens
cuucccaggaguacacccca

SEQ ID NO: 485660 - RNA, 13 nt, Homo sapiens
cuuccucacacca

SEQ ID NO: 485661 - RNA, 14 nt, Homo sapiens
cuuccucacaccag

SEQ ID NO: 485662 - RNA, 16 nt, Homo sapiens
cuugaagacacugaaa

SEQ ID NO: 485663 - RNA, 15 nt, Homo sapiens
cuugcccaguuucag

SEQ ID NO: 485664 - RNA, 18 nt, Homo sapiens
cuuggggucagagacugc

SEQ ID NO: 485665 - RNA, 14 nt, Homo sapiens
cuuguaaauaugau

SEQ ID NO: 485666 - RNA, 18 nt, Homo sapiens
cuugugacccagcacugc

SEQ ID NO: 485667 - RNA, 20 nt, Homo sapiens
cuuguuaagugcagucugau

SEQ ID NO: 485668 - RNA, 15 nt, Homo sapiens
cuuuaaaacuuaucc

SEQ ID NO: 485669 - RNA, 16 nt, Homo sapiens
cuuuauuaaguagaug

SEQ ID NO: 485670 - RNA, 18 nt, Homo sapiens
cuuuauuaaguagaugaa

SEQ ID NO: 485671 - RNA, 18 nt, Homo sapiens
cuuuugggaauggacuca

SEQ ID NO: 485672 - RNA, 18 nt, Homo sapiens
auuuguuaagguucaaga

SEQ ID NO: 485673 - RNA, 16 nt, Homo sapiens
caaaccuugaugugcc

SEQ ID NO: 485674 - RNA, 20 nt, Homo sapiens
caaagaagaccacaaauagu

SEQ ID NO: 485675 - RNA, 17 nt, Homo sapiens
caaagauuugcuuuaau

SEQ ID NO: 485676 - RNA, 11 nt, Homo sapiens
caaagugugac

SEQ ID NO: 485677 - RNA, 17 nt, Homo sapiens
caaauaauuuguauacc

SEQ ID NO: 485678 - RNA, 21 nt, Homo sapiens
caaaugggguuucacaaauag

SEQ ID NO: 485679 - RNA, 14 nt, Homo sapiens
caacagcacccucu

SEQ ID NO: 485680 - RNA, 15 nt, Homo sapiens
caacccuaaaaagca

SEQ ID NO: 485681 - RNA, 17 nt, Homo sapiens
caagagaagaaagugaa

SEQ ID NO: 485682 - RNA, 19 nt, Homo sapiens
caagauaucagcccaaaag

SEQ ID NO: 485683 - RNA, 15 nt, Homo sapiens
caagugauccuccca

SEQ ID NO: 485684 - RNA, 17 nt, Homo sapiens
caauaaacagucacugg

SEQ ID NO: 485685 - RNA, 11 nt, Homo sapiens
caaugaacuuu

SEQ ID NO: 485686 - RNA, 16 nt, Homo sapiens
caaugcauucugaggu

SEQ ID NO: 485687 - RNA, 23 nt, Homo sapiens
cacacucuuucuccugcuuuaac

SEQ ID NO: 485688 - RNA, 16 nt, Homo sapiens
cacagcaggugcugag

SEQ ID NO: 485689 - RNA, 19 nt, Homo sapiens
cacagcaguagcaguagau

SEQ ID NO: 485690 - RNA, 14 nt, Homo sapiens
cacagggucugcac

SEQ ID NO: 485691 - RNA, 16 nt, Homo sapiens
cacagggucugcacuc

SEQ ID NO: 485692 - RNA, 17 nt, Homo sapiens
cacaguuguguuccuga

SEQ ID NO: 485693 - RNA, 17 nt, Homo sapiens
cacaugcucaaugacuc

SEQ ID NO: 485694 - RNA, 19 nt, Homo sapiens
cacauggggcugggcagcu

SEQ ID NO: 485695 - RNA, 15 nt, Homo sapiens
cacccccaugacauu

SEQ ID NO: 485696 - RNA, 12 nt, Homo sapiens
cacccuguguug

SEQ ID NO: 485697 - RNA, 20 nt, Homo sapiens
cacucuagggcaguggaguc

SEQ ID NO: 485698 - RNA, 14 nt, Homo sapiens
cacugguaauccca

SEQ ID NO: 485699 - RNA, 22 nt, Homo sapiens
cagacauuccuucuacauguaa

SEQ ID NO: 485700 - RNA, 14 nt, Homo sapiens
cagaccucuggauu

SEQ ID NO: 485701 - RNA, 18 nt, Homo sapiens
aggggcccuggagcagcc

SEQ ID NO: 485702 - RNA, 21 nt, Homo sapiens
aggggucuuguuaagugcagu

SEQ ID NO: 485703 - RNA, 15 nt, Homo sapiens
agggucugcacucua

SEQ ID NO: 485704 - RNA, 23 nt, Homo sapiens
agguccuggcaaagaugaucagu

SEQ ID NO: 485705 - RNA, 18 nt, Homo sapiens
aggugggggaacacugag

SEQ ID NO: 485706 - RNA, 19 nt, Homo sapiens
aggugggggaacacugaga

SEQ ID NO: 485707 - RNA, 11 nt, Homo sapiens
agguucaagac

SEQ ID NO: 485708 - RNA, 14 nt, Homo sapiens
agguucaagcgauu

SEQ ID NO: 485709 - RNA, 15 nt, Homo sapiens
agguuucaccaugau

SEQ ID NO: 485710 - RNA, 21 nt, Homo sapiens
aguacaccccaacagcacccu

SEQ ID NO: 485711 - RNA, 21 nt, Homo sapiens
aguagauuuuaaaaguuauua

SEQ ID NO: 485712 - RNA, 23 nt, Homo sapiens
aguaggugggggaacacugagaa

SEQ ID NO: 485713 - RNA, 18 nt, Homo sapiens
aguaugaaaaugucauug

SEQ ID NO: 485714 - RNA, 14 nt, Homo sapiens
aguauucuaagcca

SEQ ID NO: 485715 - RNA, 22 nt, Homo sapiens
agucuuuacagcugagcacauu

SEQ ID NO: 485716 - RNA, 22 nt, Homo sapiens
aguggaaagacagcuucucauc

SEQ ID NO: 485717 - RNA, 22 nt, Homo sapiens
aguggugcgaucucggcucagu

SEQ ID NO: 485718 - RNA, 20 nt, Homo sapiens
agugucaggaggaaggcuua

SEQ ID NO: 485719 - RNA, 20 nt, Homo sapiens
aguuguguuccugacacuca

SEQ ID NO: 485720 - RNA, 16 nt, Homo sapiens
auaaacagucacugga

SEQ ID NO: 485721 - RNA, 17 nt, Homo sapiens
auaaauuauagaaucua

SEQ ID NO: 485722 - RNA, 17 nt, Homo sapiens
auaauuacauauuugca

SEQ ID NO: 485723 - RNA, 15 nt, Homo sapiens
auaauuuucaagcaa

SEQ ID NO: 485724 - RNA, 13 nt, Homo sapiens
auaugagcuuuau

SEQ ID NO: 485725 - RNA, 18 nt, Homo sapiens
auauuucacagcaccaaa

SEQ ID NO: 485726 - RNA, 13 nt, Homo sapiens
auauuuuauacau

SEQ ID NO: 485727 - RNA, 22 nt, Homo sapiens
aucaccuaccuucaccaucugu

SEQ ID NO: 485728 - RNA, 11 nt, Homo sapiens
aucacuuccac

SEQ ID NO: 485729 - RNA, 17 nt, Homo sapiens
aucaguccaaagggcau

SEQ ID NO: 485730 - RNA, 15 nt, Homo sapiens
aucaucaacccuaaa

SEQ ID NO: 485731 - RNA, 20 nt, Homo sapiens
aucaucuuuauuaaguagau

SEQ ID NO: 485732 - RNA, 18 nt, Homo sapiens
aucaugucuccucuccca

SEQ ID NO: 485733 - RNA, 15 nt, Homo sapiens
aucuccucagcaccc

SEQ ID NO: 485734 - RNA, 20 nt, Homo sapiens
aucucgaacuccuaaccuca

SEQ ID NO: 485735 - RNA, 20 nt, Homo sapiens
aucugaggguauaaagacau

SEQ ID NO: 485736 - RNA, 17 nt, Homo sapiens
aucuuuuaauuacagaa

SEQ ID NO: 485737 - RNA, 14 nt, Homo sapiens
augacauugcauuu

SEQ ID NO: 485738 - RNA, 13 nt, Homo sapiens
augagacagacau

SEQ ID NO: 485739 - RNA, 18 nt, Homo sapiens
augcagccccaucuccuc

SEQ ID NO: 485740 - RNA, 14 nt, Homo sapiens
augccgcuacaaaa

SEQ ID NO: 485741 - RNA, 21 nt, Homo sapiens
augcugucuguccaacugccu

SEQ ID NO: 485742 - RNA, 13 nt, Homo sapiens
auggaagcauauu

SEQ ID NO: 485743 - RNA, 19 nt, Homo sapiens
auggcguggucaagcacuc

SEQ ID NO: 485744 - RNA, 18 nt, Homo sapiens
augggguuucacaaauag

SEQ ID NO: 485745 - RNA, 19 nt, Homo sapiens
augucauuguucuugugaa

SEQ ID NO: 485746 - RNA, 22 nt, Homo sapiens
auguugagggaagcuuccauaa

SEQ ID NO: 485747 - RNA, 17 nt, Homo sapiens
auuacaggugugcacca

SEQ ID NO: 485748 - RNA, 19 nt, Homo sapiens
auuacauauuugcauaugu

SEQ ID NO: 485749 - RNA, 20 nt, Homo sapiens
auuagccagucuuuacagcu

SEQ ID NO: 485750 - RNA, 19 nt, Homo sapiens
auuauuuaaacaucagcaa

SEQ ID NO: 485751 - RNA, 16 nt, Homo sapiens
auucccagcucuaccc

SEQ ID NO: 485752 - RNA, 16 nt, Homo sapiens
auuccugagccagugu

SEQ ID NO: 485753 - RNA, 21 nt, Homo sapiens
auuccuucuacauguaaugac

SEQ ID NO: 485754 - RNA, 15 nt, Homo sapiens
auucuggcucaggga

SEQ ID NO: 485755 - RNA, 15 nt, Homo sapiens
auuguugaaagccau

SEQ ID NO: 485756 - RNA, 11 nt, Homo sapiens
auuuagccaau

SEQ ID NO: 485757 - RNA, 22 nt, Homo sapiens
auuuaguaaauaaacaagucaa

SEQ ID NO: 485758 - RNA, 21 nt, Homo sapiens
auuuuaguaagagauuccuga

SEQ ID NO: 485759 - RNA, 14 nt, Homo sapiens
auuuuauacauuaa

SEQ ID NO: 485760 - RNA, 23 nt, Homo sapiens
auuuugguggguuuugaacauaa

SEQ ID NO: 485761 - RNA, 23 nt, Homo sapiens
caaaauguccugauuacaaugcu

SEQ ID NO: 485762 - RNA, 21 nt, Homo sapiens
caaacacauuaagccuuccac

SEQ ID NO: 485763 - RNA, 19 nt, Homo sapiens
caaagaagaccacaaauag

SEQ ID NO: 485764 - RNA, 14 nt, Homo sapiens
caaagacuauuccc

SEQ ID NO: 485765 - RNA, 19 nt, Homo sapiens
caaagaugaucaguaugaa

SEQ ID NO: 485766 - RNA, 13 nt, Homo sapiens
caaauaguuguaa

SEQ ID NO: 485767 - RNA, 17 nt, Homo sapiens
caaaugggguuucacaa

SEQ ID NO: 485768 - RNA, 17 nt, Homo sapiens
caaauuuucacauaaaa

SEQ ID NO: 485769 - RNA, 16 nt, Homo sapiens
caagaaucagugcaaa

SEQ ID NO: 485770 - RNA, 19 nt, Homo sapiens
caagucugagcccucaaaa

SEQ ID NO: 485771 - RNA, 13 nt, Homo sapiens
caaucuuuuauac

SEQ ID NO: 485772 - RNA, 15 nt, Homo sapiens
caaugaauuuugcuu

SEQ ID NO: 485773 - RNA, 13 nt, Homo sapiens
cacaauacaauaa

SEQ ID NO: 485774 - RNA, 16 nt, Homo sapiens
cacacagcaguagcag

SEQ ID NO: 485775 - RNA, 19 nt, Homo sapiens
cacacggggugcgucuccc

SEQ ID NO: 485776 - RNA, 18 nt, Homo sapiens
cacacucaccucuaaaac

SEQ ID NO: 485777 - RNA, 22 nt, Homo sapiens
cacagcaggugcugagcaaagg

SEQ ID NO: 485778 - RNA, 13 nt, Homo sapiens
cacauucuucagu

SEQ ID NO: 485779 - RNA, 15 nt, Homo sapiens
caccacacccggcua

SEQ ID NO: 485780 - RNA, 13 nt, Homo sapiens
caccccaccucuu

SEQ ID NO: 485781 - RNA, 14 nt, Homo sapiens
cacccucuccagau

SEQ ID NO: 485782 - RNA, 16 nt, Homo sapiens
cacgauuaacugugaa

SEQ ID NO: 485783 - RNA, 19 nt, Homo sapiens
cacucuagggcaguggagu

SEQ ID NO: 485784 - RNA, 18 nt, Homo sapiens
cacucuuucuccugcuuu

SEQ ID NO: 485785 - RNA, 21 nt, Homo sapiens
cacugcccaaagugcuuccaa

SEQ ID NO: 485786 - RNA, 16 nt, Homo sapiens
cacugguaaucccaag

SEQ ID NO: 485787 - RNA, 17 nt, Homo sapiens
cagaagaguuucuuaac

SEQ ID NO: 485788 - RNA, 17 nt, Homo sapiens
cagagccucgcucuguu

SEQ ID NO: 485789 - RNA, 14 nt, Homo sapiens
cagaugagaguaca

SEQ ID NO: 485790 - RNA, 21 nt, Homo sapiens
cagaugcagaaaauugccuaa

SEQ ID NO: 485791 - RNA, 19 nt, Homo sapiens
cagaugggcauauguguca

SEQ ID NO: 485792 - RNA, 22 nt, Homo sapiens
cagaugggcauaugugucagug

SEQ ID NO: 485793 - RNA, 20 nt, Homo sapiens
cagcaggacuguccccuuga

SEQ ID NO: 485794 - RNA, 14 nt, Homo sapiens
cagccuggcaaggg

SEQ ID NO: 485795 - RNA, 12 nt, Homo sapiens
caggcaccugca

SEQ ID NO: 485796 - RNA, 19 nt, Homo sapiens
caggcagcuuuuucucucc

SEQ ID NO: 485797 - RNA, 12 nt, Homo sapiens
cagggagcauga

SEQ ID NO: 485798 - RNA, 14 nt, Homo sapiens
cagggagcaugaga

SEQ ID NO: 485799 - RNA, 15 nt, Homo sapiens
caguaaacacuccac

SEQ ID NO: 485800 - RNA, 15 nt, Homo sapiens
cagucagcagucaug

SEQ ID NO: 485801 - RNA, 21 nt, Homo sapiens
cagugcaacacugaagcucuu

SEQ ID NO: 485802 - RNA, 17 nt, Homo sapiens
cauaauuacucuacuuc

SEQ ID NO: 485803 - RNA, 12 nt, Homo sapiens
cauauuucacag

SEQ ID NO: 485804 - RNA, 22 nt, Homo sapiens
caucacaugcucaaugacucuc

SEQ ID NO: 485805 - RNA, 14 nt, Homo sapiens
caucagcaaaaaag

SEQ ID NO: 485806 - RNA, 15 nt, Homo sapiens
caucucagugcugua

SEQ ID NO: 485807 - RNA, 18 nt, Homo sapiens
caucucagugcuguaaaa

SEQ ID NO: 485808 - RNA, 14 nt, Homo sapiens
caucugcauuccca

SEQ ID NO: 485809 - RNA, 20 nt, Homo sapiens
caugaaagcaucugagcuaa

SEQ ID NO: 485810 - RNA, 19 nt, Homo sapiens
caugugaccgaacacugca

SEQ ID NO: 485811 - RNA, 23 nt, Homo sapiens
cauuaucuuugcuguuauugaca

SEQ ID NO: 485812 - RNA, 16 nt, Homo sapiens
cauuccuccaccugcc

SEQ ID NO: 485813 - RNA, 16 nt, Homo sapiens
cauucuggcucaggga

SEQ ID NO: 485814 - RNA, 19 nt, Homo sapiens
cauuggacacguggugcau

SEQ ID NO: 485815 - RNA, 20 nt, Homo sapiens
cauuguucuugugaacccaa

SEQ ID NO: 485816 - RNA, 15 nt, Homo sapiens
uuuaguaaauaaaca

SEQ ID NO: 485817 - RNA, 17 nt, Homo sapiens
uuuauuuuugagacaga

SEQ ID NO: 485818 - RNA, 12 nt, Homo sapiens
uuucauucacuu

SEQ ID NO: 485819 - RNA, 13 nt, Homo sapiens
uuucuaaccuuca

SEQ ID NO: 485820 - RNA, 14 nt, Homo sapiens
uuugacauuuacug

SEQ ID NO: 485821 - RNA, 14 nt, Homo sapiens
uuugaugaaaucag

SEQ ID NO: 485822 - RNA, 11 nt, Homo sapiens
uuugcuuuaau

SEQ ID NO: 485823 - RNA, 12 nt, Homo sapiens
uuugugcaagac

SEQ ID NO: 485824 - RNA, 22 nt, Homo sapiens
uuuucaagcaaaguauugugaa

SEQ ID NO: 485825 - RNA, 21 nt, Homo sapiens
uuuuuucccccuaucaguuga

SEQ ID NO: 485826 - RNA, 17 nt, Homo sapiens
acuucuaccuacauauu

SEQ ID NO: 485827 - RNA, 15 nt, Homo sapiens
acuuggggucagaga

SEQ ID NO: 485828 - RNA, 15 nt, Homo sapiens
agaaaucaaacugcu

SEQ ID NO: 485829 - RNA, 16 nt, Homo sapiens
agaacucugagcagug

SEQ ID NO: 485830 - RNA, 20 nt, Homo sapiens
agaagaccacaaauaguuau

SEQ ID NO: 485831 - RNA, 22 nt, Homo sapiens
agaagccagugcggcagguuca

SEQ ID NO: 485832 - RNA, 15 nt, Homo sapiens
agaaguaaucaguau

SEQ ID NO: 485833 - RNA, 14 nt, Homo sapiens
agacagcuucucau

SEQ ID NO: 485834 - RNA, 13 nt, Homo sapiens
agacuacagcaca

SEQ ID NO: 485835 - RNA, 14 nt, Homo sapiens
agacugcuguguuu

SEQ ID NO: 485836 - RNA, 20 nt, Homo sapiens
agaguacaccccaacagcac

SEQ ID NO: 485837 - RNA, 15 nt, Homo sapiens
agauaucagcccaaa

SEQ ID NO: 485838 - RNA, 19 nt, Homo sapiens
agaucuugguccuguguuu

SEQ ID NO: 485839 - RNA, 14 nt, Homo sapiens
agaugaaacauuaa

SEQ ID NO: 485840 - RNA, 18 nt, Homo sapiens
agcaaaaaaguacuuaaa

SEQ ID NO: 485841 - RNA, 16 nt, Homo sapiens
agcaacucuaagacua

SEQ ID NO: 485842 - RNA, 12 nt, Homo sapiens
agcacuguucca

SEQ ID NO: 485843 - RNA, 21 nt, Homo sapiens
agcagaugagaaacucuugag

SEQ ID NO: 485844 - RNA, 14 nt, Homo sapiens
agcagugcuucuca

SEQ ID NO: 485845 - RNA, 17 nt, Homo sapiens
agccaaguuuuaaauau

SEQ ID NO: 485846 - RNA, 14 nt, Homo sapiens
agccccaauucgau

SEQ ID NO: 485847 - RNA, 21 nt, Homo sapiens
agccuuccacacucaccucua

SEQ ID NO: 485848 - RNA, 18 nt, Homo sapiens
agcgauucuccugccuca

SEQ ID NO: 485849 - RNA, 21 nt, Homo sapiens
agcuucuauuagccagucuuu

SEQ ID NO: 485850 - RNA, 19 nt, Homo sapiens
aggaauacauaaaguaugu

SEQ ID NO: 485851 - RNA, 21 nt, Homo sapiens
aggaguacaccccaacagcac

SEQ ID NO: 485852 - RNA, 20 nt, Homo sapiens
aggcagcuuuuucucuccca

SEQ ID NO: 485853 - RNA, 23 nt, Homo sapiens
aggcagcuuuuucucucccacua

SEQ ID NO: 485854 - RNA, 16 nt, Homo sapiens
aggcauccuuccucac

SEQ ID NO: 485855 - RNA, 17 nt, Homo sapiens
aggccuggcccacagca

SEQ ID NO: 485856 - RNA, 14 nt, Homo sapiens
agggaagcuuccau

SEQ ID NO: 485857 - RNA, 21 nt, Homo sapiens
agggagguuaagugacuugcc

SEQ ID NO: 485858 - RNA, 21 nt, Homo sapiens
aggugggggaacacugagaaa

SEQ ID NO: 485859 - RNA, 18 nt, Homo sapiens
agguuugagaagcacugu

SEQ ID NO: 485860 - RNA, 14 nt, Homo sapiens
aguaaaacagucau

SEQ ID NO: 485861 - RNA, 17 nt, Homo sapiens
aguacaccccaacagca

SEQ ID NO: 485862 - RNA, 23 nt, Homo sapiens
aguacaccccaacagcacccucu

SEQ ID NO: 485863 - RNA, 17 nt, Homo sapiens
aguagaugaaacauuaa

SEQ ID NO: 485864 - RNA, 20 nt, Homo sapiens
aguaggugggggaacacuga

SEQ ID NO: 485865 - RNA, 22 nt, Homo sapiens
aguaggugggggaacacugaga

SEQ ID NO: 485866 - RNA, 13 nt, Homo sapiens
aguaugugcauau

SEQ ID NO: 485867 - RNA, 13 nt, Homo sapiens
agucagcagucau

SEQ ID NO: 485868 - RNA, 19 nt, Homo sapiens
agucugaugagaacucuga

SEQ ID NO: 485869 - RNA, 14 nt, Homo sapiens
agugauccucccac

SEQ ID NO: 485870 - RNA, 14 nt, Homo sapiens
agugcaacacugaa

SEQ ID NO: 485871 - RNA, 14 nt, Homo sapiens
agugcaguggugcg

SEQ ID NO: 485872 - RNA, 21 nt, Homo sapiens
aguuaaagcagugcuucucaa

SEQ ID NO: 485873 - RNA, 23 nt, Homo sapiens
aguugcuaacuuaaaaaacugca

SEQ ID NO: 485874 - RNA, 14 nt, Homo sapiens
auaaauauacauau

SEQ ID NO: 485875 - RNA, 12 nt, Homo sapiens
auaaguccuugc

SEQ ID NO: 485876 - RNA, 22 nt, Homo sapiens
auagcuugucuucguccaucug

SEQ ID NO: 485877 - RNA, 13 nt, Homo sapiens
auagugaagcaau

SEQ ID NO: 485878 - RNA, 19 nt, Homo sapiens
auagugaagcaauuugaaa

SEQ ID NO: 485879 - RNA, 19 nt, Homo sapiens
auaucagcccaaaagucaa

SEQ ID NO: 485880 - RNA, 20 nt, Homo sapiens
aucaaguauuuuugacauuu

SEQ ID NO: 485881 - RNA, 21 nt, Homo sapiens
aucacaugcucaaugacucuc

SEQ ID NO: 485882 - RNA, 12 nt, Homo sapiens
aucacuuccacu

SEQ ID NO: 485883 - RNA, 20 nt, Homo sapiens
aucagcaaaaaaguacuuaa

SEQ ID NO: 485884 - RNA, 21 nt, Homo sapiens
aucaugguuuuucuuaguaga

SEQ ID NO: 485885 - RNA, 17 nt, Homo sapiens
aucuagaauucacugag

SEQ ID NO: 485886 - RNA, 19 nt, Homo sapiens
aucucggcucagugcaacc

SEQ ID NO: 485887 - RNA, 15 nt, Homo sapiens
aucucuuuccuccua

SEQ ID NO: 485888 - RNA, 16 nt, Homo sapiens
aucugagcuaacuuau

SEQ ID NO: 485889 - RNA, 13 nt, Homo sapiens
aucuuugcuguua

SEQ ID NO: 485890 - RNA, 16 nt, Homo sapiens
aucuuuuaauuacaga

SEQ ID NO: 485891 - RNA, 13 nt, Homo sapiens
augaaaaugucau

SEQ ID NO: 485892 - RNA, 17 nt, Homo sapiens
augaaaugucaguggaa

SEQ ID NO: 485893 - RNA, 16 nt, Homo sapiens
augaagcaaacacauu

SEQ ID NO: 485894 - RNA, 16 nt, Homo sapiens
augagacagacauuca

SEQ ID NO: 485895 - RNA, 17 nt, Homo sapiens
augagacagacauucac

SEQ ID NO: 485896 - RNA, 16 nt, Homo sapiens
augcaggggaaguacu

SEQ ID NO: 485897 - RNA, 15 nt, Homo sapiens
augcuggccuugcca

SEQ ID NO: 485898 - RNA, 19 nt, Homo sapiens
auggccccugccuucccag

SEQ ID NO: 485899 - RNA, 20 nt, Homo sapiens
auggcugagcugcccacagc

SEQ ID NO: 485900 - RNA, 14 nt, Homo sapiens
augggguuucacaa

SEQ ID NO: 485901 - RNA, 21 nt, Homo sapiens
auggguuucuccagagggaau

SEQ ID NO: 485902 - RNA, 17 nt, Homo sapiens
auguaagcauaacuuau

SEQ ID NO: 485903 - RNA, 16 nt, Homo sapiens
auguaauaaugugaau

SEQ ID NO: 485904 - RNA, 19 nt, Homo sapiens
auguccugauuacaaugcu

SEQ ID NO: 485905 - RNA, 18 nt, Homo sapiens
augugaccgaacacugca

SEQ ID NO: 485906 - RNA, 13 nt, Homo sapiens
auuaacugugaaa

SEQ ID NO: 485907 - RNA, 20 nt, Homo sapiens
auuacagaagaguuucuuaa

SEQ ID NO: 485908 - RNA, 15 nt, Homo sapiens
auuacaggugugcac

SEQ ID NO: 485909 - RNA, 16 nt, Homo sapiens
auuaucuuugcuguua

SEQ ID NO: 485910 - RNA, 17 nt, Homo sapiens
auuauuuaaacaucagc

SEQ ID NO: 485911 - RNA, 16 nt, Homo sapiens
auugaacucaaugaua

SEQ ID NO: 485912 - RNA, 23 nt, Homo sapiens
auugacacuauauauuucuuaau

SEQ ID NO: 485913 - RNA, 16 nt, Homo sapiens
auugcuaagaagggaa

SEQ ID NO: 485914 - RNA, 23 nt, Homo sapiens
auugugaaaguauucuaagccaa

SEQ ID NO: 485915 - RNA, 12 nt, Homo sapiens
auugugccugua

SEQ ID NO: 485916 - RNA, 14 nt, Homo sapiens
auuuaaacaucagc

SEQ ID NO: 485917 - RNA, 17 nt, Homo sapiens
auuucacagcaccaaaa

SEQ ID NO: 485918 - RNA, 22 nt, Homo sapiens
auuugaaauaauuuucaagcaa

SEQ ID NO: 485919 - RNA, 21 nt, Homo sapiens
auuugcuauagaaaacaauac

SEQ ID NO: 485920 - RNA, 22 nt, Homo sapiens
auuugcuauagaaaacaauaca

SEQ ID NO: 485921 - RNA, 14 nt, Homo sapiens
auuuuugaaaccaa

SEQ ID NO: 485922 - RNA, 23 nt, Homo sapiens
caaaagugcagcaggagaacucu

SEQ ID NO: 485923 - RNA, 22 nt, Homo sapiens
caaaauaaaucaucuuuauuaa

SEQ ID NO: 485924 - RNA, 18 nt, Homo sapiens
caaaaugggcccuugccu

SEQ ID NO: 485925 - RNA, 12 nt, Homo sapiens
caaagauuugcu

SEQ ID NO: 485926 - RNA, 16 nt, Homo sapiens
caaagggaacagugag

SEQ ID NO: 485927 - RNA, 20 nt, Homo sapiens
caaagugcuuccaaggcaga

SEQ ID NO: 485928 - RNA, 22 nt, Homo sapiens
caaaugggguuucacaaauagu

SEQ ID NO: 485929 - RNA, 19 nt, Homo sapiens
caagaggaaaauccaaaag

SEQ ID NO: 485930 - RNA, 11 nt, Homo sapiens
gaguuaccuac

SEQ ID NO: 485931 - RNA, 14 nt, Homo sapiens
gaguuucuuaacuu

SEQ ID NO: 485932 - RNA, 18 nt, Homo sapiens
gauagcaccuaaacuuac

SEQ ID NO: 485933 - RNA, 20 nt, Homo sapiens
gauauaauuuuauuacauau

SEQ ID NO: 485934 - RNA, 21 nt, Homo sapiens
gauauaauuuuauuacauaug

SEQ ID NO: 485935 - RNA, 13 nt, Homo sapiens
gaucccucugggc

SEQ ID NO: 485936 - RNA, 14 nt, Homo sapiens
gaucccucugggca

SEQ ID NO: 485937 - RNA, 20 nt, Homo sapiens
gaucucgaacuccuaaccuc

SEQ ID NO: 485938 - RNA, 18 nt, Homo sapiens
gaugcagaaaauugccua

SEQ ID NO: 485939 - RNA, 20 nt, Homo sapiens
gaugggagugcccccaacag

SEQ ID NO: 485940 - RNA, 14 nt, Homo sapiens
gaugucccuaugga

SEQ ID NO: 485941 - RNA, 12 nt, Homo sapiens
gauuacaaugcu

SEQ ID NO: 485942 - RNA, 22 nt, Homo sapiens
gauuguugaaagccaugaggga

SEQ ID NO: 485943 - RNA, 18 nt, Homo sapiens
gcaaagauuugcuuuaau

SEQ ID NO: 485944 - RNA, 18 nt, Homo sapiens
gcaaauauuuauaagcua

SEQ ID NO: 485945 - RNA, 19 nt, Homo sapiens
gcacauucuggcucaggga

SEQ ID NO: 485946 - RNA, 19 nt, Homo sapiens
gcaccuaaacuuacauuua

SEQ ID NO: 485947 - RNA, 14 nt, Homo sapiens
gcaccucugaccua

SEQ ID NO: 485948 - RNA, 20 nt, Homo sapiens
gcaccucugaccuaucacuu

SEQ ID NO: 485949 - RNA, 20 nt, Homo sapiens
gcacucacacgcgaaaguau

SEQ ID NO: 485950 - RNA, 19 nt, Homo sapiens
gcagagccacccuguguug

SEQ ID NO: 485951 - RNA, 19 nt, Homo sapiens
gcagugcuugaaugaaguu

SEQ ID NO: 485952 - RNA, 16 nt, Homo sapiens
gcauggcugagcugcc

SEQ ID NO: 485953 - RNA, 23 nt, Homo sapiens
gccacacucuuucuccugcuuua

SEQ ID NO: 485954 - RNA, 24 nt, Homo sapiens
gccaccaaaggccagggucacuga

SEQ ID NO: 485955 - RNA, 15 nt, Homo sapiens
gccaggcugaucucg

SEQ ID NO: 485956 - RNA, 23 nt, Homo sapiens
gccagucuuuacagcugagcaca

SEQ ID NO: 485957 - RNA, 15 nt, Homo sapiens
gcccaagauaucagc

SEQ ID NO: 485958 - RNA, 13 nt, Homo sapiens
gccccaauucgau

SEQ ID NO: 485959 - RNA, 17 nt, Homo sapiens
gcccucuucauuuagcc

SEQ ID NO: 485960 - RNA, 21 nt, Homo sapiens
gcccuggagcagccaccccau

SEQ ID NO: 485961 - RNA, 14 nt, Homo sapiens
gccgagaagccagu

SEQ ID NO: 485962 - RNA, 16 nt, Homo sapiens
gccuugccacacucuu

SEQ ID NO: 485963 - RNA, 18 nt, Homo sapiens
gcggcagguucucuuuga

SEQ ID NO: 485964 - RNA, 19 nt, Homo sapiens
gcucaaugacucucuggug

SEQ ID NO: 485965 - RNA, 12 nt, Homo sapiens
gcucagugcaac

SEQ ID NO: 485966 - RNA, 17 nt, Homo sapiens
gcucccucccaucccuu

SEQ ID NO: 485967 - RNA, 15 nt, Homo sapiens
gcucucugaguccug

SEQ ID NO: 485968 - RNA, 20 nt, Homo sapiens
gcugggauuacaggugugca

SEQ ID NO: 485969 - RNA, 13 nt, Homo sapiens
gcuuacugcgcua

SEQ ID NO: 485970 - RNA, 16 nt, Homo sapiens
gcuucucucucuaaaa

SEQ ID NO: 485971 - RNA, 16 nt, Homo sapiens
gcuuuaaccaccccau

SEQ ID NO: 485972 - RNA, 23 nt, Homo sapiens
gcuuuaauuguuaagauaugaug

SEQ ID NO: 485973 - RNA, 21 nt, Homo sapiens
gcuuuugggaauggacucacu

SEQ ID NO: 485974 - RNA, 16 nt, Homo sapiens
ggaaaauauccauccu

SEQ ID NO: 485975 - RNA, 18 nt, Homo sapiens
ggaaagacagcuucucau

SEQ ID NO: 485976 - RNA, 12 nt, Homo sapiens
ggaacacugaga

SEQ ID NO: 485977 - RNA, 18 nt, Homo sapiens
ggacccaggcaccugcau

SEQ ID NO: 485978 - RNA, 12 nt, Homo sapiens
ggacuaccucug

SEQ ID NO: 485979 - RNA, 16 nt, Homo sapiens
ggagcugccccucucu

SEQ ID NO: 485980 - RNA, 17 nt, Homo sapiens
ggagugcccccaacagc

SEQ ID NO: 485981 - RNA, 15 nt, Homo sapiens
ggauugugccuguau

SEQ ID NO: 485982 - RNA, 14 nt, Homo sapiens
ggcagaagcagcag

SEQ ID NO: 485983 - RNA, 19 nt, Homo sapiens
ggcccacagcaggugcuga

SEQ ID NO: 485984 - RNA, 20 nt, Homo sapiens
ggccuggaguaacacaaagu

SEQ ID NO: 485985 - RNA, 13 nt, Homo sapiens
gggagacucugaa

SEQ ID NO: 485986 - RNA, 20 nt, Homo sapiens
gggagugcccccaacagcac

SEQ ID NO: 485987 - RNA, 21 nt, Homo sapiens
gggaucuggugggcagucgaa

SEQ ID NO: 485988 - RNA, 19 nt, Homo sapiens
ggggaaguaaaacagucau

SEQ ID NO: 485989 - RNA, 21 nt, Homo sapiens
ggguacugagagucugcacuu

SEQ ID NO: 485990 - RNA, 22 nt, Homo sapiens
gggucacugaaggccuggccca

SEQ ID NO: 485991 - RNA, 19 nt, Homo sapiens
gggucuuguuaagugcagu

SEQ ID NO: 485992 - RNA, 18 nt, Homo sapiens
ggugccuaggauugugcc

SEQ ID NO: 485993 - RNA, 20 nt, Homo sapiens
gguggguuuugaacauaaag

SEQ ID NO: 485994 - RNA, 15 nt, Homo sapiens
guaacacaaagugaa

SEQ ID NO: 485995 - RNA, 14 nt, Homo sapiens
guacaccccaccuc

SEQ ID NO: 485996 - RNA, 16 nt, Homo sapiens
gucaaugaauuuugcu

SEQ ID NO: 485997 - RNA, 18 nt, Homo sapiens
gucaguggaagaagcaga

SEQ ID NO: 485998 - RNA, 17 nt, Homo sapiens
gucaguggggcucucug

SEQ ID NO: 485999 - RNA, 15 nt, Homo sapiens
gucaucuagaauuca

SEQ ID NO: 486000 - RNA, 21 nt, Homo sapiens
gucauuuuuauaaaacuuuga

SEQ ID NO: 486001 - RNA, 21 nt, Homo sapiens
guccaacugccuguucaauaa

SEQ ID NO: 486002 - RNA, 18 nt, Homo sapiens
gucucauuccuccaccug

SEQ ID NO: 486003 - RNA, 18 nt, Homo sapiens
gucucuguugacuggcug

SEQ ID NO: 486004 - RNA, 12 nt, Homo sapiens
gugaaagcaaau

SEQ ID NO: 486005 - RNA, 15 nt, Homo sapiens
gugaaaugcagaguc

SEQ ID NO: 486006 - RNA, 20 nt, Homo sapiens
gugagcagccuggagcccug

SEQ ID NO: 486007 - RNA, 20 nt, Homo sapiens
gugcaaagauuugcuuuaau

SEQ ID NO: 486008 - RNA, 15 nt, Homo sapiens
gugcagucugaucca

SEQ ID NO: 486009 - RNA, 14 nt, Homo sapiens
gugcugagcaaagg

SEQ ID NO: 486010 - RNA, 18 nt, Homo sapiens
guggagugcaguggugcg

SEQ ID NO: 486011 - RNA, 19 nt, Homo sapiens
guggagugcaguggugcga

SEQ ID NO: 486012 - RNA, 16 nt, Homo sapiens
guggugcauuuugcuu

SEQ ID NO: 486013 - RNA, 14 nt, Homo sapiens
gugugacucauuaa

SEQ ID NO: 486014 - RNA, 16 nt, Homo sapiens
guuacagcuacuauaa

SEQ ID NO: 486015 - RNA, 22 nt, Homo sapiens
guucugagauuauuuuaaucua

SEQ ID NO: 486016 - RNA, 14 nt, Homo sapiens
guucugucuuccca

SEQ ID NO: 486017 - RNA, 11 nt, Homo sapiens
guuguguuccu

SEQ ID NO: 486018 - RNA, 17 nt, Homo sapiens
guuucuccagagggaau

SEQ ID NO: 486019 - RNA, 22 nt, Homo sapiens
uaaaaaaaaaacguauugcauu

SEQ ID NO: 486020 - RNA, 22 nt, Homo sapiens
ugcucaagaggaaaauccaaaa

SEQ ID NO: 486021 - RNA, 13 nt, Homo sapiens
uggaaucuuguaa

SEQ ID NO: 486022 - RNA, 17 nt, Homo sapiens
uggacacguggugcauu

SEQ ID NO: 486023 - RNA, 19 nt, Homo sapiens
uggagugcaguggugcgau

SEQ ID NO: 486024 - RNA, 14 nt, Homo sapiens
uggccuugccacac

SEQ ID NO: 486025 - RNA, 15 nt, Homo sapiens
uggccuuugcaauuu

SEQ ID NO: 486026 - RNA, 14 nt, Homo sapiens
uggcugauggagua

SEQ ID NO: 486027 - RNA, 21 nt, Homo sapiens
ugggauuacaggugugcacca

SEQ ID NO: 486028 - RNA, 14 nt, Homo sapiens
ugggggaacacuga

SEQ ID NO: 486029 - RNA, 14 nt, Homo sapiens
uggucaagcacucg

SEQ ID NO: 486030 - RNA, 18 nt, Homo sapiens
uggucaagcacucgggaa

SEQ ID NO: 486031 - RNA, 14 nt, Homo sapiens
uggugaacuccacc

SEQ ID NO: 486032 - RNA, 23 nt, Homo sapiens
ugucauuuuuauaaaacuuugaa

SEQ ID NO: 486033 - RNA, 13 nt, Homo sapiens
uguccccuugaag

SEQ ID NO: 486034 - RNA, 21 nt, Homo sapiens
ugugaaauguacgucauuugu

SEQ ID NO: 486035 - RNA, 13 nt, Homo sapiens
ugugaacacuuuu

SEQ ID NO: 486036 - RNA, 16 nt, Homo sapiens
ugugaacccaaagugu

SEQ ID NO: 486037 - RNA, 15 nt, Homo sapiens
ugugggaaauccaca

SEQ ID NO: 486038 - RNA, 22 nt, Homo sapiens
ugugucaguggggcucucugag

SEQ ID NO: 486039 - RNA, 22 nt, Homo sapiens
uguguuuuuucugccaccaaag

SEQ ID NO: 486040 - RNA, 15 nt, Homo sapiens
uguuaagguucaaga

SEQ ID NO: 486041 - RNA, 14 nt, Homo sapiens
uguuauuauauaau

SEQ ID NO: 486042 - RNA, 15 nt, Homo sapiens
uguucugucuuccca

SEQ ID NO: 486043 - RNA, 12 nt, Homo sapiens
uguucuugugaa

SEQ ID NO: 486044 - RNA, 21 nt, Homo sapiens
uguugagggaagcuuccauaa

SEQ ID NO: 486045 - RNA, 13 nt, Homo sapiens
uuaaaaaacugca

SEQ ID NO: 486046 - RNA, 13 nt, Homo sapiens
uggagcagccacc

SEQ ID NO: 486047 - RNA, 18 nt, Homo sapiens
uggagugcaguggugcga

SEQ ID NO: 486048 - RNA, 16 nt, Homo sapiens
uggccaggcugaucuc

SEQ ID NO: 486049 - RNA, 17 nt, Homo sapiens
uggcugauggaguaaau

SEQ ID NO: 486050 - RNA, 15 nt, Homo sapiens
ugggggaacacugag

SEQ ID NO: 486051 - RNA, 18 nt, Homo sapiens
ugggggaacacugagaaa

SEQ ID NO: 486052 - RNA, 19 nt, Homo sapiens
ugggggaacacugagaaag

SEQ ID NO: 486053 - RNA, 23 nt, Homo sapiens
ugggggggcucccguggccugua

SEQ ID NO: 486054 - RNA, 23 nt, Homo sapiens
uggguuuugaacauaaagccuug

SEQ ID NO: 486055 - RNA, 15 nt, Homo sapiens
uguaaauauagugaa

SEQ ID NO: 486056 - RNA, 15 nt, Homo sapiens
uguaauugacacuau

SEQ ID NO: 486057 - RNA, 18 nt, Homo sapiens
uguaauugacacuauaua

SEQ ID NO: 486058 - RNA, 13 nt, Homo sapiens
uguccacuucauu

SEQ ID NO: 486059 - RNA, 14 nt, Homo sapiens
uguccugauuacaa

SEQ ID NO: 486060 - RNA, 18 nt, Homo sapiens
uguccugauuacaaugcu

SEQ ID NO: 486061 - RNA, 18 nt, Homo sapiens
ugugaacccaaaguguga

SEQ ID NO: 486062 - RNA, 16 nt, Homo sapiens
ugugaccgaacacugc

SEQ ID NO: 486063 - RNA, 15 nt, Homo sapiens
ugugccuugccacau

SEQ ID NO: 486064 - RNA, 21 nt, Homo sapiens
uguuaaacuaaaaauuuacaa

SEQ ID NO: 486065 - RNA, 15 nt, Homo sapiens
uguuacagcuacuau

SEQ ID NO: 486066 - RNA, 20 nt, Homo sapiens
uguuguuuuaggaauacaua

SEQ ID NO: 486067 - RNA, 15 nt, Homo sapiens
uuaacuucagccagc

SEQ ID NO: 486068 - RNA, 22 nt, Homo sapiens
uuaagaacuagggagggggaaa

SEQ ID NO: 486069 - RNA, 14 nt, Homo sapiens
uuaaggggcagcuu

SEQ ID NO: 486070 - RNA, 19 nt, Homo sapiens
uuaauaaaauaauucucaa

SEQ ID NO: 486071 - RNA, 20 nt, Homo sapiens
uuaauuuauugaggcuuuaa

SEQ ID NO: 486072 - RNA, 20 nt, Homo sapiens
uuacaaugcauucugaggua

SEQ ID NO: 486073 - RNA, 14 nt, Homo sapiens
uuacagcuacuaua

SEQ ID NO: 486074 - RNA, 15 nt, Homo sapiens
uuacagcugagcaca

SEQ ID NO: 486075 - RNA, 19 nt, Homo sapiens
uuacagcugagcacauucu

SEQ ID NO: 486076 - RNA, 20 nt, Homo sapiens
uuacauuuaaaagacagaca

SEQ ID NO: 486077 - RNA, 17 nt, Homo sapiens
uuauagaaucuacuuua

SEQ ID NO: 486078 - RNA, 13 nt, Homo sapiens
uuaucuaacagac

SEQ ID NO: 486079 - RNA, 22 nt, Homo sapiens
uuaugaggguccucuacuucag

SEQ ID NO: 486080 - RNA, 14 nt, Homo sapiens
uuauguuacuguau

SEQ ID NO: 486081 - RNA, 20 nt, Homo sapiens
uuauuauggucauauuucac

SEQ ID NO: 486082 - RNA, 12 nt, Homo sapiens
uuauuuugugaa

SEQ ID NO: 486083 - RNA, 14 nt, Homo sapiens
uucacacaauacaa

SEQ ID NO: 486084 - RNA, 18 nt, Homo sapiens
uucacgauuaacugugaa

SEQ ID NO: 486085 - RNA, 21 nt, Homo sapiens
uucacugaguuuuguuucacu

SEQ ID NO: 486086 - RNA, 20 nt, Homo sapiens
uucacuucuaccuacauauu

SEQ ID NO: 486087 - RNA, 21 nt, Homo sapiens
uucagaaaucaaacugcuuau

SEQ ID NO: 486088 - RNA, 16 nt, Homo sapiens
uucaguuuuucacuuc

SEQ ID NO: 486089 - RNA, 14 nt, Homo sapiens
uucauggcaguaau

SEQ ID NO: 486090 - RNA, 19 nt, Homo sapiens
uucauguaauaaacagguu

SEQ ID NO: 486091 - RNA, 16 nt, Homo sapiens
uucuaacugcuguuaa

SEQ ID NO: 486092 - RNA, 16 nt, Homo sapiens
uucucuaccucauggg

SEQ ID NO: 486093 - RNA, 16 nt, Homo sapiens
uucugagguaaccuca

SEQ ID NO: 486094 - RNA, 16 nt, Homo sapiens
uucuguauaacagccu

SEQ ID NO: 486095 - RNA, 14 nt, Homo sapiens
uucugucuucccac

SEQ ID NO: 486096 - RNA, 15 nt, Homo sapiens
uugaacucaaugaua

SEQ ID NO: 486097 - RNA, 16 nt, Homo sapiens
uugacuggcuguguga

SEQ ID NO: 486098 - RNA, 19 nt, Homo sapiens
uugauauaaauaaaacauu

SEQ ID NO: 486099 - RNA, 23 nt, Homo sapiens
uugcauuuaauuuauugaggcuu

SEQ ID NO: 486100 - RNA, 16 nt, Homo sapiens
uugcuucucucucuaa

SEQ ID NO: 486101 - RNA, 16 nt, Homo sapiens
uuguaauugacacuau

SEQ ID NO: 486102 - RNA, 17 nt, Homo sapiens
uugugacccagcacugc

SEQ ID NO: 486103 - RNA, 17 nt, Homo sapiens
uuguuaagauaugaugu

SEQ ID NO: 486104 - RNA, 15 nt, Homo sapiens
uuguugaaagccaug

SEQ ID NO: 486105 - RNA, 12 nt, Homo sapiens
uuuaaacaucag

SEQ ID NO: 486106 - RNA, 18 nt, Homo sapiens
uuuacagcugagcacauu

SEQ ID NO: 486107 - RNA, 19 nt, Homo sapiens
uuuaucaaguguauuugaa

SEQ ID NO: 486108 - RNA, 13 nt, Homo sapiens
uuuauuauauaua

SEQ ID NO: 486109 - RNA, 17 nt, Homo sapiens
uuuccuuuucugucucu

SEQ ID NO: 486110 - RNA, 17 nt, Homo sapiens
uuugauaggauguggau

SEQ ID NO: 486111 - RNA, 13 nt, Homo sapiens
uuugugaacacuu

SEQ ID NO: 486112 - RNA, 17 nt, Homo sapiens
uuuuucacuucuaccua

SEQ ID NO: 486113 - RNA, 23 nt, Homo sapiens
uuuuucacuucuaccuacauauu

SEQ ID NO: 486114 - RNA, 17 nt, Homo sapiens
aaaaaucuuuucauuaa

SEQ ID NO: 486115 - RNA, 20 nt, Homo sapiens
aaaaaucuuuucauuaaaga

SEQ ID NO: 486116 - RNA, 16 nt, Homo sapiens
aaaagacauaauucac

SEQ ID NO: 486117 - RNA, 17 nt, Homo sapiens
aaaauaaauaccaaaga

SEQ ID NO: 486118 - RNA, 13 nt, Homo sapiens
aaacaaucuccca

SEQ ID NO: 486119 - RNA, 18 nt, Homo sapiens
aaacuauuuaugaauauu

SEQ ID NO: 486120 - RNA, 19 nt, Homo sapiens
aaacuccacaucugccuua

SEQ ID NO: 486121 - RNA, 19 nt, Homo sapiens
aaacuuggcucucaauaaa

SEQ ID NO: 486122 - RNA, 17 nt, Homo sapiens
aaagagggcuuccucua

SEQ ID NO: 486123 - RNA, 14 nt, Homo sapiens
aaagccucucacua

SEQ ID NO: 486124 - RNA, 20 nt, Homo sapiens
aaaguaccacauuccaugac

SEQ ID NO: 486125 - RNA, 21 nt, Homo sapiens
aaauagcucuguggguuuuaa

SEQ ID NO: 486126 - RNA, 14 nt, Homo sapiens
aaauguaccugaga

SEQ ID NO: 486127 - RNA, 13 nt, Homo sapiens
aacugagguguua

SEQ ID NO: 486128 - RNA, 23 nt, Homo sapiens
aacuucauuuuucuaauaaucau

SEQ ID NO: 486129 - RNA, 13 nt, Homo sapiens
aacuuucuucaaa

SEQ ID NO: 486130 - RNA, 13 nt, Homo sapiens
aagagggcuuccu

SEQ ID NO: 486131 - RNA, 21 nt, Homo sapiens
aagagggcuuccucuagaagc

SEQ ID NO: 486132 - RNA, 14 nt, Homo sapiens
aagccaauauuuua

SEQ ID NO: 486133 - RNA, 19 nt, Homo sapiens
aagcuuuaaauggcaauuu

SEQ ID NO: 486134 - RNA, 17 nt, Homo sapiens
aagcuuuuccuaauaaa

SEQ ID NO: 486135 - RNA, 20 nt, Homo sapiens
aaggaguaaccaauuucuuu

SEQ ID NO: 486136 - RNA, 17 nt, Homo sapiens
aaggugaguuugagcug

SEQ ID NO: 486137 - RNA, 20 nt, Homo sapiens
cucaacauuggagacaucac

SEQ ID NO: 486138 - RNA, 22 nt, Homo sapiens
cucacucucaggaaaugcugac

SEQ ID NO: 486139 - RNA, 18 nt, Homo sapiens
cuccaaagagaaaccuau

SEQ ID NO: 486140 - RNA, 17 nt, Homo sapiens
cuccacaucugccuuaa

SEQ ID NO: 486141 - RNA, 15 nt, Homo sapiens
cucccucacucucag

SEQ ID NO: 486142 - RNA, 14 nt, Homo sapiens
cucgaccaccucaa

SEQ ID NO: 486143 - RNA, 14 nt, Homo sapiens
cucuagaagccaag

SEQ ID NO: 486144 - RNA, 19 nt, Homo sapiens
cucugugcagucacuggag

SEQ ID NO: 486145 - RNA, 18 nt, Homo sapiens
cucuugaauauguauuaa

SEQ ID NO: 486146 - RNA, 18 nt, Homo sapiens
cugaaggaggccaccucc

SEQ ID NO: 486147 - RNA, 17 nt, Homo sapiens
cugagugcaggcccacc

SEQ ID NO: 486148 - RNA, 21 nt, Homo sapiens
cugcacuugggggcucagcaa

SEQ ID NO: 486149 - RNA, 17 nt, Homo sapiens
cuggaccccagccucaa

SEQ ID NO: 486150 - RNA, 17 nt, Homo sapiens
cuggagguugaagccaa

SEQ ID NO: 486151 - RNA, 16 nt, Homo sapiens
cuggcucccucacucu

SEQ ID NO: 486152 - RNA, 19 nt, Homo sapiens
cuuauaauuacaaugcaca

SEQ ID NO: 486153 - RNA, 20 nt, Homo sapiens
cuucauuuuucuaauaauca

SEQ ID NO: 486154 - RNA, 19 nt, Homo sapiens
cuucuccccugcacuguaa

SEQ ID NO: 486155 - RNA, 15 nt, Homo sapiens
cuugaagccaaagaa

SEQ ID NO: 486156 - RNA, 18 nt, Homo sapiens
cuuucuucaaaaagcauu

SEQ ID NO: 486157 - RNA, 23 nt, Homo sapiens
gaaacaaagaaagagauguuaag

SEQ ID NO: 486158 - RNA, 12 nt, Homo sapiens
gaagccaaagaa

SEQ ID NO: 486159 - RNA, 13 nt, Homo sapiens
gacaucacuggca

SEQ ID NO: 486160 - RNA, 22 nt, Homo sapiens
gacucaauaaauacauguuaaa

SEQ ID NO: 486161 - RNA, 16 nt, Homo sapiens
gagaacuucucuuccc

SEQ ID NO: 486162 - RNA, 16 nt, Homo sapiens
gagaggcaggcauaga

SEQ ID NO: 486163 - RNA, 15 nt, Homo sapiens
gagauuauguaacuc

SEQ ID NO: 486164 - RNA, 13 nt, Homo sapiens
gaggccaccuccu

SEQ ID NO: 486165 - RNA, 18 nt, Homo sapiens
gaggccccaauaccccau

SEQ ID NO: 486166 - RNA, 17 nt, Homo sapiens
gagggaggucacuggaa

SEQ ID NO: 486167 - RNA, 18 nt, Homo sapiens
gagggggcuugaagccaa

SEQ ID NO: 486168 - RNA, 19 nt, Homo sapiens
gagggggcuugaagccaaa

SEQ ID NO: 486169 - RNA, 15 nt, Homo sapiens
gaggugggaggugga

SEQ ID NO: 486170 - RNA, 14 nt, Homo sapiens
gagguugaagccaa

SEQ ID NO: 486171 - RNA, 21 nt, Homo sapiens
gaguuugagcugccuucccua

SEQ ID NO: 486172 - RNA, 14 nt, Homo sapiens
gauccaaauguaaa

SEQ ID NO: 486173 - RNA, 22 nt, Homo sapiens
gcacacuuauuuuuuucccaag

SEQ ID NO: 486174 - RNA, 15 nt, Homo sapiens
gcaggaccagcccac

SEQ ID NO: 486175 - RNA, 18 nt, Homo sapiens
gcaggagggacagucuca

SEQ ID NO: 486176 - RNA, 16 nt, Homo sapiens
gccaggaaguagcaca

SEQ ID NO: 486177 - RNA, 19 nt, Homo sapiens
gcccauguauggccaggaa

SEQ ID NO: 486178 - RNA, 18 nt, Homo sapiens
gccugggggcagccucuc

SEQ ID NO: 486179 - RNA, 22 nt, Homo sapiens
gcuaaauguaccugagacauau

SEQ ID NO: 486180 - RNA, 19 nt, Homo sapiens
gcuauuaacugccaaaaca

SEQ ID NO: 486181 - RNA, 14 nt, Homo sapiens
gcucagcaaggcca

SEQ ID NO: 486182 - RNA, 18 nt, Homo sapiens
gcucccucacucucagga

SEQ ID NO: 486183 - RNA, 20 nt, Homo sapiens
gcucugugcagucacuggag

SEQ ID NO: 486184 - RNA, 18 nt, Homo sapiens
gcuuccucuagaagccaa

SEQ ID NO: 486185 - RNA, 14 nt, Homo sapiens
ggaaaggggugcuu

SEQ ID NO: 486186 - RNA, 10 nt, Homo sapiens
ggacccugcc

SEQ ID NO: 486187 - RNA, 11 nt, Homo sapiens
ggaggcuuccu

SEQ ID NO: 486188 - RNA, 15 nt, Homo sapiens
ggagguugaagccaa

SEQ ID NO: 486189 - RNA, 16 nt, Homo sapiens
ggcaggagacugugga

SEQ ID NO: 486190 - RNA, 23 nt, Homo sapiens
ggcauggugguugggacccagug

SEQ ID NO: 486191 - RNA, 16 nt, Homo sapiens
ggccaggaaguagcac

SEQ ID NO: 486192 - RNA, 20 nt, Homo sapiens
ggcccauguauggccaggaa

SEQ ID NO: 486193 - RNA, 14 nt, Homo sapiens
ggcuagcuucugcu

SEQ ID NO: 486194 - RNA, 16 nt, Homo sapiens
ggcucccucacucuca

SEQ ID NO: 486195 - RNA, 19 nt, Homo sapiens
ggcucccucacucucagga

SEQ ID NO: 486196 - RNA, 19 nt, Homo sapiens
ggcuuccucuagaagccaa

SEQ ID NO: 486197 - RNA, 19 nt, Homo sapiens
ggcuuggccugcugugauu

SEQ ID NO: 486198 - RNA, 15 nt, Homo sapiens
gggacccaguggcag

SEQ ID NO: 486199 - RNA, 21 nt, Homo sapiens
gggcacagggccuggcccaug

SEQ ID NO: 486200 - RNA, 14 nt, Homo sapiens
gggccacccagcca

SEQ ID NO: 486201 - RNA, 17 nt, Homo sapiens
gggcucagcaaggccac

SEQ ID NO: 486202 - RNA, 17 nt, Homo sapiens
ggguuagacugccagcu

SEQ ID NO: 486203 - RNA, 17 nt, Homo sapiens
guaaacagaaauugcaa

SEQ ID NO: 486204 - RNA, 19 nt, Homo sapiens
guaaacagaaauugcaaua

SEQ ID NO: 486205 - RNA, 15 nt, Homo sapiens
guaaccucagucuac

SEQ ID NO: 486206 - RNA, 22 nt, Homo sapiens
guaaguggcuuuuuguacugua

SEQ ID NO: 486207 - RNA, 16 nt, Homo sapiens
gucaagagccaagaca

SEQ ID NO: 486208 - RNA, 10 nt, Homo sapiens
gucacuggaa

SEQ ID NO: 486209 - RNA, 19 nt, Homo sapiens
gugccaaaaaucuuuucau

SEQ ID NO: 486210 - RNA, 13 nt, Homo sapiens
guggaggcuuccu

SEQ ID NO: 486211 - RNA, 20 nt, Homo sapiens
gugggggccccgucucaggu

SEQ ID NO: 486212 - RNA, 22 nt, Homo sapiens
guggggggaacgcccacuuccc

SEQ ID NO: 486213 - RNA, 13 nt, Homo sapiens
guggugauuugga

SEQ ID NO: 486214 - RNA, 13 nt, Homo sapiens
guuagacugccag

SEQ ID NO: 486215 - RNA, 14 nt, Homo sapiens
guuccuacacagga

SEQ ID NO: 486216 - RNA, 16 nt, Homo sapiens
guuccuacacaggaca

SEQ ID NO: 486217 - RNA, 15 nt, Homo sapiens
uaaaaaaagacauaa

SEQ ID NO: 486218 - RNA, 22 nt, Homo sapiens
uaaaaaguaccacauuccauga

SEQ ID NO: 486219 - RNA, 12 nt, Homo sapiens
uaaaaccaaaga

SEQ ID NO: 486220 - RNA, 13 nt, Homo sapiens
uaaaaccaaagag

SEQ ID NO: 486221 - RNA, 20 nt, Homo sapiens
uaaaaucuugucauguguau

SEQ ID NO: 486222 - RNA, 19 nt, Homo sapiens
uaaacaaaauguagacaaa

SEQ ID NO: 486223 - RNA, 19 nt, Homo sapiens
uaaacacacagugcugcca

SEQ ID NO: 486224 - RNA, 23 nt, Homo sapiens
aaucauauuucccuuacaauuaa

SEQ ID NO: 486225 - RNA, 19 nt, Homo sapiens
aauggcaagagaucauauc

SEQ ID NO: 486226 - RNA, 21 nt, Homo sapiens
aauucuuguaacuuucuucaa

SEQ ID NO: 486227 - RNA, 15 nt, Homo sapiens
aauuuauaauuacaa

SEQ ID NO: 486228 - RNA, 18 nt, Homo sapiens
aauuucuuucuaaaacac

SEQ ID NO: 486229 - RNA, 17 nt, Homo sapiens
acaauaacuuugaaccu

SEQ ID NO: 486230 - RNA, 22 nt, Homo sapiens
acacacagaaggggacugccac

SEQ ID NO: 486231 - RNA, 16 nt, Homo sapiens
acagagccaugacuca

SEQ ID NO: 486232 - RNA, 16 nt, Homo sapiens
acagggccgccggcaa

SEQ ID NO: 486233 - RNA, 22 nt, Homo sapiens
acaucgcauagaaaucaauaau

SEQ ID NO: 486234 - RNA, 16 nt, Homo sapiens
accaccucaacauugg

SEQ ID NO: 486235 - RNA, 22 nt, Homo sapiens
acccauuuacuuuggucaauau

SEQ ID NO: 486236 - RNA, 20 nt, Homo sapiens
accccggggacccugugaca

SEQ ID NO: 486237 - RNA, 17 nt, Homo sapiens
accuccccuugccagcu

SEQ ID NO: 486238 - RNA, 15 nt, Homo sapiens
accuugaagacuauu

SEQ ID NO: 486239 - RNA, 17 nt, Homo sapiens
acgcuaaagagcccuug

SEQ ID NO: 486240 - RNA, 17 nt, Homo sapiens
acgcugacuacagggcc

SEQ ID NO: 486241 - RNA, 17 nt, Homo sapiens
acgguuccuacacagga

SEQ ID NO: 486242 - RNA, 16 nt, Homo sapiens
acguuguaaugcacac

SEQ ID NO: 486243 - RNA, 16 nt, Homo sapiens
acuauuuaugaauauu

SEQ ID NO: 486244 - RNA, 21 nt, Homo sapiens
acucacugaaucuaaccauag

SEQ ID NO: 486245 - RNA, 17 nt, Homo sapiens
acucaguaaaagcaaaa

SEQ ID NO: 486246 - RNA, 22 nt, Homo sapiens
agaaagacuguaagcuccauga

SEQ ID NO: 486247 - RNA, 14 nt, Homo sapiens
agaaauugcaauau

SEQ ID NO: 486248 - RNA, 19 nt, Homo sapiens
agaccagguggaauuacuu

SEQ ID NO: 486249 - RNA, 12 nt, Homo sapiens
uaaacucuucca

SEQ ID NO: 486250 - RNA, 18 nt, Homo sapiens
uaaagccugaaaauucca

SEQ ID NO: 486251 - RNA, 18 nt, Homo sapiens
uaacuacaugaacacaaa

SEQ ID NO: 486252 - RNA, 22 nt, Homo sapiens
uaagcuccaugauuagcauaaa

SEQ ID NO: 486253 - RNA, 12 nt, Homo sapiens
uacagugguuuu

SEQ ID NO: 486254 - RNA, 19 nt, Homo sapiens
uaccacauuccaugacgca

SEQ ID NO: 486255 - RNA, 14 nt, Homo sapiens
uaccugagacauau

SEQ ID NO: 486256 - RNA, 18 nt, Homo sapiens
ugcccccagccccggggu

SEQ ID NO: 486257 - RNA, 20 nt, Homo sapiens
ugcuauuuucuuauccuuug

SEQ ID NO: 486258 - RNA, 17 nt, Homo sapiens
uggagacaucacuugcc

SEQ ID NO: 486259 - RNA, 11 nt, Homo sapiens
uggaggggugu

SEQ ID NO: 486260 - RNA, 13 nt, Homo sapiens
uggauguauuugu

SEQ ID NO: 486261 - RNA, 17 nt, Homo sapiens
uggccaggaaguagcac

SEQ ID NO: 486262 - RNA, 18 nt, Homo sapiens
uggccaggaaguagcaca

SEQ ID NO: 486263 - RNA, 18 nt, Homo sapiens
ugggaggagggagaggga

SEQ ID NO: 486264 - RNA, 21 nt, Homo sapiens
ugggagggggcuugaagccaa

SEQ ID NO: 486265 - RNA, 21 nt, Homo sapiens
ugggauuaugggucacaggaa

SEQ ID NO: 486266 - RNA, 19 nt, Homo sapiens
uggucuaaaacagcuauuu

SEQ ID NO: 486267 - RNA, 18 nt, Homo sapiens
uguaaacagaaauugcaa

SEQ ID NO: 486268 - RNA, 13 nt, Homo sapiens
uguacuauuuaac

SEQ ID NO: 486269 - RNA, 14 nt, Homo sapiens
ugugagauggaugu

SEQ ID NO: 486270 - RNA, 15 nt, Homo sapiens
ugugcuagacuguaa

SEQ ID NO: 486271 - RNA, 15 nt, Homo sapiens
uguggcagugguuuu

SEQ ID NO: 486272 - RNA, 14 nt, Homo sapiens
uguguugcuucucu

SEQ ID NO: 486273 - RNA, 11 nt, Homo sapiens
uuaaaacuauu

SEQ ID NO: 486274 - RNA, 15 nt, Homo sapiens
uuaacucucuguuac

SEQ ID NO: 486275 - RNA, 19 nt, Homo sapiens
uuacaacuuauaauuacaa

SEQ ID NO: 486276 - RNA, 17 nt, Homo sapiens
uuauaaagauauaccaa

SEQ ID NO: 486277 - RNA, 16 nt, Homo sapiens
uuauaccgcagaguau

SEQ ID NO: 486278 - RNA, 22 nt, Homo sapiens
uucagauagagauauuuugggu

SEQ ID NO: 486279 - RNA, 16 nt, Homo sapiens
uucagugguccaggau

SEQ ID NO: 486280 - RNA, 15 nt, Homo sapiens
uucuauuaagauaua

SEQ ID NO: 486281 - RNA, 17 nt, Homo sapiens
uucuucacuugcaggca

SEQ ID NO: 486282 - RNA, 23 nt, Homo sapiens
uucuugaagaaaggcaaaucuga

SEQ ID NO: 486283 - RNA, 17 nt, Homo sapiens
uugaagucacacuguaa

SEQ ID NO: 486284 - RNA, 16 nt, Homo sapiens
uugcugaacauggaua

SEQ ID NO: 486285 - RNA, 15 nt, Homo sapiens
uugcuuuacauauga

SEQ ID NO: 486286 - RNA, 15 nt, Homo sapiens
uuggccugcugugau

SEQ ID NO: 486287 - RNA, 17 nt, Homo sapiens
uuuaagguaaaacucac

SEQ ID NO: 486288 - RNA, 20 nt, Homo sapiens
uuuaaugaguuucacagugu

SEQ ID NO: 486289 - RNA, 22 nt, Homo sapiens
uuuuaaugauauuggaggaaua

SEQ ID NO: 486290 - RNA, 14 nt, Homo sapiens
uuuugcacauucca

SEQ ID NO: 486291 - RNA, 18 nt, Homo sapiens
aaaaagcaucuaucucau

SEQ ID NO: 486292 - RNA, 22 nt, Homo sapiens
aaaaaguaccacauuccaugac

SEQ ID NO: 486293 - RNA, 17 nt, Homo sapiens
aaaaauggcaagagauc

SEQ ID NO: 486294 - RNA, 12 nt, Homo sapiens
aaaaccaaagag

SEQ ID NO: 486295 - RNA, 14 nt, Homo sapiens
aaaacuucacucca

SEQ ID NO: 486296 - RNA, 16 nt, Homo sapiens
aaaaguaccacauucc

SEQ ID NO: 486297 - RNA, 18 nt, Homo sapiens
aaaccaaagagggcuucc

SEQ ID NO: 486298 - RNA, 20 nt, Homo sapiens
aaacucacugaaucuaacca

SEQ ID NO: 486299 - RNA, 17 nt, Homo sapiens
aaaguuuguuuuacuuu

SEQ ID NO: 486300 - RNA, 16 nt, Homo sapiens
aaauauaaaauuucug

SEQ ID NO: 486301 - RNA, 18 nt, Homo sapiens
aaaucaauacacuaguug

SEQ ID NO: 486302 - RNA, 21 nt, Homo sapiens
aacagaaauugcaauauggau

SEQ ID NO: 486303 - RNA, 21 nt, Homo sapiens
aacagauauuuuuaacuuaau

SEQ ID NO: 486304 - RNA, 22 nt, Homo sapiens
aacauuggagacaucacuugcc

SEQ ID NO: 486305 - RNA, 16 nt, Homo sapiens
aaccccucgcccaguc

SEQ ID NO: 486306 - RNA, 14 nt, Homo sapiens
aagaccuugaaccg

SEQ ID NO: 486307 - RNA, 16 nt, Homo sapiens
aagacuugagaaauuu

SEQ ID NO: 486308 - RNA, 14 nt, Homo sapiens
aagagaucauaucc

SEQ ID NO: 486309 - RNA, 22 nt, Homo sapiens
aagcaaaaaguuguuuuaucca

SEQ ID NO: 486310 - RNA, 24 nt, Homo sapiens
aagguaaagcaguugagauucucu

SEQ ID NO: 486311 - RNA, 13 nt, Homo sapiens
aagucaucaucuc

SEQ ID NO: 486312 - RNA, 15 nt, Homo sapiens
aagucaucaucucca

SEQ ID NO: 486313 - RNA, 14 nt, Homo sapiens
aaguuguuuuaucc

SEQ ID NO: 486314 - RNA, 14 nt, Homo sapiens
aaucugacuuuuuc

SEQ ID NO: 486315 - RNA, 14 nt, Homo sapiens
aauguacauaccuu

SEQ ID NO: 486316 - RNA, 13 nt, Homo sapiens
aauuacuguuuaa

SEQ ID NO: 486317 - RNA, 22 nt, Homo sapiens
aauuuacaacuuauaauuacaa

SEQ ID NO: 486318 - RNA, 19 nt, Homo sapiens
aauuucuccucccuuccuu

SEQ ID NO: 486319 - RNA, 14 nt, Homo sapiens
acaauuuauaauua

SEQ ID NO: 486320 - RNA, 24 nt, Homo sapiens
acacauuaauaaacaaucucccaa

SEQ ID NO: 486321 - RNA, 15 nt, Homo sapiens
acagcuauuucccuu

SEQ ID NO: 486322 - RNA, 19 nt, Homo sapiens
acauuccaugacgcaggag

SEQ ID NO: 486323 - RNA, 22 nt, Homo sapiens
acauuggagacaucacuugcca

SEQ ID NO: 486324 - RNA, 16 nt, Homo sapiens
accaaagagggcuucc

SEQ ID NO: 486325 - RNA, 16 nt, Homo sapiens
accacauuccaugacg

SEQ ID NO: 486326 - RNA, 11 nt, Homo sapiens
accaccucaac

SEQ ID NO: 486327 - RNA, 22 nt, Homo sapiens
acccaguggcagggcacagggc

SEQ ID NO: 486328 - RNA, 20 nt, Homo sapiens
acccaugggcaggagacugu

SEQ ID NO: 486329 - RNA, 23 nt, Homo sapiens
accccugcccccagccccggggu

SEQ ID NO: 486330 - RNA, 21 nt, Homo sapiens
accgccgguucauuuugcacc

SEQ ID NO: 486331 - RNA, 22 nt, Homo sapiens
accguggaggaggaaggcaaga

SEQ ID NO: 486332 - RNA, 19 nt, Homo sapiens
accugccaggcaggggugg

SEQ ID NO: 486333 - RNA, 16 nt, Homo sapiens
acucaguaaaagcaaa

SEQ ID NO: 486334 - RNA, 17 nt, Homo sapiens
acucucaccauuuggau

SEQ ID NO: 486335 - RNA, 23 nt, Homo sapiens
acugccaccuccccuugccagcu

SEQ ID NO: 486336 - RNA, 19 nt, Homo sapiens
acuggagguugaagccaag

SEQ ID NO: 486337 - RNA, 17 nt, Homo sapiens
acuguaaaaugugggau

SEQ ID NO: 486338 - RNA, 17 nt, Homo sapiens
acuuauuuuuuucccaa

SEQ ID NO: 486339 - RNA, 13 nt, Homo sapiens
acuucacuccaaa

SEQ ID NO: 486340 - RNA, 23 nt, Homo sapiens
acuucccuggguuagacugccag

SEQ ID NO: 486341 - RNA, 14 nt, Homo sapiens
acuuggcucucaau

SEQ ID NO: 486342 - RNA, 19 nt, Homo sapiens
agaaacauucuuuccuaaa

SEQ ID NO: 486343 - RNA, 21 nt, Homo sapiens
agaaaccuauuaagucaucau

SEQ ID NO: 486344 - RNA, 16 nt, Homo sapiens
agaacuucucuuccca

SEQ ID NO: 486345 - RNA, 23 nt, Homo sapiens
agaacuucucuucccauaccacc

SEQ ID NO: 486346 - RNA, 17 nt, Homo sapiens
agacaucacuugccaau

SEQ ID NO: 486347 - RNA, 19 nt, Homo sapiens
agacaucacuugccaaugu

SEQ ID NO: 486348 - RNA, 20 nt, Homo sapiens
agaccagguggaauuacuua

SEQ ID NO: 486349 - RNA, 23 nt, Homo sapiens
agagaagagccccacucucagag

SEQ ID NO: 486350 - RNA, 16 nt, Homo sapiens
agagaucauauccuca

SEQ ID NO: 486351 - RNA, 19 nt, Homo sapiens
agagcccuugccuccccau

SEQ ID NO: 486352 - RNA, 15 nt, Homo sapiens
agagggaggucacug

SEQ ID NO: 486353 - RNA, 16 nt, Homo sapiens
agagggaggucacugg

SEQ ID NO: 486354 - RNA, 18 nt, Homo sapiens
agagggaggucacuggaa

SEQ ID NO: 486355 - RNA, 17 nt, Homo sapiens
agaguauguucuugaag

SEQ ID NO: 486356 - RNA, 21 nt, Homo sapiens
agauauuuuuaacuuaauggc

SEQ ID NO: 486357 - RNA, 13 nt, Homo sapiens
agauccaaaugua

SEQ ID NO: 486358 - RNA, 17 nt, Homo sapiens
agccaaguggggugcug

SEQ ID NO: 486359 - RNA, 18 nt, Homo sapiens
agcccccagcuuccagca

SEQ ID NO: 486360 - RNA, 17 nt, Homo sapiens
agccuccccgugccaaa

SEQ ID NO: 486361 - RNA, 17 nt, Homo sapiens
agccugaaaauuccaau

SEQ ID NO: 486362 - RNA, 13 nt, Homo sapiens
agcuucucucugc

SEQ ID NO: 486363 - RNA, 20 nt, Homo sapiens
aggaaacuccacaucugccu

SEQ ID NO: 486364 - RNA, 21 nt, Homo sapiens
aggaaacuccacaucugccuu

SEQ ID NO: 486365 - RNA, 16 nt, Homo sapiens
agggaaaggggugcuu

SEQ ID NO: 486366 - RNA, 21 nt, Homo sapiens
agggcacagggccuggcccau

SEQ ID NO: 486367 - RNA, 13 nt, Homo sapiens
agggcagaguaug

SEQ ID NO: 486368 - RNA, 14 nt, Homo sapiens
aggggacugccacc

SEQ ID NO: 486369 - RNA, 12 nt, Homo sapiens
aggucacuggaa

SEQ ID NO: 486370 - RNA, 20 nt, Homo sapiens
agguggaaaaggaacccaau

SEQ ID NO: 486371 - RNA, 14 nt, Homo sapiens
agguugaagccaag

SEQ ID NO: 486372 - RNA, 19 nt, Homo sapiens
aguacagagccaugacuca

SEQ ID NO: 486373 - RNA, 19 nt, Homo sapiens
agucacacuguaaccucag

SEQ ID NO: 486374 - RNA, 15 nt, Homo sapiens
agucaucaucuccaa

SEQ ID NO: 486375 - RNA, 18 nt, Homo sapiens
aguggcagggcacagggc

SEQ ID NO: 486376 - RNA, 19 nt, Homo sapiens
aguucccuauuugugaauu

SEQ ID NO: 486377 - RNA, 16 nt, Homo sapiens
aguugagauucucuac

SEQ ID NO: 486378 - RNA, 20 nt, Homo sapiens
auaaacuauauucugugaca

SEQ ID NO: 486379 - RNA, 12 nt, Homo sapiens
auacauguugua

SEQ ID NO: 486380 - RNA, 15 nt, Homo sapiens
auaccgcagaguauu

SEQ ID NO: 486381 - RNA, 12 nt, Homo sapiens
auagaggcuagc

SEQ ID NO: 486382 - RNA, 23 nt, Homo sapiens
auauauuuuuuucaacugccaau

SEQ ID NO: 486383 - RNA, 12 nt, Homo sapiens
auauuucugcac

SEQ ID NO: 486384 - RNA, 13 nt, Homo sapiens
auauuugaucuaa

SEQ ID NO: 486385 - RNA, 20 nt, Homo sapiens
aucucaaauuuuaaguuaaa

SEQ ID NO: 486386 - RNA, 21 nt, Homo sapiens
aucuccaaacuaaacccucac

SEQ ID NO: 486387 - RNA, 14 nt, Homo sapiens
augaauguaaauuu

SEQ ID NO: 486388 - RNA, 15 nt, Homo sapiens
augaguuucacagug

SEQ ID NO: 486389 - RNA, 21 nt, Homo sapiens
augcacaauuuauaauuacaa

SEQ ID NO: 486390 - RNA, 18 nt, Homo sapiens
augcauucuuucuucucu

SEQ ID NO: 486391 - RNA, 16 nt, Homo sapiens
augguauuauaucucu

SEQ ID NO: 486392 - RNA, 18 nt, Homo sapiens
auguugacaucacuggca

SEQ ID NO: 486393 - RNA, 17 nt, Homo sapiens
cugaguuguuaccccaa

SEQ ID NO: 486394 - RNA, 16 nt, Homo sapiens
cugcauuuucuucacu

SEQ ID NO: 486395 - RNA, 16 nt, Homo sapiens
cugccaggcacaggca

SEQ ID NO: 486396 - RNA, 21 nt, Homo sapiens
cugcugcccccaccccgggga

SEQ ID NO: 486397 - RNA, 19 nt, Homo sapiens
cugcugugauuccacuaca

SEQ ID NO: 486398 - RNA, 19 nt, Homo sapiens
cuggcccccacauggugau

SEQ ID NO: 486399 - RNA, 18 nt, Homo sapiens
cuggcucccucacucuca

SEQ ID NO: 486400 - RNA, 14 nt, Homo sapiens
cugggaugugguau

SEQ ID NO: 486401 - RNA, 16 nt, Homo sapiens
cugugcguggggcucc

SEQ ID NO: 486402 - RNA, 23 nt, Homo sapiens
cuguucuguuuccugugucucca

SEQ ID NO: 486403 - RNA, 14 nt, Homo sapiens
cuguuuaauugaca

SEQ ID NO: 486404 - RNA, 17 nt, Homo sapiens
cuuaaaagaaaacaaag

SEQ ID NO: 486405 - RNA, 22 nt, Homo sapiens
cuuaugaacagauauuuuuaac

SEQ ID NO: 486406 - RNA, 16 nt, Homo sapiens
cuuccucuagaagcca

SEQ ID NO: 486407 - RNA, 18 nt, Homo sapiens
cuuccucuagaagccaag

SEQ ID NO: 486408 - RNA, 20 nt, Homo sapiens
cuugagccgggccccugggc

SEQ ID NO: 486409 - RNA, 19 nt, Homo sapiens
cuuucuaaaacacauuuaa

SEQ ID NO: 486410 - RNA, 22 nt, Homo sapiens
gaaaauauuauuuuuaugccug

SEQ ID NO: 486411 - RNA, 18 nt, Homo sapiens
gaaacauucuuuccuaaa

SEQ ID NO: 486412 - RNA, 20 nt, Homo sapiens
gaagagccccacucucagag

SEQ ID NO: 486413 - RNA, 23 nt, Homo sapiens
gaagugacgguuccuacacagga

SEQ ID NO: 486414 - RNA, 22 nt, Homo sapiens
gacaagagaugggaaugaggug

SEQ ID NO: 486415 - RNA, 13 nt, Homo sapiens
gagaggcaggcau

SEQ ID NO: 486416 - RNA, 15 nt, Homo sapiens
gagaggggaggccaa

SEQ ID NO: 486417 - RNA, 20 nt, Homo sapiens
gagcaaauccaggaaggcaa

SEQ ID NO: 486418 - RNA, 15 nt, Homo sapiens
gaggagcccugccuc

SEQ ID NO: 486419 - RNA, 21 nt, Homo sapiens
gaggcuucuccgccagccucc

SEQ ID NO: 486420 - RNA, 23 nt, Homo sapiens
gagggcuuccucuagaagccaag

SEQ ID NO: 486421 - RNA, 11 nt, Homo sapiens
gauauauuugu

SEQ ID NO: 486422 - RNA, 13 nt, Homo sapiens
gcaaggccaccuc

SEQ ID NO: 486423 - RNA, 13 nt, Homo sapiens
gcacuggggccac

SEQ ID NO: 486424 - RNA, 16 nt, Homo sapiens
gcaggagggacagucu

SEQ ID NO: 486425 - RNA, 13 nt, Homo sapiens
gcagucacuggag

SEQ ID NO: 486426 - RNA, 17 nt, Homo sapiens
gcauuuucuucacuugc

SEQ ID NO: 486427 - RNA, 20 nt, Homo sapiens
gccaagggaaaggggugcuu

SEQ ID NO: 486428 - RNA, 20 nt, Homo sapiens
gccaggaaguagcacaggcu

SEQ ID NO: 486429 - RNA, 17 nt, Homo sapiens
gcccugcacgucauggg

SEQ ID NO: 486430 - RNA, 19 nt, Homo sapiens
gccuccccgugccaaaaau

SEQ ID NO: 486431 - RNA, 20 nt, Homo sapiens
gccugagaggcaggcauaga

SEQ ID NO: 486432 - RNA, 11 nt, Homo sapiens
gccugcacugg

SEQ ID NO: 486433 - RNA, 20 nt, Homo sapiens
gccuggcucccucacucuca

SEQ ID NO: 486434 - RNA, 21 nt, Homo sapiens
gcuggagaggagcccugccuc

SEQ ID NO: 486435 - RNA, 14 nt, Homo sapiens
gcugggcacugcuc

SEQ ID NO: 486436 - RNA, 18 nt, Homo sapiens
gcuuccagcaggagggac

SEQ ID NO: 486437 - RNA, 21 nt, Homo sapiens
gcuucucucugcaaccuugaa

SEQ ID NO: 486438 - RNA, 13 nt, Homo sapiens
gcuugaagccaaa

SEQ ID NO: 486439 - RNA, 13 nt, Homo sapiens
gcuuuucuguauu

SEQ ID NO: 486440 - RNA, 14 nt, Homo sapiens
ggacagucucacca

SEQ ID NO: 486441 - RNA, 15 nt, Homo sapiens
ggacggcaggcucac

SEQ ID NO: 486442 - RNA, 17 nt, Homo sapiens
ggacugaggcaagcaca

SEQ ID NO: 486443 - RNA, 20 nt, Homo sapiens
ggagacaucacuugccaaug

SEQ ID NO: 486444 - RNA, 19 nt, Homo sapiens
ggaggcucgaccaccucaa

SEQ ID NO: 486445 - RNA, 17 nt, Homo sapiens
ggcaauaaaagcccagg

SEQ ID NO: 486446 - RNA, 21 nt, Homo sapiens
ggcaggaccagcccacgcuga

SEQ ID NO: 486447 - RNA, 22 nt, Homo sapiens
ggcaggcucacugccaggccag

SEQ ID NO: 486448 - RNA, 22 nt, Homo sapiens
ggccccaccuggcccucucuga

SEQ ID NO: 486449 - RNA, 15 nt, Homo sapiens
ggccccgucucaggu

SEQ ID NO: 486450 - RNA, 18 nt, Homo sapiens
ggcucccucacucucagg

SEQ ID NO: 486451 - RNA, 14 nt, Homo sapiens
ggcuugaagccaaa

SEQ ID NO: 486452 - RNA, 17 nt, Homo sapiens
ggcuugaagccaaagaa

SEQ ID NO: 486453 - RNA, 22 nt, Homo sapiens
gggcucagcaaggccaccucuu

SEQ ID NO: 486454 - RNA, 15 nt, Homo sapiens
gggcuugaagccaaa

SEQ ID NO: 486455 - RNA, 21 nt, Homo sapiens
gguauuggugcuuugugucua

SEQ ID NO: 486456 - RNA, 18 nt, Homo sapiens
ggucagaggcccaaaaca

SEQ ID NO: 486457 - RNA, 19 nt, Homo sapiens
gguugggacccaguggcag

SEQ ID NO: 486458 - RNA, 18 nt, Homo sapiens
guaaacagaaauugcaau

SEQ ID NO: 486459 - RNA, 17 nt, Homo sapiens
guaccacauuccaugac

SEQ ID NO: 486460 - RNA, 16 nt, Homo sapiens
gucccagcagccagcc

SEQ ID NO: 486461 - RNA, 16 nt, Homo sapiens
gucuaauaauguuaag

SEQ ID NO: 486462 - RNA, 19 nt, Homo sapiens
gucucucacagacaggacc

SEQ ID NO: 486463 - RNA, 15 nt, Homo sapiens
gugcagucacuggag

SEQ ID NO: 486464 - RNA, 11 nt, Homo sapiens
gugccaaaaau

SEQ ID NO: 486465 - RNA, 20 nt, Homo sapiens
guucuguuuccugugucucc

SEQ ID NO: 486466 - RNA, 19 nt, Homo sapiens
guugaagaaaaaauggcaa

SEQ ID NO: 486467 - RNA, 23 nt, Homo sapiens
uaaaaaguaccacauuccaugac

SEQ ID NO: 486468 - RNA, 22 nt, Homo sapiens
uaaaacucacugaaucuaacca

SEQ ID NO: 486469 - RNA, 19 nt, Homo sapiens
uaaaagcccaggagcccau

SEQ ID NO: 486470 - RNA, 20 nt, Homo sapiens
uaaccaauuucuuucuaaaa

SEQ ID NO: 486471 - RNA, 20 nt, Homo sapiens
uaacuucauuuuucuaauaa

SEQ ID NO: 486472 - RNA, 22 nt, Homo sapiens
uaaguggcuuuuuguacuguag

SEQ ID NO: 486473 - RNA, 20 nt, Homo sapiens
uaauccugguggucuugccu

SEQ ID NO: 486474 - RNA, 21 nt, Homo sapiens
uaaugaguuucacagugugau

SEQ ID NO: 486475 - RNA, 22 nt, Homo sapiens
uaccaagggccauucaguacau

SEQ ID NO: 486476 - RNA, 17 nt, Homo sapiens
uaccacauuccaugacg

SEQ ID NO: 486477 - RNA, 11 nt, Homo sapiens
uagaagccaag

SEQ ID NO: 486478 - RNA, 17 nt, Homo sapiens
cccaagagauuauguaa

SEQ ID NO: 486479 - RNA, 13 nt, Homo sapiens
cccacauggugau

SEQ ID NO: 486480 - RNA, 20 nt, Homo sapiens
cccagccuccccgugccaaa

SEQ ID NO: 486481 - RNA, 14 nt, Homo sapiens
cccauguauggcca

SEQ ID NO: 486482 - RNA, 14 nt, Homo sapiens
ccccaauaccccau

SEQ ID NO: 486483 - RNA, 23 nt, Homo sapiens
ccccuucuccccugcacuguaaa

SEQ ID NO: 486484 - RNA, 13 nt, Homo sapiens
cccgugccaaaaa

SEQ ID NO: 486485 - RNA, 19 nt, Homo sapiens
cccuggguuagacugccag

SEQ ID NO: 486486 - RNA, 12 nt, Homo sapiens
cccuguucuucg

SEQ ID NO: 486487 - RNA, 19 nt, Homo sapiens
ccucagcaagaccuugaac

SEQ ID NO: 486488 - RNA, 14 nt, Homo sapiens
ccucuagaagccaa

SEQ ID NO: 486489 - RNA, 14 nt, Homo sapiens
ccugagacauauua

SEQ ID NO: 486490 - RNA, 12 nt, Homo sapiens
ccugcugugauu

SEQ ID NO: 486491 - RNA, 17 nt, Homo sapiens
ccuggaccccagccuca

SEQ ID NO: 486492 - RNA, 23 nt, Homo sapiens
ccugggcuuggccugcugugauu

SEQ ID NO: 486493 - RNA, 17 nt, Homo sapiens
ccugguaaguggcuuuu

SEQ ID NO: 486494 - RNA, 16 nt, Homo sapiens
ccuuaaaaccaaagag

SEQ ID NO: 486495 - RNA, 20 nt, Homo sapiens
cgccuccaaccccucgccca

SEQ ID NO: 486496 - RNA, 14 nt, Homo sapiens
cggggacccuguga

SEQ ID NO: 486497 - RNA, 15 nt, Homo sapiens
cuaaguaugaucuau

SEQ ID NO: 486498 - RNA, 14 nt, Homo sapiens
cuaauuauuauuaa

SEQ ID NO: 486499 - RNA, 20 nt, Homo sapiens
cuacauuauaccgcagagua

SEQ ID NO: 486500 - RNA, 16 nt, Homo sapiens
cuauacccagcagagg

SEQ ID NO: 486501 - RNA, 16 nt, Homo sapiens
cuauucuugauguaaa

SEQ ID NO: 486502 - RNA, 17 nt, Homo sapiens
cuauucuugauguaaaa

SEQ ID NO: 486503 - RNA, 16 nt, Homo sapiens
cucaaaacugagccau

SEQ ID NO: 486504 - RNA, 16 nt, Homo sapiens
uauuuuuuucccaagg

SEQ ID NO: 486505 - RNA, 14 nt, Homo sapiens
ucaacuuauuucug

SEQ ID NO: 486506 - RNA, 23 nt, Homo sapiens
ucaauauuugaucuaaguugcau

SEQ ID NO: 486507 - RNA, 21 nt, Homo sapiens
ucaccuugguuccuggggcau

SEQ ID NO: 486508 - RNA, 12 nt, Homo sapiens
ucacucucagga

SEQ ID NO: 486509 - RNA, 22 nt, Homo sapiens
ucagaccagguggaauuacuua

SEQ ID NO: 486510 - RNA, 17 nt, Homo sapiens
ucagcugcugcuauuau

SEQ ID NO: 486511 - RNA, 19 nt, Homo sapiens
ucaugggagggggcuugaa

SEQ ID NO: 486512 - RNA, 20 nt, Homo sapiens
ucaugggagggggcuugaag

SEQ ID NO: 486513 - RNA, 16 nt, Homo sapiens
ucauugaaacuacacu

SEQ ID NO: 486514 - RNA, 21 nt, Homo sapiens
ucccauggccccuugcauuuc

SEQ ID NO: 486515 - RNA, 23 nt, Homo sapiens
uccccagccuccccgugccaaaa

SEQ ID NO: 486516 - RNA, 14 nt, Homo sapiens
uccccgugccaaaa

SEQ ID NO: 486517 - RNA, 21 nt, Homo sapiens
uccccgugccaaaaaucuuuu

SEQ ID NO: 486518 - RNA, 16 nt, Homo sapiens
uccccugcacuguaaa

SEQ ID NO: 486519 - RNA, 18 nt, Homo sapiens
uccccugcacuguaaaau

SEQ ID NO: 486520 - RNA, 20 nt, Homo sapiens
ucccuggguuagacugccag

SEQ ID NO: 486521 - RNA, 16 nt, Homo sapiens
uccucaugaauguaaa

SEQ ID NO: 486522 - RNA, 11 nt, Homo sapiens
uccuccccaaa

SEQ ID NO: 486523 - RNA, 16 nt, Homo sapiens
uccuucuuaacucucu

SEQ ID NO: 486524 - RNA, 12 nt, Homo sapiens
ucuacaaccuaa

SEQ ID NO: 486525 - RNA, 23 nt, Homo sapiens
ucuacauuauaccgcagaguauu

SEQ ID NO: 486526 - RNA, 12 nt, Homo sapiens
ucuagaagccaa

SEQ ID NO: 486527 - RNA, 16 nt, Homo sapiens
ucucacugaagcucaa

SEQ ID NO: 486528 - RNA, 13 nt, Homo sapiens
ucucaucucugua

SEQ ID NO: 486529 - RNA, 19 nt, Homo sapiens
ucuccgccccugagcccac

SEQ ID NO: 486530 - RNA, 16 nt, Homo sapiens
ucucuauucuuuccau

SEQ ID NO: 486531 - RNA, 20 nt, Homo sapiens
ucugccuuaaaaccaaagag

SEQ ID NO: 486532 - RNA, 17 nt, Homo sapiens
ucugucuuuucugggau

SEQ ID NO: 486533 - RNA, 16 nt, Homo sapiens
ucugugcagucacugg

SEQ ID NO: 486534 - RNA, 22 nt, Homo sapiens
ucuuacguacacuguacuucug

SEQ ID NO: 486535 - RNA, 14 nt, Homo sapiens
ucuuauccuuugua

SEQ ID NO: 486536 - RNA, 14 nt, Homo sapiens
ucuuaugguauuau

SEQ ID NO: 486537 - RNA, 18 nt, Homo sapiens
ucuuccuagugccuacaa

SEQ ID NO: 486538 - RNA, 17 nt, Homo sapiens
ucuuuuccuccaugaug

SEQ ID NO: 486539 - RNA, 16 nt, Homo sapiens
ugaagaaaaaauggca

SEQ ID NO: 486540 - RNA, 23 nt, Homo sapiens
ugaagaaaaaauggcaagagauc

SEQ ID NO: 486541 - RNA, 21 nt, Homo sapiens
ugaagaaaggcaaaucugacu

SEQ ID NO: 486542 - RNA, 21 nt, Homo sapiens
ugaagucacacuguaaccuca

SEQ ID NO: 486543 - RNA, 18 nt, Homo sapiens
ugaccuuuguaguagaau

SEQ ID NO: 486544 - RNA, 21 nt, Homo sapiens
ugacuauucuugauguaaaau

SEQ ID NO: 486545 - RNA, 22 nt, Homo sapiens
ugagacauauuagucuuugaaa

SEQ ID NO: 486546 - RNA, 16 nt, Homo sapiens
ugaguuguuaccccaa

SEQ ID NO: 486547 - RNA, 18 nt, Homo sapiens
ugaucuaugcuauauuca

SEQ ID NO: 486548 - RNA, 20 nt, Homo sapiens
ugcacuguaaaaugugggau

SEQ ID NO: 486549 - RNA, 22 nt, Homo sapiens
ugcaggcaaacuuggcucucaa

SEQ ID NO: 486550 - RNA, 12 nt, Homo sapiens
ugcagucacugg

SEQ ID NO: 486551 - RNA, 14 nt, Homo sapiens
ugcagucacuggag

SEQ ID NO: 486552 - RNA, 21 nt, Homo sapiens
ugcauacuuaugacugaaugu

SEQ ID NO: 486553 - RNA, 22 nt, Homo sapiens
ugcugcauuuucuucacuugca

SEQ ID NO: 486554 - RNA, 12 nt, Homo sapiens
uggaagaaggga

SEQ ID NO: 486555 - RNA, 21 nt, Homo sapiens
uggaccaugcugucuggcaca

SEQ ID NO: 486556 - RNA, 16 nt, Homo sapiens
uggagaaucacaggcu

SEQ ID NO: 486557 - RNA, 21 nt, Homo sapiens
uggagacaucacuugccaaug

SEQ ID NO: 486558 - RNA, 19 nt, Homo sapiens
uggaggaggaaggcaagag

SEQ ID NO: 486559 - RNA, 13 nt, Homo sapiens
uggauccugugug

SEQ ID NO: 486560 - RNA, 20 nt, Homo sapiens
uggauguauuuguagccagu

SEQ ID NO: 486561 - RNA, 14 nt, Homo sapiens
uggcacaaagucuu

SEQ ID NO: 486562 - RNA, 21 nt, Homo sapiens
uggccugcugugauuccacua

SEQ ID NO: 486563 - RNA, 20 nt, Homo sapiens
uggcucccucacucucagga

SEQ ID NO: 486564 - RNA, 17 nt, Homo sapiens
uggcugagguuccucug

SEQ ID NO: 486565 - RNA, 22 nt, Homo sapiens
uggcuuuuuguacuguaguuca

SEQ ID NO: 486566 - RNA, 15 nt, Homo sapiens
uggguuuuuuaguug

SEQ ID NO: 486567 - RNA, 13 nt, Homo sapiens
uggugguauucag

SEQ ID NO: 486568 - RNA, 16 nt, Homo sapiens
uguaaauuuguacuau

SEQ ID NO: 486569 - RNA, 15 nt, Homo sapiens
uguaaugcacacuua

SEQ ID NO: 486570 - RNA, 13 nt, Homo sapiens
uguacauaccuug

SEQ ID NO: 486571 - RNA, 20 nt, Homo sapiens
uguacuucugugugcaauug

SEQ ID NO: 486572 - RNA, 16 nt, Homo sapiens
uguaucuaaagucuuc

SEQ ID NO: 486573 - RNA, 14 nt, Homo sapiens
uguauuuguagcca

SEQ ID NO: 486574 - RNA, 12 nt, Homo sapiens
ugucauguguau

SEQ ID NO: 486575 - RNA, 17 nt, Homo sapiens
ugugccccguguucccu

SEQ ID NO: 486576 - RNA, 16 nt, Homo sapiens
uuaaaaauuacuguuu

SEQ ID NO: 486577 - RNA, 14 nt, Homo sapiens
uuaaaaccaaagag

SEQ ID NO: 486578 - RNA, 17 nt, Homo sapiens
uuaaauauuucugcaca

SEQ ID NO: 486579 - RNA, 17 nt, Homo sapiens
uuaacauuccucaugaa

SEQ ID NO: 486580 - RNA, 16 nt, Homo sapiens
uuaacucucuguuaca

SEQ ID NO: 486581 - RNA, 23 nt, Homo sapiens
uuacacgucauugaaacuacacu

SEQ ID NO: 486582 - RNA, 16 nt, Homo sapiens
uucacuccaaagagaa

SEQ ID NO: 486583 - RNA, 17 nt, Homo sapiens
uucauuuuucuaauaau

SEQ ID NO: 486584 - RNA, 23 nt, Homo sapiens
uuccagcaggagggacagucuca

SEQ ID NO: 486585 - RNA, 12 nt, Homo sapiens
uucccuagcuuu

SEQ ID NO: 486586 - RNA, 22 nt, Homo sapiens
uuccuagugccuacaaugggaa

SEQ ID NO: 486587 - RNA, 17 nt, Homo sapiens
uuccucuagaagccaag

SEQ ID NO: 486588 - RNA, 21 nt, Homo sapiens
uucucuauucuuuccaugaca

SEQ ID NO: 486589 - RNA, 16 nt, Homo sapiens
uucucuauugcaagca

SEQ ID NO: 486590 - RNA, 18 nt, Homo sapiens
uucuugaagaaaggcaaa

SEQ ID NO: 486591 - RNA, 18 nt, Homo sapiens
ccagccaaacacacagaa

SEQ ID NO: 486592 - RNA, 15 nt, Homo sapiens
ccaggaaguagcaca

SEQ ID NO: 486593 - RNA, 13 nt, Homo sapiens
ccaggcacaggca

SEQ ID NO: 486594 - RNA, 14 nt, Homo sapiens
ccaggcaggggugg

SEQ ID NO: 486595 - RNA, 23 nt, Homo sapiens
cccaaguauugauuuaacuucau

SEQ ID NO: 486596 - RNA, 18 nt, Homo sapiens
cccaggagcccauuugga

SEQ ID NO: 486597 - RNA, 17 nt, Homo sapiens
cccauggaccaugcugu

SEQ ID NO: 486598 - RNA, 16 nt, Homo sapiens
cccucacucucaggaa

SEQ ID NO: 486599 - RNA, 15 nt, Homo sapiens
ccucuagaagccaag

SEQ ID NO: 486600 - RNA, 22 nt, Homo sapiens
ccugagugagaggggaggccaa

SEQ ID NO: 486601 - RNA, 19 nt, Homo sapiens
ccuggcucccucacucuca

SEQ ID NO: 486602 - RNA, 15 nt, Homo sapiens
ccuggguuagacugc

SEQ ID NO: 486603 - RNA, 23 nt, Homo sapiens
ccuucccuagcuuuagacccugg

SEQ ID NO: 486604 - RNA, 23 nt, Homo sapiens
ccuuggcauccuggcauucucaa

SEQ ID NO: 486605 - RNA, 11 nt, Homo sapiens
ccuuuugcaca

SEQ ID NO: 486606 - RNA, 19 nt, Homo sapiens
cgcagaguauuugaaguca

SEQ ID NO: 486607 - RNA, 15 nt, Homo sapiens
cggauuuauucccuu

SEQ ID NO: 486608 - RNA, 15 nt, Homo sapiens
cgugccaaaaaucuu

SEQ ID NO: 486609 - RNA, 20 nt, Homo sapiens
cguggggcucccgccuccaa

SEQ ID NO: 486610 - RNA, 21 nt, Homo sapiens
cuaaaaaauuccuaggugcua

SEQ ID NO: 486611 - RNA, 15 nt, Homo sapiens
cuagaagccaaggga

SEQ ID NO: 486612 - RNA, 20 nt, Homo sapiens
cuagacguuguaaugcacac

SEQ ID NO: 486613 - RNA, 13 nt, Homo sapiens
cuagggcagagua

SEQ ID NO: 486614 - RNA, 17 nt, Homo sapiens
cuauauucaaaauucaa

SEQ ID NO: 486615 - RNA, 18 nt, Homo sapiens
cuauucuuuccaugacac

SEQ ID NO: 486616 - RNA, 16 nt, Homo sapiens
cuauuuaugaauauua

SEQ ID NO: 486617 - RNA, 19 nt, Homo sapiens
cuauuuuuaaaaaguacca

SEQ ID NO: 486618 - RNA, 13 nt, Homo sapiens
cuccaaccccucg

SEQ ID NO: 486619 - RNA, 13 nt, Homo sapiens
cuccauccaugug

SEQ ID NO: 486620 - RNA, 15 nt, Homo sapiens
cuccaugauguuaau

SEQ ID NO: 486621 - RNA, 19 nt, Homo sapiens
cuccucaccucaugcccac

SEQ ID NO: 486622 - RNA, 21 nt, Homo sapiens
cuccuccauccauguguucca

SEQ ID NO: 486623 - RNA, 17 nt, Homo sapiens
cucugaaggaggccacc

SEQ ID NO: 486624 - RNA, 21 nt, Homo sapiens
cucuucccauaccacccaaaa

SEQ ID NO: 486625 - RNA, 22 nt, Homo sapiens
cugaaggaaaaacacaagcaaa

SEQ ID NO: 486626 - RNA, 15 nt, Homo sapiens
cugagccgcagagaa

SEQ ID NO: 486627 - RNA, 16 nt, Homo sapiens
cugcacuggggccacc

SEQ ID NO: 486628 - RNA, 14 nt, Homo sapiens
cugcacuguaaaau

SEQ ID NO: 486629 - RNA, 21 nt, Homo sapiens
cugcguccuccucaccucaug

SEQ ID NO: 486630 - RNA, 22 nt, Homo sapiens
cuggacggcaggcucacugcca

SEQ ID NO: 486631 - RNA, 18 nt, Homo sapiens
cugggcacugcucucacc

SEQ ID NO: 486632 - RNA, 15 nt, Homo sapiens
cuggggccacccagc

SEQ ID NO: 486633 - RNA, 19 nt, Homo sapiens
cuguaaugcuuuacacagg

SEQ ID NO: 486634 - RNA, 17 nt, Homo sapiens
cuguacuucugugugca

SEQ ID NO: 486635 - RNA, 24 nt, Homo sapiens
cuguacuucugugugcaauuguaa

SEQ ID NO: 486636 - RNA, 15 nt, Homo sapiens
cugugcagucacugg

SEQ ID NO: 486637 - RNA, 18 nt, Homo sapiens
cuuaaauuuuaaagccug

SEQ ID NO: 486638 - RNA, 14 nt, Homo sapiens
cuuauaauuacaau

SEQ ID NO: 486639 - RNA, 18 nt, Homo sapiens
cuucaaaaagcauuuuaa

SEQ ID NO: 486640 - RNA, 12 nt, Homo sapiens
cuugggggcuca

SEQ ID NO: 486641 - RNA, 17 nt, Homo sapiens
cuugucauguguauaaa

SEQ ID NO: 486642 - RNA, 13 nt, Homo sapiens
cuuguuauaugca

SEQ ID NO: 486643 - RNA, 17 nt, Homo sapiens
cuuuggucaauauuuga

SEQ ID NO: 486644 - RNA, 18 nt, Homo sapiens
cuuuucauuaaagaaugu

SEQ ID NO: 486645 - RNA, 19 nt, Homo sapiens
cuuuugcuauggagcaaau

SEQ ID NO: 486646 - RNA, 13 nt, Homo sapiens
gaaaaaauggcaa

SEQ ID NO: 486647 - RNA, 18 nt, Homo sapiens
gaaaauacaaaagguaaa

SEQ ID NO: 486648 - RNA, 17 nt, Homo sapiens
gaaaaucuauccuuuaa

SEQ ID NO: 486649 - RNA, 12 nt, Homo sapiens
gaaaauuccaau

SEQ ID NO: 486650 - RNA, 15 nt, Homo sapiens
gaaacauucuuuccu

SEQ ID NO: 486651 - RNA, 13 nt, Homo sapiens
gaaaggggugcuu

SEQ ID NO: 486652 - RNA, 16 nt, Homo sapiens
gacccaguggcagggc

SEQ ID NO: 486653 - RNA, 18 nt, Homo sapiens
gacccaugggcaggagac

SEQ ID NO: 486654 - RNA, 13 nt, Homo sapiens
gagacaucacuug

SEQ ID NO: 486655 - RNA, 19 nt, Homo sapiens
gagacuguggagacugcuc

SEQ ID NO: 486656 - RNA, 18 nt, Homo sapiens
gagagggaggucacugga

SEQ ID NO: 486657 - RNA, 16 nt, Homo sapiens
gagccccacucucaga

SEQ ID NO: 486658 - RNA, 15 nt, Homo sapiens
gagggagagggaggu

SEQ ID NO: 486659 - RNA, 13 nt, Homo sapiens
gaggucacuggaa

SEQ ID NO: 486660 - RNA, 15 nt, Homo sapiens
gagguugaagccaag

SEQ ID NO: 486661 - RNA, 12 nt, Homo sapiens
gaguuguccuga

SEQ ID NO: 486662 - RNA, 22 nt, Homo sapiens
gauuugaauuguuuuaagccaa

SEQ ID NO: 486663 - RNA, 19 nt, Homo sapiens
gcacuggggccacccagcc

SEQ ID NO: 486664 - RNA, 18 nt, Homo sapiens
gcagacauguauuucuua

SEQ ID NO: 486665 - RNA, 12 nt, Homo sapiens
gcagucacugga

SEQ ID NO: 486666 - RNA, 21 nt, Homo sapiens
gcauccauggggucucucaca

SEQ ID NO: 486667 - RNA, 19 nt, Homo sapiens
gccaauauuuuaagguaaa

SEQ ID NO: 486668 - RNA, 15 nt, Homo sapiens
gccaauguacauacc

SEQ ID NO: 486669 - RNA, 16 nt, Homo sapiens
gccauuggaaagcaaa

SEQ ID NO: 486670 - RNA, 18 nt, Homo sapiens
gccuccccgugccaaaaa

SEQ ID NO: 486671 - RNA, 16 nt, Homo sapiens
gcuaacuacaugaaca

SEQ ID NO: 486672 - RNA, 15 nt, Homo sapiens
gcucccucacucuca

SEQ ID NO: 486673 - RNA, 18 nt, Homo sapiens
gcugagguuccucugccu

SEQ ID NO: 486674 - RNA, 10 nt, Homo sapiens
gcuuccucua

SEQ ID NO: 486675 - RNA, 19 nt, Homo sapiens
gcuuccucuagaagccaag

SEQ ID NO: 486676 - RNA, 15 nt, Homo sapiens
gcuugaagccaaaga

SEQ ID NO: 486677 - RNA, 21 nt, Homo sapiens
ggaaaauaaucaaaccaaaga

SEQ ID NO: 486678 - RNA, 16 nt, Homo sapiens
ggaagcagugcccagg

SEQ ID NO: 486679 - RNA, 18 nt, Homo sapiens
ggacccaguggcagggca

SEQ ID NO: 486680 - RNA, 19 nt, Homo sapiens
ggauuaugggucacaggaa

SEQ ID NO: 486681 - RNA, 23 nt, Homo sapiens
ggcaaaucugacuuuuucugugc

SEQ ID NO: 486682 - RNA, 22 nt, Homo sapiens
ggcagggccuuugucugucuca

SEQ ID NO: 486683 - RNA, 16 nt, Homo sapiens
ggcaguggaguaggga

SEQ ID NO: 486684 - RNA, 21 nt, Homo sapiens
ggcucugugcagucacuggag

SEQ ID NO: 486685 - RNA, 16 nt, Homo sapiens
gggccccgucucaggu

SEQ ID NO: 486686 - RNA, 15 nt, Homo sapiens
gggguggaggggugu

SEQ ID NO: 486687 - RNA, 13 nt, Homo sapiens
gggugggggugga

SEQ ID NO: 486688 - RNA, 13 nt, Homo sapiens
ggucaauauuuga

SEQ ID NO: 486689 - RNA, 15 nt, Homo sapiens
ggugaccacaaaaga

SEQ ID NO: 486690 - RNA, 18 nt, Homo sapiens
guaccacauuccaugacg

SEQ ID NO: 486691 - RNA, 17 nt, Homo sapiens
guauuaaaauaucccaa

SEQ ID NO: 486692 - RNA, 14 nt, Homo sapiens
gugaguuugagcug

SEQ ID NO: 486693 - RNA, 22 nt, Homo sapiens
guggccccaccuggcccucucu

SEQ ID NO: 486694 - RNA, 21 nt, Homo sapiens
gugggcucugugcagucacug

SEQ ID NO: 486695 - RNA, 21 nt, Homo sapiens
guuccuacacaggacaggggu

SEQ ID NO: 486696 - RNA, 18 nt, Homo sapiens
guugacaucacuggcaug

SEQ ID NO: 486697 - RNA, 12 nt, Homo sapiens
guuucacagugu

SEQ ID NO: 486698 - RNA, 22 nt, Homo sapiens
uaaaaaaagacauaauucacac

SEQ ID NO: 486699 - RNA, 19 nt, Homo sapiens
uaaaaaguaccacauucca

SEQ ID NO: 486700 - RNA, 17 nt, Homo sapiens
uaaacaaucucccaagu

SEQ ID NO: 486701 - RNA, 15 nt, Homo sapiens
uaaacaauucuugua

SEQ ID NO: 486702 - RNA, 16 nt, Homo sapiens
uaaacccuugcugcug

SEQ ID NO: 486703 - RNA, 13 nt, Homo sapiens
uagggcagaguau

SEQ ID NO: 486704 - RNA, 15 nt, Homo sapiens
uaguagaauuuacaa

SEQ ID NO: 486705 - RNA, 18 nt, Homo sapiens
uauaauuucagugcagua

SEQ ID NO: 486706 - RNA, 23 nt, Homo sapiens
uauccuuuguacuguagcuaaau

SEQ ID NO: 486707 - RNA, 22 nt, Homo sapiens
uauccuuuucuauuaagauaua

SEQ ID NO: 486708 - RNA, 23 nt, Homo sapiens
uauccuuuucuauuaagauauau

SEQ ID NO: 486709 - RNA, 14 nt, Homo sapiens
uaucuacauuauac

SEQ ID NO: 486710 - RNA, 20 nt, Homo sapiens
uauuauuuucccauuugcug

SEQ ID NO: 486711 - RNA, 12 nt, Homo sapiens
uauucagugaua

SEQ ID NO: 486712 - RNA, 16 nt, Homo sapiens
uauucuuuccaugaca

SEQ ID NO: 486713 - RNA, 17 nt, Homo sapiens
uauucuuuccaugacac

SEQ ID NO: 486714 - RNA, 18 nt, Homo sapiens
uauugcaagcagauuccc

SEQ ID NO: 486715 - RNA, 14 nt, Homo sapiens
uauuuaaagccaaa

SEQ ID NO: 486716 - RNA, 19 nt, Homo sapiens
uauuugaagucacacugua

SEQ ID NO: 486717 - RNA, 17 nt, Homo sapiens
uauuuucuacagugguu

SEQ ID NO: 486718 - RNA, 13 nt, Homo sapiens
ucaacugccaauc

SEQ ID NO: 486719 - RNA, 15 nt, Homo sapiens
ucaaugagagccaua

SEQ ID NO: 486720 - RNA, 16 nt, Homo sapiens
ucacuaaguaugaucu

SEQ ID NO: 486721 - RNA, 23 nt, Homo sapiens
uccagcaggagggacagucucac

SEQ ID NO: 486722 - RNA, 15 nt, Homo sapiens
uccuaggugcuauuu

SEQ ID NO: 486723 - RNA, 19 nt, Homo sapiens
uccugauguuuuucugugu

SEQ ID NO: 486724 - RNA, 14 nt, Homo sapiens
uccuggggcaucca

SEQ ID NO: 486725 - RNA, 23 nt, Homo sapiens
uccuuuccugcuaggcagugcug

SEQ ID NO: 486726 - RNA, 13 nt, Homo sapiens
uccuuuucuauua

SEQ ID NO: 486727 - RNA, 18 nt, Homo sapiens
uccuuuucuauuaagaua

SEQ ID NO: 486728 - RNA, 20 nt, Homo sapiens
ucuagggcagaguauguucu

SEQ ID NO: 486729 - RNA, 11 nt, Homo sapiens
ucuauccuuua

SEQ ID NO: 486730 - RNA, 17 nt, Homo sapiens
ucuauucuuuccaugac

SEQ ID NO: 486731 - RNA, 23 nt, Homo sapiens
ucucaauaaacuuuuaccacaaa

SEQ ID NO: 486732 - RNA, 17 nt, Homo sapiens
ucucaucucuguauucc

SEQ ID NO: 486733 - RNA, 22 nt, Homo sapiens
ucuccaaacuaaacccucacaa

SEQ ID NO: 486734 - RNA, 12 nt, Homo sapiens
ucucuguuacac

SEQ ID NO: 486735 - RNA, 13 nt, Homo sapiens
ucugggcauuaca

SEQ ID NO: 486736 - RNA, 18 nt, Homo sapiens
ucuguaaugcuuuacaca

SEQ ID NO: 486737 - RNA, 18 nt, Homo sapiens
ucugugacaugcuaauua

SEQ ID NO: 486738 - RNA, 13 nt, Homo sapiens
ucuugacagugag

SEQ ID NO: 486739 - RNA, 14 nt, Homo sapiens
ucuugauguaaaau

SEQ ID NO: 486740 - RNA, 13 nt, Homo sapiens
ugaagccaaagaa

SEQ ID NO: 486741 - RNA, 22 nt, Homo sapiens
ugaauauuaaaaaaagacauaa

SEQ ID NO: 486742 - RNA, 13 nt, Homo sapiens
ugacuacagggcc

SEQ ID NO: 486743 - RNA, 23 nt, Homo sapiens
ugagauggauguauuuguagcca

SEQ ID NO: 486744 - RNA, 19 nt, Homo sapiens
ugauuuuuuuucucucucu

SEQ ID NO: 486745 - RNA, 14 nt, Homo sapiens
ugcacuggggccac

SEQ ID NO: 486746 - RNA, 10 nt, Homo sapiens
ugccaaaaau

SEQ ID NO: 486747 - RNA, 15 nt, Homo sapiens
ugccaaaaaucuuuu

SEQ ID NO: 486748 - RNA, 18 nt, Homo sapiens
ugccuuaaaaccaaagag

SEQ ID NO: 486749 - RNA, 14 nt, Homo sapiens
ugcugugauuccac

SEQ ID NO: 486750 - RNA, 11 nt, Homo sapiens
uggaggcuucc

SEQ ID NO: 486751 - RNA, 16 nt, Homo sapiens
uggccaggaaguagca

SEQ ID NO: 486752 - RNA, 22 nt, Homo sapiens
uggcccauguauggccaggaag

SEQ ID NO: 486753 - RNA, 17 nt, Homo sapiens
uggcccucucugaagga

SEQ ID NO: 486754 - RNA, 19 nt, Homo sapiens
uggccugcugugauuccac

SEQ ID NO: 486755 - RNA, 16 nt, Homo sapiens
ugggacccaguggcag

SEQ ID NO: 486756 - RNA, 23 nt, Homo sapiens
ugggcucugugcagucacuggag

SEQ ID NO: 486757 - RNA, 17 nt, Homo sapiens
ugucuagggcagaguau

SEQ ID NO: 486758 - RNA, 18 nt, Homo sapiens
ugucuagggcagaguaug

SEQ ID NO: 486759 - RNA, 16 nt, Homo sapiens
ugugaaauuuacauca

SEQ ID NO: 486760 - RNA, 16 nt, Homo sapiens
ugugcuagacuguaag

SEQ ID NO: 486761 - RNA, 13 nt, Homo sapiens
uguggcagugguu

SEQ ID NO: 486762 - RNA, 13 nt, Homo sapiens
uguuuaauugaca

SEQ ID NO: 486763 - RNA, 21 nt, Homo sapiens
uuaaaaaguaccacauuccau

SEQ ID NO: 486764 - RNA, 13 nt, Homo sapiens
uuaaaaccaaaga

SEQ ID NO: 486765 - RNA, 15 nt, Homo sapiens
uuaaacaauucuugu

SEQ ID NO: 486766 - RNA, 21 nt, Homo sapiens
uuaaacccuugcugcugaauu

SEQ ID NO: 486767 - RNA, 19 nt, Homo sapiens
uuaaugaguuucacagugu

SEQ ID NO: 486768 - RNA, 17 nt, Homo sapiens
uuacauaagggcauuau

SEQ ID NO: 486769 - RNA, 15 nt, Homo sapiens
uuauaccgcagagua

SEQ ID NO: 486770 - RNA, 15 nt, Homo sapiens
uuauuuuuuucccaa

SEQ ID NO: 486771 - RNA, 12 nt, Homo sapiens
uucaaaauucaa

SEQ ID NO: 486772 - RNA, 16 nt, Homo sapiens
uuccaaauuugcuuua

SEQ ID NO: 486773 - RNA, 23 nt, Homo sapiens
uucccugcuuccaggaaacucca

SEQ ID NO: 486774 - RNA, 22 nt, Homo sapiens
uucccuguucuucguugcugca

SEQ ID NO: 486775 - RNA, 11 nt, Homo sapiens
uuccuccauga

SEQ ID NO: 486776 - RNA, 13 nt, Homo sapiens
uuccuuuugcaca

SEQ ID NO: 486777 - RNA, 20 nt, Homo sapiens
uucucuauucuuuccaugac

SEQ ID NO: 486778 - RNA, 12 nt, Homo sapiens
uucucuugaaua

SEQ ID NO: 486779 - RNA, 21 nt, Homo sapiens
uucugugcgccuuaaacaauu

SEQ ID NO: 486780 - RNA, 18 nt, Homo sapiens
uucuuauccuuuguacug

SEQ ID NO: 486781 - RNA, 17 nt, Homo sapiens
uucuugaagaaaggcaa

SEQ ID NO: 486782 - RNA, 13 nt, Homo sapiens
uugaagccaaaga

SEQ ID NO: 486783 - RNA, 14 nt, Homo sapiens
uugaagccaaagaa

SEQ ID NO: 486784 - RNA, 19 nt, Homo sapiens
uugugucuagggcagagua

SEQ ID NO: 486785 - RNA, 22 nt, Homo sapiens
uuuaaaaaguaccacauuccau

SEQ ID NO: 486786 - RNA, 17 nt, Homo sapiens
uuuaacuuaauggcaca

SEQ ID NO: 486787 - RNA, 18 nt, Homo sapiens
uuuaauggcauaacaaag

SEQ ID NO: 486788 - RNA, 14 nt, Homo sapiens
uuuauaauuacaau

SEQ ID NO: 486789 - RNA, 18 nt, Homo sapiens
uuuauccauuugauuuga

SEQ ID NO: 486790 - RNA, 10 nt, Homo sapiens
uuucacuccu

SEQ ID NO: 486791 - RNA, 15 nt, Homo sapiens
uuuuaacauuccuca

SEQ ID NO: 486792 - RNA, 17 nt, Homo sapiens
uuuuaucccaggaaaua

SEQ ID NO: 486793 - RNA, 15 nt, Homo sapiens
uuuuucuguguuacu

SEQ ID NO: 486794 - RNA, 20 nt, Homo sapiens
gaaggcaagagaaacauucu

SEQ ID NO: 486795 - RNA, 19 nt, Homo sapiens
gaaggcaagagggggugga

SEQ ID NO: 486796 - RNA, 15 nt, Homo sapiens
gaaggggacugccac

SEQ ID NO: 486797 - RNA, 18 nt, Homo sapiens
gaaggggacugccaccuc

SEQ ID NO: 486798 - RNA, 19 nt, Homo sapiens
gagaacuucucuucccaua

SEQ ID NO: 486799 - RNA, 18 nt, Homo sapiens
gagacaucacuugccaau

SEQ ID NO: 486800 - RNA, 21 nt, Homo sapiens
gagauggauguauuuguagcc

SEQ ID NO: 486801 - RNA, 13 nt, Homo sapiens
gaggaauacuucu

SEQ ID NO: 486802 - RNA, 22 nt, Homo sapiens
gagggcuuccucuagaagccaa

SEQ ID NO: 486803 - RNA, 12 nt, Homo sapiens
gaggucacugga

SEQ ID NO: 486804 - RNA, 15 nt, Homo sapiens
gaguauuugaaguca

SEQ ID NO: 486805 - RNA, 19 nt, Homo sapiens
gauguugacaucacuggca

SEQ ID NO: 486806 - RNA, 20 nt, Homo sapiens
gauguugacaucacuggcau

SEQ ID NO: 486807 - RNA, 15 nt, Homo sapiens
gcaaaugccaaagca

SEQ ID NO: 486808 - RNA, 15 nt, Homo sapiens
gcacugcucucaccu

SEQ ID NO: 486809 - RNA, 19 nt, Homo sapiens
gcacuugggggcucagcaa

SEQ ID NO: 486810 - RNA, 14 nt, Homo sapiens
gcagaguauguucu

SEQ ID NO: 486811 - RNA, 21 nt, Homo sapiens
gcagggccuuugucugucuca

SEQ ID NO: 486812 - RNA, 15 nt, Homo sapiens
gccaaacacacagaa

SEQ ID NO: 486813 - RNA, 16 nt, Homo sapiens
gccaaguggggugcug

SEQ ID NO: 486814 - RNA, 16 nt, Homo sapiens
gcccacgcugacuaca

SEQ ID NO: 486815 - RNA, 21 nt, Homo sapiens
gccccaauaccccauggacca

SEQ ID NO: 486816 - RNA, 14 nt, Homo sapiens
gccccgucucaggu

SEQ ID NO: 486817 - RNA, 19 nt, Homo sapiens
gccgagccugcacuggggc

SEQ ID NO: 486818 - RNA, 22 nt, Homo sapiens
gccuccccauuucccaucugca

SEQ ID NO: 486819 - RNA, 17 nt, Homo sapiens
gccuccccgugccaaaa

SEQ ID NO: 486820 - RNA, 16 nt, Homo sapiens
gcuaaauguaccugag

SEQ ID NO: 486821 - RNA, 21 nt, Homo sapiens
gcuauuuucuuauccuuugua

SEQ ID NO: 486822 - RNA, 23 nt, Homo sapiens
gcugccuucccuagcuuuagacc

SEQ ID NO: 486823 - RNA, 14 nt, Homo sapiens
gcuugaagccaaag

SEQ ID NO: 486824 - RNA, 16 nt, Homo sapiens
gcuugaagccaaagaa

SEQ ID NO: 486825 - RNA, 14 nt, Homo sapiens
ggacccaguggcag

SEQ ID NO: 486826 - RNA, 15 nt, Homo sapiens
ggaccccagccucaa

SEQ ID NO: 486827 - RNA, 17 nt, Homo sapiens
ggacccugccaggcaca

SEQ ID NO: 486828 - RNA, 12 nt, Homo sapiens
ggaggccaccuc

SEQ ID NO: 486829 - RNA, 16 nt, Homo sapiens
ggagggacagucucac

SEQ ID NO: 486830 - RNA, 21 nt, Homo sapiens
ggauccuguguggagagggaa

SEQ ID NO: 486831 - RNA, 20 nt, Homo sapiens
ggcauccauggggucucuca

SEQ ID NO: 486832 - RNA, 15 nt, Homo sapiens
ggccacccagccagg

SEQ ID NO: 486833 - RNA, 13 nt, Homo sapiens
ggcccacccugcu

SEQ ID NO: 486834 - RNA, 15 nt, Homo sapiens
ggccuggcucccuca

SEQ ID NO: 486835 - RNA, 20 nt, Homo sapiens
ggcuauuaacugccaaaaca

SEQ ID NO: 486836 - RNA, 13 nt, Homo sapiens
ggcuugaagccaa

SEQ ID NO: 486837 - RNA, 17 nt, Homo sapiens
gguuccuacacaggaca

SEQ ID NO: 486838 - RNA, 19 nt, Homo sapiens
gguuuuuuucuucuguauu

SEQ ID NO: 486839 - RNA, 18 nt, Homo sapiens
guaacuccuccauccaug

SEQ ID NO: 486840 - RNA, 23 nt, Homo sapiens
guacacuguacuucugugugcaa

SEQ ID NO: 486841 - RNA, 20 nt, Homo sapiens
gugacgguuccuacacagga

SEQ ID NO: 486842 - RNA, 12 nt, Homo sapiens
gugccaaaaauc

SEQ ID NO: 486843 - RNA, 19 nt, Homo sapiens
guggcuuuuuguacuguag

SEQ ID NO: 486844 - RNA, 23 nt, Homo sapiens
gugggcucugugcagucacugga

SEQ ID NO: 486845 - RNA, 22 nt, Homo sapiens
gugguuuuauacugaaggaaaa

SEQ ID NO: 486846 - RNA, 16 nt, Homo sapiens
guuuccugugucucca

SEQ ID NO: 486847 - RNA, 14 nt, Homo sapiens
uaaaaucuugucau

SEQ ID NO: 486848 - RNA, 16 nt, Homo sapiens
uaaaguuuaucagaua

SEQ ID NO: 486849 - RNA, 14 nt, Homo sapiens
uaaauuuguacuau

SEQ ID NO: 486850 - RNA, 21 nt, Homo sapiens
uaaauuuguacuauuuaacug

SEQ ID NO: 486851 - RNA, 21 nt, Homo sapiens
uaacauuuuuauaaagauaua

SEQ ID NO: 486852 - RNA, 13 nt, Homo sapiens
uaauaauguuaag

SEQ ID NO: 486853 - RNA, 20 nt, Homo sapiens
uacaaccuaaaaaauuccua

SEQ ID NO: 486854 - RNA, 16 nt, Homo sapiens
uaccacauuccaugac

SEQ ID NO: 486855 - RNA, 18 nt, Homo sapiens
uacugaaggaaaaacaca

SEQ ID NO: 486856 - RNA, 20 nt, Homo sapiens
uagaagccaagggaaagggg

SEQ ID NO: 486857 - RNA, 18 nt, Homo sapiens
uagaauuuacaacuuaua

SEQ ID NO: 486858 - RNA, 17 nt, Homo sapiens
uagcacaggcugagugc

SEQ ID NO: 486859 - RNA, 22 nt, Homo sapiens
uagcuucugcuuuucugcccug

SEQ ID NO: 486860 - RNA, 21 nt, Homo sapiens
uaggaggcucgaccaccucaa

SEQ ID NO: 486861 - RNA, 16 nt, Homo sapiens
uauaaagauauaccaa

SEQ ID NO: 486862 - RNA, 22 nt, Homo sapiens
uauaauuacaaugcacaauuua

SEQ ID NO: 486863 - RNA, 21 nt, Homo sapiens
uauauuuuuuucaacugccaa

SEQ ID NO: 486864 - RNA, 14 nt, Homo sapiens
uauccuuuaaacuc

SEQ ID NO: 486865 - RNA, 22 nt, Homo sapiens
uauguauuaaaauaucccaagc

SEQ ID NO: 486866 - RNA, 19 nt, Homo sapiens
uauuaacugccaaaacaag

SEQ ID NO: 486867 - RNA, 18 nt, Homo sapiens
uauucagugguccaggau

SEQ ID NO: 486868 - RNA, 15 nt, Homo sapiens
uauucuuuccaugac

SEQ ID NO: 486869 - RNA, 18 nt, Homo sapiens
ucaauaauuuguggugau

SEQ ID NO: 486870 - RNA, 14 nt, Homo sapiens
ucaauauuugaucu

SEQ ID NO: 486871 - RNA, 16 nt, Homo sapiens
ucacuccaaagagaaa

SEQ ID NO: 486872 - RNA, 16 nt, Homo sapiens
ucacuggcaugguggu

SEQ ID NO: 486873 - RNA, 13 nt, Homo sapiens
ucacuugccaaug

SEQ ID NO: 486874 - RNA, 16 nt, Homo sapiens
ucacuugccaauguac

SEQ ID NO: 486875 - RNA, 16 nt, Homo sapiens
ucauaaacuauauucu

SEQ ID NO: 486876 - RNA, 17 nt, Homo sapiens
ucaucucuguauuccca

SEQ ID NO: 486877 - RNA, 13 nt, Homo sapiens
uccccgugccaaa

SEQ ID NO: 486878 - RNA, 22 nt, Homo sapiens
uccuagugccuacaaugggaaa

SEQ ID NO: 486879 - RNA, 20 nt, Homo sapiens
uccucccuuccuuuucccug

SEQ ID NO: 486880 - RNA, 20 nt, Homo sapiens
uccugagcccccagcuucca

SEQ ID NO: 486881 - RNA, 22 nt, Homo sapiens
uccuucuuaacucucuguuaca

SEQ ID NO: 486882 - RNA, 16 nt, Homo sapiens
ucuaaaacagcuauuu

SEQ ID NO: 486883 - RNA, 23 nt, Homo sapiens
ucuaaccauagcugaccuuugua

SEQ ID NO: 486884 - RNA, 18 nt, Homo sapiens
ucuauucuuuccaugaca

SEQ ID NO: 486885 - RNA, 20 nt, Homo sapiens
ucucaacucuguuuauuuga

SEQ ID NO: 486886 - RNA, 20 nt, Homo sapiens
ucucaggaaaugcugaccca

SEQ ID NO: 486887 - RNA, 20 nt, Homo sapiens
ucucuauucuuuccaugaca

SEQ ID NO: 486888 - RNA, 15 nt, Homo sapiens
ucugaaggaggccac

SEQ ID NO: 486889 - RNA, 19 nt, Homo sapiens
ucugcaaccuugaagacua

SEQ ID NO: 486890 - RNA, 13 nt, Homo sapiens
ucugcacaguguu

SEQ ID NO: 486891 - RNA, 22 nt, Homo sapiens
ucugcacaguguucccauggcc

SEQ ID NO: 486892 - RNA, 17 nt, Homo sapiens
ucuggcacagccugcac

SEQ ID NO: 486893 - RNA, 18 nt, Homo sapiens
ucugugcagucacuggag

SEQ ID NO: 486894 - RNA, 16 nt, Homo sapiens
ucuuaacucucuguua

SEQ ID NO: 486895 - RNA, 23 nt, Homo sapiens
ucuugaauauguauuaaaauauc

SEQ ID NO: 486896 - RNA, 17 nt, Homo sapiens
ugaagucacacuguaac

SEQ ID NO: 486897 - RNA, 15 nt, Homo sapiens
ugacaucacuggcau

SEQ ID NO: 486898 - RNA, 20 nt, Homo sapiens
ugacucuaaauagcccagau

SEQ ID NO: 486899 - RNA, 20 nt, Homo sapiens
ugagaacuucucuucccaua

SEQ ID NO: 486900 - RNA, 15 nt, Homo sapiens
ugaucuaugcuauau

SEQ ID NO: 486901 - RNA, 13 nt, Homo sapiens
ugauuguauuugu

SEQ ID NO: 486902 - RNA, 18 nt, Homo sapiens
ugcaaccuugaagacuau

SEQ ID NO: 486903 - RNA, 22 nt, Homo sapiens
ugcauuuccuucuuaacucucu

SEQ ID NO: 486904 - RNA, 20 nt, Homo sapiens
ugcccagguggcuguggaau

SEQ ID NO: 486905 - RNA, 22 nt, Homo sapiens
auuaaaaaaagacauaauucac

SEQ ID NO: 486906 - RNA, 16 nt, Homo sapiens
auuaaaauaucccaag

SEQ ID NO: 486907 - RNA, 18 nt, Homo sapiens
auuaagucaucaucucca

SEQ ID NO: 486908 - RNA, 14 nt, Homo sapiens
auuacuguuuaauu

SEQ ID NO: 486909 - RNA, 17 nt, Homo sapiens
auuauaccgcagaguau

SEQ ID NO: 486910 - RNA, 17 nt, Homo sapiens
auucuugauguaaaauc

SEQ ID NO: 486911 - RNA, 21 nt, Homo sapiens
auugcaauauggauguuucuu

SEQ ID NO: 486912 - RNA, 14 nt, Homo sapiens
auuucauaagacaa

SEQ ID NO: 486913 - RNA, 15 nt, Homo sapiens
auuuucuucacuugc

SEQ ID NO: 486914 - RNA, 22 nt, Homo sapiens
auuuuuaacuuaauggcacaaa

SEQ ID NO: 486915 - RNA, 17 nt, Homo sapiens
auuuuuauaaagauaua

SEQ ID NO: 486916 - RNA, 22 nt, Homo sapiens
auuuuuauaaagauauaccaag

SEQ ID NO: 486917 - RNA, 13 nt, Homo sapiens
caaacuaaacccu

SEQ ID NO: 486918 - RNA, 20 nt, Homo sapiens
caaagaaaaauaacccuuug

SEQ ID NO: 486919 - RNA, 23 nt, Homo sapiens
caacauuggagacaucacuugcc

SEQ ID NO: 486920 - RNA, 23 nt, Homo sapiens
caaccccuggaccccagccucaa

SEQ ID NO: 486921 - RNA, 20 nt, Homo sapiens
caagagaugggaaugaggug

SEQ ID NO: 486922 - RNA, 18 nt, Homo sapiens
caaguauuuggcuauuaa

SEQ ID NO: 486923 - RNA, 14 nt, Homo sapiens
caauauuugaucua

SEQ ID NO: 486924 - RNA, 22 nt, Homo sapiens
caaugggaaaacuucacuccaa

SEQ ID NO: 486925 - RNA, 15 nt, Homo sapiens
caauucuuguaacuu

SEQ ID NO: 486926 - RNA, 21 nt, Homo sapiens
caauuuucuuaugaacagaua

SEQ ID NO: 486927 - RNA, 18 nt, Homo sapiens
cacagaaggggacugcca

SEQ ID NO: 486928 - RNA, 19 nt, Homo sapiens
cacagaaggggacugccac

SEQ ID NO: 486929 - RNA, 17 nt, Homo sapiens
cacaggcugagugcagg

SEQ ID NO: 486930 - RNA, 22 nt, Homo sapiens
cacaggcugggcugggcacugc

SEQ ID NO: 486931 - RNA, 16 nt, Homo sapiens
cacagugugauuuuga

SEQ ID NO: 486932 - RNA, 13 nt, Homo sapiens
cacauuccaugac

SEQ ID NO: 486933 - RNA, 16 nt, Homo sapiens
cacauuccaugacgca

SEQ ID NO: 486934 - RNA, 20 nt, Homo sapiens
cacuaaccaugucuccaugu

SEQ ID NO: 486935 - RNA, 16 nt, Homo sapiens
cacuguaaccucaguc

SEQ ID NO: 486936 - RNA, 20 nt, Homo sapiens
cacuguacuucugugugcaa

SEQ ID NO: 486937 - RNA, 11 nt, Homo sapiens
cagacauguau

SEQ ID NO: 486938 - RNA, 21 nt, Homo sapiens
cagaccagguggaauuacuua

SEQ ID NO: 486939 - RNA, 15 nt, Homo sapiens
cagagccaugacuca

SEQ ID NO: 486940 - RNA, 21 nt, Homo sapiens
caggaaacuccacaucugccu

SEQ ID NO: 486941 - RNA, 19 nt, Homo sapiens
caggcugagugcaggccca

SEQ ID NO: 486942 - RNA, 23 nt, Homo sapiens
cagggguggggguggaggcuucc

SEQ ID NO: 486943 - RNA, 15 nt, Homo sapiens
caucacuugccaaug

SEQ ID NO: 486944 - RNA, 12 nt, Homo sapiens
cauguauggcca

SEQ ID NO: 486945 - RNA, 20 nt, Homo sapiens
cauguauuucuuacguacac

SEQ ID NO: 486946 - RNA, 14 nt, Homo sapiens
cauuccaugacgca

SEQ ID NO: 486947 - RNA, 23 nt, Homo sapiens
cauuggagacaucacuugccaau

SEQ ID NO: 486948 - RNA, 16 nt, Homo sapiens
cauuucccaucugcac

SEQ ID NO: 486949 - RNA, 15 nt, Homo sapiens
ccaaaacaagagccu

SEQ ID NO: 486950 - RNA, 17 nt, Homo sapiens
ccaagggaaaggggugc

SEQ ID NO: 486951 - RNA, 23 nt, Homo sapiens
ccacaucugccuuaaaaccaaag

SEQ ID NO: 486952 - RNA, 14 nt, Homo sapiens
ccacauuccaugac

SEQ ID NO: 486953 - RNA, 21 nt, Homo sapiens
ccagcaggagggacagucuca

SEQ ID NO: 486954 - RNA, 19 nt, Homo sapiens
ccagccuccccgugccaaa

SEQ ID NO: 486955 - RNA, 16 nt, Homo sapiens
ccaggacccugccagg

SEQ ID NO: 486956 - RNA, 19 nt, Homo sapiens
cccagccuccccgugccaa

SEQ ID NO: 486957 - RNA, 17 nt, Homo sapiens
cccaguggcagggcaca

SEQ ID NO: 486958 - RNA, 20 nt, Homo sapiens
cccauaccacccaaaaucau

SEQ ID NO: 486959 - RNA, 19 nt, Homo sapiens
cccaugggcugccuugaaa

SEQ ID NO: 486960 - RNA, 14 nt, Homo sapiens
ccccugagcccacu

SEQ ID NO: 486961 - RNA, 20 nt, Homo sapiens
cccuggaagcagugcccagg

SEQ ID NO: 486962 - RNA, 13 nt, Homo sapiens
ccgugccaaaaau

SEQ ID NO: 486963 - RNA, 17 nt, Homo sapiens
ccuacacaggacagggg

SEQ ID NO: 486964 - RNA, 18 nt, Homo sapiens
ccuccccgugccaaaaau

SEQ ID NO: 486965 - RNA, 18 nt, Homo sapiens
ccugauguuuuucugugu

SEQ ID NO: 486966 - RNA, 21 nt, Homo sapiens
ccugauguuuuucuguguuac

SEQ ID NO: 486967 - RNA, 14 nt, Homo sapiens
ccugcacuguaaaa

SEQ ID NO: 486968 - RNA, 15 nt, Homo sapiens
ccugcacuguaaaau

SEQ ID NO: 486969 - RNA, 16 nt, Homo sapiens
ccugccucuccgcccc

SEQ ID NO: 486970 - RNA, 12 nt, Homo sapiens
ccugugacaugg

SEQ ID NO: 486971 - RNA, 20 nt, Homo sapiens
ccuucuccccugcacuguaa

SEQ ID NO: 486972 - RNA, 14 nt, Homo sapiens
cgagccugcacugg

SEQ ID NO: 486973 - RNA, 22 nt, Homo sapiens
cuaaccauagcugaccuuugua

SEQ ID NO: 486974 - RNA, 22 nt, Homo sapiens
cuaaguuaaauauuucugcaca

SEQ ID NO: 486975 - RNA, 15 nt, Homo sapiens
cuacaugaacacaaa

SEQ ID NO: 486976 - RNA, 12 nt, Homo sapiens
cuagaagccaag

SEQ ID NO: 486977 - RNA, 23 nt, Homo sapiens
cuauauuuuugggaggagccaua

SEQ ID NO: 486978 - RNA, 20 nt, Homo sapiens
cuauuaagucaucaucucca

SEQ ID NO: 486979 - RNA, 16 nt, Homo sapiens
cuauucuuuccaugac

SEQ ID NO: 486980 - RNA, 17 nt, Homo sapiens
cuauucuuuccaugaca

SEQ ID NO: 486981 - RNA, 21 nt, Homo sapiens
cucaauaaacuuuuaccacaa

SEQ ID NO: 486982 - RNA, 11 nt, Homo sapiens
cucacucucag

SEQ ID NO: 486983 - RNA, 22 nt, Homo sapiens
cuccucuggacggcaggcucac

SEQ ID NO: 486984 - RNA, 21 nt, Homo sapiens
cucuccccagccuccccgugc

SEQ ID NO: 486985 - RNA, 16 nt, Homo sapiens
cucugaaggaggccac

SEQ ID NO: 486986 - RNA, 22 nt, Homo sapiens
cugacuauucuugauguaaaau

SEQ ID NO: 486987 - RNA, 22 nt, Homo sapiens
cugagaggcaggcauagaggcu

SEQ ID NO: 486988 - RNA, 15 nt, Homo sapiens
cugcacuggggccac

SEQ ID NO: 486989 - RNA, 16 nt, Homo sapiens
cugccuuaaaaccaaa

SEQ ID NO: 486990 - RNA, 19 nt, Homo sapiens
cugccuuaaaaccaaagag

SEQ ID NO: 486991 - RNA, 10 nt, Homo sapiens
cugcuuccag

SEQ ID NO: 486992 - RNA, 16 nt, Homo sapiens
cuggcacagccugcac

SEQ ID NO: 486993 - RNA, 14 nt, Homo sapiens
cuggcugagguucc

SEQ ID NO: 486994 - RNA, 18 nt, Homo sapiens
cuggcugagguuccucug

SEQ ID NO: 486995 - RNA, 19 nt, Homo sapiens
cuguacuucugugugcaau

SEQ ID NO: 486996 - RNA, 20 nt, Homo sapiens
cuguacuucugugugcaauu

SEQ ID NO: 486997 - RNA, 18 nt, Homo sapiens
cuuaaacaauucuuguaa

SEQ ID NO: 486998 - RNA, 20 nt, Homo sapiens
cuuccuagugccuacaaugg

SEQ ID NO: 486999 - RNA, 23 nt, Homo sapiens
cuucguugcugcauuuucuucac

SEQ ID NO: 487000 - RNA, 21 nt, Homo sapiens
cuucuccccugcacuguaaaa

SEQ ID NO: 487001 - RNA, 17 nt, Homo sapiens
cuucuccgccagccucc

SEQ ID NO: 487002 - RNA, 18 nt, Homo sapiens
cuucuuaacucucuguua

SEQ ID NO: 487003 - RNA, 20 nt, Homo sapiens
cuucuuaacucucuguuaca

SEQ ID NO: 487004 - RNA, 20 nt, Homo sapiens
cuugaagacuauugguuuga

SEQ ID NO: 487005 - RNA, 11 nt, Homo sapiens
cuugaagccaa

SEQ ID NO: 487006 - RNA, 12 nt, Homo sapiens
cuugaagccaaa

SEQ ID NO: 487007 - RNA, 14 nt, Homo sapiens
cuugucauguguau

SEQ ID NO: 487008 - RNA, 18 nt, Homo sapiens
cuuucuaaaacacauuua

SEQ ID NO: 487009 - RNA, 21 nt, Homo sapiens
cuuuggucaauauuugaucua

SEQ ID NO: 487010 - RNA, 18 nt, Homo sapiens
cuuuguaguagaauuuac

SEQ ID NO: 487011 - RNA, 14 nt, Homo sapiens
cuuuuauagaggcu

SEQ ID NO: 487012 - RNA, 14 nt, Homo sapiens
cuuuuccuccauga

SEQ ID NO: 487013 - RNA, 19 nt, Homo sapiens
gaaaacuucacuccaaaga

SEQ ID NO: 487014 - RNA, 22 nt, Homo sapiens
gaaccucagcaagaccuugaac

SEQ ID NO: 487015 - RNA, 12 nt, Homo sapiens
gaaggaggccac

SEQ ID NO: 487016 - RNA, 22 nt, Homo sapiens
aaaaauuacuguuuaauugaca

SEQ ID NO: 487017 - RNA, 17 nt, Homo sapiens
aaaaguuguuuuaucca

SEQ ID NO: 487018 - RNA, 14 nt, Homo sapiens
aaacaaucucccaa

SEQ ID NO: 487019 - RNA, 16 nt, Homo sapiens
aaacagaaauugcaau

SEQ ID NO: 487020 - RNA, 12 nt, Homo sapiens
aaacucuuccac

SEQ ID NO: 487021 - RNA, 16 nt, Homo sapiens
aaacucuuccacuaga

SEQ ID NO: 487022 - RNA, 13 nt, Homo sapiens
aaacuucacucca

SEQ ID NO: 487023 - RNA, 14 nt, Homo sapiens
aaacuucacuccaa

SEQ ID NO: 487024 - RNA, 17 nt, Homo sapiens
aaacuucacuccaaaga

SEQ ID NO: 487025 - RNA, 14 nt, Homo sapiens
aaagagggcuuccu

SEQ ID NO: 487026 - RNA, 17 nt, Homo sapiens
aaagcaucuaucucauc

SEQ ID NO: 487027 - RNA, 13 nt, Homo sapiens
aacacaagcaaaa

SEQ ID NO: 487028 - RNA, 19 nt, Homo sapiens
aacagauauuuuuaacuua

SEQ ID NO: 487029 - RNA, 19 nt, Homo sapiens
aacauucuuuccuaaauau

SEQ ID NO: 487030 - RNA, 17 nt, Homo sapiens
aacauuggagacaucac

SEQ ID NO: 487031 - RNA, 13 nt, Homo sapiens
aacuucacuccaa

SEQ ID NO: 487032 - RNA, 15 nt, Homo sapiens
aacuuuuaccacaaa

SEQ ID NO: 487033 - RNA, 14 nt, Homo sapiens
aagaaaaaauggca

SEQ ID NO: 487034 - RNA, 19 nt, Homo sapiens
aagacuguaagcuccauga

SEQ ID NO: 487035 - RNA, 18 nt, Homo sapiens
aagagaaacauucuuucc

SEQ ID NO: 487036 - RNA, 15 nt, Homo sapiens
aagagaucauauccu

SEQ ID NO: 487037 - RNA, 11 nt, Homo sapiens
aagccaaagaa

SEQ ID NO: 487038 - RNA, 23 nt, Homo sapiens
aagccccaugggcugccuugaaa

SEQ ID NO: 487039 - RNA, 23 nt, Homo sapiens
aaggcagguuugggaagguguuu

SEQ ID NO: 487040 - RNA, 17 nt, Homo sapiens
aagguuuuuuuuaucuu

SEQ ID NO: 487041 - RNA, 19 nt, Homo sapiens
aaguaccacauuccaugac

SEQ ID NO: 487042 - RNA, 20 nt, Homo sapiens
aaguaccacauuccaugacg

SEQ ID NO: 487043 - RNA, 16 nt, Homo sapiens
aagucaucaucuccaa

SEQ ID NO: 487044 - RNA, 21 nt, Homo sapiens
ccgugccaaaaaucuuuucau

SEQ ID NO: 487045 - RNA, 14 nt, Homo sapiens
ccuaaaaaauuccu

SEQ ID NO: 487046 - RNA, 15 nt, Homo sapiens
ccucgcccaguccca

SEQ ID NO: 487047 - RNA, 21 nt, Homo sapiens
ccucucacuaaguaugaucua

SEQ ID NO: 487048 - RNA, 18 nt, Homo sapiens
ccugaggggagacagagc

SEQ ID NO: 487049 - RNA, 17 nt, Homo sapiens
ccuuuugcacauuccaa

SEQ ID NO: 487050 - RNA, 16 nt, Homo sapiens
cguacacuguacuucu

SEQ ID NO: 487051 - RNA, 20 nt, Homo sapiens
cgugccaaaaaucuuuucau

SEQ ID NO: 487052 - RNA, 15 nt, Homo sapiens
cuaaagagcccuugc

SEQ ID NO: 487053 - RNA, 20 nt, Homo sapiens
cuacacuuuuuuggucuguu

SEQ ID NO: 487054 - RNA, 14 nt, Homo sapiens
cuagggcagaguau

SEQ ID NO: 487055 - RNA, 23 nt, Homo sapiens
cuauuaagucaucaucuccaaac

SEQ ID NO: 487056 - RNA, 16 nt, Homo sapiens
cuccaaacuaaacccu

SEQ ID NO: 487057 - RNA, 13 nt, Homo sapiens
cuccacaucugcc

SEQ ID NO: 487058 - RNA, 22 nt, Homo sapiens
cuccacaucugccuuaaaacca

SEQ ID NO: 487059 - RNA, 16 nt, Homo sapiens
cucccagguaccagcu

SEQ ID NO: 487060 - RNA, 15 nt, Homo sapiens
cuccccugcacugua

SEQ ID NO: 487061 - RNA, 14 nt, Homo sapiens
cucuacaaccuaaa

SEQ ID NO: 487062 - RNA, 13 nt, Homo sapiens
cucuagaagccaa

SEQ ID NO: 487063 - RNA, 18 nt, Homo sapiens
cucuauucuuuccaugac

SEQ ID NO: 487064 - RNA, 19 nt, Homo sapiens
cucuauucuuuccaugaca

SEQ ID NO: 487065 - RNA, 20 nt, Homo sapiens
cucucacuaaguaugaucua

SEQ ID NO: 487066 - RNA, 14 nt, Homo sapiens
cugacuacagggcc

SEQ ID NO: 487067 - RNA, 18 nt, Homo sapiens
cugacuauucuugaugua

SEQ ID NO: 487068 - RNA, 18 nt, Homo sapiens
cugagcccccagcuucca

SEQ ID NO: 487069 - RNA, 15 nt, Homo sapiens
uaguuuucuaucccu

SEQ ID NO: 487070 - RNA, 22 nt, Homo sapiens
uauacugaaggaaaaacacaag

SEQ ID NO: 487071 - RNA, 14 nt, Homo sapiens
uauauuaugucuua

SEQ ID NO: 487072 - RNA, 22 nt, Homo sapiens
uaugaucuaugcuauauucaaa

SEQ ID NO: 487073 - RNA, 19 nt, Homo sapiens
uauuaagucaucaucucca

SEQ ID NO: 487074 - RNA, 18 nt, Homo sapiens
uauugaaagcucaugaug

SEQ ID NO: 487075 - RNA, 17 nt, Homo sapiens
uauuuuauuuagacaag

SEQ ID NO: 487076 - RNA, 16 nt, Homo sapiens
ucaaaacugagccauc

SEQ ID NO: 487077 - RNA, 20 nt, Homo sapiens
ucaacucuguuuauuugaug

SEQ ID NO: 487078 - RNA, 14 nt, Homo sapiens
ucaaugagagccau

SEQ ID NO: 487079 - RNA, 15 nt, Homo sapiens
ucacuggaaagggga

SEQ ID NO: 487080 - RNA, 21 nt, Homo sapiens
ucacuggagguugaagccaag

SEQ ID NO: 487081 - RNA, 12 nt, Homo sapiens
ucagauagagau

SEQ ID NO: 487082 - RNA, 13 nt, Homo sapiens
ucagcugcugcua

SEQ ID NO: 487083 - RNA, 15 nt, Homo sapiens
ucaggauaacagaga

SEQ ID NO: 487084 - RNA, 12 nt, Homo sapiens
ucauaaacuaua

SEQ ID NO: 487085 - RNA, 13 nt, Homo sapiens
ucauaaacuauau

SEQ ID NO: 487086 - RNA, 19 nt, Homo sapiens
ucccuguuggauuuacuuc

SEQ ID NO: 487087 - RNA, 15 nt, Homo sapiens
uccuccauccaugug

SEQ ID NO: 487088 - RNA, 17 nt, Homo sapiens
uccuccaugauguuaau

SEQ ID NO: 487089 - RNA, 17 nt, Homo sapiens
ucuaagaguauacuuga

SEQ ID NO: 487090 - RNA, 13 nt, Homo sapiens
ucuagaagccaag

SEQ ID NO: 487091 - RNA, 15 nt, Homo sapiens
ucuaugcuauauuca

SEQ ID NO: 487092 - RNA, 17 nt, Homo sapiens
ucuccccugcacuguaa

SEQ ID NO: 487093 - RNA, 18 nt, Homo sapiens
ucucuauucuuuccauga

SEQ ID NO: 487094 - RNA, 12 nt, Homo sapiens
ucucuuuacuuc

SEQ ID NO: 487095 - RNA, 13 nt, Homo sapiens
aaaaagacauaau

SEQ ID NO: 487096 - RNA, 17 nt, Homo sapiens
aaaacuucacuccaaag

SEQ ID NO: 487097 - RNA, 19 nt, Homo sapiens
aaaauaaucaaaccaaaga

SEQ ID NO: 487098 - RNA, 18 nt, Homo sapiens
aaaauggcaagagaucau

SEQ ID NO: 487099 - RNA, 13 nt, Homo sapiens
aaacagaaauugc

SEQ ID NO: 487100 - RNA, 15 nt, Homo sapiens
aaacagaaauugcaa

SEQ ID NO: 487101 - RNA, 19 nt, Homo sapiens
aaacguggagaaucacagg

SEQ ID NO: 487102 - RNA, 16 nt, Homo sapiens
aaacuaaacccucaca

SEQ ID NO: 487103 - RNA, 12 nt, Homo sapiens
aaacucacugaa

SEQ ID NO: 487104 - RNA, 15 nt, Homo sapiens
aaacuuggcucucaa

SEQ ID NO: 487105 - RNA, 21 nt, Homo sapiens
aaaguaccacauuccaugacg

SEQ ID NO: 487106 - RNA, 23 nt, Homo sapiens
aaauauaaaugaaaaucuauccu

SEQ ID NO: 487107 - RNA, 16 nt, Homo sapiens
aaaugaaaaucaauuu

SEQ ID NO: 487108 - RNA, 13 nt, Homo sapiens
aaauggcaagaga

SEQ ID NO: 487109 - RNA, 20 nt, Homo sapiens
aaauguaccugagacauauu

SEQ ID NO: 487110 - RNA, 19 nt, Homo sapiens
aaauuugcuuuacauauga

SEQ ID NO: 487111 - RNA, 19 nt, Homo sapiens
aaccaaagagggcuuccuc

SEQ ID NO: 487112 - RNA, 20 nt, Homo sapiens
aacguggagaaucacaggcu

SEQ ID NO: 487113 - RNA, 13 nt, Homo sapiens
aagacauaauuca

SEQ ID NO: 487114 - RNA, 15 nt, Homo sapiens
aagacauaauucaca

SEQ ID NO: 487115 - RNA, 22 nt, Homo sapiens
aagagacaauaacuuugaaccu

SEQ ID NO: 487116 - RNA, 16 nt, Homo sapiens
aagagccccacucuca

SEQ ID NO: 487117 - RNA, 19 nt, Homo sapiens
aagcaguugagauucucua

SEQ ID NO: 487118 - RNA, 23 nt, Homo sapiens
aagccaaagaaaaauaacccuuu

SEQ ID NO: 487119 - RNA, 22 nt, Homo sapiens
aagccucugucuuuucugggau

SEQ ID NO: 487120 - RNA, 21 nt, Homo sapiens
aaggcaagagaaacauucuuu

SEQ ID NO: 487121 - RNA, 21 nt, Homo sapiens
aaguaccacauuccaugacgc

SEQ ID NO: 487122 - RNA, 23 nt, Homo sapiens
aaguaugaucuaugcuauauuca

SEQ ID NO: 487123 - RNA, 23 nt, Homo sapiens
aaguggcagacagaagcuucucu

SEQ ID NO: 487124 - RNA, 16 nt, Homo sapiens
aauauguauuuauguc

SEQ ID NO: 487125 - RNA, 22 nt, Homo sapiens
aaucucccaaguauugauuuaa

SEQ ID NO: 487126 - RNA, 15 nt, Homo sapiens
aaugcacacuuauuu

SEQ ID NO: 487127 - RNA, 15 nt, Homo sapiens
acagagccaugacuc

SEQ ID NO: 487128 - RNA, 12 nt, Homo sapiens
acagucucacca

SEQ ID NO: 487129 - RNA, 16 nt, Homo sapiens
acauaaucacaaguaa

SEQ ID NO: 487130 - RNA, 15 nt, Homo sapiens
accacauuccaugac

SEQ ID NO: 487131 - RNA, 21 nt, Homo sapiens
acuacaccuggcugagguucc

SEQ ID NO: 487132 - RNA, 21 nt, Homo sapiens
acuagacguuguaaugcacac

SEQ ID NO: 487133 - RNA, 22 nt, Homo sapiens
acucaauaaauacauguuaaau

SEQ ID NO: 487134 - RNA, 20 nt, Homo sapiens
acucacugaaucuaaccaua

SEQ ID NO: 487135 - RNA, 19 nt, Homo sapiens
acuccaaagagaaaccuau

SEQ ID NO: 487136 - RNA, 14 nt, Homo sapiens
acucucuguuacac

SEQ ID NO: 487137 - RNA, 15 nt, Homo sapiens
acugaggcaagcaca

SEQ ID NO: 487138 - RNA, 20 nt, Homo sapiens
acuguuuaauugacauacuc

SEQ ID NO: 487139 - RNA, 15 nt, Homo sapiens
agaaauugcaauaug

SEQ ID NO: 487140 - RNA, 16 nt, Homo sapiens
agaaggggacugccac

SEQ ID NO: 487141 - RNA, 17 nt, Homo sapiens
agaauauuauuaugugc

SEQ ID NO: 487142 - RNA, 22 nt, Homo sapiens
agagagaagagccccacucuca

SEQ ID NO: 487143 - RNA, 17 nt, Homo sapiens
agagaucauauccucag

SEQ ID NO: 487144 - RNA, 13 nt, Homo sapiens
agagcccuugccu

SEQ ID NO: 487145 - RNA, 19 nt, Homo sapiens
agaggccccaauaccccau

SEQ ID NO: 487146 - RNA, 15 nt, Homo sapiens
agaucccaagagauu

SEQ ID NO: 487147 - RNA, 23 nt, Homo sapiens
agcaucuaucucaucuaucucaa

SEQ ID NO: 487148 - RNA, 19 nt, Homo sapiens
agccaagggaaaggggugc

SEQ ID NO: 487149 - RNA, 16 nt, Homo sapiens
agccucaaauccagga

SEQ ID NO: 487150 - RNA, 15 nt, Homo sapiens
agccuccccgugcca

SEQ ID NO: 487151 - RNA, 18 nt, Homo sapiens
agccuccccgugccaaaa

SEQ ID NO: 487152 - RNA, 13 nt, Homo sapiens
agccugcacuggg

SEQ ID NO: 487153 - RNA, 15 nt, Homo sapiens
aggaaguagcacagg

SEQ ID NO: 487154 - RNA, 13 nt, Homo sapiens
aggcaagcacaau

SEQ ID NO: 487155 - RNA, 16 nt, Homo sapiens
aggcauagaggcuucu

SEQ ID NO: 487156 - RNA, 22 nt, Homo sapiens
aggccaccuccuaaaaggccca

SEQ ID NO: 487157 - RNA, 22 nt, Homo sapiens
aggcccacccugcuuggcccag

SEQ ID NO: 487158 - RNA, 17 nt, Homo sapiens
aggccccaauaccccau

SEQ ID NO: 487159 - RNA, 13 nt, Homo sapiens
agggacagucuca

SEQ ID NO: 487160 - RNA, 22 nt, Homo sapiens
agggguggggguggaggcuucc

SEQ ID NO: 487161 - RNA, 20 nt, Homo sapiens
agguaccagcugcgcuugcu

SEQ ID NO: 487162 - RNA, 23 nt, Homo sapiens
agucacuggagguugaagccaag

SEQ ID NO: 487163 - RNA, 16 nt, Homo sapiens
agucuccuauacccag

SEQ ID NO: 487164 - RNA, 14 nt, Homo sapiens
agugagaggauauu

SEQ ID NO: 487165 - RNA, 18 nt, Homo sapiens
aguggagcuuacacuuaa

SEQ ID NO: 487166 - RNA, 18 nt, Homo sapiens
aguucccuauuugugaau

SEQ ID NO: 487167 - RNA, 20 nt, Homo sapiens
aguugaagaaaaaauggcaa

SEQ ID NO: 487168 - RNA, 19 nt, Homo sapiens
aguuuuccuuuuguguaau

SEQ ID NO: 487169 - RNA, 17 nt, Homo sapiens
auaauuacaaugcacaa

SEQ ID NO: 487170 - RNA, 18 nt, Homo sapiens
auacucucaccauuugga

SEQ ID NO: 487171 - RNA, 14 nt, Homo sapiens
auagaggcuagcuu

SEQ ID NO: 487172 - RNA, 12 nt, Homo sapiens
auagaggcuucu

SEQ ID NO: 487173 - RNA, 16 nt, Homo sapiens
auaugcagacauguau

SEQ ID NO: 487174 - RNA, 15 nt, Homo sapiens
auauuagucuuugaa

SEQ ID NO: 487175 - RNA, 18 nt, Homo sapiens
aucuacauuauaccgcag

SEQ ID NO: 487176 - RNA, 17 nt, Homo sapiens
aucugccuuaaaaccaa

SEQ ID NO: 487177 - RNA, 20 nt, Homo sapiens
aucuugguaugggcuguucu

SEQ ID NO: 487178 - RNA, 16 nt, Homo sapiens
aucuuuucauuaaaga

SEQ ID NO: 487179 - RNA, 14 nt, Homo sapiens
augcagacauguau

SEQ ID NO: 487180 - RNA, 17 nt, Homo sapiens
augcauauuuuugcaca

SEQ ID NO: 487181 - RNA, 19 nt, Homo sapiens
auguugacaucacuggcau

SEQ ID NO: 487182 - RNA, 21 nt, Homo sapiens
auuaauaaacaaucucccaag

SEQ ID NO: 487183 - RNA, 15 nt, Homo sapiens
auuagagucagagau

SEQ ID NO: 487184 - RNA, 17 nt, Homo sapiens
auucagugguccaggau

SEQ ID NO: 487185 - RNA, 15 nt, Homo sapiens
auucuuuccaugaca

SEQ ID NO: 487186 - RNA, 20 nt, Homo sapiens
auugguuugagaacuucucu

SEQ ID NO: 487187 - RNA, 16 nt, Homo sapiens
auuguuuuaagccaau

SEQ ID NO: 487188 - RNA, 17 nt, Homo sapiens
auuuaaagccaaaugua

SEQ ID NO: 487189 - RNA, 21 nt, Homo sapiens
auuucccuuuucugugugcau

SEQ ID NO: 487190 - RNA, 21 nt, Homo sapiens
caagggccauucaguacauca

SEQ ID NO: 487191 - RNA, 15 nt, Homo sapiens
caauauuugaucuaa

SEQ ID NO: 487192 - RNA, 20 nt, Homo sapiens
caaugcacaauuuauaauua

SEQ ID NO: 487193 - RNA, 21 nt, Homo sapiens
caccccggggacccugugaca

SEQ ID NO: 487194 - RNA, 15 nt, Homo sapiens
cacuugccaauguac

SEQ ID NO: 487195 - RNA, 21 nt, Homo sapiens
cagacugguggcaguggagua

SEQ ID NO: 487196 - RNA, 22 nt, Homo sapiens
cagagagaagagccccacucuc

SEQ ID NO: 487197 - RNA, 16 nt, Homo sapiens
cagcaagaccuugaac

SEQ ID NO: 487198 - RNA, 12 nt, Homo sapiens
cagccccggggu

SEQ ID NO: 487199 - RNA, 17 nt, Homo sapiens
cagccuccccgugccaa

SEQ ID NO: 487200 - RNA, 17 nt, Homo sapiens
caggagggacagucuca

SEQ ID NO: 487201 - RNA, 18 nt, Homo sapiens
caggcauagaggcuucuc

SEQ ID NO: 487202 - RNA, 21 nt, Homo sapiens
caguacagagccaugacucaa

SEQ ID NO: 487203 - RNA, 16 nt, Homo sapiens
cauaauucacacauua

SEQ ID NO: 487204 - RNA, 13 nt, Homo sapiens
cauagaggcuucu

SEQ ID NO: 487205 - RNA, 22 nt, Homo sapiens
caugacucaauaaauacauguu

SEQ ID NO: 487206 - RNA, 18 nt, Homo sapiens
cauggccccuugcauuuc

SEQ ID NO: 487207 - RNA, 23 nt, Homo sapiens
caugggagggggcuugaagccaa

SEQ ID NO: 487208 - RNA, 18 nt, Homo sapiens
cauuauaccgcagaguau

SEQ ID NO: 487209 - RNA, 19 nt, Homo sapiens
cauuccucaugaauguaaa

SEQ ID NO: 487210 - RNA, 19 nt, Homo sapiens
cauuggagacaucacuugc

SEQ ID NO: 487211 - RNA, 23 nt, Homo sapiens
ccaaacuaaacccucacaaguaa

SEQ ID NO: 487212 - RNA, 19 nt, Homo sapiens
ccaaagagggcuuccucua

SEQ ID NO: 487213 - RNA, 21 nt, Homo sapiens
ccaauuucuuucuaaaacaca

SEQ ID NO: 487214 - RNA, 15 nt, Homo sapiens
ccacauuccaugacg

SEQ ID NO: 487215 - RNA, 10 nt, Homo sapiens
ccacucucag

SEQ ID NO: 487216 - RNA, 22 nt, Homo sapiens
uugaacagccauaucugaaugc

SEQ ID NO: 487217 - RNA, 17 nt, Homo sapiens
uugaauuuuuuuuaaca

SEQ ID NO: 487218 - RNA, 22 nt, Homo sapiens
uugcugcauuuucuucacuugc

SEQ ID NO: 487219 - RNA, 12 nt, Homo sapiens
uuguauccuuuu

SEQ ID NO: 487220 - RNA, 16 nt, Homo sapiens
uugucauuuccaaauu

SEQ ID NO: 487221 - RNA, 12 nt, Homo sapiens
uugucugucuca

SEQ ID NO: 487222 - RNA, 14 nt, Homo sapiens
uuuauaaagauaua

SEQ ID NO: 487223 - RNA, 17 nt, Homo sapiens
uuuauaaagauauacca

SEQ ID NO: 487224 - RNA, 18 nt, Homo sapiens
uuuauagaggcuagcuuc

SEQ ID NO: 487225 - RNA, 13 nt, Homo sapiens
uuucuaagagaag

SEQ ID NO: 487226 - RNA, 21 nt, Homo sapiens
uuucuaauaaucauaaacuau

SEQ ID NO: 487227 - RNA, 16 nt, Homo sapiens
uuucuauuaagauaua

SEQ ID NO: 487228 - RNA, 16 nt, Homo sapiens
uuuucucuauucuuuc

SEQ ID NO: 487229 - RNA, 17 nt, Homo sapiens
accacccaaaaucauaa

SEQ ID NO: 487230 - RNA, 21 nt, Homo sapiens
accagguggaauuacuuaaau

SEQ ID NO: 487231 - RNA, 18 nt, Homo sapiens
accaugcugucuggcaca

SEQ ID NO: 487232 - RNA, 16 nt, Homo sapiens
accauuuccccagggc

SEQ ID NO: 487233 - RNA, 12 nt, Homo sapiens
acccagccaggc

SEQ ID NO: 487234 - RNA, 18 nt, Homo sapiens
acccaguggcagggcaca

SEQ ID NO: 487235 - RNA, 18 nt, Homo sapiens
acccugccaggcacaggc

SEQ ID NO: 487236 - RNA, 18 nt, Homo sapiens
acuauuuaugaauauuaa

SEQ ID NO: 487237 - RNA, 16 nt, Homo sapiens
acugaaucuaaccaua

SEQ ID NO: 487238 - RNA, 17 nt, Homo sapiens
acugaggcaagcacaau

SEQ ID NO: 487239 - RNA, 17 nt, Homo sapiens
acugccaccuccccuug

SEQ ID NO: 487240 - RNA, 20 nt, Homo sapiens
acugccagcucuuccuagcu

SEQ ID NO: 487241 - RNA, 16 nt, Homo sapiens
acuguaagcuccauga

SEQ ID NO: 487242 - RNA, 16 nt, Homo sapiens
acuguaguucagauag

SEQ ID NO: 487243 - RNA, 12 nt, Homo sapiens
acuuaauggcac

SEQ ID NO: 487244 - RNA, 15 nt, Homo sapiens
acuuauaauuacaau

SEQ ID NO: 487245 - RNA, 22 nt, Homo sapiens
acuuauaauuacaaugcacaau

SEQ ID NO: 487246 - RNA, 22 nt, Homo sapiens
acuucauuuuucuaauaaucau

SEQ ID NO: 487247 - RNA, 13 nt, Homo sapiens
agacaucacuugc

SEQ ID NO: 487248 - RNA, 21 nt, Homo sapiens
agacugccagcucuuccuagc

SEQ ID NO: 487249 - RNA, 15 nt, Homo sapiens
agacugcuccugagc

SEQ ID NO: 487250 - RNA, 17 nt, Homo sapiens
agagccccacucucaga

SEQ ID NO: 487251 - RNA, 14 nt, Homo sapiens
agagcccuugccuc

SEQ ID NO: 487252 - RNA, 14 nt, Homo sapiens
agaucauauccuca

SEQ ID NO: 487253 - RNA, 22 nt, Homo sapiens
agccaggccugggggcagccuc

SEQ ID NO: 487254 - RNA, 23 nt, Homo sapiens
agccaggccugggggcagccucu

SEQ ID NO: 487255 - RNA, 13 nt, Homo sapiens
agccccacucuca

SEQ ID NO: 487256 - RNA, 19 nt, Homo sapiens
agccuccccgugccaaaaa

SEQ ID NO: 487257 - RNA, 10 nt, Homo sapiens
aggcuuccug

SEQ ID NO: 487258 - RNA, 16 nt, Homo sapiens
agggacagucucacca

SEQ ID NO: 487259 - RNA, 14 nt, Homo sapiens
agggaggucacugg

SEQ ID NO: 487260 - RNA, 16 nt, Homo sapiens
agggaggucacuggaa

SEQ ID NO: 487261 - RNA, 19 nt, Homo sapiens
aggugaguuugagcugccu

SEQ ID NO: 487262 - RNA, 19 nt, Homo sapiens
aguaccacauuccaugacg

SEQ ID NO: 487263 - RNA, 16 nt, Homo sapiens
agucagagaucuuggu

SEQ ID NO: 487264 - RNA, 17 nt, Homo sapiens
agugauauguaaauuaa

SEQ ID NO: 487265 - RNA, 18 nt, Homo sapiens
aguucgaaagccucucac

SEQ ID NO: 487266 - RNA, 13 nt, Homo sapiens
aguuucacagugu

SEQ ID NO: 487267 - RNA, 14 nt, Homo sapiens
auaaauaccaaaga

SEQ ID NO: 487268 - RNA, 15 nt, Homo sapiens
auaaaugaaaaucua

SEQ ID NO: 487269 - RNA, 20 nt, Homo sapiens
auaccaagggccauucagua

SEQ ID NO: 487270 - RNA, 18 nt, Homo sapiens
auacugaaggaaaaacac

SEQ ID NO: 487271 - RNA, 14 nt, Homo sapiens
auaucuacauuaua

SEQ ID NO: 487272 - RNA, 21 nt, Homo sapiens
auauuggaggaauacuucuga

SEQ ID NO: 487273 - RNA, 22 nt, Homo sapiens
aucauaaacuauauucugugac

SEQ ID NO: 487274 - RNA, 19 nt, Homo sapiens
aucccaagagauuauguaa

SEQ ID NO: 487275 - RNA, 13 nt, Homo sapiens
aucuauccuuuaa

SEQ ID NO: 487276 - RNA, 21 nt, Homo sapiens
aucugccuuaaaaccaaagag

SEQ ID NO: 487277 - RNA, 15 nt, Homo sapiens
augaacacaaaugug

SEQ ID NO: 487278 - RNA, 19 nt, Homo sapiens
augaacacaaauguguauu

SEQ ID NO: 487279 - RNA, 19 nt, Homo sapiens
augggaaaacuucacucca

SEQ ID NO: 487280 - RNA, 23 nt, Homo sapiens
augggagggggcuugaagccaaa

SEQ ID NO: 487281 - RNA, 14 nt, Homo sapiens
augggccugaguga

SEQ ID NO: 487282 - RNA, 12 nt, Homo sapiens
augucuccaugu

SEQ ID NO: 487283 - RNA, 14 nt, Homo sapiens
auuaaaaauuacug

SEQ ID NO: 487284 - RNA, 19 nt, Homo sapiens
auuaagucaucaucuccaa

SEQ ID NO: 487285 - RNA, 17 nt, Homo sapiens
auuaauaaacaaucucc

SEQ ID NO: 487286 - RNA, 17 nt, Homo sapiens
auuauguaacuccucca

SEQ ID NO: 487287 - RNA, 22 nt, Homo sapiens
auuauguaacuccuccauccau

SEQ ID NO: 487288 - RNA, 16 nt, Homo sapiens
auucaacccauuuacu

SEQ ID NO: 487289 - RNA, 18 nt, Homo sapiens
auucuuguaacuuucuuc

SEQ ID NO: 487290 - RNA, 18 nt, Homo sapiens
auugacaaucgugauagu

SEQ ID NO: 487291 - RNA, 22 nt, Homo sapiens
auuggagacaucacuugccaau

SEQ ID NO: 487292 - RNA, 15 nt, Homo sapiens
auuuauaauuacaau

SEQ ID NO: 487293 - RNA, 19 nt, Homo sapiens
auuucuccucccuuccuuu

SEQ ID NO: 487294 - RNA, 19 nt, Homo sapiens
auuuuuaucccaggaaaua

SEQ ID NO: 487295 - RNA, 21 nt, Homo sapiens
caaaaaguuguuuuauccauu

SEQ ID NO: 487296 - RNA, 13 nt, Homo sapiens
caaaaaugacucu

SEQ ID NO: 487297 - RNA, 19 nt, Homo sapiens
caaagaaagagauguuaag

SEQ ID NO: 487298 - RNA, 15 nt, Homo sapiens
caaagagaaaccuau

SEQ ID NO: 487299 - RNA, 13 nt, Homo sapiens
caaauuugcuuua

SEQ ID NO: 487300 - RNA, 18 nt, Homo sapiens
caacauuggagacaucac

SEQ ID NO: 487301 - RNA, 21 nt, Homo sapiens
caagaggggguggaggggugu

SEQ ID NO: 487302 - RNA, 15 nt, Homo sapiens
caagcagauucccug

SEQ ID NO: 487303 - RNA, 21 nt, Homo sapiens
caaugggaaaacuucacucca

SEQ ID NO: 487304 - RNA, 14 nt, Homo sapiens
cacauuccaugacg

SEQ ID NO: 487305 - RNA, 20 nt, Homo sapiens
cacuccaaagagaaaccuau

SEQ ID NO: 487306 - RNA, 19 nt, Homo sapiens
cacuggagguugaagccaa

SEQ ID NO: 487307 - RNA, 12 nt, Homo sapiens
cacuguaaaaug

SEQ ID NO: 487308 - RNA, 17 nt, Homo sapiens
cacuugccaauguacau

SEQ ID NO: 487309 - RNA, 14 nt, Homo sapiens
cagaaauugcaaua

SEQ ID NO: 487310 - RNA, 21 nt, Homo sapiens
cagaaggggacugccaccucc

SEQ ID NO: 487311 - RNA, 20 nt, Homo sapiens
cagagaagugacgguuccua

SEQ ID NO: 487312 - RNA, 13 nt, Homo sapiens
cagcaaggccacc

SEQ ID NO: 487313 - RNA, 16 nt, Homo sapiens
cagccuccccgugcca

SEQ ID NO: 487314 - RNA, 18 nt, Homo sapiens
cagccuccccgugccaaa

SEQ ID NO: 487315 - RNA, 16 nt, Homo sapiens
cagcugcgcuugcuuu

SEQ ID NO: 487316 - RNA, 20 nt, Homo sapiens
caggagacuguggagacugc

SEQ ID NO: 487317 - RNA, 17 nt, Homo sapiens
caggcauagaggcuucu

SEQ ID NO: 487318 - RNA, 16 nt, Homo sapiens
cagggcaggaccagcc

SEQ ID NO: 487319 - RNA, 20 nt, Homo sapiens
caguggcagggcacagggcc

SEQ ID NO: 487320 - RNA, 19 nt, Homo sapiens
cagugguuuuauacugaag

SEQ ID NO: 487321 - RNA, 21 nt, Homo sapiens
cauaugauuguauuuguguau

SEQ ID NO: 487322 - RNA, 18 nt, Homo sapiens
caucacuugccaauguac

SEQ ID NO: 487323 - RNA, 19 nt, Homo sapiens
caucuccaaacuaaacccu

SEQ ID NO: 487324 - RNA, 19 nt, Homo sapiens
caucugccuuaaaaccaaa

SEQ ID NO: 487325 - RNA, 13 nt, Homo sapiens
caugucuccaugu

SEQ ID NO: 487326 - RNA, 17 nt, Homo sapiens
cauuccucaugaaugua

SEQ ID NO: 487327 - RNA, 18 nt, Homo sapiens
cauuccucaugaauguaa

SEQ ID NO: 487328 - RNA, 18 nt, Homo sapiens
cauucuuuccuaaauaua

SEQ ID NO: 487329 - RNA, 17 nt, Homo sapiens
cauuuucuucacuugca

SEQ ID NO: 487330 - RNA, 23 nt, Homo sapiens
ccaagccucugucuuuucuggga

SEQ ID NO: 487331 - RNA, 13 nt, Homo sapiens
ccacccaaaauca

SEQ ID NO: 487332 - RNA, 22 nt, Homo sapiens
ccacuagacguuguaaugcaca

SEQ ID NO: 487333 - RNA, 16 nt, Homo sapiens
agagccccacucucag

SEQ ID NO: 487334 - RNA, 13 nt, Homo sapiens
agagggcuuccuc

SEQ ID NO: 487335 - RNA, 14 nt, Homo sapiens
agaggggaggccaa

SEQ ID NO: 487336 - RNA, 13 nt, Homo sapiens
agcagauucccug

SEQ ID NO: 487337 - RNA, 19 nt, Homo sapiens
agcaggagggacagucuca

SEQ ID NO: 487338 - RNA, 20 nt, Homo sapiens
agccuccccgugccaaaaau

SEQ ID NO: 487339 - RNA, 16 nt, Homo sapiens
agccugaaaauuccaa

SEQ ID NO: 487340 - RNA, 18 nt, Homo sapiens
agccugcuggcacccacc

SEQ ID NO: 487341 - RNA, 19 nt, Homo sapiens
agcugccuucccuagcuuu

SEQ ID NO: 487342 - RNA, 19 nt, Homo sapiens
agcuucugcuuuucugccc

SEQ ID NO: 487343 - RNA, 19 nt, Homo sapiens
aggaaaaacacaagcaaaa

SEQ ID NO: 487344 - RNA, 18 nt, Homo sapiens
aggaacccaauuuucuua

SEQ ID NO: 487345 - RNA, 16 nt, Homo sapiens
aggagggacagucuca

SEQ ID NO: 487346 - RNA, 15 nt, Homo sapiens
aggccaagaguggcc

SEQ ID NO: 487347 - RNA, 16 nt, Homo sapiens
agggaaugugaaauuu

SEQ ID NO: 487348 - RNA, 15 nt, Homo sapiens
agggacagucucacc

SEQ ID NO: 487349 - RNA, 12 nt, Homo sapiens
aggggagacaga

SEQ ID NO: 487350 - RNA, 21 nt, Homo sapiens
agguaccagcugcgcuugcuu

SEQ ID NO: 487351 - RNA, 21 nt, Homo sapiens
aggucugaguuguuaccccaa

SEQ ID NO: 487352 - RNA, 18 nt, Homo sapiens
aguaccacauuccaugac

SEQ ID NO: 487353 - RNA, 14 nt, Homo sapiens
aguagaauuuacaa

SEQ ID NO: 487354 - RNA, 14 nt, Homo sapiens
aguauguucuugaa

SEQ ID NO: 487355 - RNA, 15 nt, Homo sapiens
aguauucagugauau

SEQ ID NO: 487356 - RNA, 17 nt, Homo sapiens
agucccagcagccagcc

SEQ ID NO: 487357 - RNA, 12 nt, Homo sapiens
aguggggugcug

SEQ ID NO: 487358 - RNA, 18 nt, Homo sapiens
aguucagauagagauauu

SEQ ID NO: 487359 - RNA, 20 nt, Homo sapiens
auaaaagcccaggagcccau

SEQ ID NO: 487360 - RNA, 15 nt, Homo sapiens
auaaacaaucuccca

SEQ ID NO: 487361 - RNA, 14 nt, Homo sapiens
auaaagauauacca

SEQ ID NO: 487362 - RNA, 11 nt, Homo sapiens
auaauucacac

SEQ ID NO: 487363 - RNA, 24 nt, Homo sapiens
auaccacccaaaaucauaaugcca

SEQ ID NO: 487364 - RNA, 18 nt, Homo sapiens
auauuaaaaaaagacaua

SEQ ID NO: 487365 - RNA, 14 nt, Homo sapiens
auauuggaggaaua

SEQ ID NO: 487366 - RNA, 19 nt, Homo sapiens
auauuuuuuucaacugcca

SEQ ID NO: 487367 - RNA, 13 nt, Homo sapiens
aucauaaugccau

SEQ ID NO: 487368 - RNA, 18 nt, Homo sapiens
aucuccaaacuaaacccu

SEQ ID NO: 487369 - RNA, 13 nt, Homo sapiens
aucuuuucauuaa

SEQ ID NO: 487370 - RNA, 23 nt, Homo sapiens
augacucaauaaauacauguuaa

SEQ ID NO: 487371 - RNA, 19 nt, Homo sapiens
augaucuaugcuauauuca

SEQ ID NO: 487372 - RNA, 20 nt, Homo sapiens
augggaaaacuucacuccaa

SEQ ID NO: 487373 - RNA, 23 nt, Homo sapiens
auguacauaccuuguuauaugca

SEQ ID NO: 487374 - RNA, 16 nt, Homo sapiens
auuaaaaaaagacaua

SEQ ID NO: 487375 - RNA, 12 nt, Homo sapiens
auuaaaauaucc

SEQ ID NO: 487376 - RNA, 14 nt, Homo sapiens
auuaaaauauccca

SEQ ID NO: 487377 - RNA, 19 nt, Homo sapiens
auuaaagaauguuuuggaa

SEQ ID NO: 487378 - RNA, 17 nt, Homo sapiens
auuagcauaaagcacua

SEQ ID NO: 487379 - RNA, 18 nt, Homo sapiens
auuagcauaaagcacuaa

SEQ ID NO: 487380 - RNA, 14 nt, Homo sapiens
auucuuuccaugac

SEQ ID NO: 487381 - RNA, 15 nt, Homo sapiens
auuguacugcacaaa

SEQ ID NO: 487382 - RNA, 23 nt, Homo sapiens
auuuuaaagccugaaaauuccaa

SEQ ID NO: 487383 - RNA, 17 nt, Homo sapiens
auuuucaagauacaugu

SEQ ID NO: 487384 - RNA, 21 nt, Homo sapiens
auuuucauauuuaaagccaaa

SEQ ID NO: 487385 - RNA, 14 nt, Homo sapiens
auuuucuucacuug

SEQ ID NO: 487386 - RNA, 16 nt, Homo sapiens
auuuucuucacuugca

SEQ ID NO: 487387 - RNA, 14 nt, Homo sapiens
auuuuuuucccaag

SEQ ID NO: 487388 - RNA, 23 nt, Homo sapiens
caaaacuaugacaauuuuugcug

SEQ ID NO: 487389 - RNA, 15 nt, Homo sapiens
caaacuaaacccuca

SEQ ID NO: 487390 - RNA, 12 nt, Homo sapiens
caacugccaauc

SEQ ID NO: 487391 - RNA, 15 nt, Homo sapiens
caacugccaaucaag

SEQ ID NO: 487392 - RNA, 17 nt, Homo sapiens
caacuuauaauuacaau

SEQ ID NO: 487393 - RNA, 21 nt, Homo sapiens
caauuguaaacagaaauugca

SEQ ID NO: 487394 - RNA, 17 nt, Homo sapiens
caauuuauaauuacaau

SEQ ID NO: 487395 - RNA, 19 nt, Homo sapiens
cacugccaggccagccucc

SEQ ID NO: 487396 - RNA, 18 nt, Homo sapiens
cacuugccaauguacaua

SEQ ID NO: 487397 - RNA, 13 nt, Homo sapiens
cagagccaugacu

SEQ ID NO: 487398 - RNA, 15 nt, Homo sapiens
cagaggcccaaaaca

SEQ ID NO: 487399 - RNA, 19 nt, Homo sapiens
cagccuccccgugccaaaa

SEQ ID NO: 487400 - RNA, 22 nt, Homo sapiens
cagcuuuugccuugguucuucc

SEQ ID NO: 487401 - RNA, 15 nt, Homo sapiens
caggaaaugcugacc

SEQ ID NO: 487402 - RNA, 18 nt, Homo sapiens
caggaaguagcacaggcu

SEQ ID NO: 487403 - RNA, 18 nt, Homo sapiens
caggacagggguuccuuc

SEQ ID NO: 487404 - RNA, 20 nt, Homo sapiens
cagggccuuugucugucuca

SEQ ID NO: 487405 - RNA, 13 nt, Homo sapiens
caucacuugccaa

SEQ ID NO: 487406 - RNA, 21 nt, Homo sapiens
cauggaccaugcugucuggca

SEQ ID NO: 487407 - RNA, 22 nt, Homo sapiens
cauguauuucuuacguacacug

SEQ ID NO: 487408 - RNA, 11 nt, Homo sapiens
cauuccaugac

SEQ ID NO: 487409 - RNA, 12 nt, Homo sapiens
cauuccaugacg

SEQ ID NO: 487410 - RNA, 21 nt, Homo sapiens
cauuuucucuauucuuuccau

SEQ ID NO: 487411 - RNA, 18 nt, Homo sapiens
ccaaaaucauaaugccau

SEQ ID NO: 487412 - RNA, 19 nt, Homo sapiens
ccaagagauuauguaacuc

SEQ ID NO: 487413 - RNA, 15 nt, Homo sapiens
ccaagggaaaggggu

SEQ ID NO: 487414 - RNA, 16 nt, Homo sapiens
ccacauuccaugacgc

SEQ ID NO: 487415 - RNA, 14 nt, Homo sapiens
ccaccuggcccucu

SEQ ID NO: 487416 - RNA, 13 nt, Homo sapiens
ccauuugauuuga

SEQ ID NO: 487417 - RNA, 14 nt, Homo sapiens
cccagguaccagcu

SEQ ID NO: 487418 - RNA, 16 nt, Homo sapiens
cccggggugaguccau

SEQ ID NO: 487419 - RNA, 18 nt, Homo sapiens
cccuggguuagacugcca

SEQ ID NO: 487420 - RNA, 19 nt, Homo sapiens
ucuguauuuuauuuagaca

SEQ ID NO: 487421 - RNA, 23 nt, Homo sapiens
ucugucucaucucuguauuccca

SEQ ID NO: 487422 - RNA, 16 nt, Homo sapiens
ucugucuuuucuggga

SEQ ID NO: 487423 - RNA, 14 nt, Homo sapiens
ucuugguaugggcu

SEQ ID NO: 487424 - RNA, 21 nt, Homo sapiens
ugaagacuauugguuugagaa

SEQ ID NO: 487425 - RNA, 16 nt, Homo sapiens
ugaaggaaaaacacaa

SEQ ID NO: 487426 - RNA, 15 nt, Homo sapiens
ugacuauucuugaug

SEQ ID NO: 487427 - RNA, 14 nt, Homo sapiens
ugagcuaagcauuu

SEQ ID NO: 487428 - RNA, 14 nt, Homo sapiens
ugcacauuccaaaa

SEQ ID NO: 487429 - RNA, 15 nt, Homo sapiens
ugccaggcacaggca

SEQ ID NO: 487430 - RNA, 17 nt, Homo sapiens
ugcccccaccccgggga

SEQ ID NO: 487431 - RNA, 18 nt, Homo sapiens
ugcuauggagcaaaucca

SEQ ID NO: 487432 - RNA, 19 nt, Homo sapiens
uggagacaucacuugccaa

SEQ ID NO: 487433 - RNA, 19 nt, Homo sapiens
uggagagggaaugugaaau

SEQ ID NO: 487434 - RNA, 16 nt, Homo sapiens
uggagguugaagccaa

SEQ ID NO: 487435 - RNA, 17 nt, Homo sapiens
uggcagggcacagggcc

SEQ ID NO: 487436 - RNA, 22 nt, Homo sapiens
uggcucccucacucucaggaaa

SEQ ID NO: 487437 - RNA, 16 nt, Homo sapiens
ugggagguggaagaag

SEQ ID NO: 487438 - RNA, 19 nt, Homo sapiens
ugggggccccgucucaggu

SEQ ID NO: 487439 - RNA, 20 nt, Homo sapiens
uguaaacagaaauugcaaua

SEQ ID NO: 487440 - RNA, 15 nt, Homo sapiens
uguagcuaaauguac

SEQ ID NO: 487441 - RNA, 14 nt, Homo sapiens
ugucauuuccaaau

SEQ ID NO: 487442 - RNA, 16 nt, Homo sapiens
ugucuagggcagagua

SEQ ID NO: 487443 - RNA, 14 nt, Homo sapiens
ugugaaauuuacau

SEQ ID NO: 487444 - RNA, 13 nt, Homo sapiens
uguuuuuccaaaa

SEQ ID NO: 487445 - RNA, 14 nt, Homo sapiens
uuaacauuccucau

SEQ ID NO: 487446 - RNA, 23 nt, Homo sapiens
uuacaacuuauaauuacaaugca

SEQ ID NO: 487447 - RNA, 12 nt, Homo sapiens
uuauaauuacaa

SEQ ID NO: 487448 - RNA, 17 nt, Homo sapiens
uucccaucugcaccccu

SEQ ID NO: 487449 - RNA, 12 nt, Homo sapiens
uuccuaaauaua

SEQ ID NO: 487450 - RNA, 16 nt, Homo sapiens
uuccucaugaauguaa

SEQ ID NO: 487451 - RNA, 20 nt, Homo sapiens
uuccuuuucccugcuuccag

SEQ ID NO: 487452 - RNA, 21 nt, Homo sapiens
uucuaauaaucauaaacuaua

SEQ ID NO: 487453 - RNA, 21 nt, Homo sapiens
uucucuggaauaguuacuuua

SEQ ID NO: 487454 - RNA, 18 nt, Homo sapiens
uucugcacaguguuccca

SEQ ID NO: 487455 - RNA, 20 nt, Homo sapiens
uucugugugcauacuuauga

SEQ ID NO: 487456 - RNA, 18 nt, Homo sapiens
uucuuacguacacuguac

SEQ ID NO: 487457 - RNA, 23 nt, Homo sapiens
uucuucuguuauuuauuucagca

SEQ ID NO: 487458 - RNA, 13 nt, Homo sapiens
uucuuuguauuau

SEQ ID NO: 487459 - RNA, 11 nt, Homo sapiens
uugaagccaaa

SEQ ID NO: 487460 - RNA, 16 nt, Homo sapiens
uugacauacucaggau

SEQ ID NO: 487461 - RNA, 17 nt, Homo sapiens
uugccaauguacauacc

SEQ ID NO: 487462 - RNA, 16 nt, Homo sapiens
uugggacccaguggca

SEQ ID NO: 487463 - RNA, 16 nt, Homo sapiens
uuguauuuauggaaga

SEQ ID NO: 487464 - RNA, 22 nt, Homo sapiens
uuguccugauguuuuucugugu

SEQ ID NO: 487465 - RNA, 14 nt, Homo sapiens
uuguuuuaagccaa

SEQ ID NO: 487466 - RNA, 17 nt, Homo sapiens
uuuaauugacauacuca

SEQ ID NO: 487467 - RNA, 16 nt, Homo sapiens
uuucaaugaaacaaag

SEQ ID NO: 487468 - RNA, 18 nt, Homo sapiens
uuucauuaaagaauguuu

SEQ ID NO: 487469 - RNA, 13 nt, Homo sapiens
uuucuaauaauca

SEQ ID NO: 487470 - RNA, 13 nt, Homo sapiens
uuucuuacguaca

SEQ ID NO: 487471 - RNA, 14 nt, Homo sapiens
uuucuucacuugca

SEQ ID NO: 487472 - RNA, 23 nt, Homo sapiens
uuugggaggagccauagauuccu

SEQ ID NO: 487473 - RNA, 15 nt, Homo sapiens
uuuguuuuacuuugu

SEQ ID NO: 487474 - RNA, 15 nt, Homo sapiens
uuuuagauccaaaug

SEQ ID NO: 487475 - RNA, 17 nt, Homo sapiens
uuuugcacauuccaaaa

SEQ ID NO: 487476 - RNA, 14 nt, Homo sapiens
aaguagcacaggcu

SEQ ID NO: 487477 - RNA, 13 nt, Homo sapiens
aaguaugaucuau

SEQ ID NO: 487478 - RNA, 14 nt, Homo sapiens
aauaaaaaaauuaa

SEQ ID NO: 487479 - RNA, 22 nt, Homo sapiens
aauaaucauaaacuauauucug

SEQ ID NO: 487480 - RNA, 16 nt, Homo sapiens
aaucaagagacaauaa

SEQ ID NO: 487481 - RNA, 15 nt, Homo sapiens
aaucauaaacuauau

SEQ ID NO: 487482 - RNA, 22 nt, Homo sapiens
aauggcaagagaucauauccuc

SEQ ID NO: 487483 - RNA, 19 nt, Homo sapiens
aauuacaauauguauuuau

SEQ ID NO: 487484 - RNA, 17 nt, Homo sapiens
aauuuuuccgcucuuaa

SEQ ID NO: 487485 - RNA, 14 nt, Homo sapiens
acaaaaaugacucu

SEQ ID NO: 487486 - RNA, 14 nt, Homo sapiens
acaacuuauaauua

SEQ ID NO: 487487 - RNA, 20 nt, Homo sapiens
acaauuuauaauuacaauau

SEQ ID NO: 487488 - RNA, 19 nt, Homo sapiens
acacauuaauaaacaaucu

SEQ ID NO: 487489 - RNA, 23 nt, Homo sapiens
acaucugccuuaaaaccaaagag

SEQ ID NO: 487490 - RNA, 12 nt, Homo sapiens
acauuccaugac

SEQ ID NO: 487491 - RNA, 23 nt, Homo sapiens
acauuggagacaucacuugccaa

SEQ ID NO: 487492 - RNA, 15 nt, Homo sapiens
accacccaaaaucau

SEQ ID NO: 487493 - RNA, 20 nt, Homo sapiens
accaguacacuccuaucuca

SEQ ID NO: 487494 - RNA, 13 nt, Homo sapiens
acccccugcccug

SEQ ID NO: 487495 - RNA, 22 nt, Homo sapiens
accgccgguucauuuugcaccu

SEQ ID NO: 487496 - RNA, 14 nt, Homo sapiens
accucuuccuggcc

SEQ ID NO: 487497 - RNA, 14 nt, Homo sapiens
accugagacauauu

SEQ ID NO: 487498 - RNA, 16 nt, Homo sapiens
accuuguuauaugcag

SEQ ID NO: 487499 - RNA, 16 nt, Homo sapiens
uaaacagaaauugcaa

SEQ ID NO: 487500 - RNA, 22 nt, Homo sapiens
uaaacguggagaaucacaggcu

SEQ ID NO: 487501 - RNA, 13 nt, Homo sapiens
uaaacuauauucu

SEQ ID NO: 487502 - RNA, 16 nt, Homo sapiens
uaaagcaguugagauu

SEQ ID NO: 487503 - RNA, 18 nt, Homo sapiens
uaaaugaaaaucuauccu

SEQ ID NO: 487504 - RNA, 14 nt, Homo sapiens
uaagucaucaucuc

SEQ ID NO: 487505 - RNA, 19 nt, Homo sapiens
uaauugacauacucaggau

SEQ ID NO: 487506 - RNA, 20 nt, Homo sapiens
uaauuucagugcaguaauuu

SEQ ID NO: 487507 - RNA, 20 nt, Homo sapiens
uaauuuuaaagucaguguug

SEQ ID NO: 487508 - RNA, 19 nt, Homo sapiens
uacaaccuaaaaaauuccu

SEQ ID NO: 487509 - RNA, 20 nt, Homo sapiens
uacaauauguauuuaugucu

SEQ ID NO: 487510 - RNA, 17 nt, Homo sapiens
uaccgcagaguauuuga

SEQ ID NO: 487511 - RNA, 18 nt, Homo sapiens
uacuucugugugcaauug

SEQ ID NO: 487512 - RNA, 14 nt, Homo sapiens
uagaagccaaggga

SEQ ID NO: 487513 - RNA, 17 nt, Homo sapiens
uagaggcuagcuucugc

SEQ ID NO: 487514 - RNA, 18 nt, Homo sapiens
uauaauuacaaugcacaa

SEQ ID NO: 487515 - RNA, 22 nt, Homo sapiens
uauauuuuuuucaacugccaau

SEQ ID NO: 487516 - RNA, 20 nt, Homo sapiens
uaugaucuaugcuauauuca

SEQ ID NO: 487517 - RNA, 15 nt, Homo sapiens
uaugcuauauucaaa

SEQ ID NO: 487518 - RNA, 16 nt, Homo sapiens
uauuaaaauaucccaa

SEQ ID NO: 487519 - RNA, 12 nt, Homo sapiens
uauuaagauaua

SEQ ID NO: 487520 - RNA, 13 nt, Homo sapiens
uauucaaaauuca

SEQ ID NO: 487521 - RNA, 19 nt, Homo sapiens
uauugguuugagaacuucu

SEQ ID NO: 487522 - RNA, 16 nt, Homo sapiens
uauuguacugcacaaa

SEQ ID NO: 487523 - RNA, 21 nt, Homo sapiens
uauuucugcacaguguuccca

SEQ ID NO: 487524 - RNA, 15 nt, Homo sapiens
agcacaucucuucau

SEQ ID NO: 487525 - RNA, 20 nt, Homo sapiens
agcaccuuuccuucaagcca

SEQ ID NO: 487526 - RNA, 18 nt, Homo sapiens
agcacuccucccugaugu

SEQ ID NO: 487527 - RNA, 12 nt, Homo sapiens
agcagagucaag

SEQ ID NO: 487528 - RNA, 16 nt, Homo sapiens
agcagauccaccugca

SEQ ID NO: 487529 - RNA, 18 nt, Homo sapiens
agcauggcucauucugca

SEQ ID NO: 487530 - RNA, 22 nt, Homo sapiens
agcauuggccuggccagaccag

SEQ ID NO: 487531 - RNA, 22 nt, Homo sapiens
agcauuuccaacaccacagaca

SEQ ID NO: 487532 - RNA, 23 nt, Homo sapiens
agccaaauaaaaucuauacauac

SEQ ID NO: 487533 - RNA, 20 nt, Homo sapiens
agccaaguucacaccacugc

SEQ ID NO: 487534 - RNA, 13 nt, Homo sapiens
agccaaucuccag

SEQ ID NO: 487535 - RNA, 20 nt, Homo sapiens
agccauauauuuucugagua

SEQ ID NO: 487536 - RNA, 16 nt, Homo sapiens
agccccagacaacagc

SEQ ID NO: 487537 - RNA, 13 nt, Homo sapiens
agccgagcucucc

SEQ ID NO: 487538 - RNA, 18 nt, Homo sapiens
agccuauugcaacaaagu

SEQ ID NO: 487539 - RNA, 23 nt, Homo sapiens
agccuccacuuuggaucaggaaa

SEQ ID NO: 487540 - RNA, 20 nt, Homo sapiens
agccugcguggcugaccccc

SEQ ID NO: 487541 - RNA, 21 nt, Homo sapiens
agccuggccaacauggugaaa

SEQ ID NO: 487542 - RNA, 20 nt, Homo sapiens
agccuucuuguguaauguaa

SEQ ID NO: 487543 - RNA, 13 nt, Homo sapiens
agccuugugauca

SEQ ID NO: 487544 - RNA, 19 nt, Homo sapiens
agcggucuucaggcauuuu

SEQ ID NO: 487545 - RNA, 22 nt, Homo sapiens
agcuaaacccuucaacuaugca

SEQ ID NO: 487546 - RNA, 23 nt, Homo sapiens
agcuauggacagcauugccagua

SEQ ID NO: 487547 - RNA, 18 nt, Homo sapiens
agcucaggcccuggugag

SEQ ID NO: 487548 - RNA, 19 nt, Homo sapiens
agcucccaggacgcaggga

SEQ ID NO: 487549 - RNA, 18 nt, Homo sapiens
agcuccuggccaggauaa

SEQ ID NO: 487550 - RNA, 19 nt, Homo sapiens
agcuccuuuauuauaauca

SEQ ID NO: 487551 - RNA, 23 nt, Homo sapiens
agcuccuuuauuauaaucaaagc

SEQ ID NO: 487552 - RNA, 17 nt, Homo sapiens
agcucugugggagacca

SEQ ID NO: 487553 - RNA, 18 nt, Homo sapiens
agcugaggaggugcugca

SEQ ID NO: 487554 - RNA, 13 nt, Homo sapiens
agcugcauggcac

SEQ ID NO: 487555 - RNA, 14 nt, Homo sapiens
agcugcugcacagc

SEQ ID NO: 487556 - RNA, 19 nt, Homo sapiens
agcugucauggugcaauuu

SEQ ID NO: 487557 - RNA, 22 nt, Homo sapiens
agcugugugugcccguggugag

SEQ ID NO: 487558 - RNA, 23 nt, Homo sapiens
agcuuuacuuuguacaaauguaa

SEQ ID NO: 487559 - RNA, 17 nt, Homo sapiens
agcuuucugauacuuau

SEQ ID NO: 487560 - RNA, 16 nt, Homo sapiens
aggaaaauauugacaa

SEQ ID NO: 487561 - RNA, 22 nt, Homo sapiens
aggaaauguugacuggccaaaa

SEQ ID NO: 487562 - RNA, 14 nt, Homo sapiens
aggaacacaugcac

SEQ ID NO: 487563 - RNA, 22 nt, Homo sapiens
aggaacccccucaccaccugcc

SEQ ID NO: 487564 - RNA, 15 nt, Homo sapiens
aggacaucaccauuu

SEQ ID NO: 487565 - RNA, 13 nt, Homo sapiens
aggagaguguuua

SEQ ID NO: 487566 - RNA, 17 nt, Homo sapiens
aggagaugaggcuggau

SEQ ID NO: 487567 - RNA, 13 nt, Homo sapiens
aggagcuuucuca

SEQ ID NO: 487568 - RNA, 22 nt, Homo sapiens
caaagcaugccaauuucucuua

SEQ ID NO: 487569 - RNA, 17 nt, Homo sapiens
caaaggagcuuucucaa

SEQ ID NO: 487570 - RNA, 20 nt, Homo sapiens
caaaguaccacacugaguuc

SEQ ID NO: 487571 - RNA, 23 nt, Homo sapiens
caaaguuaaacgugaugugcuca

SEQ ID NO: 487572 - RNA, 18 nt, Homo sapiens
caaauacacauacauaua

SEQ ID NO: 487573 - RNA, 14 nt, Homo sapiens
caaauacaugccuu

SEQ ID NO: 487574 - RNA, 17 nt, Homo sapiens
caaaucaggaacuguau

SEQ ID NO: 487575 - RNA, 19 nt, Homo sapiens
caaaugcuuuuccaaccca

SEQ ID NO: 487576 - RNA, 23 nt, Homo sapiens
caaauggugguuguuucuuccaa

SEQ ID NO: 487577 - RNA, 21 nt, Homo sapiens
caacauuugcuuuuugcuugu

SEQ ID NO: 487578 - RNA, 17 nt, Homo sapiens
caacccaugagugcuaa

SEQ ID NO: 487579 - RNA, 23 nt, Homo sapiens
caaccuccccugguccugcacug

SEQ ID NO: 487580 - RNA, 19 nt, Homo sapiens
caacguggggcagcacaga

SEQ ID NO: 487581 - RNA, 13 nt, Homo sapiens
caacucuugcaca

SEQ ID NO: 487582 - RNA, 14 nt, Homo sapiens
caacucuugcacag

SEQ ID NO: 487583 - RNA, 16 nt, Homo sapiens
caacuguagucaucuu

SEQ ID NO: 487584 - RNA, 19 nt, Homo sapiens
caacuugaaauuauaucug

SEQ ID NO: 487585 - RNA, 21 nt, Homo sapiens
caacuuuucaaguaguuuuau

SEQ ID NO: 487586 - RNA, 13 nt, Homo sapiens
caagaacacugga

SEQ ID NO: 487587 - RNA, 15 nt, Homo sapiens
caagaauaaaggcag

SEQ ID NO: 487588 - RNA, 13 nt, Homo sapiens
caagaccaaagag

SEQ ID NO: 487589 - RNA, 13 nt, Homo sapiens
caagcagacacac

SEQ ID NO: 487590 - RNA, 17 nt, Homo sapiens
caaggaaaauauugcca

SEQ ID NO: 487591 - RNA, 18 nt, Homo sapiens
caaggacaacaagauaca

SEQ ID NO: 487592 - RNA, 16 nt, Homo sapiens
caaggacuccauugga

SEQ ID NO: 487593 - RNA, 11 nt, Homo sapiens
caaggcauuua

SEQ ID NO: 487594 - RNA, 15 nt, Homo sapiens
caaggcugcagugag

SEQ ID NO: 487595 - RNA, 22 nt, Homo sapiens
caagugcuaaccuuuucaccuc

SEQ ID NO: 487596 - RNA, 20 nt, Homo sapiens
caaguuuaaaggcuguguca

SEQ ID NO: 487597 - RNA, 21 nt, Homo sapiens
caauacccuuuuaaguuuaaa

SEQ ID NO: 487598 - RNA, 12 nt, Homo sapiens
caaucccaaaag

SEQ ID NO: 487599 - RNA, 15 nt, Homo sapiens
caaucuuaaugucuc

SEQ ID NO: 487600 - RNA, 22 nt, Homo sapiens
caauuugucuuuggaaaauuca

SEQ ID NO: 487601 - RNA, 19 nt, Homo sapiens
cacaauaagccacugguau

SEQ ID NO: 487602 - RNA, 13 nt, Homo sapiens
cacaaugaaugua

SEQ ID NO: 487603 - RNA, 12 nt, Homo sapiens
cacacaacugug

SEQ ID NO: 487604 - RNA, 18 nt, Homo sapiens
cacacaccucaugugaga

SEQ ID NO: 487605 - RNA, 22 nt, Homo sapiens
cacacauccccuuuguguagaa

SEQ ID NO: 487606 - RNA, 12 nt, Homo sapiens
cacacaucucau

SEQ ID NO: 487607 - RNA, 18 nt, Homo sapiens
cacacauuauuaccccac

SEQ ID NO: 487608 - RNA, 14 nt, Homo sapiens
cacacucacuggca

SEQ ID NO: 487609 - RNA, 13 nt, Homo sapiens
cacacugagcaag

SEQ ID NO: 487610 - RNA, 19 nt, Homo sapiens
cacacuugaccuucugucg

SEQ ID NO: 487611 - RNA, 22 nt, Homo sapiens
cacagacacacacacgcacgca

SEQ ID NO: 487612 - RNA, 15 nt, Homo sapiens
cacagcaacuauaua

SEQ ID NO: 487613 - RNA, 22 nt, Homo sapiens
cacaggagacacugugcuauaa

SEQ ID NO: 487614 - RNA, 21 nt, Homo sapiens
cacaggagggcugggcuccac

SEQ ID NO: 487615 - RNA, 20 nt, Homo sapiens
cacaggauggucucugccau

SEQ ID NO: 487616 - RNA, 22 nt, Homo sapiens
cacagucuggugcccagacuca

SEQ ID NO: 487617 - RNA, 23 nt, Homo sapiens
cacaguuuauuuuuauacuuuca

SEQ ID NO: 487618 - RNA, 22 nt, Homo sapiens
cacauaagggagauuguauaca

SEQ ID NO: 487619 - RNA, 15 nt, Homo sapiens
cacauaauucauuaa

SEQ ID NO: 487620 - RNA, 16 nt, Homo sapiens
cacauacauauauaca

SEQ ID NO: 487621 - RNA, 21 nt, Homo sapiens
cacaugugagcaugucacuuc

SEQ ID NO: 487622 - RNA, 16 nt, Homo sapiens
caccacagacacacac

SEQ ID NO: 487623 - RNA, 22 nt, Homo sapiens
caccacuuucccacacugugaa

SEQ ID NO: 487624 - RNA, 21 nt, Homo sapiens
caccauggcacccugcaccag

SEQ ID NO: 487625 - RNA, 21 nt, Homo sapiens
cacccacacccuacagcagau

SEQ ID NO: 487626 - RNA, 14 nt, Homo sapiens
caccgagacaguug

SEQ ID NO: 487627 - RNA, 22 nt, Homo sapiens
caccugccugcaucugugaaaa

SEQ ID NO: 487628 - RNA, 14 nt, Homo sapiens
caccuucucggcaa

SEQ ID NO: 487629 - RNA, 19 nt, Homo sapiens
cacgaggucaggaguucaa

SEQ ID NO: 487630 - RNA, 16 nt, Homo sapiens
cacgccacaacuccag

SEQ ID NO: 487631 - RNA, 23 nt, Homo sapiens
cacgccacaacuccaguguuccc

SEQ ID NO: 487632 - RNA, 20 nt, Homo sapiens
cacggccucuggggagaccg

SEQ ID NO: 487633 - RNA, 22 nt, Homo sapiens
cacguaguagggucaggccacg

SEQ ID NO: 487634 - RNA, 14 nt, Homo sapiens
cacguuugccaaau

SEQ ID NO: 487635 - RNA, 19 nt, Homo sapiens
cacuagguucaauucccug

SEQ ID NO: 487636 - RNA, 14 nt, Homo sapiens
cacuauucagaaga

SEQ ID NO: 487637 - RNA, 22 nt, Homo sapiens
cacuccacaguuaggccaagaa

SEQ ID NO: 487638 - RNA, 13 nt, Homo sapiens
cacuccauuccca

SEQ ID NO: 487639 - RNA, 17 nt, Homo sapiens
cacuccucccugaugua

SEQ ID NO: 487640 - RNA, 20 nt, Homo sapiens
cacuccuggggggccugaaa

SEQ ID NO: 487641 - RNA, 16 nt, Homo sapiens
cacugaaaaugugcuc

SEQ ID NO: 487642 - RNA, 22 nt, Homo sapiens
cacugaaaauuacaguauggua

SEQ ID NO: 487643 - RNA, 23 nt, Homo sapiens
cacugaguagucauuuugcccau

SEQ ID NO: 487644 - RNA, 13 nt, Homo sapiens
cacugaguucuau

SEQ ID NO: 487645 - RNA, 13 nt, Homo sapiens
cacugcuguaaag

SEQ ID NO: 487646 - RNA, 17 nt, Homo sapiens
cacugugaacuaaugac

SEQ ID NO: 487647 - RNA, 20 nt, Homo sapiens
cacuuagaauccgaagggaa

SEQ ID NO: 487648 - RNA, 15 nt, Homo sapiens
cacuuccuugccagu

SEQ ID NO: 487649 - RNA, 9 nt, Homo sapiens
cacuucuua

SEQ ID NO: 487650 - RNA, 20 nt, Homo sapiens
cacuuucaggaacacucuga

SEQ ID NO: 487651 - RNA, 18 nt, Homo sapiens
cacuuucccacacuguga

SEQ ID NO: 487652 - RNA, 18 nt, Homo sapiens
ucuuuugaaggacuccuu

SEQ ID NO: 487653 - RNA, 22 nt, Homo sapiens
ugaaaaauaguguguccaugca

SEQ ID NO: 487654 - RNA, 20 nt, Homo sapiens
ugaaaaccacccuaucauca

SEQ ID NO: 487655 - RNA, 21 nt, Homo sapiens
ugaaaaugugcucuacaucuc

SEQ ID NO: 487656 - RNA, 14 nt, Homo sapiens
ugaaacagcagcug

SEQ ID NO: 487657 - RNA, 16 nt, Homo sapiens
ugaaacagcagcugaa

SEQ ID NO: 487658 - RNA, 21 nt, Homo sapiens
ugaaacuaaugaaagcacucc

SEQ ID NO: 487659 - RNA, 11 nt, Homo sapiens
ugaaagcacag

SEQ ID NO: 487660 - RNA, 22 nt, Homo sapiens
ugaaagcacuccucccugaugu

SEQ ID NO: 487661 - RNA, 18 nt, Homo sapiens
ugaaagcuguuucauuug

SEQ ID NO: 487662 - RNA, 18 nt, Homo sapiens
ugaaagucuccuguauca

SEQ ID NO: 487663 - RNA, 16 nt, Homo sapiens
ugaaagugccaaaaua

SEQ ID NO: 487664 - RNA, 20 nt, Homo sapiens
ugaaauaaaauuaguuccau

SEQ ID NO: 487665 - RNA, 18 nt, Homo sapiens
ugaaauguuuccaggcau

SEQ ID NO: 487666 - RNA, 22 nt, Homo sapiens
ugaacaaacccuuuaaaugggg

SEQ ID NO: 487667 - RNA, 14 nt, Homo sapiens
ugaacuaaugacaa

SEQ ID NO: 487668 - RNA, 21 nt, Homo sapiens
ugaagauauucuacuaugcau

SEQ ID NO: 487669 - RNA, 18 nt, Homo sapiens
ugaaguaacuugucuuaa

SEQ ID NO: 487670 - RNA, 14 nt, Homo sapiens
ugaagucaguucuc

SEQ ID NO: 487671 - RNA, 23 nt, Homo sapiens
ugaauccaaaagaaaaacagcca

SEQ ID NO: 487672 - RNA, 16 nt, Homo sapiens
ugaaucugaccacaga

SEQ ID NO: 487673 - RNA, 12 nt, Homo sapiens
ugaaucuguaca

SEQ ID NO: 487674 - RNA, 20 nt, Homo sapiens
ugaaucuucagcauguucuc

SEQ ID NO: 487675 - RNA, 14 nt, Homo sapiens
ugaaugccagucca

SEQ ID NO: 487676 - RNA, 22 nt, Homo sapiens
ugaaugccaguccagaugugcc

SEQ ID NO: 487677 - RNA, 20 nt, Homo sapiens
ugacaagugacuuauuugcu

SEQ ID NO: 487678 - RNA, 21 nt, Homo sapiens
ugacacagcugagcuggccua

SEQ ID NO: 487679 - RNA, 16 nt, Homo sapiens
ugacagcaaacacagu

SEQ ID NO: 487680 - RNA, 17 nt, Homo sapiens
ugacagcaaacacaguc

SEQ ID NO: 487681 - RNA, 12 nt, Homo sapiens
ugacagcugcuc

SEQ ID NO: 487682 - RNA, 18 nt, Homo sapiens
ugacauccaagcuuccuu

SEQ ID NO: 487683 - RNA, 13 nt, Homo sapiens
ugacgcacuguau

SEQ ID NO: 487684 - RNA, 23 nt, Homo sapiens
ugacugcucaugguuaaugcagg

SEQ ID NO: 487685 - RNA, 23 nt, Homo sapiens
ugagcaaguuuucaccuaucugg

SEQ ID NO: 487686 - RNA, 18 nt, Homo sapiens
ugagcuaaugguucauau

SEQ ID NO: 487687 - RNA, 19 nt, Homo sapiens
ugaggacauaaaucuucca

SEQ ID NO: 487688 - RNA, 18 nt, Homo sapiens
ugaggcaggugacaguga

SEQ ID NO: 487689 - RNA, 13 nt, Homo sapiens
ugagggcccuucc

SEQ ID NO: 487690 - RNA, 10 nt, Homo sapiens
ugaguagccc

SEQ ID NO: 487691 - RNA, 14 nt, Homo sapiens
ugauaaauuugacu

SEQ ID NO: 487692 - RNA, 12 nt, Homo sapiens
ugauacuugguc

SEQ ID NO: 487693 - RNA, 16 nt, Homo sapiens
ugauagaauaaagccu

SEQ ID NO: 487694 - RNA, 18 nt, Homo sapiens
ugauauuccccauuuccu

SEQ ID NO: 487695 - RNA, 14 nt, Homo sapiens
ugauccuugcacag

SEQ ID NO: 487696 - RNA, 11 nt, Homo sapiens
ugaugugacau

SEQ ID NO: 487697 - RNA, 12 nt, Homo sapiens
ugaugugcucau

SEQ ID NO: 487698 - RNA, 15 nt, Homo sapiens
ugauuaaaacauuau

SEQ ID NO: 487699 - RNA, 23 nt, Homo sapiens
ugauucaaaagaugccauucaua

SEQ ID NO: 487700 - RNA, 19 nt, Homo sapiens
ugauucccagaaauacaac

SEQ ID NO: 487701 - RNA, 15 nt, Homo sapiens
ugauuguuuuaacug

SEQ ID NO: 487702 - RNA, 23 nt, Homo sapiens
ugauuucggaccgaaggugacag

SEQ ID NO: 487703 - RNA, 16 nt, Homo sapiens
ugcacacucacuggca

SEQ ID NO: 487704 - RNA, 16 nt, Homo sapiens
ugcacacucacuugua

SEQ ID NO: 487705 - RNA, 21 nt, Homo sapiens
ugcacacucacuuguaagaaa

SEQ ID NO: 487706 - RNA, 18 nt, Homo sapiens
ugcaccgguuucauagac

SEQ ID NO: 487707 - RNA, 20 nt, Homo sapiens
ugcacuuucaggaacacucu

SEQ ID NO: 487708 - RNA, 22 nt, Homo sapiens
ugcagagccugcagggugaccu

SEQ ID NO: 487709 - RNA, 15 nt, Homo sapiens
ugcaggaacaugacc

SEQ ID NO: 487710 - RNA, 22 nt, Homo sapiens
ugcauaaauauuagcaaagcau

SEQ ID NO: 487711 - RNA, 22 nt, Homo sapiens
ugcaucacuauucagaagacac

SEQ ID NO: 487712 - RNA, 19 nt, Homo sapiens
ugcaucaugcaugcacucu

SEQ ID NO: 487713 - RNA, 17 nt, Homo sapiens
ugcauguaauccuagca

SEQ ID NO: 487714 - RNA, 15 nt, Homo sapiens
ugcauucguccuuag

SEQ ID NO: 487715 - RNA, 20 nt, Homo sapiens
ugcauuuucugaaacuaaug

SEQ ID NO: 487716 - RNA, 16 nt, Homo sapiens
ugccacauaauucauu

SEQ ID NO: 487717 - RNA, 21 nt, Homo sapiens
ugccaggagugggugggacac

SEQ ID NO: 487718 - RNA, 23 nt, Homo sapiens
ugccauggaggcacacagcugca

SEQ ID NO: 487719 - RNA, 24 nt, Homo sapiens
ugcccauuagcccacugccuggaa

SEQ ID NO: 487720 - RNA, 14 nt, Homo sapiens
ugccccucccugcc

SEQ ID NO: 487721 - RNA, 14 nt, Homo sapiens
ugccccucucucca

SEQ ID NO: 487722 - RNA, 22 nt, Homo sapiens
ugcccucacugccucuuugcag

SEQ ID NO: 487723 - RNA, 18 nt, Homo sapiens
ugcccuccguccuggcag

SEQ ID NO: 487724 - RNA, 12 nt, Homo sapiens
ugccucaggaau

SEQ ID NO: 487725 - RNA, 20 nt, Homo sapiens
ugccuggacucagcaacuca

SEQ ID NO: 487726 - RNA, 13 nt, Homo sapiens
ugccuguggugag

SEQ ID NO: 487727 - RNA, 18 nt, Homo sapiens
ugccuuuccagugcugcu

SEQ ID NO: 487728 - RNA, 22 nt, Homo sapiens
ugcgagcaccaaguacaaggac

SEQ ID NO: 487729 - RNA, 14 nt, Homo sapiens
ugcgcaaaacugaa

SEQ ID NO: 487730 - RNA, 14 nt, Homo sapiens
ugcuaagagccucu

SEQ ID NO: 487731 - RNA, 20 nt, Homo sapiens
ugcuaccacagcaacuauau

SEQ ID NO: 487732 - RNA, 13 nt, Homo sapiens
ugcuauggggaca

SEQ ID NO: 487733 - RNA, 15 nt, Homo sapiens
ugcucauuguggcca

SEQ ID NO: 487734 - RNA, 14 nt, Homo sapiens
ugcucuuuaccuug

SEQ ID NO: 487735 - RNA, 18 nt, Homo sapiens
ugcuuaguaucucaucaa

SEQ ID NO: 487736 - RNA, 20 nt, Homo sapiens
ugcuuagugucccuuaccug

SEQ ID NO: 487737 - RNA, 12 nt, Homo sapiens
ugcuucaugagc

SEQ ID NO: 487738 - RNA, 19 nt, Homo sapiens
ugcuuguguuuauuacugc

SEQ ID NO: 487739 - RNA, 18 nt, Homo sapiens
ugcuuuuccaacccauga

SEQ ID NO: 487740 - RNA, 16 nt, Homo sapiens
uggaaaaguacaagua

SEQ ID NO: 487741 - RNA, 17 nt, Homo sapiens
uggaaaaguacaaguag

SEQ ID NO: 487742 - RNA, 19 nt, Homo sapiens
uggaacaguguuuacuuua

SEQ ID NO: 487743 - RNA, 20 nt, Homo sapiens
uggaacaguguuuacuuuaa

SEQ ID NO: 487744 - RNA, 16 nt, Homo sapiens
uggaacugcaccaccg

SEQ ID NO: 487745 - RNA, 14 nt, Homo sapiens
uggaagacaaauac

SEQ ID NO: 487746 - RNA, 15 nt, Homo sapiens
uggaagacaaauaca

SEQ ID NO: 487747 - RNA, 20 nt, Homo sapiens
uggaaugcccuucacuguca

SEQ ID NO: 487748 - RNA, 16 nt, Homo sapiens
uggagacgaugcuuua

SEQ ID NO: 487749 - RNA, 14 nt, Homo sapiens
uggagcugcuucca

SEQ ID NO: 487750 - RNA, 16 nt, Homo sapiens
uggaggcacacagcug

SEQ ID NO: 487751 - RNA, 17 nt, Homo sapiens
uggaucacucaccauuc

SEQ ID NO: 487752 - RNA, 14 nt, Homo sapiens
uggauggaauauca

SEQ ID NO: 487753 - RNA, 14 nt, Homo sapiens
uggauggcacaaug

SEQ ID NO: 487754 - RNA, 16 nt, Homo sapiens
uggauggcacaaugaa

SEQ ID NO: 487755 - RNA, 21 nt, Homo sapiens
uggcagguggccagggcucca

SEQ ID NO: 487756 - RNA, 16 nt, Homo sapiens
uggccagaccagguga

SEQ ID NO: 487757 - RNA, 17 nt, Homo sapiens
uggcccuugcuuaccuc

SEQ ID NO: 487758 - RNA, 15 nt, Homo sapiens
uggcguaucaggaaa

SEQ ID NO: 487759 - RNA, 12 nt, Homo sapiens
uggcuacugugc

SEQ ID NO: 487760 - RNA, 15 nt, Homo sapiens
uggcuacugugccuu

SEQ ID NO: 487761 - RNA, 15 nt, Homo sapiens
uggcucacacagacu

SEQ ID NO: 487762 - RNA, 20 nt, Homo sapiens
uggcucauucugcaaugagc

SEQ ID NO: 487763 - RNA, 16 nt, Homo sapiens
uggcuuugugcuuguu

SEQ ID NO: 487764 - RNA, 18 nt, Homo sapiens
ugggagaugcugggaccc

SEQ ID NO: 487765 - RNA, 13 nt, Homo sapiens
ugggcagcuguua

SEQ ID NO: 487766 - RNA, 22 nt, Homo sapiens
ugggccagggucucgucaggag

SEQ ID NO: 487767 - RNA, 23 nt, Homo sapiens
ugggcccugguucccccaggacc

SEQ ID NO: 487768 - RNA, 14 nt, Homo sapiens
uggggacaucucau

SEQ ID NO: 487769 - RNA, 18 nt, Homo sapiens
ugggggcugcugcacugc

SEQ ID NO: 487770 - RNA, 22 nt, Homo sapiens
uggguauaccucuaacugugca

SEQ ID NO: 487771 - RNA, 18 nt, Homo sapiens
ugguaacuuuacaacugg

SEQ ID NO: 487772 - RNA, 14 nt, Homo sapiens
ugguaccuccuagg

SEQ ID NO: 487773 - RNA, 20 nt, Homo sapiens
ugguagcaucauguauauau

SEQ ID NO: 487774 - RNA, 23 nt, Homo sapiens
ugguagcuuucaguauuguaaag

SEQ ID NO: 487775 - RNA, 12 nt, Homo sapiens
ugguaugugaca

SEQ ID NO: 487776 - RNA, 14 nt, Homo sapiens
ugguccugcacugu

SEQ ID NO: 487777 - RNA, 22 nt, Homo sapiens
ugguccuuaaaaaauaugcucu

SEQ ID NO: 487778 - RNA, 13 nt, Homo sapiens
uggucuggcaaua

SEQ ID NO: 487779 - RNA, 21 nt, Homo sapiens
uggucuuucugaauugcacau

SEQ ID NO: 487780 - RNA, 15 nt, Homo sapiens
ugguguaauuuauaa

SEQ ID NO: 487781 - RNA, 15 nt, Homo sapiens
uggugucugucagac

SEQ ID NO: 487782 - RNA, 14 nt, Homo sapiens
uguaaagauauugu

SEQ ID NO: 487783 - RNA, 20 nt, Homo sapiens
uguaacuguuaccauuggaa

SEQ ID NO: 487784 - RNA, 14 nt, Homo sapiens
uguaagagugauuu

SEQ ID NO: 487785 - RNA, 14 nt, Homo sapiens
uguaaguacucuaa

SEQ ID NO: 487786 - RNA, 19 nt, Homo sapiens
uguaauccuagcacuuugg

SEQ ID NO: 487787 - RNA, 13 nt, Homo sapiens
uguaaugagccau

SEQ ID NO: 487788 - RNA, 14 nt, Homo sapiens
aaaaaaaugauacu

SEQ ID NO: 487789 - RNA, 13 nt, Homo sapiens
aaaaagugucuca

SEQ ID NO: 487790 - RNA, 17 nt, Homo sapiens
aaaaauaaaccaaagga

SEQ ID NO: 487791 - RNA, 15 nt, Homo sapiens
aaaaaucuuuaggga

SEQ ID NO: 487792 - RNA, 20 nt, Homo sapiens
aaaacagggugggcaaacuc

SEQ ID NO: 487793 - RNA, 16 nt, Homo sapiens
aaaagaagagccuuaa

SEQ ID NO: 487794 - RNA, 22 nt, Homo sapiens
aaaagcaaaaggcauuucccac

SEQ ID NO: 487795 - RNA, 14 nt, Homo sapiens
aaaagccacauaga

SEQ ID NO: 487796 - RNA, 22 nt, Homo sapiens
aaaagguuaaacccacagccaa

SEQ ID NO: 487797 - RNA, 18 nt, Homo sapiens
aaaagugucucaaaggag

SEQ ID NO: 487798 - RNA, 20 nt, Homo sapiens
aaaaguuaacuacagaccau

SEQ ID NO: 487799 - RNA, 19 nt, Homo sapiens
aaaauacaugguaucucuu

SEQ ID NO: 487800 - RNA, 13 nt, Homo sapiens
aaaauacuucuuu

SEQ ID NO: 487801 - RNA, 18 nt, Homo sapiens
aaaauaguguguccaugc

SEQ ID NO: 487802 - RNA, 23 nt, Homo sapiens
aaaauauauuugcauaauaugca

SEQ ID NO: 487803 - RNA, 19 nt, Homo sapiens
aaaaugugcuauuugcaaa

SEQ ID NO: 487804 - RNA, 13 nt, Homo sapiens
aaaauuaugucca

SEQ ID NO: 487805 - RNA, 19 nt, Homo sapiens
aaaauucauuucacauuaa

SEQ ID NO: 487806 - RNA, 15 nt, Homo sapiens
aaaauuccuaucuca

SEQ ID NO: 487807 - RNA, 15 nt, Homo sapiens
aaaauuuaacaucug

SEQ ID NO: 487808 - RNA, 14 nt, Homo sapiens
aaacacaauaucau

SEQ ID NO: 487809 - RNA, 16 nt, Homo sapiens
aaacacagucacuguu

SEQ ID NO: 487810 - RNA, 14 nt, Homo sapiens
aaacagcagguugu

SEQ ID NO: 487811 - RNA, 14 nt, Homo sapiens
aaacagcuugaugc

SEQ ID NO: 487812 - RNA, 17 nt, Homo sapiens
aaacauuaguacuuuau

SEQ ID NO: 487813 - RNA, 23 nt, Homo sapiens
aaaccaauuuguucugugcaaca

SEQ ID NO: 487814 - RNA, 19 nt, Homo sapiens
aaaccgaggacccaugaaa

SEQ ID NO: 487815 - RNA, 14 nt, Homo sapiens
aaacguauuuugau

SEQ ID NO: 487816 - RNA, 12 nt, Homo sapiens
aaacucuucccu

SEQ ID NO: 487817 - RNA, 15 nt, Homo sapiens
aaacuguauuuacuu

SEQ ID NO: 487818 - RNA, 17 nt, Homo sapiens
aaagacaguaaagacca

SEQ ID NO: 487819 - RNA, 22 nt, Homo sapiens
aaagccacgcugugucccucaa

SEQ ID NO: 487820 - RNA, 18 nt, Homo sapiens
aaagccucagaaagggau

SEQ ID NO: 487821 - RNA, 18 nt, Homo sapiens
aaagcugcugcacagcug

SEQ ID NO: 487822 - RNA, 15 nt, Homo sapiens
aaagcuguguuccca

SEQ ID NO: 487823 - RNA, 13 nt, Homo sapiens
aaaggaagaugua

SEQ ID NO: 487824 - RNA, 22 nt, Homo sapiens
aacacauugaaacuguauuuac

SEQ ID NO: 487825 - RNA, 14 nt, Homo sapiens
aacaccacagacac

SEQ ID NO: 487826 - RNA, 18 nt, Homo sapiens
aacaccuucauccagauu

SEQ ID NO: 487827 - RNA, 16 nt, Homo sapiens
aacacuuggaacagug

SEQ ID NO: 487828 - RNA, 17 nt, Homo sapiens
aacagagugauuuguaa

SEQ ID NO: 487829 - RNA, 23 nt, Homo sapiens
aacagauuggauuuuauguugac

SEQ ID NO: 487830 - RNA, 17 nt, Homo sapiens
aacagcugcauggcaca

SEQ ID NO: 487831 - RNA, 19 nt, Homo sapiens
aacaguaaagaaagcagaa

SEQ ID NO: 487832 - RNA, 17 nt, Homo sapiens
aacaguuuaacagaaaa

SEQ ID NO: 487833 - RNA, 23 nt, Homo sapiens
aacauccauguccuaugugugac

SEQ ID NO: 487834 - RNA, 21 nt, Homo sapiens
aacaucugcaguguucuguga

SEQ ID NO: 487835 - RNA, 19 nt, Homo sapiens
aacaugauuguuuacagcu

SEQ ID NO: 487836 - RNA, 16 nt, Homo sapiens
aacaugguuaccucug

SEQ ID NO: 487837 - RNA, 12 nt, Homo sapiens
aacauguacaaa

SEQ ID NO: 487838 - RNA, 13 nt, Homo sapiens
aacauguacaaaa

SEQ ID NO: 487839 - RNA, 14 nt, Homo sapiens
aacaugugugacug

SEQ ID NO: 487840 - RNA, 12 nt, Homo sapiens
aaccaagcuaua

SEQ ID NO: 487841 - RNA, 11 nt, Homo sapiens
aacccaaagau

SEQ ID NO: 487842 - RNA, 14 nt, Homo sapiens
aacccggcuuccug

SEQ ID NO: 487843 - RNA, 20 nt, Homo sapiens
aacccucccaaaacagggaa

SEQ ID NO: 487844 - RNA, 14 nt, Homo sapiens
aacccuuauacuca

SEQ ID NO: 487845 - RNA, 21 nt, Homo sapiens
aacccuucaacuaugcaauga

SEQ ID NO: 487846 - RNA, 24 nt, Homo sapiens
aacccuuuaaauggggacgcagau

SEQ ID NO: 487847 - RNA, 19 nt, Homo sapiens
aaccuccccugguccugca

SEQ ID NO: 487848 - RNA, 17 nt, Homo sapiens
aaccuucuaauccaugu

SEQ ID NO: 487849 - RNA, 14 nt, Homo sapiens
aacguggggcagca

SEQ ID NO: 487850 - RNA, 21 nt, Homo sapiens
aacguggggcagcacagagag

SEQ ID NO: 487851 - RNA, 15 nt, Homo sapiens
aacuagcaaaaggau

SEQ ID NO: 487852 - RNA, 17 nt, Homo sapiens
aacuccugcauggcuca

SEQ ID NO: 487853 - RNA, 14 nt, Homo sapiens
aacucugacuguaa

SEQ ID NO: 487854 - RNA, 19 nt, Homo sapiens
aacugaaaggcaugugaag

SEQ ID NO: 487855 - RNA, 20 nt, Homo sapiens
aacuguagugguagcuuuca

SEQ ID NO: 487856 - RNA, 12 nt, Homo sapiens
aacugugccaug

SEQ ID NO: 487857 - RNA, 23 nt, Homo sapiens
aacuucuaaaacuguacuuugau

SEQ ID NO: 487858 - RNA, 17 nt, Homo sapiens
aacuucuuaacuggcaa

SEQ ID NO: 487859 - RNA, 17 nt, Homo sapiens
aacuugaagucuugaaa

SEQ ID NO: 487860 - RNA, 21 nt, Homo sapiens
aacuuggugccuaauguucca

SEQ ID NO: 487861 - RNA, 15 nt, Homo sapiens
aacuuguucuuccaa

SEQ ID NO: 487862 - RNA, 19 nt, Homo sapiens
aacuuucacuuugcaaaga

SEQ ID NO: 487863 - RNA, 20 nt, Homo sapiens
aacuuuguuaggccaaagac

SEQ ID NO: 487864 - RNA, 14 nt, Homo sapiens
aagaaacaguagcc

SEQ ID NO: 487865 - RNA, 22 nt, Homo sapiens
aagaaagcuucaaguuuucuca

SEQ ID NO: 487866 - RNA, 12 nt, Homo sapiens
aagaaaguuuau

SEQ ID NO: 487867 - RNA, 9 nt, Homo sapiens
aagaacaag

SEQ ID NO: 487868 - RNA, 20 nt, Homo sapiens
aagaaguugcugcagauucc

SEQ ID NO: 487869 - RNA, 14 nt, Homo sapiens
aagaaucaccuaau

SEQ ID NO: 487870 - RNA, 18 nt, Homo sapiens
aagacaguaaagaccauu

SEQ ID NO: 487871 - RNA, 21 nt, Homo sapiens
aagaccacacuugguguuacc

SEQ ID NO: 487872 - RNA, 17 nt, Homo sapiens
aagaccagccuggccaa

SEQ ID NO: 487873 - RNA, 21 nt, Homo sapiens
aagacuaaucgaaugaacaaa

SEQ ID NO: 487874 - RNA, 16 nt, Homo sapiens
aagagaaccgagcaaa

SEQ ID NO: 487875 - RNA, 20 nt, Homo sapiens
aagagagagcugagugagcu

SEQ ID NO: 487876 - RNA, 23 nt, Homo sapiens
aagagaugcacuauauguuuaca

SEQ ID NO: 487877 - RNA, 15 nt, Homo sapiens
aagagugaagagcau

SEQ ID NO: 487878 - RNA, 13 nt, Homo sapiens
aagaucaagcucc

SEQ ID NO: 487879 - RNA, 20 nt, Homo sapiens
aagaugauucuggcugaaaa

SEQ ID NO: 487880 - RNA, 24 nt, Homo sapiens
aagcacaaccauguucuugagcag

SEQ ID NO: 487881 - RNA, 12 nt, Homo sapiens
aagcagcagcua

SEQ ID NO: 487882 - RNA, 13 nt, Homo sapiens
aagcagccuccac

SEQ ID NO: 487883 - RNA, 16 nt, Homo sapiens
aagcauagacgucuca

SEQ ID NO: 487884 - RNA, 17 nt, Homo sapiens
aagcauagacgucucag

SEQ ID NO: 487885 - RNA, 13 nt, Homo sapiens
aagcauggcucau

SEQ ID NO: 487886 - RNA, 18 nt, Homo sapiens
aagcaugugaaagugcac

SEQ ID NO: 487887 - RNA, 13 nt, Homo sapiens
aagcccucuucaa

SEQ ID NO: 487888 - RNA, 17 nt, Homo sapiens
aagccucagaaagggau

SEQ ID NO: 487889 - RNA, 23 nt, Homo sapiens
aagcuaaaaugaaaaauagugug

SEQ ID NO: 487890 - RNA, 19 nt, Homo sapiens
aagcuauagcuaaugugcu

SEQ ID NO: 487891 - RNA, 17 nt, Homo sapiens
aagcuggcaggagacac

SEQ ID NO: 487892 - RNA, 14 nt, Homo sapiens
aaggaagaggaaga

SEQ ID NO: 487893 - RNA, 22 nt, Homo sapiens
aaggacuccauuggaucugcaa

SEQ ID NO: 487894 - RNA, 15 nt, Homo sapiens
aaggagggucucuug

SEQ ID NO: 487895 - RNA, 15 nt, Homo sapiens
aaggcagcuagacac

SEQ ID NO: 487896 - RNA, 12 nt, Homo sapiens
aaggcauccacu

SEQ ID NO: 487897 - RNA, 18 nt, Homo sapiens
aaggccucauccuccacu

SEQ ID NO: 487898 - RNA, 21 nt, Homo sapiens
aaggcuucuccacaaccuccu

SEQ ID NO: 487899 - RNA, 13 nt, Homo sapiens
aagguuaaaccca

SEQ ID NO: 487900 - RNA, 15 nt, Homo sapiens
aagguucuugcugcc

SEQ ID NO: 487901 - RNA, 18 nt, Homo sapiens
aagguuucacuguucaug

SEQ ID NO: 487902 - RNA, 19 nt, Homo sapiens
aaguacugaaauacauaug

SEQ ID NO: 487903 - RNA, 21 nt, Homo sapiens
aaguauuauucaaaccaauuu

SEQ ID NO: 487904 - RNA, 19 nt, Homo sapiens
aagucccugagaagccuca

SEQ ID NO: 487905 - RNA, 21 nt, Homo sapiens
aagucuccccuucguguugcc

SEQ ID NO: 487906 - RNA, 18 nt, Homo sapiens
aagucucuuuuuuacaaa

SEQ ID NO: 487907 - RNA, 13 nt, Homo sapiens
aagugacacagca

SEQ ID NO: 487908 - RNA, 18 nt, Homo sapiens
aagugguaggaaagccuc

SEQ ID NO: 487909 - RNA, 19 nt, Homo sapiens
aagugguaggaaagccuca

SEQ ID NO: 487910 - RNA, 13 nt, Homo sapiens
aaguguacuggau

SEQ ID NO: 487911 - RNA, 16 nt, Homo sapiens
aaguuaaucuucaugg

SEQ ID NO: 487912 - RNA, 14 nt, Homo sapiens
aaguuaauucucag

SEQ ID NO: 487913 - RNA, 16 nt, Homo sapiens
aaguucuuaaaacacu

SEQ ID NO: 487914 - RNA, 18 nt, Homo sapiens
aaguuugccccagugcua

SEQ ID NO: 487915 - RNA, 15 nt, Homo sapiens
aauaacaacugcugg

SEQ ID NO: 487916 - RNA, 12 nt, Homo sapiens
aauacaugccuu

SEQ ID NO: 487917 - RNA, 18 nt, Homo sapiens
aauacuauuauuugcuac

SEQ ID NO: 487918 - RNA, 15 nt, Homo sapiens
aauauaaaacuuaca

SEQ ID NO: 487919 - RNA, 18 nt, Homo sapiens
aauauaacgagggauaaa

SEQ ID NO: 487920 - RNA, 16 nt, Homo sapiens
aauauaacugccuuaa

SEQ ID NO: 487921 - RNA, 21 nt, Homo sapiens
aauauagcguucccaacaaca

SEQ ID NO: 487922 - RNA, 15 nt, Homo sapiens
aauauauguaugaaa

SEQ ID NO: 487923 - RNA, 21 nt, Homo sapiens
aauauuauguuaugaaaaccc

SEQ ID NO: 487924 - RNA, 17 nt, Homo sapiens
aauauuauuugcuaauu

SEQ ID NO: 487925 - RNA, 12 nt, Homo sapiens
aauauuuugcug

SEQ ID NO: 487926 - RNA, 14 nt, Homo sapiens
aaucaagauguuca

SEQ ID NO: 487927 - RNA, 12 nt, Homo sapiens
aaucaauguuca

SEQ ID NO: 487928 - RNA, 18 nt, Homo sapiens
aaucacacucucuucuua

SEQ ID NO: 487929 - RNA, 12 nt, Homo sapiens
aaucaggaaaga

SEQ ID NO: 487930 - RNA, 11 nt, Homo sapiens
aaucaguuugc

SEQ ID NO: 487931 - RNA, 18 nt, Homo sapiens
aaucauccucaugccuuu

SEQ ID NO: 487932 - RNA, 20 nt, Homo sapiens
aaucaugaacagcucugaga

SEQ ID NO: 487933 - RNA, 18 nt, Homo sapiens
aaucauuggggggagaaa

SEQ ID NO: 487934 - RNA, 15 nt, Homo sapiens
aaucauuucuaaaca

SEQ ID NO: 487935 - RNA, 21 nt, Homo sapiens
aauccaugugcugcuguggca

SEQ ID NO: 487936 - RNA, 13 nt, Homo sapiens
aauccgaagggaa

SEQ ID NO: 487937 - RNA, 22 nt, Homo sapiens
aauccuguccucagcuucuuaa

SEQ ID NO: 487938 - RNA, 17 nt, Homo sapiens
aaucuaggaagcucaga

SEQ ID NO: 487939 - RNA, 15 nt, Homo sapiens
aaucucuaccccuuu

SEQ ID NO: 487940 - RNA, 17 nt, Homo sapiens
aaucuuaaugucucuuc

SEQ ID NO: 487941 - RNA, 18 nt, Homo sapiens
aaucuuuagaauaguuaa

SEQ ID NO: 487942 - RNA, 20 nt, Homo sapiens
aaucuuugaaaacucauaca

SEQ ID NO: 487943 - RNA, 20 nt, Homo sapiens
aaugaaaauaagugaauaau

SEQ ID NO: 487944 - RNA, 16 nt, Homo sapiens
aaugaaauacuugaca

SEQ ID NO: 487945 - RNA, 19 nt, Homo sapiens
aaugauuauuuucauuaca

SEQ ID NO: 487946 - RNA, 21 nt, Homo sapiens
aaugcaaaauacaugaugauu

SEQ ID NO: 487947 - RNA, 16 nt, Homo sapiens
aaugcaccucauucca

SEQ ID NO: 487948 - RNA, 13 nt, Homo sapiens
aaugccucuucau

SEQ ID NO: 487949 - RNA, 20 nt, Homo sapiens
aaugcugcccucacugccuc

SEQ ID NO: 487950 - RNA, 19 nt, Homo sapiens
aauggauccuugucaguug

SEQ ID NO: 487951 - RNA, 12 nt, Homo sapiens
aauggcaucucg

SEQ ID NO: 487952 - RNA, 22 nt, Homo sapiens
aauggcauuuagcacaguauuu

SEQ ID NO: 487953 - RNA, 17 nt, Homo sapiens
aauggggcuuuccugau

SEQ ID NO: 487954 - RNA, 20 nt, Homo sapiens
aaugggugauauccugaaaa

SEQ ID NO: 487955 - RNA, 14 nt, Homo sapiens
aauguaaacugugc

SEQ ID NO: 487956 - RNA, 10 nt, Homo sapiens
aauguacaaa

SEQ ID NO: 487957 - RNA, 13 nt, Homo sapiens
aauguauaguauu

SEQ ID NO: 487958 - RNA, 20 nt, Homo sapiens
aauguauauacacauauacc

SEQ ID NO: 487959 - RNA, 20 nt, Homo sapiens
aaugucucuucauaauacuu

SEQ ID NO: 487960 - RNA, 21 nt, Homo sapiens
aauguggcugcugaaacucau

SEQ ID NO: 487961 - RNA, 20 nt, Homo sapiens
aauguucugacagcauuuca

SEQ ID NO: 487962 - RNA, 12 nt, Homo sapiens
aauuacaaugga

SEQ ID NO: 487963 - RNA, 13 nt, Homo sapiens
aauuacaauggaa

SEQ ID NO: 487964 - RNA, 17 nt, Homo sapiens
aauuauaaugcaauaaa

SEQ ID NO: 487965 - RNA, 19 nt, Homo sapiens
cguccuuagaauacuguau

SEQ ID NO: 487966 - RNA, 19 nt, Homo sapiens
cgucugucuguaaugugaa

SEQ ID NO: 487967 - RNA, 18 nt, Homo sapiens
cgucuuucccaaaggcau

SEQ ID NO: 487968 - RNA, 19 nt, Homo sapiens
cgugaaaguguuacauauu

SEQ ID NO: 487969 - RNA, 15 nt, Homo sapiens
cgugcacggggccag

SEQ ID NO: 487970 - RNA, 21 nt, Homo sapiens
cgugcuuuuaaggaaaggcaa

SEQ ID NO: 487971 - RNA, 14 nt, Homo sapiens
cguggcaacugugg

SEQ ID NO: 487972 - RNA, 16 nt, Homo sapiens
cguuuggccagugaca

SEQ ID NO: 487973 - RNA, 22 nt, Homo sapiens
cuaagaaucauccucaugccuu

SEQ ID NO: 487974 - RNA, 16 nt, Homo sapiens
cuaagguaaaaccauc

SEQ ID NO: 487975 - RNA, 13 nt, Homo sapiens
cuaauaaacaauu

SEQ ID NO: 487976 - RNA, 21 nt, Homo sapiens
cuaauauugaaaaugucacug

SEQ ID NO: 487977 - RNA, 15 nt, Homo sapiens
cuaauguugacuuua

SEQ ID NO: 487978 - RNA, 23 nt, Homo sapiens
cuaauuaaaaaguuaaucuucau

SEQ ID NO: 487979 - RNA, 17 nt, Homo sapiens
cuaauuagagcagauga

SEQ ID NO: 487980 - RNA, 10 nt, Homo sapiens
cuacagcaga

SEQ ID NO: 487981 - RNA, 18 nt, Homo sapiens
cuaccaaaaacuagacau

SEQ ID NO: 487982 - RNA, 16 nt, Homo sapiens
cuaccuuuucucuuca

SEQ ID NO: 487983 - RNA, 20 nt, Homo sapiens
cuacuguuccuuucagauga

SEQ ID NO: 487984 - RNA, 18 nt, Homo sapiens
cuacuuuaaauuguggau

SEQ ID NO: 487985 - RNA, 18 nt, Homo sapiens
cuagcaauugcuucucua

SEQ ID NO: 487986 - RNA, 17 nt, Homo sapiens
cuagcugaguaugcuga

SEQ ID NO: 487987 - RNA, 13 nt, Homo sapiens
cuagguucaggaa

SEQ ID NO: 487988 - RNA, 22 nt, Homo sapiens
cuaguugcauuuucauauugcu

SEQ ID NO: 487989 - RNA, 15 nt, Homo sapiens
cuauacggaccuuuu

SEQ ID NO: 487990 - RNA, 22 nt, Homo sapiens
cuaucacuuuaaauacuauuau

SEQ ID NO: 487991 - RNA, 21 nt, Homo sapiens
cuaucauggcagcaugcgaug

SEQ ID NO: 487992 - RNA, 16 nt, Homo sapiens
cuauccauuuuacacu

SEQ ID NO: 487993 - RNA, 15 nt, Homo sapiens
cuaucuuaggaguaa

SEQ ID NO: 487994 - RNA, 20 nt, Homo sapiens
cuaugauauuccccauuucc

SEQ ID NO: 487995 - RNA, 20 nt, Homo sapiens
cuauuucauuuuuugcauca

SEQ ID NO: 487996 - RNA, 20 nt, Homo sapiens
cuauuuuaguaguaaacuga

SEQ ID NO: 487997 - RNA, 17 nt, Homo sapiens
cuauuuuggacguguga

SEQ ID NO: 487998 - RNA, 14 nt, Homo sapiens
cucaauuugcagua

SEQ ID NO: 487999 - RNA, 12 nt, Homo sapiens
cucacagaguau

SEQ ID NO: 488000 - RNA, 12 nt, Homo sapiens
cucagcacuuug

SEQ ID NO: 488001 - RNA, 15 nt, Homo sapiens
cucagcauuguguac

SEQ ID NO: 488002 - RNA, 22 nt, Homo sapiens
cucaggugaaaauccaucucau

SEQ ID NO: 488003 - RNA, 14 nt, Homo sapiens
cucaucaacaaaga

SEQ ID NO: 488004 - RNA, 22 nt, Homo sapiens
cucauggaucugcauaaccgca

SEQ ID NO: 488005 - RNA, 17 nt, Homo sapiens
cucaugguuaaugcagg

SEQ ID NO: 488006 - RNA, 17 nt, Homo sapiens
cucauuagcugaauuga

SEQ ID NO: 488007 - RNA, 17 nt, Homo sapiens
cucauucugcaaugagc

SEQ ID NO: 488008 - RNA, 14 nt, Homo sapiens
cucccaggguccug

SEQ ID NO: 488009 - RNA, 15 nt, Homo sapiens
cuccccaacaaaaga

SEQ ID NO: 488010 - RNA, 22 nt, Homo sapiens
cuccuaagcaacuaggccuuca

SEQ ID NO: 488011 - RNA, 16 nt, Homo sapiens
cuccuuuggaagguga

SEQ ID NO: 488012 - RNA, 22 nt, Homo sapiens
cucgcaggccucccugccagua

SEQ ID NO: 488013 - RNA, 18 nt, Homo sapiens
cucguagaaacaagacaa

SEQ ID NO: 488014 - RNA, 15 nt, Homo sapiens
cucuaaaacuaucag

SEQ ID NO: 488015 - RNA, 18 nt, Homo sapiens
cucuagugucuuuugccu

SEQ ID NO: 488016 - RNA, 16 nt, Homo sapiens
cucuaugccccaaaua

SEQ ID NO: 488017 - RNA, 12 nt, Homo sapiens
cucucaacuuac

SEQ ID NO: 488018 - RNA, 18 nt, Homo sapiens
cucucuccacauuccaaa

SEQ ID NO: 488019 - RNA, 13 nt, Homo sapiens
cucucuccagucu

SEQ ID NO: 488020 - RNA, 16 nt, Homo sapiens
cucucuccaucagagg

SEQ ID NO: 488021 - RNA, 16 nt, Homo sapiens
cucugaaccagagaaa

SEQ ID NO: 488022 - RNA, 23 nt, Homo sapiens
cucugacuguaaaauacauggua

SEQ ID NO: 488023 - RNA, 20 nt, Homo sapiens
cucugcucuugcauaguaaa

SEQ ID NO: 488024 - RNA, 18 nt, Homo sapiens
cucuggcccuuugaauau

SEQ ID NO: 488025 - RNA, 23 nt, Homo sapiens
cucuggcucuaggacccccagug

SEQ ID NO: 488026 - RNA, 19 nt, Homo sapiens
cucugugaggaaagcacac

SEQ ID NO: 488027 - RNA, 19 nt, Homo sapiens
gaaaacuuuguuaggccaa

SEQ ID NO: 488028 - RNA, 22 nt, Homo sapiens
gaaaacuuuguuaggccaaaga

SEQ ID NO: 488029 - RNA, 21 nt, Homo sapiens
gaaaaggcuugagucuggaua

SEQ ID NO: 488030 - RNA, 15 nt, Homo sapiens
gaaaagggaucugcu

SEQ ID NO: 488031 - RNA, 21 nt, Homo sapiens
gaaaauaguggcaggacuguc

SEQ ID NO: 488032 - RNA, 15 nt, Homo sapiens
gaaaauccaucucau

SEQ ID NO: 488033 - RNA, 21 nt, Homo sapiens
gaaacauccuguuuugcaaau

SEQ ID NO: 488034 - RNA, 20 nt, Homo sapiens
gaaacccaaguuaugcaucc

SEQ ID NO: 488035 - RNA, 17 nt, Homo sapiens
gaaaccccaucucuacu

SEQ ID NO: 488036 - RNA, 16 nt, Homo sapiens
gaaacuaagaaucauc

SEQ ID NO: 488037 - RNA, 19 nt, Homo sapiens
gaaacugacuugcugugac

SEQ ID NO: 488038 - RNA, 12 nt, Homo sapiens
gaaagacaguaa

SEQ ID NO: 488039 - RNA, 15 nt, Homo sapiens
gaaagaguugcagua

SEQ ID NO: 488040 - RNA, 18 nt, Homo sapiens
gaaagggauugcuuugca

SEQ ID NO: 488041 - RNA, 12 nt, Homo sapiens
gaaauacauaug

SEQ ID NO: 488042 - RNA, 14 nt, Homo sapiens
gaaauaucugugaa

SEQ ID NO: 488043 - RNA, 14 nt, Homo sapiens
gaaauauucacaag

SEQ ID NO: 488044 - RNA, 21 nt, Homo sapiens
gaaaugcugauuuaaacuucu

SEQ ID NO: 488045 - RNA, 22 nt, Homo sapiens
gaaaugugugugaugugacauu

SEQ ID NO: 488046 - RNA, 22 nt, Homo sapiens
gaaauguugacuggccaaaaau

SEQ ID NO: 488047 - RNA, 17 nt, Homo sapiens
gaaauuauaucuguggu

SEQ ID NO: 488048 - RNA, 16 nt, Homo sapiens
gaacaaagagagcuca

SEQ ID NO: 488049 - RNA, 15 nt, Homo sapiens
gaacacacauuauua

SEQ ID NO: 488050 - RNA, 18 nt, Homo sapiens
gaacacuguuaggguaca

SEQ ID NO: 488051 - RNA, 20 nt, Homo sapiens
gaacagccguaacaggucaa

SEQ ID NO: 488052 - RNA, 20 nt, Homo sapiens
gaacaguaaagaaagcagaa

SEQ ID NO: 488053 - RNA, 19 nt, Homo sapiens
gaacauaaaaacuacugaa

SEQ ID NO: 488054 - RNA, 16 nt, Homo sapiens
gaaccaauucacuuua

SEQ ID NO: 488055 - RNA, 12 nt, Homo sapiens
gaacuaucuuca

SEQ ID NO: 488056 - RNA, 14 nt, Homo sapiens
gaacucaugugauu

SEQ ID NO: 488057 - RNA, 17 nt, Homo sapiens
gaacugaagcagaguca

SEQ ID NO: 488058 - RNA, 13 nt, Homo sapiens
gaacugcugcugg

SEQ ID NO: 488059 - RNA, 16 nt, Homo sapiens
gaacuguguacuguau

SEQ ID NO: 488060 - RNA, 16 nt, Homo sapiens
gaagaauggcuuucaa

SEQ ID NO: 488061 - RNA, 14 nt, Homo sapiens
gaagaccucaagaa

SEQ ID NO: 488062 - RNA, 18 nt, Homo sapiens
gaagagaguauggugcug

SEQ ID NO: 488063 - RNA, 12 nt, Homo sapiens
gaagagcauuug

SEQ ID NO: 488064 - RNA, 22 nt, Homo sapiens
gaagaugaauggucuggcaaua

SEQ ID NO: 488065 - RNA, 21 nt, Homo sapiens
gaaggaacccccucaccaccu

SEQ ID NO: 488066 - RNA, 14 nt, Homo sapiens
gaagggcaggaaau

SEQ ID NO: 488067 - RNA, 22 nt, Homo sapiens
gaagggccuucuccacagggac

SEQ ID NO: 488068 - RNA, 14 nt, Homo sapiens
gaaguggacuggag

SEQ ID NO: 488069 - RNA, 18 nt, Homo sapiens
gaagugguaggaaagccu

SEQ ID NO: 488070 - RNA, 14 nt, Homo sapiens
gaaguuuguuguuu

SEQ ID NO: 488071 - RNA, 14 nt, Homo sapiens
gaauaaaaugauua

SEQ ID NO: 488072 - RNA, 16 nt, Homo sapiens
gaauaacaacugcugg

SEQ ID NO: 488073 - RNA, 24 nt, Homo sapiens
gaauacuguauuguuacagcugaa

SEQ ID NO: 488074 - RNA, 14 nt, Homo sapiens
gaauagacauaaau

SEQ ID NO: 488075 - RNA, 15 nt, Homo sapiens
gaauggggcaauaac

SEQ ID NO: 488076 - RNA, 13 nt, Homo sapiens
gaauggucuuucu

SEQ ID NO: 488077 - RNA, 21 nt, Homo sapiens
gaauugagcuagaaaucacaa

SEQ ID NO: 488078 - RNA, 11 nt, Homo sapiens
gaauugcacau

SEQ ID NO: 488079 - RNA, 18 nt, Homo sapiens
gaauugguuuaaacuuuu

SEQ ID NO: 488080 - RNA, 17 nt, Homo sapiens
gaauuugcuuagccuuu

SEQ ID NO: 488081 - RNA, 18 nt, Homo sapiens
gacaaauaguaggcaaga

SEQ ID NO: 488082 - RNA, 12 nt, Homo sapiens
gacaaguaucau

SEQ ID NO: 488083 - RNA, 19 nt, Homo sapiens
gacaagugacuuauuugcu

SEQ ID NO: 488084 - RNA, 23 nt, Homo sapiens
gacagacgccugcuuuugcaaau

SEQ ID NO: 488085 - RNA, 19 nt, Homo sapiens
gacagauguggacaugcac

SEQ ID NO: 488086 - RNA, 22 nt, Homo sapiens
gacagcauuacacgccacaacu

SEQ ID NO: 488087 - RNA, 17 nt, Homo sapiens
gacaugaaauaaaugcc

SEQ ID NO: 488088 - RNA, 21 nt, Homo sapiens
gacauuaugugugcaugugug

SEQ ID NO: 488089 - RNA, 11 nt, Homo sapiens
gacauuccaau

SEQ ID NO: 488090 - RNA, 20 nt, Homo sapiens
gaccaagacuuuugucugau

SEQ ID NO: 488091 - RNA, 23 nt, Homo sapiens
gaccauggagggggcuugcacuc

SEQ ID NO: 488092 - RNA, 15 nt, Homo sapiens
gaccauuucucugca

SEQ ID NO: 488093 - RNA, 12 nt, Homo sapiens
gacccaugaccg

SEQ ID NO: 488094 - RNA, 18 nt, Homo sapiens
gacccugaggguuuccac

SEQ ID NO: 488095 - RNA, 12 nt, Homo sapiens
gaccuagggccu

SEQ ID NO: 488096 - RNA, 23 nt, Homo sapiens
gaccuccaccugggagaugcugg

SEQ ID NO: 488097 - RNA, 19 nt, Homo sapiens
gaccucccugucucuacaa

SEQ ID NO: 488098 - RNA, 12 nt, Homo sapiens
gacgcacuguau

SEQ ID NO: 488099 - RNA, 20 nt, Homo sapiens
gcuaaaauaaaccagacuca

SEQ ID NO: 488100 - RNA, 21 nt, Homo sapiens
gcuaaacccuucaacuaugca

SEQ ID NO: 488101 - RNA, 14 nt, Homo sapiens
gcuaagccugauga

SEQ ID NO: 488102 - RNA, 20 nt, Homo sapiens
gcuaauccaggacagcauua

SEQ ID NO: 488103 - RNA, 13 nt, Homo sapiens
gcuaccaaaaacu

SEQ ID NO: 488104 - RNA, 20 nt, Homo sapiens
gcuagaaagagaaaaagccc

SEQ ID NO: 488105 - RNA, 23 nt, Homo sapiens
gcuaggagauacucuucugccuc

SEQ ID NO: 488106 - RNA, 13 nt, Homo sapiens
gcuauuugcaaac

SEQ ID NO: 488107 - RNA, 20 nt, Homo sapiens
gcuccuuuauuauaaucaaa

SEQ ID NO: 488108 - RNA, 15 nt, Homo sapiens
gcugaaacucauuug

SEQ ID NO: 488109 - RNA, 15 nt, Homo sapiens
gcugaaagacaguaa

SEQ ID NO: 488110 - RNA, 17 nt, Homo sapiens
gcugagcuugugccuug

SEQ ID NO: 488111 - RNA, 13 nt, Homo sapiens
gcugcacugcccu

SEQ ID NO: 488112 - RNA, 21 nt, Homo sapiens
gcugccccaccccuccaugau

SEQ ID NO: 488113 - RNA, 22 nt, Homo sapiens
gcugccucaggaaucuccugac

SEQ ID NO: 488114 - RNA, 16 nt, Homo sapiens
gcugcucccuuuauca

SEQ ID NO: 488115 - RNA, 19 nt, Homo sapiens
gcugcucccuuuaucaugu

SEQ ID NO: 488116 - RNA, 15 nt, Homo sapiens
gcugcugcacugccc

SEQ ID NO: 488117 - RNA, 21 nt, Homo sapiens
gcuggcauuugcugcauuuca

SEQ ID NO: 488118 - RNA, 14 nt, Homo sapiens
gcugggcagcuguu

SEQ ID NO: 488119 - RNA, 21 nt, Homo sapiens
gcugggccuucggggugagcc

SEQ ID NO: 488120 - RNA, 15 nt, Homo sapiens
gcuggguuauucaga

SEQ ID NO: 488121 - RNA, 10 nt, Homo sapiens
gcuggugggg

SEQ ID NO: 488122 - RNA, 21 nt, Homo sapiens
gcuggugggggcauccuugag

SEQ ID NO: 488123 - RNA, 11 nt, Homo sapiens
gcugugcucuc

SEQ ID NO: 488124 - RNA, 16 nt, Homo sapiens
gcuuacuaaugcugcc

SEQ ID NO: 488125 - RNA, 21 nt, Homo sapiens
gcuucaccagagcauuuccaa

SEQ ID NO: 488126 - RNA, 23 nt, Homo sapiens
gcuuccagaugauccuugcacag

SEQ ID NO: 488127 - RNA, 17 nt, Homo sapiens
gcuuuacucugaauuuc

SEQ ID NO: 488128 - RNA, 20 nt, Homo sapiens
gcuuuagaauguuuuccuuc

SEQ ID NO: 488129 - RNA, 22 nt, Homo sapiens
gcuuucuuuaaaguucuucuaa

SEQ ID NO: 488130 - RNA, 14 nt, Homo sapiens
gcuuugccacugaa

SEQ ID NO: 488131 - RNA, 23 nt, Homo sapiens
gcuuugugcuuguucuuccucuu

SEQ ID NO: 488132 - RNA, 17 nt, Homo sapiens
gcuuuuccaacccauga

SEQ ID NO: 488133 - RNA, 20 nt, Homo sapiens
ggaaacucggcagcccuucc

SEQ ID NO: 488134 - RNA, 19 nt, Homo sapiens
ggaaagccucacugauaua

SEQ ID NO: 488135 - RNA, 16 nt, Homo sapiens
ggaaauaucugugaag

SEQ ID NO: 488136 - RNA, 16 nt, Homo sapiens
ggaaaucugaauguau

SEQ ID NO: 488137 - RNA, 19 nt, Homo sapiens
ggaaaugauugagagcagc

SEQ ID NO: 488138 - RNA, 13 nt, Homo sapiens
ggaacacaugcac

SEQ ID NO: 488139 - RNA, 23 nt, Homo sapiens
ggaagacaaauacacauacauau

SEQ ID NO: 488140 - RNA, 18 nt, Homo sapiens
ggaaguuuaaacauuucu

SEQ ID NO: 488141 - RNA, 16 nt, Homo sapiens
ggaauaagaagcaaau

SEQ ID NO: 488142 - RNA, 14 nt, Homo sapiens
ggacacuugauauu

SEQ ID NO: 488143 - RNA, 16 nt, Homo sapiens
ggacuuauccaugcau

SEQ ID NO: 488144 - RNA, 18 nt, Homo sapiens
ggagacacuggucucaga

SEQ ID NO: 488145 - RNA, 14 nt, Homo sapiens
ggagagaucuccaa

SEQ ID NO: 488146 - RNA, 21 nt, Homo sapiens
ggagaggauggcccaggguga

SEQ ID NO: 488147 - RNA, 14 nt, Homo sapiens
ggagcugcuuccag

SEQ ID NO: 488148 - RNA, 23 nt, Homo sapiens
ggaggggugguacuuggcaccaa

SEQ ID NO: 488149 - RNA, 16 nt, Homo sapiens
ggagucagcuguuucu

SEQ ID NO: 488150 - RNA, 22 nt, Homo sapiens
ggauaaauuuuugguggugaua

SEQ ID NO: 488151 - RNA, 19 nt, Homo sapiens
ggauauguuuucacuguau

SEQ ID NO: 488152 - RNA, 22 nt, Homo sapiens
ggaucacucaccauucccagau

SEQ ID NO: 488153 - RNA, 20 nt, Homo sapiens
ggauccagcuucacugucau

SEQ ID NO: 488154 - RNA, 12 nt, Homo sapiens
ggaugguggugc

SEQ ID NO: 488155 - RNA, 22 nt, Homo sapiens
ggauguauguguauauguuuau

SEQ ID NO: 488156 - RNA, 19 nt, Homo sapiens
ggauuuguccuuggggaca

SEQ ID NO: 488157 - RNA, 20 nt, Homo sapiens
ggcaccuauaauaccagcua

SEQ ID NO: 488158 - RNA, 15 nt, Homo sapiens
ggcagaaaauuacau

SEQ ID NO: 488159 - RNA, 20 nt, Homo sapiens
ggcaggagaaucgcuugaac

SEQ ID NO: 488160 - RNA, 14 nt, Homo sapiens
ggcauuucaggaag

SEQ ID NO: 488161 - RNA, 22 nt, Homo sapiens
ggccagggcucuggcagguggc

SEQ ID NO: 488162 - RNA, 16 nt, Homo sapiens
ggccagugacauuuca

SEQ ID NO: 488163 - RNA, 19 nt, Homo sapiens
ggcccaccaaggacagcua

SEQ ID NO: 488164 - RNA, 20 nt, Homo sapiens
ggcccagaggggcggggcca

SEQ ID NO: 488165 - RNA, 23 nt, Homo sapiens
ggcccaggagcgcagcugcauuu

SEQ ID NO: 488166 - RNA, 19 nt, Homo sapiens
ggcccuggggccuguacaa

SEQ ID NO: 488167 - RNA, 11 nt, Homo sapiens
ggccugaccuc

SEQ ID NO: 488168 - RNA, 14 nt, Homo sapiens
ggccuggggcugcc

SEQ ID NO: 488169 - RNA, 17 nt, Homo sapiens
ggcgaaucacgagguca

SEQ ID NO: 488170 - RNA, 14 nt, Homo sapiens
ggcgucaccaucca

SEQ ID NO: 488171 - RNA, 17 nt, Homo sapiens
aagggaccuucgugcaa

SEQ ID NO: 488172 - RNA, 16 nt, Homo sapiens
aagggacguccuccaa

SEQ ID NO: 488173 - RNA, 23 nt, Homo sapiens
aagggauugcuuugcauuacugu

SEQ ID NO: 488174 - RNA, 17 nt, Homo sapiens
aagggugcccaccucuu

SEQ ID NO: 488175 - RNA, 21 nt, Homo sapiens
aagguacgaguagagguuuaa

SEQ ID NO: 488176 - RNA, 16 nt, Homo sapiens
aaggugaugugauuca

SEQ ID NO: 488177 - RNA, 15 nt, Homo sapiens
aaguaagacuugauu

SEQ ID NO: 488178 - RNA, 18 nt, Homo sapiens
aaguacaggucaucugcu

SEQ ID NO: 488179 - RNA, 22 nt, Homo sapiens
aaguagacuucauuuuuccuaa

SEQ ID NO: 488180 - RNA, 20 nt, Homo sapiens
aaguagcaaaaaaguacaaa

SEQ ID NO: 488181 - RNA, 19 nt, Homo sapiens
aagucaccacuccauuccc

SEQ ID NO: 488182 - RNA, 21 nt, Homo sapiens
aagucaccacuccauucccaa

SEQ ID NO: 488183 - RNA, 20 nt, Homo sapiens
aaguccuaguuguucagcau

SEQ ID NO: 488184 - RNA, 16 nt, Homo sapiens
aagucuccuguaucau

SEQ ID NO: 488185 - RNA, 17 nt, Homo sapiens
aagucuugaaaacagug

SEQ ID NO: 488186 - RNA, 19 nt, Homo sapiens
aagucuugugugugagugu

SEQ ID NO: 488187 - RNA, 14 nt, Homo sapiens
aaguggacuguauu

SEQ ID NO: 488188 - RNA, 15 nt, Homo sapiens
aaguucuucuaagcu

SEQ ID NO: 488189 - RNA, 22 nt, Homo sapiens
aaguuuucaccuaucuggaaaa

SEQ ID NO: 488190 - RNA, 19 nt, Homo sapiens
aaguuuugccuauccuaag

SEQ ID NO: 488191 - RNA, 20 nt, Homo sapiens
aauaaaaagugacacagcag

SEQ ID NO: 488192 - RNA, 18 nt, Homo sapiens
aauaaaauuccuaucuca

SEQ ID NO: 488193 - RNA, 22 nt, Homo sapiens
aauaaagucugucaugccaaaa

SEQ ID NO: 488194 - RNA, 15 nt, Homo sapiens
aauaauaaagcauuu

SEQ ID NO: 488195 - RNA, 18 nt, Homo sapiens
aauacaugaugauuucag

SEQ ID NO: 488196 - RNA, 21 nt, Homo sapiens
aauacuucuuaaaaugugcua

SEQ ID NO: 488197 - RNA, 23 nt, Homo sapiens
aauacuucuuaaaaugugcuauu

SEQ ID NO: 488198 - RNA, 19 nt, Homo sapiens
aauagaaaaauuguaauag

SEQ ID NO: 488199 - RNA, 23 nt, Homo sapiens
aauaguaaaggaaagcaguguug

SEQ ID NO: 488200 - RNA, 17 nt, Homo sapiens
aauaguguguccaugca

SEQ ID NO: 488201 - RNA, 14 nt, Homo sapiens
aauauaaagcaucu

SEQ ID NO: 488202 - RNA, 22 nt, Homo sapiens
aauauauagcauuuaugguaau

SEQ ID NO: 488203 - RNA, 17 nt, Homo sapiens
aauauauauacauaugu

SEQ ID NO: 488204 - RNA, 13 nt, Homo sapiens
aauaucugugaag

SEQ ID NO: 488205 - RNA, 15 nt, Homo sapiens
aauauuauuugcuaa

SEQ ID NO: 488206 - RNA, 17 nt, Homo sapiens
aaucaauguucacgcaa

SEQ ID NO: 488207 - RNA, 23 nt, Homo sapiens
aaucacacucucuucuuacugua

SEQ ID NO: 488208 - RNA, 20 nt, Homo sapiens
aaucaccuaauuaauuucag

SEQ ID NO: 488209 - RNA, 23 nt, Homo sapiens
aauccaugugcugcuguggcauc

SEQ ID NO: 488210 - RNA, 21 nt, Homo sapiens
aauccauuuacagcauacuua

SEQ ID NO: 488211 - RNA, 18 nt, Homo sapiens
aaucuucagcauguucuc

SEQ ID NO: 488212 - RNA, 19 nt, Homo sapiens
aaucuucagcauguucuca

SEQ ID NO: 488213 - RNA, 13 nt, Homo sapiens
aaucuugaacuuu

SEQ ID NO: 488214 - RNA, 22 nt, Homo sapiens
aaucuuuccuuccucucauccu

SEQ ID NO: 488215 - RNA, 19 nt, Homo sapiens
aaugacuuuuauaacauuu

SEQ ID NO: 488216 - RNA, 20 nt, Homo sapiens
aaugagauuuacuuacaccc

SEQ ID NO: 488217 - RNA, 20 nt, Homo sapiens
aaugaguucccuugauucaa

SEQ ID NO: 488218 - RNA, 17 nt, Homo sapiens
aaugcacauccauuccc

SEQ ID NO: 488219 - RNA, 14 nt, Homo sapiens
aaugguaacuuuac

SEQ ID NO: 488220 - RNA, 20 nt, Homo sapiens
aaugguaacuuuacaacugg

SEQ ID NO: 488221 - RNA, 18 nt, Homo sapiens
aauguacccagccuacca

SEQ ID NO: 488222 - RNA, 18 nt, Homo sapiens
aauguauagacucagugc

SEQ ID NO: 488223 - RNA, 22 nt, Homo sapiens
aauguauagacucagugcacau

SEQ ID NO: 488224 - RNA, 21 nt, Homo sapiens
aauguaucugugugugauuug

SEQ ID NO: 488225 - RNA, 21 nt, Homo sapiens
aaugucucuucauaauacuuu

SEQ ID NO: 488226 - RNA, 15 nt, Homo sapiens
aauguucauggacua

SEQ ID NO: 488227 - RNA, 17 nt, Homo sapiens
aauguugaaacugacuu

SEQ ID NO: 488228 - RNA, 22 nt, Homo sapiens
aauguugaagaacucaugugau

SEQ ID NO: 488229 - RNA, 20 nt, Homo sapiens
aauguugauuucuaguuauu

SEQ ID NO: 488230 - RNA, 21 nt, Homo sapiens
aauuaaaaaguuaaucuucau

SEQ ID NO: 488231 - RNA, 18 nt, Homo sapiens
aauuaaagugaggagaaa

SEQ ID NO: 488232 - RNA, 19 nt, Homo sapiens
aauuaauuugugcaucaga

SEQ ID NO: 488233 - RNA, 22 nt, Homo sapiens
aauuccaaguagaauugauuuc

SEQ ID NO: 488234 - RNA, 15 nt, Homo sapiens
aauuccaaucauugu

SEQ ID NO: 488235 - RNA, 19 nt, Homo sapiens
aauucuaaugguaacuuuu

SEQ ID NO: 488236 - RNA, 16 nt, Homo sapiens
aauugcaaaacccaac

SEQ ID NO: 488237 - RNA, 20 nt, Homo sapiens
aauuggcugccaagagucca

SEQ ID NO: 488238 - RNA, 20 nt, Homo sapiens
aauugucuuuugucaugugg

SEQ ID NO: 488239 - RNA, 16 nt, Homo sapiens
aauuucuugcaauuug

SEQ ID NO: 488240 - RNA, 22 nt, Homo sapiens
aauuugggaacauaaaaacuac

SEQ ID NO: 488241 - RNA, 17 nt, Homo sapiens
aauuuuaucucuucuuc

SEQ ID NO: 488242 - RNA, 18 nt, Homo sapiens
aauuuuauugcuggaauc

SEQ ID NO: 488243 - RNA, 15 nt, Homo sapiens
acaaaauuacuuaca

SEQ ID NO: 488244 - RNA, 21 nt, Homo sapiens
acaaacaauuaacugagcaua

SEQ ID NO: 488245 - RNA, 14 nt, Homo sapiens
acaaacccuuuaaa

SEQ ID NO: 488246 - RNA, 14 nt, Homo sapiens
acaaagaaauauua

SEQ ID NO: 488247 - RNA, 21 nt, Homo sapiens
acaaauccaacgcuuuuccca

SEQ ID NO: 488248 - RNA, 22 nt, Homo sapiens
acaaauggcuuguucagucacu

SEQ ID NO: 488249 - RNA, 18 nt, Homo sapiens
acaacauccauguccuau

SEQ ID NO: 488250 - RNA, 19 nt, Homo sapiens
acaagugacuuauuugcuc

SEQ ID NO: 488251 - RNA, 13 nt, Homo sapiens
acaauaagccacu

SEQ ID NO: 488252 - RNA, 16 nt, Homo sapiens
acaaucagaccaagga

SEQ ID NO: 488253 - RNA, 18 nt, Homo sapiens
acaaucaugaacagcucu

SEQ ID NO: 488254 - RNA, 21 nt, Homo sapiens
acaauuuucagauuugcacaa

SEQ ID NO: 488255 - RNA, 12 nt, Homo sapiens
acacaacugugg

SEQ ID NO: 488256 - RNA, 14 nt, Homo sapiens
acacacacacauau

SEQ ID NO: 488257 - RNA, 14 nt, Homo sapiens
acacacacauauau

SEQ ID NO: 488258 - RNA, 17 nt, Homo sapiens
acacacaccucauguga

SEQ ID NO: 488259 - RNA, 15 nt, Homo sapiens
acacaccucauguga

SEQ ID NO: 488260 - RNA, 12 nt, Homo sapiens
acacacuugacc

SEQ ID NO: 488261 - RNA, 17 nt, Homo sapiens
acacagcugcagagaca

SEQ ID NO: 488262 - RNA, 16 nt, Homo sapiens
acacauauauacauac

SEQ ID NO: 488263 - RNA, 17 nt, Homo sapiens
acacauugaaacuguau

SEQ ID NO: 488264 - RNA, 22 nt, Homo sapiens
acaccacuuucccacacuguga

SEQ ID NO: 488265 - RNA, 12 nt, Homo sapiens
acaccuucaucc

SEQ ID NO: 488266 - RNA, 14 nt, Homo sapiens
acacgccacaacuc

SEQ ID NO: 488267 - RNA, 18 nt, Homo sapiens
acacgccacaacuccagu

SEQ ID NO: 488268 - RNA, 21 nt, Homo sapiens
acacucaucagguaaacugau

SEQ ID NO: 488269 - RNA, 21 nt, Homo sapiens
acacugaguucuaucaguuau

SEQ ID NO: 488270 - RNA, 22 nt, Homo sapiens
acacugaguucuaucaguuauc

SEQ ID NO: 488271 - RNA, 21 nt, Homo sapiens
acacugugaacuaaugacaag

SEQ ID NO: 488272 - RNA, 15 nt, Homo sapiens
acagaaaacgguuaa

SEQ ID NO: 488273 - RNA, 16 nt, Homo sapiens
acagaaaagaaauuag

SEQ ID NO: 488274 - RNA, 18 nt, Homo sapiens
acagaaauauauauacau

SEQ ID NO: 488275 - RNA, 20 nt, Homo sapiens
acagaauacuagccagagcu

SEQ ID NO: 488276 - RNA, 19 nt, Homo sapiens
acagacaaccuaccuucuu

SEQ ID NO: 488277 - RNA, 14 nt, Homo sapiens
accaaggaacaaga

SEQ ID NO: 488278 - RNA, 15 nt, Homo sapiens
accagcaacauuaua

SEQ ID NO: 488279 - RNA, 19 nt, Homo sapiens
accauaaaucaauucauug

SEQ ID NO: 488280 - RNA, 16 nt, Homo sapiens
acccaaagcacaugcu

SEQ ID NO: 488281 - RNA, 18 nt, Homo sapiens
acccaacgacccaugacc

SEQ ID NO: 488282 - RNA, 19 nt, Homo sapiens
acccaugaccguucucuga

SEQ ID NO: 488283 - RNA, 17 nt, Homo sapiens
acccaugagugcuaaga

SEQ ID NO: 488284 - RNA, 22 nt, Homo sapiens
acccgcauguacaaaaacacaa

SEQ ID NO: 488285 - RNA, 12 nt, Homo sapiens
acccuacagcag

SEQ ID NO: 488286 - RNA, 13 nt, Homo sapiens
acccuacagcaga

SEQ ID NO: 488287 - RNA, 21 nt, Homo sapiens
acccuagggauuugcacuaaa

SEQ ID NO: 488288 - RNA, 15 nt, Homo sapiens
acccuaucaucaguu

SEQ ID NO: 488289 - RNA, 20 nt, Homo sapiens
acccuauucuauccaucucc

SEQ ID NO: 488290 - RNA, 14 nt, Homo sapiens
acccucccaaaaca

SEQ ID NO: 488291 - RNA, 22 nt, Homo sapiens
acccucgauguucauggaauug

SEQ ID NO: 488292 - RNA, 13 nt, Homo sapiens
acccugugaaaug

SEQ ID NO: 488293 - RNA, 12 nt, Homo sapiens
accgaaggugac

SEQ ID NO: 488294 - RNA, 14 nt, Homo sapiens
accgaaggugacag

SEQ ID NO: 488295 - RNA, 23 nt, Homo sapiens
accuauaauguguguauguguau

SEQ ID NO: 488296 - RNA, 17 nt, Homo sapiens
accuaugugugugcuuu

SEQ ID NO: 488297 - RNA, 16 nt, Homo sapiens
accucagacacucuga

SEQ ID NO: 488298 - RNA, 14 nt, Homo sapiens
accuccaacuggau

SEQ ID NO: 488299 - RNA, 19 nt, Homo sapiens
accuccccugguccugcac

SEQ ID NO: 488300 - RNA, 24 nt, Homo sapiens
accuccccugguccugcacugucc

SEQ ID NO: 488301 - RNA, 16 nt, Homo sapiens
accuccgccauccacc

SEQ ID NO: 488302 - RNA, 16 nt, Homo sapiens
accuccuccuccaguu

SEQ ID NO: 488303 - RNA, 20 nt, Homo sapiens
accucugugaggaaagcaca

SEQ ID NO: 488304 - RNA, 17 nt, Homo sapiens
accucuucuuucccucc

SEQ ID NO: 488305 - RNA, 23 nt, Homo sapiens
accucuuuggauguuuuccccaa

SEQ ID NO: 488306 - RNA, 20 nt, Homo sapiens
accucuuuucauggaguaga

SEQ ID NO: 488307 - RNA, 13 nt, Homo sapiens
accugaacaaacc

SEQ ID NO: 488308 - RNA, 22 nt, Homo sapiens
accugacuuuggagacgaugcu

SEQ ID NO: 488309 - RNA, 18 nt, Homo sapiens
accugcacaaacauagac

SEQ ID NO: 488310 - RNA, 12 nt, Homo sapiens
accugcucugcu

SEQ ID NO: 488311 - RNA, 19 nt, Homo sapiens
accuggguaacaaagugag

SEQ ID NO: 488312 - RNA, 15 nt, Homo sapiens
accuguaauagccuc

SEQ ID NO: 488313 - RNA, 13 nt, Homo sapiens
accuguagcuuug

SEQ ID NO: 488314 - RNA, 23 nt, Homo sapiens
accuguucacgugacuccucaau

SEQ ID NO: 488315 - RNA, 12 nt, Homo sapiens
accuugcugcua

SEQ ID NO: 488316 - RNA, 20 nt, Homo sapiens
acgcacacacacgcaaauac

SEQ ID NO: 488317 - RNA, 23 nt, Homo sapiens
acgcacccacacccuacagcaga

SEQ ID NO: 488318 - RNA, 18 nt, Homo sapiens
acgcucugcugugggcac

SEQ ID NO: 488319 - RNA, 20 nt, Homo sapiens
acgcugugucccucaauuac

SEQ ID NO: 488320 - RNA, 20 nt, Homo sapiens
acgguuucuuuguuacuuua

SEQ ID NO: 488321 - RNA, 13 nt, Homo sapiens
acgugacuccuca

SEQ ID NO: 488322 - RNA, 17 nt, Homo sapiens
acgugggcggcagagag

SEQ ID NO: 488323 - RNA, 15 nt, Homo sapiens
acguggggcagcaca

SEQ ID NO: 488324 - RNA, 19 nt, Homo sapiens
acguguguccuuugguacu

SEQ ID NO: 488325 - RNA, 12 nt, Homo sapiens
acuaaacauuuc

SEQ ID NO: 488326 - RNA, 17 nt, Homo sapiens
acuaaucgaaugaacaa

SEQ ID NO: 488327 - RNA, 15 nt, Homo sapiens
acuaaugacaaguga

SEQ ID NO: 488328 - RNA, 18 nt, Homo sapiens
acuacaggccccacaccu

SEQ ID NO: 488329 - RNA, 16 nt, Homo sapiens
acuaccaagcagcuca

SEQ ID NO: 488330 - RNA, 16 nt, Homo sapiens
acuacgacuggcaucu

SEQ ID NO: 488331 - RNA, 18 nt, Homo sapiens
acuauauguuuacacaau

SEQ ID NO: 488332 - RNA, 18 nt, Homo sapiens
acuauuucugaacaaaga

SEQ ID NO: 488333 - RNA, 18 nt, Homo sapiens
acucaaggccuccagcca

SEQ ID NO: 488334 - RNA, 18 nt, Homo sapiens
acucccugucauaguuac

SEQ ID NO: 488335 - RNA, 21 nt, Homo sapiens
acuccuuaggcuuuguugaau

SEQ ID NO: 488336 - RNA, 16 nt, Homo sapiens
acucuaaaacuaucag

SEQ ID NO: 488337 - RNA, 19 nt, Homo sapiens
acucuaaaacuaucagcag

SEQ ID NO: 488338 - RNA, 14 nt, Homo sapiens
acucuacuaaugcc

SEQ ID NO: 488339 - RNA, 18 nt, Homo sapiens
acucucuucuuacuguau

SEQ ID NO: 488340 - RNA, 14 nt, Homo sapiens
acucugaauuccaa

SEQ ID NO: 488341 - RNA, 14 nt, Homo sapiens
acucugcucuugca

SEQ ID NO: 488342 - RNA, 17 nt, Homo sapiens
acucuucucucugcucu

SEQ ID NO: 488343 - RNA, 19 nt, Homo sapiens
acugaagcuuaaccgaaga

SEQ ID NO: 488344 - RNA, 22 nt, Homo sapiens
acugaaucuucagcauguucuc

SEQ ID NO: 488345 - RNA, 23 nt, Homo sapiens
acugaaucuucagcauguucuca

SEQ ID NO: 488346 - RNA, 20 nt, Homo sapiens
acugacacaagaauggucuu

SEQ ID NO: 488347 - RNA, 16 nt, Homo sapiens
acugauuaacucaguc

SEQ ID NO: 488348 - RNA, 19 nt, Homo sapiens
acugcgagguuguuuuaaa

SEQ ID NO: 488349 - RNA, 23 nt, Homo sapiens
acugcguaggagagaacagggau

SEQ ID NO: 488350 - RNA, 16 nt, Homo sapiens
acugcuguaaagcaaa

SEQ ID NO: 488351 - RNA, 21 nt, Homo sapiens
acugcuuugagaaaucucauc

SEQ ID NO: 488352 - RNA, 21 nt, Homo sapiens
acuggaauaagaagcaaauaa

SEQ ID NO: 488353 - RNA, 13 nt, Homo sapiens
acuggccaaaaau

SEQ ID NO: 488354 - RNA, 16 nt, Homo sapiens
acuggggaaagugcau

SEQ ID NO: 488355 - RNA, 18 nt, Homo sapiens
acuggggaaagugcauuu

SEQ ID NO: 488356 - RNA, 18 nt, Homo sapiens
acuguaguucacuguaga

SEQ ID NO: 488357 - RNA, 17 nt, Homo sapiens
acuguauuuacuuguua

SEQ ID NO: 488358 - RNA, 21 nt, Homo sapiens
acugucuccacccaccuugac

SEQ ID NO: 488359 - RNA, 15 nt, Homo sapiens
acuguggccucagga

SEQ ID NO: 488360 - RNA, 22 nt, Homo sapiens
acuguggucccagcuacagggg

SEQ ID NO: 488361 - RNA, 18 nt, Homo sapiens
acuguugacauccaagcu

SEQ ID NO: 488362 - RNA, 23 nt, Homo sapiens
acuguuuauuaccagauucacuu

SEQ ID NO: 488363 - RNA, 18 nt, Homo sapiens
acuguuucaguagccaau

SEQ ID NO: 488364 - RNA, 20 nt, Homo sapiens
acuuagaauccgaagggaau

SEQ ID NO: 488365 - RNA, 17 nt, Homo sapiens
acuuauccaugcaucac

SEQ ID NO: 488366 - RNA, 15 nt, Homo sapiens
acuucacacacaccu

SEQ ID NO: 488367 - RNA, 13 nt, Homo sapiens
acuucacugagaa

SEQ ID NO: 488368 - RNA, 17 nt, Homo sapiens
acuucugacccugugaa

SEQ ID NO: 488369 - RNA, 21 nt, Homo sapiens
acuucuuaacuggcaacaguu

SEQ ID NO: 488370 - RNA, 23 nt, Homo sapiens
acuuguaagaaaaugagacaaaa

SEQ ID NO: 488371 - RNA, 22 nt, Homo sapiens
acuuuagguaguagaaucucag

SEQ ID NO: 488372 - RNA, 19 nt, Homo sapiens
acuuucccacacugugaac

SEQ ID NO: 488373 - RNA, 23 nt, Homo sapiens
acuuuguauuuguucaguaugca

SEQ ID NO: 488374 - RNA, 19 nt, Homo sapiens
acuuuguuucauauucuca

SEQ ID NO: 488375 - RNA, 16 nt, Homo sapiens
agaaaaugagacaaaa

SEQ ID NO: 488376 - RNA, 23 nt, Homo sapiens
agaaacccggcuuccugugcuaa

SEQ ID NO: 488377 - RNA, 13 nt, Homo sapiens
agaaacugugguc

SEQ ID NO: 488378 - RNA, 22 nt, Homo sapiens
agaaagaacuaucuucaucuga

SEQ ID NO: 488379 - RNA, 22 nt, Homo sapiens
agaaagccagucuuaacauuuc

SEQ ID NO: 488380 - RNA, 15 nt, Homo sapiens
agaaaggggcuagca

SEQ ID NO: 488381 - RNA, 19 nt, Homo sapiens
agaaaggggcuagcacugg

SEQ ID NO: 488382 - RNA, 19 nt, Homo sapiens
agaaaguguucuguuacaa

SEQ ID NO: 488383 - RNA, 13 nt, Homo sapiens
aguugcacacuca

SEQ ID NO: 488384 - RNA, 21 nt, Homo sapiens
aguugguuaccuauugcugua

SEQ ID NO: 488385 - RNA, 13 nt, Homo sapiens
aguuuaaugauua

SEQ ID NO: 488386 - RNA, 19 nt, Homo sapiens
aguuuccaaguuuauugcc

SEQ ID NO: 488387 - RNA, 22 nt, Homo sapiens
aguuucuuuuauuuucauuucu

SEQ ID NO: 488388 - RNA, 15 nt, Homo sapiens
auaaaaacuacugaa

SEQ ID NO: 488389 - RNA, 18 nt, Homo sapiens
auaaaacuguggcacuuu

SEQ ID NO: 488390 - RNA, 21 nt, Homo sapiens
auaaaaguuaauaacagcucc

SEQ ID NO: 488391 - RNA, 11 nt, Homo sapiens
auaaaauuccu

SEQ ID NO: 488392 - RNA, 16 nt, Homo sapiens
auaaaauuccuaucuc

SEQ ID NO: 488393 - RNA, 18 nt, Homo sapiens
auaaaauuccuaucucau

SEQ ID NO: 488394 - RNA, 17 nt, Homo sapiens
auaaacagaacucccuu

SEQ ID NO: 488395 - RNA, 12 nt, Homo sapiens
auaaagcauuua

SEQ ID NO: 488396 - RNA, 23 nt, Homo sapiens
auaaagccuugugaucacuuucu

SEQ ID NO: 488397 - RNA, 15 nt, Homo sapiens
auaaagcucucugua

SEQ ID NO: 488398 - RNA, 20 nt, Homo sapiens
auaaauauacucaaguuuca

SEQ ID NO: 488399 - RNA, 18 nt, Homo sapiens
auaaauucagaauuaacu

SEQ ID NO: 488400 - RNA, 19 nt, Homo sapiens
auaaccacccuagcuuuau

SEQ ID NO: 488401 - RNA, 16 nt, Homo sapiens
auaacuauugcugcuu

SEQ ID NO: 488402 - RNA, 19 nt, Homo sapiens
auaacuuacaagacuguaa

SEQ ID NO: 488403 - RNA, 13 nt, Homo sapiens
auaagaagcaaau

SEQ ID NO: 488404 - RNA, 12 nt, Homo sapiens
auaaugccuuau

SEQ ID NO: 488405 - RNA, 14 nt, Homo sapiens
auaauguauuuuca

SEQ ID NO: 488406 - RNA, 17 nt, Homo sapiens
auaauugacugguggaa

SEQ ID NO: 488407 - RNA, 20 nt, Homo sapiens
auacaagucccguucuguag

SEQ ID NO: 488408 - RNA, 15 nt, Homo sapiens
auacacuuuauuaau

SEQ ID NO: 488409 - RNA, 18 nt, Homo sapiens
auacauacacuuguauaa

SEQ ID NO: 488410 - RNA, 19 nt, Homo sapiens
auacauauguagacuauau

SEQ ID NO: 488411 - RNA, 17 nt, Homo sapiens
auacauguguguauaua

SEQ ID NO: 488412 - RNA, 20 nt, Homo sapiens
auacauguuguaaauggcau

SEQ ID NO: 488413 - RNA, 21 nt, Homo sapiens
auacauuaagccucuugucua

SEQ ID NO: 488414 - RNA, 13 nt, Homo sapiens
auaccaacuuuag

SEQ ID NO: 488415 - RNA, 17 nt, Homo sapiens
auacgcaauuguauaua

SEQ ID NO: 488416 - RNA, 22 nt, Homo sapiens
auacggaaguaaaccugaacaa

SEQ ID NO: 488417 - RNA, 15 nt, Homo sapiens
auacuagauguuaag

SEQ ID NO: 488418 - RNA, 16 nt, Homo sapiens
auacuuaaggucauau

SEQ ID NO: 488419 - RNA, 20 nt, Homo sapiens
auacuucuuaaaaugugcua

SEQ ID NO: 488420 - RNA, 14 nt, Homo sapiens
auacuuucagucaa

SEQ ID NO: 488421 - RNA, 22 nt, Homo sapiens
auagacagauguggacaugcac

SEQ ID NO: 488422 - RNA, 18 nt, Homo sapiens
auagauaccauuuugaaa

SEQ ID NO: 488423 - RNA, 18 nt, Homo sapiens
auagccucaccuucccua

SEQ ID NO: 488424 - RNA, 17 nt, Homo sapiens
auagcuuaagaaguauc

SEQ ID NO: 488425 - RNA, 19 nt, Homo sapiens
auaggaaaagaaucuccuu

SEQ ID NO: 488426 - RNA, 16 nt, Homo sapiens
auaggcuuagugcuug

SEQ ID NO: 488427 - RNA, 15 nt, Homo sapiens
auaguggaucacuca

SEQ ID NO: 488428 - RNA, 21 nt, Homo sapiens
auauaaccauaaaucaauuca

SEQ ID NO: 488429 - RNA, 18 nt, Homo sapiens
auauagauaacugcauaa

SEQ ID NO: 488430 - RNA, 16 nt, Homo sapiens
auauagcguucccaac

SEQ ID NO: 488431 - RNA, 13 nt, Homo sapiens
auauaucuugucu

SEQ ID NO: 488432 - RNA, 19 nt, Homo sapiens
auauauguguauauauaca

SEQ ID NO: 488433 - RNA, 21 nt, Homo sapiens
auaugaaauuauaaugcaaua

SEQ ID NO: 488434 - RNA, 19 nt, Homo sapiens
auaugagcaugcucccuca

SEQ ID NO: 488435 - RNA, 14 nt, Homo sapiens
auaugaguauacaa

SEQ ID NO: 488436 - RNA, 21 nt, Homo sapiens
auaugauaaauuugacuguua

SEQ ID NO: 488437 - RNA, 11 nt, Homo sapiens
auaugcauaua

SEQ ID NO: 488438 - RNA, 15 nt, Homo sapiens
auaugcauauauaug

SEQ ID NO: 488439 - RNA, 15 nt, Homo sapiens
auaugcaucccacag

SEQ ID NO: 488440 - RNA, 14 nt, Homo sapiens
auauguacagcucu

SEQ ID NO: 488441 - RNA, 17 nt, Homo sapiens
auauguguauauauaca

SEQ ID NO: 488442 - RNA, 17 nt, Homo sapiens
auauguuuauacacaca

SEQ ID NO: 488443 - RNA, 14 nt, Homo sapiens
auauuaaagugcua

SEQ ID NO: 488444 - RNA, 18 nt, Homo sapiens
auauuauuugcuaauuaa

SEQ ID NO: 488445 - RNA, 16 nt, Homo sapiens
auauuuaaguauucaa

SEQ ID NO: 488446 - RNA, 15 nt, Homo sapiens
auauuuaugcuuaua

SEQ ID NO: 488447 - RNA, 23 nt, Homo sapiens
auauuuaugcuuauaaguuugca

SEQ ID NO: 488448 - RNA, 16 nt, Homo sapiens
auauuuucacaggugu

SEQ ID NO: 488449 - RNA, 17 nt, Homo sapiens
aucaagcuccaucuuau

SEQ ID NO: 488450 - RNA, 22 nt, Homo sapiens
aucaaguccuaguuguucagca

SEQ ID NO: 488451 - RNA, 23 nt, Homo sapiens
aucaauguucacgcaacuugaaa

SEQ ID NO: 488452 - RNA, 16 nt, Homo sapiens
aucaccuugcauuuca

SEQ ID NO: 488453 - RNA, 15 nt, Homo sapiens
aucagaaacaauuuc

SEQ ID NO: 488454 - RNA, 18 nt, Homo sapiens
aucagacugcuuugagaa

SEQ ID NO: 488455 - RNA, 22 nt, Homo sapiens
aucauaaccacccuagcuuuau

SEQ ID NO: 488456 - RNA, 14 nt, Homo sapiens
aucauacugcauac

SEQ ID NO: 488457 - RNA, 17 nt, Homo sapiens
auccaccugcacaaaca

SEQ ID NO: 488458 - RNA, 16 nt, Homo sapiens
auccagaggugaggga

SEQ ID NO: 488459 - RNA, 14 nt, Homo sapiens
auccagaugaagga

SEQ ID NO: 488460 - RNA, 16 nt, Homo sapiens
auccaucaaguugcac

SEQ ID NO: 488461 - RNA, 22 nt, Homo sapiens
auccaucaaguugcacacucac

SEQ ID NO: 488462 - RNA, 14 nt, Homo sapiens
auccaucaugcaaa

SEQ ID NO: 488463 - RNA, 20 nt, Homo sapiens
aucccacuugccccuguuac

SEQ ID NO: 488464 - RNA, 13 nt, Homo sapiens
auccuugcacaga

SEQ ID NO: 488465 - RNA, 15 nt, Homo sapiens
aucgcgccacugcac

SEQ ID NO: 488466 - RNA, 21 nt, Homo sapiens
aucuaacuauauguacagcuc

SEQ ID NO: 488467 - RNA, 12 nt, Homo sapiens
aucuauggauug

SEQ ID NO: 488468 - RNA, 18 nt, Homo sapiens
aucucaaaagaucuccug

SEQ ID NO: 488469 - RNA, 14 nt, Homo sapiens
aucucaauuugcag

SEQ ID NO: 488470 - RNA, 16 nt, Homo sapiens
aucucaucccuagucu

SEQ ID NO: 488471 - RNA, 17 nt, Homo sapiens
aucuccaacucucucug

SEQ ID NO: 488472 - RNA, 20 nt, Homo sapiens
aucuccuuuggaaggugaca

SEQ ID NO: 488473 - RNA, 23 nt, Homo sapiens
aucucgcacuacaucugauauca

SEQ ID NO: 488474 - RNA, 15 nt, Homo sapiens
aucucuucuuccuuu

SEQ ID NO: 488475 - RNA, 23 nt, Homo sapiens
aucugacauauuucauaagcaca

SEQ ID NO: 488476 - RNA, 21 nt, Homo sapiens
aucugacguuguuauccuguu

SEQ ID NO: 488477 - RNA, 12 nt, Homo sapiens
aucuggaaaaua

SEQ ID NO: 488478 - RNA, 23 nt, Homo sapiens
aucuggcccuugcuuaccucuca

SEQ ID NO: 488479 - RNA, 20 nt, Homo sapiens
aucuguacgguucugugcaa

SEQ ID NO: 488480 - RNA, 16 nt, Homo sapiens
aucuuccacaggucuc

SEQ ID NO: 488481 - RNA, 14 nt, Homo sapiens
ucacagaugggcaa

SEQ ID NO: 488482 - RNA, 11 nt, Homo sapiens
ucacaguauuu

SEQ ID NO: 488483 - RNA, 17 nt, Homo sapiens
ucacaguugagugcauc

SEQ ID NO: 488484 - RNA, 13 nt, Homo sapiens
ucacaucuuggca

SEQ ID NO: 488485 - RNA, 20 nt, Homo sapiens
ucaccacccugcucauccac

SEQ ID NO: 488486 - RNA, 17 nt, Homo sapiens
ucaccaccgagacaguu

SEQ ID NO: 488487 - RNA, 15 nt, Homo sapiens
ucaccacuccauucc

SEQ ID NO: 488488 - RNA, 16 nt, Homo sapiens
ucaccacuccauuccc

SEQ ID NO: 488489 - RNA, 13 nt, Homo sapiens
ucaccuaucugga

SEQ ID NO: 488490 - RNA, 21 nt, Homo sapiens
ucaccuugcauuucaaaaugg

SEQ ID NO: 488491 - RNA, 16 nt, Homo sapiens
ucacucaccauuccca

SEQ ID NO: 488492 - RNA, 16 nt, Homo sapiens
ucacuguucaugaaua

SEQ ID NO: 488493 - RNA, 14 nt, Homo sapiens
ucacuucugaauug

SEQ ID NO: 488494 - RNA, 16 nt, Homo sapiens
ucagaaacgaaaucua

SEQ ID NO: 488495 - RNA, 20 nt, Homo sapiens
ucagauuuugugaacuccag

SEQ ID NO: 488496 - RNA, 16 nt, Homo sapiens
ucagcaaacccaaaga

SEQ ID NO: 488497 - RNA, 17 nt, Homo sapiens
ucagcuacauauaugaa

SEQ ID NO: 488498 - RNA, 23 nt, Homo sapiens
ucagcucaauuguuaaugugaug

SEQ ID NO: 488499 - RNA, 16 nt, Homo sapiens
ucagcucucuguauaa

SEQ ID NO: 488500 - RNA, 19 nt, Homo sapiens
ucaggaaaggaagauguaa

SEQ ID NO: 488501 - RNA, 18 nt, Homo sapiens
ucaggaaauaucugugaa

SEQ ID NO: 488502 - RNA, 19 nt, Homo sapiens
ucaggaauaugcaucccac

SEQ ID NO: 488503 - RNA, 19 nt, Homo sapiens
ucaggaccccaucugcuga

SEQ ID NO: 488504 - RNA, 22 nt, Homo sapiens
ucaggcauuuuuguaaugagcc

SEQ ID NO: 488505 - RNA, 15 nt, Homo sapiens
ucaggcuugugacau

SEQ ID NO: 488506 - RNA, 19 nt, Homo sapiens
ucagggggccaggugcaca

SEQ ID NO: 488507 - RNA, 16 nt, Homo sapiens
ucaguaaaugugauuc

SEQ ID NO: 488508 - RNA, 15 nt, Homo sapiens
ucaguucaaagucau

SEQ ID NO: 488509 - RNA, 12 nt, Homo sapiens
ucaguuugcuaa

SEQ ID NO: 488510 - RNA, 13 nt, Homo sapiens
ucauaaacaaaga

SEQ ID NO: 488511 - RNA, 20 nt, Homo sapiens
ucauacagugguauugcuag

SEQ ID NO: 488512 - RNA, 17 nt, Homo sapiens
ucauaucuguaugccuc

SEQ ID NO: 488513 - RNA, 13 nt, Homo sapiens
ucauauguucuca

SEQ ID NO: 488514 - RNA, 18 nt, Homo sapiens
ucauauugcuaccaaaaa

SEQ ID NO: 488515 - RNA, 15 nt, Homo sapiens
ucauauuguucaaua

SEQ ID NO: 488516 - RNA, 19 nt, Homo sapiens
ucaucaauucccauugcau

SEQ ID NO: 488517 - RNA, 22 nt, Homo sapiens
ucauccacucuacuaaugccuc

SEQ ID NO: 488518 - RNA, 17 nt, Homo sapiens
ucaucccuuaauuuaag

SEQ ID NO: 488519 - RNA, 19 nt, Homo sapiens
ucaucugucugucccaguu

SEQ ID NO: 488520 - RNA, 20 nt, Homo sapiens
ucaugcuuuaaaguguaaua

SEQ ID NO: 488521 - RNA, 21 nt, Homo sapiens
ucauguugauguguccgugaa

SEQ ID NO: 488522 - RNA, 17 nt, Homo sapiens
ucauucccaggcacucu

SEQ ID NO: 488523 - RNA, 18 nt, Homo sapiens
ucauugggccauguuuaa

SEQ ID NO: 488524 - RNA, 15 nt, Homo sapiens
ucauuuuucaggaaa

SEQ ID NO: 488525 - RNA, 16 nt, Homo sapiens
uccaacagaaagcaua

SEQ ID NO: 488526 - RNA, 12 nt, Homo sapiens
uccaacauguga

SEQ ID NO: 488527 - RNA, 13 nt, Homo sapiens
uccaacccaugag

SEQ ID NO: 488528 - RNA, 18 nt, Homo sapiens
uccaacccaugagugcua

SEQ ID NO: 488529 - RNA, 13 nt, Homo sapiens
uccaagaacaauu

SEQ ID NO: 488530 - RNA, 16 nt, Homo sapiens
uccaauuugcacuuuc

SEQ ID NO: 488531 - RNA, 14 nt, Homo sapiens
uccacacacacaaa

SEQ ID NO: 488532 - RNA, 15 nt, Homo sapiens
uccacaguuaucuua

SEQ ID NO: 488533 - RNA, 19 nt, Homo sapiens
uccacccuuggacuuucuu

SEQ ID NO: 488534 - RNA, 14 nt, Homo sapiens
uccagaaguaagua

SEQ ID NO: 488535 - RNA, 15 nt, Homo sapiens
uccagagcagaguuu

SEQ ID NO: 488536 - RNA, 19 nt, Homo sapiens
uccagaugugccuagacac

SEQ ID NO: 488537 - RNA, 17 nt, Homo sapiens
uccagccacuuauuucc

SEQ ID NO: 488538 - RNA, 18 nt, Homo sapiens
uccagcuaagccugauga

SEQ ID NO: 488539 - RNA, 17 nt, Homo sapiens
uccaggaacacaugcac

SEQ ID NO: 488540 - RNA, 19 nt, Homo sapiens
uccaggaacacaugcacac

SEQ ID NO: 488541 - RNA, 22 nt, Homo sapiens
uccaggagaugaggcuggauag

SEQ ID NO: 488542 - RNA, 13 nt, Homo sapiens
uccagucauacca

SEQ ID NO: 488543 - RNA, 15 nt, Homo sapiens
uccaguucugaugag

SEQ ID NO: 488544 - RNA, 22 nt, Homo sapiens
uccaucacccguacaggcaauu

SEQ ID NO: 488545 - RNA, 13 nt, Homo sapiens
uccaucaugcaaa

SEQ ID NO: 488546 - RNA, 21 nt, Homo sapiens
ucccaaaagucaccacuccau

SEQ ID NO: 488547 - RNA, 23 nt, Homo sapiens
ucccaaccuccccugguccugca

SEQ ID NO: 488548 - RNA, 23 nt, Homo sapiens
ucccaagguucugggugcaggag

SEQ ID NO: 488549 - RNA, 17 nt, Homo sapiens
ucccacucaggugaaaa

SEQ ID NO: 488550 - RNA, 14 nt, Homo sapiens
uccccaauuauccu

SEQ ID NO: 488551 - RNA, 13 nt, Homo sapiens
uccccaggacuug

SEQ ID NO: 488552 - RNA, 22 nt, Homo sapiens
uccccggggucuucuaccucag

SEQ ID NO: 488553 - RNA, 14 nt, Homo sapiens
uccccuccaaguga

SEQ ID NO: 488554 - RNA, 13 nt, Homo sapiens
uccccuuguaaaa

SEQ ID NO: 488555 - RNA, 19 nt, Homo sapiens
ucccucagcccucauuaaa

SEQ ID NO: 488556 - RNA, 20 nt, Homo sapiens
ucccuggugucguauuuugc

SEQ ID NO: 488557 - RNA, 16 nt, Homo sapiens
ucccuuaauuuaaguc

SEQ ID NO: 488558 - RNA, 23 nt, Homo sapiens
ucccuuaauuuaagucauuuuca

SEQ ID NO: 488559 - RNA, 20 nt, Homo sapiens
ucccuuuaucauguguuucu

SEQ ID NO: 488560 - RNA, 20 nt, Homo sapiens
ugagauuuaccagggaugua

SEQ ID NO: 488561 - RNA, 18 nt, Homo sapiens
ugagcaaacugaagccca

SEQ ID NO: 488562 - RNA, 23 nt, Homo sapiens
ugagcaugcucccucaugcagau

SEQ ID NO: 488563 - RNA, 20 nt, Homo sapiens
ugaggcggggagcaugaaga

SEQ ID NO: 488564 - RNA, 20 nt, Homo sapiens
ugagggcgugaaacacaaua

SEQ ID NO: 488565 - RNA, 22 nt, Homo sapiens
ugagugcuggauauuuuacuac

SEQ ID NO: 488566 - RNA, 19 nt, Homo sapiens
ugaguucccuugauucaaa

SEQ ID NO: 488567 - RNA, 14 nt, Homo sapiens
ugauaacagaguga

SEQ ID NO: 488568 - RNA, 14 nt, Homo sapiens
ugauauauuuucca

SEQ ID NO: 488569 - RNA, 21 nt, Homo sapiens
ugauccagagcagaguuuacg

SEQ ID NO: 488570 - RNA, 15 nt, Homo sapiens
ugaugaaaaccaccc

SEQ ID NO: 488571 - RNA, 19 nt, Homo sapiens
ugaugaaguuguacaacac

SEQ ID NO: 488572 - RNA, 16 nt, Homo sapiens
ugauggauauguuuuc

SEQ ID NO: 488573 - RNA, 23 nt, Homo sapiens
ugauggauauguuuucacuguau

SEQ ID NO: 488574 - RNA, 14 nt, Homo sapiens
ugauguaacugugu

SEQ ID NO: 488575 - RNA, 23 nt, Homo sapiens
ugauguccaaacuuaacagauca

SEQ ID NO: 488576 - RNA, 15 nt, Homo sapiens
ugauuaacucagucc

SEQ ID NO: 488577 - RNA, 20 nt, Homo sapiens
ugauucaaauaacccugaau

SEQ ID NO: 488578 - RNA, 21 nt, Homo sapiens
ugauugagagcagccucuuga

SEQ ID NO: 488579 - RNA, 19 nt, Homo sapiens
ugauuuauucuggugucua

SEQ ID NO: 488580 - RNA, 21 nt, Homo sapiens
ugauuucccuucuucugucau

SEQ ID NO: 488581 - RNA, 18 nt, Homo sapiens
ugauuuuuuuuauugccu

SEQ ID NO: 488582 - RNA, 16 nt, Homo sapiens
ugcaaccaaacuccca

SEQ ID NO: 488583 - RNA, 17 nt, Homo sapiens
ugcaauucaucccagag

SEQ ID NO: 488584 - RNA, 14 nt, Homo sapiens
ugcaauuuacuugg

SEQ ID NO: 488585 - RNA, 22 nt, Homo sapiens
ugcacaacauccucagaaccau

SEQ ID NO: 488586 - RNA, 14 nt, Homo sapiens
ugcacaagcacuau

SEQ ID NO: 488587 - RNA, 14 nt, Homo sapiens
ugcacaaugucuug

SEQ ID NO: 488588 - RNA, 17 nt, Homo sapiens
ugcacaaugucuuggua

SEQ ID NO: 488589 - RNA, 22 nt, Homo sapiens
ugcacacucacuggcaucuuug

SEQ ID NO: 488590 - RNA, 23 nt, Homo sapiens
ugcacaugugagcaugucacuuc

SEQ ID NO: 488591 - RNA, 19 nt, Homo sapiens
ugcaccagguagaacgcca

SEQ ID NO: 488592 - RNA, 13 nt, Homo sapiens
ugcaccucauucc

SEQ ID NO: 488593 - RNA, 13 nt, Homo sapiens
ugcacucuagccg

SEQ ID NO: 488594 - RNA, 21 nt, Homo sapiens
ugcacugcccuccgcccuucc

SEQ ID NO: 488595 - RNA, 19 nt, Homo sapiens
ugcagagccugcaggguga

SEQ ID NO: 488596 - RNA, 21 nt, Homo sapiens
ugcaguaaaguuccaugaaga

SEQ ID NO: 488597 - RNA, 14 nt, Homo sapiens
ugcagucaucuccc

SEQ ID NO: 488598 - RNA, 20 nt, Homo sapiens
ugcauaaccgcacagacauu

SEQ ID NO: 488599 - RNA, 14 nt, Homo sapiens
ugcauagcuugcac

SEQ ID NO: 488600 - RNA, 18 nt, Homo sapiens
ugcaucagaaaaugcagc

SEQ ID NO: 488601 - RNA, 16 nt, Homo sapiens
ugcaucccugcagcuc

SEQ ID NO: 488602 - RNA, 18 nt, Homo sapiens
ugcaucccugcagcucaa

SEQ ID NO: 488603 - RNA, 19 nt, Homo sapiens
ugcaugucgcacaauguuu

SEQ ID NO: 488604 - RNA, 17 nt, Homo sapiens
ugcauuuucauauugcu

SEQ ID NO: 488605 - RNA, 14 nt, Homo sapiens
ugccagaugccaaa

SEQ ID NO: 488606 - RNA, 20 nt, Homo sapiens
ugccauuuuuugucugugau

SEQ ID NO: 488607 - RNA, 20 nt, Homo sapiens
ugcccagacucaaggccucc

SEQ ID NO: 488608 - RNA, 14 nt, Homo sapiens
ugccccagugcuac

SEQ ID NO: 488609 - RNA, 22 nt, Homo sapiens
ugccugcggaguugugcacgua

SEQ ID NO: 488610 - RNA, 21 nt, Homo sapiens
ugccuguggugagguccuguc

SEQ ID NO: 488611 - RNA, 22 nt, Homo sapiens
ugcguaggagagaacagggaug

SEQ ID NO: 488612 - RNA, 17 nt, Homo sapiens
uuaauaauaaaauauca

SEQ ID NO: 488613 - RNA, 14 nt, Homo sapiens
uuaauauaacugcc

SEQ ID NO: 488614 - RNA, 16 nt, Homo sapiens
uuaaucaagauguuca

SEQ ID NO: 488615 - RNA, 12 nt, Homo sapiens
uuaauguacaaa

SEQ ID NO: 488616 - RNA, 14 nt, Homo sapiens
uuacaaggugacaa

SEQ ID NO: 488617 - RNA, 19 nt, Homo sapiens
uuacaguggcaguauugac

SEQ ID NO: 488618 - RNA, 15 nt, Homo sapiens
uuacugauuaacuca

SEQ ID NO: 488619 - RNA, 14 nt, Homo sapiens
uuacuuuguacaaa

SEQ ID NO: 488620 - RNA, 17 nt, Homo sapiens
uuagaauccgaagggaa

SEQ ID NO: 488621 - RNA, 22 nt, Homo sapiens
uuagauuaacccuauuaaucua

SEQ ID NO: 488622 - RNA, 15 nt, Homo sapiens
uuagcccacugccug

SEQ ID NO: 488623 - RNA, 21 nt, Homo sapiens
uuagcccagucauauguucuc

SEQ ID NO: 488624 - RNA, 23 nt, Homo sapiens
uuagcucucccaacucuugcaca

SEQ ID NO: 488625 - RNA, 21 nt, Homo sapiens
uuaggcaauggugaacuguca

SEQ ID NO: 488626 - RNA, 18 nt, Homo sapiens
uuaggcaguauaaagaau

SEQ ID NO: 488627 - RNA, 19 nt, Homo sapiens
uuaguggacccugaaaugu

SEQ ID NO: 488628 - RNA, 12 nt, Homo sapiens
uuauaccuguac

SEQ ID NO: 488629 - RNA, 17 nt, Homo sapiens
uuauagaagaaugcaug

SEQ ID NO: 488630 - RNA, 19 nt, Homo sapiens
uuauaucagacugcuuuga

SEQ ID NO: 488631 - RNA, 18 nt, Homo sapiens
uuauaucuguggucuuca

SEQ ID NO: 488632 - RNA, 11 nt, Homo sapiens
uuaucaugugu

SEQ ID NO: 488633 - RNA, 21 nt, Homo sapiens
uuauccagaggguugugauuu

SEQ ID NO: 488634 - RNA, 17 nt, Homo sapiens
uuauccuguauguaaua

SEQ ID NO: 488635 - RNA, 19 nt, Homo sapiens
uuaucugauccuuguggca

SEQ ID NO: 488636 - RNA, 18 nt, Homo sapiens
uuauuaaaagaguagaaa

SEQ ID NO: 488637 - RNA, 19 nt, Homo sapiens
uuauugcuggaaucuacua

SEQ ID NO: 488638 - RNA, 17 nt, Homo sapiens
uuauuuuugaaacaaac

SEQ ID NO: 488639 - RNA, 19 nt, Homo sapiens
uucaaaagaugccauucau

SEQ ID NO: 488640 - RNA, 14 nt, Homo sapiens
uucaacaaguaccu

SEQ ID NO: 488641 - RNA, 15 nt, Homo sapiens
uucaacuucaggaaa

SEQ ID NO: 488642 - RNA, 18 nt, Homo sapiens
uucaaguuaauucucaga

SEQ ID NO: 488643 - RNA, 16 nt, Homo sapiens
uucaaguuuucucaga

SEQ ID NO: 488644 - RNA, 24 nt, Homo sapiens
uucaauaacugacggauguaaggu

SEQ ID NO: 488645 - RNA, 18 nt, Homo sapiens
uucaccagagcauuucca

SEQ ID NO: 488646 - RNA, 11 nt, Homo sapiens
uucaccauaau

SEQ ID NO: 488647 - RNA, 16 nt, Homo sapiens
uucaccucuucuuucc

SEQ ID NO: 488648 - RNA, 14 nt, Homo sapiens
uucacgcaacuuga

SEQ ID NO: 488649 - RNA, 17 nt, Homo sapiens
uucacugagaagacauu

SEQ ID NO: 488650 - RNA, 16 nt, Homo sapiens
uucacuggcaaaugga

SEQ ID NO: 488651 - RNA, 19 nt, Homo sapiens
uucagaaacuaagaaucau

SEQ ID NO: 488652 - RNA, 15 nt, Homo sapiens
uucagcauguucuca

SEQ ID NO: 488653 - RNA, 16 nt, Homo sapiens
uucaggaacacucuga

SEQ ID NO: 488654 - RNA, 13 nt, Homo sapiens
uucaggaagaccg

SEQ ID NO: 488655 - RNA, 13 nt, Homo sapiens
uucaguauuguaa

SEQ ID NO: 488656 - RNA, 17 nt, Homo sapiens
uucauuacuagauaaaa

SEQ ID NO: 488657 - RNA, 18 nt, Homo sapiens
uucauuaucauaugaacu

SEQ ID NO: 488658 - RNA, 17 nt, Homo sapiens
uuccaaacucuucccuc

SEQ ID NO: 488659 - RNA, 14 nt, Homo sapiens
uuccaacaccacag

SEQ ID NO: 488660 - RNA, 23 nt, Homo sapiens
uuccaacaccacagacacacaca

SEQ ID NO: 488661 - RNA, 13 nt, Homo sapiens
uuccaacauacaa

SEQ ID NO: 488662 - RNA, 22 nt, Homo sapiens
uuccagauucccagcuuccaga

SEQ ID NO: 488663 - RNA, 20 nt, Homo sapiens
uuccagcuaagccugaugau

SEQ ID NO: 488664 - RNA, 16 nt, Homo sapiens
uuccagggaaccagag

SEQ ID NO: 488665 - RNA, 18 nt, Homo sapiens
uuccauggauuccccugg

SEQ ID NO: 488666 - RNA, 23 nt, Homo sapiens
uuccaugucugaaguuugcccca

SEQ ID NO: 488667 - RNA, 22 nt, Homo sapiens
uuccauuuggucuucuaguaua

SEQ ID NO: 488668 - RNA, 17 nt, Homo sapiens
uucccaacaacauccau

SEQ ID NO: 488669 - RNA, 20 nt, Homo sapiens
uucccaacuagacauuacca

SEQ ID NO: 488670 - RNA, 22 nt, Homo sapiens
uucccacacugugaacuaauga

SEQ ID NO: 488671 - RNA, 22 nt, Homo sapiens
uucccuucuacaaggacuccau

SEQ ID NO: 488672 - RNA, 16 nt, Homo sapiens
uuccucuuaccuguaa

SEQ ID NO: 488673 - RNA, 16 nt, Homo sapiens
uuccugucuuauccuc

SEQ ID NO: 488674 - RNA, 20 nt, Homo sapiens
uuccugucuuauccuccacc

SEQ ID NO: 488675 - RNA, 21 nt, Homo sapiens
uucguccuuagaauacuguau

SEQ ID NO: 488676 - RNA, 19 nt, Homo sapiens
uucuaaaauuacagacaaa

SEQ ID NO: 488677 - RNA, 17 nt, Homo sapiens
uucuaaccuccuaagca

SEQ ID NO: 488678 - RNA, 15 nt, Homo sapiens
uucuaacucugaugu

SEQ ID NO: 488679 - RNA, 16 nt, Homo sapiens
uucuaauccaugugcu

SEQ ID NO: 488680 - RNA, 21 nt, Homo sapiens
uucuacuuacacaucuuccac

SEQ ID NO: 488681 - RNA, 22 nt, Homo sapiens
uucuauuucaacuucaggaaag

SEQ ID NO: 488682 - RNA, 21 nt, Homo sapiens
uucucuagacaucuagucuca

SEQ ID NO: 488683 - RNA, 16 nt, Homo sapiens
uucucucugugcuggu

SEQ ID NO: 488684 - RNA, 9 nt, Homo sapiens
uucucugcu

SEQ ID NO: 488685 - RNA, 17 nt, Homo sapiens
uucugaguagcauauau

SEQ ID NO: 488686 - RNA, 13 nt, Homo sapiens
uucugcaauucaa

SEQ ID NO: 488687 - RNA, 22 nt, Homo sapiens
uucuggugucuaauaaacacag

SEQ ID NO: 488688 - RNA, 16 nt, Homo sapiens
uucuguacauguggaa

SEQ ID NO: 488689 - RNA, 13 nt, Homo sapiens
uucuuaaaacacu

SEQ ID NO: 488690 - RNA, 12 nt, Homo sapiens
uucuuacuguau

SEQ ID NO: 488691 - RNA, 18 nt, Homo sapiens
uucuuauaacauuguaug

SEQ ID NO: 488692 - RNA, 15 nt, Homo sapiens
uucuuauuccauauu

SEQ ID NO: 488693 - RNA, 21 nt, Homo sapiens
uucuuccuuuuguauccucca

SEQ ID NO: 488694 - RNA, 17 nt, Homo sapiens
uucuugcagucaucaga

SEQ ID NO: 488695 - RNA, 21 nt, Homo sapiens
uucuugccugaacuccugcca

SEQ ID NO: 488696 - RNA, 12 nt, Homo sapiens
uucuugugauug

SEQ ID NO: 488697 - RNA, 21 nt, Homo sapiens
uugaaaaagggaagccauucc

SEQ ID NO: 488698 - RNA, 14 nt, Homo sapiens
uugaaacaaacaug

SEQ ID NO: 488699 - RNA, 23 nt, Homo sapiens
uugaaaggagaaaaaaaaagcca

SEQ ID NO: 488700 - RNA, 18 nt, Homo sapiens
uugaacuuuauaaaacau

SEQ ID NO: 488701 - RNA, 22 nt, Homo sapiens
uugaagucaugcuccccugugc

SEQ ID NO: 488702 - RNA, 17 nt, Homo sapiens
uugaauauaauggccuc

SEQ ID NO: 488703 - RNA, 14 nt, Homo sapiens
uugagaacauuccc

SEQ ID NO: 488704 - RNA, 12 nt, Homo sapiens
uugccaccauuu

SEQ ID NO: 488705 - RNA, 18 nt, Homo sapiens
caauuaauucaucccuua

SEQ ID NO: 488706 - RNA, 16 nt, Homo sapiens
caauuuauugcacaaa

SEQ ID NO: 488707 - RNA, 21 nt, Homo sapiens
caauuuccggccaacaguuaa

SEQ ID NO: 488708 - RNA, 14 nt, Homo sapiens
caauuugcacuuuc

SEQ ID NO: 488709 - RNA, 23 nt, Homo sapiens
caauuugucuuuggaaaauucag

SEQ ID NO: 488710 - RNA, 13 nt, Homo sapiens
cacaacauccuca

SEQ ID NO: 488711 - RNA, 16 nt, Homo sapiens
cacaacuccaguguuc

SEQ ID NO: 488712 - RNA, 23 nt, Homo sapiens
cacaagguugcuggcauuugcug

SEQ ID NO: 488713 - RNA, 22 nt, Homo sapiens
cacaauaaaagaaacugugguc

SEQ ID NO: 488714 - RNA, 13 nt, Homo sapiens
cacacaacugugg

SEQ ID NO: 488715 - RNA, 14 nt, Homo sapiens
cacacacacauaua

SEQ ID NO: 488716 - RNA, 16 nt, Homo sapiens
cacacccuacagcaga

SEQ ID NO: 488717 - RNA, 15 nt, Homo sapiens
cacacucacuggcau

SEQ ID NO: 488718 - RNA, 21 nt, Homo sapiens
cacacucucuucuuacuguau

SEQ ID NO: 488719 - RNA, 14 nt, Homo sapiens
cacagaaaaugcac

SEQ ID NO: 488720 - RNA, 20 nt, Homo sapiens
cacagaaauauauauacaua

SEQ ID NO: 488721 - RNA, 13 nt, Homo sapiens
cacagagaccccc

SEQ ID NO: 488722 - RNA, 20 nt, Homo sapiens
cacagaugggcaaggccuuu

SEQ ID NO: 488723 - RNA, 20 nt, Homo sapiens
cacagcuccuuuuccagagc

SEQ ID NO: 488724 - RNA, 13 nt, Homo sapiens
cacagggacacag

SEQ ID NO: 488725 - RNA, 14 nt, Homo sapiens
cacagggacacagu

SEQ ID NO: 488726 - RNA, 12 nt, Homo sapiens
cacagucacugc

SEQ ID NO: 488727 - RNA, 16 nt, Homo sapiens
cacagugucuguaaau

SEQ ID NO: 488728 - RNA, 22 nt, Homo sapiens
cacaguuaucuuagcuggauau

SEQ ID NO: 488729 - RNA, 16 nt, Homo sapiens
cacaguugagugcauc

SEQ ID NO: 488730 - RNA, 18 nt, Homo sapiens
cacauacauauauacauu

SEQ ID NO: 488731 - RNA, 13 nt, Homo sapiens
cacauccauuccc

SEQ ID NO: 488732 - RNA, 18 nt, Homo sapiens
cacauccauucccaagaa

SEQ ID NO: 488733 - RNA, 23 nt, Homo sapiens
cacaugcacacacacacaucuca

SEQ ID NO: 488734 - RNA, 19 nt, Homo sapiens
cacaugccccucuuagaag

SEQ ID NO: 488735 - RNA, 15 nt, Homo sapiens
caccaaaacugcucc

SEQ ID NO: 488736 - RNA, 13 nt, Homo sapiens
caccaaguacaag

SEQ ID NO: 488737 - RNA, 16 nt, Homo sapiens
caccaaguacaaggac

SEQ ID NO: 488738 - RNA, 15 nt, Homo sapiens
caccagcaacauuau

SEQ ID NO: 488739 - RNA, 11 nt, Homo sapiens
caccauggcac

SEQ ID NO: 488740 - RNA, 18 nt, Homo sapiens
caccgaccaacuccagac

SEQ ID NO: 488741 - RNA, 16 nt, Homo sapiens
caccgagaggaaaaag

SEQ ID NO: 488742 - RNA, 15 nt, Homo sapiens
caccuaucuggaaaa

SEQ ID NO: 488743 - RNA, 15 nt, Homo sapiens
caccugggacaggga

SEQ ID NO: 488744 - RNA, 14 nt, Homo sapiens
caccuugcauuuca

SEQ ID NO: 488745 - RNA, 22 nt, Homo sapiens
cacgauaugcaaguucauccaa

SEQ ID NO: 488746 - RNA, 21 nt, Homo sapiens
cacgccugguucuguacaugu

SEQ ID NO: 488747 - RNA, 16 nt, Homo sapiens
cacguugggacaggga

SEQ ID NO: 488748 - RNA, 23 nt, Homo sapiens
cacuaagucucuuuuuuacaaag

SEQ ID NO: 488749 - RNA, 14 nt, Homo sapiens
cacucaggugaaaa

SEQ ID NO: 488750 - RNA, 15 nt, Homo sapiens
cacugagaagacauu

SEQ ID NO: 488751 - RNA, 13 nt, Homo sapiens
cacugaguacaaa

SEQ ID NO: 488752 - RNA, 16 nt, Homo sapiens
cacugaguagucauuu

SEQ ID NO: 488753 - RNA, 16 nt, Homo sapiens
cacugcacucuagccg

SEQ ID NO: 488754 - RNA, 18 nt, Homo sapiens
cacugccauggaggcaca

SEQ ID NO: 488755 - RNA, 13 nt, Homo sapiens
cacugguuuucaa

SEQ ID NO: 488756 - RNA, 22 nt, Homo sapiens
cacugucaccacccugcucauc

SEQ ID NO: 488757 - RNA, 13 nt, Homo sapiens
cacugugcuucuu

SEQ ID NO: 488758 - RNA, 23 nt, Homo sapiens
cacugugcuucuuaauguguaau

SEQ ID NO: 488759 - RNA, 15 nt, Homo sapiens
cacuuauuuccaugg

SEQ ID NO: 488760 - RNA, 16 nt, Homo sapiens
cacuuauuuccaugga

SEQ ID NO: 488761 - RNA, 22 nt, Homo sapiens
cacuuguaagaaaaugagacaa

SEQ ID NO: 488762 - RNA, 12 nt, Homo sapiens
cacuuugcaaag

SEQ ID NO: 488763 - RNA, 18 nt, Homo sapiens
cacuuuguuucauauucu

SEQ ID NO: 488764 - RNA, 19 nt, Homo sapiens
cagaaaaaaaagugucuca

SEQ ID NO: 488765 - RNA, 13 nt, Homo sapiens
cagaaaagcaccu

SEQ ID NO: 488766 - RNA, 21 nt, Homo sapiens
cagaaaaugcaccucauucca

SEQ ID NO: 488767 - RNA, 23 nt, Homo sapiens
cagaaauacaacagaaguuauau

SEQ ID NO: 488768 - RNA, 15 nt, Homo sapiens
cagaagggagugaaa

SEQ ID NO: 488769 - RNA, 14 nt, Homo sapiens
cagaauuaagugga

SEQ ID NO: 488770 - RNA, 20 nt, Homo sapiens
cagacacacaagcagacaca

SEQ ID NO: 488771 - RNA, 14 nt, Homo sapiens
cagacacacacaca

SEQ ID NO: 488772 - RNA, 16 nt, Homo sapiens
cagacacacacauaua

SEQ ID NO: 488773 - RNA, 19 nt, Homo sapiens
cagaccaaggaacaagacc

SEQ ID NO: 488774 - RNA, 16 nt, Homo sapiens
cagaccacugucucca

SEQ ID NO: 488775 - RNA, 23 nt, Homo sapiens
cagagaggacuguugacauccaa

SEQ ID NO: 488776 - RNA, 14 nt, Homo sapiens
cagagcacauggcc

SEQ ID NO: 488777 - RNA, 19 nt, Homo sapiens
cagagguugcagugagcug

SEQ ID NO: 488778 - RNA, 20 nt, Homo sapiens
cagaguccugguuuccucag

SEQ ID NO: 488779 - RNA, 15 nt, Homo sapiens
cagauccaccugcac

SEQ ID NO: 488780 - RNA, 17 nt, Homo sapiens
cagauccaccugcacaa

SEQ ID NO: 488781 - RNA, 17 nt, Homo sapiens
cagaugaccuuuuggaa

SEQ ID NO: 488782 - RNA, 17 nt, Homo sapiens
cagauguggacaugcac

SEQ ID NO: 488783 - RNA, 18 nt, Homo sapiens
cagauuaaauuuaauuaa

SEQ ID NO: 488784 - RNA, 14 nt, Homo sapiens
cagauucccagcuu

SEQ ID NO: 488785 - RNA, 18 nt, Homo sapiens
cagauucccagcuuccag

SEQ ID NO: 488786 - RNA, 18 nt, Homo sapiens
cagauuugcaacagcaaa

SEQ ID NO: 488787 - RNA, 13 nt, Homo sapiens
cagauuuuaguuu

SEQ ID NO: 488788 - RNA, 16 nt, Homo sapiens
cagcaaacccaaagau

SEQ ID NO: 488789 - RNA, 14 nt, Homo sapiens
cagcacagccucac

SEQ ID NO: 488790 - RNA, 21 nt, Homo sapiens
cagcacccagguuuugcacuc

SEQ ID NO: 488791 - RNA, 18 nt, Homo sapiens
cagcaguuugugaucugu

SEQ ID NO: 488792 - RNA, 17 nt, Homo sapiens
cagcaguuuucuuuuaa

SEQ ID NO: 488793 - RNA, 21 nt, Homo sapiens
cagcauggcguaucaggaaag

SEQ ID NO: 488794 - RNA, 14 nt, Homo sapiens
cagcauugccagua

SEQ ID NO: 488795 - RNA, 21 nt, Homo sapiens
cagcauuggccuggccagacc

SEQ ID NO: 488796 - RNA, 16 nt, Homo sapiens
cagccacuuauuucca

SEQ ID NO: 488797 - RNA, 16 nt, Homo sapiens
cagccuguaacugucc

SEQ ID NO: 488798 - RNA, 22 nt, Homo sapiens
guccaggagaugaggcuggaua

SEQ ID NO: 488799 - RNA, 14 nt, Homo sapiens
guccugagucugcc

SEQ ID NO: 488800 - RNA, 20 nt, Homo sapiens
guccugggggcugcugcacu

SEQ ID NO: 488801 - RNA, 21 nt, Homo sapiens
guccugggggcugcugcacug

SEQ ID NO: 488802 - RNA, 21 nt, Homo sapiens
guccuucucucaccuccuaaa

SEQ ID NO: 488803 - RNA, 24 nt, Homo sapiens
guccuuuuucuucccuuaggcaau

SEQ ID NO: 488804 - RNA, 15 nt, Homo sapiens
gucguccccagacca

SEQ ID NO: 488805 - RNA, 20 nt, Homo sapiens
gucucaaaauaaaaccagaa

SEQ ID NO: 488806 - RNA, 20 nt, Homo sapiens
gucucaaaggagcuuucuca

SEQ ID NO: 488807 - RNA, 17 nt, Homo sapiens
gucugcuuaguaucuca

SEQ ID NO: 488808 - RNA, 15 nt, Homo sapiens
gucugucaugccaaa

SEQ ID NO: 488809 - RNA, 22 nt, Homo sapiens
gucugugaaagucuccuguauc

SEQ ID NO: 488810 - RNA, 23 nt, Homo sapiens
gucuuaauuaaguaaacuaauga

SEQ ID NO: 488811 - RNA, 20 nt, Homo sapiens
gucuucagggggccaggugc

SEQ ID NO: 488812 - RNA, 21 nt, Homo sapiens
gucuuucuuuuauacugacac

SEQ ID NO: 488813 - RNA, 15 nt, Homo sapiens
gugaacugaagcaga

SEQ ID NO: 488814 - RNA, 14 nt, Homo sapiens
gugaagagcauuug

SEQ ID NO: 488815 - RNA, 20 nt, Homo sapiens
gugacugcgcacugaguaca

SEQ ID NO: 488816 - RNA, 20 nt, Homo sapiens
gugaggucaucccggggcca

SEQ ID NO: 488817 - RNA, 23 nt, Homo sapiens
gugaucuguccuuccaaccuguu

SEQ ID NO: 488818 - RNA, 21 nt, Homo sapiens
gugauuuucaaauauguaaac

SEQ ID NO: 488819 - RNA, 13 nt, Homo sapiens
gugcacggggcca

SEQ ID NO: 488820 - RNA, 16 nt, Homo sapiens
gugccacacaauggau

SEQ ID NO: 488821 - RNA, 22 nt, Homo sapiens
gugcuaauccaggacagcauua

SEQ ID NO: 488822 - RNA, 22 nt, Homo sapiens
gugcuuggaaaauguucugaca

SEQ ID NO: 488823 - RNA, 23 nt, Homo sapiens
gugcuuguucuuccucuuaccug

SEQ ID NO: 488824 - RNA, 15 nt, Homo sapiens
guggaaaacucacag

SEQ ID NO: 488825 - RNA, 18 nt, Homo sapiens
guggaaaccuugcugcua

SEQ ID NO: 488826 - RNA, 16 nt, Homo sapiens
guggagcugcuuccag

SEQ ID NO: 488827 - RNA, 20 nt, Homo sapiens
guggaugaagacccuaucuc

SEQ ID NO: 488828 - RNA, 18 nt, Homo sapiens
guggucugcugccucagg

SEQ ID NO: 488829 - RNA, 21 nt, Homo sapiens
guguccuguuuuuauucccuu

SEQ ID NO: 488830 - RNA, 16 nt, Homo sapiens
gugugcauguguguau

SEQ ID NO: 488831 - RNA, 19 nt, Homo sapiens
guguguauauauguguaua

SEQ ID NO: 488832 - RNA, 13 nt, Homo sapiens
gugugugcaguga

SEQ ID NO: 488833 - RNA, 20 nt, Homo sapiens
guguugggaaaaaggccucu

SEQ ID NO: 488834 - RNA, 14 nt, Homo sapiens
guuaauaacagcuc

SEQ ID NO: 488835 - RNA, 14 nt, Homo sapiens
guuaauguacaaaa

SEQ ID NO: 488836 - RNA, 21 nt, Homo sapiens
guuaaugugauggauggcaca

SEQ ID NO: 488837 - RNA, 21 nt, Homo sapiens
guuacagggaaggaggguagg

SEQ ID NO: 488838 - RNA, 13 nt, Homo sapiens
guuagaccacuuu

SEQ ID NO: 488839 - RNA, 16 nt, Homo sapiens
guuagccucacccggu

SEQ ID NO: 488840 - RNA, 20 nt, Homo sapiens
guuauccuguuuuugcaaaa

SEQ ID NO: 488841 - RNA, 19 nt, Homo sapiens
guucacgugacuccucaau

SEQ ID NO: 488842 - RNA, 16 nt, Homo sapiens
guucagaaaagcaccu

SEQ ID NO: 488843 - RNA, 22 nt, Homo sapiens
guucaggaggagacagucagga

SEQ ID NO: 488844 - RNA, 19 nt, Homo sapiens
guucccauauauuguuaua

SEQ ID NO: 488845 - RNA, 23 nt, Homo sapiens
guuccuuggguuauuauuuugca

SEQ ID NO: 488846 - RNA, 16 nt, Homo sapiens
guugagugcaucccag

SEQ ID NO: 488847 - RNA, 22 nt, Homo sapiens
guuguaaguacucuaauauaca

SEQ ID NO: 488848 - RNA, 16 nt, Homo sapiens
guuuaacauacaauca

SEQ ID NO: 488849 - RNA, 16 nt, Homo sapiens
guuuaagguucuugcu

SEQ ID NO: 488850 - RNA, 23 nt, Homo sapiens
guuuacacugucaaacaucugga

SEQ ID NO: 488851 - RNA, 18 nt, Homo sapiens
guuuagaaucaagucugu

SEQ ID NO: 488852 - RNA, 20 nt, Homo sapiens
guuuagaaucaagucuguga

SEQ ID NO: 488853 - RNA, 18 nt, Homo sapiens
guuuagugugauugugaa

SEQ ID NO: 488854 - RNA, 20 nt, Homo sapiens
guuuauuauaaacaaaaagc

SEQ ID NO: 488855 - RNA, 15 nt, Homo sapiens
guuuccucagccuca

SEQ ID NO: 488856 - RNA, 23 nt, Homo sapiens
guuuccucagccucacccugcau

SEQ ID NO: 488857 - RNA, 15 nt, Homo sapiens
guuugaacucuguaa

SEQ ID NO: 488858 - RNA, 13 nt, Homo sapiens
guuuucacuguaa

SEQ ID NO: 488859 - RNA, 22 nt, Homo sapiens
guuuucauccauuaaaauuaau

SEQ ID NO: 488860 - RNA, 17 nt, Homo sapiens
guuuugcaugucugcau

SEQ ID NO: 488861 - RNA, 22 nt, Homo sapiens
guuuuguaaugagauuuacuua

SEQ ID NO: 488862 - RNA, 15 nt, Homo sapiens
uaaaaauuaugucca

SEQ ID NO: 488863 - RNA, 15 nt, Homo sapiens
uaaaacauguacaaa

SEQ ID NO: 488864 - RNA, 23 nt, Homo sapiens
uaaaacauuauagauuuucaugu

SEQ ID NO: 488865 - RNA, 22 nt, Homo sapiens
augcacuauauguuuacacaau

SEQ ID NO: 488866 - RNA, 17 nt, Homo sapiens
augccaauuucucuuaa

SEQ ID NO: 488867 - RNA, 23 nt, Homo sapiens
augccaauuucucuuaaguacug

SEQ ID NO: 488868 - RNA, 12 nt, Homo sapiens
augcgcaaauac

SEQ ID NO: 488869 - RNA, 22 nt, Homo sapiens
augcgcugaucguuucuuccag

SEQ ID NO: 488870 - RNA, 23 nt, Homo sapiens
augcuaucucgcuagccauauau

SEQ ID NO: 488871 - RNA, 20 nt, Homo sapiens
augcugauuuaaacuucuua

SEQ ID NO: 488872 - RNA, 22 nt, Homo sapiens
augcugcugagcacaucucuuc

SEQ ID NO: 488873 - RNA, 19 nt, Homo sapiens
augcuggacauuaacaaga

SEQ ID NO: 488874 - RNA, 19 nt, Homo sapiens
augcugggacccucggggc

SEQ ID NO: 488875 - RNA, 18 nt, Homo sapiens
auggaagacaaauacaca

SEQ ID NO: 488876 - RNA, 16 nt, Homo sapiens
auggaagccacaucac

SEQ ID NO: 488877 - RNA, 16 nt, Homo sapiens
auggaggcacacagcu

SEQ ID NO: 488878 - RNA, 14 nt, Homo sapiens
auggauccuuguca

SEQ ID NO: 488879 - RNA, 14 nt, Homo sapiens
auggcuacugugcc

SEQ ID NO: 488880 - RNA, 20 nt, Homo sapiens
auggcucauucugcaaugag

SEQ ID NO: 488881 - RNA, 16 nt, Homo sapiens
augguacaaaccaaau

SEQ ID NO: 488882 - RNA, 16 nt, Homo sapiens
augguagacugugaca

SEQ ID NO: 488883 - RNA, 19 nt, Homo sapiens
auguaaacuuuaacuucca

SEQ ID NO: 488884 - RNA, 22 nt, Homo sapiens
auguaaaugaaguaacuugucu

SEQ ID NO: 488885 - RNA, 12 nt, Homo sapiens
auguacagcucu

SEQ ID NO: 488886 - RNA, 17 nt, Homo sapiens
auguauacgcacgcacc

SEQ ID NO: 488887 - RNA, 14 nt, Homo sapiens
auguauauuuacca

SEQ ID NO: 488888 - RNA, 13 nt, Homo sapiens
augucacuguuau

SEQ ID NO: 488889 - RNA, 20 nt, Homo sapiens
augucacuucccugcuuaaa

SEQ ID NO: 488890 - RNA, 17 nt, Homo sapiens
auguccaaacuuaacag

SEQ ID NO: 488891 - RNA, 13 nt, Homo sapiens
augucgcacaaug

SEQ ID NO: 488892 - RNA, 15 nt, Homo sapiens
augucucgcuaguga

SEQ ID NO: 488893 - RNA, 19 nt, Homo sapiens
augucuuuaaaaugauuca

SEQ ID NO: 488894 - RNA, 15 nt, Homo sapiens
augugacgcacugua

SEQ ID NO: 488895 - RNA, 16 nt, Homo sapiens
augugacgcacuguau

SEQ ID NO: 488896 - RNA, 22 nt, Homo sapiens
augugauggauggcacaaugaa

SEQ ID NO: 488897 - RNA, 18 nt, Homo sapiens
augugcgaacacagugac

SEQ ID NO: 488898 - RNA, 17 nt, Homo sapiens
augugcucuacaucucg

SEQ ID NO: 488899 - RNA, 19 nt, Homo sapiens
auguggaaaacucacagau

SEQ ID NO: 488900 - RNA, 17 nt, Homo sapiens
auguggccuuuaucuca

SEQ ID NO: 488901 - RNA, 21 nt, Homo sapiens
auguguccgugaaaguuguga

SEQ ID NO: 488902 - RNA, 16 nt, Homo sapiens
augugucuugcaauga

SEQ ID NO: 488903 - RNA, 16 nt, Homo sapiens
augugugcuuggaaaa

SEQ ID NO: 488904 - RNA, 14 nt, Homo sapiens
augugugugcuuug

SEQ ID NO: 488905 - RNA, 13 nt, Homo sapiens
auguucugacagc

SEQ ID NO: 488906 - RNA, 19 nt, Homo sapiens
auguugauguguccgugaa

SEQ ID NO: 488907 - RNA, 19 nt, Homo sapiens
auguuuuuaugauaucccu

SEQ ID NO: 488908 - RNA, 13 nt, Homo sapiens
auuaaaaacauuu

SEQ ID NO: 488909 - RNA, 20 nt, Homo sapiens
auuaaagagccauucuggca

SEQ ID NO: 488910 - RNA, 22 nt, Homo sapiens
auuaaccuuaucauaaauucaa

SEQ ID NO: 488911 - RNA, 13 nt, Homo sapiens
auuaacuuccucu

SEQ ID NO: 488912 - RNA, 16 nt, Homo sapiens
auuaaguaaacuaaug

SEQ ID NO: 488913 - RNA, 23 nt, Homo sapiens
auuaauaccugaccucacagagu

SEQ ID NO: 488914 - RNA, 19 nt, Homo sapiens
auuacccuucuuuccauuu

SEQ ID NO: 488915 - RNA, 15 nt, Homo sapiens
auuacuuacuuauua

SEQ ID NO: 488916 - RNA, 21 nt, Homo sapiens
auuagauuuuaaaacuucauc

SEQ ID NO: 488917 - RNA, 16 nt, Homo sapiens
auuagcccacugccug

SEQ ID NO: 488918 - RNA, 20 nt, Homo sapiens
auuauauucccaaaucucaa

SEQ ID NO: 488919 - RNA, 21 nt, Homo sapiens
auuaucauaugaacuugucag

SEQ ID NO: 488920 - RNA, 13 nt, Homo sapiens
auuauuugcacag

SEQ ID NO: 488921 - RNA, 14 nt, Homo sapiens
auuauuugcacaga

SEQ ID NO: 488922 - RNA, 15 nt, Homo sapiens
auuauuugcacagaa

SEQ ID NO: 488923 - RNA, 17 nt, Homo sapiens
auuauuugcacagaaga

SEQ ID NO: 488924 - RNA, 19 nt, Homo sapiens
auucaaaagaugccauuca

SEQ ID NO: 488925 - RNA, 22 nt, Homo sapiens
auucaaaccuaaguugcuggac

SEQ ID NO: 488926 - RNA, 22 nt, Homo sapiens
auucaaagaaucaccuaauuaa

SEQ ID NO: 488927 - RNA, 16 nt, Homo sapiens
auucagagaauaucaa

SEQ ID NO: 488928 - RNA, 21 nt, Homo sapiens
auucagcaaggcgcuaacuug

SEQ ID NO: 488929 - RNA, 15 nt, Homo sapiens
auuccaauuugcacu

SEQ ID NO: 488930 - RNA, 16 nt, Homo sapiens
auuccagggaaccaga

SEQ ID NO: 488931 - RNA, 17 nt, Homo sapiens
auuccagggaaccagag

SEQ ID NO: 488932 - RNA, 20 nt, Homo sapiens
auuccauauuagaaaacuuu

SEQ ID NO: 488933 - RNA, 22 nt, Homo sapiens
auucguccuuagaauacuguau

SEQ ID NO: 488934 - RNA, 17 nt, Homo sapiens
auucuaaguagaguaua

SEQ ID NO: 488935 - RNA, 21 nt, Homo sapiens
auucuauuucaacuucaggaa

SEQ ID NO: 488936 - RNA, 14 nt, Homo sapiens
auucucagauuccu

SEQ ID NO: 488937 - RNA, 17 nt, Homo sapiens
auugaaaaugucacugu

SEQ ID NO: 488938 - RNA, 22 nt, Homo sapiens
auugaagcuaaaauaaaccaga

SEQ ID NO: 488939 - RNA, 19 nt, Homo sapiens
auugagcuagaaaucacaa

SEQ ID NO: 488940 - RNA, 16 nt, Homo sapiens
auugaggaugaacuca

SEQ ID NO: 488941 - RNA, 18 nt, Homo sapiens
auugccacauaauucauu

SEQ ID NO: 488942 - RNA, 18 nt, Homo sapiens
auugccuugagguacuuu

SEQ ID NO: 488943 - RNA, 19 nt, Homo sapiens
auugcuaccaaaaacuaga

SEQ ID NO: 488944 - RNA, 14 nt, Homo sapiens
auugcuaguuuaaa

SEQ ID NO: 488945 - RNA, 13 nt, Homo sapiens
auuggcagaagca

SEQ ID NO: 488946 - RNA, 22 nt, Homo sapiens
auuggucaagaaaagcaugaaa

SEQ ID NO: 488947 - RNA, 21 nt, Homo sapiens
auuguauagccccacagauua

SEQ ID NO: 488948 - RNA, 13 nt, Homo sapiens
auuuaaaacauuu

SEQ ID NO: 488949 - RNA, 15 nt, Homo sapiens
auuuaaacuucuuaa

SEQ ID NO: 488950 - RNA, 15 nt, Homo sapiens
auuuaagcacaaaaa

SEQ ID NO: 488951 - RNA, 17 nt, Homo sapiens
auuuacagcauacuuaa

SEQ ID NO: 488952 - RNA, 23 nt, Homo sapiens
auuuacuuguuauguuguaauau

SEQ ID NO: 488953 - RNA, 16 nt, Homo sapiens
auuuagcacaguauuu

SEQ ID NO: 488954 - RNA, 17 nt, Homo sapiens
auuuaugagaucacuga

SEQ ID NO: 488955 - RNA, 20 nt, Homo sapiens
auuucauaccuguacacacu

SEQ ID NO: 488956 - RNA, 15 nt, Homo sapiens
auuuccuccugggca

SEQ ID NO: 488957 - RNA, 18 nt, Homo sapiens
auuucuaacucugaugua

SEQ ID NO: 488958 - RNA, 16 nt, Homo sapiens
auuucuaaguguuuca

SEQ ID NO: 488959 - RNA, 17 nt, Homo sapiens
cagagugaagagugaag

SEQ ID NO: 488960 - RNA, 21 nt, Homo sapiens
cagaucaagaaaaaaagggag

SEQ ID NO: 488961 - RNA, 22 nt, Homo sapiens
cagaucaagaaaaaaagggaga

SEQ ID NO: 488962 - RNA, 14 nt, Homo sapiens
cagauccaccugca

SEQ ID NO: 488963 - RNA, 19 nt, Homo sapiens
cagaugauccuugcacaga

SEQ ID NO: 488964 - RNA, 22 nt, Homo sapiens
cagauuccuuuggccacuguau

SEQ ID NO: 488965 - RNA, 19 nt, Homo sapiens
cagauugaaggaagacaug

SEQ ID NO: 488966 - RNA, 19 nt, Homo sapiens
cagauuuaagcaagaccau

SEQ ID NO: 488967 - RNA, 23 nt, Homo sapiens
cagauuuauuuuugaaacaaaca

SEQ ID NO: 488968 - RNA, 12 nt, Homo sapiens
cagcaaauuaau

SEQ ID NO: 488969 - RNA, 11 nt, Homo sapiens
cagcacuuugg

SEQ ID NO: 488970 - RNA, 18 nt, Homo sapiens
cagcacuuuguuucauau

SEQ ID NO: 488971 - RNA, 15 nt, Homo sapiens
cagcagcugaagcca

SEQ ID NO: 488972 - RNA, 16 nt, Homo sapiens
cagcagcugaagccag

SEQ ID NO: 488973 - RNA, 22 nt, Homo sapiens
cagcagguugugugugugugca

SEQ ID NO: 488974 - RNA, 17 nt, Homo sapiens
cagcauuucagcuguga

SEQ ID NO: 488975 - RNA, 20 nt, Homo sapiens
cagccacuuauuuccaugga

SEQ ID NO: 488976 - RNA, 19 nt, Homo sapiens
cagcccugauugcgcaaaa

SEQ ID NO: 488977 - RNA, 16 nt, Homo sapiens
cagcuaagccugauga

SEQ ID NO: 488978 - RNA, 16 nt, Homo sapiens
cagcucagugagcugg

SEQ ID NO: 488979 - RNA, 13 nt, Homo sapiens
cagcucccugaau

SEQ ID NO: 488980 - RNA, 13 nt, Homo sapiens
cagcugaagccag

SEQ ID NO: 488981 - RNA, 13 nt, Homo sapiens
cagcugcauggca

SEQ ID NO: 488982 - RNA, 15 nt, Homo sapiens
cagcugcauggcaca

SEQ ID NO: 488983 - RNA, 20 nt, Homo sapiens
cagcuggccaccauggcacc

SEQ ID NO: 488984 - RNA, 16 nt, Homo sapiens
cagcugucuguggcuu

SEQ ID NO: 488985 - RNA, 23 nt, Homo sapiens
cagcugugugugcccguggugag

SEQ ID NO: 488986 - RNA, 19 nt, Homo sapiens
cagcuucaccagagcauuu

SEQ ID NO: 488987 - RNA, 20 nt, Homo sapiens
cagcuucaccagagcauuuc

SEQ ID NO: 488988 - RNA, 21 nt, Homo sapiens
cagcuucaccagagcauuucc

SEQ ID NO: 488989 - RNA, 22 nt, Homo sapiens
cagcuuccagaugauccuugca

SEQ ID NO: 488990 - RNA, 20 nt, Homo sapiens
caggacaacuuuacaaaaca

SEQ ID NO: 488991 - RNA, 21 nt, Homo sapiens
caggagaaaccccugacaccu

SEQ ID NO: 488992 - RNA, 23 nt, Homo sapiens
caggagaggauggcccaggguga

SEQ ID NO: 488993 - RNA, 23 nt, Homo sapiens
caggagggcugggcuccacuuca

SEQ ID NO: 488994 - RNA, 20 nt, Homo sapiens
caggaguucaagaccagccu

SEQ ID NO: 488995 - RNA, 19 nt, Homo sapiens
caggauaauauauuugcag

SEQ ID NO: 488996 - RNA, 17 nt, Homo sapiens
caggauuagacagucaa

SEQ ID NO: 488997 - RNA, 23 nt, Homo sapiens
caggcaugucccaugugagcugc

SEQ ID NO: 488998 - RNA, 23 nt, Homo sapiens
cagggauuuguccuuggggacau

SEQ ID NO: 488999 - RNA, 12 nt, Homo sapiens
cagggcacuucc

SEQ ID NO: 489000 - RNA, 13 nt, Homo sapiens
cagggcacuuccg

SEQ ID NO: 489001 - RNA, 21 nt, Homo sapiens
caggugacuuuccuaugacac

SEQ ID NO: 489002 - RNA, 13 nt, Homo sapiens
caggugcacagac

SEQ ID NO: 489003 - RNA, 19 nt, Homo sapiens
caggugccccucucuccau

SEQ ID NO: 489004 - RNA, 20 nt, Homo sapiens
caggugccccucucuccauc

SEQ ID NO: 489005 - RNA, 21 nt, Homo sapiens
caguaaauguauauugaugua

SEQ ID NO: 489006 - RNA, 12 nt, Homo sapiens
ccaaauugcagc

SEQ ID NO: 489007 - RNA, 21 nt, Homo sapiens
ccaacaugugauguguugcuc

SEQ ID NO: 489008 - RNA, 16 nt, Homo sapiens
ccaacccaaaccugga

SEQ ID NO: 489009 - RNA, 23 nt, Homo sapiens
ccaacguggggcagcacagagag

SEQ ID NO: 489010 - RNA, 16 nt, Homo sapiens
ccaacuuuguuuucca

SEQ ID NO: 489011 - RNA, 16 nt, Homo sapiens
ccaagacucuuuauga

SEQ ID NO: 489012 - RNA, 21 nt, Homo sapiens
ccaagagagggccaugcaauu

SEQ ID NO: 489013 - RNA, 13 nt, Homo sapiens
ccaaggaacaaga

SEQ ID NO: 489014 - RNA, 14 nt, Homo sapiens
ccaaggaacaagac

SEQ ID NO: 489015 - RNA, 17 nt, Homo sapiens
ccaagguucugggugca

SEQ ID NO: 489016 - RNA, 14 nt, Homo sapiens
ccaaguaacauuuu

SEQ ID NO: 489017 - RNA, 16 nt, Homo sapiens
ccaagugaaugaguuu

SEQ ID NO: 489018 - RNA, 16 nt, Homo sapiens
ccaauuugcacuuuca

SEQ ID NO: 489019 - RNA, 23 nt, Homo sapiens
ccacacgcugcaccuaaagccua

SEQ ID NO: 489020 - RNA, 14 nt, Homo sapiens
ccacacguuugcca

SEQ ID NO: 489021 - RNA, 13 nt, Homo sapiens
ccacauaauucau

SEQ ID NO: 489022 - RNA, 11 nt, Homo sapiens
ccacauuccaa

SEQ ID NO: 489023 - RNA, 16 nt, Homo sapiens
ccaccaaaacugcucc

SEQ ID NO: 489024 - RNA, 20 nt, Homo sapiens
ccaccaccaaaacugcuccu

SEQ ID NO: 489025 - RNA, 22 nt, Homo sapiens
ccaccauggcacccugcaccag

SEQ ID NO: 489026 - RNA, 12 nt, Homo sapiens
ccacccuaucau

SEQ ID NO: 489027 - RNA, 13 nt, Homo sapiens
ccacccugcucau

SEQ ID NO: 489028 - RNA, 22 nt, Homo sapiens
ccaccugccugcaucugugaaa

SEQ ID NO: 489029 - RNA, 14 nt, Homo sapiens
ccacugagucucau

SEQ ID NO: 489030 - RNA, 17 nt, Homo sapiens
ccacuuauuuccaugga

SEQ ID NO: 489031 - RNA, 15 nt, Homo sapiens
ccagagcauuuccaa

SEQ ID NO: 489032 - RNA, 17 nt, Homo sapiens
ccagaggggcggggcca

SEQ ID NO: 489033 - RNA, 19 nt, Homo sapiens
ccagaugauccuugcacag

SEQ ID NO: 489034 - RNA, 21 nt, Homo sapiens
ccagccugaugccaccuccuc

SEQ ID NO: 489035 - RNA, 13 nt, Homo sapiens
ccaggacagcauu

SEQ ID NO: 489036 - RNA, 20 nt, Homo sapiens
ccaggagcgcagcugcauuu

SEQ ID NO: 489037 - RNA, 11 nt, Homo sapiens
ccaggagcuca

SEQ ID NO: 489038 - RNA, 18 nt, Homo sapiens
ccaggcaccaucucccuu

SEQ ID NO: 489039 - RNA, 24 nt, Homo sapiens
ccagggcucuggcagguggccagg

SEQ ID NO: 489040 - RNA, 17 nt, Homo sapiens
ccagucauauguucuca

SEQ ID NO: 489041 - RNA, 12 nt, Homo sapiens
ccagucuuccac

SEQ ID NO: 489042 - RNA, 21 nt, Homo sapiens
ccagugcucacacaaucagac

SEQ ID NO: 489043 - RNA, 21 nt, Homo sapiens
ccaguguccccaggggcacac

SEQ ID NO: 489044 - RNA, 20 nt, Homo sapiens
ccaguguuuacaaggugaca

SEQ ID NO: 489045 - RNA, 15 nt, Homo sapiens
ccaguuaacuguuaa

SEQ ID NO: 489046 - RNA, 14 nt, Homo sapiens
ccauacuucucuca

SEQ ID NO: 489047 - RNA, 15 nt, Homo sapiens
ccauacuucucucag

SEQ ID NO: 489048 - RNA, 15 nt, Homo sapiens
ccauauuaaaaucug

SEQ ID NO: 489049 - RNA, 18 nt, Homo sapiens
ccauccaucaugcaaaau

SEQ ID NO: 489050 - RNA, 21 nt, Homo sapiens
ccaugcaucacuauucagaag

SEQ ID NO: 489051 - RNA, 22 nt, Homo sapiens
ccauggaagcuggcaggagaca

SEQ ID NO: 489052 - RNA, 20 nt, Homo sapiens
ccauggcuccucaccaccga

SEQ ID NO: 489053 - RNA, 21 nt, Homo sapiens
ccaugguagacugugacacag

SEQ ID NO: 489054 - RNA, 18 nt, Homo sapiens
ccauucccagauguacca

SEQ ID NO: 489055 - RNA, 19 nt, Homo sapiens
cccaaaagucaccacucca

SEQ ID NO: 489056 - RNA, 20 nt, Homo sapiens
cccaaauuaagaaucuagga

SEQ ID NO: 489057 - RNA, 19 nt, Homo sapiens
cccaacuagacauuaccaa

SEQ ID NO: 489058 - RNA, 21 nt, Homo sapiens
cccaggacuuauccaugcauc

SEQ ID NO: 489059 - RNA, 19 nt, Homo sapiens
cccaucgucucggccuuca

SEQ ID NO: 489060 - RNA, 14 nt, Homo sapiens
cccaugagugcuaa

SEQ ID NO: 489061 - RNA, 20 nt, Homo sapiens
ccccacaacacaccuugccc

SEQ ID NO: 489062 - RNA, 18 nt, Homo sapiens
ccccagagcuggaccuga

SEQ ID NO: 489063 - RNA, 17 nt, Homo sapiens
cccggagagguaacuga

SEQ ID NO: 489064 - RNA, 12 nt, Homo sapiens
cccgugccaaau

SEQ ID NO: 489065 - RNA, 20 nt, Homo sapiens
cccucucuccacauuccaaa

SEQ ID NO: 489066 - RNA, 23 nt, Homo sapiens
cccucuuuucugaucugcaguuu

SEQ ID NO: 489067 - RNA, 12 nt, Homo sapiens
cccugacacugu

SEQ ID NO: 489068 - RNA, 16 nt, Homo sapiens
cccugauugcgcaaaa

SEQ ID NO: 489069 - RNA, 18 nt, Homo sapiens
cccuggggccuguacaaa

SEQ ID NO: 489070 - RNA, 16 nt, Homo sapiens
cccugguccugcacug

SEQ ID NO: 489071 - RNA, 15 nt, Homo sapiens
cccuucaacuaugca

SEQ ID NO: 489072 - RNA, 19 nt, Homo sapiens
cccuucaaugcaaaauaca

SEQ ID NO: 489073 - RNA, 11 nt, Homo sapiens
cccuucacugu

SEQ ID NO: 489074 - RNA, 12 nt, Homo sapiens
ccgccauccacc

SEQ ID NO: 489075 - RNA, 23 nt, Homo sapiens
ccgccauccaccccguugcucaa

SEQ ID NO: 489076 - RNA, 16 nt, Homo sapiens
ccgggcaggcauuuca

SEQ ID NO: 489077 - RNA, 23 nt, Homo sapiens
ccguuguguggguuuacucugug

SEQ ID NO: 489078 - RNA, 20 nt, Homo sapiens
ccuagauuuuaaauagacaa

SEQ ID NO: 489079 - RNA, 19 nt, Homo sapiens
ccuagucuucuguguaugu

SEQ ID NO: 489080 - RNA, 21 nt, Homo sapiens
ccuaguuguucagcauggcau

SEQ ID NO: 489081 - RNA, 22 nt, Homo sapiens
ccuaugaaguuggcacauuuca

SEQ ID NO: 489082 - RNA, 18 nt, Homo sapiens
ccuauuuuggacguguga

SEQ ID NO: 489083 - RNA, 19 nt, Homo sapiens
ccucaccauuuuuguucua

SEQ ID NO: 489084 - RNA, 19 nt, Homo sapiens
ccuccaagugaaugaguuu

SEQ ID NO: 489085 - RNA, 17 nt, Homo sapiens
ccuccuaaaguagacuu

SEQ ID NO: 489086 - RNA, 13 nt, Homo sapiens
ccuccugaugucu

SEQ ID NO: 489087 - RNA, 16 nt, Homo sapiens
ccuccuguauuccuga

SEQ ID NO: 489088 - RNA, 16 nt, Homo sapiens
ccuccuugucuuggca

SEQ ID NO: 489089 - RNA, 17 nt, Homo sapiens
ccucugcauaaauauua

SEQ ID NO: 489090 - RNA, 22 nt, Homo sapiens
ccucuggagaguagaugcuugc

SEQ ID NO: 489091 - RNA, 13 nt, Homo sapiens
ccucuuaccugua

SEQ ID NO: 489092 - RNA, 16 nt, Homo sapiens
ccucuuucacuucuua

SEQ ID NO: 489093 - RNA, 16 nt, Homo sapiens
ccugaaagcaacagcu

SEQ ID NO: 489094 - RNA, 18 nt, Homo sapiens
ccugacagcaaacacagu

SEQ ID NO: 489095 - RNA, 18 nt, Homo sapiens
ccugagaagccucauggg

SEQ ID NO: 489096 - RNA, 20 nt, Homo sapiens
ccugaugugacgcacuguau

SEQ ID NO: 489097 - RNA, 21 nt, Homo sapiens
ccugaugugacgcacuguauu

SEQ ID NO: 489098 - RNA, 15 nt, Homo sapiens
ccugcaucugugaaa

SEQ ID NO: 489099 - RNA, 17 nt, Homo sapiens
ccugcccccgcucugcc

SEQ ID NO: 489100 - RNA, 21 nt, Homo sapiens
ccugccugcaucugugaaaag

SEQ ID NO: 489101 - RNA, 22 nt, Homo sapiens
ccugcuacaguagcugugggga

SEQ ID NO: 489102 - RNA, 22 nt, Homo sapiens
ccugcuuagugucccuuaccug

SEQ ID NO: 489103 - RNA, 18 nt, Homo sapiens
ccuggccaggauaauaua

SEQ ID NO: 489104 - RNA, 14 nt, Homo sapiens
ccugggguuuccac

SEQ ID NO: 489105 - RNA, 11 nt, Homo sapiens
ccugguggugg

SEQ ID NO: 489106 - RNA, 16 nt, Homo sapiens
ccuguacacacacaga

SEQ ID NO: 489107 - RNA, 17 nt, Homo sapiens
ccuguacacacacagac

SEQ ID NO: 489108 - RNA, 14 nt, Homo sapiens
ccuguuuugcaaau

SEQ ID NO: 489109 - RNA, 15 nt, Homo sapiens
ccuguuuuugcaaaa

SEQ ID NO: 489110 - RNA, 16 nt, Homo sapiens
ccuguuuuugcaaaaa

SEQ ID NO: 489111 - RNA, 22 nt, Homo sapiens
ccuuaaauuaguacagcacuuu

SEQ ID NO: 489112 - RNA, 16 nt, Homo sapiens
ccuuaauuaauucuca

SEQ ID NO: 489113 - RNA, 21 nt, Homo sapiens
ccuuaauuuaagucauuuuca

SEQ ID NO: 489114 - RNA, 17 nt, Homo sapiens
ccuuagaauacuguauu

SEQ ID NO: 489115 - RNA, 16 nt, Homo sapiens
ccuuaucauaaauuca

SEQ ID NO: 489116 - RNA, 20 nt, Homo sapiens
ccuucccugacacugucugc

SEQ ID NO: 489117 - RNA, 15 nt, Homo sapiens
ccuucguguugccau

SEQ ID NO: 489118 - RNA, 16 nt, Homo sapiens
ccuucuaauccaugug

SEQ ID NO: 489119 - RNA, 17 nt, Homo sapiens
ccuucuccacagggaca

SEQ ID NO: 489120 - RNA, 23 nt, Homo sapiens
ccuucugucguccccagaccagu

SEQ ID NO: 489121 - RNA, 14 nt, Homo sapiens
ccuucuuuccagag

SEQ ID NO: 489122 - RNA, 22 nt, Homo sapiens
ccuucuuuugaaggacuccuua

SEQ ID NO: 489123 - RNA, 22 nt, Homo sapiens
ccuugacguuucuucuuucuag

SEQ ID NO: 489124 - RNA, 21 nt, Homo sapiens
ccuugcauuuuagcuaauuua

SEQ ID NO: 489125 - RNA, 16 nt, Homo sapiens
ccuugcuuaccucuca

SEQ ID NO: 489126 - RNA, 20 nt, Homo sapiens
ccuuggcgcgcagcccggga

SEQ ID NO: 489127 - RNA, 13 nt, Homo sapiens
ccuugucuuggca

SEQ ID NO: 489128 - RNA, 15 nt, Homo sapiens
ccuuuggaaggugac

SEQ ID NO: 489129 - RNA, 19 nt, Homo sapiens
ccuuuguguagaaagccaa

SEQ ID NO: 489130 - RNA, 23 nt, Homo sapiens
ccuuuuauuuuuuaagguaacaa

SEQ ID NO: 489131 - RNA, 20 nt, Homo sapiens
ccuuuugguuccucacauau

SEQ ID NO: 489132 - RNA, 20 nt, Homo sapiens
cgaaaauucauuucacauua

SEQ ID NO: 489133 - RNA, 14 nt, Homo sapiens
cgaacacagugaca

SEQ ID NO: 489134 - RNA, 15 nt, Homo sapiens
cgaggacagcaaugc

SEQ ID NO: 489135 - RNA, 17 nt, Homo sapiens
cgcaagucacagaaaau

SEQ ID NO: 489136 - RNA, 21 nt, Homo sapiens
cgcaccgacuagacacacaaa

SEQ ID NO: 489137 - RNA, 19 nt, Homo sapiens
cgcauguacaaaaacacaa

SEQ ID NO: 489138 - RNA, 14 nt, Homo sapiens
cgccugggaucuga

SEQ ID NO: 489139 - RNA, 19 nt, Homo sapiens
cgcuccacguuucaggcag

SEQ ID NO: 489140 - RNA, 18 nt, Homo sapiens
cucauucugcaaugagcc

SEQ ID NO: 489141 - RNA, 19 nt, Homo sapiens
cucauucugcaaugagcca

SEQ ID NO: 489142 - RNA, 21 nt, Homo sapiens
cucauucugcaaugagccaug

SEQ ID NO: 489143 - RNA, 16 nt, Homo sapiens
cucauuguucagaaaa

SEQ ID NO: 489144 - RNA, 20 nt, Homo sapiens
cuccaccgucuuucuuuuau

SEQ ID NO: 489145 - RNA, 13 nt, Homo sapiens
cuccagucuucca

SEQ ID NO: 489146 - RNA, 14 nt, Homo sapiens
cuccagucuuccac

SEQ ID NO: 489147 - RNA, 16 nt, Homo sapiens
cuccaguucugaugag

SEQ ID NO: 489148 - RNA, 14 nt, Homo sapiens
cucccaacucuugc

SEQ ID NO: 489149 - RNA, 18 nt, Homo sapiens
cucccaacucuugcacag

SEQ ID NO: 489150 - RNA, 18 nt, Homo sapiens
cucccacaucccccgugu

SEQ ID NO: 489151 - RNA, 17 nt, Homo sapiens
cucccugaaucugacca

SEQ ID NO: 489152 - RNA, 19 nt, Homo sapiens
cuccuccuugucuuggcag

SEQ ID NO: 489153 - RNA, 15 nt, Homo sapiens
cuccugccauagucu

SEQ ID NO: 489154 - RNA, 16 nt, Homo sapiens
cuccugcucauugugg

SEQ ID NO: 489155 - RNA, 20 nt, Homo sapiens
cuccuucacucccugucaua

SEQ ID NO: 489156 - RNA, 17 nt, Homo sapiens
cuccuugcuuccugucu

SEQ ID NO: 489157 - RNA, 16 nt, Homo sapiens
cuccuuuaauauacuc

SEQ ID NO: 489158 - RNA, 19 nt, Homo sapiens
cuccuuuggaaggugacac

SEQ ID NO: 489159 - RNA, 22 nt, Homo sapiens
cuccuuuugguuccucacauau

SEQ ID NO: 489160 - RNA, 14 nt, Homo sapiens
cucggccuucacaa

SEQ ID NO: 489161 - RNA, 15 nt, Homo sapiens
cucuaaaacuagaaa

SEQ ID NO: 489162 - RNA, 16 nt, Homo sapiens
cucuacuaaugccucu

SEQ ID NO: 489163 - RNA, 12 nt, Homo sapiens
cucucagccuua

SEQ ID NO: 489164 - RNA, 17 nt, Homo sapiens
cucucccaacucuugca

SEQ ID NO: 489165 - RNA, 18 nt, Homo sapiens
cucucccaacucuugcac

SEQ ID NO: 489166 - RNA, 21 nt, Homo sapiens
cucucuggcuaaggacaggca

SEQ ID NO: 489167 - RNA, 12 nt, Homo sapiens
cucugaauucca

SEQ ID NO: 489168 - RNA, 16 nt, Homo sapiens
cucugcaccuuugcac

SEQ ID NO: 489169 - RNA, 11 nt, Homo sapiens
cucuguaaaac

SEQ ID NO: 489170 - RNA, 17 nt, Homo sapiens
cucuucauuuucccauu

SEQ ID NO: 489171 - RNA, 12 nt, Homo sapiens
cucuucuggaau

SEQ ID NO: 489172 - RNA, 16 nt, Homo sapiens
cucuuucccuuccagu

SEQ ID NO: 489173 - RNA, 21 nt, Homo sapiens
cugaaauccgggucaagugaa

SEQ ID NO: 489174 - RNA, 15 nt, Homo sapiens
cugaacacugaaguc

SEQ ID NO: 489175 - RNA, 12 nt, Homo sapiens
cugaaccagaga

SEQ ID NO: 489176 - RNA, 17 nt, Homo sapiens
cugaacuccugccauag

SEQ ID NO: 489177 - RNA, 15 nt, Homo sapiens
cugaagcagagucaa

SEQ ID NO: 489178 - RNA, 18 nt, Homo sapiens
cugacagcaaacacaguc

SEQ ID NO: 489179 - RNA, 21 nt, Homo sapiens
cugacauauuucauaagcaca

SEQ ID NO: 489180 - RNA, 23 nt, Homo sapiens
cugacauauuucauaagcacauc

SEQ ID NO: 489181 - RNA, 23 nt, Homo sapiens
cugaggcaugaaaauuguguuac

SEQ ID NO: 489182 - RNA, 21 nt, Homo sapiens
cugauagauauccuuggcaca

SEQ ID NO: 489183 - RNA, 15 nt, Homo sapiens
cugauccuuguggca

SEQ ID NO: 489184 - RNA, 21 nt, Homo sapiens
cugauguugguaucuaaggcu

SEQ ID NO: 489185 - RNA, 19 nt, Homo sapiens
cugauugcgcaaaacugaa

SEQ ID NO: 489186 - RNA, 18 nt, Homo sapiens
cugauuuaaacuucuuaa

SEQ ID NO: 489187 - RNA, 14 nt, Homo sapiens
cugcaaugagccau

SEQ ID NO: 489188 - RNA, 19 nt, Homo sapiens
cugcaccaggccaucagca

SEQ ID NO: 489189 - RNA, 20 nt, Homo sapiens
cugcagagcacaaacuucag

SEQ ID NO: 489190 - RNA, 17 nt, Homo sapiens
cugcaggccacuuaccu

SEQ ID NO: 489191 - RNA, 15 nt, Homo sapiens
cugcaucugugaaaa

SEQ ID NO: 489192 - RNA, 13 nt, Homo sapiens
cugcauggcacau

SEQ ID NO: 489193 - RNA, 18 nt, Homo sapiens
cugcauggcucacacaga

SEQ ID NO: 489194 - RNA, 20 nt, Homo sapiens
cugcauuucaaguuaauucu

SEQ ID NO: 489195 - RNA, 22 nt, Homo sapiens
cugccaagagagggccaugcaa

SEQ ID NO: 489196 - RNA, 14 nt, Homo sapiens
cugccuguggugag

SEQ ID NO: 489197 - RNA, 12 nt, Homo sapiens
cugcguuuucau

SEQ ID NO: 489198 - RNA, 20 nt, Homo sapiens
cugcuauuuuacugucuuaa

SEQ ID NO: 489199 - RNA, 16 nt, Homo sapiens
cugcucuugggcaaua

SEQ ID NO: 489200 - RNA, 15 nt, Homo sapiens
cugcugcacugcccu

SEQ ID NO: 489201 - RNA, 13 nt, Homo sapiens
cugcuucucagcg

SEQ ID NO: 489202 - RNA, 14 nt, Homo sapiens
cugcuuuugcaaau

SEQ ID NO: 489203 - RNA, 19 nt, Homo sapiens
cuggaauaagaagcaaaua

SEQ ID NO: 489204 - RNA, 15 nt, Homo sapiens
cuggccagaccaggu

SEQ ID NO: 489205 - RNA, 22 nt, Homo sapiens
cuggccuauuuuggacguguga

SEQ ID NO: 489206 - RNA, 23 nt, Homo sapiens
cuggccuauuuuggacgugugag

SEQ ID NO: 489207 - RNA, 14 nt, Homo sapiens
cugggcuacaauuu

SEQ ID NO: 489208 - RNA, 19 nt, Homo sapiens
cuggggcuuuugugccagg

SEQ ID NO: 489209 - RNA, 20 nt, Homo sapiens
cugggggccugaccuccccc

SEQ ID NO: 489210 - RNA, 21 nt, Homo sapiens
cuggucacccccacccccggg

SEQ ID NO: 489211 - RNA, 15 nt, Homo sapiens
cugguccugcacugu

SEQ ID NO: 489212 - RNA, 23 nt, Homo sapiens
cuggugaugggguuuguuuucau

SEQ ID NO: 489213 - RNA, 21 nt, Homo sapiens
cuggugggggccucuuuacca

SEQ ID NO: 489214 - RNA, 21 nt, Homo sapiens
cugguucccccaggacccuga

SEQ ID NO: 489215 - RNA, 20 nt, Homo sapiens
cuguaaaucaagaccaaaga

SEQ ID NO: 489216 - RNA, 22 nt, Homo sapiens
cuguaauagccucaccuucccu

SEQ ID NO: 489217 - RNA, 23 nt, Homo sapiens
acaccacuuucccacacugugaa

SEQ ID NO: 489218 - RNA, 20 nt, Homo sapiens
acacucucuucuuacuguau

SEQ ID NO: 489219 - RNA, 15 nt, Homo sapiens
acacucugaauucca

SEQ ID NO: 489220 - RNA, 16 nt, Homo sapiens
acacucugaauuccaa

SEQ ID NO: 489221 - RNA, 18 nt, Homo sapiens
acacuugaccuucugucg

SEQ ID NO: 489222 - RNA, 14 nt, Homo sapiens
acagaaaccaagga

SEQ ID NO: 489223 - RNA, 20 nt, Homo sapiens
acagaaauauauauacauau

SEQ ID NO: 489224 - RNA, 15 nt, Homo sapiens
acagaaccaauucac

SEQ ID NO: 489225 - RNA, 12 nt, Homo sapiens
acagacacuccu

SEQ ID NO: 489226 - RNA, 21 nt, Homo sapiens
acagacgccugcuuuugcaaa

SEQ ID NO: 489227 - RNA, 22 nt, Homo sapiens
acagagcacuagguucaauucc

SEQ ID NO: 489228 - RNA, 22 nt, Homo sapiens
acagaucaagaaaaaaagggag

SEQ ID NO: 489229 - RNA, 17 nt, Homo sapiens
acagcagcugaagccag

SEQ ID NO: 489230 - RNA, 19 nt, Homo sapiens
acagcccaggcaucuccuu

SEQ ID NO: 489231 - RNA, 15 nt, Homo sapiens
acaggucgccaguga

SEQ ID NO: 489232 - RNA, 22 nt, Homo sapiens
acagucacugcucuucagccau

SEQ ID NO: 489233 - RNA, 15 nt, Homo sapiens
acaguguuuacuuua

SEQ ID NO: 489234 - RNA, 15 nt, Homo sapiens
acaguugggaaaaua

SEQ ID NO: 489235 - RNA, 19 nt, Homo sapiens
acauaaguaagacuugauu

SEQ ID NO: 489236 - RNA, 17 nt, Homo sapiens
acauaguagcaauggau

SEQ ID NO: 489237 - RNA, 19 nt, Homo sapiens
acauauaccuauaaugugu

SEQ ID NO: 489238 - RNA, 19 nt, Homo sapiens
agacagauguggacaugca

SEQ ID NO: 489239 - RNA, 20 nt, Homo sapiens
agacagauguggacaugcac

SEQ ID NO: 489240 - RNA, 14 nt, Homo sapiens
agacaguaaagacc

SEQ ID NO: 489241 - RNA, 18 nt, Homo sapiens
agacaguguguccaguua

SEQ ID NO: 489242 - RNA, 21 nt, Homo sapiens
agacaguugguuuugcauguc

SEQ ID NO: 489243 - RNA, 15 nt, Homo sapiens
agacaugaaauugag

SEQ ID NO: 489244 - RNA, 14 nt, Homo sapiens
agaccaggugaccu

SEQ ID NO: 489245 - RNA, 15 nt, Homo sapiens
agaccaggugaccuu

SEQ ID NO: 489246 - RNA, 12 nt, Homo sapiens
agacccucagac

SEQ ID NO: 489247 - RNA, 13 nt, Homo sapiens
agacccucagacc

SEQ ID NO: 489248 - RNA, 13 nt, Homo sapiens
agacuauauacau

SEQ ID NO: 489249 - RNA, 23 nt, Homo sapiens
agacucagugcacauuuugaaau

SEQ ID NO: 489250 - RNA, 20 nt, Homo sapiens
agacuguaaauuccaaagau

SEQ ID NO: 489251 - RNA, 21 nt, Homo sapiens
agagaaaaagcccucuucaau

SEQ ID NO: 489252 - RNA, 14 nt, Homo sapiens
agagagaaacagcu

SEQ ID NO: 489253 - RNA, 14 nt, Homo sapiens
agagagggggccac

SEQ ID NO: 489254 - RNA, 20 nt, Homo sapiens
agagauuuaucuuuauacag

SEQ ID NO: 489255 - RNA, 14 nt, Homo sapiens
agagcagagaagua

SEQ ID NO: 489256 - RNA, 22 nt, Homo sapiens
agagcauuuccaacaccacaga

SEQ ID NO: 489257 - RNA, 14 nt, Homo sapiens
agagcucaucauca

SEQ ID NO: 489258 - RNA, 15 nt, Homo sapiens
agagcucccaggacg

SEQ ID NO: 489259 - RNA, 13 nt, Homo sapiens
agagcugccagug

SEQ ID NO: 489260 - RNA, 21 nt, Homo sapiens
agaggacaccuguacuggaga

SEQ ID NO: 489261 - RNA, 22 nt, Homo sapiens
agagguagguaggaucauccca

SEQ ID NO: 489262 - RNA, 23 nt, Homo sapiens
agagguugcagugagcugagauc

SEQ ID NO: 489263 - RNA, 17 nt, Homo sapiens
agaguagaugcuugcuc

SEQ ID NO: 489264 - RNA, 15 nt, Homo sapiens
agagucuucaucugu

SEQ ID NO: 489265 - RNA, 14 nt, Homo sapiens
agaguuccuucuca

SEQ ID NO: 489266 - RNA, 20 nt, Homo sapiens
agaucauaauuuuauguuca

SEQ ID NO: 489267 - RNA, 20 nt, Homo sapiens
agauccuggagugauaugau

SEQ ID NO: 489268 - RNA, 18 nt, Homo sapiens
agaucgcgccacugcacu

SEQ ID NO: 489269 - RNA, 21 nt, Homo sapiens
agaucugaauggggcuuuccu

SEQ ID NO: 489270 - RNA, 21 nt, Homo sapiens
agaucuuuuagcccagucaua

SEQ ID NO: 489271 - RNA, 23 nt, Homo sapiens
agaugaauggucuggcaauauuc

SEQ ID NO: 489272 - RNA, 17 nt, Homo sapiens
agaugacaacacacacc

SEQ ID NO: 489273 - RNA, 20 nt, Homo sapiens
agaugcuuugacacugaaua

SEQ ID NO: 489274 - RNA, 18 nt, Homo sapiens
agauuucagcuacauaua

SEQ ID NO: 489275 - RNA, 12 nt, Homo sapiens
agcaaaagccuc

SEQ ID NO: 489276 - RNA, 15 nt, Homo sapiens
agcaagcucacuugc

SEQ ID NO: 489277 - RNA, 19 nt, Homo sapiens
agcaagcucacuugcuuua

SEQ ID NO: 489278 - RNA, 19 nt, Homo sapiens
agcaaugcagagagggcau

SEQ ID NO: 489279 - RNA, 16 nt, Homo sapiens
agcacaucucuucaug

SEQ ID NO: 489280 - RNA, 21 nt, Homo sapiens
agcagaaaaaaaagugucuca

SEQ ID NO: 489281 - RNA, 13 nt, Homo sapiens
agcagacacacac

SEQ ID NO: 489282 - RNA, 22 nt, Homo sapiens
agcagagugaaauucaauucau

SEQ ID NO: 489283 - RNA, 21 nt, Homo sapiens
agcagaugaccccuccccuaa

SEQ ID NO: 489284 - RNA, 15 nt, Homo sapiens
agcagcagcagcagc

SEQ ID NO: 489285 - RNA, 16 nt, Homo sapiens
agcaguggcaaaauau

SEQ ID NO: 489286 - RNA, 23 nt, Homo sapiens
agcaguguuggggguagcggcau

SEQ ID NO: 489287 - RNA, 14 nt, Homo sapiens
agcaugaaaacuga

SEQ ID NO: 489288 - RNA, 17 nt, Homo sapiens
agcaugugaaagugcac

SEQ ID NO: 489289 - RNA, 20 nt, Homo sapiens
agcauuuccaacaccacaga

SEQ ID NO: 489290 - RNA, 23 nt, Homo sapiens
agccaaguucacaccacugccau

SEQ ID NO: 489291 - RNA, 19 nt, Homo sapiens
agccagucuuaacauuucu

SEQ ID NO: 489292 - RNA, 20 nt, Homo sapiens
agccauaguggaucacucac

SEQ ID NO: 489293 - RNA, 21 nt, Homo sapiens
agccccaacccaaaccuggag

SEQ ID NO: 489294 - RNA, 17 nt, Homo sapiens
agccccagacaacagcc

SEQ ID NO: 489295 - RNA, 17 nt, Homo sapiens
agccuacccuauucuau

SEQ ID NO: 489296 - RNA, 19 nt, Homo sapiens
agccuaugauauuccccau

SEQ ID NO: 489297 - RNA, 13 nt, Homo sapiens
agccucagaaagg

SEQ ID NO: 489298 - RNA, 21 nt, Homo sapiens
agccucagaaagggauugcuu

SEQ ID NO: 489299 - RNA, 21 nt, Homo sapiens
agccucagcaaacccaaagau

SEQ ID NO: 489300 - RNA, 12 nt, Homo sapiens
agccucuugucu

SEQ ID NO: 489301 - RNA, 18 nt, Homo sapiens
agccucuugucuacauau

SEQ ID NO: 489302 - RNA, 15 nt, Homo sapiens
agccugaugauggaa

SEQ ID NO: 489303 - RNA, 17 nt, Homo sapiens
agccugcagggugaccu

SEQ ID NO: 489304 - RNA, 20 nt, Homo sapiens
agccugguugcccagggauu

SEQ ID NO: 489305 - RNA, 11 nt, Homo sapiens
agccuguguca

SEQ ID NO: 489306 - RNA, 12 nt, Homo sapiens
agcguucccaac

SEQ ID NO: 489307 - RNA, 16 nt, Homo sapiens
agcuaagccugaugau

SEQ ID NO: 489308 - RNA, 17 nt, Homo sapiens
agcuauagcuaaugugc

SEQ ID NO: 489309 - RNA, 20 nt, Homo sapiens
agcucucccaacucuugcac

SEQ ID NO: 489310 - RNA, 17 nt, Homo sapiens
agcucuccugggccagg

SEQ ID NO: 489311 - RNA, 15 nt, Homo sapiens
agcugaguaugcuga

SEQ ID NO: 489312 - RNA, 16 nt, Homo sapiens
agcugcugcacagcug

SEQ ID NO: 489313 - RNA, 12 nt, Homo sapiens
agcuggacaccc

SEQ ID NO: 489314 - RNA, 23 nt, Homo sapiens
agcuuauuuguauuuuuccucuu

SEQ ID NO: 489315 - RNA, 18 nt, Homo sapiens
agcuucaaguuuucucag

SEQ ID NO: 489316 - RNA, 17 nt, Homo sapiens
agcuucaccagagcauu

SEQ ID NO: 489317 - RNA, 14 nt, Homo sapiens
agcuucacugucau

SEQ ID NO: 489318 - RNA, 19 nt, Homo sapiens
agcuugcacaacauccuca

SEQ ID NO: 489319 - RNA, 20 nt, Homo sapiens
agcuugcacaacauccucag

SEQ ID NO: 489320 - RNA, 23 nt, Homo sapiens
aggaaacagauuuaagcaagacc

SEQ ID NO: 489321 - RNA, 17 nt, Homo sapiens
aggaaagcacacaguca

SEQ ID NO: 489322 - RNA, 12 nt, Homo sapiens
aggaaagccaaa

SEQ ID NO: 489323 - RNA, 22 nt, Homo sapiens
aggaaagccaaauuuuauuaaa

SEQ ID NO: 489324 - RNA, 12 nt, Homo sapiens
aggaacaagacc

SEQ ID NO: 489325 - RNA, 20 nt, Homo sapiens
aggaacacaugcacacacac

SEQ ID NO: 489326 - RNA, 20 nt, Homo sapiens
aggaacccccucaccaccug

SEQ ID NO: 489327 - RNA, 15 nt, Homo sapiens
aggaagagugcaaaa

SEQ ID NO: 489328 - RNA, 17 nt, Homo sapiens
aggaagcagccuccacu

SEQ ID NO: 489329 - RNA, 15 nt, Homo sapiens
aggaaggaaacagau

SEQ ID NO: 489330 - RNA, 13 nt, Homo sapiens
aggaauuuugcua

SEQ ID NO: 489331 - RNA, 20 nt, Homo sapiens
aggacaacaagauacaaaua

SEQ ID NO: 489332 - RNA, 19 nt, Homo sapiens
aggacaccuguacuggaga

SEQ ID NO: 489333 - RNA, 19 nt, Homo sapiens
aggacagcuacacgcugac

SEQ ID NO: 489334 - RNA, 19 nt, Homo sapiens
aggacccaugaaacagcag

SEQ ID NO: 489335 - RNA, 15 nt, Homo sapiens
aggacucccugcuua

SEQ ID NO: 489336 - RNA, 15 nt, Homo sapiens
aggagaugaggcugg

SEQ ID NO: 489337 - RNA, 15 nt, Homo sapiens
aggagcugggggcag

SEQ ID NO: 489338 - RNA, 20 nt, Homo sapiens
aggaggcagagguugcagug

SEQ ID NO: 489339 - RNA, 13 nt, Homo sapiens
aggcaauggugaa

SEQ ID NO: 489340 - RNA, 16 nt, Homo sapiens
aggcagcuagacacca

SEQ ID NO: 489341 - RNA, 16 nt, Homo sapiens
aggcaggugacaguga

SEQ ID NO: 489342 - RNA, 15 nt, Homo sapiens
aggcauccacuucac

SEQ ID NO: 489343 - RNA, 12 nt, Homo sapiens
aggccaacagca

SEQ ID NO: 489344 - RNA, 14 nt, Homo sapiens
aggcccacauugcc

SEQ ID NO: 489345 - RNA, 15 nt, Homo sapiens
aggcgucaccaucca

SEQ ID NO: 489346 - RNA, 21 nt, Homo sapiens
aggcucucgcacaccucugca

SEQ ID NO: 489347 - RNA, 19 nt, Homo sapiens
cuguacaaaagggacauga

SEQ ID NO: 489348 - RNA, 17 nt, Homo sapiens
cuguacuaaaauaugca

SEQ ID NO: 489349 - RNA, 23 nt, Homo sapiens
cugucaccacccugcucauccac

SEQ ID NO: 489350 - RNA, 18 nt, Homo sapiens
cugucauggugcaauuug

SEQ ID NO: 489351 - RNA, 15 nt, Homo sapiens
cugugaaaugacugc

SEQ ID NO: 489352 - RNA, 17 nt, Homo sapiens
cugugauaacagaguga

SEQ ID NO: 489353 - RNA, 18 nt, Homo sapiens
cugugcaacaaacucaaa

SEQ ID NO: 489354 - RNA, 16 nt, Homo sapiens
cugugucccucaauua

SEQ ID NO: 489355 - RNA, 19 nt, Homo sapiens
cugugugugucuagguaga

SEQ ID NO: 489356 - RNA, 21 nt, Homo sapiens
cuguuugcugugcguggaaug

SEQ ID NO: 489357 - RNA, 11 nt, Homo sapiens
cuuaaaacacu

SEQ ID NO: 489358 - RNA, 12 nt, Homo sapiens
cuuaacaucccu

SEQ ID NO: 489359 - RNA, 22 nt, Homo sapiens
cuuaacauuucuaacucugaug

SEQ ID NO: 489360 - RNA, 21 nt, Homo sapiens
cuuaacuggucuccuugcuuc

SEQ ID NO: 489361 - RNA, 22 nt, Homo sapiens
cuuaaguacugaaauacauaug

SEQ ID NO: 489362 - RNA, 19 nt, Homo sapiens
cuuaauggccuuaauuaau

SEQ ID NO: 489363 - RNA, 11 nt, Homo sapiens
cuuaauuaccu

SEQ ID NO: 489364 - RNA, 22 nt, Homo sapiens
cuuaccuguugucugaaacaua

SEQ ID NO: 489365 - RNA, 13 nt, Homo sapiens
cuuagcaucugaa

SEQ ID NO: 489366 - RNA, 19 nt, Homo sapiens
cuuaguugcuggcucugcu

SEQ ID NO: 489367 - RNA, 21 nt, Homo sapiens
cuuauccuccaccgucuuucu

SEQ ID NO: 489368 - RNA, 15 nt, Homo sapiens
cuuauuuaucaguaa

SEQ ID NO: 489369 - RNA, 14 nt, Homo sapiens
cuuauuuccaugga

SEQ ID NO: 489370 - RNA, 14 nt, Homo sapiens
cuucaacuaugcaa

SEQ ID NO: 489371 - RNA, 15 nt, Homo sapiens
cuucaaguuuucuca

SEQ ID NO: 489372 - RNA, 17 nt, Homo sapiens
cuucaaugcaaaauaca

SEQ ID NO: 489373 - RNA, 21 nt, Homo sapiens
cuucaggaucaaguccuaguu

SEQ ID NO: 489374 - RNA, 14 nt, Homo sapiens
cuucauccagauga

SEQ ID NO: 489375 - RNA, 18 nt, Homo sapiens
cuucaugugucuugcaau

SEQ ID NO: 489376 - RNA, 14 nt, Homo sapiens
cuucauguugaugu

SEQ ID NO: 489377 - RNA, 17 nt, Homo sapiens
cuucauuuaacacugag

SEQ ID NO: 489378 - RNA, 14 nt, Homo sapiens
cuuccaacauguga

SEQ ID NO: 489379 - RNA, 13 nt, Homo sapiens
cuuccaccuggaa

SEQ ID NO: 489380 - RNA, 15 nt, Homo sapiens
cuucccugacacugu

SEQ ID NO: 489381 - RNA, 14 nt, Homo sapiens
cuuccucuuaccug

SEQ ID NO: 489382 - RNA, 19 nt, Homo sapiens
cuuccugaacucccaguca

SEQ ID NO: 489383 - RNA, 15 nt, Homo sapiens
cuucuccacagggac

SEQ ID NO: 489384 - RNA, 15 nt, Homo sapiens
cuucuccccuuccau

SEQ ID NO: 489385 - RNA, 22 nt, Homo sapiens
cuucucuauaucaugcuuuaaa

SEQ ID NO: 489386 - RNA, 20 nt, Homo sapiens
cuucuggggguagaucucaa

SEQ ID NO: 489387 - RNA, 18 nt, Homo sapiens
cuucugucaucuaccuuu

SEQ ID NO: 489388 - RNA, 22 nt, Homo sapiens
cuucuuaauauaacugccuuaa

SEQ ID NO: 489389 - RNA, 19 nt, Homo sapiens
cuugaacccaggaggcaga

SEQ ID NO: 489390 - RNA, 16 nt, Homo sapiens
cuugaggccaaaugag

SEQ ID NO: 489391 - RNA, 18 nt, Homo sapiens
cuugcacaacauccucag

SEQ ID NO: 489392 - RNA, 14 nt, Homo sapiens
cuugcauacaaaca

SEQ ID NO: 489393 - RNA, 18 nt, Homo sapiens
cuugccccuguuaccuaa

SEQ ID NO: 489394 - RNA, 14 nt, Homo sapiens
cuugcuaucuauaa

SEQ ID NO: 489395 - RNA, 19 nt, Homo sapiens
cuugcugccccacaacaca

SEQ ID NO: 489396 - RNA, 22 nt, Homo sapiens
cuuggcgagauuugggggugcu

SEQ ID NO: 489397 - RNA, 15 nt, Homo sapiens
cuuggcuggagucac

SEQ ID NO: 489398 - RNA, 12 nt, Homo sapiens
cuuggugauuga

SEQ ID NO: 489399 - RNA, 12 nt, Homo sapiens
cuuguguacaaa

SEQ ID NO: 489400 - RNA, 18 nt, Homo sapiens
cuuguuguuucuugccug

SEQ ID NO: 489401 - RNA, 23 nt, Homo sapiens
cuuguuuguguuugaauugauuu

SEQ ID NO: 489402 - RNA, 15 nt, Homo sapiens
cuuuaaaaugauuca

SEQ ID NO: 489403 - RNA, 22 nt, Homo sapiens
cuuuaaauacuauuauuugcua

SEQ ID NO: 489404 - RNA, 15 nt, Homo sapiens
cuuuaaauugauaaa

SEQ ID NO: 489405 - RNA, 19 nt, Homo sapiens
cuuuaugaucuggcccuug

SEQ ID NO: 489406 - RNA, 15 nt, Homo sapiens
cuuucaggaacacuc

SEQ ID NO: 489407 - RNA, 20 nt, Homo sapiens
cuuucuguacuaaacauuuc

SEQ ID NO: 489408 - RNA, 22 nt, Homo sapiens
cuuucugugccacacaauggau

SEQ ID NO: 489409 - RNA, 15 nt, Homo sapiens
cuuucuuccuuucua

SEQ ID NO: 489410 - RNA, 15 nt, Homo sapiens
gcuccgccucugucc

SEQ ID NO: 489411 - RNA, 17 nt, Homo sapiens
gcuccugcucauugugg

SEQ ID NO: 489412 - RNA, 16 nt, Homo sapiens
gcucucccaacucuug

SEQ ID NO: 489413 - RNA, 21 nt, Homo sapiens
gcucucccaacucuugcacag

SEQ ID NO: 489414 - RNA, 16 nt, Homo sapiens
gcucucgcacaccucu

SEQ ID NO: 489415 - RNA, 22 nt, Homo sapiens
gcugagcuugugccuuggugau

SEQ ID NO: 489416 - RNA, 19 nt, Homo sapiens
gcugauuuacuaacaguaa

SEQ ID NO: 489417 - RNA, 16 nt, Homo sapiens
gcugcaggaaucaaaa

SEQ ID NO: 489418 - RNA, 13 nt, Homo sapiens
gcugccuguggug

SEQ ID NO: 489419 - RNA, 14 nt, Homo sapiens
gcuggacacccccu

SEQ ID NO: 489420 - RNA, 20 nt, Homo sapiens
gcugggacuucuuacccaaa

SEQ ID NO: 489421 - RNA, 17 nt, Homo sapiens
gcugggucccgggugcc

SEQ ID NO: 489422 - RNA, 14 nt, Homo sapiens
gcuuaguaucucau

SEQ ID NO: 489423 - RNA, 20 nt, Homo sapiens
gcuucaauuuauugcacaaa

SEQ ID NO: 489424 - RNA, 21 nt, Homo sapiens
gcuucaggcccgaaggucucu

SEQ ID NO: 489425 - RNA, 20 nt, Homo sapiens
gcuucccaugucuuucucca

SEQ ID NO: 489426 - RNA, 18 nt, Homo sapiens
gcuucuacuccaugguga

SEQ ID NO: 489427 - RNA, 20 nt, Homo sapiens
gcuucucuaaaacagcacua

SEQ ID NO: 489428 - RNA, 11 nt, Homo sapiens
gcuugaugcug

SEQ ID NO: 489429 - RNA, 20 nt, Homo sapiens
gcuugugacauuugaauaag

SEQ ID NO: 489430 - RNA, 20 nt, Homo sapiens
gcuuuagguaaaaagcuuaa

SEQ ID NO: 489431 - RNA, 18 nt, Homo sapiens
gcuuugucuucagccucu

SEQ ID NO: 489432 - RNA, 20 nt, Homo sapiens
gcuuuucauugcugugacag

SEQ ID NO: 489433 - RNA, 20 nt, Homo sapiens
gcuuuugcuggucacugcca

SEQ ID NO: 489434 - RNA, 17 nt, Homo sapiens
ggaaaaaauuagacaag

SEQ ID NO: 489435 - RNA, 23 nt, Homo sapiens
ggaaaauguucugacagcauuuc

SEQ ID NO: 489436 - RNA, 19 nt, Homo sapiens
ggaaagcauggcucauucu

SEQ ID NO: 489437 - RNA, 15 nt, Homo sapiens
ggaaauaucugugaa

SEQ ID NO: 489438 - RNA, 19 nt, Homo sapiens
ggaaaugauaacaacccaa

SEQ ID NO: 489439 - RNA, 11 nt, Homo sapiens
ggaacauaaaa

SEQ ID NO: 489440 - RNA, 20 nt, Homo sapiens
ggaagagcuaggcagggugu

SEQ ID NO: 489441 - RNA, 14 nt, Homo sapiens
ggaagagugcaaaa

SEQ ID NO: 489442 - RNA, 23 nt, Homo sapiens
ggaauaugcaucccacagccagu

SEQ ID NO: 489443 - RNA, 13 nt, Homo sapiens
ggacaaguaucau

SEQ ID NO: 489444 - RNA, 17 nt, Homo sapiens
ggaccccaucugcugag

SEQ ID NO: 489445 - RNA, 17 nt, Homo sapiens
ggaccuaggaccauuuc

SEQ ID NO: 489446 - RNA, 19 nt, Homo sapiens
ggaccuccaccugggagau

SEQ ID NO: 489447 - RNA, 11 nt, Homo sapiens
ggacugugcag

SEQ ID NO: 489448 - RNA, 18 nt, Homo sapiens
ggacuguggccucaggag

SEQ ID NO: 489449 - RNA, 22 nt, Homo sapiens
ggagaauaaaauuccuaucuca

SEQ ID NO: 489450 - RNA, 17 nt, Homo sapiens
ggagacacugugcuaua

SEQ ID NO: 489451 - RNA, 21 nt, Homo sapiens
ggagacagucaggaagccucc

SEQ ID NO: 489452 - RNA, 17 nt, Homo sapiens
ggagagcaacacaggau

SEQ ID NO: 489453 - RNA, 21 nt, Homo sapiens
ggagcuagcugaguaugcuga

SEQ ID NO: 489454 - RNA, 18 nt, Homo sapiens
ggagcuuucucaaugucu

SEQ ID NO: 489455 - RNA, 22 nt, Homo sapiens
ggaggggugguacuuggcacca

SEQ ID NO: 489456 - RNA, 15 nt, Homo sapiens
ggauggucucugcca

SEQ ID NO: 489457 - RNA, 13 nt, Homo sapiens
ggaugucuuucag

SEQ ID NO: 489458 - RNA, 17 nt, Homo sapiens
ggcaaaaacaaaacucu

SEQ ID NO: 489459 - RNA, 23 nt, Homo sapiens
ggcaaauauuuugucacugcugu

SEQ ID NO: 489460 - RNA, 21 nt, Homo sapiens
ggcagaaggaagcagguguga

SEQ ID NO: 489461 - RNA, 20 nt, Homo sapiens
ggcagagaggacuguugaca

SEQ ID NO: 489462 - RNA, 14 nt, Homo sapiens
ggcaggaagucccu

SEQ ID NO: 489463 - RNA, 14 nt, Homo sapiens
ggcauugacagcug

SEQ ID NO: 489464 - RNA, 21 nt, Homo sapiens
ggcauuggguaagggacucca

SEQ ID NO: 489465 - RNA, 12 nt, Homo sapiens
ggccaagcagaa

SEQ ID NO: 489466 - RNA, 15 nt, Homo sapiens
ggccacccugugcag

SEQ ID NO: 489467 - RNA, 20 nt, Homo sapiens
ggccagggucucgucaggag

SEQ ID NO: 489468 - RNA, 16 nt, Homo sapiens
ggccucccugccagua

SEQ ID NO: 489469 - RNA, 22 nt, Homo sapiens
ggccuccuguggccugccaguc

SEQ ID NO: 489470 - RNA, 16 nt, Homo sapiens
ggcgccugggaucuga

SEQ ID NO: 489471 - RNA, 18 nt, Homo sapiens
ggcucaacacugugacau

SEQ ID NO: 489472 - RNA, 14 nt, Homo sapiens
ggcucccacugccc

SEQ ID NO: 489473 - RNA, 13 nt, Homo sapiens
ggcuccucaccac

SEQ ID NO: 489474 - RNA, 13 nt, Homo sapiens
ggcucucugugaa

SEQ ID NO: 489475 - RNA, 19 nt, Homo sapiens
ggcugcccacacaccccaa

SEQ ID NO: 489476 - RNA, 20 nt, Homo sapiens
ggcugcugaaacucauuuga

SEQ ID NO: 489477 - RNA, 17 nt, Homo sapiens
ggcuucagccccugggg

SEQ ID NO: 489478 - RNA, 16 nt, Homo sapiens
gggaaagagauccagg

SEQ ID NO: 489479 - RNA, 14 nt, Homo sapiens
ugaagagcauuugg

SEQ ID NO: 489480 - RNA, 20 nt, Homo sapiens
ugaagaucugguuccagaac

SEQ ID NO: 489481 - RNA, 19 nt, Homo sapiens
ugaagcaaauuucuagaua

SEQ ID NO: 489482 - RNA, 17 nt, Homo sapiens
ugaagcuaaaacacuuc

SEQ ID NO: 489483 - RNA, 20 nt, Homo sapiens
ugaaguuugccccagugcua

SEQ ID NO: 489484 - RNA, 20 nt, Homo sapiens
ugaauaacuuuagcuuuuac

SEQ ID NO: 489485 - RNA, 17 nt, Homo sapiens
ugaaucugaccacagac

SEQ ID NO: 489486 - RNA, 18 nt, Homo sapiens
ugaauuuggggcuacuua

SEQ ID NO: 489487 - RNA, 13 nt, Homo sapiens
ugacaauaagaaa

SEQ ID NO: 489488 - RNA, 12 nt, Homo sapiens
ugacacugcucc

SEQ ID NO: 489489 - RNA, 11 nt, Homo sapiens
ugacacugucu

SEQ ID NO: 489490 - RNA, 15 nt, Homo sapiens
ugacagaguaagacu

SEQ ID NO: 489491 - RNA, 16 nt, Homo sapiens
ugaccacagacacucc

SEQ ID NO: 489492 - RNA, 18 nt, Homo sapiens
ugaccucccccuccuucc

SEQ ID NO: 489493 - RNA, 18 nt, Homo sapiens
ugacguauauauaaacag

SEQ ID NO: 489494 - RNA, 13 nt, Homo sapiens
ugacuccaagaac

SEQ ID NO: 489495 - RNA, 16 nt, Homo sapiens
ugacucugcucuugca

SEQ ID NO: 489496 - RNA, 15 nt, Homo sapiens
ugacugcgcacugag

SEQ ID NO: 489497 - RNA, 14 nt, Homo sapiens
ugacuuaugugcag

SEQ ID NO: 489498 - RNA, 22 nt, Homo sapiens
ugagaaggagggucucuugccc

SEQ ID NO: 489499 - RNA, 21 nt, Homo sapiens
ugagacgcaaggaucacuuga

SEQ ID NO: 489500 - RNA, 21 nt, Homo sapiens
ugagaugggaggaucacuuga

SEQ ID NO: 489501 - RNA, 21 nt, Homo sapiens
ugagcuucagauuuugugaac

SEQ ID NO: 489502 - RNA, 22 nt, Homo sapiens
ugaggccaagaguuugagacca

SEQ ID NO: 489503 - RNA, 20 nt, Homo sapiens
ugaggucaucccggggccau

SEQ ID NO: 489504 - RNA, 15 nt, Homo sapiens
ugagguugugcugcc

SEQ ID NO: 489505 - RNA, 17 nt, Homo sapiens
ugagugaaauauuacuc

SEQ ID NO: 489506 - RNA, 16 nt, Homo sapiens
ugauaaaauguuuuca

SEQ ID NO: 489507 - RNA, 15 nt, Homo sapiens
ugauaugauccagag

SEQ ID NO: 489508 - RNA, 12 nt, Homo sapiens
ugaugauguucu

SEQ ID NO: 489509 - RNA, 13 nt, Homo sapiens
ugaugauguucug

SEQ ID NO: 489510 - RNA, 13 nt, Homo sapiens
ugauguccccaaa

SEQ ID NO: 489511 - RNA, 14 nt, Homo sapiens
ugauucuauguaac

SEQ ID NO: 489512 - RNA, 22 nt, Homo sapiens
ugauuucuuauuauuauauguu

SEQ ID NO: 489513 - RNA, 17 nt, Homo sapiens
ugcaaaacauugaagag

SEQ ID NO: 489514 - RNA, 19 nt, Homo sapiens
ugcaaaaggguaagaugaa

SEQ ID NO: 489515 - RNA, 18 nt, Homo sapiens
ugcaauaaacucagucaa

SEQ ID NO: 489516 - RNA, 12 nt, Homo sapiens
ugcaauuacugc

SEQ ID NO: 489517 - RNA, 17 nt, Homo sapiens
ugcacagucacugcucu

SEQ ID NO: 489518 - RNA, 19 nt, Homo sapiens
ugcacagucacugcucuuc

SEQ ID NO: 489519 - RNA, 21 nt, Homo sapiens
ugcacauccauucccaagaaa

SEQ ID NO: 489520 - RNA, 13 nt, Homo sapiens
ugcaccaggccau

SEQ ID NO: 489521 - RNA, 13 nt, Homo sapiens
ugcaccuuugcac

SEQ ID NO: 489522 - RNA, 13 nt, Homo sapiens
ugcagucaucucc

SEQ ID NO: 489523 - RNA, 15 nt, Homo sapiens
ugcaguuauguuauc

SEQ ID NO: 489524 - RNA, 17 nt, Homo sapiens
ugcauaaccgcacagac

SEQ ID NO: 489525 - RNA, 21 nt, Homo sapiens
ugcaucacauauucauauugu

SEQ ID NO: 489526 - RNA, 22 nt, Homo sapiens
ugcaucagaaaaugcagccuua

SEQ ID NO: 489527 - RNA, 22 nt, Homo sapiens
ugcauucauucauccucuuaua

SEQ ID NO: 489528 - RNA, 17 nt, Homo sapiens
ugccaaauccugggcau

SEQ ID NO: 489529 - RNA, 15 nt, Homo sapiens
ugccaaggagcucag

SEQ ID NO: 489530 - RNA, 20 nt, Homo sapiens
ugccaucagccccugcugcu

SEQ ID NO: 489531 - RNA, 16 nt, Homo sapiens
ugccaugaacuggagg

SEQ ID NO: 489532 - RNA, 22 nt, Homo sapiens
ugcccagaucagccagaagcca

SEQ ID NO: 489533 - RNA, 20 nt, Homo sapiens
ugcccagccccugguggugg

SEQ ID NO: 489534 - RNA, 23 nt, Homo sapiens
ugcccucaucccgaccucuuaga

SEQ ID NO: 489535 - RNA, 16 nt, Homo sapiens
ugccuacaauauucuc

SEQ ID NO: 489536 - RNA, 15 nt, Homo sapiens
ugcggugugucucca

SEQ ID NO: 489537 - RNA, 21 nt, Homo sapiens
ugcguaggagagaacagggau

SEQ ID NO: 489538 - RNA, 15 nt, Homo sapiens
ugcgucccacugagu

SEQ ID NO: 489539 - RNA, 24 nt, Homo sapiens
ugcuaauuaaaaaguuaaucuuca

SEQ ID NO: 489540 - RNA, 19 nt, Homo sapiens
ugcuacaaaaaaguagcaa

SEQ ID NO: 489541 - RNA, 20 nt, Homo sapiens
ugcuaucucgcuagccauau

SEQ ID NO: 489542 - RNA, 17 nt, Homo sapiens
ugcuaugcuggacauua

SEQ ID NO: 489543 - RNA, 14 nt, Homo sapiens
ugcuauggggacau

SEQ ID NO: 489544 - RNA, 19 nt, Homo sapiens
ugcuauggggacauuccaa

SEQ ID NO: 489545 - RNA, 14 nt, Homo sapiens
ugcuauuugcaaac

SEQ ID NO: 489546 - RNA, 19 nt, Homo sapiens
ugcucaugguuaaugcagg

SEQ ID NO: 489547 - RNA, 16 nt, Homo sapiens
ugcucuucagccauag

SEQ ID NO: 489548 - RNA, 15 nt, Homo sapiens
ugcugaggcaugaaa

SEQ ID NO: 489549 - RNA, 16 nt, Homo sapiens
ugcugcccucacugcc

SEQ ID NO: 489550 - RNA, 16 nt, Homo sapiens
ugcuggucacugccau

SEQ ID NO: 489551 - RNA, 13 nt, Homo sapiens
ugcuguuucuaca

SEQ ID NO: 489552 - RNA, 14 nt, Homo sapiens
ugcuuaguaucuca

SEQ ID NO: 489553 - RNA, 15 nt, Homo sapiens
ugcuuaguaucucau

SEQ ID NO: 489554 - RNA, 18 nt, Homo sapiens
ugcuuuagcacaggacaa

SEQ ID NO: 489555 - RNA, 17 nt, Homo sapiens
uggaaaaaauuagacaa

SEQ ID NO: 489556 - RNA, 22 nt, Homo sapiens
uggaaacaugcuguacuaaaau

SEQ ID NO: 489557 - RNA, 12 nt, Homo sapiens
uggaaaccuguc

SEQ ID NO: 489558 - RNA, 23 nt, Homo sapiens
uggaaaccuugcugcuaugcugu

SEQ ID NO: 489559 - RNA, 21 nt, Homo sapiens
uggaagacaaauacacauaca

SEQ ID NO: 489560 - RNA, 18 nt, Homo sapiens
uggaagggccuucuccac

SEQ ID NO: 489561 - RNA, 13 nt, Homo sapiens
uggaaggugacac

SEQ ID NO: 489562 - RNA, 14 nt, Homo sapiens
uggaccugagcuau

SEQ ID NO: 489563 - RNA, 13 nt, Homo sapiens
uuccucuuaccug

SEQ ID NO: 489564 - RNA, 22 nt, Homo sapiens
uuccugaccuccgccauccacc

SEQ ID NO: 489565 - RNA, 15 nt, Homo sapiens
uuccugcuccuccag

SEQ ID NO: 489566 - RNA, 15 nt, Homo sapiens
uuccuuccacaguua

SEQ ID NO: 489567 - RNA, 14 nt, Homo sapiens
uuccuucuacuuac

SEQ ID NO: 489568 - RNA, 23 nt, Homo sapiens
uucuaacauaaguaagacuugau

SEQ ID NO: 489569 - RNA, 23 nt, Homo sapiens
uucuaauccuaucuggggagcuc

SEQ ID NO: 489570 - RNA, 16 nt, Homo sapiens
uucuacaaauguuacu

SEQ ID NO: 489571 - RNA, 21 nt, Homo sapiens
uucuacuccauggugaacuga

SEQ ID NO: 489572 - RNA, 17 nt, Homo sapiens
uucuagggagauguauu

SEQ ID NO: 489573 - RNA, 14 nt, Homo sapiens
uucuaguagcacaa

SEQ ID NO: 489574 - RNA, 20 nt, Homo sapiens
uucuauuagcuuacugauua

SEQ ID NO: 489575 - RNA, 15 nt, Homo sapiens
uucucacgucuccua

SEQ ID NO: 489576 - RNA, 19 nt, Homo sapiens
uucucucuccagucuucca

SEQ ID NO: 489577 - RNA, 15 nt, Homo sapiens
uucucuguacauauu

SEQ ID NO: 489578 - RNA, 15 nt, Homo sapiens
uucugaaauucacaa

SEQ ID NO: 489579 - RNA, 13 nt, Homo sapiens
uucugaacaaaga

SEQ ID NO: 489580 - RNA, 17 nt, Homo sapiens
uucugacccugugaaau

SEQ ID NO: 489581 - RNA, 16 nt, Homo sapiens
uucugcagucaucucc

SEQ ID NO: 489582 - RNA, 17 nt, Homo sapiens
uucugucaucuaccuuu

SEQ ID NO: 489583 - RNA, 15 nt, Homo sapiens
uucuuaaaaugugcu

SEQ ID NO: 489584 - RNA, 18 nt, Homo sapiens
uucuuccaacaugugaug

SEQ ID NO: 489585 - RNA, 18 nt, Homo sapiens
uucuuccucuuaccugua

SEQ ID NO: 489586 - RNA, 14 nt, Homo sapiens
uucuugcaauuuga

SEQ ID NO: 489587 - RNA, 21 nt, Homo sapiens
uucuugugcccuuaaaaccaa

SEQ ID NO: 489588 - RNA, 13 nt, Homo sapiens
uugaaaacucaua

SEQ ID NO: 489589 - RNA, 23 nt, Homo sapiens
uugaaagggacaaguaucaucua

SEQ ID NO: 489590 - RNA, 15 nt, Homo sapiens
uugaacucuguaaaa

SEQ ID NO: 489591 - RNA, 13 nt, Homo sapiens
uugaagaacucau

SEQ ID NO: 489592 - RNA, 15 nt, Homo sapiens
uugaaggaagacaug

SEQ ID NO: 489593 - RNA, 18 nt, Homo sapiens
uugaaugcuuaaaugauc

SEQ ID NO: 489594 - RNA, 21 nt, Homo sapiens
uugacacugaauaaaauauug

SEQ ID NO: 489595 - RNA, 18 nt, Homo sapiens
uugacauuuguuugguua

SEQ ID NO: 489596 - RNA, 21 nt, Homo sapiens
uugagcuagaaaucacaagaa

SEQ ID NO: 489597 - RNA, 13 nt, Homo sapiens
uugagucuggaua

SEQ ID NO: 489598 - RNA, 15 nt, Homo sapiens
uugauguaacugugu

SEQ ID NO: 489599 - RNA, 16 nt, Homo sapiens
uugauuaaaacauuau

SEQ ID NO: 489600 - RNA, 17 nt, Homo sapiens
uugcaaauaacuuacaa

SEQ ID NO: 489601 - RNA, 12 nt, Homo sapiens
uugcacacucac

SEQ ID NO: 489602 - RNA, 14 nt, Homo sapiens
uugccgcauauuau

SEQ ID NO: 489603 - RNA, 13 nt, Homo sapiens
uugcuaccaaaaa

SEQ ID NO: 489604 - RNA, 13 nt, Homo sapiens
uugcugcauuuca

SEQ ID NO: 489605 - RNA, 21 nt, Homo sapiens
uugcugugaaaugacugcauc

SEQ ID NO: 489606 - RNA, 21 nt, Homo sapiens
uugcuuguguacaaacccaga

SEQ ID NO: 489607 - RNA, 12 nt, Homo sapiens
uuggaaggugac

SEQ ID NO: 489608 - RNA, 15 nt, Homo sapiens
uuggcuuaauuccaa

SEQ ID NO: 489609 - RNA, 14 nt, Homo sapiens
uugggagcuuuaaa

SEQ ID NO: 489610 - RNA, 12 nt, Homo sapiens
uugguacccugg

SEQ ID NO: 489611 - RNA, 20 nt, Homo sapiens
uugguuucgucugucuguaa

SEQ ID NO: 489612 - RNA, 19 nt, Homo sapiens
uccaacagaaagcauagac

SEQ ID NO: 489613 - RNA, 15 nt, Homo sapiens
uccaaguaacauuuu

SEQ ID NO: 489614 - RNA, 19 nt, Homo sapiens
uccaagugaaugaguuucc

SEQ ID NO: 489615 - RNA, 22 nt, Homo sapiens
uccacaaccuccuccuccaguu

SEQ ID NO: 489616 - RNA, 15 nt, Homo sapiens
uccacacaggcccau

SEQ ID NO: 489617 - RNA, 19 nt, Homo sapiens
uccacaguuaggccaagaa

SEQ ID NO: 489618 - RNA, 22 nt, Homo sapiens
uccacaguuaucuuagcuggau

SEQ ID NO: 489619 - RNA, 14 nt, Homo sapiens
uccagaacucuucc

SEQ ID NO: 489620 - RNA, 22 nt, Homo sapiens
uccagaggaugucuuucuccuc

SEQ ID NO: 489621 - RNA, 18 nt, Homo sapiens
uccagaggguugugauuu

SEQ ID NO: 489622 - RNA, 22 nt, Homo sapiens
uccagccacuuauuuccaugga

SEQ ID NO: 489623 - RNA, 15 nt, Homo sapiens
uccagccccagacaa

SEQ ID NO: 489624 - RNA, 17 nt, Homo sapiens
uccauaucuaaccagug

SEQ ID NO: 489625 - RNA, 21 nt, Homo sapiens
uccaugcaucacuauucagaa

SEQ ID NO: 489626 - RNA, 12 nt, Homo sapiens
uccauucccaag

SEQ ID NO: 489627 - RNA, 19 nt, Homo sapiens
uccauuuuggugucuuucu

SEQ ID NO: 489628 - RNA, 15 nt, Homo sapiens
ucccaaagcaucccu

SEQ ID NO: 489629 - RNA, 16 nt, Homo sapiens
ucccaacaacauccau

SEQ ID NO: 489630 - RNA, 17 nt, Homo sapiens
ucccaaugcacauccau

SEQ ID NO: 489631 - RNA, 15 nt, Homo sapiens
ucccacacugugaac

SEQ ID NO: 489632 - RNA, 13 nt, Homo sapiens
ucccagcacuuug

SEQ ID NO: 489633 - RNA, 16 nt, Homo sapiens
ucccaguuaacuguua

SEQ ID NO: 489634 - RNA, 18 nt, Homo sapiens
ucccaugguagacuguga

SEQ ID NO: 489635 - RNA, 21 nt, Homo sapiens
ucccaugguagacugugacac

SEQ ID NO: 489636 - RNA, 24 nt, Homo sapiens
uccccagucccaaugcacauccau

SEQ ID NO: 489637 - RNA, 15 nt, Homo sapiens
uccccuggacauauu

SEQ ID NO: 489638 - RNA, 15 nt, Homo sapiens
uccccugguccugca

SEQ ID NO: 489639 - RNA, 18 nt, Homo sapiens
uccccuucguguugccau

SEQ ID NO: 489640 - RNA, 17 nt, Homo sapiens
ucccucccucccagauc

SEQ ID NO: 489641 - RNA, 23 nt, Homo sapiens
ucccucuaaaacuagaaaaggaa

SEQ ID NO: 489642 - RNA, 13 nt, Homo sapiens
ucccugcugccag

SEQ ID NO: 489643 - RNA, 19 nt, Homo sapiens
ucccuuaauuuaagucauu

SEQ ID NO: 489644 - RNA, 18 nt, Homo sapiens
ucccuuagaacaccugag

SEQ ID NO: 489645 - RNA, 17 nt, Homo sapiens
ucccuuuguugcacacu

SEQ ID NO: 489646 - RNA, 20 nt, Homo sapiens
uccgacuucucuagacaucu

SEQ ID NO: 489647 - RNA, 15 nt, Homo sapiens
uccggaauccugucc

SEQ ID NO: 489648 - RNA, 17 nt, Homo sapiens
uccuaaaguagacuuca

SEQ ID NO: 489649 - RNA, 19 nt, Homo sapiens
uccuaaaguagacuucauu

SEQ ID NO: 489650 - RNA, 15 nt, Homo sapiens
uccuaggaguacaag

SEQ ID NO: 489651 - RNA, 22 nt, Homo sapiens
uccuaguuguucagcauggcau

SEQ ID NO: 489652 - RNA, 21 nt, Homo sapiens
uccucauucccucgucuuucc

SEQ ID NO: 489653 - RNA, 17 nt, Homo sapiens
uccuccaccgucuuucu

SEQ ID NO: 489654 - RNA, 14 nt, Homo sapiens
uccuccuucacucc

SEQ ID NO: 489655 - RNA, 19 nt, Homo sapiens
uccucguuuuguaaugaga

SEQ ID NO: 489656 - RNA, 14 nt, Homo sapiens
uccugaacucccag

SEQ ID NO: 489657 - RNA, 21 nt, Homo sapiens
uccugaugugacgcacuguau

SEQ ID NO: 489658 - RNA, 22 nt, Homo sapiens
uccugaugugacgcacuguauu

SEQ ID NO: 489659 - RNA, 21 nt, Homo sapiens
uccugccccaucacuuacaga

SEQ ID NO: 489660 - RNA, 16 nt, Homo sapiens
uccugccuucauggaa

SEQ ID NO: 489661 - RNA, 19 nt, Homo sapiens
uccugcuccuccaguacaa

SEQ ID NO: 489662 - RNA, 21 nt, Homo sapiens
uccuggccaggauaauauauu

SEQ ID NO: 489663 - RNA, 19 nt, Homo sapiens
uccuguacaaucaugaaca

SEQ ID NO: 489664 - RNA, 22 nt, Homo sapiens
uccuguacaaucaugaacagcu

SEQ ID NO: 489665 - RNA, 17 nt, Homo sapiens
uccuuaaaaaauaugcu

SEQ ID NO: 489666 - RNA, 17 nt, Homo sapiens
uccuuagaauacuguau

SEQ ID NO: 489667 - RNA, 16 nt, Homo sapiens
uccuucugauccacag

SEQ ID NO: 489668 - RNA, 19 nt, Homo sapiens
ucgauguuuagugugauag

SEQ ID NO: 489669 - RNA, 21 nt, Homo sapiens
ucgcaggccucccugccagua

SEQ ID NO: 489670 - RNA, 20 nt, Homo sapiens
ucggggcaggaagucccuga

SEQ ID NO: 489671 - RNA, 15 nt, Homo sapiens
ucguagaaacaagac

SEQ ID NO: 489672 - RNA, 17 nt, Homo sapiens
ucguagaaacaagacaa

SEQ ID NO: 489673 - RNA, 21 nt, Homo sapiens
ucguaggggagagaucuccaa

SEQ ID NO: 489674 - RNA, 18 nt, Homo sapiens
ucuaaagccacgcugugu

SEQ ID NO: 489675 - RNA, 23 nt, Homo sapiens
ucuaacuauauguacagcucucc

SEQ ID NO: 489676 - RNA, 17 nt, Homo sapiens
ucuaagguaaaaccauc

SEQ ID NO: 489677 - RNA, 21 nt, Homo sapiens
ucuaauccaugugcugcugug

SEQ ID NO: 489678 - RNA, 17 nt, Homo sapiens
ucuacuggacuguaaaa

SEQ ID NO: 489679 - RNA, 22 nt, Homo sapiens
ucuagauccuaugugaaaagaa

SEQ ID NO: 489680 - RNA, 20 nt, Homo sapiens
ucuaggacccccagugcuca

SEQ ID NO: 489681 - RNA, 21 nt, Homo sapiens
ucuaggacccccagugcucac

SEQ ID NO: 489682 - RNA, 18 nt, Homo sapiens
ucuauugaguguacauuu

SEQ ID NO: 489683 - RNA, 21 nt, Homo sapiens
ucucaaaauaaaaccagaaag

SEQ ID NO: 489684 - RNA, 17 nt, Homo sapiens
ucucagugcuagcuuau

SEQ ID NO: 489685 - RNA, 14 nt, Homo sapiens
ucuccacauuccaa

SEQ ID NO: 489686 - RNA, 14 nt, Homo sapiens
ucuccaguggauuc

SEQ ID NO: 489687 - RNA, 22 nt, Homo sapiens
ucucccagcuuucagggacagc

SEQ ID NO: 489688 - RNA, 21 nt, Homo sapiens
ucuccccucccuuguccuuga

SEQ ID NO: 489689 - RNA, 15 nt, Homo sapiens
ucuccucacugaaaa

SEQ ID NO: 489690 - RNA, 17 nt, Homo sapiens
ucucgcuagccauauau

SEQ ID NO: 489691 - RNA, 20 nt, Homo sapiens
ucucgucaggaggugccuga

SEQ ID NO: 489692 - RNA, 18 nt, Homo sapiens
aacagggaugcuaucucg

SEQ ID NO: 489693 - RNA, 17 nt, Homo sapiens
aacaguguuuacuuuaa

SEQ ID NO: 489694 - RNA, 15 nt, Homo sapiens
aacauaauacauuaa

SEQ ID NO: 489695 - RNA, 20 nt, Homo sapiens
aacauaauacauuaauacuu

SEQ ID NO: 489696 - RNA, 19 nt, Homo sapiens
aacauagacagauguggac

SEQ ID NO: 489697 - RNA, 18 nt, Homo sapiens
aacaucagguuaggcagu

SEQ ID NO: 489698 - RNA, 13 nt, Homo sapiens
aacaugccagaag

SEQ ID NO: 489699 - RNA, 23 nt, Homo sapiens
aacauucccuggaauugccacau

SEQ ID NO: 489700 - RNA, 21 nt, Homo sapiens
aacauucuauuucaacuucag

SEQ ID NO: 489701 - RNA, 14 nt, Homo sapiens
aaccaauuucuucc

SEQ ID NO: 489702 - RNA, 12 nt, Homo sapiens
aaccagugccag

SEQ ID NO: 489703 - RNA, 15 nt, Homo sapiens
aacccacagccaaac

SEQ ID NO: 489704 - RNA, 23 nt, Homo sapiens
aaccugacagcaaacacagucac

SEQ ID NO: 489705 - RNA, 18 nt, Homo sapiens
aaccuucaaguaugugcu

SEQ ID NO: 489706 - RNA, 15 nt, Homo sapiens
aacgagccuuuucac

SEQ ID NO: 489707 - RNA, 23 nt, Homo sapiens
aacgcauaggaaaagaaucuccu

SEQ ID NO: 489708 - RNA, 18 nt, Homo sapiens
aacggcccaccaaggaca

SEQ ID NO: 489709 - RNA, 13 nt, Homo sapiens
aacguacuaugga

SEQ ID NO: 489710 - RNA, 18 nt, Homo sapiens
aacuaaugaaagcacucc

SEQ ID NO: 489711 - RNA, 13 nt, Homo sapiens
aacuauugcugcu

SEQ ID NO: 489712 - RNA, 15 nt, Homo sapiens
aacucaguccugaca

SEQ ID NO: 489713 - RNA, 14 nt, Homo sapiens
aacucauacagugg

SEQ ID NO: 489714 - RNA, 16 nt, Homo sapiens
aacucucuaaacuggu

SEQ ID NO: 489715 - RNA, 12 nt, Homo sapiens
aacugaagccca

SEQ ID NO: 489716 - RNA, 14 nt, Homo sapiens
aacugaagcccaca

SEQ ID NO: 489717 - RNA, 20 nt, Homo sapiens
aacugaguuagaauguugaa

SEQ ID NO: 489718 - RNA, 19 nt, Homo sapiens
aacugauggguaucaugcu

SEQ ID NO: 489719 - RNA, 13 nt, Homo sapiens
aacugguacaauu

SEQ ID NO: 489720 - RNA, 22 nt, Homo sapiens
aacuguggaaggcacacugagc

SEQ ID NO: 489721 - RNA, 20 nt, Homo sapiens
aacuugauucuugugauuga

SEQ ID NO: 489722 - RNA, 19 nt, Homo sapiens
aacuuuagcagaaucaaaa

SEQ ID NO: 489723 - RNA, 22 nt, Homo sapiens
aagaaaaaauucccucauuuaa

SEQ ID NO: 489724 - RNA, 22 nt, Homo sapiens
aagaaaaucaaagcugaggaca

SEQ ID NO: 489725 - RNA, 22 nt, Homo sapiens
aagaaacagauaccauacucau

SEQ ID NO: 489726 - RNA, 18 nt, Homo sapiens
aagaaagagucaaugaga

SEQ ID NO: 489727 - RNA, 13 nt, Homo sapiens
aagaaaugcacaa

SEQ ID NO: 489728 - RNA, 15 nt, Homo sapiens
aagaacucaugugau

SEQ ID NO: 489729 - RNA, 19 nt, Homo sapiens
aagaaguugcugcagauuc

SEQ ID NO: 489730 - RNA, 20 nt, Homo sapiens
aagaauuggcagaagcaguu

SEQ ID NO: 489731 - RNA, 15 nt, Homo sapiens
aagacaaugcuuucc

SEQ ID NO: 489732 - RNA, 12 nt, Homo sapiens
aagaccaaagag

SEQ ID NO: 489733 - RNA, 22 nt, Homo sapiens
aagaccaagacuuuugucugau

SEQ ID NO: 489734 - RNA, 15 nt, Homo sapiens
aagacucugucucaa

SEQ ID NO: 489735 - RNA, 21 nt, Homo sapiens
aagacuguaaauuccaaagau

SEQ ID NO: 489736 - RNA, 19 nt, Homo sapiens
aagacuuuugucugaucaa

SEQ ID NO: 489737 - RNA, 21 nt, Homo sapiens
aagagaaaaagcccucuucaa

SEQ ID NO: 489738 - RNA, 18 nt, Homo sapiens
aagagagaaaucugaaaa

SEQ ID NO: 489739 - RNA, 23 nt, Homo sapiens
aagagagcucaucaucagucuua

SEQ ID NO: 489740 - RNA, 10 nt, Homo sapiens
aagagcauuu

SEQ ID NO: 489741 - RNA, 12 nt, Homo sapiens
aagagcauuugg

SEQ ID NO: 489742 - RNA, 20 nt, Homo sapiens
aagcauuugacuuucugucu

SEQ ID NO: 489743 - RNA, 21 nt, Homo sapiens
aagccagucuuaacauuucua

SEQ ID NO: 489744 - RNA, 22 nt, Homo sapiens
aagcccagccuaucucucuucu

SEQ ID NO: 489745 - RNA, 16 nt, Homo sapiens
aagccuacccuauucu

SEQ ID NO: 489746 - RNA, 13 nt, Homo sapiens
aagccuauugcaa

SEQ ID NO: 489747 - RNA, 22 nt, Homo sapiens
aagccucagcaaacccaaagau

SEQ ID NO: 489748 - RNA, 12 nt, Homo sapiens
aagccugaugau

SEQ ID NO: 489749 - RNA, 15 nt, Homo sapiens
aagcucauaauggaa

SEQ ID NO: 489750 - RNA, 22 nt, Homo sapiens
aagcugaccuggaaaugaauga

SEQ ID NO: 489751 - RNA, 14 nt, Homo sapiens
aaggaaagcagugu

SEQ ID NO: 489752 - RNA, 19 nt, Homo sapiens
aaggaacccccucaccacc

SEQ ID NO: 489753 - RNA, 19 nt, Homo sapiens
aaggaagauguaagaagcu

SEQ ID NO: 489754 - RNA, 19 nt, Homo sapiens
aaggacagcuacacgcuga

SEQ ID NO: 489755 - RNA, 12 nt, Homo sapiens
aaggaucacuug

SEQ ID NO: 489756 - RNA, 15 nt, Homo sapiens
aaggaugucuuucag

SEQ ID NO: 489757 - RNA, 15 nt, Homo sapiens
aaggcacacugagca

SEQ ID NO: 489758 - RNA, 22 nt, Homo sapiens
aaggcauguggccuuuaucuca

SEQ ID NO: 489759 - RNA, 17 nt, Homo sapiens
aaggcauuuauugccau

SEQ ID NO: 489760 - RNA, 12 nt, Homo sapiens
aagggauugcuu

SEQ ID NO: 489761 - RNA, 19 nt, Homo sapiens
aaggggcuguuacauaaca

SEQ ID NO: 489762 - RNA, 16 nt, Homo sapiens
aagggugcccaccucu

SEQ ID NO: 489763 - RNA, 19 nt, Homo sapiens
aagguacucuggacuuucu

SEQ ID NO: 489764 - RNA, 22 nt, Homo sapiens
aaggucccgaauggaguccaga

SEQ ID NO: 489765 - RNA, 20 nt, Homo sapiens
aagguuucacuguucaugaa

SEQ ID NO: 489766 - RNA, 13 nt, Homo sapiens
aaguaaacuaaug

SEQ ID NO: 489767 - RNA, 16 nt, Homo sapiens
aaguaacuugucuuaa

SEQ ID NO: 489768 - RNA, 16 nt, Homo sapiens
aaguaccacacugagu

SEQ ID NO: 489769 - RNA, 21 nt, Homo sapiens
aaguacucuaauauacagugu

SEQ ID NO: 489770 - RNA, 22 nt, Homo sapiens
aaguacucuaauauacagugug

SEQ ID NO: 489771 - RNA, 23 nt, Homo sapiens
aaguauuuugcuuguuaaauucu

SEQ ID NO: 489772 - RNA, 15 nt, Homo sapiens
aagucuccuguauca

SEQ ID NO: 489773 - RNA, 13 nt, Homo sapiens
aagucuuacuguu

SEQ ID NO: 489774 - RNA, 17 nt, Homo sapiens
aagugacuuauuugcuc

SEQ ID NO: 489775 - RNA, 15 nt, Homo sapiens
aaguguacuggauuu

SEQ ID NO: 489776 - RNA, 22 nt, Homo sapiens
aaguuauccagaggguugugau

SEQ ID NO: 489777 - RNA, 17 nt, Homo sapiens
aaguucauccaacguga

SEQ ID NO: 489778 - RNA, 14 nt, Homo sapiens
aaguuuacugggga

SEQ ID NO: 489779 - RNA, 11 nt, Homo sapiens
aaguuugcaac

SEQ ID NO: 489780 - RNA, 21 nt, Homo sapiens
aaguuuuauaaaagacaugaa

SEQ ID NO: 489781 - RNA, 13 nt, Homo sapiens
aauaaaaugauua

SEQ ID NO: 489782 - RNA, 19 nt, Homo sapiens
aauaaaauuccuaucucau

SEQ ID NO: 489783 - RNA, 23 nt, Homo sapiens
aauaaauucagaauuaacuccuu

SEQ ID NO: 489784 - RNA, 18 nt, Homo sapiens
aauaacaaaucauuucua

SEQ ID NO: 489785 - RNA, 17 nt, Homo sapiens
aauaacccugaaucaga

SEQ ID NO: 489786 - RNA, 18 nt, Homo sapiens
aauaacccugaaucagag

SEQ ID NO: 489787 - RNA, 18 nt, Homo sapiens
aauaacugacggauguaa

SEQ ID NO: 489788 - RNA, 19 nt, Homo sapiens
aauaaggccucauccucca

SEQ ID NO: 489789 - RNA, 17 nt, Homo sapiens
aauaauaaagcauuuau

SEQ ID NO: 489790 - RNA, 23 nt, Homo sapiens
aauacacauacauauauacauuu

SEQ ID NO: 489791 - RNA, 16 nt, Homo sapiens
aauacauuaauacuuc

SEQ ID NO: 489792 - RNA, 11 nt, Homo sapiens
aauaggcuugu

SEQ ID NO: 489793 - RNA, 22 nt, Homo sapiens
aauaguucccuuugccaacaga

SEQ ID NO: 489794 - RNA, 14 nt, Homo sapiens
aauauaacugccuu

SEQ ID NO: 489795 - RNA, 13 nt, Homo sapiens
aauauauagcauu

SEQ ID NO: 489796 - RNA, 20 nt, Homo sapiens
aauaucagaaguauaucugu

SEQ ID NO: 489797 - RNA, 20 nt, Homo sapiens
aauauccaagcccagccuau

SEQ ID NO: 489798 - RNA, 23 nt, Homo sapiens
aauaucugugaaggacuugguga

SEQ ID NO: 489799 - RNA, 21 nt, Homo sapiens
aauauguacacuggaacugua

SEQ ID NO: 489800 - RNA, 22 nt, Homo sapiens
aauauuaagacagacgccugcu

SEQ ID NO: 489801 - RNA, 15 nt, Homo sapiens
aauauuauguuauga

SEQ ID NO: 489802 - RNA, 20 nt, Homo sapiens
aauauugauauuuucuacaa

SEQ ID NO: 489803 - RNA, 15 nt, Homo sapiens
aaucaagucugugaa

SEQ ID NO: 489804 - RNA, 15 nt, Homo sapiens
aaucaccuugcauuu

SEQ ID NO: 489805 - RNA, 18 nt, Homo sapiens
aaucaccuugcauuucaa

SEQ ID NO: 489806 - RNA, 14 nt, Homo sapiens
aaucagaugccuca

SEQ ID NO: 489807 - RNA, 13 nt, Homo sapiens
aaucauacaguaa

SEQ ID NO: 489808 - RNA, 19 nt, Homo sapiens
aaucccauuuaugcaauuu

SEQ ID NO: 489809 - RNA, 22 nt, Homo sapiens
aauccuaacauuauauucccaa

SEQ ID NO: 489810 - RNA, 16 nt, Homo sapiens
aauccuguccucagcu

SEQ ID NO: 489811 - RNA, 15 nt, Homo sapiens
aaucuccucacugaa

SEQ ID NO: 489812 - RNA, 19 nt, Homo sapiens
aaucuuauuaaaguuucaa

SEQ ID NO: 489813 - RNA, 15 nt, Homo sapiens
aaugaaauacuugac

SEQ ID NO: 489814 - RNA, 21 nt, Homo sapiens
aaugaaguaacuugucuuaaa

SEQ ID NO: 489815 - RNA, 20 nt, Homo sapiens
aaugagggcgugaaacacaa

SEQ ID NO: 489816 - RNA, 19 nt, Homo sapiens
aaugagucacuuacuucau

SEQ ID NO: 489817 - RNA, 13 nt, Homo sapiens
aaugcagccuuaa

SEQ ID NO: 489818 - RNA, 16 nt, Homo sapiens
aaugcccuucacuguc

SEQ ID NO: 489819 - RNA, 22 nt, Homo sapiens
aaugcgcugaucguuucuucca

SEQ ID NO: 489820 - RNA, 15 nt, Homo sapiens
aaugcuauuugugua

SEQ ID NO: 489821 - RNA, 21 nt, Homo sapiens
aaugcugauuuaaacuucuua

SEQ ID NO: 489822 - RNA, 22 nt, Homo sapiens
aauggcaacaaacugcacauga

SEQ ID NO: 489823 - RNA, 20 nt, Homo sapiens
aauggcaaguuuugauauga

SEQ ID NO: 489824 - RNA, 20 nt, Homo sapiens
aauggcauugacagcugcuc

SEQ ID NO: 489825 - RNA, 17 nt, Homo sapiens
aauggcuuguucaguca

SEQ ID NO: 489826 - RNA, 14 nt, Homo sapiens
aaugggugauaucc

SEQ ID NO: 489827 - RNA, 18 nt, Homo sapiens
aaugguaauuuaguguau

SEQ ID NO: 489828 - RNA, 20 nt, Homo sapiens
accuucugucguccccagac

SEQ ID NO: 489829 - RNA, 19 nt, Homo sapiens
accuugcauuucaaaaugg

SEQ ID NO: 489830 - RNA, 11 nt, Homo sapiens
accuugcccau

SEQ ID NO: 489831 - RNA, 23 nt, Homo sapiens
accuuuucucuucauuuucccau

SEQ ID NO: 489832 - RNA, 14 nt, Homo sapiens
acgcuugcuaucau

SEQ ID NO: 489833 - RNA, 19 nt, Homo sapiens
acgcuugcuuuagcacagg

SEQ ID NO: 489834 - RNA, 20 nt, Homo sapiens
acggaccuuuuugcuguuua

SEQ ID NO: 489835 - RNA, 12 nt, Homo sapiens
acgucagaagaa

SEQ ID NO: 489836 - RNA, 14 nt, Homo sapiens
acgugacuccucaa

SEQ ID NO: 489837 - RNA, 18 nt, Homo sapiens
acguggggcagcacagag

SEQ ID NO: 489838 - RNA, 12 nt, Homo sapiens
acgugugaggau

SEQ ID NO: 489839 - RNA, 14 nt, Homo sapiens
acuacaucugauau

SEQ ID NO: 489840 - RNA, 21 nt, Homo sapiens
acuaccuuuggcuuaauucca

SEQ ID NO: 489841 - RNA, 14 nt, Homo sapiens
acuacgacuggcau

SEQ ID NO: 489842 - RNA, 13 nt, Homo sapiens
acuagauguuaag

SEQ ID NO: 489843 - RNA, 16 nt, Homo sapiens
acuauauguacagcuc

SEQ ID NO: 489844 - RNA, 20 nt, Homo sapiens
acucaaaucaggaacuguau

SEQ ID NO: 489845 - RNA, 15 nt, Homo sapiens
acucacuuguaagaa

SEQ ID NO: 489846 - RNA, 23 nt, Homo sapiens
acuccagcccugauugcgcaaaa

SEQ ID NO: 489847 - RNA, 13 nt, Homo sapiens
acucccugcuuag

SEQ ID NO: 489848 - RNA, 16 nt, Homo sapiens
acuccucccugaugua

SEQ ID NO: 489849 - RNA, 14 nt, Homo sapiens
acuccugcucugcu

SEQ ID NO: 489850 - RNA, 18 nt, Homo sapiens
acuccuguaaaauaugaa

SEQ ID NO: 489851 - RNA, 22 nt, Homo sapiens
acuccuuacagaagggagugaa

SEQ ID NO: 489852 - RNA, 14 nt, Homo sapiens
acuccuucaauauu

SEQ ID NO: 489853 - RNA, 15 nt, Homo sapiens
acucugaauuuccag

SEQ ID NO: 489854 - RNA, 19 nt, Homo sapiens
acugaacuuuucaaaauaa

SEQ ID NO: 489855 - RNA, 12 nt, Homo sapiens
acugaagcuuaa

SEQ ID NO: 489856 - RNA, 21 nt, Homo sapiens
acugagggcaggaggcuccau

SEQ ID NO: 489857 - RNA, 22 nt, Homo sapiens
acugauggcaauauuaagacag

SEQ ID NO: 489858 - RNA, 23 nt, Homo sapiens
acugcauaaaugaauaaauucag

SEQ ID NO: 489859 - RNA, 13 nt, Homo sapiens
acugccccugcac

SEQ ID NO: 489860 - RNA, 14 nt, Homo sapiens
acuguaaaauacau

SEQ ID NO: 489861 - RNA, 22 nt, Homo sapiens
acuguauuucggcuaugucuca

SEQ ID NO: 489862 - RNA, 21 nt, Homo sapiens
acugucaugugcgaacacagu

SEQ ID NO: 489863 - RNA, 23 nt, Homo sapiens
acugucuuaauuaaguaaacuaa

SEQ ID NO: 489864 - RNA, 17 nt, Homo sapiens
acuguggcacuuuucac

SEQ ID NO: 489865 - RNA, 22 nt, Homo sapiens
acuguuaaauaaggccucaucc

SEQ ID NO: 489866 - RNA, 19 nt, Homo sapiens
acuuaacagaucacaugcc

SEQ ID NO: 489867 - RNA, 13 nt, Homo sapiens
acuuaauuaccua

SEQ ID NO: 489868 - RNA, 16 nt, Homo sapiens
acuuacacaucuucca

SEQ ID NO: 489869 - RNA, 19 nt, Homo sapiens
acuuacacaucuuccacag

SEQ ID NO: 489870 - RNA, 16 nt, Homo sapiens
acuuauuuccauggau

SEQ ID NO: 489871 - RNA, 17 nt, Homo sapiens
acuucaaauguuauuca

SEQ ID NO: 489872 - RNA, 18 nt, Homo sapiens
acuucuuaaaaugugcua

SEQ ID NO: 489873 - RNA, 23 nt, Homo sapiens
acuugauucuugugauugacuuu

SEQ ID NO: 489874 - RNA, 21 nt, Homo sapiens
acuugcuaucuauaaaaaaga

SEQ ID NO: 489875 - RNA, 18 nt, Homo sapiens
acuuggugauuaccugaa

SEQ ID NO: 489876 - RNA, 19 nt, Homo sapiens
acuuuaaucccacuugccc

SEQ ID NO: 489877 - RNA, 19 nt, Homo sapiens
acuuuaguaacagcacaac

SEQ ID NO: 489878 - RNA, 22 nt, Homo sapiens
acuuuaguaacagcacaacaaa

SEQ ID NO: 489879 - RNA, 18 nt, Homo sapiens
acuuucauguacuaugga

SEQ ID NO: 489880 - RNA, 15 nt, Homo sapiens
acuuugaaagagcuu

SEQ ID NO: 489881 - RNA, 19 nt, Homo sapiens
acuuugaaagagcuuuuag

SEQ ID NO: 489882 - RNA, 14 nt, Homo sapiens
acuuugauucacau

SEQ ID NO: 489883 - RNA, 18 nt, Homo sapiens
acuuugcaaagacagugu

SEQ ID NO: 489884 - RNA, 15 nt, Homo sapiens
acuuuuccaacauac

SEQ ID NO: 489885 - RNA, 16 nt, Homo sapiens
acuuuuccaacauaca

SEQ ID NO: 489886 - RNA, 23 nt, Homo sapiens
agaaaaaaaaugagaaaaaagua

SEQ ID NO: 489887 - RNA, 16 nt, Homo sapiens
agaaaaaauucccuca

SEQ ID NO: 489888 - RNA, 14 nt, Homo sapiens
agaaaagcaugaaa

SEQ ID NO: 489889 - RNA, 14 nt, Homo sapiens
agaaacauccuguu

SEQ ID NO: 489890 - RNA, 12 nt, Homo sapiens
agaaacaugcca

SEQ ID NO: 489891 - RNA, 12 nt, Homo sapiens
agaaagccaaau

SEQ ID NO: 489892 - RNA, 14 nt, Homo sapiens
agaaauacaacaga

SEQ ID NO: 489893 - RNA, 13 nt, Homo sapiens
agaaauacuuuca

SEQ ID NO: 489894 - RNA, 14 nt, Homo sapiens
agaaauaugagcau

SEQ ID NO: 489895 - RNA, 17 nt, Homo sapiens
agaaaucauacugcaua

SEQ ID NO: 489896 - RNA, 22 nt, Homo sapiens
agaaauugguaccuugcacaca

SEQ ID NO: 489897 - RNA, 16 nt, Homo sapiens
agaaauuuuaucucuu

SEQ ID NO: 489898 - RNA, 22 nt, Homo sapiens
agaacaccugagcugcugcaug

SEQ ID NO: 489899 - RNA, 17 nt, Homo sapiens
agaacaggagcaagaac

SEQ ID NO: 489900 - RNA, 14 nt, Homo sapiens
agaaccgagcaaag

SEQ ID NO: 489901 - RNA, 18 nt, Homo sapiens
agaagagaguauggugcu

SEQ ID NO: 489902 - RNA, 19 nt, Homo sapiens
agaagccuaaaaaaagcua

SEQ ID NO: 489903 - RNA, 12 nt, Homo sapiens
agaauacuguau

SEQ ID NO: 489904 - RNA, 14 nt, Homo sapiens
agaaucaagucugu

SEQ ID NO: 489905 - RNA, 21 nt, Homo sapiens
agaaucaccuaauuaauuuca

SEQ ID NO: 489906 - RNA, 22 nt, Homo sapiens
agaaucuccuuuggaaggugac

SEQ ID NO: 489907 - RNA, 23 nt, Homo sapiens
agaauuagauuuuaaaacuucau

SEQ ID NO: 489908 - RNA, 22 nt, Homo sapiens
agacauaccucucaacuuacau

SEQ ID NO: 489909 - RNA, 23 nt, Homo sapiens
agacaugaaauugagucauuuua

SEQ ID NO: 489910 - RNA, 21 nt, Homo sapiens
agacauuauuuuguauggaau

SEQ ID NO: 489911 - RNA, 22 nt, Homo sapiens
agaccaagacuuuugucugauc

SEQ ID NO: 489912 - RNA, 12 nt, Homo sapiens
agaccaguagug

SEQ ID NO: 489913 - RNA, 23 nt, Homo sapiens
agaccucugugaggaaagcacac

SEQ ID NO: 489914 - RNA, 18 nt, Homo sapiens
agacucacuaaauccuuu

SEQ ID NO: 489915 - RNA, 13 nt, Homo sapiens
agacucagugcac

SEQ ID NO: 489916 - RNA, 23 nt, Homo sapiens
agacuguuuauuaccagauucac

SEQ ID NO: 489917 - RNA, 20 nt, Homo sapiens
agagaaaaagcccucuucaa

SEQ ID NO: 489918 - RNA, 15 nt, Homo sapiens
agagaaaacuucaga

SEQ ID NO: 489919 - RNA, 22 nt, Homo sapiens
agagaaauuauguuuucaucca

SEQ ID NO: 489920 - RNA, 16 nt, Homo sapiens
agagaaguacagguca

SEQ ID NO: 489921 - RNA, 15 nt, Homo sapiens
agagaaguccagcuc

SEQ ID NO: 489922 - RNA, 18 nt, Homo sapiens
agagagaaacagcuugau

SEQ ID NO: 489923 - RNA, 16 nt, Homo sapiens
agagagauauaucuga

SEQ ID NO: 489924 - RNA, 14 nt, Homo sapiens
agagcacaaacuuc

SEQ ID NO: 489925 - RNA, 21 nt, Homo sapiens
agagccauucuggcacuuuaa

SEQ ID NO: 489926 - RNA, 17 nt, Homo sapiens
agagccuagaggcucac

SEQ ID NO: 489927 - RNA, 21 nt, Homo sapiens
agagcucaucaucagucuuaa

SEQ ID NO: 489928 - RNA, 20 nt, Homo sapiens
agaggaaaaaggcuucucca

SEQ ID NO: 489929 - RNA, 15 nt, Homo sapiens
agaggaagagugcaa

SEQ ID NO: 489930 - RNA, 23 nt, Homo sapiens
agaggcuaugaagaaaacagcug

SEQ ID NO: 489931 - RNA, 17 nt, Homo sapiens
agaggcuuccagucuca

SEQ ID NO: 489932 - RNA, 17 nt, Homo sapiens
agaggggcggggccagg

SEQ ID NO: 489933 - RNA, 20 nt, Homo sapiens
agagggggaggggugguacu

SEQ ID NO: 489934 - RNA, 23 nt, Homo sapiens
agagguaccaaaaaagaaaguuu

SEQ ID NO: 489935 - RNA, 17 nt, Homo sapiens
agagucaagcugaugaa

SEQ ID NO: 489936 - RNA, 14 nt, Homo sapiens
agagugcaaaacau

SEQ ID NO: 489937 - RNA, 15 nt, Homo sapiens
agauacaaauaccuu

SEQ ID NO: 489938 - RNA, 15 nt, Homo sapiens
agauaguauacacau

SEQ ID NO: 489939 - RNA, 22 nt, Homo sapiens
agaucaaaauaaaaagugacac

SEQ ID NO: 489940 - RNA, 20 nt, Homo sapiens
agaucaagaaaaaaagggag

SEQ ID NO: 489941 - RNA, 16 nt, Homo sapiens
agauccaccugcacaa

SEQ ID NO: 489942 - RNA, 19 nt, Homo sapiens
agaucgcgccacugcacuc

SEQ ID NO: 489943 - RNA, 18 nt, Homo sapiens
agaucuuggcccuguuaa

SEQ ID NO: 489944 - RNA, 19 nt, Homo sapiens
agauggaaggaagggagaa

SEQ ID NO: 489945 - RNA, 22 nt, Homo sapiens
agauggcagagggcagagcaca

SEQ ID NO: 489946 - RNA, 16 nt, Homo sapiens
agauguggacaugcac

SEQ ID NO: 489947 - RNA, 17 nt, Homo sapiens
agauguuuuaguuuaaa

SEQ ID NO: 489948 - RNA, 19 nt, Homo sapiens
agauuuaagcaagaccaug

SEQ ID NO: 489949 - RNA, 21 nt, Homo sapiens
agauuuauuuuugaaacaaac

SEQ ID NO: 489950 - RNA, 17 nt, Homo sapiens
agauuuuaaaacuucau

SEQ ID NO: 489951 - RNA, 22 nt, Homo sapiens
agauuuuaaauagacaauccaa

SEQ ID NO: 489952 - RNA, 19 nt, Homo sapiens
agauuuucauguucuugca

SEQ ID NO: 489953 - RNA, 19 nt, Homo sapiens
agcaaaaaaguacaaaguu

SEQ ID NO: 489954 - RNA, 12 nt, Homo sapiens
agcaaaaggcau

SEQ ID NO: 489955 - RNA, 15 nt, Homo sapiens
agcaaacccaaagau

SEQ ID NO: 489956 - RNA, 15 nt, Homo sapiens
agcacagcuuuccug

SEQ ID NO: 489957 - RNA, 14 nt, Homo sapiens
agcaccucuugaag

SEQ ID NO: 489958 - RNA, 18 nt, Homo sapiens
agcacuuccuugccaguc

SEQ ID NO: 489959 - RNA, 18 nt, Homo sapiens
agcacuuucuucuuccca

SEQ ID NO: 489960 - RNA, 19 nt, Homo sapiens
agcacuuuguuucauauuc

SEQ ID NO: 489961 - RNA, 16 nt, Homo sapiens
agcagcagcagcagca

SEQ ID NO: 489962 - RNA, 17 nt, Homo sapiens
agcaugaagauaaaucc

SEQ ID NO: 489963 - RNA, 23 nt, Homo sapiens
agcauggcucauucugcaaugag

SEQ ID NO: 489964 - RNA, 14 nt, Homo sapiens
auaaccgcacagac

SEQ ID NO: 489965 - RNA, 22 nt, Homo sapiens
auaaggaguugccgcauauuau

SEQ ID NO: 489966 - RNA, 23 nt, Homo sapiens
auaaggccucauccuccacugaa

SEQ ID NO: 489967 - RNA, 17 nt, Homo sapiens
auaauauauuugcagau

SEQ ID NO: 489968 - RNA, 21 nt, Homo sapiens
auaaugguaauuuaguguaua

SEQ ID NO: 489969 - RNA, 18 nt, Homo sapiens
auaauguauuuucagcuc

SEQ ID NO: 489970 - RNA, 13 nt, Homo sapiens
auaauguguguau

SEQ ID NO: 489971 - RNA, 14 nt, Homo sapiens
auacaaucauguga

SEQ ID NO: 489972 - RNA, 13 nt, Homo sapiens
auacaauuuacuu

SEQ ID NO: 489973 - RNA, 13 nt, Homo sapiens
auacacacaggag

SEQ ID NO: 489974 - RNA, 20 nt, Homo sapiens
auacacuuuauuaauauaac

SEQ ID NO: 489975 - RNA, 16 nt, Homo sapiens
auacauacacuuguau

SEQ ID NO: 489976 - RNA, 14 nt, Homo sapiens
auacauguguguau

SEQ ID NO: 489977 - RNA, 15 nt, Homo sapiens
auacauguguguaua

SEQ ID NO: 489978 - RNA, 14 nt, Homo sapiens
auacauuaauacuu

SEQ ID NO: 489979 - RNA, 17 nt, Homo sapiens
auaccugaccucacaga

SEQ ID NO: 489980 - RNA, 15 nt, Homo sapiens
auacuauuauuugcu

SEQ ID NO: 489981 - RNA, 13 nt, Homo sapiens
auacuucuuuuua

SEQ ID NO: 489982 - RNA, 15 nt, Homo sapiens
auagaauaacaacug

SEQ ID NO: 489983 - RNA, 19 nt, Homo sapiens
auagacagauguggacaug

SEQ ID NO: 489984 - RNA, 15 nt, Homo sapiens
auagaguucuaugag

SEQ ID NO: 489985 - RNA, 22 nt, Homo sapiens
auagaguuuuuauuaauuacuu

SEQ ID NO: 489986 - RNA, 22 nt, Homo sapiens
auagauuuucauguucuugcag

SEQ ID NO: 489987 - RNA, 16 nt, Homo sapiens
auagcuacccaaaaga

SEQ ID NO: 489988 - RNA, 15 nt, Homo sapiens
auagcuuaagaagua

SEQ ID NO: 489989 - RNA, 13 nt, Homo sapiens
auagcuugcacaa

SEQ ID NO: 489990 - RNA, 18 nt, Homo sapiens
auaguaaauguaguucau

SEQ ID NO: 489991 - RNA, 15 nt, Homo sapiens
auaguagcaauggau

SEQ ID NO: 489992 - RNA, 18 nt, Homo sapiens
auagucuuaacuggucuc

SEQ ID NO: 489993 - RNA, 17 nt, Homo sapiens
auauaaaaaaucuuuag

SEQ ID NO: 489994 - RNA, 20 nt, Homo sapiens
auauaauguauuuucagcuc

SEQ ID NO: 489995 - RNA, 20 nt, Homo sapiens
auauacauauguagacuaua

SEQ ID NO: 489996 - RNA, 17 nt, Homo sapiens
auauaccuauaaugugu

SEQ ID NO: 489997 - RNA, 19 nt, Homo sapiens
auauccaacagaaagcaua

SEQ ID NO: 489998 - RNA, 14 nt, Homo sapiens
auaucuguauauau

SEQ ID NO: 489999 - RNA, 17 nt, Homo sapiens
auaucuguggucuucaa

SEQ ID NO: 490000 - RNA, 13 nt, Homo sapiens
auaugaguauaca

SEQ ID NO: 490001 - RNA, 21 nt, Homo sapiens
auauguaaacuuuaacuucca

SEQ ID NO: 490002 - RNA, 13 nt, Homo sapiens
auauguauauaug

SEQ ID NO: 490003 - RNA, 16 nt, Homo sapiens
auauuaaaaucugaug

SEQ ID NO: 490004 - RNA, 14 nt, Homo sapiens
auauucuacuaugc

SEQ ID NO: 490005 - RNA, 19 nt, Homo sapiens
auauuucuaguagcacaac

SEQ ID NO: 490006 - RNA, 18 nt, Homo sapiens
auauuuucugaguagcau

SEQ ID NO: 490007 - RNA, 15 nt, Homo sapiens
aucaagaccaaagag

SEQ ID NO: 490008 - RNA, 15 nt, Homo sapiens
aucaauucauugugu

SEQ ID NO: 490009 - RNA, 17 nt, Homo sapiens
aucacugaacuuuucaa

SEQ ID NO: 490010 - RNA, 16 nt, Homo sapiens
aucagaaaaugcagcc

SEQ ID NO: 490011 - RNA, 20 nt, Homo sapiens
aucaggaaauaucugugaag

SEQ ID NO: 490012 - RNA, 16 nt, Homo sapiens
aucaguguugcaacau

SEQ ID NO: 490013 - RNA, 15 nt, Homo sapiens
aucaguuuuuguucu

SEQ ID NO: 490014 - RNA, 15 nt, Homo sapiens
aucaugaacagcucu

SEQ ID NO: 490015 - RNA, 20 nt, Homo sapiens
aucaugcuucuacuccaugg

SEQ ID NO: 490016 - RNA, 24 nt, Homo sapiens
aucaugcuucuacuccauggugaa

SEQ ID NO: 490017 - RNA, 18 nt, Homo sapiens
aucauguguuucugugua

SEQ ID NO: 490018 - RNA, 18 nt, Homo sapiens
auccaccccguugcucaa

SEQ ID NO: 490019 - RNA, 14 nt, Homo sapiens
auccaccugcacaa

SEQ ID NO: 490020 - RNA, 15 nt, Homo sapiens
auccaccugcacaaa

SEQ ID NO: 490021 - RNA, 16 nt, Homo sapiens
auccagagcagaguuu

SEQ ID NO: 490022 - RNA, 18 nt, Homo sapiens
auccagaggguugugauu

SEQ ID NO: 490023 - RNA, 19 nt, Homo sapiens
auccagaggguugugauuu

SEQ ID NO: 490024 - RNA, 18 nt, Homo sapiens
auccaggaacacaugcac

SEQ ID NO: 490025 - RNA, 20 nt, Homo sapiens
auccaugugcugcuguggca

SEQ ID NO: 490026 - RNA, 18 nt, Homo sapiens
auccauuuuacacuugcu

SEQ ID NO: 490027 - RNA, 18 nt, Homo sapiens
aucccagcauucuguucc

SEQ ID NO: 490028 - RNA, 22 nt, Homo sapiens
aucccaucgucucggccuucac

SEQ ID NO: 490029 - RNA, 15 nt, Homo sapiens
aucccugcagcucaa

SEQ ID NO: 490030 - RNA, 15 nt, Homo sapiens
auccuaucuggggag

SEQ ID NO: 490031 - RNA, 21 nt, Homo sapiens
auccuccuucacucccuguca

SEQ ID NO: 490032 - RNA, 22 nt, Homo sapiens
auccucuuucuuaguauaugaa

SEQ ID NO: 490033 - RNA, 15 nt, Homo sapiens
auccuggagugauau

SEQ ID NO: 490034 - RNA, 21 nt, Homo sapiens
auccuucuccccaaggucugu

SEQ ID NO: 490035 - RNA, 14 nt, Homo sapiens
aucguaacaagcaa

SEQ ID NO: 490036 - RNA, 15 nt, Homo sapiens
aucguuucuuccagu

SEQ ID NO: 490037 - RNA, 21 nt, Homo sapiens
aucuacuagaaccuucuaauc

SEQ ID NO: 490038 - RNA, 22 nt, Homo sapiens
aucuagguucaggaagaccaca

SEQ ID NO: 490039 - RNA, 13 nt, Homo sapiens
aucuauggcaagc

SEQ ID NO: 490040 - RNA, 22 nt, Homo sapiens
aucucaacuuagcacacgugaa

SEQ ID NO: 490041 - RNA, 23 nt, Homo sapiens
aucucauccaucaaguugcacac

SEQ ID NO: 490042 - RNA, 21 nt, Homo sapiens
aucucauuuuuaagaacaagc

SEQ ID NO: 490043 - RNA, 21 nt, Homo sapiens
aucucgcacuacaucugauau

SEQ ID NO: 490044 - RNA, 20 nt, Homo sapiens
aucucguuguaaguacucua

SEQ ID NO: 490045 - RNA, 15 nt, Homo sapiens
aucucugaaagcaca

SEQ ID NO: 490046 - RNA, 18 nt, Homo sapiens
aucugaccacagacacuc

SEQ ID NO: 490047 - RNA, 16 nt, Homo sapiens
aucuucauaucuauca

SEQ ID NO: 490048 - RNA, 18 nt, Homo sapiens
aucuuuagaaacaucagu

SEQ ID NO: 490049 - RNA, 19 nt, Homo sapiens
aucuuugcuauggggacau

SEQ ID NO: 490050 - RNA, 16 nt, Homo sapiens
aucuuuuuucccccac

SEQ ID NO: 490051 - RNA, 23 nt, Homo sapiens
augaaaaauaguguguccaugca

SEQ ID NO: 490052 - RNA, 18 nt, Homo sapiens
augaaacuauuacuccua

SEQ ID NO: 490053 - RNA, 20 nt, Homo sapiens
augaaauugagucauuuuau

SEQ ID NO: 490054 - RNA, 15 nt, Homo sapiens
augaagcagauuuau

SEQ ID NO: 490055 - RNA, 19 nt, Homo sapiens
augaaggucuaccugaaaa

SEQ ID NO: 490056 - RNA, 20 nt, Homo sapiens
augaauguucgggcuuuuca

SEQ ID NO: 490057 - RNA, 16 nt, Homo sapiens
augaccauaaaauuag

SEQ ID NO: 490058 - RNA, 13 nt, Homo sapiens
augagaacaugaa

SEQ ID NO: 490059 - RNA, 17 nt, Homo sapiens
augagagaagagaguau

SEQ ID NO: 490060 - RNA, 20 nt, Homo sapiens
augagucacuuacuucauau

SEQ ID NO: 490061 - RNA, 19 nt, Homo sapiens
augagugcgggaccacuau

SEQ ID NO: 490062 - RNA, 18 nt, Homo sapiens
augagugcuaagagccuc

SEQ ID NO: 490063 - RNA, 19 nt, Homo sapiens
augauacuugguccuuaaa

SEQ ID NO: 490064 - RNA, 18 nt, Homo sapiens
augauauuccccauuucc

SEQ ID NO: 490065 - RNA, 15 nt, Homo sapiens
augcaauuacugcug

SEQ ID NO: 490066 - RNA, 20 nt, Homo sapiens
augcacacacacacaucuca

SEQ ID NO: 490067 - RNA, 19 nt, Homo sapiens
augcacauccauucccaag

SEQ ID NO: 490068 - RNA, 18 nt, Homo sapiens
augcacccgcauguacaa

SEQ ID NO: 490069 - RNA, 22 nt, Homo sapiens
augcauauuaaagaaagucaua

SEQ ID NO: 490070 - RNA, 16 nt, Homo sapiens
augcccucaucccgac

SEQ ID NO: 490071 - RNA, 22 nt, Homo sapiens
augccuaauaaacaauucaagu

SEQ ID NO: 490072 - RNA, 15 nt, Homo sapiens
augccucagagggua

SEQ ID NO: 490073 - RNA, 22 nt, Homo sapiens
augccucagaggguagccuuga

SEQ ID NO: 490074 - RNA, 15 nt, Homo sapiens
augccuuuccagugc

SEQ ID NO: 490075 - RNA, 14 nt, Homo sapiens
augcgcaaauacaa

SEQ ID NO: 490076 - RNA, 22 nt, Homo sapiens
augcuacaaaaaaguagcaaaa

SEQ ID NO: 490077 - RNA, 22 nt, Homo sapiens
augcuguacuaaaauaugcagg

SEQ ID NO: 490078 - RNA, 20 nt, Homo sapiens
auggaagacaaauacacaua

SEQ ID NO: 490079 - RNA, 13 nt, Homo sapiens
auggaucugcaua

SEQ ID NO: 490080 - RNA, 17 nt, Homo sapiens
auggcuuguucagucac

SEQ ID NO: 490081 - RNA, 16 nt, Homo sapiens
augggaggaucacuug

SEQ ID NO: 490082 - RNA, 15 nt, Homo sapiens
augguagacugugac

SEQ ID NO: 490083 - RNA, 18 nt, Homo sapiens
augguauauauuuugaaa

SEQ ID NO: 490084 - RNA, 20 nt, Homo sapiens
auggucucugccaugaacug

SEQ ID NO: 490085 - RNA, 13 nt, Homo sapiens
auggugcaauuug

SEQ ID NO: 490086 - RNA, 18 nt, Homo sapiens
auggugcuggguccuuaa

SEQ ID NO: 490087 - RNA, 20 nt, Homo sapiens
auggugguuguuucuuccaa

SEQ ID NO: 490088 - RNA, 16 nt, Homo sapiens
auguaccauaaugcua

SEQ ID NO: 490089 - RNA, 19 nt, Homo sapiens
auguaccauaaugcuaaau

SEQ ID NO: 490090 - RNA, 22 nt, Homo sapiens
auguacccagccuaccagagau

SEQ ID NO: 490091 - RNA, 17 nt, Homo sapiens
augucuugguacuugcu

SEQ ID NO: 490092 - RNA, 17 nt, Homo sapiens
augugacauuugucauu

SEQ ID NO: 490093 - RNA, 19 nt, Homo sapiens
augugacgcacuguauucc

SEQ ID NO: 490094 - RNA, 15 nt, Homo sapiens
augugcccccagacg

SEQ ID NO: 490095 - RNA, 14 nt, Homo sapiens
augugccuagacac

SEQ ID NO: 490096 - RNA, 15 nt, Homo sapiens
auguggaaaacucac

SEQ ID NO: 490097 - RNA, 19 nt, Homo sapiens
augugucuuguauuaucau

SEQ ID NO: 490098 - RNA, 19 nt, Homo sapiens
auguuaaacguuacuuuca

SEQ ID NO: 490099 - RNA, 17 nt, Homo sapiens
auguucuugagcagcug

SEQ ID NO: 490100 - RNA, 19 nt, Homo sapiens
auguugacuggccaaaaau

SEQ ID NO: 490101 - RNA, 13 nt, Homo sapiens
auguuuaguguga

SEQ ID NO: 490102 - RNA, 15 nt, Homo sapiens
auguuuucacuguau

SEQ ID NO: 490103 - RNA, 18 nt, Homo sapiens
auguuuucacuguauuca

SEQ ID NO: 490104 - RNA, 15 nt, Homo sapiens
auuaaaagaguagaa

SEQ ID NO: 490105 - RNA, 14 nt, Homo sapiens
auuaaguaaacuaa

SEQ ID NO: 490106 - RNA, 16 nt, Homo sapiens
auuaauauaaccauaa

SEQ ID NO: 490107 - RNA, 12 nt, Homo sapiens
auuaauuacuua

SEQ ID NO: 490108 - RNA, 18 nt, Homo sapiens
auuacacgccacaacucc

SEQ ID NO: 490109 - RNA, 14 nt, Homo sapiens
auuacagaggguag

SEQ ID NO: 490110 - RNA, 13 nt, Homo sapiens
auuagcugugauu

SEQ ID NO: 490111 - RNA, 17 nt, Homo sapiens
auuagcuuacugauuaa

SEQ ID NO: 490112 - RNA, 19 nt, Homo sapiens
auuauagauuuucauguuc

SEQ ID NO: 490113 - RNA, 19 nt, Homo sapiens
auuauggcuuugugcuugu

SEQ ID NO: 490114 - RNA, 23 nt, Homo sapiens
auucaaauaacccugaaucagag

SEQ ID NO: 490115 - RNA, 22 nt, Homo sapiens
auucaagaaagccagucuuaac

SEQ ID NO: 490116 - RNA, 17 nt, Homo sapiens
auucaugcaacuugauu

SEQ ID NO: 490117 - RNA, 19 nt, Homo sapiens
auucaugcaacuugauucu

SEQ ID NO: 490118 - RNA, 16 nt, Homo sapiens
auucauuagcugugau

SEQ ID NO: 490119 - RNA, 16 nt, Homo sapiens
auuccaaucauuguua

SEQ ID NO: 490120 - RNA, 20 nt, Homo sapiens
auucccaugguagacuguga

SEQ ID NO: 490121 - RNA, 22 nt, Homo sapiens
auucccaugguagacugugaca

SEQ ID NO: 490122 - RNA, 12 nt, Homo sapiens
auuccuaucuca

SEQ ID NO: 490123 - RNA, 21 nt, Homo sapiens
auuccugccccaucacuuaca

SEQ ID NO: 490124 - RNA, 18 nt, Homo sapiens
auucuaauuagauuaacc

SEQ ID NO: 490125 - RNA, 16 nt, Homo sapiens
auucuauccaucuccu

SEQ ID NO: 490126 - RNA, 22 nt, Homo sapiens
auucugcuugguuccacaauca

SEQ ID NO: 490127 - RNA, 14 nt, Homo sapiens
auugaggaugaacu

SEQ ID NO: 490128 - RNA, 18 nt, Homo sapiens
auugauuuuuaaacagca

SEQ ID NO: 490129 - RNA, 21 nt, Homo sapiens
auuguaauuugggaacauaaa

SEQ ID NO: 490130 - RNA, 18 nt, Homo sapiens
auuguauaauuaugaagc

SEQ ID NO: 490131 - RNA, 18 nt, Homo sapiens
auugugauaagguaacau

SEQ ID NO: 490132 - RNA, 13 nt, Homo sapiens
auuguguaugaga

SEQ ID NO: 490133 - RNA, 11 nt, Homo sapiens
auuuaccacag

SEQ ID NO: 490134 - RNA, 14 nt, Homo sapiens
auuuagaugagauc

SEQ ID NO: 490135 - RNA, 18 nt, Homo sapiens
auuuaugagaucacugaa

SEQ ID NO: 490136 - RNA, 18 nt, Homo sapiens
auuuauuuuuucaucuca

SEQ ID NO: 490137 - RNA, 13 nt, Homo sapiens
auuucaacuucag

SEQ ID NO: 490138 - RNA, 15 nt, Homo sapiens
auuuccggccaacag

SEQ ID NO: 490139 - RNA, 15 nt, Homo sapiens
auuuccuaaggcaug

SEQ ID NO: 490140 - RNA, 19 nt, Homo sapiens
auuucuaaauguuucccag

SEQ ID NO: 490141 - RNA, 18 nt, Homo sapiens
auuucuaaguguuucaca

SEQ ID NO: 490142 - RNA, 22 nt, Homo sapiens
auuucucucuccagucuuccac

SEQ ID NO: 490143 - RNA, 13 nt, Homo sapiens
auuucuggcaaau

SEQ ID NO: 490144 - RNA, 15 nt, Homo sapiens
auuucuggcaaauau

SEQ ID NO: 490145 - RNA, 19 nt, Homo sapiens
auuugauguaaguuacuga

SEQ ID NO: 490146 - RNA, 10 nt, Homo sapiens
auuugcacag

SEQ ID NO: 490147 - RNA, 22 nt, Homo sapiens
auuuguccuuggggacaucuca

SEQ ID NO: 490148 - RNA, 19 nt, Homo sapiens
auuugugaaagugccaaaa

SEQ ID NO: 490149 - RNA, 17 nt, Homo sapiens
auuuguguaacugaaag

SEQ ID NO: 490150 - RNA, 16 nt, Homo sapiens
auuuuaaauagacaau

SEQ ID NO: 490151 - RNA, 15 nt, Homo sapiens
auuuuaagcuaggaa

SEQ ID NO: 490152 - RNA, 18 nt, Homo sapiens
auuuuacuaccaaugcca

SEQ ID NO: 490153 - RNA, 16 nt, Homo sapiens
auuuuacugucuuaau

SEQ ID NO: 490154 - RNA, 12 nt, Homo sapiens
auuuuauaggug

SEQ ID NO: 490155 - RNA, 14 nt, Homo sapiens
auuuuauauaugaa

SEQ ID NO: 490156 - RNA, 22 nt, Homo sapiens
auuuucauauugcuaccaaaaa

SEQ ID NO: 490157 - RNA, 13 nt, Homo sapiens
auuuuccauuaaa

SEQ ID NO: 490158 - RNA, 22 nt, Homo sapiens
auuuuccauuaaaagccauauu

SEQ ID NO: 490159 - RNA, 19 nt, Homo sapiens
auuuucugaaacuaaugaa

SEQ ID NO: 490160 - RNA, 16 nt, Homo sapiens
auuuuggacgugugag

SEQ ID NO: 490161 - RNA, 19 nt, Homo sapiens
auuuuuaucuauccuaugu

SEQ ID NO: 490162 - RNA, 12 nt, Homo sapiens
caaaaacacaaa

SEQ ID NO: 490163 - RNA, 17 nt, Homo sapiens
caaaaacuagacauuau

SEQ ID NO: 490164 - RNA, 14 nt, Homo sapiens
caaaaagcauguga

SEQ ID NO: 490165 - RNA, 22 nt, Homo sapiens
caaaaauaucuuuuuuccccca

SEQ ID NO: 490166 - RNA, 17 nt, Homo sapiens
caaaagaugccauucau

SEQ ID NO: 490167 - RNA, 14 nt, Homo sapiens
caaaaggaccccaa

SEQ ID NO: 490168 - RNA, 21 nt, Homo sapiens
caaaagucaccacuccauucc

SEQ ID NO: 490169 - RNA, 22 nt, Homo sapiens
caaaagucaccacuccauuccc

SEQ ID NO: 490170 - RNA, 20 nt, Homo sapiens
caaaaguuuuguaccuaagu

SEQ ID NO: 490171 - RNA, 19 nt, Homo sapiens
caaacagauccugaaagaa

SEQ ID NO: 490172 - RNA, 19 nt, Homo sapiens
caaacccagauugaagcua

SEQ ID NO: 490173 - RNA, 22 nt, Homo sapiens
caaacuuaacagaucacaugcc

SEQ ID NO: 490174 - RNA, 23 nt, Homo sapiens
caaagacgguagagagaaacagc

SEQ ID NO: 490175 - RNA, 19 nt, Homo sapiens
caaagaguuuucugugcaa

SEQ ID NO: 490176 - RNA, 15 nt, Homo sapiens
caaagcacaugcuua

SEQ ID NO: 490177 - RNA, 14 nt, Homo sapiens
caaagcaucccucu

SEQ ID NO: 490178 - RNA, 14 nt, Homo sapiens
caaagcauuugacu

SEQ ID NO: 490179 - RNA, 20 nt, Homo sapiens
caaagcccacucacccuuug

SEQ ID NO: 490180 - RNA, 17 nt, Homo sapiens
caaagcugcugcacagc

SEQ ID NO: 490181 - RNA, 14 nt, Homo sapiens
caaaggagcuuucu

SEQ ID NO: 490182 - RNA, 16 nt, Homo sapiens
caaaggagcuuucuca

SEQ ID NO: 490183 - RNA, 16 nt, Homo sapiens
caaaguuaaacgugau

SEQ ID NO: 490184 - RNA, 13 nt, Homo sapiens
caaauaaaaucua

SEQ ID NO: 490185 - RNA, 13 nt, Homo sapiens
caaauacacuuua

SEQ ID NO: 490186 - RNA, 19 nt, Homo sapiens
caaauauuuugucacugcu

SEQ ID NO: 490187 - RNA, 22 nt, Homo sapiens
caaaugccuuucuagcaauugc

SEQ ID NO: 490188 - RNA, 17 nt, Homo sapiens
caaaugcuacucaguau

SEQ ID NO: 490189 - RNA, 18 nt, Homo sapiens
caaaugucuacugaagcu

SEQ ID NO: 490190 - RNA, 15 nt, Homo sapiens
caacacaccuugccc

SEQ ID NO: 490191 - RNA, 22 nt, Homo sapiens
caacacaggauggucucugcca

SEQ ID NO: 490192 - RNA, 15 nt, Homo sapiens
caacagcaaauuaau

SEQ ID NO: 490193 - RNA, 17 nt, Homo sapiens
caacagcugugugugcc

SEQ ID NO: 490194 - RNA, 17 nt, Homo sapiens
caacaugguuaccucug

SEQ ID NO: 490195 - RNA, 19 nt, Homo sapiens
caaccuccccugguccugc

SEQ ID NO: 490196 - RNA, 20 nt, Homo sapiens
caaccuggguaacaaaguga

SEQ ID NO: 490197 - RNA, 16 nt, Homo sapiens
caaccuuaacuuacua

SEQ ID NO: 490198 - RNA, 14 nt, Homo sapiens
caacuaugcaauga

SEQ ID NO: 490199 - RNA, 16 nt, Homo sapiens
caacugauaauauuga

SEQ ID NO: 490200 - RNA, 13 nt, Homo sapiens
caacuuacauaug

SEQ ID NO: 490201 - RNA, 22 nt, Homo sapiens
caacuugaaauuauaucugugg

SEQ ID NO: 490202 - RNA, 20 nt, Homo sapiens
caacuuucacuuugcaaaga

SEQ ID NO: 490203 - RNA, 21 nt, Homo sapiens
caagaccaugggguggaagga

SEQ ID NO: 490204 - RNA, 17 nt, Homo sapiens
caaggaucacuugagcc

SEQ ID NO: 490205 - RNA, 14 nt, Homo sapiens
caaguaacauuuug

SEQ ID NO: 490206 - RNA, 18 nt, Homo sapiens
caaguagguuuacauuac

SEQ ID NO: 490207 - RNA, 17 nt, Homo sapiens
caagucacagaaaaugc

SEQ ID NO: 490208 - RNA, 14 nt, Homo sapiens
caagucuaguggaa

SEQ ID NO: 490209 - RNA, 23 nt, Homo sapiens
caaguucacaccacugccauuuc

SEQ ID NO: 490210 - RNA, 17 nt, Homo sapiens
caaguugcacacucacu

SEQ ID NO: 490211 - RNA, 13 nt, Homo sapiens
caauaaacaacuu

SEQ ID NO: 490212 - RNA, 17 nt, Homo sapiens
caauaaacucagucaaa

SEQ ID NO: 490213 - RNA, 15 nt, Homo sapiens
caauaagaaacaguu

SEQ ID NO: 490214 - RNA, 15 nt, Homo sapiens
caaucagaugccuca

SEQ ID NO: 490215 - RNA, 12 nt, Homo sapiens
caaugagccaug

SEQ ID NO: 490216 - RNA, 13 nt, Homo sapiens
caaugagccauga

SEQ ID NO: 490217 - RNA, 16 nt, Homo sapiens
caauggaaacaaucuu

SEQ ID NO: 490218 - RNA, 17 nt, Homo sapiens
cacaaccuccuccucca

SEQ ID NO: 490219 - RNA, 20 nt, Homo sapiens
cacaaccuccuccuccaguu

SEQ ID NO: 490220 - RNA, 19 nt, Homo sapiens
cacaaucugucaguucuaa

SEQ ID NO: 490221 - RNA, 22 nt, Homo sapiens
cacaauuaauucaucccuuaau

SEQ ID NO: 490222 - RNA, 14 nt, Homo sapiens
cacacacacacaua

SEQ ID NO: 490223 - RNA, 13 nt, Homo sapiens
cacacacauauau

SEQ ID NO: 490224 - RNA, 14 nt, Homo sapiens
cacacacgcagaca

SEQ ID NO: 490225 - RNA, 20 nt, Homo sapiens
cacaccuugcccaugcacaa

SEQ ID NO: 490226 - RNA, 20 nt, Homo sapiens
cacacucucuucuuacugua

SEQ ID NO: 490227 - RNA, 13 nt, Homo sapiens
cacagacaauucu

SEQ ID NO: 490228 - RNA, 21 nt, Homo sapiens
cacagcugcagagacagagag

SEQ ID NO: 490229 - RNA, 18 nt, Homo sapiens
cacaggacaacuuuacaa

SEQ ID NO: 490230 - RNA, 17 nt, Homo sapiens
cacagggcaugaaauga

SEQ ID NO: 490231 - RNA, 12 nt, Homo sapiens
cacauacauaua

SEQ ID NO: 490232 - RNA, 14 nt, Homo sapiens
cacauauauacaua

SEQ ID NO: 490233 - RNA, 22 nt, Homo sapiens
cacauauauguauacgcacgca

SEQ ID NO: 490234 - RNA, 14 nt, Homo sapiens
cacauccauuccca

SEQ ID NO: 490235 - RNA, 16 nt, Homo sapiens
cacaucuuguaacuua

SEQ ID NO: 490236 - RNA, 12 nt, Homo sapiens
caccaacuucac

SEQ ID NO: 490237 - RNA, 21 nt, Homo sapiens
caccacuuucccacacuguga

SEQ ID NO: 490238 - RNA, 22 nt, Homo sapiens
caccccuccaugauuccaaggg

SEQ ID NO: 490239 - RNA, 19 nt, Homo sapiens
ccuacagaauacuagccag

SEQ ID NO: 490240 - RNA, 20 nt, Homo sapiens
ccuagacucuaaaacuauca

SEQ ID NO: 490241 - RNA, 19 nt, Homo sapiens
ccuaggaguacaagugccu

SEQ ID NO: 490242 - RNA, 16 nt, Homo sapiens
ccuagucuucugugua

SEQ ID NO: 490243 - RNA, 15 nt, Homo sapiens
ccuauaaugugugua

SEQ ID NO: 490244 - RNA, 17 nt, Homo sapiens
ccuaucuggggagcucc

SEQ ID NO: 490245 - RNA, 16 nt, Homo sapiens
ccuauugcuguaaaua

SEQ ID NO: 490246 - RNA, 19 nt, Homo sapiens
ccucaagaaaaauucacag

SEQ ID NO: 490247 - RNA, 14 nt, Homo sapiens
ccucacauauuauu

SEQ ID NO: 490248 - RNA, 18 nt, Homo sapiens
ccucacugaaaauuacag

SEQ ID NO: 490249 - RNA, 15 nt, Homo sapiens
ccucagaaagggauu

SEQ ID NO: 490250 - RNA, 18 nt, Homo sapiens
ccucagcaaacccaaaga

SEQ ID NO: 490251 - RNA, 17 nt, Homo sapiens
ccucauccuccacugaa

SEQ ID NO: 490252 - RNA, 13 nt, Homo sapiens
ccuccgacuucuc

SEQ ID NO: 490253 - RNA, 13 nt, Homo sapiens
ccucucuccauca

SEQ ID NO: 490254 - RNA, 18 nt, Homo sapiens
ccucuguucuuggaacaa

SEQ ID NO: 490255 - RNA, 19 nt, Homo sapiens
ccucuuaaugucucaaaau

SEQ ID NO: 490256 - RNA, 19 nt, Homo sapiens
ccucuuagaagaaauauga

SEQ ID NO: 490257 - RNA, 19 nt, Homo sapiens
ccucuugaaugcuuaaaug

SEQ ID NO: 490258 - RNA, 19 nt, Homo sapiens
ccugaaucugaccacagac

SEQ ID NO: 490259 - RNA, 14 nt, Homo sapiens
ccugcacaaacaua

SEQ ID NO: 490260 - RNA, 15 nt, Homo sapiens
ccugcagggugaccu

SEQ ID NO: 490261 - RNA, 21 nt, Homo sapiens
ccugcauagcuugcacaacau

SEQ ID NO: 490262 - RNA, 20 nt, Homo sapiens
ccugggcuuuuguuuugcuu

SEQ ID NO: 490263 - RNA, 12 nt, Homo sapiens
ccugggggccug

SEQ ID NO: 490264 - RNA, 23 nt, Homo sapiens
ccugguggugggggcuucucugc

SEQ ID NO: 490265 - RNA, 21 nt, Homo sapiens
ccuguacaaaagggacaugaa

SEQ ID NO: 490266 - RNA, 22 nt, Homo sapiens
ccuguacuggagagcaacacag

SEQ ID NO: 490267 - RNA, 22 nt, Homo sapiens
ccuguuaaaucguaacaagcaa

SEQ ID NO: 490268 - RNA, 15 nt, Homo sapiens
ccuguuaaggcaucc

SEQ ID NO: 490269 - RNA, 16 nt, Homo sapiens
ccuuaaacagugucca

SEQ ID NO: 490270 - RNA, 16 nt, Homo sapiens
ccuuagaauacuguau

SEQ ID NO: 490271 - RNA, 23 nt, Homo sapiens
ccuucaaugcaaaauacaugaug

SEQ ID NO: 490272 - RNA, 20 nt, Homo sapiens
ccuucucucaccuccuaaag

SEQ ID NO: 490273 - RNA, 11 nt, Homo sapiens
ccuugcugcua

SEQ ID NO: 490274 - RNA, 24 nt, Homo sapiens
ccuuguccuugaaaguaggauaua

SEQ ID NO: 490275 - RNA, 16 nt, Homo sapiens
ccuuuacuugucuuuc

SEQ ID NO: 490276 - RNA, 12 nt, Homo sapiens
ccuuucuaaucc

SEQ ID NO: 490277 - RNA, 13 nt, Homo sapiens
ccuuuguugcaca

SEQ ID NO: 490278 - RNA, 22 nt, Homo sapiens
ccuuuugguuccucacauauua

SEQ ID NO: 490279 - RNA, 13 nt, Homo sapiens
cgaaguuugcaac

SEQ ID NO: 490280 - RNA, 16 nt, Homo sapiens
cgacaacuuguaacuc

SEQ ID NO: 490281 - RNA, 14 nt, Homo sapiens
cgaggacccaugaa

SEQ ID NO: 490282 - RNA, 13 nt, Homo sapiens
cgagucuggagac

SEQ ID NO: 490283 - RNA, 13 nt, Homo sapiens
cgcacgcacacac

SEQ ID NO: 490284 - RNA, 15 nt, Homo sapiens
cgcagcccgggagau

SEQ ID NO: 490285 - RNA, 14 nt, Homo sapiens
cgcaggguggagau

SEQ ID NO: 490286 - RNA, 23 nt, Homo sapiens
cgccugguucuguacauguggaa

SEQ ID NO: 490287 - RNA, 18 nt, Homo sapiens
cgcugcaccuaaagccua

SEQ ID NO: 490288 - RNA, 22 nt, Homo sapiens
cgcuuuugcuggucacugccau

SEQ ID NO: 490289 - RNA, 15 nt, Homo sapiens
cggaccgaaggugac

SEQ ID NO: 490290 - RNA, 13 nt, Homo sapiens
cggaguugugcac

SEQ ID NO: 490291 - RNA, 15 nt, Homo sapiens
cggccggccuggggc

SEQ ID NO: 490292 - RNA, 21 nt, Homo sapiens
cggggugagcccccagagcug

SEQ ID NO: 490293 - RNA, 12 nt, Homo sapiens
cgugaaacacaa

SEQ ID NO: 490294 - RNA, 12 nt, Homo sapiens
cgugagaaggag

SEQ ID NO: 490295 - RNA, 18 nt, Homo sapiens
cgugaucaguguugcaac

SEQ ID NO: 490296 - RNA, 20 nt, Homo sapiens
cguggugagguugugcugcc

SEQ ID NO: 490297 - RNA, 19 nt, Homo sapiens
cguuacuuucauguacuau

SEQ ID NO: 490298 - RNA, 17 nt, Homo sapiens
cuaaaaaugcaucacau

SEQ ID NO: 490299 - RNA, 13 nt, Homo sapiens
cuaaacauuuccu

SEQ ID NO: 490300 - RNA, 20 nt, Homo sapiens
cuaacucaaaggagccuuuu

SEQ ID NO: 490301 - RNA, 12 nt, Homo sapiens
cuaacugugcaa

SEQ ID NO: 490302 - RNA, 20 nt, Homo sapiens
cuaagcaacuaggccuucag

SEQ ID NO: 490303 - RNA, 14 nt, Homo sapiens
cuaagccugaugau

SEQ ID NO: 490304 - RNA, 19 nt, Homo sapiens
cuaauauugaaaaugucac

SEQ ID NO: 490305 - RNA, 12 nt, Homo sapiens
cuaauccuaucu

SEQ ID NO: 490306 - RNA, 14 nt, Homo sapiens
cuaaugacaaguga

SEQ ID NO: 490307 - RNA, 13 nt, Homo sapiens
cuaaugccucuuc

SEQ ID NO: 490308 - RNA, 22 nt, Homo sapiens
cuaauguugacuuuaauacucu

SEQ ID NO: 490309 - RNA, 22 nt, Homo sapiens
cuaauuaaaaaguuaaucuuca

SEQ ID NO: 490310 - RNA, 19 nt, Homo sapiens
cuacaauacaacacauuga

SEQ ID NO: 490311 - RNA, 15 nt, Homo sapiens
cuaccaagcagcuca

SEQ ID NO: 490312 - RNA, 17 nt, Homo sapiens
cuaccauuauggcuuug

SEQ ID NO: 490313 - RNA, 18 nt, Homo sapiens
cuacccuauucuauccau

SEQ ID NO: 490314 - RNA, 14 nt, Homo sapiens
cuaccuugaugaaa

SEQ ID NO: 490315 - RNA, 19 nt, Homo sapiens
cuagaaagagaaaaagccc

SEQ ID NO: 490316 - RNA, 13 nt, Homo sapiens
cuagacauuauuu

SEQ ID NO: 490317 - RNA, 14 nt, Homo sapiens
cuaggaacaaaucu

SEQ ID NO: 490318 - RNA, 22 nt, Homo sapiens
cuagucuucuguguaugugaug

SEQ ID NO: 490319 - RNA, 23 nt, Homo sapiens
cuaguugccguggcaacugugga

SEQ ID NO: 490320 - RNA, 19 nt, Homo sapiens
cuauagauugauuuaccuu

SEQ ID NO: 490321 - RNA, 18 nt, Homo sapiens
cuaucaaucaccuugcau

SEQ ID NO: 490322 - RNA, 18 nt, Homo sapiens
cuaucuggggagcuccug

SEQ ID NO: 490323 - RNA, 20 nt, Homo sapiens
cuauggacagcauugccagu

SEQ ID NO: 490324 - RNA, 21 nt, Homo sapiens
cuauggacagcauugccagua

SEQ ID NO: 490325 - RNA, 15 nt, Homo sapiens
cuauuccauauuaaa

SEQ ID NO: 490326 - RNA, 13 nt, Homo sapiens
cuauucuauccau

SEQ ID NO: 490327 - RNA, 17 nt, Homo sapiens
cuauuuaaguggacugu

SEQ ID NO: 490328 - RNA, 19 nt, Homo sapiens
cucaacaauaaaacauuau

SEQ ID NO: 490329 - RNA, 16 nt, Homo sapiens
cucaacuuacauaugu

SEQ ID NO: 490330 - RNA, 21 nt, Homo sapiens
cucaaggcugcagugagccaa

SEQ ID NO: 490331 - RNA, 17 nt, Homo sapiens
cucaauuguuaauguga

SEQ ID NO: 490332 - RNA, 13 nt, Homo sapiens
cucacagaguaug

SEQ ID NO: 490333 - RNA, 15 nt, Homo sapiens
cucacagaugggcaa

SEQ ID NO: 490334 - RNA, 20 nt, Homo sapiens
cucacauagcuacccaaaag

SEQ ID NO: 490335 - RNA, 20 nt, Homo sapiens
cucaccuucccuaguucuuu

SEQ ID NO: 490336 - RNA, 13 nt, Homo sapiens
cucacugauauau

SEQ ID NO: 490337 - RNA, 14 nt, Homo sapiens
cucacuggcaucuu

SEQ ID NO: 490338 - RNA, 21 nt, Homo sapiens
cucacuugcuuuaguuguuaa

SEQ ID NO: 490339 - RNA, 22 nt, Homo sapiens
cucagaaccauucacuggcaaa

SEQ ID NO: 490340 - RNA, 23 nt, Homo sapiens
cucagagcacagccaaucuccag

SEQ ID NO: 490341 - RNA, 23 nt, Homo sapiens
cucagaugauggauauguuuuca

SEQ ID NO: 490342 - RNA, 14 nt, Homo sapiens
cucagcuucuuaau

SEQ ID NO: 490343 - RNA, 21 nt, Homo sapiens
cucagguuauucguuacucua

SEQ ID NO: 490344 - RNA, 14 nt, Homo sapiens
cucagucaaaugua

SEQ ID NO: 490345 - RNA, 23 nt, Homo sapiens
cucaucuuuuaucuaacuauaug

SEQ ID NO: 490346 - RNA, 21 nt, Homo sapiens
cucaugcagauaguauacaca

SEQ ID NO: 490347 - RNA, 17 nt, Homo sapiens
cuccacccuuggacuuu

SEQ ID NO: 490348 - RNA, 24 nt, Homo sapiens
cuccaggcucccucccucccagau

SEQ ID NO: 490349 - RNA, 16 nt, Homo sapiens
cucccucccagaucca

SEQ ID NO: 490350 - RNA, 18 nt, Homo sapiens
cuccuaagcaacuaggcc

SEQ ID NO: 490351 - RNA, 17 nt, Homo sapiens
cuccucccugauguaca

SEQ ID NO: 490352 - RNA, 22 nt, Homo sapiens
cuccuggggggccugaaagcaa

SEQ ID NO: 490353 - RNA, 19 nt, Homo sapiens
cuccuguggccugccaguc

SEQ ID NO: 490354 - RNA, 18 nt, Homo sapiens
cuccuuuucccaaagcau

SEQ ID NO: 490355 - RNA, 17 nt, Homo sapiens
cucgaugcagacagggg

SEQ ID NO: 490356 - RNA, 23 nt, Homo sapiens
cucgguaaaccgaggacccauga

SEQ ID NO: 490357 - RNA, 18 nt, Homo sapiens
cucuaaaacagcacuauc

SEQ ID NO: 490358 - RNA, 18 nt, Homo sapiens
cucuaaacugguacaauu

SEQ ID NO: 490359 - RNA, 19 nt, Homo sapiens
cucuaaacugguacaauuu

SEQ ID NO: 490360 - RNA, 21 nt, Homo sapiens
cucuaacugugcaaagcagag

SEQ ID NO: 490361 - RNA, 20 nt, Homo sapiens
cucuacaucucguauggauu

SEQ ID NO: 490362 - RNA, 17 nt, Homo sapiens
cucuagacaucuagucu

SEQ ID NO: 490363 - RNA, 21 nt, Homo sapiens
cucuagugucuuuugccuuua

SEQ ID NO: 490364 - RNA, 21 nt, Homo sapiens
cucuauuuagcaacagaauua

SEQ ID NO: 490365 - RNA, 23 nt, Homo sapiens
cucucuuuugguuugugggucca

SEQ ID NO: 490366 - RNA, 15 nt, Homo sapiens
cucugcaccuuugca

SEQ ID NO: 490367 - RNA, 15 nt, Homo sapiens
cucugcaggccacuu

SEQ ID NO: 490368 - RNA, 17 nt, Homo sapiens
cucuguauauaaauaug

SEQ ID NO: 490369 - RNA, 20 nt, Homo sapiens
cucuuaaguacugaaauaca

SEQ ID NO: 490370 - RNA, 15 nt, Homo sapiens
cucuuaccuguaaua

SEQ ID NO: 490371 - RNA, 17 nt, Homo sapiens
cucuucccccaccacca

SEQ ID NO: 490372 - RNA, 13 nt, Homo sapiens
cucuucuacuucu

SEQ ID NO: 490373 - RNA, 12 nt, Homo sapiens
cugaaacuaaug

SEQ ID NO: 490374 - RNA, 21 nt, Homo sapiens
cugaaagacaguaaagaccau

SEQ ID NO: 490375 - RNA, 22 nt, Homo sapiens
cugaacaagcgcuuacgugaua

SEQ ID NO: 490376 - RNA, 20 nt, Homo sapiens
uaaugcuaaauaaaacugug

SEQ ID NO: 490377 - RNA, 18 nt, Homo sapiens
uaauggaaaaaaagacug

SEQ ID NO: 490378 - RNA, 20 nt, Homo sapiens
uaauggaagagaaaucucau

SEQ ID NO: 490379 - RNA, 18 nt, Homo sapiens
uaauguggcuucuggaau

SEQ ID NO: 490380 - RNA, 14 nt, Homo sapiens
uaauguugauuucu

SEQ ID NO: 490381 - RNA, 14 nt, Homo sapiens
uaauuaaacugaug

SEQ ID NO: 490382 - RNA, 13 nt, Homo sapiens
uaauuagauuaac

SEQ ID NO: 490383 - RNA, 15 nt, Homo sapiens
uaauuuaauuuagug

SEQ ID NO: 490384 - RNA, 22 nt, Homo sapiens
uaauuuaguggauggaauauca

SEQ ID NO: 490385 - RNA, 15 nt, Homo sapiens
uaauuucuugcaauu

SEQ ID NO: 490386 - RNA, 14 nt, Homo sapiens
uacaaaauauccaa

SEQ ID NO: 490387 - RNA, 21 nt, Homo sapiens
uacaaacaauuaacugagcau

SEQ ID NO: 490388 - RNA, 17 nt, Homo sapiens
uacaaaugugugacugc

SEQ ID NO: 490389 - RNA, 20 nt, Homo sapiens
uacaaaugugugacugcuca

SEQ ID NO: 490390 - RNA, 13 nt, Homo sapiens
uacaagacuguaa

SEQ ID NO: 490391 - RNA, 20 nt, Homo sapiens
uacaaguuuucauaagcaca

SEQ ID NO: 490392 - RNA, 19 nt, Homo sapiens
uacaaucaugaacagcucu

SEQ ID NO: 490393 - RNA, 23 nt, Homo sapiens
uacaauuuguuaauuccuaugaa

SEQ ID NO: 490394 - RNA, 23 nt, Homo sapiens
uacacaauuaauucaucccuuaa

SEQ ID NO: 490395 - RNA, 12 nt, Homo sapiens
uacacacaggag

SEQ ID NO: 490396 - RNA, 13 nt, Homo sapiens
uacacauacauau

SEQ ID NO: 490397 - RNA, 14 nt, Homo sapiens
uacacaucuuccac

SEQ ID NO: 490398 - RNA, 20 nt, Homo sapiens
uacacaucuuccacaggucu

SEQ ID NO: 490399 - RNA, 22 nt, Homo sapiens
uacacuuguauaaauguauaua

SEQ ID NO: 490400 - RNA, 17 nt, Homo sapiens
uacagaacacuuugcua

SEQ ID NO: 490401 - RNA, 13 nt, Homo sapiens
uacagcagaucca

SEQ ID NO: 490402 - RNA, 20 nt, Homo sapiens
uacagcagauccaccugcac

SEQ ID NO: 490403 - RNA, 14 nt, Homo sapiens
uacauaacaagaaa

SEQ ID NO: 490404 - RNA, 22 nt, Homo sapiens
uacauacgcuaccuugaugaaa

SEQ ID NO: 490405 - RNA, 21 nt, Homo sapiens
uacaugccuuuccagugcugc

SEQ ID NO: 490406 - RNA, 21 nt, Homo sapiens
uacauguggaaaacucacaga

SEQ ID NO: 490407 - RNA, 17 nt, Homo sapiens
uaccaaagcugcugcac

SEQ ID NO: 490408 - RNA, 22 nt, Homo sapiens
uaccaccaagaggaaaauauug

SEQ ID NO: 490409 - RNA, 20 nt, Homo sapiens
uaccauagcuuaagaaguau

SEQ ID NO: 490410 - RNA, 17 nt, Homo sapiens
uaccauuggaaauuuca

SEQ ID NO: 490411 - RNA, 22 nt, Homo sapiens
uacccuauucuauccaucuccu

SEQ ID NO: 490412 - RNA, 14 nt, Homo sapiens
uaccuauugcugua

SEQ ID NO: 490413 - RNA, 16 nt, Homo sapiens
uaccucucagccuuag

SEQ ID NO: 490414 - RNA, 18 nt, Homo sapiens
uaccugaaaauucaacau

SEQ ID NO: 490415 - RNA, 14 nt, Homo sapiens
uaccuucuuuccag

SEQ ID NO: 490416 - RNA, 21 nt, Homo sapiens
uaccuuuucucuucauuuucc

SEQ ID NO: 490417 - RNA, 19 nt, Homo sapiens
uacuaacaguaacugccau

SEQ ID NO: 490418 - RNA, 15 nt, Homo sapiens
uacucuugaucuuca

SEQ ID NO: 490419 - RNA, 14 nt, Homo sapiens
uacugauuaacuca

SEQ ID NO: 490420 - RNA, 17 nt, Homo sapiens
uacuguaguucacugua

SEQ ID NO: 490421 - RNA, 19 nt, Homo sapiens
uacuguucaauuucagaaa

SEQ ID NO: 490422 - RNA, 20 nt, Homo sapiens
uacuucuuaaaaugugcuau

SEQ ID NO: 490423 - RNA, 16 nt, Homo sapiens
uacuucuugugcuuua

SEQ ID NO: 490424 - RNA, 23 nt, Homo sapiens
uacuucuugugcuuuacucugaa

SEQ ID NO: 490425 - RNA, 15 nt, Homo sapiens
uacuugcuaucuaua

SEQ ID NO: 490426 - RNA, 23 nt, Homo sapiens
uacuuuauagaagaaugcaugcu

SEQ ID NO: 490427 - RNA, 14 nt, Homo sapiens
uagaaagggucccu

SEQ ID NO: 490428 - RNA, 19 nt, Homo sapiens
uagaaaguguucuguuaca

SEQ ID NO: 490429 - RNA, 18 nt, Homo sapiens
uagaaauuuuaucucuuc

SEQ ID NO: 490430 - RNA, 14 nt, Homo sapiens
uagaacaacauaaa

SEQ ID NO: 490431 - RNA, 13 nt, Homo sapiens
uagaauacuguau

SEQ ID NO: 490432 - RNA, 14 nt, Homo sapiens
uagaauacuguauu

SEQ ID NO: 490433 - RNA, 17 nt, Homo sapiens
uagaaucaagucuguga

SEQ ID NO: 490434 - RNA, 18 nt, Homo sapiens
uagaaucaagucugugaa

SEQ ID NO: 490435 - RNA, 14 nt, Homo sapiens
uagacgucucaggu

SEQ ID NO: 490436 - RNA, 14 nt, Homo sapiens
uagauuaacccuau

SEQ ID NO: 490437 - RNA, 13 nt, Homo sapiens
uagcauauauaau

SEQ ID NO: 490438 - RNA, 21 nt, Homo sapiens
uagcccagucauauguucuca

SEQ ID NO: 490439 - RNA, 21 nt, Homo sapiens
uagccccaacccaaaccugga

SEQ ID NO: 490440 - RNA, 22 nt, Homo sapiens
uagcguucccaacaacauccau

SEQ ID NO: 490441 - RNA, 20 nt, Homo sapiens
uagcucucccaacucuugca

SEQ ID NO: 490442 - RNA, 23 nt, Homo sapiens
uagcucucccaacucuugcacag

SEQ ID NO: 490443 - RNA, 17 nt, Homo sapiens
uagcugaguaugcugaa

SEQ ID NO: 490444 - RNA, 22 nt, Homo sapiens
uagcugucauggugcaauuugu

SEQ ID NO: 490445 - RNA, 23 nt, Homo sapiens
uaggaccauuucucugcaggcca

SEQ ID NO: 490446 - RNA, 17 nt, Homo sapiens
uaggagagaacagggau

SEQ ID NO: 490447 - RNA, 20 nt, Homo sapiens
uagggagaaacaaaaauaca

SEQ ID NO: 490448 - RNA, 18 nt, Homo sapiens
uaggggagagaucuccaa

SEQ ID NO: 490449 - RNA, 20 nt, Homo sapiens
uaggugcuaauuaauaaaga

SEQ ID NO: 490450 - RNA, 19 nt, Homo sapiens
uagguucaggaagaccaca

SEQ ID NO: 490451 - RNA, 22 nt, Homo sapiens
uaguauaugaaaggacagggau

SEQ ID NO: 490452 - RNA, 17 nt, Homo sapiens
uagugcacaagcacuau

SEQ ID NO: 490453 - RNA, 17 nt, Homo sapiens
uauaaggaaagccaaau

SEQ ID NO: 490454 - RNA, 22 nt, Homo sapiens
uauaccauuuccguaauucuua

SEQ ID NO: 490455 - RNA, 16 nt, Homo sapiens
uauacuagauguuaag

SEQ ID NO: 490456 - RNA, 15 nt, Homo sapiens
uauagaagucuucau

SEQ ID NO: 490457 - RNA, 15 nt, Homo sapiens
uauagcguucccaac

SEQ ID NO: 490458 - RNA, 22 nt, Homo sapiens
uauauaaaauacacguguauau

SEQ ID NO: 490459 - RNA, 15 nt, Homo sapiens
uauauauacauaugu

SEQ ID NO: 490460 - RNA, 14 nt, Homo sapiens
uauaucuguauaua

SEQ ID NO: 490461 - RNA, 19 nt, Homo sapiens
uauauuugcagauaauucu

SEQ ID NO: 490462 - RNA, 18 nt, Homo sapiens
uaucagaguauccacugu

SEQ ID NO: 490463 - RNA, 19 nt, Homo sapiens
uaucaggaaauaucuguga

SEQ ID NO: 490464 - RNA, 15 nt, Homo sapiens
uaucauuaaccuuau

SEQ ID NO: 490465 - RNA, 12 nt, Homo sapiens
uauccaucuccu

SEQ ID NO: 490466 - RNA, 19 nt, Homo sapiens
uaucucgcuagccauauau

SEQ ID NO: 490467 - RNA, 15 nt, Homo sapiens
uaucuguacagauca

SEQ ID NO: 490468 - RNA, 16 nt, Homo sapiens
uaugaauagacauaaa

SEQ ID NO: 490469 - RNA, 14 nt, Homo sapiens
uaugaauauuucau

SEQ ID NO: 490470 - RNA, 14 nt, Homo sapiens
uaugaccauaaaau

SEQ ID NO: 490471 - RNA, 13 nt, Homo sapiens
uaugacucaaaga

SEQ ID NO: 490472 - RNA, 15 nt, Homo sapiens
uauggaaauccacaa

SEQ ID NO: 490473 - RNA, 20 nt, Homo sapiens
uauggauugaaggauuguga

SEQ ID NO: 490474 - RNA, 18 nt, Homo sapiens
uauguagacuauauacau

SEQ ID NO: 490475 - RNA, 20 nt, Homo sapiens
uauguuuauuauuugcacag

SEQ ID NO: 490476 - RNA, 16 nt, Homo sapiens
uauguuuucacuguau

SEQ ID NO: 490477 - RNA, 15 nt, Homo sapiens
uauuauaucauuaac

SEQ ID NO: 490478 - RNA, 17 nt, Homo sapiens
uauuauauuuggaugca

SEQ ID NO: 490479 - RNA, 14 nt, Homo sapiens
uauuauguuaugaa

SEQ ID NO: 490480 - RNA, 12 nt, Homo sapiens
uauucaacaacu

SEQ ID NO: 490481 - RNA, 20 nt, Homo sapiens
uauucaggaccccaucugcu

SEQ ID NO: 490482 - RNA, 21 nt, Homo sapiens
uauucccaugguagacuguga

SEQ ID NO: 490483 - RNA, 17 nt, Homo sapiens
uauugaaaaugucacug

SEQ ID NO: 490484 - RNA, 16 nt, Homo sapiens
uauugcuaccaaaaac

SEQ ID NO: 490485 - RNA, 16 nt, Homo sapiens
uauuuaaaacauuuca

SEQ ID NO: 490486 - RNA, 15 nt, Homo sapiens
uauuuaaguauucaa

SEQ ID NO: 490487 - RNA, 15 nt, Homo sapiens
uauuucuacauggaa

SEQ ID NO: 490488 - RNA, 22 nt, Homo sapiens
uauuugcauaauaugcauauau

SEQ ID NO: 490489 - RNA, 13 nt, Homo sapiens
uauuuucauuucu

SEQ ID NO: 490490 - RNA, 20 nt, Homo sapiens
uauuuucuacaaauguuacu

SEQ ID NO: 490491 - RNA, 16 nt, Homo sapiens
uauuuuggacguguga

SEQ ID NO: 490492 - RNA, 22 nt, Homo sapiens
ucaaaauaaaaagugacacagc

SEQ ID NO: 490493 - RNA, 13 nt, Homo sapiens
ucaaaauguggac

SEQ ID NO: 490494 - RNA, 21 nt, Homo sapiens
ucaaaccaauuucuuccuucc

SEQ ID NO: 490495 - RNA, 23 nt, Homo sapiens
ucaaagacuucauuuaacacuga

SEQ ID NO: 490496 - RNA, 16 nt, Homo sapiens
ucaaaggagcuuucuc

SEQ ID NO: 490497 - RNA, 15 nt, Homo sapiens
ucaacuuacauaugu

SEQ ID NO: 490498 - RNA, 17 nt, Homo sapiens
ucaagaaaaaaagggag

SEQ ID NO: 490499 - RNA, 17 nt, Homo sapiens
ucaagaaaaauucacag

SEQ ID NO: 490500 - RNA, 21 nt, Homo sapiens
ucaagaaaaauucacaguuga

SEQ ID NO: 490501 - RNA, 14 nt, Homo sapiens
ucaaguuaauucuc

SEQ ID NO: 490502 - RNA, 16 nt, Homo sapiens
ucaaguugcacacuca

SEQ ID NO: 490503 - RNA, 19 nt, Homo sapiens
ucaaguuuucucagaugau

SEQ ID NO: 490504 - RNA, 19 nt, Homo sapiens
ucaauaaagaaagauggaa

SEQ ID NO: 490505 - RNA, 22 nt, Homo sapiens
ucaauaaagaaagauggaagga

SEQ ID NO: 490506 - RNA, 16 nt, Homo sapiens
ucaauauuucuaguag

SEQ ID NO: 490507 - RNA, 19 nt, Homo sapiens
ucaauauuucuaguagcac

SEQ ID NO: 490508 - RNA, 20 nt, Homo sapiens
ucaaucuuuagaaaaggcau

SEQ ID NO: 490509 - RNA, 21 nt, Homo sapiens
ucaaugauuauuuucauuaca

SEQ ID NO: 490510 - RNA, 13 nt, Homo sapiens
ucaaugucuuccc

SEQ ID NO: 490511 - RNA, 22 nt, Homo sapiens
ucaauucccacguagacucuua

SEQ ID NO: 490512 - RNA, 19 nt, Homo sapiens
uuauauaugaaaacuaagu

SEQ ID NO: 490513 - RNA, 22 nt, Homo sapiens
uuauauucccaaaucucaaaag

SEQ ID NO: 490514 - RNA, 20 nt, Homo sapiens
uuauccuccaccgucuuucu

SEQ ID NO: 490515 - RNA, 15 nt, Homo sapiens
uuaugaagcagauuu

SEQ ID NO: 490516 - RNA, 15 nt, Homo sapiens
uuauuaaaguuucaa

SEQ ID NO: 490517 - RNA, 15 nt, Homo sapiens
uuauuaauuacuuac

SEQ ID NO: 490518 - RNA, 18 nt, Homo sapiens
uuauuaccccacacaucc

SEQ ID NO: 490519 - RNA, 18 nt, Homo sapiens
uuauucaacaacuacuac

SEQ ID NO: 490520 - RNA, 23 nt, Homo sapiens
uuauucaauaacuauugcugcuu

SEQ ID NO: 490521 - RNA, 17 nt, Homo sapiens
uuauucauuagcuguga

SEQ ID NO: 490522 - RNA, 15 nt, Homo sapiens
uuauuuccauggauu

SEQ ID NO: 490523 - RNA, 13 nt, Homo sapiens
uucaaaaacaccc

SEQ ID NO: 490524 - RNA, 17 nt, Homo sapiens
uucaaacgaaauggcuc

SEQ ID NO: 490525 - RNA, 19 nt, Homo sapiens
uucaaagagaugggccuuu

SEQ ID NO: 490526 - RNA, 19 nt, Homo sapiens
uucaacaugguuaccucug

SEQ ID NO: 490527 - RNA, 21 nt, Homo sapiens
uucaaucacugaaaaugugcu

SEQ ID NO: 490528 - RNA, 18 nt, Homo sapiens
uucacagugucuguaaau

SEQ ID NO: 490529 - RNA, 14 nt, Homo sapiens
uucaccagagcauu

SEQ ID NO: 490530 - RNA, 18 nt, Homo sapiens
uucaccaguacauucuca

SEQ ID NO: 490531 - RNA, 18 nt, Homo sapiens
uucacuaccaagcagcuc

SEQ ID NO: 490532 - RNA, 17 nt, Homo sapiens
uucacucccugucauag

SEQ ID NO: 490533 - RNA, 21 nt, Homo sapiens
uucacuguauucaauaacuga

SEQ ID NO: 490534 - RNA, 15 nt, Homo sapiens
uucagaaaagcaccu

SEQ ID NO: 490535 - RNA, 21 nt, Homo sapiens
uucagagaaaacuucagagaa

SEQ ID NO: 490536 - RNA, 12 nt, Homo sapiens
uucagaugaggu

SEQ ID NO: 490537 - RNA, 13 nt, Homo sapiens
uucagggggccag

SEQ ID NO: 490538 - RNA, 13 nt, Homo sapiens
uucaguaugcaaa

SEQ ID NO: 490539 - RNA, 18 nt, Homo sapiens
uucauaccuucugaugaa

SEQ ID NO: 490540 - RNA, 14 nt, Homo sapiens
uucauauucucaga

SEQ ID NO: 490541 - RNA, 17 nt, Homo sapiens
uucauauuuuaauuuca

SEQ ID NO: 490542 - RNA, 22 nt, Homo sapiens
uucauccaacgugaagauacca

SEQ ID NO: 490543 - RNA, 23 nt, Homo sapiens
uucaucucauuuuuaagaacaag

SEQ ID NO: 490544 - RNA, 15 nt, Homo sapiens
uuccaacaccacaga

SEQ ID NO: 490545 - RNA, 13 nt, Homo sapiens
uuccagugcugcu

SEQ ID NO: 490546 - RNA, 18 nt, Homo sapiens
uuccaugucugaaguuug

SEQ ID NO: 490547 - RNA, 18 nt, Homo sapiens
uucccauaucaaaagaca

SEQ ID NO: 490548 - RNA, 22 nt, Homo sapiens
uucccauuuccuugucuaaaga

SEQ ID NO: 490549 - RNA, 11 nt, Homo sapiens
uuccccggagc

SEQ ID NO: 490550 - RNA, 15 nt, Homo sapiens
uucccuucaaugcaa

SEQ ID NO: 490551 - RNA, 13 nt, Homo sapiens
uuccuaaggcaug

SEQ ID NO: 490552 - RNA, 11 nt, Homo sapiens
uuccuaucuca

SEQ ID NO: 490553 - RNA, 22 nt, Homo sapiens
uuccuccccaggacuuggucuu

SEQ ID NO: 490554 - RNA, 18 nt, Homo sapiens
uuccugcuccuccaguac

SEQ ID NO: 490555 - RNA, 23 nt, Homo sapiens
uucgaagaauuggcagaagcagu

SEQ ID NO: 490556 - RNA, 21 nt, Homo sapiens
uucgccccauuuucuuuacag

SEQ ID NO: 490557 - RNA, 17 nt, Homo sapiens
uucggaccgaaggugac

SEQ ID NO: 490558 - RNA, 14 nt, Homo sapiens
uucuaacauaagua

SEQ ID NO: 490559 - RNA, 15 nt, Homo sapiens
uucuaauccaugugc

SEQ ID NO: 490560 - RNA, 21 nt, Homo sapiens
uucuauuagcuuacugauuaa

SEQ ID NO: 490561 - RNA, 20 nt, Homo sapiens
uucucagcgcaacagcugug

SEQ ID NO: 490562 - RNA, 12 nt, Homo sapiens
uucucuagacau

SEQ ID NO: 490563 - RNA, 16 nt, Homo sapiens
uucugacagcauuuca

SEQ ID NO: 490564 - RNA, 16 nt, Homo sapiens
uucuguuaucuagaaa

SEQ ID NO: 490565 - RNA, 17 nt, Homo sapiens
uucuuaaaaugugcuau

SEQ ID NO: 490566 - RNA, 19 nt, Homo sapiens
uucuuaauauaacugccuu

SEQ ID NO: 490567 - RNA, 16 nt, Homo sapiens
uucuuccaagacucca

SEQ ID NO: 490568 - RNA, 16 nt, Homo sapiens
uucuucccuuaggcaa

SEQ ID NO: 490569 - RNA, 17 nt, Homo sapiens
uucuuugcauucguccu

SEQ ID NO: 490570 - RNA, 19 nt, Homo sapiens
uucuuuuauacugacacaa

SEQ ID NO: 490571 - RNA, 16 nt, Homo sapiens
uugaaacuguauuuac

SEQ ID NO: 490572 - RNA, 19 nt, Homo sapiens
uugaaauuauaucuguggu

SEQ ID NO: 490573 - RNA, 23 nt, Homo sapiens
uugaagcuaaaauaaaccagacu

SEQ ID NO: 490574 - RNA, 21 nt, Homo sapiens
uugacguauauauaaacagaa

SEQ ID NO: 490575 - RNA, 19 nt, Homo sapiens
uugacguuucuucuuucua

SEQ ID NO: 490576 - RNA, 20 nt, Homo sapiens
uugacguuucuucuuucuag

SEQ ID NO: 490577 - RNA, 16 nt, Homo sapiens
uugacuuuuuggcuca

SEQ ID NO: 490578 - RNA, 21 nt, Homo sapiens
uugaguuugcaucaaucuuaa

SEQ ID NO: 490579 - RNA, 17 nt, Homo sapiens
uugaugcuguuucuaca

SEQ ID NO: 490580 - RNA, 18 nt, Homo sapiens
uugaugcuguuucuacau

SEQ ID NO: 490581 - RNA, 14 nt, Homo sapiens
uugauuaaaacauu

SEQ ID NO: 490582 - RNA, 14 nt, Homo sapiens
uugcaguacagaga

SEQ ID NO: 490583 - RNA, 22 nt, Homo sapiens
uugcgugaaaguguuacauauu

SEQ ID NO: 490584 - RNA, 21 nt, Homo sapiens
uugcucagagugaagagugaa

SEQ ID NO: 490585 - RNA, 22 nt, Homo sapiens
uugcuuagccuuuaauaggcuu

SEQ ID NO: 490586 - RNA, 22 nt, Homo sapiens
uuggaacugcaccaccgaccaa

SEQ ID NO: 490587 - RNA, 18 nt, Homo sapiens
uugggaaaugcugauuua

SEQ ID NO: 490588 - RNA, 21 nt, Homo sapiens
uuggguaagggacuccagaag

SEQ ID NO: 490589 - RNA, 20 nt, Homo sapiens
uugguacacacuugaccuuc

SEQ ID NO: 490590 - RNA, 17 nt, Homo sapiens
uuggucacaaagcuauu

SEQ ID NO: 490591 - RNA, 22 nt, Homo sapiens
uuggugaccuagggaucagaga

SEQ ID NO: 490592 - RNA, 18 nt, Homo sapiens
uugguuaccuauugcugu

SEQ ID NO: 490593 - RNA, 13 nt, Homo sapiens
uugucacugcugu

SEQ ID NO: 490594 - RNA, 20 nt, Homo sapiens
uugugaccuucucuauauca

SEQ ID NO: 490595 - RNA, 15 nt, Homo sapiens
uugugagcuucagau

SEQ ID NO: 490596 - RNA, 15 nt, Homo sapiens
uuguuguuucuugcc

SEQ ID NO: 490597 - RNA, 20 nt, Homo sapiens
uuguuucuuacgcuugcuau

SEQ ID NO: 490598 - RNA, 21 nt, Homo sapiens
uuguuucuuccaagacuccag

SEQ ID NO: 490599 - RNA, 15 nt, Homo sapiens
uuuaaaacauuucau

SEQ ID NO: 490600 - RNA, 12 nt, Homo sapiens
uuuaaacccaau

SEQ ID NO: 490601 - RNA, 15 nt, Homo sapiens
uuuaaagaagaguaa

SEQ ID NO: 490602 - RNA, 15 nt, Homo sapiens
uuuaacugauuacug

SEQ ID NO: 490603 - RNA, 14 nt, Homo sapiens
uuuaagguaacaaa

SEQ ID NO: 490604 - RNA, 17 nt, Homo sapiens
uuuaauauacuccuuaa

SEQ ID NO: 490605 - RNA, 13 nt, Homo sapiens
uuuaaugauuugc

SEQ ID NO: 490606 - RNA, 15 nt, Homo sapiens
uuuaauuacaaugga

SEQ ID NO: 490607 - RNA, 12 nt, Homo sapiens
uuuacauuacug

SEQ ID NO: 490608 - RNA, 20 nt, Homo sapiens
uuuaccuuuggaauugugcu

SEQ ID NO: 490609 - RNA, 20 nt, Homo sapiens
uuuagaaucaagucugugaa

SEQ ID NO: 490610 - RNA, 19 nt, Homo sapiens
uuuagguaaaaagcuuaaa

SEQ ID NO: 490611 - RNA, 14 nt, Homo sapiens
uuuaguaguuuaau

SEQ ID NO: 490612 - RNA, 20 nt, Homo sapiens
uuuaguuuaaaaaucagaaa

SEQ ID NO: 490613 - RNA, 19 nt, Homo sapiens
uuuauaacauuuugagaaa

SEQ ID NO: 490614 - RNA, 17 nt, Homo sapiens
uuuauaagcacagacaa

SEQ ID NO: 490615 - RNA, 12 nt, Homo sapiens
uuuauuacaacu

SEQ ID NO: 490616 - RNA, 14 nt, Homo sapiens
uuuauucaacaacu

SEQ ID NO: 490617 - RNA, 23 nt, Homo sapiens
uuuauuuaaggggaauuaacaau

SEQ ID NO: 490618 - RNA, 23 nt, Homo sapiens
uuucaaguggaaaccuugcugcu

SEQ ID NO: 490619 - RNA, 20 nt, Homo sapiens
uuucagagaaauacuuucag

SEQ ID NO: 490620 - RNA, 22 nt, Homo sapiens
uuucaggauuauuuuaauuaau

SEQ ID NO: 490621 - RNA, 19 nt, Homo sapiens
uuucauccugauacuguag

SEQ ID NO: 490622 - RNA, 18 nt, Homo sapiens
uuucauuucuaacauaag

SEQ ID NO: 490623 - RNA, 10 nt, Homo sapiens
uuuccaccuu

SEQ ID NO: 490624 - RNA, 21 nt, Homo sapiens
uuucuacuuuaaauuguggau

SEQ ID NO: 490625 - RNA, 18 nt, Homo sapiens
uuucucagaugauggaua

SEQ ID NO: 490626 - RNA, 13 nt, Homo sapiens
uuucucagcauau

SEQ ID NO: 490627 - RNA, 21 nt, Homo sapiens
uuucugaacaaagagagcuca

SEQ ID NO: 490628 - RNA, 20 nt, Homo sapiens
uuucuuccaguuagagucuu

SEQ ID NO: 490629 - RNA, 16 nt, Homo sapiens
uuugagagugaccucu

SEQ ID NO: 490630 - RNA, 18 nt, Homo sapiens
uuugcaaauaacuuacaa

SEQ ID NO: 490631 - RNA, 22 nt, Homo sapiens
uuugcauuaugacuccuguaaa

SEQ ID NO: 490632 - RNA, 21 nt, Homo sapiens
uuugccaacagaaacaugcca

SEQ ID NO: 490633 - RNA, 21 nt, Homo sapiens
uuugcuauggggacauuccaa

SEQ ID NO: 490634 - RNA, 17 nt, Homo sapiens
uuugcucucucauuccc

SEQ ID NO: 490635 - RNA, 14 nt, Homo sapiens
uuugcugguuucau

SEQ ID NO: 490636 - RNA, 18 nt, Homo sapiens
uuugguacacacuugacc

SEQ ID NO: 490637 - RNA, 15 nt, Homo sapiens
uuuguaaacuuugaa

SEQ ID NO: 490638 - RNA, 17 nt, Homo sapiens
uuuguaccuguaggucu

SEQ ID NO: 490639 - RNA, 21 nt, Homo sapiens
uuuguaugcaagcaguuucaa

SEQ ID NO: 490640 - RNA, 17 nt, Homo sapiens
uuuguauuuuuccucuu

SEQ ID NO: 490641 - RNA, 18 nt, Homo sapiens
uuugugaaagugccaaaa

SEQ ID NO: 490642 - RNA, 17 nt, Homo sapiens
uuuguugagacuaucaa

SEQ ID NO: 490643 - RNA, 10 nt, Homo sapiens
uuuguugcac

SEQ ID NO: 490644 - RNA, 19 nt, Homo sapiens
uuuuaauugaaagggacaa

SEQ ID NO: 490645 - RNA, 12 nt, Homo sapiens
uuuucacuguau

SEQ ID NO: 490646 - RNA, 16 nt, Homo sapiens
uuuuccuucuacuuac

SEQ ID NO: 490647 - RNA, 14 nt, Homo sapiens
uuuugguggugaua

SEQ ID NO: 490648 - RNA, 13 nt, Homo sapiens
uuuuguugcacug

SEQ ID NO: 490649 - RNA, 14 nt, Homo sapiens
aaaauagcuauaaa

SEQ ID NO: 490650 - RNA, 23 nt, Homo sapiens
aaaauaguucccuuugccaacag

SEQ ID NO: 490651 - RNA, 17 nt, Homo sapiens
aaaauauguccauaucu

SEQ ID NO: 490652 - RNA, 22 nt, Homo sapiens
aaaauauuugugaaagugccaa

SEQ ID NO: 490653 - RNA, 18 nt, Homo sapiens
aaaaucccaagucauuuc

SEQ ID NO: 490654 - RNA, 14 nt, Homo sapiens
aaaaugcagccuua

SEQ ID NO: 490655 - RNA, 20 nt, Homo sapiens
aaaauguauauagcugugag

SEQ ID NO: 490656 - RNA, 21 nt, Homo sapiens
aaaauguucugacagcauuuc

SEQ ID NO: 490657 - RNA, 15 nt, Homo sapiens
aaaauuacagacaaa

SEQ ID NO: 490658 - RNA, 16 nt, Homo sapiens
aaaauuucuggcaaau

SEQ ID NO: 490659 - RNA, 18 nt, Homo sapiens
aaacaaggggcuguuaca

SEQ ID NO: 490660 - RNA, 15 nt, Homo sapiens
aaggagcuuucucaa

SEQ ID NO: 490661 - RNA, 11 nt, Homo sapiens
aaggcaaugau

SEQ ID NO: 490662 - RNA, 18 nt, Homo sapiens
aaggcauguggccuuuau

SEQ ID NO: 490663 - RNA, 23 nt, Homo sapiens
aaggcauguggccuuuaucucaa

SEQ ID NO: 490664 - RNA, 18 nt, Homo sapiens
aaggcauuuauugccaua

SEQ ID NO: 490665 - RNA, 22 nt, Homo sapiens
aaggcccagccuguaacugucc

SEQ ID NO: 490666 - RNA, 19 nt, Homo sapiens
aaggcuucucauccacugu

SEQ ID NO: 490667 - RNA, 21 nt, Homo sapiens
aagggagaagggugguaaaua

SEQ ID NO: 490668 - RNA, 21 nt, Homo sapiens
aaggucuaccugaaaauucaa

SEQ ID NO: 490669 - RNA, 16 nt, Homo sapiens
aaggucuaugcucaua

SEQ ID NO: 490670 - RNA, 16 nt, Homo sapiens
aagguuucacuguuca

SEQ ID NO: 490671 - RNA, 15 nt, Homo sapiens
aaguaaguaguuucc

SEQ ID NO: 490672 - RNA, 17 nt, Homo sapiens
aaguacagguacuuugu

SEQ ID NO: 490673 - RNA, 14 nt, Homo sapiens
aaguaccacacuga

SEQ ID NO: 490674 - RNA, 23 nt, Homo sapiens
aaguagacuucauuuuuccuaac

SEQ ID NO: 490675 - RNA, 12 nt, Homo sapiens
aaguagugugaa

SEQ ID NO: 490676 - RNA, 20 nt, Homo sapiens
aagucacauaaaaugcggca

SEQ ID NO: 490677 - RNA, 14 nt, Homo sapiens
aaguccagcucucc

SEQ ID NO: 490678 - RNA, 17 nt, Homo sapiens
aagucugucaugccaaa

SEQ ID NO: 490679 - RNA, 14 nt, Homo sapiens
aagugaaggagcug

SEQ ID NO: 490680 - RNA, 16 nt, Homo sapiens
aagugcuugaggccaa

SEQ ID NO: 490681 - RNA, 14 nt, Homo sapiens
aaguugcacacuca

SEQ ID NO: 490682 - RNA, 19 nt, Homo sapiens
aaguugucuuacacuucuc

SEQ ID NO: 490683 - RNA, 13 nt, Homo sapiens
aauaaaaccagaa

SEQ ID NO: 490684 - RNA, 14 nt, Homo sapiens
aauaaacucaguca

SEQ ID NO: 490685 - RNA, 22 nt, Homo sapiens
aauaaagccuugugaucacuuu

SEQ ID NO: 490686 - RNA, 13 nt, Homo sapiens
aauaauaccuuau

SEQ ID NO: 490687 - RNA, 19 nt, Homo sapiens
aauaauguccuuucauuug

SEQ ID NO: 490688 - RNA, 20 nt, Homo sapiens
aauaauuagguuaacauugu

SEQ ID NO: 490689 - RNA, 15 nt, Homo sapiens
aauacaacacauuga

SEQ ID NO: 490690 - RNA, 13 nt, Homo sapiens
aauacacuuuauu

SEQ ID NO: 490691 - RNA, 16 nt, Homo sapiens
aauacaugccuuucca

SEQ ID NO: 490692 - RNA, 18 nt, Homo sapiens
aauacauuaagccucuug

SEQ ID NO: 490693 - RNA, 22 nt, Homo sapiens
aauacauuguuguaagagugau

SEQ ID NO: 490694 - RNA, 18 nt, Homo sapiens
aauaccugaccucacaga

SEQ ID NO: 490695 - RNA, 19 nt, Homo sapiens
aauacuucuuaaaaugugc

SEQ ID NO: 490696 - RNA, 11 nt, Homo sapiens
aauacuuucag

SEQ ID NO: 490697 - RNA, 14 nt, Homo sapiens
aauauaaccauaaa

SEQ ID NO: 490698 - RNA, 14 nt, Homo sapiens
aauauaucuugucu

SEQ ID NO: 490699 - RNA, 12 nt, Homo sapiens
aauauauggucu

SEQ ID NO: 490700 - RNA, 14 nt, Homo sapiens
aauauucagagaaa

SEQ ID NO: 490701 - RNA, 16 nt, Homo sapiens
aauauucuguaacuau

SEQ ID NO: 490702 - RNA, 22 nt, Homo sapiens
aauauuugugaaagugccaaaa

SEQ ID NO: 490703 - RNA, 17 nt, Homo sapiens
aauauuuugcugcugaa

SEQ ID NO: 490704 - RNA, 15 nt, Homo sapiens
aaucaaagcugagga

SEQ ID NO: 490705 - RNA, 16 nt, Homo sapiens
aaucaagaccaaagag

SEQ ID NO: 490706 - RNA, 23 nt, Homo sapiens
aaucaagucugugaaagucuccu

SEQ ID NO: 490707 - RNA, 16 nt, Homo sapiens
aaucaauucauugugu

SEQ ID NO: 490708 - RNA, 19 nt, Homo sapiens
aaucagaccaaggaacaag

SEQ ID NO: 490709 - RNA, 16 nt, Homo sapiens
aaucauccucaugccu

SEQ ID NO: 490710 - RNA, 21 nt, Homo sapiens
aaucaugugaaauuuaggcag

SEQ ID NO: 490711 - RNA, 17 nt, Homo sapiens
aauccaggacagcauua

SEQ ID NO: 490712 - RNA, 15 nt, Homo sapiens
aauccaugugcugcu

SEQ ID NO: 490713 - RNA, 20 nt, Homo sapiens
aauccuguccucagcuucuu

SEQ ID NO: 490714 - RNA, 12 nt, Homo sapiens
aauccuuacaaa

SEQ ID NO: 490715 - RNA, 22 nt, Homo sapiens
aaucuagguucaggaagaccac

SEQ ID NO: 490716 - RNA, 14 nt, Homo sapiens
aaucucagcacuuu

SEQ ID NO: 490717 - RNA, 21 nt, Homo sapiens
aaucuucucaucuuuuaucua

SEQ ID NO: 490718 - RNA, 15 nt, Homo sapiens
aaucuugaacuuuau

SEQ ID NO: 490719 - RNA, 19 nt, Homo sapiens
aaugaauuuuuuccuacca

SEQ ID NO: 490720 - RNA, 19 nt, Homo sapiens
aaugagaguuccuucucac

SEQ ID NO: 490721 - RNA, 11 nt, Homo sapiens
aaugagccauu

SEQ ID NO: 490722 - RNA, 22 nt, Homo sapiens
aaugagcuccugcucauugugg

SEQ ID NO: 490723 - RNA, 19 nt, Homo sapiens
aaugauacuugguccuuaa

SEQ ID NO: 490724 - RNA, 17 nt, Homo sapiens
aaugauaugucuuuaaa

SEQ ID NO: 490725 - RNA, 14 nt, Homo sapiens
aaugcagccuuaaa

SEQ ID NO: 490726 - RNA, 14 nt, Homo sapiens
aaugcagcuuucaa

SEQ ID NO: 490727 - RNA, 18 nt, Homo sapiens
aaugcaucacauauucau

SEQ ID NO: 490728 - RNA, 15 nt, Homo sapiens
aaugccaaauugcag

SEQ ID NO: 490729 - RNA, 14 nt, Homo sapiens
aaugcuaugucauu

SEQ ID NO: 490730 - RNA, 12 nt, Homo sapiens
aaugcuuuccau

SEQ ID NO: 490731 - RNA, 22 nt, Homo sapiens
aaugcuuuuccaacccaugagu

SEQ ID NO: 490732 - RNA, 16 nt, Homo sapiens
aauggcccuguagcuc

SEQ ID NO: 490733 - RNA, 16 nt, Homo sapiens
aauguaaacugugcca

SEQ ID NO: 490734 - RNA, 17 nt, Homo sapiens
aauguaucaacauauuu

SEQ ID NO: 490735 - RNA, 15 nt, Homo sapiens
aaugucacuguuaua

SEQ ID NO: 490736 - RNA, 23 nt, Homo sapiens
aaugugauucaccucuucuuucc

SEQ ID NO: 490737 - RNA, 21 nt, Homo sapiens
aaugugcuauuugcaaacuua

SEQ ID NO: 490738 - RNA, 18 nt, Homo sapiens
aaugugcucuacaucucg

SEQ ID NO: 490739 - RNA, 19 nt, Homo sapiens
aauguucaucaauucccau

SEQ ID NO: 490740 - RNA, 21 nt, Homo sapiens
aauguuccaugucugaaguuu

SEQ ID NO: 490741 - RNA, 13 nt, Homo sapiens
aauuacagacaaa

SEQ ID NO: 490742 - RNA, 13 nt, Homo sapiens
aauuacuaacuuc

SEQ ID NO: 490743 - RNA, 21 nt, Homo sapiens
aauuacuggcaaaaacaaaac

SEQ ID NO: 490744 - RNA, 17 nt, Homo sapiens
aauuagacauaccucuc

SEQ ID NO: 490745 - RNA, 22 nt, Homo sapiens
aauuaggauaacuucacugaga

SEQ ID NO: 490746 - RNA, 14 nt, Homo sapiens
aauuccuaucucau

SEQ ID NO: 490747 - RNA, 17 nt, Homo sapiens
aauugauguugaugcaa

SEQ ID NO: 490748 - RNA, 15 nt, Homo sapiens
aauuuauugcacaaa

SEQ ID NO: 490749 - RNA, 22 nt, Homo sapiens
aauuucuccaguggauucccag

SEQ ID NO: 490750 - RNA, 15 nt, Homo sapiens
aauuugcacuuucag

SEQ ID NO: 490751 - RNA, 13 nt, Homo sapiens
aauuuuaucucuu

SEQ ID NO: 490752 - RNA, 15 nt, Homo sapiens
aauuuucauuuuaca

SEQ ID NO: 490753 - RNA, 16 nt, Homo sapiens
aauuuuuaagugucag

SEQ ID NO: 490754 - RNA, 15 nt, Homo sapiens
acaaaaacuaaaaac

SEQ ID NO: 490755 - RNA, 16 nt, Homo sapiens
acaaaaagauaccuua

SEQ ID NO: 490756 - RNA, 20 nt, Homo sapiens
acaaaagcccgccuaacuca

SEQ ID NO: 490757 - RNA, 18 nt, Homo sapiens
acaaaauauccaagccca

SEQ ID NO: 490758 - RNA, 14 nt, Homo sapiens
acaaacugucuaaa

SEQ ID NO: 490759 - RNA, 16 nt, Homo sapiens
acaaagagagcucauc

SEQ ID NO: 490760 - RNA, 12 nt, Homo sapiens
acaaauacacau

SEQ ID NO: 490761 - RNA, 19 nt, Homo sapiens
acaaauggcuuguucaguc

SEQ ID NO: 490762 - RNA, 16 nt, Homo sapiens
acaaauguuacuucua

SEQ ID NO: 490763 - RNA, 18 nt, Homo sapiens
acaaauguuacuucuaaa

SEQ ID NO: 490764 - RNA, 23 nt, Homo sapiens
acaaccuccuccuccaguucuga

SEQ ID NO: 490765 - RNA, 15 nt, Homo sapiens
acaacugauaauauu

SEQ ID NO: 490766 - RNA, 23 nt, Homo sapiens
acaagacuguaaauuccaaagau

SEQ ID NO: 490767 - RNA, 23 nt, Homo sapiens
acaagccucagcaaacccaaaga

SEQ ID NO: 490768 - RNA, 13 nt, Homo sapiens
acaaggugacaaa

SEQ ID NO: 490769 - RNA, 21 nt, Homo sapiens
acaaguagguuuacauuacug

SEQ ID NO: 490770 - RNA, 21 nt, Homo sapiens
acaauaaaagaaacugugguc

SEQ ID NO: 490771 - RNA, 18 nt, Homo sapiens
acaauaggcuuagugcuu

SEQ ID NO: 490772 - RNA, 14 nt, Homo sapiens
acacacacaucuca

SEQ ID NO: 490773 - RNA, 13 nt, Homo sapiens
acacaccugguga

SEQ ID NO: 490774 - RNA, 22 nt, Homo sapiens
acacacuuccucguuuuguaau

SEQ ID NO: 490775 - RNA, 21 nt, Homo sapiens
acacagcugcagagacagaga

SEQ ID NO: 490776 - RNA, 20 nt, Homo sapiens
acacaggauggucucugcca

SEQ ID NO: 490777 - RNA, 16 nt, Homo sapiens
acacauauauguauac

SEQ ID NO: 490778 - RNA, 13 nt, Homo sapiens
acacaucuuccac

SEQ ID NO: 490779 - RNA, 14 nt, Homo sapiens
acauauucuuucac

SEQ ID NO: 490780 - RNA, 16 nt, Homo sapiens
acauccaagcuuccuu

SEQ ID NO: 490781 - RNA, 23 nt, Homo sapiens
acauccuguuuugcaaauuggac

SEQ ID NO: 490782 - RNA, 22 nt, Homo sapiens
acaucucauccaucaaguugca

SEQ ID NO: 490783 - RNA, 14 nt, Homo sapiens
acaucucuucaugc

SEQ ID NO: 490784 - RNA, 16 nt, Homo sapiens
acaucuuguaacuuaa

SEQ ID NO: 490785 - RNA, 20 nt, Homo sapiens
acaugacccguacacaccac

SEQ ID NO: 490786 - RNA, 21 nt, Homo sapiens
acaugcuacaaaaaaguagca

SEQ ID NO: 490787 - RNA, 19 nt, Homo sapiens
acaugggggaacaaugagc

SEQ ID NO: 490788 - RNA, 13 nt, Homo sapiens
acaugugugacug

SEQ ID NO: 490789 - RNA, 20 nt, Homo sapiens
acauguguguauauaugugu

SEQ ID NO: 490790 - RNA, 22 nt, Homo sapiens
acauguguguauauauguguau

SEQ ID NO: 490791 - RNA, 21 nt, Homo sapiens
acauguuaaacguuacuuuca

SEQ ID NO: 490792 - RNA, 19 nt, Homo sapiens
acauuaagccucuugucua

SEQ ID NO: 490793 - RNA, 16 nt, Homo sapiens
acauuacugauuucca

SEQ ID NO: 490794 - RNA, 23 nt, Homo sapiens
acauuauagauuuucauguucuu

SEQ ID NO: 490795 - RNA, 15 nt, Homo sapiens
acauuaugugugcau

SEQ ID NO: 490796 - RNA, 19 nt, Homo sapiens
acauuaugugugcaugugu

SEQ ID NO: 490797 - RNA, 18 nt, Homo sapiens
accaaagcugcugcacag

SEQ ID NO: 490798 - RNA, 15 nt, Homo sapiens
accaaguacaaggac

SEQ ID NO: 490799 - RNA, 20 nt, Homo sapiens
accaaguuggucuuacuuug

SEQ ID NO: 490800 - RNA, 18 nt, Homo sapiens
accaauuucuuccuucca

SEQ ID NO: 490801 - RNA, 14 nt, Homo sapiens
accacagacacucc

SEQ ID NO: 490802 - RNA, 15 nt, Homo sapiens
accacuccauuccca

SEQ ID NO: 490803 - RNA, 21 nt, Homo sapiens
accacuuucccacacugugaa

SEQ ID NO: 490804 - RNA, 14 nt, Homo sapiens
accagagcauuucc

SEQ ID NO: 490805 - RNA, 16 nt, Homo sapiens
accagagcgauguguu

SEQ ID NO: 490806 - RNA, 21 nt, Homo sapiens
accauccaccuucccuucuac

SEQ ID NO: 490807 - RNA, 14 nt, Homo sapiens
accauuucucugca

SEQ ID NO: 490808 - RNA, 16 nt, Homo sapiens
acccaugaaacagcag

SEQ ID NO: 490809 - RNA, 17 nt, Homo sapiens
acccaugaaacagcagc

SEQ ID NO: 490810 - RNA, 18 nt, Homo sapiens
accccuccccuaaugccu

SEQ ID NO: 490811 - RNA, 15 nt, Homo sapiens
acccgcauguacaaa

SEQ ID NO: 490812 - RNA, 18 nt, Homo sapiens
acccguacaggcaauucc

SEQ ID NO: 490813 - RNA, 17 nt, Homo sapiens
acccuacagcagaucca

SEQ ID NO: 490814 - RNA, 16 nt, Homo sapiens
acccuagggauuugca

SEQ ID NO: 490815 - RNA, 17 nt, Homo sapiens
acccugaggguuuccac

SEQ ID NO: 490816 - RNA, 21 nt, Homo sapiens
acccugcucauccacucuacu

SEQ ID NO: 490817 - RNA, 15 nt, Homo sapiens
acccuggacagugcc

SEQ ID NO: 490818 - RNA, 14 nt, Homo sapiens
acccuucuuuccau

SEQ ID NO: 490819 - RNA, 17 nt, Homo sapiens
acccuucuuuugaagga

SEQ ID NO: 490820 - RNA, 11 nt, Homo sapiens
accgucuuucu

SEQ ID NO: 490821 - RNA, 12 nt, Homo sapiens
accuauugcugu

SEQ ID NO: 490822 - RNA, 13 nt, Homo sapiens
accuauugcugua

SEQ ID NO: 490823 - RNA, 20 nt, Homo sapiens
accucaagaaaaauucacag

SEQ ID NO: 490824 - RNA, 15 nt, Homo sapiens
accucacagaguaug

SEQ ID NO: 490825 - RNA, 18 nt, Homo sapiens
accucaccccauugauug

SEQ ID NO: 490826 - RNA, 21 nt, Homo sapiens
accuccuccuccaguucugau

SEQ ID NO: 490827 - RNA, 14 nt, Homo sapiens
accuccucuguucu

SEQ ID NO: 490828 - RNA, 16 nt, Homo sapiens
accucucaacuuacau

SEQ ID NO: 490829 - RNA, 18 nt, Homo sapiens
accucuugaagaacugac

SEQ ID NO: 490830 - RNA, 11 nt, Homo sapiens
accucuuguuu

SEQ ID NO: 490831 - RNA, 12 nt, Homo sapiens
accugaacaaac

SEQ ID NO: 490832 - RNA, 14 nt, Homo sapiens
accugaccucacag

SEQ ID NO: 490833 - RNA, 17 nt, Homo sapiens
accuguacacacacaga

SEQ ID NO: 490834 - RNA, 18 nt, Homo sapiens
accuguacacacacagac

SEQ ID NO: 490835 - RNA, 22 nt, Homo sapiens
accuguacacacacagacacac

SEQ ID NO: 490836 - RNA, 22 nt, Homo sapiens
accuguucacgugacuccucaa

SEQ ID NO: 490837 - RNA, 21 nt, Homo sapiens
accuguugucugaaacauaga

SEQ ID NO: 490838 - RNA, 13 nt, Homo sapiens
accuucuaaucca

SEQ ID NO: 490839 - RNA, 23 nt, Homo sapiens
accuucuaauccaugugcugcug

SEQ ID NO: 490840 - RNA, 14 nt, Homo sapiens
accuucugaugaag

SEQ ID NO: 490841 - RNA, 20 nt, Homo sapiens
accuucugaugaaguuguac

SEQ ID NO: 490842 - RNA, 16 nt, Homo sapiens
accuuuucaccuccaa

SEQ ID NO: 490843 - RNA, 22 nt, Homo sapiens
accuuuucaccuccaacuggau

SEQ ID NO: 490844 - RNA, 17 nt, Homo sapiens
acgauagccuagcuuuc

SEQ ID NO: 490845 - RNA, 17 nt, Homo sapiens
acgauaugcaaguucau

SEQ ID NO: 490846 - RNA, 11 nt, Homo sapiens
acgcacuguau

SEQ ID NO: 490847 - RNA, 20 nt, Homo sapiens
acgccugcuuuugcaaauaa

SEQ ID NO: 490848 - RNA, 18 nt, Homo sapiens
acgcuuuucccaccucuu

SEQ ID NO: 490849 - RNA, 12 nt, Homo sapiens
acggugaauauu

SEQ ID NO: 490850 - RNA, 13 nt, Homo sapiens
acguuugccaaau

SEQ ID NO: 490851 - RNA, 16 nt, Homo sapiens
acguuuggccagugac

SEQ ID NO: 490852 - RNA, 13 nt, Homo sapiens
acuagacauuacc

SEQ ID NO: 490853 - RNA, 13 nt, Homo sapiens
acuaggccuucag

SEQ ID NO: 490854 - RNA, 15 nt, Homo sapiens
acuauagugauauau

SEQ ID NO: 490855 - RNA, 22 nt, Homo sapiens
acucaaguuucagguaugcuua

SEQ ID NO: 490856 - RNA, 18 nt, Homo sapiens
acucacuggcaucuuugc

SEQ ID NO: 490857 - RNA, 17 nt, Homo sapiens
acucaguauauagccuu

SEQ ID NO: 490858 - RNA, 20 nt, Homo sapiens
acucaucaccccucuucccc

SEQ ID NO: 490859 - RNA, 15 nt, Homo sapiens
acucccugcugugug

SEQ ID NO: 490860 - RNA, 14 nt, Homo sapiens
acuccugccauagu

SEQ ID NO: 490861 - RNA, 14 nt, Homo sapiens
acuccuuacagaag

SEQ ID NO: 490862 - RNA, 15 nt, Homo sapiens
acucugaauuccaag

SEQ ID NO: 490863 - RNA, 14 nt, Homo sapiens
acugaaaggcaugu

SEQ ID NO: 490864 - RNA, 21 nt, Homo sapiens
acugacacaagaauggucuuu

SEQ ID NO: 490865 - RNA, 22 nt, Homo sapiens
acugagugaaauauuacucugc

SEQ ID NO: 490866 - RNA, 18 nt, Homo sapiens
acugaguuagaauguuga

SEQ ID NO: 490867 - RNA, 14 nt, Homo sapiens
acugaguucuauca

SEQ ID NO: 490868 - RNA, 15 nt, Homo sapiens
acugauuacuguaga

SEQ ID NO: 490869 - RNA, 23 nt, Homo sapiens
acugcaccaccgaccaacuccag

SEQ ID NO: 490870 - RNA, 23 nt, Homo sapiens
acugccauuuuuugucugugaua

SEQ ID NO: 490871 - RNA, 18 nt, Homo sapiens
acuggaggccaggaaucu

SEQ ID NO: 490872 - RNA, 17 nt, Homo sapiens
acuggucuccuugcuuc

SEQ ID NO: 490873 - RNA, 13 nt, Homo sapiens
acuguaaauucca

SEQ ID NO: 490874 - RNA, 19 nt, Homo sapiens
acuguagugguagcuuuca

SEQ ID NO: 490875 - RNA, 16 nt, Homo sapiens
acuguggcacuuuuca

SEQ ID NO: 490876 - RNA, 21 nt, Homo sapiens
acuguuaaauaaggccucauc

SEQ ID NO: 490877 - RNA, 13 nt, Homo sapiens
acuguucaugaau

SEQ ID NO: 490878 - RNA, 20 nt, Homo sapiens
acuguuuauuaccagauuca

SEQ ID NO: 490879 - RNA, 21 nt, Homo sapiens
acuguuuauuaccagauucac

SEQ ID NO: 490880 - RNA, 16 nt, Homo sapiens
acuguuuuguuuguua

SEQ ID NO: 490881 - RNA, 22 nt, Homo sapiens
acuuaauaucagugaacacagu

SEQ ID NO: 490882 - RNA, 22 nt, Homo sapiens
acuuaaucauacaguaagcuga

SEQ ID NO: 490883 - RNA, 21 nt, Homo sapiens
acuuaauuaccuaagagccac

SEQ ID NO: 490884 - RNA, 22 nt, Homo sapiens
acuucacacacaccucauguga

SEQ ID NO: 490885 - RNA, 20 nt, Homo sapiens
acuucacuaccaagcagcuc

SEQ ID NO: 490886 - RNA, 20 nt, Homo sapiens
acuucuguguugugauuccc

SEQ ID NO: 490887 - RNA, 20 nt, Homo sapiens
acuucuuucccuuccuccau

SEQ ID NO: 490888 - RNA, 18 nt, Homo sapiens
acuuggcaccaauaaagg

SEQ ID NO: 490889 - RNA, 21 nt, Homo sapiens
acuuggucuuuuuucuggguc

SEQ ID NO: 490890 - RNA, 21 nt, Homo sapiens
acuugucagugggaaacaaac

SEQ ID NO: 490891 - RNA, 15 nt, Homo sapiens
acuuuaaauacuauu

SEQ ID NO: 490892 - RNA, 16 nt, Homo sapiens
acuuucucuuggacau

SEQ ID NO: 490893 - RNA, 16 nt, Homo sapiens
agucuuccaccuggaa

SEQ ID NO: 490894 - RNA, 15 nt, Homo sapiens
agucuuuugcauguc

SEQ ID NO: 490895 - RNA, 20 nt, Homo sapiens
agugaaaauuuuauugaaua

SEQ ID NO: 490896 - RNA, 14 nt, Homo sapiens
agugaaauucaauu

SEQ ID NO: 490897 - RNA, 15 nt, Homo sapiens
agugacacagcagcu

SEQ ID NO: 490898 - RNA, 17 nt, Homo sapiens
agugacauuucaaucac

SEQ ID NO: 490899 - RNA, 12 nt, Homo sapiens
agugaccuggaa

SEQ ID NO: 490900 - RNA, 12 nt, Homo sapiens
agugcaucccag

SEQ ID NO: 490901 - RNA, 14 nt, Homo sapiens
agugcauucauuca

SEQ ID NO: 490902 - RNA, 22 nt, Homo sapiens
agugccucugauucuauguaac

SEQ ID NO: 490903 - RNA, 19 nt, Homo sapiens
aguggaaaccuugcugcua

SEQ ID NO: 490904 - RNA, 22 nt, Homo sapiens
aguggugggcaccuauaauacc

SEQ ID NO: 490905 - RNA, 22 nt, Homo sapiens
aguguuuacaaggugacaaaug

SEQ ID NO: 490906 - RNA, 15 nt, Homo sapiens
aguuaacuacagacc

SEQ ID NO: 490907 - RNA, 22 nt, Homo sapiens
aguuaucuuagcuggauauaau

SEQ ID NO: 490908 - RNA, 19 nt, Homo sapiens
aguucuaaccuccuaagca

SEQ ID NO: 490909 - RNA, 11 nt, Homo sapiens
aguucugauga

SEQ ID NO: 490910 - RNA, 12 nt, Homo sapiens
aguucugaugag

SEQ ID NO: 490911 - RNA, 15 nt, Homo sapiens
aguucuuaaaacacu

SEQ ID NO: 490912 - RNA, 19 nt, Homo sapiens
aguucuuaguugcuggcuc

SEQ ID NO: 490913 - RNA, 21 nt, Homo sapiens
aguugguauuuuauaagcaca

SEQ ID NO: 490914 - RNA, 15 nt, Homo sapiens
aguuuaaagaagagu

SEQ ID NO: 490915 - RNA, 23 nt, Homo sapiens
aguuuauuccagagcugccagug

SEQ ID NO: 490916 - RNA, 15 nt, Homo sapiens
aguuuucugugcaaa

SEQ ID NO: 490917 - RNA, 20 nt, Homo sapiens
auaaaaagugacacagcagc

SEQ ID NO: 490918 - RNA, 15 nt, Homo sapiens
auaaaagacaugaaa

SEQ ID NO: 490919 - RNA, 17 nt, Homo sapiens
auaaaauaguuguccau

SEQ ID NO: 490920 - RNA, 14 nt, Homo sapiens
auaaaauguauaaa

SEQ ID NO: 490921 - RNA, 21 nt, Homo sapiens
auaaaauguuuucacuguaau

SEQ ID NO: 490922 - RNA, 11 nt, Homo sapiens
auaaacacaga

SEQ ID NO: 490923 - RNA, 15 nt, Homo sapiens
auaaacacagauuau

SEQ ID NO: 490924 - RNA, 20 nt, Homo sapiens
auaaaccaaaggacauuaug

SEQ ID NO: 490925 - RNA, 16 nt, Homo sapiens
auaaauccaacucuga

SEQ ID NO: 490926 - RNA, 21 nt, Homo sapiens
auaaccauaaaucaauucauu

SEQ ID NO: 490927 - RNA, 18 nt, Homo sapiens
auaagaugcugcugagca

SEQ ID NO: 490928 - RNA, 20 nt, Homo sapiens
auaagcacauccaacuacuc

SEQ ID NO: 490929 - RNA, 12 nt, Homo sapiens
auaauacauuaa

SEQ ID NO: 490930 - RNA, 16 nt, Homo sapiens
auaauugacuggugga

SEQ ID NO: 490931 - RNA, 22 nt, Homo sapiens
auacaaauaccuuuaaauugau

SEQ ID NO: 490932 - RNA, 14 nt, Homo sapiens
auacaacacauuga

SEQ ID NO: 490933 - RNA, 12 nt, Homo sapiens
auacacauacau

SEQ ID NO: 490934 - RNA, 16 nt, Homo sapiens
auacacauacauauau

SEQ ID NO: 490935 - RNA, 22 nt, Homo sapiens
auacauuuucuggugggccuua

SEQ ID NO: 490936 - RNA, 21 nt, Homo sapiens
auaccaaagcugcugcacagc

SEQ ID NO: 490937 - RNA, 16 nt, Homo sapiens
auaccuucugaugaag

SEQ ID NO: 490938 - RNA, 13 nt, Homo sapiens
auacuuucaggca

SEQ ID NO: 490939 - RNA, 21 nt, Homo sapiens
auagagugacuccaagaacaa

SEQ ID NO: 490940 - RNA, 16 nt, Homo sapiens
auagcuaaugugcuga

SEQ ID NO: 490941 - RNA, 16 nt, Homo sapiens
auaggaaggucauuuc

SEQ ID NO: 490942 - RNA, 21 nt, Homo sapiens
auagugucccaguacaaaaag

SEQ ID NO: 490943 - RNA, 14 nt, Homo sapiens
auaguguguccaug

SEQ ID NO: 490944 - RNA, 14 nt, Homo sapiens
auauaaaaguuuaa

SEQ ID NO: 490945 - RNA, 13 nt, Homo sapiens
auauaacugccuu

SEQ ID NO: 490946 - RNA, 19 nt, Homo sapiens
auauacacauauaccuaua

SEQ ID NO: 490947 - RNA, 14 nt, Homo sapiens
auauaucuugucua

SEQ ID NO: 490948 - RNA, 16 nt, Homo sapiens
auauauuuuguaugca

SEQ ID NO: 490949 - RNA, 17 nt, Homo sapiens
auauauuuuguaugcaa

SEQ ID NO: 490950 - RNA, 17 nt, Homo sapiens
auaucaguuacaguggc

SEQ ID NO: 490951 - RNA, 21 nt, Homo sapiens
auaucauccugccuucaugga

SEQ ID NO: 490952 - RNA, 22 nt, Homo sapiens
auaucaugcuuuaaaguguaau

SEQ ID NO: 490953 - RNA, 17 nt, Homo sapiens
auauccuuggcacaucc

SEQ ID NO: 490954 - RNA, 16 nt, Homo sapiens
auaugaaauuauaaug

SEQ ID NO: 490955 - RNA, 14 nt, Homo sapiens
auaugauccagagc

SEQ ID NO: 490956 - RNA, 21 nt, Homo sapiens
auauguguauauauacauaca

SEQ ID NO: 490957 - RNA, 11 nt, Homo sapiens
auauguucuca

SEQ ID NO: 490958 - RNA, 16 nt, Homo sapiens
auauguuuauacacac

SEQ ID NO: 490959 - RNA, 20 nt, Homo sapiens
auauuauaucagacugcuuu

SEQ ID NO: 490960 - RNA, 21 nt, Homo sapiens
auauucauaccuucugaugaa

SEQ ID NO: 490961 - RNA, 22 nt, Homo sapiens
auauucccaugguagacuguga

SEQ ID NO: 490962 - RNA, 16 nt, Homo sapiens
auauucuacuaugcau

SEQ ID NO: 490963 - RNA, 17 nt, Homo sapiens
auauugcuaccaaaaac

SEQ ID NO: 490964 - RNA, 18 nt, Homo sapiens
auauuuaaagucuugaau

SEQ ID NO: 490965 - RNA, 17 nt, Homo sapiens
auauuuccuaaggcaug

SEQ ID NO: 490966 - RNA, 23 nt, Homo sapiens
auauuugcauaauaugcauauau

SEQ ID NO: 490967 - RNA, 20 nt, Homo sapiens
aucaaaauaaaaagugacac

SEQ ID NO: 490968 - RNA, 21 nt, Homo sapiens
aucaaaauaaaaagugacaca

SEQ ID NO: 490969 - RNA, 15 nt, Homo sapiens
aucaacucauguuaa

SEQ ID NO: 490970 - RNA, 18 nt, Homo sapiens
aucaagaaaaaaagggag

SEQ ID NO: 490971 - RNA, 14 nt, Homo sapiens
aucaagaccaaaga

SEQ ID NO: 490972 - RNA, 14 nt, Homo sapiens
aucaagucugugaa

SEQ ID NO: 490973 - RNA, 22 nt, Homo sapiens
aucacacucucuucuuacugua

SEQ ID NO: 490974 - RNA, 14 nt, Homo sapiens
aucagaaagacauu

SEQ ID NO: 490975 - RNA, 20 nt, Homo sapiens
aucagaccaaggaacaagac

SEQ ID NO: 490976 - RNA, 12 nt, Homo sapiens
aucagucuuaau

SEQ ID NO: 490977 - RNA, 13 nt, Homo sapiens
aucaguguugcaa

SEQ ID NO: 490978 - RNA, 22 nt, Homo sapiens
aucaguuacaguggcaguauug

SEQ ID NO: 490979 - RNA, 20 nt, Homo sapiens
aucaguuugcuaacauauuu

SEQ ID NO: 490980 - RNA, 13 nt, Homo sapiens
aucaucagucuua

SEQ ID NO: 490981 - RNA, 18 nt, Homo sapiens
aucauccugccuucaugg

SEQ ID NO: 490982 - RNA, 14 nt, Homo sapiens
aucaucuuguugaa

SEQ ID NO: 490983 - RNA, 13 nt, Homo sapiens
aucauguauauau

SEQ ID NO: 490984 - RNA, 20 nt, Homo sapiens
aucauuggggggagaaaaag

SEQ ID NO: 490985 - RNA, 20 nt, Homo sapiens
aucauuucuugguaugauca

SEQ ID NO: 490986 - RNA, 12 nt, Homo sapiens
auccaacgugaa

SEQ ID NO: 490987 - RNA, 22 nt, Homo sapiens
auccaagcccagccuaucucuc

SEQ ID NO: 490988 - RNA, 19 nt, Homo sapiens
auccaccccguugcucaag

SEQ ID NO: 490989 - RNA, 21 nt, Homo sapiens
auccaccccguugcucaagcc

SEQ ID NO: 490990 - RNA, 22 nt, Homo sapiens
auccaccugcacaaacauagac

SEQ ID NO: 490991 - RNA, 22 nt, Homo sapiens
auccagauugggugccagcaua

SEQ ID NO: 490992 - RNA, 12 nt, Homo sapiens
auccaggacagc

SEQ ID NO: 490993 - RNA, 15 nt, Homo sapiens
auccaucaugcaaaa

SEQ ID NO: 490994 - RNA, 14 nt, Homo sapiens
auccaugugcugcu

SEQ ID NO: 490995 - RNA, 21 nt, Homo sapiens
auccaugugcugcuguggcau

SEQ ID NO: 490996 - RNA, 20 nt, Homo sapiens
cuuugcuauggggacauucc

SEQ ID NO: 490997 - RNA, 21 nt, Homo sapiens
cuuugcuauggggacauucca

SEQ ID NO: 490998 - RNA, 21 nt, Homo sapiens
cuuuggcuuaauuccaaucau

SEQ ID NO: 490999 - RNA, 20 nt, Homo sapiens
cuuugugagccuaugauauu

SEQ ID NO: 491000 - RNA, 19 nt, Homo sapiens
cuuuguguagaaagccaaa

SEQ ID NO: 491001 - RNA, 21 nt, Homo sapiens
cuuuguguagaaagccaaaua

SEQ ID NO: 491002 - RNA, 17 nt, Homo sapiens
cuuuuagaggcuaugaa

SEQ ID NO: 491003 - RNA, 20 nt, Homo sapiens
cuuuuaggagaauucacaga

SEQ ID NO: 491004 - RNA, 23 nt, Homo sapiens
cuuuuauuuuuuaagguaacaaa

SEQ ID NO: 491005 - RNA, 15 nt, Homo sapiens
cuuuucugcaauuca

SEQ ID NO: 491006 - RNA, 18 nt, Homo sapiens
cuuuugaauuuuugguua

SEQ ID NO: 491007 - RNA, 16 nt, Homo sapiens
cuuuugucauguggcu

SEQ ID NO: 491008 - RNA, 19 nt, Homo sapiens
cuuuuucuuuacaaacaaa

SEQ ID NO: 491009 - RNA, 23 nt, Homo sapiens
gaaaaaggaugucuuucaggauu

SEQ ID NO: 491010 - RNA, 22 nt, Homo sapiens
gaaaaaggccaguggaaauuca

SEQ ID NO: 491011 - RNA, 18 nt, Homo sapiens
gaaaaauaguguguccau

SEQ ID NO: 491012 - RNA, 15 nt, Homo sapiens
gaaaaauuucuggca

SEQ ID NO: 491013 - RNA, 17 nt, Homo sapiens
gaaaacaaaaaacaaaa

SEQ ID NO: 491014 - RNA, 22 nt, Homo sapiens
gaaaaggcuugagucuggauaa

SEQ ID NO: 491015 - RNA, 23 nt, Homo sapiens
gaaaauaguggcaggacuguccc

SEQ ID NO: 491016 - RNA, 16 nt, Homo sapiens
gaaaaugucacuguua

SEQ ID NO: 491017 - RNA, 14 nt, Homo sapiens
gaaaauuacaguau

SEQ ID NO: 491018 - RNA, 15 nt, Homo sapiens
gaaacaaacauggau

SEQ ID NO: 491019 - RNA, 21 nt, Homo sapiens
gaaacagcagcugaagccagc

SEQ ID NO: 491020 - RNA, 17 nt, Homo sapiens
gaaacagcuugaugcug

SEQ ID NO: 491021 - RNA, 18 nt, Homo sapiens
gaaacaugccagaaggaa

SEQ ID NO: 491022 - RNA, 22 nt, Homo sapiens
gaaacccaaguuaugcaucccc

SEQ ID NO: 491023 - RNA, 14 nt, Homo sapiens
gaaaccccugacac

SEQ ID NO: 491024 - RNA, 20 nt, Homo sapiens
gaaacgauagccuagcuuuc

SEQ ID NO: 491025 - RNA, 13 nt, Homo sapiens
gaaagcaacagcu

SEQ ID NO: 491026 - RNA, 13 nt, Homo sapiens
gaaagcccuucuc

SEQ ID NO: 491027 - RNA, 14 nt, Homo sapiens
gaaagccucacuga

SEQ ID NO: 491028 - RNA, 17 nt, Homo sapiens
gaaaggaagaccucaag

SEQ ID NO: 491029 - RNA, 15 nt, Homo sapiens
gaaaggacagggauu

SEQ ID NO: 491030 - RNA, 15 nt, Homo sapiens
gaaagucauaguuuu

SEQ ID NO: 491031 - RNA, 18 nt, Homo sapiens
gaaagucuccuguaucau

SEQ ID NO: 491032 - RNA, 13 nt, Homo sapiens
gaaagugccaaaa

SEQ ID NO: 491033 - RNA, 13 nt, Homo sapiens
gaaauacuuucag

SEQ ID NO: 491034 - RNA, 15 nt, Homo sapiens
gaaauaucugugaag

SEQ ID NO: 491035 - RNA, 21 nt, Homo sapiens
gaaauguugacuggccaaaaa

SEQ ID NO: 491036 - RNA, 15 nt, Homo sapiens
gaaauuagggcucua

SEQ ID NO: 491037 - RNA, 18 nt, Homo sapiens
gaaauuauaucugugguc

SEQ ID NO: 491038 - RNA, 16 nt, Homo sapiens
gaaauuuaagcacaaa

SEQ ID NO: 491039 - RNA, 18 nt, Homo sapiens
gaacaagacccccaggaa

SEQ ID NO: 491040 - RNA, 12 nt, Homo sapiens
gaacaguguuua

SEQ ID NO: 491041 - RNA, 19 nt, Homo sapiens
gaacucagcugucuguggc

SEQ ID NO: 491042 - RNA, 20 nt, Homo sapiens
gaagacccuaucucccacaa

SEQ ID NO: 491043 - RNA, 20 nt, Homo sapiens
gaagcaaaagaaacgugaga

SEQ ID NO: 491044 - RNA, 16 nt, Homo sapiens
gaagcagccuccacuu

SEQ ID NO: 491045 - RNA, 21 nt, Homo sapiens
gaagcuaaaauaaaccagacu

SEQ ID NO: 491046 - RNA, 23 nt, Homo sapiens
gaaggaaacagauuuaagcaaga

SEQ ID NO: 491047 - RNA, 22 nt, Homo sapiens
gaaggaacccccucaccaccug

SEQ ID NO: 491048 - RNA, 21 nt, Homo sapiens
gaaggcagcuagacaccaaug

SEQ ID NO: 491049 - RNA, 15 nt, Homo sapiens
gaaggcccagccugu

SEQ ID NO: 491050 - RNA, 16 nt, Homo sapiens
gaaguuugcaaccuuu

SEQ ID NO: 491051 - RNA, 14 nt, Homo sapiens
gaauaaaauauuga

SEQ ID NO: 491052 - RNA, 19 nt, Homo sapiens
gaauaaaauuccuaucuca

SEQ ID NO: 491053 - RNA, 17 nt, Homo sapiens
gaauaugguggaaaaua

SEQ ID NO: 491054 - RNA, 15 nt, Homo sapiens
gaaucucuaugcccu

SEQ ID NO: 491055 - RNA, 12 nt, Homo sapiens
gaaucugaccac

SEQ ID NO: 491056 - RNA, 16 nt, Homo sapiens
gaaugaacaaagucca

SEQ ID NO: 491057 - RNA, 18 nt, Homo sapiens
gaaugagaguuccuucuc

SEQ ID NO: 491058 - RNA, 15 nt, Homo sapiens
gaaugcuuaaaugau

SEQ ID NO: 491059 - RNA, 22 nt, Homo sapiens
gaauggucuggcaauauucugu

SEQ ID NO: 491060 - RNA, 16 nt, Homo sapiens
gaauguauaguauuug

SEQ ID NO: 491061 - RNA, 22 nt, Homo sapiens
gacaagugacuuauuugcucau

SEQ ID NO: 491062 - RNA, 12 nt, Homo sapiens
gacaauuacuuu

SEQ ID NO: 491063 - RNA, 13 nt, Homo sapiens
gacacugaauaaa

SEQ ID NO: 491064 - RNA, 22 nt, Homo sapiens
gacagaagccuaaaaaaagcua

SEQ ID NO: 491065 - RNA, 16 nt, Homo sapiens
gacaucuagucucagu

SEQ ID NO: 491066 - RNA, 21 nt, Homo sapiens
gacaugcgggcugggcagcug

SEQ ID NO: 491067 - RNA, 16 nt, Homo sapiens
gacccccagugcucac

SEQ ID NO: 491068 - RNA, 16 nt, Homo sapiens
gacccccgugccaaau

SEQ ID NO: 491069 - RNA, 15 nt, Homo sapiens
aaaaaaaagugucuc

SEQ ID NO: 491070 - RNA, 17 nt, Homo sapiens
aaaaacaacucaugcca

SEQ ID NO: 491071 - RNA, 20 nt, Homo sapiens
aaaaauauauauagugcuau

SEQ ID NO: 491072 - RNA, 16 nt, Homo sapiens
aaaaaugcagggugau

SEQ ID NO: 491073 - RNA, 14 nt, Homo sapiens
aaaacagcugcaug

SEQ ID NO: 491074 - RNA, 17 nt, Homo sapiens
aaaacagugugaugcaa

SEQ ID NO: 491075 - RNA, 15 nt, Homo sapiens
aaaacuguacuuuga

SEQ ID NO: 491076 - RNA, 15 nt, Homo sapiens
aaaagacauguugua

SEQ ID NO: 491077 - RNA, 21 nt, Homo sapiens
aaaaggcuugagucuggauaa

SEQ ID NO: 491078 - RNA, 20 nt, Homo sapiens
aaaaugagggucucacugcu

SEQ ID NO: 491079 - RNA, 20 nt, Homo sapiens
aaaaugagucacuuacuuca

SEQ ID NO: 491080 - RNA, 21 nt, Homo sapiens
aaaauuacagacaaaauuacu

SEQ ID NO: 491081 - RNA, 15 nt, Homo sapiens
aaaauuacuuacaca

SEQ ID NO: 491082 - RNA, 14 nt, Homo sapiens
aaacaaaauccuug

SEQ ID NO: 491083 - RNA, 20 nt, Homo sapiens
cucuccacauuccaaacaga

SEQ ID NO: 491084 - RNA, 20 nt, Homo sapiens
cucucccaacucuugcacag

SEQ ID NO: 491085 - RNA, 22 nt, Homo sapiens
cucucgcacaccucugcaccuu

SEQ ID NO: 491086 - RNA, 10 nt, Homo sapiens
cucucuccag

SEQ ID NO: 491087 - RNA, 14 nt, Homo sapiens
cucugaauuccaag

SEQ ID NO: 491088 - RNA, 17 nt, Homo sapiens
cucugccaugaacugga

SEQ ID NO: 491089 - RNA, 19 nt, Homo sapiens
cucuguucuuggaacaacg

SEQ ID NO: 491090 - RNA, 20 nt, Homo sapiens
cucuuacguuuaacauacaa

SEQ ID NO: 491091 - RNA, 20 nt, Homo sapiens
cucuucaugcgcagucccca

SEQ ID NO: 491092 - RNA, 17 nt, Homo sapiens
cucuugaagaacugacu

SEQ ID NO: 491093 - RNA, 22 nt, Homo sapiens
cucuugcacagucacugcucuu

SEQ ID NO: 491094 - RNA, 21 nt, Homo sapiens
cucuuuaccauagcuuaagaa

SEQ ID NO: 491095 - RNA, 15 nt, Homo sapiens
cugaaagcaacagcu

SEQ ID NO: 491096 - RNA, 18 nt, Homo sapiens
cugaacaaagagagcuca

SEQ ID NO: 491097 - RNA, 21 nt, Homo sapiens
cugaauauuuauuuuaagggu

SEQ ID NO: 491098 - RNA, 17 nt, Homo sapiens
cugaaucugaccacaga

SEQ ID NO: 491099 - RNA, 17 nt, Homo sapiens
cugaauuggccagagga

SEQ ID NO: 491100 - RNA, 19 nt, Homo sapiens
cugaauuuggggcuacuua

SEQ ID NO: 491101 - RNA, 22 nt, Homo sapiens
cugacacaagaauggucuuucu

SEQ ID NO: 491102 - RNA, 12 nt, Homo sapiens
cugacacugucu

SEQ ID NO: 491103 - RNA, 15 nt, Homo sapiens
cugacagcaaacaca

SEQ ID NO: 491104 - RNA, 18 nt, Homo sapiens
cugaccacagacacuccu

SEQ ID NO: 491105 - RNA, 23 nt, Homo sapiens
cugaggacaaggaaauuccucag

SEQ ID NO: 491106 - RNA, 14 nt, Homo sapiens
cugaggguuuccac

SEQ ID NO: 491107 - RNA, 18 nt, Homo sapiens
cugaguacaaauguguga

SEQ ID NO: 491108 - RNA, 20 nt, Homo sapiens
cugaguagucauuuugccca

SEQ ID NO: 491109 - RNA, 18 nt, Homo sapiens
cugagugagcugaagagu

SEQ ID NO: 491110 - RNA, 22 nt, Homo sapiens
cugauagauauccuuggcacau

SEQ ID NO: 491111 - RNA, 14 nt, Homo sapiens
cugaucccuuccac

SEQ ID NO: 491112 - RNA, 19 nt, Homo sapiens
cugaucccuuccaccugcu

SEQ ID NO: 491113 - RNA, 12 nt, Homo sapiens
cugaugauuugu

SEQ ID NO: 491114 - RNA, 20 nt, Homo sapiens
cugaugccaccuccucuguu

SEQ ID NO: 491115 - RNA, 20 nt, Homo sapiens
cugaugugacgcacuguauu

SEQ ID NO: 491116 - RNA, 12 nt, Homo sapiens
cugauuacugua

SEQ ID NO: 491117 - RNA, 20 nt, Homo sapiens
cugauugcgcaaaacugaaa

SEQ ID NO: 491118 - RNA, 23 nt, Homo sapiens
cugcacagcuggccaccauggca

SEQ ID NO: 491119 - RNA, 21 nt, Homo sapiens
cugcacaugauuucacaaaua

SEQ ID NO: 491120 - RNA, 16 nt, Homo sapiens
cugcaccaccgaccaa

SEQ ID NO: 491121 - RNA, 16 nt, Homo sapiens
cugcaccuaaagccua

SEQ ID NO: 491122 - RNA, 15 nt, Homo sapiens
cugcaccuuugcacg

SEQ ID NO: 491123 - RNA, 16 nt, Homo sapiens
cugcaccuuugcacgu

SEQ ID NO: 491124 - RNA, 20 nt, Homo sapiens
cugcagaaaauuaauugaaa

SEQ ID NO: 491125 - RNA, 13 nt, Homo sapiens
cugcagauuccuu

SEQ ID NO: 491126 - RNA, 15 nt, Homo sapiens
cugcaggaaucaaaa

SEQ ID NO: 491127 - RNA, 17 nt, Homo sapiens
cugcauaaaugaauaaa

SEQ ID NO: 491128 - RNA, 21 nt, Homo sapiens
cugcauaaaugaauaaauuca

SEQ ID NO: 491129 - RNA, 22 nt, Homo sapiens
cugcauuuucugaaacuaauga

SEQ ID NO: 491130 - RNA, 16 nt, Homo sapiens
cugccaugaacuggag

SEQ ID NO: 491131 - RNA, 21 nt, Homo sapiens
cugccauuuuuugucugugau

SEQ ID NO: 491132 - RNA, 14 nt, Homo sapiens
cugccccaucacuu

SEQ ID NO: 491133 - RNA, 19 nt, Homo sapiens
cugccuugcccacuccugc

SEQ ID NO: 491134 - RNA, 16 nt, Homo sapiens
cugcgggucauauuca

SEQ ID NO: 491135 - RNA, 15 nt, Homo sapiens
cugcuccuccaguac

SEQ ID NO: 491136 - RNA, 17 nt, Homo sapiens
cugcuguggcaucagga

SEQ ID NO: 491137 - RNA, 14 nt, Homo sapiens
cugcuuaguaucuc

SEQ ID NO: 491138 - RNA, 18 nt, Homo sapiens
cugcuuugagaaaucuca

SEQ ID NO: 491139 - RNA, 19 nt, Homo sapiens
cuggacucuguggggccac

SEQ ID NO: 491140 - RNA, 16 nt, Homo sapiens
cuggagauggggagaa

SEQ ID NO: 491141 - RNA, 14 nt, Homo sapiens
cuggauauaaugua

SEQ ID NO: 491142 - RNA, 14 nt, Homo sapiens
cuggaugguggugc

SEQ ID NO: 491143 - RNA, 21 nt, Homo sapiens
cuggcccuugcuuaccucuca

SEQ ID NO: 491144 - RNA, 13 nt, Homo sapiens
cuggcuucaggaa

SEQ ID NO: 491145 - RNA, 16 nt, Homo sapiens
cuggcuucaggaauau

SEQ ID NO: 491146 - RNA, 23 nt, Homo sapiens
cugggaggagagguccacuuccc

SEQ ID NO: 491147 - RNA, 14 nt, Homo sapiens
cuggggucugugau

SEQ ID NO: 491148 - RNA, 16 nt, Homo sapiens
cuggucuuggugaaca

SEQ ID NO: 491149 - RNA, 19 nt, Homo sapiens
cugguucuguacaugugga

SEQ ID NO: 491150 - RNA, 13 nt, Homo sapiens
cugguuuccucag

SEQ ID NO: 491151 - RNA, 16 nt, Homo sapiens
cuguaaauuccaaaga

SEQ ID NO: 491152 - RNA, 22 nt, Homo sapiens
cuguaauaaauaaauauacuca

SEQ ID NO: 491153 - RNA, 17 nt, Homo sapiens
cuguacacacacagaca

SEQ ID NO: 491154 - RNA, 11 nt, Homo sapiens
cuguagcuuug

SEQ ID NO: 491155 - RNA, 12 nt, Homo sapiens
cugucaccaccc

SEQ ID NO: 491156 - RNA, 15 nt, Homo sapiens
cugucagucguguug

SEQ ID NO: 491157 - RNA, 17 nt, Homo sapiens
cugucagucguguugcu

SEQ ID NO: 491158 - RNA, 19 nt, Homo sapiens
cugucagucguguugcuua

SEQ ID NO: 491159 - RNA, 14 nt, Homo sapiens
cugucaugccaaaa

SEQ ID NO: 491160 - RNA, 16 nt, Homo sapiens
cugucaugccaaaagu

SEQ ID NO: 491161 - RNA, 16 nt, Homo sapiens
cugucauggugcaauu

SEQ ID NO: 491162 - RNA, 22 nt, Homo sapiens
cugucaugugcgaacacaguga

SEQ ID NO: 491163 - RNA, 22 nt, Homo sapiens
cugucccggagcucaggcccug

SEQ ID NO: 491164 - RNA, 13 nt, Homo sapiens
cuguccuaccuuu

SEQ ID NO: 491165 - RNA, 17 nt, Homo sapiens
cuguccuuuaugauccc

SEQ ID NO: 491166 - RNA, 21 nt, Homo sapiens
cugucuggaggggagcucugu

SEQ ID NO: 491167 - RNA, 18 nt, Homo sapiens
cuguggugagguccuguc

SEQ ID NO: 491168 - RNA, 23 nt, Homo sapiens
cuguuacauaacaagaaaaucaa

SEQ ID NO: 491169 - RNA, 13 nt, Homo sapiens
cuguuagagucca

SEQ ID NO: 491170 - RNA, 14 nt, Homo sapiens
cuguucacuuugua

SEQ ID NO: 491171 - RNA, 12 nt, Homo sapiens
cuguuguaauau

SEQ ID NO: 491172 - RNA, 17 nt, Homo sapiens
cuguuucaguagccaau

SEQ ID NO: 491173 - RNA, 15 nt, Homo sapiens
cuguuuuugcaaaaa

SEQ ID NO: 491174 - RNA, 15 nt, Homo sapiens
cuuaaacagugucca

SEQ ID NO: 491175 - RNA, 20 nt, Homo sapiens
cuuaauuaccuaagagccac

SEQ ID NO: 491176 - RNA, 14 nt, Homo sapiens
cuuaauuuaaguca

SEQ ID NO: 491177 - RNA, 16 nt, Homo sapiens
cuuacaagacuguaaa

SEQ ID NO: 491178 - RNA, 20 nt, Homo sapiens
cuuacagaaccaauucacuu

SEQ ID NO: 491179 - RNA, 22 nt, Homo sapiens
cuuacaguagaggguccagucu

SEQ ID NO: 491180 - RNA, 13 nt, Homo sapiens
cuuagaacaccug

SEQ ID NO: 491181 - RNA, 16 nt, Homo sapiens
cuuagaagaaauauga

SEQ ID NO: 491182 - RNA, 14 nt, Homo sapiens
cuuagaauacugua

SEQ ID NO: 491183 - RNA, 19 nt, Homo sapiens
cuuagaauuauuugcacua

SEQ ID NO: 491184 - RNA, 17 nt, Homo sapiens
cuuagcuuuucugcaau

SEQ ID NO: 491185 - RNA, 22 nt, Homo sapiens
cuuagcuuuucugcaauucaac

SEQ ID NO: 491186 - RNA, 16 nt, Homo sapiens
cuuaucauaaauucaa

SEQ ID NO: 491187 - RNA, 23 nt, Homo sapiens
cuucaaauugucuuuugucaugu

SEQ ID NO: 491188 - RNA, 19 nt, Homo sapiens
cuucaacaugguuaccucu

SEQ ID NO: 491189 - RNA, 20 nt, Homo sapiens
cuucaacaugguuaccucug

SEQ ID NO: 491190 - RNA, 13 nt, Homo sapiens
cuucaugaaaugc

SEQ ID NO: 491191 - RNA, 16 nt, Homo sapiens
cuuccaacaugugaug

SEQ ID NO: 491192 - RNA, 23 nt, Homo sapiens
cuucccaaccuccccugguccug

SEQ ID NO: 491193 - RNA, 16 nt, Homo sapiens
cuucccugacacuguc

SEQ ID NO: 491194 - RNA, 18 nt, Homo sapiens
cuuccuuuuguauccucc

SEQ ID NO: 491195 - RNA, 17 nt, Homo sapiens
cuucgaggacagcaaug

SEQ ID NO: 491196 - RNA, 16 nt, Homo sapiens
cuucuaauccaugugc

SEQ ID NO: 491197 - RNA, 15 nt, Homo sapiens
cuucuaguggguuua

SEQ ID NO: 491198 - RNA, 21 nt, Homo sapiens
cuucucaagaccgaguguaca

SEQ ID NO: 491199 - RNA, 14 nt, Homo sapiens
cuucuccacaggga

SEQ ID NO: 491200 - RNA, 18 nt, Homo sapiens
cuucuccccuccaaguga

SEQ ID NO: 491201 - RNA, 15 nt, Homo sapiens
cuucuggcugucagu

SEQ ID NO: 491202 - RNA, 19 nt, Homo sapiens
cuucuggggguagaucuca

SEQ ID NO: 491203 - RNA, 13 nt, Homo sapiens
cuucuuacuguau

SEQ ID NO: 491204 - RNA, 23 nt, Homo sapiens
cuucuuuccauuucucucuccag

SEQ ID NO: 491205 - RNA, 12 nt, Homo sapiens
cuugagcagcug

SEQ ID NO: 491206 - RNA, 21 nt, Homo sapiens
cuugaggaccuccaccuggga

SEQ ID NO: 491207 - RNA, 13 nt, Homo sapiens
cuugcacacauca

SEQ ID NO: 491208 - RNA, 17 nt, Homo sapiens
cuugcaguuauguuauc

SEQ ID NO: 491209 - RNA, 15 nt, Homo sapiens
cuugcuuaccucuca

SEQ ID NO: 491210 - RNA, 14 nt, Homo sapiens
cuugcuuccugucu

SEQ ID NO: 491211 - RNA, 13 nt, Homo sapiens
cuugggcucugcu

SEQ ID NO: 491212 - RNA, 16 nt, Homo sapiens
cuuggggacaucucau

SEQ ID NO: 491213 - RNA, 19 nt, Homo sapiens
cuuguaacuuaauauacua

SEQ ID NO: 491214 - RNA, 13 nt, Homo sapiens
cuugucuacauau

SEQ ID NO: 491215 - RNA, 12 nt, Homo sapiens
cuugucuuggca

SEQ ID NO: 491216 - RNA, 17 nt, Homo sapiens
cuuguguuacuuaauca

SEQ ID NO: 491217 - RNA, 22 nt, Homo sapiens
cuuguucuuccucuuaccugua

SEQ ID NO: 491218 - RNA, 18 nt, Homo sapiens
cuuguugcagacuggugu

SEQ ID NO: 491219 - RNA, 20 nt, Homo sapiens
cuuguuuuuuuucaaacgga

SEQ ID NO: 491220 - RNA, 15 nt, Homo sapiens
cuuuagaaaaggcau

SEQ ID NO: 491221 - RNA, 21 nt, Homo sapiens
cuuuauaaaacauguacaaaa

SEQ ID NO: 491222 - RNA, 20 nt, Homo sapiens
cuuucccuaauacaggguug

SEQ ID NO: 491223 - RNA, 19 nt, Homo sapiens
ccuaggaccauuucucugc

SEQ ID NO: 491224 - RNA, 13 nt, Homo sapiens
ccuaggcuuuuac

SEQ ID NO: 491225 - RNA, 20 nt, Homo sapiens
ccuaguagggguaccacuga

SEQ ID NO: 491226 - RNA, 10 nt, Homo sapiens
ccuaucucau

SEQ ID NO: 491227 - RNA, 15 nt, Homo sapiens
ccucacugauauauu

SEQ ID NO: 491228 - RNA, 21 nt, Homo sapiens
ccucagaaagggauugcuuug

SEQ ID NO: 491229 - RNA, 20 nt, Homo sapiens
ccucauucccucgucuuucc

SEQ ID NO: 491230 - RNA, 20 nt, Homo sapiens
ccucauuguucagaaaagca

SEQ ID NO: 491231 - RNA, 13 nt, Homo sapiens
ccucccacugagg

SEQ ID NO: 491232 - RNA, 14 nt, Homo sapiens
ccuccuuuucccaa

SEQ ID NO: 491233 - RNA, 21 nt, Homo sapiens
ccucuaaaacuagaaaaggaa

SEQ ID NO: 491234 - RNA, 12 nt, Homo sapiens
ccucugcuaaau

SEQ ID NO: 491235 - RNA, 17 nt, Homo sapiens
ccugaaucagaggcaga

SEQ ID NO: 491236 - RNA, 22 nt, Homo sapiens
ccugaugucuugguuuccauca

SEQ ID NO: 491237 - RNA, 18 nt, Homo sapiens
ccugcauagcuugcacaa

SEQ ID NO: 491238 - RNA, 15 nt, Homo sapiens
ccugccugugaguga

SEQ ID NO: 491239 - RNA, 19 nt, Homo sapiens
ccugcggaguugugcacgu

SEQ ID NO: 491240 - RNA, 15 nt, Homo sapiens
ccugcuccuccagua

SEQ ID NO: 491241 - RNA, 13 nt, Homo sapiens
ccugcucugcucg

SEQ ID NO: 491242 - RNA, 22 nt, Homo sapiens
ccuggagaagaauggcuuucaa

SEQ ID NO: 491243 - RNA, 21 nt, Homo sapiens
ccuggccagaccaggugaccu

SEQ ID NO: 491244 - RNA, 17 nt, Homo sapiens
ccuggcccuggggccug

SEQ ID NO: 491245 - RNA, 20 nt, Homo sapiens
ccugggggcugcugcacugc

SEQ ID NO: 491246 - RNA, 18 nt, Homo sapiens
ccuggguaacaaagugag

SEQ ID NO: 491247 - RNA, 14 nt, Homo sapiens
ccuggucaggguga

SEQ ID NO: 491248 - RNA, 17 nt, Homo sapiens
ccugguccugcacuguc

SEQ ID NO: 491249 - RNA, 14 nt, Homo sapiens
ccuguacuggagag

SEQ ID NO: 491250 - RNA, 21 nt, Homo sapiens
ccugucaaacauuaguacuuu

SEQ ID NO: 491251 - RNA, 15 nt, Homo sapiens
ccugucucuacaaaa

SEQ ID NO: 491252 - RNA, 16 nt, Homo sapiens
ccuuaaaaauguaugu

SEQ ID NO: 491253 - RNA, 16 nt, Homo sapiens
ccuuaaauuaguacag

SEQ ID NO: 491254 - RNA, 22 nt, Homo sapiens
ccuuacaaaugauugcuuuuaa

SEQ ID NO: 491255 - RNA, 20 nt, Homo sapiens
ccuuagauuuggugaacaac

SEQ ID NO: 491256 - RNA, 17 nt, Homo sapiens
ccuucaaguaugugcua

SEQ ID NO: 491257 - RNA, 23 nt, Homo sapiens
ccuuccccacaauaggcuuagug

SEQ ID NO: 491258 - RNA, 14 nt, Homo sapiens
ccuuccucugcucc

SEQ ID NO: 491259 - RNA, 12 nt, Homo sapiens
ccuucgggguga

SEQ ID NO: 491260 - RNA, 17 nt, Homo sapiens
ccuucgugcaacuguag

SEQ ID NO: 491261 - RNA, 22 nt, Homo sapiens
ccuucuacuuacacaucuucca

SEQ ID NO: 491262 - RNA, 16 nt, Homo sapiens
ccuucuccacagggac

SEQ ID NO: 491263 - RNA, 15 nt, Homo sapiens
ccuugaaaguaggau

SEQ ID NO: 491264 - RNA, 19 nt, Homo sapiens
ccuugauauaaaaaaucuu

SEQ ID NO: 491265 - RNA, 22 nt, Homo sapiens
ccuugauauaaaaaaucuuuag

SEQ ID NO: 491266 - RNA, 17 nt, Homo sapiens
ccuugggaugggcacag

SEQ ID NO: 491267 - RNA, 14 nt, Homo sapiens
ccuugucuaaagau

SEQ ID NO: 491268 - RNA, 15 nt, Homo sapiens
ccuuguguuacuuaa

SEQ ID NO: 491269 - RNA, 17 nt, Homo sapiens
ccuuuacuugucuuucu

SEQ ID NO: 491270 - RNA, 17 nt, Homo sapiens
ccuuuucaaauccauuu

SEQ ID NO: 491271 - RNA, 22 nt, Homo sapiens
ccuuuucuccuaucuucauauc

SEQ ID NO: 491272 - RNA, 16 nt, Homo sapiens
ccuuuugguuccucac

SEQ ID NO: 491273 - RNA, 22 nt, Homo sapiens
cgagaaggccgaggaauccuca

SEQ ID NO: 491274 - RNA, 20 nt, Homo sapiens
cgcaaauacaugccuuucca

SEQ ID NO: 491275 - RNA, 21 nt, Homo sapiens
cgcaaggaucacuugagccca

SEQ ID NO: 491276 - RNA, 14 nt, Homo sapiens
cgcacugaguacaa

SEQ ID NO: 491277 - RNA, 19 nt, Homo sapiens
cgcacugggcauuggguaa

SEQ ID NO: 491278 - RNA, 13 nt, Homo sapiens
cgcacuguauucc

SEQ ID NO: 491279 - RNA, 17 nt, Homo sapiens
cgcuagagcagcccaaa

SEQ ID NO: 491280 - RNA, 16 nt, Homo sapiens
cgcugacggaggagcu

SEQ ID NO: 491281 - RNA, 20 nt, Homo sapiens
cgcugcaucccugcagcuca

SEQ ID NO: 491282 - RNA, 14 nt, Homo sapiens
cgcuugcuaucaug

SEQ ID NO: 491283 - RNA, 13 nt, Homo sapiens
cgcuugcuuuagc

SEQ ID NO: 491284 - RNA, 13 nt, Homo sapiens
cgggcaggcauuu

SEQ ID NO: 491285 - RNA, 15 nt, Homo sapiens
cgggccccaccugca

SEQ ID NO: 491286 - RNA, 22 nt, Homo sapiens
cgguaaaccgaggacccaugaa

SEQ ID NO: 491287 - RNA, 18 nt, Homo sapiens
cgugaaacacaauaucau

SEQ ID NO: 491288 - RNA, 19 nt, Homo sapiens
cgugaaaguugugaucugu

SEQ ID NO: 491289 - RNA, 19 nt, Homo sapiens
cgugccaaauccugggcau

SEQ ID NO: 491290 - RNA, 23 nt, Homo sapiens
cguguauguuuuucaguucaaag

SEQ ID NO: 491291 - RNA, 14 nt, Homo sapiens
cgugugaggaugug

SEQ ID NO: 491292 - RNA, 19 nt, Homo sapiens
cuaaaaauaaaccaaagga

SEQ ID NO: 491293 - RNA, 14 nt, Homo sapiens
cuaaaacagggugg

SEQ ID NO: 491294 - RNA, 17 nt, Homo sapiens
cuaaauaaaacuguggc

SEQ ID NO: 491295 - RNA, 14 nt, Homo sapiens
cuaacucugaugua

SEQ ID NO: 491296 - RNA, 20 nt, Homo sapiens
cuaagcugaguuaggugucu

SEQ ID NO: 491297 - RNA, 20 nt, Homo sapiens
cuaauauugaaaaugucacu

SEQ ID NO: 491298 - RNA, 13 nt, Homo sapiens
cuaauccaugugc

SEQ ID NO: 491299 - RNA, 23 nt, Homo sapiens
cuaaugccugcggaguugugcac

SEQ ID NO: 491300 - RNA, 22 nt, Homo sapiens
cuaaugcugcccucacugccuc

SEQ ID NO: 491301 - RNA, 17 nt, Homo sapiens
cuacagaacacuuugcu

SEQ ID NO: 491302 - RNA, 14 nt, Homo sapiens
cuacagcagaucca

SEQ ID NO: 491303 - RNA, 20 nt, Homo sapiens
cuaccacagcaacuauauau

SEQ ID NO: 491304 - RNA, 17 nt, Homo sapiens
cuacccuauucuaucca

SEQ ID NO: 491305 - RNA, 17 nt, Homo sapiens
cuagaacacaaauccaa

SEQ ID NO: 491306 - RNA, 23 nt, Homo sapiens
cuagaaccuucuaauccaugugc

SEQ ID NO: 491307 - RNA, 13 nt, Homo sapiens
cuagacacacaaa

SEQ ID NO: 491308 - RNA, 16 nt, Homo sapiens
cuagauccuaugugaa

SEQ ID NO: 491309 - RNA, 15 nt, Homo sapiens
cuagcaauuccauca

SEQ ID NO: 491310 - RNA, 23 nt, Homo sapiens
cuagguagagauauuggaaggcu

SEQ ID NO: 491311 - RNA, 12 nt, Homo sapiens
cuauaaugugug

SEQ ID NO: 491312 - RNA, 17 nt, Homo sapiens
cuauagcuaaugugcug

SEQ ID NO: 491313 - RNA, 17 nt, Homo sapiens
cuauauuuaaguauuca

SEQ ID NO: 491314 - RNA, 16 nt, Homo sapiens
cuaucuucaucugaga

SEQ ID NO: 491315 - RNA, 20 nt, Homo sapiens
cuaugaaguuggcacauuuc

SEQ ID NO: 491316 - RNA, 22 nt, Homo sapiens
cuaugacucaaagaugaaagcu

SEQ ID NO: 491317 - RNA, 18 nt, Homo sapiens
cuaugccuuuuguagcug

SEQ ID NO: 491318 - RNA, 16 nt, Homo sapiens
cuauggacaauuuacc

SEQ ID NO: 491319 - RNA, 16 nt, Homo sapiens
cuauucuauccaucuc

SEQ ID NO: 491320 - RNA, 16 nt, Homo sapiens
cuauuuaaguggacug

SEQ ID NO: 491321 - RNA, 16 nt, Homo sapiens
cuauuuagaugagauc

SEQ ID NO: 491322 - RNA, 22 nt, Homo sapiens
cuauuucacacagaaaccaagg

SEQ ID NO: 491323 - RNA, 15 nt, Homo sapiens
cucaaaauaaaacca

SEQ ID NO: 491324 - RNA, 18 nt, Homo sapiens
cucaagaaaaauucacag

SEQ ID NO: 491325 - RNA, 20 nt, Homo sapiens
cucaaggcugcagugagcca

SEQ ID NO: 491326 - RNA, 13 nt, Homo sapiens
cucaccuccuaaa

SEQ ID NO: 491327 - RNA, 13 nt, Homo sapiens
cucacgccuguaa

SEQ ID NO: 491328 - RNA, 20 nt, Homo sapiens
cucacgccuguaaucccagc

SEQ ID NO: 491329 - RNA, 20 nt, Homo sapiens
cucacugguuuucaauacca

SEQ ID NO: 491330 - RNA, 18 nt, Homo sapiens
cucagacaccuagacucu

SEQ ID NO: 491331 - RNA, 23 nt, Homo sapiens
cucagcauggcguaucaggaaag

SEQ ID NO: 491332 - RNA, 21 nt, Homo sapiens
cucaggugaaaauccaucuca

SEQ ID NO: 491333 - RNA, 22 nt, Homo sapiens
cucagguuauucguuacucuaa

SEQ ID NO: 491334 - RNA, 16 nt, Homo sapiens
cucaguguagguccca

SEQ ID NO: 491335 - RNA, 20 nt, Homo sapiens
cucauacagugguauugcua

SEQ ID NO: 491336 - RNA, 22 nt, Homo sapiens
cucaucaacaaagaaauauuau

SEQ ID NO: 491337 - RNA, 12 nt, Homo sapiens
cucaucagaaac

SEQ ID NO: 491338 - RNA, 16 nt, Homo sapiens
cucauccuccacugaa

SEQ ID NO: 491339 - RNA, 14 nt, Homo sapiens
cuccaaaugucuac

SEQ ID NO: 491340 - RNA, 23 nt, Homo sapiens
cuccaaucgauguuuagugugau

SEQ ID NO: 491341 - RNA, 20 nt, Homo sapiens
cuccacaguuaggccaagaa

SEQ ID NO: 491342 - RNA, 11 nt, Homo sapiens
cuccacauucc

SEQ ID NO: 491343 - RNA, 15 nt, Homo sapiens
cuccaguucugauga

SEQ ID NO: 491344 - RNA, 12 nt, Homo sapiens
cucccagaucca

SEQ ID NO: 491345 - RNA, 13 nt, Homo sapiens
cuccccaggacuu

SEQ ID NO: 491346 - RNA, 16 nt, Homo sapiens
cuccccugguccugca

SEQ ID NO: 491347 - RNA, 17 nt, Homo sapiens
cucccucccucccagau

SEQ ID NO: 491348 - RNA, 12 nt, Homo sapiens
cucccugaugua

SEQ ID NO: 491349 - RNA, 22 nt, Homo sapiens
cucccuggacucuguggggcca

SEQ ID NO: 491350 - RNA, 17 nt, Homo sapiens
cucccuuuuuaaacaaa

SEQ ID NO: 491351 - RNA, 17 nt, Homo sapiens
cuccgcccuucccugac

SEQ ID NO: 491352 - RNA, 14 nt, Homo sapiens
cuccucacugaaaa

SEQ ID NO: 491353 - RNA, 15 nt, Homo sapiens
cuccugcugccagua

SEQ ID NO: 491354 - RNA, 16 nt, Homo sapiens
cuccuucccacucuuc

SEQ ID NO: 491355 - RNA, 21 nt, Homo sapiens
cucgcacaccucugcaccuuu

SEQ ID NO: 491356 - RNA, 16 nt, Homo sapiens
cucgcacuacaucuga

SEQ ID NO: 491357 - RNA, 22 nt, Homo sapiens
cucguucaguuuaguaagcaaa

SEQ ID NO: 491358 - RNA, 18 nt, Homo sapiens
cucguuguaaguacucua

SEQ ID NO: 491359 - RNA, 13 nt, Homo sapiens
cucuagacaucua

SEQ ID NO: 491360 - RNA, 23 nt, Homo sapiens
cucuagacaucuagucucagugc

SEQ ID NO: 491361 - RNA, 14 nt, Homo sapiens
cucucaccuccuaa

SEQ ID NO: 491362 - RNA, 16 nt, Homo sapiens
cucucaccuccuaaag

SEQ ID NO: 491363 - RNA, 21 nt, Homo sapiens
ccaucuuuagaaacaucaguu

SEQ ID NO: 491364 - RNA, 14 nt, Homo sapiens
ccaugaaacagcag

SEQ ID NO: 491365 - RNA, 23 nt, Homo sapiens
ccaugaaacagcagcugaagcca

SEQ ID NO: 491366 - RNA, 16 nt, Homo sapiens
ccaugcccucccugcu

SEQ ID NO: 491367 - RNA, 13 nt, Homo sapiens
ccauggaggcaca

SEQ ID NO: 491368 - RNA, 21 nt, Homo sapiens
ccauggagggggcuugcacuc

SEQ ID NO: 491369 - RNA, 22 nt, Homo sapiens
ccauggcuccucaccaccgaga

SEQ ID NO: 491370 - RNA, 13 nt, Homo sapiens
ccauucacuggca

SEQ ID NO: 491371 - RNA, 22 nt, Homo sapiens
ccauuguauuuaaaacauuuca

SEQ ID NO: 491372 - RNA, 19 nt, Homo sapiens
ccauuguuucuaauaagca

SEQ ID NO: 491373 - RNA, 13 nt, Homo sapiens
ccauuuugaaaua

SEQ ID NO: 491374 - RNA, 18 nt, Homo sapiens
ccauuuuggugucuuucu

SEQ ID NO: 491375 - RNA, 16 nt, Homo sapiens
cccaacgacccaugac

SEQ ID NO: 491376 - RNA, 16 nt, Homo sapiens
cccaacucuugcacag

SEQ ID NO: 491377 - RNA, 13 nt, Homo sapiens
cccacacugugaa

SEQ ID NO: 491378 - RNA, 22 nt, Homo sapiens
cccacagagguggaacuuaauu

SEQ ID NO: 491379 - RNA, 23 nt, Homo sapiens
cccaccccuuccccuuguaaaaa

SEQ ID NO: 491380 - RNA, 20 nt, Homo sapiens
cccagaagcucaaggcugca

SEQ ID NO: 491381 - RNA, 13 nt, Homo sapiens
cccagguaucuga

SEQ ID NO: 491382 - RNA, 16 nt, Homo sapiens
cccaggucugaucugg

SEQ ID NO: 491383 - RNA, 22 nt, Homo sapiens
cccaucgucucggccuucacaa

SEQ ID NO: 491384 - RNA, 13 nt, Homo sapiens
cccaugaaacagc

SEQ ID NO: 491385 - RNA, 19 nt, Homo sapiens
cccaugguagacugugaca

SEQ ID NO: 491386 - RNA, 21 nt, Homo sapiens
cccaugguagacugugacaca

SEQ ID NO: 491387 - RNA, 18 nt, Homo sapiens
cccauuagcccacugccu

SEQ ID NO: 491388 - RNA, 22 nt, Homo sapiens
cccauuguauuuaaaacauuuc

SEQ ID NO: 491389 - RNA, 18 nt, Homo sapiens
cccauuuccuguacaauc

SEQ ID NO: 491390 - RNA, 23 nt, Homo sapiens
ccccagacgcacgugggucuuca

SEQ ID NO: 491391 - RNA, 17 nt, Homo sapiens
ccccucauggaucugca

SEQ ID NO: 491392 - RNA, 17 nt, Homo sapiens
ccccuggacauauuccc

SEQ ID NO: 491393 - RNA, 18 nt, Homo sapiens
ccccugguccugcacugu

SEQ ID NO: 491394 - RNA, 22 nt, Homo sapiens
cccucauuuaaacccaaucaga

SEQ ID NO: 491395 - RNA, 23 nt, Homo sapiens
cccugauugcgcaaaacugaaag

SEQ ID NO: 491396 - RNA, 17 nt, Homo sapiens
cccugcaccaggccauc

SEQ ID NO: 491397 - RNA, 20 nt, Homo sapiens
cccugcauagcuugcacaac

SEQ ID NO: 491398 - RNA, 23 nt, Homo sapiens
cccugcgcgggaccaucuggaau

SEQ ID NO: 491399 - RNA, 20 nt, Homo sapiens
cccuucaaugcaaaauacau

SEQ ID NO: 491400 - RNA, 16 nt, Homo sapiens
cccuucacugucacca

SEQ ID NO: 491401 - RNA, 15 nt, Homo sapiens
cccuuccucccaaaa

SEQ ID NO: 491402 - RNA, 20 nt, Homo sapiens
cccuuucugugugaagauca

SEQ ID NO: 491403 - RNA, 17 nt, Homo sapiens
ccgacuagacacacaaa

SEQ ID NO: 491404 - RNA, 12 nt, Homo sapiens
ccgagcaaagau

SEQ ID NO: 491405 - RNA, 17 nt, Homo sapiens
ccgagccgagcucuccu

SEQ ID NO: 491406 - RNA, 12 nt, Homo sapiens
ccguaaggcaag

SEQ ID NO: 491407 - RNA, 20 nt, Homo sapiens
ccguaauucuuauuccauau

SEQ ID NO: 491408 - RNA, 19 nt, Homo sapiens
ccuaacaggauuagacagu

SEQ ID NO: 491409 - RNA, 12 nt, Homo sapiens
ccuaagagccac

SEQ ID NO: 491410 - RNA, 18 nt, Homo sapiens
ccuacagaauacuagcca

SEQ ID NO: 491411 - RNA, 19 nt, Homo sapiens
cacuuugcaaagacagugu

SEQ ID NO: 491412 - RNA, 13 nt, Homo sapiens
cacuuuguuucau

SEQ ID NO: 491413 - RNA, 17 nt, Homo sapiens
cagaaacuaagaaucau

SEQ ID NO: 491414 - RNA, 12 nt, Homo sapiens
cagaacacuuug

SEQ ID NO: 491415 - RNA, 21 nt, Homo sapiens
cagaaccuacuguuccuuuca

SEQ ID NO: 491416 - RNA, 19 nt, Homo sapiens
cagaaguagcuuugcacuu

SEQ ID NO: 491417 - RNA, 14 nt, Homo sapiens
cagaaguccagagu

SEQ ID NO: 491418 - RNA, 18 nt, Homo sapiens
cagaauggggacaucuug

SEQ ID NO: 491419 - RNA, 16 nt, Homo sapiens
cagaauuggaaaagac

SEQ ID NO: 491420 - RNA, 18 nt, Homo sapiens
cagagacccccgugccaa

SEQ ID NO: 491421 - RNA, 15 nt, Homo sapiens
cagagagggggccac

SEQ ID NO: 491422 - RNA, 11 nt, Homo sapiens
cagagcacaaa

SEQ ID NO: 491423 - RNA, 23 nt, Homo sapiens
cagagcauuuccaacaccacaga

SEQ ID NO: 491424 - RNA, 20 nt, Homo sapiens
cagagcucagcacagccuca

SEQ ID NO: 491425 - RNA, 18 nt, Homo sapiens
cagagugaaauucaauuc

SEQ ID NO: 491426 - RNA, 20 nt, Homo sapiens
cagagugaaauucaauucau

SEQ ID NO: 491427 - RNA, 16 nt, Homo sapiens
cagagugaagagugaa

SEQ ID NO: 491428 - RNA, 22 nt, Homo sapiens
cagauccaggaacacaugcaca

SEQ ID NO: 491429 - RNA, 21 nt, Homo sapiens
cagaucuuuuagcccagucau

SEQ ID NO: 491430 - RNA, 18 nt, Homo sapiens
cagaugauccuugcacag

SEQ ID NO: 491431 - RNA, 13 nt, Homo sapiens
cagauucacuucu

SEQ ID NO: 491432 - RNA, 19 nt, Homo sapiens
cagauuucagcuacauaua

SEQ ID NO: 491433 - RNA, 15 nt, Homo sapiens
cagauuuugugaacu

SEQ ID NO: 491434 - RNA, 20 nt, Homo sapiens
cagcaaauuaauguguaaaa

SEQ ID NO: 491435 - RNA, 18 nt, Homo sapiens
cagcagcugaagccagcu

SEQ ID NO: 491436 - RNA, 22 nt, Homo sapiens
cagcagcuucaccagagcauuu

SEQ ID NO: 491437 - RNA, 18 nt, Homo sapiens
cagcagggccacugagua

SEQ ID NO: 491438 - RNA, 23 nt, Homo sapiens
cagcagggccacugaguagucau

SEQ ID NO: 491439 - RNA, 14 nt, Homo sapiens
cagcauauauauaa

SEQ ID NO: 491440 - RNA, 13 nt, Homo sapiens
cagcauguucuca

SEQ ID NO: 491441 - RNA, 21 nt, Homo sapiens
cagccuggccaacauggugaa

SEQ ID NO: 491442 - RNA, 11 nt, Homo sapiens
cagcuagacac

SEQ ID NO: 491443 - RNA, 17 nt, Homo sapiens
cagcuaggaacaaaucu

SEQ ID NO: 491444 - RNA, 12 nt, Homo sapiens
cagcucugagau

SEQ ID NO: 491445 - RNA, 21 nt, Homo sapiens
cagcugagccuucugagcugg

SEQ ID NO: 491446 - RNA, 14 nt, Homo sapiens
cagcugcauggcac

SEQ ID NO: 491447 - RNA, 23 nt, Homo sapiens
cagcuucuggggguagaucucaa

SEQ ID NO: 491448 - RNA, 17 nt, Homo sapiens
caggaaauaucugugaa

SEQ ID NO: 491449 - RNA, 13 nt, Homo sapiens
caggacagcauua

SEQ ID NO: 491450 - RNA, 14 nt, Homo sapiens
caggcagagcucag

SEQ ID NO: 491451 - RNA, 14 nt, Homo sapiens
caggcccuggugag

SEQ ID NO: 491452 - RNA, 18 nt, Homo sapiens
caggccucccugccagua

SEQ ID NO: 491453 - RNA, 23 nt, Homo sapiens
caggcugccccaccccuccauga

SEQ ID NO: 491454 - RNA, 14 nt, Homo sapiens
cagggcaaucaaug

SEQ ID NO: 491455 - RNA, 19 nt, Homo sapiens
cagggcagauuuuaguuuu

SEQ ID NO: 491456 - RNA, 14 nt, Homo sapiens
cagggccacugagu

SEQ ID NO: 491457 - RNA, 21 nt, Homo sapiens
caggggagacgaggccaagcu

SEQ ID NO: 491458 - RNA, 17 nt, Homo sapiens
cagggucuaaaauuaca

SEQ ID NO: 491459 - RNA, 14 nt, Homo sapiens
cagggugaccugcu

SEQ ID NO: 491460 - RNA, 15 nt, Homo sapiens
caggugaaaauccau

SEQ ID NO: 491461 - RNA, 20 nt, Homo sapiens
caggugaaaauccaucucau

SEQ ID NO: 491462 - RNA, 11 nt, Homo sapiens
caggugcacag

SEQ ID NO: 491463 - RNA, 19 nt, Homo sapiens
cagguggccagggcuccac

SEQ ID NO: 491464 - RNA, 21 nt, Homo sapiens
cagguugugugugugugcagu

SEQ ID NO: 491465 - RNA, 22 nt, Homo sapiens
cagguugugugugugugcagug

SEQ ID NO: 491466 - RNA, 13 nt, Homo sapiens
uguaaugugaauu

SEQ ID NO: 491467 - RNA, 15 nt, Homo sapiens
uguacacacacagac

SEQ ID NO: 491468 - RNA, 20 nt, Homo sapiens
uguacauaguuauguaaaaa

SEQ ID NO: 491469 - RNA, 21 nt, Homo sapiens
uguacuggagagcaacacagg

SEQ ID NO: 491470 - RNA, 23 nt, Homo sapiens
uguacuggauuuaacuaccuuug

SEQ ID NO: 491471 - RNA, 18 nt, Homo sapiens
uguagcucugaaugcuau

SEQ ID NO: 491472 - RNA, 20 nt, Homo sapiens
uguauagacucagugcacau

SEQ ID NO: 491473 - RNA, 17 nt, Homo sapiens
uguauaguauuugaaaa

SEQ ID NO: 491474 - RNA, 16 nt, Homo sapiens
ugucacugcuguaaag

SEQ ID NO: 491475 - RNA, 22 nt, Homo sapiens
ugucacugcuguaaagcaaaau

SEQ ID NO: 491476 - RNA, 17 nt, Homo sapiens
ugucaguguagaucaac

SEQ ID NO: 491477 - RNA, 18 nt, Homo sapiens
ugucaguucuaaccuccu

SEQ ID NO: 491478 - RNA, 17 nt, Homo sapiens
ugucauggugcaauuug

SEQ ID NO: 491479 - RNA, 23 nt, Homo sapiens
ugucaugugcgaacacagugaca

SEQ ID NO: 491480 - RNA, 18 nt, Homo sapiens
ugucccaguacaaaaagg

SEQ ID NO: 491481 - RNA, 19 nt, Homo sapiens
ugucccaguuaacuguuaa

SEQ ID NO: 491482 - RNA, 15 nt, Homo sapiens
ugucccucaauuaca

SEQ ID NO: 491483 - RNA, 16 nt, Homo sapiens
ugucuucauguugaug

SEQ ID NO: 491484 - RNA, 21 nt, Homo sapiens
ugugaaaugacugcaucaugc

SEQ ID NO: 491485 - RNA, 15 nt, Homo sapiens
ugugaccgggguccu

SEQ ID NO: 491486 - RNA, 20 nt, Homo sapiens
ugugaucuguuguaauauca

SEQ ID NO: 491487 - RNA, 15 nt, Homo sapiens
ugugcuauuugcaaa

SEQ ID NO: 491488 - RNA, 17 nt, Homo sapiens
ugugcuggugggggccu

SEQ ID NO: 491489 - RNA, 14 nt, Homo sapiens
ugugcuuaccuguu

SEQ ID NO: 491490 - RNA, 19 nt, Homo sapiens
ugugcuucuuaauguguaa

SEQ ID NO: 491491 - RNA, 13 nt, Homo sapiens
uguggacaugcac

SEQ ID NO: 491492 - RNA, 13 nt, Homo sapiens
uguggccaguuua

SEQ ID NO: 491493 - RNA, 13 nt, Homo sapiens
uguguauguguau

SEQ ID NO: 491494 - RNA, 22 nt, Homo sapiens
ugugugcuuugccacugaagua

SEQ ID NO: 491495 - RNA, 20 nt, Homo sapiens
uguguguauaagugcacaca

SEQ ID NO: 491496 - RNA, 17 nt, Homo sapiens
uguucauggacuauucc

SEQ ID NO: 491497 - RNA, 17 nt, Homo sapiens
uguuccuuucagaugac

SEQ ID NO: 491498 - RNA, 20 nt, Homo sapiens
uguucuagcccccaaagagu

SEQ ID NO: 491499 - RNA, 21 nt, Homo sapiens
uguucuguggcugauuuacua

SEQ ID NO: 491500 - RNA, 14 nt, Homo sapiens
uguucuguuacaaa

SEQ ID NO: 491501 - RNA, 22 nt, Homo sapiens
uguugcacugaaguuugauaaa

SEQ ID NO: 491502 - RNA, 16 nt, Homo sapiens
uguuucucagucucac

SEQ ID NO: 491503 - RNA, 22 nt, Homo sapiens
uguuucuugccugaacuccugc

SEQ ID NO: 491504 - RNA, 18 nt, Homo sapiens
uuaaaaugagucacuuac

SEQ ID NO: 491505 - RNA, 12 nt, Homo sapiens
uuaaaaugugua

SEQ ID NO: 491506 - RNA, 18 nt, Homo sapiens
uuaaaauuugaaacauug

SEQ ID NO: 491507 - RNA, 14 nt, Homo sapiens
uuaaacccacagcc

SEQ ID NO: 491508 - RNA, 10 nt, Homo sapiens
uuaaagaaga

SEQ ID NO: 491509 - RNA, 21 nt, Homo sapiens
uuaaagcucguagaaacaaga

SEQ ID NO: 491510 - RNA, 13 nt, Homo sapiens
uuaacaccuucau

SEQ ID NO: 491511 - RNA, 10 nt, Homo sapiens
uuaacuacag

SEQ ID NO: 491512 - RNA, 15 nt, Homo sapiens
uuaagaacaagcagu

SEQ ID NO: 491513 - RNA, 23 nt, Homo sapiens
uuaagcacaaccauguucuugag

SEQ ID NO: 491514 - RNA, 13 nt, Homo sapiens
uuaauaacagcuc

SEQ ID NO: 491515 - RNA, 15 nt, Homo sapiens
uuaaucccacuugcc

SEQ ID NO: 491516 - RNA, 20 nt, Homo sapiens
uuaauugaaauaccuauuca

SEQ ID NO: 491517 - RNA, 21 nt, Homo sapiens
uuacaagacuguaaauuccaa

SEQ ID NO: 491518 - RNA, 15 nt, Homo sapiens
uuacacaucuuccac

SEQ ID NO: 491519 - RNA, 19 nt, Homo sapiens
uuacauauucuuucacuug

SEQ ID NO: 491520 - RNA, 18 nt, Homo sapiens
uuaccacaggaugcauau

SEQ ID NO: 491521 - RNA, 18 nt, Homo sapiens
uuaccucugcauaaauau

SEQ ID NO: 491522 - RNA, 22 nt, Homo sapiens
uuaccuguaauagccucaccuu

SEQ ID NO: 491523 - RNA, 20 nt, Homo sapiens
uuacuacaugugggagcuuu

SEQ ID NO: 491524 - RNA, 18 nt, Homo sapiens
uuacuggggaaagugcau

SEQ ID NO: 491525 - RNA, 16 nt, Homo sapiens
uuacuuucauguacua

SEQ ID NO: 491526 - RNA, 14 nt, Homo sapiens
uuagacauaccucu

SEQ ID NO: 491527 - RNA, 12 nt, Homo sapiens
uuagaguuuacu

SEQ ID NO: 491528 - RNA, 12 nt, Homo sapiens
uuagcaaagcau

SEQ ID NO: 491529 - RNA, 13 nt, Homo sapiens
uuagccuguguca

SEQ ID NO: 491530 - RNA, 16 nt, Homo sapiens
uuagcuuacugauuaa

SEQ ID NO: 491531 - RNA, 17 nt, Homo sapiens
uuaggaugucuguaaua

SEQ ID NO: 491532 - RNA, 14 nt, Homo sapiens
uuaguccucaccuu

SEQ ID NO: 491533 - RNA, 23 nt, Homo sapiens
uuaguuuuauuuucuaaaguacu

SEQ ID NO: 491534 - RNA, 18 nt, Homo sapiens
uuauauaugaaaacuaag

SEQ ID NO: 491535 - RNA, 19 nt, Homo sapiens
uuauauucccaaaucucaa

SEQ ID NO: 491536 - RNA, 17 nt, Homo sapiens
uuauccuccuucacucc

SEQ ID NO: 491537 - RNA, 10 nt, Homo sapiens
uuauccugua

SEQ ID NO: 491538 - RNA, 17 nt, Homo sapiens
uuaucuaccaacuuuca

SEQ ID NO: 491539 - RNA, 20 nt, Homo sapiens
uuaugaucuggcccuugcuu

SEQ ID NO: 491540 - RNA, 22 nt, Homo sapiens
uuauguuuauuauuugcacaga

SEQ ID NO: 491541 - RNA, 23 nt, Homo sapiens
uuauucagaaccuaaaaguauua

SEQ ID NO: 491542 - RNA, 14 nt, Homo sapiens
uuauuuccauggau

SEQ ID NO: 491543 - RNA, 20 nt, Homo sapiens
uucaacaacuacuacuugau

SEQ ID NO: 491544 - RNA, 13 nt, Homo sapiens
uucaacuaugcaa

SEQ ID NO: 491545 - RNA, 20 nt, Homo sapiens
uucaacuaugcaaugaaugu

SEQ ID NO: 491546 - RNA, 15 nt, Homo sapiens
uucaaguaugugcua

SEQ ID NO: 491547 - RNA, 22 nt, Homo sapiens
uucaaucacugaaaaugugcuc

SEQ ID NO: 491548 - RNA, 11 nt, Homo sapiens
uucaccagagc

SEQ ID NO: 491549 - RNA, 17 nt, Homo sapiens
uucaccagagcauuucc

SEQ ID NO: 491550 - RNA, 16 nt, Homo sapiens
uucagaaacaaagcau

SEQ ID NO: 491551 - RNA, 23 nt, Homo sapiens
uucagggggccaggugcacagac

SEQ ID NO: 491552 - RNA, 20 nt, Homo sapiens
uucauauucucagaugggcu

SEQ ID NO: 491553 - RNA, 18 nt, Homo sapiens
uucauauugcuaccaaaa

SEQ ID NO: 491554 - RNA, 23 nt, Homo sapiens
uucauggaguagagucaggagaa

SEQ ID NO: 491555 - RNA, 20 nt, Homo sapiens
uucaugugugugaguuugcu

SEQ ID NO: 491556 - RNA, 17 nt, Homo sapiens
gaccaguagugaccaau

SEQ ID NO: 491557 - RNA, 13 nt, Homo sapiens
gacccccaggaag

SEQ ID NO: 491558 - RNA, 18 nt, Homo sapiens
gacccucggggcaggaag

SEQ ID NO: 491559 - RNA, 15 nt, Homo sapiens
gacucugccuuccag

SEQ ID NO: 491560 - RNA, 15 nt, Homo sapiens
gacugugacacagcu

SEQ ID NO: 491561 - RNA, 19 nt, Homo sapiens
gacuucauuuaacacugag

SEQ ID NO: 491562 - RNA, 15 nt, Homo sapiens
gacuucucuagacau

SEQ ID NO: 491563 - RNA, 18 nt, Homo sapiens
gacuucuuacccaaagca

SEQ ID NO: 491564 - RNA, 17 nt, Homo sapiens
gacuugauugguuuaaa

SEQ ID NO: 491565 - RNA, 17 nt, Homo sapiens
gacuuuuauaacauuuu

SEQ ID NO: 491566 - RNA, 18 nt, Homo sapiens
gagaaaaagcccucuuca

SEQ ID NO: 491567 - RNA, 15 nt, Homo sapiens
gagaaauacuuucag

SEQ ID NO: 491568 - RNA, 19 nt, Homo sapiens
gagaaauuaaauacucuga

SEQ ID NO: 491569 - RNA, 12 nt, Homo sapiens
gagaacagggau

SEQ ID NO: 491570 - RNA, 16 nt, Homo sapiens
gagaagaccucuguga

SEQ ID NO: 491571 - RNA, 18 nt, Homo sapiens
gagacccccgugccaaau

SEQ ID NO: 491572 - RNA, 14 nt, Homo sapiens
gagagaaaucugaa

SEQ ID NO: 491573 - RNA, 16 nt, Homo sapiens
gagagaacagggaugc

SEQ ID NO: 491574 - RNA, 16 nt, Homo sapiens
gagagcagccucuuga

SEQ ID NO: 491575 - RNA, 13 nt, Homo sapiens
gagagggggccac

SEQ ID NO: 491576 - RNA, 14 nt, Homo sapiens
gagaguuccuucuc

SEQ ID NO: 491577 - RNA, 13 nt, Homo sapiens
gagcagagaagua

SEQ ID NO: 491578 - RNA, 12 nt, Homo sapiens
gagcauuuccaa

SEQ ID NO: 491579 - RNA, 22 nt, Homo sapiens
gagcccccagagcuggaccuga

SEQ ID NO: 491580 - RNA, 15 nt, Homo sapiens
gagccgagcucuccu

SEQ ID NO: 491581 - RNA, 22 nt, Homo sapiens
gagccuucuuguguaauguaaa

SEQ ID NO: 491582 - RNA, 23 nt, Homo sapiens
gagcuauucucacucggaccugg

SEQ ID NO: 491583 - RNA, 17 nt, Homo sapiens
gagcugaggacucucac

SEQ ID NO: 491584 - RNA, 13 nt, Homo sapiens
gagcuggaccuga

SEQ ID NO: 491585 - RNA, 17 nt, Homo sapiens
gagcuuucucaaugucu

SEQ ID NO: 491586 - RNA, 20 nt, Homo sapiens
gagcuuuugguaugugacau

SEQ ID NO: 491587 - RNA, 15 nt, Homo sapiens
gaggaauaaaaugau

SEQ ID NO: 491588 - RNA, 23 nt, Homo sapiens
gaggacucccugcuuagcucugu

SEQ ID NO: 491589 - RNA, 18 nt, Homo sapiens
gaggacucucacgauaug

SEQ ID NO: 491590 - RNA, 19 nt, Homo sapiens
gaggugagagaagaccucu

SEQ ID NO: 491591 - RNA, 14 nt, Homo sapiens
gagguguuuugcca

SEQ ID NO: 491592 - RNA, 18 nt, Homo sapiens
gaguagccccaacccaaa

SEQ ID NO: 491593 - RNA, 13 nt, Homo sapiens
gagugcaucccag

SEQ ID NO: 491594 - RNA, 23 nt, Homo sapiens
gaguuccacuucaacaaguaccu

SEQ ID NO: 491595 - RNA, 15 nt, Homo sapiens
gaguuccuucucacu

SEQ ID NO: 491596 - RNA, 16 nt, Homo sapiens
gauaaauaguguuauu

SEQ ID NO: 491597 - RNA, 18 nt, Homo sapiens
gauaaauuugacuguuau

SEQ ID NO: 491598 - RNA, 17 nt, Homo sapiens
gauaauuaaaugaaaua

SEQ ID NO: 491599 - RNA, 17 nt, Homo sapiens
gauaauucuggaccaga

SEQ ID NO: 491600 - RNA, 22 nt, Homo sapiens
gauagaauaaagccuugugauc

SEQ ID NO: 491601 - RNA, 19 nt, Homo sapiens
gauagauauccuuggcaca

SEQ ID NO: 491602 - RNA, 17 nt, Homo sapiens
gauaggaaggucauuuc

SEQ ID NO: 491603 - RNA, 14 nt, Homo sapiens
gaucaaauguacau

SEQ ID NO: 491604 - RNA, 15 nt, Homo sapiens
gaucagagauuuguc

SEQ ID NO: 491605 - RNA, 20 nt, Homo sapiens
gauccaggaacacaugcaca

SEQ ID NO: 491606 - RNA, 22 nt, Homo sapiens
gauccaggaacacaugcacaca

SEQ ID NO: 491607 - RNA, 21 nt, Homo sapiens
gaucucaauuugcaguauuca

SEQ ID NO: 491608 - RNA, 13 nt, Homo sapiens
gaucugaggacaa

SEQ ID NO: 491609 - RNA, 22 nt, Homo sapiens
gaugcacuauauguuuacacaa

SEQ ID NO: 491610 - RNA, 12 nt, Homo sapiens
gaugccucagag

SEQ ID NO: 491611 - RNA, 14 nt, Homo sapiens
gaugcugcugagca

SEQ ID NO: 491612 - RNA, 20 nt, Homo sapiens
gaugcugcugagcacaucuc

SEQ ID NO: 491613 - RNA, 13 nt, Homo sapiens
gauggagcuggag

SEQ ID NO: 491614 - RNA, 19 nt, Homo sapiens
gaugggguugggcucugcg

SEQ ID NO: 491615 - RNA, 20 nt, Homo sapiens
auaauuaaaugaaauacuug

SEQ ID NO: 491616 - RNA, 19 nt, Homo sapiens
auacaauauaucuugucua

SEQ ID NO: 491617 - RNA, 15 nt, Homo sapiens
auacacauacauaua

SEQ ID NO: 491618 - RNA, 14 nt, Homo sapiens
auacaugaugauuu

SEQ ID NO: 491619 - RNA, 20 nt, Homo sapiens
auacaugccuuuccagugcu

SEQ ID NO: 491620 - RNA, 22 nt, Homo sapiens
auaccucucaacuuacauaugu

SEQ ID NO: 491621 - RNA, 18 nt, Homo sapiens
auacucauuucuaaaaga

SEQ ID NO: 491622 - RNA, 21 nt, Homo sapiens
auagauauccuuggcacaucc

SEQ ID NO: 491623 - RNA, 22 nt, Homo sapiens
auagaugaguguuaaacuagau

SEQ ID NO: 491624 - RNA, 20 nt, Homo sapiens
auaggaucugaggacaagga

SEQ ID NO: 491625 - RNA, 17 nt, Homo sapiens
auaguauacacaucaua

SEQ ID NO: 491626 - RNA, 12 nt, Homo sapiens
auauaacugccu

SEQ ID NO: 491627 - RNA, 23 nt, Homo sapiens
auauaauggaagagaaaucucau

SEQ ID NO: 491628 - RNA, 13 nt, Homo sapiens
auauauaaacaga

SEQ ID NO: 491629 - RNA, 15 nt, Homo sapiens
auauauagugcuaua

SEQ ID NO: 491630 - RNA, 12 nt, Homo sapiens
auauaugcaaaa

SEQ ID NO: 491631 - RNA, 17 nt, Homo sapiens
auaucuaucagaguauc

SEQ ID NO: 491632 - RNA, 19 nt, Homo sapiens
auaucuaucagaguaucca

SEQ ID NO: 491633 - RNA, 15 nt, Homo sapiens
auaucuguggucuuc

SEQ ID NO: 491634 - RNA, 17 nt, Homo sapiens
auaugaaaacuaaguuc

SEQ ID NO: 491635 - RNA, 23 nt, Homo sapiens
auaugauccagagcagaguuuac

SEQ ID NO: 491636 - RNA, 22 nt, Homo sapiens
auauguaaacuuuaacuuccac

SEQ ID NO: 491637 - RNA, 14 nt, Homo sapiens
auauguacacugga

SEQ ID NO: 491638 - RNA, 16 nt, Homo sapiens
auauguccauaucuaa

SEQ ID NO: 491639 - RNA, 17 nt, Homo sapiens
auauguuuucacuguau

SEQ ID NO: 491640 - RNA, 18 nt, Homo sapiens
auauguuuucacuguauu

SEQ ID NO: 491641 - RNA, 17 nt, Homo sapiens
auauuagcgacaacaga

SEQ ID NO: 491642 - RNA, 12 nt, Homo sapiens
auauucccaugg

SEQ ID NO: 491643 - RNA, 20 nt, Homo sapiens
auauugaaaaugucacuguu

SEQ ID NO: 491644 - RNA, 18 nt, Homo sapiens
auauuuugucacugcugu

SEQ ID NO: 491645 - RNA, 12 nt, Homo sapiens
aucaaacagaaa

SEQ ID NO: 491646 - RNA, 22 nt, Homo sapiens
aucaagucugugaaagucuccu

SEQ ID NO: 491647 - RNA, 14 nt, Homo sapiens
aucaaguugcacac

SEQ ID NO: 491648 - RNA, 18 nt, Homo sapiens
aucacugaaaaugugcuc

SEQ ID NO: 491649 - RNA, 21 nt, Homo sapiens
aucacuuacagaaccaauuca

SEQ ID NO: 491650 - RNA, 16 nt, Homo sapiens
aucagaugccucagag

SEQ ID NO: 491651 - RNA, 21 nt, Homo sapiens
aucauaaccacccuagcuuua

SEQ ID NO: 491652 - RNA, 14 nt, Homo sapiens
aucaugcaugcacu

SEQ ID NO: 491653 - RNA, 17 nt, Homo sapiens
aucaugcaugcacucuu

SEQ ID NO: 491654 - RNA, 16 nt, Homo sapiens
auccaccugcacaaac

SEQ ID NO: 491655 - RNA, 23 nt, Homo sapiens
auccaccugcacaaacauagaca

SEQ ID NO: 491656 - RNA, 15 nt, Homo sapiens
auccacuucacaguu

SEQ ID NO: 491657 - RNA, 22 nt, Homo sapiens
auccagaaacuuguucuuccaa

SEQ ID NO: 491658 - RNA, 20 nt, Homo sapiens
auccagaugaaggaaaggaa

SEQ ID NO: 491659 - RNA, 17 nt, Homo sapiens
auccaggaacacaugca

SEQ ID NO: 491660 - RNA, 22 nt, Homo sapiens
auccaggaacacaugcacacac

SEQ ID NO: 491661 - RNA, 17 nt, Homo sapiens
auccaugcggccggccu

SEQ ID NO: 491662 - RNA, 23 nt, Homo sapiens
auccaugugcugcuguggcauca

SEQ ID NO: 491663 - RNA, 13 nt, Homo sapiens
auuucuaguagca

SEQ ID NO: 491664 - RNA, 14 nt, Homo sapiens
auuucucucuccag

SEQ ID NO: 491665 - RNA, 18 nt, Homo sapiens
auuucuguucacuuugua

SEQ ID NO: 491666 - RNA, 19 nt, Homo sapiens
auuucuuauuauuauaugu

SEQ ID NO: 491667 - RNA, 11 nt, Homo sapiens
auuugauguaa

SEQ ID NO: 491668 - RNA, 19 nt, Homo sapiens
auuugcauaauaugcauau

SEQ ID NO: 491669 - RNA, 15 nt, Homo sapiens
auuugcugcauuuca

SEQ ID NO: 491670 - RNA, 21 nt, Homo sapiens
auuuguccuuggggacaucuc

SEQ ID NO: 491671 - RNA, 23 nt, Homo sapiens
auuuucaaauauguaaacuuuaa

SEQ ID NO: 491672 - RNA, 18 nt, Homo sapiens
auuuucagauuugcacaa

SEQ ID NO: 491673 - RNA, 15 nt, Homo sapiens
auuuuggacguguga

SEQ ID NO: 491674 - RNA, 18 nt, Homo sapiens
auuuuggagagauaggaa

SEQ ID NO: 491675 - RNA, 13 nt, Homo sapiens
auuuugucacugc

SEQ ID NO: 491676 - RNA, 15 nt, Homo sapiens
auuuuucaaggcauu

SEQ ID NO: 491677 - RNA, 20 nt, Homo sapiens
auuuuuuaagguaacaaaua

SEQ ID NO: 491678 - RNA, 20 nt, Homo sapiens
auuuuuuaauuacaauggaa

SEQ ID NO: 491679 - RNA, 12 nt, Homo sapiens
caaaacauugaa

SEQ ID NO: 491680 - RNA, 14 nt, Homo sapiens
caaaagaugccauu

SEQ ID NO: 491681 - RNA, 23 nt, Homo sapiens
caaaagucaccacuccauuccca

SEQ ID NO: 491682 - RNA, 18 nt, Homo sapiens
caaaauaaaaagugacac

SEQ ID NO: 491683 - RNA, 14 nt, Homo sapiens
caaaauccuugccu

SEQ ID NO: 491684 - RNA, 19 nt, Homo sapiens
caaaauuuuauaagcaaau

SEQ ID NO: 491685 - RNA, 18 nt, Homo sapiens
caaacaauuaacugagca

SEQ ID NO: 491686 - RNA, 18 nt, Homo sapiens
caaacuuacuuaauauca

SEQ ID NO: 491687 - RNA, 23 nt, Homo sapiens
caaagaucaaaauaaaaagugac

SEQ ID NO: 491688 - RNA, 20 nt, Homo sapiens
caaagcagagugaaauucaa

SEQ ID NO: 491689 - RNA, 16 nt, Homo sapiens
caaaggcuucuuggcu

SEQ ID NO: 491690 - RNA, 14 nt, Homo sapiens
caaauacacauaca

SEQ ID NO: 491691 - RNA, 15 nt, Homo sapiens
caaauacacauacau

SEQ ID NO: 491692 - RNA, 17 nt, Homo sapiens
caaauccuuuauuauua

SEQ ID NO: 491693 - RNA, 19 nt, Homo sapiens
caaaugccuuucuagcaau

SEQ ID NO: 491694 - RNA, 19 nt, Homo sapiens
caaauggcuuguucaguca

SEQ ID NO: 491695 - RNA, 14 nt, Homo sapiens
caaaugguacaaaa

SEQ ID NO: 491696 - RNA, 15 nt, Homo sapiens
caaaugucuacugaa

SEQ ID NO: 491697 - RNA, 18 nt, Homo sapiens
caacagaaacaugccaga

SEQ ID NO: 491698 - RNA, 10 nt, Homo sapiens
caacauaaaa

SEQ ID NO: 491699 - RNA, 19 nt, Homo sapiens
caacauccucagaaccauu

SEQ ID NO: 491700 - RNA, 21 nt, Homo sapiens
caacauggugaaaccccaucu

SEQ ID NO: 491701 - RNA, 16 nt, Homo sapiens
caacaugugugacugc

SEQ ID NO: 491702 - RNA, 16 nt, Homo sapiens
caacccaaggcaauga

SEQ ID NO: 491703 - RNA, 12 nt, Homo sapiens
caacccaugagu

SEQ ID NO: 491704 - RNA, 16 nt, Homo sapiens
caacccaugagugcua

SEQ ID NO: 491705 - RNA, 21 nt, Homo sapiens
caacuaaaaaaaaugcaagga

SEQ ID NO: 491706 - RNA, 14 nt, Homo sapiens
caacuacuacuuga

SEQ ID NO: 491707 - RNA, 23 nt, Homo sapiens
caacucagagcacagccaaucuc

SEQ ID NO: 491708 - RNA, 23 nt, Homo sapiens
caacuuuuccaacauacaauuua

SEQ ID NO: 491709 - RNA, 18 nt, Homo sapiens
caagacccccaggaagga

SEQ ID NO: 491710 - RNA, 22 nt, Homo sapiens
caagacuguaaauuccaaagau

SEQ ID NO: 491711 - RNA, 22 nt, Homo sapiens
caagagagggccaugcaauuca

SEQ ID NO: 491712 - RNA, 17 nt, Homo sapiens
caagcccagccuaucuc

SEQ ID NO: 491713 - RNA, 16 nt, Homo sapiens
caaggaaauuccucag

SEQ ID NO: 491714 - RNA, 21 nt, Homo sapiens
caaguagguuuacauuacuga

SEQ ID NO: 491715 - RNA, 14 nt, Homo sapiens
caagugaaggagcu

SEQ ID NO: 491716 - RNA, 16 nt, Homo sapiens
caaguucacaccugca

SEQ ID NO: 491717 - RNA, 14 nt, Homo sapiens
caaguugcacacuc

SEQ ID NO: 491718 - RNA, 16 nt, Homo sapiens
caauaaaagaaacugu

SEQ ID NO: 491719 - RNA, 19 nt, Homo sapiens
caauauuugugugcuaaac

SEQ ID NO: 491720 - RNA, 17 nt, Homo sapiens
caaucaucuauugagug

SEQ ID NO: 491721 - RNA, 16 nt, Homo sapiens
caaucgggaguagcaa

SEQ ID NO: 491722 - RNA, 18 nt, Homo sapiens
caaucuccaggcucccuc

SEQ ID NO: 491723 - RNA, 21 nt, Homo sapiens
caaugauuauuuucauuacaa

SEQ ID NO: 491724 - RNA, 17 nt, Homo sapiens
caaugcacauccauucc

SEQ ID NO: 491725 - RNA, 19 nt, Homo sapiens
caaugcacauccauuccca

SEQ ID NO: 491726 - RNA, 11 nt, Homo sapiens
caaugucuucc

SEQ ID NO: 491727 - RNA, 15 nt, Homo sapiens
caauucccauugcau

SEQ ID NO: 491728 - RNA, 13 nt, Homo sapiens
caauuuauugcac

SEQ ID NO: 491729 - RNA, 13 nt, Homo sapiens
caauuucuuccuu

SEQ ID NO: 491730 - RNA, 12 nt, Homo sapiens
caauuugcacuu

SEQ ID NO: 491731 - RNA, 15 nt, Homo sapiens
cacaaagcuauuuaa

SEQ ID NO: 491732 - RNA, 20 nt, Homo sapiens
cacaagaacaaauacacuuu

SEQ ID NO: 491733 - RNA, 21 nt, Homo sapiens
cacaagguugcuggcauuugc

SEQ ID NO: 491734 - RNA, 12 nt, Homo sapiens
cacacaauggau

SEQ ID NO: 491735 - RNA, 14 nt, Homo sapiens
cacacaucucauuu

SEQ ID NO: 491736 - RNA, 17 nt, Homo sapiens
cacacugaguucuauca

SEQ ID NO: 491737 - RNA, 22 nt, Homo sapiens
cacagacacacaagcagacaca

SEQ ID NO: 491738 - RNA, 22 nt, Homo sapiens
cacagagggccccucucuccac

SEQ ID NO: 491739 - RNA, 11 nt, Homo sapiens
cacagccaaac

SEQ ID NO: 491740 - RNA, 20 nt, Homo sapiens
cacaguugagugcaucccag

SEQ ID NO: 491741 - RNA, 18 nt, Homo sapiens
cacauccaacuacuccua

SEQ ID NO: 491742 - RNA, 17 nt, Homo sapiens
cacaucccaucgucucg

SEQ ID NO: 491743 - RNA, 12 nt, Homo sapiens
cacaucuuccac

SEQ ID NO: 491744 - RNA, 15 nt, Homo sapiens
cacaucuuguaacuu

SEQ ID NO: 491745 - RNA, 15 nt, Homo sapiens
cacaugcacacacac

SEQ ID NO: 491746 - RNA, 19 nt, Homo sapiens
cacauguuuucaaauggag

SEQ ID NO: 491747 - RNA, 17 nt, Homo sapiens
cacauugaaacuguauu

SEQ ID NO: 491748 - RNA, 12 nt, Homo sapiens
caccaaguacaa

SEQ ID NO: 491749 - RNA, 14 nt, Homo sapiens
caccacagacacac

SEQ ID NO: 491750 - RNA, 14 nt, Homo sapiens
caccacgugccaag

SEQ ID NO: 491751 - RNA, 19 nt, Homo sapiens
caccacgugccaaggagcu

SEQ ID NO: 491752 - RNA, 20 nt, Homo sapiens
caccagagcauuuccaacac

SEQ ID NO: 491753 - RNA, 18 nt, Homo sapiens
caccagaugugacagugu

SEQ ID NO: 491754 - RNA, 22 nt, Homo sapiens
caccgagaggaaaaaggcuucu

SEQ ID NO: 491755 - RNA, 14 nt, Homo sapiens
caccucugcaccuu

SEQ ID NO: 491756 - RNA, 18 nt, Homo sapiens
caccugagcugcugcaug

SEQ ID NO: 491757 - RNA, 19 nt, Homo sapiens
caccugagcugcugcauga

SEQ ID NO: 491758 - RNA, 19 nt, Homo sapiens
caccugcacaaacauagac

SEQ ID NO: 491759 - RNA, 23 nt, Homo sapiens
caccugguuccggaauccugucc

SEQ ID NO: 491760 - RNA, 19 nt, Homo sapiens
caccuguacuggagagcaa

SEQ ID NO: 491761 - RNA, 21 nt, Homo sapiens
caccuucccuaguucuuugca

SEQ ID NO: 491762 - RNA, 19 nt, Homo sapiens
caccuugcccaugcacaag

SEQ ID NO: 491763 - RNA, 13 nt, Homo sapiens
caccuuugcacgu

SEQ ID NO: 491764 - RNA, 20 nt, Homo sapiens
cacgcacacacacaaacaca

SEQ ID NO: 491765 - RNA, 18 nt, Homo sapiens
cacgccacaacuccagug

SEQ ID NO: 491766 - RNA, 19 nt, Homo sapiens
cacgccacaacuccagugu

SEQ ID NO: 491767 - RNA, 19 nt, Homo sapiens
cacgccugguucuguacau

SEQ ID NO: 491768 - RNA, 22 nt, Homo sapiens
cacgccugguucuguacaugug

SEQ ID NO: 491769 - RNA, 18 nt, Homo sapiens
cacuauucagaagacaca

SEQ ID NO: 491770 - RNA, 20 nt, Homo sapiens
cacucucuucuuacuguauu

SEQ ID NO: 491771 - RNA, 14 nt, Homo sapiens
cacugaaguuugau

SEQ ID NO: 491772 - RNA, 11 nt, Homo sapiens
cacuguauuca

SEQ ID NO: 491773 - RNA, 21 nt, Homo sapiens
cacugucccggagcucaggcc

SEQ ID NO: 491774 - RNA, 22 nt, Homo sapiens
cacuuacagaaccaauucacuu

SEQ ID NO: 491775 - RNA, 16 nt, Homo sapiens
cacuuccuugccaguc

SEQ ID NO: 491776 - RNA, 14 nt, Homo sapiens
cacuuguauaaaug

SEQ ID NO: 491777 - RNA, 20 nt, Homo sapiens
cacuuucccacacugugaac

SEQ ID NO: 491778 - RNA, 17 nt, Homo sapiens
cacuuucugaaauucac

SEQ ID NO: 491779 - RNA, 17 nt, Homo sapiens
cacuuugcaaagacagu

SEQ ID NO: 491780 - RNA, 12 nt, Homo sapiens
cagaaaauuaca

SEQ ID NO: 491781 - RNA, 22 nt, Homo sapiens
cagaaacccggcuuccugugcu

SEQ ID NO: 491782 - RNA, 22 nt, Homo sapiens
cagaaagggauugcuuugcauu

SEQ ID NO: 491783 - RNA, 12 nt, Homo sapiens
cagaaccauuca

SEQ ID NO: 491784 - RNA, 18 nt, Homo sapiens
cagaagcaguugcaauaa

SEQ ID NO: 491785 - RNA, 17 nt, Homo sapiens
cagaaggaaucuucuca

SEQ ID NO: 491786 - RNA, 14 nt, Homo sapiens
cagaauacuagcca

SEQ ID NO: 491787 - RNA, 17 nt, Homo sapiens
cagaauggggacaucuu

SEQ ID NO: 491788 - RNA, 14 nt, Homo sapiens
cagacaaaauuacu

SEQ ID NO: 491789 - RNA, 22 nt, Homo sapiens
cagacacacacacgcacgcaca

SEQ ID NO: 491790 - RNA, 15 nt, Homo sapiens
cagacaccuagacuc

SEQ ID NO: 491791 - RNA, 14 nt, Homo sapiens
cagacacucugacu

SEQ ID NO: 491792 - RNA, 20 nt, Homo sapiens
cagacacucugacuaccucc

SEQ ID NO: 491793 - RNA, 15 nt, Homo sapiens
cagaccaggugaccu

SEQ ID NO: 491794 - RNA, 19 nt, Homo sapiens
cagaccaguagugaccaau

SEQ ID NO: 491795 - RNA, 15 nt, Homo sapiens
cagagacccccgugc

SEQ ID NO: 491796 - RNA, 16 nt, Homo sapiens
cagagaggacuguuga

SEQ ID NO: 491797 - RNA, 13 nt, Homo sapiens
cagaggcuuccag

SEQ ID NO: 491798 - RNA, 16 nt, Homo sapiens
cagagguugcagugag

SEQ ID NO: 491799 - RNA, 20 nt, Homo sapiens
cagagguugcagugagcuga

SEQ ID NO: 491800 - RNA, 17 nt, Homo sapiens
cagagucaagcugauga

SEQ ID NO: 491801 - RNA, 19 nt, Homo sapiens
caguagucaccuaugucug

SEQ ID NO: 491802 - RNA, 19 nt, Homo sapiens
cagucaaggaguggcuuac

SEQ ID NO: 491803 - RNA, 15 nt, Homo sapiens
cagucuggugcccag

SEQ ID NO: 491804 - RNA, 14 nt, Homo sapiens
cagugauuucggac

SEQ ID NO: 491805 - RNA, 13 nt, Homo sapiens
cagugccuaacuc

SEQ ID NO: 491806 - RNA, 21 nt, Homo sapiens
cagugggaaacaaacugucua

SEQ ID NO: 491807 - RNA, 20 nt, Homo sapiens
caguguacucugaguccuca

SEQ ID NO: 491808 - RNA, 17 nt, Homo sapiens
caguguuacaaggguau

SEQ ID NO: 491809 - RNA, 18 nt, Homo sapiens
caguucccucagcccuca

SEQ ID NO: 491810 - RNA, 19 nt, Homo sapiens
caguucccucagcccucau

SEQ ID NO: 491811 - RNA, 15 nt, Homo sapiens
caguucuaaccuccu

SEQ ID NO: 491812 - RNA, 13 nt, Homo sapiens
caguucugaugag

SEQ ID NO: 491813 - RNA, 15 nt, Homo sapiens
caguuugugaucugu

SEQ ID NO: 491814 - RNA, 18 nt, Homo sapiens
cauaaccgcacagacauu

SEQ ID NO: 491815 - RNA, 18 nt, Homo sapiens
cauaagggagauuguaua

SEQ ID NO: 491816 - RNA, 18 nt, Homo sapiens
cauaaguaagacuugauu

SEQ ID NO: 491817 - RNA, 13 nt, Homo sapiens
cauaauacauuaa

SEQ ID NO: 491818 - RNA, 13 nt, Homo sapiens
cauaauaugcaua

SEQ ID NO: 491819 - RNA, 15 nt, Homo sapiens
cauaauaugcauaua

SEQ ID NO: 491820 - RNA, 16 nt, Homo sapiens
cauacaauuuacuuuu

SEQ ID NO: 491821 - RNA, 13 nt, Homo sapiens
cauaccaaagcug

SEQ ID NO: 491822 - RNA, 13 nt, Homo sapiens
cauacugcauaca

SEQ ID NO: 491823 - RNA, 13 nt, Homo sapiens
cauagcuugcaca

SEQ ID NO: 491824 - RNA, 23 nt, Homo sapiens
cauagcuugcacaacauccucag

SEQ ID NO: 491825 - RNA, 16 nt, Homo sapiens
cauaguggaucacuca

SEQ ID NO: 491826 - RNA, 23 nt, Homo sapiens
cauauuuucacagguguggugua

SEQ ID NO: 491827 - RNA, 19 nt, Homo sapiens
cauauuuuuuuuacuguca

SEQ ID NO: 491828 - RNA, 12 nt, Homo sapiens
caucaaagcccu

SEQ ID NO: 491829 - RNA, 13 nt, Homo sapiens
caucaaagcccuc

SEQ ID NO: 491830 - RNA, 19 nt, Homo sapiens
caucagucuuaauauucag

SEQ ID NO: 491831 - RNA, 17 nt, Homo sapiens
cauccacuucacaguuc

SEQ ID NO: 491832 - RNA, 18 nt, Homo sapiens
caucccacgcuugcuuua

SEQ ID NO: 491833 - RNA, 15 nt, Homo sapiens
caucccugcagcuca

SEQ ID NO: 491834 - RNA, 21 nt, Homo sapiens
caucgguucaggaggagacag

SEQ ID NO: 491835 - RNA, 16 nt, Homo sapiens
caucuagucucagugc

SEQ ID NO: 491836 - RNA, 13 nt, Homo sapiens
caucucuguaaaa

SEQ ID NO: 491837 - RNA, 17 nt, Homo sapiens
caucugagagaggcuaa

SEQ ID NO: 491838 - RNA, 17 nt, Homo sapiens
caugaacagcucugaga

SEQ ID NO: 491839 - RNA, 19 nt, Homo sapiens
caugaaggucuaccugaaa

SEQ ID NO: 491840 - RNA, 18 nt, Homo sapiens
caugacccguacacacca

SEQ ID NO: 491841 - RNA, 11 nt, Homo sapiens
caugcacacac

SEQ ID NO: 491842 - RNA, 13 nt, Homo sapiens
caugcacccgcau

SEQ ID NO: 491843 - RNA, 20 nt, Homo sapiens
caugcacucuuuugagcagu

SEQ ID NO: 491844 - RNA, 18 nt, Homo sapiens
caugcagacccucagacc

SEQ ID NO: 491845 - RNA, 14 nt, Homo sapiens
caugccagaaggaa

SEQ ID NO: 491846 - RNA, 22 nt, Homo sapiens
caugcccagccccugguggugg

SEQ ID NO: 491847 - RNA, 15 nt, Homo sapiens
cauggaucugcauaa

SEQ ID NO: 491848 - RNA, 16 nt, Homo sapiens
cauggcacauaccaaa

SEQ ID NO: 491849 - RNA, 21 nt, Homo sapiens
cauggcguaucaggaaagcau

SEQ ID NO: 491850 - RNA, 22 nt, Homo sapiens
cauggcucauucugcaaugagc

SEQ ID NO: 491851 - RNA, 13 nt, Homo sapiens
caugguaucucuu

SEQ ID NO: 491852 - RNA, 16 nt, Homo sapiens
caugguuaaugcaggc

SEQ ID NO: 491853 - RNA, 16 nt, Homo sapiens
cauguacaaaaacaca

SEQ ID NO: 491854 - RNA, 22 nt, Homo sapiens
cauguacuauggaaaaguacaa

SEQ ID NO: 491855 - RNA, 20 nt, Homo sapiens
caugucacuucccugcuuaa

SEQ ID NO: 491856 - RNA, 12 nt, Homo sapiens
caugugaaggga

SEQ ID NO: 491857 - RNA, 18 nt, Homo sapiens
caugugcugcuguggcau

SEQ ID NO: 491858 - RNA, 19 nt, Homo sapiens
cauguggcuaaaugccuaa

SEQ ID NO: 491859 - RNA, 23 nt, Homo sapiens
cauuaaacuaauuaaacugaugg

SEQ ID NO: 491860 - RNA, 18 nt, Homo sapiens
cauuaaaucuugaacuuu

SEQ ID NO: 491861 - RNA, 22 nt, Homo sapiens
cauuaccaagaaacaguagcca

SEQ ID NO: 491862 - RNA, 15 nt, Homo sapiens
cauuaccuguagcuu

SEQ ID NO: 491863 - RNA, 21 nt, Homo sapiens
cauuauagauuuucauguucu

SEQ ID NO: 491864 - RNA, 21 nt, Homo sapiens
cauuaugugugcaugugugua

SEQ ID NO: 491865 - RNA, 17 nt, Homo sapiens
cauuccagucaagcaga

SEQ ID NO: 491866 - RNA, 21 nt, Homo sapiens
cauucccuggaauugccacau

SEQ ID NO: 491867 - RNA, 17 nt, Homo sapiens
cauuccgagauuuuaaa

SEQ ID NO: 491868 - RNA, 22 nt, Homo sapiens
cauucguccuuagaauacugua

SEQ ID NO: 491869 - RNA, 23 nt, Homo sapiens
cauucguccuuagaauacuguau

SEQ ID NO: 491870 - RNA, 12 nt, Homo sapiens
cauucugcaaug

SEQ ID NO: 491871 - RNA, 14 nt, Homo sapiens
cauugaaacuguau

SEQ ID NO: 491872 - RNA, 15 nt, Homo sapiens
cauugaaacuguauu

SEQ ID NO: 491873 - RNA, 22 nt, Homo sapiens
cauugauugguaguucgaagaa

SEQ ID NO: 491874 - RNA, 13 nt, Homo sapiens
cauuguccagagc

SEQ ID NO: 491875 - RNA, 22 nt, Homo sapiens
cauuguucagaaaagcaccucu

SEQ ID NO: 491876 - RNA, 13 nt, Homo sapiens
cauuuauguguga

SEQ ID NO: 491877 - RNA, 12 nt, Homo sapiens
cauuugguacac

SEQ ID NO: 491878 - RNA, 19 nt, Homo sapiens
cauuugguacacacuugac

SEQ ID NO: 491879 - RNA, 20 nt, Homo sapiens
cauuugguacacacuugacc

SEQ ID NO: 491880 - RNA, 19 nt, Homo sapiens
cauuuucugaaacuaauga

SEQ ID NO: 491881 - RNA, 22 nt, Homo sapiens
ccaaagcacaugcuuagcuuau

SEQ ID NO: 491882 - RNA, 22 nt, Homo sapiens
ccaaagcccacucacccuuuga

SEQ ID NO: 491883 - RNA, 17 nt, Homo sapiens
ccaaagcugcugcacag

SEQ ID NO: 491884 - RNA, 14 nt, Homo sapiens
ccaaaggacauuau

SEQ ID NO: 491885 - RNA, 17 nt, Homo sapiens
ccaaaggccaacagcau

SEQ ID NO: 491886 - RNA, 23 nt, Homo sapiens
ccaaaugaguucccuugauucaa

SEQ ID NO: 491887 - RNA, 13 nt, Homo sapiens
cggaaaugauuga

SEQ ID NO: 491888 - RNA, 17 nt, Homo sapiens
cggaaccugugagcugc

SEQ ID NO: 491889 - RNA, 16 nt, Homo sapiens
cggaccgaaggugaca

SEQ ID NO: 491890 - RNA, 16 nt, Homo sapiens
cgggcauacguuuucu

SEQ ID NO: 491891 - RNA, 12 nt, Homo sapiens
cgggcuuuucac

SEQ ID NO: 491892 - RNA, 18 nt, Homo sapiens
cgucccacugagucucau

SEQ ID NO: 491893 - RNA, 17 nt, Homo sapiens
cgucccuccacguucac

SEQ ID NO: 491894 - RNA, 18 nt, Homo sapiens
cguccuuagaauacugua

SEQ ID NO: 491895 - RNA, 21 nt, Homo sapiens
cgugggucuucagggggccag

SEQ ID NO: 491896 - RNA, 19 nt, Homo sapiens
cguguauucaggaccccau

SEQ ID NO: 491897 - RNA, 19 nt, Homo sapiens
cuaaaaaaaaugcaaggaa

SEQ ID NO: 491898 - RNA, 23 nt, Homo sapiens
cuaaacccuucaacuaugcaaug

SEQ ID NO: 491899 - RNA, 15 nt, Homo sapiens
cuaaaguacugagca

SEQ ID NO: 491900 - RNA, 12 nt, Homo sapiens
cuaaaguagacu

SEQ ID NO: 491901 - RNA, 16 nt, Homo sapiens
cuaaauauuaugccuu

SEQ ID NO: 491902 - RNA, 21 nt, Homo sapiens
cuaacaggauuagacagucaa

SEQ ID NO: 491903 - RNA, 23 nt, Homo sapiens
cuaacucaaaucaggaacuguau

SEQ ID NO: 491904 - RNA, 13 nt, Homo sapiens
cuaacuucuaaaa

SEQ ID NO: 491905 - RNA, 14 nt, Homo sapiens
cuaacuugcuuaaa

SEQ ID NO: 491906 - RNA, 21 nt, Homo sapiens
cuaagauaauuaaaugaaaua

SEQ ID NO: 491907 - RNA, 13 nt, Homo sapiens
cuaaguagaguau

SEQ ID NO: 491908 - RNA, 16 nt, Homo sapiens
cuaaucgaaugaacaa

SEQ ID NO: 491909 - RNA, 21 nt, Homo sapiens
cuaaugguaacuuuuguaguc

SEQ ID NO: 491910 - RNA, 21 nt, Homo sapiens
cuacaauacaacacauugaaa

SEQ ID NO: 491911 - RNA, 16 nt, Homo sapiens
cuacagaacacuuugc

SEQ ID NO: 491912 - RNA, 23 nt, Homo sapiens
cuacaggggaggcugagacgcaa

SEQ ID NO: 491913 - RNA, 22 nt, Homo sapiens
cuacaucucguauggauuucua

SEQ ID NO: 491914 - RNA, 15 nt, Homo sapiens
cuaccaaagcccacu

SEQ ID NO: 491915 - RNA, 17 nt, Homo sapiens
cuaccccuuucuucucg

SEQ ID NO: 491916 - RNA, 22 nt, Homo sapiens
cuacccuauucuauccaucucc

SEQ ID NO: 491917 - RNA, 15 nt, Homo sapiens
cuaccuucuuuccag

SEQ ID NO: 491918 - RNA, 19 nt, Homo sapiens
cuacuuuaaauuguggaug

SEQ ID NO: 491919 - RNA, 14 nt, Homo sapiens
cuagccggagugac

SEQ ID NO: 491920 - RNA, 16 nt, Homo sapiens
cuaggcagacaccagg

SEQ ID NO: 491921 - RNA, 16 nt, Homo sapiens
cuagugucuuuugccu

SEQ ID NO: 491922 - RNA, 13 nt, Homo sapiens
cuauaauaccagc

SEQ ID NO: 491923 - RNA, 15 nt, Homo sapiens
cuauauacaugugug

SEQ ID NO: 491924 - RNA, 17 nt, Homo sapiens
cuauauacaugugugua

SEQ ID NO: 491925 - RNA, 15 nt, Homo sapiens
cuauccuauguuaaa

SEQ ID NO: 491926 - RNA, 22 nt, Homo sapiens
cuaucuucauaucuaucagagu

SEQ ID NO: 491927 - RNA, 18 nt, Homo sapiens
cuaugaagaaaacagcug

SEQ ID NO: 491928 - RNA, 22 nt, Homo sapiens
cuaugaagaaaacagcugcaug

SEQ ID NO: 491929 - RNA, 19 nt, Homo sapiens
cuaugaaguuggcacauuu

SEQ ID NO: 491930 - RNA, 21 nt, Homo sapiens
cuaugguguguuguaucuuug

SEQ ID NO: 491931 - RNA, 16 nt, Homo sapiens
cuauuuuggacgugug

SEQ ID NO: 491932 - RNA, 19 nt, Homo sapiens
cucaaaggagccuuuucaa

SEQ ID NO: 491933 - RNA, 18 nt, Homo sapiens
cucaaaugcuacucagua

SEQ ID NO: 491934 - RNA, 22 nt, Homo sapiens
cucaacuuacauaugucuucaa

SEQ ID NO: 491935 - RNA, 20 nt, Homo sapiens
cucaagccggaaacucggca

SEQ ID NO: 491936 - RNA, 18 nt, Homo sapiens
cucacacaaucagaccaa

SEQ ID NO: 491937 - RNA, 17 nt, Homo sapiens
cucacugaaaauuacag

SEQ ID NO: 491938 - RNA, 15 nt, Homo sapiens
cucacugguuuucaa

SEQ ID NO: 491939 - RNA, 13 nt, Homo sapiens
cucagaaagggau

SEQ ID NO: 491940 - RNA, 15 nt, Homo sapiens
cucagagcacagcca

SEQ ID NO: 491941 - RNA, 17 nt, Homo sapiens
cucagcaaacccaaaga

SEQ ID NO: 491942 - RNA, 21 nt, Homo sapiens
cucauccaucaaguugcacac

SEQ ID NO: 491943 - RNA, 16 nt, Homo sapiens
cucauggaucugcaua

SEQ ID NO: 491944 - RNA, 21 nt, Homo sapiens
cucauuagcugaauugagcua

SEQ ID NO: 491945 - RNA, 15 nt, Homo sapiens
cucauucugcaauga

SEQ ID NO: 491946 - RNA, 21 nt, Homo sapiens
uuguaagaaaaugagacaaaa

SEQ ID NO: 491947 - RNA, 15 nt, Homo sapiens
uuguaaguacucuaa

SEQ ID NO: 491948 - RNA, 21 nt, Homo sapiens
uuguaauauuuugcugcugaa

SEQ ID NO: 491949 - RNA, 18 nt, Homo sapiens
uuguauccuccauuguau

SEQ ID NO: 491950 - RNA, 16 nt, Homo sapiens
uuguauggaagccacc

SEQ ID NO: 491951 - RNA, 16 nt, Homo sapiens
uugugagccuaugaua

SEQ ID NO: 491952 - RNA, 16 nt, Homo sapiens
uugugguaaacaaaga

SEQ ID NO: 491953 - RNA, 17 nt, Homo sapiens
uuguguacaaaauaucc

SEQ ID NO: 491954 - RNA, 19 nt, Homo sapiens
uugugugugugugcaguga

SEQ ID NO: 491955 - RNA, 12 nt, Homo sapiens
uuguuaauuucu

SEQ ID NO: 491956 - RNA, 21 nt, Homo sapiens
uuguuauccuguuuuugcaaa

SEQ ID NO: 491957 - RNA, 15 nt, Homo sapiens
uuguucuuacaguua

SEQ ID NO: 491958 - RNA, 16 nt, Homo sapiens
uuguuuuaaguuuacu

SEQ ID NO: 491959 - RNA, 14 nt, Homo sapiens
uuuaaaagucacau

SEQ ID NO: 491960 - RNA, 16 nt, Homo sapiens
uuuaaaagucacauaa

SEQ ID NO: 491961 - RNA, 18 nt, Homo sapiens
uuuaaagaaaaguucuua

SEQ ID NO: 491962 - RNA, 23 nt, Homo sapiens
uuuaaagagcaggauagcucuuc

SEQ ID NO: 491963 - RNA, 13 nt, Homo sapiens
uuuaaagucagau

SEQ ID NO: 491964 - RNA, 16 nt, Homo sapiens
uuuaacauacaaucau

SEQ ID NO: 491965 - RNA, 18 nt, Homo sapiens
uuuaacugauuacuguag

SEQ ID NO: 491966 - RNA, 16 nt, Homo sapiens
uuuaaucccacuugcc

SEQ ID NO: 491967 - RNA, 15 nt, Homo sapiens
uuuacaaggugacaa

SEQ ID NO: 491968 - RNA, 12 nt, Homo sapiens
uuuacagucucu

SEQ ID NO: 491969 - RNA, 20 nt, Homo sapiens
uuuacauuacugauuuccag

SEQ ID NO: 491970 - RNA, 16 nt, Homo sapiens
uuuaccuugcauuuua

SEQ ID NO: 491971 - RNA, 13 nt, Homo sapiens
uuuacuauuuuag

SEQ ID NO: 491972 - RNA, 22 nt, Homo sapiens
uuuagauuuauuuuuucaucuc

SEQ ID NO: 491973 - RNA, 17 nt, Homo sapiens
uuuagcagaaucaaaau

SEQ ID NO: 491974 - RNA, 18 nt, Homo sapiens
uuuaggauugaaguggcu

SEQ ID NO: 491975 - RNA, 23 nt, Homo sapiens
uuuauaaccaacauuuuguugcu

SEQ ID NO: 491976 - RNA, 20 nt, Homo sapiens
uuuauaugauuaaauuauca

SEQ ID NO: 491977 - RNA, 22 nt, Homo sapiens
uuucaaauauguaaacuuuaac

SEQ ID NO: 491978 - RNA, 15 nt, Homo sapiens
uuucagcuacauaua

SEQ ID NO: 491979 - RNA, 14 nt, Homo sapiens
uuucauaagcacau

SEQ ID NO: 491980 - RNA, 15 nt, Homo sapiens
uuucauauucucaga

SEQ ID NO: 491981 - RNA, 20 nt, Homo sapiens
uuucauuuugagaacauucc

SEQ ID NO: 491982 - RNA, 22 nt, Homo sapiens
uuuccagucauaccaacuuuag

SEQ ID NO: 491983 - RNA, 23 nt, Homo sapiens
uuuccugaugugacgcacuguau

SEQ ID NO: 491984 - RNA, 19 nt, Homo sapiens
uuuccugcuccuccaguac

SEQ ID NO: 491985 - RNA, 19 nt, Homo sapiens
uuuccuucuacuuacacau

SEQ ID NO: 491986 - RNA, 15 nt, Homo sapiens
uuucggaaaugauug

SEQ ID NO: 491987 - RNA, 17 nt, Homo sapiens
uuucuaacucugaugua

SEQ ID NO: 491988 - RNA, 13 nt, Homo sapiens
uuucuaguagcac

SEQ ID NO: 491989 - RNA, 21 nt, Homo sapiens
uuucucugcaggccacuuacc

SEQ ID NO: 491990 - RNA, 22 nt, Homo sapiens
uuucugcaaugguuuaguggcu

SEQ ID NO: 491991 - RNA, 19 nt, Homo sapiens
uuucugcgggucauauuca

SEQ ID NO: 491992 - RNA, 22 nt, Homo sapiens
uuugaauaaggaaaaacagagu

SEQ ID NO: 491993 - RNA, 13 nt, Homo sapiens
uuugagaacauuc

SEQ ID NO: 491994 - RNA, 17 nt, Homo sapiens
uuugagaacauucccug

SEQ ID NO: 491995 - RNA, 15 nt, Homo sapiens
uuugagagugauucu

SEQ ID NO: 491996 - RNA, 23 nt, Homo sapiens
uuugcacaaaaagauaccuuaaa

SEQ ID NO: 491997 - RNA, 13 nt, Homo sapiens
uuugcacuuucag

SEQ ID NO: 491998 - RNA, 18 nt, Homo sapiens
uuugcauaauaugcauau

SEQ ID NO: 491999 - RNA, 22 nt, Homo sapiens
uuugcgugaaaguguuacauau

SEQ ID NO: 492000 - RNA, 20 nt, Homo sapiens
uuugcuuguguuuauuacug

SEQ ID NO: 492001 - RNA, 15 nt, Homo sapiens
uuuggccagugacau

SEQ ID NO: 492002 - RNA, 22 nt, Homo sapiens
uuuggcucauuagcugaauuga

SEQ ID NO: 492003 - RNA, 20 nt, Homo sapiens
uuugggcucccaaaacaccu

SEQ ID NO: 492004 - RNA, 20 nt, Homo sapiens
uuugggggugcuaauccagg

SEQ ID NO: 492005 - RNA, 18 nt, Homo sapiens
uuuguaccuaaguggaua

SEQ ID NO: 492006 - RNA, 22 nt, Homo sapiens
uuuguauagaguucaucccagc

SEQ ID NO: 492007 - RNA, 14 nt, Homo sapiens
uuugucacugcugu

SEQ ID NO: 492008 - RNA, 12 nt, Homo sapiens
uuugucugugau

SEQ ID NO: 492009 - RNA, 17 nt, Homo sapiens
uuuguuuuaaacuguga

SEQ ID NO: 492010 - RNA, 12 nt, Homo sapiens
uuuuaaagucag

SEQ ID NO: 492011 - RNA, 22 nt, Homo sapiens
uuuuauaccuguacacacacag

SEQ ID NO: 492012 - RNA, 14 nt, Homo sapiens
uuuuauugccuuga

SEQ ID NO: 492013 - RNA, 18 nt, Homo sapiens
uuuucaccauaauuuaau

SEQ ID NO: 492014 - RNA, 20 nt, Homo sapiens
uuuucauuagcaaaaaaagu

SEQ ID NO: 492015 - RNA, 21 nt, Homo sapiens
uuuuccuucuacuuacacauc

SEQ ID NO: 492016 - RNA, 21 nt, Homo sapiens
uuuucuagaaauguuuagguu

SEQ ID NO: 492017 - RNA, 20 nt, Homo sapiens
uuuugcuggucacugccaug

SEQ ID NO: 492018 - RNA, 21 nt, Homo sapiens
uuuugucugcuuaguaucuca

SEQ ID NO: 492019 - RNA, 15 nt, Homo sapiens
uuuuuccuaacagga

SEQ ID NO: 492020 - RNA, 14 nt, Homo sapiens
uuuuucugggucuu

SEQ ID NO: 492021 - RNA, 21 nt, Homo sapiens
uuuuuuaagcaacacuuggaa

SEQ ID NO: 492022 - RNA, 16 nt, Homo sapiens
aaaggaugucuuucag

SEQ ID NO: 492023 - RNA, 14 nt, Homo sapiens
aaaguacagguacu

SEQ ID NO: 492024 - RNA, 17 nt, Homo sapiens
aaaguaccacacugagu

SEQ ID NO: 492025 - RNA, 14 nt, Homo sapiens
aaaguagacuucau

SEQ ID NO: 492026 - RNA, 15 nt, Homo sapiens
aaaguccacaguuua

SEQ ID NO: 492027 - RNA, 12 nt, Homo sapiens
aaagugucucaa

SEQ ID NO: 492028 - RNA, 18 nt, Homo sapiens
aaauaacccugaaucaga

SEQ ID NO: 492029 - RNA, 15 nt, Homo sapiens
aaauaacugcuuuaa

SEQ ID NO: 492030 - RNA, 12 nt, Homo sapiens
aaauacacgugu

SEQ ID NO: 492031 - RNA, 15 nt, Homo sapiens
aaauaguguguccau

SEQ ID NO: 492032 - RNA, 13 nt, Homo sapiens
aaauauacucaag

SEQ ID NO: 492033 - RNA, 11 nt, Homo sapiens
aaauauguaaa

SEQ ID NO: 492034 - RNA, 15 nt, Homo sapiens
aaaugaauaaauuca

SEQ ID NO: 492035 - RNA, 14 nt, Homo sapiens
aaaugagaacauga

SEQ ID NO: 492036 - RNA, 15 nt, Homo sapiens
aaaugagaacaugaa

SEQ ID NO: 492037 - RNA, 16 nt, Homo sapiens
aaaugaguucccuuga

SEQ ID NO: 492038 - RNA, 14 nt, Homo sapiens
aaaugauucacuuu

SEQ ID NO: 492039 - RNA, 14 nt, Homo sapiens
aaaugcagcuuuca

SEQ ID NO: 492040 - RNA, 22 nt, Homo sapiens
aaauggugguuguuucuuccaa

SEQ ID NO: 492041 - RNA, 14 nt, Homo sapiens
aaauguauguuggu

SEQ ID NO: 492042 - RNA, 21 nt, Homo sapiens
aaaugugucuuguauuaucau

SEQ ID NO: 492043 - RNA, 17 nt, Homo sapiens
aaauuaagaaaucauuc

SEQ ID NO: 492044 - RNA, 14 nt, Homo sapiens
aaauuaauguguaa

SEQ ID NO: 492045 - RNA, 14 nt, Homo sapiens
aaauuacagacaaa

SEQ ID NO: 492046 - RNA, 14 nt, Homo sapiens
aaauuaguuccauu

SEQ ID NO: 492047 - RNA, 14 nt, Homo sapiens
aaauuaucuuuaaa

SEQ ID NO: 492048 - RNA, 18 nt, Homo sapiens
aaauuauguuuucaucca

SEQ ID NO: 492049 - RNA, 13 nt, Homo sapiens
aaauucacaaagu

SEQ ID NO: 492050 - RNA, 13 nt, Homo sapiens
aaauuccuaucuc

SEQ ID NO: 492051 - RNA, 14 nt, Homo sapiens
aaauuccuaucuca

SEQ ID NO: 492052 - RNA, 19 nt, Homo sapiens
aaauuucaaaagacauguu

SEQ ID NO: 492053 - RNA, 14 nt, Homo sapiens
aaauuugagaguga

SEQ ID NO: 492054 - RNA, 13 nt, Homo sapiens
aacaaaguccaca

SEQ ID NO: 492055 - RNA, 14 nt, Homo sapiens
aacaacugcuggga

SEQ ID NO: 492056 - RNA, 16 nt, Homo sapiens
aacaauuaacugagca

SEQ ID NO: 492057 - RNA, 13 nt, Homo sapiens
aacacaaauccaa

SEQ ID NO: 492058 - RNA, 17 nt, Homo sapiens
aauuauguuuucaucca

SEQ ID NO: 492059 - RNA, 22 nt, Homo sapiens
aauuauguuuucauccauuaaa

SEQ ID NO: 492060 - RNA, 12 nt, Homo sapiens
aauucacuuuag

SEQ ID NO: 492061 - RNA, 16 nt, Homo sapiens
aauucauuguguauga

SEQ ID NO: 492062 - RNA, 12 nt, Homo sapiens
aauuccaaagau

SEQ ID NO: 492063 - RNA, 22 nt, Homo sapiens
aauugaaagggacaaguaucau

SEQ ID NO: 492064 - RNA, 23 nt, Homo sapiens
aauugaagagagauauaucugaa

SEQ ID NO: 492065 - RNA, 20 nt, Homo sapiens
aauugauaaaauguuuucac

SEQ ID NO: 492066 - RNA, 22 nt, Homo sapiens
aauugauuuuuaaacagcaggu

SEQ ID NO: 492067 - RNA, 16 nt, Homo sapiens
aauugucuuuugucau

SEQ ID NO: 492068 - RNA, 15 nt, Homo sapiens
aauuuaccacaggau

SEQ ID NO: 492069 - RNA, 20 nt, Homo sapiens
aauuuaugaagcagauuuau

SEQ ID NO: 492070 - RNA, 20 nt, Homo sapiens
aauuuccggccaacaguuaa

SEQ ID NO: 492071 - RNA, 16 nt, Homo sapiens
aauuucuuccuuccac

SEQ ID NO: 492072 - RNA, 21 nt, Homo sapiens
aauuucuuccuuccacaguua

SEQ ID NO: 492073 - RNA, 15 nt, Homo sapiens
aauuucuugcaauuu

SEQ ID NO: 492074 - RNA, 16 nt, Homo sapiens
acaaaauaauaccuua

SEQ ID NO: 492075 - RNA, 16 nt, Homo sapiens
acaaacauagacagau

SEQ ID NO: 492076 - RNA, 12 nt, Homo sapiens
acaaacauggau

SEQ ID NO: 492077 - RNA, 23 nt, Homo sapiens
acaaaugcuuuuccaacccauga

SEQ ID NO: 492078 - RNA, 20 nt, Homo sapiens
acaacauccucagaaccauu

SEQ ID NO: 492079 - RNA, 22 nt, Homo sapiens
acaacauccucagaaccauuca

SEQ ID NO: 492080 - RNA, 17 nt, Homo sapiens
acaagacccccaggaag

SEQ ID NO: 492081 - RNA, 14 nt, Homo sapiens
acaagacuguaaau

SEQ ID NO: 492082 - RNA, 17 nt, Homo sapiens
acaagauacaaauaccu

SEQ ID NO: 492083 - RNA, 15 nt, Homo sapiens
acaagcuauagcuaa

SEQ ID NO: 492084 - RNA, 19 nt, Homo sapiens
acaaggaaauuccucagca

SEQ ID NO: 492085 - RNA, 18 nt, Homo sapiens
acaaggcaaaaacaaaga

SEQ ID NO: 492086 - RNA, 22 nt, Homo sapiens
acaaucaugaacagcucugaga

SEQ ID NO: 492087 - RNA, 17 nt, Homo sapiens
acacaauuaauucaucc

SEQ ID NO: 492088 - RNA, 19 nt, Homo sapiens
acacacaggucgccaguga

SEQ ID NO: 492089 - RNA, 16 nt, Homo sapiens
acacaccacgcgucac

SEQ ID NO: 492090 - RNA, 15 nt, Homo sapiens
acacagucaccuucu

SEQ ID NO: 492091 - RNA, 18 nt, Homo sapiens
acacaucuuccacagguc

SEQ ID NO: 492092 - RNA, 23 nt, Homo sapiens
acacugagcaaguuuucaccuau

SEQ ID NO: 492093 - RNA, 13 nt, Homo sapiens
acacugugcuaua

SEQ ID NO: 492094 - RNA, 14 nt, Homo sapiens
acacugugcuauaa

SEQ ID NO: 492095 - RNA, 23 nt, Homo sapiens
acacuuggaacaguguuuacuuu

SEQ ID NO: 492096 - RNA, 21 nt, Homo sapiens
acagaaccaauucacuuuaga

SEQ ID NO: 492097 - RNA, 21 nt, Homo sapiens
acagaguaugaucucagggca

SEQ ID NO: 492098 - RNA, 19 nt, Homo sapiens
acagaugggcaaggccuuu

SEQ ID NO: 492099 - RNA, 18 nt, Homo sapiens
acagauguggacaugcac

SEQ ID NO: 492100 - RNA, 23 nt, Homo sapiens
acagauguggacaugcacccgca

SEQ ID NO: 492101 - RNA, 19 nt, Homo sapiens
acagcagauccaccugcac

SEQ ID NO: 492102 - RNA, 19 nt, Homo sapiens
acagcagcugaagccagcu

SEQ ID NO: 492103 - RNA, 23 nt, Homo sapiens
acagcauuacacgccacaacucc

SEQ ID NO: 492104 - RNA, 16 nt, Homo sapiens
acagcuccuuuuccag

SEQ ID NO: 492105 - RNA, 14 nt, Homo sapiens
acagcugcauggca

SEQ ID NO: 492106 - RNA, 18 nt, Homo sapiens
acaggauggucucugcca

SEQ ID NO: 492107 - RNA, 20 nt, Homo sapiens
acaggccagguggugggcau

SEQ ID NO: 492108 - RNA, 16 nt, Homo sapiens
acagggacacagucug

SEQ ID NO: 492109 - RNA, 22 nt, Homo sapiens
acaguaacugccauuuuuuguc

SEQ ID NO: 492110 - RNA, 22 nt, Homo sapiens
acaguaugguaacuuugcaaau

SEQ ID NO: 492111 - RNA, 15 nt, Homo sapiens
acaguggcaguauug

SEQ ID NO: 492112 - RNA, 20 nt, Homo sapiens
acaguggcaguauugacaau

SEQ ID NO: 492113 - RNA, 21 nt, Homo sapiens
acagugguauugcuaguuuaa

SEQ ID NO: 492114 - RNA, 17 nt, Homo sapiens
acaguuggaacaguaau

SEQ ID NO: 492115 - RNA, 15 nt, Homo sapiens
acauaauacauuaau

SEQ ID NO: 492116 - RNA, 17 nt, Homo sapiens
acauacgcacugggcau

SEQ ID NO: 492117 - RNA, 14 nt, Homo sapiens
acauccauucccaa

SEQ ID NO: 492118 - RNA, 19 nt, Homo sapiens
acaucuagucucagugcua

SEQ ID NO: 492119 - RNA, 18 nt, Homo sapiens
acaucuggaaaauaaaag

SEQ ID NO: 492120 - RNA, 11 nt, Homo sapiens
acaugauuuca

SEQ ID NO: 492121 - RNA, 23 nt, Homo sapiens
acaugcacacacacacaucucau

SEQ ID NO: 492122 - RNA, 23 nt, Homo sapiens
acauggcccccagaggcuuccag

SEQ ID NO: 492123 - RNA, 23 nt, Homo sapiens
acaugugugacugcgcacugagu

SEQ ID NO: 492124 - RNA, 16 nt, Homo sapiens
acauguguguauauau

SEQ ID NO: 492125 - RNA, 17 nt, Homo sapiens
acauuucuaacucugau

SEQ ID NO: 492126 - RNA, 23 nt, Homo sapiens
acauuugcuuuuugcuuguguac

SEQ ID NO: 492127 - RNA, 18 nt, Homo sapiens
acauuuuguggugacaga

SEQ ID NO: 492128 - RNA, 11 nt, Homo sapiens
accaagcuaua

SEQ ID NO: 492129 - RNA, 13 nt, Homo sapiens
accaaguuggucu

SEQ ID NO: 492130 - RNA, 13 nt, Homo sapiens
accaauuggauga

SEQ ID NO: 492131 - RNA, 13 nt, Homo sapiens
accacacugaguu

SEQ ID NO: 492132 - RNA, 17 nt, Homo sapiens
accacaggaugcauauu

SEQ ID NO: 492133 - RNA, 13 nt, Homo sapiens
accacugucucca

SEQ ID NO: 492134 - RNA, 20 nt, Homo sapiens
accagagaaaugaaagucag

SEQ ID NO: 492135 - RNA, 13 nt, Homo sapiens
accagauucacuu

SEQ ID NO: 492136 - RNA, 12 nt, Homo sapiens
accaggugaccu

SEQ ID NO: 492137 - RNA, 16 nt, Homo sapiens
accaguuucagagaaa

SEQ ID NO: 492138 - RNA, 21 nt, Homo sapiens
accauaagcuuuuucucugaa

SEQ ID NO: 492139 - RNA, 19 nt, Homo sapiens
accauuauggcuuugugcu

SEQ ID NO: 492140 - RNA, 21 nt, Homo sapiens
accauuuugaaauauucacaa

SEQ ID NO: 492141 - RNA, 21 nt, Homo sapiens
acccagauugaagcuaaaaua

SEQ ID NO: 492142 - RNA, 11 nt, Homo sapiens
acccaugaccg

SEQ ID NO: 492143 - RNA, 19 nt, Homo sapiens
accccuccccuaaugccug

SEQ ID NO: 492144 - RNA, 14 nt, Homo sapiens
acccuacagcagau

SEQ ID NO: 492145 - RNA, 23 nt, Homo sapiens
acccuugcgcuuuugcuggucac

SEQ ID NO: 492146 - RNA, 17 nt, Homo sapiens
accuagcaauuccauca

SEQ ID NO: 492147 - RNA, 23 nt, Homo sapiens
accuaugugugugcuuugccacu

SEQ ID NO: 492148 - RNA, 19 nt, Homo sapiens
accucacagaguaugaucu

SEQ ID NO: 492149 - RNA, 22 nt, Homo sapiens
accucacagaguaugaucucag

SEQ ID NO: 492150 - RNA, 17 nt, Homo sapiens
accuccuaggaguacaa

SEQ ID NO: 492151 - RNA, 22 nt, Homo sapiens
accucuuuggauguuuucccca

SEQ ID NO: 492152 - RNA, 11 nt, Homo sapiens
accugaacaaa

SEQ ID NO: 492153 - RNA, 13 nt, Homo sapiens
accugagcugcug

SEQ ID NO: 492154 - RNA, 20 nt, Homo sapiens
accugccugcaucugugaaa

SEQ ID NO: 492155 - RNA, 13 nt, Homo sapiens
cccccagugcuca

SEQ ID NO: 492156 - RNA, 14 nt, Homo sapiens
cccccgugccaaau

SEQ ID NO: 492157 - RNA, 21 nt, Homo sapiens
cccgcauguacaaaaacacaa

SEQ ID NO: 492158 - RNA, 14 nt, Homo sapiens
cccuauucuaucca

SEQ ID NO: 492159 - RNA, 22 nt, Homo sapiens
cccugaaauauuuucuacuuua

SEQ ID NO: 492160 - RNA, 19 nt, Homo sapiens
cccugaaucugaccacaga

SEQ ID NO: 492161 - RNA, 16 nt, Homo sapiens
cccugaggguuuccac

SEQ ID NO: 492162 - RNA, 22 nt, Homo sapiens
cccugauuuauucuggugucua

SEQ ID NO: 492163 - RNA, 17 nt, Homo sapiens
cccugcagagcacaaac

SEQ ID NO: 492164 - RNA, 15 nt, Homo sapiens
cccugcucauccacu

SEQ ID NO: 492165 - RNA, 14 nt, Homo sapiens
cccuguuaccuaau

SEQ ID NO: 492166 - RNA, 11 nt, Homo sapiens
cccuuccccau

SEQ ID NO: 492167 - RNA, 18 nt, Homo sapiens
ccgaccaacuccagacuu

SEQ ID NO: 492168 - RNA, 19 nt, Homo sapiens
ccgcaagaaagcaugacuu

SEQ ID NO: 492169 - RNA, 21 nt, Homo sapiens
ccgggcaggcauuucaggaag

SEQ ID NO: 492170 - RNA, 19 nt, Homo sapiens
ccgucuuuugaaaacucau

SEQ ID NO: 492171 - RNA, 15 nt, Homo sapiens
ccguuaaaaaaucaa

SEQ ID NO: 492172 - RNA, 23 nt, Homo sapiens
ccuaagagauuuaucuuuauaca

SEQ ID NO: 492173 - RNA, 14 nt, Homo sapiens
ccuaauaaacaauu

SEQ ID NO: 492174 - RNA, 17 nt, Homo sapiens
ccuacuguuccuuucag

SEQ ID NO: 492175 - RNA, 14 nt, Homo sapiens
ccuaucaucaguua

SEQ ID NO: 492176 - RNA, 14 nt, Homo sapiens
ccucaccaccgaga

SEQ ID NO: 492177 - RNA, 15 nt, Homo sapiens
ccucacccugcauag

SEQ ID NO: 492178 - RNA, 14 nt, Homo sapiens
ccucaccuucccua

SEQ ID NO: 492179 - RNA, 18 nt, Homo sapiens
ccucacugccucuuugca

SEQ ID NO: 492180 - RNA, 14 nt, Homo sapiens
ccucagaaagggau

SEQ ID NO: 492181 - RNA, 14 nt, Homo sapiens
ccuccaacgggugg

SEQ ID NO: 492182 - RNA, 13 nt, Homo sapiens
ccuccagccacuu

SEQ ID NO: 492183 - RNA, 15 nt, Homo sapiens
ccuccaugauuccaa

SEQ ID NO: 492184 - RNA, 22 nt, Homo sapiens
ccuccuaggaguacaagugccu

SEQ ID NO: 492185 - RNA, 12 nt, Homo sapiens
ccuccugcugag

SEQ ID NO: 492186 - RNA, 20 nt, Homo sapiens
ccucggggcaggaagucccu

SEQ ID NO: 492187 - RNA, 22 nt, Homo sapiens
ccucuaaaacuagaaaaggaag

SEQ ID NO: 492188 - RNA, 21 nt, Homo sapiens
ccucuagguaaacuagcaaaa

SEQ ID NO: 492189 - RNA, 11 nt, Homo sapiens
ccucucuccau

SEQ ID NO: 492190 - RNA, 23 nt, Homo sapiens
ccucuugaaugcuuaaaugauca

SEQ ID NO: 492191 - RNA, 14 nt, Homo sapiens
ccucuuuaccauag

SEQ ID NO: 492192 - RNA, 16 nt, Homo sapiens
ccugaaauguuuccag

SEQ ID NO: 492193 - RNA, 16 nt, Homo sapiens
ccugacacugucugcu

SEQ ID NO: 492194 - RNA, 23 nt, Homo sapiens
ccugacgcgcgcccgcagggugg

SEQ ID NO: 492195 - RNA, 15 nt, Homo sapiens
ccugaggguuuccac

SEQ ID NO: 492196 - RNA, 14 nt, Homo sapiens
ccugcagggugacc

SEQ ID NO: 492197 - RNA, 19 nt, Homo sapiens
ccugcauggcucacacaga

SEQ ID NO: 492198 - RNA, 14 nt, Homo sapiens
ccugccauagucuu

SEQ ID NO: 492199 - RNA, 13 nt, Homo sapiens
ccugcguggcuga

SEQ ID NO: 492200 - RNA, 11 nt, Homo sapiens
ccugcucugcu

SEQ ID NO: 492201 - RNA, 14 nt, Homo sapiens
ccuggaaggcagcu

SEQ ID NO: 492202 - RNA, 22 nt, Homo sapiens
ccuggaauugccacauaauuca

SEQ ID NO: 492203 - RNA, 16 nt, Homo sapiens
ccuggacauauuccca

SEQ ID NO: 492204 - RNA, 23 nt, Homo sapiens
ccuggcuuagcguucuguuucac

SEQ ID NO: 492205 - RNA, 18 nt, Homo sapiens
ccugggcaacagagugag

SEQ ID NO: 492206 - RNA, 17 nt, Homo sapiens
ccugggggcugcugcac

SEQ ID NO: 492207 - RNA, 18 nt, Homo sapiens
ccuguaggucuaugaugu

SEQ ID NO: 492208 - RNA, 20 nt, Homo sapiens
ccuguaggucuaugaugucc

SEQ ID NO: 492209 - RNA, 20 nt, Homo sapiens
ccugugugugucuagguaga

SEQ ID NO: 492210 - RNA, 20 nt, Homo sapiens
ccuguuaaauggggagacaa

SEQ ID NO: 492211 - RNA, 23 nt, Homo sapiens
ccuguuaaggcauccacuucaca

SEQ ID NO: 492212 - RNA, 19 nt, Homo sapiens
ccuguucugugucugcugu

SEQ ID NO: 492213 - RNA, 15 nt, Homo sapiens
ccuguuuugcaaauu

SEQ ID NO: 492214 - RNA, 18 nt, Homo sapiens
ccuucaaugcaaaauaca

SEQ ID NO: 492215 - RNA, 16 nt, Homo sapiens
ccuucacaaucuguca

SEQ ID NO: 492216 - RNA, 21 nt, Homo sapiens
ccuucaguaaaugugauucac

SEQ ID NO: 492217 - RNA, 20 nt, Homo sapiens
ccuuccaggcguagggccag

SEQ ID NO: 492218 - RNA, 22 nt, Homo sapiens
ccuucuuuccagaggaugucuu

SEQ ID NO: 492219 - RNA, 19 nt, Homo sapiens
ccuucuuuccauuucucuc

SEQ ID NO: 492220 - RNA, 16 nt, Homo sapiens
ccuugggaugggcaca

SEQ ID NO: 492221 - RNA, 14 nt, Homo sapiens
ccuugggcucugcu

SEQ ID NO: 492222 - RNA, 18 nt, Homo sapiens
ccuuguagguauuacauc

SEQ ID NO: 492223 - RNA, 24 nt, Homo sapiens
ccuugugaccuucucuauaucaug

SEQ ID NO: 492224 - RNA, 20 nt, Homo sapiens
ccuuuaauaggcuuguguaa

SEQ ID NO: 492225 - RNA, 12 nt, Homo sapiens
ccuuuaucucaa

SEQ ID NO: 492226 - RNA, 17 nt, Homo sapiens
ccuuuggaaggugacac

SEQ ID NO: 492227 - RNA, 23 nt, Homo sapiens
ccuuuguccuccugcugccagua

SEQ ID NO: 492228 - RNA, 13 nt, Homo sapiens
cgagaauuguuac

SEQ ID NO: 492229 - RNA, 15 nt, Homo sapiens
cgagccgagcucucc

SEQ ID NO: 492230 - RNA, 23 nt, Homo sapiens
cgaggaagaagaaacccuaggca

SEQ ID NO: 492231 - RNA, 18 nt, Homo sapiens
cgcuguguccccgcgggc

SEQ ID NO: 492232 - RNA, 23 nt, Homo sapiens
cggccucucuuggaacugcacca

SEQ ID NO: 492233 - RNA, 23 nt, Homo sapiens
cuucacacacaccucaugugaga

SEQ ID NO: 492234 - RNA, 18 nt, Homo sapiens
cuucacugucaugugcga

SEQ ID NO: 492235 - RNA, 18 nt, Homo sapiens
cuucacuucugacucuuc

SEQ ID NO: 492236 - RNA, 17 nt, Homo sapiens
cuucaggaauaugcauc

SEQ ID NO: 492237 - RNA, 23 nt, Homo sapiens
cuucagggggccaggugcacaga

SEQ ID NO: 492238 - RNA, 21 nt, Homo sapiens
cuucaguaaaugugauucacc

SEQ ID NO: 492239 - RNA, 22 nt, Homo sapiens
cuucaugcgcaguccccaggua

SEQ ID NO: 492240 - RNA, 14 nt, Homo sapiens
cuucauggaacuca

SEQ ID NO: 492241 - RNA, 18 nt, Homo sapiens
cuucauggaacucagcug

SEQ ID NO: 492242 - RNA, 21 nt, Homo sapiens
cuucauggaacucagcugucu

SEQ ID NO: 492243 - RNA, 14 nt, Homo sapiens
cuuccaaacucuuc

SEQ ID NO: 492244 - RNA, 18 nt, Homo sapiens
cuuccagaugauccuugc

SEQ ID NO: 492245 - RNA, 21 nt, Homo sapiens
cuucccaugucuuucuccaaa

SEQ ID NO: 492246 - RNA, 16 nt, Homo sapiens
cuucccuaguucuuug

SEQ ID NO: 492247 - RNA, 19 nt, Homo sapiens
cuuccucguuuuguaauga

SEQ ID NO: 492248 - RNA, 20 nt, Homo sapiens
cuuccugggucaagugcuaa

SEQ ID NO: 492249 - RNA, 16 nt, Homo sapiens
cuucgugcaacuguag

SEQ ID NO: 492250 - RNA, 20 nt, Homo sapiens
cuucucauccccagucccaa

SEQ ID NO: 492251 - RNA, 23 nt, Homo sapiens
cuucuccacaaccuccuccucca

SEQ ID NO: 492252 - RNA, 17 nt, Homo sapiens
cuucuccccuccaagug

SEQ ID NO: 492253 - RNA, 19 nt, Homo sapiens
cuucucucaccuccuaaag

SEQ ID NO: 492254 - RNA, 23 nt, Homo sapiens
cuucuguguaugugauguuguua

SEQ ID NO: 492255 - RNA, 17 nt, Homo sapiens
cuucuuguguaauguaa

SEQ ID NO: 492256 - RNA, 17 nt, Homo sapiens
cuucuuuccucuuaaug

SEQ ID NO: 492257 - RNA, 16 nt, Homo sapiens
cuugaaauuauaucug

SEQ ID NO: 492258 - RNA, 20 nt, Homo sapiens
cuugaaugcuuaaaugauca

SEQ ID NO: 492259 - RNA, 22 nt, Homo sapiens
cuugaggccaaaugaguucccu

SEQ ID NO: 492260 - RNA, 15 nt, Homo sapiens
cuugcugugaaauga

SEQ ID NO: 492261 - RNA, 20 nt, Homo sapiens
cuugcugugaaaugacugca

SEQ ID NO: 492262 - RNA, 16 nt, Homo sapiens
cuuggaacaguguuua

SEQ ID NO: 492263 - RNA, 13 nt, Homo sapiens
cuuggcacauccg

SEQ ID NO: 492264 - RNA, 18 nt, Homo sapiens
cuugguuuccaucaaagc

SEQ ID NO: 492265 - RNA, 19 nt, Homo sapiens
cuugucuacuggacuguaa

SEQ ID NO: 492266 - RNA, 18 nt, Homo sapiens
cuuguguacaaacccaga

SEQ ID NO: 492267 - RNA, 20 nt, Homo sapiens
cuuuaagagagaaaucugaa

SEQ ID NO: 492268 - RNA, 17 nt, Homo sapiens
cuuuacuuuguacaaau

SEQ ID NO: 492269 - RNA, 18 nt, Homo sapiens
cuuucccacacugugaac

SEQ ID NO: 492270 - RNA, 23 nt, Homo sapiens
cuuuccucuuaaugucucaaaau

SEQ ID NO: 492271 - RNA, 16 nt, Homo sapiens
cuuucucagcauauau

SEQ ID NO: 492272 - RNA, 15 nt, Homo sapiens
cuuucugaaauucac

SEQ ID NO: 492273 - RNA, 15 nt, Homo sapiens
cuuucugaauugcac

SEQ ID NO: 492274 - RNA, 17 nt, Homo sapiens
cuuucugaauugcacau

SEQ ID NO: 492275 - RNA, 15 nt, Homo sapiens
cuuugcaaauggugg

SEQ ID NO: 492276 - RNA, 17 nt, Homo sapiens
cuuugcuauggggacau

SEQ ID NO: 492277 - RNA, 19 nt, Homo sapiens
cuuugcugaaugucauuuu

SEQ ID NO: 492278 - RNA, 19 nt, Homo sapiens
cuuugggaggcugagaugg

SEQ ID NO: 492279 - RNA, 18 nt, Homo sapiens
cuuuguguagaaagccaa

SEQ ID NO: 492280 - RNA, 21 nt, Homo sapiens
cuuuguuucauauucucagau

SEQ ID NO: 492281 - RNA, 15 nt, Homo sapiens
cuuuuccaacccaug

SEQ ID NO: 492282 - RNA, 17 nt, Homo sapiens
cuuuuccaacccaugag

SEQ ID NO: 492283 - RNA, 20 nt, Homo sapiens
cuuuuccagagcauuccagu

SEQ ID NO: 492284 - RNA, 19 nt, Homo sapiens
cuuuugcaugucgcacaau

SEQ ID NO: 492285 - RNA, 22 nt, Homo sapiens
cuuuugugccaggagugggugg

SEQ ID NO: 492286 - RNA, 17 nt, Homo sapiens
cuuuuuacaauguauca

SEQ ID NO: 492287 - RNA, 19 nt, Homo sapiens
cuuuuuuuaaguguucugu

SEQ ID NO: 492288 - RNA, 13 nt, Homo sapiens
gaaaaaaagggag

SEQ ID NO: 492289 - RNA, 15 nt, Homo sapiens
gaaaaaauucccuca

SEQ ID NO: 492290 - RNA, 17 nt, Homo sapiens
gaaaaacucaaccaaau

SEQ ID NO: 492291 - RNA, 19 nt, Homo sapiens
gaaaaacuuuugacuugua

SEQ ID NO: 492292 - RNA, 21 nt, Homo sapiens
gaaaaauaugugaaggaccuu

SEQ ID NO: 492293 - RNA, 22 nt, Homo sapiens
gaaaaccucuuucggaaaugau

SEQ ID NO: 492294 - RNA, 17 nt, Homo sapiens
gaaaacucauacagugg

SEQ ID NO: 492295 - RNA, 16 nt, Homo sapiens
gaaaacuucagagaaa

SEQ ID NO: 492296 - RNA, 19 nt, Homo sapiens
guccuuagaauacuguauu

SEQ ID NO: 492297 - RNA, 18 nt, Homo sapiens
guccuuggggacaucuca

SEQ ID NO: 492298 - RNA, 14 nt, Homo sapiens
guccuuucauuugu

SEQ ID NO: 492299 - RNA, 17 nt, Homo sapiens
gucgaugagacuguuua

SEQ ID NO: 492300 - RNA, 13 nt, Homo sapiens
gucucaaucugau

SEQ ID NO: 492301 - RNA, 18 nt, Homo sapiens
gucuggcuccagcccuug

SEQ ID NO: 492302 - RNA, 14 nt, Homo sapiens
gucuuauccuccac

SEQ ID NO: 492303 - RNA, 12 nt, Homo sapiens
gucuucaucugu

SEQ ID NO: 492304 - RNA, 19 nt, Homo sapiens
gucuuucugaauugcacau

SEQ ID NO: 492305 - RNA, 20 nt, Homo sapiens
gugaaagucuccuguaucau

SEQ ID NO: 492306 - RNA, 12 nt, Homo sapiens
gugaaaugugag

SEQ ID NO: 492307 - RNA, 19 nt, Homo sapiens
gugaacuuucucagcauau

SEQ ID NO: 492308 - RNA, 21 nt, Homo sapiens
gugaagaucacguuccuuccc

SEQ ID NO: 492309 - RNA, 16 nt, Homo sapiens
gugaagcaacauuucu

SEQ ID NO: 492310 - RNA, 13 nt, Homo sapiens
gugacacagcagc

SEQ ID NO: 492311 - RNA, 17 nt, Homo sapiens
gugacauuugucauuuu

SEQ ID NO: 492312 - RNA, 20 nt, Homo sapiens
gugagugacaucgguucagg

SEQ ID NO: 492313 - RNA, 22 nt, Homo sapiens
gugaguggggaggagacucagg

SEQ ID NO: 492314 - RNA, 18 nt, Homo sapiens
gugauggauggcacaaug

SEQ ID NO: 492315 - RNA, 14 nt, Homo sapiens
gugauguaacuacu

SEQ ID NO: 492316 - RNA, 20 nt, Homo sapiens
gugauguggugggagcacag

SEQ ID NO: 492317 - RNA, 18 nt, Homo sapiens
gugcaacaaacucaaaau

SEQ ID NO: 492318 - RNA, 23 nt, Homo sapiens
gugcaauauauuuuguaugcaag

SEQ ID NO: 492319 - RNA, 15 nt, Homo sapiens
gugcacggggccagc

SEQ ID NO: 492320 - RNA, 21 nt, Homo sapiens
gugcugcuguggcaucaggaa

SEQ ID NO: 492321 - RNA, 17 nt, Homo sapiens
guggaccaguucccuca

SEQ ID NO: 492322 - RNA, 19 nt, Homo sapiens
gugggagcacagcuuuccu

SEQ ID NO: 492323 - RNA, 22 nt, Homo sapiens
gugggagcuuuugguaugugac

SEQ ID NO: 492324 - RNA, 17 nt, Homo sapiens
gugggccuuaacauccc

SEQ ID NO: 492325 - RNA, 14 nt, Homo sapiens
gugguacuuggcac

SEQ ID NO: 492326 - RNA, 16 nt, Homo sapiens
guguauauauguguau

SEQ ID NO: 492327 - RNA, 16 nt, Homo sapiens
gugucagcaugucuca

SEQ ID NO: 492328 - RNA, 23 nt, Homo sapiens
gugucauuuggcuuuccagucau

SEQ ID NO: 492329 - RNA, 14 nt, Homo sapiens
guguccccugccug

SEQ ID NO: 492330 - RNA, 20 nt, Homo sapiens
guguccgugaaaguugugau

SEQ ID NO: 492331 - RNA, 22 nt, Homo sapiens
guguugcaacauaaugaaaaag

SEQ ID NO: 492332 - RNA, 14 nt, Homo sapiens
guguuuauuacugc

SEQ ID NO: 492333 - RNA, 23 nt, Homo sapiens
guuacaaggguauccugugcuau

SEQ ID NO: 492334 - RNA, 17 nt, Homo sapiens
guuacaguggcaguauu

SEQ ID NO: 492335 - RNA, 10 nt, Homo sapiens
guuaccuaau

SEQ ID NO: 492336 - RNA, 22 nt, Homo sapiens
guuacucuaagguaaaaccauc

SEQ ID NO: 492337 - RNA, 22 nt, Homo sapiens
guuacugacaagccucagcaaa

SEQ ID NO: 492338 - RNA, 16 nt, Homo sapiens
guuaucuuagcuggau

SEQ ID NO: 492339 - RNA, 22 nt, Homo sapiens
guucagaaaagcaccucuugaa

SEQ ID NO: 492340 - RNA, 16 nt, Homo sapiens
guucauauaugcaaaa

SEQ ID NO: 492341 - RNA, 11 nt, Homo sapiens
guuccuuucag

SEQ ID NO: 492342 - RNA, 16 nt, Homo sapiens
guugacuggccaaaaa

SEQ ID NO: 492343 - RNA, 22 nt, Homo sapiens
guuggagaguacggcuaccugg

SEQ ID NO: 492344 - RNA, 19 nt, Homo sapiens
guugguuaccuauugcugu

SEQ ID NO: 492345 - RNA, 17 nt, Homo sapiens
guuguuaauguacaaaa

SEQ ID NO: 492346 - RNA, 15 nt, Homo sapiens
guuuaaagaagagua

SEQ ID NO: 492347 - RNA, 15 nt, Homo sapiens
guuuaagguucuugc

SEQ ID NO: 492348 - RNA, 15 nt, Homo sapiens
guuuacacugucaaa

SEQ ID NO: 492349 - RNA, 21 nt, Homo sapiens
guuuagaaucaagucugugaa

SEQ ID NO: 492350 - RNA, 17 nt, Homo sapiens
guuuauacacacaggag

SEQ ID NO: 492351 - RNA, 20 nt, Homo sapiens
guuuauuuuuauacuuucag

SEQ ID NO: 492352 - RNA, 18 nt, Homo sapiens
guuuccaaguuuauugcc

SEQ ID NO: 492353 - RNA, 12 nt, Homo sapiens
guuucugagaaa

SEQ ID NO: 492354 - RNA, 13 nt, Homo sapiens
guuugaucuuccu

SEQ ID NO: 492355 - RNA, 22 nt, Homo sapiens
guuugaugucauuaauguguug

SEQ ID NO: 492356 - RNA, 22 nt, Homo sapiens
guuugccaaauuuuccuuccug

SEQ ID NO: 492357 - RNA, 16 nt, Homo sapiens
guuuggccagugacau

SEQ ID NO: 492358 - RNA, 21 nt, Homo sapiens
guuuguauagaguucauccca

SEQ ID NO: 492359 - RNA, 13 nt, Homo sapiens
guuuuguauauua

SEQ ID NO: 492360 - RNA, 21 nt, Homo sapiens
guuuuguuuuuuauuuugccu

SEQ ID NO: 492361 - RNA, 15 nt, Homo sapiens
uaaaaaaagcuaaaa

SEQ ID NO: 492362 - RNA, 12 nt, Homo sapiens
uaaaaacugaag

SEQ ID NO: 492363 - RNA, 15 nt, Homo sapiens
uaaaaaguauugcca

SEQ ID NO: 492364 - RNA, 13 nt, Homo sapiens
uaaaaagugacac

SEQ ID NO: 492365 - RNA, 18 nt, Homo sapiens
uaaaaagugacacagcag

SEQ ID NO: 492366 - RNA, 19 nt, Homo sapiens
uaaaaagugacacagcagc

SEQ ID NO: 492367 - RNA, 20 nt, Homo sapiens
uaaaaagugacacagcagcu

SEQ ID NO: 492368 - RNA, 22 nt, Homo sapiens
uaaaacuuuaaucccacuugcc

SEQ ID NO: 492369 - RNA, 13 nt, Homo sapiens
uaaaacuuuuuga

SEQ ID NO: 492370 - RNA, 19 nt, Homo sapiens
uaaaagaaagaugcugaug

SEQ ID NO: 492371 - RNA, 20 nt, Homo sapiens
uauuauucaaaccaauuucu

SEQ ID NO: 492372 - RNA, 14 nt, Homo sapiens
uauuauuugcacag

SEQ ID NO: 492373 - RNA, 15 nt, Homo sapiens
uauuauuugcacaga

SEQ ID NO: 492374 - RNA, 21 nt, Homo sapiens
uauucaagaaagccagucuua

SEQ ID NO: 492375 - RNA, 14 nt, Homo sapiens
uauucuggugucua

SEQ ID NO: 492376 - RNA, 18 nt, Homo sapiens
uauugaaaaugucacugu

SEQ ID NO: 492377 - RNA, 23 nt, Homo sapiens
uauugcuaccaaaaacuagacau

SEQ ID NO: 492378 - RNA, 20 nt, Homo sapiens
uauuuaaaaacaaaaggcaa

SEQ ID NO: 492379 - RNA, 18 nt, Homo sapiens
uauuuaaggggaauuaac

SEQ ID NO: 492380 - RNA, 14 nt, Homo sapiens
uauuuauaacauug

SEQ ID NO: 492381 - RNA, 15 nt, Homo sapiens
uauuuauaaccaaca

SEQ ID NO: 492382 - RNA, 17 nt, Homo sapiens
uauuuauucuuuaacug

SEQ ID NO: 492383 - RNA, 21 nt, Homo sapiens
uauuucauaccuguacacacu

SEQ ID NO: 492384 - RNA, 15 nt, Homo sapiens
uauuucuaguagcac

SEQ ID NO: 492385 - RNA, 17 nt, Homo sapiens
uauuucuuuagaacaac

SEQ ID NO: 492386 - RNA, 20 nt, Homo sapiens
uauuugcauaauaugcauau

SEQ ID NO: 492387 - RNA, 20 nt, Homo sapiens
uauuuuaagaaguugcugca

SEQ ID NO: 492388 - RNA, 17 nt, Homo sapiens
uauuuuuccucuuucac

SEQ ID NO: 492389 - RNA, 14 nt, Homo sapiens
uauuuuuuuuacug

SEQ ID NO: 492390 - RNA, 20 nt, Homo sapiens
ucaaaagaucuccugugcac

SEQ ID NO: 492391 - RNA, 18 nt, Homo sapiens
ucaaaggagcuuucucaa

SEQ ID NO: 492392 - RNA, 18 nt, Homo sapiens
ucaaaucaggaacuguau

SEQ ID NO: 492393 - RNA, 18 nt, Homo sapiens
ucaagaaaaauucacagu

SEQ ID NO: 492394 - RNA, 13 nt, Homo sapiens
ucaagaaaagcau

SEQ ID NO: 492395 - RNA, 14 nt, Homo sapiens
ucaagaaagccagu

SEQ ID NO: 492396 - RNA, 22 nt, Homo sapiens
ucaagaaagccagucuuaacau

SEQ ID NO: 492397 - RNA, 12 nt, Homo sapiens
ucaaggcauuua

SEQ ID NO: 492398 - RNA, 15 nt, Homo sapiens
ucaagucugggaaca

SEQ ID NO: 492399 - RNA, 11 nt, Homo sapiens
ucaaguugcac

SEQ ID NO: 492400 - RNA, 22 nt, Homo sapiens
ucaauauuucuaguagcacaac

SEQ ID NO: 492401 - RNA, 23 nt, Homo sapiens
ucacaagaacaaauacacuuuau

SEQ ID NO: 492402 - RNA, 22 nt, Homo sapiens
ucacacacaccucaugugagaa

SEQ ID NO: 492403 - RNA, 23 nt, Homo sapiens
ucacacucucuucuuacuguauu

SEQ ID NO: 492404 - RNA, 22 nt, Homo sapiens
ucacauauucauauuguucaau

SEQ ID NO: 492405 - RNA, 17 nt, Homo sapiens
ucaccuaauuaauuuca

SEQ ID NO: 492406 - RNA, 19 nt, Homo sapiens
ucacgcaacuugaaauuau

SEQ ID NO: 492407 - RNA, 20 nt, Homo sapiens
ucacgucuccuacuuuuugu

SEQ ID NO: 492408 - RNA, 18 nt, Homo sapiens
ucacuaaauccuuuccaa

SEQ ID NO: 492409 - RNA, 18 nt, Homo sapiens
ucacuccccacaucccau

SEQ ID NO: 492410 - RNA, 19 nt, Homo sapiens
ucacuccccacaucccauc

SEQ ID NO: 492411 - RNA, 16 nt, Homo sapiens
ucacugccucuuugca

SEQ ID NO: 492412 - RNA, 15 nt, Homo sapiens
ucacugucaccaccc

SEQ ID NO: 492413 - RNA, 21 nt, Homo sapiens
ucacuuagaauccgaagggaa

SEQ ID NO: 492414 - RNA, 18 nt, Homo sapiens
ucacuuguuuguguuuga

SEQ ID NO: 492415 - RNA, 21 nt, Homo sapiens
ucagaaacaaagcauuugacu

SEQ ID NO: 492416 - RNA, 23 nt, Homo sapiens
ucagaaacccggcuuccugugcu

SEQ ID NO: 492417 - RNA, 13 nt, Homo sapiens
ucagaaagggauu

SEQ ID NO: 492418 - RNA, 21 nt, Homo sapiens
ucagaggacaccuguacugga

SEQ ID NO: 492419 - RNA, 22 nt, Homo sapiens
ucagcauauauauaaaauacac

SEQ ID NO: 492420 - RNA, 20 nt, Homo sapiens
ucagccccacuccacaguua

SEQ ID NO: 492421 - RNA, 16 nt, Homo sapiens
ucagccucacccugca

SEQ ID NO: 492422 - RNA, 14 nt, Homo sapiens
ucaggaaaacaccc

SEQ ID NO: 492423 - RNA, 19 nt, Homo sapiens
ucaggaaauaucugugaag

SEQ ID NO: 492424 - RNA, 18 nt, Homo sapiens
ucaggcaggcaccuagca

SEQ ID NO: 492425 - RNA, 19 nt, Homo sapiens
ucaggugaaaauccaucuc

SEQ ID NO: 492426 - RNA, 18 nt, Homo sapiens
ucagguuauucguuacuc

SEQ ID NO: 492427 - RNA, 14 nt, Homo sapiens
ucaguaagaucaag

SEQ ID NO: 492428 - RNA, 12 nt, Homo sapiens
uugcuaacauau

SEQ ID NO: 492429 - RNA, 23 nt, Homo sapiens
uugcuaacauauuuaaagucuug

SEQ ID NO: 492430 - RNA, 21 nt, Homo sapiens
uugcuaccaaaaacuagacau

SEQ ID NO: 492431 - RNA, 16 nt, Homo sapiens
uugcuaggagauacuc

SEQ ID NO: 492432 - RNA, 21 nt, Homo sapiens
uugcuaucuauaaaaaagaga

SEQ ID NO: 492433 - RNA, 17 nt, Homo sapiens
uugcuggucacugccau

SEQ ID NO: 492434 - RNA, 16 nt, Homo sapiens
uugcuuaaaugugaau

SEQ ID NO: 492435 - RNA, 20 nt, Homo sapiens
uugcuucucauccccagucc

SEQ ID NO: 492436 - RNA, 22 nt, Homo sapiens
uugcuuuagcacaggacaacuu

SEQ ID NO: 492437 - RNA, 21 nt, Homo sapiens
uuggaacaguguuuacuuuaa

SEQ ID NO: 492438 - RNA, 19 nt, Homo sapiens
uuggauuuuauguugacau

SEQ ID NO: 492439 - RNA, 14 nt, Homo sapiens
uuggcacauuucau

SEQ ID NO: 492440 - RNA, 13 nt, Homo sapiens
uugggcucugcgu

SEQ ID NO: 492441 - RNA, 14 nt, Homo sapiens
uuguaacucuauga

SEQ ID NO: 492442 - RNA, 17 nt, Homo sapiens
uugucacugcuguaaag

SEQ ID NO: 492443 - RNA, 22 nt, Homo sapiens
uugucaguguagaucaacucau

SEQ ID NO: 492444 - RNA, 22 nt, Homo sapiens
uugucauguggcuaaaugccua

SEQ ID NO: 492445 - RNA, 19 nt, Homo sapiens
uugucuaagaaacauugga

SEQ ID NO: 492446 - RNA, 19 nt, Homo sapiens
uuguggcacacaacugugg

SEQ ID NO: 492447 - RNA, 20 nt, Homo sapiens
uugugguaaacaaagacaug

SEQ ID NO: 492448 - RNA, 17 nt, Homo sapiens
uuguguagaaagccaaa

SEQ ID NO: 492449 - RNA, 16 nt, Homo sapiens
uuguucaguaugcaaa

SEQ ID NO: 492450 - RNA, 20 nt, Homo sapiens
uuguuuguccuuuauguauu

SEQ ID NO: 492451 - RNA, 13 nt, Homo sapiens
uuguuuguuuauu

SEQ ID NO: 492452 - RNA, 13 nt, Homo sapiens
uuguuuuguggau

SEQ ID NO: 492453 - RNA, 13 nt, Homo sapiens
uuuaaaacauuuc

SEQ ID NO: 492454 - RNA, 20 nt, Homo sapiens
uuuaacaucugcaguguucu

SEQ ID NO: 492455 - RNA, 16 nt, Homo sapiens
uuuaauuacaauggaa

SEQ ID NO: 492456 - RNA, 22 nt, Homo sapiens
uuuaauugaaagggacaaguau

SEQ ID NO: 492457 - RNA, 17 nt, Homo sapiens
uuuacacugucaaacau

SEQ ID NO: 492458 - RNA, 19 nt, Homo sapiens
uuuaccacaggaugcauau

SEQ ID NO: 492459 - RNA, 20 nt, Homo sapiens
uuuaccacaggaugcauauu

SEQ ID NO: 492460 - RNA, 11 nt, Homo sapiens
uuuacuuuaaa

SEQ ID NO: 492461 - RNA, 16 nt, Homo sapiens
uuuagaacaacauaaa

SEQ ID NO: 492462 - RNA, 18 nt, Homo sapiens
uuuagaaucaagucugug

SEQ ID NO: 492463 - RNA, 15 nt, Homo sapiens
uuuagcacaguauuu

SEQ ID NO: 492464 - RNA, 12 nt, Homo sapiens
uuuaguccucac

SEQ ID NO: 492465 - RNA, 19 nt, Homo sapiens
uuuauaggacgaaugccaa

SEQ ID NO: 492466 - RNA, 13 nt, Homo sapiens
uuucaaagagaug

SEQ ID NO: 492467 - RNA, 20 nt, Homo sapiens
uuucacaaauauuaaaaagu

SEQ ID NO: 492468 - RNA, 13 nt, Homo sapiens
uuucacagugucu

SEQ ID NO: 492469 - RNA, 12 nt, Homo sapiens
ugcuaccaaaaa

SEQ ID NO: 492470 - RNA, 13 nt, Homo sapiens
ugcuaccaaaaac

SEQ ID NO: 492471 - RNA, 14 nt, Homo sapiens
ugcuacuuccugcc

SEQ ID NO: 492472 - RNA, 13 nt, Homo sapiens
ugcuaucagaaau

SEQ ID NO: 492473 - RNA, 22 nt, Homo sapiens
ugcuaucucgcuagccauauau

SEQ ID NO: 492474 - RNA, 19 nt, Homo sapiens
ugcuauuuuacugucuuaa

SEQ ID NO: 492475 - RNA, 17 nt, Homo sapiens
ugcucauaacuguguca

SEQ ID NO: 492476 - RNA, 14 nt, Homo sapiens
ugcucucugcucac

SEQ ID NO: 492477 - RNA, 15 nt, Homo sapiens
ugcugaaugucauuu

SEQ ID NO: 492478 - RNA, 11 nt, Homo sapiens
ugcugcacugc

SEQ ID NO: 492479 - RNA, 21 nt, Homo sapiens
ugcugccaggcucccacugcc

SEQ ID NO: 492480 - RNA, 21 nt, Homo sapiens
ugcugcuauuuuacugucuua

SEQ ID NO: 492481 - RNA, 10 nt, Homo sapiens
ugcugcugaa

SEQ ID NO: 492482 - RNA, 22 nt, Homo sapiens
ugcugugcguggaaugcccuuc

SEQ ID NO: 492483 - RNA, 20 nt, Homo sapiens
ugcuuaccucucagccuuag

SEQ ID NO: 492484 - RNA, 23 nt, Homo sapiens
ugcuuccccaaaggccaacagca

SEQ ID NO: 492485 - RNA, 17 nt, Homo sapiens
ugcuucuuuccucuuaa

SEQ ID NO: 492486 - RNA, 19 nt, Homo sapiens
ugcuucuuuccucuuaaug

SEQ ID NO: 492487 - RNA, 13 nt, Homo sapiens
ugcuuuccauauu

SEQ ID NO: 492488 - RNA, 17 nt, Homo sapiens
ugcuuuccauauuguga

SEQ ID NO: 492489 - RNA, 19 nt, Homo sapiens
ugcuuuccauauugugaua

SEQ ID NO: 492490 - RNA, 20 nt, Homo sapiens
ugcuuucucuucuacuucuu

SEQ ID NO: 492491 - RNA, 20 nt, Homo sapiens
uggaaaaaaagacugaugaa

SEQ ID NO: 492492 - RNA, 22 nt, Homo sapiens
uggaaccaacgaucauaucugu

SEQ ID NO: 492493 - RNA, 18 nt, Homo sapiens
uggaacucagcugucugu

SEQ ID NO: 492494 - RNA, 16 nt, Homo sapiens
uggaaggagaaagggg

SEQ ID NO: 492495 - RNA, 16 nt, Homo sapiens
uggaauguuuuaacug

SEQ ID NO: 492496 - RNA, 22 nt, Homo sapiens
uggagauggggagaaaccuaca

SEQ ID NO: 492497 - RNA, 19 nt, Homo sapiens
uggagggcugcagagccug

SEQ ID NO: 492498 - RNA, 22 nt, Homo sapiens
uggaugcugucuucgaggacag

SEQ ID NO: 492499 - RNA, 16 nt, Homo sapiens
uggcacuuuaaugaua

SEQ ID NO: 492500 - RNA, 20 nt, Homo sapiens
uggcagagggcagagcacau

SEQ ID NO: 492501 - RNA, 18 nt, Homo sapiens
uggcagcaugcgauguca

SEQ ID NO: 492502 - RNA, 21 nt, Homo sapiens
uggcauccaagacucuuuaug

SEQ ID NO: 492503 - RNA, 22 nt, Homo sapiens
uggcauccaagacucuuuauga

SEQ ID NO: 492504 - RNA, 12 nt, Homo sapiens
uggcccuguuaa

SEQ ID NO: 492505 - RNA, 15 nt, Homo sapiens
uggccuuuaucucaa

SEQ ID NO: 492506 - RNA, 15 nt, Homo sapiens
uggcgcacccggcag

SEQ ID NO: 492507 - RNA, 19 nt, Homo sapiens
uggcgcuggcuucaggaau

SEQ ID NO: 492508 - RNA, 18 nt, Homo sapiens
uggcugauuuacuaacag

SEQ ID NO: 492509 - RNA, 23 nt, Homo sapiens
uggcuuacuacaugugggagcuu

SEQ ID NO: 492510 - RNA, 14 nt, Homo sapiens
uggcuuugugcuua

SEQ ID NO: 492511 - RNA, 15 nt, Homo sapiens
ugggcaaggccuuug

SEQ ID NO: 492512 - RNA, 21 nt, Homo sapiens
ugggcaauauucucuguacau

SEQ ID NO: 492513 - RNA, 16 nt, Homo sapiens
ugggccuucgggguga

SEQ ID NO: 492514 - RNA, 22 nt, Homo sapiens
ugggcuccacuucauccagaug

SEQ ID NO: 492515 - RNA, 20 nt, Homo sapiens
uggggaaacggcccaccaag

SEQ ID NO: 492516 - RNA, 18 nt, Homo sapiens
uggggcaauaacaaauca

SEQ ID NO: 492517 - RNA, 19 nt, Homo sapiens
uggggcuccucacauagcu

SEQ ID NO: 492518 - RNA, 14 nt, Homo sapiens
uggggucugugaug

SEQ ID NO: 492519 - RNA, 17 nt, Homo sapiens
uggguaucaugcuucua

SEQ ID NO: 492520 - RNA, 18 nt, Homo sapiens
ugggucuucagggggcca

SEQ ID NO: 492521 - RNA, 19 nt, Homo sapiens
ugggucuucagggggccag

SEQ ID NO: 492522 - RNA, 15 nt, Homo sapiens
uggguuuacucugug

SEQ ID NO: 492523 - RNA, 15 nt, Homo sapiens
ugguagacugugaca

SEQ ID NO: 492524 - RNA, 15 nt, Homo sapiens
uggucacaaagcuau

SEQ ID NO: 492525 - RNA, 18 nt, Homo sapiens
uggucacuucuucugucc

SEQ ID NO: 492526 - RNA, 19 nt, Homo sapiens
uggucuuucugaauugcac

SEQ ID NO: 492527 - RNA, 19 nt, Homo sapiens
uggugaaaccccaucucua

SEQ ID NO: 492528 - RNA, 13 nt, Homo sapiens
uggugacugagau

SEQ ID NO: 492529 - RNA, 19 nt, Homo sapiens
uggugagguugugcugccu

SEQ ID NO: 492530 - RNA, 21 nt, Homo sapiens
uggugcauccgugaaugcgcu

SEQ ID NO: 492531 - RNA, 12 nt, Homo sapiens
ugguuaccucug

SEQ ID NO: 492532 - RNA, 16 nt, Homo sapiens
ugguucauauaugcaa

SEQ ID NO: 492533 - RNA, 23 nt, Homo sapiens
ugguuccggaauccuguccucag

SEQ ID NO: 492534 - RNA, 21 nt, Homo sapiens
uguaaaugaaguaacuugucu

SEQ ID NO: 492535 - RNA, 16 nt, Homo sapiens
uguaacuuuacaguua

SEQ ID NO: 492536 - RNA, 18 nt, Homo sapiens
uguaagagcaaaagccuc

SEQ ID NO: 492537 - RNA, 14 nt, Homo sapiens
uguaauaguuuuaa

SEQ ID NO: 492538 - RNA, 20 nt, Homo sapiens
uguacaaauguaaauagaua

SEQ ID NO: 492539 - RNA, 20 nt, Homo sapiens
uguacaaucaugaacagcuc

SEQ ID NO: 492540 - RNA, 22 nt, Homo sapiens
uguacagcucuccccucccuug

SEQ ID NO: 492541 - RNA, 13 nt, Homo sapiens
uguacauguggaa

SEQ ID NO: 492542 - RNA, 21 nt, Homo sapiens
uguacauguggaaaacucaca

SEQ ID NO: 492543 - RNA, 22 nt, Homo sapiens
uguacuugauuuuucaaagacu

SEQ ID NO: 492544 - RNA, 17 nt, Homo sapiens
uguauauacacauauac

SEQ ID NO: 492545 - RNA, 15 nt, Homo sapiens
uguauaucuguauau

SEQ ID NO: 492546 - RNA, 13 nt, Homo sapiens
uguauguguauau

SEQ ID NO: 492547 - RNA, 22 nt, Homo sapiens
uguauuuucagcucaauuguua

SEQ ID NO: 492548 - RNA, 18 nt, Homo sapiens
uguauuuuucaaggcauu

SEQ ID NO: 492549 - RNA, 19 nt, Homo sapiens
ugucauauuuuccuuuaug

SEQ ID NO: 492550 - RNA, 13 nt, Homo sapiens
ugucaugccaaaa

SEQ ID NO: 492551 - RNA, 16 nt, Homo sapiens
ugucauuuuuaucuau

SEQ ID NO: 492552 - RNA, 18 nt, Homo sapiens
uguccauaucuaaccagu

SEQ ID NO: 492553 - RNA, 16 nt, Homo sapiens
uguccuaggcuuuuac

SEQ ID NO: 492554 - RNA, 19 nt, Homo sapiens
uguccuuggggacaucuca

SEQ ID NO: 492555 - RNA, 19 nt, Homo sapiens
ugucuaauaaacacagauu

SEQ ID NO: 492556 - RNA, 14 nt, Homo sapiens
aaacaauucaaaga

SEQ ID NO: 492557 - RNA, 13 nt, Homo sapiens
aaacacagauuau

SEQ ID NO: 492558 - RNA, 18 nt, Homo sapiens
aaacacuucuacuguuca

SEQ ID NO: 492559 - RNA, 20 nt, Homo sapiens
aaacagcagcugaagccagc

SEQ ID NO: 492560 - RNA, 19 nt, Homo sapiens
aaacauccuguuuugcaaa

SEQ ID NO: 492561 - RNA, 16 nt, Homo sapiens
aaacaugauuguuuac

SEQ ID NO: 492562 - RNA, 20 nt, Homo sapiens
aaacauguuaaacguuacuu

SEQ ID NO: 492563 - RNA, 17 nt, Homo sapiens
aaaccgaggacccauga

SEQ ID NO: 492564 - RNA, 15 nt, Homo sapiens
aaacgaaaaucauug

SEQ ID NO: 492565 - RNA, 14 nt, Homo sapiens
aaacuaagaaucau

SEQ ID NO: 492566 - RNA, 15 nt, Homo sapiens
aaacuguacuuugau

SEQ ID NO: 492567 - RNA, 19 nt, Homo sapiens
aaacuguggcacuuuucac

SEQ ID NO: 492568 - RNA, 13 nt, Homo sapiens
aaacuucagagaa

SEQ ID NO: 492569 - RNA, 18 nt, Homo sapiens
aaacuuuuaugcgcaaau

SEQ ID NO: 492570 - RNA, 15 nt, Homo sapiens
aaagagauuguucua

SEQ ID NO: 492571 - RNA, 23 nt, Homo sapiens
aaagagccauucuggcacuuuaa

SEQ ID NO: 492572 - RNA, 22 nt, Homo sapiens
aaagaguugcaguaaaguucca

SEQ ID NO: 492573 - RNA, 23 nt, Homo sapiens
aaagcauagacgucucagguuau

SEQ ID NO: 492574 - RNA, 16 nt, Homo sapiens
aaagcucauaauggaa

SEQ ID NO: 492575 - RNA, 17 nt, Homo sapiens
aaagcugaggacagggu

SEQ ID NO: 492576 - RNA, 19 nt, Homo sapiens
aaagcuucaaguuuucuca

SEQ ID NO: 492577 - RNA, 22 nt, Homo sapiens
aaaguaccacacugaguucuau

SEQ ID NO: 492578 - RNA, 15 nt, Homo sapiens
aaaguauuauucaaa

SEQ ID NO: 492579 - RNA, 22 nt, Homo sapiens
aaaguauuauucaaaccaauuu

SEQ ID NO: 492580 - RNA, 13 nt, Homo sapiens
aaaguggagugua

SEQ ID NO: 492581 - RNA, 17 nt, Homo sapiens
aaaguguaauaauauga

SEQ ID NO: 492582 - RNA, 17 nt, Homo sapiens
aaagugugucacccuuu

SEQ ID NO: 492583 - RNA, 19 nt, Homo sapiens
aaaguuaauaacagcuccu

SEQ ID NO: 492584 - RNA, 15 nt, Homo sapiens
aaauaaaccagacuc

SEQ ID NO: 492585 - RNA, 12 nt, Homo sapiens
aaauacauauga

SEQ ID NO: 492586 - RNA, 20 nt, Homo sapiens
aaauauacuugcuaucuaua

SEQ ID NO: 492587 - RNA, 13 nt, Homo sapiens
aaauauauauaca

SEQ ID NO: 492588 - RNA, 16 nt, Homo sapiens
aaauauuuggucucua

SEQ ID NO: 492589 - RNA, 23 nt, Homo sapiens
aaauauuugugaaagugccaaaa

SEQ ID NO: 492590 - RNA, 19 nt, Homo sapiens
aaauauuuucuacuuuaaa

SEQ ID NO: 492591 - RNA, 20 nt, Homo sapiens
aaauauuuugucacugcugu

SEQ ID NO: 492592 - RNA, 17 nt, Homo sapiens
aaaucaagaccaaagag

SEQ ID NO: 492593 - RNA, 14 nt, Homo sapiens
aaaucauacugcau

SEQ ID NO: 492594 - RNA, 20 nt, Homo sapiens
aaaucucgcacuacaucuga

SEQ ID NO: 492595 - RNA, 20 nt, Homo sapiens
aaaucuguauugcuaagaua

SEQ ID NO: 492596 - RNA, 16 nt, Homo sapiens
aaaugaaagucaguuu

SEQ ID NO: 492597 - RNA, 16 nt, Homo sapiens
aaaugaaauacuugac

SEQ ID NO: 492598 - RNA, 12 nt, Homo sapiens
aaaugagacaaa

SEQ ID NO: 492599 - RNA, 16 nt, Homo sapiens
aaaugcaccucauucc

SEQ ID NO: 492600 - RNA, 20 nt, Homo sapiens
aaaugcuuuuccaacccaug

SEQ ID NO: 492601 - RNA, 19 nt, Homo sapiens
aaauggacuacaguagcuc

SEQ ID NO: 492602 - RNA, 24 nt, Homo sapiens
aaauguauagacucagugcacauu

SEQ ID NO: 492603 - RNA, 14 nt, Homo sapiens
aaauguauauacac

SEQ ID NO: 492604 - RNA, 16 nt, Homo sapiens
aaauguccguguaaaa

SEQ ID NO: 492605 - RNA, 21 nt, Homo sapiens
aaauguucauggacuauucca

SEQ ID NO: 492606 - RNA, 21 nt, Homo sapiens
aaauguuuuguaaacuuugaa

SEQ ID NO: 492607 - RNA, 15 nt, Homo sapiens
aaauuaaaaugauuu

SEQ ID NO: 492608 - RNA, 14 nt, Homo sapiens
aaauuacaguaugg

SEQ ID NO: 492609 - RNA, 17 nt, Homo sapiens
aaauuauucacccauuu

SEQ ID NO: 492610 - RNA, 17 nt, Homo sapiens
aaauucaauucauagaa

SEQ ID NO: 492611 - RNA, 17 nt, Homo sapiens
aaauucgacaacuugua

SEQ ID NO: 492612 - RNA, 23 nt, Homo sapiens
aaauugagucauuuuauauauga

SEQ ID NO: 492613 - RNA, 14 nt, Homo sapiens
aaauugauguugau

SEQ ID NO: 492614 - RNA, 24 nt, Homo sapiens
aaauugucuuuugucauguggcua

SEQ ID NO: 492615 - RNA, 14 nt, Homo sapiens
aaauuugacuguua

SEQ ID NO: 492616 - RNA, 12 nt, Homo sapiens
aacaaagacaug

SEQ ID NO: 492617 - RNA, 21 nt, Homo sapiens
aacaaauggcuuguucaguca

SEQ ID NO: 492618 - RNA, 17 nt, Homo sapiens
aacaagacccccaggaa

SEQ ID NO: 492619 - RNA, 22 nt, Homo sapiens
aacaaggggcuguuacauaaca

SEQ ID NO: 492620 - RNA, 21 nt, Homo sapiens
aacaauuguccauggucucaa

SEQ ID NO: 492621 - RNA, 16 nt, Homo sapiens
aacaauuucugugucc

SEQ ID NO: 492622 - RNA, 16 nt, Homo sapiens
aacacaaauacggaag

SEQ ID NO: 492623 - RNA, 12 nt, Homo sapiens
aacacacaugca

SEQ ID NO: 492624 - RNA, 22 nt, Homo sapiens
aacagaucacaugccccucuua

SEQ ID NO: 492625 - RNA, 16 nt, Homo sapiens
aacagcuggacacccc

SEQ ID NO: 492626 - RNA, 22 nt, Homo sapiens
aacagugugaugcaauuacugc

SEQ ID NO: 492627 - RNA, 16 nt, Homo sapiens
aacaguguuuacuuua

SEQ ID NO: 492628 - RNA, 12 nt, Homo sapiens
aacauaaugaaa

SEQ ID NO: 492629 - RNA, 14 nt, Homo sapiens
aacauacaauuuac

SEQ ID NO: 492630 - RNA, 20 nt, Homo sapiens
aacauauuuaaagucuugaa

SEQ ID NO: 492631 - RNA, 19 nt, Homo sapiens
aacaugguuaccucugcau

SEQ ID NO: 492632 - RNA, 19 nt, Homo sapiens
aaccacccuaucaucaguu

SEQ ID NO: 492633 - RNA, 17 nt, Homo sapiens
aaccauaaaucaauuca

SEQ ID NO: 492634 - RNA, 23 nt, Homo sapiens
aaccauaaaucaauucauugugu

SEQ ID NO: 492635 - RNA, 18 nt, Homo sapiens
aaccaucuaggaugauuu

SEQ ID NO: 492636 - RNA, 15 nt, Homo sapiens
aacccagauugaagc

SEQ ID NO: 492637 - RNA, 18 nt, Homo sapiens
aaccgaggacccaugaaa

SEQ ID NO: 492638 - RNA, 14 nt, Homo sapiens
aaccuccuaagcaa

SEQ ID NO: 492639 - RNA, 17 nt, Homo sapiens
aaccuccuccuccaguu

SEQ ID NO: 492640 - RNA, 23 nt, Homo sapiens
aaccuguucacgugacuccucaa

SEQ ID NO: 492641 - RNA, 23 nt, Homo sapiens
aaccuuuucaccuccaacuggau

SEQ ID NO: 492642 - RNA, 15 nt, Homo sapiens
aacuaaacagauaaa

SEQ ID NO: 492643 - RNA, 17 nt, Homo sapiens
aacuaaguucucuaucu

SEQ ID NO: 492644 - RNA, 11 nt, Homo sapiens
aacuacuuucu

SEQ ID NO: 492645 - RNA, 17 nt, Homo sapiens
aacuacuuucuguuauc

SEQ ID NO: 492646 - RNA, 20 nt, Homo sapiens
aacuagacauuaccaaagug

SEQ ID NO: 492647 - RNA, 16 nt, Homo sapiens
aacuauugggugaaua

SEQ ID NO: 492648 - RNA, 21 nt, Homo sapiens
aacucaaccaaaugguacaaa

SEQ ID NO: 492649 - RNA, 13 nt, Homo sapiens
aacucagcugucu

SEQ ID NO: 492650 - RNA, 13 nt, Homo sapiens
aacuccaguguuc

SEQ ID NO: 492651 - RNA, 12 nt, Homo sapiens
aacuccuuacag

SEQ ID NO: 492652 - RNA, 13 nt, Homo sapiens
aacucugauguaa

SEQ ID NO: 492653 - RNA, 14 nt, Homo sapiens
aacucuuccuccaa

SEQ ID NO: 492654 - RNA, 13 nt, Homo sapiens
aacucuugcacag

SEQ ID NO: 492655 - RNA, 17 nt, Homo sapiens
aacugaagcagagucaa

SEQ ID NO: 492656 - RNA, 14 nt, Homo sapiens
aacugagaugcuga

SEQ ID NO: 492657 - RNA, 23 nt, Homo sapiens
aacugcaccaccgaccaacucca

SEQ ID NO: 492658 - RNA, 16 nt, Homo sapiens
aacuggaggccaggaa

SEQ ID NO: 492659 - RNA, 17 nt, Homo sapiens
aacuguaaaauacuucu

SEQ ID NO: 492660 - RNA, 19 nt, Homo sapiens
aacuguaaaauacuucuuu

SEQ ID NO: 492661 - RNA, 15 nt, Homo sapiens
aacuuaauuaccuaa

SEQ ID NO: 492662 - RNA, 13 nt, Homo sapiens
aacuuacauaugu

SEQ ID NO: 492663 - RNA, 18 nt, Homo sapiens
aacuugauucuugugauu

SEQ ID NO: 492664 - RNA, 14 nt, Homo sapiens
aacuuggugccuaa

SEQ ID NO: 492665 - RNA, 16 nt, Homo sapiens
aacuuggugccuaaug

SEQ ID NO: 492666 - RNA, 21 nt, Homo sapiens
caugcuacaaaaaaguagcaa

SEQ ID NO: 492667 - RNA, 22 nt, Homo sapiens
cauggaacucagcugucugugg

SEQ ID NO: 492668 - RNA, 17 nt, Homo sapiens
cauggaguagagucagg

SEQ ID NO: 492669 - RNA, 14 nt, Homo sapiens
cauggcacccugca

SEQ ID NO: 492670 - RNA, 16 nt, Homo sapiens
caugguagacugugac

SEQ ID NO: 492671 - RNA, 15 nt, Homo sapiens
caugugaaagugcac

SEQ ID NO: 492672 - RNA, 16 nt, Homo sapiens
caugugagcaugucac

SEQ ID NO: 492673 - RNA, 20 nt, Homo sapiens
caugugcgaacacagugaca

SEQ ID NO: 492674 - RNA, 19 nt, Homo sapiens
cauguggaaaacucacaga

SEQ ID NO: 492675 - RNA, 18 nt, Homo sapiens
cauguggccuuuaucuca

SEQ ID NO: 492676 - RNA, 19 nt, Homo sapiens
cauguggccuuuaucucaa

SEQ ID NO: 492677 - RNA, 20 nt, Homo sapiens
caugugugacugcgcacuga

SEQ ID NO: 492678 - RNA, 15 nt, Homo sapiens
cauuaaagagccauu

SEQ ID NO: 492679 - RNA, 22 nt, Homo sapiens
cauuaauguugauuucuaguua

SEQ ID NO: 492680 - RNA, 19 nt, Homo sapiens
cauuacacgccacaacucc

SEQ ID NO: 492681 - RNA, 18 nt, Homo sapiens
cauuaucauaugaacuug

SEQ ID NO: 492682 - RNA, 19 nt, Homo sapiens
cauuccagucaagcagaaa

SEQ ID NO: 492683 - RNA, 13 nt, Homo sapiens
cauucugcaauga

SEQ ID NO: 492684 - RNA, 21 nt, Homo sapiens
cauugauauauccuuuugcua

SEQ ID NO: 492685 - RNA, 20 nt, Homo sapiens
cauuguauuuaaaacauuuc

SEQ ID NO: 492686 - RNA, 14 nt, Homo sapiens
cauuucagcuguga

SEQ ID NO: 492687 - RNA, 14 nt, Homo sapiens
cauuucucuuucaa

SEQ ID NO: 492688 - RNA, 18 nt, Homo sapiens
cauuucuugguaugauca

SEQ ID NO: 492689 - RNA, 11 nt, Homo sapiens
cauuugcugca

SEQ ID NO: 492690 - RNA, 18 nt, Homo sapiens
cauuuuuaagaacaagca

SEQ ID NO: 492691 - RNA, 19 nt, Homo sapiens
cauuuuucauagauaccau

SEQ ID NO: 492692 - RNA, 19 nt, Homo sapiens
cauuuuuguaaugagccau

SEQ ID NO: 492693 - RNA, 13 nt, Homo sapiens
ccaaaaauaucuu

SEQ ID NO: 492694 - RNA, 19 nt, Homo sapiens
ccaaagaguuuucugugca

SEQ ID NO: 492695 - RNA, 15 nt, Homo sapiens
ccaaagcugcugcac

SEQ ID NO: 492696 - RNA, 18 nt, Homo sapiens
ccaaaggccaacagcauu

SEQ ID NO: 492697 - RNA, 19 nt, Homo sapiens
ccaaagguuucaacuguaa

SEQ ID NO: 492698 - RNA, 11 nt, Homo sapiens
ccaacauguga

SEQ ID NO: 492699 - RNA, 19 nt, Homo sapiens
ccaacccaaaccuggagau

SEQ ID NO: 492700 - RNA, 20 nt, Homo sapiens
ccaacguggggcagcacaga

SEQ ID NO: 492701 - RNA, 21 nt, Homo sapiens
ccaacguggggcagcacagag

SEQ ID NO: 492702 - RNA, 23 nt, Homo sapiens
ccaagacucuuuaugaucuggcc

SEQ ID NO: 492703 - RNA, 15 nt, Homo sapiens
ccaagaguccaagcc

SEQ ID NO: 492704 - RNA, 17 nt, Homo sapiens
ccaagaguuugagacca

SEQ ID NO: 492705 - RNA, 21 nt, Homo sapiens
ccaaggugugccccgugggca

SEQ ID NO: 492706 - RNA, 21 nt, Homo sapiens
ccaaguaacauuuugugguga

SEQ ID NO: 492707 - RNA, 23 nt, Homo sapiens
ccaagugaaugaguuuccagcua

SEQ ID NO: 492708 - RNA, 19 nt, Homo sapiens
ccaaguuggucuuacuuug

SEQ ID NO: 492709 - RNA, 13 nt, Homo sapiens
ccaauuugcacuu

SEQ ID NO: 492710 - RNA, 18 nt, Homo sapiens
ccacacccuacagcagau

SEQ ID NO: 492711 - RNA, 20 nt, Homo sapiens
ccacagccaaacuaggacac

SEQ ID NO: 492712 - RNA, 18 nt, Homo sapiens
ccacauuccaaacagagu

SEQ ID NO: 492713 - RNA, 24 nt, Homo sapiens
ccaccugccugcaucugugaaaag

SEQ ID NO: 492714 - RNA, 13 nt, Homo sapiens
ccacuccacaguu

SEQ ID NO: 492715 - RNA, 11 nt, Homo sapiens
ccacugugcuu

SEQ ID NO: 492716 - RNA, 17 nt, Homo sapiens
ccacuugccccuguuac

SEQ ID NO: 492717 - RNA, 16 nt, Homo sapiens
ccagaagcagcagcua

SEQ ID NO: 492718 - RNA, 22 nt, Homo sapiens
ccagaagcucaaggcugcagug

SEQ ID NO: 492719 - RNA, 18 nt, Homo sapiens
ccagaaggaaucuucuca

SEQ ID NO: 492720 - RNA, 20 nt, Homo sapiens
ccagaaguagcuuugcacuu

SEQ ID NO: 492721 - RNA, 11 nt, Homo sapiens
ccagaccccau

SEQ ID NO: 492722 - RNA, 22 nt, Homo sapiens
ccagagcuggaccugagcuauu

SEQ ID NO: 492723 - RNA, 17 nt, Homo sapiens
ccagaggcuuccagucu

SEQ ID NO: 492724 - RNA, 17 nt, Homo sapiens
ccagaggguugugauuu

SEQ ID NO: 492725 - RNA, 20 nt, Homo sapiens
ccagagucuagcguagugca

SEQ ID NO: 492726 - RNA, 19 nt, Homo sapiens
ccagcugcaggaaucaaaa

SEQ ID NO: 492727 - RNA, 16 nt, Homo sapiens
ccaggaacacaugcac

SEQ ID NO: 492728 - RNA, 19 nt, Homo sapiens
ccaggaacacaugcacaca

SEQ ID NO: 492729 - RNA, 19 nt, Homo sapiens
ccaggacgcagggagaccc

SEQ ID NO: 492730 - RNA, 20 nt, Homo sapiens
ccaggcucucgcacaccucu

SEQ ID NO: 492731 - RNA, 13 nt, Homo sapiens
ccaggugaaggag

SEQ ID NO: 492732 - RNA, 12 nt, Homo sapiens
ccaggugcacag

SEQ ID NO: 492733 - RNA, 22 nt, Homo sapiens
ccagugcuacacguuggaguau

SEQ ID NO: 492734 - RNA, 22 nt, Homo sapiens
ccaguggauucuuguuuugcuu

SEQ ID NO: 492735 - RNA, 14 nt, Homo sapiens
ccaguucugaugag

SEQ ID NO: 492736 - RNA, 23 nt, Homo sapiens
ccauaaaauuagacauaccucuc

SEQ ID NO: 492737 - RNA, 21 nt, Homo sapiens
ccauaaaucaauucauugugu

SEQ ID NO: 492738 - RNA, 14 nt, Homo sapiens
ccaucaugcaaaau

SEQ ID NO: 492739 - RNA, 22 nt, Homo sapiens
ccaucaugcaaaauucuuucag

SEQ ID NO: 492740 - RNA, 19 nt, Homo sapiens
ccauccaccccguugcuca

SEQ ID NO: 492741 - RNA, 20 nt, Homo sapiens
ccaucuaggaugauuuuccc

SEQ ID NO: 492742 - RNA, 12 nt, Homo sapiens
ccaucugcugag

SEQ ID NO: 492743 - RNA, 13 nt, Homo sapiens
ccaugcaauucau

SEQ ID NO: 492744 - RNA, 17 nt, Homo sapiens
ccaugcaucacuauuca

SEQ ID NO: 492745 - RNA, 12 nt, Homo sapiens
ccaugcccucau

SEQ ID NO: 492746 - RNA, 19 nt, Homo sapiens
ccaugcucagcucagcauu

SEQ ID NO: 492747 - RNA, 15 nt, Homo sapiens
ccaugguagacugug

SEQ ID NO: 492748 - RNA, 18 nt, Homo sapiens
ccaugguagacugugaca

SEQ ID NO: 492749 - RNA, 16 nt, Homo sapiens
ccaugugcugcugugg

SEQ ID NO: 492750 - RNA, 14 nt, Homo sapiens
ccauuaaaagccau

SEQ ID NO: 492751 - RNA, 11 nt, Homo sapiens
ccauucugcuu

SEQ ID NO: 492752 - RNA, 17 nt, Homo sapiens
ccauucuggcacuuuaa

SEQ ID NO: 492753 - RNA, 18 nt, Homo sapiens
ccauucuggcacuuuaau

SEQ ID NO: 492754 - RNA, 13 nt, Homo sapiens
ccauuuacagucu

SEQ ID NO: 492755 - RNA, 15 nt, Homo sapiens
ccauuuucuuuacag

SEQ ID NO: 492756 - RNA, 18 nt, Homo sapiens
ccauuuuuugucugugau

SEQ ID NO: 492757 - RNA, 17 nt, Homo sapiens
cccaaaucucaaaagau

SEQ ID NO: 492758 - RNA, 22 nt, Homo sapiens
cccaaccuccccugguccugca

SEQ ID NO: 492759 - RNA, 15 nt, Homo sapiens
cccaacucuugcaca

SEQ ID NO: 492760 - RNA, 20 nt, Homo sapiens
cccaaugcacauccauuccc

SEQ ID NO: 492761 - RNA, 22 nt, Homo sapiens
cccaaugcacauccauucccaa

SEQ ID NO: 492762 - RNA, 13 nt, Homo sapiens
cccacgcccucau

SEQ ID NO: 492763 - RNA, 16 nt, Homo sapiens
cccagaccaguaguga

SEQ ID NO: 492764 - RNA, 23 nt, Homo sapiens
cccagauccaggaacacaugcac

SEQ ID NO: 492765 - RNA, 21 nt, Homo sapiens
cccaggagcgcagcugcauuu

SEQ ID NO: 492766 - RNA, 12 nt, Homo sapiens
cccagugcucac

SEQ ID NO: 492767 - RNA, 22 nt, Homo sapiens
cccagugcucacacaaucagac

SEQ ID NO: 492768 - RNA, 19 nt, Homo sapiens
cccauuagcccacugccug

SEQ ID NO: 492769 - RNA, 13 nt, Homo sapiens
cccauuuccugua

SEQ ID NO: 492770 - RNA, 22 nt, Homo sapiens
ccccaaaguaccacacugaguu

SEQ ID NO: 492771 - RNA, 21 nt, Homo sapiens
ccccauuuccuguacaaucau

SEQ ID NO: 492772 - RNA, 13 nt, Homo sapiens
cccgcaaugugcc

SEQ ID NO: 492773 - RNA, 22 nt, Homo sapiens
cccguggugagguugugcugcc

SEQ ID NO: 492774 - RNA, 15 nt, Homo sapiens
cccuaucucccacaa

SEQ ID NO: 492775 - RNA, 14 nt, Homo sapiens
cccuccacguucac

SEQ ID NO: 492776 - RNA, 15 nt, Homo sapiens
cccucccugcugcca

SEQ ID NO: 492777 - RNA, 15 nt, Homo sapiens
cccuccgacuucucu

SEQ ID NO: 492778 - RNA, 22 nt, Homo sapiens
cccucuuuucugaucugcaguu

SEQ ID NO: 492779 - RNA, 16 nt, Homo sapiens
cccugaaucugaccac

SEQ ID NO: 492780 - RNA, 22 nt, Homo sapiens
cccugaaucugaccacagacac

SEQ ID NO: 492781 - RNA, 21 nt, Homo sapiens
cccuggggccuguacaaaagg

SEQ ID NO: 492782 - RNA, 15 nt, Homo sapiens
cccugggguuuccac

SEQ ID NO: 492783 - RNA, 17 nt, Homo sapiens
cccugguccugcacugu

SEQ ID NO: 492784 - RNA, 16 nt, Homo sapiens
cccuguagcucugaau

SEQ ID NO: 492785 - RNA, 12 nt, Homo sapiens
cccuucaaaagc

SEQ ID NO: 492786 - RNA, 16 nt, Homo sapiens
cccuucaacuaugcaa

SEQ ID NO: 492787 - RNA, 11 nt, Homo sapiens
cccuuccccac

SEQ ID NO: 492788 - RNA, 14 nt, Homo sapiens
cccuucuuuccauu

SEQ ID NO: 492789 - RNA, 15 nt, Homo sapiens
cccuuguccuugaaa

SEQ ID NO: 492790 - RNA, 19 nt, Homo sapiens
cccuuuaucauguguuucu

SEQ ID NO: 492791 - RNA, 23 nt, Homo sapiens
cccuuugagcuacagaacacuuu

SEQ ID NO: 492792 - RNA, 15 nt, Homo sapiens
cccuuugccaacaga

SEQ ID NO: 492793 - RNA, 11 nt, Homo sapiens
ccgaaggugac

SEQ ID NO: 492794 - RNA, 13 nt, Homo sapiens
ccgaaggugacag

SEQ ID NO: 492795 - RNA, 15 nt, Homo sapiens
ccgagccgagcucuc

SEQ ID NO: 492796 - RNA, 19 nt, Homo sapiens
ccggagugacagaguaaga

SEQ ID NO: 492797 - RNA, 17 nt, Homo sapiens
ccguggcuuugugcuua

SEQ ID NO: 492798 - RNA, 21 nt, Homo sapiens
ccguggugagguugugcugcc

SEQ ID NO: 492799 - RNA, 14 nt, Homo sapiens
ccuaaaaguauuau

SEQ ID NO: 492800 - RNA, 14 nt, Homo sapiens
ccuaagagauuuau

SEQ ID NO: 492801 - RNA, 16 nt, Homo sapiens
ccuaagucacuuugag

SEQ ID NO: 492802 - RNA, 14 nt, Homo sapiens
ccuaauuaauuuca

SEQ ID NO: 492803 - RNA, 19 nt, Homo sapiens
gauucuaggaccugugucc

SEQ ID NO: 492804 - RNA, 21 nt, Homo sapiens
gauugagagcagccucuugaa

SEQ ID NO: 492805 - RNA, 13 nt, Homo sapiens
gauuggcacagac

SEQ ID NO: 492806 - RNA, 18 nt, Homo sapiens
gauuuauucuggugucua

SEQ ID NO: 492807 - RNA, 19 nt, Homo sapiens
gauuuguccuuggggacau

SEQ ID NO: 492808 - RNA, 18 nt, Homo sapiens
gauuuguucuuacaguua

SEQ ID NO: 492809 - RNA, 23 nt, Homo sapiens
gauuuuauguuuaaaauggcauu

SEQ ID NO: 492810 - RNA, 21 nt, Homo sapiens
gcaaaaacgaaagcugggcaa

SEQ ID NO: 492811 - RNA, 14 nt, Homo sapiens
gcaaacccaaagau

SEQ ID NO: 492812 - RNA, 15 nt, Homo sapiens
gcaacaaacucaaaa

SEQ ID NO: 492813 - RNA, 16 nt, Homo sapiens
gcaacuaggccuucag

SEQ ID NO: 492814 - RNA, 14 nt, Homo sapiens
gcaaggaaggacac

SEQ ID NO: 492815 - RNA, 14 nt, Homo sapiens
gcaaggaucacuug

SEQ ID NO: 492816 - RNA, 14 nt, Homo sapiens
gcaauauuaagaca

SEQ ID NO: 492817 - RNA, 13 nt, Homo sapiens
gcaauucauccca

SEQ ID NO: 492818 - RNA, 13 nt, Homo sapiens
gcaauuguauaua

SEQ ID NO: 492819 - RNA, 21 nt, Homo sapiens
gcaauuguauauauaugugaa

SEQ ID NO: 492820 - RNA, 22 nt, Homo sapiens
gcacaaaauauaaagcaucuaa

SEQ ID NO: 492821 - RNA, 17 nt, Homo sapiens
gcacacacacaaacaca

SEQ ID NO: 492822 - RNA, 18 nt, Homo sapiens
gcacacagcugcagagac

SEQ ID NO: 492823 - RNA, 14 nt, Homo sapiens
gcacacagucaccu

SEQ ID NO: 492824 - RNA, 21 nt, Homo sapiens
gcacaccucugcaccuuugca

SEQ ID NO: 492825 - RNA, 11 nt, Homo sapiens
gcacaguauuu

SEQ ID NO: 492826 - RNA, 14 nt, Homo sapiens
gcacccuugcgcuu

SEQ ID NO: 492827 - RNA, 12 nt, Homo sapiens
gcacgcacacac

SEQ ID NO: 492828 - RNA, 23 nt, Homo sapiens
gcacguaguagggucaggccacg

SEQ ID NO: 492829 - RNA, 17 nt, Homo sapiens
gcacuauugagucuuca

SEQ ID NO: 492830 - RNA, 17 nt, Homo sapiens
gcacuuccuugccaguc

SEQ ID NO: 492831 - RNA, 18 nt, Homo sapiens
gcagauccaccugcacaa

SEQ ID NO: 492832 - RNA, 13 nt, Homo sapiens
gcagcuagacacc

SEQ ID NO: 492833 - RNA, 13 nt, Homo sapiens
gcagcuauggaca

SEQ ID NO: 492834 - RNA, 17 nt, Homo sapiens
gcagcugaagccagcuc

SEQ ID NO: 492835 - RNA, 21 nt, Homo sapiens
gcagcuucaccagagcauuuc

SEQ ID NO: 492836 - RNA, 14 nt, Homo sapiens
gcagcuuuccaguu

SEQ ID NO: 492837 - RNA, 18 nt, Homo sapiens
gcaggaagucccugagaa

SEQ ID NO: 492838 - RNA, 18 nt, Homo sapiens
gcaggcgguauccagagg

SEQ ID NO: 492839 - RNA, 15 nt, Homo sapiens
gcagugagcugagau

SEQ ID NO: 492840 - RNA, 23 nt, Homo sapiens
gcaguuuuguuuuuuauuuugcc

SEQ ID NO: 492841 - RNA, 19 nt, Homo sapiens
gcauaguaaauguaguuca

SEQ ID NO: 492842 - RNA, 21 nt, Homo sapiens
gcauauuauaucagacugcuu

SEQ ID NO: 492843 - RNA, 22 nt, Homo sapiens
gcauccacuucacaguucugaa

SEQ ID NO: 492844 - RNA, 19 nt, Homo sapiens
gcauguggccuuuaucuca

SEQ ID NO: 492845 - RNA, 15 nt, Homo sapiens
gcauuuagcacagua

SEQ ID NO: 492846 - RNA, 16 nt, Homo sapiens
gcauuuagcacaguau

SEQ ID NO: 492847 - RNA, 19 nt, Homo sapiens
gcauuuccaacaccacaga

SEQ ID NO: 492848 - RNA, 16 nt, Homo sapiens
gcauuugcugcauuuc

SEQ ID NO: 492849 - RNA, 22 nt, Homo sapiens
gcauuugguacacacuugaccu

SEQ ID NO: 492850 - RNA, 23 nt, Homo sapiens
gccaaagacaaauaguaggcaag

SEQ ID NO: 492851 - RNA, 15 nt, Homo sapiens
gccaaauaaaaucua

SEQ ID NO: 492852 - RNA, 12 nt, Homo sapiens
gccaacuuuguu

SEQ ID NO: 492853 - RNA, 17 nt, Homo sapiens
gccaccagaugugacag

SEQ ID NO: 492854 - RNA, 22 nt, Homo sapiens
gccagaccaggugaccuuagau

SEQ ID NO: 492855 - RNA, 16 nt, Homo sapiens
gccagcauacauuuuc

SEQ ID NO: 492856 - RNA, 13 nt, Homo sapiens
gccagggaaacca

SEQ ID NO: 492857 - RNA, 15 nt, Homo sapiens
gccaggugcacagac

SEQ ID NO: 492858 - RNA, 22 nt, Homo sapiens
gccauuuuuugucugugauaac

SEQ ID NO: 492859 - RNA, 23 nt, Homo sapiens
gcccaugcccuccguccuggcag

SEQ ID NO: 492860 - RNA, 19 nt, Homo sapiens
gccccugacuuaacuuuaa

SEQ ID NO: 492861 - RNA, 15 nt, Homo sapiens
gccccuguuaccuaa

SEQ ID NO: 492862 - RNA, 15 nt, Homo sapiens
gcccuucacugucac

SEQ ID NO: 492863 - RNA, 12 nt, Homo sapiens
gccguggcugcg

SEQ ID NO: 492864 - RNA, 21 nt, Homo sapiens
gccuaauauugaaaaugucac

SEQ ID NO: 492865 - RNA, 15 nt, Homo sapiens
gccugaugauggaag

SEQ ID NO: 492866 - RNA, 23 nt, Homo sapiens
gccugaugauggaagggccuucu

SEQ ID NO: 492867 - RNA, 20 nt, Homo sapiens
gccugcggaguugugcacgu

SEQ ID NO: 492868 - RNA, 20 nt, Homo sapiens
gccuggccaacauggugaaa

SEQ ID NO: 492869 - RNA, 13 nt, Homo sapiens
gccuuuaucucaa

SEQ ID NO: 492870 - RNA, 16 nt, Homo sapiens
gcgaacacagugacac

SEQ ID NO: 492871 - RNA, 20 nt, Homo sapiens
gcguaggagagaacagggau

SEQ ID NO: 492872 - RNA, 22 nt, Homo sapiens
gcguaucaggaaagcauggcuc

SEQ ID NO: 492873 - RNA, 22 nt, Homo sapiens
gcuaaaaugaaaaauagugugu

SEQ ID NO: 492874 - RNA, 20 nt, Homo sapiens
gcuaccugggucaacccaac

SEQ ID NO: 492875 - RNA, 18 nt, Homo sapiens
gcuauggggacauuccaa

SEQ ID NO: 492876 - RNA, 20 nt, Homo sapiens
gcuauuugcaaacuuacuua

SEQ ID NO: 492877 - RNA, 21 nt, Homo sapiens
gcucccucccucccagaucca

SEQ ID NO: 492878 - RNA, 18 nt, Homo sapiens
gcucccuuccucccaaaa

SEQ ID NO: 492879 - RNA, 18 nt, Homo sapiens
gcucucccaacucuugca

SEQ ID NO: 492880 - RNA, 17 nt, Homo sapiens
gcugaucguuucuucca

SEQ ID NO: 492881 - RNA, 20 nt, Homo sapiens
gcugaugaaguuaagcacaa

SEQ ID NO: 492882 - RNA, 14 nt, Homo sapiens
gcugcaggaaucaa

SEQ ID NO: 492883 - RNA, 18 nt, Homo sapiens
gcugugagcuuucugaua

SEQ ID NO: 492884 - RNA, 14 nt, Homo sapiens
gcuuaaaugaucaa

SEQ ID NO: 492885 - RNA, 14 nt, Homo sapiens
gcuucaugagcuaa

SEQ ID NO: 492886 - RNA, 22 nt, Homo sapiens
gcuuccccaaaggccaacagca

SEQ ID NO: 492887 - RNA, 13 nt, Homo sapiens
gcuucucaucccc

SEQ ID NO: 492888 - RNA, 21 nt, Homo sapiens
gcuucuuaauauaacugccuu

SEQ ID NO: 492889 - RNA, 10 nt, Homo sapiens
gcuugcuauc

SEQ ID NO: 492890 - RNA, 14 nt, Homo sapiens
gcuuuagcacagga

SEQ ID NO: 492891 - RNA, 18 nt, Homo sapiens
gcuuucaguauuguaaag

SEQ ID NO: 492892 - RNA, 23 nt, Homo sapiens
gcuuuguugaaugaagcagagaa

SEQ ID NO: 492893 - RNA, 13 nt, Homo sapiens
gcuuuucucccag

SEQ ID NO: 492894 - RNA, 13 nt, Homo sapiens
gcuuuucugcaau

SEQ ID NO: 492895 - RNA, 20 nt, Homo sapiens
gcuuuugcaaauaacuuaca

SEQ ID NO: 492896 - RNA, 22 nt, Homo sapiens
ggaaaaaaaaaaauaugagauu

SEQ ID NO: 492897 - RNA, 14 nt, Homo sapiens
ggaaauccuaccuu

SEQ ID NO: 492898 - RNA, 18 nt, Homo sapiens
ggaacaagacccccagga

SEQ ID NO: 492899 - RNA, 16 nt, Homo sapiens
ggaauaugcaucccac

SEQ ID NO: 492900 - RNA, 15 nt, Homo sapiens
ggaauccucagagaa

SEQ ID NO: 492901 - RNA, 17 nt, Homo sapiens
ggacaacaagauacaaa

SEQ ID NO: 492902 - RNA, 20 nt, Homo sapiens
ggacauuccaauuugcacuu

SEQ ID NO: 492903 - RNA, 14 nt, Homo sapiens
ggaccgaaggugac

SEQ ID NO: 492904 - RNA, 15 nt, Homo sapiens
ggacuacaguagcuc

SEQ ID NO: 492905 - RNA, 19 nt, Homo sapiens
ggagcccugggguuuccac

SEQ ID NO: 492906 - RNA, 20 nt, Homo sapiens
ggaggagaagaaaauguucu

SEQ ID NO: 492907 - RNA, 20 nt, Homo sapiens
ggaggcagagguugcaguga

SEQ ID NO: 492908 - RNA, 12 nt, Homo sapiens
ggagggguggua

SEQ ID NO: 492909 - RNA, 12 nt, Homo sapiens
ggaguccagacc

SEQ ID NO: 492910 - RNA, 14 nt, Homo sapiens
ggaugggggggcca

SEQ ID NO: 492911 - RNA, 19 nt, Homo sapiens
ggcagacaccaggccaggc

SEQ ID NO: 492912 - RNA, 17 nt, Homo sapiens
ggcagagaggacuguug

SEQ ID NO: 492913 - RNA, 21 nt, Homo sapiens
ggcauuuagcacaguauuuaa

SEQ ID NO: 492914 - RNA, 12 nt, Homo sapiens
ggccagugacau

SEQ ID NO: 492915 - RNA, 21 nt, Homo sapiens
ggccuauagauugauuuaccu

SEQ ID NO: 492916 - RNA, 17 nt, Homo sapiens
ggccuucuccacaggga

SEQ ID NO: 492917 - RNA, 17 nt, Homo sapiens
ggcgcuagcacagcucc

SEQ ID NO: 492918 - RNA, 20 nt, Homo sapiens
ggcucauucugcaaugagcc

SEQ ID NO: 492919 - RNA, 16 nt, Homo sapiens
ggcuccacuucaucca

SEQ ID NO: 492920 - RNA, 22 nt, Homo sapiens
ggcucccacugccccugcaccu

SEQ ID NO: 492921 - RNA, 19 nt, Homo sapiens
ggcuccgacuugugcacag

SEQ ID NO: 492922 - RNA, 20 nt, Homo sapiens
ggcuccucaccaccgagaca

SEQ ID NO: 492923 - RNA, 20 nt, Homo sapiens
ggcucuaggacccccagugc

SEQ ID NO: 492924 - RNA, 24 nt, Homo sapiens
ggcucugcgucccacugagucuca

SEQ ID NO: 492925 - RNA, 13 nt, Homo sapiens
ggcugauuuacua

SEQ ID NO: 492926 - RNA, 20 nt, Homo sapiens
ggcugugcucucaccagcug

SEQ ID NO: 492927 - RNA, 15 nt, Homo sapiens
ggcuuguucagucac

SEQ ID NO: 492928 - RNA, 21 nt, Homo sapiens
gggaacauaaaaacuacugaa

SEQ ID NO: 492929 - RNA, 23 nt, Homo sapiens
gggaaggucccgaauggagucca

SEQ ID NO: 492930 - RNA, 22 nt, Homo sapiens
gggacacggccucuggggagac

SEQ ID NO: 492931 - RNA, 19 nt, Homo sapiens
gggaccuggggaagcaaaa

SEQ ID NO: 492932 - RNA, 20 nt, Homo sapiens
gggcaccuauaauaccagcu

SEQ ID NO: 492933 - RNA, 19 nt, Homo sapiens
gggcagccugccuugccca

SEQ ID NO: 492934 - RNA, 23 nt, Homo sapiens
gggccagccuuuagaacacuguu

SEQ ID NO: 492935 - RNA, 18 nt, Homo sapiens
gggccaggugcacagacg

SEQ ID NO: 492936 - RNA, 18 nt, Homo sapiens
gggcuccacuucauccag

SEQ ID NO: 492937 - RNA, 18 nt, Homo sapiens
ggggagugaggcagguga

SEQ ID NO: 492938 - RNA, 14 nt, Homo sapiens
gggguuagaccacu

SEQ ID NO: 492939 - RNA, 21 nt, Homo sapiens
ucugaauugcacaugugagca

SEQ ID NO: 492940 - RNA, 23 nt, Homo sapiens
ucugcauaaauauuagcaaagca

SEQ ID NO: 492941 - RNA, 14 nt, Homo sapiens
ucugcucucaagga

SEQ ID NO: 492942 - RNA, 16 nt, Homo sapiens
ucuggagaccaggacu

SEQ ID NO: 492943 - RNA, 16 nt, Homo sapiens
ucuggcccuugcuuac

SEQ ID NO: 492944 - RNA, 17 nt, Homo sapiens
ucuggggggauauuucc

SEQ ID NO: 492945 - RNA, 17 nt, Homo sapiens
ucuguacuaaacauuuc

SEQ ID NO: 492946 - RNA, 22 nt, Homo sapiens
ucuguauauaaauaugugaaau

SEQ ID NO: 492947 - RNA, 18 nt, Homo sapiens
ucuguccuuuaugauccc

SEQ ID NO: 492948 - RNA, 21 nt, Homo sapiens
ucugucguccccagaccagua

SEQ ID NO: 492949 - RNA, 21 nt, Homo sapiens
ucugugaauagcaguggcaaa

SEQ ID NO: 492950 - RNA, 18 nt, Homo sapiens
ucugugugugauuugcua

SEQ ID NO: 492951 - RNA, 17 nt, Homo sapiens
ucuuaaaaugugcuauu

SEQ ID NO: 492952 - RNA, 23 nt, Homo sapiens
ucuuaaguacugaaauacauaug

SEQ ID NO: 492953 - RNA, 18 nt, Homo sapiens
ucuuaauauaacugccuu

SEQ ID NO: 492954 - RNA, 21 nt, Homo sapiens
ucuuaauuaaguaaacuaaug

SEQ ID NO: 492955 - RNA, 18 nt, Homo sapiens
ucuuaguauaugaaagga

SEQ ID NO: 492956 - RNA, 16 nt, Homo sapiens
ucuuauaacauuguau

SEQ ID NO: 492957 - RNA, 15 nt, Homo sapiens
ucuucaauccccaua

SEQ ID NO: 492958 - RNA, 23 nt, Homo sapiens
ucuucagggggccaggugcacag

SEQ ID NO: 492959 - RNA, 11 nt, Homo sapiens
ucuucauggcc

SEQ ID NO: 492960 - RNA, 19 nt, Homo sapiens
ucuucaugugucuugcaau

SEQ ID NO: 492961 - RNA, 21 nt, Homo sapiens
ucuucaugugucuugcaauga

SEQ ID NO: 492962 - RNA, 15 nt, Homo sapiens
ucuucccccaccacc

SEQ ID NO: 492963 - RNA, 20 nt, Homo sapiens
ucuucccuuaggcaauggug

SEQ ID NO: 492964 - RNA, 14 nt, Homo sapiens
ucuuccucuuaccu

SEQ ID NO: 492965 - RNA, 22 nt, Homo sapiens
ucuuccuuccacaguuaucuua

SEQ ID NO: 492966 - RNA, 19 nt, Homo sapiens
ucuucucaucuuuuaucua

SEQ ID NO: 492967 - RNA, 14 nt, Homo sapiens
ucuucugucaucua

SEQ ID NO: 492968 - RNA, 21 nt, Homo sapiens
ucuucuuuugggaggauuuga

SEQ ID NO: 492969 - RNA, 14 nt, Homo sapiens
ucuuguauuaucau

SEQ ID NO: 492970 - RNA, 24 nt, Homo sapiens
ucuuuaccuugcauuuuagcuaau

SEQ ID NO: 492971 - RNA, 20 nt, Homo sapiens
ucuuuaggauggggaguauu

SEQ ID NO: 492972 - RNA, 15 nt, Homo sapiens
ucuuuauacagauuu

SEQ ID NO: 492973 - RNA, 13 nt, Homo sapiens
ucuuuaugaucug

SEQ ID NO: 492974 - RNA, 16 nt, Homo sapiens
ucuuuccuuccucuca

SEQ ID NO: 492975 - RNA, 17 nt, Homo sapiens
ucuuucggaaaugauug

SEQ ID NO: 492976 - RNA, 13 nt, Homo sapiens
ucuuucuuucugc

SEQ ID NO: 492977 - RNA, 17 nt, Homo sapiens
ucuuuucgccguggcug

SEQ ID NO: 492978 - RNA, 12 nt, Homo sapiens
ugaaaacucauc

SEQ ID NO: 492979 - RNA, 17 nt, Homo sapiens
ugaaacacaauaucauc

SEQ ID NO: 492980 - RNA, 13 nt, Homo sapiens
ugaaagcaacagc

SEQ ID NO: 492981 - RNA, 15 nt, Homo sapiens
ugaaagcaacagcug

SEQ ID NO: 492982 - RNA, 14 nt, Homo sapiens
ugaaaggcauguga

SEQ ID NO: 492983 - RNA, 19 nt, Homo sapiens
ugaaauauuuucuacuuua

SEQ ID NO: 492984 - RNA, 16 nt, Homo sapiens
ugaaauugcuuugcug

SEQ ID NO: 492985 - RNA, 23 nt, Homo sapiens
ugaacaaagagagcucaucauca

SEQ ID NO: 492986 - RNA, 13 nt, Homo sapiens
ugaaccaagcuau

SEQ ID NO: 492987 - RNA, 13 nt, Homo sapiens
ugaacuccugcca

SEQ ID NO: 492988 - RNA, 15 nt, Homo sapiens
ugaacucuguaaaac

SEQ ID NO: 492989 - RNA, 17 nt, Homo sapiens
ugaagacccuaucuccc

SEQ ID NO: 492990 - RNA, 20 nt, Homo sapiens
ugaagagaaccgagcaaaga

SEQ ID NO: 492991 - RNA, 14 nt, Homo sapiens
ugaagagagauaua

SEQ ID NO: 492992 - RNA, 12 nt, Homo sapiens
ugaagagcauuu

SEQ ID NO: 492993 - RNA, 17 nt, Homo sapiens
ugaagaguaguuuacua

SEQ ID NO: 492994 - RNA, 16 nt, Homo sapiens
ugaagcaacugaaucu

SEQ ID NO: 492995 - RNA, 21 nt, Homo sapiens
ugaagucuugaaaacagugug

SEQ ID NO: 492996 - RNA, 20 nt, Homo sapiens
ugaauaaaauauugauuuca

SEQ ID NO: 492997 - RNA, 21 nt, Homo sapiens
ugaaugccaguccagaugugc

SEQ ID NO: 492998 - RNA, 12 nt, Homo sapiens
ugacacagcagc

SEQ ID NO: 492999 - RNA, 14 nt, Homo sapiens
ugacagcaaacaca

SEQ ID NO: 493000 - RNA, 17 nt, Homo sapiens
ugacaucgguucaggag

SEQ ID NO: 493001 - RNA, 20 nt, Homo sapiens
ugaccaaucgggaguagcaa

SEQ ID NO: 493002 - RNA, 13 nt, Homo sapiens
ugaccacagacac

SEQ ID NO: 493003 - RNA, 16 nt, Homo sapiens
ugaccacuuguagucc

SEQ ID NO: 493004 - RNA, 19 nt, Homo sapiens
ugacccuggagcccggcag

SEQ ID NO: 493005 - RNA, 13 nt, Homo sapiens
ugacuggccaaaa

SEQ ID NO: 493006 - RNA, 14 nt, Homo sapiens
ugacuggccaaaaa

SEQ ID NO: 493007 - RNA, 15 nt, Homo sapiens
ugacuggccaaaaau

SEQ ID NO: 493008 - RNA, 12 nt, Homo sapiens
ugacugguggaa

SEQ ID NO: 493009 - RNA, 17 nt, Homo sapiens
ugacuucacacacaccu

SEQ ID NO: 493010 - RNA, 23 nt, Homo sapiens
ugacuuccugaacucccagucau

SEQ ID NO: 493011 - RNA, 21 nt, Homo sapiens
ugacuuuccuaugacacucau

SEQ ID NO: 493012 - RNA, 20 nt, Homo sapiens
ugagccacuggcagugugcu

SEQ ID NO: 493013 - RNA, 21 nt, Homo sapiens
ugagccuaugauauuccccau

SEQ ID NO: 493014 - RNA, 14 nt, Homo sapiens
ugagcuugugccuu

SEQ ID NO: 493015 - RNA, 18 nt, Homo sapiens
ugaggaaagcacacaguc

SEQ ID NO: 493016 - RNA, 17 nt, Homo sapiens
ugaggauguauguguau

SEQ ID NO: 493017 - RNA, 19 nt, Homo sapiens
ugaggcaggugacagugag

SEQ ID NO: 493018 - RNA, 19 nt, Homo sapiens
ugaggucaucccggggcca

SEQ ID NO: 493019 - RNA, 19 nt, Homo sapiens
ugaguagccccaacccaaa

SEQ ID NO: 493020 - RNA, 14 nt, Homo sapiens
ugaguauauguaac

SEQ ID NO: 493021 - RNA, 19 nt, Homo sapiens
ugagugaaauauuacucug

SEQ ID NO: 493022 - RNA, 20 nt, Homo sapiens
ugauaaauuugacuguuauu

SEQ ID NO: 493023 - RNA, 20 nt, Homo sapiens
ugauaacaacccaaggcaau

SEQ ID NO: 493024 - RNA, 14 nt, Homo sapiens
ugauaugaguauac

SEQ ID NO: 493025 - RNA, 13 nt, Homo sapiens
ugaucaaauguac

SEQ ID NO: 493026 - RNA, 18 nt, Homo sapiens
ugaugugcucaucagaaa

SEQ ID NO: 493027 - RNA, 13 nt, Homo sapiens
ugauucccagaaa

SEQ ID NO: 493028 - RNA, 19 nt, Homo sapiens
ugauugguuuaaaagucac

SEQ ID NO: 493029 - RNA, 12 nt, Homo sapiens
ugauugugaacu

SEQ ID NO: 493030 - RNA, 18 nt, Homo sapiens
ugauuuaccuuuggaauu

SEQ ID NO: 493031 - RNA, 20 nt, Homo sapiens
ugauuucggaccgaagguga

SEQ ID NO: 493032 - RNA, 14 nt, Homo sapiens
ugauuugaaccaaa

SEQ ID NO: 493033 - RNA, 21 nt, Homo sapiens
ugauuugaaccaaaacaguga

SEQ ID NO: 493034 - RNA, 20 nt, Homo sapiens
ugcaaaauucuuucagauga

SEQ ID NO: 493035 - RNA, 13 nt, Homo sapiens
ugcaaugagccau

SEQ ID NO: 493036 - RNA, 17 nt, Homo sapiens
ugcacaagcacuaucac

SEQ ID NO: 493037 - RNA, 20 nt, Homo sapiens
ugcacacacacacaucucau

SEQ ID NO: 493038 - RNA, 20 nt, Homo sapiens
ugcacagucacugcucuuca

SEQ ID NO: 493039 - RNA, 15 nt, Homo sapiens
ugcacauccauuccc

SEQ ID NO: 493040 - RNA, 20 nt, Homo sapiens
ugcacauccauucccaagaa

SEQ ID NO: 493041 - RNA, 18 nt, Homo sapiens
ugcacccgcauguacaaa

SEQ ID NO: 493042 - RNA, 13 nt, Homo sapiens
ugcacggggccag

SEQ ID NO: 493043 - RNA, 22 nt, Homo sapiens
ugcacuuucaggaacacucuga

SEQ ID NO: 493044 - RNA, 13 nt, Homo sapiens
ugcagagacagag

SEQ ID NO: 493045 - RNA, 16 nt, Homo sapiens
ugcaggaacaugaccc

SEQ ID NO: 493046 - RNA, 22 nt, Homo sapiens
ugcaggucugauucccagaaau

SEQ ID NO: 493047 - RNA, 17 nt, Homo sapiens
ugcagugagcugagauc

SEQ ID NO: 493048 - RNA, 22 nt, Homo sapiens
ugcaguuuuugccuggguccca

SEQ ID NO: 493049 - RNA, 18 nt, Homo sapiens
ugcauaaccgcacagaca

SEQ ID NO: 493050 - RNA, 16 nt, Homo sapiens
ugcauaauaugcauau

SEQ ID NO: 493051 - RNA, 18 nt, Homo sapiens
ugcauaauaugcauauau

SEQ ID NO: 493052 - RNA, 16 nt, Homo sapiens
ugcauagcuugcacaa
